United States Patent 7,901,882 (ANALYSIS OF METHYLATION USING NUCLEIC ACID ARRAYS) - sequence listing, part 3

SEQ ID NO: 78229 - DNA, 25 bp, Homo sapien
ggtacctctgtaggcgatcctgctc

SEQ ID NO: 78230 - DNA, 25 bp, Homo sapien
gcgctcccttcaaacgccaaagaga

SEQ ID NO: 78231 - DNA, 25 bp, Homo sapien
agggtccaggctcttcctttcgatg

SEQ ID NO: 78232 - DNA, 25 bp, Homo sapien
ggccgcacttactctgaagggtcca

SEQ ID NO: 78233 - DNA, 25 bp, Homo sapien
agcgtcccagtagcctggagtggcc

SEQ ID NO: 78234 - DNA, 25 bp, Homo sapien
tgcctgctcccgtgcaaactttctg

SEQ ID NO: 78235 - DNA, 25 bp, Homo sapien
agaagggagcagagtcaagcccaga

SEQ ID NO: 78236 - DNA, 25 bp, Homo sapien
ggaggccgccacttggaatgttccc

SEQ ID NO: 78237 - DNA, 25 bp, Homo sapien
gctgctcaggacttaaccttccatc

SEQ ID NO: 78238 - DNA, 25 bp, Homo sapien
cgtgacgttgcacaggcctatcata

SEQ ID NO: 78239 - DNA, 25 bp, Homo sapien
ttctcaactcgttcggtcagcgggc

SEQ ID NO: 78240 - DNA, 25 bp, Homo sapien
ggctaaccgggagtacattgagata

SEQ ID NO: 78241 - DNA, 25 bp, Homo sapien
cccgagaattcgtgggtgctcaaga

SEQ ID NO: 78242 - DNA, 25 bp, Homo sapien
gcctatcatagtgcccgagaattcg

SEQ ID NO: 78243 - DNA, 25 bp, Homo sapien
cacgcgccgtgtaacgaccataacg

SEQ ID NO: 78244 - DNA, 25 bp, Homo sapien
ataacgcgcgtgcactacaacctcg

SEQ ID NO: 78245 - DNA, 25 bp, Homo sapien
ggcgtccaggcttctgtgttctata

SEQ ID NO: 78246 - DNA, 25 bp, Homo sapien
cgaataggagtctggtcaggcgtca

SEQ ID NO: 78247 - DNA, 25 bp, Homo sapien
tctcagctccggatcaggattcgcg

SEQ ID NO: 78248 - DNA, 25 bp, Homo sapien
acaccaggagtttctcgggcccagc

SEQ ID NO: 78249 - DNA, 25 bp, Homo sapien
tcaggcgtcaggctagtccgacgaa

SEQ ID NO: 78250 - DNA, 25 bp, Homo sapien
agccttccaaagagcggcggttgtc

SEQ ID NO: 78251 - DNA, 25 bp, Homo sapien
ttgggtagcttgtcctctccgaccc

SEQ ID NO: 78252 - DNA, 25 bp, Homo sapien
ccgcgtggtgacgtcatatccgcct

SEQ ID NO: 78253 - DNA, 25 bp, Homo sapien
acggctttcccggagtggacaccag

SEQ ID NO: 78254 - DNA, 25 bp, Homo sapien
ggaacgagaccgctcaggaccatcc

SEQ ID NO: 78255 - DNA, 25 bp, Homo sapien
gacacggtgccgctgacagcagcca

SEQ ID NO: 78256 - DNA, 25 bp, Homo sapien
ccgggatggccttcatggagaagcc

SEQ ID NO: 78257 - DNA, 25 bp, Homo sapien
gccaaggatggggaccgcagctccc

SEQ ID NO: 78258 - DNA, 25 bp, Homo sapien
gcgaccaggaaagcgactccgagtt

SEQ ID NO: 78259 - DNA, 25 bp, Homo sapien
agcagccatcgaggcgagccagagc

SEQ ID NO: 78260 - DNA, 25 bp, Homo sapien
caccttggactaggggagcaggaac

SEQ ID NO: 78261 - DNA, 25 bp, Homo sapien
attcccgggctcaccttggactagg

SEQ ID NO: 78262 - DNA, 25 bp, Homo sapien
gtgctaattgccaggcggcgacaga

SEQ ID NO: 78263 - DNA, 25 bp, Homo sapien
cacacgtgcctggtcggtgttactt

SEQ ID NO: 78264 - DNA, 25 bp, Homo sapien
ctttattgacagtaggcggtgaccg

SEQ ID NO: 78265 - DNA, 25 bp, Homo sapien
ctggagccgcctcaaatcaacttta

SEQ ID NO: 78266 - DNA, 25 bp, Homo sapien
tccgctgccaaacgacaacagaggg

SEQ ID NO: 78267 - DNA, 25 bp, Homo sapien
cgccatcttggtcgtgtcctctatc

SEQ ID NO: 78268 - DNA, 25 bp, Homo sapien
aggatgctggctccgcaaacccaag

SEQ ID NO: 78269 - DNA, 25 bp, Homo sapien
gcggtccagtgaaagcgcctcttca

SEQ ID NO: 78270 - DNA, 25 bp, Homo sapien
ctgcgctggctgagttcctcaggcc

SEQ ID NO: 78271 - DNA, 25 bp, Homo sapien
tcccgggctggcacgagccagcagc

SEQ ID NO: 78272 - DNA, 25 bp, Homo sapien
tttcaggagacgtctgcgccgagcg

SEQ ID NO: 78273 - DNA, 25 bp, Homo sapien
ccgggtttcaggagacgtctgcgcc

SEQ ID NO: 78274 - DNA, 25 bp, Homo sapien
ttccagcccgcgctgccgttagggg

SEQ ID NO: 78275 - DNA, 25 bp, Homo sapien
ctccgactgcgctggctgagttcct

SEQ ID NO: 78276 - DNA, 25 bp, Homo sapien
tcgtgtggtcttgaccgcgcggctc

SEQ ID NO: 78277 - DNA, 25 bp, Homo sapien
cgtccgggcccggagcatcgcccgc

SEQ ID NO: 78278 - DNA, 25 bp, Homo sapien
ccgctgagggtcaagttacggcggc

SEQ ID NO: 78279 - DNA, 25 bp, Homo sapien
gccagggactgagcgccgtgcacca

SEQ ID NO: 78280 - DNA, 25 bp, Homo sapien
gactgagcgccgtgcaccacagagc

SEQ ID NO: 78281 - DNA, 25 bp, Homo sapien
ggtggcgttgctcccacttacccga

SEQ ID NO: 78282 - DNA, 25 bp, Homo sapien
ttacccgaccggagcagcacagccc

SEQ ID NO: 78283 - DNA, 25 bp, Homo sapien
tcctactgcagagccagcactgctg

SEQ ID NO: 78284 - DNA, 25 bp, Homo sapien
cacagcaggagcgtagtccggagcc

SEQ ID NO: 78285 - DNA, 25 bp, Homo sapien
cgagcgcacagcaggagcgtagtcc

SEQ ID NO: 78286 - DNA, 25 bp, Homo sapien
tgaccctgacggctggaaatcggct

SEQ ID NO: 78287 - DNA, 25 bp, Homo sapien
cagacttgggcaggctcttctcagc

SEQ ID NO: 78288 - DNA, 25 bp, Homo sapien
gggagtgattgtgtgtgtaacctac

SEQ ID NO: 78289 - DNA, 25 bp, Homo sapien
tgtaacctacgtgacggggcgccca

SEQ ID NO: 78290 - DNA, 25 bp, Homo sapien
gacaaccgcccgctggcctaggaaa

SEQ ID NO: 78291 - DNA, 25 bp, Homo sapien
atacgcggtgacgtagcgttgccca

SEQ ID NO: 78292 - DNA, 25 bp, Homo sapien
cccagaatcaaaccgcgaaagagca

SEQ ID NO: 78293 - DNA, 25 bp, Homo sapien
ttgcgctctctaggcttctcgccga

SEQ ID NO: 78294 - DNA, 25 bp, Homo sapien
gggcaaaaagtcctgtgaccggaca

SEQ ID NO: 78295 - DNA, 25 bp, Homo sapien
ccctaccttccaggatgttgacagc

SEQ ID NO: 78296 - DNA, 25 bp, Homo sapien
ctgacgaaccatcccaaaacggcgg

SEQ ID NO: 78297 - DNA, 25 bp, Homo sapien
acggattttcgctacttgtctatga

SEQ ID NO: 78298 - DNA, 25 bp, Homo sapien
agcggaggccaatacgcgcagagca

SEQ ID NO: 78299 - DNA, 25 bp, Homo sapien
ccagaaacagtattccacttgggct

SEQ ID NO: 78300 - DNA, 25 bp, Homo sapien
acctgacgcgcgtggaaacccagac

SEQ ID NO: 78301 - DNA, 25 bp, Homo sapien
cggaagagtactcgggacagaagcc

SEQ ID NO: 78302 - DNA, 25 bp, Homo sapien
cgttttcggacatgcggaggttact

SEQ ID NO: 78303 - DNA, 25 bp, Homo sapien
ctgccgactcaagttggggatcctc

SEQ ID NO: 78304 - DNA, 25 bp, Homo sapien
gcccgatcggctctctcctttttaa

SEQ ID NO: 78305 - DNA, 25 bp, Homo sapien
ctgcgttcccggtcactttttgaga

SEQ ID NO: 78306 - DNA, 25 bp, Homo sapien
ctcgcacggaggcaagaacttattc

SEQ ID NO: 78307 - DNA, 25 bp, Homo sapien
tgctccattatgtcgtgtgcttccc

SEQ ID NO: 78308 - DNA, 25 bp, Homo sapien
cgcccggataggagaaaaggattgc

SEQ ID NO: 78309 - DNA, 25 bp, Homo sapien
tccctgctttcctcttttcgatgtg

SEQ ID NO: 78310 - DNA, 25 bp, Homo sapien
gcttctgttttggagtagggtcgtc

SEQ ID NO: 78311 - DNA, 25 bp, Homo sapien
ctggctttctcgaaacccgctgggg

SEQ ID NO: 78312 - DNA, 25 bp, Homo sapien
tctgggagacgctggcttttcgttt

SEQ ID NO: 78313 - DNA, 25 bp, Homo sapien
gcagcaggctttggagcaaggtaaa

SEQ ID NO: 78314 - DNA, 25 bp, Homo sapien
tggtttggaaaagtgcagcccgaga

SEQ ID NO: 78315 - DNA, 25 bp, Homo sapien
cgtccttgtgaggtcttagccaaaa

SEQ ID NO: 78316 - DNA, 25 bp, Homo sapien
gcgcttatctgtttgacatgaggga

SEQ ID NO: 78317 - DNA, 25 bp, Homo sapien
cctgctatgacctcgaaagcgctta

SEQ ID NO: 78318 - DNA, 25 bp, Homo sapien
ctcggggtgatcgacaagaaacttc

SEQ ID NO: 78319 - DNA, 25 bp, Homo sapien
tctctccttgcggtctgaagatgcc

SEQ ID NO: 78320 - DNA, 25 bp, Homo sapien
gtgtcctttatctccggacccgctg

SEQ ID NO: 78321 - DNA, 25 bp, Homo sapien
tcagctgcccactcgtgatttccag

SEQ ID NO: 78322 - DNA, 25 bp, Homo sapien
taggctaccgctcgctgcgcgtttt

SEQ ID NO: 78323 - DNA, 25 bp, Homo sapien
tcgctggagccttcgcttcttttcg

SEQ ID NO: 78324 - DNA, 25 bp, Homo sapien
gccatgaagcagattctcggggtga

SEQ ID NO: 78325 - DNA, 25 bp, Homo sapien
gcttcttttcgtctcgggagcgtta

SEQ ID NO: 78326 - DNA, 25 bp, Homo sapien
ggttgccgcgactacacctcacgaa

SEQ ID NO: 78327 - DNA, 25 bp, Homo sapien
ccaaggcggccctttataaagatgc

SEQ ID NO: 78328 - DNA, 25 bp, Homo sapien
gactacacctcacgaacttttcgcg

SEQ ID NO: 78329 - DNA, 25 bp, Homo sapien
cgtgcgcaaatatggtaacgtgacc

SEQ ID NO: 78330 - DNA, 25 bp, Homo sapien
ccctttataaagatgcggtgacgtc

SEQ ID NO: 78331 - DNA, 25 bp, Homo sapien
tggtaacgtgaccacgccctggcct

SEQ ID NO: 78332 - DNA, 25 bp, Homo sapien
gccgcgcgtgcgcaaatatggtaac

SEQ ID NO: 78333 - DNA, 25 bp, Homo sapien
tgccttcccggaagggctcagaggc

SEQ ID NO: 78334 - DNA, 25 bp, Homo sapien
gcgtcgaagagtacggccctgaaga

SEQ ID NO: 78335 - DNA, 25 bp, Homo sapien
cccagcagggacgatagcacggtct

SEQ ID NO: 78336 - DNA, 25 bp, Homo sapien
cgttacaacggcctacggtgctgga

SEQ ID NO: 78337 - DNA, 25 bp, Homo sapien
atcctctaccgagcgcgcgcgaaga

SEQ ID NO: 78338 - DNA, 25 bp, Homo sapien
tcccaggtcatcttctgcaatcgca

SEQ ID NO: 78339 - DNA, 25 bp, Homo sapien
cgtgctgcccgtatggctcaacttc

SEQ ID NO: 78340 - DNA, 25 bp, Homo sapien
cgcatccacagctaccgaggtacgg

SEQ ID NO: 78341 - DNA, 25 bp, Homo sapien
gctatttccgcgagcgcgttccatc

SEQ ID NO: 78342 - DNA, 25 bp, Homo sapien
tccaagagacgtgggctgaatcgcc

SEQ ID NO: 78343 - DNA, 25 bp, Homo sapien
ctaacggagcggtaatcaggaccca

SEQ ID NO: 78344 - DNA, 25 bp, Homo sapien
agatcatttcatcagcgtgctcggc

SEQ ID NO: 78345 - DNA, 25 bp, Homo sapien
ccctcctgggaatgattagatgatt

SEQ ID NO: 78346 - DNA, 25 bp, Homo sapien
ccagattcggatcaaacggggcggc

SEQ ID NO: 78347 - DNA, 25 bp, Homo sapien
ctcggcagcagagatagctattcag

SEQ ID NO: 78348 - DNA, 25 bp, Homo sapien
tcgccgcgcggatattaaaagtgtg

SEQ ID NO: 78349 - DNA, 25 bp, Homo sapien
acgcgccagtaatccgagctcttga

SEQ ID NO: 78350 - DNA, 25 bp, Homo sapien
caggctggggttaaaactggctgcc

SEQ ID NO: 78351 - DNA, 25 bp, Homo sapien
ctgtataaagatggctaggggcgcc

SEQ ID NO: 78352 - DNA, 25 bp, Homo sapien
ctcacggtgacaggctggggttaaa

SEQ ID NO: 78353 - DNA, 25 bp, Homo sapien
tatgtatatattccgtgttcgcttg

SEQ ID NO: 78354 - DNA, 25 bp, Homo sapien
caggaggatttacatggctgtataa

SEQ ID NO: 78355 - DNA, 25 bp, Homo sapien
ccgtgttcgcttgtacaggaggatt

SEQ ID NO: 78356 - DNA, 25 bp, Homo sapien
ctgtttattgagttatatatgtata

SEQ ID NO: 78357 - DNA, 25 bp, Homo sapien
cgcgcactaatgattctgtttattg

SEQ ID NO: 78358 - DNA, 25 bp, Homo sapien
cttcgagtgaagaagttgtcaaact

SEQ ID NO: 78359 - DNA, 25 bp, Homo sapien
agaccgagactgagtcccgcggagc

SEQ ID NO: 78360 - DNA, 25 bp, Homo sapien
ttgtcaaacttcgtaagcgtcaagc

SEQ ID NO: 78361 - DNA, 25 bp, Homo sapien
cttcgtaagcgtcaagccgggtgct

SEQ ID NO: 78362 - DNA, 25 bp, Homo sapien
caagccgggtgctctcccgacaaga

SEQ ID NO: 78363 - DNA, 25 bp, Homo sapien
ctcccgacaagaccgagactgagtc

SEQ ID NO: 78364 - DNA, 25 bp, Homo sapien
tctgcccgccacagaggctggtgca

SEQ ID NO: 78365 - DNA, 25 bp, Homo sapien
gggcgcgacctcttcgagtgaagaa

SEQ ID NO: 78366 - DNA, 25 bp, Homo sapien
aggccacctcgggaacacctggaag

SEQ ID NO: 78367 - DNA, 25 bp, Homo sapien
cgctttgccgcactggttgcattta

SEQ ID NO: 78368 - DNA, 25 bp, Homo sapien
ctcgcctggcacgttacctttttgg

SEQ ID NO: 78369 - DNA, 25 bp, Homo sapien
gcctttgccgcaaaattcgcagacg

SEQ ID NO: 78370 - DNA, 25 bp, Homo sapien
gagctgcggttgaacgctttgccgc

SEQ ID NO: 78371 - DNA, 25 bp, Homo sapien
agggataatctttggccatcgtatc

SEQ ID NO: 78372 - DNA, 25 bp, Homo sapien
gttgcatttatgtggcttttcctga

SEQ ID NO: 78373 - DNA, 25 bp, Homo sapien
ttcgcagacgaagggcttgtagccc

SEQ ID NO: 78374 - DNA, 25 bp, Homo sapien
gctgcttttccagagctccgagtaa

SEQ ID NO: 78375 - DNA, 25 bp, Homo sapien
gcagtgtctttgacggcacctcgta

SEQ ID NO: 78376 - DNA, 25 bp, Homo sapien
gcagcgtgtctcttctgtcacattt

SEQ ID NO: 78377 - DNA, 25 bp, Homo sapien
cccgggtcacccatttgcattcaaa

SEQ ID NO: 78378 - DNA, 25 bp, Homo sapien
ccaaggagatgcgttccgagccatg

SEQ ID NO: 78379 - DNA, 25 bp, Homo sapien
ctctaagtctgcattccggaaaagg

SEQ ID NO: 78380 - DNA, 25 bp, Homo sapien
gcgctcgatggaaaaggccagtgtc

SEQ ID NO: 78381 - DNA, 25 bp, Homo sapien
ggctccgacgtcttggccatgatgc

SEQ ID NO: 78382 - DNA, 25 bp, Homo sapien
tgtgtccttcccacgccgaagaaca

SEQ ID NO: 78383 - DNA, 25 bp, Homo sapien
cggacgctttggcttcttcgccatc

SEQ ID NO: 78384 - DNA, 25 bp, Homo sapien
aggagtcctaggttgccctgtgtaa

SEQ ID NO: 78385 - DNA, 25 bp, Homo sapien
ggcggtagggaaacagacgatcaca

SEQ ID NO: 78386 - DNA, 25 bp, Homo sapien
tggccctaggttgggcctcaaactc

SEQ ID NO: 78387 - DNA, 25 bp, Homo sapien
gcctatttcacttggagcgcctcag

SEQ ID NO: 78388 - DNA, 25 bp, Homo sapien
tccgattcgctccatggcgtgggtt

SEQ ID NO: 78389 - DNA, 25 bp, Homo sapien
acgatcacagttaggcctgaggccc

SEQ ID NO: 78390 - DNA, 25 bp, Homo sapien
tgcgcgttgttctcaggattagtgc

SEQ ID NO: 78391 - DNA, 25 bp, Homo sapien
tgcatctgcccgcatcctttgggag

SEQ ID NO: 78392 - DNA, 25 bp, Homo sapien
tgggccagagccgtctgcatctgcc

SEQ ID NO: 78393 - DNA, 25 bp, Homo sapien
cctttagggacagatgggccagagc

SEQ ID NO: 78394 - DNA, 25 bp, Homo sapien
attcgaactggcttgcccgtggcgg

SEQ ID NO: 78395 - DNA, 25 bp, Homo sapien
tagtgctgttgggagacaaagagcc

SEQ ID NO: 78396 - DNA, 25 bp, Homo sapien
gcttgtccaaagcacaggggcctcc

SEQ ID NO: 78397 - DNA, 25 bp, Homo sapien
agcgccggagagctcccaggtttcg

SEQ ID NO: 78398 - DNA, 25 bp, Homo sapien
acgaagggtccagcatagtggcgcc

SEQ ID NO: 78399 - DNA, 25 bp, Homo sapien
aggcagccggggatcagctctcccg

SEQ ID NO: 78400 - DNA, 25 bp, Homo sapien
atccgattcttcttcgctggacgaa

SEQ ID NO: 78401 - DNA, 25 bp, Homo sapien
tcacgaacacatacagctgcagcct

SEQ ID NO: 78402 - DNA, 25 bp, Homo sapien
cgatgcagcgcatcacgaacacata

SEQ ID NO: 78403 - DNA, 25 bp, Homo sapien
tcggtccacaaagcgggacctgcct

SEQ ID NO: 78404 - DNA, 25 bp, Homo sapien
gagcctctcggtccacaaagcggga

SEQ ID NO: 78405 - DNA, 25 bp, Homo sapien
tgcaagcgagcaaggcctctctggg

SEQ ID NO: 78406 - DNA, 25 bp, Homo sapien
tccgcttctggtggcttacgtcatt

SEQ ID NO: 78407 - DNA, 25 bp, Homo sapien
tgacccggacaccaggcatacgcta

SEQ ID NO: 78408 - DNA, 25 bp, Homo sapien
ttgcgcacgtgctgtctaccagttc

SEQ ID NO: 78409 - DNA, 25 bp, Homo sapien
gctgacgctgaaaaccctggaccta

SEQ ID NO: 78410 - DNA, 25 bp, Homo sapien
aaccgcagtggacatctaggcctca

SEQ ID NO: 78411 - DNA, 25 bp, Homo sapien
ccgaggtactttagctgggatatga

SEQ ID NO: 78412 - DNA, 25 bp, Homo sapien
ggtgcggacatctattttgcccttc

SEQ ID NO: 78413 - DNA, 25 bp, Homo sapien
agccaggcttactacgtgacccgga

SEQ ID NO: 78414 - DNA, 25 bp, Homo sapien
agcccagcgttagcgggtgggctcc

SEQ ID NO: 78415 - DNA, 25 bp, Homo sapien
actggtggatgagaagagcgagcga

SEQ ID NO: 78416 - DNA, 25 bp, Homo sapien
tcgcttccccgacgcgctgggttcc

SEQ ID NO: 78417 - DNA, 25 bp, Homo sapien
ctggctgctcccgaaggggcttctg

SEQ ID NO: 78418 - DNA, 25 bp, Homo sapien
ccctgaggacggtggtgccaagcga

SEQ ID NO: 78419 - DNA, 25 bp, Homo sapien
gtgccaagcgaacttcatttttaaa

SEQ ID NO: 78420 - DNA, 25 bp, Homo sapien
aaaagaactggtggatgagaagagc

SEQ ID NO: 78421 - DNA, 25 bp, Homo sapien
tcgctgactcgcttcgcttccccga

SEQ ID NO: 78422 - DNA, 25 bp, Homo sapien
gcgggtctcgaacgccggcacttgc

SEQ ID NO: 78423 - DNA, 25 bp, Homo sapien
gagcggggcctcaccgtcagtcacg

SEQ ID NO: 78424 - DNA, 25 bp, Homo sapien
gtcagtcacggctcccatggcgtgc

SEQ ID NO: 78425 - DNA, 25 bp, Homo sapien
cggcggcggaggtcaaactcccaca

SEQ ID NO: 78426 - DNA, 25 bp, Homo sapien
ggtcaaactcccacaatgcagccgg

SEQ ID NO: 78427 - DNA, 25 bp, Homo sapien
cagccgggtaaacagccatggagga

SEQ ID NO: 78428 - DNA, 25 bp, Homo sapien
ggcgcggccggcaatcaaaaaaggc

SEQ ID NO: 78429 - DNA, 25 bp, Homo sapien
ctcccacaatgcagccgggtaaaca

SEQ ID NO: 78430 - DNA, 25 bp, Homo sapien
tgtcacctgaaggtgccgcgtggtc

SEQ ID NO: 78431 - DNA, 25 bp, Homo sapien
ctctgaggacgtctgtcgacgagca

SEQ ID NO: 78432 - DNA, 25 bp, Homo sapien
ccgtagcgtgccatggcctgctaca

SEQ ID NO: 78433 - DNA, 25 bp, Homo sapien
gccgcaacatggacgcgctcagcga

SEQ ID NO: 78434 - DNA, 25 bp, Homo sapien
tgctggacgacctgtgccgcaacat

SEQ ID NO: 78435 - DNA, 25 bp, Homo sapien
cagttccgattctctggccggcgct

SEQ ID NO: 78436 - DNA, 25 bp, Homo sapien
atggcctgctacatctaccagctgc

SEQ ID NO: 78437 - DNA, 25 bp, Homo sapien
ctctgagtccagagaacggtgggta

SEQ ID NO: 78438 - DNA, 25 bp, Homo sapien
gtggcgtgcacacggtacttcgtcc

SEQ ID NO: 78439 - DNA, 25 bp, Homo sapien
acggtacttcgtcctgacacctggg

SEQ ID NO: 78440 - DNA, 25 bp, Homo sapien
ttcatgcttttgacaactctgcggc

SEQ ID NO: 78441 - DNA, 25 bp, Homo sapien
cggctcctccataggtggctgcatt

SEQ ID NO: 78442 - DNA, 25 bp, Homo sapien
cataggtggctgcatttccgacttc

SEQ ID NO: 78443 - DNA, 25 bp, Homo sapien
ggctgcatttccgacttcgccctgg

SEQ ID NO: 78444 - DNA, 25 bp, Homo sapien
ggggcttgacgtgcaaacttcgccg

SEQ ID NO: 78445 - DNA, 25 bp, Homo sapien
gcgtctccgcttaagggagccggcc

SEQ ID NO: 78446 - DNA, 25 bp, Homo sapien
ctctgcccagtcctgaagtgatgct

SEQ ID NO: 78447 - DNA, 25 bp, Homo sapien
agatgctatcgtttgctgggttgcg

SEQ ID NO: 78448 - DNA, 25 bp, Homo sapien
aggggcagagatgctatcgtttgct

SEQ ID NO: 78449 - DNA, 25 bp, Homo sapien
aacttcctgggaaggacggtgagtg

SEQ ID NO: 78450 - DNA, 25 bp, Homo sapien
aatctgtgggttgaggcttccaaac

SEQ ID NO: 78451 - DNA, 25 bp, Homo sapien
atgctgggacagtcgtggaatctgt

SEQ ID NO: 78452 - DNA, 25 bp, Homo sapien
ccagtcctgaagtgatgctgggaca

SEQ ID NO: 78453 - DNA, 25 bp, Homo sapien
ctatcgtttgctgggttgcggaacg

SEQ ID NO: 78454 - DNA, 25 bp, Homo sapien
tgcgggcctcactgttatcgcggac

SEQ ID NO: 78455 - DNA, 25 bp, Homo sapien
acaacttggttacgaccggctgcgg

SEQ ID NO: 78456 - DNA, 25 bp, Homo sapien
tccaggttctccagcggcatcgcgg

SEQ ID NO: 78457 - DNA, 25 bp, Homo sapien
cgcgatacgcaagtcggggttcttg

SEQ ID NO: 78458 - DNA, 25 bp, Homo sapien
gcgcagctgcgcgatacgcaagtcg

SEQ ID NO: 78459 - DNA, 25 bp, Homo sapien
actgttatcgcggacggccgccatc

SEQ ID NO: 78460 - DNA, 25 bp, Homo sapien
gtcctctgctggacacctccgggaa

SEQ ID NO: 78461 - DNA, 25 bp, Homo sapien
gggacagcggctgacaggacacaac

SEQ ID NO: 78462 - DNA, 25 bp, Homo sapien
acaaggcaggtaacattcctggggc

SEQ ID NO: 78463 - DNA, 25 bp, Homo sapien
tagccttgcattgctccgacgctgc

SEQ ID NO: 78464 - DNA, 25 bp, Homo sapien
gtagcggccgcagctaaggaaccca

SEQ ID NO: 78465 - DNA, 25 bp, Homo sapien
ccgcagctaaggaacccagcggggc

SEQ ID NO: 78466 - DNA, 25 bp, Homo sapien
acttacccggcttagccttgcattg

SEQ ID NO: 78467 - DNA, 25 bp, Homo sapien
ggctccgcacaaggcaggtaacatt

SEQ ID NO: 78468 - DNA, 25 bp, Homo sapien
tgctctgtgcgcagctccggatcca

SEQ ID NO: 78469 - DNA, 25 bp, Homo sapien
cctgcaggggctccgcacaaggcag

SEQ ID NO: 78470 - DNA, 25 bp, Homo sapien
tccgcaagaagcgagcatcgggcgc

SEQ ID NO: 78471 - DNA, 25 bp, Homo sapien
tgctgggattccgatttgcccggag

SEQ ID NO: 78472 - DNA, 25 bp, Homo sapien
aagaagcgagcatcgggcgcccgcc

SEQ ID NO: 78473 - DNA, 25 bp, Homo sapien
tccggctgaacatggccggacgcct

SEQ ID NO: 78474 - DNA, 25 bp, Homo sapien
acactcaccgagcggctggagagtc

SEQ ID NO: 78475 - DNA, 25 bp, Homo sapien
cccgctagagctccaagtggctgga

SEQ ID NO: 78476 - DNA, 25 bp, Homo sapien
gggcagcagaggacaccccaaaaga

SEQ ID NO: 78477 - DNA, 25 bp, Homo sapien
agctttggtgctgggattccgattt

SEQ ID NO: 78478 - DNA, 25 bp, Homo sapien
gaccttattttccagcccattcgag

SEQ ID NO: 78479 - DNA, 25 bp, Homo sapien
atttcgtattcgctcagggtctcta

SEQ ID NO: 78480 - DNA, 25 bp, Homo sapien
tgctccgtcgcgttcttttgaagtg

SEQ ID NO: 78481 - DNA, 25 bp, Homo sapien
tcagtggcagagttaatgctccgtc

SEQ ID NO: 78482 - DNA, 25 bp, Homo sapien
ccggcattggcggtgagattaaata

SEQ ID NO: 78483 - DNA, 25 bp, Homo sapien
cctcttcggaataaaacttggtctg

SEQ ID NO: 78484 - DNA, 25 bp, Homo sapien
gcccacttaccattcctgagcagag

SEQ ID NO: 78485 - DNA, 25 bp, Homo sapien
cagtgtactcgcacgcacagagcta

SEQ ID NO: 78486 - DNA, 25 bp, Homo sapien
gacgtctcgtctcttctcgtgcttc

SEQ ID NO: 78487 - DNA, 25 bp, Homo sapien
ctgctggggtctgccaggaaaataa

SEQ ID NO: 78488 - DNA, 25 bp, Homo sapien
cctcacttccggaacaccttgtgga

SEQ ID NO: 78489 - DNA, 25 bp, Homo sapien
actggactccaatgacggatgctgc

SEQ ID NO: 78490 - DNA, 25 bp, Homo sapien
gggttgtctgctatactctctgctg

SEQ ID NO: 78491 - DNA, 25 bp, Homo sapien
agtcccattccaggtgtggtgttca

SEQ ID NO: 78492 - DNA, 25 bp, Homo sapien
gctgtcgggtttcctcgaagtccca

SEQ ID NO: 78493 - DNA, 25 bp, Homo sapien
tctccaaagtgttgtcggcgctgcg

SEQ ID NO: 78494 - DNA, 25 bp, Homo sapien
cagctctggcaaggctccgtgttgg

SEQ ID NO: 78495 - DNA, 25 bp, Homo sapien
cggcggcaggcttagagctgcaaac

SEQ ID NO: 78496 - DNA, 25 bp, Homo sapien
cttagagctgcaaactcccggggcg

SEQ ID NO: 78497 - DNA, 25 bp, Homo sapien
tgccaccaggggacgccatgtgcac

SEQ ID NO: 78498 - DNA, 25 bp, Homo sapien
aggagaccacttcgccgtccaacag

SEQ ID NO: 78499 - DNA, 25 bp, Homo sapien
aggggacgccatgtgcacagcctgt

SEQ ID NO: 78500 - DNA, 25 bp, Homo sapien
ctcggcgagcggctcagattcagct

SEQ ID NO: 78501 - DNA, 25 bp, Homo sapien
gacgcgtttctgtcctctgccagct

SEQ ID NO: 78502 - DNA, 25 bp, Homo sapien
atctccacgtcgtagggctgcacca

SEQ ID NO: 78503 - DNA, 25 bp, Homo sapien
cgagctcaccgtgttcagcgagttc

SEQ ID NO: 78504 - DNA, 25 bp, Homo sapien
cggagtgcgcttctcttctgtcagc

SEQ ID NO: 78505 - DNA, 25 bp, Homo sapien
ttctcttctgtcagcgaggccggct

SEQ ID NO: 78506 - DNA, 25 bp, Homo sapien
ccggctggttgctactgtgatgaga

SEQ ID NO: 78507 - DNA, 25 bp, Homo sapien
cgagggcacctcgttctcggttttg

SEQ ID NO: 78508 - DNA, 25 bp, Homo sapien
tcggttttgggcactgtagcagaga

SEQ ID NO: 78509 - DNA, 25 bp, Homo sapien
gctcaccgaggacacgatgacgaag

SEQ ID NO: 78510 - DNA, 25 bp, Homo sapien
cagcggcgtcaatgcgcgctattca

SEQ ID NO: 78511 - DNA, 25 bp, Homo sapien
gctattcacactccgggctgcggct

SEQ ID NO: 78512 - DNA, 25 bp, Homo sapien
ggccgagatgctcgcccaagaaaca

SEQ ID NO: 78513 - DNA, 25 bp, Homo sapien
aatgcgcgctattcacactccgggc

SEQ ID NO: 78514 - DNA, 25 bp, Homo sapien
ccttttatggggctcgcaggcagta

SEQ ID NO: 78515 - DNA, 25 bp, Homo sapien
agaaacatggctggctggagcctcc

SEQ ID NO: 78516 - DNA, 25 bp, Homo sapien
tgctccttttatggggctcgcaggc

SEQ ID NO: 78517 - DNA, 25 bp, Homo sapien
gcggcaagtgcagcgcgttccagcc

SEQ ID NO: 78518 - DNA, 25 bp, Homo sapien
agagattccaacgtgcttcccgatg

SEQ ID NO: 78519 - DNA, 25 bp, Homo sapien
cagttcattctattccgcgccgcgg

SEQ ID NO: 78520 - DNA, 25 bp, Homo sapien
cctccgcttgttcatgggagaaaca

SEQ ID NO: 78521 - DNA, 25 bp, Homo sapien
ttgccttttacaaatgcggtgcctc

SEQ ID NO: 78522 - DNA, 25 bp, Homo sapien
agggccgcacacgtgttttactcca

SEQ ID NO: 78523 - DNA, 25 bp, Homo sapien
ggctcggcttgttttgttacagttc

SEQ ID NO: 78524 - DNA, 25 bp, Homo sapien
cccgggcaatctggctttggcattt

SEQ ID NO: 78525 - DNA, 25 bp, Homo sapien
cactctgcgccgctcgggttatttt

SEQ ID NO: 78526 - DNA, 25 bp, Homo sapien
ggcaggccagatagaaacaggcaaa

SEQ ID NO: 78527 - DNA, 25 bp, Homo sapien
gtgtcgccgcctagtctccggtctt

SEQ ID NO: 78528 - DNA, 25 bp, Homo sapien
ctggggaacctcagggtaagatcgc

SEQ ID NO: 78529 - DNA, 25 bp, Homo sapien
cactgaaagtattgaagtcagagcc

SEQ ID NO: 78530 - DNA, 25 bp, Homo sapien
gcaaggggtataattgacaaggcac

SEQ ID NO: 78531 - DNA, 25 bp, Homo sapien
cctgctggatttcaggggccgacca

SEQ ID NO: 78532 - DNA, 25 bp, Homo sapien
aaaaggcagtgaccggagccgagcc

SEQ ID NO: 78533 - DNA, 25 bp, Homo sapien
agtctccggtcttggtgctctcccg

SEQ ID NO: 78534 - DNA, 25 bp, Homo sapien
ccacagaaggacttactcctcagtg

SEQ ID NO: 78535 - DNA, 25 bp, Homo sapien
tgcggaggcgtaacaccagcctgca

SEQ ID NO: 78536 - DNA, 25 bp, Homo sapien
tgtccggtcggttttctgagcattt

SEQ ID NO: 78537 - DNA, 25 bp, Homo sapien
cgttggctctcgcagctctgcagct

SEQ ID NO: 78538 - DNA, 25 bp, Homo sapien
tgcagctcacgcaagggcgtttcta

SEQ ID NO: 78539 - DNA, 25 bp, Homo sapien
ctcctcagtgatattccaagcagca

SEQ ID NO: 78540 - DNA, 25 bp, Homo sapien
aacgtgatggcaaaggagatctgcc

SEQ ID NO: 78541 - DNA, 25 bp, Homo sapien
ctgccagaagtacctggagaagggc

SEQ ID NO: 78542 - DNA, 25 bp, Homo sapien
cggctccagccgaagcaaaagcagc

SEQ ID NO: 78543 - DNA, 25 bp, Homo sapien
tcgcagccgaacaatcagccgcttg

SEQ ID NO: 78544 - DNA, 25 bp, Homo sapien
ggcccacgttggatgctttgcaaca

SEQ ID NO: 78545 - DNA, 25 bp, Homo sapien
ctctagactccgcaccggggcatgg

SEQ ID NO: 78546 - DNA, 25 bp, Homo sapien
caggcatcttcctctgggctcggag

SEQ ID NO: 78547 - DNA, 25 bp, Homo sapien
attcgggcaaggtgtacccagcctg

SEQ ID NO: 78548 - DNA, 25 bp, Homo sapien
gcgctagctgcgaactccgccgatt

SEQ ID NO: 78549 - DNA, 25 bp, Homo sapien
tcggagcgcaaagccgtagacctcg

SEQ ID NO: 78550 - DNA, 25 bp, Homo sapien
agcaggctggcctttgaacttgttc

SEQ ID NO: 78551 - DNA, 25 bp, Homo sapien
tttgaacttgttccgccgatcgcgc

SEQ ID NO: 78552 - DNA, 25 bp, Homo sapien
ccatcgagaaatggccgcgtcggca

SEQ ID NO: 78553 - DNA, 25 bp, Homo sapien
cccgggagctagagaagcgaaatga

SEQ ID NO: 78554 - DNA, 25 bp, Homo sapien
cattggccaggggaagcttagaaga

SEQ ID NO: 78555 - DNA, 25 bp, Homo sapien
atcagcgccaggaattcggaggcta

SEQ ID NO: 78556 - DNA, 25 bp, Homo sapien
agccggggcaatcaaactacatttc

SEQ ID NO: 78557 - DNA, 25 bp, Homo sapien
tgtctcccagatccttaactcgcgg

SEQ ID NO: 78558 - DNA, 25 bp, Homo sapien
taaacaggaaactcggcacggggca

SEQ ID NO: 78559 - DNA, 25 bp, Homo sapien
agcgctagggctcgcagaagcttcc

SEQ ID NO: 78560 - DNA, 25 bp, Homo sapien
ctagtgcgttgggtcgctcataccc

SEQ ID NO: 78561 - DNA, 25 bp, Homo sapien
actctagtgcgttgggtcgctcata

SEQ ID NO: 78562 - DNA, 25 bp, Homo sapien
cagacagcggagactctagtgcgtt

SEQ ID NO: 78563 - DNA, 25 bp, Homo sapien
ggacgccatcttaaacaggaaactc

SEQ ID NO: 78564 - DNA, 25 bp, Homo sapien
tgcttcagcgccttcgccatgagtc

SEQ ID NO: 78565 - DNA, 25 bp, Homo sapien
tcgccatgagtctgcgcgggcagac

SEQ ID NO: 78566 - DNA, 25 bp, Homo sapien
ctcctgctgcgtagtccagcgtcta

SEQ ID NO: 78567 - DNA, 25 bp, Homo sapien
tcctcagtcggcctggacaccgata

SEQ ID NO: 78568 - DNA, 25 bp, Homo sapien
tggacaccgatactaggctcttctg

SEQ ID NO: 78569 - DNA, 25 bp, Homo sapien
accgatactaggctcttctgtacag

SEQ ID NO: 78570 - DNA, 25 bp, Homo sapien
catgtcagagcgcggatgcagccca

SEQ ID NO: 78571 - DNA, 25 bp, Homo sapien
ccgcgcgcctgcaccaggctgcagc

SEQ ID NO: 78572 - DNA, 25 bp, Homo sapien
gtccagcgtctacgccctcgccttt

SEQ ID NO: 78573 - DNA, 25 bp, Homo sapien
tgtacagccctccagcaataccttc

SEQ ID NO: 78574 - DNA, 25 bp, Homo sapien
gcaggactcccgatgtttgcccgca

SEQ ID NO: 78575 - DNA, 25 bp, Homo sapien
tcccacctgcttgctcctagaaaga

SEQ ID NO: 78576 - DNA, 25 bp, Homo sapien
aagcgctaaggtcgacttgtccaga

SEQ ID NO: 78577 - DNA, 25 bp, Homo sapien
cttgtccagaaaagagctcacggtg

SEQ ID NO: 78578 - DNA, 25 bp, Homo sapien
agccacacatccttacttcggagtg

SEQ ID NO: 78579 - DNA, 25 bp, Homo sapien
ctgcccacgagacagcacctaaata

SEQ ID NO: 78580 - DNA, 25 bp, Homo sapien
ttcttactcgactagagccggcatc

SEQ ID NO: 78581 - DNA, 25 bp, Homo sapien
gcgcgtccggaactaggtactgatc

SEQ ID NO: 78582 - DNA, 25 bp, Homo sapien
gcgggttaaacagtacgagctcttc

SEQ ID NO: 78583 - DNA, 25 bp, Homo sapien
tttcccgctctggtctcagtggttc

SEQ ID NO: 78584 - DNA, 25 bp, Homo sapien
gtggttccagtcagcgagcaggaca

SEQ ID NO: 78585 - DNA, 25 bp, Homo sapien
ccgggcggcagtcctgcattaaaga

SEQ ID NO: 78586 - DNA, 25 bp, Homo sapien
ccagcccatggtcgcgggttaaaca

SEQ ID NO: 78587 - DNA, 25 bp, Homo sapien
tgacgtacaggaagcagctcccatt

SEQ ID NO: 78588 - DNA, 25 bp, Homo sapien
tccggcagtgtttgttcagaggagc

SEQ ID NO: 78589 - DNA, 25 bp, Homo sapien
agtggcaccttcctcacttcagtca

SEQ ID NO: 78590 - DNA, 25 bp, Homo sapien
gagtcgtcataaccggctactgccg

SEQ ID NO: 78591 - DNA, 25 bp, Homo sapien
ctgttccagaggagggagtcgtcat

SEQ ID NO: 78592 - DNA, 25 bp, Homo sapien
taccacccgggcaagaacagcgcag

SEQ ID NO: 78593 - DNA, 25 bp, Homo sapien
agagtcgaggaaccatctgcccttc

SEQ ID NO: 78594 - DNA, 25 bp, Homo sapien
agtgcgtgcgtaggctatagccctc

SEQ ID NO: 78595 - DNA, 25 bp, Homo sapien
gctggaaacctggtcaacgcggcta

SEQ ID NO: 78596 - DNA, 25 bp, Homo sapien
ccagctgtccgcttgaacgtcagtc

SEQ ID NO: 78597 - DNA, 25 bp, Homo sapien
cccttgaacgtcagtcccggcagag

SEQ ID NO: 78598 - DNA, 25 bp, Homo sapien
cgcagggttgccgttagttaccgag

SEQ ID NO: 78599 - DNA, 25 bp, Homo sapien
acgcggaagggtttctattgatgtc

SEQ ID NO: 78600 - DNA, 25 bp, Homo sapien
ttccactcggctggttctgtcagcg

SEQ ID NO: 78601 - DNA, 25 bp, Homo sapien
gccgttcccgcacagctgagacgaa

SEQ ID NO: 78602 - DNA, 25 bp, Homo sapien
gcgcttgcttcttccacgtacacag

SEQ ID NO: 78603 - DNA, 25 bp, Homo sapien
gtcgatttcgtgcttacagcagttc

SEQ ID NO: 78604 - DNA, 25 bp, Homo sapien
acgagcccagagttcggtcgacaga

SEQ ID NO: 78605 - DNA, 25 bp, Homo sapien
tggctaccgatagaggtcgatttcc

SEQ ID NO: 78606 - DNA, 25 bp, Homo sapien
gcccgcaccgggcagataccgggag

SEQ ID NO: 78607 - DNA, 25 bp, Homo sapien
gtcagcatcgcgctacacactgggc

SEQ ID NO: 78608 - DNA, 25 bp, Homo sapien
agaagggtcagcatcgcgctacaca

SEQ ID NO: 78609 - DNA, 25 bp, Homo sapien
gctcctctattctccttcttttctt

SEQ ID NO: 78610 - DNA, 25 bp, Homo sapien
agcagctcctctattctccttcttt

SEQ ID NO: 78611 - DNA, 25 bp, Homo sapien
gcagcactaacttctcagccagcag

SEQ ID NO: 78612 - DNA, 25 bp, Homo sapien
accgccgcgctctctcacaacccag

SEQ ID NO: 78613 - DNA, 25 bp, Homo sapien
gctcctcgccatccgccatattgtt

SEQ ID NO: 78614 - DNA, 25 bp, Homo sapien
cggccggacttcagggacatttcca

SEQ ID NO: 78615 - DNA, 25 bp, Homo sapien
atcccgggatgtagagacgctctct

SEQ ID NO: 78616 - DNA, 25 bp, Homo sapien
gtggtggctgccatgatgatttcca

SEQ ID NO: 78617 - DNA, 25 bp, Homo sapien
accgcgtagtgagcaacctgctcta

SEQ ID NO: 78618 - DNA, 25 bp, Homo sapien
ttccaaatggaacaaccgcgtagtg

SEQ ID NO: 78619 - DNA, 25 bp, Homo sapien
ctcagctcagctgatcggttgccgc

SEQ ID NO: 78620 - DNA, 25 bp, Homo sapien
ccagattctggaggcgaagaacgca

SEQ ID NO: 78621 - DNA, 25 bp, Homo sapien
cgcaaagctgagaacatggacgtta

SEQ ID NO: 78622 - DNA, 25 bp, Homo sapien
acacttggcttccacgtcttgcgcg

SEQ ID NO: 78623 - DNA, 25 bp, Homo sapien
cggagcaactctttgcaggcagaga

SEQ ID NO: 78624 - DNA, 25 bp, Homo sapien
ctgtgctaagctccaccaagctggc

SEQ ID NO: 78625 - DNA, 25 bp, Homo sapien
cgcagcgccgagcaagctgtgctaa

SEQ ID NO: 78626 - DNA, 25 bp, Homo sapien
caacggctgcgactggcacacagaa

SEQ ID NO: 78627 - DNA, 25 bp, Homo sapien
actcgtctttcaccgtgcgtcctgg

SEQ ID NO: 78628 - DNA, 25 bp, Homo sapien
tcaagttccatacgaagcggctgcc

SEQ ID NO: 78629 - DNA, 25 bp, Homo sapien
ccgtgtaccatctccgcagcgtgga

SEQ ID NO: 78630 - DNA, 25 bp, Homo sapien
tgcacatctggctggcctcaacttc

SEQ ID NO: 78631 - DNA, 25 bp, Homo sapien
tgaggcgcgtcagcggacaccacct

SEQ ID NO: 78632 - DNA, 25 bp, Homo sapien
caatgggcgccttccgtttggcgca

SEQ ID NO: 78633 - DNA, 25 bp, Homo sapien
ttcccgctgttcgagcccacgtgag

SEQ ID NO: 78634 - DNA, 25 bp, Homo sapien
catctggcttctgaccaatggacga

SEQ ID NO: 78635 - DNA, 25 bp, Homo sapien
tgaccaatggacgagcttcctaagg

SEQ ID NO: 78636 - DNA, 25 bp, Homo sapien
ggctgcgtcttgctcggagtcccgc

SEQ ID NO: 78637 - DNA, 25 bp, Homo sapien
ttcgagcccacgtgagtggctccgc

SEQ ID NO: 78638 - DNA, 25 bp, Homo sapien
ccgctgccaatgaggctcggctgat

SEQ ID NO: 78639 - DNA, 25 bp, Homo sapien
gctgttccggcccagtcattgtatc

SEQ ID NO: 78640 - DNA, 25 bp, Homo sapien
gctttgctccacacttacagctgtg

SEQ ID NO: 78641 - DNA, 25 bp, Homo sapien
tgtccaagctccagctcagcacgtg

SEQ ID NO: 78642 - DNA, 25 bp, Homo sapien
tcctgcaagtccactctgcgctgtg

SEQ ID NO: 78643 - DNA, 25 bp, Homo sapien
gctactttattgtctcggctgcgca

SEQ ID NO: 78644 - DNA, 25 bp, Homo sapien
ctccagcggaggctgcactagacct

SEQ ID NO: 78645 - DNA, 25 bp, Homo sapien
ccggggctgtagacggctactttat

SEQ ID NO: 78646 - DNA, 25 bp, Homo sapien
catgaagagcccaaaacctattacg

SEQ ID NO: 78647 - DNA, 25 bp, Homo sapien
aggaagctcggatggagcgcacttc

SEQ ID NO: 78648 - DNA, 25 bp, Homo sapien
aagcgggagccatgcagtccgaatc

SEQ ID NO: 78649 - DNA, 25 bp, Homo sapien
ttacgaactcaaaagtcaaccgctg

SEQ ID NO: 78650 - DNA, 25 bp, Homo sapien
ctctgggacaaggacccagtgccct

SEQ ID NO: 78651 - DNA, 25 bp, Homo sapien
cccaagtgcgcctttaggaagctcg

SEQ ID NO: 78652 - DNA, 25 bp, Homo sapien
cgggctctgttctcactttccagca

SEQ ID NO: 78653 - DNA, 25 bp, Homo sapien
atgccagctgctgagactgattggg

SEQ ID NO: 78654 - DNA, 25 bp, Homo sapien
ggaccaacctgacactctccatgta

SEQ ID NO: 78655 - DNA, 25 bp, Homo sapien
cctcggcgtgcaggcggactgcacg

SEQ ID NO: 78656 - DNA, 25 bp, Homo sapien
tgacactctccatgtagccgccagg

SEQ ID NO: 78657 - DNA, 25 bp, Homo sapien
tcagaaggaccaacctgacactctc

SEQ ID NO: 78658 - DNA, 25 bp, Homo sapien
caaagatcaatcagaaggaccaacc

SEQ ID NO: 78659 - DNA, 25 bp, Homo sapien
gagcgaaaccggcaaagatcaatca

SEQ ID NO: 78660 - DNA, 25 bp, Homo sapien
aaggagagcgaaaccggcaaagatc

SEQ ID NO: 78661 - DNA, 25 bp, Homo sapien
actctccatgtagccgccaggcgcg

SEQ ID NO: 78662 - DNA, 25 bp, Homo sapien
cagcgcagaaaagcgcttttcctcg

SEQ ID NO: 78663 - DNA, 25 bp, Homo sapien
ctccctgggaggagaactttcgctt

SEQ ID NO: 78664 - DNA, 25 bp, Homo sapien
gaggagaactttcgcttcacgtcgg

SEQ ID NO: 78665 - DNA, 25 bp, Homo sapien
tcccagagtcggtctcgccaaagtg

SEQ ID NO: 78666 - DNA, 25 bp, Homo sapien
tctcgccaaagtgtgccagtgcgca

SEQ ID NO: 78667 - DNA, 25 bp, Homo sapien
tgccagtgcgcaccgaggaaaacta

SEQ ID NO: 78668 - DNA, 25 bp, Homo sapien
caccgaggaaaactaagccgacgcg

SEQ ID NO: 78669 - DNA, 25 bp, Homo sapien
aaacgtgcctcgtcgctgaaccagg

SEQ ID NO: 78670 - DNA, 25 bp, Homo sapien
cgactcgcagctgccactggaaaga

SEQ ID NO: 78671 - DNA, 25 bp, Homo sapien
ggcgagaaagcgctctgcaaacttc

SEQ ID NO: 78672 - DNA, 25 bp, Homo sapien
tgttcaccgtgtcccagctgttgtg

SEQ ID NO: 78673 - DNA, 25 bp, Homo sapien
aaggtcaagtcctccagcgtcttca

SEQ ID NO: 78674 - DNA, 25 bp, Homo sapien
tcttcagagtcgagctgtacgtccc

SEQ ID NO: 78675 - DNA, 25 bp, Homo sapien
agcgaggggcactcacaactccatg

SEQ ID NO: 78676 - DNA, 25 bp, Homo sapien
agaaacaagctctaggccctccggg

SEQ ID NO: 78677 - DNA, 25 bp, Homo sapien
ttcccacaagcagagagtcagtcct

SEQ ID NO: 78678 - DNA, 25 bp, Homo sapien
gcgcaggtgcgtgtttgaattttcc

SEQ ID NO: 78679 - DNA, 25 bp, Homo sapien
cggcctgggcttattgatttctctc

SEQ ID NO: 78680 - DNA, 25 bp, Homo sapien
acatcgaaagttgcgccaggcggcc

SEQ ID NO: 78681 - DNA, 25 bp, Homo sapien
accacagtcagtttgctggggcccg

SEQ ID NO: 78682 - DNA, 25 bp, Homo sapien
cgcgacgcaggacaaatcggagctt

SEQ ID NO: 78683 - DNA, 25 bp, Homo sapien
gcggcaactggcaaactcctcggct

SEQ ID NO: 78684 - DNA, 25 bp, Homo sapien
ctaagtttccgagcgcgacgttgtc

SEQ ID NO: 78685 - DNA, 25 bp, Homo sapien
acgccaacgccggacatcgaaagtt

SEQ ID NO: 78686 - DNA, 25 bp, Homo sapien
ctcacctgtcgagccagaaggtcca

SEQ ID NO: 78687 - DNA, 25 bp, Homo sapien
agcgcccgccgtgcaataatcattg

SEQ ID NO: 78688 - DNA, 25 bp, Homo sapien
cacctcccaagggatgggcaacttt

SEQ ID NO: 78689 - DNA, 25 bp, Homo sapien
ggcaacttttccgagcgctgtcaca

SEQ ID NO: 78690 - DNA, 25 bp, Homo sapien
tcacagctgaggtcgtgtcctgagc

SEQ ID NO: 78691 - DNA, 25 bp, Homo sapien
ggtaagcaggacagccctctccctg

SEQ ID NO: 78692 - DNA, 25 bp, Homo sapien
gccgaaacttttcgggctgcgctgt

SEQ ID NO: 78693 - DNA, 25 bp, Homo sapien
cagcacgccgcgttccgatcggaag

SEQ ID NO: 78694 - DNA, 25 bp, Homo sapien
tggtgggcgccacgcacctcgtcta

SEQ ID NO: 78695 - DNA, 25 bp, Homo sapien
caccgcttctatgcagagcgcctgg

SEQ ID NO: 78696 - DNA, 25 bp, Homo sapien
tgggctgcaagctgctcgccttcct

SEQ ID NO: 78697 - DNA, 25 bp, Homo sapien
cgtactacctgctgctcgacctgtg

SEQ ID NO: 78698 - DNA, 25 bp, Homo sapien
tagcgggcaacgtgctgttcgcgct

SEQ ID NO: 78699 - DNA, 25 bp, Homo sapien
agcctgctgctgtgcgtgagcctag

SEQ ID NO: 78700 - DNA, 25 bp, Homo sapien
cctgcgcgcaccattcctgagatgg

SEQ ID NO: 78701 - DNA, 25 bp, Homo sapien
gcgaggccctgtccgcagtgaagcc

SEQ ID NO: 78702 - DNA, 25 bp, Homo sapien
ggctcccagacgagcacgtgctatg

SEQ ID NO: 78703 - DNA, 25 bp, Homo sapien
tacagatgtttaggggtcgcctact

SEQ ID NO: 78704 - DNA, 25 bp, Homo sapien
gcgccgaaaacttgcaaatcatttg

SEQ ID NO: 78705 - DNA, 25 bp, Homo sapien
gtttccaaagctccacgtgctcagc

SEQ ID NO: 78706 - DNA, 25 bp, Homo sapien
aaccgcttttgtggtctccgagaca

SEQ ID NO: 78707 - DNA, 25 bp, Homo sapien
tcgcacgcgccggaaccgcttttgt

SEQ ID NO: 78708 - DNA, 25 bp, Homo sapien
tggtctccgagacactcatttgctg

SEQ ID NO: 78709 - DNA, 25 bp, Homo sapien
cactcatttgctgtcctggtttcca

SEQ ID NO: 78710 - DNA, 25 bp, Homo sapien
gccgtcgtaatttcgcaggaatcca

SEQ ID NO: 78711 - DNA, 25 bp, Homo sapien
atccagtgctggaaacttcgctcgg

SEQ ID NO: 78712 - DNA, 25 bp, Homo sapien
ttcctctgccatgcggagctttgta

SEQ ID NO: 78713 - DNA, 25 bp, Homo sapien
ttgcctcttctgaagtccctgcgtc

SEQ ID NO: 78714 - DNA, 25 bp, Homo sapien
tggttaaatccatcacagtctccgg

SEQ ID NO: 78715 - DNA, 25 bp, Homo sapien
ggaagtagttccacgcagtttgcgc

SEQ ID NO: 78716 - DNA, 25 bp, Homo sapien
gggagcttgcaacagcctcaccgct

SEQ ID NO: 78717 - DNA, 25 bp, Homo sapien
ggatagcctcgcacaccaggcggtg

SEQ ID NO: 78718 - DNA, 25 bp, Homo sapien
taccgcgattttgccgggaggacgc

SEQ ID NO: 78719 - DNA, 25 bp, Homo sapien
acccgggattagcacgtgggctcct

SEQ ID NO: 78720 - DNA, 25 bp, Homo sapien
gcctgcggtcgcacacacctgaatt

SEQ ID NO: 78721 - DNA, 25 bp, Homo sapien
ctcccttgtttagacagagcaatca

SEQ ID NO: 78722 - DNA, 25 bp, Homo sapien
aggaacttatgccttcgctcccttg

SEQ ID NO: 78723 - DNA, 25 bp, Homo sapien
cgatcacgtgtcaaataaccatgga

SEQ ID NO: 78724 - DNA, 25 bp, Homo sapien
gggaggacgccaaaaaagacgatca

SEQ ID NO: 78725 - DNA, 25 bp, Homo sapien
gggcctcgtccatggctgtcaggac

SEQ ID NO: 78726 - DNA, 25 bp, Homo sapien
cgcggaggttatcctggggctcatc

SEQ ID NO: 78727 - DNA, 25 bp, Homo sapien
atgtggcttgctcgcggaggttatc

SEQ ID NO: 78728 - DNA, 25 bp, Homo sapien
ctgaaagcccagaaggaggacgatg

SEQ ID NO: 78729 - DNA, 25 bp, Homo sapien
cccaagcgcctgaaagcccagaagg

SEQ ID NO: 78730 - DNA, 25 bp, Homo sapien
agctcagaggtctgcgtcgcgttct

SEQ ID NO: 78731 - DNA, 25 bp, Homo sapien
tccagccggccagctcagaggtctg

SEQ ID NO: 78732 - DNA, 25 bp, Homo sapien
cggggcaaggtcaagcacaactgga

SEQ ID NO: 78733 - DNA, 25 bp, Homo sapien
cacaactggagcagcacgtcggaag

SEQ ID NO: 78734 - DNA, 25 bp, Homo sapien
cgcaggctttctcactgatccggga

SEQ ID NO: 78735 - DNA, 25 bp, Homo sapien
gcctgcttcgcagttggctttccgg

SEQ ID NO: 78736 - DNA, 25 bp, Homo sapien
ggccctcgagcaacgtctgactttg

SEQ ID NO: 78737 - DNA, 25 bp, Homo sapien
tagacacattggtggacgatgccgc

SEQ ID NO: 78738 - DNA, 25 bp, Homo sapien
cgacggagctacacccgctagttca

SEQ ID NO: 78739 - DNA, 25 bp, Homo sapien
gctgggtggttatgccacctcatta

SEQ ID NO: 78740 - DNA, 25 bp, Homo sapien
acttctcaagtgtcggtgctcaacg

SEQ ID NO: 78741 - DNA, 25 bp, Homo sapien
ccatgcaggatggtttgtgtacaaa

SEQ ID NO: 78742 - DNA, 25 bp, Homo sapien
attcgcgcaatcgagcactgctctc

SEQ ID NO: 78743 - DNA, 25 bp, Homo sapien
ttgaaccggcgggatgactagcaac

SEQ ID NO: 78744 - DNA, 25 bp, Homo sapien
gggcagttccctggcaccaagagaa

SEQ ID NO: 78745 - DNA, 25 bp, Homo sapien
cccgaactcgcctgagaaagtatgg

SEQ ID NO: 78746 - DNA, 25 bp, Homo sapien
tcgaccttgcattctccctctaaag

SEQ ID NO: 78747 - DNA, 25 bp, Homo sapien
aacgaatgcgcctttcctgcggcca

SEQ ID NO: 78748 - DNA, 25 bp, Homo sapien
ccacgcgcaggaactctcggtgtga

SEQ ID NO: 78749 - DNA, 25 bp, Homo sapien
tggcgatagtcaggaagtccggatc

SEQ ID NO: 78750 - DNA, 25 bp, Homo sapien
aatgctctattagaaaatattcact

SEQ ID NO: 78751 - DNA, 25 bp, Homo sapien
aatggtccttaatttaattggatca

SEQ ID NO: 78752 - DNA, 25 bp, Homo sapien
gtgggggcaatttgtgctccactga

SEQ ID NO: 78753 - DNA, 25 bp, Homo sapien
tcaaatggtccttaatttaattgga

SEQ ID NO: 78754 - DNA, 25 bp, Homo sapien
ccgagaaactgatgacgttgcagaa

SEQ ID NO: 78755 - DNA, 25 bp, Homo sapien
tgccagacgttcctcgccgggagtc

SEQ ID NO: 78756 - DNA, 25 bp, Homo sapien
actttgccagacgttcctcgccggg

SEQ ID NO: 78757 - DNA, 25 bp, Homo sapien
tattcactttgccagacgttcctcg

SEQ ID NO: 78758 - DNA, 25 bp, Homo sapien
gttcctccggggtacaatgagtggc

SEQ ID NO: 78759 - DNA, 25 bp, Homo sapien
ctgtggctactcacacgcacgtgcg

SEQ ID NO: 78760 - DNA, 25 bp, Homo sapien
gtcccatgcccggtgcaggcatgtc

SEQ ID NO: 78761 - DNA, 25 bp, Homo sapien
ttcagcagtcccatgcccggtgcag

SEQ ID NO: 78762 - DNA, 25 bp, Homo sapien
tgttggttcagcagtcccatgcccg

SEQ ID NO: 78763 - DNA, 25 bp, Homo sapien
ccgccagagcgctgttggttcagca

SEQ ID NO: 78764 - DNA, 25 bp, Homo sapien
caaacggtccgccagagcgctgttg

SEQ ID NO: 78765 - DNA, 25 bp, Homo sapien
cggggtacaatgagtggctgacctc

SEQ ID NO: 78766 - DNA, 25 bp, Homo sapien
ctccgggaagccatggacgtcgaga

SEQ ID NO: 78767 - DNA, 25 bp, Homo sapien
cagtctttctcccacccgttcaggg

SEQ ID NO: 78768 - DNA, 25 bp, Homo sapien
ctctggctttgtgtcggccgccggc

SEQ ID NO: 78769 - DNA, 25 bp, Homo sapien
tctctcctttcagggcggatggttc

SEQ ID NO: 78770 - DNA, 25 bp, Homo sapien
ccatggacgtcgagaggctccagga

SEQ ID NO: 78771 - DNA, 25 bp, Homo sapien
tcgctctgtcggtcttgctctctcg

SEQ ID NO: 78772 - DNA, 25 bp, Homo sapien
aggtgctcgctctgtcggtcttgct

SEQ ID NO: 78773 - DNA, 25 bp, Homo sapien
ctcttctctcctttcagggcggatg

SEQ ID NO: 78774 - DNA, 25 bp, Homo sapien
tcaatagtggtgtggacgagacaaa

SEQ ID NO: 78775 - DNA, 25 bp, Homo sapien
acaaaggcaatgaggcaaggagcga

SEQ ID NO: 78776 - DNA, 25 bp, Homo sapien
agcacggggcatgcaaactcgaaat

SEQ ID NO: 78777 - DNA, 25 bp, Homo sapien
ccgagtgtgtaatggcgtcaatagt

SEQ ID NO: 78778 - DNA, 25 bp, Homo sapien
taatggcgtcaatagtggtgtggac

SEQ ID NO: 78779 - DNA, 25 bp, Homo sapien
gaaagcacggggcatgcaaactcga

SEQ ID NO: 78780 - DNA, 25 bp, Homo sapien
tggacgagacaaaggcaatgaggca

SEQ ID NO: 78781 - DNA, 25 bp, Homo sapien
tgtgtaatggcgtcaatagtggtgt

SEQ ID NO: 78782 - DNA, 25 bp, Homo sapien
tcggccgaaatgaaagactcgttgc

SEQ ID NO: 78783 - DNA, 25 bp, Homo sapien
gctcatctggctttgcgcgtactcc

SEQ ID NO: 78784 - DNA, 25 bp, Homo sapien
cacggccgacttctgctggatcagc

SEQ ID NO: 78785 - DNA, 25 bp, Homo sapien
ggctctccgctctttgctttccagg

SEQ ID NO: 78786 - DNA, 25 bp, Homo sapien
ctccttcagggacgggctataggta

SEQ ID NO: 78787 - DNA, 25 bp, Homo sapien
cttccgtgatggagagcagattctt

SEQ ID NO: 78788 - DNA, 25 bp, Homo sapien
cgctcgagctgtccttgtcggattt

SEQ ID NO: 78789 - DNA, 25 bp, Homo sapien
ttgtccacgctctcagggtcactct

SEQ ID NO: 78790 - DNA, 25 bp, Homo sapien
tgaatttcttctggtagcgcagcgc

SEQ ID NO: 78791 - DNA, 25 bp, Homo sapien
cgcgcgctgtattcggtgaatttct

SEQ ID NO: 78792 - DNA, 25 bp, Homo sapien
cagcgcggtcatctgcagctcaagc

SEQ ID NO: 78793 - DNA, 25 bp, Homo sapien
gtacgcgcacttgatgtccagcttg

SEQ ID NO: 78794 - DNA, 25 bp, Homo sapien
gtcctccaggaccttgtggcacagc

SEQ ID NO: 78795 - DNA, 25 bp, Homo sapien
gcctaattgatccagacttcctcgg

SEQ ID NO: 78796 - DNA, 25 bp, Homo sapien
actcctccggccgtatttgcgcgag

SEQ ID NO: 78797 - DNA, 25 bp, Homo sapien
gcgcacatacatcgtgccttggatg

SEQ ID NO: 78798 - DNA, 25 bp, Homo sapien
atcccggacttacctggtctctgca

SEQ ID NO: 78799 - DNA, 25 bp, Homo sapien
ctgggcggcggtcaccgtgtcacct

SEQ ID NO: 78800 - DNA, 25 bp, Homo sapien
gagcagccaactgggtcccgagcct

SEQ ID NO: 78801 - DNA, 25 bp, Homo sapien
tgccacgcagttagggccctcggaa

SEQ ID NO: 78802 - DNA, 25 bp, Homo sapien
gcgcagcaccctcgtccgcacggtt

SEQ ID NO: 78803 - DNA, 25 bp, Homo sapien
ggtctctgcagctcgccagacgccc

SEQ ID NO: 78804 - DNA, 25 bp, Homo sapien
caggagtcgggcatcccggacttac

SEQ ID NO: 78805 - DNA, 25 bp, Homo sapien
tccgggtggcctcgtgccacgcagt

SEQ ID NO: 78806 - DNA, 25 bp, Homo sapien
cgaggatgggatccgggtttgccac

SEQ ID NO: 78807 - DNA, 25 bp, Homo sapien
agtgagcaggcgcaccttagctggt

SEQ ID NO: 78808 - DNA, 25 bp, Homo sapien
ggcgcaccttagctggtccgagcaa

SEQ ID NO: 78809 - DNA, 25 bp, Homo sapien
agctgtctcgtggtgcccagtgcag

SEQ ID NO: 78810 - DNA, 25 bp, Homo sapien
cttagctggtccgagcaacaggccc

SEQ ID NO: 78811 - DNA, 25 bp, Homo sapien
ccctgctcaatgtggcggctgcagc

SEQ ID NO: 78812 - DNA, 25 bp, Homo sapien
accgccctagcagctgtctcgtggt

SEQ ID NO: 78813 - DNA, 25 bp, Homo sapien
cctagcagctgtctcgtggtgccca

SEQ ID NO: 78814 - DNA, 25 bp, Homo sapien
ccctcggaatggtccgcaaggacgg

SEQ ID NO: 78815 - DNA, 25 bp, Homo sapien
gcagttccgcgccttccagagggcg

SEQ ID NO: 78816 - DNA, 25 bp, Homo sapien
ccaaatctctaagcggtggagggga

SEQ ID NO: 78817 - DNA, 25 bp, Homo sapien
cccgcaaagtcagggaggttcctcg

SEQ ID NO: 78818 - DNA, 25 bp, Homo sapien
gctccagcttgggatttgggactca

SEQ ID NO: 78819 - DNA, 25 bp, Homo sapien
tcaggacggccgaggaacccgtgaa

SEQ ID NO: 78820 - DNA, 25 bp, Homo sapien
ggcggcgcctcggaacagctcactt

SEQ ID NO: 78821 - DNA, 25 bp, Homo sapien
aacgcgctcggctcgcacagcagtt

SEQ ID NO: 78822 - DNA, 25 bp, Homo sapien
ggacagctgacatctcggaggccgt

SEQ ID NO: 78823 - DNA, 25 bp, Homo sapien
cagccgagaagggacagctgacatc

SEQ ID NO: 78824 - DNA, 25 bp, Homo sapien
agccgagaagggacagctgacatct

SEQ ID NO: 78825 - DNA, 25 bp, Homo sapien
gccgagaagggacagctgacatctc

SEQ ID NO: 78826 - DNA, 25 bp, Homo sapien
ccgagaagggacagctgacatctcg

SEQ ID NO: 78827 - DNA, 25 bp, Homo sapien
agaagggacagctgacatctcggag

SEQ ID NO: 78828 - DNA, 25 bp, Homo sapien
aagggacagctgacatctcggaggc

SEQ ID NO: 78829 - DNA, 25 bp, Homo sapien
agggacagctgacatctcggaggcc

SEQ ID NO: 78830 - DNA, 25 bp, Homo sapien
aggctttgttgtccgcgacaggctc

SEQ ID NO: 78831 - DNA, 25 bp, Homo sapien
gaggctctccaattgctgggccaga

SEQ ID NO: 78832 - DNA, 25 bp, Homo sapien
ctgagcctgaagtcgccacggactc

SEQ ID NO: 78833 - DNA, 25 bp, Homo sapien
tgggcttccaatcttggcctgccta

SEQ ID NO: 78834 - DNA, 25 bp, Homo sapien
gactcggggcaacaggcagatttgc

SEQ ID NO: 78835 - DNA, 25 bp, Homo sapien
aaaccgcacgctatggctgacagcc

SEQ ID NO: 78836 - DNA, 25 bp, Homo sapien
acggacttttacattcgccgaagca

SEQ ID NO: 78837 - DNA, 25 bp, Homo sapien
gtatctccggtcttcaggcctcctt

SEQ ID NO: 78838 - DNA, 25 bp, Homo sapien
ctggaatcctgggaacgactgtacc

SEQ ID NO: 78839 - DNA, 25 bp, Homo sapien
ctaacggggctgccgcaagagcaag

SEQ ID NO: 78840 - DNA, 25 bp, Homo sapien
gaatcctgggaacgactgtaccttc

SEQ ID NO: 78841 - DNA, 25 bp, Homo sapien
gcctggaatcctgggaacgactgta

SEQ ID NO: 78842 - DNA, 25 bp, Homo sapien
tgcctgatctgtgcggcctggaatc

SEQ ID NO: 78843 - DNA, 25 bp, Homo sapien
gggctgccgcaagagcaaggggaca

SEQ ID NO: 78844 - DNA, 25 bp, Homo sapien
cccgaggccgtgagttcggggccag

SEQ ID NO: 78845 - DNA, 25 bp, Homo sapien
tgggaacgactgtaccttccccagc

SEQ ID NO: 78846 - DNA, 25 bp, Homo sapien
ccagataatgaaactgctctctccc

SEQ ID NO: 78847 - DNA, 25 bp, Homo sapien
gataatgaaactgctctctccccca

SEQ ID NO: 78848 - DNA, 25 bp, Homo sapien
cccagataatgaaactgctctctcc

SEQ ID NO: 78849 - DNA, 25 bp, Homo sapien
agaagcggccggaggaaagactgga

SEQ ID NO: 78850 - DNA, 25 bp, Homo sapien
agggttctgcgggcatggcccaccc

SEQ ID NO: 78851 - DNA, 25 bp, Homo sapien
gtagagaggacccagcacaccccaa

SEQ ID NO: 78852 - DNA, 25 bp, Homo sapien
gagtagagaggacccagcacacccc

SEQ ID NO: 78853 - DNA, 25 bp, Homo sapien
atgaaactgctctctcccccaaaaa

SEQ ID NO: 78854 - DNA, 25 bp, Homo sapien
gggcacctccacctccgaagctcgc

SEQ ID NO: 78855 - DNA, 25 bp, Homo sapien
ggcactcgggactttgtgttccctg

SEQ ID NO: 78856 - DNA, 25 bp, Homo sapien
gggccccctcaagctgagtcacagg

SEQ ID NO: 78857 - DNA, 25 bp, Homo sapien
ctcagtgggacagcttgggccccct

SEQ ID NO: 78858 - DNA, 25 bp, Homo sapien
cccagtaaatgacaggaggaccagg

SEQ ID NO: 78859 - DNA, 25 bp, Homo sapien
gaggcctccgcaccccagtaaatga

SEQ ID NO: 78860 - DNA, 25 bp, Homo sapien
tgcaagaaggcaggcgaaagcggac

SEQ ID NO: 78861 - DNA, 25 bp, Homo sapien
gaggcctctgcgtcaagcacagatg

SEQ ID NO: 78862 - DNA, 25 bp, Homo sapien
aggtcacgccagctgaggcagcacc

SEQ ID NO: 78863 - DNA, 25 bp, Homo sapien
tttcagaatcgaagggccaggcacc

SEQ ID NO: 78864 - DNA, 25 bp, Homo sapien
gtccaggattcagatctggtttcag

SEQ ID NO: 78865 - DNA, 25 bp, Homo sapien
agctggccagagagacgggcctccc

SEQ ID NO: 78866 - DNA, 25 bp, Homo sapien
gagaaggatcgctttccaggcatcg

SEQ ID NO: 78867 - DNA, 25 bp, Homo sapien
ctcctccgagcctttgagaaggatc

SEQ ID NO: 78868 - DNA, 25 bp, Homo sapien
aggccatcggcattccggagcccag

SEQ ID NO: 78869 - DNA, 25 bp, Homo sapien
agcccagggtccagatttggtttca

SEQ ID NO: 78870 - DNA, 25 bp, Homo sapien
ggtttctctcgtgttcagggtagta

SEQ ID NO: 78871 - DNA, 25 bp, Homo sapien
cctccattccttgcccaggcttccg

SEQ ID NO: 78872 - DNA, 25 bp, Homo sapien
taagcctaagcaccgccagtcgcgg

SEQ ID NO: 78873 - DNA, 25 bp, Homo sapien
agagccgggtccagatacgcgcgcc

SEQ ID NO: 78874 - DNA, 25 bp, Homo sapien
cccaagagccgggtccagatacgcg

SEQ ID NO: 78875 - DNA, 25 bp, Homo sapien
tcagggtagtatggacgtggacaat

SEQ ID NO: 78876 - DNA, 25 bp, Homo sapien
ctctcgtgttcagggtagtatggac

SEQ ID NO: 78877 - DNA, 25 bp, Homo sapien
ttgctttgggcgtgcgtttcctagc

SEQ ID NO: 78878 - DNA, 25 bp, Homo sapien
ggcctgcacctgcacttcaggccct

SEQ ID NO: 78879 - DNA, 25 bp, Homo sapien
cggcctgcacctgcacttcaggccc

SEQ ID NO: 78880 - DNA, 25 bp, Homo sapien
gcggcctgcacctgcacttcaggcc

SEQ ID NO: 78881 - DNA, 25 bp, Homo sapien
gcccagtttaagactcgaggcgcac

SEQ ID NO: 78882 - DNA, 25 bp, Homo sapien
cgcccagtttaagactcgaggcgca

SEQ ID NO: 78883 - DNA, 25 bp, Homo sapien
acgcccagtttaagactcgaggcgc

SEQ ID NO: 78884 - DNA, 25 bp, Homo sapien
aacgcccagtttaagactcgaggcg

SEQ ID NO: 78885 - DNA, 25 bp, Homo sapien
cccagtttaagactcgaggcgcacg

SEQ ID NO: 78886 - DNA, 25 bp, Homo sapien
aggaggactaggcaggtcacacagt

SEQ ID NO: 78887 - DNA, 25 bp, Homo sapien
ccaggaggactaggcaggtcacaca

SEQ ID NO: 78888 - DNA, 25 bp, Homo sapien
tcacacagtgaaggagggaaccaga

SEQ ID NO: 78889 - DNA, 25 bp, Homo sapien
gggaaccagaaacttcacttgctaa

SEQ ID NO: 78890 - DNA, 25 bp, Homo sapien
cactactcctctgggaatggggaac

SEQ ID NO: 78891 - DNA, 25 bp, Homo sapien
tcctctgggaatggggaacgtctcc

SEQ ID NO: 78892 - DNA, 25 bp, Homo sapien
tggttcccaaggtccttgatggtaa

SEQ ID NO: 78893 - DNA, 25 bp, Homo sapien
cacagtgaaggagggaaccagaaac

SEQ ID NO: 78894 - DNA, 25 bp, Homo sapien
tgactccaggtgagttcggcaaaga

SEQ ID NO: 78895 - DNA, 25 bp, Homo sapien
tgctcattagtagcacgggcagctc

SEQ ID NO: 78896 - DNA, 25 bp, Homo sapien
ctcgaaccagagacgtggcattggc

SEQ ID NO: 78897 - DNA, 25 bp, Homo sapien
ggaggctgccgtctaaacctgactc

SEQ ID NO: 78898 - DNA, 25 bp, Homo sapien
tattcacacggacgctgcggagctt

SEQ ID NO: 78899 - DNA, 25 bp, Homo sapien
gcgctgccctcgttattcacacgga

SEQ ID NO: 78900 - DNA, 25 bp, Homo sapien
aaggacggctcccagacagagagtg

SEQ ID NO: 78901 - DNA, 25 bp, Homo sapien
agcgctgctgcctttatatttccca

SEQ ID NO: 78902 - DNA, 25 bp, Homo sapien
cacggagaaaattacctgcccatta

SEQ ID NO: 78903 - DNA, 25 bp, Homo sapien
tttttcaagaaagcgcgtgcagctc

SEQ ID NO: 78904 - DNA, 25 bp, Homo sapien
agggcttccatgaaatcactcacgg

SEQ ID NO: 78905 - DNA, 25 bp, Homo sapien
ctgcccattaaacgggacgcggcga

SEQ ID NO: 78906 - DNA, 25 bp, Homo sapien
gcggggctctccgaatttgttcatc

SEQ ID NO: 78907 - DNA, 25 bp, Homo sapien
agccgcctggtgcactatcctcaga

SEQ ID NO: 78908 - DNA, 25 bp, Homo sapien
ggtcctggaggctgatctttttcaa

SEQ ID NO: 78909 - DNA, 25 bp, Homo sapien
tccggcagacggagggatgaataat

SEQ ID NO: 78910 - DNA, 25 bp, Homo sapien
ccttattcttcttgcgcatcgtgca

SEQ ID NO: 78911 - DNA, 25 bp, Homo sapien
gcgtcttcgccaggaggactttccc

SEQ ID NO: 78912 - DNA, 25 bp, Homo sapien
attgtggagcatccttccgatgtca

SEQ ID NO: 78913 - DNA, 25 bp, Homo sapien
ccgatgtcatcgtctctaagggcga

SEQ ID NO: 78914 - DNA, 25 bp, Homo sapien
ggcgagcccacgactctgaactgca

SEQ ID NO: 78915 - DNA, 25 bp, Homo sapien
actctgaactgcaaggcggagggcc

SEQ ID NO: 78916 - DNA, 25 bp, Homo sapien
gatgcttctgcccagcggatcctta

SEQ ID NO: 78917 - DNA, 25 bp, Homo sapien
ggccaacgcccaccattgagtggta

SEQ ID NO: 78918 - DNA, 25 bp, Homo sapien
tggaggttcgagattcaggcttttc

SEQ ID NO: 78919 - DNA, 25 bp, Homo sapien
tcttccaggtcggtgtcatcaatga

SEQ ID NO: 78920 - DNA, 25 bp, Homo sapien
tcccactgtcgatggcgctgttgtt

SEQ ID NO: 78921 - DNA, 25 bp, Homo sapien
cggtcgtcaggttgatcccactgtc

SEQ ID NO: 78922 - DNA, 25 bp, Homo sapien
agagagctacggaacgccttcacga

SEQ ID NO: 78923 - DNA, 25 bp, Homo sapien
agctgatttgcttgtgtcggtcgtc

SEQ ID NO: 78924 - DNA, 25 bp, Homo sapien
ctcagctaaagcgacgtctccaggc

SEQ ID NO: 78925 - DNA, 25 bp, Homo sapien
gctgggaatcttcgatccggaattc

SEQ ID NO: 78926 - DNA, 25 bp, Homo sapien
ggcggcgatagcagccaaagtagaa

SEQ ID NO: 78927 - DNA, 25 bp, Homo sapien
ccctggctcgtggaagctgtaaaga

SEQ ID NO: 78928 - DNA, 25 bp, Homo sapien
cctaaactacgcagaagcccaaact

SEQ ID NO: 78929 - DNA, 25 bp, Homo sapien
cggacactcgcacgtcttctgggcg

SEQ ID NO: 78930 - DNA, 25 bp, Homo sapien
cgggcccttgttcccatcacttggg

SEQ ID NO: 78931 - DNA, 25 bp, Homo sapien
gggccaaaaagtgcttctccgtctc

SEQ ID NO: 78932 - DNA, 25 bp, Homo sapien
agtagtgccgtttcctgcctccacg

SEQ ID NO: 78933 - DNA, 25 bp, Homo sapien
agacagcagcaggaccgcggacact

SEQ ID NO: 78934 - DNA, 25 bp, Homo sapien
ggccgatatcgtcatcgctgtgaga

SEQ ID NO: 78935 - DNA, 25 bp, Homo sapien
cgatatcgtcatcgctgtgagactt

SEQ ID NO: 78936 - DNA, 25 bp, Homo sapien
gggccgatatcgtcatcgctgtgag

SEQ ID NO: 78937 - DNA, 25 bp, Homo sapien
gtcatcgctgtgagacttggggctg

SEQ ID NO: 78938 - DNA, 25 bp, Homo sapien
atatcgtcatcgctgtgagacttgg

SEQ ID NO: 78939 - DNA, 25 bp, Homo sapien
gatatcgtcatcgctgtgagacttg

SEQ ID NO: 78940 - DNA, 25 bp, Homo sapien
ccgatatcgtcatcgctgtgagact

SEQ ID NO: 78941 - DNA, 25 bp, Homo sapien
gccgatatcgtcatcgctgtgagac

SEQ ID NO: 78942 - DNA, 25 bp, Homo sapien
tcgtcagggcgcagaaaagaagctt

SEQ ID NO: 78943 - DNA, 25 bp, Homo sapien
cggtgcttcacgattccttctctgg

SEQ ID NO: 78944 - DNA, 25 bp, Homo sapien
ctgccttcctgataaatacccggtg

SEQ ID NO: 78945 - DNA, 25 bp, Homo sapien
tcccgagcatcacagccagacatgg

SEQ ID NO: 78946 - DNA, 25 bp, Homo sapien
ctgagatatccagcggcgcacctga

SEQ ID NO: 78947 - DNA, 25 bp, Homo sapien
cgcggagctaattggagatggtttc

SEQ ID NO: 78948 - DNA, 25 bp, Homo sapien
ctgctgcgttatcttgtgggcttcc

SEQ ID NO: 78949 - DNA, 25 bp, Homo sapien
gacctaaaggcaccgctagcgtctg

SEQ ID NO: 78950 - DNA, 25 bp, Homo sapien
tagcggccaggtgtgagcgccctcc

SEQ ID NO: 78951 - DNA, 25 bp, Homo sapien
cgcgccaacgctggaaccgaaggct

SEQ ID NO: 78952 - DNA, 25 bp, Homo sapien
tgcttctccccattgtgttctcaga

SEQ ID NO: 78953 - DNA, 25 bp, Homo sapien
ttgccacgccgagttttccgcatcg

SEQ ID NO: 78954 - DNA, 25 bp, Homo sapien
cagtggggttgccacgccgagtttt

SEQ ID NO: 78955 - DNA, 25 bp, Homo sapien
ggcagaagccgtctctgcagcgccg

SEQ ID NO: 78956 - DNA, 25 bp, Homo sapien
tggcaactgggcagaagccgtctct

SEQ ID NO: 78957 - DNA, 25 bp, Homo sapien
acgctggaaccgaaggctcatggaa

SEQ ID NO: 78958 - DNA, 25 bp, Homo sapien
gtgcgctcctctcaacgtacgtgcg

SEQ ID NO: 78959 - DNA, 25 bp, Homo sapien
ctctcaacgtacgtgcgctcctctc

SEQ ID NO: 78960 - DNA, 25 bp, Homo sapien
gcgctcctctcaacgtacgtgcgct

SEQ ID NO: 78961 - DNA, 25 bp, Homo sapien
aacgtacgtgcgctcctctcaacgt

SEQ ID NO: 78962 - DNA, 25 bp, Homo sapien
tcctctcaacgtacgtgcgctcctc

SEQ ID NO: 78963 - DNA, 25 bp, Homo sapien
acgtgcgctcctctcaacgtacgtg

SEQ ID NO: 78964 - DNA, 25 bp, Homo sapien
acgtacgtgcgctcctctcaacgta

SEQ ID NO: 78965 - DNA, 25 bp, Homo sapien
tctcaacgtacgtgcgctcctctca

SEQ ID NO: 78966 - DNA, 25 bp, Homo sapien
attccgccgcagtccaagtagccga

SEQ ID NO: 78967 - DNA, 25 bp, Homo sapien
tccaagtagccgaggcccgagaggt

SEQ ID NO: 78968 - DNA, 25 bp, Homo sapien
gggagtcatcggagccgccatattc

SEQ ID NO: 78969 - DNA, 25 bp, Homo sapien
atctccaggagtctggccagttcgg

SEQ ID NO: 78970 - DNA, 25 bp, Homo sapien
gtccacggcgtagggcttcaagtac

SEQ ID NO: 78971 - DNA, 25 bp, Homo sapien
ggtacctgcgctggaagtccacggc

SEQ ID NO: 78972 - DNA, 25 bp, Homo sapien
gcgctgtcaaacctgccactacgga

SEQ ID NO: 78973 - DNA, 25 bp, Homo sapien
ttcaagtacgggtcgatctccagga

SEQ ID NO: 78974 - DNA, 25 bp, Homo sapien
ccgccatttcactctgtcggagaca

SEQ ID NO: 78975 - DNA, 25 bp, Homo sapien
ggaggacttttcgcccctgcggtca

SEQ ID NO: 78976 - DNA, 25 bp, Homo sapien
gccatttcactctgtcggagacact

SEQ ID NO: 78977 - DNA, 25 bp, Homo sapien
cgccgccatttcactctgtcggaga

SEQ ID NO: 78978 - DNA, 25 bp, Homo sapien
gagacggaacaagtagaccaggctg

SEQ ID NO: 78979 - DNA, 25 bp, Homo sapien
gcagcgagacggaacaagtagacca

SEQ ID NO: 78980 - DNA, 25 bp, Homo sapien
ccggcagcgagacggaacaagtaga

SEQ ID NO: 78981 - DNA, 25 bp, Homo sapien
atttcactctgtcggagacactgaa

SEQ ID NO: 78982 - DNA, 25 bp, Homo sapien
cgagtccgcgggttcgaacaccgca

SEQ ID NO: 78983 - DNA, 25 bp, Homo sapien
aggaggacaccagcggagccctgca

SEQ ID NO: 78984 - DNA, 25 bp, Homo sapien
tgcgggctcctgctacaaggtaatc

SEQ ID NO: 78985 - DNA, 25 bp, Homo sapien
ccgttctccgcttctacagtgtctg

SEQ ID NO: 78986 - DNA, 25 bp, Homo sapien
gccctttagagaagggaccatgatt

SEQ ID NO: 78987 - DNA, 25 bp, Homo sapien
cgccgagaggaaggcaagctccaaa

SEQ ID NO: 78988 - DNA, 25 bp, Homo sapien
gaccatgatttggaaacgcagcgcc

SEQ ID NO: 78989 - DNA, 25 bp, Homo sapien
agtgctgcttgcttgctcctcctct

SEQ ID NO: 78990 - DNA, 25 bp, Homo sapien
cagatactgggacgctccataaggc

SEQ ID NO: 78991 - DNA, 25 bp, Homo sapien
gctctgacgcggaactttgcaaagt

SEQ ID NO: 78992 - DNA, 25 bp, Homo sapien
agcccagctccggtttgcatataca

SEQ ID NO: 78993 - DNA, 25 bp, Homo sapien
agaccgatactctcgatgcccttcg

SEQ ID NO: 78994 - DNA, 25 bp, Homo sapien
gatggctttctgctcaaggacgctc

SEQ ID NO: 78995 - DNA, 25 bp, Homo sapien
cggatgttccctgccgcgcttatat

SEQ ID NO: 78996 - DNA, 25 bp, Homo sapien
atgcgcgggcaccttcatcttcagc

SEQ ID NO: 78997 - DNA, 25 bp, Homo sapien
tatacacaatgcacgcccggggctc

SEQ ID NO: 78998 - DNA, 25 bp, Homo sapien
tcagaagctcgcgctcgcgacaggc

SEQ ID NO: 78999 - DNA, 25 bp, Homo sapien
tgggccactctcctgaggcgatgca

SEQ ID NO: 79000 - DNA, 25 bp, Homo sapien
gaacacgccacattcctctcggatc

SEQ ID NO: 79001 - DNA, 25 bp, Homo sapien
tcgagctcagaagctcgcgctcgcg

SEQ ID NO: 79002 - DNA, 25 bp, Homo sapien
tgccgctgcggccaaggtgtaagca

SEQ ID NO: 79003 - DNA, 25 bp, Homo sapien
tgcggccaaggtgtaagcaccaacc

SEQ ID NO: 79004 - DNA, 25 bp, Homo sapien
aggtgtaagcaccaaccagctgcca

SEQ ID NO: 79005 - DNA, 25 bp, Homo sapien
tgtaagcaccaaccagctgccagct

SEQ ID NO: 79006 - DNA, 25 bp, Homo sapien
gggcgcagccaccaaagctgaaatg

SEQ ID NO: 79007 - DNA, 25 bp, Homo sapien
gcgaagctgccaagaaaccggctgc

SEQ ID NO: 79008 - DNA, 25 bp, Homo sapien
gcaaaatggaaggaagcgctggatc

SEQ ID NO: 79009 - DNA, 25 bp, Homo sapien
tctccgcggcggaagtcattcttat

SEQ ID NO: 79010 - DNA, 25 bp, Homo sapien
aaagctgaaatgtgaccgcgtcccg

SEQ ID NO: 79011 - DNA, 25 bp, Homo sapien
gcagcaaccgacttgtgcgaaagga

SEQ ID NO: 79012 - DNA, 25 bp, Homo sapien
tgccaaagggtagagggcagcaacc

SEQ ID NO: 79013 - DNA, 25 bp, Homo sapien
agtcattcttatgccctgccaaagg

SEQ ID NO: 79014 - DNA, 25 bp, Homo sapien
caggggccaacaatcaccgggtacg

SEQ ID NO: 79015 - DNA, 25 bp, Homo sapien
cgccagttcctggattactcgagta

SEQ ID NO: 79016 - DNA, 25 bp, Homo sapien
ggccgcggcttcaaactccgtagtg

SEQ ID NO: 79017 - DNA, 25 bp, Homo sapien
aggcgccgcctagaagtgacttctc

SEQ ID NO: 79018 - DNA, 25 bp, Homo sapien
cggtagctgcggatacaagccttcc

SEQ ID NO: 79019 - DNA, 25 bp, Homo sapien
ccatggcgtccctcttcaagaagaa

SEQ ID NO: 79020 - DNA, 25 bp, Homo sapien
cgcgattctgcctactgtccctgga

SEQ ID NO: 79021 - DNA, 25 bp, Homo sapien
cacacttagtctaggagcccggaga

SEQ ID NO: 79022 - DNA, 25 bp, Homo sapien
tgaggatgtcattctcattgtccca

SEQ ID NO: 79023 - DNA, 25 bp, Homo sapien
gaagtcgcggtaggccacgcagata

SEQ ID NO: 79024 - DNA, 25 bp, Homo sapien
ccacgcagatagtgcggagcccatc

SEQ ID NO: 79025 - DNA, 25 bp, Homo sapien
tgcggagcccatcgcaagccatggg

SEQ ID NO: 79026 - DNA, 25 bp, Homo sapien
gccatgggctcaatcaccttcttta

SEQ ID NO: 79027 - DNA, 25 bp, Homo sapien
gggctcaatcaccttctttaccatc

SEQ ID NO: 79028 - DNA, 25 bp, Homo sapien
tcgatgcccaccacgcagatgcagg

SEQ ID NO: 79029 - DNA, 25 bp, Homo sapien
ggtgagttcgttgaggatgtcattc

SEQ ID NO: 79030 - DNA, 25 bp, Homo sapien
tcgctccggacaccatggacaagtt

SEQ ID NO: 79031 - DNA, 25 bp, Homo sapien
aactgcagccaacttccgaggcagc

SEQ ID NO: 79032 - DNA, 25 bp, Homo sapien
ggttcggtcatcctctgtcctgacg

SEQ ID NO: 79033 - DNA, 25 bp, Homo sapien
cccgattatttacagcctcagcaga

SEQ ID NO: 79034 - DNA, 25 bp, Homo sapien
tgctacttcttaaaacctctgcggg

SEQ ID NO: 79035 - DNA, 25 bp, Homo sapien
acctctgcgggctgcttagtcacag

SEQ ID NO: 79036 - DNA, 25 bp, Homo sapien
ctccgtcttaggtcactgttttcaa

SEQ ID NO: 79037 - DNA, 25 bp, Homo sapien
tggacaagttttggtggcacgcagc

SEQ ID NO: 79038 - DNA, 25 bp, Homo sapien
gacagcgcttgctctcggcggaaac

SEQ ID NO: 79039 - DNA, 25 bp, Homo sapien
aatcgcttgcagttttccaacttta

SEQ ID NO: 79040 - DNA, 25 bp, Homo sapien
cgcaggaattcaagaattgcccttt

SEQ ID NO: 79041 - DNA, 25 bp, Homo sapien
gtcttcgaatccatctctcggtggg

SEQ ID NO: 79042 - DNA, 25 bp, Homo sapien
agccgtagatcggaaatcgcttgca

SEQ ID NO: 79043 - DNA, 25 bp, Homo sapien
agtcctttcccacactactttgatc

SEQ ID NO: 79044 - DNA, 25 bp, Homo sapien
ctttgatctaacagcgcaggaattc

SEQ ID NO: 79045 - DNA, 25 bp, Homo sapien
tctcggtgggatcttgagaggattc

SEQ ID NO: 79046 - DNA, 25 bp, Homo sapien
ttgaccaacagacggccggtttatc

SEQ ID NO: 79047 - DNA, 25 bp, Homo sapien
ggcagcttgcgtcttccaataaaaa

SEQ ID NO: 79048 - DNA, 25 bp, Homo sapien
ttagcctaggcatctacggcggcgg

SEQ ID NO: 79049 - DNA, 25 bp, Homo sapien
cggccggtttatcaaacagactgtc

SEQ ID NO: 79050 - DNA, 25 bp, Homo sapien
tgcaccgcctatggcagagcccgta

SEQ ID NO: 79051 - DNA, 25 bp, Homo sapien
cctagctccttggtaccgtaggatc

SEQ ID NO: 79052 - DNA, 25 bp, Homo sapien
cagactgtcgatttcaccaatagta

SEQ ID NO: 79053 - DNA, 25 bp, Homo sapien
aaccgccgagcagcattgaccaaca

SEQ ID NO: 79054 - DNA, 25 bp, Homo sapien
ccttaattgagatacgtgggacttc

SEQ ID NO: 79055 - DNA, 25 bp, Homo sapien
gggctgccgtaacctacttggccta

SEQ ID NO: 79056 - DNA, 25 bp, Homo sapien
tggcctactggacaacgacgagatc

SEQ ID NO: 79057 - DNA, 25 bp, Homo sapien
gctctggaaccactacgccgacttg

SEQ ID NO: 79058 - DNA, 25 bp, Homo sapien
ggcactgcgtttcctgattgacctc

SEQ ID NO: 79059 - DNA, 25 bp, Homo sapien
tcccggcgtgtttgagaggaaagtc

SEQ ID NO: 79060 - DNA, 25 bp, Homo sapien
agatgtcgggactcagcttttcaga

SEQ ID NO: 79061 - DNA, 25 bp, Homo sapien
ggcccttcgacggagaacaacaaga

SEQ ID NO: 79062 - DNA, 25 bp, Homo sapien
gtcctgacctgaggaatagacttta

SEQ ID NO: 79063 - DNA, 25 bp, Homo sapien
gaccctccttacctgggcgtcagta

SEQ ID NO: 79064 - DNA, 25 bp, Homo sapien
agttaagcgaacacgagcgccagga

SEQ ID NO: 79065 - DNA, 25 bp, Homo sapien
ggcgagcgcagcctgatgctctttt

SEQ ID NO: 79066 - DNA, 25 bp, Homo sapien
tggctgcccaagtcagttcccggag

SEQ ID NO: 79067 - DNA, 25 bp, Homo sapien
ccagtgggttctttgtgcacaagtc

SEQ ID NO: 79068 - DNA, 25 bp, Homo sapien
cgccagagagtccatgcgccttgga

SEQ ID NO: 79069 - DNA, 25 bp, Homo sapien
ttcaggatctacgatcgccctgccg

SEQ ID NO: 79070 - DNA, 25 bp, Homo sapien
tgcgcctcggtctgagccgtgctgc

SEQ ID NO: 79071 - DNA, 25 bp, Homo sapien
ggaccctcatttcgaagcgcgcgga

SEQ ID NO: 79072 - DNA, 25 bp, Homo sapien
accctcatttcgaagcgcgcggagg

SEQ ID NO: 79073 - DNA, 25 bp, Homo sapien
ctgtgcgcctcggtctgagccgtgc

SEQ ID NO: 79074 - DNA, 25 bp, Homo sapien
agcgacccagcgagcctcggcggaa

SEQ ID NO: 79075 - DNA, 25 bp, Homo sapien
gacccagcgagcctcggcggaacag

SEQ ID NO: 79076 - DNA, 25 bp, Homo sapien
caggaccctcatttcgaagcgcgcg

SEQ ID NO: 79077 - DNA, 25 bp, Homo sapien
cctcatttcgaagcgcgcggaggcg

SEQ ID NO: 79078 - DNA, 25 bp, Homo sapien
ttccttggctaagagggcagtcgtc

SEQ ID NO: 79079 - DNA, 25 bp, Homo sapien
agccaggactcttcagccactcaga

SEQ ID NO: 79080 - DNA, 25 bp, Homo sapien
ttccgcgcctcgaagtaacgtcagc

SEQ ID NO: 79081 - DNA, 25 bp, Homo sapien
ctacggtgtatctgcgtctttggtc

SEQ ID NO: 79082 - DNA, 25 bp, Homo sapien
cgctccggttgcctagttacgagaa

SEQ ID NO: 79083 - DNA, 25 bp, Homo sapien
gacccacgcggttagcaaggcttag

SEQ ID NO: 79084 - DNA, 25 bp, Homo sapien
cttatccactttaggggcgtctcgg

SEQ ID NO: 79085 - DNA, 25 bp, Homo sapien
gtcccgctaactcggctacggtgta

SEQ ID NO: 79086 - DNA, 25 bp, Homo sapien
cgggagctaagcctcttcgacaaga

SEQ ID NO: 79087 - DNA, 25 bp, Homo sapien
ttgaaagctctcagcgggacaatgc

SEQ ID NO: 79088 - DNA, 25 bp, Homo sapien
ctgattcgcgtacacctgttgtttg

SEQ ID NO: 79089 - DNA, 25 bp, Homo sapien
cctggaggctttttgatactgattc

SEQ ID NO: 79090 - DNA, 25 bp, Homo sapien
cagcctttaccagctaccggaagta

SEQ ID NO: 79091 - DNA, 25 bp, Homo sapien
gcgaatcccggaagtcagactgttt

SEQ ID NO: 79092 - DNA, 25 bp, Homo sapien
cggctgggtacctctatctgaatga

SEQ ID NO: 79093 - DNA, 25 bp, Homo sapien
gcgtcctgggaagtatcagccttta

SEQ ID NO: 79094 - DNA, 25 bp, Homo sapien
aagtccagggctaggagcctcagcc

SEQ ID NO: 79095 - DNA, 25 bp, Homo sapien
tgcttgagatgaccgtctggccgtt

SEQ ID NO: 79096 - DNA, 25 bp, Homo sapien
cgagttttcgcaaaacaccctggcg

SEQ ID NO: 79097 - DNA, 25 bp, Homo sapien
aaacaccctggcgacgcggaagctc

SEQ ID NO: 79098 - DNA, 25 bp, Homo sapien
gcttggacgactgtcttccgcctca

SEQ ID NO: 79099 - DNA, 25 bp, Homo sapien
tgtcttccgcctcaactgtggagcc

SEQ ID NO: 79100 - DNA, 25 bp, Homo sapien
acctcatcgtgtccgccatcttggg

SEQ ID NO: 79101 - DNA, 25 bp, Homo sapien
ccatcttggggcgacggccagaagt

SEQ ID NO: 79102 - DNA, 25 bp, Homo sapien
gagcagtggagctccgcattctaga

SEQ ID NO: 79103 - DNA, 25 bp, Homo sapien
gccatggccgcgacagaggagcgga

SEQ ID NO: 79104 - DNA, 25 bp, Homo sapien
acctggctgggcgaaggcaggaccg

SEQ ID NO: 79105 - DNA, 25 bp, Homo sapien
cgggagcagtggagctccgcattct

SEQ ID NO: 79106 - DNA, 25 bp, Homo sapien
agtggagctccgcattctagagggc

SEQ ID NO: 79107 - DNA, 25 bp, Homo sapien
agctccgcattctagagggcggcgg

SEQ ID NO: 79108 - DNA, 25 bp, Homo sapien
cgacagaggagcggagcctgcacaa

SEQ ID NO: 79109 - DNA, 25 bp, Homo sapien
aggcaggaccgcgagtgcggaggct

SEQ ID NO: 79110 - DNA, 25 bp, Homo sapien
ttttggctccgcaagtgcccacttg

SEQ ID NO: 79111 - DNA, 25 bp, Homo sapien
ggctttcatcgcaccggccagagga

SEQ ID NO: 79112 - DNA, 25 bp, Homo sapien
cactcggcccttggactgctaggag

SEQ ID NO: 79113 - DNA, 25 bp, Homo sapien
ccggcgctttgcttttctacaactg

SEQ ID NO: 79114 - DNA, 25 bp, Homo sapien
tctacaactggaagccgcgaaggcg

SEQ ID NO: 79115 - DNA, 25 bp, Homo sapien
ggtgtcgggaactgactcctcttaa

SEQ ID NO: 79116 - DNA, 25 bp, Homo sapien
ctgctctgaaatgggcggctaagtg

SEQ ID NO: 79117 - DNA, 25 bp, Homo sapien
cggcctcagagatgcccggaaaatc

SEQ ID NO: 79118 - DNA, 25 bp, Homo sapien
cgccgaagctcgaataaatctctgg

SEQ ID NO: 79119 - DNA, 25 bp, Homo sapien
gtgcagcctaaacgcggcccagctg

SEQ ID NO: 79120 - DNA, 25 bp, Homo sapien
aaacacgcgggtggtgcagcctaaa

SEQ ID NO: 79121 - DNA, 25 bp, Homo sapien
gcccaggatctaaggagtagctatt

SEQ ID NO: 79122 - DNA, 25 bp, Homo sapien
cagcctctcgccataaattagccaa

SEQ ID NO: 79123 - DNA, 25 bp, Homo sapien
tttcgtcgagagctgacatcacccg

SEQ ID NO: 79124 - DNA, 25 bp, Homo sapien
tggccttcaattattcagcgagatt

SEQ ID NO: 79125 - DNA, 25 bp, Homo sapien
ggcgatccctctctattttcgtcga

SEQ ID NO: 79126 - DNA, 25 bp, Homo sapien
atctcgccggcaaaatgcaatctcg

SEQ ID NO: 79127 - DNA, 25 bp, Homo sapien
tcgccggcaaaatgcaatctcgggg

SEQ ID NO: 79128 - DNA, 25 bp, Homo sapien
aggagagcatctcgccggcaaaatg

SEQ ID NO: 79129 - DNA, 25 bp, Homo sapien
gttctaggagagcatctcgccggca

SEQ ID NO: 79130 - DNA, 25 bp, Homo sapien
cgccggttctaggagagcatctcgc

SEQ ID NO: 79131 - DNA, 25 bp, Homo sapien
tgcagactgtaccatcctgcccgag

SEQ ID NO: 79132 - DNA, 25 bp, Homo sapien
aaaatgcaatctcgggggaggcaga

SEQ ID NO: 79133 - DNA, 25 bp, Homo sapien
gcagccccgtaatcgcggtgcggca

SEQ ID NO: 79134 - DNA, 25 bp, Homo sapien
ctcctcgcaggaaataggcagctca

SEQ ID NO: 79135 - DNA, 25 bp, Homo sapien
tcaatgtatagttcctcggcgcgcc

SEQ ID NO: 79136 - DNA, 25 bp, Homo sapien
cggagctcttcaatcccagaagcta

SEQ ID NO: 79137 - DNA, 25 bp, Homo sapien
tcccatgatgctacgccgggaactg

SEQ ID NO: 79138 - DNA, 25 bp, Homo sapien
tcccagaaagctgtgcgcgagccta

SEQ ID NO: 79139 - DNA, 25 bp, Homo sapien
tggtgcccggtaacgacactctccg

SEQ ID NO: 79140 - DNA, 25 bp, Homo sapien
tcgttgccacaacgctacgctggtg

SEQ ID NO: 79141 - DNA, 25 bp, Homo sapien
acagtatcgtcttgcagtcgttgcc

SEQ ID NO: 79142 - DNA, 25 bp, Homo sapien
cctctgcaggttaaatcggggtgaa

SEQ ID NO: 79143 - DNA, 25 bp, Homo sapien
ggcaccaggcaacacctaggccgtt

SEQ ID NO: 79144 - DNA, 25 bp, Homo sapien
ctgcagttcgctcgccactttctgt

SEQ ID NO: 79145 - DNA, 25 bp, Homo sapien
cgtgattgggttcccgttccacaca

SEQ ID NO: 79146 - DNA, 25 bp, Homo sapien
ctctccaagttctgtggcaaaagcg

SEQ ID NO: 79147 - DNA, 25 bp, Homo sapien
ccgcctgcagtaatgggaaacactt

SEQ ID NO: 79148 - DNA, 25 bp, Homo sapien
aaacacttgtgagccgagcggagcc

SEQ ID NO: 79149 - DNA, 25 bp, Homo sapien
ggccctgcacatattcgcgggatga

SEQ ID NO: 79150 - DNA, 25 bp, Homo sapien
tgtaaccaaggcttccgcgacccta

SEQ ID NO: 79151 - DNA, 25 bp, Homo sapien
ccacgtgtgcgactctctgtaacca

SEQ ID NO: 79152 - DNA, 25 bp, Homo sapien
tcgcgaccattagcaggccacgtgt

SEQ ID NO: 79153 - DNA, 25 bp, Homo sapien
aggcttctcgccgaccgacaggtct

SEQ ID NO: 79154 - DNA, 25 bp, Homo sapien
ttgctaagcctccaaactttccgtg

SEQ ID NO: 79155 - DNA, 25 bp, Homo sapien
gagcccgggtgcctaaagcagcagc

SEQ ID NO: 79156 - DNA, 25 bp, Homo sapien
agcgtgtctcttaggcccgacatga

SEQ ID NO: 79157 - DNA, 25 bp, Homo sapien
ctcgtcaccggtgtcgcgaccatta

SEQ ID NO: 79158 - DNA, 25 bp, Homo sapien
ccgccgggaacatggaaccgcgacg

SEQ ID NO: 79159 - DNA, 25 bp, Homo sapien
cctgggacaaatccgccgctcggaa

SEQ ID NO: 79160 - DNA, 25 bp, Homo sapien
ggcgacgcaggtcccgctcactcac

SEQ ID NO: 79161 - DNA, 25 bp, Homo sapien
gcggttcgtccaagccggacgcctg

SEQ ID NO: 79162 - DNA, 25 bp, Homo sapien
cctcttcaaaccgccgggaacatgg

SEQ ID NO: 79163 - DNA, 25 bp, Homo sapien
agggctcggccctgggacaaatccg

SEQ ID NO: 79164 - DNA, 25 bp, Homo sapien
gggaacatggaaccgcgacgcgacc

SEQ ID NO: 79165 - DNA, 25 bp, Homo sapien
tcgtccaagccggacgcctgcagca

SEQ ID NO: 79166 - DNA, 25 bp, Homo sapien
gctgcaaggccatgttcccgcacta

SEQ ID NO: 79167 - DNA, 25 bp, Homo sapien
gaacctttcgagaagagccgctgca

SEQ ID NO: 79168 - DNA, 25 bp, Homo sapien
cccgaggtcttaggcaacatctccg

SEQ ID NO: 79169 - DNA, 25 bp, Homo sapien
gctgcacaggcggaaagaacctttc

SEQ ID NO: 79170 - DNA, 25 bp, Homo sapien
tcccgcactatcacctggagcagtg

SEQ ID NO: 79171 - DNA, 25 bp, Homo sapien
gtagtccggatcctatcgccgcctg

SEQ ID NO: 79172 - DNA, 25 bp, Homo sapien
agaggctttcttgtcacgtacaacc

SEQ ID NO: 79173 - DNA, 25 bp, Homo sapien
ataagaatccgacgcgcccagaagg

SEQ ID NO: 79174 - DNA, 25 bp, Homo sapien
cagcctcgcgggtaagcccaggagc

SEQ ID NO: 79175 - DNA, 25 bp, Homo sapien
cgagagaatctgctctgggaccctc

SEQ ID NO: 79176 - DNA, 25 bp, Homo sapien
taggggttcggctgtgctcccgcct

SEQ ID NO: 79177 - DNA, 25 bp, Homo sapien
tgcaccttcctcctcgaatttgggg

SEQ ID NO: 79178 - DNA, 25 bp, Homo sapien
ccgcgccaccttcctttggtttctg

SEQ ID NO: 79179 - DNA, 25 bp, Homo sapien
cttcgctgcgggtttgcactgcccg

SEQ ID NO: 79180 - DNA, 25 bp, Homo sapien
tccggctttgcagcctctgaggctc

SEQ ID NO: 79181 - DNA, 25 bp, Homo sapien
ctgggaccctcttttgtcgaatcgc

SEQ ID NO: 79182 - DNA, 25 bp, Homo sapien
ggcagccagctcgtcagtgacttcc

SEQ ID NO: 79183 - DNA, 25 bp, Homo sapien
cggccggcagtctgcctgcatagtg

SEQ ID NO: 79184 - DNA, 25 bp, Homo sapien
tctgcctgcatagtgcgggtgcctc

SEQ ID NO: 79185 - DNA, 25 bp, Homo sapien
ctcgtcagtgacttccgggacgtcc

SEQ ID NO: 79186 - DNA, 25 bp, Homo sapien
gagctaaggaacgtgcctcccgcgc

SEQ ID NO: 79187 - DNA, 25 bp, Homo sapien
ttccgcgaaacccaatcagcatgct

SEQ ID NO: 79188 - DNA, 25 bp, Homo sapien
ggcgcctgttattgttgggccctca

SEQ ID NO: 79189 - DNA, 25 bp, Homo sapien
tcagcccaaactgatcccgcagagg

SEQ ID NO: 79190 - DNA, 25 bp, Homo sapien
cctggctttgagacaacgtgattct

SEQ ID NO: 79191 - DNA, 25 bp, Homo sapien
caccgccttgggagcgcgcaagcat

SEQ ID NO: 79192 - DNA, 25 bp, Homo sapien
ctcagccctggtcgcttctggcgat

SEQ ID NO: 79193 - DNA, 25 bp, Homo sapien
ctgagctgaaatggcagacgatctc

SEQ ID NO: 79194 - DNA, 25 bp, Homo sapien
ccacgtcgagacctgagctgaaatg

SEQ ID NO: 79195 - DNA, 25 bp, Homo sapien
cagctggtcgcctacccgtgatgtt

SEQ ID NO: 79196 - DNA, 25 bp, Homo sapien
cgacagtgtctagcgggagctccgc

SEQ ID NO: 79197 - DNA, 25 bp, Homo sapien
ccgtgatgttctgcccacgtcgaga

SEQ ID NO: 79198 - DNA, 25 bp, Homo sapien
agagtcgcccgaacaatgcgagcgg

SEQ ID NO: 79199 - DNA, 25 bp, Homo sapien
cgcccggcctatgggcgttacgtca

SEQ ID NO: 79200 - DNA, 25 bp, Homo sapien
gcctatgggcgttacgtcactgttc

SEQ ID NO: 79201 - DNA, 25 bp, Homo sapien
cgtcactgttctgccttataaggcg

SEQ ID NO: 79202 - DNA, 25 bp, Homo sapien
cccgcggatgttccggccgtgtgaa

SEQ ID NO: 79203 - DNA, 25 bp, Homo sapien
atgttccggccgtgtgaacggaccg

SEQ ID NO: 79204 - DNA, 25 bp, Homo sapien
gcgctccgagagtcgcccgaacaat

SEQ ID NO: 79205 - DNA, 25 bp, Homo sapien
cgctgcgagccgactgtgcgcgctc

SEQ ID NO: 79206 - DNA, 25 bp, Homo sapien
gagctcgggtttcagctcgccaggc

SEQ ID NO: 79207 - DNA, 25 bp, Homo sapien
tctgctgccttaacccttgcggggc

SEQ ID NO: 79208 - DNA, 25 bp, Homo sapien
gctctcccatcctcatctgagggga

SEQ ID NO: 79209 - DNA, 25 bp, Homo sapien
atcctcatctgaggggaaccacctt

SEQ ID NO: 79210 - DNA, 25 bp, Homo sapien
cccgagcgtctactggggagggaga

SEQ ID NO: 79211 - DNA, 25 bp, Homo sapien
tcatctgaggggaaccaccttcagc

SEQ ID NO: 79212 - DNA, 25 bp, Homo sapien
tcagccagagcgacgtcagcccaaa

SEQ ID NO: 79213 - DNA, 25 bp, Homo sapien
tcgggtttcagctcgccaggctctc

SEQ ID NO: 79214 - DNA, 25 bp, Homo sapien
tgtaaccccatgatgtctaagcttc

SEQ ID NO: 79215 - DNA, 25 bp, Homo sapien
aatgaggagttgtttaatggatgta

SEQ ID NO: 79216 - DNA, 25 bp, Homo sapien
atggatgtaaagtttcagttttgca

SEQ ID NO: 79217 - DNA, 25 bp, Homo sapien
gttttgcaagccgaaaagagtttga

SEQ ID NO: 79218 - DNA, 25 bp, Homo sapien
aatggttaaagcggtcctgggctgc

SEQ ID NO: 79219 - DNA, 25 bp, Homo sapien
gtgccatggccaccttcaccgcctc

SEQ ID NO: 79220 - DNA, 25 bp, Homo sapien
agcaaatgaaacgttggcagagatg

SEQ ID NO: 79221 - DNA, 25 bp, Homo sapien
gagaagaagaagttaatcagggatt

SEQ ID NO: 79222 - DNA, 25 bp, Homo sapien
acgagcgcggccactggaacaacaa

SEQ ID NO: 79223 - DNA, 25 bp, Homo sapien
ccactggaacaacaaggtggagttc

SEQ ID NO: 79224 - DNA, 25 bp, Homo sapien
agcggaacccgagcggagaacctcg

SEQ ID NO: 79225 - DNA, 25 bp, Homo sapien
tcctgaaaagccagctcgcccgggg

SEQ ID NO: 79226 - DNA, 25 bp, Homo sapien
actccaggcacctcgcgtgtgagct

SEQ ID NO: 79227 - DNA, 25 bp, Homo sapien
agtgcgcacgcgcacgtgccaattc

SEQ ID NO: 79228 - DNA, 25 bp, Homo sapien
cgtgccaattcgcacctgagggttc

SEQ ID NO: 79229 - DNA, 25 bp, Homo sapien
tcaagcgcgacaaggcggtccacga

SEQ ID NO: 79230 - DNA, 25 bp, Homo sapien
attgagtctcggagttggtctcagc

SEQ ID NO: 79231 - DNA, 25 bp, Homo sapien
gacgccgtgacgttgcgttcctcca

SEQ ID NO: 79232 - DNA, 25 bp, Homo sapien
tccgaagaccttttacgacattgag

SEQ ID NO: 79233 - DNA, 25 bp, Homo sapien
tctcagcgccggatccacttttcgg

SEQ ID NO: 79234 - DNA, 25 bp, Homo sapien
ttttcggcaaagtgacgtggacgtc

SEQ ID NO: 79235 - DNA, 25 bp, Homo sapien
gtggacgtcaacagcaatggcggaa

SEQ ID NO: 79236 - DNA, 25 bp, Homo sapien
gaaagccggggctaatttccaatgc

SEQ ID NO: 79237 - DNA, 25 bp, Homo sapien
aagctcagtgctggacttccgaaga

SEQ ID NO: 79238 - DNA, 25 bp, Homo sapien
acagaggctgatggacgtgtatttc

SEQ ID NO: 79239 - DNA, 25 bp, Homo sapien
acgtgtatttctccacggtgtgggc

SEQ ID NO: 79240 - DNA, 25 bp, Homo sapien
tctcgttggtccgtcctggtgttac

SEQ ID NO: 79241 - DNA, 25 bp, Homo sapien
cctgcttgacagaggctgatggacg

SEQ ID NO: 79242 - DNA, 25 bp, Homo sapien
agtcatgacctgtaagtggcgcggc

SEQ ID NO: 79243 - DNA, 25 bp, Homo sapien
tgcttgtctgcagagtcatgacctg

SEQ ID NO: 79244 - DNA, 25 bp, Homo sapien
cctggtgttacaggcgcactggaat

SEQ ID NO: 79245 - DNA, 25 bp, Homo sapien
gcactggaatgaacgcagacccttc

SEQ ID NO: 79246 - DNA, 25 bp, Homo sapien
cggatccagttttccagttatagcc

SEQ ID NO: 79247 - DNA, 25 bp, Homo sapien
catctaggttggctgcagtcgaaac

SEQ ID NO: 79248 - DNA, 25 bp, Homo sapien
ggctgctgcatcactgaacttctta

SEQ ID NO: 79249 - DNA, 25 bp, Homo sapien
acctcttgaacctctgtggccgtta

SEQ ID NO: 79250 - DNA, 25 bp, Homo sapien
ccagtttactggtcgatttcggatc

SEQ ID NO: 79251 - DNA, 25 bp, Homo sapien
ggcgtagaccgagctacccagttta

SEQ ID NO: 79252 - DNA, 25 bp, Homo sapien
tccacaggtttagaggcggccatga

SEQ ID NO: 79253 - DNA, 25 bp, Homo sapien
gcgtgcccgagaaaccaacggatta

SEQ ID NO: 79254 - DNA, 25 bp, Homo sapien
gatgaagcacatctggacagctgtg

SEQ ID NO: 79255 - DNA, 25 bp, Homo sapien
gagtgccacatcagcgacggcgctg

SEQ ID NO: 79256 - DNA, 25 bp, Homo sapien
tctccttctcgccacttattattta

SEQ ID NO: 79257 - DNA, 25 bp, Homo sapien
caccaatgagctggggcttgtgcca

SEQ ID NO: 79258 - DNA, 25 bp, Homo sapien
ccaatcggcagcaagtgaagagctg

SEQ ID NO: 79259 - DNA, 25 bp, Homo sapien
cgcccggccaatcggcagcaagtga

SEQ ID NO: 79260 - DNA, 25 bp, Homo sapien
acattcccttaggatgcagccagcg

SEQ ID NO: 79261 - DNA, 25 bp, Homo sapien
agcgacggcgctgcacttccacatt

SEQ ID NO: 79262 - DNA, 25 bp, Homo sapien
tgccacgtacagagcccaagttctc

SEQ ID NO: 79263 - DNA, 25 bp, Homo sapien
ttctcgctaggcttgttgggtcagc

SEQ ID NO: 79264 - DNA, 25 bp, Homo sapien
ctttcgagaaaaccggaagtgcgtg

SEQ ID NO: 79265 - DNA, 25 bp, Homo sapien
tcctgggtatgtccacgcgcaataa

SEQ ID NO: 79266 - DNA, 25 bp, Homo sapien
tccagtgagaaagcagggactcttc

SEQ ID NO: 79267 - DNA, 25 bp, Homo sapien
tcctaaatcccgtcatccagtgaga

SEQ ID NO: 79268 - DNA, 25 bp, Homo sapien
cggggcagctcacgcttcctaaatc

SEQ ID NO: 79269 - DNA, 25 bp, Homo sapien
cgcccattggcgagaaacggaaata

SEQ ID NO: 79270 - DNA, 25 bp, Homo sapien
gcccgagctttctcttgtccatctt

SEQ ID NO: 79271 - DNA, 25 bp, Homo sapien
tctgaccctttctcaccggatgaag

SEQ ID NO: 79272 - DNA, 25 bp, Homo sapien
ccgggtaggagacaatatgttcagc

SEQ ID NO: 79273 - DNA, 25 bp, Homo sapien
tcgatgacagctcggaccgggtctt

SEQ ID NO: 79274 - DNA, 25 bp, Homo sapien
cccgcaaagtgcgaagcgcgcttgc

SEQ ID NO: 79275 - DNA, 25 bp, Homo sapien
accgggaagatccatgggccgatga

SEQ ID NO: 79276 - DNA, 25 bp, Homo sapien
aatttcagttgcaggcgctgtcacc

SEQ ID NO: 79277 - DNA, 25 bp, Homo sapien
tctcccgctgctgaaatttcagttg

SEQ ID NO: 79278 - DNA, 25 bp, Homo sapien
gtacgtcggagtccttcgtcctcca

SEQ ID NO: 79279 - DNA, 25 bp, Homo sapien
tctaaggcgcttcttttagccaaga

SEQ ID NO: 79280 - DNA, 25 bp, Homo sapien
agcgttctttgcgtgctgtgacgta

SEQ ID NO: 79281 - DNA, 25 bp, Homo sapien
ttctttgcgccagcgggaaccacta

SEQ ID NO: 79282 - DNA, 25 bp, Homo sapien
ggaaccactatctctgcactcctgg

SEQ ID NO: 79283 - DNA, 25 bp, Homo sapien
tcctggtaagcgagtttcttctttc

SEQ ID NO: 79284 - DNA, 25 bp, Homo sapien
ccggagacgttccaagatgcactta

SEQ ID NO: 79285 - DNA, 25 bp, Homo sapien
cgtagtcttcgagtacccagttgcc

SEQ ID NO: 79286 - DNA, 25 bp, Homo sapien
cgggagacgagaagcctgaaaagtc

SEQ ID NO: 79287 - DNA, 25 bp, Homo sapien
tgctccgggcctttctttgagctcc

SEQ ID NO: 79288 - DNA, 25 bp, Homo sapien
acaccggagacgctcatgagacata

SEQ ID NO: 79289 - DNA, 25 bp, Homo sapien
acagtgcgagccaccgagtagttgc

SEQ ID NO: 79290 - DNA, 25 bp, Homo sapien
cgcaggctgagtttctgacggtgcc

SEQ ID NO: 79291 - DNA, 25 bp, Homo sapien
gcctctcagttacacgcaggagtta

SEQ ID NO: 79292 - DNA, 25 bp, Homo sapien
cgaaggcggcctcttttcattcctc

SEQ ID NO: 79293 - DNA, 25 bp, Homo sapien
ttcattcctcgggaccgctctaggc

SEQ ID NO: 79294 - DNA, 25 bp, Homo sapien
cagggcgaggccctgtcttactatc

SEQ ID NO: 79295 - DNA, 25 bp, Homo sapien
gctggtggacctagtacaatggacc

SEQ ID NO: 79296 - DNA, 25 bp, Homo sapien
agcccaggtggcacgtgtcagccag

SEQ ID NO: 79297 - DNA, 25 bp, Homo sapien
agctccaaccgactggcccgttttg

SEQ ID NO: 79298 - DNA, 25 bp, Homo sapien
tgtcttactatctggcgcgcctgct

SEQ ID NO: 79299 - DNA, 25 bp, Homo sapien
cgtgcgctacggcatcaacccggag

SEQ ID NO: 79300 - DNA, 25 bp, Homo sapien
tcaacccggagcagattcagggcga

SEQ ID NO: 79301 - DNA, 25 bp, Homo sapien
aacctcacggacgtggtggtgcccg

SEQ ID NO: 79302 - DNA, 25 bp, Homo sapien
caggcggcagcttttcggattttac

SEQ ID NO: 79303 - DNA, 25 bp, Homo sapien
agcgctcttcgacggctcccttagt

SEQ ID NO: 79304 - DNA, 25 bp, Homo sapien
gcccggtagctttcctcgcttgaca

SEQ ID NO: 79305 - DNA, 25 bp, Homo sapien
ttcgtcaggtaacgcaggatggccc

SEQ ID NO: 79306 - DNA, 25 bp, Homo sapien
ttacgcttgacattgccctcggtgc

SEQ ID NO: 79307 - DNA, 25 bp, Homo sapien
ccctccgactcgtgggtacgcatag

SEQ ID NO: 79308 - DNA, 25 bp, Homo sapien
tggtaatacagagtcccgccgcgca

SEQ ID NO: 79309 - DNA, 25 bp, Homo sapien
ctggcgactgacaaaatggctgctg

SEQ ID NO: 79310 - DNA, 25 bp, Homo sapien
tccggggtagatcttgtacccgcta

SEQ ID NO: 79311 - DNA, 25 bp, Homo sapien
acgggtcgtgcttacttcatggcga

SEQ ID NO: 79312 - DNA, 25 bp, Homo sapien
tctgcccgaggatgtaagcggattg

SEQ ID NO: 79313 - DNA, 25 bp, Homo sapien
acagccatgccagggacgacagaga

SEQ ID NO: 79314 - DNA, 25 bp, Homo sapien
aagtccatcagggagggtgtctaca

SEQ ID NO: 79315 - DNA, 25 bp, Homo sapien
agctcgaccctgcaacaaaaagtga

SEQ ID NO: 79316 - DNA, 25 bp, Homo sapien
tggcgacagctccacggaaagacaa

SEQ ID NO: 79317 - DNA, 25 bp, Homo sapien
cctggccctccttgatgacgtaatc

SEQ ID NO: 79318 - DNA, 25 bp, Homo sapien
gtgcctccttgctgcttcgggaact

SEQ ID NO: 79319 - DNA, 25 bp, Homo sapien
gtgcgccactttcccaatcctgggg

SEQ ID NO: 79320 - DNA, 25 bp, Homo sapien
cctcatttgttctctgcgggctacg

SEQ ID NO: 79321 - DNA, 25 bp, Homo sapien
ccggagctaagcctagtgcaccaga

SEQ ID NO: 79322 - DNA, 25 bp, Homo sapien
tggcttaaaagcacaccggggcttg

SEQ ID NO: 79323 - DNA, 25 bp, Homo sapien
ccgagctctcagaaacgttggctta

SEQ ID NO: 79324 - DNA, 25 bp, Homo sapien
cccgcaagttggcactggattctgc

SEQ ID NO: 79325 - DNA, 25 bp, Homo sapien
agccgtcgaagctccctattcattc

SEQ ID NO: 79326 - DNA, 25 bp, Homo sapien
ggacggttgcctggtattattagca

SEQ ID NO: 79327 - DNA, 25 bp, Homo sapien
tggaccagttcttttgatgcggatc

SEQ ID NO: 79328 - DNA, 25 bp, Homo sapien
cttcacggagctgaattaaatagtg

SEQ ID NO: 79329 - DNA, 25 bp, Homo sapien
ttagcaagcagcaaatatggcggtg

SEQ ID NO: 79330 - DNA, 25 bp, Homo sapien
tagatgtgcagttctggaccagttc

SEQ ID NO: 79331 - DNA, 25 bp, Homo sapien
agttgtagttcacctgccgttccca

SEQ ID NO: 79332 - DNA, 25 bp, Homo sapien
tttgatgcggatctgtggtcgtcgc

SEQ ID NO: 79333 - DNA, 25 bp, Homo sapien
aaacctaggtttagatgtgcagttc

SEQ ID NO: 79334 - DNA, 25 bp, Homo sapien
tccgaagttcacgaggagttgggtc

SEQ ID NO: 79335 - DNA, 25 bp, Homo sapien
gccagcgcgctcctagactgcgaag

SEQ ID NO: 79336 - DNA, 25 bp, Homo sapien
ccgggtcgaaggcataggcagaatt

SEQ ID NO: 79337 - DNA, 25 bp, Homo sapien
tgggttgccaaagcgtcgcagctaa

SEQ ID NO: 79338 - DNA, 25 bp, Homo sapien
tcagtttcctccacttgcggcaacg

SEQ ID NO: 79339 - DNA, 25 bp, Homo sapien
ttgcggcaacgccacagctcggtac

SEQ ID NO: 79340 - DNA, 25 bp, Homo sapien
cagctcggtacagttcggacctcca

SEQ ID NO: 79341 - DNA, 25 bp, Homo sapien
cagggtgccaacttcgcttccaggc

SEQ ID NO: 79342 - DNA, 25 bp, Homo sapien
cattttactggaaatcggacgcatc

SEQ ID NO: 79343 - DNA, 25 bp, Homo sapien
gacgtacgcaccttagccatcaatt

SEQ ID NO: 79344 - DNA, 25 bp, Homo sapien
gcgccctccttagagctaggacgta

SEQ ID NO: 79345 - DNA, 25 bp, Homo sapien
acctgagctacttctacggcgcgtc

SEQ ID NO: 79346 - DNA, 25 bp, Homo sapien
gttaaataccctggcagtcccgcgc

SEQ ID NO: 79347 - DNA, 25 bp, Homo sapien
ggcgcattgcctcatcctgtacatt

SEQ ID NO: 79348 - DNA, 25 bp, Homo sapien
tttcccggtgaagggcaggcaaaca

SEQ ID NO: 79349 - DNA, 25 bp, Homo sapien
cctgggagcatgattgtggacaagc

SEQ ID NO: 79350 - DNA, 25 bp, Homo sapien
ccgagacagcgcatccagagctaga

SEQ ID NO: 79351 - DNA, 25 bp, Homo sapien
ccagaagtatcaatggcccttgctc

SEQ ID NO: 79352 - DNA, 25 bp, Homo sapien
tggtgtaccatttgggaccctccca

SEQ ID NO: 79353 - DNA, 25 bp, Homo sapien
tgcaggacaagggtcctcggccatc

SEQ ID NO: 79354 - DNA, 25 bp, Homo sapien
ttcgggaccaaacgcatctcgggct

SEQ ID NO: 79355 - DNA, 25 bp, Homo sapien
tcgggcagcaaaggaaaaagacctc

SEQ ID NO: 79356 - DNA, 25 bp, Homo sapien
ccgctcataaagacacggttccttg

SEQ ID NO: 79357 - DNA, 25 bp, Homo sapien
tgcggagacgcacgacagagcaagt

SEQ ID NO: 79358 - DNA, 25 bp, Homo sapien
cattgcgtggtggaaagttgcgtgc

SEQ ID NO: 79359 - DNA, 25 bp, Homo sapien
ccctgcgtcgggacccgccagcgcg

SEQ ID NO: 79360 - DNA, 25 bp, Homo sapien
tgggagaagacgctgcccctgcgtc

SEQ ID NO: 79361 - DNA, 25 bp, Homo sapien
gtgtgtctgggagaagacgctgccc

SEQ ID NO: 79362 - DNA, 25 bp, Homo sapien
ccacagcccaggggacggtgtgtct

SEQ ID NO: 79363 - DNA, 25 bp, Homo sapien
agaaccgaaggtgcagcgccacagc

SEQ ID NO: 79364 - DNA, 25 bp, Homo sapien
gagaaccgaaggtgcagcgccacag

SEQ ID NO: 79365 - DNA, 25 bp, Homo sapien
aagttgcgtgcggcagagaaccgaa

SEQ ID NO: 79366 - DNA, 25 bp, Homo sapien
ccacgtcgcaggataggtttttcta

SEQ ID NO: 79367 - DNA, 25 bp, Homo sapien
ttcggtgaattaccgagctggcatt

SEQ ID NO: 79368 - DNA, 25 bp, Homo sapien
cctggaccctcagatccgtggtttc

SEQ ID NO: 79369 - DNA, 25 bp, Homo sapien
gaggatccgatatcggccctggacc

SEQ ID NO: 79370 - DNA, 25 bp, Homo sapien
agccaccgtgaatctgaggatccga

SEQ ID NO: 79371 - DNA, 25 bp, Homo sapien
ttcttttggcgccacaggctcgtgt

SEQ ID NO: 79372 - DNA, 25 bp, Homo sapien
tccttcacggtggttcttttggcgc

SEQ ID NO: 79373 - DNA, 25 bp, Homo sapien
aagttccgctttcagacctccttca

SEQ ID NO: 79374 - DNA, 25 bp, Homo sapien
tccgagacgtggaaacgcaacaatt

SEQ ID NO: 79375 - DNA, 25 bp, Homo sapien
tgggatcgctgagaacagctcgctc

SEQ ID NO: 79376 - DNA, 25 bp, Homo sapien
cttcttgcctttcggcgccgtagct

SEQ ID NO: 79377 - DNA, 25 bp, Homo sapien
gccggcaagaagtgtggagcctccc

SEQ ID NO: 79378 - DNA, 25 bp, Homo sapien
cccacttcaaactggacggcggcgg

SEQ ID NO: 79379 - DNA, 25 bp, Homo sapien
caaggcacgaaggagctaaccaata

SEQ ID NO: 79380 - DNA, 25 bp, Homo sapien
ctcgcagcacgtcagaaaggaattg

SEQ ID NO: 79381 - DNA, 25 bp, Homo sapien
gcctgcgggttctggtctttaaatg

SEQ ID NO: 79382 - DNA, 25 bp, Homo sapien
cacgtgtgacgagtgcgagcccgac

SEQ ID NO: 79383 - DNA, 25 bp, Homo sapien
ggccgcgtcacagcacccacatggc

SEQ ID NO: 79384 - DNA, 25 bp, Homo sapien
actgcctcacgacggcacgtgtgac

SEQ ID NO: 79385 - DNA, 25 bp, Homo sapien
tgtgccgagaatgcggcttctgcta

SEQ ID NO: 79386 - DNA, 25 bp, Homo sapien
aggcagaagttcctcagtcaccatc

SEQ ID NO: 79387 - DNA, 25 bp, Homo sapien
cagtcaccatctggccgaatacgtc

SEQ ID NO: 79388 - DNA, 25 bp, Homo sapien
cccacatggcctctggagtgggcgc

SEQ ID NO: 79389 - DNA, 25 bp, Homo sapien
cggccttcgaggaactgcctcacga

SEQ ID NO: 79390 - DNA, 25 bp, Homo sapien
agagcatcctcatccatttgggcac

SEQ ID NO: 79391 - DNA, 25 bp, Homo sapien
gcgcaatgcgcttcttctgcctgca

SEQ ID NO: 79392 - DNA, 25 bp, Homo sapien
tttcccagatagaagaccggagccc

SEQ ID NO: 79393 - DNA, 25 bp, Homo sapien
ttccggactggatccttaagaggtg

SEQ ID NO: 79394 - DNA, 25 bp, Homo sapien
tccgtggattccgatttgctccgtc

SEQ ID NO: 79395 - DNA, 25 bp, Homo sapien
ttgctccgtctgaccagcctaggca

SEQ ID NO: 79396 - DNA, 25 bp, Homo sapien
ctaggcaatccagcatcgcgtggta

SEQ ID NO: 79397 - DNA, 25 bp, Homo sapien
ctccacgagtgacaaccatgttttc

SEQ ID NO: 79398 - DNA, 25 bp, Homo sapien
cgaggcgatttcctccctgccggta

SEQ ID NO: 79399 - DNA, 25 bp, Homo sapien
cggatggggccatgcttttcttcca

SEQ ID NO: 79400 - DNA, 25 bp, Homo sapien
ccagactgtgcttgtttgagcagga

SEQ ID NO: 79401 - DNA, 25 bp, Homo sapien
tcttcgagaggataacggaaatgcc

SEQ ID NO: 79402 - DNA, 25 bp, Homo sapien
tgttctccctgccagtacgctgtgg

SEQ ID NO: 79403 - DNA, 25 bp, Homo sapien
ccggcgatctttctaggaggccacc

SEQ ID NO: 79404 - DNA, 25 bp, Homo sapien
agccctggtcaggttcagccgcaac

SEQ ID NO: 79405 - DNA, 25 bp, Homo sapien
tttcttccaggacaatcggggctcc

SEQ ID NO: 79406 - DNA, 25 bp, Homo sapien
tgcgtttgcaaccagcacctctcgg

SEQ ID NO: 79407 - DNA, 25 bp, Homo sapien
tgttttcctactcacttgcgagccg

SEQ ID NO: 79408 - DNA, 25 bp, Homo sapien
gccgctgagggctagctacacacac

SEQ ID NO: 79409 - DNA, 25 bp, Homo sapien
tagagaaaccctgactggccgctga

SEQ ID NO: 79410 - DNA, 25 bp, Homo sapien
gccagccttcggtggatttattgaa

SEQ ID NO: 79411 - DNA, 25 bp, Homo sapien
aacgtttcgtctgcgttggtgaccg

SEQ ID NO: 79412 - DNA, 25 bp, Homo sapien
agcagcccagttgctcgttcatctg

SEQ ID NO: 79413 - DNA, 25 bp, Homo sapien
tcggcgaaagtacgtggagccctgc

SEQ ID NO: 79414 - DNA, 25 bp, Homo sapien
ggtgacatcgcacgtccatctgcca

SEQ ID NO: 79415 - DNA, 25 bp, Homo sapien
cgagacatggcgaccaacggcagca

SEQ ID NO: 79416 - DNA, 25 bp, Homo sapien
cgcaaaactgctgtccacgtggacc

SEQ ID NO: 79417 - DNA, 25 bp, Homo sapien
accaacggcagcaaggtggccgacg

SEQ ID NO: 79418 - DNA, 25 bp, Homo sapien
tggccgacgggcagatctccaccga

SEQ ID NO: 79419 - DNA, 25 bp, Homo sapien
ccctgtggccaatgacaagcccaaa

SEQ ID NO: 79420 - DNA, 25 bp, Homo sapien
ccaaaaccttggtggtcaaggtgca

SEQ ID NO: 79421 - DNA, 25 bp, Homo sapien
ccctgcgtccaaattccgagacatg

SEQ ID NO: 79422 - DNA, 25 bp, Homo sapien
gggacttcatcaagcccgggtcggc

SEQ ID NO: 79423 - DNA, 25 bp, Homo sapien
gtaggatccataccgccgaactgcg

SEQ ID NO: 79424 - DNA, 25 bp, Homo sapien
agggtgcgtgcgaacatgtaagtta

SEQ ID NO: 79425 - DNA, 25 bp, Homo sapien
tagatcaatagtcagcttagcggcc

SEQ ID NO: 79426 - DNA, 25 bp, Homo sapien
cttagcggcctcaatcaatgcttcg

SEQ ID NO: 79427 - DNA, 25 bp, Homo sapien
ttcgcagggagagcatgcaaccatc

SEQ ID NO: 79428 - DNA, 25 bp, Homo sapien
accggcattatcttcctcttttagg

SEQ ID NO: 79429 - DNA, 25 bp, Homo sapien
agagatccattactgcgcgcggcgg

SEQ ID NO: 79430 - DNA, 25 bp, Homo sapien
cgcaggaggctgaaccctgtgttcc

SEQ ID NO: 79431 - DNA, 25 bp, Homo sapien
cgtggaccaggacacctaggctttc

SEQ ID NO: 79432 - DNA, 25 bp, Homo sapien
attgcacccgttcctgtccgcgggt

SEQ ID NO: 79433 - DNA, 25 bp, Homo sapien
cgtctagcgccgaagcggtccctga

SEQ ID NO: 79434 - DNA, 25 bp, Homo sapien
cgcaaccgctgctgttgacgcggcg

SEQ ID NO: 79435 - DNA, 25 bp, Homo sapien
gctcagggcccgagtgttctgcgcc

SEQ ID NO: 79436 - DNA, 25 bp, Homo sapien
acgtctgcacttcgggcgctcaggg

SEQ ID NO: 79437 - DNA, 25 bp, Homo sapien
tctctctctacttttctcctctttg

SEQ ID NO: 79438 - DNA, 25 bp, Homo sapien
ttctccctcgctgaaagtctgaagg

SEQ ID NO: 79439 - DNA, 25 bp, Homo sapien
ccctgcctctgtggaaatggtggtc

SEQ ID NO: 79440 - DNA, 25 bp, Homo sapien
tcctgaatgacgtcacctgtggccc

SEQ ID NO: 79441 - DNA, 25 bp, Homo sapien
gttaccaggcgaccaccggacaatc

SEQ ID NO: 79442 - DNA, 25 bp, Homo sapien
ccagagcagcagtcatcgcagaacg

SEQ ID NO: 79443 - DNA, 25 bp, Homo sapien
cctcgtagcggagcagcttcagctt

SEQ ID NO: 79444 - DNA, 25 bp, Homo sapien
cttcaggttgctcttccggaggaac

SEQ ID NO: 79445 - DNA, 25 bp, Homo sapien
agtacagccacgaccggttaccagg

SEQ ID NO: 79446 - DNA, 25 bp, Homo sapien
cagctgtgcgctctgatttcgtgcg

SEQ ID NO: 79447 - DNA, 25 bp, Homo sapien
aggtttcggcctgagatcccgtgaa

SEQ ID NO: 79448 - DNA, 25 bp, Homo sapien
tcgggctccggaagtccctaggcac

SEQ ID NO: 79449 - DNA, 25 bp, Homo sapien
gctctcagaagcttccggatccggt

SEQ ID NO: 79450 - DNA, 25 bp, Homo sapien
cggcctttagctttcgccgcgcttt

SEQ ID NO: 79451 - DNA, 25 bp, Homo sapien
ctcgcgatttctcgggagaggaatc

SEQ ID NO: 79452 - DNA, 25 bp, Homo sapien
ggggattcctcactcagctgtgcgc

SEQ ID NO: 79453 - DNA, 25 bp, Homo sapien
tcccgtgaaggcgagaaatctcgcg

SEQ ID NO: 79454 - DNA, 25 bp, Homo sapien
ggtacctgtcgtccatgccctcgaa

SEQ ID NO: 79455 - DNA, 25 bp, Homo sapien
actgcgtcgtcgactcagttgtctc

SEQ ID NO: 79456 - DNA, 25 bp, Homo sapien
acctcggcactcacgagttggcgtg

SEQ ID NO: 79457 - DNA, 25 bp, Homo sapien
cgtggatgaaatccagacgcagctg

SEQ ID NO: 79458 - DNA, 25 bp, Homo sapien
cccgctgaagcgcagggtacctgtc

SEQ ID NO: 79459 - DNA, 25 bp, Homo sapien
cgcgcaactcaaggggacaaggaca

SEQ ID NO: 79460 - DNA, 25 bp, Homo sapien
caaggacacctgaccggcagccgtt

SEQ ID NO: 79461 - DNA, 25 bp, Homo sapien
ggcgggttcagcaaacacgtgctcc

SEQ ID NO: 79462 - DNA, 25 bp, Homo sapien
ttggctggaaacttttcgccgcgcc

SEQ ID NO: 79463 - DNA, 25 bp, Homo sapien
ctccaggctctgtggtaggtgaacc

SEQ ID NO: 79464 - DNA, 25 bp, Homo sapien
ctggaggcggcaaagcacaactttc

SEQ ID NO: 79465 - DNA, 25 bp, Homo sapien
ccgctctgagagtcggtttcttttc

SEQ ID NO: 79466 - DNA, 25 bp, Homo sapien
cagccgccagcgttcggccaagtgt

SEQ ID NO: 79467 - DNA, 25 bp, Homo sapien
gcgttccgagttcccaggagttcga

SEQ ID NO: 79468 - DNA, 25 bp, Homo sapien
taaatctctgctgtgggagaaaccc

SEQ ID NO: 79469 - DNA, 25 bp, Homo sapien
gcggggccgactaacctattccaga

SEQ ID NO: 79470 - DNA, 25 bp, Homo sapien
ggccggatctgggaattcatttttc

SEQ ID NO: 79471 - DNA, 25 bp, Homo sapien
gggagtagcaaagctgcttcctttc

SEQ ID NO: 79472 - DNA, 25 bp, Homo sapien
tgcttcctttcattcctctctggga

SEQ ID NO: 79473 - DNA, 25 bp, Homo sapien
actgatcctgggaaccgaagcttta

SEQ ID NO: 79474 - DNA, 25 bp, Homo sapien
tcttcccgagtctctggcgtgcact

SEQ ID NO: 79475 - DNA, 25 bp, Homo sapien
ttgaacctggcatcaccaccgcgtg

SEQ ID NO: 79476 - DNA, 25 bp, Homo sapien
ttaagacgtctgaccaccctacttg

SEQ ID NO: 79477 - DNA, 25 bp, Homo sapien
tggtctcatcttcccagacgcctgg

SEQ ID NO: 79478 - DNA, 25 bp, Homo sapien
aagtttccacaaatgcagtcgctgc

SEQ ID NO: 79479 - DNA, 25 bp, Homo sapien
cgactggccgaagcctgcaagtttc

SEQ ID NO: 79480 - DNA, 25 bp, Homo sapien
acctatctgaggaccgactggccga

SEQ ID NO: 79481 - DNA, 25 bp, Homo sapien
aggaaagaggacctatctgaggacc

SEQ ID NO: 79482 - DNA, 25 bp, Homo sapien
cgcggtgaacatctgagtgctgact

SEQ ID NO: 79483 - DNA, 25 bp, Homo sapien
aacatttgcggtcgcggtgaacatc

SEQ ID NO: 79484 - DNA, 25 bp, Homo sapien
gaaggaaggaaacatttgcggtcgc

SEQ ID NO: 79485 - DNA, 25 bp, Homo sapien
tgaacatctgagtgctgactgtgtg

SEQ ID NO: 79486 - DNA, 25 bp, Homo sapien
gttgctcgaactccctgggtgcccg

SEQ ID NO: 79487 - DNA, 25 bp, Homo sapien
ccgggaacgggctgcaccaatggcc

SEQ ID NO: 79488 - DNA, 25 bp, Homo sapien
acgggctgcaccaatggccaggtga

SEQ ID NO: 79489 - DNA, 25 bp, Homo sapien
tgccgactccgtgtgccaggagtgc

SEQ ID NO: 79490 - DNA, 25 bp, Homo sapien
actccgtgtgccaggagtgcgtccc

SEQ ID NO: 79491 - DNA, 25 bp, Homo sapien
gctgactgctcaccgcgagtcagga

SEQ ID NO: 79492 - DNA, 25 bp, Homo sapien
ggcgcgctgactgctcaccgcgagt

SEQ ID NO: 79493 - DNA, 25 bp, Homo sapien
cttcgttgctcgaactccctgggtg

SEQ ID NO: 79494 - DNA, 25 bp, Homo sapien
tgcggggagctctttagcaagttcc

SEQ ID NO: 79495 - DNA, 25 bp, Homo sapien
cgggagtaggatgcgttctttcgaa

SEQ ID NO: 79496 - DNA, 25 bp, Homo sapien
agcaagttccgccttccagcctgaa

SEQ ID NO: 79497 - DNA, 25 bp, Homo sapien
agagccacgacgctctgcgcatgtg

SEQ ID NO: 79498 - DNA, 25 bp, Homo sapien
tgcttgcacggatacctcagcgggc

SEQ ID NO: 79499 - DNA, 25 bp, Homo sapien
tgcgcatgtgcgctcttcgcaagct

SEQ ID NO: 79500 - DNA, 25 bp, Homo sapien
ttccgtcagttaccgtgcctgtgca

SEQ ID NO: 79501 - DNA, 25 bp, Homo sapien
aactacgaagatggcggttgcgcgc

SEQ ID NO: 79502 - DNA, 25 bp, Homo sapien
tgctctgaatggagccgagtcaccg

SEQ ID NO: 79503 - DNA, 25 bp, Homo sapien
atcgcaaacttttctccgttggacg

SEQ ID NO: 79504 - DNA, 25 bp, Homo sapien
ccctaaacggagatggtctgcatct

SEQ ID NO: 79505 - DNA, 25 bp, Homo sapien
ggcagcgccctgaacaaatcagaaa

SEQ ID NO: 79506 - DNA, 25 bp, Homo sapien
cagactttccctgccggcacatgga

SEQ ID NO: 79507 - DNA, 25 bp, Homo sapien
agccagtagacgagctggagctctc

SEQ ID NO: 79508 - DNA, 25 bp, Homo sapien
aacacgcctctcaatggtgccgaca

SEQ ID NO: 79509 - DNA, 25 bp, Homo sapien
tgccgacaaggtcttcccttctttg

SEQ ID NO: 79510 - DNA, 25 bp, Homo sapien
agcggcaaagacgacacggccttgt

SEQ ID NO: 79511 - DNA, 25 bp, Homo sapien
taaatgttcgcggaagcggcaaaga

SEQ ID NO: 79512 - DNA, 25 bp, Homo sapien
gcaaagacgacacggccttgtggga

SEQ ID NO: 79513 - DNA, 25 bp, Homo sapien
tcccagtcgcgaccttttgtcttct

SEQ ID NO: 79514 - DNA, 25 bp, Homo sapien
gtcttctcttacagcgcacccgttg

SEQ ID NO: 79515 - DNA, 25 bp, Homo sapien
gtcgcgtgcggccaggaaaacttgc

SEQ ID NO: 79516 - DNA, 25 bp, Homo sapien
tctcttacagcgcacccgttggtgc

SEQ ID NO: 79517 - DNA, 25 bp, Homo sapien
cccgactgagcagctggatgtcgcg

SEQ ID NO: 79518 - DNA, 25 bp, Homo sapien
gcactcgacgcgcagacacctttag

SEQ ID NO: 79519 - DNA, 25 bp, Homo sapien
tcgacgcgcagacacctttagcttc

SEQ ID NO: 79520 - DNA, 25 bp, Homo sapien
tgagcgtccgtctttgagctcgggc

SEQ ID NO: 79521 - DNA, 25 bp, Homo sapien
tgtggcctcagcactcgacgcgcag

SEQ ID NO: 79522 - DNA, 25 bp, Homo sapien
ccgcccgcttgagaagagcgcgctt

SEQ ID NO: 79523 - DNA, 25 bp, Homo sapien
cgccgcggccaacgcgccaccaaac

SEQ ID NO: 79524 - DNA, 25 bp, Homo sapien
cgggtacccagcgggagcagctcca

SEQ ID NO: 79525 - DNA, 25 bp, Homo sapien
cgcgccctgagcgtccgtctttgag

SEQ ID NO: 79526 - DNA, 25 bp, Homo sapien
cgtcaggcgatctccgcagcacaca

SEQ ID NO: 79527 - DNA, 25 bp, Homo sapien
gatctccgcagcacacacactgtgg

SEQ ID NO: 79528 - DNA, 25 bp, Homo sapien
atctccgcagcacacacactgtggg

SEQ ID NO: 79529 - DNA, 25 bp, Homo sapien
gcagcacacacactgtgggcacctg

SEQ ID NO: 79530 - DNA, 25 bp, Homo sapien
cagcacacacactgtgggcacctgt

SEQ ID NO: 79531 - DNA, 25 bp, Homo sapien
cccgtcaggcgatctccgcagcaca

SEQ ID NO: 79532 - DNA, 25 bp, Homo sapien
gcacacacactgtgggcacctgtgc

SEQ ID NO: 79533 - DNA, 25 bp, Homo sapien
agcacacacactgtgggcacctgtg

SEQ ID NO: 79534 - DNA, 25 bp, Homo sapien
gaaagctccttggcggtccagtgag

SEQ ID NO: 79535 - DNA, 25 bp, Homo sapien
gctcctgacccggaaagctccttgg

SEQ ID NO: 79536 - DNA, 25 bp, Homo sapien
ggcaggctcctgacccggaaagctc

SEQ ID NO: 79537 - DNA, 25 bp, Homo sapien
tccggaggcgtgcacgctcgtgcca

SEQ ID NO: 79538 - DNA, 25 bp, Homo sapien
gtgcacgctcgtgccaccacttgag

SEQ ID NO: 79539 - DNA, 25 bp, Homo sapien
cgtgccaccacttgagctcctcgga

SEQ ID NO: 79540 - DNA, 25 bp, Homo sapien
gggagtgccctcctcctcgtaagca

SEQ ID NO: 79541 - DNA, 25 bp, Homo sapien
agtgccctcctcctcgtaagcaggg

SEQ ID NO: 79542 - DNA, 25 bp, Homo sapien
gcgctgacgaagctggcgcatcctc

SEQ ID NO: 79543 - DNA, 25 bp, Homo sapien
aaaaagatgcaccaggccggggctc

SEQ ID NO: 79544 - DNA, 25 bp, Homo sapien
gcgtccagattctccattccaattg

SEQ ID NO: 79545 - DNA, 25 bp, Homo sapien
ttccaaagggtggtttacaggcagc

SEQ ID NO: 79546 - DNA, 25 bp, Homo sapien
ctctaagcgctttctcttgctgaga

SEQ ID NO: 79547 - DNA, 25 bp, Homo sapien
ttgatggcagcgcttttctctaagc

SEQ ID NO: 79548 - DNA, 25 bp, Homo sapien
ttgccacaatctggtccggggacta

SEQ ID NO: 79549 - DNA, 25 bp, Homo sapien
gcggagcttcggctcttgccacaat

SEQ ID NO: 79550 - DNA, 25 bp, Homo sapien
cggggcctcacgtgacactagactc

SEQ ID NO: 79551 - DNA, 25 bp, Homo sapien
ctccttccggaagcgtaacactgaa

SEQ ID NO: 79552 - DNA, 25 bp, Homo sapien
gtcaggtactcagccacttccagtg

SEQ ID NO: 79553 - DNA, 25 bp, Homo sapien
ccctggcctggcttaccttgaggac

SEQ ID NO: 79554 - DNA, 25 bp, Homo sapien
cgcctggtccctgaaaagtcgagca

SEQ ID NO: 79555 - DNA, 25 bp, Homo sapien
ggctgcacacttccctgtgtctcga

SEQ ID NO: 79556 - DNA, 25 bp, Homo sapien
tacccgaccgcgcagagttatgacg

SEQ ID NO: 79557 - DNA, 25 bp, Homo sapien
taacactgaacgtgcctgcgcaatg

SEQ ID NO: 79558 - DNA, 25 bp, Homo sapien
tgaacggaaccgcatcgactacgtc

SEQ ID NO: 79559 - DNA, 25 bp, Homo sapien
actctttgaaatgcctgcggtgcta

SEQ ID NO: 79560 - DNA, 25 bp, Homo sapien
acgtcccaagcttttgctgaggtgc

SEQ ID NO: 79561 - DNA, 25 bp, Homo sapien
gaggcaagaccttcacctgcgtatc

SEQ ID NO: 79562 - DNA, 25 bp, Homo sapien
tgcgtatctttgacccaagcccgga

SEQ ID NO: 79563 - DNA, 25 bp, Homo sapien
agccagggcggacaacatcttcacg

SEQ ID NO: 79564 - DNA, 25 bp, Homo sapien
agaggcgattctcacggttcacctg

SEQ ID NO: 79565 - DNA, 25 bp, Homo sapien
ccgcgcactgaaggcaaaacactta

SEQ ID NO: 79566 - DNA, 25 bp, Homo sapien
tcagcctgagaatgtctgcaaacgg

SEQ ID NO: 79567 - DNA, 25 bp, Homo sapien
agagtctgcaaacgggcacggagcg

SEQ ID NO: 79568 - DNA, 25 bp, Homo sapien
aatgtctgcaaacgggcatggagcg

SEQ ID NO: 79569 - DNA, 25 bp, Homo sapien
cggggctcagcctgagaatgtctgc

SEQ ID NO: 79570 - DNA, 25 bp, Homo sapien
ctgagaatgtctgcaaacgggcatg

SEQ ID NO: 79571 - DNA, 25 bp, Homo sapien
ggctcagcctgagaatgtctgcaaa

SEQ ID NO: 79572 - DNA, 25 bp, Homo sapien
cagcctgagagggtgtctgcaaacg

SEQ ID NO: 79573 - DNA, 25 bp, Homo sapien
gagagtctgcaaacgggcacggagc

SEQ ID NO: 79574 - DNA, 25 bp, Homo sapien
gggaggctgccttcatcgagtaaac

SEQ ID NO: 79575 - DNA, 25 bp, Homo sapien
ggagctacgcgagagcacgtccagc

SEQ ID NO: 79576 - DNA, 25 bp, Homo sapien
ggacttacgaaaggcggagctacgc

SEQ ID NO: 79577 - DNA, 25 bp, Homo sapien
ggcaccgcagccatcatgcgaggcg

SEQ ID NO: 79578 - DNA, 25 bp, Homo sapien
cgcgagagcacgtccagcgaccgga

SEQ ID NO: 79579 - DNA, 25 bp, Homo sapien
gccgcgccggggttctgcactgtca

SEQ ID NO: 79580 - DNA, 25 bp, Homo sapien
cgccttagggattctcacacggttc

SEQ ID NO: 79581 - DNA, 25 bp, Homo sapien
gggattctcacacggttccacggct

SEQ ID NO: 79582 - DNA, 25 bp, Homo sapien
tcagcggttcccagaagcttctcgg

SEQ ID NO: 79583 - DNA, 25 bp, Homo sapien
tctcgggtggaagaaggatccagcc

SEQ ID NO: 79584 - DNA, 25 bp, Homo sapien
ggcggcaaatgcgtagagtcactca

SEQ ID NO: 79585 - DNA, 25 bp, Homo sapien
cgacgcagcttgagggaagcatccc

SEQ ID NO: 79586 - DNA, 25 bp, Homo sapien
agggtttctcatagttggcgtcttc

SEQ ID NO: 79587 - DNA, 25 bp, Homo sapien
tgagtcacgtcgctgaagtttgttt

SEQ ID NO: 79588 - DNA, 25 bp, Homo sapien
tcaacacgcactcggcctctttgga

SEQ ID NO: 79589 - DNA, 25 bp, Homo sapien
ttccaccgaaggttgacaccagcgc

SEQ ID NO: 79590 - DNA, 25 bp, Homo sapien
atacctgcctgatattccaaaatgg

SEQ ID NO: 79591 - DNA, 25 bp, Homo sapien
tctcttcacagcgtctgccggaggc

SEQ ID NO: 79592 - DNA, 25 bp, Homo sapien
ttctccgcctcatgacactggttca

SEQ ID NO: 79593 - DNA, 25 bp, Homo sapien
ctggttcaaagccaaacagaaaagc

SEQ ID NO: 79594 - DNA, 25 bp, Homo sapien
cagaaaagcccgacgagtttattat

SEQ ID NO: 79595 - DNA, 25 bp, Homo sapien
gaataccgtcgaagatacctgcctg

SEQ ID NO: 79596 - DNA, 25 bp, Homo sapien
aatggcccaacggagccctgatcgc

SEQ ID NO: 79597 - DNA, 25 bp, Homo sapien
ccctaaaggacgtcatgtagataat

SEQ ID NO: 79598 - DNA, 25 bp, Homo sapien
acgcgcatactcgaggtgctctggc

SEQ ID NO: 79599 - DNA, 25 bp, Homo sapien
gactgcgagctgcaagcctcagatc

SEQ ID NO: 79600 - DNA, 25 bp, Homo sapien
tccctaaggctcgttgggactgcga

SEQ ID NO: 79601 - DNA, 25 bp, Homo sapien
ctggatcccaggcaacagacagatg

SEQ ID NO: 79602 - DNA, 25 bp, Homo sapien
ctgcgcttcctgaagtaaggattcc

SEQ ID NO: 79603 - DNA, 25 bp, Homo sapien
cacaggttaacccagccagcggctt

SEQ ID NO: 79604 - DNA, 25 bp, Homo sapien
agacacgcaccctgacacgtacttg

SEQ ID NO: 79605 - DNA, 25 bp, Homo sapien
tgctctggcgccacgcacaaacata

SEQ ID NO: 79606 - DNA, 25 bp, Homo sapien
atcatgtctacagcggggtggtgaa

SEQ ID NO: 79607 - DNA, 25 bp, Homo sapien
ccctgggaattgaccttgggagact

SEQ ID NO: 79608 - DNA, 25 bp, Homo sapien
cgctcgactcctagaacttgccaga

SEQ ID NO: 79609 - DNA, 25 bp, Homo sapien
ggtgaacctcagcaccgagaacatc

SEQ ID NO: 79610 - DNA, 25 bp, Homo sapien
acacgcctcggggacaactctgctt

SEQ ID NO: 79611 - DNA, 25 bp, Homo sapien
ggggcgccgatttcgatcatgtcta

SEQ ID NO: 79612 - DNA, 25 bp, Homo sapien
cgggctttggaaggaccctctctgc

SEQ ID NO: 79613 - DNA, 25 bp, Homo sapien
agcccgaccaggtaagacactcgct

SEQ ID NO: 79614 - DNA, 25 bp, Homo sapien
cagaatgccgttgcactacgctaga

SEQ ID NO: 79615 - DNA, 25 bp, Homo sapien
tagccaataagaagacagaatgccg

SEQ ID NO: 79616 - DNA, 25 bp, Homo sapien
aagcgaacagcctaccctgggcgcg

SEQ ID NO: 79617 - DNA, 25 bp, Homo sapien
cgcagctcagcaagcgaacagccta

SEQ ID NO: 79618 - DNA, 25 bp, Homo sapien
tgtctgaccgtctgggcgaatctct

SEQ ID NO: 79619 - DNA, 25 bp, Homo sapien
cccgcctgggtcatgatcccaggag

SEQ ID NO: 79620 - DNA, 25 bp, Homo sapien
aggaggcgcacttagcgcagccctg

SEQ ID NO: 79621 - DNA, 25 bp, Homo sapien
ggaacgctgccgtggtagccaataa

SEQ ID NO: 79622 - DNA, 25 bp, Homo sapien
tcccacttagctcggtgctaggggc

SEQ ID NO: 79623 - DNA, 25 bp, Homo sapien
caagttcctcccacttagctcggtg

SEQ ID NO: 79624 - DNA, 25 bp, Homo sapien
agctcggtgctaggggcgcatttcc

SEQ ID NO: 79625 - DNA, 25 bp, Homo sapien
gcatgcctctgctcctttgcgcacg

SEQ ID NO: 79626 - DNA, 25 bp, Homo sapien
cgcgcctcagagagagctgtggttg

SEQ ID NO: 79627 - DNA, 25 bp, Homo sapien
tgccggaagttgagcggcggtaagt

SEQ ID NO: 79628 - DNA, 25 bp, Homo sapien
cccgccctcctcacgactcaagttc

SEQ ID NO: 79629 - DNA, 25 bp, Homo sapien
cacgcgcgccgcttcccagtggcaa

SEQ ID NO: 79630 - DNA, 25 bp, Homo sapien
tcacaatagcctttccatgttgccc

SEQ ID NO: 79631 - DNA, 25 bp, Homo sapien
gttaccaccgatatcaacgccgtcg

SEQ ID NO: 79632 - DNA, 25 bp, Homo sapien
tgaggccgtcgttaccaccgatatc

SEQ ID NO: 79633 - DNA, 25 bp, Homo sapien
taggtctccgcacccttagctcggg

SEQ ID NO: 79634 - DNA, 25 bp, Homo sapien
gcttctccacacgtgcactcgggtc

SEQ ID NO: 79635 - DNA, 25 bp, Homo sapien
atatcaacgccgtcgtagtcgccgc

SEQ ID NO: 79636 - DNA, 25 bp, Homo sapien
tgagaagcagagaaatctccctccg

SEQ ID NO: 79637 - DNA, 25 bp, Homo sapien
cgggcgcttcacaatagcctttcca

SEQ ID NO: 79638 - DNA, 25 bp, Homo sapien
cgactgtccgtcaggtaagccgcgg

SEQ ID NO: 79639 - DNA, 25 bp, Homo sapien
gcgctccgactgtccgtcaggtaag

SEQ ID NO: 79640 - DNA, 25 bp, Homo sapien
ccggtaacacccatcgtcaggaatc

SEQ ID NO: 79641 - DNA, 25 bp, Homo sapien
aacacccatcgtcaggaatccttca

SEQ ID NO: 79642 - DNA, 25 bp, Homo sapien
atcgtcaggaatccttcacggccgc

SEQ ID NO: 79643 - DNA, 25 bp, Homo sapien
gcgcgcggagcctgtaactcgcagc

SEQ ID NO: 79644 - DNA, 25 bp, Homo sapien
gagcctgtaactcgcagcgcgcgct

SEQ ID NO: 79645 - DNA, 25 bp, Homo sapien
atggagggcgctccgactgtccgtc

SEQ ID NO: 79646 - DNA, 25 bp, Homo sapien
ccaaactgttcgatatgatatcctc

SEQ ID NO: 79647 - DNA, 25 bp, Homo sapien
tattcactcccaccatgatggggtc

SEQ ID NO: 79648 - DNA, 25 bp, Homo sapien
gagagaggcgcagcggaccactctc

SEQ ID NO: 79649 - DNA, 25 bp, Homo sapien
cagatccgcacggtaattcagtacc

SEQ ID NO: 79650 - DNA, 25 bp, Homo sapien
cggtaattcagtaccaaactgttcg

SEQ ID NO: 79651 - DNA, 25 bp, Homo sapien
tcctgtgtcccggaattggctagcc

SEQ ID NO: 79652 - DNA, 25 bp, Homo sapien
tcccggaattggctagcccaggtga

SEQ ID NO: 79653 - DNA, 25 bp, Homo sapien
ctggatctggatgagacacttattc

SEQ ID NO: 79654 - DNA, 25 bp, Homo sapien
cggtctgctctttagggtggttgaa

SEQ ID NO: 79655 - DNA, 25 bp, Homo sapien
ctgtgtgcttgctaactgtgcttca

SEQ ID NO: 79656 - DNA, 25 bp, Homo sapien
ggccggagtcataggctcagcaacc

SEQ ID NO: 79657 - DNA, 25 bp, Homo sapien
accgcgcaggattgagcgaaaatta

SEQ ID NO: 79658 - DNA, 25 bp, Homo sapien
ggggatcttactcgagaccaccatg

SEQ ID NO: 79659 - DNA, 25 bp, Homo sapien
gcttaagcacgggagatttcgcgcc

SEQ ID NO: 79660 - DNA, 25 bp, Homo sapien
ctgcatggttaaggatcctccgatc

SEQ ID NO: 79661 - DNA, 25 bp, Homo sapien
tgtgcttcaggaatccgctctggga

SEQ ID NO: 79662 - DNA, 25 bp, Homo sapien
ctccgcctctttggctgcagttgca

SEQ ID NO: 79663 - DNA, 25 bp, Homo sapien
cacggtctcacgtagttcggaaatc

SEQ ID NO: 79664 - DNA, 25 bp, Homo sapien
atcgggagacgcgtctgtgcctccg

SEQ ID NO: 79665 - DNA, 25 bp, Homo sapien
tgtgcctccggggaagccgacccat

SEQ ID NO: 79666 - DNA, 25 bp, Homo sapien
ctgcagttgcacctccggccagagg

SEQ ID NO: 79667 - DNA, 25 bp, Homo sapien
ctagcgggcatatgcttcgcctttc

SEQ ID NO: 79668 - DNA, 25 bp, Homo sapien
cccaggcttggagcggagaccgctc

SEQ ID NO: 79669 - DNA, 25 bp, Homo sapien
cggccagagggcaggtaacttccct

SEQ ID NO: 79670 - DNA, 25 bp, Homo sapien
cgaacctcggccaaagctgcagcaa

SEQ ID NO: 79671 - DNA, 25 bp, Homo sapien
ctcgcttgaatgtcggctttgcttt

SEQ ID NO: 79672 - DNA, 25 bp, Homo sapien
ctcgattgggatcaccttgggactc

SEQ ID NO: 79673 - DNA, 25 bp, Homo sapien
agaggtccctcgctcttgccgtcat

SEQ ID NO: 79674 - DNA, 25 bp, Homo sapien
gctcgcgttggctcagttaccatag

SEQ ID NO: 79675 - DNA, 25 bp, Homo sapien
agcaggcataggacaccgtcgaacc

SEQ ID NO: 79676 - DNA, 25 bp, Homo sapien
ctgaggcgccaggagcattttccaa

SEQ ID NO: 79677 - DNA, 25 bp, Homo sapien
ccttgtgaaccgtttccagcgattc

SEQ ID NO: 79678 - DNA, 25 bp, Homo sapien
gcccgcgacgtgctcaaagatgtcg

SEQ ID NO: 79679 - DNA, 25 bp, Homo sapien
cgcccgcgacgtgctcaaagatgtc

SEQ ID NO: 79680 - DNA, 25 bp, Homo sapien
cccgcgacgtgctcaaagatgtcgt

SEQ ID NO: 79681 - DNA, 25 bp, Homo sapien
ccgcgacgtgctcaaagatgtcgtt

SEQ ID NO: 79682 - DNA, 25 bp, Homo sapien
gcgacgtgctcaaagatgtcgttga

SEQ ID NO: 79683 - DNA, 25 bp, Homo sapien
gacgtgctcaaagatgtcgttgacg

SEQ ID NO: 79684 - DNA, 25 bp, Homo sapien
ctcgcccgcgacgtgctcaaagatg

SEQ ID NO: 79685 - DNA, 25 bp, Homo sapien
tcgcccgcgacgtgctcaaagatgt

SEQ ID NO: 79686 - DNA, 25 bp, Homo sapien
tctcggagcgattgcacgtgaccga

SEQ ID NO: 79687 - DNA, 25 bp, Homo sapien
gcccagggccacctctgaacatctg

SEQ ID NO: 79688 - DNA, 25 bp, Homo sapien
agagagaggcttggcccagggccac

SEQ ID NO: 79689 - DNA, 25 bp, Homo sapien
gccgcgccaaagcacccggagggct

SEQ ID NO: 79690 - DNA, 25 bp, Homo sapien
gagcgattgcacgtgaccgactgca

SEQ ID NO: 79691 - DNA, 25 bp, Homo sapien
cttcctctcggagcgattgcacgtg

SEQ ID NO: 79692 - DNA, 25 bp, Homo sapien
gcttagcctctgacttcctctcgga

SEQ ID NO: 79693 - DNA, 25 bp, Homo sapien
ttgcacgtgaccgactgcaggcgag

SEQ ID NO: 79694 - DNA, 25 bp, Homo sapien
agtagatcctgtccacgctgtgctg

SEQ ID NO: 79695 - DNA, 25 bp, Homo sapien
ctcggattcgttgcgttccaggatc

SEQ ID NO: 79696 - DNA, 25 bp, Homo sapien
gcccgagtcgaagctttcacctttg

SEQ ID NO: 79697 - DNA, 25 bp, Homo sapien
cgggatctcgatgtcgctgtagcca

SEQ ID NO: 79698 - DNA, 25 bp, Homo sapien
gactgcactgacaccaccgacggga

SEQ ID NO: 79699 - DNA, 25 bp, Homo sapien
tggatgcgcaccgttacgtcacaga

SEQ ID NO: 79700 - DNA, 25 bp, Homo sapien
tagcacgccgctgtacatgaagtca

SEQ ID NO: 79701 - DNA, 25 bp, Homo sapien
ctgcccgtagtagtcgtaatcgtcc

SEQ ID NO: 79702 - DNA, 25 bp, Homo sapien
tcgacacaggcgcaatcaggttagg

SEQ ID NO: 79703 - DNA, 25 bp, Homo sapien
cgcccgtcccacaacaaattagagt

SEQ ID NO: 79704 - DNA, 25 bp, Homo sapien
ggcattacctcctcgcgctctttaa

SEQ ID NO: 79705 - DNA, 25 bp, Homo sapien
ttcttcggcagaaggcccacattgg

SEQ ID NO: 79706 - DNA, 25 bp, Homo sapien
taggatagctctcacgccaatcttg

SEQ ID NO: 79707 - DNA, 25 bp, Homo sapien
ggttgccgcccataaacaaaatgca

SEQ ID NO: 79708 - DNA, 25 bp, Homo sapien
atctctgtcaccttcgattgggcta

SEQ ID NO: 79709 - DNA, 25 bp, Homo sapien
acatccattgggacgcggaaacttc

SEQ ID NO: 79710 - DNA, 25 bp, Homo sapien
ctcttgtttgggagataattgcttc

SEQ ID NO: 79711 - DNA, 25 bp, Homo sapien
gaacaaaagcgtcagcccagggccc

SEQ ID NO: 79712 - DNA, 25 bp, Homo sapien
cgaacacccgggagttcgctttcat

SEQ ID NO: 79713 - DNA, 25 bp, Homo sapien
agacctccggggaggcctcttgctc

SEQ ID NO: 79714 - DNA, 25 bp, Homo sapien
tggcctcagccgctgagaccctggg

SEQ ID NO: 79715 - DNA, 25 bp, Homo sapien
gtgtgatctcatctctttgtttctc

SEQ ID NO: 79716 - DNA, 25 bp, Homo sapien
ctgccttctttaggcgttccctcgg

SEQ ID NO: 79717 - DNA, 25 bp, Homo sapien
taattgcttctttcaggggcttgga

SEQ ID NO: 79718 - DNA, 25 bp, Homo sapien
ctcaagatgtgaatgattcttctgg

SEQ ID NO: 79719 - DNA, 25 bp, Homo sapien
ttctgtttatatgctaggttacatt

SEQ ID NO: 79720 - DNA, 25 bp, Homo sapien
aatgattcttctggttctgtttata

SEQ ID NO: 79721 - DNA, 25 bp, Homo sapien
tgtgaatgattcttctggttctgtt

SEQ ID NO: 79722 - DNA, 25 bp, Homo sapien
ctcctctcaagatgtgaatgattct

SEQ ID NO: 79723 - DNA, 25 bp, Homo sapien
aagatgtgaatgattcttctggttc

SEQ ID NO: 79724 - DNA, 25 bp, Homo sapien
cctctcaagatgtgaatgattcttc

SEQ ID NO: 79725 - DNA, 25 bp, Homo sapien
gatgtgaatgattcttctggttctg

SEQ ID NO: 79726 - DNA, 25 bp, Homo sapien
ggggagctgacctatgacaaacatg

SEQ ID NO: 79727 - DNA, 25 bp, Homo sapien
tgcagagctctagtacccagccacg

SEQ ID NO: 79728 - DNA, 25 bp, Homo sapien
gttcaccctgccgtcactgctggaa

SEQ ID NO: 79729 - DNA, 25 bp, Homo sapien
ggtggccaagcaacaccgccttcta

SEQ ID NO: 79730 - DNA, 25 bp, Homo sapien
ggcctgactcactcctttgtttctg

SEQ ID NO: 79731 - DNA, 25 bp, Homo sapien
tctatctgtactagcccgaggcgga

SEQ ID NO: 79732 - DNA, 25 bp, Homo sapien
gcccgcactcatcagaaatcgtttg

SEQ ID NO: 79733 - DNA, 25 bp, Homo sapien
tgcttgttgacgctgttacctctct

SEQ ID NO: 79734 - DNA, 25 bp, Homo sapien
tctagtgctcacagaacggcatcgc

SEQ ID NO: 79735 - DNA, 25 bp, Homo sapien
tctctagtaaaacgcgccgctcctt

SEQ ID NO: 79736 - DNA, 25 bp, Homo sapien
gcaacccggacagacaagcctcttg

SEQ ID NO: 79737 - DNA, 25 bp, Homo sapien
gtagcccgtgcctggtgtaaacaca

SEQ ID NO: 79738 - DNA, 25 bp, Homo sapien
aacagccttgctctcctcttcggga

SEQ ID NO: 79739 - DNA, 25 bp, Homo sapien
gtgtctgtgccaagtctatccaacg

SEQ ID NO: 79740 - DNA, 25 bp, Homo sapien
acggccggatcccagaacagccttg

SEQ ID NO: 79741 - DNA, 25 bp, Homo sapien
agcgccttataggaccgcgaaccga

SEQ ID NO: 79742 - DNA, 25 bp, Homo sapien
gacacagacactgcgcgccgagacg

SEQ ID NO: 79743 - DNA, 25 bp, Homo sapien
ctgcgtcccgacctgcaggaagcga

SEQ ID NO: 79744 - DNA, 25 bp, Homo sapien
tgtcctcgaccagcgggaagcgaga

SEQ ID NO: 79745 - DNA, 25 bp, Homo sapien
ctgacctgtgaaaagcgaagggaca

SEQ ID NO: 79746 - DNA, 25 bp, Homo sapien
gactcaccgttctagtgcgcgggga

SEQ ID NO: 79747 - DNA, 25 bp, Homo sapien
cgaggctgcttggacggcaaactct

SEQ ID NO: 79748 - DNA, 25 bp, Homo sapien
actgcgcgccgagacgaggctgctt

SEQ ID NO: 79749 - DNA, 25 bp, Homo sapien
cgctggtagaggacggacacagaca

SEQ ID NO: 79750 - DNA, 25 bp, Homo sapien
aacgctgagaagtcatcccggggcc

SEQ ID NO: 79751 - DNA, 25 bp, Homo sapien
ctcccggtcgcaacaggagaggagc

SEQ ID NO: 79752 - DNA, 25 bp, Homo sapien
ctcaccgtgcagagagaggagcagc

SEQ ID NO: 79753 - DNA, 25 bp, Homo sapien
aagaaagggctggagctactcaccg

SEQ ID NO: 79754 - DNA, 25 bp, Homo sapien
cccgaccctcggcaaagcaaggagg

SEQ ID NO: 79755 - DNA, 25 bp, Homo sapien
tgagaaagttggactcccgaccctc

SEQ ID NO: 79756 - DNA, 25 bp, Homo sapien
tctctgacaaggaacacctgggctg

SEQ ID NO: 79757 - DNA, 25 bp, Homo sapien
gtcagacccacagacgagccaagtg

SEQ ID NO: 79758 - DNA, 25 bp, Homo sapien
caaatcgaccacaccgggcgctgga

SEQ ID NO: 79759 - DNA, 25 bp, Homo sapien
tgtccagggaactgcatttcccggg

SEQ ID NO: 79760 - DNA, 25 bp, Homo sapien
cccggaatcgtgacctggggtatga

SEQ ID NO: 79761 - DNA, 25 bp, Homo sapien
tcgtgacctggggtatgaatgagcc

SEQ ID NO: 79762 - DNA, 25 bp, Homo sapien
ctggggtatgaatgagccctggatt

SEQ ID NO: 79763 - DNA, 25 bp, Homo sapien
ctggattttttcctacccggcagca

SEQ ID NO: 79764 - DNA, 25 bp, Homo sapien
ggctcttgagtacgagctccgcctc

SEQ ID NO: 79765 - DNA, 25 bp, Homo sapien
gaggcggctcttgagtacgagctcc

SEQ ID NO: 79766 - DNA, 25 bp, Homo sapien
gcatttcctgagctggatgatccta

SEQ ID NO: 79767 - DNA, 25 bp, Homo sapien
caggatgcttgtttttcgctctacc

SEQ ID NO: 79768 - DNA, 25 bp, Homo sapien
tcgctctaccaaagtcgtctgaagg

SEQ ID NO: 79769 - DNA, 25 bp, Homo sapien
ccgcaggagcctgtgaaagtcccta

SEQ ID NO: 79770 - DNA, 25 bp, Homo sapien
ccctaggactccaagtgaggaagtg

SEQ ID NO: 79771 - DNA, 25 bp, Homo sapien
gcccaagttcttccatcttccgatg

SEQ ID NO: 79772 - DNA, 25 bp, Homo sapien
gcccatcttacagcggtgccaagca

SEQ ID NO: 79773 - DNA, 25 bp, Homo sapien
tcgcagaactgctctcgggagaacg

SEQ ID NO: 79774 - DNA, 25 bp, Homo sapien
gctgctccgcccagcggtttctgat

SEQ ID NO: 79775 - DNA, 25 bp, Homo sapien
cggcgcttcagcttcagcaacgtca

SEQ ID NO: 79776 - DNA, 25 bp, Homo sapien
gagaggggctcccttcaaactcggc

SEQ ID NO: 79777 - DNA, 25 bp, Homo sapien
tctctgacgagaaccggccagtccg

SEQ ID NO: 79778 - DNA, 25 bp, Homo sapien
ctcccaccttggtgtggagggacca

SEQ ID NO: 79779 - DNA, 25 bp, Homo sapien
gactcacacgctgcggcgacaggaa

SEQ ID NO: 79780 - DNA, 25 bp, Homo sapien
agcgtcgaagacaaaggaatctctg

SEQ ID NO: 79781 - DNA, 25 bp, Homo sapien
tccgctccagctcgaaagacggtgg

SEQ ID NO: 79782 - DNA, 25 bp, Homo sapien
agctgaaggttttccggcctgttga

SEQ ID NO: 79783 - DNA, 25 bp, Homo sapien
gatccggagagcgagcaaacagccc

SEQ ID NO: 79784 - DNA, 25 bp, Homo sapien
tgggtatgttctacacttcgaacga

SEQ ID NO: 79785 - DNA, 25 bp, Homo sapien
cttcgaacgacagccctagcaaatc

SEQ ID NO: 79786 - DNA, 25 bp, Homo sapien
tagcaaatccgtcttcaccagcagc

SEQ ID NO: 79787 - DNA, 25 bp, Homo sapien
gtgtccgcagtcatcagcaccaaca

SEQ ID NO: 79788 - DNA, 25 bp, Homo sapien
ctccgagccctttgcggtatctgtg

SEQ ID NO: 79789 - DNA, 25 bp, Homo sapien
agcgcaaggcgctgaacatctccga

SEQ ID NO: 79790 - DNA, 25 bp, Homo sapien
tctggacctgcctgaaacactgagg

SEQ ID NO: 79791 - DNA, 25 bp, Homo sapien
ggctactctggacctgcctgaaaca

SEQ ID NO: 79792 - DNA, 25 bp, Homo sapien
cggctcccgggccatctttgtgcgg

SEQ ID NO: 79793 - DNA, 25 bp, Homo sapien
gcccgtgcttggctactctggacct

SEQ ID NO: 79794 - DNA, 25 bp, Homo sapien
cccggaattcagaatgacagggagg

SEQ ID NO: 79795 - DNA, 25 bp, Homo sapien
ctcccgggaagatgccgtggccgct

SEQ ID NO: 79796 - DNA, 25 bp, Homo sapien
tagctcgccgcttcggctctggctg

SEQ ID NO: 79797 - DNA, 25 bp, Homo sapien
atctgcagtaggtctgccggcgatg

SEQ ID NO: 79798 - DNA, 25 bp, Homo sapien
ggacttcctgtgtcgtatttccaag

SEQ ID NO: 79799 - DNA, 25 bp, Homo sapien
ctgccgattcggaagtccttgagga

SEQ ID NO: 79800 - DNA, 25 bp, Homo sapien
cctgggtcaaatgcacggattctca

SEQ ID NO: 79801 - DNA, 25 bp, Homo sapien
tctttgctgccgaagctgtgactgc

SEQ ID NO: 79802 - DNA, 25 bp, Homo sapien
tcctgagcgctcaagtttgtccgta

SEQ ID NO: 79803 - DNA, 25 bp, Homo sapien
agagccctattacccggaatctgga

SEQ ID NO: 79804 - DNA, 25 bp, Homo sapien
accgcggagctttctctgtagagca

SEQ ID NO: 79805 - DNA, 25 bp, Homo sapien
cggattctcacctcgtacagttacg

SEQ ID NO: 79806 - DNA, 25 bp, Homo sapien
ccgtttctttccaaagccgggcatg

SEQ ID NO: 79807 - DNA, 25 bp, Homo sapien
tgcaaatcgtgggagcgtgtcaacc

SEQ ID NO: 79808 - DNA, 25 bp, Homo sapien
gtgtggccgaccatgaggattccca

SEQ ID NO: 79809 - DNA, 25 bp, Homo sapien
tccagtccaggctacagcaggtatc

SEQ ID NO: 79810 - DNA, 25 bp, Homo sapien
ccaccctgcttatctggggacagtc

SEQ ID NO: 79811 - DNA, 25 bp, Homo sapien
ttagctcactcagcgcggccaagcg

SEQ ID NO: 79812 - DNA, 25 bp, Homo sapien
tggaggctccaagattagctcactc

SEQ ID NO: 79813 - DNA, 25 bp, Homo sapien
tccactctcgcttgggtgcagaagg

SEQ ID NO: 79814 - DNA, 25 bp, Homo sapien
ggagatggaagtcgcctccgctcct

SEQ ID NO: 79815 - DNA, 25 bp, Homo sapien
cgcgaacacccaaaggactctgagt

SEQ ID NO: 79816 - DNA, 25 bp, Homo sapien
gtgccaggcctatcagagccgctga

SEQ ID NO: 79817 - DNA, 25 bp, Homo sapien
cgctcctggtcaggactgtgcccga

SEQ ID NO: 79818 - DNA, 25 bp, Homo sapien
catcctgcccgggagatggaagtcg

SEQ ID NO: 79819 - DNA, 25 bp, Homo sapien
gggacggcagaaaaccgcacgcatc

SEQ ID NO: 79820 - DNA, 25 bp, Homo sapien
ctgtgcccgagagagcccacggcat

SEQ ID NO: 79821 - DNA, 25 bp, Homo sapien
ttcccaggcgtcatgtgctcccggg

SEQ ID NO: 79822 - DNA, 25 bp, Homo sapien
tcagcggcttcttctcctgagactc

SEQ ID NO: 79823 - DNA, 25 bp, Homo sapien
cgcgtgcgcagaagaggcaaaattc

SEQ ID NO: 79824 - DNA, 25 bp, Homo sapien
ggaatttaaaaggagcgcgtgcgca

SEQ ID NO: 79825 - DNA, 25 bp, Homo sapien
gtttgagtcaaccagacccggcatc

SEQ ID NO: 79826 - DNA, 25 bp, Homo sapien
gacccggcatctttcgcgccaaaag

SEQ ID NO: 79827 - DNA, 25 bp, Homo sapien
tgagcggagacagccaaatctatgc

SEQ ID NO: 79828 - DNA, 25 bp, Homo sapien
ggcaaacgccgattcgtccgcagtc

SEQ ID NO: 79829 - DNA, 25 bp, Homo sapien
tccggcagtcgctctaaaaagtaca

SEQ ID NO: 79830 - DNA, 25 bp, Homo sapien
tatccgtcatcagtgttgggctcag

SEQ ID NO: 79831 - DNA, 25 bp, Homo sapien
aatttggggtcgatatccgtcatga

SEQ ID NO: 79832 - DNA, 25 bp, Homo sapien
gttagatgcggggtcgatatccatc

SEQ ID NO: 79833 - DNA, 25 bp, Homo sapien
ggactccggtcgatatccgtcatca

SEQ ID NO: 79834 - DNA, 25 bp, Homo sapien
ttcgggtcaatatccatcatcgctg

SEQ ID NO: 79835 - DNA, 25 bp, Homo sapien
ggggtcgacacccatcatcgccgtt

SEQ ID NO: 79836 - DNA, 25 bp, Homo sapien
attcctcatgactgttagactcggg

SEQ ID NO: 79837 - DNA, 25 bp, Homo sapien
gatttggggtcgatattcctcatga

SEQ ID NO: 79838 - DNA, 25 bp, Homo sapien
gtgtctactgaaggccgctcccgac

SEQ ID NO: 79839 - DNA, 25 bp, Homo sapien
gctccgcggcctttcgaaagcgctt

SEQ ID NO: 79840 - DNA, 25 bp, Homo sapien
ccgatgccacggagcaagtgggcca

SEQ ID NO: 79841 - DNA, 25 bp, Homo sapien
cgcaattatggcatcctggccgatg

SEQ ID NO: 79842 - DNA, 25 bp, Homo sapien
ccatgccgacagtagaggagcttta

SEQ ID NO: 79843 - DNA, 25 bp, Homo sapien
tgggcttgtcgctcaccatgccgac

SEQ ID NO: 79844 - DNA, 25 bp, Homo sapien
cccgacgtgcgcgtctttacgtaga

SEQ ID NO: 79845 - DNA, 25 bp, Homo sapien
agaggagctttaccgcaattatggc

SEQ ID NO: 79846 - DNA, 25 bp, Homo sapien
tcctccaatcgagcgtatgattttc

SEQ ID NO: 79847 - DNA, 25 bp, Homo sapien
catagcgacgtgcacgcagtagcca

SEQ ID NO: 79848 - DNA, 25 bp, Homo sapien
ccgcaggtgtctcaaactcggtacc

SEQ ID NO: 79849 - DNA, 25 bp, Homo sapien
tgattttctgtacggtaaggaccgc

SEQ ID NO: 79850 - DNA, 25 bp, Homo sapien
gctcccagatggtgggacctggcca

SEQ ID NO: 79851 - DNA, 25 bp, Homo sapien
ggcgaacgaaacacgaccctctgga

SEQ ID NO: 79852 - DNA, 25 bp, Homo sapien
ggactgacctcttgcccacggttgt

SEQ ID NO: 79853 - DNA, 25 bp, Homo sapien
ggcggcaccatgagccacgcagtaa

SEQ ID NO: 79854 - DNA, 25 bp, Homo sapien
gcatgcttgtgtggagatgcgcgcc

SEQ ID NO: 79855 - DNA, 25 bp, Homo sapien
cacggctctgagtaaggacgtgccg

SEQ ID NO: 79856 - DNA, 25 bp, Homo sapien
gcggcatgaagaaggagagtgagca

SEQ ID NO: 79857 - DNA, 25 bp, Homo sapien
ccgcctgcgcaagtgcctggagagc

SEQ ID NO: 79858 - DNA, 25 bp, Homo sapien
ccggaagacccggcgacagtgccag

SEQ ID NO: 79859 - DNA, 25 bp, Homo sapien
gcgcctgcgagatcacccggaagac

SEQ ID NO: 79860 - DNA, 25 bp, Homo sapien
gcgcgccgagtgtgcgcgtgaacac

SEQ ID NO: 79861 - DNA, 25 bp, Homo sapien
cggaagggcgcctgcgagatcaccc

SEQ ID NO: 79862 - DNA, 25 bp, Homo sapien
ggagcgtacctccttcggtgattgg

SEQ ID NO: 79863 - DNA, 25 bp, Homo sapien
cgctgtctcattggcctgaagctta

SEQ ID NO: 79864 - DNA, 25 bp, Homo sapien
gccgtccaatcgcaagacctagctg

SEQ ID NO: 79865 - DNA, 25 bp, Homo sapien
cctagctgcagtgtgattggccttc

SEQ ID NO: 79866 - DNA, 25 bp, Homo sapien
gcggccgcctccaacaacggtggaa

SEQ ID NO: 79867 - DNA, 25 bp, Homo sapien
ggccctcggtgcagcaaatcggaaa

SEQ ID NO: 79868 - DNA, 25 bp, Homo sapien
cggagccaatcacggacgtcgtttg

SEQ ID NO: 79869 - DNA, 25 bp, Homo sapien
cgccggcccttacgaagaggcttga

SEQ ID NO: 79870 - DNA, 25 bp, Homo sapien
ccagctcctcggatctttctccttg

SEQ ID NO: 79871 - DNA, 25 bp, Homo sapien
gccaagcccgctgctatgtgcagga

SEQ ID NO: 79872 - DNA, 25 bp, Homo sapien
gctatgtgcaggacgcccacggtcc

SEQ ID NO: 79873 - DNA, 25 bp, Homo sapien
cgcctcgaccctgctctcccgcgag

SEQ ID NO: 79874 - DNA, 25 bp, Homo sapien
ttgcagactccacgcgcctcacggc

SEQ ID NO: 79875 - DNA, 25 bp, Homo sapien
ggcgaggagcttcagattcaggtcc

SEQ ID NO: 79876 - DNA, 25 bp, Homo sapien
ttcagattcaggtccctagccggcc

SEQ ID NO: 79877 - DNA, 25 bp, Homo sapien
ggctccgggaccttgcagactccac

SEQ ID NO: 79878 - DNA, 25 bp, Homo sapien
ctacgtgaaccaaggcgagaacctg

SEQ ID NO: 79879 - DNA, 25 bp, Homo sapien
agtctctgcagatccgggcctgctc

SEQ ID NO: 79880 - DNA, 25 bp, Homo sapien
aagcgcagaccctactgtgactcca

SEQ ID NO: 79881 - DNA, 25 bp, Homo sapien
cttcactaaccgagactgctgcttg

SEQ ID NO: 79882 - DNA, 25 bp, Homo sapien
ccgcatcatgggcaacggcttcgcg

SEQ ID NO: 79883 - DNA, 25 bp, Homo sapien
cgcatgctcctgtactcttccaaga

SEQ ID NO: 79884 - DNA, 25 bp, Homo sapien
cctcgagtgacaggagaagcgcaga

SEQ ID NO: 79885 - DNA, 25 bp, Homo sapien
cggctggcacagttccacttcacta

SEQ ID NO: 79886 - DNA, 25 bp, Homo sapien
tgcctcggcaaacagcccaaggatg

SEQ ID NO: 79887 - DNA, 25 bp, Homo sapien
cccaaggatgttcggttatctcgcc

SEQ ID NO: 79888 - DNA, 25 bp, Homo sapien
cgcgctttatagtcgctggagcctg

SEQ ID NO: 79889 - DNA, 25 bp, Homo sapien
attgtcatctgagccggaccgggtt

SEQ ID NO: 79890 - DNA, 25 bp, Homo sapien
tgcaagttctcgatctcagccggga

SEQ ID NO: 79891 - DNA, 25 bp, Homo sapien
tgcgcagaactgaggcagacaccca

SEQ ID NO: 79892 - DNA, 25 bp, Homo sapien
tcagactccagcgtctcggtggaca

SEQ ID NO: 79893 - DNA, 25 bp, Homo sapien
acctcctggaaacagttgccgctga

SEQ ID NO: 79894 - DNA, 25 bp, Homo sapien
ccagcgtttccacatctgcggaaga

SEQ ID NO: 79895 - DNA, 25 bp, Homo sapien
aaacttgctcgggtcccgcaggctc

SEQ ID NO: 79896 - DNA, 25 bp, Homo sapien
taagtttcgtaagcagcattactgc

SEQ ID NO: 79897 - DNA, 25 bp, Homo sapien
cgagcgcgagccagcgtttccacat

SEQ ID NO: 79898 - DNA, 25 bp, Homo sapien
cccgcgctgacctgggaaacttgct

SEQ ID NO: 79899 - DNA, 25 bp, Homo sapien
ctcaccgtggtctggtccaggtctc

SEQ ID NO: 79900 - DNA, 25 bp, Homo sapien
cgccgatcgccagcctcggaggaaa

SEQ ID NO: 79901 - DNA, 25 bp, Homo sapien
ccagcctcggaggaaatgcgacctc

SEQ ID NO: 79902 - DNA, 25 bp, Homo sapien
cgcaggcgcacttcctgaagctgaa

SEQ ID NO: 79903 - DNA, 25 bp, Homo sapien
ggcggagctccttgttaacgacatc

SEQ ID NO: 79904 - DNA, 25 bp, Homo sapien
cagctgaaacgagagtacctgcttc

SEQ ID NO: 79905 - DNA, 25 bp, Homo sapien
aagtataagccgtcgagcctgcgca

SEQ ID NO: 79906 - DNA, 25 bp, Homo sapien
gccaagatgtcgttcccaaagtata

SEQ ID NO: 79907 - DNA, 25 bp, Homo sapien
gcaattgtgccctggttcgccaaga

SEQ ID NO: 79908 - DNA, 25 bp, Homo sapien
gtcagcatagacaaagggcctcaga

SEQ ID NO: 79909 - DNA, 25 bp, Homo sapien
ggcgcactgcgagaagagcacttcg

SEQ ID NO: 79910 - DNA, 25 bp, Homo sapien
ggctccctcgcacctgtgtgtgtct

SEQ ID NO: 79911 - DNA, 25 bp, Homo sapien
caccagcgcgcgaatgcccgtgtga

SEQ ID NO: 79912 - DNA, 25 bp, Homo sapien
cgaatctaggattggcgccgaagct

SEQ ID NO: 79913 - DNA, 25 bp, Homo sapien
ctgctcggttaggacctcggagagc

SEQ ID NO: 79914 - DNA, 25 bp, Homo sapien
cgccgcgaccagagggcccagagaa

SEQ ID NO: 79915 - DNA, 25 bp, Homo sapien
aggtgcctaagtcctgggtcagata

SEQ ID NO: 79916 - DNA, 25 bp, Homo sapien
gctctggagcctgactgctcggtta

SEQ ID NO: 79917 - DNA, 25 bp, Homo sapien
gggtcagatagtcatccctctggga

SEQ ID NO: 79918 - DNA, 25 bp, Homo sapien
gcgcttagaaggcaggcacccagca

SEQ ID NO: 79919 - DNA, 25 bp, Homo sapien
gggacatctaccttcgtagcacaga

SEQ ID NO: 79920 - DNA, 25 bp, Homo sapien
gctcaacttttaccggcgtcctaca

SEQ ID NO: 79921 - DNA, 25 bp, Homo sapien
cagggtacagtagacggtgcaatcc

SEQ ID NO: 79922 - DNA, 25 bp, Homo sapien
gagggacattctccgctgtttggga

SEQ ID NO: 79923 - DNA, 25 bp, Homo sapien
taaataacagttcggcgcggctctc

SEQ ID NO: 79924 - DNA, 25 bp, Homo sapien
cggggtgttgtgtaatcgctcccac

SEQ ID NO: 79925 - DNA, 25 bp, Homo sapien
tgggacgctcactcgcgagcacaaa

SEQ ID NO: 79926 - DNA, 25 bp, Homo sapien
agcggtctccatccctgaagccaag

SEQ ID NO: 79927 - DNA, 25 bp, Homo sapien
tccagggccgacctcttcaagatgg

SEQ ID NO: 79928 - DNA, 25 bp, Homo sapien
gctcggggtttagaaatcacagatt

SEQ ID NO: 79929 - DNA, 25 bp, Homo sapien
tcggactccctgcattcggaccagg

SEQ ID NO: 79930 - DNA, 25 bp, Homo sapien
tcgtcacggaggacgggaaaatcca

SEQ ID NO: 79931 - DNA, 25 bp, Homo sapien
ttggtagtcagcgagctacgccctc

SEQ ID NO: 79932 - DNA, 25 bp, Homo sapien
cttcctggccgccaaaaccgaggtg

SEQ ID NO: 79933 - DNA, 25 bp, Homo sapien
gctccgagatcgtatcacccacaga

SEQ ID NO: 79934 - DNA, 25 bp, Homo sapien
tcagggcaagccacagtcccagcgt

SEQ ID NO: 79935 - DNA, 25 bp, Homo sapien
ggtgaggacacctcccgacccatgg

SEQ ID NO: 79936 - DNA, 25 bp, Homo sapien
cctggcaacagctgcggacatcttc

SEQ ID NO: 79937 - DNA, 25 bp, Homo sapien
ggcaaactcttctcggccgatcagg

SEQ ID NO: 79938 - DNA, 25 bp, Homo sapien
cccactccgacgcagaagattcatg

SEQ ID NO: 79939 - DNA, 25 bp, Homo sapien
agcctgattctgaacgccgccgttt

SEQ ID NO: 79940 - DNA, 25 bp, Homo sapien
cttcccgagaacgaatctgagcctg

SEQ ID NO: 79941 - DNA, 25 bp, Homo sapien
cccgaaagccatagactcgtgggga

SEQ ID NO: 79942 - DNA, 25 bp, Homo sapien
gccgaggcttgtgggctactagaac

SEQ ID NO: 79943 - DNA, 25 bp, Homo sapien
gacaggactgacctaggcgcttttc

SEQ ID NO: 79944 - DNA, 25 bp, Homo sapien
gggtgaccgttattggactcgcaga

SEQ ID NO: 79945 - DNA, 25 bp, Homo sapien
tgaagggccggatccaggactgaat

SEQ ID NO: 79946 - DNA, 25 bp, Homo sapien
ccgtcgctcccagaggagaaacgta

SEQ ID NO: 79947 - DNA, 25 bp, Homo sapien
ctccaggaacaaggccgtgcggaca

SEQ ID NO: 79948 - DNA, 25 bp, Homo sapien
ggccgacttaggcaggccgctccag

SEQ ID NO: 79949 - DNA, 25 bp, Homo sapien
tcaagccacgtcagctcgggaagcc

SEQ ID NO: 79950 - DNA, 25 bp, Homo sapien
ggcggagcgccctttgctaataagc

SEQ ID NO: 79951 - DNA, 25 bp, Homo sapien
aatcagaacgtgagacgctccggtg

SEQ ID NO: 79952 - DNA, 25 bp, Homo sapien
cgggatcaagtgcagctgcttcagg

SEQ ID NO: 79953 - DNA, 25 bp, Homo sapien
ctggtggcggagttaaagtcaaagc

SEQ ID NO: 79954 - DNA, 25 bp, Homo sapien
caggagagtaattatgaatagcgca

SEQ ID NO: 79955 - DNA, 25 bp, Homo sapien
agcgcagcgggattctcacacctag

SEQ ID NO: 79956 - DNA, 25 bp, Homo sapien
acacctagaccgtcgcgagcgggtt

SEQ ID NO: 79957 - DNA, 25 bp, Homo sapien
tcttccactaaagaacctggggctc

SEQ ID NO: 79958 - DNA, 25 bp, Homo sapien
gagcggtagctaggcggcttctcct

SEQ ID NO: 79959 - DNA, 25 bp, Homo sapien
tccttgtcctcttcagagctccagg

SEQ ID NO: 79960 - DNA, 25 bp, Homo sapien
ttcagagctccaggaactgaggccg

SEQ ID NO: 79961 - DNA, 25 bp, Homo sapien
cagagctccaggaactgaggccgga

SEQ ID NO: 79962 - DNA, 25 bp, Homo sapien
agtagctgcggtgcctgcgtcgtct

SEQ ID NO: 79963 - DNA, 25 bp, Homo sapien
gtcgtctcccgtgcctctgagtgct

SEQ ID NO: 79964 - DNA, 25 bp, Homo sapien
cgtgcctctgagtgctctcccgggg

SEQ ID NO: 79965 - DNA, 25 bp, Homo sapien
tgcggtgcctgcgtcgtctcccgtg

SEQ ID NO: 79966 - DNA, 25 bp, Homo sapien
cctcggcacagagaacgttggtggc

SEQ ID NO: 79967 - DNA, 25 bp, Homo sapien
gtcgtaagcgccctaagcttctttc

SEQ ID NO: 79968 - DNA, 25 bp, Homo sapien
tttccatcgccaaggagtaggggtc

SEQ ID NO: 79969 - DNA, 25 bp, Homo sapien
acagcgggaacaggatttgagagcc

SEQ ID NO: 79970 - DNA, 25 bp, Homo sapien
gtcagctaagctctctgcgggctaa

SEQ ID NO: 79971 - DNA, 25 bp, Homo sapien
ctgcgcgcagtcctgagatcagacc

SEQ ID NO: 79972 - DNA, 25 bp, Homo sapien
ccagattacaggatcaaggctttcc

SEQ ID NO: 79973 - DNA, 25 bp, Homo sapien
agaccagagctcatcctcgtggaga

SEQ ID NO: 79974 - DNA, 25 bp, Homo sapien
acgcctcgcggtgagggccagaacc

SEQ ID NO: 79975 - DNA, 25 bp, Homo sapien
gccacatccggggtgaaaatcgagc

SEQ ID NO: 79976 - DNA, 25 bp, Homo sapien
attacaaaacaacctctcctccttg

SEQ ID NO: 79977 - DNA, 25 bp, Homo sapien
gcctagatctttctgctccagcaca

SEQ ID NO: 79978 - DNA, 25 bp, Homo sapien
tagcgccacgcattacaaaacaacc

SEQ ID NO: 79979 - DNA, 25 bp, Homo sapien
gatctttctgctccagcacagcctg

SEQ ID NO: 79980 - DNA, 25 bp, Homo sapien
cagggaaaacgctcctttagcgcca

SEQ ID NO: 79981 - DNA, 25 bp, Homo sapien
ccggggtgaaaatcgagcctagatc

SEQ ID NO: 79982 - DNA, 25 bp, Homo sapien
ggcgccacactccacaggaccatct

SEQ ID NO: 79983 - DNA, 25 bp, Homo sapien
gaccatctccgaggctggctcagga

SEQ ID NO: 79984 - DNA, 25 bp, Homo sapien
catctccgaggctggctcaggatgc

SEQ ID NO: 79985 - DNA, 25 bp, Homo sapien
agcgcgtggcgcacgtcctacacgc

SEQ ID NO: 79986 - DNA, 25 bp, Homo sapien
tggcgcaggcctgtacaccgcgtcg

SEQ ID NO: 79987 - DNA, 25 bp, Homo sapien
gtgacattgagctcaccagcgccac

SEQ ID NO: 79988 - DNA, 25 bp, Homo sapien
agcctcagcggtctgcgcctggcag

SEQ ID NO: 79989 - DNA, 25 bp, Homo sapien
ccactccaacgctgggtgacattga

SEQ ID NO: 79990 - DNA, 25 bp, Homo sapien
actgccgcgtcaatctccaacaaag

SEQ ID NO: 79991 - DNA, 25 bp, Homo sapien
gtcggctacttttgctcgtaccagc

SEQ ID NO: 79992 - DNA, 25 bp, Homo sapien
actggaaactctggcctgtcggcta

SEQ ID NO: 79993 - DNA, 25 bp, Homo sapien
cttgaagatgaatgaaccgccgctt

SEQ ID NO: 79994 - DNA, 25 bp, Homo sapien
gcagccctaccagtcaggctaggta

SEQ ID NO: 79995 - DNA, 25 bp, Homo sapien
acgcgaggggcactctctacagaaa

SEQ ID NO: 79996 - DNA, 25 bp, Homo sapien
ggcgcatgtgcaaaggaagtccctc

SEQ ID NO: 79997 - DNA, 25 bp, Homo sapien
actaccgagccgagatgaccaatgg

SEQ ID NO: 79998 - DNA, 25 bp, Homo sapien
ttcctaatggttagcgcccagcctg

SEQ ID NO: 79999 - DNA, 25 bp, Homo sapien
caggctcaaggcaaccgatcccggt

SEQ ID NO: 80000 - DNA, 25 bp, Homo sapien
gatcccggtgccaccgctgaagtta

SEQ ID NO: 80001 - DNA, 25 bp, Homo sapien
agactcagctcagccggcgttcgca

SEQ ID NO: 80002 - DNA, 25 bp, Homo sapien
ctgccgggagacgtagtcttgtaac

SEQ ID NO: 80003 - DNA, 25 bp, Homo sapien
tctcgccggacattcctaatggtta

SEQ ID NO: 80004 - DNA, 25 bp, Homo sapien
cgccggccttgtggccgttaggaca

SEQ ID NO: 80005 - DNA, 25 bp, Homo sapien
agtcttgtaacgctctctcgccgga

SEQ ID NO: 80006 - DNA, 25 bp, Homo sapien
ctccagggaagcgaaactgaaactt

SEQ ID NO: 80007 - DNA, 25 bp, Homo sapien
cggacccagttccagctgacctagg

SEQ ID NO: 80008 - DNA, 25 bp, Homo sapien
caccttccgggtggagttcagtgaa

SEQ ID NO: 80009 - DNA, 25 bp, Homo sapien
gcacggtcagcacccaggaacacga

SEQ ID NO: 80010 - DNA, 25 bp, Homo sapien
agggcccagaggcaccggacctact

SEQ ID NO: 80011 - DNA, 25 bp, Homo sapien
ttccagagctctaagtcctcgggcg

SEQ ID NO: 80012 - DNA, 25 bp, Homo sapien
cccgctcctcgtgcgggtgtacaag

SEQ ID NO: 80013 - DNA, 25 bp, Homo sapien
aactgaaactttgcgcccagtccgc

SEQ ID NO: 80014 - DNA, 25 bp, Homo sapien
tggtccgcatccgtgggtagacgct

SEQ ID NO: 80015 - DNA, 25 bp, Homo sapien
tcggaattgttgtgtgcaacatccc

SEQ ID NO: 80016 - DNA, 25 bp, Homo sapien
accgtctgcgacatcctcaatctgt

SEQ ID NO: 80017 - DNA, 25 bp, Homo sapien
gggtctcatgagctttggtcgcacg

SEQ ID NO: 80018 - DNA, 25 bp, Homo sapien
gcaaatcctcgaggtggccttggga

SEQ ID NO: 80019 - DNA, 25 bp, Homo sapien
cgcgagctcggaattgttgtgtgca

SEQ ID NO: 80020 - DNA, 25 bp, Homo sapien
tagacgctgtgggtctcatgagctt

SEQ ID NO: 80021 - DNA, 25 bp, Homo sapien
gttcagagcatggagcaaatcctcg

SEQ ID NO: 80022 - DNA, 25 bp, Homo sapien
gcaagttatcctggccgcaccacgt

SEQ ID NO: 80023 - DNA, 25 bp, Homo sapien
ttgacacgcattaaggagccactga

SEQ ID NO: 80024 - DNA, 25 bp, Homo sapien
ggagccactgaaaactccatctaag

SEQ ID NO: 80025 - DNA, 25 bp, Homo sapien
tccatctaagcagaaaagcggctta

SEQ ID NO: 80026 - DNA, 25 bp, Homo sapien
gggaccgcggcttgacacgcattaa

SEQ ID NO: 80027 - DNA, 25 bp, Homo sapien
tccatgcgttctgggcaagttatcc

SEQ ID NO: 80028 - DNA, 25 bp, Homo sapien
cgcaccacgtggaacggagtagata

SEQ ID NO: 80029 - DNA, 25 bp, Homo sapien
aagcggcttagtcatccatgcgttc

SEQ ID NO: 80030 - DNA, 25 bp, Homo sapien
cctcccggagtatggtgaggagcgc

SEQ ID NO: 80031 - DNA, 25 bp, Homo sapien
gcacaaccctctcttctagggggcg

SEQ ID NO: 80032 - DNA, 25 bp, Homo sapien
ccacgccacgcacaaccctctcttc

SEQ ID NO: 80033 - DNA, 25 bp, Homo sapien
ttcctcccggagtatggtgaggagc

SEQ ID NO: 80034 - DNA, 25 bp, Homo sapien
tcttcctcccggagtatggtgagga

SEQ ID NO: 80035 - DNA, 25 bp, Homo sapien
ctcttcctcccggagtatggtgagg

SEQ ID NO: 80036 - DNA, 25 bp, Homo sapien
gcgcggaaggcctcccggcgctctt

SEQ ID NO: 80037 - DNA, 25 bp, Homo sapien
acgcacaaccctctcttctaggggg

SEQ ID NO: 80038 - DNA, 25 bp, Homo sapien
agagtcaaagttagcggcccggagt

SEQ ID NO: 80039 - DNA, 25 bp, Homo sapien
ttgcagatgtacttccagagcccga

SEQ ID NO: 80040 - DNA, 25 bp, Homo sapien
catcccgcttcctggtgttcttcta

SEQ ID NO: 80041 - DNA, 25 bp, Homo sapien
ctggtgttcttctacccggaggacg

SEQ ID NO: 80042 - DNA, 25 bp, Homo sapien
gcagaatggattccgagcgcacccg

SEQ ID NO: 80043 - DNA, 25 bp, Homo sapien
ccctgcgcttccaggcgcttaatgg

SEQ ID NO: 80044 - DNA, 25 bp, Homo sapien
gcggaaccgcgcaagtaactcttta

SEQ ID NO: 80045 - DNA, 25 bp, Homo sapien
cccgaagaacttgaacaccaagttg

SEQ ID NO: 80046 - DNA, 25 bp, Homo sapien
tgagttgtggcgctttttacctaac

SEQ ID NO: 80047 - DNA, 25 bp, Homo sapien
caacgatcacaggagtggtcgcctc

SEQ ID NO: 80048 - DNA, 25 bp, Homo sapien
gagcctgctgccatggctaccgcaa

SEQ ID NO: 80049 - DNA, 25 bp, Homo sapien
gcaaggcgggttctgccggaaccca

SEQ ID NO: 80050 - DNA, 25 bp, Homo sapien
ggccaaactccgagacccgaagctg

SEQ ID NO: 80051 - DNA, 25 bp, Homo sapien
acccgaagctgcaccacaggaagga

SEQ ID NO: 80052 - DNA, 25 bp, Homo sapien
ccgggtgtggaaatacaaacacgtg

SEQ ID NO: 80053 - DNA, 25 bp, Homo sapien
gcgggaccacgcagctttgttttga

SEQ ID NO: 80054 - DNA, 25 bp, Homo sapien
aggcctacggcttctccagctggga

SEQ ID NO: 80055 - DNA, 25 bp, Homo sapien
tctccagctgggacatcgcgctgct

SEQ ID NO: 80056 - DNA, 25 bp, Homo sapien
ctggcgttcgttcagggcctggtct

SEQ ID NO: 80057 - DNA, 25 bp, Homo sapien
tgctgctcaggactattctgcgctg

SEQ ID NO: 80058 - DNA, 25 bp, Homo sapien
acgcgtcgccatgggctctcgctgg

SEQ ID NO: 80059 - DNA, 25 bp, Homo sapien
tcgcgttcatgtggctcctggacaa

SEQ ID NO: 80060 - DNA, 25 bp, Homo sapien
gcctggtctggaacacctggggtcc

SEQ ID NO: 80061 - DNA, 25 bp, Homo sapien
ctggggtcccatccagaactcggcg

SEQ ID NO: 80062 - DNA, 25 bp, Homo sapien
ggacaggtcctcgtctcggtccttc

SEQ ID NO: 80063 - DNA, 25 bp, Homo sapien
ttctcctgccgaactgcaggccgtg

SEQ ID NO: 80064 - DNA, 25 bp, Homo sapien
tgcacgtcttgaactcctgcgggtg

SEQ ID NO: 80065 - DNA, 25 bp, Homo sapien
ttgctgcaacttcgctggcggacct

SEQ ID NO: 80066 - DNA, 25 bp, Homo sapien
ctgggacctcagagcaagcctgttc

SEQ ID NO: 80067 - DNA, 25 bp, Homo sapien
cacgaggagaatccaggccactttc

SEQ ID NO: 80068 - DNA, 25 bp, Homo sapien
gggcaaggcgtgttctcattacaga

SEQ ID NO: 80069 - DNA, 25 bp, Homo sapien
tgcaagaccggaaaggacgagagtc

SEQ ID NO: 80070 - DNA, 25 bp, Homo sapien
aagcgcacgctgtcctgggtgacac

SEQ ID NO: 80071 - DNA, 25 bp, Homo sapien
ctcaccggtgccaatgtagagtaca

SEQ ID NO: 80072 - DNA, 25 bp, Homo sapien
gagcgtgtctttagcctgcaccagg

SEQ ID NO: 80073 - DNA, 25 bp, Homo sapien
caccacgaggtgtgagaagcgcacg

SEQ ID NO: 80074 - DNA, 25 bp, Homo sapien
ccgacctgcagtccaggttggaccg

SEQ ID NO: 80075 - DNA, 25 bp, Homo sapien
gcacggcctcgctcatcaggaagag

SEQ ID NO: 80076 - DNA, 25 bp, Homo sapien
gctccgtcaggttctcgttgggacc

SEQ ID NO: 80077 - DNA, 25 bp, Homo sapien
acagcgccttcaggatggtgcccga

SEQ ID NO: 80078 - DNA, 25 bp, Homo sapien
aacgcagcagcgatgagggctctca

SEQ ID NO: 80079 - DNA, 25 bp, Homo sapien
agtgcaacccggacccaagctggct

SEQ ID NO: 80080 - DNA, 25 bp, Homo sapien
gtgctgtttactagccggccctctc

SEQ ID NO: 80081 - DNA, 25 bp, Homo sapien
aaatcgggaaatcgccgctcgcgtc

SEQ ID NO: 80082 - DNA, 25 bp, Homo sapien
tggcttcaacttgccagagcccgga

SEQ ID NO: 80083 - DNA, 25 bp, Homo sapien
tacccacccgagttgctgaagtttg

SEQ ID NO: 80084 - DNA, 25 bp, Homo sapien
tgctgaagtttgcaagttgcagccc

SEQ ID NO: 80085 - DNA, 25 bp, Homo sapien
gtccctgagcgggagatttcacact

SEQ ID NO: 80086 - DNA, 25 bp, Homo sapien
gcatgctttggcagacgtggcaccg

SEQ ID NO: 80087 - DNA, 25 bp, Homo sapien
tgctgctggcaatctgggtgagact

SEQ ID NO: 80088 - DNA, 25 bp, Homo sapien
gggtgcttacgccacggccacaact

SEQ ID NO: 80089 - DNA, 25 bp, Homo sapien
acggccacaactttgcggggatgca

SEQ ID NO: 80090 - DNA, 25 bp, Homo sapien
cctgcactgccggaaaccttggttt

SEQ ID NO: 80091 - DNA, 25 bp, Homo sapien
ttagggccaccttgttcttggcttc

SEQ ID NO: 80092 - DNA, 25 bp, Homo sapien
cgtctgggaaactgcgggccaccac

SEQ ID NO: 80093 - DNA, 25 bp, Homo sapien
tgagccaggctgcagactacaactc

SEQ ID NO: 80094 - DNA, 25 bp, Homo sapien
ccaagtccgtgcctttgggatggga

SEQ ID NO: 80095 - DNA, 25 bp, Homo sapien
ggcaggagccaagtccgtgcctttg

SEQ ID NO: 80096 - DNA, 25 bp, Homo sapien
tcgccctcgggattgaagacctacc

SEQ ID NO: 80097 - DNA, 25 bp, Homo sapien
tcttaggggtcgttcgaatccctgc

SEQ ID NO: 80098 - DNA, 25 bp, Homo sapien
gcgggtcccgtctcgacaggtactc

SEQ ID NO: 80099 - DNA, 25 bp, Homo sapien
ccacaatgcacttcggggcgcgtca

SEQ ID NO: 80100 - DNA, 25 bp, Homo sapien
acgcgccgcagcgtcgccgaaaggt

SEQ ID NO: 80101 - DNA, 25 bp, Homo sapien
cccttcgacttgagggttctctggg

SEQ ID NO: 80102 - DNA, 25 bp, Homo sapien
cacgaagcagagtcacgagcgcagc

SEQ ID NO: 80103 - DNA, 25 bp, Homo sapien
cgctgctacgtaagcagccgcgaga

SEQ ID NO: 80104 - DNA, 25 bp, Homo sapien
cacacgctgcggaattctgacggca

SEQ ID NO: 80105 - DNA, 25 bp, Homo sapien
ggacaccgtcagtgccgggagaaca

SEQ ID NO: 80106 - DNA, 25 bp, Homo sapien
caggccttggtaccctggccgttct

SEQ ID NO: 80107 - DNA, 25 bp, Homo sapien
tctgggacagcctctagagagactg

SEQ ID NO: 80108 - DNA, 25 bp, Homo sapien
tctgcttctgcttggcttccacgcg

SEQ ID NO: 80109 - DNA, 25 bp, Homo sapien
ctggcttctcctcgctctaaatcta

SEQ ID NO: 80110 - DNA, 25 bp, Homo sapien
cgtcaccgctcagcggaggatcgtc

SEQ ID NO: 80111 - DNA, 25 bp, Homo sapien
tgattccgcctaagcggagcccagc

SEQ ID NO: 80112 - DNA, 25 bp, Homo sapien
gcggcgctcgctgattccgcctaag

SEQ ID NO: 80113 - DNA, 25 bp, Homo sapien
agagacgtccgggatcctggctcgc

SEQ ID NO: 80114 - DNA, 25 bp, Homo sapien
cccaggtccgaaatggagttgcctc

SEQ ID NO: 80115 - DNA, 25 bp, Homo sapien
gatccgcgtcagaagtcccaggtcc

SEQ ID NO: 80116 - DNA, 25 bp, Homo sapien
ctcacgcttttggagccggacatcc

SEQ ID NO: 80117 - DNA, 25 bp, Homo sapien
agaagtagctgaggatccgcgtcag

SEQ ID NO: 80118 - DNA, 25 bp, Homo sapien
cccggctcgcgagcagccggataag

SEQ ID NO: 80119 - DNA, 25 bp, Homo sapien
acagcgccgtgcaaatgtacaaaca

SEQ ID NO: 80120 - DNA, 25 bp, Homo sapien
atccctggaatgaggcaccggccaa

SEQ ID NO: 80121 - DNA, 25 bp, Homo sapien
ctgctgtggacacggcatctcgcac

SEQ ID NO: 80122 - DNA, 25 bp, Homo sapien
aagcgcccggagttcagccgaacct

SEQ ID NO: 80123 - DNA, 25 bp, Homo sapien
cgggacgccgacgttcacagtccaa

SEQ ID NO: 80124 - DNA, 25 bp, Homo sapien
aacgcacatttcgtgcgcgcccagg

SEQ ID NO: 80125 - DNA, 25 bp, Homo sapien
gacatggcgcacactgctgtggaca

SEQ ID NO: 80126 - DNA, 25 bp, Homo sapien
gccgttcaacatccgaatctggccg

SEQ ID NO: 80127 - DNA, 25 bp, Homo sapien
gcgccgttcaacatccgaatctggc

SEQ ID NO: 80128 - DNA, 25 bp, Homo sapien
aacatccgaatctggccgcccagga

SEQ ID NO: 80129 - DNA, 25 bp, Homo sapien
gctccgcgccgcaggtagtccggcc

SEQ ID NO: 80130 - DNA, 25 bp, Homo sapien
gccgcaggtagtccggccgctgccc

SEQ ID NO: 80131 - DNA, 25 bp, Homo sapien
ccagtgcctgggaacttggctcgac

SEQ ID NO: 80132 - DNA, 25 bp, Homo sapien
agtgcctgggaacttggctcgaccc

SEQ ID NO: 80133 - DNA, 25 bp, Homo sapien
tggcgccgttcaacatccgaatctg

SEQ ID NO: 80134 - DNA, 25 bp, Homo sapien
accggggccgattcagcgctcggcc

SEQ ID NO: 80135 - DNA, 25 bp, Homo sapien
ccggctgtcatcaccacattgtaga

SEQ ID NO: 80136 - DNA, 25 bp, Homo sapien
ccacattgtagatgaccaggtacgc

SEQ ID NO: 80137 - DNA, 25 bp, Homo sapien
cgaagcccgctctcctagcgcgagc

SEQ ID NO: 80138 - DNA, 25 bp, Homo sapien
actgccgccatgtcaagtgcccgaa

SEQ ID NO: 80139 - DNA, 25 bp, Homo sapien
ttcttcttccgcgtgccgctggcgt

SEQ ID NO: 80140 - DNA, 25 bp, Homo sapien
tagatgaccaggtacgccgtggcca

SEQ ID NO: 80141 - DNA, 25 bp, Homo sapien
cccgccgggaatgcactgcctgcgg

SEQ ID NO: 80142 - DNA, 25 bp, Homo sapien
cccgtctttcggcttgcctcagttg

SEQ ID NO: 80143 - DNA, 25 bp, Homo sapien
tggatgttgcgtcgtccctcgctat

SEQ ID NO: 80144 - DNA, 25 bp, Homo sapien
gctgcttctgccagctggatgttgc

SEQ ID NO: 80145 - DNA, 25 bp, Homo sapien
ggattagttcaatgtagccaccctc

SEQ ID NO: 80146 - DNA, 25 bp, Homo sapien
cctcggcgccatcttggattagttc

SEQ ID NO: 80147 - DNA, 25 bp, Homo sapien
atcagggtaattcccgcctcttggg

SEQ ID NO: 80148 - DNA, 25 bp, Homo sapien
gccactgccatcttggatcagggta

SEQ ID NO: 80149 - DNA, 25 bp, Homo sapien
cttggctgagggcaaagacgctcct

SEQ ID NO: 80150 - DNA, 25 bp, Homo sapien
aggccgtcaccgagtcctctagcga

SEQ ID NO: 80151 - DNA, 25 bp, Homo sapien
agggcccgcgcctggacaaaagcat

SEQ ID NO: 80152 - DNA, 25 bp, Homo sapien
aagaaaactcgtgcagcctggcgtc

SEQ ID NO: 80153 - DNA, 25 bp, Homo sapien
cccttcggatgattcctagaaaggc

SEQ ID NO: 80154 - DNA, 25 bp, Homo sapien
cgctacggggtcaggactcaaacca

SEQ ID NO: 80155 - DNA, 25 bp, Homo sapien
cacatttgggctggaaggaccttca

SEQ ID NO: 80156 - DNA, 25 bp, Homo sapien
taccttcccggaatcacatttgggc

SEQ ID NO: 80157 - DNA, 25 bp, Homo sapien
ctagaaaggcaatcgcatcagtgtc

SEQ ID NO: 80158 - DNA, 25 bp, Homo sapien
ggtcgagctccagacctgaccatct

SEQ ID NO: 80159 - DNA, 25 bp, Homo sapien
ttaagcggaggttccaggacttgcg

SEQ ID NO: 80160 - DNA, 25 bp, Homo sapien
tgggagaagccaataaacggcgaac

SEQ ID NO: 80161 - DNA, 25 bp, Homo sapien
agcgccttgggcgtacgcaatagac

SEQ ID NO: 80162 - DNA, 25 bp, Homo sapien
ccgagggaagtgaagcctcacggta

SEQ ID NO: 80163 - DNA, 25 bp, Homo sapien
tgtcgccgcattgtctttgtctttt

SEQ ID NO: 80164 - DNA, 25 bp, Homo sapien
acagaaacatctagagaccgagcgg

SEQ ID NO: 80165 - DNA, 25 bp, Homo sapien
aaggatcccgccgaatgccgcgctt

SEQ ID NO: 80166 - DNA, 25 bp, Homo sapien
ggggtggctacctcaggctcgctcc

SEQ ID NO: 80167 - DNA, 25 bp, Homo sapien
cgttagacgttagcgctccgccttc

SEQ ID NO: 80168 - DNA, 25 bp, Homo sapien
agaaggagagcagtagaacctcggc

SEQ ID NO: 80169 - DNA, 25 bp, Homo sapien
gcacgaccgccgttagcgttagacg

SEQ ID NO: 80170 - DNA, 25 bp, Homo sapien
ccaaaccggctgtctggcttcaggc

SEQ ID NO: 80171 - DNA, 25 bp, Homo sapien
tgtctggcttcaggcgacacctggc

SEQ ID NO: 80172 - DNA, 25 bp, Homo sapien
tggggagagaccgagtgcctcccac

SEQ ID NO: 80173 - DNA, 25 bp, Homo sapien
tcccacccttcttaagaaggagagc

SEQ ID NO: 80174 - DNA, 25 bp, Homo sapien
ccggccggagcttcaattcagctcg

SEQ ID NO: 80175 - DNA, 25 bp, Homo sapien
gagcttcaattcagctcggcgctcc

SEQ ID NO: 80176 - DNA, 25 bp, Homo sapien
ggagcagggctgaacaatagagaca

SEQ ID NO: 80177 - DNA, 25 bp, Homo sapien
cagactcggacgtggacgccttttt

SEQ ID NO: 80178 - DNA, 25 bp, Homo sapien
gccgagattctggttgttatggcag

SEQ ID NO: 80179 - DNA, 25 bp, Homo sapien
aaggctactgcctcggacgcggcgt

SEQ ID NO: 80180 - DNA, 25 bp, Homo sapien
ctggagttgccgagattctggttgt

SEQ ID NO: 80181 - DNA, 25 bp, Homo sapien
agggctgaaggctactgcctcggac

SEQ ID NO: 80182 - DNA, 25 bp, Homo sapien
ctcaagaaaaaggtgctgaaggccc

SEQ ID NO: 80183 - DNA, 25 bp, Homo sapien
gacggcttctcaggacgcaactgca

SEQ ID NO: 80184 - DNA, 25 bp, Homo sapien
ggctgctgcagtgcatccgctgcag

SEQ ID NO: 80185 - DNA, 25 bp, Homo sapien
ttgacgaacacacacagctcaagaa

SEQ ID NO: 80186 - DNA, 25 bp, Homo sapien
gctctcggcggctcattgacgaaca

SEQ ID NO: 80187 - DNA, 25 bp, Homo sapien
tccaggagatgctagcccggaagga

SEQ ID NO: 80188 - DNA, 25 bp, Homo sapien
tcgaggacctccaggagatgctagc

SEQ ID NO: 80189 - DNA, 25 bp, Homo sapien
cagtgcatccgctgcagcgacggct

SEQ ID NO: 80190 - DNA, 25 bp, Homo sapien
gccttggtgccttctgttagccaga

SEQ ID NO: 80191 - DNA, 25 bp, Homo sapien
tgggaactcagtcacctagcagcga

SEQ ID NO: 80192 - DNA, 25 bp, Homo sapien
agcgactttggatgtcagggcgcca

SEQ ID NO: 80193 - DNA, 25 bp, Homo sapien
agagagtttgctgcgatccgtttca

SEQ ID NO: 80194 - DNA, 25 bp, Homo sapien
gcgatccgtttcacagtttcccaga

SEQ ID NO: 80195 - DNA, 25 bp, Homo sapien
ggctctttgctaagtgctgctgttg

SEQ ID NO: 80196 - DNA, 25 bp, Homo sapien
gcgacagggcttacacccgaggtcc

SEQ ID NO: 80197 - DNA, 25 bp, Homo sapien
ctgctgttgcttcccgtgtagaggt

SEQ ID NO: 80198 - DNA, 25 bp, Homo sapien
cggccgagtttgcattgggcgtctt

SEQ ID NO: 80199 - DNA, 25 bp, Homo sapien
cttgcccggtgcagactaggctgca

SEQ ID NO: 80200 - DNA, 25 bp, Homo sapien
tgctcagtggctgcgtggaacacaa

SEQ ID NO: 80201 - DNA, 25 bp, Homo sapien
tgcgtggaacacaaagcgctgtctc

SEQ ID NO: 80202 - DNA, 25 bp, Homo sapien
tgtctccgagcagaagcgtcttctc

SEQ ID NO: 80203 - DNA, 25 bp, Homo sapien
agctgaaccagacccaccaaagagg

SEQ ID NO: 80204 - DNA, 25 bp, Homo sapien
acgcaggctggcaaaggagactcaa

SEQ ID NO: 80205 - DNA, 25 bp, Homo sapien
agaggagaatctgcacgtgacgtca

SEQ ID NO: 80206 - DNA, 25 bp, Homo sapien
cattggtgacgggtctgtacgacgt

SEQ ID NO: 80207 - DNA, 25 bp, Homo sapien
catctacatcgatctgcggggcatc

SEQ ID NO: 80208 - DNA, 25 bp, Homo sapien
ttcgtgctgaagagcgggctttcct

SEQ ID NO: 80209 - DNA, 25 bp, Homo sapien
tgtacgacgtgcaggctttcaagtt

SEQ ID NO: 80210 - DNA, 25 bp, Homo sapien
agcaaacaggcagcgcgcgacaatg

SEQ ID NO: 80211 - DNA, 25 bp, Homo sapien
ggcgcctgggaatttgaagcaaaca

SEQ ID NO: 80212 - DNA, 25 bp, Homo sapien
gaaacccacgggtgcagcaagccgg

SEQ ID NO: 80213 - DNA, 25 bp, Homo sapien
tcaagtttggggacttcgtgctgaa

SEQ ID NO: 80214 - DNA, 25 bp, Homo sapien
gacttgggctccgagacgcgcccag

SEQ ID NO: 80215 - DNA, 25 bp, Homo sapien
ccgccacacggtcagcttacggtga

SEQ ID NO: 80216 - DNA, 25 bp, Homo sapien
cgggactcctagtgtgtcgccgctc

SEQ ID NO: 80217 - DNA, 25 bp, Homo sapien
cgcggctgagtgtgcgacaaagttt

SEQ ID NO: 80218 - DNA, 25 bp, Homo sapien
aacaggagactcacgacagcccggc

SEQ ID NO: 80219 - DNA, 25 bp, Homo sapien
agcctgtttacacaggaagggaagc

SEQ ID NO: 80220 - DNA, 25 bp, Homo sapien
cagcaggccggccagcctgtttaca

SEQ ID NO: 80221 - DNA, 25 bp, Homo sapien
acaaggaccgctttgtgcccgccaa

SEQ ID NO: 80222 - DNA, 25 bp, Homo sapien
ggcaggcctatggttcactctgcta

SEQ ID NO: 80223 - DNA, 25 bp, Homo sapien
ccgggctcaccttctggtctgaact

SEQ ID NO: 80224 - DNA, 25 bp, Homo sapien
gccagactcagctcctcggggaagt

SEQ ID NO: 80225 - DNA, 25 bp, Homo sapien
tcgaggctaacaggggacactcagc

SEQ ID NO: 80226 - DNA, 25 bp, Homo sapien
ttccaagacgcaagaggcggtgctc

SEQ ID NO: 80227 - DNA, 25 bp, Homo sapien
ggctaggttgcgacttggacaaatc

SEQ ID NO: 80228 - DNA, 25 bp, Homo sapien
actcgcgctgtcgttatactaggaa

SEQ ID NO: 80229 - DNA, 25 bp, Homo sapien
cgggactcgtgagaacagacagttc

SEQ ID NO: 80230 - DNA, 25 bp, Homo sapien
ccgcctcaaaagttatcgggagccg

SEQ ID NO: 80231 - DNA, 25 bp, Homo sapien
cgaccctcagggtcccgcacacgcc

SEQ ID NO: 80232 - DNA, 25 bp, Homo sapien
caggttcccggctctcactcacccg

SEQ ID NO: 80233 - DNA, 25 bp, Homo sapien
ctcaaaagttatcgggagccgcggg

SEQ ID NO: 80234 - DNA, 25 bp, Homo sapien
gcggcgccgctacatgctaattagc

SEQ ID NO: 80235 - DNA, 25 bp, Homo sapien
acatgctaattagcccgggcgggtc

SEQ ID NO: 80236 - DNA, 25 bp, Homo sapien
gctcctcctcagttgacatcaccgg

SEQ ID NO: 80237 - DNA, 25 bp, Homo sapien
cacagactggccaggcgccaggttc

SEQ ID NO: 80238 - DNA, 25 bp, Homo sapien
agaggctggcgcaaccgagaatagc

SEQ ID NO: 80239 - DNA, 25 bp, Homo sapien
accgagaatagccagcgcggaggaa

SEQ ID NO: 80240 - DNA, 25 bp, Homo sapien
tttcctgcgaatggacaatgggaga

SEQ ID NO: 80241 - DNA, 25 bp, Homo sapien
ctcctcagcaaaggaagtgggcgcg

SEQ ID NO: 80242 - DNA, 25 bp, Homo sapien
tcagcacctgtacctcgccagacgc

SEQ ID NO: 80243 - DNA, 25 bp, Homo sapien
cacggagacggggatctgcagccaa

SEQ ID NO: 80244 - DNA, 25 bp, Homo sapien
tctgcagccaatccgaaactgcctg

SEQ ID NO: 80245 - DNA, 25 bp, Homo sapien
gacagccctttcctgcgaatggaca

SEQ ID NO: 80246 - DNA, 25 bp, Homo sapien
cccaagtactggggccaggcccgtg

SEQ ID NO: 80247 - DNA, 25 bp, Homo sapien
ggtaggagaggatccacctgggcgg

SEQ ID NO: 80248 - DNA, 25 bp, Homo sapien
gagaggaactgtcccgagaccaccc

SEQ ID NO: 80249 - DNA, 25 bp, Homo sapien
aactgtcccgagaccaccctctcca

SEQ ID NO: 80250 - DNA, 25 bp, Homo sapien
gccagcaccgggagtctcgggccca

SEQ ID NO: 80251 - DNA, 25 bp, Homo sapien
tgcccgcgccgcacagagcaaggga

SEQ ID NO: 80252 - DNA, 25 bp, Homo sapien
agaggctttccctccgcaagggtcg

SEQ ID NO: 80253 - DNA, 25 bp, Homo sapien
cgcaggcctccgcccacattcacct

SEQ ID NO: 80254 - DNA, 25 bp, Homo sapien
tggaaggtgctggtccctgcataca

SEQ ID NO: 80255 - DNA, 25 bp, Homo sapien
cagaggggcgcacgcgcacagacac

SEQ ID NO: 80256 - DNA, 25 bp, Homo sapien
actcacaaagtttcccatcccgttg

SEQ ID NO: 80257 - DNA, 25 bp, Homo sapien
acttgttagtggctgcggagaagcc

SEQ ID NO: 80258 - DNA, 25 bp, Homo sapien
cgctgtctggcggacacttgttagt

SEQ ID NO: 80259 - DNA, 25 bp, Homo sapien
agccacgggccaagagcgcacggac

SEQ ID NO: 80260 - DNA, 25 bp, Homo sapien
ttcgccagacggtgggcaaaagccc

SEQ ID NO: 80261 - DNA, 25 bp, Homo sapien
gggcctgctcacttcagggagcgcc

SEQ ID NO: 80262 - DNA, 25 bp, Homo sapien
gacacagcgtggcttcgattccggc

SEQ ID NO: 80263 - DNA, 25 bp, Homo sapien
cctggctggaaagacacagcgtggc

SEQ ID NO: 80264 - DNA, 25 bp, Homo sapien
gagacgcagacatgccgcagctaga

SEQ ID NO: 80265 - DNA, 25 bp, Homo sapien
ctgtggcagcttcggcaacagctcc

SEQ ID NO: 80266 - DNA, 25 bp, Homo sapien
ggagaacttttgctgtggcagcttc

SEQ ID NO: 80267 - DNA, 25 bp, Homo sapien
gcggcagctccaacctttctagggg

SEQ ID NO: 80268 - DNA, 25 bp, Homo sapien
gattccggcgcctgcgtgtcaccag

SEQ ID NO: 80269 - DNA, 25 bp, Homo sapien
ccaacctttctaggggccttgagag

SEQ ID NO: 80270 - DNA, 25 bp, Homo sapien
tcttgtcaacctagagggctcccgg

SEQ ID NO: 80271 - DNA, 25 bp, Homo sapien
cagcgttcttctcacggtccagatc

SEQ ID NO: 80272 - DNA, 25 bp, Homo sapien
gcagtctcgacacttccctcagtca

SEQ ID NO: 80273 - DNA, 25 bp, Homo sapien
agcaccctgtttttccactgagcct

SEQ ID NO: 80274 - DNA, 25 bp, Homo sapien
cctccgcttccttgccgaccgcagc

SEQ ID NO: 80275 - DNA, 25 bp, Homo sapien
gatctcccagctacgcgaccactga

SEQ ID NO: 80276 - DNA, 25 bp, Homo sapien
tgtcaacctagagggctcccggagc

SEQ ID NO: 80277 - DNA, 25 bp, Homo sapien
ggccaaccagtctctcagctagcga

SEQ ID NO: 80278 - DNA, 25 bp, Homo sapien
cggtgagtctctcgcgctatctcca

SEQ ID NO: 80279 - DNA, 25 bp, Homo sapien
acagccgaagcgtctggcgccatct

SEQ ID NO: 80280 - DNA, 25 bp, Homo sapien
ttccggagtagcgtgagctcacttc

SEQ ID NO: 80281 - DNA, 25 bp, Homo sapien
tatctccagacccaagcgcgaatgc

SEQ ID NO: 80282 - DNA, 25 bp, Homo sapien
agccactcgggacaacttcctctta

SEQ ID NO: 80283 - DNA, 25 bp, Homo sapien
gtcctcaggcagtgcgtccagtcaa

SEQ ID NO: 80284 - DNA, 25 bp, Homo sapien
ccttcccttccggagtagcgtgagc

SEQ ID NO: 80285 - DNA, 25 bp, Homo sapien
agtgcgtccagtcaagcccgctcgg

SEQ ID NO: 80286 - DNA, 25 bp, Homo sapien
tcgacagggacttgaagacagtgcc

SEQ ID NO: 80287 - DNA, 25 bp, Homo sapien
agacagtgcctccaccgtcgagaga

SEQ ID NO: 80288 - DNA, 25 bp, Homo sapien
cgcaattaccaagatcgtgaccctc

SEQ ID NO: 80289 - DNA, 25 bp, Homo sapien
ggttaagctcggaaagccgcaatta

SEQ ID NO: 80290 - DNA, 25 bp, Homo sapien
tacctggaagaacccgctttgccgc

SEQ ID NO: 80291 - DNA, 25 bp, Homo sapien
ctcacgggtagtctgagcagaactt

SEQ ID NO: 80292 - DNA, 25 bp, Homo sapien
agcgacgagtcttcaacaagttgga

SEQ ID NO: 80293 - DNA, 25 bp, Homo sapien
tcgagagacgttttctccgggcgtg

SEQ ID NO: 80294 - DNA, 25 bp, Homo sapien
gtcatggacggcttcgccataccca

SEQ ID NO: 80295 - DNA, 25 bp, Homo sapien
gcggtctctgctgaccctgtggcac

SEQ ID NO: 80296 - DNA, 25 bp, Homo sapien
ccagcactggcggtcacttctgggc

SEQ ID NO: 80297 - DNA, 25 bp, Homo sapien
gaaggtcccgctgcagtcctccaag

SEQ ID NO: 80298 - DNA, 25 bp, Homo sapien
ccctgagaaagatatggccctggag

SEQ ID NO: 80299 - DNA, 25 bp, Homo sapien
gccggaagttcaactcgcaggagga

SEQ ID NO: 80300 - DNA, 25 bp, Homo sapien
acctagcgccacgacggccggaagt

SEQ ID NO: 80301 - DNA, 25 bp, Homo sapien
tgggaacgtcgccttatcaagaacc

SEQ ID NO: 80302 - DNA, 25 bp, Homo sapien
cccgcatagtcacgctcaggttgct

SEQ ID NO: 80303 - DNA, 25 bp, Homo sapien
caggtcgccgaggaaacgtttcaga

SEQ ID NO: 80304 - DNA, 25 bp, Homo sapien
tcagctcgctgtcccaagcggtaaa

SEQ ID NO: 80305 - DNA, 25 bp, Homo sapien
tcggtgggcagcagcttattcagct

SEQ ID NO: 80306 - DNA, 25 bp, Homo sapien
gccaatctgcccaacggctacatga

SEQ ID NO: 80307 - DNA, 25 bp, Homo sapien
cagatgatgaacttcctgcggcgcc

SEQ ID NO: 80308 - DNA, 25 bp, Homo sapien
cctgagtctctgctggctaagccga

SEQ ID NO: 80309 - DNA, 25 bp, Homo sapien
cccagacctttaagccagatgatga

SEQ ID NO: 80310 - DNA, 25 bp, Homo sapien
gctctccttcttaagaagggtggga

SEQ ID NO: 80311 - DNA, 25 bp, Homo sapien
ctgaagccagacagccggtttggga

SEQ ID NO: 80312 - DNA, 25 bp, Homo sapien
tcgcctgaagccagacagccggttt

SEQ ID NO: 80313 - DNA, 25 bp, Homo sapien
gccaggtgtcgcctgaagccagaca

SEQ ID NO: 80314 - DNA, 25 bp, Homo sapien
cgaggttctactgctctccttctta

SEQ ID NO: 80315 - DNA, 25 bp, Homo sapien
ggcggagcgctaacgtctaacgcta

SEQ ID NO: 80316 - DNA, 25 bp, Homo sapien
tagcagcgccctagcgggaccctgg

SEQ ID NO: 80317 - DNA, 25 bp, Homo sapien
gtctaacgctaacggcggtcgtgcc

SEQ ID NO: 80318 - DNA, 25 bp, Homo sapien
agggatctactgtgcacgtccaagg

SEQ ID NO: 80319 - DNA, 25 bp, Homo sapien
aagccgggagggatctactgtgcac

SEQ ID NO: 80320 - DNA, 25 bp, Homo sapien
ccctaccagagggtgacgagacggg

SEQ ID NO: 80321 - DNA, 25 bp, Homo sapien
ttgccggctattggcttctcccatc

SEQ ID NO: 80322 - DNA, 25 bp, Homo sapien
cccgtttgccggctattggcttctc

SEQ ID NO: 80323 - DNA, 25 bp, Homo sapien
ctgtgcacgtccaaggcgctgggcc

SEQ ID NO: 80324 - DNA, 25 bp, Homo sapien
aagtgcggccttcggcgtgatcctt

SEQ ID NO: 80325 - DNA, 25 bp, Homo sapien
atctactgtgcacgtccaaggcgct

SEQ ID NO: 80326 - DNA, 25 bp, Homo sapien
gagcggcctcagacacctaagggta

SEQ ID NO: 80327 - DNA, 25 bp, Homo sapien
cgctgcaggagtcacgcgtgtgaca

SEQ ID NO: 80328 - DNA, 25 bp, Homo sapien
tcacgcgtgtgacatccaaccagga

SEQ ID NO: 80329 - DNA, 25 bp, Homo sapien
atccaaccaggagccgtgccctgag

SEQ ID NO: 80330 - DNA, 25 bp, Homo sapien
agccgtgccctgagcaggccaggaa

SEQ ID NO: 80331 - DNA, 25 bp, Homo sapien
cgctgaatgcacaccgcagcggtgt

SEQ ID NO: 80332 - DNA, 25 bp, Homo sapien
tcagacacctaagggtaggaccggc

SEQ ID NO: 80333 - DNA, 25 bp, Homo sapien
agacagggccgctgaatgcacaccg

SEQ ID NO: 80334 - DNA, 25 bp, Homo sapien
gaagacctttccctgtcacagaatg

SEQ ID NO: 80335 - DNA, 25 bp, Homo sapien
ggttcagcctcaattgctccaaaga

SEQ ID NO: 80336 - DNA, 25 bp, Homo sapien
gcgctgcggtcatttagcctgatga

SEQ ID NO: 80337 - DNA, 25 bp, Homo sapien
tttctcttccataagccgggccagc

SEQ ID NO: 80338 - DNA, 25 bp, Homo sapien
cgctggtccctttctcttatcgagc

SEQ ID NO: 80339 - DNA, 25 bp, Homo sapien
gtcacaaatcatcgcgtcgccttcg

SEQ ID NO: 80340 - DNA, 25 bp, Homo sapien
tcccgggcaggttagacttctgtga

SEQ ID NO: 80341 - DNA, 25 bp, Homo sapien
ccgccagtccgcgagctctggttaa

SEQ ID NO: 80342 - DNA, 25 bp, Homo sapien
tgtccgagctcaaaaaagccgtctc

SEQ ID NO: 80343 - DNA, 25 bp, Homo sapien
ctctcgctgccgtgttcaggtcact

SEQ ID NO: 80344 - DNA, 25 bp, Homo sapien
gcctcgggccatcacagcctgaatg

SEQ ID NO: 80345 - DNA, 25 bp, Homo sapien
cagggagctttgtcccgcagcgaac

SEQ ID NO: 80346 - DNA, 25 bp, Homo sapien
gccgcagccagagtgctttgtccga

SEQ ID NO: 80347 - DNA, 25 bp, Homo sapien
cctggcgcagacctcttttaacttt

SEQ ID NO: 80348 - DNA, 25 bp, Homo sapien
actgagctttactggcttcgccgga

SEQ ID NO: 80349 - DNA, 25 bp, Homo sapien
tgtgtgtcatccacgcagtgtgctc

SEQ ID NO: 80350 - DNA, 25 bp, Homo sapien
cgcctttgcgcaactgaagcggatg

SEQ ID NO: 80351 - DNA, 25 bp, Homo sapien
aggctccatttaccctccgcggagg

SEQ ID NO: 80352 - DNA, 25 bp, Homo sapien
aagaagggcttcttgcagctccggg

SEQ ID NO: 80353 - DNA, 25 bp, Homo sapien
ggcggcacttaagcggcagcttcct

SEQ ID NO: 80354 - DNA, 25 bp, Homo sapien
attcataacattcccgcaagcgagg

SEQ ID NO: 80355 - DNA, 25 bp, Homo sapien
gcgcacaggctggaatccgtacatt

SEQ ID NO: 80356 - DNA, 25 bp, Homo sapien
gcttggctctctcgcctcactttga

SEQ ID NO: 80357 - DNA, 25 bp, Homo sapien
tgcttaccgtctgaatctcccactg

SEQ ID NO: 80358 - DNA, 25 bp, Homo sapien
acacacttctctcggggctgagttg

SEQ ID NO: 80359 - DNA, 25 bp, Homo sapien
ggggaatccgaactgtacctgttca

SEQ ID NO: 80360 - DNA, 25 bp, Homo sapien
ctggcggaactctgatagggagata

SEQ ID NO: 80361 - DNA, 25 bp, Homo sapien
ggcgaaccgaagaagccggcatatt

SEQ ID NO: 80362 - DNA, 25 bp, Homo sapien
tctgcccttcgcgaatctttttgcg

SEQ ID NO: 80363 - DNA, 25 bp, Homo sapien
tgtacataactcaatagccggaagc

SEQ ID NO: 80364 - DNA, 25 bp, Homo sapien
ccgaggctttggtcacctgtcttcc

SEQ ID NO: 80365 - DNA, 25 bp, Homo sapien
acctgttcagagatccgcgaccttg

SEQ ID NO: 80366 - DNA, 25 bp, Homo sapien
tcgaagtcctgattccacgataggc

SEQ ID NO: 80367 - DNA, 25 bp, Homo sapien
gccgcggggatacgcctttcaccgc

SEQ ID NO: 80368 - DNA, 25 bp, Homo sapien
cccagcaattggagcgctgagtcga

SEQ ID NO: 80369 - DNA, 25 bp, Homo sapien
gcgctgagtcgaagtcctgattcca

SEQ ID NO: 80370 - DNA, 25 bp, Homo sapien
cctgattccacgataggcggatgaa

SEQ ID NO: 80371 - DNA, 25 bp, Homo sapien
ccacgataggcggatgaagccctaa

SEQ ID NO: 80372 - DNA, 25 bp, Homo sapien
acgataggcggatgaagccctaacg

SEQ ID NO: 80373 - DNA, 25 bp, Homo sapien
caattggagcgctgagtcgaagtcc

SEQ ID NO: 80374 - DNA, 25 bp, Homo sapien
ttgtcccttagtcctccctggacag

SEQ ID NO: 80375 - DNA, 25 bp, Homo sapien
gacagagggcgtgaagttggctgcg

SEQ ID NO: 80376 - DNA, 25 bp, Homo sapien
tggacagagggcgtgaagttggctg

SEQ ID NO: 80377 - DNA, 25 bp, Homo sapien
tccctggacagagggcgtgaagttg

SEQ ID NO: 80378 - DNA, 25 bp, Homo sapien
tgtcccttagtcctccctggacaga

SEQ ID NO: 80379 - DNA, 25 bp, Homo sapien
agcttgtcccttagtcctccctgga

SEQ ID NO: 80380 - DNA, 25 bp, Homo sapien
tgctgcagcttgtcccttagtcctc

SEQ ID NO: 80381 - DNA, 25 bp, Homo sapien
gtcccttagtcctccctggacagag

SEQ ID NO: 80382 - DNA, 25 bp, Homo sapien
cagctcgtcagagcgcgagaacctg

SEQ ID NO: 80383 - DNA, 25 bp, Homo sapien
ttcagggcgctttcagttcacggag

SEQ ID NO: 80384 - DNA, 25 bp, Homo sapien
gctttcagttcacggagcgcacgga

SEQ ID NO: 80385 - DNA, 25 bp, Homo sapien
cacaggacactggtacggcttcaca

SEQ ID NO: 80386 - DNA, 25 bp, Homo sapien
cttcacacctgagtgcgagcgcctg

SEQ ID NO: 80387 - DNA, 25 bp, Homo sapien
cctgtgccgcgacagctcgtcagag

SEQ ID NO: 80388 - DNA, 25 bp, Homo sapien
tgcaccttgatgtgcttggagaggt

SEQ ID NO: 80389 - DNA, 25 bp, Homo sapien
cgcgaacttcttctcgcacacagga

SEQ ID NO: 80390 - DNA, 25 bp, Homo sapien
ctcagcaaagtgctggtgggcgacc

SEQ ID NO: 80391 - DNA, 25 bp, Homo sapien
ctgctgcggtgaccgacagtaaccc

SEQ ID NO: 80392 - DNA, 25 bp, Homo sapien
gaaatgaagagagccggctcagacc

SEQ ID NO: 80393 - DNA, 25 bp, Homo sapien
tgagttcctgtcgtgtgactgcgtg

SEQ ID NO: 80394 - DNA, 25 bp, Homo sapien
ctcggtcaggccatggctttggtaa

SEQ ID NO: 80395 - DNA, 25 bp, Homo sapien
tgcccaccatatgggagggccggcc

SEQ ID NO: 80396 - DNA, 25 bp, Homo sapien
tttggtaatgttcggtctgagcgga

SEQ ID NO: 80397 - DNA, 25 bp, Homo sapien
agcactcgcgcggtgcctccgagag

SEQ ID NO: 80398 - DNA, 25 bp, Homo sapien
agccgcagcaacagcacccagcttg

SEQ ID NO: 80399 - DNA, 25 bp, Homo sapien
ccaagtgccgagtggcagatgtgct

SEQ ID NO: 80400 - DNA, 25 bp, Homo sapien
gggctcccaggcatgacactgcaga

SEQ ID NO: 80401 - DNA, 25 bp, Homo sapien
tgacactgcagatccgcgactgagc

SEQ ID NO: 80402 - DNA, 25 bp, Homo sapien
atccgcgactgagcctgtgaggtct

SEQ ID NO: 80403 - DNA, 25 bp, Homo sapien
cccaggctttatgaggtggccctaa

SEQ ID NO: 80404 - DNA, 25 bp, Homo sapien
atgaggtggccctaagggccaatcc

SEQ ID NO: 80405 - DNA, 25 bp, Homo sapien
tcggactcaccaagtgccgagtggc

SEQ ID NO: 80406 - DNA, 25 bp, Homo sapien
ttcaacttgtttacaagcctgcgtc

SEQ ID NO: 80407 - DNA, 25 bp, Homo sapien
gagcgcgtagtctgcccatagcctc

SEQ ID NO: 80408 - DNA, 25 bp, Homo sapien
cttctgggcagaaaggggattcgcc

SEQ ID NO: 80409 - DNA, 25 bp, Homo sapien
cctctttgtaagtcccttctgggca

SEQ ID NO: 80410 - DNA, 25 bp, Homo sapien
acaagcctgcgtcaccgggaacctt

SEQ ID NO: 80411 - DNA, 25 bp, Homo sapien
cccgcctgcgagctaggaactgtgg

SEQ ID NO: 80412 - DNA, 25 bp, Homo sapien
ctgcgcggtcgtcttgacgcctgac

SEQ ID NO: 80413 - DNA, 25 bp, Homo sapien
gacgcctgaccagggccggttttca

SEQ ID NO: 80414 - DNA, 25 bp, Homo sapien
agacgtaaacccaagagccctgctc

SEQ ID NO: 80415 - DNA, 25 bp, Homo sapien
tggttgccttggagacgtaaaccca

SEQ ID NO: 80416 - DNA, 25 bp, Homo sapien
cctgaagaatggttgccttggagac

SEQ ID NO: 80417 - DNA, 25 bp, Homo sapien
gccagcctgaagaatggttgccttg

SEQ ID NO: 80418 - DNA, 25 bp, Homo sapien
tcacagccagcctgaagaatggttg

SEQ ID NO: 80419 - DNA, 25 bp, Homo sapien
cctttgtggcgtcacagccagcctg

SEQ ID NO: 80420 - DNA, 25 bp, Homo sapien
ggcccagccctcaagcgcccagcct

SEQ ID NO: 80421 - DNA, 25 bp, Homo sapien
cagggaggacatcgtgcccagagct

SEQ ID NO: 80422 - DNA, 25 bp, Homo sapien
cgcgactacacgacctggaagctca

SEQ ID NO: 80423 - DNA, 25 bp, Homo sapien
tgtcggctaagcacaccagcctgcg

SEQ ID NO: 80424 - DNA, 25 bp, Homo sapien
cagcagaagacgatgcgggtgcacc

SEQ ID NO: 80425 - DNA, 25 bp, Homo sapien
cgcaaacccgcgtccctaggaatgg

SEQ ID NO: 80426 - DNA, 25 bp, Homo sapien
tcctcgaaagtgtcggctaagcaca

SEQ ID NO: 80427 - DNA, 25 bp, Homo sapien
gaagatgacctactcctcgaaagtg

SEQ ID NO: 80428 - DNA, 25 bp, Homo sapien
tgcgggtgcaccagaagatgaccta

SEQ ID NO: 80429 - DNA, 25 bp, Homo sapien
tggaagctcaccttgaccaaaggtg

SEQ ID NO: 80430 - DNA, 25 bp, Homo sapien
tcggagcagcttcggacgcagagct

SEQ ID NO: 80431 - DNA, 25 bp, Homo sapien
gctcgccaggttgacacgggagcca

SEQ ID NO: 80432 - DNA, 25 bp, Homo sapien
aggctcggcctcctgtgatccggca

SEQ ID NO: 80433 - DNA, 25 bp, Homo sapien
gcacttccagcagcaccaagaaaga

SEQ ID NO: 80434 - DNA, 25 bp, Homo sapien
caccaagaaagagtcgccgtcgctg

SEQ ID NO: 80435 - DNA, 25 bp, Homo sapien
tcgagacgcaccagcaggtcctggc

SEQ ID NO: 80436 - DNA, 25 bp, Homo sapien
cccagcgacggcgtcggagcagctt

SEQ ID NO: 80437 - DNA, 25 bp, Homo sapien
cgccgggaggtccatcttggtccca

SEQ ID NO: 80438 - DNA, 25 bp, Homo sapien
gtggggcacgccaccgcgacaatgc

SEQ ID NO: 80439 - DNA, 25 bp, Homo sapien
atgcctcttggccttgggtggataa

SEQ ID NO: 80440 - DNA, 25 bp, Homo sapien
tggccttgggtggataatggcaccc

SEQ ID NO: 80441 - DNA, 25 bp, Homo sapien
gaggggcttccccaatcagtctccg

SEQ ID NO: 80442 - DNA, 25 bp, Homo sapien
gtcctgggccagtgcaactccgccc

SEQ ID NO: 80443 - DNA, 25 bp, Homo sapien
cccagccgtatccagcggactgtcc

SEQ ID NO: 80444 - DNA, 25 bp, Homo sapien
ctcgcgctttccaccgcggcctgac

SEQ ID NO: 80445 - DNA, 25 bp, Homo sapien
ccgcgacaatgcctcttggccttgg

SEQ ID NO: 80446 - DNA, 25 bp, Homo sapien
gtatttcgtactcgctcttcacggc

SEQ ID NO: 80447 - DNA, 25 bp, Homo sapien
cgcagtcttccgcagtcgcgagtac

SEQ ID NO: 80448 - DNA, 25 bp, Homo sapien
cgggtcaccaatagcgacacggata

SEQ ID NO: 80449 - DNA, 25 bp, Homo sapien
gcagcgcctattagtgtcatcctca

SEQ ID NO: 80450 - DNA, 25 bp, Homo sapien
tcctggattcattcactcgctcttt

SEQ ID NO: 80451 - DNA, 25 bp, Homo sapien
ctcgctcttttcattcacgaaggta

SEQ ID NO: 80452 - DNA, 25 bp, Homo sapien
gtggcctacctagccctgcgtattt

SEQ ID NO: 80453 - DNA, 25 bp, Homo sapien
gtggaaagccatggagagcgctctc

SEQ ID NO: 80454 - DNA, 25 bp, Homo sapien
gcttcgcggagttcctggcctacct

SEQ ID NO: 80455 - DNA, 25 bp, Homo sapien
agcgcctgctacagccggaggacct

SEQ ID NO: 80456 - DNA, 25 bp, Homo sapien
tccgctacgacgtcgtgggcaagtt

SEQ ID NO: 80457 - DNA, 25 bp, Homo sapien
tacggtgcacgcatcgttcagcgcc

SEQ ID NO: 80458 - DNA, 25 bp, Homo sapien
gccgccttccagaggcgctacggtg

SEQ ID NO: 80459 - DNA, 25 bp, Homo sapien
tcgagcgcctggcatcggcttaccg

SEQ ID NO: 80460 - DNA, 25 bp, Homo sapien
tgcgcgcctacttggccttcctgtt

SEQ ID NO: 80461 - DNA, 25 bp, Homo sapien
catggcctgctctactgctacgtgc

SEQ ID NO: 80462 - DNA, 25 bp, Homo sapien
tatctccaggttgtgcctgcgtccg

SEQ ID NO: 80463 - DNA, 25 bp, Homo sapien
gtactatggggacagtagctcttgc

SEQ ID NO: 80464 - DNA, 25 bp, Homo sapien
ctaggtgtcacctgcccttcgcaaa

SEQ ID NO: 80465 - DNA, 25 bp, Homo sapien
gcgtccggagaccacccaatcttgg

SEQ ID NO: 80466 - DNA, 25 bp, Homo sapien
ggccgggcctgctcacaaaccgaaa

SEQ ID NO: 80467 - DNA, 25 bp, Homo sapien
ttgctgaagatcaccacccggctgc

SEQ ID NO: 80468 - DNA, 25 bp, Homo sapien
agggccgcgcctacccgagtactat

SEQ ID NO: 80469 - DNA, 25 bp, Homo sapien
aagcgcgagcctctttatctccagg

SEQ ID NO: 80470 - DNA, 25 bp, Homo sapien
atgcgaggtctcctttcagaggatc

SEQ ID NO: 80471 - DNA, 25 bp, Homo sapien
ctttcagaggatctggcctgggctg

SEQ ID NO: 80472 - DNA, 25 bp, Homo sapien
tgggaaacagacaatgcgaggtctc

SEQ ID NO: 80473 - DNA, 25 bp, Homo sapien
catgcacttctgaaggcggccgcga

SEQ ID NO: 80474 - DNA, 25 bp, Homo sapien
agcgccagatcgcagcatgcacttc

SEQ ID NO: 80475 - DNA, 25 bp, Homo sapien
gaacccatttccactttcagctgcg

SEQ ID NO: 80476 - DNA, 25 bp, Homo sapien
ggtgcacgccgaaacattctacaga

SEQ ID NO: 80477 - DNA, 25 bp, Homo sapien
tgcgcgaattcggtgcacgccgaaa

SEQ ID NO: 80478 - DNA, 25 bp, Homo sapien
gtttcttgaatttgcgcccggcctc

SEQ ID NO: 80479 - DNA, 25 bp, Homo sapien
agcttcgcgacatgggcttcaggga

SEQ ID NO: 80480 - DNA, 25 bp, Homo sapien
tggcagccttggagcttcgcgacat

SEQ ID NO: 80481 - DNA, 25 bp, Homo sapien
cgtcggccaataggacgtggctttg

SEQ ID NO: 80482 - DNA, 25 bp, Homo sapien
cgactcagcgccacccgattggtga

SEQ ID NO: 80483 - DNA, 25 bp, Homo sapien
cctccagacggaaggactgcaatcc

SEQ ID NO: 80484 - DNA, 25 bp, Homo sapien
ggtacacatcttcggcctcagccta

SEQ ID NO: 80485 - DNA, 25 bp, Homo sapien
taacgcactctagcaggcacagacc

SEQ ID NO: 80486 - DNA, 25 bp, Homo sapien
ggaaggctgcaccaacaggtctgcc

SEQ ID NO: 80487 - DNA, 25 bp, Homo sapien
gctgtacagagccttatcaccaatg

SEQ ID NO: 80488 - DNA, 25 bp, Homo sapien
acttcataacccagtggcggccctg

SEQ ID NO: 80489 - DNA, 25 bp, Homo sapien
gacccaggaggtttgtgcagtcatg

SEQ ID NO: 80490 - DNA, 25 bp, Homo sapien
tgcagtcatggacagctacacaggc

SEQ ID NO: 80491 - DNA, 25 bp, Homo sapien
cagacacctgccatggacggaaaaa

SEQ ID NO: 80492 - DNA, 25 bp, Homo sapien
ctgcacggaggcttgcttggataga

SEQ ID NO: 80493 - DNA, 25 bp, Homo sapien
agggaaggctacacacagaattatc

SEQ ID NO: 80494 - DNA, 25 bp, Homo sapien
cggagcgttagcctcccgcgagtat

SEQ ID NO: 80495 - DNA, 25 bp, Homo sapien
gcagccatgttgtcccgcgggccat

SEQ ID NO: 80496 - DNA, 25 bp, Homo sapien
agctcagggcaacgtccacacacca

SEQ ID NO: 80497 - DNA, 25 bp, Homo sapien
ctcccgcgagtatcggtgagcggct

SEQ ID NO: 80498 - DNA, 25 bp, Homo sapien
gcacctttgagtgcgcgagttgccg

SEQ ID NO: 80499 - DNA, 25 bp, Homo sapien
ggaatcgatggagcacctttgagtg

SEQ ID NO: 80500 - DNA, 25 bp, Homo sapien
cacccgcctcggaggaatcgatgga

SEQ ID NO: 80501 - DNA, 25 bp, Homo sapien
ggctgccgaactgccatgggcgcca

SEQ ID NO: 80502 - DNA, 25 bp, Homo sapien
ccgatcgccgtgtgaagggcaagcc

SEQ ID NO: 80503 - DNA, 25 bp, Homo sapien
aaacgacaccaggtagcctgccgcg

SEQ ID NO: 80504 - DNA, 25 bp, Homo sapien
cgaggagcaaacgacaccaggtagc

SEQ ID NO: 80505 - DNA, 25 bp, Homo sapien
tggtggcgaggagcaaacgacacca

SEQ ID NO: 80506 - DNA, 25 bp, Homo sapien
tcggatccctcctcggaaatgggac

SEQ ID NO: 80507 - DNA, 25 bp, Homo sapien
aacttcggatccctcctcggaaatg

SEQ ID NO: 80508 - DNA, 25 bp, Homo sapien
tcgccgtgtgaagggcaagccactc

SEQ ID NO: 80509 - DNA, 25 bp, Homo sapien
acaccaggtagcctgccgcggggca

SEQ ID NO: 80510 - DNA, 25 bp, Homo sapien
ggcgccccattcatgctgggcatcg

SEQ ID NO: 80511 - DNA, 25 bp, Homo sapien
gcgccgacgcggagagaccgcaccc

SEQ ID NO: 80512 - DNA, 25 bp, Homo sapien
ccctgcggtgtccaggcccgtcccg

SEQ ID NO: 80513 - DNA, 25 bp, Homo sapien
gctggacctcggctcagacctctgg

SEQ ID NO: 80514 - DNA, 25 bp, Homo sapien
cccggatagggatcggagcctccca

SEQ ID NO: 80515 - DNA, 25 bp, Homo sapien
aggaggtcgtgcaggctaagccccc

SEQ ID NO: 80516 - DNA, 25 bp, Homo sapien
aagttggagcggcttcccgaccaca

SEQ ID NO: 80517 - DNA, 25 bp, Homo sapien
gttggagcggcttcccgaccacagc

SEQ ID NO: 80518 - DNA, 25 bp, Homo sapien
ggcgagcacttcttcacgtccaaga

SEQ ID NO: 80519 - DNA, 25 bp, Homo sapien
ccacggcctgggcagtactgacaac

SEQ ID NO: 80520 - DNA, 25 bp, Homo sapien
cgatctcttcaaactgggtgagcca

SEQ ID NO: 80521 - DNA, 25 bp, Homo sapien
ccaggccaagctcttcgtgggcaca

SEQ ID NO: 80522 - DNA, 25 bp, Homo sapien
acatgttcggcttcgtgtaccagga

SEQ ID NO: 80523 - DNA, 25 bp, Homo sapien
tccgcagcgagcagtttgtctacta

SEQ ID NO: 80524 - DNA, 25 bp, Homo sapien
cgcatctataagctgtcggggaacc

SEQ ID NO: 80525 - DNA, 25 bp, Homo sapien
ttcccggcctttgacatctactatg

SEQ ID NO: 80526 - DNA, 25 bp, Homo sapien
gtcacggcagcagtcgctgcaccga

SEQ ID NO: 80527 - DNA, 25 bp, Homo sapien
ccgacacacctgcatcgtggatgca

SEQ ID NO: 80528 - DNA, 25 bp, Homo sapien
tgcatcgtggatgcacgcgcgtcac

SEQ ID NO: 80529 - DNA, 25 bp, Homo sapien
gccgacccgcgcttcgagtgcggat

SEQ ID NO: 80530 - DNA, 25 bp, Homo sapien
cctacgccctgtgggatgcctgtac

SEQ ID NO: 80531 - DNA, 25 bp, Homo sapien
gctcactatcacaggcgagaacctg

SEQ ID NO: 80532 - DNA, 25 bp, Homo sapien
cctgcgattcgaagacgtgcgtctg

SEQ ID NO: 80533 - DNA, 25 bp, Homo sapien
gaacctgggcctgcgattcgaagac

SEQ ID NO: 80534 - DNA, 25 bp, Homo sapien
cggccccggtggctcatgttgttcg

SEQ ID NO: 80535 - DNA, 25 bp, Homo sapien
cgtagaaccccagctgcccagagtg

SEQ ID NO: 80536 - DNA, 25 bp, Homo sapien
cagccctgacgccagtcgtagaacc

SEQ ID NO: 80537 - DNA, 25 bp, Homo sapien
cgtgaaccggaaccggatctccacg

SEQ ID NO: 80538 - DNA, 25 bp, Homo sapien
agagtgagagcaaccgtgaaccgga

SEQ ID NO: 80539 - DNA, 25 bp, Homo sapien
tgagagagtgagagcaaccgtgaac

SEQ ID NO: 80540 - DNA, 25 bp, Homo sapien
caggacacggcagagtgagagagtg

SEQ ID NO: 80541 - DNA, 25 bp, Homo sapien
acccgggcgatagccaggacacggc

SEQ ID NO: 80542 - DNA, 25 bp, Homo sapien
tcatcgcctacaagcgcaagtcacg

SEQ ID NO: 80543 - DNA, 25 bp, Homo sapien
cgcaagtcacgagatgctgaccgca

SEQ ID NO: 80544 - DNA, 25 bp, Homo sapien
tggcttcgagttctcgccagggaca

SEQ ID NO: 80545 - DNA, 25 bp, Homo sapien
cgccagggacactgcaggtgtactc

SEQ ID NO: 80546 - DNA, 25 bp, Homo sapien
tgctgaccgcacactcaagcggctg

SEQ ID NO: 80547 - DNA, 25 bp, Homo sapien
acgctgcctgccattgtgggcattg

SEQ ID NO: 80548 - DNA, 25 bp, Homo sapien
tcatcgtggctgtgctcatcgccta

SEQ ID NO: 80549 - DNA, 25 bp, Homo sapien
aggtgtactcggacagcctgctgac

SEQ ID NO: 80550 - DNA, 25 bp, Homo sapien
gcccgacctggagagcggcaccaag

SEQ ID NO: 80551 - DNA, 25 bp, Homo sapien
accacctggaccagcgtgagggtga

SEQ ID NO: 80552 - DNA, 25 bp, Homo sapien
tggtgaagaaccacgaccacctgga

SEQ ID NO: 80553 - DNA, 25 bp, Homo sapien
gcggcaccaagctgtggcacctggt

SEQ ID NO: 80554 - DNA, 25 bp, Homo sapien
tgcagagagcatgctgcgcacggcc

SEQ ID NO: 80555 - DNA, 25 bp, Homo sapien
atgatcacgcccgacctggagagcg

SEQ ID NO: 80556 - DNA, 25 bp, Homo sapien
tgaccgcggcagcaagatggtctcg

SEQ ID NO: 80557 - DNA, 25 bp, Homo sapien
agatggtctcggagatctacttgac

SEQ ID NO: 80558 - DNA, 25 bp, Homo sapien
cagctgtgatcatccagcatgatgc

SEQ ID NO: 80559 - DNA, 25 bp, Homo sapien
ccagcatgatgcagcgtgaggacag

SEQ ID NO: 80560 - DNA, 25 bp, Homo sapien
gggacagccctcaccgcatgcgtgt

SEQ ID NO: 80561 - DNA, 25 bp, Homo sapien
cagccctcaccgcatgcgtgtggag

SEQ ID NO: 80562 - DNA, 25 bp, Homo sapien
ctcaccgcatgcgtgtggagtgtcc

SEQ ID NO: 80563 - DNA, 25 bp, Homo sapien
cgcagtgcagcgactgcccggccct

SEQ ID NO: 80564 - DNA, 25 bp, Homo sapien
tgatcatccagcatgatgcagcgtg

SEQ ID NO: 80565 - DNA, 25 bp, Homo sapien
caggtggtggacacgatggccctga

SEQ ID NO: 80566 - DNA, 25 bp, Homo sapien
acggtcgctcttcttcacgtaattg

SEQ ID NO: 80567 - DNA, 25 bp, Homo sapien
atctgtgtcatcaggcgcaggactg

SEQ ID NO: 80568 - DNA, 25 bp, Homo sapien
tcgcgctgtcactgttagggaaatc

SEQ ID NO: 80569 - DNA, 25 bp, Homo sapien
acatttgtgtccatgcacgcggtgc

SEQ ID NO: 80570 - DNA, 25 bp, Homo sapien
ctcgggttaactgatcgcagggaaa

SEQ ID NO: 80571 - DNA, 25 bp, Homo sapien
aggctgacctaatttccactctttg

SEQ ID NO: 80572 - DNA, 25 bp, Homo sapien
ctgagcaatccagagcagcgtctcc

SEQ ID NO: 80573 - DNA, 25 bp, Homo sapien
ttcgtccgaggtgcatacaagatga

SEQ ID NO: 80574 - DNA, 25 bp, Homo sapien
aggcagaggtgtccagctcggtcct

SEQ ID NO: 80575 - DNA, 25 bp, Homo sapien
cggcagacgctccatgggcccgagt

SEQ ID NO: 80576 - DNA, 25 bp, Homo sapien
tgtcaaggagggcatgtgtccgcca

SEQ ID NO: 80577 - DNA, 25 bp, Homo sapien
tcagtgcccgcggatacgacgctct

SEQ ID NO: 80578 - DNA, 25 bp, Homo sapien
atacgacgctcttgggtggagttgc

SEQ ID NO: 80579 - DNA, 25 bp, Homo sapien
atggctctcacctgagactccggcg

SEQ ID NO: 80580 - DNA, 25 bp, Homo sapien
acacgcacgttccagaggaggcaca

SEQ ID NO: 80581 - DNA, 25 bp, Homo sapien
cggagctccgatttgggagcgactc

SEQ ID NO: 80582 - DNA, 25 bp, Homo sapien
cgcagcctttgtcctgagctgcaga

SEQ ID NO: 80583 - DNA, 25 bp, Homo sapien
atgcccgcgggctgcaaacctctcc

SEQ ID NO: 80584 - DNA, 25 bp, Homo sapien
tcgcctgggcaggactcggatgccc

SEQ ID NO: 80585 - DNA, 25 bp, Homo sapien
caggagacgcccttctggcctggcc

SEQ ID NO: 80586 - DNA, 25 bp, Homo sapien
tgcgcgactgcctgtcccaggcgct

SEQ ID NO: 80587 - DNA, 25 bp, Homo sapien
acaggtgctcactgcgcgactgcct

SEQ ID NO: 80588 - DNA, 25 bp, Homo sapien
agcctctacaggtgctcactgcgcg

SEQ ID NO: 80589 - DNA, 25 bp, Homo sapien
ccgagcggcccctagctgtgcagag

SEQ ID NO: 80590 - DNA, 25 bp, Homo sapien
atcaccagctgggagtggccaaggt

SEQ ID NO: 80591 - DNA, 25 bp, Homo sapien
tctggatctcgcttcacagccaaga

SEQ ID NO: 80592 - DNA, 25 bp, Homo sapien
ttcacagccaagatcaccagctggg

SEQ ID NO: 80593 - DNA, 25 bp, Homo sapien
gcccacgtcaagcatggcgcggagc

SEQ ID NO: 80594 - DNA, 25 bp, Homo sapien
cctggtgcccacgtcaagcatggcg

SEQ ID NO: 80595 - DNA, 25 bp, Homo sapien
gtcaccagctgggagtggccgaccc

SEQ ID NO: 80596 - DNA, 25 bp, Homo sapien
aagcatggcgcggagcgactgcact

SEQ ID NO: 80597 - DNA, 25 bp, Homo sapien
ccgcagaacgtcggggactcccttg

SEQ ID NO: 80598 - DNA, 25 bp, Homo sapien
ctgacgcgttgtgctggccctacgc

SEQ ID NO: 80599 - DNA, 25 bp, Homo sapien
gccctgtgccctgacgcgttgtgct

SEQ ID NO: 80600 - DNA, 25 bp, Homo sapien
ggaggtcccgttcgctgtccagagc

SEQ ID NO: 80601 - DNA, 25 bp, Homo sapien
tgcctccgtgcctccgcggatggag

SEQ ID NO: 80602 - DNA, 25 bp, Homo sapien
ccctgctgaggaggaggtcccgttc

SEQ ID NO: 80603 - DNA, 25 bp, Homo sapien
gaagatccgcgtgcgtccgtcctga

SEQ ID NO: 80604 - DNA, 25 bp, Homo sapien
ttgtgctggccctacgcccggcgga

SEQ ID NO: 80605 - DNA, 25 bp, Homo sapien
tcgcgtctaccggagcgcgcactag

SEQ ID NO: 80606 - DNA, 25 bp, Homo sapien
tcaaattcccaagaggcggagcagc

SEQ ID NO: 80607 - DNA, 25 bp, Homo sapien
gtgggttcccacatccagggccttc

SEQ ID NO: 80608 - DNA, 25 bp, Homo sapien
ccaaattgcgaaaacggccacagtc

SEQ ID NO: 80609 - DNA, 25 bp, Homo sapien
gaggcctgcgtttctcactcggaaa

SEQ ID NO: 80610 - DNA, 25 bp, Homo sapien
agacaagacgctgcttcacggaaga

SEQ ID NO: 80611 - DNA, 25 bp, Homo sapien
gcagcccgctgacctcttaaagaga

SEQ ID NO: 80612 - DNA, 25 bp, Homo sapien
ctccagcagcctataggaataagtc

SEQ ID NO: 80613 - DNA, 25 bp, Homo sapien
cagagtcccagagtccctgttatca

SEQ ID NO: 80614 - DNA, 25 bp, Homo sapien
ctttggtgggtcacgtgaaccactt

SEQ ID NO: 80615 - DNA, 25 bp, Homo sapien
acgtcatgacgtcgcgttccgtagg

SEQ ID NO: 80616 - DNA, 25 bp, Homo sapien
cagtggacgccgacgtcatgacgtc

SEQ ID NO: 80617 - DNA, 25 bp, Homo sapien
gtcccttctggtcgccagtggacgc

SEQ ID NO: 80618 - DNA, 25 bp, Homo sapien
ggtcacgcagccagcaagtgtcgtc

SEQ ID NO: 80619 - DNA, 25 bp, Homo sapien
ctgcgtgaggcgactcgcctaccta

SEQ ID NO: 80620 - DNA, 25 bp, Homo sapien
gcgaaacctggttgttgctgtagtg

SEQ ID NO: 80621 - DNA, 25 bp, Homo sapien
tgaaccacttttcgcgcgaaacctg

SEQ ID NO: 80622 - DNA, 25 bp, Homo sapien
actacccggactgaggactgcgcac

SEQ ID NO: 80623 - DNA, 25 bp, Homo sapien
ttcctgacttactgctgggtgcgcg

SEQ ID NO: 80624 - DNA, 25 bp, Homo sapien
agtgcgccttcctgacttactgctg

SEQ ID NO: 80625 - DNA, 25 bp, Homo sapien
tcctaccgggtttgcacgggcgcgc

SEQ ID NO: 80626 - DNA, 25 bp, Homo sapien
ccgatcacagactgcggagtgggtc

SEQ ID NO: 80627 - DNA, 25 bp, Homo sapien
tcactcttaaggttccgatcacaga

SEQ ID NO: 80628 - DNA, 25 bp, Homo sapien
ctgcgtaacgtcgagaggaagtgcc

SEQ ID NO: 80629 - DNA, 25 bp, Homo sapien
tgctggagtcggtgcttcactctta

SEQ ID NO: 80630 - DNA, 25 bp, Homo sapien
ctggaggatctcaaaggccactctg

SEQ ID NO: 80631 - DNA, 25 bp, Homo sapien
ctcctgtatggtaggtccagttgtc

SEQ ID NO: 80632 - DNA, 25 bp, Homo sapien
tgaccgcagtagcaggtgtctcttg

SEQ ID NO: 80633 - DNA, 25 bp, Homo sapien
ctggagatccaccaccgcttcaaga

SEQ ID NO: 80634 - DNA, 25 bp, Homo sapien
ttcaagaacttcctgcgcactcacg

SEQ ID NO: 80635 - DNA, 25 bp, Homo sapien
gccacggccacaacgtcttcaagga

SEQ ID NO: 80636 - DNA, 25 bp, Homo sapien
aaggagcgcatcagcgacatgtgca

SEQ ID NO: 80637 - DNA, 25 bp, Homo sapien
catgtgcaaaggtgtggcttcccta

SEQ ID NO: 80638 - DNA, 25 bp, Homo sapien
gggtattctctcctgttctgggcga

SEQ ID NO: 80639 - DNA, 25 bp, Homo sapien
gtacagccacggaaggcccgtgaca

SEQ ID NO: 80640 - DNA, 25 bp, Homo sapien
agtgcattgtgtgcctgcgcactcg

SEQ ID NO: 80641 - DNA, 25 bp, Homo sapien
tgtgtcacggtgaatgggtattctc

SEQ ID NO: 80642 - DNA, 25 bp, Homo sapien
tctgggcgactctattaggagctga

SEQ ID NO: 80643 - DNA, 25 bp, Homo sapien
aggagctgacaaaaacgggcgtaca

SEQ ID NO: 80644 - DNA, 25 bp, Homo sapien
gtgagtgacggccatgcggaccaat

SEQ ID NO: 80645 - DNA, 25 bp, Homo sapien
aggaggccgcattgtgaaggtccca

SEQ ID NO: 80646 - DNA, 25 bp, Homo sapien
gtgttcgaggaggacacgcacctgt

SEQ ID NO: 80647 - DNA, 25 bp, Homo sapien
ttcctgtaagaagggactgctcagc

SEQ ID NO: 80648 - DNA, 25 bp, Homo sapien
ttcacacggcggcttcggaccaact

SEQ ID NO: 80649 - DNA, 25 bp, Homo sapien
agcgcgtctgccttcttgactcatt

SEQ ID NO: 80650 - DNA, 25 bp, Homo sapien
tgactcattcttatttccggggttg

SEQ ID NO: 80651 - DNA, 25 bp, Homo sapien
tgagcgtgtttacatccgccgggtg

SEQ ID NO: 80652 - DNA, 25 bp, Homo sapien
ccgccaggaccaagcgaggtggacc

SEQ ID NO: 80653 - DNA, 25 bp, Homo sapien
cggggacactgatggccattgaccc

SEQ ID NO: 80654 - DNA, 25 bp, Homo sapien
ggcgctgcgattctccactactagt

SEQ ID NO: 80655 - DNA, 25 bp, Homo sapien
tgggaaactagctccgcgcacaccg

SEQ ID NO: 80656 - DNA, 25 bp, Homo sapien
gaggcacctcgcagacgcacaaatg

SEQ ID NO: 80657 - DNA, 25 bp, Homo sapien
cacaaatgcgggtgcccaaggcaaa

SEQ ID NO: 80658 - DNA, 25 bp, Homo sapien
tttgcttcctgtgcgtctccgacag

SEQ ID NO: 80659 - DNA, 25 bp, Homo sapien
cgcacacatgggtagcgggagccca

SEQ ID NO: 80660 - DNA, 25 bp, Homo sapien
aaacaaatcgctagaggggctcgga

SEQ ID NO: 80661 - DNA, 25 bp, Homo sapien
tctccgacagcacaggacacgtagc

SEQ ID NO: 80662 - DNA, 25 bp, Homo sapien
acttccttcgagtcgcagtgggccg

SEQ ID NO: 80663 - DNA, 25 bp, Homo sapien
ccagccagcacaggcccatattggg

SEQ ID NO: 80664 - DNA, 25 bp, Homo sapien
tgcagcctcggctctaagtgacttc

SEQ ID NO: 80665 - DNA, 25 bp, Homo sapien
agggcgcgggacctctatttatatc

SEQ ID NO: 80666 - DNA, 25 bp, Homo sapien
tctcgggccacttccaagcagaggg

SEQ ID NO: 80667 - DNA, 25 bp, Homo sapien
gaaccaggcagcaccttcgtaagta

SEQ ID NO: 80668 - DNA, 25 bp, Homo sapien
ccgtctggaaccagcgcgggaatag

SEQ ID NO: 80669 - DNA, 25 bp, Homo sapien
cccatattgggcagtggcctcagtc

SEQ ID NO: 80670 - DNA, 25 bp, Homo sapien
gctgttacgtgtatgggagccacca

SEQ ID NO: 80671 - DNA, 25 bp, Homo sapien
gccctactcagcaggtaatgacgga

SEQ ID NO: 80672 - DNA, 25 bp, Homo sapien
tagcactgacgtgtctctcggcgga

SEQ ID NO: 80673 - DNA, 25 bp, Homo sapien
gtagacgctgggataaggtccctgc

SEQ ID NO: 80674 - DNA, 25 bp, Homo sapien
ccgccatggcaagtgagtcctgtag

SEQ ID NO: 80675 - DNA, 25 bp, Homo sapien
gagtcctgtagggaagccctattga

SEQ ID NO: 80676 - DNA, 25 bp, Homo sapien
ctccagggagcttacggtctattca

SEQ ID NO: 80677 - DNA, 25 bp, Homo sapien
gctctcgcgttaccaagtctgcgca

SEQ ID NO: 80678 - DNA, 25 bp, Homo sapien
gcgctcctgtcactggcattgggaa

SEQ ID NO: 80679 - DNA, 25 bp, Homo sapien
cgctctccttggcagttcggacttc

SEQ ID NO: 80680 - DNA, 25 bp, Homo sapien
ctgcatgcggctccagtgtaagtgc

SEQ ID NO: 80681 - DNA, 25 bp, Homo sapien
gtcacagtaggtgtggtccctcctc

SEQ ID NO: 80682 - DNA, 25 bp, Homo sapien
accgtctagtctgggttctcaaaga

SEQ ID NO: 80683 - DNA, 25 bp, Homo sapien
acctgggatttagccatgggacctg

SEQ ID NO: 80684 - DNA, 25 bp, Homo sapien
acgggaccacttgcgatgacagcta

SEQ ID NO: 80685 - DNA, 25 bp, Homo sapien
ctcccgattcccgagttccgagtgg

SEQ ID NO: 80686 - DNA, 25 bp, Homo sapien
gctgcgtcttcgtagtgctcttcac

SEQ ID NO: 80687 - DNA, 25 bp, Homo sapien
cgcctagaccggctttccattggtg

SEQ ID NO: 80688 - DNA, 25 bp, Homo sapien
ggcaatttgcaaaggcccgcctaga

SEQ ID NO: 80689 - DNA, 25 bp, Homo sapien
ccattggtggaagcgggaacacctc

SEQ ID NO: 80690 - DNA, 25 bp, Homo sapien
tgcggccgttactagggcaatttgc

SEQ ID NO: 80691 - DNA, 25 bp, Homo sapien
cgcctgagttaccatgcggccgtta

SEQ ID NO: 80692 - DNA, 25 bp, Homo sapien
aatcttcattttgcagacgccggga

SEQ ID NO: 80693 - DNA, 25 bp, Homo sapien
cgccgggagctaaaaccagcgtgga

SEQ ID NO: 80694 - DNA, 25 bp, Homo sapien
ctgacaatgcccgagaggagccgca

SEQ ID NO: 80695 - DNA, 25 bp, Homo sapien
ggcgcaaggtgcagctgacaatgcc

SEQ ID NO: 80696 - DNA, 25 bp, Homo sapien
aaacgccggcgccttgttcagggct

SEQ ID NO: 80697 - DNA, 25 bp, Homo sapien
aggaaatctcgctcttccgaaagtc

SEQ ID NO: 80698 - DNA, 25 bp, Homo sapien
caggatcgttctggcttccgtacaa

SEQ ID NO: 80699 - DNA, 25 bp, Homo sapien
cttccgtacaatcctgcagagagca

SEQ ID NO: 80700 - DNA, 25 bp, Homo sapien
gcagagctggcgcacagaacacccg

SEQ ID NO: 80701 - DNA, 25 bp, Homo sapien
tccgagtttggtgttttgcagcgaa

SEQ ID NO: 80702 - DNA, 25 bp, Homo sapien
atccggaccatcatcggcggtgagc

SEQ ID NO: 80703 - DNA, 25 bp, Homo sapien
ctgggccacatcgacagcggcaaga

SEQ ID NO: 80704 - DNA, 25 bp, Homo sapien
gccgcctttgacaagcagccgcaga

SEQ ID NO: 80705 - DNA, 25 bp, Homo sapien
gcatcacgctcgatctgggcttctc

SEQ ID NO: 80706 - DNA, 25 bp, Homo sapien
cactgcttcaggtcacgctggtcga

SEQ ID NO: 80707 - DNA, 25 bp, Homo sapien
tgtccgaattcgctcgagcctttgc

SEQ ID NO: 80708 - DNA, 25 bp, Homo sapien
acgtgacttgcctagggctccgcag

SEQ ID NO: 80709 - DNA, 25 bp, Homo sapien
tctttgcccgagttccaggcagcgc

SEQ ID NO: 80710 - DNA, 25 bp, Homo sapien
tgcaggaccaaggtgcgccaaccag

SEQ ID NO: 80711 - DNA, 25 bp, Homo sapien
caccacgcccgagaggcttcgcagc

SEQ ID NO: 80712 - DNA, 25 bp, Homo sapien
agagcggatgtgctgaaaatgccca

SEQ ID NO: 80713 - DNA, 25 bp, Homo sapien
ctacacttgggaagagcggatgtgc

SEQ ID NO: 80714 - DNA, 25 bp, Homo sapien
agcagccacgctacacttgggaaga

SEQ ID NO: 80715 - DNA, 25 bp, Homo sapien
tgtgtaacactcagcagccacgcta

SEQ ID NO: 80716 - DNA, 25 bp, Homo sapien
ggaggcgctacattgtgtaacactc

SEQ ID NO: 80717 - DNA, 25 bp, Homo sapien
gctgaaaatgcccagtgcaggacca

SEQ ID NO: 80718 - DNA, 25 bp, Homo sapien
ttgctaatttcctgagctgccctcc

SEQ ID NO: 80719 - DNA, 25 bp, Homo sapien
ccggtgtcattgtttgctaatttcc

SEQ ID NO: 80720 - DNA, 25 bp, Homo sapien
agggtccacgctcggcctgatggcc

SEQ ID NO: 80721 - DNA, 25 bp, Homo sapien
gctgccctccgacttgtttacgtta

SEQ ID NO: 80722 - DNA, 25 bp, Homo sapien
ttgaagctctgggatttcctgcttc

SEQ ID NO: 80723 - DNA, 25 bp, Homo sapien
ctcggctcaccagtttgaagctctg

SEQ ID NO: 80724 - DNA, 25 bp, Homo sapien
cgcttacctcggctcaccagtttga

SEQ ID NO: 80725 - DNA, 25 bp, Homo sapien
tcctgcttcttttcctctcggagaa

SEQ ID NO: 80726 - DNA, 25 bp, Homo sapien
tgctactgcgtctggaggattgata

SEQ ID NO: 80727 - DNA, 25 bp, Homo sapien
gcccttgtccgatggtttgcaactc

SEQ ID NO: 80728 - DNA, 25 bp, Homo sapien
tcttcccagtgcgaactctgctgtg

SEQ ID NO: 80729 - DNA, 25 bp, Homo sapien
gccgctttcctcgtccttgtaaatg

SEQ ID NO: 80730 - DNA, 25 bp, Homo sapien
gcgactccgactcggccctgtaagg

SEQ ID NO: 80731 - DNA, 25 bp, Homo sapien
ggccaagaagtcgttcctgcagagc

SEQ ID NO: 80732 - DNA, 25 bp, Homo sapien
atctgctccagttaccaggcggtga

SEQ ID NO: 80733 - DNA, 25 bp, Homo sapien
agccggtgaccttcgacgagatcca

SEQ ID NO: 80734 - DNA, 25 bp, Homo sapien
cggactgtctgggacgcacgaccta

SEQ ID NO: 80735 - DNA, 25 bp, Homo sapien
agcccgaatgtggtctcaggactgc

SEQ ID NO: 80736 - DNA, 25 bp, Homo sapien
tggtctcaggactgcggcaaacacc

SEQ ID NO: 80737 - DNA, 25 bp, Homo sapien
aacacctgtcggactgtctgggacg

SEQ ID NO: 80738 - DNA, 25 bp, Homo sapien
gacgcacgacctagggacacggacc

SEQ ID NO: 80739 - DNA, 25 bp, Homo sapien
tagggacacggacccagtgcacggt

SEQ ID NO: 80740 - DNA, 25 bp, Homo sapien
ttagcgagggatcctgggcccaccc

SEQ ID NO: 80741 - DNA, 25 bp, Homo sapien
tgcggcaaacacctgtcggactgtc

SEQ ID NO: 80742 - DNA, 25 bp, Homo sapien
gccacctgcggggtcggtcagatcc

SEQ ID NO: 80743 - DNA, 25 bp, Homo sapien
ggtcggtcagatccgggcctttgtc

SEQ ID NO: 80744 - DNA, 25 bp, Homo sapien
cgagcaaacacagctgagcgcccgg

SEQ ID NO: 80745 - DNA, 25 bp, Homo sapien
ggcgcgcctttgtcatgcagatggc

SEQ ID NO: 80746 - DNA, 25 bp, Homo sapien
ctttgtcatgcagatggcccgctgg

SEQ ID NO: 80747 - DNA, 25 bp, Homo sapien
gggacaactccgctcccacatcatg

SEQ ID NO: 80748 - DNA, 25 bp, Homo sapien
cacatcatgccgaggctcccgtgaa

SEQ ID NO: 80749 - DNA, 25 bp, Homo sapien
aggctcccgtgaagaccgcgtcgtc

SEQ ID NO: 80750 - DNA, 25 bp, Homo sapien
gcatggtgttcagcggaccgctttt

SEQ ID NO: 80751 - DNA, 25 bp, Homo sapien
acagggcaaacggaccaagcgattc

SEQ ID NO: 80752 - DNA, 25 bp, Homo sapien
tggcggcaggcaatagacagacttg

SEQ ID NO: 80753 - DNA, 25 bp, Homo sapien
taaccagggtttccggtctctggca

SEQ ID NO: 80754 - DNA, 25 bp, Homo sapien
tgctgtgcccaggtaaccaaatact

SEQ ID NO: 80755 - DNA, 25 bp, Homo sapien
cctgtggctccgagaaatgggaaga

SEQ ID NO: 80756 - DNA, 25 bp, Homo sapien
cgagctgggttaagccgcgaaaagc

SEQ ID NO: 80757 - DNA, 25 bp, Homo sapien
acgcggctttttatttcgacatcac

SEQ ID NO: 80758 - DNA, 25 bp, Homo sapien
tgtggcacttgatcccagcgacacg

SEQ ID NO: 80759 - DNA, 25 bp, Homo sapien
cagctcgattcctgcggatcctaca

SEQ ID NO: 80760 - DNA, 25 bp, Homo sapien
cccgcccggtagacaaacacatgaa

SEQ ID NO: 80761 - DNA, 25 bp, Homo sapien
gggttctcatcaccacgggcccagt

SEQ ID NO: 80762 - DNA, 25 bp, Homo sapien
ggggttcagccacgcacactcacgt

SEQ ID NO: 80763 - DNA, 25 bp, Homo sapien
ccctgcgagtcgaggtgattgaaga

SEQ ID NO: 80764 - DNA, 25 bp, Homo sapien
gcggcacaatcaggacctctcaaca

SEQ ID NO: 80765 - DNA, 25 bp, Homo sapien
ttggcgccagatacacatactgatc

SEQ ID NO: 80766 - DNA, 25 bp, Homo sapien
tggggttgccttcctcgacaacgca

SEQ ID NO: 80767 - DNA, 25 bp, Homo sapien
gcctatttggcgtctccggagacta

SEQ ID NO: 80768 - DNA, 25 bp, Homo sapien
ctgctcggaactccactctgcggga

SEQ ID NO: 80769 - DNA, 25 bp, Homo sapien
tcgtaaaatgagatcgccgcggagc

SEQ ID NO: 80770 - DNA, 25 bp, Homo sapien
tccggagactagcaagaccctctga

SEQ ID NO: 80771 - DNA, 25 bp, Homo sapien
tccctcgggaaagcaggtaattcgc

SEQ ID NO: 80772 - DNA, 25 bp, Homo sapien
gcagctcagaaaatcgccgcacaga

SEQ ID NO: 80773 - DNA, 25 bp, Homo sapien
tattcccagtttcagcgcagcgagc

SEQ ID NO: 80774 - DNA, 25 bp, Homo sapien
agtgcccaccctacgttgtgtttcg

SEQ ID NO: 80775 - DNA, 25 bp, Homo sapien
tgggctaacgccgatgcaactgtgc

SEQ ID NO: 80776 - DNA, 25 bp, Homo sapien
cgcccgccatcgaatgcatcattta

SEQ ID NO: 80777 - DNA, 25 bp, Homo sapien
gctgtgtcacgggagactttcttga

SEQ ID NO: 80778 - DNA, 25 bp, Homo sapien
tttcggggcacacaagctacctgtg

SEQ ID NO: 80779 - DNA, 25 bp, Homo sapien
ctaccgggatgagcatgcaagtgtc

SEQ ID NO: 80780 - DNA, 25 bp, Homo sapien
tgcgggtgtgtcaaacaagtgtacc

SEQ ID NO: 80781 - DNA, 25 bp, Homo sapien
agcatcctgcgagtgcctcactgtg

SEQ ID NO: 80782 - DNA, 25 bp, Homo sapien
tgacctgagcatccacgcagctgtg

SEQ ID NO: 80783 - DNA, 25 bp, Homo sapien
gaacgataccctgccggctgcgtgt

SEQ ID NO: 80784 - DNA, 25 bp, Homo sapien
attcaggatgctttccgcgcagagc

SEQ ID NO: 80785 - DNA, 25 bp, Homo sapien
gaaagagcctcatctacgcacgaga

SEQ ID NO: 80786 - DNA, 25 bp, Homo sapien
aggaagccttcgctcctgtaacagg

SEQ ID NO: 80787 - DNA, 25 bp, Homo sapien
tgcatcgccttacccggccggaatt

SEQ ID NO: 80788 - DNA, 25 bp, Homo sapien
ctgctagagccatcggacctgtgag

SEQ ID NO: 80789 - DNA, 25 bp, Homo sapien
actgggtttcttgccatcctcagcg

SEQ ID NO: 80790 - DNA, 25 bp, Homo sapien
cggtgactttgttcagggccgagaa

SEQ ID NO: 80791 - DNA, 25 bp, Homo sapien
cagagaccgagatacgcggggtaac

SEQ ID NO: 80792 - DNA, 25 bp, Homo sapien
ggagccggtcatcaggcgccaagcc

SEQ ID NO: 80793 - DNA, 25 bp, Homo sapien
ccttcccgaggctgagtttcctgaa

SEQ ID NO: 80794 - DNA, 25 bp, Homo sapien
tttcctgaacgggaagctgccggcc

SEQ ID NO: 80795 - DNA, 25 bp, Homo sapien
ctggcgttcatcgagcctctcagca

SEQ ID NO: 80796 - DNA, 25 bp, Homo sapien
gggagaatcccacgccacagccgag

SEQ ID NO: 80797 - DNA, 25 bp, Homo sapien
cagggtgacacacagcccagtagtg

SEQ ID NO: 80798 - DNA, 25 bp, Homo sapien
agacccagtcctagtccggccagag

SEQ ID NO: 80799 - DNA, 25 bp, Homo sapien
tgatttcggccaagctttctgactg

SEQ ID NO: 80800 - DNA, 25 bp, Homo sapien
cgggcccagcgagttatcttgattt

SEQ ID NO: 80801 - DNA, 25 bp, Homo sapien
gccgcagtgttacgaagggacacca

SEQ ID NO: 80802 - DNA, 25 bp, Homo sapien
gtctgcgcctgcgatttcgcccata

SEQ ID NO: 80803 - DNA, 25 bp, Homo sapien
atgcgcgacttttctagcccgagcc

SEQ ID NO: 80804 - DNA, 25 bp, Homo sapien
gcgccacagccggagaattggcttt

SEQ ID NO: 80805 - DNA, 25 bp, Homo sapien
ggcacaccactgtgaacactgatta

SEQ ID NO: 80806 - DNA, 25 bp, Homo sapien
ccgccactgagcagccgttcattgg

SEQ ID NO: 80807 - DNA, 25 bp, Homo sapien
gcgccgaacaaggaaggaccctgtc

SEQ ID NO: 80808 - DNA, 25 bp, Homo sapien
cgtcgggccgtgagaaatgaagtct

SEQ ID NO: 80809 - DNA, 25 bp, Homo sapien
gctgcttaggtccactgtgcgcttc

SEQ ID NO: 80810 - DNA, 25 bp, Homo sapien
tgtgcgcttcacgtcctcattgatc

SEQ ID NO: 80811 - DNA, 25 bp, Homo sapien
tcggccgtcaccttagccaggtggc

SEQ ID NO: 80812 - DNA, 25 bp, Homo sapien
ctccatgaccgggaagagcagtgcg

SEQ ID NO: 80813 - DNA, 25 bp, Homo sapien
tcctcattgatcagcggcggtgcct

SEQ ID NO: 80814 - DNA, 25 bp, Homo sapien
tatgcgacgacaggatgactgcttc

SEQ ID NO: 80815 - DNA, 25 bp, Homo sapien
ttgcaacttcgcgacactccactgg

SEQ ID NO: 80816 - DNA, 25 bp, Homo sapien
tcttgtaaaagatggccgctgcgga

SEQ ID NO: 80817 - DNA, 25 bp, Homo sapien
ccatatggctcactgcgcaagctca

SEQ ID NO: 80818 - DNA, 25 bp, Homo sapien
cttcaccaaacacggagaggctttc

SEQ ID NO: 80819 - DNA, 25 bp, Homo sapien
ccttgtcacgtcagccgaacggcta

SEQ ID NO: 80820 - DNA, 25 bp, Homo sapien
ccgaatgccggataggtcaaagaca

SEQ ID NO: 80821 - DNA, 25 bp, Homo sapien
gcggttgcagcgaaggtttcttgta

SEQ ID NO: 80822 - DNA, 25 bp, Homo sapien
ttgaagttgagtaaagggacgccga

SEQ ID NO: 80823 - DNA, 25 bp, Homo sapien
cccggtgcggaaccaattgtgacga

SEQ ID NO: 80824 - DNA, 25 bp, Homo sapien
caattgtgacgacggctaggttacc

SEQ ID NO: 80825 - DNA, 25 bp, Homo sapien
ggcgctacaaaggtgccacaccgga

SEQ ID NO: 80826 - DNA, 25 bp, Homo sapien
gccaccatgagcaccaagcagatca

SEQ ID NO: 80827 - DNA, 25 bp, Homo sapien
agatcacttgcaggtcagtgcgctg

SEQ ID NO: 80828 - DNA, 25 bp, Homo sapien
ctcggaaagttactcggctgttcgc

SEQ ID NO: 80829 - DNA, 25 bp, Homo sapien
ctctggggcttacgctttaactgga

SEQ ID NO: 80830 - DNA, 25 bp, Homo sapien
tccgccaagtaggtgggatccacta

SEQ ID NO: 80831 - DNA, 25 bp, Homo sapien
aaaacctacacgtgatgggcgccca

SEQ ID NO: 80832 - DNA, 25 bp, Homo sapien
caaggcctcatcgagtgcgggtatc

SEQ ID NO: 80833 - DNA, 25 bp, Homo sapien
ccacttgcgggattccaaggcctca

SEQ ID NO: 80834 - DNA, 25 bp, Homo sapien
ctccgccctgtagaaggccgtttcg

SEQ ID NO: 80835 - DNA, 25 bp, Homo sapien
aaacctggagccgtctctcgcgaga

SEQ ID NO: 80836 - DNA, 25 bp, Homo sapien
atctcgaatcccttggcgccgatca

SEQ ID NO: 80837 - DNA, 25 bp, Homo sapien
cgtgtgccacccttaaagcgtagtc

SEQ ID NO: 80838 - DNA, 25 bp, Homo sapien
gcgggcctggagtcttggccataaa

SEQ ID NO: 80839 - DNA, 25 bp, Homo sapien
cagccggaacgtgacgcaaggttga

SEQ ID NO: 80840 - DNA, 25 bp, Homo sapien
tcgagcgtctcgtgacaggtacttc

SEQ ID NO: 80841 - DNA, 25 bp, Homo sapien
agacccgagagggttccttgacttg

SEQ ID NO: 80842 - DNA, 25 bp, Homo sapien
tctcgcttctgtcctccgtttagtc

SEQ ID NO: 80843 - DNA, 25 bp, Homo sapien
ccgtctcggacgctctgtttactgt

SEQ ID NO: 80844 - DNA, 25 bp, Homo sapien
ctgtttactgttggcctggatctca

SEQ ID NO: 80845 - DNA, 25 bp, Homo sapien
tggaaccagaacttggaccttctcg

SEQ ID NO: 80846 - DNA, 25 bp, Homo sapien
ccttgggatggtccgagggtgcagt

SEQ ID NO: 80847 - DNA, 25 bp, Homo sapien
ttgtcatggcagcaactaaggagag

SEQ ID NO: 80848 - DNA, 25 bp, Homo sapien
gttgtcatggcagcaactaaggaga

SEQ ID NO: 80849 - DNA, 25 bp, Homo sapien
cagttgtcatggcagcaactaagga

SEQ ID NO: 80850 - DNA, 25 bp, Homo sapien
cgcagttgtcatggcagcaactaag

SEQ ID NO: 80851 - DNA, 25 bp, Homo sapien
gacgcagttgtcatggcagcaacta

SEQ ID NO: 80852 - DNA, 25 bp, Homo sapien
tggacgcagttgtcatggcagcaac

SEQ ID NO: 80853 - DNA, 25 bp, Homo sapien
gtggacgcagttgtcatggcagcaa

SEQ ID NO: 80854 - DNA, 25 bp, Homo sapien
aggccaaggccaagggccctctggc

SEQ ID NO: 80855 - DNA, 25 bp, Homo sapien
tgcccaacagccaactgcccgccct

SEQ ID NO: 80856 - DNA, 25 bp, Homo sapien
caactgcccgccctcaaccgccaaa

SEQ ID NO: 80857 - DNA, 25 bp, Homo sapien
aggccaagggccctctggcgctgct

SEQ ID NO: 80858 - DNA, 25 bp, Homo sapien
ggaggtctcacccaagccctatcag

SEQ ID NO: 80859 - DNA, 25 bp, Homo sapien
aagccctatcagctgggtccctacg

SEQ ID NO: 80860 - DNA, 25 bp, Homo sapien
ctatcagctgggtccctacgggcct

SEQ ID NO: 80861 - DNA, 25 bp, Homo sapien
ccgctcagcgcctccggaggtctca

SEQ ID NO: 80862 - DNA, 25 bp, Homo sapien
ccagagattatacccgccgagatgc

SEQ ID NO: 80863 - DNA, 25 bp, Homo sapien
ccaggtgcacgtgactaaggccttg

SEQ ID NO: 80864 - DNA, 25 bp, Homo sapien
cagtgagtactgcacgttgtcgcgg

SEQ ID NO: 80865 - DNA, 25 bp, Homo sapien
gtcatcagacgtgtgtgtgtccctg

SEQ ID NO: 80866 - DNA, 25 bp, Homo sapien
ggtctctaccgcgaaccggcggcta

SEQ ID NO: 80867 - DNA, 25 bp, Homo sapien
cgcctgtacgagctttcgccaaaga

SEQ ID NO: 80868 - DNA, 25 bp, Homo sapien
cgccaaagagcttttcctaggcaaa

SEQ ID NO: 80869 - DNA, 25 bp, Homo sapien
cgtcacgacggccagagattatacc

SEQ ID NO: 80870 - DNA, 25 bp, Homo sapien
cagtcgccgggcttctggaatgcct

SEQ ID NO: 80871 - DNA, 25 bp, Homo sapien
actcagctacgtttggcggttgcta

SEQ ID NO: 80872 - DNA, 25 bp, Homo sapien
gggcgaagagactccaagactgaga

SEQ ID NO: 80873 - DNA, 25 bp, Homo sapien
gcctgctgcgcctaagcacaagatg

SEQ ID NO: 80874 - DNA, 25 bp, Homo sapien
ttcgcctaaccaggagtcagtcgcc

SEQ ID NO: 80875 - DNA, 25 bp, Homo sapien
gcacaagatgcgtttgctatttggg

SEQ ID NO: 80876 - DNA, 25 bp, Homo sapien
cagaacatgaatgtgcactgggtgc

SEQ ID NO: 80877 - DNA, 25 bp, Homo sapien
aaacgccgaagagggaacacgcatc

SEQ ID NO: 80878 - DNA, 25 bp, Homo sapien
tcagataccgatgaagaggcgcgcc

SEQ ID NO: 80879 - DNA, 25 bp, Homo sapien
ctggggtaaaccagacgcactgtga

SEQ ID NO: 80880 - DNA, 25 bp, Homo sapien
ggcgctctcagcgagcacatcgaga

SEQ ID NO: 80881 - DNA, 25 bp, Homo sapien
ccacggacggggactcagataccga

SEQ ID NO: 80882 - DNA, 25 bp, Homo sapien
caggtgacgggaactccagagatgt

SEQ ID NO: 80883 - DNA, 25 bp, Homo sapien
aggaggtcttccaccacctggactg

SEQ ID NO: 80884 - DNA, 25 bp, Homo sapien
cctggaccagtacctgcaggaggtc

SEQ ID NO: 80885 - DNA, 25 bp, Homo sapien
ctcctttcgagaaactctggggccg

SEQ ID NO: 80886 - DNA, 25 bp, Homo sapien
tttcccaaacttcgggtgtgcaatc

SEQ ID NO: 80887 - DNA, 25 bp, Homo sapien
gcagacggcgcaagaaacgtgctca

SEQ ID NO: 80888 - DNA, 25 bp, Homo sapien
cggcaggctgaacgccgccaataca

SEQ ID NO: 80889 - DNA, 25 bp, Homo sapien
tacagtaggccgagaagagtcgcga

SEQ ID NO: 80890 - DNA, 25 bp, Homo sapien
cgtcgtgtctcagtttccttcagtg

SEQ ID NO: 80891 - DNA, 25 bp, Homo sapien
ttaaaggagcttggacgcaccggac

SEQ ID NO: 80892 - DNA, 25 bp, Homo sapien
ctcaagcgcttctgggtgcagaggc

SEQ ID NO: 80893 - DNA, 25 bp, Homo sapien
acgcgctctcgtgttccgcagtttc

SEQ ID NO: 80894 - DNA, 25 bp, Homo sapien
ctcaggcagtcagcgaaacgccgga

SEQ ID NO: 80895 - DNA, 25 bp, Homo sapien
gacgctccttgtgtttcattggcta

SEQ ID NO: 80896 - DNA, 25 bp, Homo sapien
gtgtttcattggctacccgtgcagc

SEQ ID NO: 80897 - DNA, 25 bp, Homo sapien
gcttcgtcggtcatcatgctccgcg

SEQ ID NO: 80898 - DNA, 25 bp, Homo sapien
agacgcctgcagacgctccttgtgt

SEQ ID NO: 80899 - DNA, 25 bp, Homo sapien
aaacgccggaaacgcctgcagacgc

SEQ ID NO: 80900 - DNA, 25 bp, Homo sapien
agaggcacaacttcccgcttcgtcg

SEQ ID NO: 80901 - DNA, 25 bp, Homo sapien
tccaagtgccaagtccacctgacgg

SEQ ID NO: 80902 - DNA, 25 bp, Homo sapien
caccgggttcacaacctgctaaggc

SEQ ID NO: 80903 - DNA, 25 bp, Homo sapien
cttctccggcatactcgctctgggt

SEQ ID NO: 80904 - DNA, 25 bp, Homo sapien
acctctgggactggcatccgttcag

SEQ ID NO: 80905 - DNA, 25 bp, Homo sapien
cggcggacaagagaagtggctcctc

SEQ ID NO: 80906 - DNA, 25 bp, Homo sapien
tcgcagtgcgacttccagagaaccg

SEQ ID NO: 80907 - DNA, 25 bp, Homo sapien
actgagaggcagctcctagtcctgg

SEQ ID NO: 80908 - DNA, 25 bp, Homo sapien
cgacttgaaccaactgcggcggacc

SEQ ID NO: 80909 - DNA, 25 bp, Homo sapien
atcatgaggtcctgctcgggcatca

SEQ ID NO: 80910 - DNA, 25 bp, Homo sapien
gctttgaggacttgaacccggccca

SEQ ID NO: 80911 - DNA, 25 bp, Homo sapien
cttcatggtgaagtcgacgccgatg

SEQ ID NO: 80912 - DNA, 25 bp, Homo sapien
aagtcgacgccgatggtgcttccct

SEQ ID NO: 80913 - DNA, 25 bp, Homo sapien
ttgaagcgctgcaccacgcacgtct

SEQ ID NO: 80914 - DNA, 25 bp, Homo sapien
ccagcaccagcttgaacaggaaatc

SEQ ID NO: 80915 - DNA, 25 bp, Homo sapien
gaaatcgtactgctcgtccgggtcc

SEQ ID NO: 80916 - DNA, 25 bp, Homo sapien
cctgccatggcctagaagaagccga

SEQ ID NO: 80917 - DNA, 25 bp, Homo sapien
ccaaaggaaacttcagatggacgcg

SEQ ID NO: 80918 - DNA, 25 bp, Homo sapien
gccagccacagggatctgattcctc

SEQ ID NO: 80919 - DNA, 25 bp, Homo sapien
gcatcccttgcggtgccagaagccg

SEQ ID NO: 80920 - DNA, 25 bp, Homo sapien
tgcctgggaaaacactgcagcggtg

SEQ ID NO: 80921 - DNA, 25 bp, Homo sapien
cggcatgagccggtgaccaagctcg

SEQ ID NO: 80922 - DNA, 25 bp, Homo sapien
gctgtgacaatgactgcccgctttt

SEQ ID NO: 80923 - DNA, 25 bp, Homo sapien
gcccgcttttggagcgctccgattt

SEQ ID NO: 80924 - DNA, 25 bp, Homo sapien
tggcgattcggaccgatccgacctg

SEQ ID NO: 80925 - DNA, 25 bp, Homo sapien
cgcgctttcagcatcttggtaccca

SEQ ID NO: 80926 - DNA, 25 bp, Homo sapien
gttaggcgacgctgacttgctttca

SEQ ID NO: 80927 - DNA, 25 bp, Homo sapien
caagcgcccgcgattaagactctcg

SEQ ID NO: 80928 - DNA, 25 bp, Homo sapien
ctactggcagtcgacttctaacttg

SEQ ID NO: 80929 - DNA, 25 bp, Homo sapien
ttctaacttggctcgggcatccatc

SEQ ID NO: 80930 - DNA, 25 bp, Homo sapien
gtggccgccatttcgaagctgaaga

SEQ ID NO: 80931 - DNA, 25 bp, Homo sapien
ttcggggcccaaaaaaggcagcaga

SEQ ID NO: 80932 - DNA, 25 bp, Homo sapien
ttgctttcaggagaggcactcggta

SEQ ID NO: 80933 - DNA, 25 bp, Homo sapien
ggcatccatcgctctggcctgaact

SEQ ID NO: 80934 - DNA, 25 bp, Homo sapien
gagagaaaattctggcgctccgtca

SEQ ID NO: 80935 - DNA, 25 bp, Homo sapien
agacgccgacgctcacaggaactga

SEQ ID NO: 80936 - DNA, 25 bp, Homo sapien
cagacactgatgttttgccggaaac

SEQ ID NO: 80937 - DNA, 25 bp, Homo sapien
agcggacgctcacagaaactgaaga

SEQ ID NO: 80938 - DNA, 25 bp, Homo sapien
actgcccacagagcctgatgttttg

SEQ ID NO: 80939 - DNA, 25 bp, Homo sapien
cggcgggtcttagttctggaaacag

SEQ ID NO: 80940 - DNA, 25 bp, Homo sapien
gttcactattggtactgcgggagca

SEQ ID NO: 80941 - DNA, 25 bp, Homo sapien
acgctcgcaggaactgaggattcta

SEQ ID NO: 80942 - DNA, 25 bp, Homo sapien
gctcgcaaggtagaggctgtttatt

SEQ ID NO: 80943 - DNA, 25 bp, Homo sapien
ccagcacatggcctgcacgactata

SEQ ID NO: 80944 - DNA, 25 bp, Homo sapien
ttctcggttcattcccagctgggtc

SEQ ID NO: 80945 - DNA, 25 bp, Homo sapien
tgtttctgcgcgcagcgtcttttcc

SEQ ID NO: 80946 - DNA, 25 bp, Homo sapien
gctgtttattttgagggtccttgcc

SEQ ID NO: 80947 - DNA, 25 bp, Homo sapien
cggcgacccagctttccaggacgaa

SEQ ID NO: 80948 - DNA, 25 bp, Homo sapien
ttccagtgagttcccgccaaatcca

SEQ ID NO: 80949 - DNA, 25 bp, Homo sapien
attccgcgaccctcgaagcgtcagg

SEQ ID NO: 80950 - DNA, 25 bp, Homo sapien
cggaagtggtccctgtagaaccact

SEQ ID NO: 80951 - DNA, 25 bp, Homo sapien
agcattgcgttgctgcattgcgccc

SEQ ID NO: 80952 - DNA, 25 bp, Homo sapien
ccgtcgagcattgcgttgctgcatt

SEQ ID NO: 80953 - DNA, 25 bp, Homo sapien
accactgtggcaccgctactccgtg

SEQ ID NO: 80954 - DNA, 25 bp, Homo sapien
ttagacgaggctgtggctaccggaa

SEQ ID NO: 80955 - DNA, 25 bp, Homo sapien
ggttaacattagacgaggctgtggc

SEQ ID NO: 80956 - DNA, 25 bp, Homo sapien
tgccgcgcccgtcgagcattgcgtt

SEQ ID NO: 80957 - DNA, 25 bp, Homo sapien
ctccggcggagctaaggttaacatt

SEQ ID NO: 80958 - DNA, 25 bp, Homo sapien
gccagccctgaaacacgctgggggc

SEQ ID NO: 80959 - DNA, 25 bp, Homo sapien
cgccagggaacggccaatatggagg

SEQ ID NO: 80960 - DNA, 25 bp, Homo sapien
agcgcggcgggaaccttccctgcca

SEQ ID NO: 80961 - DNA, 25 bp, Homo sapien
accccgccagggaacggccaatatg

SEQ ID NO: 80962 - DNA, 25 bp, Homo sapien
cccgccagggaacggccaatatgga

SEQ ID NO: 80963 - DNA, 25 bp, Homo sapien
ccagccctgaaacacgctgggggcg

SEQ ID NO: 80964 - DNA, 25 bp, Homo sapien
ccgccagggaacggccaatatggag

SEQ ID NO: 80965 - DNA, 25 bp, Homo sapien
gccagggaacggccaatatggagga

SEQ ID NO: 80966 - DNA, 25 bp, Homo sapien
agtcccgagaagcttgggatcgata

SEQ ID NO: 80967 - DNA, 25 bp, Homo sapien
cccgagaagcttgggatcgatatgt

SEQ ID NO: 80968 - DNA, 25 bp, Homo sapien
agaagcttgggatcgatatgtctcc

SEQ ID NO: 80969 - DNA, 25 bp, Homo sapien
gatatgtctcccaaggcagtcactg

SEQ ID NO: 80970 - DNA, 25 bp, Homo sapien
tgtctcccaaggcagtcactgtctc

SEQ ID NO: 80971 - DNA, 25 bp, Homo sapien
tcatcccaaaccggaggggagaaga

SEQ ID NO: 80972 - DNA, 25 bp, Homo sapien
aggaaagtggagtcccgagaagctt

SEQ ID NO: 80973 - DNA, 25 bp, Homo sapien
gatcgatatgtctcccaaggcagtc

SEQ ID NO: 80974 - DNA, 25 bp, Homo sapien
caccaagtcacccggaggaggcgac

SEQ ID NO: 80975 - DNA, 25 bp, Homo sapien
gccgccctcgaggtgaccggttgct

SEQ ID NO: 80976 - DNA, 25 bp, Homo sapien
ccctcgaggtgaccggttgctggcc

SEQ ID NO: 80977 - DNA, 25 bp, Homo sapien
cttgccctgcttcgctggactgtga

SEQ ID NO: 80978 - DNA, 25 bp, Homo sapien
gcttcgctggactgtgaagccccct

SEQ ID NO: 80979 - DNA, 25 bp, Homo sapien
gggcaccaagtcacccggaggaggc

SEQ ID NO: 80980 - DNA, 25 bp, Homo sapien
agctagctgcgcttgccctgcttcg

SEQ ID NO: 80981 - DNA, 25 bp, Homo sapien
tgcgcttgccctgcttcgctggact

SEQ ID NO: 80982 - DNA, 25 bp, Homo sapien
ctggtcgaaccacggaaccttcttg

SEQ ID NO: 80983 - DNA, 25 bp, Homo sapien
ccgagccggagcgaagagaaatccc

SEQ ID NO: 80984 - DNA, 25 bp, Homo sapien
cctcggtgtagatcttggccagcga

SEQ ID NO: 80985 - DNA, 25 bp, Homo sapien
cgccctccagcttcttgcggttgag

SEQ ID NO: 80986 - DNA, 25 bp, Homo sapien
tacttgaggtaggtgcgcccattct

SEQ ID NO: 80987 - DNA, 25 bp, Homo sapien
accagcgccttgatcgagtacttga

SEQ ID NO: 80988 - DNA, 25 bp, Homo sapien
ggtgcccttcacctgcagaagcgtg

SEQ ID NO: 80989 - DNA, 25 bp, Homo sapien
cctcttcttagatggggacaacgcc

SEQ ID NO: 80990 - DNA, 25 bp, Homo sapien
tgatcctgggacagccgcagtcctg

SEQ ID NO: 80991 - DNA, 25 bp, Homo sapien
accctgactcgagacattgggatgc

SEQ ID NO: 80992 - DNA, 25 bp, Homo sapien
gctgaccctgactcgagacattggg

SEQ ID NO: 80993 - DNA, 25 bp, Homo sapien
tggcaccttacccttgcaccctgtc

SEQ ID NO: 80994 - DNA, 25 bp, Homo sapien
ctcaggggagtgacctcgctgcttg

SEQ ID NO: 80995 - DNA, 25 bp, Homo sapien
ttggctgtgatcctgggacagccgc

SEQ ID NO: 80996 - DNA, 25 bp, Homo sapien
cagccgcactgggttggctgtgatc

SEQ ID NO: 80997 - DNA, 25 bp, Homo sapien
caggctgggtctctttgcccaggtt

SEQ ID NO: 80998 - DNA, 25 bp, Homo sapien
gctcagactgcagaagcaacctgtt

SEQ ID NO: 80999 - DNA, 25 bp, Homo sapien
gccaattggctgagcgctgtcacgt

SEQ ID NO: 81000 - DNA, 25 bp, Homo sapien
tgcgaaaggcgctcagctcagactg

SEQ ID NO: 81001 - DNA, 25 bp, Homo sapien
cgtaactccaagtcgtgcgaaaggc

SEQ ID NO: 81002 - DNA, 25 bp, Homo sapien
tcatagtcgtcgtccatggtcgtgg

SEQ ID NO: 81003 - DNA, 25 bp, Homo sapien
agaacagactgtggtacgcttcata

SEQ ID NO: 81004 - DNA, 25 bp, Homo sapien
taccgagcagcgacaagaacagact

SEQ ID NO: 81005 - DNA, 25 bp, Homo sapien
tgtcacgtgttaagagcgagcccgc

SEQ ID NO: 81006 - DNA, 25 bp, Homo sapien
agcttaccgcgcatgtacgttgcca

SEQ ID NO: 81007 - DNA, 25 bp, Homo sapien
gcggagtaagatgtgaaacctcttc

SEQ ID NO: 81008 - DNA, 25 bp, Homo sapien
accgaggtctgaatgttgcgaaagc

SEQ ID NO: 81009 - DNA, 25 bp, Homo sapien
tccattctcgaggaagacgcaccgc

SEQ ID NO: 81010 - DNA, 25 bp, Homo sapien
cgaccaatcgctcgcgctctggttg

SEQ ID NO: 81011 - DNA, 25 bp, Homo sapien
ccgtgttgacgtggagagataaagc

SEQ ID NO: 81012 - DNA, 25 bp, Homo sapien
ggctccagtgccaccattgcttttg

SEQ ID NO: 81013 - DNA, 25 bp, Homo sapien
tttccctttcggacatgcgcgctcg

SEQ ID NO: 81014 - DNA, 25 bp, Homo sapien
cttcaccgggaaagataggtacttg

SEQ ID NO: 81015 - DNA, 25 bp, Homo sapien
ggtgacccttccaactgcctctgga

SEQ ID NO: 81016 - DNA, 25 bp, Homo sapien
tctggagtccaaatccgaaccggtc

SEQ ID NO: 81017 - DNA, 25 bp, Homo sapien
gaaagataggtacttggcagccggt

SEQ ID NO: 81018 - DNA, 25 bp, Homo sapien
gtcccgagtacaagcggcgccttca

SEQ ID NO: 81019 - DNA, 25 bp, Homo sapien
agccttgaccaagcggtcccgagta

SEQ ID NO: 81020 - DNA, 25 bp, Homo sapien
tgcccagcagccttgaccaagcggt

SEQ ID NO: 81021 - DNA, 25 bp, Homo sapien
tacaagcggcgccttcaccgggaaa

SEQ ID NO: 81022 - DNA, 25 bp, Homo sapien
cgcctcgctgttgagcgccaggtac

SEQ ID NO: 81023 - DNA, 25 bp, Homo sapien
ttgagcttgcgctcacaggccggtc

SEQ ID NO: 81024 - DNA, 25 bp, Homo sapien
cccaactggatgtaggactcggtga

SEQ ID NO: 81025 - DNA, 25 bp, Homo sapien
gaagcccagcttgtgctgctccttg

SEQ ID NO: 81026 - DNA, 25 bp, Homo sapien
tggcagaagccctggtagatggacc

SEQ ID NO: 81027 - DNA, 25 bp, Homo sapien
gatggacccgcacacgactaccagg

SEQ ID NO: 81028 - DNA, 25 bp, Homo sapien
ccagctgcaggatcttgttgtagtt

SEQ ID NO: 81029 - DNA, 25 bp, Homo sapien
cgcgcactgcaagcccaactggatg

SEQ ID NO: 81030 - DNA, 25 bp, Homo sapien
gccgccacggccaaggcgtgagcac

SEQ ID NO: 81031 - DNA, 25 bp, Homo sapien
cgggagctgctatttctgtctggtg

SEQ ID NO: 81032 - DNA, 25 bp, Homo sapien
atttctgtctggtgagcgcagcccg

SEQ ID NO: 81033 - DNA, 25 bp, Homo sapien
ccaccatgagcaccgccgccttcca

SEQ ID NO: 81034 - DNA, 25 bp, Homo sapien
ctggagaagatgacgtccagcgaca

SEQ ID NO: 81035 - DNA, 25 bp, Homo sapien
cagcgacaaggacttcaggtgcagc

SEQ ID NO: 81036 - DNA, 25 bp, Homo sapien
tctccttcccgctctgaagccgggg

SEQ ID NO: 81037 - DNA, 25 bp, Homo sapien
ccaagaccaccaagccaggcccagg

SEQ ID NO: 81038 - DNA, 25 bp, Homo sapien
agcgtcttagaagccgcagatgcca

SEQ ID NO: 81039 - DNA, 25 bp, Homo sapien
agtccgcggcaatgaatgaatgttc

SEQ ID NO: 81040 - DNA, 25 bp, Homo sapien
cgctgctccacccagaagttgcggt

SEQ ID NO: 81041 - DNA, 25 bp, Homo sapien
cttgggcccttgagcgtcttagaag

SEQ ID NO: 81042 - DNA, 25 bp, Homo sapien
agattcctgctctcgccaaattggc

SEQ ID NO: 81043 - DNA, 25 bp, Homo sapien
aggcactgaggacacaccgcgaagc

SEQ ID NO: 81044 - DNA, 25 bp, Homo sapien
gccggatagccaggtcctgtcctca

SEQ ID NO: 81045 - DNA, 25 bp, Homo sapien
acagggctacagttagtcgcccaca

SEQ ID NO: 81046 - DNA, 25 bp, Homo sapien
ccatggcgatcgagggctcctaaaa

SEQ ID NO: 81047 - DNA, 25 bp, Homo sapien
cccaggtcaaaatgacagcggaatg

SEQ ID NO: 81048 - DNA, 25 bp, Homo sapien
ttcccacgcggtctctgggctggtt

SEQ ID NO: 81049 - DNA, 25 bp, Homo sapien
ctgcaggtagtgctgagttgctcca

SEQ ID NO: 81050 - DNA, 25 bp, Homo sapien
agttgctccaggtaagctcctcctc

SEQ ID NO: 81051 - DNA, 25 bp, Homo sapien
gctcctcctctcaaaaagctctagg

SEQ ID NO: 81052 - DNA, 25 bp, Homo sapien
ccctgagtaatatggggtttcgtcg

SEQ ID NO: 81053 - DNA, 25 bp, Homo sapien
tttcgtcggatttctgcccgccgct

SEQ ID NO: 81054 - DNA, 25 bp, Homo sapien
ggcctcctgccttgcgcaagcagaa

SEQ ID NO: 81055 - DNA, 25 bp, Homo sapien
cccagttccgcgtcacattgaaggg

SEQ ID NO: 81056 - DNA, 25 bp, Homo sapien
cctggcgctgcaatctcaatggttg

SEQ ID NO: 81057 - DNA, 25 bp, Homo sapien
tcggccacggagcttggagttagaa

SEQ ID NO: 81058 - DNA, 25 bp, Homo sapien
atcttcgcgttggaatgaggacgtc

SEQ ID NO: 81059 - DNA, 25 bp, Homo sapien
tcttagcgatagaaatgggatcttc

SEQ ID NO: 81060 - DNA, 25 bp, Homo sapien
agactcctgacctgccgactgcgga

SEQ ID NO: 81061 - DNA, 25 bp, Homo sapien
gcctgagaacctgggagttcgaatc

SEQ ID NO: 81062 - DNA, 25 bp, Homo sapien
atgcagagacatgtgcgcgaggctt

SEQ ID NO: 81063 - DNA, 25 bp, Homo sapien
cgctggagaatgtgctcctggcagc

SEQ ID NO: 81064 - DNA, 25 bp, Homo sapien
gcacaagtcctcttcgccatcgtgg

SEQ ID NO: 81065 - DNA, 25 bp, Homo sapien
accacctatggcaaccggaagcaga

SEQ ID NO: 81066 - DNA, 25 bp, Homo sapien
gagggcttccacttgaccacctatg

SEQ ID NO: 81067 - DNA, 25 bp, Homo sapien
tggtgacgcacacgacacccaactt

SEQ ID NO: 81068 - DNA, 25 bp, Homo sapien
acgccgcgctagaagacctggaggt

SEQ ID NO: 81069 - DNA, 25 bp, Homo sapien
accgcgggtctttgagtctagcgga

SEQ ID NO: 81070 - DNA, 25 bp, Homo sapien
gctgcgggaatccacctgcagctgt

SEQ ID NO: 81071 - DNA, 25 bp, Homo sapien
cggcttaaaagaccctctcagggca

SEQ ID NO: 81072 - DNA, 25 bp, Homo sapien
ggagctcggtgcagcctcttctgga

SEQ ID NO: 81073 - DNA, 25 bp, Homo sapien
cgctctatccaactgcgccgcgggc

SEQ ID NO: 81074 - DNA, 25 bp, Homo sapien
gaggcgttcgctgcgggaatccacc

SEQ ID NO: 81075 - DNA, 25 bp, Homo sapien
accctctcagggcacgaggcgttcg

SEQ ID NO: 81076 - DNA, 25 bp, Homo sapien
tttactgcgctcaggagctcggtgc

SEQ ID NO: 81077 - DNA, 25 bp, Homo sapien
gtcagcgccggcttaaaagaccctc

SEQ ID NO: 81078 - DNA, 25 bp, Homo sapien
cttgcctgcgggacaccggagtcaa

SEQ ID NO: 81079 - DNA, 25 bp, Homo sapien
cacggttccgaggtctccaccgtct

SEQ ID NO: 81080 - DNA, 25 bp, Homo sapien
gtgcgcgtccagaggaaatccgccc

SEQ ID NO: 81081 - DNA, 25 bp, Homo sapien
cgcgcagtgcgcgtccagaggaaat

SEQ ID NO: 81082 - DNA, 25 bp, Homo sapien
cgccgcaggcggcaccaaactctgc

SEQ ID NO: 81083 - DNA, 25 bp, Homo sapien
aagcgtttatatgtcggcgaggggc

SEQ ID NO: 81084 - DNA, 25 bp, Homo sapien
gtgggagctgccacccgcttgcctg

SEQ ID NO: 81085 - DNA, 25 bp, Homo sapien
tgcctgtccgttccacggttccgag

SEQ ID NO: 81086 - DNA, 25 bp, Homo sapien
tgccaccaaaacaaagctgcgcgcg

SEQ ID NO: 81087 - DNA, 25 bp, Homo sapien
cgcagccgcttggaacttcgcatta

SEQ ID NO: 81088 - DNA, 25 bp, Homo sapien
atctgttttcctactgcgtgccggc

SEQ ID NO: 81089 - DNA, 25 bp, Homo sapien
gtgcgcccagctgatcttagaaacc

SEQ ID NO: 81090 - DNA, 25 bp, Homo sapien
tctcatccctggcagcagcaaaggc

SEQ ID NO: 81091 - DNA, 25 bp, Homo sapien
gttctctctggttaagcgttctctc

SEQ ID NO: 81092 - DNA, 25 bp, Homo sapien
tatcatcacatagccgggtcctcgc

SEQ ID NO: 81093 - DNA, 25 bp, Homo sapien
cgggacttcgccgagattttctgta

SEQ ID NO: 81094 - DNA, 25 bp, Homo sapien
ggcctcgtcttcctctagcgcggat

SEQ ID NO: 81095 - DNA, 25 bp, Homo sapien
aaacactacacttcagctgctgcag

SEQ ID NO: 81096 - DNA, 25 bp, Homo sapien
ggaaagcaaccggtctgacctcact

SEQ ID NO: 81097 - DNA, 25 bp, Homo sapien
gtgcagaccgccagtcccaagaaaa

SEQ ID NO: 81098 - DNA, 25 bp, Homo sapien
ctcacttcctgtcgccgagcggaag

SEQ ID NO: 81099 - DNA, 25 bp, Homo sapien
cccgggagagaagtgcagaccgcca

SEQ ID NO: 81100 - DNA, 25 bp, Homo sapien
cgtcttcctctagcgcggatcgcta

SEQ ID NO: 81101 - DNA, 25 bp, Homo sapien
gtcccaagaaaacactacacttcag

SEQ ID NO: 81102 - DNA, 25 bp, Homo sapien
gacagcggccatgactctcagcttg

SEQ ID NO: 81103 - DNA, 25 bp, Homo sapien
tcgcttcttctcacgccgggagcag

SEQ ID NO: 81104 - DNA, 25 bp, Homo sapien
gcgcgcacctctctcagcggaagta

SEQ ID NO: 81105 - DNA, 25 bp, Homo sapien
gcccgtgaacacgaatgcgcctgcg

SEQ ID NO: 81106 - DNA, 25 bp, Homo sapien
ttgcctgctgagattgtgactgcca

SEQ ID NO: 81107 - DNA, 25 bp, Homo sapien
ccagcaagaacaaggcgggccacca

SEQ ID NO: 81108 - DNA, 25 bp, Homo sapien
agagcgcttaaacgcctcggggaca

SEQ ID NO: 81109 - DNA, 25 bp, Homo sapien
ccaaacattgtccattccgggccga

SEQ ID NO: 81110 - DNA, 25 bp, Homo sapien
gaggcctgcccgattacccgcaaga

SEQ ID NO: 81111 - DNA, 25 bp, Homo sapien
ggcccagaggcgctaagtagctaaa

SEQ ID NO: 81112 - DNA, 25 bp, Homo sapien
cgtacgttccgaaatggctgctgtc

SEQ ID NO: 81113 - DNA, 25 bp, Homo sapien
ctgtcaggctaggaaagcttggccc

SEQ ID NO: 81114 - DNA, 25 bp, Homo sapien
gcctacttgggtcggcgaacacttc

SEQ ID NO: 81115 - DNA, 25 bp, Homo sapien
ggctcctgcacgtgagagtccaatc

SEQ ID NO: 81116 - DNA, 25 bp, Homo sapien
ctgggaagtacagttccgtgatgcc

SEQ ID NO: 81117 - DNA, 25 bp, Homo sapien
ctcaagagcgggaatcggaagtctc

SEQ ID NO: 81118 - DNA, 25 bp, Homo sapien
ccctggcggattcgtggactcgcaa

SEQ ID NO: 81119 - DNA, 25 bp, Homo sapien
tggactcgcaagacagcagcctgga

SEQ ID NO: 81120 - DNA, 25 bp, Homo sapien
gctactctcgggtgtccctgccaat

SEQ ID NO: 81121 - DNA, 25 bp, Homo sapien
ggcatgcctgctatgcgctcctgca

SEQ ID NO: 81122 - DNA, 25 bp, Homo sapien
ggccaggctagaggcatgcctgcta

SEQ ID NO: 81123 - DNA, 25 bp, Homo sapien
ttcggaacagcggaagagcagtgtc

SEQ ID NO: 81124 - DNA, 25 bp, Homo sapien
tgtgccctcgtaggccttcggaaca

SEQ ID NO: 81125 - DNA, 25 bp, Homo sapien
tgagattcgcccttgtgccctcgta

SEQ ID NO: 81126 - DNA, 25 bp, Homo sapien
agcgtctgacgctcgaggagctgtt

SEQ ID NO: 81127 - DNA, 25 bp, Homo sapien
cctggacttcaacccggtctgcaag

SEQ ID NO: 81128 - DNA, 25 bp, Homo sapien
atccctgcagggattgggccttgca

SEQ ID NO: 81129 - DNA, 25 bp, Homo sapien
cccattgggccttcgggacagcaga

SEQ ID NO: 81130 - DNA, 25 bp, Homo sapien
cagcagaggagcagtgtccggccat

SEQ ID NO: 81131 - DNA, 25 bp, Homo sapien
cggattcgtggacacgcaggacaga

SEQ ID NO: 81132 - DNA, 25 bp, Homo sapien
ccacttctatgccaagcgtctgacg

SEQ ID NO: 81133 - DNA, 25 bp, Homo sapien
ccagaggctgctttcggttacccta

SEQ ID NO: 81134 - DNA, 25 bp, Homo sapien
agactcgactcacgacttccgggcg

SEQ ID NO: 81135 - DNA, 25 bp, Homo sapien
cggcatggattagcccgggaagact

SEQ ID NO: 81136 - DNA, 25 bp, Homo sapien
cctgccgctctgctttcagggagtc

SEQ ID NO: 81137 - DNA, 25 bp, Homo sapien
accgccacgtggacgcagtagccgt

SEQ ID NO: 81138 - DNA, 25 bp, Homo sapien
gaagttttcgcaatggccgccggaa

SEQ ID NO: 81139 - DNA, 25 bp, Homo sapien
tctctgcgacggaaagaaagccgcc

SEQ ID NO: 81140 - DNA, 25 bp, Homo sapien
gtgcgttttacaatgaactccgggc

SEQ ID NO: 81141 - DNA, 25 bp, Homo sapien
tgaactccgggcactcgagtcgctc

SEQ ID NO: 81142 - DNA, 25 bp, Homo sapien
tgccgcagcaagcggatcagcctgg

SEQ ID NO: 81143 - DNA, 25 bp, Homo sapien
gggccggactcagcgtagagcacgc

SEQ ID NO: 81144 - DNA, 25 bp, Homo sapien
cagcaagcggatcagcctggcctcc

SEQ ID NO: 81145 - DNA, 25 bp, Homo sapien
gcagcaagcggatcagcctggcctc

SEQ ID NO: 81146 - DNA, 25 bp, Homo sapien
tcagcgtagagcacgcgcacagcct

SEQ ID NO: 81147 - DNA, 25 bp, Homo sapien
cgcagcaagcggatcagcctggcct

SEQ ID NO: 81148 - DNA, 25 bp, Homo sapien
gccgcagcaagcggatcagcctggc

SEQ ID NO: 81149 - DNA, 25 bp, Homo sapien
ctgccgcagcaagcggatcagcctg

SEQ ID NO: 81150 - DNA, 25 bp, Homo sapien
gctcaactgagctcctggggacact

SEQ ID NO: 81151 - DNA, 25 bp, Homo sapien
ggcaagagactggttccgaaacctc

SEQ ID NO: 81152 - DNA, 25 bp, Homo sapien
ttgctgacggagacgagcattgccc

SEQ ID NO: 81153 - DNA, 25 bp, Homo sapien
tgggctttctgctcagctttgtcgc

SEQ ID NO: 81154 - DNA, 25 bp, Homo sapien
tccactctagggtggagcggtcgta

SEQ ID NO: 81155 - DNA, 25 bp, Homo sapien
cctggggacacttgatttagatctc

SEQ ID NO: 81156 - DNA, 25 bp, Homo sapien
gatttagatctccaagtgcttggtc

SEQ ID NO: 81157 - DNA, 25 bp, Homo sapien
gcgcccgcagtctgggctttctgct

SEQ ID NO: 81158 - DNA, 25 bp, Homo sapien
agggcgcctcatcccactctggaag

SEQ ID NO: 81159 - DNA, 25 bp, Homo sapien
tgacgcgctgcgtggaatccaaatc

SEQ ID NO: 81160 - DNA, 25 bp, Homo sapien
tggaatccaaatcccacggccggtg

SEQ ID NO: 81161 - DNA, 25 bp, Homo sapien
ggtgtcgttactctgcgcatgtgta

SEQ ID NO: 81162 - DNA, 25 bp, Homo sapien
aatcagctgactgggtctcgtgaca

SEQ ID NO: 81163 - DNA, 25 bp, Homo sapien
cagcctcccgcgaaggtaaagccga

SEQ ID NO: 81164 - DNA, 25 bp, Homo sapien
ctggccggaggaaagcagaatttca

SEQ ID NO: 81165 - DNA, 25 bp, Homo sapien
ggggcgtgtccttttcagcacccac

SEQ ID NO: 81166 - DNA, 25 bp, Homo sapien
tctcgggacaggtagactaggacca

SEQ ID NO: 81167 - DNA, 25 bp, Homo sapien
ctgcgtcgctgagaaacgtcggatc

SEQ ID NO: 81168 - DNA, 25 bp, Homo sapien
ccgccctggactcgggcaaggaatt

SEQ ID NO: 81169 - DNA, 25 bp, Homo sapien
attcaggaggccaaagagcggaccc

SEQ ID NO: 81170 - DNA, 25 bp, Homo sapien
cttgggttgcaacagaagagggctc

SEQ ID NO: 81171 - DNA, 25 bp, Homo sapien
cggagccgccttaatcgtcgttctt

SEQ ID NO: 81172 - DNA, 25 bp, Homo sapien
cgtcgttcttttagcacatttgggg

SEQ ID NO: 81173 - DNA, 25 bp, Homo sapien
acggagaggtaacaatctgctttca

SEQ ID NO: 81174 - DNA, 25 bp, Homo sapien
gccaaatcggactcgccagtagcac

SEQ ID NO: 81175 - DNA, 25 bp, Homo sapien
cttcggccaaatcggactcgccagt

SEQ ID NO: 81176 - DNA, 25 bp, Homo sapien
tcggccaaatcggactcgccagtag

SEQ ID NO: 81177 - DNA, 25 bp, Homo sapien
ggccaaatcggactcgccagtagca

SEQ ID NO: 81178 - DNA, 25 bp, Homo sapien
ccaaatcggactcgccagtagcacc

SEQ ID NO: 81179 - DNA, 25 bp, Homo sapien
aatcggactcgccagtagcacctgg

SEQ ID NO: 81180 - DNA, 25 bp, Homo sapien
atcggactcgccagtagcacctggc

SEQ ID NO: 81181 - DNA, 25 bp, Homo sapien
cggccaaatcggactcgccagtagc

SEQ ID NO: 81182 - DNA, 25 bp, Homo sapien
tccttcaggattggggcaacgtccc

SEQ ID NO: 81183 - DNA, 25 bp, Homo sapien
ctgagcaacgcttgcccgctgaatc

SEQ ID NO: 81184 - DNA, 25 bp, Homo sapien
cgcggcatccacaggtctcgagtgc

SEQ ID NO: 81185 - DNA, 25 bp, Homo sapien
tccacaggtctcgagtgccgaagtc

SEQ ID NO: 81186 - DNA, 25 bp, Homo sapien
tctcgagtgccgaagtccttcagga

SEQ ID NO: 81187 - DNA, 25 bp, Homo sapien
ccctctagagcatgggccgaggccg

SEQ ID NO: 81188 - DNA, 25 bp, Homo sapien
agcctacgcgccgttgctgagcaac

SEQ ID NO: 81189 - DNA, 25 bp, Homo sapien
tccagccaaccgcacacagcctacg

SEQ ID NO: 81190 - DNA, 25 bp, Homo sapien
ctcagaggtggtggattcgaatccc

SEQ ID NO: 81191 - DNA, 25 bp, Homo sapien
cgaatccctacaggtaacctgcgtc

SEQ ID NO: 81192 - DNA, 25 bp, Homo sapien
tacaggtaacctgcgtcgccggtcg

SEQ ID NO: 81193 - DNA, 25 bp, Homo sapien
tcaggctccgtgaggtcagaagtga

SEQ ID NO: 81194 - DNA, 25 bp, Homo sapien
tgaggtcagaagtgaggcgcttccc

SEQ ID NO: 81195 - DNA, 25 bp, Homo sapien
agaagtgaggcgcttcccacgtccc

SEQ ID NO: 81196 - DNA, 25 bp, Homo sapien
gagtcccagccatggcggagtctgt

SEQ ID NO: 81197 - DNA, 25 bp, Homo sapien
catcgagaagatgagctcagaggtg

SEQ ID NO: 81198 - DNA, 25 bp, Homo sapien
gacggccgtgcttcccaagggtctc

SEQ ID NO: 81199 - DNA, 25 bp, Homo sapien
gccgcttgttctccgtgtccagctt

SEQ ID NO: 81200 - DNA, 25 bp, Homo sapien
ggcggcccatggacaacaactcctg

SEQ ID NO: 81201 - DNA, 25 bp, Homo sapien
caactcctggttcttgctgacgcga

SEQ ID NO: 81202 - DNA, 25 bp, Homo sapien
tgctgacgcgaaagatctcgtactc

SEQ ID NO: 81203 - DNA, 25 bp, Homo sapien
cctcggcggaacgagttgcgcagca

SEQ ID NO: 81204 - DNA, 25 bp, Homo sapien
tccgccgaactttcaaagccgcttg

SEQ ID NO: 81205 - DNA, 25 bp, Homo sapien
gcaccgacgagccagtggacttgaa

SEQ ID NO: 81206 - DNA, 25 bp, Homo sapien
cgctgaccacctactggaccggctg

SEQ ID NO: 81207 - DNA, 25 bp, Homo sapien
catccgcaccctgatccaatgtttg

SEQ ID NO: 81208 - DNA, 25 bp, Homo sapien
ctgcactgtctgctgccacagctga

SEQ ID NO: 81209 - DNA, 25 bp, Homo sapien
tgtctgctgccacagctgagcagcc

SEQ ID NO: 81210 - DNA, 25 bp, Homo sapien
acctcttcgtcgagctcgctgacca

SEQ ID NO: 81211 - DNA, 25 bp, Homo sapien
caccagcccgactgccatccgcacc

SEQ ID NO: 81212 - DNA, 25 bp, Homo sapien
cctgatccaatgtttgggcagcgtc

SEQ ID NO: 81213 - DNA, 25 bp, Homo sapien
ccgcctgcagcaccgacctcttcgt

SEQ ID NO: 81214 - DNA, 25 bp, Homo sapien
gtgcgaagagccctcctgcctaggt

SEQ ID NO: 81215 - DNA, 25 bp, Homo sapien
ctgtcacatggggaaacgaagaaga

SEQ ID NO: 81216 - DNA, 25 bp, Homo sapien
attggctggtctcaccacgtgaccg

SEQ ID NO: 81217 - DNA, 25 bp, Homo sapien
cgctgccgagggcaatttggtgatt

SEQ ID NO: 81218 - DNA, 25 bp, Homo sapien
cccgctctgctaggtagcaaccgaa

SEQ ID NO: 81219 - DNA, 25 bp, Homo sapien
gagccgaattcctagcgcagctgtg

SEQ ID NO: 81220 - DNA, 25 bp, Homo sapien
cccgagggactcgaactaatcctgc

SEQ ID NO: 81221 - DNA, 25 bp, Homo sapien
gtagtgtcactttggccagcccgag

SEQ ID NO: 81222 - DNA, 25 bp, Homo sapien
tgattggctctctttccagctccgc

SEQ ID NO: 81223 - DNA, 25 bp, Homo sapien
cttggcgatcccacagcggcaggca

SEQ ID NO: 81224 - DNA, 25 bp, Homo sapien
cgcccggcacgtcacttattttgca

SEQ ID NO: 81225 - DNA, 25 bp, Homo sapien
tcagggattgtcacctaagagcttc

SEQ ID NO: 81226 - DNA, 25 bp, Homo sapien
cggcaggcagagcaaaatacgcagg

SEQ ID NO: 81227 - DNA, 25 bp, Homo sapien
aagagcttcgtcctggcacctgatt

SEQ ID NO: 81228 - DNA, 25 bp, Homo sapien
tgctagccgagcactctcgccagaa

SEQ ID NO: 81229 - DNA, 25 bp, Homo sapien
agaacctctggctcgcgcgtgcctt

SEQ ID NO: 81230 - DNA, 25 bp, Homo sapien
ctagtctccgctgcgagtaggccca

SEQ ID NO: 81231 - DNA, 25 bp, Homo sapien
agccacgtcctctcggcgtcaaagg

SEQ ID NO: 81232 - DNA, 25 bp, Homo sapien
caaagcaaacgctggagaacccgga

SEQ ID NO: 81233 - DNA, 25 bp, Homo sapien
cttttccggtggaagtgacgccatc

SEQ ID NO: 81234 - DNA, 25 bp, Homo sapien
ggtcctgaaggccacagaaggcatc

SEQ ID NO: 81235 - DNA, 25 bp, Homo sapien
tcaaacgtggaggtgagcagtctgt

SEQ ID NO: 81236 - DNA, 25 bp, Homo sapien
ctccagggccagttaccaggacagg

SEQ ID NO: 81237 - DNA, 25 bp, Homo sapien
ctgcagcagaagagcggaaatgtca

SEQ ID NO: 81238 - DNA, 25 bp, Homo sapien
ttgtaaagcggccagactagtgcgc

SEQ ID NO: 81239 - DNA, 25 bp, Homo sapien
ggcttgcatcttgcagccctccggt

SEQ ID NO: 81240 - DNA, 25 bp, Homo sapien
atcagccctggtgggcgaacctttc

SEQ ID NO: 81241 - DNA, 25 bp, Homo sapien
ggaccctgcgcgacaaccggacagt

SEQ ID NO: 81242 - DNA, 25 bp, Homo sapien
cgcggatctctctctgggttgtaaa

SEQ ID NO: 81243 - DNA, 25 bp, Homo sapien
acctttcccaagaggcgctgcttgc

SEQ ID NO: 81244 - DNA, 25 bp, Homo sapien
gccacggagaatgaggctcgctatc

SEQ ID NO: 81245 - DNA, 25 bp, Homo sapien
gactagtgcgctccgaagctgctca

SEQ ID NO: 81246 - DNA, 25 bp, Homo sapien
tgctggactccttccactcgcgggt

SEQ ID NO: 81247 - DNA, 25 bp, Homo sapien
gtcgtctccagagctcagaaaatga

SEQ ID NO: 81248 - DNA, 25 bp, Homo sapien
cggctgcacaaacacgggaggtcaa

SEQ ID NO: 81249 - DNA, 25 bp, Homo sapien
ggaggtcaaagattgcgcccagccc

SEQ ID NO: 81250 - DNA, 25 bp, Homo sapien
cgcccaggccgggaatggaataaag

SEQ ID NO: 81251 - DNA, 25 bp, Homo sapien
ggctgcacagaagcgagtccgactg

SEQ ID NO: 81252 - DNA, 25 bp, Homo sapien
gctgcattgtgcttcatgtcccttc

SEQ ID NO: 81253 - DNA, 25 bp, Homo sapien
gtcccttcccatcaacatttctgtg

SEQ ID NO: 81254 - DNA, 25 bp, Homo sapien
gacgaagcttctgctgagccgcctg

SEQ ID NO: 81255 - DNA, 25 bp, Homo sapien
ccaccgggcccatttcttgaagcag

SEQ ID NO: 81256 - DNA, 25 bp, Homo sapien
ggcccatttcttgaagcagcggcga

SEQ ID NO: 81257 - DNA, 25 bp, Homo sapien
ctgccaggctcagacgaagcttctg

SEQ ID NO: 81258 - DNA, 25 bp, Homo sapien
cagctgcctccgtaggccatggagc

SEQ ID NO: 81259 - DNA, 25 bp, Homo sapien
ggtggccgcaatgtcccaagtggac

SEQ ID NO: 81260 - DNA, 25 bp, Homo sapien
gacgacacccacctagtcccgagga

SEQ ID NO: 81261 - DNA, 25 bp, Homo sapien
aagcagcggcgaaccacttttcctc

SEQ ID NO: 81262 - DNA, 25 bp, Homo sapien
tgtcgcctccgggaaatgccctaaa

SEQ ID NO: 81263 - DNA, 25 bp, Homo sapien
aggcgcctcgctgcaagtaaagatg

SEQ ID NO: 81264 - DNA, 25 bp, Homo sapien
tgggccggtaagaagcatccgcttc

SEQ ID NO: 81265 - DNA, 25 bp, Homo sapien
acagccgaaacgctccgtgcctagg

SEQ ID NO: 81266 - DNA, 25 bp, Homo sapien
cgatcccgtttaccgaccagagtca

SEQ ID NO: 81267 - DNA, 25 bp, Homo sapien
agccaccagtttcaagggatgcgga

SEQ ID NO: 81268 - DNA, 25 bp, Homo sapien
tgcactcaccgtagcagggaacctg

SEQ ID NO: 81269 - DNA, 25 bp, Homo sapien
ccggcgactcgcagtaagagacgca

SEQ ID NO: 81270 - DNA, 25 bp, Homo sapien
agcagacggacccaacgctgttgtc

SEQ ID NO: 81271 - DNA, 25 bp, Homo sapien
tggcttaggaaccaccattcgcgtg

SEQ ID NO: 81272 - DNA, 25 bp, Homo sapien
gccacgtcgcttttgctgtaccggg

SEQ ID NO: 81273 - DNA, 25 bp, Homo sapien
atctgccctgttacgcttgagcgcg

SEQ ID NO: 81274 - DNA, 25 bp, Homo sapien
ggaccacgcgtctcatccatggctt

SEQ ID NO: 81275 - DNA, 25 bp, Homo sapien
gcggtgctgctgacgctaggtaaaa

SEQ ID NO: 81276 - DNA, 25 bp, Homo sapien
ctcagggtcttgacaccaactttca

SEQ ID NO: 81277 - DNA, 25 bp, Homo sapien
gggcgcagattgctcttcgtcatct

SEQ ID NO: 81278 - DNA, 25 bp, Homo sapien
agctagccagcgagcccggttcctt

SEQ ID NO: 81279 - DNA, 25 bp, Homo sapien
cccagcctctgatgtcatgcggggc

SEQ ID NO: 81280 - DNA, 25 bp, Homo sapien
cgactcggcgacaagccaagagatt

SEQ ID NO: 81281 - DNA, 25 bp, Homo sapien
gccaagagattaagccgggtactta

SEQ ID NO: 81282 - DNA, 25 bp, Homo sapien
aagccgggtacttaccgctctgctc

SEQ ID NO: 81283 - DNA, 25 bp, Homo sapien
ctctaccctggcaaggaggggcctt

SEQ ID NO: 81284 - DNA, 25 bp, Homo sapien
ggcaggagagaacctcctcgccgta

SEQ ID NO: 81285 - DNA, 25 bp, Homo sapien
tctcagtggattcccaaaatctccc

SEQ ID NO: 81286 - DNA, 25 bp, Homo sapien
aacggtgctttatcgcgggcagtca

SEQ ID NO: 81287 - DNA, 25 bp, Homo sapien
ccctggtggcggaatgcgactccag

SEQ ID NO: 81288 - DNA, 25 bp, Homo sapien
gctcacggccggtcagagagcctga

SEQ ID NO: 81289 - DNA, 25 bp, Homo sapien
gtgcctcgtggcaccttactctcta

SEQ ID NO: 81290 - DNA, 25 bp, Homo sapien
ctcctcttgttctctaacgtgttta

SEQ ID NO: 81291 - DNA, 25 bp, Homo sapien
ttcgtgcagaaaacataaatagact

SEQ ID NO: 81292 - DNA, 25 bp, Homo sapien
gaagttttctcgaggctgtgtcccg

SEQ ID NO: 81293 - DNA, 25 bp, Homo sapien
cgtgtttaatacactttcgtgcaga

SEQ ID NO: 81294 - DNA, 25 bp, Homo sapien
ttctaaacataactgcgagcggcac

SEQ ID NO: 81295 - DNA, 25 bp, Homo sapien
aggagaacatcccttaggccaccca

SEQ ID NO: 81296 - DNA, 25 bp, Homo sapien
ccaagcccatcccattgacgaagta

SEQ ID NO: 81297 - DNA, 25 bp, Homo sapien
attgacgaagtaaccgcccgctgga

SEQ ID NO: 81298 - DNA, 25 bp, Homo sapien
gctggaggccgaaaaagcgttcctc

SEQ ID NO: 81299 - DNA, 25 bp, Homo sapien
agcgttcctcgagatgatctttttc

SEQ ID NO: 81300 - DNA, 25 bp, Homo sapien
tctctcgcttataactctgcctgga

SEQ ID NO: 81301 - DNA, 25 bp, Homo sapien
gccgcccgctgagagggaattctaa

SEQ ID NO: 81302 - DNA, 25 bp, Homo sapien
tccgccgcttcaaagaacgcgagga

SEQ ID NO: 81303 - DNA, 25 bp, Homo sapien
gcttacatcgtgctgctgcggcaaa

SEQ ID NO: 81304 - DNA, 25 bp, Homo sapien
aacgcgaggagaacgtcaaggctga

SEQ ID NO: 81305 - DNA, 25 bp, Homo sapien
agccttgatcagctcgcggcctgac

SEQ ID NO: 81306 - DNA, 25 bp, Homo sapien
cgagtacagcgatgacgatgacatg

SEQ ID NO: 81307 - DNA, 25 bp, Homo sapien
cgatgacgatgacatgagctggaag

SEQ ID NO: 81308 - DNA, 25 bp, Homo sapien
tgccaagtgcatcgcagccttgatc

SEQ ID NO: 81309 - DNA, 25 bp, Homo sapien
ggctgacgtcttcactgcttacatc

SEQ ID NO: 81310 - DNA, 25 bp, Homo sapien
gactgagccagcgagtgcgcgccta

SEQ ID NO: 81311 - DNA, 25 bp, Homo sapien
gagtgcgcgcctagaagtttttata

SEQ ID NO: 81312 - DNA, 25 bp, Homo sapien
cgcgcctagaagtttttataagtgg

SEQ ID NO: 81313 - DNA, 25 bp, Homo sapien
gtggccgccgccgatgatgaaacgc

SEQ ID NO: 81314 - DNA, 25 bp, Homo sapien
gccgatgatgaaacgcgctctccct

SEQ ID NO: 81315 - DNA, 25 bp, Homo sapien
ttttcctcgggtgtcaaaggcgcta

SEQ ID NO: 81316 - DNA, 25 bp, Homo sapien
tcgggtgtcaaaggcgctacgagcc

SEQ ID NO: 81317 - DNA, 25 bp, Homo sapien
ccctcagacaggtgtgacgccgcag

SEQ ID NO: 81318 - DNA, 25 bp, Homo sapien
tgcttgtctattgtctgtaaccctc

SEQ ID NO: 81319 - DNA, 25 bp, Homo sapien
cgcgctggggttttaaagtgcctcg

SEQ ID NO: 81320 - DNA, 25 bp, Homo sapien
cgcggtcactgcgtctaatgtttgc

SEQ ID NO: 81321 - DNA, 25 bp, Homo sapien
agcagcggcaacagcgcaagcagaa

SEQ ID NO: 81322 - DNA, 25 bp, Homo sapien
gcggcacgaaggctgacccagagct

SEQ ID NO: 81323 - DNA, 25 bp, Homo sapien
ctcgtcctcgctcaggtagagactc

SEQ ID NO: 81324 - DNA, 25 bp, Homo sapien
aggtccacggctcgcagactgatcc

SEQ ID NO: 81325 - DNA, 25 bp, Homo sapien
ctcctcgctgcatcgtccggagttg

SEQ ID NO: 81326 - DNA, 25 bp, Homo sapien
gcggactgcgtttccttccctgagc

SEQ ID NO: 81327 - DNA, 25 bp, Homo sapien
gacccattttctcacagtttccaac

SEQ ID NO: 81328 - DNA, 25 bp, Homo sapien
cctgttttcattgggagcaaataac

SEQ ID NO: 81329 - DNA, 25 bp, Homo sapien
ggacactcctacagacccactttga

SEQ ID NO: 81330 - DNA, 25 bp, Homo sapien
acgctcagatccaaaaggcgggctg

SEQ ID NO: 81331 - DNA, 25 bp, Homo sapien
aaggaatgcggcctttggctggtcc

SEQ ID NO: 81332 - DNA, 25 bp, Homo sapien
cgctctgagcgcacaagtttgttct

SEQ ID NO: 81333 - DNA, 25 bp, Homo sapien
tttgtcaccaaggttctgaggggcc

SEQ ID NO: 81334 - DNA, 25 bp, Homo sapien
tttctccacataggcctgcttcttg

SEQ ID NO: 81335 - DNA, 25 bp, Homo sapien
gccgccgctggtcctcgatggcgcc

SEQ ID NO: 81336 - DNA, 25 bp, Homo sapien
acaggctgcctgcagctgcccgagc

SEQ ID NO: 81337 - DNA, 25 bp, Homo sapien
tgcttcttgcgcagctcctcttcgg

SEQ ID NO: 81338 - DNA, 25 bp, Homo sapien
tccacataggcctgcttcttgcgca

SEQ ID NO: 81339 - DNA, 25 bp, Homo sapien
actttctccacataggcctgcttct

SEQ ID NO: 81340 - DNA, 25 bp, Homo sapien
ttgcgcagctcctcttcggctcgag

SEQ ID NO: 81341 - DNA, 25 bp, Homo sapien
agcagctcggcacgccgccgctggt

SEQ ID NO: 81342 - DNA, 25 bp, Homo sapien
acagctcgcggctctggaatgccag

SEQ ID NO: 81343 - DNA, 25 bp, Homo sapien
acgttccaggctccctttgtgctca

SEQ ID NO: 81344 - DNA, 25 bp, Homo sapien
aagaggacgcccgaaggccagcgga

SEQ ID NO: 81345 - DNA, 25 bp, Homo sapien
gtcacccgcggctgcaagattaatg

SEQ ID NO: 81346 - DNA, 25 bp, Homo sapien
cgcggctgcaagattaatggctcca

SEQ ID NO: 81347 - DNA, 25 bp, Homo sapien
tggctccagcgaggagccaagaaca

SEQ ID NO: 81348 - DNA, 25 bp, Homo sapien
agccaagaacagctcggcgctcact

SEQ ID NO: 81349 - DNA, 25 bp, Homo sapien
gcggctctggaatgccaggcatcca

SEQ ID NO: 81350 - DNA, 25 bp, Homo sapien
gctggcaccttttcctaggtttcca

SEQ ID NO: 81351 - DNA, 25 bp, Homo sapien
gcctgcggatgcaagcgagtcctac

SEQ ID NO: 81352 - DNA, 25 bp, Homo sapien
tcagaagctttagagcgctgccctc

SEQ ID NO: 81353 - DNA, 25 bp, Homo sapien
ttcctacgggagattaacacacaca

SEQ ID NO: 81354 - DNA, 25 bp, Homo sapien
ggaatctgtgctccctcaagccctg

SEQ ID NO: 81355 - DNA, 25 bp, Homo sapien
caggcgaagtacagagagcggactc

SEQ ID NO: 81356 - DNA, 25 bp, Homo sapien
acaagccttcgtcgtccagtgcatg

SEQ ID NO: 81357 - DNA, 25 bp, Homo sapien
ggtcacttgcacgtcttgttaacta

SEQ ID NO: 81358 - DNA, 25 bp, Homo sapien
ctctaacgctgacgtcaccgggctg

SEQ ID NO: 81359 - DNA, 25 bp, Homo sapien
tctcgagccctctttgttttccaaa

SEQ ID NO: 81360 - DNA, 25 bp, Homo sapien
tgcgccgagactccagctttggctg

SEQ ID NO: 81361 - DNA, 25 bp, Homo sapien
ttctttctaagtgagggccaattcg

SEQ ID NO: 81362 - DNA, 25 bp, Homo sapien
acactgtggctgttgtctccggagt

SEQ ID NO: 81363 - DNA, 25 bp, Homo sapien
gcaggaccctgcaacttgagctcca

SEQ ID NO: 81364 - DNA, 25 bp, Homo sapien
gacctgcaacccgaaacactgtggc

SEQ ID NO: 81365 - DNA, 25 bp, Homo sapien
aggcccggagaggtctttaagcatc

SEQ ID NO: 81366 - DNA, 25 bp, Homo sapien
cccttgggtgtcgtccaggacgcca

SEQ ID NO: 81367 - DNA, 25 bp, Homo sapien
ggaccattgtgctgcgcaggctgaa

SEQ ID NO: 81368 - DNA, 25 bp, Homo sapien
tgaattctccgaagcgactgaaacc

SEQ ID NO: 81369 - DNA, 25 bp, Homo sapien
cgccgagccctgcaaacaataagtg

SEQ ID NO: 81370 - DNA, 25 bp, Homo sapien
caggctgcagggtgaatagatttgc

SEQ ID NO: 81371 - DNA, 25 bp, Homo sapien
gctctcagacgacagatggcgggca

SEQ ID NO: 81372 - DNA, 25 bp, Homo sapien
gcggctgcttacaatggctctcaga

SEQ ID NO: 81373 - DNA, 25 bp, Homo sapien
ctgaagctggcccattccgttgcgc

SEQ ID NO: 81374 - DNA, 25 bp, Homo sapien
gcgtgcttgcggcaaccctgtaacc

SEQ ID NO: 81375 - DNA, 25 bp, Homo sapien
gtcagcccttcctcggagtccaggt

SEQ ID NO: 81376 - DNA, 25 bp, Homo sapien
tgcctcaggcaggatgtaccaaacg

SEQ ID NO: 81377 - DNA, 25 bp, Homo sapien
ctttcctcccgacacgagtgcagta

SEQ ID NO: 81378 - DNA, 25 bp, Homo sapien
cggttatgagcgtaaagtgacagcc

SEQ ID NO: 81379 - DNA, 25 bp, Homo sapien
tccgacactgagcaacgaacgcatt

SEQ ID NO: 81380 - DNA, 25 bp, Homo sapien
tgtctgcactcgctttcctcggatt

SEQ ID NO: 81381 - DNA, 25 bp, Homo sapien
gcgccgactacagaggctggacgta

SEQ ID NO: 81382 - DNA, 25 bp, Homo sapien
tgaagcggctctaagtcacctttga

SEQ ID NO: 81383 - DNA, 25 bp, Homo sapien
gactctgccaaacacgccattaggg

SEQ ID NO: 81384 - DNA, 25 bp, Homo sapien
cgctgcttttcgctgactctgccaa

SEQ ID NO: 81385 - DNA, 25 bp, Homo sapien
cgctaggctgcttgcgctgcaaatg

SEQ ID NO: 81386 - DNA, 25 bp, Homo sapien
gcgttgatgtccttcttcagctcca

SEQ ID NO: 81387 - DNA, 25 bp, Homo sapien
tcagcagcatgtcgatagatacagc

SEQ ID NO: 81388 - DNA, 25 bp, Homo sapien
cttctccgagtgcacgatcagcagc

SEQ ID NO: 81389 - DNA, 25 bp, Homo sapien
tgggagggcgctaccctaatgaagc

SEQ ID NO: 81390 - DNA, 25 bp, Homo sapien
gctgcattgcggtgcatgctcctta

SEQ ID NO: 81391 - DNA, 25 bp, Homo sapien
tgagtggtcggtcctacctaaagtc

SEQ ID NO: 81392 - DNA, 25 bp, Homo sapien
accctccacggagcaagttggctgc

SEQ ID NO: 81393 - DNA, 25 bp, Homo sapien
tctgctcccaggcacggatacgctt

SEQ ID NO: 81394 - DNA, 25 bp, Homo sapien
ttcgcctcttgagccttggaacagg

SEQ ID NO: 81395 - DNA, 25 bp, Homo sapien
gaaagcgcgctccaaagacaccgtg

SEQ ID NO: 81396 - DNA, 25 bp, Homo sapien
agaagctctgccgtggtatcccgca

SEQ ID NO: 81397 - DNA, 25 bp, Homo sapien
tcattggccgtacccttggggacca

SEQ ID NO: 81398 - DNA, 25 bp, Homo sapien
ttcctgtacacgctccagtaagctg

SEQ ID NO: 81399 - DNA, 25 bp, Homo sapien
ggctctgggacgcaaagccctatca

SEQ ID NO: 81400 - DNA, 25 bp, Homo sapien
agcagcccgcagctctgaatacagg

SEQ ID NO: 81401 - DNA, 25 bp, Homo sapien
atccacagatcccagctgaaagctg

SEQ ID NO: 81402 - DNA, 25 bp, Homo sapien
ggccatggcatgaacgaatacacgt

SEQ ID NO: 81403 - DNA, 25 bp, Homo sapien
tgcggattgccacggattaacactt

SEQ ID NO: 81404 - DNA, 25 bp, Homo sapien
tacagctcgtctttccttggcggtc

SEQ ID NO: 81405 - DNA, 25 bp, Homo sapien
ggccagatgaatcccgcaggaatgc

SEQ ID NO: 81406 - DNA, 25 bp, Homo sapien
cctcggcccgacttggccaaagaag

SEQ ID NO: 81407 - DNA, 25 bp, Homo sapien
acgcgccgcattcgtagcccgagag

SEQ ID NO: 81408 - DNA, 25 bp, Homo sapien
caacgaggtaggcaaaggaacactg

SEQ ID NO: 81409 - DNA, 25 bp, Homo sapien
ccgcacagccctcgggaacttgtta

SEQ ID NO: 81410 - DNA, 25 bp, Homo sapien
caaatgccagcgttttggaagaact

SEQ ID NO: 81411 - DNA, 25 bp, Homo sapien
aactgagagtcacgtcgttaggcgc

SEQ ID NO: 81412 - DNA, 25 bp, Homo sapien
tcgttaggcgctgaggctttctttt

SEQ ID NO: 81413 - DNA, 25 bp, Homo sapien
aaggatgtgtcaccagctccgggcc

SEQ ID NO: 81414 - DNA, 25 bp, Homo sapien
tggctctccacttcgactctcagaa

SEQ ID NO: 81415 - DNA, 25 bp, Homo sapien
ggccttaatggatcccgcgggctgt

SEQ ID NO: 81416 - DNA, 25 bp, Homo sapien
acgcatgcgcaagctgctacctagc

SEQ ID NO: 81417 - DNA, 25 bp, Homo sapien
ccggataaacacatcagcctgctcg

SEQ ID NO: 81418 - DNA, 25 bp, Homo sapien
ggagcatgctctctgcgagccgaca

SEQ ID NO: 81419 - DNA, 25 bp, Homo sapien
cattcgttagctggcacatccttcc

SEQ ID NO: 81420 - DNA, 25 bp, Homo sapien
ggcttcccgcattacactgcttctg

SEQ ID NO: 81421 - DNA, 25 bp, Homo sapien
gtgggctgtggtgaaacattcgtta

SEQ ID NO: 81422 - DNA, 25 bp, Homo sapien
gggtctcgaactctcacgccttact

SEQ ID NO: 81423 - DNA, 25 bp, Homo sapien
ggccacctctgttaacgaacgcatc

SEQ ID NO: 81424 - DNA, 25 bp, Homo sapien
acatgcgtactcaggtgcgccggta

SEQ ID NO: 81425 - DNA, 25 bp, Homo sapien
cgcagcacaagcgagtgagtcctga

SEQ ID NO: 81426 - DNA, 25 bp, Homo sapien
gtacccacgctttagcacatgcgta

SEQ ID NO: 81427 - DNA, 25 bp, Homo sapien
caacgccgtattgacgcgcagcaca

SEQ ID NO: 81428 - DNA, 25 bp, Homo sapien
gacgcgccggcacagcaaaaatggc

SEQ ID NO: 81429 - DNA, 25 bp, Homo sapien
tcccaagcaggttctgtagtccagc

SEQ ID NO: 81430 - DNA, 25 bp, Homo sapien
cgccttcaacggagctgcaatccta

SEQ ID NO: 81431 - DNA, 25 bp, Homo sapien
tgccgcccgccatttttggagcttc

SEQ ID NO: 81432 - DNA, 25 bp, Homo sapien
cttcttggagatctaggcaggaacc

SEQ ID NO: 81433 - DNA, 25 bp, Homo sapien
cgaggctcctccctaggtctcaggg

SEQ ID NO: 81434 - DNA, 25 bp, Homo sapien
ccaatcgcgagaggcgtaggcttct

SEQ ID NO: 81435 - DNA, 25 bp, Homo sapien
tccatcttggatcggcgcttccagc

SEQ ID NO: 81436 - DNA, 25 bp, Homo sapien
ggcgcgcgcaaacgctttccagtgg

SEQ ID NO: 81437 - DNA, 25 bp, Homo sapien
ggtggcattttccacacgccaatgg

SEQ ID NO: 81438 - DNA, 25 bp, Homo sapien
aaaccaggcgttccagctgctcaca

SEQ ID NO: 81439 - DNA, 25 bp, Homo sapien
cggtggccaccttaattcttgttga

SEQ ID NO: 81440 - DNA, 25 bp, Homo sapien
gctgctcacacgctgtttggtaccc

SEQ ID NO: 81441 - DNA, 25 bp, Homo sapien
catttatctgggaacagcgcggatc

SEQ ID NO: 81442 - DNA, 25 bp, Homo sapien
gcactcaggggcacaccttcattta

SEQ ID NO: 81443 - DNA, 25 bp, Homo sapien
gccatttccggaactcgggctagtg

SEQ ID NO: 81444 - DNA, 25 bp, Homo sapien
cgctgcaaagagcaggggtctccta

SEQ ID NO: 81445 - DNA, 25 bp, Homo sapien
gagacgcacacctttgccctgcata

SEQ ID NO: 81446 - DNA, 25 bp, Homo sapien
cgtgcacccatttggcctcatttga

SEQ ID NO: 81447 - DNA, 25 bp, Homo sapien
tgctctgcacgacgcctgaaaggcc

SEQ ID NO: 81448 - DNA, 25 bp, Homo sapien
ggcgctgagattttcgtggtacatc

SEQ ID NO: 81449 - DNA, 25 bp, Homo sapien
tgtggcgtcatatgggatcaatttc

SEQ ID NO: 81450 - DNA, 25 bp, Homo sapien
atcgacggtttgtagacatcttttc

SEQ ID NO: 81451 - DNA, 25 bp, Homo sapien
gcgaatctttcctcacagtgctctg

SEQ ID NO: 81452 - DNA, 25 bp, Homo sapien
gactgggaccttgatcctgcctgcc

SEQ ID NO: 81453 - DNA, 25 bp, Homo sapien
tcctgcagcgtccatgatgaaggcc

SEQ ID NO: 81454 - DNA, 25 bp, Homo sapien
cttctgcaccgggattccgcgagac

SEQ ID NO: 81455 - DNA, 25 bp, Homo sapien
cgcttcctcttctcgcgctgagtta

SEQ ID NO: 81456 - DNA, 25 bp, Homo sapien
cgctgtccgtccatacagcctgtta

SEQ ID NO: 81457 - DNA, 25 bp, Homo sapien
agacggccttgttggcaggcagaca

SEQ ID NO: 81458 - DNA, 25 bp, Homo sapien
cagattgggtccagagtgggtttcc

SEQ ID NO: 81459 - DNA, 25 bp, Homo sapien
atcccagtgcggcagagaccgttgt

SEQ ID NO: 81460 - DNA, 25 bp, Homo sapien
cgcttgattgacatgagggcccgcc

SEQ ID NO: 81461 - DNA, 25 bp, Homo sapien
aaaaagtccttttgccagctgtggc

SEQ ID NO: 81462 - DNA, 25 bp, Homo sapien
tgcagggcactttcttcgggaagga

SEQ ID NO: 81463 - DNA, 25 bp, Homo sapien
cgtcagtggcattgtttggcgtctc

SEQ ID NO: 81464 - DNA, 25 bp, Homo sapien
ccggagacgccactaggtgacaatg

SEQ ID NO: 81465 - DNA, 25 bp, Homo sapien
ccttagcgtcctctccggcaaaata

SEQ ID NO: 81466 - DNA, 25 bp, Homo sapien
cgtcgaacagagtcgctcatatgca

SEQ ID NO: 81467 - DNA, 25 bp, Homo sapien
ctcaggagtttgcatacgaagccga

SEQ ID NO: 81468 - DNA, 25 bp, Homo sapien
ccggatacttggagacagcagcgtc

SEQ ID NO: 81469 - DNA, 25 bp, Homo sapien
cgaggggcttctgataatgatattc

SEQ ID NO: 81470 - DNA, 25 bp, Homo sapien
catcctggacgctctgcgccctgga

SEQ ID NO: 81471 - DNA, 25 bp, Homo sapien
aagcagattaggtcggtgcccttag

SEQ ID NO: 81472 - DNA, 25 bp, Homo sapien
gaagcagattaggtcggtgccctta

SEQ ID NO: 81473 - DNA, 25 bp, Homo sapien
agaagcagattaggtcggtgccctt

SEQ ID NO: 81474 - DNA, 25 bp, Homo sapien
gagaagcagattaggtcggtgccct

SEQ ID NO: 81475 - DNA, 25 bp, Homo sapien
agagaagcagattaggtcggtgccc

SEQ ID NO: 81476 - DNA, 25 bp, Homo sapien
gcccggagagaagcagattaggtcg

SEQ ID NO: 81477 - DNA, 25 bp, Homo sapien
aaaggcccggagagaagcagattag

SEQ ID NO: 81478 - DNA, 25 bp, Homo sapien
gcacgcagcggaccttgagtagctg

SEQ ID NO: 81479 - DNA, 25 bp, Homo sapien
agcggaccttgagtagctgcgctgt

SEQ ID NO: 81480 - DNA, 25 bp, Homo sapien
cggtgcccttagaggcctcttcctt

SEQ ID NO: 81481 - DNA, 25 bp, Homo sapien
acagcggcggttccctgacaaaatc

SEQ ID NO: 81482 - DNA, 25 bp, Homo sapien
ggttccctgacaaaatccctgttgc

SEQ ID NO: 81483 - DNA, 25 bp, Homo sapien
ctgacaaaatccctgttgctcgggg

SEQ ID NO: 81484 - DNA, 25 bp, Homo sapien
ttcggacgccttgctaaggctggca

SEQ ID NO: 81485 - DNA, 25 bp, Homo sapien
gccttgctaaggctggcacgcagcg

SEQ ID NO: 81486 - DNA, 25 bp, Homo sapien
agctggaccaggcaatcggggtctc

SEQ ID NO: 81487 - DNA, 25 bp, Homo sapien
aggaattgcaggaaggcgctcgcct

SEQ ID NO: 81488 - DNA, 25 bp, Homo sapien
tctcaaggccaagacgcgcagcgct

SEQ ID NO: 81489 - DNA, 25 bp, Homo sapien
caggcaatcggggtctccgaaacgt

SEQ ID NO: 81490 - DNA, 25 bp, Homo sapien
actccgctcctcattgcgaattgga

SEQ ID NO: 81491 - DNA, 25 bp, Homo sapien
tgcgaattggactgcgcattggctg

SEQ ID NO: 81492 - DNA, 25 bp, Homo sapien
gcattggctgcgacccaaggctgaa

SEQ ID NO: 81493 - DNA, 25 bp, Homo sapien
cccaaggctgaacacaagaagcttg

SEQ ID NO: 81494 - DNA, 25 bp, Homo sapien
ttacctggccacttaatcccggaga

SEQ ID NO: 81495 - DNA, 25 bp, Homo sapien
cagtttagctcgagcgccatccaga

SEQ ID NO: 81496 - DNA, 25 bp, Homo sapien
ctgggactggcatgatcagctgaac

SEQ ID NO: 81497 - DNA, 25 bp, Homo sapien
tcggagatcagcaaacgcctaggtg

SEQ ID NO: 81498 - DNA, 25 bp, Homo sapien
ttcagaccacatcaagcggcccatg

SEQ ID NO: 81499 - DNA, 25 bp, Homo sapien
cgggaccatgtccaaaccttcagac

SEQ ID NO: 81500 - DNA, 25 bp, Homo sapien
taggtgccgaatggaagcttctgtc

SEQ ID NO: 81501 - DNA, 25 bp, Homo sapien
cttgccctggctaaaaaattacctg

SEQ ID NO: 81502 - DNA, 25 bp, Homo sapien
tgggtgttccgcttccatcctaacg

SEQ ID NO: 81503 - DNA, 25 bp, Homo sapien
cctcttcgcggacatgggattaccc

SEQ ID NO: 81504 - DNA, 25 bp, Homo sapien
cccggagccgctttaaagtgcagta

SEQ ID NO: 81505 - DNA, 25 bp, Homo sapien
acgacccgctacttggactacattg

SEQ ID NO: 81506 - DNA, 25 bp, Homo sapien
cgcacgcgtctatttagggcccagc

SEQ ID NO: 81507 - DNA, 25 bp, Homo sapien
tctgaaattcttggctcggggaacc

SEQ ID NO: 81508 - DNA, 25 bp, Homo sapien
tcccaggcttggtttctcgtgcaaa

SEQ ID NO: 81509 - DNA, 25 bp, Homo sapien
aactcgggctcagaaaagtgctctc

SEQ ID NO: 81510 - DNA, 25 bp, Homo sapien
cctcagaaatcaggctcagcccggg

SEQ ID NO: 81511 - DNA, 25 bp, Homo sapien
gcactcggtcggctgtggtcctgca

SEQ ID NO: 81512 - DNA, 25 bp, Homo sapien
ggccgccctcagaaatcaggctcag

SEQ ID NO: 81513 - DNA, 25 bp, Homo sapien
ccatggagacccgatgcagctggac

SEQ ID NO: 81514 - DNA, 25 bp, Homo sapien
cgatgcagctggacagcctgtcagc

SEQ ID NO: 81515 - DNA, 25 bp, Homo sapien
tggcccgacagcctgactcgagaca

SEQ ID NO: 81516 - DNA, 25 bp, Homo sapien
agcctgactcgagacaccgggatgc

SEQ ID NO: 81517 - DNA, 25 bp, Homo sapien
ccagcgctttgaggaccctgtggac

SEQ ID NO: 81518 - DNA, 25 bp, Homo sapien
agtgacccaaatacatgccgcgttc

SEQ ID NO: 81519 - DNA, 25 bp, Homo sapien
ggcagcagtccctgtcaaacctgtt

SEQ ID NO: 81520 - DNA, 25 bp, Homo sapien
gagcagccaagagttgccctggaca

SEQ ID NO: 81521 - DNA, 25 bp, Homo sapien
gactcctggcatccggagaacctga

SEQ ID NO: 81522 - DNA, 25 bp, Homo sapien
agaacctgaactccggcgctgcaag

SEQ ID NO: 81523 - DNA, 25 bp, Homo sapien
gatccctctgcgttaggcacgcgtc

SEQ ID NO: 81524 - DNA, 25 bp, Homo sapien
ggggccgattactgactttgaagtc

SEQ ID NO: 81525 - DNA, 25 bp, Homo sapien
gacttctctcgcttagcaacctggg

SEQ ID NO: 81526 - DNA, 25 bp, Homo sapien
ctagaaatcctggggcgtctactta

SEQ ID NO: 81527 - DNA, 25 bp, Homo sapien
gcgctagaaatcctggggcgtctac

SEQ ID NO: 81528 - DNA, 25 bp, Homo sapien
gctagaaatcctggggcgtctactt

SEQ ID NO: 81529 - DNA, 25 bp, Homo sapien
tagaaatcctggggcgtctacttaa

SEQ ID NO: 81530 - DNA, 25 bp, Homo sapien
ctggggcgtctacttaaaaccagag

SEQ ID NO: 81531 - DNA, 25 bp, Homo sapien
tggggcgtctacttaaaaccagaga

SEQ ID NO: 81532 - DNA, 25 bp, Homo sapien
cgctagaaatcctggggcgtctact

SEQ ID NO: 81533 - DNA, 25 bp, Homo sapien
ggcgctagaaatcctggggcgtcta

SEQ ID NO: 81534 - DNA, 25 bp, Homo sapien
gcgttgccggttctcacactaggaa

SEQ ID NO: 81535 - DNA, 25 bp, Homo sapien
tttcgctcgaatccctgcgctaggc

SEQ ID NO: 81536 - DNA, 25 bp, Homo sapien
gcagagccgtcatcgcaggctcctg

SEQ ID NO: 81537 - DNA, 25 bp, Homo sapien
ggggcctcgttactcactttctagc

SEQ ID NO: 81538 - DNA, 25 bp, Homo sapien
tgagcaaggtgttctcttcggaagc

SEQ ID NO: 81539 - DNA, 25 bp, Homo sapien
acactaggaaggagcctgaagtcag

SEQ ID NO: 81540 - DNA, 25 bp, Homo sapien
gaagtcagaaaagatggggcctcgt

SEQ ID NO: 81541 - DNA, 25 bp, Homo sapien
acggaatcccggctctgtgtgcgcc

SEQ ID NO: 81542 - DNA, 25 bp, Homo sapien
aaatggggggcatcaccatgcctgc

SEQ ID NO: 81543 - DNA, 25 bp, Homo sapien
aatcacgggctatgcccggggagct

SEQ ID NO: 81544 - DNA, 25 bp, Homo sapien
ggcacatgcgcaggcacaagaaacc

SEQ ID NO: 81545 - DNA, 25 bp, Homo sapien
tgaggccaggcaatcacgggctatg

SEQ ID NO: 81546 - DNA, 25 bp, Homo sapien
aggccaggcaatcacgggctatgcc

SEQ ID NO: 81547 - DNA, 25 bp, Homo sapien
gccaggcaatcacgggctatgcccg

SEQ ID NO: 81548 - DNA, 25 bp, Homo sapien
caggcacatgcgcaggcacaagaaa

SEQ ID NO: 81549 - DNA, 25 bp, Homo sapien
gtacgtggacaagtacaggcacatg

SEQ ID NO: 81550 - DNA, 25 bp, Homo sapien
gcgcccagtggagacttctttcaca

SEQ ID NO: 81551 - DNA, 25 bp, Homo sapien
gcggaacacccatccatatgcagtg

SEQ ID NO: 81552 - DNA, 25 bp, Homo sapien
gtttcccaaagcctgcagattttca

SEQ ID NO: 81553 - DNA, 25 bp, Homo sapien
tgaggatcctccattgagcggcata

SEQ ID NO: 81554 - DNA, 25 bp, Homo sapien
ctgccgctgtaaattatgaggatcc

SEQ ID NO: 81555 - DNA, 25 bp, Homo sapien
cgggagaagttcacattccggattc

SEQ ID NO: 81556 - DNA, 25 bp, Homo sapien
atccctgcgggatttctggacgccc

SEQ ID NO: 81557 - DNA, 25 bp, Homo sapien
tcttcctacgctgggcggctccaaa

SEQ ID NO: 81558 - DNA, 25 bp, Homo sapien
atgccaagtggtggcgttcctcctg

SEQ ID NO: 81559 - DNA, 25 bp, Homo sapien
atgtccaccaccacatgccaagtgg

SEQ ID NO: 81560 - DNA, 25 bp, Homo sapien
ggagcacccaggacctgtacgacaa

SEQ ID NO: 81561 - DNA, 25 bp, Homo sapien
gcttcacaccttcggcagcaggagg

SEQ ID NO: 81562 - DNA, 25 bp, Homo sapien
gagcgcgttagcttcacaccttcgg

SEQ ID NO: 81563 - DNA, 25 bp, Homo sapien
ctgcatcgcggccaccgggatggac

SEQ ID NO: 81564 - DNA, 25 bp, Homo sapien
accgggatggacatgtggagcaccc

SEQ ID NO: 81565 - DNA, 25 bp, Homo sapien
tggcgttcctcctgtccatcctggg

SEQ ID NO: 81566 - DNA, 25 bp, Homo sapien
tgatccctcggactgcagccaagct

SEQ ID NO: 81567 - DNA, 25 bp, Homo sapien
ctctcggacgagctatttttaggtc

SEQ ID NO: 81568 - DNA, 25 bp, Homo sapien
tcttcccagtgaagccgagtcttgg

SEQ ID NO: 81569 - DNA, 25 bp, Homo sapien
aatgtttaacctcccgaatcgctga

SEQ ID NO: 81570 - DNA, 25 bp, Homo sapien
gctcccgggacgaattcctggcata

SEQ ID NO: 81571 - DNA, 25 bp, Homo sapien
ttcctggcatagttttcccgcgcgg

SEQ ID NO: 81572 - DNA, 25 bp, Homo sapien
agatggttcccggaatgctcaccgc

SEQ ID NO: 81573 - DNA, 25 bp, Homo sapien
agtcttggggcatcccgtcattcgt

SEQ ID NO: 81574 - DNA, 25 bp, Homo sapien
agcccaggaccgactgatcgctcag

SEQ ID NO: 81575 - DNA, 25 bp, Homo sapien
atagatcttatccagctcgccgtgg

SEQ ID NO: 81576 - DNA, 25 bp, Homo sapien
cagctcccgccaactttaataagta

SEQ ID NO: 81577 - DNA, 25 bp, Homo sapien
ttaataagtatagccaccgcctggg

SEQ ID NO: 81578 - DNA, 25 bp, Homo sapien
cctgggtgtagactcctgcaaaata

SEQ ID NO: 81579 - DNA, 25 bp, Homo sapien
ttgcatgtgacgatacttgggcggc

SEQ ID NO: 81580 - DNA, 25 bp, Homo sapien
catgcagcgtagatccgcctcgttg

SEQ ID NO: 81581 - DNA, 25 bp, Homo sapien
cagcgccagcgtctcatagatctta

SEQ ID NO: 81582 - DNA, 25 bp, Homo sapien
gttctcgtctatctggctgccttta

SEQ ID NO: 81583 - DNA, 25 bp, Homo sapien
actttgccaagcgtttcactgagcc

SEQ ID NO: 81584 - DNA, 25 bp, Homo sapien
tccgtaaaactcgtagcgtcagggc

SEQ ID NO: 81585 - DNA, 25 bp, Homo sapien
ggcagatcttctttgcgcatgcgga

SEQ ID NO: 81586 - DNA, 25 bp, Homo sapien
ctttccggtacttgagcggtgtcca

SEQ ID NO: 81587 - DNA, 25 bp, Homo sapien
ggctgggcttatagacaactggctg

SEQ ID NO: 81588 - DNA, 25 bp, Homo sapien
gcggccgagccaaagacgtttccaa

SEQ ID NO: 81589 - DNA, 25 bp, Homo sapien
ccaggctcagagtagctgctgtttc

SEQ ID NO: 81590 - DNA, 25 bp, Homo sapien
cgtggatcagcaagcccagagcctc

SEQ ID NO: 81591 - DNA, 25 bp, Homo sapien
gagtcaccaaccgagtctgccgcga

SEQ ID NO: 81592 - DNA, 25 bp, Homo sapien
gtacaagatcttcgacgcgcccgga

SEQ ID NO: 81593 - DNA, 25 bp, Homo sapien
gccactgcgaacgacaggtacaaga

SEQ ID NO: 81594 - DNA, 25 bp, Homo sapien
ccctgctgttcttatggattactgg

SEQ ID NO: 81595 - DNA, 25 bp, Homo sapien
aggtgcttctaactggcggcaaatc

SEQ ID NO: 81596 - DNA, 25 bp, Homo sapien
gcctcgcgacaaaccgctgcgtgga

SEQ ID NO: 81597 - DNA, 25 bp, Homo sapien
ggtcgccagtcgaggaattctgaca

SEQ ID NO: 81598 - DNA, 25 bp, Homo sapien
aacggtgtgcgttcgtgaaatcggc

SEQ ID NO: 81599 - DNA, 25 bp, Homo sapien
agcaggcgctgtggcaatataagga

SEQ ID NO: 81600 - DNA, 25 bp, Homo sapien
ccgcagcggcgctctatttttagca

SEQ ID NO: 81601 - DNA, 25 bp, Homo sapien
accacggatctgacccgggtaagtg

SEQ ID NO: 81602 - DNA, 25 bp, Homo sapien
gagtcgaattcccactcggcgtcca

SEQ ID NO: 81603 - DNA, 25 bp, Homo sapien
cgtccctaggctcagaagttggccc

SEQ ID NO: 81604 - DNA, 25 bp, Homo sapien
tcgcatccatcccaacgaagtttgg

SEQ ID NO: 81605 - DNA, 25 bp, Homo sapien
cgtctcaggattcgaagggaatgca

SEQ ID NO: 81606 - DNA, 25 bp, Homo sapien
ggcatttcttccacccgcctgttga

SEQ ID NO: 81607 - DNA, 25 bp, Homo sapien
tccgtcgcagagaaccctgagctcg

SEQ ID NO: 81608 - DNA, 25 bp, Homo sapien
atgcggacctaagctcgggtgaagc

SEQ ID NO: 81609 - DNA, 25 bp, Homo sapien
tgctgcccgagctctgtaccttcgt

SEQ ID NO: 81610 - DNA, 25 bp, Homo sapien
ctggggctcagcataacctggttgc

SEQ ID NO: 81611 - DNA, 25 bp, Homo sapien
gccgccttcgaattccttgacaatg

SEQ ID NO: 81612 - DNA, 25 bp, Homo sapien
tcgcagacttactcgggttggaatc

SEQ ID NO: 81613 - DNA, 25 bp, Homo sapien
gtcctcgagcttgggagacagatgc

SEQ ID NO: 81614 - DNA, 25 bp, Homo sapien
aggcgtgagcttcgccctttctgaa

SEQ ID NO: 81615 - DNA, 25 bp, Homo sapien
ctgagagtcatgtgatgccctggca

SEQ ID NO: 81616 - DNA, 25 bp, Homo sapien
agcgacaagagcacagctgagagtc

SEQ ID NO: 81617 - DNA, 25 bp, Homo sapien
tggtgtcaccacaacacagaagcga

SEQ ID NO: 81618 - DNA, 25 bp, Homo sapien
actacaaagtatggcccgtgggtga

SEQ ID NO: 81619 - DNA, 25 bp, Homo sapien
ctgcagtggctcgaaaggctgaaac

SEQ ID NO: 81620 - DNA, 25 bp, Homo sapien
tcccatggcttaggagcacagcact

SEQ ID NO: 81621 - DNA, 25 bp, Homo sapien
ctggcagctcactggaccatgggaa

SEQ ID NO: 81622 - DNA, 25 bp, Homo sapien
cctcggggcttctttcctagatcca

SEQ ID NO: 81623 - DNA, 25 bp, Homo sapien
gtgaaaccgcgtggagtcctgtcct

SEQ ID NO: 81624 - DNA, 25 bp, Homo sapien
cagaaacgcccacgcgagccttgga

SEQ ID NO: 81625 - DNA, 25 bp, Homo sapien
cggtgccagctcgttgtctgtttat

SEQ ID NO: 81626 - DNA, 25 bp, Homo sapien
gtctgtttatttgctgcctgctcca

SEQ ID NO: 81627 - DNA, 25 bp, Homo sapien
gctccactggatagtgcgctgtttg

SEQ ID NO: 81628 - DNA, 25 bp, Homo sapien
gcaggaccagttccgagttgccagg

SEQ ID NO: 81629 - DNA, 25 bp, Homo sapien
ttcctagatccacttcccggacgtg

SEQ ID NO: 81630 - DNA, 25 bp, Homo sapien
gcacagctgctttggccaccacagg

SEQ ID NO: 81631 - DNA, 25 bp, Homo sapien
aagcggctcctgtcagttgttctca

SEQ ID NO: 81632 - DNA, 25 bp, Homo sapien
gagggtgacgatactcagaggattc

SEQ ID NO: 81633 - DNA, 25 bp, Homo sapien
ttgggcttgttgttccgtatactca

SEQ ID NO: 81634 - DNA, 25 bp, Homo sapien
aaatcagagatccttcggaagcggc

SEQ ID NO: 81635 - DNA, 25 bp, Homo sapien
actggagcttaaattctggcggcga

SEQ ID NO: 81636 - DNA, 25 bp, Homo sapien
gcggcgagatggacattctgaaatc

SEQ ID NO: 81637 - DNA, 25 bp, Homo sapien
agtgggcactcacgcacagctgctt

SEQ ID NO: 81638 - DNA, 25 bp, Homo sapien
caactgcgggcgaactgacacctct

SEQ ID NO: 81639 - DNA, 25 bp, Homo sapien
gttgaacttctagagcgccactgct

SEQ ID NO: 81640 - DNA, 25 bp, Homo sapien
ggaggtggcttcttcgttgaacttc

SEQ ID NO: 81641 - DNA, 25 bp, Homo sapien
actcgggccactcccggagcaaaga

SEQ ID NO: 81642 - DNA, 25 bp, Homo sapien
aagccatagcctcgtgtgccactcg

SEQ ID NO: 81643 - DNA, 25 bp, Homo sapien
cggagcgaaccgacttgcaaaacca

SEQ ID NO: 81644 - DNA, 25 bp, Homo sapien
ttaccgatctatgggcggaagcgca

SEQ ID NO: 81645 - DNA, 25 bp, Homo sapien
ctctcggtcctcactcaaggtcttg

SEQ ID NO: 81646 - DNA, 25 bp, Homo sapien
gagagccactcaccttactcagtcg

SEQ ID NO: 81647 - DNA, 25 bp, Homo sapien
cccaaacgattctctccagcctctc

SEQ ID NO: 81648 - DNA, 25 bp, Homo sapien
tttggcctgcgaatgcccccaaacg

SEQ ID NO: 81649 - DNA, 25 bp, Homo sapien
ccaatcgagcccgagcgcgtcgagg

SEQ ID NO: 81650 - DNA, 25 bp, Homo sapien
gttaggctgggatcagctacgtcag

SEQ ID NO: 81651 - DNA, 25 bp, Homo sapien
gccaggttaggctgggatcagctac

SEQ ID NO: 81652 - DNA, 25 bp, Homo sapien
accttactcagtcgccggcctccca

SEQ ID NO: 81653 - DNA, 25 bp, Homo sapien
aaacgaaggcgtcggtgcgatgtgc

SEQ ID NO: 81654 - DNA, 25 bp, Homo sapien
cggcccacagagcacaggtgaggca

SEQ ID NO: 81655 - DNA, 25 bp, Homo sapien
gctgggtgagttccggacgcttcca

SEQ ID NO: 81656 - DNA, 25 bp, Homo sapien
cggccttcggctaaggcagaggacc

SEQ ID NO: 81657 - DNA, 25 bp, Homo sapien
aacagtcggcgcgtttggtactcgc

SEQ ID NO: 81658 - DNA, 25 bp, Homo sapien
ctgcgcctgtttctcggccagggga

SEQ ID NO: 81659 - DNA, 25 bp, Homo sapien
ggagcaaggccacgcggcctacgca

SEQ ID NO: 81660 - DNA, 25 bp, Homo sapien
ctgagaggcgcgacaaacagtcggc

SEQ ID NO: 81661 - DNA, 25 bp, Homo sapien
cagccgagtcggaaccaaccggttg

SEQ ID NO: 81662 - DNA, 25 bp, Homo sapien
cggtgcaaccacaagagtcgccagc

SEQ ID NO: 81663 - DNA, 25 bp, Homo sapien
gcgagtacgccgtctctccacagaa

SEQ ID NO: 81664 - DNA, 25 bp, Homo sapien
agtcgccttcaggagagacccatca

SEQ ID NO: 81665 - DNA, 25 bp, Homo sapien
gcacggcctttcctaactctctttg

SEQ ID NO: 81666 - DNA, 25 bp, Homo sapien
ggcaagctagaacgcaccgccagca

SEQ ID NO: 81667 - DNA, 25 bp, Homo sapien
taggcggttatcctccaagctggca

SEQ ID NO: 81668 - DNA, 25 bp, Homo sapien
ggaacgggacccaaagcgacagtga

SEQ ID NO: 81669 - DNA, 25 bp, Homo sapien
ttccaagtgcgcagtcagcagccca

SEQ ID NO: 81670 - DNA, 25 bp, Homo sapien
ttcttggagggcctagctttcctcc

SEQ ID NO: 81671 - DNA, 25 bp, Homo sapien
tctgtgaacactacgcgcaagccct

SEQ ID NO: 81672 - DNA, 25 bp, Homo sapien
tcggacacttctgctttcgcccggg

SEQ ID NO: 81673 - DNA, 25 bp, Homo sapien
ttctgccacggcgtcatctggaaga

SEQ ID NO: 81674 - DNA, 25 bp, Homo sapien
gtcatctggaagacccgctttttca

SEQ ID NO: 81675 - DNA, 25 bp, Homo sapien
ccctaggtcctgcaccagggttttg

SEQ ID NO: 81676 - DNA, 25 bp, Homo sapien
ttggggccaaagcaagcagtgcctc

SEQ ID NO: 81677 - DNA, 25 bp, Homo sapien
ggtggagcttcttcacggtctgtga

SEQ ID NO: 81678 - DNA, 25 bp, Homo sapien
ggcctgcctatcctgcgatctttgg

SEQ ID NO: 81679 - DNA, 25 bp, Homo sapien
cggtcagatgcgtgccattagtgga

SEQ ID NO: 81680 - DNA, 25 bp, Homo sapien
gctctgcatggagctggtggcctaa

SEQ ID NO: 81681 - DNA, 25 bp, Homo sapien
gagcctcttcctactgggcatgaga

SEQ ID NO: 81682 - DNA, 25 bp, Homo sapien
ctgacgagatagaacggaagagcca

SEQ ID NO: 81683 - DNA, 25 bp, Homo sapien
ggaagagccacgaaaggccctttga

SEQ ID NO: 81684 - DNA, 25 bp, Homo sapien
ggccctttgattccaatacgaaaca

SEQ ID NO: 81685 - DNA, 25 bp, Homo sapien
agaggaatctcaaggccacccacca

SEQ ID NO: 81686 - DNA, 25 bp, Homo sapien
tccagctcccggattctgcggggta

SEQ ID NO: 81687 - DNA, 25 bp, Homo sapien
agcctcgaggccgtgagcccgaacg

SEQ ID NO: 81688 - DNA, 25 bp, Homo sapien
acccgtgggcgccaatcaatgctat

SEQ ID NO: 81689 - DNA, 25 bp, Homo sapien
tcaatgctatggtggcggagagtaa

SEQ ID NO: 81690 - DNA, 25 bp, Homo sapien
attgccagcgcagagctccggctct

SEQ ID NO: 81691 - DNA, 25 bp, Homo sapien
agaaatacgggagggtctcgtcagt

SEQ ID NO: 81692 - DNA, 25 bp, Homo sapien
gtaatgtcgcccagtgccagcagag

SEQ ID NO: 81693 - DNA, 25 bp, Homo sapien
accagcgacctcagtctgcaggagc

SEQ ID NO: 81694 - DNA, 25 bp, Homo sapien
acagggcagggtcacaaacactctc

SEQ ID NO: 81695 - DNA, 25 bp, Homo sapien
cccagcggtcgcgaaaaccagagtc

SEQ ID NO: 81696 - DNA, 25 bp, Homo sapien
cactcacagcctttagcggttgttg

SEQ ID NO: 81697 - DNA, 25 bp, Homo sapien
cagaggttgagcacgattccatttc

SEQ ID NO: 81698 - DNA, 25 bp, Homo sapien
gtccctaacgcctccagagacttta

SEQ ID NO: 81699 - DNA, 25 bp, Homo sapien
cttctctgcagaaccgtgcggctga

SEQ ID NO: 81700 - DNA, 25 bp, Homo sapien
ttactaaggacaaccgggcaggctg

SEQ ID NO: 81701 - DNA, 25 bp, Homo sapien
ggcctttatctctgcacggtcagca

SEQ ID NO: 81702 - DNA, 25 bp, Homo sapien
gccagcccttcttattcttctcgta

SEQ ID NO: 81703 - DNA, 25 bp, Homo sapien
ccttctggctccttgactgtgcgac

SEQ ID NO: 81704 - DNA, 25 bp, Homo sapien
tcttctcgtagaacgggaacttcgc

SEQ ID NO: 81705 - DNA, 25 bp, Homo sapien
gcggatgctattttgccagcccttc

SEQ ID NO: 81706 - DNA, 25 bp, Homo sapien
cgaacatgtcttcgcaggccgggtc

SEQ ID NO: 81707 - DNA, 25 bp, Homo sapien
cgccatgctctgcacgcgtgtgtac

SEQ ID NO: 81708 - DNA, 25 bp, Homo sapien
cccaggccattgtacgagttcacta

SEQ ID NO: 81709 - DNA, 25 bp, Homo sapien
ggaacttcgcgatgatgtactggta

SEQ ID NO: 81710 - DNA, 25 bp, Homo sapien
cggggcgccctgatttacttctcaa

SEQ ID NO: 81711 - DNA, 25 bp, Homo sapien
ggcccagctctactagggaagcgtc

SEQ ID NO: 81712 - DNA, 25 bp, Homo sapien
cacggctctgatacagacgcttttc

SEQ ID NO: 81713 - DNA, 25 bp, Homo sapien
accgccgattgagcgcagtctcagc

SEQ ID NO: 81714 - DNA, 25 bp, Homo sapien
cgcctgcggatacggttccagtgaa

SEQ ID NO: 81715 - DNA, 25 bp, Homo sapien
agggtcccgcagctgcaattcagca

SEQ ID NO: 81716 - DNA, 25 bp, Homo sapien
ctgtgcctaggttttgtggacgcca

SEQ ID NO: 81717 - DNA, 25 bp, Homo sapien
ggcagcgcttcgctagaaccactca

SEQ ID NO: 81718 - DNA, 25 bp, Homo sapien
gcacgacgcctttctgcttctcgag

SEQ ID NO: 81719 - DNA, 25 bp, Homo sapien
ttgaggctagagcactgggacatgc

SEQ ID NO: 81720 - DNA, 25 bp, Homo sapien
tgcccgactcctttttgaggctaga

SEQ ID NO: 81721 - DNA, 25 bp, Homo sapien
gtcaggggaaatgccgcactggctt

SEQ ID NO: 81722 - DNA, 25 bp, Homo sapien
tcaccgctggcatagctgtcgtcca

SEQ ID NO: 81723 - DNA, 25 bp, Homo sapien
gccaagctcttaccggcttccgaga

SEQ ID NO: 81724 - DNA, 25 bp, Homo sapien
aatgcagacgccctgcctcggtctt

SEQ ID NO: 81725 - DNA, 25 bp, Homo sapien
agcaaggtggttctaggccaagctc

SEQ ID NO: 81726 - DNA, 25 bp, Homo sapien
gcccagcgacctgcgactgaaacaa

SEQ ID NO: 81727 - DNA, 25 bp, Homo sapien
gactgaaacaaatccgccctcgggc

SEQ ID NO: 81728 - DNA, 25 bp, Homo sapien
tgcaggccttctctgtgcgttgcca

SEQ ID NO: 81729 - DNA, 25 bp, Homo sapien
ccacagtgggacgaacctccagata

SEQ ID NO: 81730 - DNA, 25 bp, Homo sapien
taaataagaacagtccgcgtgagcc

SEQ ID NO: 81731 - DNA, 25 bp, Homo sapien
cgtgagccgggctcatcttaacact

SEQ ID NO: 81732 - DNA, 25 bp, Homo sapien
tcttaacactaagcagaggggcctg

SEQ ID NO: 81733 - DNA, 25 bp, Homo sapien
cggacttgaaagctgccggctgaga

SEQ ID NO: 81734 - DNA, 25 bp, Homo sapien
acaggcgggtgatgtctttcctgga

SEQ ID NO: 81735 - DNA, 25 bp, Homo sapien
tttcccggtgttgttccaggcctga

SEQ ID NO: 81736 - DNA, 25 bp, Homo sapien
tgttccaggcctgacgggtgttcag

SEQ ID NO: 81737 - DNA, 25 bp, Homo sapien
gtaggactcagggtgtaggacgagc

SEQ ID NO: 81738 - DNA, 25 bp, Homo sapien
gggcttcctcactttcgtaccgcgc

SEQ ID NO: 81739 - DNA, 25 bp, Homo sapien
gtgatgtctttcctggaggcagcga

SEQ ID NO: 81740 - DNA, 25 bp, Homo sapien
ggggttcaggtgcacgggcacagac

SEQ ID NO: 81741 - DNA, 25 bp, Homo sapien
taggacgagcgtggcgcgtccctcc

SEQ ID NO: 81742 - DNA, 25 bp, Homo sapien
ctcttgggcctagcagaggacgtag

SEQ ID NO: 81743 - DNA, 25 bp, Homo sapien
gcctggagagtgtccctctgaactg

SEQ ID NO: 81744 - DNA, 25 bp, Homo sapien
ccatagcctcgacggcgctcttggg

SEQ ID NO: 81745 - DNA, 25 bp, Homo sapien
cgggcagcgaagtcctttttgaggt

SEQ ID NO: 81746 - DNA, 25 bp, Homo sapien
gaccgcagtccgtgctgctgagaga

SEQ ID NO: 81747 - DNA, 25 bp, Homo sapien
gacccggatgcacgtccgatgacta

SEQ ID NO: 81748 - DNA, 25 bp, Homo sapien
ccgatgactaataacgtgggacgtc

SEQ ID NO: 81749 - DNA, 25 bp, Homo sapien
cagaagacttcctgctcaacgacga

SEQ ID NO: 81750 - DNA, 25 bp, Homo sapien
aaggcggaattccaggtcaaagatg

SEQ ID NO: 81751 - DNA, 25 bp, Homo sapien
atcgacgttggtgcgggctccagca

SEQ ID NO: 81752 - DNA, 25 bp, Homo sapien
gcgcggcggtgaagtcctctttgaa

SEQ ID NO: 81753 - DNA, 25 bp, Homo sapien
tctttgaagtaacagatgtcggtgg

SEQ ID NO: 81754 - DNA, 25 bp, Homo sapien
ccaccgggctcagcttagctcgttg

SEQ ID NO: 81755 - DNA, 25 bp, Homo sapien
ctcagcttagctcgttggacccttg

SEQ ID NO: 81756 - DNA, 25 bp, Homo sapien
ggacccttgggccttcctgatgcag

SEQ ID NO: 81757 - DNA, 25 bp, Homo sapien
tagctcgttggacccttgggccttc

SEQ ID NO: 81758 - DNA, 25 bp, Homo sapien
gcggaggtacacctgctgcccaata

SEQ ID NO: 81759 - DNA, 25 bp, Homo sapien
gacccgccctagaggcggaggtaca

SEQ ID NO: 81760 - DNA, 25 bp, Homo sapien
acactcgcaggaccgacattggcgc

SEQ ID NO: 81761 - DNA, 25 bp, Homo sapien
aggaccgacattggcgcgagctcca

SEQ ID NO: 81762 - DNA, 25 bp, Homo sapien
caatcggctgcgcttggcagggcct

SEQ ID NO: 81763 - DNA, 25 bp, Homo sapien
cctcccggagatcggagtcggtgct

SEQ ID NO: 81764 - DNA, 25 bp, Homo sapien
ctgtgtggctcagcctcgcgcgatg

SEQ ID NO: 81765 - DNA, 25 bp, Homo sapien
gaacctcgcacgctgtgtggctcag

SEQ ID NO: 81766 - DNA, 25 bp, Homo sapien
ttgctctttcgagatggggctgcca

SEQ ID NO: 81767 - DNA, 25 bp, Homo sapien
tggcaggcgaaaaccacgcgatagc

SEQ ID NO: 81768 - DNA, 25 bp, Homo sapien
cgtagatcctgtttctggcaggcga

SEQ ID NO: 81769 - DNA, 25 bp, Homo sapien
gcgttcttctgggagacgtagatcc

SEQ ID NO: 81770 - DNA, 25 bp, Homo sapien
cggactttcgctggggcgttcttct

SEQ ID NO: 81771 - DNA, 25 bp, Homo sapien
gttcagctccgaggccggtaagtga

SEQ ID NO: 81772 - DNA, 25 bp, Homo sapien
caaccgctaccttgctctttcgaga

SEQ ID NO: 81773 - DNA, 25 bp, Homo sapien
agtgaccttccggactttcgctggg

SEQ ID NO: 81774 - DNA, 25 bp, Homo sapien
aacgtggccttccagaccgctggta

SEQ ID NO: 81775 - DNA, 25 bp, Homo sapien
cccgggcactgattaaggctgcgaa

SEQ ID NO: 81776 - DNA, 25 bp, Homo sapien
cccagtgttgtagttgtgtttcgga

SEQ ID NO: 81777 - DNA, 25 bp, Homo sapien
tcagactgactgacgtggaacttcc

SEQ ID NO: 81778 - DNA, 25 bp, Homo sapien
ggagccgattctcgcgatagtcaga

SEQ ID NO: 81779 - DNA, 25 bp, Homo sapien
ttgttaccggctactcaggccttga

SEQ ID NO: 81780 - DNA, 25 bp, Homo sapien
agctccaggaatcggccgtaaccta

SEQ ID NO: 81781 - DNA, 25 bp, Homo sapien
ttctacgggatctggacctaccatg

SEQ ID NO: 81782 - DNA, 25 bp, Homo sapien
tatggtcaccgtcctgcacgatctc

SEQ ID NO: 81783 - DNA, 25 bp, Homo sapien
cactgttagggttcccgctggcttt

SEQ ID NO: 81784 - DNA, 25 bp, Homo sapien
tctccgcccgcgaacactgttaggg

SEQ ID NO: 81785 - DNA, 25 bp, Homo sapien
ctggcttcagcaagttggcgatttt

SEQ ID NO: 81786 - DNA, 25 bp, Homo sapien
cagcgtgcggatgatcatatggtca

SEQ ID NO: 81787 - DNA, 25 bp, Homo sapien
gcgattttgcgcaaggccacattga

SEQ ID NO: 81788 - DNA, 25 bp, Homo sapien
cgccagagagttggcagggaaactc

SEQ ID NO: 81789 - DNA, 25 bp, Homo sapien
tcagagaaccgttcccaaggtagcg

SEQ ID NO: 81790 - DNA, 25 bp, Homo sapien
cgcgcacaaagcctgcgggaggatc

SEQ ID NO: 81791 - DNA, 25 bp, Homo sapien
gacgtttgctttgttggccgaactc

SEQ ID NO: 81792 - DNA, 25 bp, Homo sapien
ctacaaaggaagaggagaccggaga

SEQ ID NO: 81793 - DNA, 25 bp, Homo sapien
tcgtttcagacgttcagttcgtttc

SEQ ID NO: 81794 - DNA, 25 bp, Homo sapien
gcgccaccttcgtttcagacgttca

SEQ ID NO: 81795 - DNA, 25 bp, Homo sapien
gatgtcgaagggtcaggtttgtcca

SEQ ID NO: 81796 - DNA, 25 bp, Homo sapien
ggatccattgtagcggtcgctcctc

SEQ ID NO: 81797 - DNA, 25 bp, Homo sapien
aaagcctgcgggaggatccattgta

SEQ ID NO: 81798 - DNA, 25 bp, Homo sapien
actcccaggactcagttaggggcca

SEQ ID NO: 81799 - DNA, 25 bp, Homo sapien
agtctgagggaaacagatctgcgcc

SEQ ID NO: 81800 - DNA, 25 bp, Homo sapien
gaacttgaccttgcgctcccttagc

SEQ ID NO: 81801 - DNA, 25 bp, Homo sapien
cggggccaaggcgaacttgaccttg

SEQ ID NO: 81802 - DNA, 25 bp, Homo sapien
acgacgtttggtctcgggactcaag

SEQ ID NO: 81803 - DNA, 25 bp, Homo sapien
actaggggacctgctgggcctagca

SEQ ID NO: 81804 - DNA, 25 bp, Homo sapien
ctgctatttgcagggctcagcaacg

SEQ ID NO: 81805 - DNA, 25 bp, Homo sapien
attcagccgcgatccaggtcctagt

SEQ ID NO: 81806 - DNA, 25 bp, Homo sapien
tgtgacttgtctcccagctcgggga

SEQ ID NO: 81807 - DNA, 25 bp, Homo sapien
gtctggggagtacggacaactttga

SEQ ID NO: 81808 - DNA, 25 bp, Homo sapien
tggattcccgaagtcagttccctgc

SEQ ID NO: 81809 - DNA, 25 bp, Homo sapien
taggctcaagctggatttgcccacc

SEQ ID NO: 81810 - DNA, 25 bp, Homo sapien
gtgctggggaagtttgctcttctcc

SEQ ID NO: 81811 - DNA, 25 bp, Homo sapien
gctagaagcgcacccatcgggcacg

SEQ ID NO: 81812 - DNA, 25 bp, Homo sapien
tcatgaatatgcacgagccacctcc

SEQ ID NO: 81813 - DNA, 25 bp, Homo sapien
gccgatgcccgcgttcatgaatatg

SEQ ID NO: 81814 - DNA, 25 bp, Homo sapien
ccggggtagcctgccggacaaccat

SEQ ID NO: 81815 - DNA, 25 bp, Homo sapien
gggcgtggcctcaccctactagggc

SEQ ID NO: 81816 - DNA, 25 bp, Homo sapien
gtccgacgccgactgaggcacgagc

SEQ ID NO: 81817 - DNA, 25 bp, Homo sapien
cagaaagcagaacccgcaggtgagc

SEQ ID NO: 81818 - DNA, 25 bp, Homo sapien
cggacaaccataggcaaagttagtt

SEQ ID NO: 81819 - DNA, 25 bp, Homo sapien
ctacccgcccgagatgagaggggca

SEQ ID NO: 81820 - DNA, 25 bp, Homo sapien
acccgccctggaatgccagcgtggg

SEQ ID NO: 81821 - DNA, 25 bp, Homo sapien
cctgcagcgcggagcagaaagcaga

SEQ ID NO: 81822 - DNA, 25 bp, Homo sapien
ggtcactaaggtccacagagctgtc

SEQ ID NO: 81823 - DNA, 25 bp, Homo sapien
tggactcggccagtgatttcacttg

SEQ ID NO: 81824 - DNA, 25 bp, Homo sapien
tgctgtcattgtcaccgtctgagta

SEQ ID NO: 81825 - DNA, 25 bp, Homo sapien
gcgctcgtaagcactctgcctcttg

SEQ ID NO: 81826 - DNA, 25 bp, Homo sapien
aggccgtcatctcgtccagtttgcg

SEQ ID NO: 81827 - DNA, 25 bp, Homo sapien
ccctcgaagtaggagctgtgcactt

SEQ ID NO: 81828 - DNA, 25 bp, Homo sapien
ctgcatcctcatgttggacagcaca

SEQ ID NO: 81829 - DNA, 25 bp, Homo sapien
ctcctcatcgatgtacagggtgaca

SEQ ID NO: 81830 - DNA, 25 bp, Homo sapien
tgtggccatgcaagaccacgtcttt

SEQ ID NO: 81831 - DNA, 25 bp, Homo sapien
tgcctcaaggccttccactcggatg

SEQ ID NO: 81832 - DNA, 25 bp, Homo sapien
ctgcaagttctctttccacaatggc

SEQ ID NO: 81833 - DNA, 25 bp, Homo sapien
cgcatcatcgagtactgccgcaatg

SEQ ID NO: 81834 - DNA, 25 bp, Homo sapien
acgtctttgtggacaccagcgccga

SEQ ID NO: 81835 - DNA, 25 bp, Homo sapien
tctgccgcaacaagcgcatcgctta

SEQ ID NO: 81836 - DNA, 25 bp, Homo sapien
cgggcgtctcaccaagcgctacatg

SEQ ID NO: 81837 - DNA, 25 bp, Homo sapien
acggctacctcaagtggcgctttga

SEQ ID NO: 81838 - DNA, 25 bp, Homo sapien
cgggagccatcaaatagtcatcttc

SEQ ID NO: 81839 - DNA, 25 bp, Homo sapien
gcctctgtttatgtcgggagccatc

SEQ ID NO: 81840 - DNA, 25 bp, Homo sapien
cgtcacgacgctcacaccaatggga

SEQ ID NO: 81841 - DNA, 25 bp, Homo sapien
atttcgcgtaggttgcatggcccaa

SEQ ID NO: 81842 - DNA, 25 bp, Homo sapien
gaggccgaatccatgcgtctgagga

SEQ ID NO: 81843 - DNA, 25 bp, Homo sapien
tgcgtcgctttcagcctctggtgaa

SEQ ID NO: 81844 - DNA, 25 bp, Homo sapien
ctttcattgaaagagcccgtaggga

SEQ ID NO: 81845 - DNA, 25 bp, Homo sapien
cccgtagggatcacgtgaaagaaca

SEQ ID NO: 81846 - DNA, 25 bp, Homo sapien
gggattcttcccgaacaggcgcttg

SEQ ID NO: 81847 - DNA, 25 bp, Homo sapien
cctgacgtcccagtccctgagaatt

SEQ ID NO: 81848 - DNA, 25 bp, Homo sapien
ggcgcttgccctctcttttatggta

SEQ ID NO: 81849 - DNA, 25 bp, Homo sapien
caggatcgcttcagtaaggcgcttc

SEQ ID NO: 81850 - DNA, 25 bp, Homo sapien
ggcgccaagcttccaagcggctaga

SEQ ID NO: 81851 - DNA, 25 bp, Homo sapien
cttcagggatgagctcagccagatc

SEQ ID NO: 81852 - DNA, 25 bp, Homo sapien
cgccttccgcggctattggattagt

SEQ ID NO: 81853 - DNA, 25 bp, Homo sapien
atggtaagtactctccagctcctgg

SEQ ID NO: 81854 - DNA, 25 bp, Homo sapien
aggaccgctcgctcaacgtcttcgt

SEQ ID NO: 81855 - DNA, 25 bp, Homo sapien
tcttcgtcaaggacgacgaccggct

SEQ ID NO: 81856 - DNA, 25 bp, Homo sapien
cggcacccacgctgtagttggtgtg

SEQ ID NO: 81857 - DNA, 25 bp, Homo sapien
cgcggctggaccagctgttggacat

SEQ ID NO: 81858 - DNA, 25 bp, Homo sapien
tggcccattcctggctacggggagt

SEQ ID NO: 81859 - DNA, 25 bp, Homo sapien
tgcacgcctggcagatcaactggcc

SEQ ID NO: 81860 - DNA, 25 bp, Homo sapien
cccgcagtgaagcatgggccagaag

SEQ ID NO: 81861 - DNA, 25 bp, Homo sapien
ctacacggcgctggtaggcagtgac

SEQ ID NO: 81862 - DNA, 25 bp, Homo sapien
cgtgtctcgtcggtccctatttgag

SEQ ID NO: 81863 - DNA, 25 bp, Homo sapien
cggtccctatttgagttagaggtgg

SEQ ID NO: 81864 - DNA, 25 bp, Homo sapien
aagaccgcttcagccaccgtgcaga

SEQ ID NO: 81865 - DNA, 25 bp, Homo sapien
cgtgcagaaaggtgcctgcgtccta

SEQ ID NO: 81866 - DNA, 25 bp, Homo sapien
gggtgatgccgcagccctccgcagt

SEQ ID NO: 81867 - DNA, 25 bp, Homo sapien
tgttcaggaagggatttccgggcta

SEQ ID NO: 81868 - DNA, 25 bp, Homo sapien
gccgagactgcggagagcatgttca

SEQ ID NO: 81869 - DNA, 25 bp, Homo sapien
agagttgctgtgctgccgagactgc

SEQ ID NO: 81870 - DNA, 25 bp, Homo sapien
ccgggtctctgcagaccgttggaga

SEQ ID NO: 81871 - DNA, 25 bp, Homo sapien
cacaaggccggatgtgttctgagcc

SEQ ID NO: 81872 - DNA, 25 bp, Homo sapien
cgcagtccctgatcgcaggtcagga

SEQ ID NO: 81873 - DNA, 25 bp, Homo sapien
gacagtttgggtctacgtggcagca

SEQ ID NO: 81874 - DNA, 25 bp, Homo sapien
ttacaggcagccctcaagtgctctg

SEQ ID NO: 81875 - DNA, 25 bp, Homo sapien
cagcagcgaggactagagcaacaca

SEQ ID NO: 81876 - DNA, 25 bp, Homo sapien
tgaggatcttcagcagcggctccaa

SEQ ID NO: 81877 - DNA, 25 bp, Homo sapien
agggctctgcagactgaccagtctc

SEQ ID NO: 81878 - DNA, 25 bp, Homo sapien
ccgctggattccagccgagattcaa

SEQ ID NO: 81879 - DNA, 25 bp, Homo sapien
gccgagattcaagctcccgggatcc

SEQ ID NO: 81880 - DNA, 25 bp, Homo sapien
cctgagccggctagtctccaggtaa

SEQ ID NO: 81881 - DNA, 25 bp, Homo sapien
ctccaggtaaggaggcggccgcaac

SEQ ID NO: 81882 - DNA, 25 bp, Homo sapien
aggcggccgcaacttcgcggccttt

SEQ ID NO: 81883 - DNA, 25 bp, Homo sapien
cgcccgagcgcaggttaacattcct

SEQ ID NO: 81884 - DNA, 25 bp, Homo sapien
acattcctggatgcgcaggttagga

SEQ ID NO: 81885 - DNA, 25 bp, Homo sapien
ttaggaccgtgtggtgtagacccac

SEQ ID NO: 81886 - DNA, 25 bp, Homo sapien
acagggtttctgaagggatagaccg

SEQ ID NO: 81887 - DNA, 25 bp, Homo sapien
tttcccacgccgcagagcgatagaa

SEQ ID NO: 81888 - DNA, 25 bp, Homo sapien
gcagagcgatagaacccgcaacagg

SEQ ID NO: 81889 - DNA, 25 bp, Homo sapien
gaagaacaggtagggactacgactc

SEQ ID NO: 81890 - DNA, 25 bp, Homo sapien
cccagaagcctcttgacaaggacta

SEQ ID NO: 81891 - DNA, 25 bp, Homo sapien
atttcccagaaagctccgcgcggtt

SEQ ID NO: 81892 - DNA, 25 bp, Homo sapien
cggaactgcctctgctttcgaaagc

SEQ ID NO: 81893 - DNA, 25 bp, Homo sapien
tgtctacctccaggggtcgttcgtg

SEQ ID NO: 81894 - DNA, 25 bp, Homo sapien
ggcctggtccttggcgccgcagtta

SEQ ID NO: 81895 - DNA, 25 bp, Homo sapien
gcgtccattttctgggcggtgctgt

SEQ ID NO: 81896 - DNA, 25 bp, Homo sapien
gagccgccggcgtccattttctggg

SEQ ID NO: 81897 - DNA, 25 bp, Homo sapien
agcccgatcgctcctcgcttctgga

SEQ ID NO: 81898 - DNA, 25 bp, Homo sapien
cggactcacgggtccggaagcacca

SEQ ID NO: 81899 - DNA, 25 bp, Homo sapien
cacgggtccggaagcaccatggacc

SEQ ID NO: 81900 - DNA, 25 bp, Homo sapien
gcatggggccttacggggccctcac

SEQ ID NO: 81901 - DNA, 25 bp, Homo sapien
cgtggcccaactgcgcggctgtgct

SEQ ID NO: 81902 - DNA, 25 bp, Homo sapien
gatcccaggacggaagcccggcaac

SEQ ID NO: 81903 - DNA, 25 bp, Homo sapien
aggctcgggcacgtccagatttagg

SEQ ID NO: 81904 - DNA, 25 bp, Homo sapien
ttattccttaggtgtgtgcggtttg

SEQ ID NO: 81905 - DNA, 25 bp, Homo sapien
aggcgccactcgttcctccaggacc

SEQ ID NO: 81906 - DNA, 25 bp, Homo sapien
cacccggtaagacagtgagggacca

SEQ ID NO: 81907 - DNA, 25 bp, Homo sapien
ccacgccacccggtaagacagtgag

SEQ ID NO: 81908 - DNA, 25 bp, Homo sapien
ggaaaggggctgctcgccacgccac

SEQ ID NO: 81909 - DNA, 25 bp, Homo sapien
gttccactcaaactagcacgcgggg

SEQ ID NO: 81910 - DNA, 25 bp, Homo sapien
aggagatgtgcaggtctattcattg

SEQ ID NO: 81911 - DNA, 25 bp, Homo sapien
ttaaggccgctcagagccacgactg

SEQ ID NO: 81912 - DNA, 25 bp, Homo sapien
tcagagccacgactgggagctaccc

SEQ ID NO: 81913 - DNA, 25 bp, Homo sapien
gactgggagctacccttagccagcg

SEQ ID NO: 81914 - DNA, 25 bp, Homo sapien
gttctctgcagggtagcccggctcg

SEQ ID NO: 81915 - DNA, 25 bp, Homo sapien
tggggattttaaggccgctcagagc

SEQ ID NO: 81916 - DNA, 25 bp, Homo sapien
caagccgggagtacggttctctgca

SEQ ID NO: 81917 - DNA, 25 bp, Homo sapien
tcccgcgagcgttaggagatgtgca

SEQ ID NO: 81918 - DNA, 25 bp, Homo sapien
ccacgcacaaactcgggtcctgttt

SEQ ID NO: 81919 - DNA, 25 bp, Homo sapien
caaactcgggtcctgtttgctcttc

SEQ ID NO: 81920 - DNA, 25 bp, Homo sapien
aggcagctttctctcgcacgccggg

SEQ ID NO: 81921 - DNA, 25 bp, Homo sapien
ccgctgtcaagctctagctccagaa

SEQ ID NO: 81922 - DNA, 25 bp, Homo sapien
tctagctccagaagggactgggtcc

SEQ ID NO: 81923 - DNA, 25 bp, Homo sapien
actgggtcctctccgagttgcagtg

SEQ ID NO: 81924 - DNA, 25 bp, Homo sapien
ctctccgagttgcagtgcaggcacc

SEQ ID NO: 81925 - DNA, 25 bp, Homo sapien
caggcaccacatggcggccgcagtg

SEQ ID NO: 81926 - DNA, 25 bp, Homo sapien
tcagactcaggccttcgcgcggctg

SEQ ID NO: 81927 - DNA, 25 bp, Homo sapien
acttgaatcgagggacggcgtgaca

SEQ ID NO: 81928 - DNA, 25 bp, Homo sapien
cctgagctgcaggaaacgggccgcc

SEQ ID NO: 81929 - DNA, 25 bp, Homo sapien
agaggttgaaaaaggcgccctgagc

SEQ ID NO: 81930 - DNA, 25 bp, Homo sapien
gctgttcgtttcctgggctcggcga

SEQ ID NO: 81931 - DNA, 25 bp, Homo sapien
gtgggagccgagcagtaattatacg

SEQ ID NO: 81932 - DNA, 25 bp, Homo sapien
gctcggcgggacacctgtacttgcc

SEQ ID NO: 81933 - DNA, 25 bp, Homo sapien
agtaattatacggaggcgcggcccg

SEQ ID NO: 81934 - DNA, 25 bp, Homo sapien
ggacaccaggatttctcagtttctc

SEQ ID NO: 81935 - DNA, 25 bp, Homo sapien
cgagttccgaccagtcctgacactg

SEQ ID NO: 81936 - DNA, 25 bp, Homo sapien
cgacaagtttgacctgcagcgagga

SEQ ID NO: 81937 - DNA, 25 bp, Homo sapien
cagcgacgttggctgcgacaagttt

SEQ ID NO: 81938 - DNA, 25 bp, Homo sapien
ccactgatgaacagggacgccggtc

SEQ ID NO: 81939 - DNA, 25 bp, Homo sapien
gtccacgcttcggaggcctctgtct

SEQ ID NO: 81940 - DNA, 25 bp, Homo sapien
caacaggctggagcgtccacgcttc

SEQ ID NO: 81941 - DNA, 25 bp, Homo sapien
cggctccctgggaaatcgtgttagc

SEQ ID NO: 81942 - DNA, 25 bp, Homo sapien
agtcgggaggcgacaagatgttctc

SEQ ID NO: 81943 - DNA, 25 bp, Homo sapien
ccgagccctctcagttggcctagga

SEQ ID NO: 81944 - DNA, 25 bp, Homo sapien
ctggcgtcaggtgacgtcactgtgc

SEQ ID NO: 81945 - DNA, 25 bp, Homo sapien
ctccctcaagaagtggaacgcggtg

SEQ ID NO: 81946 - DNA, 25 bp, Homo sapien
tccaggtgatgggtaagcgctgcac

SEQ ID NO: 81947 - DNA, 25 bp, Homo sapien
gggcgtccgtcagaagcctcggaaa

SEQ ID NO: 81948 - DNA, 25 bp, Homo sapien
cagcgcagcaggcagattcagcggc

SEQ ID NO: 81949 - DNA, 25 bp, Homo sapien
atacgtgcgccatctgcagggtcca

SEQ ID NO: 81950 - DNA, 25 bp, Homo sapien
ctggtggccacttgtgcgagtgccc

SEQ ID NO: 81951 - DNA, 25 bp, Homo sapien
agccctcggactgcgacagcaaaga

SEQ ID NO: 81952 - DNA, 25 bp, Homo sapien
gagggacccaccaaagacagcgcgc

SEQ ID NO: 81953 - DNA, 25 bp, Homo sapien
ccttcctagaggacgtgcagaactg

SEQ ID NO: 81954 - DNA, 25 bp, Homo sapien
tccgcaaggcggcaaccttcctaga

SEQ ID NO: 81955 - DNA, 25 bp, Homo sapien
cctgtgtgagcagcagcccatcggt

SEQ ID NO: 81956 - DNA, 25 bp, Homo sapien
gccagaagctgtccctgaacttcca

SEQ ID NO: 81957 - DNA, 25 bp, Homo sapien
gagctccgccagaagctgtccctga

SEQ ID NO: 81958 - DNA, 25 bp, Homo sapien
gtctgcgtcgctaatccagcctggc

SEQ ID NO: 81959 - DNA, 25 bp, Homo sapien
attctgattccctcttctgtttgga

SEQ ID NO: 81960 - DNA, 25 bp, Homo sapien
cctgccacggcaaacaaaacatgta

SEQ ID NO: 81961 - DNA, 25 bp, Homo sapien
tttcctctgctcaacagttctcctg

SEQ ID NO: 81962 - DNA, 25 bp, Homo sapien
gtctgcaaaggccactgcttaaagg

SEQ ID NO: 81963 - DNA, 25 bp, Homo sapien
cggcagaaagcgagccctgagaagc

SEQ ID NO: 81964 - DNA, 25 bp, Homo sapien
attgtgctgtcgactggatctggtt

SEQ ID NO: 81965 - DNA, 25 bp, Homo sapien
cccaggaaacagctgatagcgctaa

SEQ ID NO: 81966 - DNA, 25 bp, Homo sapien
ccagagagcgtcctgtaggaacgtc

SEQ ID NO: 81967 - DNA, 25 bp, Homo sapien
tgtaggaacgtcacagagcccagag

SEQ ID NO: 81968 - DNA, 25 bp, Homo sapien
gtcctgtaggaacgtcacagagccc

SEQ ID NO: 81969 - DNA, 25 bp, Homo sapien
cctgtaggaacgtcacagagcccag

SEQ ID NO: 81970 - DNA, 25 bp, Homo sapien
agagagcgtcctgtaggaacgtcac

SEQ ID NO: 81971 - DNA, 25 bp, Homo sapien
gtaggaacgtcacagagcccagaga

SEQ ID NO: 81972 - DNA, 25 bp, Homo sapien
gagcgtcctgtaggaacgtcacaga

SEQ ID NO: 81973 - DNA, 25 bp, Homo sapien
tcctgtaggaacgtcacagagccca

SEQ ID NO: 81974 - DNA, 25 bp, Homo sapien
agaagtccctcaaccagagcctggc

SEQ ID NO: 81975 - DNA, 25 bp, Homo sapien
cgactggagtcgttttcgtgctctc

SEQ ID NO: 81976 - DNA, 25 bp, Homo sapien
gacgattaagttccctcagagagga

SEQ ID NO: 81977 - DNA, 25 bp, Homo sapien
acgtgcgtgcgactaaaccttcgga

SEQ ID NO: 81978 - DNA, 25 bp, Homo sapien
gtccgcgcgcacaccatgacgaaga

SEQ ID NO: 81979 - DNA, 25 bp, Homo sapien
accaccggagaattcctggggcgca

SEQ ID NO: 81980 - DNA, 25 bp, Homo sapien
gccgcgggtagcatcttctcagcgc

SEQ ID NO: 81981 - DNA, 25 bp, Homo sapien
ggacgcccgccttttgctattatta

SEQ ID NO: 81982 - DNA, 25 bp, Homo sapien
ccgattggccctcagaatgtgcgac

SEQ ID NO: 81983 - DNA, 25 bp, Homo sapien
cggagcagcacagtgcgcgccgatt

SEQ ID NO: 81984 - DNA, 25 bp, Homo sapien
gccgagatcgctaccgatttcgtcc

SEQ ID NO: 81985 - DNA, 25 bp, Homo sapien
gcctgcccaaagatgaagggtcagg

SEQ ID NO: 81986 - DNA, 25 bp, Homo sapien
cgccttcggctgcagaagaactggc

SEQ ID NO: 81987 - DNA, 25 bp, Homo sapien
cccaggcttccctttgagagtaggg

SEQ ID NO: 81988 - DNA, 25 bp, Homo sapien
agtgcgtgcacggagtaaacaaacc

SEQ ID NO: 81989 - DNA, 25 bp, Homo sapien
ctgcccggtcaaggcccaggagttt

SEQ ID NO: 81990 - DNA, 25 bp, Homo sapien
cgggactcagcgaaacccagtcaga

SEQ ID NO: 81991 - DNA, 25 bp, Homo sapien
gctacaaatcccaatgctccagagt

SEQ ID NO: 81992 - DNA, 25 bp, Homo sapien
ccagagggcgcgctacaaatcccaa

SEQ ID NO: 81993 - DNA, 25 bp, Homo sapien
gggtttgcgccgtgatctgcagccc

SEQ ID NO: 81994 - DNA, 25 bp, Homo sapien
tctctgctccgggtccgtgagcagc

SEQ ID NO: 81995 - DNA, 25 bp, Homo sapien
acgtggcagcggatcacagaactgc

SEQ ID NO: 81996 - DNA, 25 bp, Homo sapien
ccggtcatagacgtggcagcggatc

SEQ ID NO: 81997 - DNA, 25 bp, Homo sapien
caagtcaccttctgcacgctggagc

SEQ ID NO: 81998 - DNA, 25 bp, Homo sapien
tctgaagcagaaagctcgagcccga

SEQ ID NO: 81999 - DNA, 25 bp, Homo sapien
cagacttgtgggcagcgggaactcc

SEQ ID NO: 82000 - DNA, 25 bp, Homo sapien
aactcgcaagtttgcgccgcgcact

SEQ ID NO: 82001 - DNA, 25 bp, Homo sapien
acagaaactgctttcgctccgtttc

SEQ ID NO: 82002 - DNA, 25 bp, Homo sapien
gctccgtttctctcctgctctgaag

SEQ ID NO: 82003 - DNA, 25 bp, Homo sapien
gcagtggccgaggacgaaataagca

SEQ ID NO: 82004 - DNA, 25 bp, Homo sapien
acgaaataagcagtccaggaggagg

SEQ ID NO: 82005 - DNA, 25 bp, Homo sapien
gagcagaacttacgggcctcgcgcg

SEQ ID NO: 82006 - DNA, 25 bp, Homo sapien
tgatgctctttcaccacttcgctga

SEQ ID NO: 82007 - DNA, 25 bp, Homo sapien
cttcgctgagacagggataccgctc

SEQ ID NO: 82008 - DNA, 25 bp, Homo sapien
catctgtaaaacttggggactccca

SEQ ID NO: 82009 - DNA, 25 bp, Homo sapien
gggactcccatttcgatcgtcaaca

SEQ ID NO: 82010 - DNA, 25 bp, Homo sapien
cggaagcggctgttatcgtctgtaa

SEQ ID NO: 82011 - DNA, 25 bp, Homo sapien
ttcgcagcctctgtaaggaaaaagg

SEQ ID NO: 82012 - DNA, 25 bp, Homo sapien
gccgcgctctagatcagggaaagta

SEQ ID NO: 82013 - DNA, 25 bp, Homo sapien
gataccgctctgagatccatctgta

SEQ ID NO: 82014 - DNA, 25 bp, Homo sapien
gcacgtgaaacccaagccggaatca

SEQ ID NO: 82015 - DNA, 25 bp, Homo sapien
ctctgagggagaagcgcccaaatca

SEQ ID NO: 82016 - DNA, 25 bp, Homo sapien
gaggctgcgaggcactagtcaacca

SEQ ID NO: 82017 - DNA, 25 bp, Homo sapien
cttaggggatcccagccatagcgca

SEQ ID NO: 82018 - DNA, 25 bp, Homo sapien
cgtcttttctgcataggacccgggg

SEQ ID NO: 82019 - DNA, 25 bp, Homo sapien
agcgagcgacgttcgtgaagctttc

SEQ ID NO: 82020 - DNA, 25 bp, Homo sapien
catgtgctatcaacgggcactctga

SEQ ID NO: 82021 - DNA, 25 bp, Homo sapien
acggagcatctccacaagggccgca

SEQ ID NO: 82022 - DNA, 25 bp, Homo sapien
agccaactgcgtgtcggtgcaaccg

SEQ ID NO: 82023 - DNA, 25 bp, Homo sapien
ggacacaccctcctgactgtttggg

SEQ ID NO: 82024 - DNA, 25 bp, Homo sapien
gggcttagcaactgcggcctcgcaa

SEQ ID NO: 82025 - DNA, 25 bp, Homo sapien
ccaggttcccgagagccaactgcgt

SEQ ID NO: 82026 - DNA, 25 bp, Homo sapien
cgtcacccgagcctggacgagtgga

SEQ ID NO: 82027 - DNA, 25 bp, Homo sapien
cacagcagggaagccactggcccag

SEQ ID NO: 82028 - DNA, 25 bp, Homo sapien
aagccactggcccagaggcgcacag

SEQ ID NO: 82029 - DNA, 25 bp, Homo sapien
gcgaacaaacgcacctcaggccaag

SEQ ID NO: 82030 - DNA, 25 bp, Homo sapien
cagatggaaagcgaagcgttactcc

SEQ ID NO: 82031 - DNA, 25 bp, Homo sapien
caaaaggaaggctggacagacagat

SEQ ID NO: 82032 - DNA, 25 bp, Homo sapien
ccctctcgaaggcaggacagcggtg

SEQ ID NO: 82033 - DNA, 25 bp, Homo sapien
tacttggatctccagtgggagctgc

SEQ ID NO: 82034 - DNA, 25 bp, Homo sapien
tggacctgcaggtacttggatctcc

SEQ ID NO: 82035 - DNA, 25 bp, Homo sapien
ccgcaggcaaaacgcggcaagtgga

SEQ ID NO: 82036 - DNA, 25 bp, Homo sapien
aagtggattcagagtttgcgggccc

SEQ ID NO: 82037 - DNA, 25 bp, Homo sapien
gtctcgtctcctggctgtgcagtgt

SEQ ID NO: 82038 - DNA, 25 bp, Homo sapien
cgccaccaacttggggctgtcagtg

SEQ ID NO: 82039 - DNA, 25 bp, Homo sapien
cctcaacttatatcggggcattccc

SEQ ID NO: 82040 - DNA, 25 bp, Homo sapien
tcctccctagtgtcgtcgctacaga

SEQ ID NO: 82041 - DNA, 25 bp, Homo sapien
aagcttttcttgctggcgtgcgaca

SEQ ID NO: 82042 - DNA, 25 bp, Homo sapien
gcagcagtgggaacgactcatcctt

SEQ ID NO: 82043 - DNA, 25 bp, Homo sapien
attccctctgtctcaggcgccgagt

SEQ ID NO: 82044 - DNA, 25 bp, Homo sapien
agagtcgcgaacatctcctcggagc

SEQ ID NO: 82045 - DNA, 25 bp, Homo sapien
actcatcctttttccagccctgggg

SEQ ID NO: 82046 - DNA, 25 bp, Homo sapien
aggcgattatggtgccgtctgactc

SEQ ID NO: 82047 - DNA, 25 bp, Homo sapien
cgcgccgctagggttgttccctagt

SEQ ID NO: 82048 - DNA, 25 bp, Homo sapien
cctagtttacgtctctgggcaaagc

SEQ ID NO: 82049 - DNA, 25 bp, Homo sapien
tcgcgttacctctctggggactgct

SEQ ID NO: 82050 - DNA, 25 bp, Homo sapien
gccgtctgactcgacgcttagtttc

SEQ ID NO: 82051 - DNA, 25 bp, Homo sapien
aggccactgctgaatatcccgtttg

SEQ ID NO: 82052 - DNA, 25 bp, Homo sapien
atatcccgtttgttctccggcggca

SEQ ID NO: 82053 - DNA, 25 bp, Homo sapien
ccgaagcgggttgagtaaagcagca

SEQ ID NO: 82054 - DNA, 25 bp, Homo sapien
ctgcatcggcctgcgggagtccagc

SEQ ID NO: 82055 - DNA, 25 bp, Homo sapien
cccgcgctctccctgagacccaagc

SEQ ID NO: 82056 - DNA, 25 bp, Homo sapien
gcccagctgtgtcggatctacctgc

SEQ ID NO: 82057 - DNA, 25 bp, Homo sapien
tgtgtcggatctacctgcccgcgac

SEQ ID NO: 82058 - DNA, 25 bp, Homo sapien
tggaaagcacgacatcccgcaggca

SEQ ID NO: 82059 - DNA, 25 bp, Homo sapien
ggcagcatatctgagcctgcatcgg

SEQ ID NO: 82060 - DNA, 25 bp, Homo sapien
atatctgagcctgcatcggcctgcg

SEQ ID NO: 82061 - DNA, 25 bp, Homo sapien
aggcctcgagttcgtgtcctctcgg

SEQ ID NO: 82062 - DNA, 25 bp, Homo sapien
cagctcatggcgaaggtcagcagca

SEQ ID NO: 82063 - DNA, 25 bp, Homo sapien
tcgctgcaggtttaggagaagaccc

SEQ ID NO: 82064 - DNA, 25 bp, Homo sapien
cggtagcccgacaggatgaagcact

SEQ ID NO: 82065 - DNA, 25 bp, Homo sapien
agcgtctcgttggtaggcttcagca

SEQ ID NO: 82066 - DNA, 25 bp, Homo sapien
agtgcgtccagaagttgagcgtctc

SEQ ID NO: 82067 - DNA, 25 bp, Homo sapien
tcgccgccgctcaggaagaacagac

SEQ ID NO: 82068 - DNA, 25 bp, Homo sapien
tccgagcagccgctcctaaaaatta

SEQ ID NO: 82069 - DNA, 25 bp, Homo sapien
cgacgcgtagcaccacaacggtagc

SEQ ID NO: 82070 - DNA, 25 bp, Homo sapien
attcagctcgagactggcgtgccca

SEQ ID NO: 82071 - DNA, 25 bp, Homo sapien
ggtctgcattctagtcgcgacggta

SEQ ID NO: 82072 - DNA, 25 bp, Homo sapien
ctaccactgtcgtttggggcccaca

SEQ ID NO: 82073 - DNA, 25 bp, Homo sapien
caggcggatctcagaaggccagttc

SEQ ID NO: 82074 - DNA, 25 bp, Homo sapien
gggcttcactgagatccgctctttc

SEQ ID NO: 82075 - DNA, 25 bp, Homo sapien
acagtcgactattcagccttgcagg

SEQ ID NO: 82076 - DNA, 25 bp, Homo sapien
gcgcggctgaggaaattactgacac

SEQ ID NO: 82077 - DNA, 25 bp, Homo sapien
cgtgactcccaggaaaactagcgga

SEQ ID NO: 82078 - DNA, 25 bp, Homo sapien
ggagctgagtcccatataagccgcc

SEQ ID NO: 82079 - DNA, 25 bp, Homo sapien
ctgcccggaaactgcccagggataa

SEQ ID NO: 82080 - DNA, 25 bp, Homo sapien
atcctcccggtgatggaagcagccg

SEQ ID NO: 82081 - DNA, 25 bp, Homo sapien
tgcccagggataagtcggccgactc

SEQ ID NO: 82082 - DNA, 25 bp, Homo sapien
cgctgccagagaggtgggaaaattc

SEQ ID NO: 82083 - DNA, 25 bp, Homo sapien
aggaacgagtgacagccggacagtc

SEQ ID NO: 82084 - DNA, 25 bp, Homo sapien
cggattgtgcctgtgatgagccgca

SEQ ID NO: 82085 - DNA, 25 bp, Homo sapien
cctctcggaatgaaggtgttccgta

SEQ ID NO: 82086 - DNA, 25 bp, Homo sapien
tctacatacataaagcccaggctgg

SEQ ID NO: 82087 - DNA, 25 bp, Homo sapien
cagcgtggataattccctcggaggc

SEQ ID NO: 82088 - DNA, 25 bp, Homo sapien
gctggcgttttgagtgatcggttta

SEQ ID NO: 82089 - DNA, 25 bp, Homo sapien
gtttattaatacagcggggccgctg

SEQ ID NO: 82090 - DNA, 25 bp, Homo sapien
ctgccgaggcggatcgcaataacaa

SEQ ID NO: 82091 - DNA, 25 bp, Homo sapien
ccaccagaggcgtcgttatgtaatt

SEQ ID NO: 82092 - DNA, 25 bp, Homo sapien
gggaacacttgctggagagtcatca

SEQ ID NO: 82093 - DNA, 25 bp, Homo sapien
gagtcatcagcccttcacctggtgc

SEQ ID NO: 82094 - DNA, 25 bp, Homo sapien
cctcaacgtgaagaacgtgtacttc

SEQ ID NO: 82095 - DNA, 25 bp, Homo sapien
ccttcttggtctcaggagagccagc

SEQ ID NO: 82096 - DNA, 25 bp, Homo sapien
gtgtgagacatcctagctcctcttc

SEQ ID NO: 82097 - DNA, 25 bp, Homo sapien
agctcttgtgcgaagccagcagtgc

SEQ ID NO: 82098 - DNA, 25 bp, Homo sapien
gctcctctataacttggctggcgtg

SEQ ID NO: 82099 - DNA, 25 bp, Homo sapien
ctcttggcagcgcaacgaactgacc

SEQ ID NO: 82100 - DNA, 25 bp, Homo sapien
ttcctcaacgggcaggtggtattcg

SEQ ID NO: 82101 - DNA, 25 bp, Homo sapien
ggcgcttcctgcagctcaataagtg

SEQ ID NO: 82102 - DNA, 25 bp, Homo sapien
agcagctgaggcttcaccgtgcatc

SEQ ID NO: 82103 - DNA, 25 bp, Homo sapien
gggaagcctgcacttagctttggga

SEQ ID NO: 82104 - DNA, 25 bp, Homo sapien
tcacgcagcgcttctggctggaacg

SEQ ID NO: 82105 - DNA, 25 bp, Homo sapien
ctatttaaggagctgcctgcggcta

SEQ ID NO: 82106 - DNA, 25 bp, Homo sapien
cccacgtctggactgtttgctcagc

SEQ ID NO: 82107 - DNA, 25 bp, Homo sapien
cgagtccgcacccagacagggattc

SEQ ID NO: 82108 - DNA, 25 bp, Homo sapien
cgggcacgctgagttcaccgagaac

SEQ ID NO: 82109 - DNA, 25 bp, Homo sapien
tgctcagcgcggacgctatttaagg

SEQ ID NO: 82110 - DNA, 25 bp, Homo sapien
gacggagaggatttttcaagttata

SEQ ID NO: 82111 - DNA, 25 bp, Homo sapien
ccgtagaaacgccagagacccatga

SEQ ID NO: 82112 - DNA, 25 bp, Homo sapien
acccaatcaagcgagacctgtcacg

SEQ ID NO: 82113 - DNA, 25 bp, Homo sapien
tcacgcagagcgaaacgaaagggcc

SEQ ID NO: 82114 - DNA, 25 bp, Homo sapien
ctgggcaggaaactgctcgctccca

SEQ ID NO: 82115 - DNA, 25 bp, Homo sapien
cggaacttctgcaaccacctgagga

SEQ ID NO: 82116 - DNA, 25 bp, Homo sapien
agcgtttttacctgcgagtggcctg

SEQ ID NO: 82117 - DNA, 25 bp, Homo sapien
ccagacgccgggtctagttgtactg

SEQ ID NO: 82118 - DNA, 25 bp, Homo sapien
tgttgctaaaatgcacgcgccgcgc

SEQ ID NO: 82119 - DNA, 25 bp, Homo sapien
ccgcgctggaaacctggaagtctgt

SEQ ID NO: 82120 - DNA, 25 bp, Homo sapien
tgacactactttccaaggcggcttt

SEQ ID NO: 82121 - DNA, 25 bp, Homo sapien
ccgcgcccaaggagcaacgtagtgc

SEQ ID NO: 82122 - DNA, 25 bp, Homo sapien
ggtttgctctcgcagcatccggaga

SEQ ID NO: 82123 - DNA, 25 bp, Homo sapien
gacgtcgagtaaccgtggtcgccag

SEQ ID NO: 82124 - DNA, 25 bp, Homo sapien
ctgccttcggcactgagacacgcga

SEQ ID NO: 82125 - DNA, 25 bp, Homo sapien
cgcggagcctacgatgacactactt

SEQ ID NO: 82126 - DNA, 25 bp, Homo sapien
tttttgctctttggagagactccgg

SEQ ID NO: 82127 - DNA, 25 bp, Homo sapien
tgccgagtttccgttccacttcagg

SEQ ID NO: 82128 - DNA, 25 bp, Homo sapien
cctctgacgcaaacacaattatggg

SEQ ID NO: 82129 - DNA, 25 bp, Homo sapien
gtcccatagggaggcgactgagaaa

SEQ ID NO: 82130 - DNA, 25 bp, Homo sapien
agccgaggtcctagcgtggcttcct

SEQ ID NO: 82131 - DNA, 25 bp, Homo sapien
gtgactgccaggcacacctgttgca

SEQ ID NO: 82132 - DNA, 25 bp, Homo sapien
tgttgcacagccctcccggaagtcg

SEQ ID NO: 82133 - DNA, 25 bp, Homo sapien
gcctggaccagcctcagagtctaca

SEQ ID NO: 82134 - DNA, 25 bp, Homo sapien
tgggagtaacctttgcgccaacacc

SEQ ID NO: 82135 - DNA, 25 bp, Homo sapien
ttccgctcccgagcgagacaaggtc

SEQ ID NO: 82136 - DNA, 25 bp, Homo sapien
tctcagaagtcagccggaaaagggt

SEQ ID NO: 82137 - DNA, 25 bp, Homo sapien
gcggctcctggtttcgtttcctgaa

SEQ ID NO: 82138 - DNA, 25 bp, Homo sapien
ctggtttcgtttcctgaatcttacg

SEQ ID NO: 82139 - DNA, 25 bp, Homo sapien
tgaatcttacgtacacaacacggtt

SEQ ID NO: 82140 - DNA, 25 bp, Homo sapien
acagctgctgcgcaaccttctcaga

SEQ ID NO: 82141 - DNA, 25 bp, Homo sapien
tgcgcctctagactgccgggcacag

SEQ ID NO: 82142 - DNA, 25 bp, Homo sapien
ttgcggccagtacagatgctgattc

SEQ ID NO: 82143 - DNA, 25 bp, Homo sapien
ccgcagacgcgcacgggaacaaaca

SEQ ID NO: 82144 - DNA, 25 bp, Homo sapien
cccggtatgtttttgtgcacagagt

SEQ ID NO: 82145 - DNA, 25 bp, Homo sapien
gtcctggctggacaataaatgaccg

SEQ ID NO: 82146 - DNA, 25 bp, Homo sapien
accgcgtcgctgtttacttagtgtc

SEQ ID NO: 82147 - DNA, 25 bp, Homo sapien
ttccaccctgggaacaggctttctg

SEQ ID NO: 82148 - DNA, 25 bp, Homo sapien
tctgctgacgctggctttagggaaa

SEQ ID NO: 82149 - DNA, 25 bp, Homo sapien
cgtccgcctcgctgattatcttttc

SEQ ID NO: 82150 - DNA, 25 bp, Homo sapien
ctgggcgctttaaacaaatggctgc

SEQ ID NO: 82151 - DNA, 25 bp, Homo sapien
tgcctcccagcgctctgagttaagg

SEQ ID NO: 82152 - DNA, 25 bp, Homo sapien
gcatccaggaaaaacaggcgctttg

SEQ ID NO: 82153 - DNA, 25 bp, Homo sapien
gaccggctacctagcgtctagctga

SEQ ID NO: 82154 - DNA, 25 bp, Homo sapien
cgcagctggagaactgttgcctttg

SEQ ID NO: 82155 - DNA, 25 bp, Homo sapien
cttcgggaagaaaacagctgctgct

SEQ ID NO: 82156 - DNA, 25 bp, Homo sapien
cactgacttgcgatgtcgaccggtc

SEQ ID NO: 82157 - DNA, 25 bp, Homo sapien
ggccaaatgggatccgaggtgtcta

SEQ ID NO: 82158 - DNA, 25 bp, Homo sapien
cagcgccgaatactgacctgtgtga

SEQ ID NO: 82159 - DNA, 25 bp, Homo sapien
aagcaaatgtggttggcctgttccg

SEQ ID NO: 82160 - DNA, 25 bp, Homo sapien
tgcacgcggatgtgatttacaagtt

SEQ ID NO: 82161 - DNA, 25 bp, Homo sapien
gcgcgtacatgtctccagggagccc

SEQ ID NO: 82162 - DNA, 25 bp, Homo sapien
agagctgctacctgttgtcgaaaca

SEQ ID NO: 82163 - DNA, 25 bp, Homo sapien
cctctgcagtcagccgtggaactca

SEQ ID NO: 82164 - DNA, 25 bp, Homo sapien
gccgaattgctgttgggccaagtcc

SEQ ID NO: 82165 - DNA, 25 bp, Homo sapien
cgaggttcaccgtcaggttcatgcc

SEQ ID NO: 82166 - DNA, 25 bp, Homo sapien
tccggcgatttaaagggctgctggc

SEQ ID NO: 82167 - DNA, 25 bp, Homo sapien
ctcagtcgagtgtggcaaaagccga

SEQ ID NO: 82168 - DNA, 25 bp, Homo sapien
gcctccgacaagatgccttccagtg

SEQ ID NO: 82169 - DNA, 25 bp, Homo sapien
ctctgtagaaagtgcacgccgcgtt

SEQ ID NO: 82170 - DNA, 25 bp, Homo sapien
ctacctcgtcttaggcctctgtaga

SEQ ID NO: 82171 - DNA, 25 bp, Homo sapien
cggctacttgttgcctgcggtccaa

SEQ ID NO: 82172 - DNA, 25 bp, Homo sapien
aacaggttttcgctctcggatctcc

SEQ ID NO: 82173 - DNA, 25 bp, Homo sapien
gcgaaactcaaggatctggccctga

SEQ ID NO: 82174 - DNA, 25 bp, Homo sapien
gacgaagccttctccatcgcggttc

SEQ ID NO: 82175 - DNA, 25 bp, Homo sapien
cgtcctttgggatgcgacgaagcct

SEQ ID NO: 82176 - DNA, 25 bp, Homo sapien
aatgtagccttttctctccgcaagc

SEQ ID NO: 82177 - DNA, 25 bp, Homo sapien
tgcggtgtagactcttcgggaaacc

SEQ ID NO: 82178 - DNA, 25 bp, Homo sapien
tcgctcctcgccttgttacaatgta

SEQ ID NO: 82179 - DNA, 25 bp, Homo sapien
ctcggaatgagaacgcggtgacacg

SEQ ID NO: 82180 - DNA, 25 bp, Homo sapien
ccggagggcatttctggaatgcgtt

SEQ ID NO: 82181 - DNA, 25 bp, Homo sapien
cgttttaagtgtcagttgcggtgta

SEQ ID NO: 82182 - DNA, 25 bp, Homo sapien
cgattttccctcctcggctggcgag

SEQ ID NO: 82183 - DNA, 25 bp, Homo sapien
gttcggagcactatgctgcgccgca

SEQ ID NO: 82184 - DNA, 25 bp, Homo sapien
cctaacgtggtcaacgggcagatga

SEQ ID NO: 82185 - DNA, 25 bp, Homo sapien
cggcatgggcgccttcaagctcaac

SEQ ID NO: 82186 - DNA, 25 bp, Homo sapien
attgcctgcaggctaggacttcgcg

SEQ ID NO: 82187 - DNA, 25 bp, Homo sapien
gcagccgtccggctactttgcgttt

SEQ ID NO: 82188 - DNA, 25 bp, Homo sapien
ggggctgagatgctccatgcctttc

SEQ ID NO: 82189 - DNA, 25 bp, Homo sapien
cacgcgggactttctgttccgcaac

SEQ ID NO: 82190 - DNA, 25 bp, Homo sapien
tcccagttcgctgcgcaaacacatg

SEQ ID NO: 82191 - DNA, 25 bp, Homo sapien
aggagctctcttggctctcggcttg

SEQ ID NO: 82192 - DNA, 25 bp, Homo sapien
ccctttgaggcaggagctctcttgg

SEQ ID NO: 82193 - DNA, 25 bp, Homo sapien
acacatgaaggtaatcgccgcactc

SEQ ID NO: 82194 - DNA, 25 bp, Homo sapien
gcgacaagccctatctttgcaagat

SEQ ID NO: 82195 - DNA, 25 bp, Homo sapien
gtgcacacgagcgacaagccctatc

SEQ ID NO: 82196 - DNA, 25 bp, Homo sapien
catgaaggtaatcgccgcactctcg

SEQ ID NO: 82197 - DNA, 25 bp, Homo sapien
acacgagcgacaagccctatctttg

SEQ ID NO: 82198 - DNA, 25 bp, Homo sapien
agacaacccgaccacaagctcctta

SEQ ID NO: 82199 - DNA, 25 bp, Homo sapien
gccgcactggctctttatgtccgta

SEQ ID NO: 82200 - DNA, 25 bp, Homo sapien
tggctctttatgtccgtaaaaacgc

SEQ ID NO: 82201 - DNA, 25 bp, Homo sapien
aaaaacgcgactttattcctgcagg

SEQ ID NO: 82202 - DNA, 25 bp, Homo sapien
aggtccacgaatcctcctcgcaggg

SEQ ID NO: 82203 - DNA, 25 bp, Homo sapien
ggccacagtgcgctctcttccaatt

SEQ ID NO: 82204 - DNA, 25 bp, Homo sapien
gtgcgctctcttccaattttaacga

SEQ ID NO: 82205 - DNA, 25 bp, Homo sapien
cgcgactttattcctgcaggtccac

SEQ ID NO: 82206 - DNA, 25 bp, Homo sapien
ctttccaaatcgtcgcggcaggctc

SEQ ID NO: 82207 - DNA, 25 bp, Homo sapien
gtgagttcacactgcggagccgaca

SEQ ID NO: 82208 - DNA, 25 bp, Homo sapien
ggtcgtcagcgtttgagggaccctc

SEQ ID NO: 82209 - DNA, 25 bp, Homo sapien
ccgaggttccacgtgctgatgaata

SEQ ID NO: 82210 - DNA, 25 bp, Homo sapien
gctgatgaatatgcatgagactccc

SEQ ID NO: 82211 - DNA, 25 bp, Homo sapien
tccggcctgtgaaagtcgctggcta

SEQ ID NO: 82212 - DNA, 25 bp, Homo sapien
cgctggctaggctcccaaaatagtg

SEQ ID NO: 82213 - DNA, 25 bp, Homo sapien
ccgcgctggtttaagtgagttcaca

SEQ ID NO: 82214 - DNA, 25 bp, Homo sapien
tggattcaaatgagcgctggtgccc

SEQ ID NO: 82215 - DNA, 25 bp, Homo sapien
cccgatgatcccagccaagagagac

SEQ ID NO: 82216 - DNA, 25 bp, Homo sapien
acggagaagagtcacacctgtacga

SEQ ID NO: 82217 - DNA, 25 bp, Homo sapien
ccgaggttcgccaagcctcttcaga

SEQ ID NO: 82218 - DNA, 25 bp, Homo sapien
gcctcttcagagcactgtcgcactt

SEQ ID NO: 82219 - DNA, 25 bp, Homo sapien
tcccacggtccagcaaggcaggagc

SEQ ID NO: 82220 - DNA, 25 bp, Homo sapien
caggagctgctcttaaccttggctc

SEQ ID NO: 82221 - DNA, 25 bp, Homo sapien
tgcgactgtcatcgaggaaaacctc

SEQ ID NO: 82222 - DNA, 25 bp, Homo sapien
gcccgaaatctagatcccagacctg

SEQ ID NO: 82223 - DNA, 25 bp, Homo sapien
atgactgaatctgtctgctggcctc

SEQ ID NO: 82224 - DNA, 25 bp, Homo sapien
tgcccgtctccggtatgactgaatc

SEQ ID NO: 82225 - DNA, 25 bp, Homo sapien
gggctgatttggaactgctgcgcta

SEQ ID NO: 82226 - DNA, 25 bp, Homo sapien
gccgctggggtgtatacgtttatac

SEQ ID NO: 82227 - DNA, 25 bp, Homo sapien
tttatacgccgtacgctccagggta

SEQ ID NO: 82228 - DNA, 25 bp, Homo sapien
ctccagggtagtcaggaatgtcgcg

SEQ ID NO: 82229 - DNA, 25 bp, Homo sapien
tcccagacctggtaagtcgcgttcc

SEQ ID NO: 82230 - DNA, 25 bp, Homo sapien
ctgcgacaggactttcgagcgagtg

SEQ ID NO: 82231 - DNA, 25 bp, Homo sapien
tttcgagcgagtgcgaggaaagccc

SEQ ID NO: 82232 - DNA, 25 bp, Homo sapien
ctttcgacagttctgaggttttatc

SEQ ID NO: 82233 - DNA, 25 bp, Homo sapien
cgacagttctgaggttttatccgac

SEQ ID NO: 82234 - DNA, 25 bp, Homo sapien
ctgaggttttatccgaccctgcccg

SEQ ID NO: 82235 - DNA, 25 bp, Homo sapien
agctccgccactgacgtcaggggct

SEQ ID NO: 82236 - DNA, 25 bp, Homo sapien
tgctggcggctggaacccgagtcca

SEQ ID NO: 82237 - DNA, 25 bp, Homo sapien
tggaacccgagtccaggccacaggc

SEQ ID NO: 82238 - DNA, 25 bp, Homo sapien
ttcgggaccaggtgaacgctgatct

SEQ ID NO: 82239 - DNA, 25 bp, Homo sapien
cgctgatctgatagttgacacggga

SEQ ID NO: 82240 - DNA, 25 bp, Homo sapien
ggcatcatccttgctgccgtcaata

SEQ ID NO: 82241 - DNA, 25 bp, Homo sapien
gctgccgtcaatatcccgagaggga

SEQ ID NO: 82242 - DNA, 25 bp, Homo sapien
tcactataaattcggagctgcctcc

SEQ ID NO: 82243 - DNA, 25 bp, Homo sapien
tcgccaatgattccagcgcctgaca

SEQ ID NO: 82244 - DNA, 25 bp, Homo sapien
cagcgagtgacaggacgtctggacc

SEQ ID NO: 82245 - DNA, 25 bp, Homo sapien
gacacgggacgactgtggcatcatc

SEQ ID NO: 82246 - DNA, 25 bp, Homo sapien
ggagctctcgttcctgcttccgtct

SEQ ID NO: 82247 - DNA, 25 bp, Homo sapien
acgtgacggccgctataagagcgca

SEQ ID NO: 82248 - DNA, 25 bp, Homo sapien
cgtgtttctgcctgcgtcagctgcc

SEQ ID NO: 82249 - DNA, 25 bp, Homo sapien
ttcctcttgctctcacggcgaaggg

SEQ ID NO: 82250 - DNA, 25 bp, Homo sapien
ggccgccacgctgagcctattttta

SEQ ID NO: 82251 - DNA, 25 bp, Homo sapien
ctgagcctatttttaggcctttggg

SEQ ID NO: 82252 - DNA, 25 bp, Homo sapien
ccggctttggcttcacttgttgcga

SEQ ID NO: 82253 - DNA, 25 bp, Homo sapien
ggcagcaccatgacaggtaccgccg

SEQ ID NO: 82254 - DNA, 25 bp, Homo sapien
tgcatttatttctccggcggccaca

SEQ ID NO: 82255 - DNA, 25 bp, Homo sapien
cgtcgctctgtgactggcactagga

SEQ ID NO: 82256 - DNA, 25 bp, Homo sapien
cgtctccttctgcaacaatctggga

SEQ ID NO: 82257 - DNA, 25 bp, Homo sapien
ctggatcgttttcgagccgcctcga

SEQ ID NO: 82258 - DNA, 25 bp, Homo sapien
ggcggccacatatgcgaccaacaga

SEQ ID NO: 82259 - DNA, 25 bp, Homo sapien
ctcgccagcgaagacaatgcattta

SEQ ID NO: 82260 - DNA, 25 bp, Homo sapien
tcaggttcatttggggacgcctcca

SEQ ID NO: 82261 - DNA, 25 bp, Homo sapien
gcggagccaaaccagtcagagcaca

SEQ ID NO: 82262 - DNA, 25 bp, Homo sapien
gggagtccctggcataacgcagcca

SEQ ID NO: 82263 - DNA, 25 bp, Homo sapien
gtcgagcacccagcggggagtccct

SEQ ID NO: 82264 - DNA, 25 bp, Homo sapien
tggcataacgcagccaggaggcagt

SEQ ID NO: 82265 - DNA, 25 bp, Homo sapien
aggccctgtcgtcgccgccacacca

SEQ ID NO: 82266 - DNA, 25 bp, Homo sapien
tggaatgcgtccaccgcctgacccg

SEQ ID NO: 82267 - DNA, 25 bp, Homo sapien
ccagggccggcaagaagccacatgc

SEQ ID NO: 82268 - DNA, 25 bp, Homo sapien
ccgcagcctacaccggcccgagacg

SEQ ID NO: 82269 - DNA, 25 bp, Homo sapien
ggtagtgagtcacacacgccgctcg

SEQ ID NO: 82270 - DNA, 25 bp, Homo sapien
gctgtacaacctgcacccgttcggg

SEQ ID NO: 82271 - DNA, 25 bp, Homo sapien
gctcgctcgcggaagtagtcctaca

SEQ ID NO: 82272 - DNA, 25 bp, Homo sapien
tgtcgcggcaagcataggtatgagc

SEQ ID NO: 82273 - DNA, 25 bp, Homo sapien
ctggccgctgattgcttgaagtcgc

SEQ ID NO: 82274 - DNA, 25 bp, Homo sapien
gaggcctcctagctagcggaccgaa

SEQ ID NO: 82275 - DNA, 25 bp, Homo sapien
cggaatttgccggatggtctccctg

SEQ ID NO: 82276 - DNA, 25 bp, Homo sapien
gctctagctagggatgggacttctt

SEQ ID NO: 82277 - DNA, 25 bp, Homo sapien
agtagtcctacattcgcggtcagcg

SEQ ID NO: 82278 - DNA, 25 bp, Homo sapien
ccctcctggcctcgagaattatgca

SEQ ID NO: 82279 - DNA, 25 bp, Homo sapien
cgtgacgtggatcacttgctgccca

SEQ ID NO: 82280 - DNA, 25 bp, Homo sapien
cgaggccggattcatcttctgcaaa

SEQ ID NO: 82281 - DNA, 25 bp, Homo sapien
tggcaaaggaaaggtcgcacgattc

SEQ ID NO: 82282 - DNA, 25 bp, Homo sapien
tgacaaatcccgacccgactctgtg

SEQ ID NO: 82283 - DNA, 25 bp, Homo sapien
ccctgggcgtgatgggtactttact

SEQ ID NO: 82284 - DNA, 25 bp, Homo sapien
gcccgaaagttgagctgttgaatta

SEQ ID NO: 82285 - DNA, 25 bp, Homo sapien
cagtctaagggcttcggctctcaca

SEQ ID NO: 82286 - DNA, 25 bp, Homo sapien
tgtcctacgatttcacccggcagcg

SEQ ID NO: 82287 - DNA, 25 bp, Homo sapien
acgcgttacactcggacgttccctg

SEQ ID NO: 82288 - DNA, 25 bp, Homo sapien
ctcggcgaccactgcaatgaaagtc

SEQ ID NO: 82289 - DNA, 25 bp, Homo sapien
gcgccgcgtctcaggaattccacag

SEQ ID NO: 82290 - DNA, 25 bp, Homo sapien
tagatttttgggtttgcgccgcgtc

SEQ ID NO: 82291 - DNA, 25 bp, Homo sapien
ctgtccacttgaggcaggaaggcca

SEQ ID NO: 82292 - DNA, 25 bp, Homo sapien
ggaatggctcgcaaccgccctagaa

SEQ ID NO: 82293 - DNA, 25 bp, Homo sapien
tactggcggcgccttcgtagatttt

SEQ ID NO: 82294 - DNA, 25 bp, Homo sapien
tatcgagcggcccagagaacatacc

SEQ ID NO: 82295 - DNA, 25 bp, Homo sapien
gggccgctcgcatctctaacaattt

SEQ ID NO: 82296 - DNA, 25 bp, Homo sapien
tcgccctcgcctctttagtaggtcg

SEQ ID NO: 82297 - DNA, 25 bp, Homo sapien
tctccgtttctaggggcacatggtt

SEQ ID NO: 82298 - DNA, 25 bp, Homo sapien
atcacgcggccaagaacgagactcg

SEQ ID NO: 82299 - DNA, 25 bp, Homo sapien
ttccgcttcgcctaggtgttgtcgt

SEQ ID NO: 82300 - DNA, 25 bp, Homo sapien
ctctgatctcagactgggcacggta

SEQ ID NO: 82301 - DNA, 25 bp, Homo sapien
ttgtcgtccctgctagtactccggg

SEQ ID NO: 82302 - DNA, 25 bp, Homo sapien
tggcagcagccatcgcacatcaggt

SEQ ID NO: 82303 - DNA, 25 bp, Homo sapien
ggacgaacctcagagcgcgctcggc

SEQ ID NO: 82304 - DNA, 25 bp, Homo sapien
ggtcctcaccgtaatgctctgaaag

SEQ ID NO: 82305 - DNA, 25 bp, Homo sapien
tttggcgtcgcagtagccgacaatg

SEQ ID NO: 82306 - DNA, 25 bp, Homo sapien
tcgcacatcaggttatccacgtagc

SEQ ID NO: 82307 - DNA, 25 bp, Homo sapien
ttatccacgtagctctgccaaccgg

SEQ ID NO: 82308 - DNA, 25 bp, Homo sapien
gttcagcgatgagggacgaacctca

SEQ ID NO: 82309 - DNA, 25 bp, Homo sapien
tggctgcccagacgtatttggcgtc

SEQ ID NO: 82310 - DNA, 25 bp, Homo sapien
acgatccgggtcagctcctgcaggt

SEQ ID NO: 82311 - DNA, 25 bp, Homo sapien
ggacacagcgcagagtccattccag

SEQ ID NO: 82312 - DNA, 25 bp, Homo sapien
tccctaccggtctcgggatctctgg

SEQ ID NO: 82313 - DNA, 25 bp, Homo sapien
atctctgggtcggaagttctcgccc

SEQ ID NO: 82314 - DNA, 25 bp, Homo sapien
gggtcggaagttctcgccctgctgc

SEQ ID NO: 82315 - DNA, 25 bp, Homo sapien
tgctgctccgagacctaggtccgct

SEQ ID NO: 82316 - DNA, 25 bp, Homo sapien
tgtcgccggtgtcgctccagcaggc

SEQ ID NO: 82317 - DNA, 25 bp, Homo sapien
cacccgagatcgagctccggatctg

SEQ ID NO: 82318 - DNA, 25 bp, Homo sapien
ctttcctctcttgggcatggcgacc

SEQ ID NO: 82319 - DNA, 25 bp, Homo sapien
catggcgaccgtatcggggcgaggc

SEQ ID NO: 82320 - DNA, 25 bp, Homo sapien
cctctcttgggcatggcgaccgtat

SEQ ID NO: 82321 - DNA, 25 bp, Homo sapien
tcgctttcctctcttgggcatggcg

SEQ ID NO: 82322 - DNA, 25 bp, Homo sapien
tgggcccggaacttgagtcgctttc

SEQ ID NO: 82323 - DNA, 25 bp, Homo sapien
gttggctacggctttcttgactcgt

SEQ ID NO: 82324 - DNA, 25 bp, Homo sapien
cgttggctacggctttcttgactcg

SEQ ID NO: 82325 - DNA, 25 bp, Homo sapien
tctcttgggcatggcgaccgtatcg

SEQ ID NO: 82326 - DNA, 25 bp, Homo sapien
ttcgccgcgctaactcttcgctagc

SEQ ID NO: 82327 - DNA, 25 bp, Homo sapien
cgcggatgcattctccgtggaagac

SEQ ID NO: 82328 - DNA, 25 bp, Homo sapien
cgagggcgtcaacgataactgggat

SEQ ID NO: 82329 - DNA, 25 bp, Homo sapien
gggactccgactcttgagacgcgga

SEQ ID NO: 82330 - DNA, 25 bp, Homo sapien
gctcacaccctcctcaagatggcgg

SEQ ID NO: 82331 - DNA, 25 bp, Homo sapien
ttgagacgcggatgcattctccgtg

SEQ ID NO: 82332 - DNA, 25 bp, Homo sapien
cgaggactaagacgagggcgtcaac

SEQ ID NO: 82333 - DNA, 25 bp, Homo sapien
cgactcttgagacgcggatgcattc

SEQ ID NO: 82334 - DNA, 25 bp, Homo sapien
cccgttttcgcgtgatcaagctgga

SEQ ID NO: 82335 - DNA, 25 bp, Homo sapien
aggacgtctcctccgagattttcga

SEQ ID NO: 82336 - DNA, 25 bp, Homo sapien
gtggccactagcatcaccgaggaca

SEQ ID NO: 82337 - DNA, 25 bp, Homo sapien
agatccggggattgcattagacaca

SEQ ID NO: 82338 - DNA, 25 bp, Homo sapien
agctgcttccagatcaccagtgtca

SEQ ID NO: 82339 - DNA, 25 bp, Homo sapien
tgccggccaagaagaagagctgctt

SEQ ID NO: 82340 - DNA, 25 bp, Homo sapien
tgactcttaacagcggcgggcctca

SEQ ID NO: 82341 - DNA, 25 bp, Homo sapien
tgcgagcgcagctcttccgaagaga

SEQ ID NO: 82342 - DNA, 25 bp, Homo sapien
cgccgcctcgatctactttgggttc

SEQ ID NO: 82343 - DNA, 25 bp, Homo sapien
ctttccgggacaacatggcgccgtc

SEQ ID NO: 82344 - DNA, 25 bp, Homo sapien
aattcgctgtctccacgcatgagga

SEQ ID NO: 82345 - DNA, 25 bp, Homo sapien
acggatcctttgcttggcgaccatc

SEQ ID NO: 82346 - DNA, 25 bp, Homo sapien
ggttcggctgccaacgtcagcacta

SEQ ID NO: 82347 - DNA, 25 bp, Homo sapien
tctgtcaagcgtcgccctagatttg

SEQ ID NO: 82348 - DNA, 25 bp, Homo sapien
tggctccggaaacaccaattcgctg

SEQ ID NO: 82349 - DNA, 25 bp, Homo sapien
cgctctttccttaccgaggtcttgg

SEQ ID NO: 82350 - DNA, 25 bp, Homo sapien
cagaccgaggtgttccggcagttct

SEQ ID NO: 82351 - DNA, 25 bp, Homo sapien
atggccaacagcatgcacgtcatcg

SEQ ID NO: 82352 - DNA, 25 bp, Homo sapien
accgtgcaccgggacatggccaaca

SEQ ID NO: 82353 - DNA, 25 bp, Homo sapien
atgtgccagacgctgacagagatcc

SEQ ID NO: 82354 - DNA, 25 bp, Homo sapien
catgcacgtcatcggccaggccatg

SEQ ID NO: 82355 - DNA, 25 bp, Homo sapien
ccgagctgaccagccgtgtcggtca

SEQ ID NO: 82356 - DNA, 25 bp, Homo sapien
tccatgcccagcagaccgaggtgtt

SEQ ID NO: 82357 - DNA, 25 bp, Homo sapien
tgccaggagctggtgaccgtgcacc

SEQ ID NO: 82358 - DNA, 25 bp, Homo sapien
gcttctgctgcttctcctagtggcg

SEQ ID NO: 82359 - DNA, 25 bp, Homo sapien
gccgaagtggctggctcatttaaga

SEQ ID NO: 82360 - DNA, 25 bp, Homo sapien
ggagcgccaaccgtttgtcagttca

SEQ ID NO: 82361 - DNA, 25 bp, Homo sapien
gcggcgtgcccagcaagagattaaa

SEQ ID NO: 82362 - DNA, 25 bp, Homo sapien
tcgctgcctggctagatgaaggtta

SEQ ID NO: 82363 - DNA, 25 bp, Homo sapien
ttaaagatgcagtacgccacggggc

SEQ ID NO: 82364 - DNA, 25 bp, Homo sapien
tctgccctcttttccggggtaatgc

SEQ ID NO: 82365 - DNA, 25 bp, Homo sapien
ttcgctggcctcgtagaactgtgcc

SEQ ID NO: 82366 - DNA, 25 bp, Homo sapien
aagatgcctgcgctcttatccagct

SEQ ID NO: 82367 - DNA, 25 bp, Homo sapien
cacatatgtaaagatgcctgcgctc

SEQ ID NO: 82368 - DNA, 25 bp, Homo sapien
tcaccttctgggatatgctcttctg

SEQ ID NO: 82369 - DNA, 25 bp, Homo sapien
cccgatttcccggacgaggcactgg

SEQ ID NO: 82370 - DNA, 25 bp, Homo sapien
cgtcggcggcagttcactctgcaca

SEQ ID NO: 82371 - DNA, 25 bp, Homo sapien
ctgcatggcagaacaccaactgggc

SEQ ID NO: 82372 - DNA, 25 bp, Homo sapien
ggaatggagacccagctcactgtta

SEQ ID NO: 82373 - DNA, 25 bp, Homo sapien
ctttcttctgtttcgaatactctga

SEQ ID NO: 82374 - DNA, 25 bp, Homo sapien
tcgtcgtcgtagtcaccgatgtccg

SEQ ID NO: 82375 - DNA, 25 bp, Homo sapien
tgtccgtgaccttccagaggtactc

SEQ ID NO: 82376 - DNA, 25 bp, Homo sapien
ccagaggtactcttcgctgaacgtc

SEQ ID NO: 82377 - DNA, 25 bp, Homo sapien
cgctgaacgtctcaggggcctccaa

SEQ ID NO: 82378 - DNA, 25 bp, Homo sapien
ctccgaagccgctaggcgagcgcaa

SEQ ID NO: 82379 - DNA, 25 bp, Homo sapien
ggcgggattacagccagctctttgg

SEQ ID NO: 82380 - DNA, 25 bp, Homo sapien
cgagcctcccggatttaaagcggca

SEQ ID NO: 82381 - DNA, 25 bp, Homo sapien
gtcgacgaaggcaccacccaggagt

SEQ ID NO: 82382 - DNA, 25 bp, Homo sapien
aagcgtcgccgaagtcctctggcca

SEQ ID NO: 82383 - DNA, 25 bp, Homo sapien
cttctggcggcattggttacacacc

SEQ ID NO: 82384 - DNA, 25 bp, Homo sapien
gacgcgtccctcagctcaaacgaga

SEQ ID NO: 82385 - DNA, 25 bp, Homo sapien
cagtgagcatgcctggctcgctgca

SEQ ID NO: 82386 - DNA, 25 bp, Homo sapien
gcgctccgaaccaaccatggaactg

SEQ ID NO: 82387 - DNA, 25 bp, Homo sapien
cttgctgcagggtttattagcgctg

SEQ ID NO: 82388 - DNA, 25 bp, Homo sapien
agcagaccggacactcgaagagcga

SEQ ID NO: 82389 - DNA, 25 bp, Homo sapien
ccggcctggcactgcagaataggag

SEQ ID NO: 82390 - DNA, 25 bp, Homo sapien
ccctcttgcagcctgtaggccaggt

SEQ ID NO: 82391 - DNA, 25 bp, Homo sapien
tgtcaggcatccgttgcccaggagg

SEQ ID NO: 82392 - DNA, 25 bp, Homo sapien
tgcgcttgacctccgtcacgcagag

SEQ ID NO: 82393 - DNA, 25 bp, Homo sapien
cagcaggaccttagcgggctgtttc

SEQ ID NO: 82394 - DNA, 25 bp, Homo sapien
tggcaggagctccagtcgatgccca

SEQ ID NO: 82395 - DNA, 25 bp, Homo sapien
ctcggtggcctcgaagtgaaaggaa

SEQ ID NO: 82396 - DNA, 25 bp, Homo sapien
agcccggccagcattgtcaggcatc

SEQ ID NO: 82397 - DNA, 25 bp, Homo sapien
ccttgaggtccctgcgcatcgagtt

SEQ ID NO: 82398 - DNA, 25 bp, Homo sapien
aaaaaagtcacacgttcccatcagc

SEQ ID NO: 82399 - DNA, 25 bp, Homo sapien
ttgggtccattggtgaaaaaagtca

SEQ ID NO: 82400 - DNA, 25 bp, Homo sapien
gcggcagcatccaacctgctttatt

SEQ ID NO: 82401 - DNA, 25 bp, Homo sapien
gccaccagcctaggcgccaagaaaa

SEQ ID NO: 82402 - DNA, 25 bp, Homo sapien
ttgggcgagcacttcagccaccagc

SEQ ID NO: 82403 - DNA, 25 bp, Homo sapien
cgctagccgcggaccaacaggtaaa

SEQ ID NO: 82404 - DNA, 25 bp, Homo sapien
atcccaacccgaatgatggaggctg

SEQ ID NO: 82405 - DNA, 25 bp, Homo sapien
gggcgaggcagataccgcacaaata

SEQ ID NO: 82406 - DNA, 25 bp, Homo sapien
agcgtgaagttaacgcgcgtggccc

SEQ ID NO: 82407 - DNA, 25 bp, Homo sapien
cactttggggatgttgagcttggcc

SEQ ID NO: 82408 - DNA, 25 bp, Homo sapien
ctaggcgctgcgcttcgtttcacag

SEQ ID NO: 82409 - DNA, 25 bp, Homo sapien
gcgcttcgtttcacagactcacttc

SEQ ID NO: 82410 - DNA, 25 bp, Homo sapien
cgagggcggtcacagacaaacccga

SEQ ID NO: 82411 - DNA, 25 bp, Homo sapien
agctggggtcccagactcaagggaa

SEQ ID NO: 82412 - DNA, 25 bp, Homo sapien
cccggacggcgccatgacatgagca

SEQ ID NO: 82413 - DNA, 25 bp, Homo sapien
atgacatgagcagtggtggcgaccc

SEQ ID NO: 82414 - DNA, 25 bp, Homo sapien
ccctctttatgtttacgagcgtgtg

SEQ ID NO: 82415 - DNA, 25 bp, Homo sapien
tgcagccacggtactcgctccattc

SEQ ID NO: 82416 - DNA, 25 bp, Homo sapien
tgtttgccctggtgaccaatgggct

SEQ ID NO: 82417 - DNA, 25 bp, Homo sapien
ccctggtgaccaatgggctcgagct

SEQ ID NO: 82418 - DNA, 25 bp, Homo sapien
ggatgagcccgacttctgtgtctgg

SEQ ID NO: 82419 - DNA, 25 bp, Homo sapien
tcagcagcacaaggatgagaaacga

SEQ ID NO: 82420 - DNA, 25 bp, Homo sapien
caaggatgagaaacgaccaccgggc

SEQ ID NO: 82421 - DNA, 25 bp, Homo sapien
ttacgagcgtgtgggaagctaattc

SEQ ID NO: 82422 - DNA, 25 bp, Homo sapien
tgtggcgcccacaatgctcccatga

SEQ ID NO: 82423 - DNA, 25 bp, Homo sapien
atgccttgggcacttggtcgacagt

SEQ ID NO: 82424 - DNA, 25 bp, Homo sapien
cccatgacaaggagctgacaagttc

SEQ ID NO: 82425 - DNA, 25 bp, Homo sapien
acaggtgcgtgcaagtgtactcaca

SEQ ID NO: 82426 - DNA, 25 bp, Homo sapien
cgtgcattaggagctcgacgagtcc

SEQ ID NO: 82427 - DNA, 25 bp, Homo sapien
tgaagagcgtttttctcgccgccgc

SEQ ID NO: 82428 - DNA, 25 bp, Homo sapien
cccgccgcgaggttacaatgctgaa

SEQ ID NO: 82429 - DNA, 25 bp, Homo sapien
tccattttccgtcgcgggcatcttg

SEQ ID NO: 82430 - DNA, 25 bp, Homo sapien
agaagttgctggcttgcccgatagc

SEQ ID NO: 82431 - DNA, 25 bp, Homo sapien
ggggatccagttcgcctgctccctt

SEQ ID NO: 82432 - DNA, 25 bp, Homo sapien
ctggcttttccgatgcttgctgcgc

SEQ ID NO: 82433 - DNA, 25 bp, Homo sapien
caagctagagccctgcagagcgagt

SEQ ID NO: 82434 - DNA, 25 bp, Homo sapien
ctgagctgcacgtttctaaggtagg

SEQ ID NO: 82435 - DNA, 25 bp, Homo sapien
ggttcctgaactacgcggacgccga

SEQ ID NO: 82436 - DNA, 25 bp, Homo sapien
cgtgccggcagaggctgaacacact

SEQ ID NO: 82437 - DNA, 25 bp, Homo sapien
gccctgttgtgtaagctcggcgttg

SEQ ID NO: 82438 - DNA, 25 bp, Homo sapien
cccgccaagctttgtcgcgcaaaga

SEQ ID NO: 82439 - DNA, 25 bp, Homo sapien
cccagcgcgatcacaggcaccgaca

SEQ ID NO: 82440 - DNA, 25 bp, Homo sapien
cccgcacaacgcgaggatgctggtg

SEQ ID NO: 82441 - DNA, 25 bp, Homo sapien
caagctgggcttcgccttctccagg

SEQ ID NO: 82442 - DNA, 25 bp, Homo sapien
cagcaccatggtgcccgctcccggc

SEQ ID NO: 82443 - DNA, 25 bp, Homo sapien
acccgagcaagctgggcttcgcctt

SEQ ID NO: 82444 - DNA, 25 bp, Homo sapien
tttgtcgcgcaaagatccacgaccg

SEQ ID NO: 82445 - DNA, 25 bp, Homo sapien
tcacctgttgtgcagacccgagcaa

SEQ ID NO: 82446 - DNA, 25 bp, Homo sapien
gcgccctgagacttctggattggga

SEQ ID NO: 82447 - DNA, 25 bp, Homo sapien
cgggagttggcaagaccacagccta

SEQ ID NO: 82448 - DNA, 25 bp, Homo sapien
agcggcctgcatgcttcctacagcg

SEQ ID NO: 82449 - DNA, 25 bp, Homo sapien
gaatggcgtccttgggcctttgata

SEQ ID NO: 82450 - DNA, 25 bp, Homo sapien
gtctccgggttttgaccgcactcga

SEQ ID NO: 82451 - DNA, 25 bp, Homo sapien
cctgaactaactgcgggcgccctga

SEQ ID NO: 82452 - DNA, 25 bp, Homo sapien
gcccaaaaacctgctctgcgactga

SEQ ID NO: 82453 - DNA, 25 bp, Homo sapien
tggagtacctcctgttttctttgtg

SEQ ID NO: 82454 - DNA, 25 bp, Homo sapien
actaactcggtgttgctcctcccgg

SEQ ID NO: 82455 - DNA, 25 bp, Homo sapien
caccgcagtggtgcagtttttgccc

SEQ ID NO: 82456 - DNA, 25 bp, Homo sapien
agcccagatttctgccgggaaccgc

SEQ ID NO: 82457 - DNA, 25 bp, Homo sapien
cgcctcggacagcaggacggtacat

SEQ ID NO: 82458 - DNA, 25 bp, Homo sapien
tgcctcggcttgcactcagtgaatg

SEQ ID NO: 82459 - DNA, 25 bp, Homo sapien
agctgaactcgtcccaagtttcttg

SEQ ID NO: 82460 - DNA, 25 bp, Homo sapien
ccgcggcgagtttcccaagaaagct

SEQ ID NO: 82461 - DNA, 25 bp, Homo sapien
agcgaggtggatttttctagcaaca

SEQ ID NO: 82462 - DNA, 25 bp, Homo sapien
tccggagcctcggttacctccatga

SEQ ID NO: 82463 - DNA, 25 bp, Homo sapien
caagcagtggtttctggtgacgtca

SEQ ID NO: 82464 - DNA, 25 bp, Homo sapien
ggcgggccatttagcgtcacaagca

SEQ ID NO: 82465 - DNA, 25 bp, Homo sapien
tgcttccgtagcaccgcacaagagg

SEQ ID NO: 82466 - DNA, 25 bp, Homo sapien
ttgtcctggcagactacaacccgtc

SEQ ID NO: 82467 - DNA, 25 bp, Homo sapien
cgatttcgcggcctttcaggtgccc

SEQ ID NO: 82468 - DNA, 25 bp, Homo sapien
tttcgcgtaccacatgccgatttcg

SEQ ID NO: 82469 - DNA, 25 bp, Homo sapien
actgtgcgcccacttccgttttgct

SEQ ID NO: 82470 - DNA, 25 bp, Homo sapien
ttctgcgctacgctcacggtgaagc

SEQ ID NO: 82471 - DNA, 25 bp, Homo sapien
gggtcccaggaattgaagctccacg

SEQ ID NO: 82472 - DNA, 25 bp, Homo sapien
gcaactgcacttttaccatcatggg

SEQ ID NO: 82473 - DNA, 25 bp, Homo sapien
acgacttttgtaagcgctaggatca

SEQ ID NO: 82474 - DNA, 25 bp, Homo sapien
cacactcgcgctttgtgagcaactg

SEQ ID NO: 82475 - DNA, 25 bp, Homo sapien
agctcctggtgccatagagagtccc

SEQ ID NO: 82476 - DNA, 25 bp, Homo sapien
tccgaaggccaaagcgtacacgata

SEQ ID NO: 82477 - DNA, 25 bp, Homo sapien
tcatgggcagccaaaggacgacttt

SEQ ID NO: 82478 - DNA, 25 bp, Homo sapien
cgagctgagggagaaaggtccaaag

SEQ ID NO: 82479 - DNA, 25 bp, Homo sapien
atcccactggtgagtcccaggagag

SEQ ID NO: 82480 - DNA, 25 bp, Homo sapien
aacttctcccgaatcccactggtga

SEQ ID NO: 82481 - DNA, 25 bp, Homo sapien
ctcattggtcgggatgtgtcggctc

SEQ ID NO: 82482 - DNA, 25 bp, Homo sapien
cgcccaactcctggcgcgggatctg

SEQ ID NO: 82483 - DNA, 25 bp, Homo sapien
aagtggcgaagcttgaccgagagca

SEQ ID NO: 82484 - DNA, 25 bp, Homo sapien
agatgtgcaagtggcgaagcttgac

SEQ ID NO: 82485 - DNA, 25 bp, Homo sapien
cagctaaggtccagcgcgatccgag

SEQ ID NO: 82486 - DNA, 25 bp, Homo sapien
ccgcaggactgggtagatctgctgc

SEQ ID NO: 82487 - DNA, 25 bp, Homo sapien
gtagcccaagcagcggcaggtaatc

SEQ ID NO: 82488 - DNA, 25 bp, Homo sapien
tgcgtactggcttcccgtttataaa

SEQ ID NO: 82489 - DNA, 25 bp, Homo sapien
ttcatggtgtccaaagcaaagcgca

SEQ ID NO: 82490 - DNA, 25 bp, Homo sapien
cacatccgctggctgctggaagttc

SEQ ID NO: 82491 - DNA, 25 bp, Homo sapien
cggcaggtaatcaggtccctacaga

SEQ ID NO: 82492 - DNA, 25 bp, Homo sapien
cacgctgagcttagagcatcgcctc

SEQ ID NO: 82493 - DNA, 25 bp, Homo sapien
tcggggcaagcgcagagagacaaaa

SEQ ID NO: 82494 - DNA, 25 bp, Homo sapien
tctctaagaggtcctgagcagggtc

SEQ ID NO: 82495 - DNA, 25 bp, Homo sapien
tccttctgaattatgggaccctgaa

SEQ ID NO: 82496 - DNA, 25 bp, Homo sapien
cgcaagggacccgagagttacatta

SEQ ID NO: 82497 - DNA, 25 bp, Homo sapien
tcgcgctgagcacacctagtctcta

SEQ ID NO: 82498 - DNA, 25 bp, Homo sapien
gagtatatcctcctcgcgctgagca

SEQ ID NO: 82499 - DNA, 25 bp, Homo sapien
cttcccaggaaagggcaatggagta

SEQ ID NO: 82500 - DNA, 25 bp, Homo sapien
ccgcagctcagtcgccaaggaaacg

SEQ ID NO: 82501 - DNA, 25 bp, Homo sapien
agttacattatttcgcggacacaca

SEQ ID NO: 82502 - DNA, 25 bp, Homo sapien
gcgggcagtctactcacgtgggcct

SEQ ID NO: 82503 - DNA, 25 bp, Homo sapien
tggttttcccgtcagcagctttcgt

SEQ ID NO: 82504 - DNA, 25 bp, Homo sapien
aagtgggtgtcacgggcctcaatac

SEQ ID NO: 82505 - DNA, 25 bp, Homo sapien
cagcagctttcgtctgcaagggaaa

SEQ ID NO: 82506 - DNA, 25 bp, Homo sapien
cctcctgtagggagcgcgggaccct

SEQ ID NO: 82507 - DNA, 25 bp, Homo sapien
aagcgtatgcgcctgttcccaggca

SEQ ID NO: 82508 - DNA, 25 bp, Homo sapien
agacagctgcgaggcaccgcgccaa

SEQ ID NO: 82509 - DNA, 25 bp, Homo sapien
ccgaggccgcaaactccagtgggaa

SEQ ID NO: 82510 - DNA, 25 bp, Homo sapien
cagtcctccgtcagctgcttctgtt

SEQ ID NO: 82511 - DNA, 25 bp, Homo sapien
tcctccgtcagctgcttctgtttgg

SEQ ID NO: 82512 - DNA, 25 bp, Homo sapien
cagcccggcagtcctccgtcagctg

SEQ ID NO: 82513 - DNA, 25 bp, Homo sapien
cctccgtcagctgcttctgtttgga

SEQ ID NO: 82514 - DNA, 25 bp, Homo sapien
ggcagtcctccgtcagctgcttctg

SEQ ID NO: 82515 - DNA, 25 bp, Homo sapien
gcagtcctccgtcagctgcttctgt

SEQ ID NO: 82516 - DNA, 25 bp, Homo sapien
agtcctccgtcagctgcttctgttt

SEQ ID NO: 82517 - DNA, 25 bp, Homo sapien
gtcctccgtcagctgcttctgtttg

SEQ ID NO: 82518 - DNA, 25 bp, Homo sapien
tgagagcctacatgtcttcgccggg

SEQ ID NO: 82519 - DNA, 25 bp, Homo sapien
agacagtaactaggcctgctctaca

SEQ ID NO: 82520 - DNA, 25 bp, Homo sapien
cggagacgcgtgcaccctgaagaca

SEQ ID NO: 82521 - DNA, 25 bp, Homo sapien
gtcgcttgggcctggctcagcttac

SEQ ID NO: 82522 - DNA, 25 bp, Homo sapien
ctctggggctctattgttggggcct

SEQ ID NO: 82523 - DNA, 25 bp, Homo sapien
cttcgccgggagtgcttgtcccgga

SEQ ID NO: 82524 - DNA, 25 bp, Homo sapien
gctctacagagggaaacgcaggctc

SEQ ID NO: 82525 - DNA, 25 bp, Homo sapien
aggcccattgtctccgtcctctggg

SEQ ID NO: 82526 - DNA, 25 bp, Homo sapien
gcgatgtcgccctctcgagctcatt

SEQ ID NO: 82527 - DNA, 25 bp, Homo sapien
gctccattccgtccttgtcggcaga

SEQ ID NO: 82528 - DNA, 25 bp, Homo sapien
cccagtacccggactaggcgcaggt

SEQ ID NO: 82529 - DNA, 25 bp, Homo sapien
gtcgtctgcccactgcgagatccga

SEQ ID NO: 82530 - DNA, 25 bp, Homo sapien
actgcgagatccgagccacgacgtt

SEQ ID NO: 82531 - DNA, 25 bp, Homo sapien
agccacgacgttgggctccattccg

SEQ ID NO: 82532 - DNA, 25 bp, Homo sapien
cgcctgaggcctcacgttgttctca

SEQ ID NO: 82533 - DNA, 25 bp, Homo sapien
aggcctcacgttgttctcagggtcg

SEQ ID NO: 82534 - DNA, 25 bp, Homo sapien
tctggctgtgcaggtacacaccgcc

SEQ ID NO: 82535 - DNA, 25 bp, Homo sapien
gtgtcgttttccgagcccaggagct

SEQ ID NO: 82536 - DNA, 25 bp, Homo sapien
cgccctcgatgtacagcgggtactc

SEQ ID NO: 82537 - DNA, 25 bp, Homo sapien
cggtagcccttgacaccggcaagca

SEQ ID NO: 82538 - DNA, 25 bp, Homo sapien
acctgacgtggccttgcacatctgg

SEQ ID NO: 82539 - DNA, 25 bp, Homo sapien
cacatctggggcatcctggtgaccc

SEQ ID NO: 82540 - DNA, 25 bp, Homo sapien
agccttgacgctgtagtggccctcc

SEQ ID NO: 82541 - DNA, 25 bp, Homo sapien
ctccttgatgcggtactgcgagctg

SEQ ID NO: 82542 - DNA, 25 bp, Homo sapien
ggccaggtgtcacaggtgtccacag

SEQ ID NO: 82543 - DNA, 25 bp, Homo sapien
tcgctcaggtccttgcgcgcgaagt

SEQ ID NO: 82544 - DNA, 25 bp, Homo sapien
actgagggcttgtagccaccgacgc

SEQ ID NO: 82545 - DNA, 25 bp, Homo sapien
agccgctgctgatctctccaaggag

SEQ ID NO: 82546 - DNA, 25 bp, Homo sapien
acgctgcctcggtatggatctcttg

SEQ ID NO: 82547 - DNA, 25 bp, Homo sapien
ggcgcgcacacatgaagtcacaggt

SEQ ID NO: 82548 - DNA, 25 bp, Homo sapien
gtcacaggtgttgaaccagtgtcca

SEQ ID NO: 82549 - DNA, 25 bp, Homo sapien
gaaacctaaacagtggcgcttcgca

SEQ ID NO: 82550 - DNA, 25 bp, Homo sapien
taatcacgtggggtctgaagtcttc

SEQ ID NO: 82551 - DNA, 25 bp, Homo sapien
aactcaggccctgtgacagcgactg

SEQ ID NO: 82552 - DNA, 25 bp, Homo sapien
tctggaaagcgtgggcctcggtcat

SEQ ID NO: 82553 - DNA, 25 bp, Homo sapien
cgctggtggttgagtgatgtaatca

SEQ ID NO: 82554 - DNA, 25 bp, Homo sapien
ctgaagtcttcgtgggtgtaggttt

SEQ ID NO: 82555 - DNA, 25 bp, Homo sapien
ggtgtaggtttcttcgttatgctga

SEQ ID NO: 82556 - DNA, 25 bp, Homo sapien
tcgttatgctgacgacaggcagtgc

SEQ ID NO: 82557 - DNA, 25 bp, Homo sapien
cattgggcacgagcggtcacgtgac

SEQ ID NO: 82558 - DNA, 25 bp, Homo sapien
tgctgttgctccattcggcgctttt

SEQ ID NO: 82559 - DNA, 25 bp, Homo sapien
ttttatctcgggagcggcgatgctt

SEQ ID NO: 82560 - DNA, 25 bp, Homo sapien
cggggcctgtggcatgttttatctc

SEQ ID NO: 82561 - DNA, 25 bp, Homo sapien
agccacgcgtcgtagagtccctggt

SEQ ID NO: 82562 - DNA, 25 bp, Homo sapien
gcggcgatgctttgttgatcttgtc

SEQ ID NO: 82563 - DNA, 25 bp, Homo sapien
tccattcggcgcttttctggcggct

SEQ ID NO: 82564 - DNA, 25 bp, Homo sapien
ctgccaagccgaacgggctctggct

SEQ ID NO: 82565 - DNA, 25 bp, Homo sapien
atggctctgtgcaacggagactcca

SEQ ID NO: 82566 - DNA, 25 bp, Homo sapien
gcatcttgcggtaagcctgcgctga

SEQ ID NO: 82567 - DNA, 25 bp, Homo sapien
tgcagctgcaaacccgtgtcggtgc

SEQ ID NO: 82568 - DNA, 25 bp, Homo sapien
ccaggctttcgctcgagaatgagtg

SEQ ID NO: 82569 - DNA, 25 bp, Homo sapien
ggacccgcttgcgattagctgcttc

SEQ ID NO: 82570 - DNA, 25 bp, Homo sapien
ttagctgcttcttgggatgctccgc

SEQ ID NO: 82571 - DNA, 25 bp, Homo sapien
gcccagaagcgagcccgcattcaga

SEQ ID NO: 82572 - DNA, 25 bp, Homo sapien
agttgagcatcctgcctgtggtcca

SEQ ID NO: 82573 - DNA, 25 bp, Homo sapien
gcgctgatttgagccatcgcccaga

SEQ ID NO: 82574 - DNA, 25 bp, Homo sapien
ctgctgtttggagctgcctttagga

SEQ ID NO: 82575 - DNA, 25 bp, Homo sapien
ccactagataggcttccgggcgtga

SEQ ID NO: 82576 - DNA, 25 bp, Homo sapien
gattggccagcttggcgccactaga

SEQ ID NO: 82577 - DNA, 25 bp, Homo sapien
acccggtttggcgaagagcaagcgt

SEQ ID NO: 82578 - DNA, 25 bp, Homo sapien
ctgcctttaggagccatggcggagc

SEQ ID NO: 82579 - DNA, 25 bp, Homo sapien
tggccgagagattgcggctgaaatc

SEQ ID NO: 82580 - DNA, 25 bp, Homo sapien
atggcagacacgatgaacgcgtttc

SEQ ID NO: 82581 - DNA, 25 bp, Homo sapien
caaggcgggcaaaggcccttgactc

SEQ ID NO: 82582 - DNA, 25 bp, Homo sapien
tgtatacatcagaccgaggcgccga

SEQ ID NO: 82583 - DNA, 25 bp, Homo sapien
cggggtgattgattttgagactgcc

SEQ ID NO: 82584 - DNA, 25 bp, Homo sapien
aggcgaccggaagccacttaaagca

SEQ ID NO: 82585 - DNA, 25 bp, Homo sapien
tgagagcgcacaagtcttcgtcttc

SEQ ID NO: 82586 - DNA, 25 bp, Homo sapien
ttggtttacacttcttaggcactta

SEQ ID NO: 82587 - DNA, 25 bp, Homo sapien
cactcgggtcccgtcagcatgaaga

SEQ ID NO: 82588 - DNA, 25 bp, Homo sapien
tgagactgccctttgtaccgaattc

SEQ ID NO: 82589 - DNA, 25 bp, Homo sapien
tctcaggctcccgttcaggtaaagg

SEQ ID NO: 82590 - DNA, 25 bp, Homo sapien
ctgatctcatcgcaggtcgtcacga

SEQ ID NO: 82591 - DNA, 25 bp, Homo sapien
tcggcgttaaaatgagggcgtcacc

SEQ ID NO: 82592 - DNA, 25 bp, Homo sapien
atatcgggaactgacacttttcggc

SEQ ID NO: 82593 - DNA, 25 bp, Homo sapien
cagcctgaggtgtttgttgtatatc

SEQ ID NO: 82594 - DNA, 25 bp, Homo sapien
ttatcccacgtttcgcagcctgagg

SEQ ID NO: 82595 - DNA, 25 bp, Homo sapien
ggctcccagacgtcaacaaagaatc

SEQ ID NO: 82596 - DNA, 25 bp, Homo sapien
cctgatccttcgaggcccacgatga

SEQ ID NO: 82597 - DNA, 25 bp, Homo sapien
gggcgtcacctgctcgaactaaagt

SEQ ID NO: 82598 - DNA, 25 bp, Homo sapien
tcctccaaatgcagttccggagtgg

SEQ ID NO: 82599 - DNA, 25 bp, Homo sapien
tctcacagcattccgcgtaagacta

SEQ ID NO: 82600 - DNA, 25 bp, Homo sapien
tttcacacccgtcctagtcgaagtc

SEQ ID NO: 82601 - DNA, 25 bp, Homo sapien
gacgatggctttcctcagcctggga

SEQ ID NO: 82602 - DNA, 25 bp, Homo sapien
ttccgcgtaagactagcccagcctt

SEQ ID NO: 82603 - DNA, 25 bp, Homo sapien
tgggatgacccggtcctccaaatgc

SEQ ID NO: 82604 - DNA, 25 bp, Homo sapien
gactccgccaccacgctcctctgcg

SEQ ID NO: 82605 - DNA, 25 bp, Homo sapien
tttcctcagcctgggatgacccggt

SEQ ID NO: 82606 - DNA, 25 bp, Homo sapien
cagggaccttgcctaacgagggcca

SEQ ID NO: 82607 - DNA, 25 bp, Homo sapien
ctggagcgaggcaatccagcggtca

SEQ ID NO: 82608 - DNA, 25 bp, Homo sapien
gcgtgcgcagaaaagagctgcctcc

SEQ ID NO: 82609 - DNA, 25 bp, Homo sapien
ccgaatggctcctggcaggcagacc

SEQ ID NO: 82610 - DNA, 25 bp, Homo sapien
agcgtttccatctgtgctgcgagcg

SEQ ID NO: 82611 - DNA, 25 bp, Homo sapien
ccgcagagcgagagcgtttccatct

SEQ ID NO: 82612 - DNA, 25 bp, Homo sapien
tccctgtcgagagcactgatttccc

SEQ ID NO: 82613 - DNA, 25 bp, Homo sapien
agcgggaagagcctctctgtgctcc

SEQ ID NO: 82614 - DNA, 25 bp, Homo sapien
cgggtgaactttcccgccctatgcg

SEQ ID NO: 82615 - DNA, 25 bp, Homo sapien
tggcaagccctctacccgctgggaa

SEQ ID NO: 82616 - DNA, 25 bp, Homo sapien
ccgctgggaacgttcagggttatca

SEQ ID NO: 82617 - DNA, 25 bp, Homo sapien
ttatcagcccgtgggaagcaaggta

SEQ ID NO: 82618 - DNA, 25 bp, Homo sapien
gtaggacccgcagcttgcaagaatc

SEQ ID NO: 82619 - DNA, 25 bp, Homo sapien
acaatggccggttcgacccagaacg

SEQ ID NO: 82620 - DNA, 25 bp, Homo sapien
tcgccgccgcaaggcgggtgaactt

SEQ ID NO: 82621 - DNA, 25 bp, Homo sapien
ctctgggcttagacctacggcagga

SEQ ID NO: 82622 - DNA, 25 bp, Homo sapien
gcgggtctgacgtctgcgctgccca

SEQ ID NO: 82623 - DNA, 25 bp, Homo sapien
gcccagatttgctggtgaggggtga

SEQ ID NO: 82624 - DNA, 25 bp, Homo sapien
acgactgccagggtgtgatgggaag

SEQ ID NO: 82625 - DNA, 25 bp, Homo sapien
ctgtctctgggtgacgactgccagg

SEQ ID NO: 82626 - DNA, 25 bp, Homo sapien
ttctgtctctgggtgacgactgcca

SEQ ID NO: 82627 - DNA, 25 bp, Homo sapien
tgatgggaagggttagcagcgcagc

SEQ ID NO: 82628 - DNA, 25 bp, Homo sapien
gccactggggcggatttctgtctct

SEQ ID NO: 82629 - DNA, 25 bp, Homo sapien
gcgcgccaggtaagggcccagattt

SEQ ID NO: 82630 - DNA, 25 bp, Homo sapien
gaacaggacatacggtggtcgcgcc

SEQ ID NO: 82631 - DNA, 25 bp, Homo sapien
ggcgggccaaatcggccagagctct

SEQ ID NO: 82632 - DNA, 25 bp, Homo sapien
ggcaggctctctgtgtcgcaacact

SEQ ID NO: 82633 - DNA, 25 bp, Homo sapien
agcttccgaaccaggcgggattcca

SEQ ID NO: 82634 - DNA, 25 bp, Homo sapien
ggctctctgtgtcgcaacactggcg

SEQ ID NO: 82635 - DNA, 25 bp, Homo sapien
cgcaggaacaggacatacggtggtc

SEQ ID NO: 82636 - DNA, 25 bp, Homo sapien
ggattccaccgggtatttgcctgcg

SEQ ID NO: 82637 - DNA, 25 bp, Homo sapien
tccaccgggtatttgcctgcggagg

SEQ ID NO: 82638 - DNA, 25 bp, Homo sapien
gcgcccaattttcgcttccgggatg

SEQ ID NO: 82639 - DNA, 25 bp, Homo sapien
cttccgggatggaagctacgtcatt

SEQ ID NO: 82640 - DNA, 25 bp, Homo sapien
tggaagccaagaatatgaggaagtc

SEQ ID NO: 82641 - DNA, 25 bp, Homo sapien
ggaagtcttcttccttcgcgccttc

SEQ ID NO: 82642 - DNA, 25 bp, Homo sapien
ttcttcttccttacgctccagggca

SEQ ID NO: 82643 - DNA, 25 bp, Homo sapien
ggcagcctgacagagccgctcgaag

SEQ ID NO: 82644 - DNA, 25 bp, Homo sapien
cacacacaacatggcggcttcctgg

SEQ ID NO: 82645 - DNA, 25 bp, Homo sapien
tgaaattctcatccgccacacacaa

SEQ ID NO: 82646 - DNA, 25 bp, Homo sapien
gtgaaacttccgagtacaggcgatc

SEQ ID NO: 82647 - DNA, 25 bp, Homo sapien
aaccaccttgtttgtgatagccaca

SEQ ID NO: 82648 - DNA, 25 bp, Homo sapien
gcagcccaggatgcgtaagtccgtc

SEQ ID NO: 82649 - DNA, 25 bp, Homo sapien
aagtccgtctcactgggcaggtcga

SEQ ID NO: 82650 - DNA, 25 bp, Homo sapien
ggcccggacgccatagtcttagcga

SEQ ID NO: 82651 - DNA, 25 bp, Homo sapien
agactaaccagcgttctcggcgcga

SEQ ID NO: 82652 - DNA, 25 bp, Homo sapien
gccacacgaataacggagctttaca

SEQ ID NO: 82653 - DNA, 25 bp, Homo sapien
cagcagtagctgtcgaatgaggccc

SEQ ID NO: 82654 - DNA, 25 bp, Homo sapien
gctagcgttttacccttgcgcggcc

SEQ ID NO: 82655 - DNA, 25 bp, Homo sapien
cctctgtcttagttcggctctattg

SEQ ID NO: 82656 - DNA, 25 bp, Homo sapien
tcatttctcggaagcccagggactc

SEQ ID NO: 82657 - DNA, 25 bp, Homo sapien
cggatctaacttacccgctagcgtt

SEQ ID NO: 82658 - DNA, 25 bp, Homo sapien
ctcttgtgacgtaagccgcagaatc

SEQ ID NO: 82659 - DNA, 25 bp, Homo sapien
tggttgcagtagagaggatccctcc

SEQ ID NO: 82660 - DNA, 25 bp, Homo sapien
tgccacggaacatgtgcaagacccg

SEQ ID NO: 82661 - DNA, 25 bp, Homo sapien
tccaagccaggaacgatcgcggtca

SEQ ID NO: 82662 - DNA, 25 bp, Homo sapien
ctcgcagatgagagagcgcatgctg

SEQ ID NO: 82663 - DNA, 25 bp, Homo sapien
gctgctaacgtgtgtgtatcccgta

SEQ ID NO: 82664 - DNA, 25 bp, Homo sapien
ctcggaatgggacaagctcttcatc

SEQ ID NO: 82665 - DNA, 25 bp, Homo sapien
gctcttcatcatgctggagaactcg

SEQ ID NO: 82666 - DNA, 25 bp, Homo sapien
tgctgcaagccacggacgacgtcct

SEQ ID NO: 82667 - DNA, 25 bp, Homo sapien
gcaagccaagccaggcaaccttcta

SEQ ID NO: 82668 - DNA, 25 bp, Homo sapien
aagctttcatgggaagcgcgcgcgc

SEQ ID NO: 82669 - DNA, 25 bp, Homo sapien
ccaggctgaccagtgctctggacga

SEQ ID NO: 82670 - DNA, 25 bp, Homo sapien
gcagctgttggccaaagtctctcca

SEQ ID NO: 82671 - DNA, 25 bp, Homo sapien
aggaccttaaatcctgctccaggcg

SEQ ID NO: 82672 - DNA, 25 bp, Homo sapien
cgtgtcccagggttctgacagtgga

SEQ ID NO: 82673 - DNA, 25 bp, Homo sapien
gctgacaatctaaacgcgacctggg

SEQ ID NO: 82674 - DNA, 25 bp, Homo sapien
tgctcgcaaacctggcagctgactg

SEQ ID NO: 82675 - DNA, 25 bp, Homo sapien
gcgtgctcaggctgaacagcttttc

SEQ ID NO: 82676 - DNA, 25 bp, Homo sapien
agcttttcttccctgatctctcgga

SEQ ID NO: 82677 - DNA, 25 bp, Homo sapien
gctgtggagcgcttattggtttttc

SEQ ID NO: 82678 - DNA, 25 bp, Homo sapien
gcgtcactgagcctctgtaccgata

SEQ ID NO: 82679 - DNA, 25 bp, Homo sapien
accgacgttcatcaaccaggagacc

SEQ ID NO: 82680 - DNA, 25 bp, Homo sapien
ccgcaggcagatgtttattattaaa

SEQ ID NO: 82681 - DNA, 25 bp, Homo sapien
agcttggagcctgcctgttaggacc

SEQ ID NO: 82682 - DNA, 25 bp, Homo sapien
tggctcctatcgcacgggacattcc

SEQ ID NO: 82683 - DNA, 25 bp, Homo sapien
attttggcctttctcgccggacctg

SEQ ID NO: 82684 - DNA, 25 bp, Homo sapien
cctctgtcctccgttagtcttgggg

SEQ ID NO: 82685 - DNA, 25 bp, Homo sapien
tgcttcagggcgtaccatgcccgca

SEQ ID NO: 82686 - DNA, 25 bp, Homo sapien
ctgaacctgaaaggacaagggcgtc

SEQ ID NO: 82687 - DNA, 25 bp, Homo sapien
cggcgtgctttttggctttcagtct

SEQ ID NO: 82688 - DNA, 25 bp, Homo sapien
gttggcgtcacagacccagggctgc

SEQ ID NO: 82689 - DNA, 25 bp, Homo sapien
tgcagctgcgcctgaacctgaaagg

SEQ ID NO: 82690 - DNA, 25 bp, Homo sapien
cgtgcctcgtgagatccctggtcct

SEQ ID NO: 82691 - DNA, 25 bp, Homo sapien
ggctttccgagtccaagatgcgata

SEQ ID NO: 82692 - DNA, 25 bp, Homo sapien
ctttcagtctgagatcggcgatgct

SEQ ID NO: 82693 - DNA, 25 bp, Homo sapien
tcctgcgtggagtctggctttccga

SEQ ID NO: 82694 - DNA, 25 bp, Homo sapien
tcaacaggttcaagcggaatattcg

SEQ ID NO: 82695 - DNA, 25 bp, Homo sapien
ctccctcgtggaaacgcagactcga

SEQ ID NO: 82696 - DNA, 25 bp, Homo sapien
cctggacagccaggtaatctccgtc

SEQ ID NO: 82697 - DNA, 25 bp, Homo sapien
ggctcgggccaaaccctgcataagg

SEQ ID NO: 82698 - DNA, 25 bp, Homo sapien
acgcagactcgaccctaaacgctta

SEQ ID NO: 82699 - DNA, 25 bp, Homo sapien
gccgaaaggtatcagcgagagcaac

SEQ ID NO: 82700 - DNA, 25 bp, Homo sapien
ggcgggcgaaagcaaccgctctttc

SEQ ID NO: 82701 - DNA, 25 bp, Homo sapien
atgttggctgcccaaagggctcgcc

SEQ ID NO: 82702 - DNA, 25 bp, Homo sapien
ccggcaaactctgcgctagaggcta

SEQ ID NO: 82703 - DNA, 25 bp, Homo sapien
aggctagctttagtcccgccgtctg

SEQ ID NO: 82704 - DNA, 25 bp, Homo sapien
tgcatttcggtggaatgggaacatc

SEQ ID NO: 82705 - DNA, 25 bp, Homo sapien
ctctagctgacaaagctggggtcca

SEQ ID NO: 82706 - DNA, 25 bp, Homo sapien
gtcaggtcgttaccctccgtcagtc

SEQ ID NO: 82707 - DNA, 25 bp, Homo sapien
tcaaaagacttggagacgaacgccg

SEQ ID NO: 82708 - DNA, 25 bp, Homo sapien
aacgccgtaagttcttccatcgccg

SEQ ID NO: 82709 - DNA, 25 bp, Homo sapien
cggagggttaagctttccacctctg

SEQ ID NO: 82710 - DNA, 25 bp, Homo sapien
ggcggcgccctgatctaaagaaacg

SEQ ID NO: 82711 - DNA, 25 bp, Homo sapien
aaatcggccgcgttacaatctactc

SEQ ID NO: 82712 - DNA, 25 bp, Homo sapien
tggcagcgtccatcgatgcactcga

SEQ ID NO: 82713 - DNA, 25 bp, Homo sapien
gcactcgatatctcggctgaagctg

SEQ ID NO: 82714 - DNA, 25 bp, Homo sapien
aactgaagcaagttcggtggacgcc

SEQ ID NO: 82715 - DNA, 25 bp, Homo sapien
ccaggaaggcgctgagcttaaactg

SEQ ID NO: 82716 - DNA, 25 bp, Homo sapien
ggacccaggtgatgcccacgaccag

SEQ ID NO: 82717 - DNA, 25 bp, Homo sapien
gtgtgagcccaaaggtctggaccca

SEQ ID NO: 82718 - DNA, 25 bp, Homo sapien
tcgtccgtactggaggctagctctt

SEQ ID NO: 82719 - DNA, 25 bp, Homo sapien
agacttctcgcctccactgtgttga

SEQ ID NO: 82720 - DNA, 25 bp, Homo sapien
ctggtgacgtcacagagcaatgtcc

SEQ ID NO: 82721 - DNA, 25 bp, Homo sapien
gcggcgagttaacatcgtttttcca

SEQ ID NO: 82722 - DNA, 25 bp, Homo sapien
ccaagacagagccagaatgttcagg

SEQ ID NO: 82723 - DNA, 25 bp, Homo sapien
tgaacagcagttttgaggatgaccc

SEQ ID NO: 82724 - DNA, 25 bp, Homo sapien
tccactgtgttgattgcggttgcca

SEQ ID NO: 82725 - DNA, 25 bp, Homo sapien
ttcttctcgtgagttacgggagcca

SEQ ID NO: 82726 - DNA, 25 bp, Homo sapien
ctcgtagcgcaccaacatgtacttg

SEQ ID NO: 82727 - DNA, 25 bp, Homo sapien
acggtgccgtatttgtgcttgccca

SEQ ID NO: 82728 - DNA, 25 bp, Homo sapien
tcttcatagggttccgagccaggtc

SEQ ID NO: 82729 - DNA, 25 bp, Homo sapien
ggatgcccaggaacccgtagatctc

SEQ ID NO: 82730 - DNA, 25 bp, Homo sapien
agatctcctcggtcttcttcatagg

SEQ ID NO: 82731 - DNA, 25 bp, Homo sapien
gagaagtcctcgcacaccgtggtca

SEQ ID NO: 82732 - DNA, 25 bp, Homo sapien
tctccaggaagtagaggtcgcagtc

SEQ ID NO: 82733 - DNA, 25 bp, Homo sapien
ttgaggtttaatcgcgggtcttcca

SEQ ID NO: 82734 - DNA, 25 bp, Homo sapien
gacccagtgtacagatgcgggcaca

SEQ ID NO: 82735 - DNA, 25 bp, Homo sapien
gtcagcgagtctgggctctgagcga

SEQ ID NO: 82736 - DNA, 25 bp, Homo sapien
tctaggagccgggtcagcgagtctg

SEQ ID NO: 82737 - DNA, 25 bp, Homo sapien
acgcaccgacggctcggcggaccct

SEQ ID NO: 82738 - DNA, 25 bp, Homo sapien
cgccgcgacccagtgtacagatgcg

SEQ ID NO: 82739 - DNA, 25 bp, Homo sapien
cccagtgtacagatgcgggcacaga

SEQ ID NO: 82740 - DNA, 25 bp, Homo sapien
ccagtgtacagatgcgggcacagag

SEQ ID NO: 82741 - DNA, 25 bp, Homo sapien
cgagcgccgcgacccagtgtacaga

SEQ ID NO: 82742 - DNA, 25 bp, Homo sapien
ctccgcaaagcgattgcactttctc

SEQ ID NO: 82743 - DNA, 25 bp, Homo sapien
ccacgggactttgacgcgtgctctg

SEQ ID NO: 82744 - DNA, 25 bp, Homo sapien
gtgcgttaccggcagctgaacccac

SEQ ID NO: 82745 - DNA, 25 bp, Homo sapien
tacaacattggctgccggcgtgact

SEQ ID NO: 82746 - DNA, 25 bp, Homo sapien
cccggaagtgctcttacaacattgg

SEQ ID NO: 82747 - DNA, 25 bp, Homo sapien
cgcgcgagcagcgtaggcactgctc

SEQ ID NO: 82748 - DNA, 25 bp, Homo sapien
tctgcgcttgccatgagactcctgg

SEQ ID NO: 82749 - DNA, 25 bp, Homo sapien
gcactttctcttccaagtcggcaga

SEQ ID NO: 82750 - DNA, 25 bp, Homo sapien
cttagtgctaggatgcggcatcgcc

SEQ ID NO: 82751 - DNA, 25 bp, Homo sapien
tcggccagcactcgtagcgcgctgg

SEQ ID NO: 82752 - DNA, 25 bp, Homo sapien
catggggccactccttttccacgtt

SEQ ID NO: 82753 - DNA, 25 bp, Homo sapien
ccggcgctcgcggaaataaggccgt

SEQ ID NO: 82754 - DNA, 25 bp, Homo sapien
aagttggctcggcacccgacagaca

SEQ ID NO: 82755 - DNA, 25 bp, Homo sapien
tgcatggacgcaggaaagttggctc

SEQ ID NO: 82756 - DNA, 25 bp, Homo sapien
ccggaagttgaagaagtgaagcgcc

SEQ ID NO: 82757 - DNA, 25 bp, Homo sapien
ccagctcagggacttggcgtttccc

SEQ ID NO: 82758 - DNA, 25 bp, Homo sapien
ttgcgatcgattccagccacacctg

SEQ ID NO: 82759 - DNA, 25 bp, Homo sapien
tgctgttactgatgtgcttccttgg

SEQ ID NO: 82760 - DNA, 25 bp, Homo sapien
cccgactttctcttcgaggtagatc

SEQ ID NO: 82761 - DNA, 25 bp, Homo sapien
atcgtcatcgtggtcactggtgcca

SEQ ID NO: 82762 - DNA, 25 bp, Homo sapien
cacctgtggatgttgctagttactc

SEQ ID NO: 82763 - DNA, 25 bp, Homo sapien
gcgcagttcgaactactccggagtc

SEQ ID NO: 82764 - DNA, 25 bp, Homo sapien
ctgcgctgagtctgaaataggtgta

SEQ ID NO: 82765 - DNA, 25 bp, Homo sapien
tgtgaccgccgtcttgacagtgttc

SEQ ID NO: 82766 - DNA, 25 bp, Homo sapien
ccctggaggactatgaggagccctt

SEQ ID NO: 82767 - DNA, 25 bp, Homo sapien
cgactgccagcggttccttacaaag

SEQ ID NO: 82768 - DNA, 25 bp, Homo sapien
gcgcctagagcgagatgcgaaatta

SEQ ID NO: 82769 - DNA, 25 bp, Homo sapien
tttcctgggaaagtgtctggttctc

SEQ ID NO: 82770 - DNA, 25 bp, Homo sapien
cgcgcctggcgcaaaatggttaata

SEQ ID NO: 82771 - DNA, 25 bp, Homo sapien
ttaatacaaagtctgcgcgcgccgc

SEQ ID NO: 82772 - DNA, 25 bp, Homo sapien
agtgcaaatcttcatcgtcgccggg

SEQ ID NO: 82773 - DNA, 25 bp, Homo sapien
cttcccggtctaccagaagaaggtg

SEQ ID NO: 82774 - DNA, 25 bp, Homo sapien
agtgagtactcagcccgccaggtct

SEQ ID NO: 82775 - DNA, 25 bp, Homo sapien
cgctttcattttgggccgagctgga

SEQ ID NO: 82776 - DNA, 25 bp, Homo sapien
accgcacgtgtcaccgagaagctga

SEQ ID NO: 82777 - DNA, 25 bp, Homo sapien
ccagagtcccgggaaagtcctgccg

SEQ ID NO: 82778 - DNA, 25 bp, Homo sapien
gagttaatccgaaagcgccgcaagc

SEQ ID NO: 82779 - DNA, 25 bp, Homo sapien
gctcagcatgtgtccagcgcgcagt

SEQ ID NO: 82780 - DNA, 25 bp, Homo sapien
cccgcgcagtaactgcgaacatttc

SEQ ID NO: 82781 - DNA, 25 bp, Homo sapien
gccgcgcctcgggacaattataaaa

SEQ ID NO: 82782 - DNA, 25 bp, Homo sapien
cctggtgagagcacttgtgcgcctt

SEQ ID NO: 82783 - DNA, 25 bp, Homo sapien
gctccctgaaccaagcgcgcgtggg

SEQ ID NO: 82784 - DNA, 25 bp, Homo sapien
agactcggcgagcttttgtagccgc

SEQ ID NO: 82785 - DNA, 25 bp, Homo sapien
gcgaggcgaccaaccgctgacatgt

SEQ ID NO: 82786 - DNA, 25 bp, Homo sapien
tgcccagcactgcaccgcgaggcga

SEQ ID NO: 82787 - DNA, 25 bp, Homo sapien
tggtgcttgtgctgagaatgactgc

SEQ ID NO: 82788 - DNA, 25 bp, Homo sapien
ccaggctggtgcttgtgctgagaat

SEQ ID NO: 82789 - DNA, 25 bp, Homo sapien
ttacctgctccgcacgacctctgcg

SEQ ID NO: 82790 - DNA, 25 bp, Homo sapien
atcctgctggtgctcttcgccatcg

SEQ ID NO: 82791 - DNA, 25 bp, Homo sapien
tctgcccacctacgaggagtccatg

SEQ ID NO: 82792 - DNA, 25 bp, Homo sapien
gctgcacgccttcctggacaacgtg

SEQ ID NO: 82793 - DNA, 25 bp, Homo sapien
atcggctatttcctgcagcgcatca

SEQ ID NO: 82794 - DNA, 25 bp, Homo sapien
agccggctctcaggactcactgctg

SEQ ID NO: 82795 - DNA, 25 bp, Homo sapien
tcctgcgcctcagagcacgagatgc

SEQ ID NO: 82796 - DNA, 25 bp, Homo sapien
ctacgaggaggtcaagtatctgccc

SEQ ID NO: 82797 - DNA, 25 bp, Homo sapien
agggccgctaccctcttatctgagc

SEQ ID NO: 82798 - DNA, 25 bp, Homo sapien
aatgctggcgtatgggagttcctta

SEQ ID NO: 82799 - DNA, 25 bp, Homo sapien
ggcgagtcgccagttagtcttcacc

SEQ ID NO: 82800 - DNA, 25 bp, Homo sapien
ggtgggtactacacaaccgtctcca

SEQ ID NO: 82801 - DNA, 25 bp, Homo sapien
cagccttcgctggtgacctttcatg

SEQ ID NO: 82802 - DNA, 25 bp, Homo sapien
gccagcgtccgacttgaagttgcta

SEQ ID NO: 82803 - DNA, 25 bp, Homo sapien
ggccctgagcctcgcagatcttttc

SEQ ID NO: 82804 - DNA, 25 bp, Homo sapien
ccaagctactcaaatgtctcgggga

SEQ ID NO: 82805 - DNA, 25 bp, Homo sapien
aggcacgtctagattttcccactta

SEQ ID NO: 82806 - DNA, 25 bp, Homo sapien
ctccgcatccgtaaaggtccttaga

SEQ ID NO: 82807 - DNA, 25 bp, Homo sapien
tgctgggctcgttcgaaagtaaacg

SEQ ID NO: 82808 - DNA, 25 bp, Homo sapien
ttctcagggaacacccacatctgtc

SEQ ID NO: 82809 - DNA, 25 bp, Homo sapien
ggaagtcgccacacattctcaggga

SEQ ID NO: 82810 - DNA, 25 bp, Homo sapien
gtgtcttccatcgttgcctcacaga

SEQ ID NO: 82811 - DNA, 25 bp, Homo sapien
gaattatcttttacttggcgccaca

SEQ ID NO: 82812 - DNA, 25 bp, Homo sapien
ggccgacggcttctgaggaattatc

SEQ ID NO: 82813 - DNA, 25 bp, Homo sapien
ctctctatcctgtggggagcttcgg

SEQ ID NO: 82814 - DNA, 25 bp, Homo sapien
aagtttgctgccctcctcgaatggg

SEQ ID NO: 82815 - DNA, 25 bp, Homo sapien
agcgccctggacacccactccgcag

SEQ ID NO: 82816 - DNA, 25 bp, Homo sapien
gctcgagcagctgagtgcgttctct

SEQ ID NO: 82817 - DNA, 25 bp, Homo sapien
gccaatacctggtcggggacgcgcc

SEQ ID NO: 82818 - DNA, 25 bp, Homo sapien
ggccaccgcgcgtctcaagtttgct

SEQ ID NO: 82819 - DNA, 25 bp, Homo sapien
tcagggtctcaaggcgcctccgcag

SEQ ID NO: 82820 - DNA, 25 bp, Homo sapien
ggacctcagggtctcaaggcgcctc

SEQ ID NO: 82821 - DNA, 25 bp, Homo sapien
ctccatcctcgggtctggagtcagg

SEQ ID NO: 82822 - DNA, 25 bp, Homo sapien
ccattggctaaccaggctccggtgc

SEQ ID NO: 82823 - DNA, 25 bp, Homo sapien
ctccggtgcgttcgaccaatcagaa

SEQ ID NO: 82824 - DNA, 25 bp, Homo sapien
tgcagctccggcaaagacaactgtg

SEQ ID NO: 82825 - DNA, 25 bp, Homo sapien
cagtttctcgttgtccgccatggcc

SEQ ID NO: 82826 - DNA, 25 bp, Homo sapien
cttgagccgttggttgtccagtttc

SEQ ID NO: 82827 - DNA, 25 bp, Homo sapien
ccaagtcgcggcctttgttcttgaa

SEQ ID NO: 82828 - DNA, 25 bp, Homo sapien
cgacataaacttcccggcgcgctag

SEQ ID NO: 82829 - DNA, 25 bp, Homo sapien
agttgttttgctccactcgtccagg

SEQ ID NO: 82830 - DNA, 25 bp, Homo sapien
cggcggcaagatcagctgccagttc

SEQ ID NO: 82831 - DNA, 25 bp, Homo sapien
ggttgccacgggaacttctcagatg

SEQ ID NO: 82832 - DNA, 25 bp, Homo sapien
ccggtggagagctcatctgctacca

SEQ ID NO: 82833 - DNA, 25 bp, Homo sapien
gccagttcatgctgtgcccggagct

SEQ ID NO: 82834 - DNA, 25 bp, Homo sapien
cccgccggtcagtcctattttgtgg

SEQ ID NO: 82835 - DNA, 25 bp, Homo sapien
ctatgactgcctacagggtggcttc

SEQ ID NO: 82836 - DNA, 25 bp, Homo sapien
tgcgagggctaccagtactatgact

SEQ ID NO: 82837 - DNA, 25 bp, Homo sapien
gccgcccaactgcatcgaggctgta

SEQ ID NO: 82838 - DNA, 25 bp, Homo sapien
tctgacagctgggtgggaacacctc

SEQ ID NO: 82839 - DNA, 25 bp, Homo sapien
gatcgtctccctaccgctttgcaag

SEQ ID NO: 82840 - DNA, 25 bp, Homo sapien
cgcggaacttgctcagcctctgaca

SEQ ID NO: 82841 - DNA, 25 bp, Homo sapien
cttgattcttcttgcccaaccgggg

SEQ ID NO: 82842 - DNA, 25 bp, Homo sapien
caacgattcgcaagagctaggcagc

SEQ ID NO: 82843 - DNA, 25 bp, Homo sapien
ccggggtcagtattagcttgtctta

SEQ ID NO: 82844 - DNA, 25 bp, Homo sapien
acgctcacgtatggctctcggcttc

SEQ ID NO: 82845 - DNA, 25 bp, Homo sapien
agtgcgtcccttctcgcttgcctta

SEQ ID NO: 82846 - DNA, 25 bp, Homo sapien
ctacccggatttgacggtggctgga

SEQ ID NO: 82847 - DNA, 25 bp, Homo sapien
cgacgcaaggcaggtattgcaccct

SEQ ID NO: 82848 - DNA, 25 bp, Homo sapien
agctgctcgtcaccgagacccgaga

SEQ ID NO: 82849 - DNA, 25 bp, Homo sapien
cacgctccgctctagaggagtgggc

SEQ ID NO: 82850 - DNA, 25 bp, Homo sapien
ggtggctataccctccacccagtgg

SEQ ID NO: 82851 - DNA, 25 bp, Homo sapien
tggcaggactcaaccgcctcggaga

SEQ ID NO: 82852 - DNA, 25 bp, Homo sapien
gcggtcaccttgcattccgagcacg

SEQ ID NO: 82853 - DNA, 25 bp, Homo sapien
gcaggcctgttaggggcccaccaat

SEQ ID NO: 82854 - DNA, 25 bp, Homo sapien
cgagctggtggccaacatgctccca

SEQ ID NO: 82855 - DNA, 25 bp, Homo sapien
caacatgaagccaggcggctagggc

SEQ ID NO: 82856 - DNA, 25 bp, Homo sapien
cgcccacaaaaggatttttcaaatg

SEQ ID NO: 82857 - DNA, 25 bp, Homo sapien
gcggtgcctgctcctgacctgggct

SEQ ID NO: 82858 - DNA, 25 bp, Homo sapien
cttcgaccggcactggtcccagcgc

SEQ ID NO: 82859 - DNA, 25 bp, Homo sapien
aggccatctcccagcggtggcaaca

SEQ ID NO: 82860 - DNA, 25 bp, Homo sapien
tcccagcggtggcaacatgaagcca

SEQ ID NO: 82861 - DNA, 25 bp, Homo sapien
ctggtggccaacatgctcccagtcg

SEQ ID NO: 82862 - DNA, 25 bp, Homo sapien
cttttaatacgtcactcgggccgcg

SEQ ID NO: 82863 - DNA, 25 bp, Homo sapien
gacgccgtccggagactcctgtggc

SEQ ID NO: 82864 - DNA, 25 bp, Homo sapien
gccgtgctcagtctgcgtgagcgcc

SEQ ID NO: 82865 - DNA, 25 bp, Homo sapien
agtaggttccggagtccgagacctg

SEQ ID NO: 82866 - DNA, 25 bp, Homo sapien
gttttcagcaaatccagggctggtc

SEQ ID NO: 82867 - DNA, 25 bp, Homo sapien
gtctattttgttgcgggttttcagc

SEQ ID NO: 82868 - DNA, 25 bp, Homo sapien
ctcgcgagatcttctctgtggcgga

SEQ ID NO: 82869 - DNA, 25 bp, Homo sapien
tttcgagcatttcgctcgcgagatc

SEQ ID NO: 82870 - DNA, 25 bp, Homo sapien
tggtgcctctgaacgtgtgaaacgc

SEQ ID NO: 82871 - DNA, 25 bp, Homo sapien
ttacgctccgcgctcgaatatcttc

SEQ ID NO: 82872 - DNA, 25 bp, Homo sapien
gtgtgtgcccactcacaagtgcaga

SEQ ID NO: 82873 - DNA, 25 bp, Homo sapien
ccgcggtagctaggaggttaatcgt

SEQ ID NO: 82874 - DNA, 25 bp, Homo sapien
tgaaggctcccggttctgtatctcc

SEQ ID NO: 82875 - DNA, 25 bp, Homo sapien
ggactgcgtctgaaactcggcatca

SEQ ID NO: 82876 - DNA, 25 bp, Homo sapien
gcatccatcgggctgcagactttgg

SEQ ID NO: 82877 - DNA, 25 bp, Homo sapien
cccgactctactgaaggggcacgtc

SEQ ID NO: 82878 - DNA, 25 bp, Homo sapien
tgacaacaccgctaagaaggaataa

SEQ ID NO: 82879 - DNA, 25 bp, Homo sapien
acccagtgggtctcgaaggtacagc

SEQ ID NO: 82880 - DNA, 25 bp, Homo sapien
ccacccagtgggtctcgaaggtaca

SEQ ID NO: 82881 - DNA, 25 bp, Homo sapien
ggagagaggccttgcttcaagctga

SEQ ID NO: 82882 - DNA, 25 bp, Homo sapien
aagggccgctgccaagcaggacgcc

SEQ ID NO: 82883 - DNA, 25 bp, Homo sapien
taagaaggaataagggccgctgcca

SEQ ID NO: 82884 - DNA, 25 bp, Homo sapien
ccgctaagaaggaataagggccgct

SEQ ID NO: 82885 - DNA, 25 bp, Homo sapien
ctcgaaggtacagcgagtgatggca

SEQ ID NO: 82886 - DNA, 25 bp, Homo sapien
gcttgctgcccgctaggcggactca

SEQ ID NO: 82887 - DNA, 25 bp, Homo sapien
taggcggactcagagaccatcctcc

SEQ ID NO: 82888 - DNA, 25 bp, Homo sapien
accaccgccggatggccgcggatag

SEQ ID NO: 82889 - DNA, 25 bp, Homo sapien
gatagctgccgggagtttccgtctt

SEQ ID NO: 82890 - DNA, 25 bp, Homo sapien
cgtcttggtctccttggttaccgcg

SEQ ID NO: 82891 - DNA, 25 bp, Homo sapien
cgcgttacctcggtacccatagcaa

SEQ ID NO: 82892 - DNA, 25 bp, Homo sapien
ggtacccatagcaaccagaaagctg

SEQ ID NO: 82893 - DNA, 25 bp, Homo sapien
aaccagaaagctgggttctgccact

SEQ ID NO: 82894 - DNA, 25 bp, Homo sapien
gccggcaggcggcatttacaaaccc

SEQ ID NO: 82895 - DNA, 25 bp, Homo sapien
gatcaattcactccggcgacgccgg

SEQ ID NO: 82896 - DNA, 25 bp, Homo sapien
taccagcaactgaggcactgacttc

SEQ ID NO: 82897 - DNA, 25 bp, Homo sapien
gcgttgtccgcaattcctgcaatcg

SEQ ID NO: 82898 - DNA, 25 bp, Homo sapien
tgggacagaacagctacaccttacc

SEQ ID NO: 82899 - DNA, 25 bp, Homo sapien
tagacctcttctgctcggtgcagag

SEQ ID NO: 82900 - DNA, 25 bp, Homo sapien
cactcgcgtagggtaacctcgctta

SEQ ID NO: 82901 - DNA, 25 bp, Homo sapien
aaccaggcgttgtccggaatcctgc

SEQ ID NO: 82902 - DNA, 25 bp, Homo sapien
cccagaggacctcgacaggagcaca

SEQ ID NO: 82903 - DNA, 25 bp, Homo sapien
tcttgagcctttggaatctcggatc

SEQ ID NO: 82904 - DNA, 25 bp, Homo sapien
aggaggggaccacaacattgttatg

SEQ ID NO: 82905 - DNA, 25 bp, Homo sapien
tgcgagccaagcctagccaagtcgg

SEQ ID NO: 82906 - DNA, 25 bp, Homo sapien
gaggttgatggagcccttccaggaa

SEQ ID NO: 82907 - DNA, 25 bp, Homo sapien
gggcgaggctcaagcacccagaaaa

SEQ ID NO: 82908 - DNA, 25 bp, Homo sapien
gggactggcgaactccgcctctctg

SEQ ID NO: 82909 - DNA, 25 bp, Homo sapien
aaagcaggaagtcgatcccgcgggc

SEQ ID NO: 82910 - DNA, 25 bp, Homo sapien
tcgtagtagagcatcgcgccgtaga

SEQ ID NO: 82911 - DNA, 25 bp, Homo sapien
gctattctggccaacgggattccgg

SEQ ID NO: 82912 - DNA, 25 bp, Homo sapien
ggctcccactgcacgactttgttgc

SEQ ID NO: 82913 - DNA, 25 bp, Homo sapien
ggaggccctccgcatacttcagagc

SEQ ID NO: 82914 - DNA, 25 bp, Homo sapien
agccaaacttctgcgaggctcgttc

SEQ ID NO: 82915 - DNA, 25 bp, Homo sapien
ggagcacatcccgtttcccatagtc

SEQ ID NO: 82916 - DNA, 25 bp, Homo sapien
gcgccgtagagaaagccgaacacga

SEQ ID NO: 82917 - DNA, 25 bp, Homo sapien
atccgcttctgctttcgggagcaca

SEQ ID NO: 82918 - DNA, 25 bp, Homo sapien
ggctcactcggtttcagttgctccc

SEQ ID NO: 82919 - DNA, 25 bp, Homo sapien
cctcagcgcctgacagatttttgtc

SEQ ID NO: 82920 - DNA, 25 bp, Homo sapien
gggtgtgctctccacccggtacttc

SEQ ID NO: 82921 - DNA, 25 bp, Homo sapien
cgctccggaacgcttggagagagca

SEQ ID NO: 82922 - DNA, 25 bp, Homo sapien
aggaagcgccctacagctccggctg

SEQ ID NO: 82923 - DNA, 25 bp, Homo sapien
tcgccgagatgtcctcgcgactgtg

SEQ ID NO: 82924 - DNA, 25 bp, Homo sapien
tcccagacgcctgtgacgcctgttg

SEQ ID NO: 82925 - DNA, 25 bp, Homo sapien
gggctgtctctttaagcgctccgga

SEQ ID NO: 82926 - DNA, 25 bp, Homo sapien
ccacgtgccatgacttcctggagtg

SEQ ID NO: 82927 - DNA, 25 bp, Homo sapien
gcctacacgggtgtggtctacctgc

SEQ ID NO: 82928 - DNA, 25 bp, Homo sapien
ttggcacgcgcaggctcaatgccta

SEQ ID NO: 82929 - DNA, 25 bp, Homo sapien
caagggcaatgaggagggctacttt

SEQ ID NO: 82930 - DNA, 25 bp, Homo sapien
ccatcgccctgaacatcatcaaggg

SEQ ID NO: 82931 - DNA, 25 bp, Homo sapien
ctggtgcctgcgcatatcttccgca

SEQ ID NO: 82932 - DNA, 25 bp, Homo sapien
actaccagctcaacttccagacggg

SEQ ID NO: 82933 - DNA, 25 bp, Homo sapien
tcctggagtgccagaactcgccagc

SEQ ID NO: 82934 - DNA, 25 bp, Homo sapien
cagcacacgatgttggacagcaaag

SEQ ID NO: 82935 - DNA, 25 bp, Homo sapien
tcgcccggcttagcaacgtagataa

SEQ ID NO: 82936 - DNA, 25 bp, Homo sapien
ggccagtgccaggaattcagatttt

SEQ ID NO: 82937 - DNA, 25 bp, Homo sapien
gagacgtgtccagaccgcaccgttt

SEQ ID NO: 82938 - DNA, 25 bp, Homo sapien
accgcaccgtttcgcaggaggaaca

SEQ ID NO: 82939 - DNA, 25 bp, Homo sapien
ttacttggcaaggtggaactcggcc

SEQ ID NO: 82940 - DNA, 25 bp, Homo sapien
ccgaatgtgactttctcgcgaagca

SEQ ID NO: 82941 - DNA, 25 bp, Homo sapien
ttcagattttggcaaccgcaccttg

SEQ ID NO: 82942 - DNA, 25 bp, Homo sapien
gagcgactttcaaggtctggatact

SEQ ID NO: 82943 - DNA, 25 bp, Homo sapien
ggcgccggcaacacagctctgcctt

SEQ ID NO: 82944 - DNA, 25 bp, Homo sapien
acgccggtagatggcattgcgctcc

SEQ ID NO: 82945 - DNA, 25 bp, Homo sapien
atacttgcaggtacggcaggacgcc

SEQ ID NO: 82946 - DNA, 25 bp, Homo sapien
agccacccaggtgaacccgcctctg

SEQ ID NO: 82947 - DNA, 25 bp, Homo sapien
tcaaggtctggatacttgcaggtac

SEQ ID NO: 82948 - DNA, 25 bp, Homo sapien
ctccgaaataaagcgcagcgccggc

SEQ ID NO: 82949 - DNA, 25 bp, Homo sapien
gatggcattgcgctccgaaataaag

SEQ ID NO: 82950 - DNA, 25 bp, Homo sapien
tcgtctacagtcctggcggagcatc

SEQ ID NO: 82951 - DNA, 25 bp, Homo sapien
ctggttggccagaggcaactctccc

SEQ ID NO: 82952 - DNA, 25 bp, Homo sapien
ttgacacctcaaggaagagcgctcc

SEQ ID NO: 82953 - DNA, 25 bp, Homo sapien
ctcgaagtagaagcatttggacaaa

SEQ ID NO: 82954 - DNA, 25 bp, Homo sapien
tttggacaaacgcagtcctgtcgtc

SEQ ID NO: 82955 - DNA, 25 bp, Homo sapien
gccaggcgagtcatccaacactttt

SEQ ID NO: 82956 - DNA, 25 bp, Homo sapien
gctgcacccagacgaagcgccggag

SEQ ID NO: 82957 - DNA, 25 bp, Homo sapien
tcccacacccgggactagctggttg

SEQ ID NO: 82958 - DNA, 25 bp, Homo sapien
gcccatggggttgaagaaccatttc

SEQ ID NO: 82959 - DNA, 25 bp, Homo sapien
tcggcttccacgtccagccagggaa

SEQ ID NO: 82960 - DNA, 25 bp, Homo sapien
tgtaaattgcgttttcggtcccaga

SEQ ID NO: 82961 - DNA, 25 bp, Homo sapien
gcttagggctccagctgtgcacagt

SEQ ID NO: 82962 - DNA, 25 bp, Homo sapien
ctgagacacggaacagcctcctctt

SEQ ID NO: 82963 - DNA, 25 bp, Homo sapien
ttggagagaacgtcgggctgattac

SEQ ID NO: 82964 - DNA, 25 bp, Homo sapien
cggtcagggtagctggcttttaata

SEQ ID NO: 82965 - DNA, 25 bp, Homo sapien
cgggcgatttctgcccagttacctt

SEQ ID NO: 82966 - DNA, 25 bp, Homo sapien
taaagttccatttccggccatgagg

SEQ ID NO: 82967 - DNA, 25 bp, Homo sapien
gagcccaactcttcgcggtggcagt

SEQ ID NO: 82968 - DNA, 25 bp, Homo sapien
cgttcctcttcctgcggcctgaaag

SEQ ID NO: 82969 - DNA, 25 bp, Homo sapien
tgcacgtcccacagctcagggaatc

SEQ ID NO: 82970 - DNA, 25 bp, Homo sapien
cgaactgcatgtgtgagccgagtcc

SEQ ID NO: 82971 - DNA, 25 bp, Homo sapien
cgcccttctcagttagggttagaca

SEQ ID NO: 82972 - DNA, 25 bp, Homo sapien
ctcgcggctctcgtgagagtcactc

SEQ ID NO: 82973 - DNA, 25 bp, Homo sapien
gcacggattggccaagctgactctc

SEQ ID NO: 82974 - DNA, 25 bp, Homo sapien
ggtagataaactggggctcccggca

SEQ ID NO: 82975 - DNA, 25 bp, Homo sapien
ggacgcaccgtgctcctcatgttac

SEQ ID NO: 82976 - DNA, 25 bp, Homo sapien
cgccttgatcattcccgagccgttg

SEQ ID NO: 82977 - DNA, 25 bp, Homo sapien
accaccggtagctggcagtggttca

SEQ ID NO: 82978 - DNA, 25 bp, Homo sapien
gagccgttgtcgatcaccaccggta

SEQ ID NO: 82979 - DNA, 25 bp, Homo sapien
tcctgtctctgagccgctctagcta

SEQ ID NO: 82980 - DNA, 25 bp, Homo sapien
gagtgcctggaacgccgcgtcacag

SEQ ID NO: 82981 - DNA, 25 bp, Homo sapien
gcggccgataatgttcgggtagata

SEQ ID NO: 82982 - DNA, 25 bp, Homo sapien
tatccatgacgcctgctgcttcggg

SEQ ID NO: 82983 - DNA, 25 bp, Homo sapien
ggctcggtgacgtcctcccaagatg

SEQ ID NO: 82984 - DNA, 25 bp, Homo sapien
aagacagagccggacgtgacgccac

SEQ ID NO: 82985 - DNA, 25 bp, Homo sapien
tcccgcactgccacgggaagacaga

SEQ ID NO: 82986 - DNA, 25 bp, Homo sapien
gtgggtctctgtggtacatcctgta

SEQ ID NO: 82987 - DNA, 25 bp, Homo sapien
gagcgccagacgctgactgccggca

SEQ ID NO: 82988 - DNA, 25 bp, Homo sapien
gccggcaccagaatgctcgcgatga

SEQ ID NO: 82989 - DNA, 25 bp, Homo sapien
agcgctgcgagctagcgagccctca

SEQ ID NO: 82990 - DNA, 25 bp, Homo sapien
gggcggacccacacatggtaggaac

SEQ ID NO: 82991 - DNA, 25 bp, Homo sapien
aattcgtcatggtcctaacgcgccg

SEQ ID NO: 82992 - DNA, 25 bp, Homo sapien
ccaatcgccaggtggaaggcactca

SEQ ID NO: 82993 - DNA, 25 bp, Homo sapien
cttcggtgcactggttccgcaaagg

SEQ ID NO: 82994 - DNA, 25 bp, Homo sapien
gcaaagggctgcgactccacgacaa

SEQ ID NO: 82995 - DNA, 25 bp, Homo sapien
gcgtgcgctgcgtttacattctcga

SEQ ID NO: 82996 - DNA, 25 bp, Homo sapien
ttacattctcgacccgtggttcgcg

SEQ ID NO: 82997 - DNA, 25 bp, Homo sapien
ctcctcagtcgggatcaaccgatgg

SEQ ID NO: 82998 - DNA, 25 bp, Homo sapien
agcctgcttcgagtcccgctggctg

SEQ ID NO: 82999 - DNA, 25 bp, Homo sapien
gaccctgagagcacggcgacagaca

SEQ ID NO: 83000 - DNA, 25 bp, Homo sapien
acggcgacagacaccatctgcacaa

SEQ ID NO: 83001 - DNA, 25 bp, Homo sapien
tctgcacaacctatcgcgcaaaggg

SEQ ID NO: 83002 - DNA, 25 bp, Homo sapien
gcgcagacgtgctccctacttctta

SEQ ID NO: 83003 - DNA, 25 bp, Homo sapien
tactggcctgagtggaggcccaagc

SEQ ID NO: 83004 - DNA, 25 bp, Homo sapien
ttacagtccgcctgcagctgtgagg

SEQ ID NO: 83005 - DNA, 25 bp, Homo sapien
ctgtgaggcggctacacgagcctcg

SEQ ID NO: 83006 - DNA, 25 bp, Homo sapien
gagacacaagaagcggatccaggta

SEQ ID NO: 83007 - DNA, 25 bp, Homo sapien
atccaggtagcaaagccgagctctg

SEQ ID NO: 83008 - DNA, 25 bp, Homo sapien
ccctaaaagggcgagcgaaagcaag

SEQ ID NO: 83009 - DNA, 25 bp, Homo sapien
gccgcgctcagaatccggctgcgga

SEQ ID NO: 83010 - DNA, 25 bp, Homo sapien
cgccagccggcggattacataacgg

SEQ ID NO: 83011 - DNA, 25 bp, Homo sapien
aaggcaccgctaaggaccgctggcc

SEQ ID NO: 83012 - DNA, 25 bp, Homo sapien
ctcgctccacgtcagagggaaccgg

SEQ ID NO: 83013 - DNA, 25 bp, Homo sapien
gattctccagttcccgcacagcagg

SEQ ID NO: 83014 - DNA, 25 bp, Homo sapien
ctccaggggagatgctttttaaaca

SEQ ID NO: 83015 - DNA, 25 bp, Homo sapien
tatgcaactcttcgctctttcctgg

SEQ ID NO: 83016 - DNA, 25 bp, Homo sapien
ccgacagccatcgatcctcgggtga

SEQ ID NO: 83017 - DNA, 25 bp, Homo sapien
gcgctcaaaggttgcccgtctctga

SEQ ID NO: 83018 - DNA, 25 bp, Homo sapien
tggcgcccagaggtgaatagtctca

SEQ ID NO: 83019 - DNA, 25 bp, Homo sapien
gcgtgcattcattggggccgacttt

SEQ ID NO: 83020 - DNA, 25 bp, Homo sapien
cctggctggctcaaaattccctcta

SEQ ID NO: 83021 - DNA, 25 bp, Homo sapien
gattaccgcggagccttagcaactg

SEQ ID NO: 83022 - DNA, 25 bp, Homo sapien
gccaggctctccgacgggctcaacc

SEQ ID NO: 83023 - DNA, 25 bp, Homo sapien
cgctgcagcaggagtgtccctgatc

SEQ ID NO: 83024 - DNA, 25 bp, Homo sapien
agtgtccctgatcccgggtggtcgc

SEQ ID NO: 83025 - DNA, 25 bp, Homo sapien
cccggcgcgtccagctaagcaggaa

SEQ ID NO: 83026 - DNA, 25 bp, Homo sapien
cgtccagctaagcaggaagggcccg

SEQ ID NO: 83027 - DNA, 25 bp, Homo sapien
caggcgcgcccaagacccatccgcg

SEQ ID NO: 83028 - DNA, 25 bp, Homo sapien
gccctgctgcgtctgcccactgccc

SEQ ID NO: 83029 - DNA, 25 bp, Homo sapien
tgcagcaggagtgtccctgatcccg

SEQ ID NO: 83030 - DNA, 25 bp, Homo sapien
ctggaccctagagttcgtcttcgcc

SEQ ID NO: 83031 - DNA, 25 bp, Homo sapien
cgtgtcggattctcccgctgaggag

SEQ ID NO: 83032 - DNA, 25 bp, Homo sapien
ctgcctggagggtaactggacccta

SEQ ID NO: 83033 - DNA, 25 bp, Homo sapien
ccatcactaacatgggctgcgcatg

SEQ ID NO: 83034 - DNA, 25 bp, Homo sapien
tagccggctcctccacgataggacg

SEQ ID NO: 83035 - DNA, 25 bp, Homo sapien
taggacgggtctcgagtctctcttt

SEQ ID NO: 83036 - DNA, 25 bp, Homo sapien
actgcccgcaaaagagccctgagct

SEQ ID NO: 83037 - DNA, 25 bp, Homo sapien
ggggcccacttgcaggaatgacagc

SEQ ID NO: 83038 - DNA, 25 bp, Homo sapien
caccaggtccgggtgaaagcctact

SEQ ID NO: 83039 - DNA, 25 bp, Homo sapien
acggccgcggttctccggcaagcgc

SEQ ID NO: 83040 - DNA, 25 bp, Homo sapien
gcagcggggaccattcccaccaggt

SEQ ID NO: 83041 - DNA, 25 bp, Homo sapien
ggtgaaagcctactaccgcgggtga

SEQ ID NO: 83042 - DNA, 25 bp, Homo sapien
gagatgccgacccagagggacagca

SEQ ID NO: 83043 - DNA, 25 bp, Homo sapien
actcagggtgagtgacgaagtgata

SEQ ID NO: 83044 - DNA, 25 bp, Homo sapien
ctactaccgcgggtgagtgtcctgg

SEQ ID NO: 83045 - DNA, 25 bp, Homo sapien
atgtcccacacggtcgcaggcggcg

SEQ ID NO: 83046 - DNA, 25 bp, Homo sapien
caataggccagacggcacgcgcgtc

SEQ ID NO: 83047 - DNA, 25 bp, Homo sapien
tggcccatcaccacagagcggcggg

SEQ ID NO: 83048 - DNA, 25 bp, Homo sapien
gcgctctgaggagccacaataggcc

SEQ ID NO: 83049 - DNA, 25 bp, Homo sapien
aagctgtgtgtctccgcagtgacgt

SEQ ID NO: 83050 - DNA, 25 bp, Homo sapien
cggtggggaattcacaaagctcgtc

SEQ ID NO: 83051 - DNA, 25 bp, Homo sapien
aagctcgtcgagcttacccgggcac

SEQ ID NO: 83052 - DNA, 25 bp, Homo sapien
ggtgttccacggctgatcacgcttc

SEQ ID NO: 83053 - DNA, 25 bp, Homo sapien
ccagacagccggctgggcgactaga

SEQ ID NO: 83054 - DNA, 25 bp, Homo sapien
gccgggtccctttgagaatgaacaa

SEQ ID NO: 83055 - DNA, 25 bp, Homo sapien
ccgaacttaacttctctaggccgca

SEQ ID NO: 83056 - DNA, 25 bp, Homo sapien
gagcgggatattagacggcgtcaca

SEQ ID NO: 83057 - DNA, 25 bp, Homo sapien
ttggcggcggctcccaaatccttat

SEQ ID NO: 83058 - DNA, 25 bp, Homo sapien
gctgacaggagaatcgaaccggctc

SEQ ID NO: 83059 - DNA, 25 bp, Homo sapien
cgtgttaattactgcggtcccagcc

SEQ ID NO: 83060 - DNA, 25 bp, Homo sapien
ccacctgccgcaagctggatgagct

SEQ ID NO: 83061 - DNA, 25 bp, Homo sapien
ctaggccgcagtattcttatctgga

SEQ ID NO: 83062 - DNA, 25 bp, Homo sapien
gtggctggcagtccgcacttactgc

SEQ ID NO: 83063 - DNA, 25 bp, Homo sapien
gagtccctttgaggagtttgctccc

SEQ ID NO: 83064 - DNA, 25 bp, Homo sapien
gtttgctcccaggtaaaagggcaga

SEQ ID NO: 83065 - DNA, 25 bp, Homo sapien
aaagggcagacgttgctcccgacct

SEQ ID NO: 83066 - DNA, 25 bp, Homo sapien
gccggaaaagcgtctccgtttcatg

SEQ ID NO: 83067 - DNA, 25 bp, Homo sapien
ccgtttcatggtctcggtccgaggc

SEQ ID NO: 83068 - DNA, 25 bp, Homo sapien
cggctccctgggtcattccgggaga

SEQ ID NO: 83069 - DNA, 25 bp, Homo sapien
tgccgagacctaggctgcccgcatt

SEQ ID NO: 83070 - DNA, 25 bp, Homo sapien
agtcttgcagtgaatcagccggttg

SEQ ID NO: 83071 - DNA, 25 bp, Homo sapien
ggacacctctgccatgggctgccgg

SEQ ID NO: 83072 - DNA, 25 bp, Homo sapien
agacatggcggcagctcctctcaca

SEQ ID NO: 83073 - DNA, 25 bp, Homo sapien
agttccgcatgatcaccgattgcag

SEQ ID NO: 83074 - DNA, 25 bp, Homo sapien
ggagcagttccgcatgatcaccgat

SEQ ID NO: 83075 - DNA, 25 bp, Homo sapien
tcggtgctgtaggtgtgtttattcc

SEQ ID NO: 83076 - DNA, 25 bp, Homo sapien
tgcagtgaatcagccggttgtagcg

SEQ ID NO: 83077 - DNA, 25 bp, Homo sapien
gatctccgcttcgtgaccaccagga

SEQ ID NO: 83078 - DNA, 25 bp, Homo sapien
gttgcatgttcacgaggctgttccc

SEQ ID NO: 83079 - DNA, 25 bp, Homo sapien
cgcttcgcctcccaatttcaggtga

SEQ ID NO: 83080 - DNA, 25 bp, Homo sapien
cctcccaatttcaggtgagagtccc

SEQ ID NO: 83081 - DNA, 25 bp, Homo sapien
ccttcagcggggactgatccgcatt

SEQ ID NO: 83082 - DNA, 25 bp, Homo sapien
gactgatccgcattggctgccctgc

SEQ ID NO: 83083 - DNA, 25 bp, Homo sapien
cgccagcctcaagtccggactggta

SEQ ID NO: 83084 - DNA, 25 bp, Homo sapien
tccggactggtagccgttgcatgtt

SEQ ID NO: 83085 - DNA, 25 bp, Homo sapien
tccgccattcctggtcctaggctgg

SEQ ID NO: 83086 - DNA, 25 bp, Homo sapien
taacccaggaaaccagtgcgctgcc

SEQ ID NO: 83087 - DNA, 25 bp, Homo sapien
cagttacctagtggctgctcccgga

SEQ ID NO: 83088 - DNA, 25 bp, Homo sapien
gccgcgcggtctgcatttatatcaa

SEQ ID NO: 83089 - DNA, 25 bp, Homo sapien
catttatatcaaagcgtgctgcgtc

SEQ ID NO: 83090 - DNA, 25 bp, Homo sapien
cacgcgctgagagcgtcagattgtc

SEQ ID NO: 83091 - DNA, 25 bp, Homo sapien
gtggttgaactgactctcgggtttc

SEQ ID NO: 83092 - DNA, 25 bp, Homo sapien
cgctcctggctgttcaagccgatta

SEQ ID NO: 83093 - DNA, 25 bp, Homo sapien
ttgcagtggcctctacagttaccta

SEQ ID NO: 83094 - DNA, 25 bp, Homo sapien
tttcagctggcaaagagcgcctttc

SEQ ID NO: 83095 - DNA, 25 bp, Homo sapien
cgcagtcgactttaatgggaaccaa

SEQ ID NO: 83096 - DNA, 25 bp, Homo sapien
tttctctcggtcagcgctcagttct

SEQ ID NO: 83097 - DNA, 25 bp, Homo sapien
attggctaccagattcccgaggctc

SEQ ID NO: 83098 - DNA, 25 bp, Homo sapien
cacgtgctgcggattagtgcacttc

SEQ ID NO: 83099 - DNA, 25 bp, Homo sapien
gcgtggagcgcactttcagcagtct

SEQ ID NO: 83100 - DNA, 25 bp, Homo sapien
gcgctcctccgtgctggaaacagca

SEQ ID NO: 83101 - DNA, 25 bp, Homo sapien
ccatcaggtgcgtggcagttatcac

SEQ ID NO: 83102 - DNA, 25 bp, Homo sapien
attgggagcgcgacccgccattcac

SEQ ID NO: 83103 - DNA, 25 bp, Homo sapien
aaccattctcttctcccattgggag

SEQ ID NO: 83104 - DNA, 25 bp, Homo sapien
cacggcggcaggaaaccattctctt

SEQ ID NO: 83105 - DNA, 25 bp, Homo sapien
gcctttaacttcttgtgctcagccc

SEQ ID NO: 83106 - DNA, 25 bp, Homo sapien
aagcgtctctgtgccgcgtcgtaaa

SEQ ID NO: 83107 - DNA, 25 bp, Homo sapien
cgtcgtaaatgataccggtgtggtt

SEQ ID NO: 83108 - DNA, 25 bp, Homo sapien
aacggaatttgccttgagtgcgcgg

SEQ ID NO: 83109 - DNA, 25 bp, Homo sapien
cctgccttttcagaaacggaatttg

SEQ ID NO: 83110 - DNA, 25 bp, Homo sapien
tgcaaccggtgcatataaggacttg

SEQ ID NO: 83111 - DNA, 25 bp, Homo sapien
ggtctatttcactcgcgtcctcatg

SEQ ID NO: 83112 - DNA, 25 bp, Homo sapien
acatgcttctttgcttgtgcgtgga

SEQ ID NO: 83113 - DNA, 25 bp, Homo sapien
gaactgtctatcaccgcttcctggg

SEQ ID NO: 83114 - DNA, 25 bp, Homo sapien
tagggacccaagctctatttttgtg

SEQ ID NO: 83115 - DNA, 25 bp, Homo sapien
tgtggccaattcgtgcactgcagca

SEQ ID NO: 83116 - DNA, 25 bp, Homo sapien
aaatggcccttcagtcgcgtcttgg

SEQ ID NO: 83117 - DNA, 25 bp, Homo sapien
tggggtttctcctcggttcaaatgc

SEQ ID NO: 83118 - DNA, 25 bp, Homo sapien
cggggctcacttgcacgtgtacatc

SEQ ID NO: 83119 - DNA, 25 bp, Homo sapien
gtgttgtagccacgcccacagcaca

SEQ ID NO: 83120 - DNA, 25 bp, Homo sapien
cccagctcccgaaactgtggcagtg

SEQ ID NO: 83121 - DNA, 25 bp, Homo sapien
cgctgcacgtgttgcacttgacata

SEQ ID NO: 83122 - DNA, 25 bp, Homo sapien
cttgtccttgagcacgtagcccagc

SEQ ID NO: 83123 - DNA, 25 bp, Homo sapien
acggcctcgttgtacttgtccttga

SEQ ID NO: 83124 - DNA, 25 bp, Homo sapien
cttctcgatgtacaccaggtccgtg

SEQ ID NO: 83125 - DNA, 25 bp, Homo sapien
gcggtacgacagtggcttcttgatc

SEQ ID NO: 83126 - DNA, 25 bp, Homo sapien
cacttcctggttggtacgggatgcc

SEQ ID NO: 83127 - DNA, 25 bp, Homo sapien
agtggtcacatcacacggcgggagc

SEQ ID NO: 83128 - DNA, 25 bp, Homo sapien
cgcggtcagcagctgtgatcacacc

SEQ ID NO: 83129 - DNA, 25 bp, Homo sapien
ggcaggaactctccgcccggattcg

SEQ ID NO: 83130 - DNA, 25 bp, Homo sapien
ccgcgcggcaaaagtgcgtgccaga

SEQ ID NO: 83131 - DNA, 25 bp, Homo sapien
tgcgtgccagagttgtcagctttca

SEQ ID NO: 83132 - DNA, 25 bp, Homo sapien
gcaggaattccacccgaaggcgtgc

SEQ ID NO: 83133 - DNA, 25 bp, Homo sapien
actcgctgaaatcccgtccaagttg

SEQ ID NO: 83134 - DNA, 25 bp, Homo sapien
tcttcgacgtgtcactttctgaggc

SEQ ID NO: 83135 - DNA, 25 bp, Homo sapien
tgaggctgtagatttccatatggtg

SEQ ID NO: 83136 - DNA, 25 bp, Homo sapien
aaaaaattgggcagtggctcgcggc

SEQ ID NO: 83137 - DNA, 25 bp, Homo sapien
agccttcccagcagattttgtccga

SEQ ID NO: 83138 - DNA, 25 bp, Homo sapien
gattttgtccgaggaatccgctccc

SEQ ID NO: 83139 - DNA, 25 bp, Homo sapien
aggccgaggaatcttcgacgtgtca

SEQ ID NO: 83140 - DNA, 25 bp, Homo sapien
gagtccgccaaagtgcgtccctgtc

SEQ ID NO: 83141 - DNA, 25 bp, Homo sapien
cggcaaaaacttggcgccggagtgc

SEQ ID NO: 83142 - DNA, 25 bp, Homo sapien
gtgcagctctcactgacgaattgga

SEQ ID NO: 83143 - DNA, 25 bp, Homo sapien
acaccatgaccgtgagcagtccaga

SEQ ID NO: 83144 - DNA, 25 bp, Homo sapien
ggtgagagagtgacccactgctttc

SEQ ID NO: 83145 - DNA, 25 bp, Homo sapien
ctgccggctcagctgaacaggctct

SEQ ID NO: 83146 - DNA, 25 bp, Homo sapien
ggaagcgcgacaccaccagcatggt

SEQ ID NO: 83147 - DNA, 25 bp, Homo sapien
ttggtgaccaccaccttggcccgga

SEQ ID NO: 83148 - DNA, 25 bp, Homo sapien
gccacggcccagatgacgaagatga

SEQ ID NO: 83149 - DNA, 25 bp, Homo sapien
gaagcatcccagtccaggtcggcca

SEQ ID NO: 83150 - DNA, 25 bp, Homo sapien
ggcgttagtcactgccttgaccata

SEQ ID NO: 83151 - DNA, 25 bp, Homo sapien
ccaggaacatattcagcactgtggc

SEQ ID NO: 83152 - DNA, 25 bp, Homo sapien
tggaggaatggcttccctgtcactc

SEQ ID NO: 83153 - DNA, 25 bp, Homo sapien
ttgcgcttctaacgcctcagtccta

SEQ ID NO: 83154 - DNA, 25 bp, Homo sapien
tgagactgccagttgccagcgaatt

SEQ ID NO: 83155 - DNA, 25 bp, Homo sapien
gggcagactcccacgaagcacaggc

SEQ ID NO: 83156 - DNA, 25 bp, Homo sapien
tcagcacccgaaggcatgagactgc

SEQ ID NO: 83157 - DNA, 25 bp, Homo sapien
gtgcgtctcctgctcagagccagaa

SEQ ID NO: 83158 - DNA, 25 bp, Homo sapien
acgcgtttcttataagcccaggagc

SEQ ID NO: 83159 - DNA, 25 bp, Homo sapien
ggcagctgctcattcacgcgtttct

SEQ ID NO: 83160 - DNA, 25 bp, Homo sapien
gcaggacacaggacgacctcatctt

SEQ ID NO: 83161 - DNA, 25 bp, Homo sapien
cagcagcatcagcttccaggggtcg

SEQ ID NO: 83162 - DNA, 25 bp, Homo sapien
gggctgcacctcaccacttgctgtg

SEQ ID NO: 83163 - DNA, 25 bp, Homo sapien
acgcagacggggaaatgcagatcta

SEQ ID NO: 83164 - DNA, 25 bp, Homo sapien
ggcgaatgcgataccctgaaaattc

SEQ ID NO: 83165 - DNA, 25 bp, Homo sapien
gactggaccacctcaaaaagcgaca

SEQ ID NO: 83166 - DNA, 25 bp, Homo sapien
ctggccgtcagaggcacggctggat

SEQ ID NO: 83167 - DNA, 25 bp, Homo sapien
ccggtgaggtcaccggccgttgcca

SEQ ID NO: 83168 - DNA, 25 bp, Homo sapien
gcgccacagaatggactcgcccggg

SEQ ID NO: 83169 - DNA, 25 bp, Homo sapien
gccacagaatggactcgcccgggcg

SEQ ID NO: 83170 - DNA, 25 bp, Homo sapien
ggtctcaggtgaggcgccaacgtgg

SEQ ID NO: 83171 - DNA, 25 bp, Homo sapien
acagcgcctgcataggggccgcggt

SEQ ID NO: 83172 - DNA, 25 bp, Homo sapien
gctcgctcccggtgttgggatccga

SEQ ID NO: 83173 - DNA, 25 bp, Homo sapien
gggcacccacgggtccagtgcctgg

SEQ ID NO: 83174 - DNA, 25 bp, Homo sapien
ttggagagcgtcgaccaatcaccgc

SEQ ID NO: 83175 - DNA, 25 bp, Homo sapien
cctgcctatgggaaagaggttgaca

SEQ ID NO: 83176 - DNA, 25 bp, Homo sapien
gaggttgacatcacgcgccaatcgg

SEQ ID NO: 83177 - DNA, 25 bp, Homo sapien
cgccaatcggcatggctcttagaga

SEQ ID NO: 83178 - DNA, 25 bp, Homo sapien
tcggcgtttgaagaggtggaactcc

SEQ ID NO: 83179 - DNA, 25 bp, Homo sapien
aagggctcttttgcctgcggtcgac

SEQ ID NO: 83180 - DNA, 25 bp, Homo sapien
tagtgaccgcgaattccggagcgcc

SEQ ID NO: 83181 - DNA, 25 bp, Homo sapien
cgcccgagtcgttgggcttatttga

SEQ ID NO: 83182 - DNA, 25 bp, Homo sapien
ctcacacgccgctctgagtggtttg

SEQ ID NO: 83183 - DNA, 25 bp, Homo sapien
gcgctctccgtcaccaagacgaaaa

SEQ ID NO: 83184 - DNA, 25 bp, Homo sapien
aagatcgcgcctccgaccggcggga

SEQ ID NO: 83185 - DNA, 25 bp, Homo sapien
cctggaaccggagcacgatgacgcc

SEQ ID NO: 83186 - DNA, 25 bp, Homo sapien
acagaaactcagagcgtccgacgcc

SEQ ID NO: 83187 - DNA, 25 bp, Homo sapien
gtttggcgaacctcacacgtgactc

SEQ ID NO: 83188 - DNA, 25 bp, Homo sapien
ggggccatcaccagcaccaagtctg

SEQ ID NO: 83189 - DNA, 25 bp, Homo sapien
cgatgacgccgagaagacagaaact

SEQ ID NO: 83190 - DNA, 25 bp, Homo sapien
gtgcagtcgcctccaaagccttaga

SEQ ID NO: 83191 - DNA, 25 bp, Homo sapien
cgcggagggttgacccttcaattcg

SEQ ID NO: 83192 - DNA, 25 bp, Homo sapien
ccgcggctgtaagccgaggatcagg

SEQ ID NO: 83193 - DNA, 25 bp, Homo sapien
agacacggcaggaaaggcgagtcgg

SEQ ID NO: 83194 - DNA, 25 bp, Homo sapien
cgagcgactgtgcggcgctcacgct

SEQ ID NO: 83195 - DNA, 25 bp, Homo sapien
cagtcgcctccaaagccttagagcg

SEQ ID NO: 83196 - DNA, 25 bp, Homo sapien
gagtgcagtcgcctccaaagcctta

SEQ ID NO: 83197 - DNA, 25 bp, Homo sapien
ccgggcggagtgcagtcgcctccaa

SEQ ID NO: 83198 - DNA, 25 bp, Homo sapien
cgcttgtgagcaggacccgtcgcca

SEQ ID NO: 83199 - DNA, 25 bp, Homo sapien
ccatgggcctcatggtctgtggaca

SEQ ID NO: 83200 - DNA, 25 bp, Homo sapien
gcaggtgaagcaccgtcagggcaca

SEQ ID NO: 83201 - DNA, 25 bp, Homo sapien
cccagcggctacaagagcaccgtga

SEQ ID NO: 83202 - DNA, 25 bp, Homo sapien
gtgaagggcgctatccactacccgg

SEQ ID NO: 83203 - DNA, 25 bp, Homo sapien
caccggtttaagaagtggacgcagc

SEQ ID NO: 83204 - DNA, 25 bp, Homo sapien
attcggtctttaggccgcgcttgtg

SEQ ID NO: 83205 - DNA, 25 bp, Homo sapien
tggtcttccggaatgcaccggttta

SEQ ID NO: 83206 - DNA, 25 bp, Homo sapien
cttggctcgacaaacgcgtctttta

SEQ ID NO: 83207 - DNA, 25 bp, Homo sapien
ttacggctgctgaaaatccggcctg

SEQ ID NO: 83208 - DNA, 25 bp, Homo sapien
cgccgctcaggtaatcggagtcctt

SEQ ID NO: 83209 - DNA, 25 bp, Homo sapien
gttttgccaaaacaagctccgcgct

SEQ ID NO: 83210 - DNA, 25 bp, Homo sapien
gtcctacccaagctggcgcgactga

SEQ ID NO: 83211 - DNA, 25 bp, Homo sapien
cgaagccgcttgtcttaggagagga

SEQ ID NO: 83212 - DNA, 25 bp, Homo sapien
ttcacacacgtatgcagtgcacgcc

SEQ ID NO: 83213 - DNA, 25 bp, Homo sapien
ttttattatgactcagcccagcccg

SEQ ID NO: 83214 - DNA, 25 bp, Homo sapien
gccttgcttctctttgtcgcagcca

SEQ ID NO: 83215 - DNA, 25 bp, Homo sapien
atggcgtaggtgaacgcagcctccc

SEQ ID NO: 83216 - DNA, 25 bp, Homo sapien
ccacgccggcggcaatgatggcgta

SEQ ID NO: 83217 - DNA, 25 bp, Homo sapien
tgtcgcagccacagtcgctcaggtt

SEQ ID NO: 83218 - DNA, 25 bp, Homo sapien
gaccttggcgaagccgatgccgtag

SEQ ID NO: 83219 - DNA, 25 bp, Homo sapien
ggcattctgcttgatctcccgggca

SEQ ID NO: 83220 - DNA, 25 bp, Homo sapien
caagttcatgagagtccgggcattc

SEQ ID NO: 83221 - DNA, 25 bp, Homo sapien
gctcaggttgccctgggtacaggca

SEQ ID NO: 83222 - DNA, 25 bp, Homo sapien
gtgcggcgcattcttttaaaaatca

SEQ ID NO: 83223 - DNA, 25 bp, Homo sapien
gctgtgcggcgcattcttttaaaaa

SEQ ID NO: 83224 - DNA, 25 bp, Homo sapien
tgtgcggcgcattcttttaaaaatc

SEQ ID NO: 83225 - DNA, 25 bp, Homo sapien
cccgcgggcactcgaaggcgcctcg

SEQ ID NO: 83226 - DNA, 25 bp, Homo sapien
gtgtgggccgctgggcccgagacgg

SEQ ID NO: 83227 - DNA, 25 bp, Homo sapien
tggagccgccggcgaagtttcccca

SEQ ID NO: 83228 - DNA, 25 bp, Homo sapien
ggctgtgcggcgcattcttttaaaa

SEQ ID NO: 83229 - DNA, 25 bp, Homo sapien
ctgtgcggcgcattcttttaaaaat

SEQ ID NO: 83230 - DNA, 25 bp, Homo sapien
ctccgcagccgaaggctgactgtca

SEQ ID NO: 83231 - DNA, 25 bp, Homo sapien
gctgactgtcaaaagtcagtccaac

SEQ ID NO: 83232 - DNA, 25 bp, Homo sapien
acccacagggaaacagctgcaggaa

SEQ ID NO: 83233 - DNA, 25 bp, Homo sapien
cactgcgcatgtgcttggcggagca

SEQ ID NO: 83234 - DNA, 25 bp, Homo sapien
agctgcaggaagtgactgcggaacc

SEQ ID NO: 83235 - DNA, 25 bp, Homo sapien
tccaggggctcgtcctgaaagctcc

SEQ ID NO: 83236 - DNA, 25 bp, Homo sapien
cggcgtcgccactgcgcatgtgctt

SEQ ID NO: 83237 - DNA, 25 bp, Homo sapien
agcctcttctcggagcaactttctc

SEQ ID NO: 83238 - DNA, 25 bp, Homo sapien
agcgagaagtagaaagcggcagttc

SEQ ID NO: 83239 - DNA, 25 bp, Homo sapien
ctgcgtttgcctcttactgggttta

SEQ ID NO: 83240 - DNA, 25 bp, Homo sapien
aggctacgggctggtcgtctcccag

SEQ ID NO: 83241 - DNA, 25 bp, Homo sapien
gcggagttcgcctgcgatcgccgca

SEQ ID NO: 83242 - DNA, 25 bp, Homo sapien
ctctcctagctgcagaggcgagggc

SEQ ID NO: 83243 - DNA, 25 bp, Homo sapien
cctttgcttctactcccagttttgg

SEQ ID NO: 83244 - DNA, 25 bp, Homo sapien
gcgcgaaaccgcgagcttttcttga

SEQ ID NO: 83245 - DNA, 25 bp, Homo sapien
ccgcgagcttttcttgaggggctgt

SEQ ID NO: 83246 - DNA, 25 bp, Homo sapien
acccagaaaggccagcgtggctgca

SEQ ID NO: 83247 - DNA, 25 bp, Homo sapien
agacgggcccagcatgttacgagac

SEQ ID NO: 83248 - DNA, 25 bp, Homo sapien
tctctgagaggaagtcccacccaga

SEQ ID NO: 83249 - DNA, 25 bp, Homo sapien
tctcttgagatgctgggcagtggca

SEQ ID NO: 83250 - DNA, 25 bp, Homo sapien
tgcagtaccctactctcttgagatg

SEQ ID NO: 83251 - DNA, 25 bp, Homo sapien
tcctgggctagcgatatgcagtacc

SEQ ID NO: 83252 - DNA, 25 bp, Homo sapien
tttgaatttgcattatttcctgggc

SEQ ID NO: 83253 - DNA, 25 bp, Homo sapien
cagctccttcatggggatctcacga

SEQ ID NO: 83254 - DNA, 25 bp, Homo sapien
gggccactcgcatcgagaccgaatc

SEQ ID NO: 83255 - DNA, 25 bp, Homo sapien
gaccgaatccactaccaggccgatg

SEQ ID NO: 83256 - DNA, 25 bp, Homo sapien
ccgatgtgcgactagaggccactga

SEQ ID NO: 83257 - DNA, 25 bp, Homo sapien
aggccactgaggagatctacctgac

SEQ ID NO: 83258 - DNA, 25 bp, Homo sapien
agccggatgtcagtcagctccgatc

SEQ ID NO: 83259 - DNA, 25 bp, Homo sapien
aagagggcttcgactgcctgtcgtc

SEQ ID NO: 83260 - DNA, 25 bp, Homo sapien
gggcctctctgagctcggacaccag

SEQ ID NO: 83261 - DNA, 25 bp, Homo sapien
cgctggtggtagatgagcatgcaca

SEQ ID NO: 83262 - DNA, 25 bp, Homo sapien
ccgcctggcgtggagtaatcctaga

SEQ ID NO: 83263 - DNA, 25 bp, Homo sapien
gcgggataaattcgctggccgcctg

SEQ ID NO: 83264 - DNA, 25 bp, Homo sapien
tgcgggcgcatcttctaacgggaga

SEQ ID NO: 83265 - DNA, 25 bp, Homo sapien
gagctccctttatacggaaactctg

SEQ ID NO: 83266 - DNA, 25 bp, Homo sapien
gcctccgacgggcatttgtctggct

SEQ ID NO: 83267 - DNA, 25 bp, Homo sapien
cggaaactctgccttcgttatatgg

SEQ ID NO: 83268 - DNA, 25 bp, Homo sapien
ctgctgccgttgtctttacggaacc

SEQ ID NO: 83269 - DNA, 25 bp, Homo sapien
gaggcggctaagtcccagggacttc

SEQ ID NO: 83270 - DNA, 25 bp, Homo sapien
tgcgacgctcggagtgaccttcgag

SEQ ID NO: 83271 - DNA, 25 bp, Homo sapien
aggccttttctaaggcaggtgttca

SEQ ID NO: 83272 - DNA, 25 bp, Homo sapien
atccggacctagacggtcgtgcgcg

SEQ ID NO: 83273 - DNA, 25 bp, Homo sapien
agtgaccttcgagcgactggggacc

SEQ ID NO: 83274 - DNA, 25 bp, Homo sapien
ctcgacagcacgtttgcgacgctcg

SEQ ID NO: 83275 - DNA, 25 bp, Homo sapien
tgagtgccggctgcctcgacagcac

SEQ ID NO: 83276 - DNA, 25 bp, Homo sapien
agtcgtgcatgcagcgttgtgtgac

SEQ ID NO: 83277 - DNA, 25 bp, Homo sapien
gcaggtgttcacaccggccggaccg

SEQ ID NO: 83278 - DNA, 25 bp, Homo sapien
ggtctgcaggacttggaccgccgac

SEQ ID NO: 83279 - DNA, 25 bp, Homo sapien
cacgctgctaagtagcgcccgtcta

SEQ ID NO: 83280 - DNA, 25 bp, Homo sapien
agcgcccgtctaagtggcgtggcca

SEQ ID NO: 83281 - DNA, 25 bp, Homo sapien
ttcgttttcttgttggtgtggcgcc

SEQ ID NO: 83282 - DNA, 25 bp, Homo sapien
tgcttcctattttctctctcgtttc

SEQ ID NO: 83283 - DNA, 25 bp, Homo sapien
agcgcagctcacagccgagaccaga

SEQ ID NO: 83284 - DNA, 25 bp, Homo sapien
acgtccctgcgagaagcccgggatc

SEQ ID NO: 83285 - DNA, 25 bp, Homo sapien
ctcgtgctctgagttcctggaagga

SEQ ID NO: 83286 - DNA, 25 bp, Homo sapien
cttcgattggctaaacctgctgggc

SEQ ID NO: 83287 - DNA, 25 bp, Homo sapien
tcccataggtggcaaagcgagcctc

SEQ ID NO: 83288 - DNA, 25 bp, Homo sapien
agcgagcctcaagccgtagaactga

SEQ ID NO: 83289 - DNA, 25 bp, Homo sapien
tgtgcgcccgcctaaacttggaagg

SEQ ID NO: 83290 - DNA, 25 bp, Homo sapien
gccgcattctgattggctagactta

SEQ ID NO: 83291 - DNA, 25 bp, Homo sapien
tcacttcgccagttagcccttaggg

SEQ ID NO: 83292 - DNA, 25 bp, Homo sapien
acggagggttcccagagtgtcccat

SEQ ID NO: 83293 - DNA, 25 bp, Homo sapien
cctggaccctagtgattggctgata

SEQ ID NO: 83294 - DNA, 25 bp, Homo sapien
tcagggcggatgaaactctcctaca

SEQ ID NO: 83295 - DNA, 25 bp, Homo sapien
tgccctcacttaagatggccacatc

SEQ ID NO: 83296 - DNA, 25 bp, Homo sapien
tcctcattggtaaattggctctctc

SEQ ID NO: 83297 - DNA, 25 bp, Homo sapien
ccggcggtgaggagaatagaaaact

SEQ ID NO: 83298 - DNA, 25 bp, Homo sapien
cgcgtttccgccaacgatagcgtca

SEQ ID NO: 83299 - DNA, 25 bp, Homo sapien
gccgcagccatgttttcgcataact

SEQ ID NO: 83300 - DNA, 25 bp, Homo sapien
ctcactcgtggctttccgaaggctg

SEQ ID NO: 83301 - DNA, 25 bp, Homo sapien
tcgcataactggcaaaacgcgtttc

SEQ ID NO: 83302 - DNA, 25 bp, Homo sapien
ccggagactcgccattggattaaaa

SEQ ID NO: 83303 - DNA, 25 bp, Homo sapien
ctctgcaagccaacaattcgggata

SEQ ID NO: 83304 - DNA, 25 bp, Homo sapien
cccgccgccgtttaaagatagatga

SEQ ID NO: 83305 - DNA, 25 bp, Homo sapien
cgggatagaaaacacctccgtggtg

SEQ ID NO: 83306 - DNA, 25 bp, Homo sapien
gcagttcggcagacacttagtgagc

SEQ ID NO: 83307 - DNA, 25 bp, Homo sapien
agttggctcaggaacactgcagttc

SEQ ID NO: 83308 - DNA, 25 bp, Homo sapien
actctcccgtaagtgaggcgcctcg

SEQ ID NO: 83309 - DNA, 25 bp, Homo sapien
tccggcgacagggtctacaagaacg

SEQ ID NO: 83310 - DNA, 25 bp, Homo sapien
tacccgatccggaggtagaccatgc

SEQ ID NO: 83311 - DNA, 25 bp, Homo sapien
cggtttatgtttttgccagcgaatg

SEQ ID NO: 83312 - DNA, 25 bp, Homo sapien
cgcgctttccggttcatagtcccga

SEQ ID NO: 83313 - DNA, 25 bp, Homo sapien
cctgcctatatctcctggggtgtcc

SEQ ID NO: 83314 - DNA, 25 bp, Homo sapien
tgaacctttgcagcagctagccctc

SEQ ID NO: 83315 - DNA, 25 bp, Homo sapien
tcctgctagacctgctgtccctatg

SEQ ID NO: 83316 - DNA, 25 bp, Homo sapien
tgggtacctgttccctgtttgcacg

SEQ ID NO: 83317 - DNA, 25 bp, Homo sapien
gggccgtgccaactttgtcgaaaca

SEQ ID NO: 83318 - DNA, 25 bp, Homo sapien
ctacagacattataggctgagtgca

SEQ ID NO: 83319 - DNA, 25 bp, Homo sapien
ctgagcctgttatcctacagacatt

SEQ ID NO: 83320 - DNA, 25 bp, Homo sapien
ggcgggaagacatgcatcgtctctc

SEQ ID NO: 83321 - DNA, 25 bp, Homo sapien
gcgctggtgtacaacgcccgcagca

SEQ ID NO: 83322 - DNA, 25 bp, Homo sapien
ttcctgccaggttgcctcatgtctc

SEQ ID NO: 83323 - DNA, 25 bp, Homo sapien
gggcgtctctagaactcactccttc

SEQ ID NO: 83324 - DNA, 25 bp, Homo sapien
agctctcgaaagttacgtccgtatc

SEQ ID NO: 83325 - DNA, 25 bp, Homo sapien
gagtttacttcggttctgattcagc

SEQ ID NO: 83326 - DNA, 25 bp, Homo sapien
agtcgctaaattgccacgggtcgtc

SEQ ID NO: 83327 - DNA, 25 bp, Homo sapien
gtctgtgtacttccggcagcctcca

SEQ ID NO: 83328 - DNA, 25 bp, Homo sapien
gggccctgcattctctagccatgga

SEQ ID NO: 83329 - DNA, 25 bp, Homo sapien
gggtcgtctttgctctctctacttc

SEQ ID NO: 83330 - DNA, 25 bp, Homo sapien
cttcggagcgaacagcaggacaatc

SEQ ID NO: 83331 - DNA, 25 bp, Homo sapien
ccagcacccgttgcagggcaggtaa

SEQ ID NO: 83332 - DNA, 25 bp, Homo sapien
aatgagacgttggtgccactgcgcc

SEQ ID NO: 83333 - DNA, 25 bp, Homo sapien
gcggacacggaacagggaactatca

SEQ ID NO: 83334 - DNA, 25 bp, Homo sapien
gtgcagctcagccaggaattcgcta

SEQ ID NO: 83335 - DNA, 25 bp, Homo sapien
ggcggcagcgtaactttccacgaaa

SEQ ID NO: 83336 - DNA, 25 bp, Homo sapien
cgccttcttgtacagcgggtgagca

SEQ ID NO: 83337 - DNA, 25 bp, Homo sapien
tgcctgcaggccgaagaatcttttt

SEQ ID NO: 83338 - DNA, 25 bp, Homo sapien
cgctcccggagcgtgtgaaaactgt

SEQ ID NO: 83339 - DNA, 25 bp, Homo sapien
ggatgttctgatcgtcgcctgtttc

SEQ ID NO: 83340 - DNA, 25 bp, Homo sapien
cgctactcatgactgcaaacggata

SEQ ID NO: 83341 - DNA, 25 bp, Homo sapien
actgagggatgagcagcaacttgcc

SEQ ID NO: 83342 - DNA, 25 bp, Homo sapien
cggggcgtctaaatacagttgcact

SEQ ID NO: 83343 - DNA, 25 bp, Homo sapien
gcggcagtcagagcagttcattcta

SEQ ID NO: 83344 - DNA, 25 bp, Homo sapien
tcaagtcattggttagcacgctctc

SEQ ID NO: 83345 - DNA, 25 bp, Homo sapien
tttccaatggaacgccgagagactc

SEQ ID NO: 83346 - DNA, 25 bp, Homo sapien
taggcccgcctcttggttgcttaac

SEQ ID NO: 83347 - DNA, 25 bp, Homo sapien
gttgcttaacttccgcgggccagaa

SEQ ID NO: 83348 - DNA, 25 bp, Homo sapien
ctcgggtagcccttagcaactgagg

SEQ ID NO: 83349 - DNA, 25 bp, Homo sapien
gcctgcgcagttaaagctccggtaa

SEQ ID NO: 83350 - DNA, 25 bp, Homo sapien
tctcccgcttgtagaggaacgactc

SEQ ID NO: 83351 - DNA, 25 bp, Homo sapien
agaaaactgttcacgccttggagga

SEQ ID NO: 83352 - DNA, 25 bp, Homo sapien
tggcagctcctggtcttcgaccttc

SEQ ID NO: 83353 - DNA, 25 bp, Homo sapien
aggactcgtataccaggaagctgcc

SEQ ID NO: 83354 - DNA, 25 bp, Homo sapien
cctgcttatagaggaaggactcgta

SEQ ID NO: 83355 - DNA, 25 bp, Homo sapien
ccgggaggtccaatacacctgctta

SEQ ID NO: 83356 - DNA, 25 bp, Homo sapien
ctcagcagctacaggattcggggtc

SEQ ID NO: 83357 - DNA, 25 bp, Homo sapien
acgactcgtgcaccaggaagctatc

SEQ ID NO: 83358 - DNA, 25 bp, Homo sapien
tgtgtctggaggcaaatccgacgta

SEQ ID NO: 83359 - DNA, 25 bp, Homo sapien
gtttctagaatctcttcccagcggc

SEQ ID NO: 83360 - DNA, 25 bp, Homo sapien
cacgtcggacacctcttgcattttc

SEQ ID NO: 83361 - DNA, 25 bp, Homo sapien
ctttgcggttccaacatggcggagc

SEQ ID NO: 83362 - DNA, 25 bp, Homo sapien
tcgcggctctaacggggctttctac

SEQ ID NO: 83363 - DNA, 25 bp, Homo sapien
ccgttttgccactttgtcgagtgtt

SEQ ID NO: 83364 - DNA, 25 bp, Homo sapien
ggctccgttatgttttgaaacaaca

SEQ ID NO: 83365 - DNA, 25 bp, Homo sapien
aggccgctggattccttgcttctcc

SEQ ID NO: 83366 - DNA, 25 bp, Homo sapien
agcacggctcatcccagctcagagg

SEQ ID NO: 83367 - DNA, 25 bp, Homo sapien
aggaaagtcgctcaagcagtggaca

SEQ ID NO: 83368 - DNA, 25 bp, Homo sapien
agcagccgcaaactaggccggaaaa

SEQ ID NO: 83369 - DNA, 25 bp, Homo sapien
tgcacgcctttaccagagagcgacg

SEQ ID NO: 83370 - DNA, 25 bp, Homo sapien
tgggctcccttgcttccaccgggag

SEQ ID NO: 83371 - DNA, 25 bp, Homo sapien
aagaagaccggaaggccgcactcac

SEQ ID NO: 83372 - DNA, 25 bp, Homo sapien
gcccgcagtcgcactaaggagcaca

SEQ ID NO: 83373 - DNA, 25 bp, Homo sapien
aggcgccctacgcaacacggcagga

SEQ ID NO: 83374 - DNA, 25 bp, Homo sapien
ctcccgcagaaagtgggaagcaatc

SEQ ID NO: 83375 - DNA, 25 bp, Homo sapien
ggacacactgtgcacccggaaaaac

SEQ ID NO: 83376 - DNA, 25 bp, Homo sapien
catttccgcatttgagtctagagtc

SEQ ID NO: 83377 - DNA, 25 bp, Homo sapien
cgagcaggctgacaagtttattcta

SEQ ID NO: 83378 - DNA, 25 bp, Homo sapien
ctcgggctaaaggttcgaagctaga

SEQ ID NO: 83379 - DNA, 25 bp, Homo sapien
tttaagccacgtcctgggacaggtc

SEQ ID NO: 83380 - DNA, 25 bp, Homo sapien
tcgtgttaggccagattacatgctc

SEQ ID NO: 83381 - DNA, 25 bp, Homo sapien
caggcctcttcgaagtgcgcgtcaa

SEQ ID NO: 83382 - DNA, 25 bp, Homo sapien
tggaaacttttgtcggagacggaga

SEQ ID NO: 83383 - DNA, 25 bp, Homo sapien
gaaggataagtacacgctgcccggc

SEQ ID NO: 83384 - DNA, 25 bp, Homo sapien
catggctcttggctccatgggttcg

SEQ ID NO: 83385 - DNA, 25 bp, Homo sapien
ccggcggaaaaccaagacgctcatg

SEQ ID NO: 83386 - DNA, 25 bp, Homo sapien
tgaccagctcgcagacctacatgaa

SEQ ID NO: 83387 - DNA, 25 bp, Homo sapien
ggccggcggcaaccagaaaaacagc

SEQ ID NO: 83388 - DNA, 25 bp, Homo sapien
gcgcccgcatgtacaacatgatgga

SEQ ID NO: 83389 - DNA, 25 bp, Homo sapien
ttacgcgcacatgaacggctggagc

SEQ ID NO: 83390 - DNA, 25 bp, Homo sapien
agacaagtctagaaagtctcccgag

SEQ ID NO: 83391 - DNA, 25 bp, Homo sapien
ccgacccgcgtcagacaagtctaga

SEQ ID NO: 83392 - DNA, 25 bp, Homo sapien
ggctctgctcaaacggtcgcattcc

SEQ ID NO: 83393 - DNA, 25 bp, Homo sapien
cgggctctgctcaaacggtcgcatt

SEQ ID NO: 83394 - DNA, 25 bp, Homo sapien
tgtggggctcgagttctctctgccc

SEQ ID NO: 83395 - DNA, 25 bp, Homo sapien
ccgggtcacctcacccatggggctc

SEQ ID NO: 83396 - DNA, 25 bp, Homo sapien
cgggcaaattgaggccgagctgacg

SEQ ID NO: 83397 - DNA, 25 bp, Homo sapien
tgcccagtgctgagagccgacgcgc

SEQ ID NO: 83398 - DNA, 25 bp, Homo sapien
attcgctccgagtgttgatcttggc

SEQ ID NO: 83399 - DNA, 25 bp, Homo sapien
ccgcagcgctgagtgaagcgaatta

SEQ ID NO: 83400 - DNA, 25 bp, Homo sapien
gactgcgtagtcagcttctgcttta

SEQ ID NO: 83401 - DNA, 25 bp, Homo sapien
ctcatatttagcaagccgggacggt

SEQ ID NO: 83402 - DNA, 25 bp, Homo sapien
ttttttgcctgacgccactgtgctg

SEQ ID NO: 83403 - DNA, 25 bp, Homo sapien
tcgcggtaagagcagaaaattggtc

SEQ ID NO: 83404 - DNA, 25 bp, Homo sapien
ggcatcaccgatagccggttaattc

SEQ ID NO: 83405 - DNA, 25 bp, Homo sapien
agggccacgtgctgtgccttcgaaa

SEQ ID NO: 83406 - DNA, 25 bp, Homo sapien
ggagctcagttcgttcctcagcctg

SEQ ID NO: 83407 - DNA, 25 bp, Homo sapien
ctgagcggtgcccacgatgatggaa

SEQ ID NO: 83408 - DNA, 25 bp, Homo sapien
tgcccacgatgatggaagactttgc

SEQ ID NO: 83409 - DNA, 25 bp, Homo sapien
gatgatggaagactttgcaagaccc

SEQ ID NO: 83410 - DNA, 25 bp, Homo sapien
ctcctgggtcgtttcgaaccgagct

SEQ ID NO: 83411 - DNA, 25 bp, Homo sapien
aaccgagctgccctagagctgtcgg

SEQ ID NO: 83412 - DNA, 25 bp, Homo sapien
acgagctgacctcgtaggtgaccga

SEQ ID NO: 83413 - DNA, 25 bp, Homo sapien
ggagacaggtgcacgagctgacctc

SEQ ID NO: 83414 - DNA, 25 bp, Homo sapien
ctctcggtggcccagaataaacttc

SEQ ID NO: 83415 - DNA, 25 bp, Homo sapien
tcgctgtttggtcgcaagccattta

SEQ ID NO: 83416 - DNA, 25 bp, Homo sapien
cttcagccgaatgagaggatgtcta

SEQ ID NO: 83417 - DNA, 25 bp, Homo sapien
aacgcccagagtgccgagtttcgtc

SEQ ID NO: 83418 - DNA, 25 bp, Homo sapien
aaactgtctgaagcccaccggtgga

SEQ ID NO: 83419 - DNA, 25 bp, Homo sapien
ttcagaaacctgttcgagccgttcc

SEQ ID NO: 83420 - DNA, 25 bp, Homo sapien
aactcagccggctaatcagtgctcg

SEQ ID NO: 83421 - DNA, 25 bp, Homo sapien
cgctcccttgggcttttcgtgaaag

SEQ ID NO: 83422 - DNA, 25 bp, Homo sapien
aacggtcaataatgaaggtggctgc

SEQ ID NO: 83423 - DNA, 25 bp, Homo sapien
ccactcgtcacggacttctggaagc

SEQ ID NO: 83424 - DNA, 25 bp, Homo sapien
agccggcgcttctccgttacttctt

SEQ ID NO: 83425 - DNA, 25 bp, Homo sapien
ggcgtgctcttcctgcctcgaacaa

SEQ ID NO: 83426 - DNA, 25 bp, Homo sapien
cctcgaacaatttgggacgtgtttg

SEQ ID NO: 83427 - DNA, 25 bp, Homo sapien
gggaagcgaagaacctgtcttctgc

SEQ ID NO: 83428 - DNA, 25 bp, Homo sapien
ggacttctggaagcgtgtcacgatc

SEQ ID NO: 83429 - DNA, 25 bp, Homo sapien
tgctttgggtgacaacggtcaataa

SEQ ID NO: 83430 - DNA, 25 bp, Homo sapien
ccgtggcacccgcaggcgagacaaa

SEQ ID NO: 83431 - DNA, 25 bp, Homo sapien
gcccgatcctggacaacaatgcgcg

SEQ ID NO: 83432 - DNA, 25 bp, Homo sapien
gcccttggcctactaggcggccttg

SEQ ID NO: 83433 - DNA, 25 bp, Homo sapien
atccgaggaacttctggctgcaagc

SEQ ID NO: 83434 - DNA, 25 bp, Homo sapien
ttttgcgcttccaagggatccgagg

SEQ ID NO: 83435 - DNA, 25 bp, Homo sapien
cgcgaccgggaaacaaagacacatt

SEQ ID NO: 83436 - DNA, 25 bp, Homo sapien
cccagtaaagaagcagcggcgcgtc

SEQ ID NO: 83437 - DNA, 25 bp, Homo sapien
agacaaagttcgctcccggtgaggc

SEQ ID NO: 83438 - DNA, 25 bp, Homo sapien
cccgctgaggtgaaacctgagccca

SEQ ID NO: 83439 - DNA, 25 bp, Homo sapien
gctgctcggattcctcctgttcggt

SEQ ID NO: 83440 - DNA, 25 bp, Homo sapien
cagtgtctttgatcccgggcccggg

SEQ ID NO: 83441 - DNA, 25 bp, Homo sapien
agctcccgcagtgtctttgatcccg

SEQ ID NO: 83442 - DNA, 25 bp, Homo sapien
gtcgagctcccgcagtgtctttgat

SEQ ID NO: 83443 - DNA, 25 bp, Homo sapien
cccagagcaggtgtcccagaccctg

SEQ ID NO: 83444 - DNA, 25 bp, Homo sapien
gcggccttcacaagggcgctttgtc

SEQ ID NO: 83445 - DNA, 25 bp, Homo sapien
tcggattcctcctgttcggtgggga

SEQ ID NO: 83446 - DNA, 25 bp, Homo sapien
ggctccgcagcgaatggacggcggc

SEQ ID NO: 83447 - DNA, 25 bp, Homo sapien
cggcggcggataagttgagcagctg

SEQ ID NO: 83448 - DNA, 25 bp, Homo sapien
cccgaccagacacaatggagccggc

SEQ ID NO: 83449 - DNA, 25 bp, Homo sapien
cctcctcggctctcgcgtagcggct

SEQ ID NO: 83450 - DNA, 25 bp, Homo sapien
ctcaccatgttggtgtcctccaggc

SEQ ID NO: 83451 - DNA, 25 bp, Homo sapien
cggctcctctcacgggcttgcccgg

SEQ ID NO: 83452 - DNA, 25 bp, Homo sapien
gaccacggccgggtctacgcaggct

SEQ ID NO: 83453 - DNA, 25 bp, Homo sapien
cgcgccgacatcctcctgccgcgcc

SEQ ID NO: 83454 - DNA, 25 bp, Homo sapien
ttcttaactgacaagtggccacctg

SEQ ID NO: 83455 - DNA, 25 bp, Homo sapien
caagtggccacctgaactttttatt

SEQ ID NO: 83456 - DNA, 25 bp, Homo sapien
tatttagtgtcggttgcaatgggcg

SEQ ID NO: 83457 - DNA, 25 bp, Homo sapien
ccatcctgccacaaagcaatgcttt

SEQ ID NO: 83458 - DNA, 25 bp, Homo sapien
catggtgggcaaaagatcccttctt

SEQ ID NO: 83459 - DNA, 25 bp, Homo sapien
cagagccatggtgggcaaaagatcc

SEQ ID NO: 83460 - DNA, 25 bp, Homo sapien
ctgatgggactgctagaaaagatcc

SEQ ID NO: 83461 - DNA, 25 bp, Homo sapien
ctggtctctctgagcaccttgcttt

SEQ ID NO: 83462 - DNA, 25 bp, Homo sapien
gcccgatgtaaacggctacgagctg

SEQ ID NO: 83463 - DNA, 25 bp, Homo sapien
cgggcccagtcctcagaaatggaaa

SEQ ID NO: 83464 - DNA, 25 bp, Homo sapien
ccacctaaggggtgctgcgaaagcc

SEQ ID NO: 83465 - DNA, 25 bp, Homo sapien
agcccggcttcagtagcgacgattg

SEQ ID NO: 83466 - DNA, 25 bp, Homo sapien
agggcgtctccacgaacaccaatca

SEQ ID NO: 83467 - DNA, 25 bp, Homo sapien
tgatccaagaatgtgagggcgtctc

SEQ ID NO: 83468 - DNA, 25 bp, Homo sapien
cctgagcctacctttgggctgatcc

SEQ ID NO: 83469 - DNA, 25 bp, Homo sapien
gttcctccactacgaagcctcgtga

SEQ ID NO: 83470 - DNA, 25 bp, Homo sapien
cccgggactccagagtgcgtttaga

SEQ ID NO: 83471 - DNA, 25 bp, Homo sapien
gaccgtttaccgcacgcgcgtggtc

SEQ ID NO: 83472 - DNA, 25 bp, Homo sapien
tgcttatgagaagcagccgaaaagc

SEQ ID NO: 83473 - DNA, 25 bp, Homo sapien
ggagaaacgaaaccacctgcttatg

SEQ ID NO: 83474 - DNA, 25 bp, Homo sapien
gagaaacctacctgtgccggagaaa

SEQ ID NO: 83475 - DNA, 25 bp, Homo sapien
ccgaatcggtgccagagaaacctac

SEQ ID NO: 83476 - DNA, 25 bp, Homo sapien
tgagggccactcaccggccagggac

SEQ ID NO: 83477 - DNA, 25 bp, Homo sapien
tgcgtttagatgaaaggggaccgac

SEQ ID NO: 83478 - DNA, 25 bp, Homo sapien
ctcctcggtgctgcgggtcgccctg

SEQ ID NO: 83479 - DNA, 25 bp, Homo sapien
cccaaagaggcgcttagtctttcct

SEQ ID NO: 83480 - DNA, 25 bp, Homo sapien
tagagcagctccgaggtcccccgtg

SEQ ID NO: 83481 - DNA, 25 bp, Homo sapien
ccgtgcggagctaggcgcgcaccca

SEQ ID NO: 83482 - DNA, 25 bp, Homo sapien
ggagctaggcgcgcacccaggacac

SEQ ID NO: 83483 - DNA, 25 bp, Homo sapien
cgtccgcagggaggtcagctctcct

SEQ ID NO: 83484 - DNA, 25 bp, Homo sapien
tccgcagggaggtcagctctcctgg

SEQ ID NO: 83485 - DNA, 25 bp, Homo sapien
ccaaagaggcgcttagtctttcctc

SEQ ID NO: 83486 - DNA, 25 bp, Homo sapien
ggtcgccctgcaattccgagaagaa

SEQ ID NO: 83487 - DNA, 25 bp, Homo sapien
agaaagtcagagacgccgtggccca

SEQ ID NO: 83488 - DNA, 25 bp, Homo sapien
ccggctgctttctgcgtagctgggc

SEQ ID NO: 83489 - DNA, 25 bp, Homo sapien
ccctgcaattccgagaagaaagtca

SEQ ID NO: 83490 - DNA, 25 bp, Homo sapien
gccctcgcctggaaaccagccgtcg

SEQ ID NO: 83491 - DNA, 25 bp, Homo sapien
cgccctgcaattccgagaagaaagt

SEQ ID NO: 83492 - DNA, 25 bp, Homo sapien
cctgcaattccgagaagaaagtcag

SEQ ID NO: 83493 - DNA, 25 bp, Homo sapien
ctttctgcgtagctgggcagggccc

SEQ ID NO: 83494 - DNA, 25 bp, Homo sapien
acggatggttcgttctccgtgccgc

SEQ ID NO: 83495 - DNA, 25 bp, Homo sapien
cgcggagttagtctgtggtcagtta

SEQ ID NO: 83496 - DNA, 25 bp, Homo sapien
gaggccagcacagtccgcctcttgg

SEQ ID NO: 83497 - DNA, 25 bp, Homo sapien
ctggagggctgaattcgagtcgaaa

SEQ ID NO: 83498 - DNA, 25 bp, Homo sapien
cggatcgctaaatggggaaagttct

SEQ ID NO: 83499 - DNA, 25 bp, Homo sapien
tgttggcttcctttccggatcgcta

SEQ ID NO: 83500 - DNA, 25 bp, Homo sapien
tacgtggtgaaaacacggctgtgcc

SEQ ID NO: 83501 - DNA, 25 bp, Homo sapien
cgggatacgtctccaggccacggat

SEQ ID NO: 83502 - DNA, 25 bp, Homo sapien
ttaaaggcatctccgcccaaggatg

SEQ ID NO: 83503 - DNA, 25 bp, Homo sapien
tggagctccggtccttactcggaac

SEQ ID NO: 83504 - DNA, 25 bp, Homo sapien
ccgcctccagggactgtagagtgag

SEQ ID NO: 83505 - DNA, 25 bp, Homo sapien
agcaagtcgccaatctcgccggaac

SEQ ID NO: 83506 - DNA, 25 bp, Homo sapien
tccaggcaagaaacgagagtccctc

SEQ ID NO: 83507 - DNA, 25 bp, Homo sapien
caaaactgtttctaccgctgcggtg

SEQ ID NO: 83508 - DNA, 25 bp, Homo sapien
gcttcgtttaccgacatgagtgatc

SEQ ID NO: 83509 - DNA, 25 bp, Homo sapien
tcctggggaggcatctcttctttta

SEQ ID NO: 83510 - DNA, 25 bp, Homo sapien
aaactggtggcgacactgcctgagc

SEQ ID NO: 83511 - DNA, 25 bp, Homo sapien
gcacgagcccgattggcagattgta

SEQ ID NO: 83512 - DNA, 25 bp, Homo sapien
ccacccgaatgcctcgctgggattg

SEQ ID NO: 83513 - DNA, 25 bp, Homo sapien
caagaggcttttacaccgaacggag

SEQ ID NO: 83514 - DNA, 25 bp, Homo sapien
tgatgtggacgacaacggagacgca

SEQ ID NO: 83515 - DNA, 25 bp, Homo sapien
cggcaacctctgcagcgtcagtgct

SEQ ID NO: 83516 - DNA, 25 bp, Homo sapien
ctgggattggctcatttcttggttc

SEQ ID NO: 83517 - DNA, 25 bp, Homo sapien
gccgagtggtttcaacggtgacgcc

SEQ ID NO: 83518 - DNA, 25 bp, Homo sapien
cggttgggatcgttgtactgaagca

SEQ ID NO: 83519 - DNA, 25 bp, Homo sapien
gaagcaggtactctcgtttcagctg

SEQ ID NO: 83520 - DNA, 25 bp, Homo sapien
ttcagctgggctcttatggccaacc

SEQ ID NO: 83521 - DNA, 25 bp, Homo sapien
aggctcgacggcttatactttggga

SEQ ID NO: 83522 - DNA, 25 bp, Homo sapien
cgacatcttggcgaaccagggcaca

SEQ ID NO: 83523 - DNA, 25 bp, Homo sapien
tgtcgttaacaaggagctccgcctc

SEQ ID NO: 83524 - DNA, 25 bp, Homo sapien
atgcgcatgcgcgaagtgctcttct

SEQ ID NO: 83525 - DNA, 25 bp, Homo sapien
gcgcgattctgaggccctttgtcta

SEQ ID NO: 83526 - DNA, 25 bp, Homo sapien
cgtcatcgcccagccttcttaaaga

SEQ ID NO: 83527 - DNA, 25 bp, Homo sapien
gctgtctctgagaacctgcgggaga

SEQ ID NO: 83528 - DNA, 25 bp, Homo sapien
gggcgagaacaaagccgacctcctc

SEQ ID NO: 83529 - DNA, 25 bp, Homo sapien
ctctcgcgatatctagggaggaggc

SEQ ID NO: 83530 - DNA, 25 bp, Homo sapien
gacgcgacgccgaagccaagcggac

SEQ ID NO: 83531 - DNA, 25 bp, Homo sapien
ccggcctagagctccagcgcaggag

SEQ ID NO: 83532 - DNA, 25 bp, Homo sapien
ctaccgcagcggttgtcacgacaca

SEQ ID NO: 83533 - DNA, 25 bp, Homo sapien
caggagaagagactcgagcggcacc

SEQ ID NO: 83534 - DNA, 25 bp, Homo sapien
ccacgccatggcctgggtttcggga

SEQ ID NO: 83535 - DNA, 25 bp, Homo sapien
ggaacgcctggttgtcaaagccttg

SEQ ID NO: 83536 - DNA, 25 bp, Homo sapien
cgctccttggtcaggatggacctca

SEQ ID NO: 83537 - DNA, 25 bp, Homo sapien
cgttgagaacgaccacgtctgcctc

SEQ ID NO: 83538 - DNA, 25 bp, Homo sapien
taggagtcatcaccaccgggcgcat

SEQ ID NO: 83539 - DNA, 25 bp, Homo sapien
aggggccacttagatgtaggagtca

SEQ ID NO: 83540 - DNA, 25 bp, Homo sapien
gtttcgggagccttgctttattctg

SEQ ID NO: 83541 - DNA, 25 bp, Homo sapien
ttgctttattctgcctcgggtcgga

SEQ ID NO: 83542 - DNA, 25 bp, Homo sapien
ttggctcacacctccacagaagcta

SEQ ID NO: 83543 - DNA, 25 bp, Homo sapien
tcacaggcagtgatcccagggaagc

SEQ ID NO: 83544 - DNA, 25 bp, Homo sapien
gggaagccatctttgacaccctttg

SEQ ID NO: 83545 - DNA, 25 bp, Homo sapien
cgaggttattaattgcagcatcaca

SEQ ID NO: 83546 - DNA, 25 bp, Homo sapien
gtgactgtcacaaacatcgaggtta

SEQ ID NO: 83547 - DNA, 25 bp, Homo sapien
gctaagggcctgtcctcagagagca

SEQ ID NO: 83548 - DNA, 25 bp, Homo sapien
ggcaaagacactcacaatggacata

SEQ ID NO: 83549 - DNA, 25 bp, Homo sapien
gatctgacgtcactctcctcgctga

SEQ ID NO: 83550 - DNA, 25 bp, Homo sapien
ccgctgtgcgcgttcaggcagctgc

SEQ ID NO: 83551 - DNA, 25 bp, Homo sapien
cccgctcgctgcagctaaagaaaca

SEQ ID NO: 83552 - DNA, 25 bp, Homo sapien
cctgcagtcggccttgctgaattct

SEQ ID NO: 83553 - DNA, 25 bp, Homo sapien
tgctacgcgtccagctgttgatcgc

SEQ ID NO: 83554 - DNA, 25 bp, Homo sapien
tgatcgcccactgacctgtagaaga

SEQ ID NO: 83555 - DNA, 25 bp, Homo sapien
tccgcctgagcctaaaccgaagaca

SEQ ID NO: 83556 - DNA, 25 bp, Homo sapien
actccaggccaccaaaggcaggggc

SEQ ID NO: 83557 - DNA, 25 bp, Homo sapien
cgtccagctgttgatcgcccactga

SEQ ID NO: 83558 - DNA, 25 bp, Homo sapien
cagaagagcctagtatcggtgtcca

SEQ ID NO: 83559 - DNA, 25 bp, Homo sapien
gaaggtattgctggagggctgtaca

SEQ ID NO: 83560 - DNA, 25 bp, Homo sapien
ctgtacagaagagcctagtatcggt

SEQ ID NO: 83561 - DNA, 25 bp, Homo sapien
cacccagcaggcttgcgcgctcgct

SEQ ID NO: 83562 - DNA, 25 bp, Homo sapien
tgcatccgcgctctgacatgcctgc

SEQ ID NO: 83563 - DNA, 25 bp, Homo sapien
tatcggtgtccaggccgactgagga

SEQ ID NO: 83564 - DNA, 25 bp, Homo sapien
agcctagtatcggtgtccaggccga

SEQ ID NO: 83565 - DNA, 25 bp, Homo sapien
gtagacgctggactacgcagcagga

SEQ ID NO: 83566 - DNA, 25 bp, Homo sapien
ctttggagcgcagactctcgggcgt

SEQ ID NO: 83567 - DNA, 25 bp, Homo sapien
agaccgacttttgccgcaaggtgca

SEQ ID NO: 83568 - DNA, 25 bp, Homo sapien
gcgagaccgacttttgccgcaaggt

SEQ ID NO: 83569 - DNA, 25 bp, Homo sapien
tcgccgagggcgagaccgacttttg

SEQ ID NO: 83570 - DNA, 25 bp, Homo sapien
cgacccgccgtgtcccgtgagtcgc

SEQ ID NO: 83571 - DNA, 25 bp, Homo sapien
ccgggaagagccgcccaggaatcag

SEQ ID NO: 83572 - DNA, 25 bp, Homo sapien
catccctggagctttggagcgcaga

SEQ ID NO: 83573 - DNA, 25 bp, Homo sapien
tcgacctgcgacgaggagccgaccc

SEQ ID NO: 83574 - DNA, 25 bp, Homo sapien
gaacctgctcctcgcgcgtcaggga

SEQ ID NO: 83575 - DNA, 25 bp, Homo sapien
gtgtcctcagcaacggtgacccgca

SEQ ID NO: 83576 - DNA, 25 bp, Homo sapien
ctattgtttacagcggtcagggacc

SEQ ID NO: 83577 - DNA, 25 bp, Homo sapien
gcgtggacaccaccgacctattgtt

SEQ ID NO: 83578 - DNA, 25 bp, Homo sapien
tcctgagaatttgctgcctgctgcg

SEQ ID NO: 83579 - DNA, 25 bp, Homo sapien
agacgggacgctcacttcctgagaa

SEQ ID NO: 83580 - DNA, 25 bp, Homo sapien
ttctacagacacgaaggtgaagcca

SEQ ID NO: 83581 - DNA, 25 bp, Homo sapien
gctgtgcacccaactaggctctgtg

SEQ ID NO: 83582 - DNA, 25 bp, Homo sapien
aagagccgtctccattcagcaggcg

SEQ ID NO: 83583 - DNA, 25 bp, Homo sapien
tggagagccgtctccattcagcagg

SEQ ID NO: 83584 - DNA, 25 bp, Homo sapien
ctgagttcggcaggagacagactga

SEQ ID NO: 83585 - DNA, 25 bp, Homo sapien
ctgcggctctgggtgaaccagtcac

SEQ ID NO: 83586 - DNA, 25 bp, Homo sapien
accagtcacgcgaggagaatgcacc

SEQ ID NO: 83587 - DNA, 25 bp, Homo sapien
tgcacctggcgattccacacatcta

SEQ ID NO: 83588 - DNA, 25 bp, Homo sapien
tacagcgagtctcctgagccgcagg

SEQ ID NO: 83589 - DNA, 25 bp, Homo sapien
ctctggagctatgaagagccgtctc

SEQ ID NO: 83590 - DNA, 25 bp, Homo sapien
cagcggcaccggactgacctgcagt

SEQ ID NO: 83591 - DNA, 25 bp, Homo sapien
cgcgatgccgcgccacgagggacac

SEQ ID NO: 83592 - DNA, 25 bp, Homo sapien
gacctgcagtgacccgcgatgccgc

SEQ ID NO: 83593 - DNA, 25 bp, Homo sapien
acccgcgatgccgcgccacgaggga

SEQ ID NO: 83594 - DNA, 25 bp, Homo sapien
tgacctgcagtgacccgcgatgccg

SEQ ID NO: 83595 - DNA, 25 bp, Homo sapien
tgacccgcgatgccgcgccacgagg

SEQ ID NO: 83596 - DNA, 25 bp, Homo sapien
gcagtgacccgcgatgccgcgccac

SEQ ID NO: 83597 - DNA, 25 bp, Homo sapien
gcagcggcaccggactgacctgcag

SEQ ID NO: 83598 - DNA, 25 bp, Homo sapien
ttatggcttcattcgagagctgctg

SEQ ID NO: 83599 - DNA, 25 bp, Homo sapien
cgccacgagggacacttatggcttc

SEQ ID NO: 83600 - DNA, 25 bp, Homo sapien
agagctgctgccaaaacgcctggcg

SEQ ID NO: 83601 - DNA, 25 bp, Homo sapien
actgtgttcgtacgtgcatagtttc

SEQ ID NO: 83602 - DNA, 25 bp, Homo sapien
ttcgatatcacatcgcggggctgtg

SEQ ID NO: 83603 - DNA, 25 bp, Homo sapien
gtagctgcgtcgtttcgatatcaca

SEQ ID NO: 83604 - DNA, 25 bp, Homo sapien
ctgtgtgccgccttacttcctgctt

SEQ ID NO: 83605 - DNA, 25 bp, Homo sapien
tcctgcttcgagaatgtataacgtg

SEQ ID NO: 83606 - DNA, 25 bp, Homo sapien
ttctccgtgccgtgtccctcggctc

SEQ ID NO: 83607 - DNA, 25 bp, Homo sapien
ctccgtgccgtgtccctcggctctc

SEQ ID NO: 83608 - DNA, 25 bp, Homo sapien
attctccgtgccgtgtccctcggct

SEQ ID NO: 83609 - DNA, 25 bp, Homo sapien
ctctcccattctccgtgccctgtcc

SEQ ID NO: 83610 - DNA, 25 bp, Homo sapien
tctctcctattctctgtgccgtgtc

SEQ ID NO: 83611 - DNA, 25 bp, Homo sapien
cctcggctctctcccattctctgtg

SEQ ID NO: 83612 - DNA, 25 bp, Homo sapien
cccattctctgtgccgtgtccctcg

SEQ ID NO: 83613 - DNA, 25 bp, Homo sapien
ctctcccattctccgtgccgtgtcc

SEQ ID NO: 83614 - DNA, 25 bp, Homo sapien
gtgctcaagggaaccaagacgaaga

SEQ ID NO: 83615 - DNA, 25 bp, Homo sapien
gccgagtactcctacgtgaagtcta

SEQ ID NO: 83616 - DNA, 25 bp, Homo sapien
gactcacatactcgtccagaaccgg

SEQ ID NO: 83617 - DNA, 25 bp, Homo sapien
tttatttcgcgtccgcttctgtttc

SEQ ID NO: 83618 - DNA, 25 bp, Homo sapien
ggttctacagagacgtaggctgtca

SEQ ID NO: 83619 - DNA, 25 bp, Homo sapien
ctctgagccattcagcgtttgggtg

SEQ ID NO: 83620 - DNA, 25 bp, Homo sapien
ccgctgctctagcaggaggcggttc

SEQ ID NO: 83621 - DNA, 25 bp, Homo sapien
gcgcgcggatgccttttggccctct

SEQ ID NO: 83622 - DNA, 25 bp, Homo sapien
ctcccagaataagcaacagctttac

SEQ ID NO: 83623 - DNA, 25 bp, Homo sapien
tcccagaataagcaacagctttact

SEQ ID NO: 83624 - DNA, 25 bp, Homo sapien
gctcccagaataagcaacagcttta

SEQ ID NO: 83625 - DNA, 25 bp, Homo sapien
ggctcccagaataagcaacagcttt

SEQ ID NO: 83626 - DNA, 25 bp, Homo sapien
ccagaataagcaacagctttacttc

SEQ ID NO: 83627 - DNA, 25 bp, Homo sapien
acgctgcagaagtgcagcaagtgtg

SEQ ID NO: 83628 - DNA, 25 bp, Homo sapien
cctgctgccaggacacgctgcagaa

SEQ ID NO: 83629 - DNA, 25 bp, Homo sapien
tgccaggacacgctgcagaagtgca

SEQ ID NO: 83630 - DNA, 25 bp, Homo sapien
tggtccgggaccacatcatcagggc

SEQ ID NO: 83631 - DNA, 25 bp, Homo sapien
ccgcctgcttcacgtgtgtgacctg

SEQ ID NO: 83632 - DNA, 25 bp, Homo sapien
cttcacgtgtgtgacctgcgcccgg

SEQ ID NO: 83633 - DNA, 25 bp, Homo sapien
cttctatcagaaggatatgcgaccc

SEQ ID NO: 83634 - DNA, 25 bp, Homo sapien
tggctgggcagagcttctatcagaa

SEQ ID NO: 83635 - DNA, 25 bp, Homo sapien
cccggaagcccaggcaattcattca

SEQ ID NO: 83636 - DNA, 25 bp, Homo sapien
ctgaggtcccgggtgtctttcacgc

SEQ ID NO: 83637 - DNA, 25 bp, Homo sapien
ggcaattcattcatccagcgccgct

SEQ ID NO: 83638 - DNA, 25 bp, Homo sapien
aaggacattgccctcgccagccgtg

SEQ ID NO: 83639 - DNA, 25 bp, Homo sapien
ttgccctcgccagccgtgaggaaat

SEQ ID NO: 83640 - DNA, 25 bp, Homo sapien
cctgtgcactttgccaccgacttcg

SEQ ID NO: 83641 - DNA, 25 bp, Homo sapien
gctcctctgagctcgtgaagctaag

SEQ ID NO: 83642 - DNA, 25 bp, Homo sapien
gggctccaacccaggcggactggac

SEQ ID NO: 83643 - DNA, 25 bp, Homo sapien
gtttgcccctggacagccctgacgg

SEQ ID NO: 83644 - DNA, 25 bp, Homo sapien
gtgtgtctgggtggcccatcagccc

SEQ ID NO: 83645 - DNA, 25 bp, Homo sapien
gtctgggtggcccatcagcccctct

SEQ ID NO: 83646 - DNA, 25 bp, Homo sapien
gcaaagcagggccttggccaacggg

SEQ ID NO: 83647 - DNA, 25 bp, Homo sapien
gcgagtcctcgttgggacaagcgac

SEQ ID NO: 83648 - DNA, 25 bp, Homo sapien
cgagtcctcgttgggacaagcgaca

SEQ ID NO: 83649 - DNA, 25 bp, Homo sapien
tgtttgcccctggacagccctgacg

SEQ ID NO: 83650 - DNA, 25 bp, Homo sapien
agtcctcgttgggacaagcgacaat

SEQ ID NO: 83651 - DNA, 25 bp, Homo sapien
ccctgtgcacttggattttcattgc

SEQ ID NO: 83652 - DNA, 25 bp, Homo sapien
ttcgtcagccaccaagaaaaccgtc

SEQ ID NO: 83653 - DNA, 25 bp, Homo sapien
tttccaccgcggaaggacattgcct

SEQ ID NO: 83654 - DNA, 25 bp, Homo sapien
cgctccacaacgcatgggctggttt

SEQ ID NO: 83655 - DNA, 25 bp, Homo sapien
agagacccaggtcttgagccctgta

SEQ ID NO: 83656 - DNA, 25 bp, Homo sapien
tggacaggcgcactctacaaatctc

SEQ ID NO: 83657 - DNA, 25 bp, Homo sapien
cttcgtgtaaaatccagtctcgggg

SEQ ID NO: 83658 - DNA, 25 bp, Homo sapien
agccctgtaagcacgctcggcgtta

SEQ ID NO: 83659 - DNA, 25 bp, Homo sapien
ggccctgacacctgggatcacaccc

SEQ ID NO: 83660 - DNA, 25 bp, Homo sapien
ggtcttcctcgggacaagcgacaat

SEQ ID NO: 83661 - DNA, 25 bp, Homo sapien
ccgtcctgagcaggccccaagtgtt

SEQ ID NO: 83662 - DNA, 25 bp, Homo sapien
cctggagtgtcagctaaagggaggc

SEQ ID NO: 83663 - DNA, 25 bp, Homo sapien
aatcagacgcgcgtagctggaccgg

SEQ ID NO: 83664 - DNA, 25 bp, Homo sapien
ctacggccataccattctaaacacg

SEQ ID NO: 83665 - DNA, 25 bp, Homo sapien
taccattctaaacacgagagaaacc

SEQ ID NO: 83666 - DNA, 25 bp, Homo sapien
cgggacaaagcagggccttcctgcc

SEQ ID NO: 83667 - DNA, 25 bp, Homo sapien
cgatgcctggaaagcgatccttctc

SEQ ID NO: 83668 - DNA, 25 bp, Homo sapien
tccggaatgccgatggcctgggcca

SEQ ID NO: 83669 - DNA, 25 bp, Homo sapien
tggctcggggtccaaacgagtctcc

SEQ ID NO: 83670 - DNA, 25 bp, Homo sapien
ggtgctgcctcagctggcgtgacct

SEQ ID NO: 83671 - DNA, 25 bp, Homo sapien
tctgaaaccaaatctggaccctggg

SEQ ID NO: 83672 - DNA, 25 bp, Homo sapien
gtgcctggcccttcgattctgaaac

SEQ ID NO: 83673 - DNA, 25 bp, Homo sapien
ctgaaaccagatctgaatcctggac

SEQ ID NO: 83674 - DNA, 25 bp, Homo sapien
cgatccttctcaaaggctcggagga

SEQ ID NO: 83675 - DNA, 25 bp, Homo sapien
cactcctgcccggaccgcagtcctc

SEQ ID NO: 83676 - DNA, 25 bp, Homo sapien
cgaggctgccgtgcgtttctaacac

SEQ ID NO: 83677 - DNA, 25 bp, Homo sapien
tgcgtagcttctggcaccacggcca

SEQ ID NO: 83678 - DNA, 25 bp, Homo sapien
ggcatatgcgtagcttctggcacca

SEQ ID NO: 83679 - DNA, 25 bp, Homo sapien
catggcgggcatatgcgtagcttct

SEQ ID NO: 83680 - DNA, 25 bp, Homo sapien
accgaggttgtgttctgctcctccc

SEQ ID NO: 83681 - DNA, 25 bp, Homo sapien
gtgcgtttctaacaccgaggttgtg

SEQ ID NO: 83682 - DNA, 25 bp, Homo sapien
ggctgccgtgcgtttctaacaccga

SEQ ID NO: 83683 - DNA, 25 bp, Homo sapien
gcgggaatccatcgtcaggccatca

SEQ ID NO: 83684 - DNA, 25 bp, Homo sapien
ctcgctctggtcttctacgtggaaa

SEQ ID NO: 83685 - DNA, 25 bp, Homo sapien
cattgcctccttcacggagagaggg

SEQ ID NO: 83686 - DNA, 25 bp, Homo sapien
ggcacactcaagactcccacggagg

SEQ ID NO: 83687 - DNA, 25 bp, Homo sapien
gccatgccgactgtttgctcccgga

SEQ ID NO: 83688 - DNA, 25 bp, Homo sapien
cgtgattttggtttccgcgtggctt

SEQ ID NO: 83689 - DNA, 25 bp, Homo sapien
gtgccttcgctctccttgccaggtt

SEQ ID NO: 83690 - DNA, 25 bp, Homo sapien
gaaatgaacgagagccacacgcctg

SEQ ID NO: 83691 - DNA, 25 bp, Homo sapien
gcgttgaggcccagaccggaacttc

SEQ ID NO: 83692 - DNA, 25 bp, Homo sapien
ggtagaggtcttgggcacctgacaa

SEQ ID NO: 83693 - DNA, 25 bp, Homo sapien
ctgtcgagctcagggcacgtgctag

SEQ ID NO: 83694 - DNA, 25 bp, Homo sapien
tgagccattggctgtcgagctcagg

SEQ ID NO: 83695 - DNA, 25 bp, Homo sapien
tcccgcctcttttttctcgtgcgtc

SEQ ID NO: 83696 - DNA, 25 bp, Homo sapien
tacctgctgtgcgtctggcgccgag

SEQ ID NO: 83697 - DNA, 25 bp, Homo sapien
gcccaggggtacctgctgtgcgtct

SEQ ID NO: 83698 - DNA, 25 bp, Homo sapien
gcgcctacgtcaccgcgcagacctc

SEQ ID NO: 83699 - DNA, 25 bp, Homo sapien
tccaaactctggaaggccggctgtc

SEQ ID NO: 83700 - DNA, 25 bp, Homo sapien
cgcgccatctctgcgatagacaata

SEQ ID NO: 83701 - DNA, 25 bp, Homo sapien
ggaacctcgttcattccaaactctg

SEQ ID NO: 83702 - DNA, 25 bp, Homo sapien
cagcaaacgagctggtccggacgga

SEQ ID NO: 83703 - DNA, 25 bp, Homo sapien
tccaccgctgacagcaaacgagctg

SEQ ID NO: 83704 - DNA, 25 bp, Homo sapien
gtcactgcggctctgacgcgctctt

SEQ ID NO: 83705 - DNA, 25 bp, Homo sapien
gccggctgtccttcggttactgata

SEQ ID NO: 83706 - DNA, 25 bp, Homo sapien
caataatcgggtcaacacgcggcga

SEQ ID NO: 83707 - DNA, 25 bp, Homo sapien
gaacccaggaaacgggagcagcctg

SEQ ID NO: 83708 - DNA, 25 bp, Homo sapien
cgtgcacggcttagaggagctcccg

SEQ ID NO: 83709 - DNA, 25 bp, Homo sapien
agccgtgcacggcttagaggagctc

SEQ ID NO: 83710 - DNA, 25 bp, Homo sapien
tgtctcacaccctccgctttcagcc

SEQ ID NO: 83711 - DNA, 25 bp, Homo sapien
cccaggaaacgggagcagcctggca

SEQ ID NO: 83712 - DNA, 25 bp, Homo sapien
ggggctggaggtccgtccccatcac

SEQ ID NO: 83713 - DNA, 25 bp, Homo sapien
gacacggcattgagtgccagcgctg

SEQ ID NO: 83714 - DNA, 25 bp, Homo sapien
cctggcaggcgtgcagccgtgcacg

SEQ ID NO: 83715 - DNA, 25 bp, Homo sapien
gttttcaaagcggacctcaccatgg

SEQ ID NO: 83716 - DNA, 25 bp, Homo sapien
ccatggcaaacctcaaaaggccttg

SEQ ID NO: 83717 - DNA, 25 bp, Homo sapien
ggatcatccagaaccaacttaattc

SEQ ID NO: 83718 - DNA, 25 bp, Homo sapien
gggacaggcgagagtcaactttaca

SEQ ID NO: 83719 - DNA, 25 bp, Homo sapien
tacaaagtcatgtgctcagtgttcc

SEQ ID NO: 83720 - DNA, 25 bp, Homo sapien
ccctggcttttctttgtgactactg

SEQ ID NO: 83721 - DNA, 25 bp, Homo sapien
gactactggctctgaaggtgttttc

SEQ ID NO: 83722 - DNA, 25 bp, Homo sapien
aaggccttgtctccatgaggtcgtc

SEQ ID NO: 83723 - DNA, 25 bp, Homo sapien
atgtggagtgcctgcctgctcacac

SEQ ID NO: 83724 - DNA, 25 bp, Homo sapien
gcctgctcacacgtgccgacgtgga

SEQ ID NO: 83725 - DNA, 25 bp, Homo sapien
ctcacatgtgccgatgtggagtgcc

SEQ ID NO: 83726 - DNA, 25 bp, Homo sapien
gcctgctcacacgtgccgatgcgga

SEQ ID NO: 83727 - DNA, 25 bp, Homo sapien
tggagtgcccgcctgctcacacgtg

SEQ ID NO: 83728 - DNA, 25 bp, Homo sapien
ctgctcacacgtgccgacgtggagt

SEQ ID NO: 83729 - DNA, 25 bp, Homo sapien
ctgctcacacgtgcccatgcggagt

SEQ ID NO: 83730 - DNA, 25 bp, Homo sapien
ctgctcacacgtgccgatgcggagt

SEQ ID NO: 83731 - DNA, 25 bp, Homo sapien
cgggccgctcattagaagtggaatc

SEQ ID NO: 83732 - DNA, 25 bp, Homo sapien
gtacgttttatctacagcggcggtg

SEQ ID NO: 83733 - DNA, 25 bp, Homo sapien
ccacatctggataaataggaagccc

SEQ ID NO: 83734 - DNA, 25 bp, Homo sapien
ggcggcctacataaaatcgatcctc

SEQ ID NO: 83735 - DNA, 25 bp, Homo sapien
gagactgcttgtccctcttaacccg

SEQ ID NO: 83736 - DNA, 25 bp, Homo sapien
ttcacgtcgtcaaattagggcccga

SEQ ID NO: 83737 - DNA, 25 bp, Homo sapien
ggagaggttctcacgcgcgattctc

SEQ ID NO: 83738 - DNA, 25 bp, Homo sapien
aattgcacacacagcaggcggccta

SEQ ID NO: 83739 - DNA, 25 bp, Homo sapien
ccgcctgcggtttattgattgagtg

SEQ ID NO: 83740 - DNA, 25 bp, Homo sapien
gctggagtcccgctcaaggccaaca

SEQ ID NO: 83741 - DNA, 25 bp, Homo sapien
ggcaccagcagagtggcctgaattc

SEQ ID NO: 83742 - DNA, 25 bp, Homo sapien
cccgacgcgcatggtcatttataaa

SEQ ID NO: 83743 - DNA, 25 bp, Homo sapien
ctcttccgtagcaaccggttatgta

SEQ ID NO: 83744 - DNA, 25 bp, Homo sapien
ccggttatgtacagagtcaacgact

SEQ ID NO: 83745 - DNA, 25 bp, Homo sapien
ttgaacttgttctccagcgccacga

SEQ ID NO: 83746 - DNA, 25 bp, Homo sapien
gaagttccgcaaagtgcttcgcagc

SEQ ID NO: 83747 - DNA, 25 bp, Homo sapien
tccggtaagaaatgaccaatcgctc

SEQ ID NO: 83748 - DNA, 25 bp, Homo sapien
accctcagcaggagtaggatccgcc

SEQ ID NO: 83749 - DNA, 25 bp, Homo sapien
agccggatttgttcgccctccatct

SEQ ID NO: 83750 - DNA, 25 bp, Homo sapien
ccctgtgcttcagtagggccggaaa

SEQ ID NO: 83751 - DNA, 25 bp, Homo sapien
cttgaaagagatatgcacgcgccgt

SEQ ID NO: 83752 - DNA, 25 bp, Homo sapien
cacgcgccgtaatgggatatcgacc

SEQ ID NO: 83753 - DNA, 25 bp, Homo sapien
ttccagcgataaccagcgttttgtc

SEQ ID NO: 83754 - DNA, 25 bp, Homo sapien
actacccttctaggccggagacgcg

SEQ ID NO: 83755 - DNA, 25 bp, Homo sapien
agacactttccagattgctgcgccc

SEQ ID NO: 83756 - DNA, 25 bp, Homo sapien
cgagcacccaggcacacaagccctg

SEQ ID NO: 83757 - DNA, 25 bp, Homo sapien
tgcagagccctcacaaacgcgctgg

SEQ ID NO: 83758 - DNA, 25 bp, Homo sapien
aaacgcgctggcatccctgcatctc

SEQ ID NO: 83759 - DNA, 25 bp, Homo sapien
gcgctggtgttggttcctctttcac

SEQ ID NO: 83760 - DNA, 25 bp, Homo sapien
tggttcctctttcactgtttcccga

SEQ ID NO: 83761 - DNA, 25 bp, Homo sapien
ggaggggcacaccagacactttcca

SEQ ID NO: 83762 - DNA, 25 bp, Homo sapien
ggcacaccagacactttccagattg

SEQ ID NO: 83763 - DNA, 25 bp, Homo sapien
atcaccggagtttgggaagtcagag

SEQ ID NO: 83764 - DNA, 25 bp, Homo sapien
cagggcagcttcagcactgcgaaca

SEQ ID NO: 83765 - DNA, 25 bp, Homo sapien
taccacactcgggacaccagaagcg

SEQ ID NO: 83766 - DNA, 25 bp, Homo sapien
tcctccagaatgagtgtaccacact

SEQ ID NO: 83767 - DNA, 25 bp, Homo sapien
aggcctgggttccttctctaagata

SEQ ID NO: 83768 - DNA, 25 bp, Homo sapien
acggcgacccatgttgatcaccgga

SEQ ID NO: 83769 - DNA, 25 bp, Homo sapien
cacttaggggcctgtgactcctcca

SEQ ID NO: 83770 - DNA, 25 bp, Homo sapien
acagcgccagcaactccgagggtct

SEQ ID NO: 83771 - DNA, 25 bp, Homo sapien
tcaggccgcacaatgagcttaattg

SEQ ID NO: 83772 - DNA, 25 bp, Homo sapien
ccttggagagtgattctggcgccac

SEQ ID NO: 83773 - DNA, 25 bp, Homo sapien
tcacgcgcgtgaatcataattagga

SEQ ID NO: 83774 - DNA, 25 bp, Homo sapien
ttaaattatcatcatcacgcgcgtg

SEQ ID NO: 83775 - DNA, 25 bp, Homo sapien
gcgggtgccagcatttcttccagca

SEQ ID NO: 83776 - DNA, 25 bp, Homo sapien
tgaggttaatgcctcccgcagctcc

SEQ ID NO: 83777 - DNA, 25 bp, Homo sapien
cgttatcactcacggggctcctcgt

SEQ ID NO: 83778 - DNA, 25 bp, Homo sapien
ccgcagctccgcgattattaaatta

SEQ ID NO: 83779 - DNA, 25 bp, Homo sapien
gcgtcagcaatgcttcactctcaga

SEQ ID NO: 83780 - DNA, 25 bp, Homo sapien
gtcaagctcaaagcgacagattcca

SEQ ID NO: 83781 - DNA, 25 bp, Homo sapien
ctggtcggatgtttgcctgtcaagc

SEQ ID NO: 83782 - DNA, 25 bp, Homo sapien
gatgttctcaaagccctgctcgccg

SEQ ID NO: 83783 - DNA, 25 bp, Homo sapien
tgatcagggacacgaccgcagcctc

SEQ ID NO: 83784 - DNA, 25 bp, Homo sapien
gtgcggaaaccacggcccgatgttc

SEQ ID NO: 83785 - DNA, 25 bp, Homo sapien
tcgtccactcctgagtgatcaggga

SEQ ID NO: 83786 - DNA, 25 bp, Homo sapien
actctcagacgcttggcggaggcca

SEQ ID NO: 83787 - DNA, 25 bp, Homo sapien
tgcatgccaaccacggcctgtgtga

SEQ ID NO: 83788 - DNA, 25 bp, Homo sapien
tttctgattctctgcgaccttcgcg

SEQ ID NO: 83789 - DNA, 25 bp, Homo sapien
tgtgtgaccgcacggtgcatgccaa

SEQ ID NO: 83790 - DNA, 25 bp, Homo sapien
tgtctgtgtgcgactcagtccctcg

SEQ ID NO: 83791 - DNA, 25 bp, Homo sapien
cgtgtccctacgatcgtgtgcattg

SEQ ID NO: 83792 - DNA, 25 bp, Homo sapien
tgtgtccgagtgtccgcatccacgt

SEQ ID NO: 83793 - DNA, 25 bp, Homo sapien
cgcgtccgacctgtgatctccgagt

SEQ ID NO: 83794 - DNA, 25 bp, Homo sapien
atgcgtgtgtttctgctcctggctt

SEQ ID NO: 83795 - DNA, 25 bp, Homo sapien
tgtttgttttggcaatcagaggtgt

SEQ ID NO: 83796 - DNA, 25 bp, Homo sapien
tcagaggtgtgagcgctttaatata

SEQ ID NO: 83797 - DNA, 25 bp, Homo sapien
ataaataaggggtccaggcagccgg

SEQ ID NO: 83798 - DNA, 25 bp, Homo sapien
aggcagccggcctgacacggcattt

SEQ ID NO: 83799 - DNA, 25 bp, Homo sapien
acacggcatttgtcttggagggagc

SEQ ID NO: 83800 - DNA, 25 bp, Homo sapien
cctcgaaggcctcagtgccagtgtc

SEQ ID NO: 83801 - DNA, 25 bp, Homo sapien
tctcgtgggtggcattaaaaactcc

SEQ ID NO: 83802 - DNA, 25 bp, Homo sapien
gcattaaaaactcccgccacagtgg

SEQ ID NO: 83803 - DNA, 25 bp, Homo sapien
agggaggcgtctccgggaatctact

SEQ ID NO: 83804 - DNA, 25 bp, Homo sapien
tctcactgtcactgggacctcgggg

SEQ ID NO: 83805 - DNA, 25 bp, Homo sapien
gcgtctccgggaatctactccggga

SEQ ID NO: 83806 - DNA, 25 bp, Homo sapien
attgggtgtgtctgagcatcgtccc

SEQ ID NO: 83807 - DNA, 25 bp, Homo sapien
atccgctggtgaattgggtgtgtct

SEQ ID NO: 83808 - DNA, 25 bp, Homo sapien
cctccgatccgctggtgaattgggt

SEQ ID NO: 83809 - DNA, 25 bp, Homo sapien
tggatgggttcctgcggcctccgat

SEQ ID NO: 83810 - DNA, 25 bp, Homo sapien
acgccttggatctcactgtcactgg

SEQ ID NO: 83811 - DNA, 25 bp, Homo sapien
acactgtcaggcctgatggggaccg

SEQ ID NO: 83812 - DNA, 25 bp, Homo sapien
tgatctctctcctgggcagattaat

SEQ ID NO: 83813 - DNA, 25 bp, Homo sapien
ctctctcctgggcagattaattaag

SEQ ID NO: 83814 - DNA, 25 bp, Homo sapien
ctcctgggcagattaattaagtgtt

SEQ ID NO: 83815 - DNA, 25 bp, Homo sapien
ctgggcagattaattaagtgttatc

SEQ ID NO: 83816 - DNA, 25 bp, Homo sapien
tgttatcaattagcggccctggcta

SEQ ID NO: 83817 - DNA, 25 bp, Homo sapien
gccacaggtccgggccgatgtccgt

SEQ ID NO: 83818 - DNA, 25 bp, Homo sapien
taagtgttatcaattagcggccctg

SEQ ID NO: 83819 - DNA, 25 bp, Homo sapien
cgctgccgtagaaactgggcccatc

SEQ ID NO: 83820 - DNA, 25 bp, Homo sapien
gccgtagaaactgggcccatccgcg

SEQ ID NO: 83821 - DNA, 25 bp, Homo sapien
agaaactgggcccatccgcggtgcc

SEQ ID NO: 83822 - DNA, 25 bp, Homo sapien
accgccgctgccgtagaaactgggc

SEQ ID NO: 83823 - DNA, 25 bp, Homo sapien
ctgccgtagaaactgggcccatccg

SEQ ID NO: 83824 - DNA, 25 bp, Homo sapien
tggagcgcatgagcggggtgcgccc

SEQ ID NO: 83825 - DNA, 25 bp, Homo sapien
aactgggcccatccgcggtgccggt

SEQ ID NO: 83826 - DNA, 25 bp, Homo sapien
gccgctgccgtagaaactgggccca

SEQ ID NO: 83827 - DNA, 25 bp, Homo sapien
tcgtcactctgcaaagacccgagcg

SEQ ID NO: 83828 - DNA, 25 bp, Homo sapien
aggtctcagccgctctgggtctggc

SEQ ID NO: 83829 - DNA, 25 bp, Homo sapien
ttctggaaaggtctcagccgctctg

SEQ ID NO: 83830 - DNA, 25 bp, Homo sapien
cggaagcagcttctggaaaggtctc

SEQ ID NO: 83831 - DNA, 25 bp, Homo sapien
aggctccctgcactcagcacggaag

SEQ ID NO: 83832 - DNA, 25 bp, Homo sapien
ggaaaggctccctgcactcagcacg

SEQ ID NO: 83833 - DNA, 25 bp, Homo sapien
tctggcttcaggagcggggtccttc

SEQ ID NO: 83834 - DNA, 25 bp, Homo sapien
gcggaaaggctccctggaaaggctc

SEQ ID NO: 83835 - DNA, 25 bp, Homo sapien
gagtgaaaccggagccacgtgccca

SEQ ID NO: 83836 - DNA, 25 bp, Homo sapien
agcctgccaggaacatcagttcacg

SEQ ID NO: 83837 - DNA, 25 bp, Homo sapien
gtggtccacagtgagccacagtggc

SEQ ID NO: 83838 - DNA, 25 bp, Homo sapien
taactccgtgagagacgagccctga

SEQ ID NO: 83839 - DNA, 25 bp, Homo sapien
gtcagaaagacccacgccaaggggc

SEQ ID NO: 83840 - DNA, 25 bp, Homo sapien
tgcctctcggcaaagccggtcagaa

SEQ ID NO: 83841 - DNA, 25 bp, Homo sapien
agtcaccaaggggtcctgcctctcg

SEQ ID NO: 83842 - DNA, 25 bp, Homo sapien
ggctgagcgtggcaagctaaatcca

SEQ ID NO: 83843 - DNA, 25 bp, Homo sapien
gccgagcgcagctcaaacccagtta

SEQ ID NO: 83844 - DNA, 25 bp, Homo sapien
cagcttcgattagctccggccggga

SEQ ID NO: 83845 - DNA, 25 bp, Homo sapien
gccgtcaggcctcagatgtcttaca

SEQ ID NO: 83846 - DNA, 25 bp, Homo sapien
tgtcttacatattaatttcccgctg

SEQ ID NO: 83847 - DNA, 25 bp, Homo sapien
tcccgctgcagaacatttgccgagc

SEQ ID NO: 83848 - DNA, 25 bp, Homo sapien
cccagttagctggattgatgaaggt

SEQ ID NO: 83849 - DNA, 25 bp, Homo sapien
tggcaaaaggatacgacacacgctg

SEQ ID NO: 83850 - DNA, 25 bp, Homo sapien
gattccaccttttcagcttcgatta

SEQ ID NO: 83851 - DNA, 25 bp, Homo sapien
tccgacagccctgaaaagaccactg

SEQ ID NO: 83852 - DNA, 25 bp, Homo sapien
cccggagtgaaggtccctggagcaa

SEQ ID NO: 83853 - DNA, 25 bp, Homo sapien
cggatgtgactcaggaagacactgc

SEQ ID NO: 83854 - DNA, 25 bp, Homo sapien
aggacggcggctctaagtcggcctc

SEQ ID NO: 83855 - DNA, 25 bp, Homo sapien
cttcctgacgggttctggtgaggac

SEQ ID NO: 83856 - DNA, 25 bp, Homo sapien
aaggactcggaaacctctgccctca

SEQ ID NO: 83857 - DNA, 25 bp, Homo sapien
aagaccactgatttcaggcccttcc

SEQ ID NO: 83858 - DNA, 25 bp, Homo sapien
ccgtctgttccgacagccctgaaaa

SEQ ID NO: 83859 - DNA, 25 bp, Homo sapien
atcaaaggctgtccaagggcacgga

SEQ ID NO: 83860 - DNA, 25 bp, Homo sapien
tccgcaggatcaaaggctgtccaag

SEQ ID NO: 83861 - DNA, 25 bp, Homo sapien
aggcaccgtccaggagccagcgccc

SEQ ID NO: 83862 - DNA, 25 bp, Homo sapien
gaggaaactgcctggcccgaaggaa

SEQ ID NO: 83863 - DNA, 25 bp, Homo sapien
cccaggccaccgagcacagcgggga

SEQ ID NO: 83864 - DNA, 25 bp, Homo sapien
aaggccactaaggaagccgcagagc

SEQ ID NO: 83865 - DNA, 25 bp, Homo sapien
cgacgcccagaaaggccactaagga

SEQ ID NO: 83866 - DNA, 25 bp, Homo sapien
gctgtccaagggcacggatgcctcc

SEQ ID NO: 83867 - DNA, 25 bp, Homo sapien
agtgaccacgaggagggaagcctcc

SEQ ID NO: 83868 - DNA, 25 bp, Homo sapien
cagtgaccacgaggagggaagcctc

SEQ ID NO: 83869 - DNA, 25 bp, Homo sapien
gtccacagaacagtgaccacgaaga

SEQ ID NO: 83870 - DNA, 25 bp, Homo sapien
cgcgtccacagaacagtgaccacga

SEQ ID NO: 83871 - DNA, 25 bp, Homo sapien
gggaagcctccgtgtccacagaaca

SEQ ID NO: 83872 - DNA, 25 bp, Homo sapien
agcctccgtgtccacagaacagtga

SEQ ID NO: 83873 - DNA, 25 bp, Homo sapien
ggaagcctccgtgtccacagaacag

SEQ ID NO: 83874 - DNA, 25 bp, Homo sapien
gcgtccacagaacagtgaccacgaa

SEQ ID NO: 83875 - DNA, 25 bp, Homo sapien
ccgtcacggctctaggggagaagac

SEQ ID NO: 83876 - DNA, 25 bp, Homo sapien
tccgggtggctcatcaagaatgtgc

SEQ ID NO: 83877 - DNA, 25 bp, Homo sapien
aatgtgctgtccatgcccatcgtca

SEQ ID NO: 83878 - DNA, 25 bp, Homo sapien
gggagtcgccacattttacaacagg

SEQ ID NO: 83879 - DNA, 25 bp, Homo sapien
ctttgacgaacaggacgaggttctc

SEQ ID NO: 83880 - DNA, 25 bp, Homo sapien
cgaggttctcatggaggtaagcacc

SEQ ID NO: 83881 - DNA, 25 bp, Homo sapien
cactcctggtgggaaaacggcctct

SEQ ID NO: 83882 - DNA, 25 bp, Homo sapien
cctccggtgggaaaatatcatgaca

SEQ ID NO: 83883 - DNA, 25 bp, Homo sapien
cttaaggtggaagtctcccagccgg

SEQ ID NO: 83884 - DNA, 25 bp, Homo sapien
cattagtatttgtcaccagggcggc

SEQ ID NO: 83885 - DNA, 25 bp, Homo sapien
cctgcggctgctgatttagacatta

SEQ ID NO: 83886 - DNA, 25 bp, Homo sapien
gcggctgctgatttagacattagta

SEQ ID NO: 83887 - DNA, 25 bp, Homo sapien
ctgctgatttagacattagtatttg

SEQ ID NO: 83888 - DNA, 25 bp, Homo sapien
ttagtatttgtcaccagggcggcgg

SEQ ID NO: 83889 - DNA, 25 bp, Homo sapien
caccttaaggtggaagtctcccagc

SEQ ID NO: 83890 - DNA, 25 bp, Homo sapien
ggggctcctcacaccttaaggtgga

SEQ ID NO: 83891 - DNA, 25 bp, Homo sapien
ctcggaagcacagtcaagcctcgcg

SEQ ID NO: 83892 - DNA, 25 bp, Homo sapien
tgtccaggatccacagctcggaagc

SEQ ID NO: 83893 - DNA, 25 bp, Homo sapien
ggcctttggattcggcgtccctctc

SEQ ID NO: 83894 - DNA, 25 bp, Homo sapien
ttggcttcggtttccagacttgggc

SEQ ID NO: 83895 - DNA, 25 bp, Homo sapien
ctgattgacccagtgatccaaaaaa

SEQ ID NO: 83896 - DNA, 25 bp, Homo sapien
cgaggcattggctgactgattgacc

SEQ ID NO: 83897 - DNA, 25 bp, Homo sapien
cgcgcctgcgatctgagcttaatta

SEQ ID NO: 83898 - DNA, 25 bp, Homo sapien
gcttaattaaacttctcccgaggca

SEQ ID NO: 83899 - DNA, 25 bp, Homo sapien
aggccctcgggtcctccagaggctg

SEQ ID NO: 83900 - DNA, 25 bp, Homo sapien
cgcagccggaacatggaccgcagtc

SEQ ID NO: 83901 - DNA, 25 bp, Homo sapien
catccgcgtccatttcccgggaagt

SEQ ID NO: 83902 - DNA, 25 bp, Homo sapien
gggcatgagaaacgccaggccctcg

SEQ ID NO: 83903 - DNA, 25 bp, Homo sapien
gcacccagctctgaggggcatgaga

SEQ ID NO: 83904 - DNA, 25 bp, Homo sapien
gcccttcaattttccagctgcctga

SEQ ID NO: 83905 - DNA, 25 bp, Homo sapien
aaagagaagggagcggccacgcact

SEQ ID NO: 83906 - DNA, 25 bp, Homo sapien
gccaccggggcaggctttcccagga

SEQ ID NO: 83907 - DNA, 25 bp, Homo sapien
tgcgctagtgcccgcacccggtgtg

SEQ ID NO: 83908 - DNA, 25 bp, Homo sapien
accccgtctgcgtgcaagtgccagg

SEQ ID NO: 83909 - DNA, 25 bp, Homo sapien
ccgtctgcgtgcaagtgccaggggc

SEQ ID NO: 83910 - DNA, 25 bp, Homo sapien
tctgcgtgcaagtgccaggggcggg

SEQ ID NO: 83911 - DNA, 25 bp, Homo sapien
gacagcggtgcgtgcgctagtgccc

SEQ ID NO: 83912 - DNA, 25 bp, Homo sapien
cggtgcgtgcgctagtgcccgcacc

SEQ ID NO: 83913 - DNA, 25 bp, Homo sapien
tgcgtgcgctagtgcccgcacccgg

SEQ ID NO: 83914 - DNA, 25 bp, Homo sapien
gtgcgctagtgcccgcacccggtgt

SEQ ID NO: 83915 - DNA, 25 bp, Homo sapien
cctggaagctctgcaggaacgtgtg

SEQ ID NO: 83916 - DNA, 25 bp, Homo sapien
agagggcatcacacgggccttgctg

SEQ ID NO: 83917 - DNA, 25 bp, Homo sapien
gcagaagatttgtcgtgagcgcgac

SEQ ID NO: 83918 - DNA, 25 bp, Homo sapien
tgagcgcgacagacccactagactc

SEQ ID NO: 83919 - DNA, 25 bp, Homo sapien
acagacccactagactctgcaggtc

SEQ ID NO: 83920 - DNA, 25 bp, Homo sapien
tctgcagacaacgaggctcggagga

SEQ ID NO: 83921 - DNA, 25 bp, Homo sapien
gaggcaagcagcgaaccaaagctcc

SEQ ID NO: 83922 - DNA, 25 bp, Homo sapien
ctcagttacggggagagggcatcac

SEQ ID NO: 83923 - DNA, 25 bp, Homo sapien
ttccaggtgatgatgtttagagccc

SEQ ID NO: 83924 - DNA, 25 bp, Homo sapien
cccgagaagctatttgtgctggtga

SEQ ID NO: 83925 - DNA, 25 bp, Homo sapien
gtccgaggtgagcacacgcgacacc

SEQ ID NO: 83926 - DNA, 25 bp, Homo sapien
actcagaacgcccaggtccgaggtg

SEQ ID NO: 83927 - DNA, 25 bp, Homo sapien
cccagaagtgcaacgcgcacgggtg

SEQ ID NO: 83928 - DNA, 25 bp, Homo sapien
gacgcagcctctgtgtgaccagggc

SEQ ID NO: 83929 - DNA, 25 bp, Homo sapien
tgttcctccagtactttcacatttg

SEQ ID NO: 83930 - DNA, 25 bp, Homo sapien
ctgcagccggaagatattgactcga

SEQ ID NO: 83931 - DNA, 25 bp, Homo sapien
gcgcgatactgtcgacagcaataga

SEQ ID NO: 83932 - DNA, 25 bp, Homo sapien
ttacacggctctaagtggtggagtg

SEQ ID NO: 83933 - DNA, 25 bp, Homo sapien
ggagaaattcctgacaattcacttg

SEQ ID NO: 83934 - DNA, 25 bp, Homo sapien
atagacagggtaattgcagagcggc

SEQ ID NO: 83935 - DNA, 25 bp, Homo sapien
cagccaggccggatctatttaaaag

SEQ ID NO: 83936 - DNA, 25 bp, Homo sapien
catttgtcctggacgctcgtctgga

SEQ ID NO: 83937 - DNA, 25 bp, Homo sapien
gcggctgccggggtataaattacac

SEQ ID NO: 83938 - DNA, 25 bp, Homo sapien
cgccagcttatcacgggccagcaga

SEQ ID NO: 83939 - DNA, 25 bp, Homo sapien
gtcagctccaacaactccgcccggt

SEQ ID NO: 83940 - DNA, 25 bp, Homo sapien
tcagggccgtcagctccaacaactc

SEQ ID NO: 83941 - DNA, 25 bp, Homo sapien
tgcctggtacttcaccgaggccagg

SEQ ID NO: 83942 - DNA, 25 bp, Homo sapien
ctgcctggtacttcaccgaggccag

SEQ ID NO: 83943 - DNA, 25 bp, Homo sapien
cgcctggtacttcaccgaggccagg

SEQ ID NO: 83944 - DNA, 25 bp, Homo sapien
cctggcctggcagacccttcgtcac

SEQ ID NO: 83945 - DNA, 25 bp, Homo sapien
agctccaacaactccgcccggtact

SEQ ID NO: 83946 - DNA, 25 bp, Homo sapien
agacccttcgtcaccgaggccaggg

SEQ ID NO: 83947 - DNA, 25 bp, Homo sapien
cgcggatcggacgttaccatacatt

SEQ ID NO: 83948 - DNA, 25 bp, Homo sapien
ttggccacggtctcaggccaccagg

SEQ ID NO: 83949 - DNA, 25 bp, Homo sapien
gctcgccagcgctttcaccggatgg

SEQ ID NO: 83950 - DNA, 25 bp, Homo sapien
agtccacttggtcacccgctgcagg

SEQ ID NO: 83951 - DNA, 25 bp, Homo sapien
tgcacggtgaccttgcggtaaccca

SEQ ID NO: 83952 - DNA, 25 bp, Homo sapien
ggtaacccaagtgccatccgtcagc

SEQ ID NO: 83953 - DNA, 25 bp, Homo sapien
acacggcggcagctcatctgaattc

SEQ ID NO: 83954 - DNA, 25 bp, Homo sapien
cagccataactcagcctgcggagga

SEQ ID NO: 83955 - DNA, 25 bp, Homo sapien
gtcacgccaggtgatcagaaggccc

SEQ ID NO: 83956 - DNA, 25 bp, Homo sapien
tcagggtcacgccaggtgatcagaa

SEQ ID NO: 83957 - DNA, 25 bp, Homo sapien
caggggtcacaccaggtgatcagaa

SEQ ID NO: 83958 - DNA, 25 bp, Homo sapien
tcaggggtcacaccaggtgatcaga

SEQ ID NO: 83959 - DNA, 25 bp, Homo sapien
gtcacaccaggtgatcagaaggccc

SEQ ID NO: 83960 - DNA, 25 bp, Homo sapien
ggtcacgccaggtgatcagaagccc

SEQ ID NO: 83961 - DNA, 25 bp, Homo sapien
acccacgtggtcagggtcacgccag

SEQ ID NO: 83962 - DNA, 25 bp, Homo sapien
gcccacgtggtcagggtcacgccaa

SEQ ID NO: 83963 - DNA, 25 bp, Homo sapien
tgtgcggctagagcgtgaaaacagc

SEQ ID NO: 83964 - DNA, 25 bp, Homo sapien
ggccacccacgctgtagagacggtg

SEQ ID NO: 83965 - DNA, 25 bp, Homo sapien
accacggcgttttgttttcattcag

SEQ ID NO: 83966 - DNA, 25 bp, Homo sapien
ctgctcggacccgacagatgctgta

SEQ ID NO: 83967 - DNA, 25 bp, Homo sapien
agatgctgtaaggtcacgccgaggc

SEQ ID NO: 83968 - DNA, 25 bp, Homo sapien
gcaggctctgaacgcctctggacga

SEQ ID NO: 83969 - DNA, 25 bp, Homo sapien
cgacacagtcggtgcaggagaaaaa

SEQ ID NO: 83970 - DNA, 25 bp, Homo sapien
cacacggaactgaaggggccaccca

SEQ ID NO: 83971 - DNA, 25 bp, Homo sapien
gcaagcaggactccgcggaacacca

SEQ ID NO: 83972 - DNA, 25 bp, Homo sapien
ttctgacaaggaccggcaatgccgc

SEQ ID NO: 83973 - DNA, 25 bp, Homo sapien
caccgcctcttggagactggagtcc

SEQ ID NO: 83974 - DNA, 25 bp, Homo sapien
cgcacaagctcctcgggttctgaca

SEQ ID NO: 83975 - DNA, 25 bp, Homo sapien
gagcctgtgctttcactggggtcca

SEQ ID NO: 83976 - DNA, 25 bp, Homo sapien
tgggaccggtcgaccacacagcact

SEQ ID NO: 83977 - DNA, 25 bp, Homo sapien
gcacccgcgagtcgctcctgtgaga

SEQ ID NO: 83978 - DNA, 25 bp, Homo sapien
cggaacaccagagcgggcctgagcc

SEQ ID NO: 83979 - DNA, 25 bp, Homo sapien
ccttgtcccacatgcgaagctcttt

SEQ ID NO: 83980 - DNA, 25 bp, Homo sapien
gaagctctttctcgtgacacatctg

SEQ ID NO: 83981 - DNA, 25 bp, Homo sapien
ctgtgtctctgtgtagccaaccaga

SEQ ID NO: 83982 - DNA, 25 bp, Homo sapien
acgagctgggcgaaatcctggtaag

SEQ ID NO: 83983 - DNA, 25 bp, Homo sapien
tcctggtaagaaccttgctcccgtc

SEQ ID NO: 83984 - DNA, 25 bp, Homo sapien
ctgggaggaagagttctgcattctc

SEQ ID NO: 83985 - DNA, 25 bp, Homo sapien
gagttctgcattctccgggacccga

SEQ ID NO: 83986 - DNA, 25 bp, Homo sapien
gggacccgacggtgctttgcacaca

SEQ ID NO: 83987 - DNA, 25 bp, Homo sapien
gtcggacttcctcaacaatgcggta

SEQ ID NO: 83988 - DNA, 25 bp, Homo sapien
caatgcggtaagatgaagggtctcc

SEQ ID NO: 83989 - DNA, 25 bp, Homo sapien
gaaggacccgactacacatcactgg

SEQ ID NO: 83990 - DNA, 25 bp, Homo sapien
gacatgtgtttggagctaagcgccc

SEQ ID NO: 83991 - DNA, 25 bp, Homo sapien
caatctttgaatacactggcctcca

SEQ ID NO: 83992 - DNA, 25 bp, Homo sapien
tgagctcaagagacaccaatcccgc

SEQ ID NO: 83993 - DNA, 25 bp, Homo sapien
gtggctcataggctggatctccgct

SEQ ID NO: 83994 - DNA, 25 bp, Homo sapien
cgatggacgccgtcttggaaccctt

SEQ ID NO: 83995 - DNA, 25 bp, Homo sapien
gccacaccatgaggacagggcctgg

SEQ ID NO: 83996 - DNA, 25 bp, Homo sapien
ggggccacatgaacagcacccagct

SEQ ID NO: 83997 - DNA, 25 bp, Homo sapien
aggctttcacgccacagggaccctt

SEQ ID NO: 83998 - DNA, 25 bp, Homo sapien
cagctcgacgctgccacggaaaaac

SEQ ID NO: 83999 - DNA, 25 bp, Homo sapien
aggacttgaaggctttcacgccaca

SEQ ID NO: 84000 - DNA, 25 bp, Homo sapien
acctcagccagcacggcggtgtgga

SEQ ID NO: 84001 - DNA, 25 bp, Homo sapien
agacaggccgcctacacacggggtc

SEQ ID NO: 84002 - DNA, 25 bp, Homo sapien
ggcagctctgctaaaggacttgaag

SEQ ID NO: 84003 - DNA, 25 bp, Homo sapien
ctccaggcctagaaggcaagacctg

SEQ ID NO: 84004 - DNA, 25 bp, Homo sapien
aaagcggcttcggaatccgccgcaa

SEQ ID NO: 84005 - DNA, 25 bp, Homo sapien
caggctacgcagaaaaagcggcttc

SEQ ID NO: 84006 - DNA, 25 bp, Homo sapien
cacaggagaatctcggcgatttaca

SEQ ID NO: 84007 - DNA, 25 bp, Homo sapien
ggctccgcgactgcgctcagattaa

SEQ ID NO: 84008 - DNA, 25 bp, Homo sapien
tcagccgcggcggaacaaaaccgcg

SEQ ID NO: 84009 - DNA, 25 bp, Homo sapien
gcctcgtgcggaaaagtcgcctcga

SEQ ID NO: 84010 - DNA, 25 bp, Homo sapien
ccggtcggcactagccgtggctcag

SEQ ID NO: 84011 - DNA, 25 bp, Homo sapien
gcgtcaccgtcgcagcggctctgat

SEQ ID NO: 84012 - DNA, 25 bp, Homo sapien
agggcctgaggcagaaacccgcgtc

SEQ ID NO: 84013 - DNA, 25 bp, Homo sapien
ccaaccgcctttatgtgggcgccgg

SEQ ID NO: 84014 - DNA, 25 bp, Homo sapien
acgccgcaggggtccactcagctgt

SEQ ID NO: 84015 - DNA, 25 bp, Homo sapien
tgcgacgctgataggtcgcgccttg

SEQ ID NO: 84016 - DNA, 25 bp, Homo sapien
gtaagcggcacgtttctcggcctgg

SEQ ID NO: 84017 - DNA, 25 bp, Homo sapien
agcgcggctctgcttggttcctgcc

SEQ ID NO: 84018 - DNA, 25 bp, Homo sapien
cgggtactgactgcttcccacggtc

SEQ ID NO: 84019 - DNA, 25 bp, Homo sapien
tctcagcttcagacaccctggcgtg

SEQ ID NO: 84020 - DNA, 25 bp, Homo sapien
cggcaccgcacctgtgcattgagca

SEQ ID NO: 84021 - DNA, 25 bp, Homo sapien
actcgaaattcatggggcgactgcg

SEQ ID NO: 84022 - DNA, 25 bp, Homo sapien
gcgaggcacagcttcccattggacg

SEQ ID NO: 84023 - DNA, 25 bp, Homo sapien
gcgaaggcaaccgtcggcgtttgaa

SEQ ID NO: 84024 - DNA, 25 bp, Homo sapien
catcaagggctagaagcgcgacggc

SEQ ID NO: 84025 - DNA, 25 bp, Homo sapien
ccagataggcgagagtgaaggtcac

SEQ ID NO: 84026 - DNA, 25 bp, Homo sapien
cccagtagcgtcagttgcggaactc

SEQ ID NO: 84027 - DNA, 25 bp, Homo sapien
tggattacctggagcagtttggaac

SEQ ID NO: 84028 - DNA, 25 bp, Homo sapien
cacccacagggtgtccgagagcagc

SEQ ID NO: 84029 - DNA, 25 bp, Homo sapien
taccaggcaattccgcgaagcctca

SEQ ID NO: 84030 - DNA, 25 bp, Homo sapien
ggagcagtttggaacttcctcggta

SEQ ID NO: 84031 - DNA, 25 bp, Homo sapien
tcctctcagttctaggcacgggcgc

SEQ ID NO: 84032 - DNA, 25 bp, Homo sapien
gattcactcctctcagttctaggca

SEQ ID NO: 84033 - DNA, 25 bp, Homo sapien
gcggcggcatgattcactcctctca

SEQ ID NO: 84034 - DNA, 25 bp, Homo sapien
ttcctcggtaggtaccaggcaattc

SEQ ID NO: 84035 - DNA, 25 bp, Homo sapien
gcaagtgtgctaagttgaggctata

SEQ ID NO: 84036 - DNA, 25 bp, Homo sapien
ggctataaattacccgcggccaggc

SEQ ID NO: 84037 - DNA, 25 bp, Homo sapien
tctggctctgtaaatcggccctttc

SEQ ID NO: 84038 - DNA, 25 bp, Homo sapien
tggaggccgcgcacgaaagaaaaac

SEQ ID NO: 84039 - DNA, 25 bp, Homo sapien
ttttattaaagcaacatcagggctg

SEQ ID NO: 84040 - DNA, 25 bp, Homo sapien
ggggcttccaaacgcctgcatgagg

SEQ ID NO: 84041 - DNA, 25 bp, Homo sapien
acagcttgtcttcacccaccgggtg

SEQ ID NO: 84042 - DNA, 25 bp, Homo sapien
cgccaaggcacaaacgacacagctt

SEQ ID NO: 84043 - DNA, 25 bp, Homo sapien
gcggctcggagattatgcaaatccc

SEQ ID NO: 84044 - DNA, 25 bp, Homo sapien
ccgcgcggctcggagattatgcaaa

SEQ ID NO: 84045 - DNA, 25 bp, Homo sapien
gagacccaagcccagaggcgcgccc

SEQ ID NO: 84046 - DNA, 25 bp, Homo sapien
cggtggtccctcgtctgctccggcc

SEQ ID NO: 84047 - DNA, 25 bp, Homo sapien
gcggcgctgaaagccggggtcacgc

SEQ ID NO: 84048 - DNA, 25 bp, Homo sapien
cgcggctggaatgtttgcctttgct

SEQ ID NO: 84049 - DNA, 25 bp, Homo sapien
cggtggcacaaagggtgcttcctgc

SEQ ID NO: 84050 - DNA, 25 bp, Homo sapien
gtggcacaaagggtgcttcctgccc

SEQ ID NO: 84051 - DNA, 25 bp, Homo sapien
ggcgctactgtgcaggttcaggcgg

SEQ ID NO: 84052 - DNA, 25 bp, Homo sapien
cgggcgggcagctttaattaccgct

SEQ ID NO: 84053 - DNA, 25 bp, Homo sapien
cgggcagctttaattaccgctcgct

SEQ ID NO: 84054 - DNA, 25 bp, Homo sapien
ctttaattaccgctcgctgggccca

SEQ ID NO: 84055 - DNA, 25 bp, Homo sapien
ctgggcccattgagcctcgtgctaa

SEQ ID NO: 84056 - DNA, 25 bp, Homo sapien
gcccattgagcctcgtgctaatccg

SEQ ID NO: 84057 - DNA, 25 bp, Homo sapien
ttgagcctcgtgctaatccgggccg

SEQ ID NO: 84058 - DNA, 25 bp, Homo sapien
caattaaagcgagctcggcggggcc

SEQ ID NO: 84059 - DNA, 25 bp, Homo sapien
gttctgcgcagacggaaagttccca

SEQ ID NO: 84060 - DNA, 25 bp, Homo sapien
ccagtttgtggccagcttcggccaa

SEQ ID NO: 84061 - DNA, 25 bp, Homo sapien
caggtaagaagggacccactaggca

SEQ ID NO: 84062 - DNA, 25 bp, Homo sapien
ccaaggcgagagaccggacttctaa

SEQ ID NO: 84063 - DNA, 25 bp, Homo sapien
gcgcctcctcggagtccttggggac

SEQ ID NO: 84064 - DNA, 25 bp, Homo sapien
gctgttgttattcgggttctgcgca

SEQ ID NO: 84065 - DNA, 25 bp, Homo sapien
atttccacgattcccgctgttgtta

SEQ ID NO: 84066 - DNA, 25 bp, Homo sapien
gattccgctgcctccttgccggaga

SEQ ID NO: 84067 - DNA, 25 bp, Homo sapien
actttgctcttctcggtatgttttc

SEQ ID NO: 84068 - DNA, 25 bp, Homo sapien
tgttttccgtcatgaccgccgtgtg

SEQ ID NO: 84069 - DNA, 25 bp, Homo sapien
tcatgaccgccgtgtggagcttcca

SEQ ID NO: 84070 - DNA, 25 bp, Homo sapien
gagcttccataggagctgcaggata

SEQ ID NO: 84071 - DNA, 25 bp, Homo sapien
gctgcaggatacagaaccttgccca

SEQ ID NO: 84072 - DNA, 25 bp, Homo sapien
acccagcgccgtgtttgtactttgc

SEQ ID NO: 84073 - DNA, 25 bp, Homo sapien
tccggcctgtgctctgaccggtgaa

SEQ ID NO: 84074 - DNA, 25 bp, Homo sapien
tgctctgaccggtgaacccgcgcat

SEQ ID NO: 84075 - DNA, 25 bp, Homo sapien
cgctactgatgaggggtttaggaca

SEQ ID NO: 84076 - DNA, 25 bp, Homo sapien
tgcaaggggatttaaggcccggctc

SEQ ID NO: 84077 - DNA, 25 bp, Homo sapien
gacaccgtgagacggccaggccatt

SEQ ID NO: 84078 - DNA, 25 bp, Homo sapien
tctgcggctcccaccagtgagcagg

SEQ ID NO: 84079 - DNA, 25 bp, Homo sapien
gcggcacccggatccttctctaaaa

SEQ ID NO: 84080 - DNA, 25 bp, Homo sapien
gctcgggaacctctcctccaaggga

SEQ ID NO: 84081 - DNA, 25 bp, Homo sapien
taggacgattcgagatggagctgca

SEQ ID NO: 84082 - DNA, 25 bp, Homo sapien
ccattggccaggagctctgcggctc

SEQ ID NO: 84083 - DNA, 25 bp, Homo sapien
tgtacttcaagtgcgcgccttccgg

SEQ ID NO: 84084 - DNA, 25 bp, Homo sapien
acggacctggccctgtacttcaagt

SEQ ID NO: 84085 - DNA, 25 bp, Homo sapien
tcgtggatgagtccaagaactacca

SEQ ID NO: 84086 - DNA, 25 bp, Homo sapien
acgagcacgtgatccacctgatgga

SEQ ID NO: 84087 - DNA, 25 bp, Homo sapien
cgacccggaaggagatcgtcatgtg

SEQ ID NO: 84088 - DNA, 25 bp, Homo sapien
accagaacctgaaccggcggcagca

SEQ ID NO: 84089 - DNA, 25 bp, Homo sapien
acgcgctgggcataacctccgcaga

SEQ ID NO: 84090 - DNA, 25 bp, Homo sapien
atctgcgtcccaagccgacgatgga

SEQ ID NO: 84091 - DNA, 25 bp, Homo sapien
tcacgcagcgcgtactgtgccactt

SEQ ID NO: 84092 - DNA, 25 bp, Homo sapien
aatgcctcccacgaggactccgggg

SEQ ID NO: 84093 - DNA, 25 bp, Homo sapien
gctgcaggtgctgaatgcctcccac

SEQ ID NO: 84094 - DNA, 25 bp, Homo sapien
tgccacttcagtgtgcgggtgacag

SEQ ID NO: 84095 - DNA, 25 bp, Homo sapien
gagctctggggccacgccagctaca

SEQ ID NO: 84096 - DNA, 25 bp, Homo sapien
gggccacgccagctacagaaaggag

SEQ ID NO: 84097 - DNA, 25 bp, Homo sapien
cagctacagaaaggagccgagtgcc

SEQ ID NO: 84098 - DNA, 25 bp, Homo sapien
ccctgagtccctgcgtgggtcagga

SEQ ID NO: 84099 - DNA, 25 bp, Homo sapien
aaggccttttggctgagcgttcacg

SEQ ID NO: 84100 - DNA, 25 bp, Homo sapien
ccactgaattgggacggttgcgaca

SEQ ID NO: 84101 - DNA, 25 bp, Homo sapien
cctctgtcgagccaccaatttcata

SEQ ID NO: 84102 - DNA, 25 bp, Homo sapien
cagagacgtgcatcctgtgaaacca

SEQ ID NO: 84103 - DNA, 25 bp, Homo sapien
ggttgcgacactcaaagcccaaaga

SEQ ID NO: 84104 - DNA, 25 bp, Homo sapien
agtccctgacatggagctgcccacg

SEQ ID NO: 84105 - DNA, 25 bp, Homo sapien
tagctttgttcccatggctgccggg

SEQ ID NO: 84106 - DNA, 25 bp, Homo sapien
ggtaacgactctgtcccatgccggc

SEQ ID NO: 84107 - DNA, 25 bp, Homo sapien
cacaccactggtgcgcatcgcaagg

SEQ ID NO: 84108 - DNA, 25 bp, Homo sapien
catgagctccaacacaccactggtg

SEQ ID NO: 84109 - DNA, 25 bp, Homo sapien
catcgcaaggctgtcctcaggggag

SEQ ID NO: 84110 - DNA, 25 bp, Homo sapien
gtgcgcatcgcaaggctgtcctcag

SEQ ID NO: 84111 - DNA, 25 bp, Homo sapien
ccactggtgcgcatcgcaaggctgt

SEQ ID NO: 84112 - DNA, 25 bp, Homo sapien
tgagctccaacacaccactggtgcg

SEQ ID NO: 84113 - DNA, 25 bp, Homo sapien
agtccaacgcgtccatgagctccaa

SEQ ID NO: 84114 - DNA, 25 bp, Homo sapien
aagcaggtgtccctggagtccaacg

SEQ ID NO: 84115 - DNA, 25 bp, Homo sapien
tgccactgacaaggacctgtcggac

SEQ ID NO: 84116 - DNA, 25 bp, Homo sapien
gacgatgccactgacaaggacctgt

SEQ ID NO: 84117 - DNA, 25 bp, Homo sapien
ccactgacaaggacctgtcggacct

SEQ ID NO: 84118 - DNA, 25 bp, Homo sapien
gctccgtgcacagacgatgccactg

SEQ ID NO: 84119 - DNA, 25 bp, Homo sapien
ccgtgcacagacgatgccactgaca

SEQ ID NO: 84120 - DNA, 25 bp, Homo sapien
tgcacagacgatgccactgacaagg

SEQ ID NO: 84121 - DNA, 25 bp, Homo sapien
gatgccactgacaaggacctgtcgg

SEQ ID NO: 84122 - DNA, 25 bp, Homo sapien
acagacgatgccactgacaaggacc

SEQ ID NO: 84123 - DNA, 25 bp, Homo sapien
atgatgaagatgatcgggaaacaca

SEQ ID NO: 84124 - DNA, 25 bp, Homo sapien
atcatcaacctgctgggcgcctgca

SEQ ID NO: 84125 - DNA, 25 bp, Homo sapien
agtacgcggccaagggtaacctgcg

SEQ ID NO: 84126 - DNA, 25 bp, Homo sapien
acctgtcggacctggtgtctgagat

SEQ ID NO: 84127 - DNA, 25 bp, Homo sapien
gatcgggaaacacaaaaacatcatc

SEQ ID NO: 84128 - DNA, 25 bp, Homo sapien
aaaaacatcatcaacctgctgggcg

SEQ ID NO: 84129 - DNA, 25 bp, Homo sapien
acatcatcaacctgctgggcgcctg

SEQ ID NO: 84130 - DNA, 25 bp, Homo sapien
gcagcccgtctgaggagcccgtgtc

SEQ ID NO: 84131 - DNA, 25 bp, Homo sapien
tgaggccttgtttgaccgagtctac

SEQ ID NO: 84132 - DNA, 25 bp, Homo sapien
cctgaggccttgtttgaccgagtct

SEQ ID NO: 84133 - DNA, 25 bp, Homo sapien
cgagtctacactcaccagagtgacg

SEQ ID NO: 84134 - DNA, 25 bp, Homo sapien
gaccgagtctacactcaccagagtg

SEQ ID NO: 84135 - DNA, 25 bp, Homo sapien
gtttgaccgagtctacactcaccag

SEQ ID NO: 84136 - DNA, 25 bp, Homo sapien
ccttgtttgaccgagtctacactca

SEQ ID NO: 84137 - DNA, 25 bp, Homo sapien
tctacactcaccagagtgacgtgta

SEQ ID NO: 84138 - DNA, 25 bp, Homo sapien
aggccttgtttgaccgagtctacac

SEQ ID NO: 84139 - DNA, 25 bp, Homo sapien
agaagacgaccaacgtgagcccggc

SEQ ID NO: 84140 - DNA, 25 bp, Homo sapien
ccgaggacaacgtgatgaagatcgc

SEQ ID NO: 84141 - DNA, 25 bp, Homo sapien
aatgtgctggtgaccgaggacaacg

SEQ ID NO: 84142 - DNA, 25 bp, Homo sapien
aagatcgcagacttcgggctggccc

SEQ ID NO: 84143 - DNA, 25 bp, Homo sapien
ctactacaagaagacgaccaacgtg

SEQ ID NO: 84144 - DNA, 25 bp, Homo sapien
gtgcacaacctcgactactacaaga

SEQ ID NO: 84145 - DNA, 25 bp, Homo sapien
gggacgtgcacaacctcgactacta

SEQ ID NO: 84146 - DNA, 25 bp, Homo sapien
tcatgccagtaggacgcctggcgcc

SEQ ID NO: 84147 - DNA, 25 bp, Homo sapien
ggacgcagctcactgtagtgcagtg

SEQ ID NO: 84148 - DNA, 25 bp, Homo sapien
ctcactgtagtgcagtggagtcggc

SEQ ID NO: 84149 - DNA, 25 bp, Homo sapien
gagagggcagctcgccatgccgacc

SEQ ID NO: 84150 - DNA, 25 bp, Homo sapien
cccacgaaggcaagtgctgaagctt

SEQ ID NO: 84151 - DNA, 25 bp, Homo sapien
ccctccgtctgttctgagtctcagg

SEQ ID NO: 84152 - DNA, 25 bp, Homo sapien
ttctgagtctcaggtgtcgcctcca

SEQ ID NO: 84153 - DNA, 25 bp, Homo sapien
gagtctcaggtgtcgcctccactcg

SEQ ID NO: 84154 - DNA, 25 bp, Homo sapien
tcgtcgcctccacccacaccgtgga

SEQ ID NO: 84155 - DNA, 25 bp, Homo sapien
tgccgcgatcttggtgtcgatccat

SEQ ID NO: 84156 - DNA, 25 bp, Homo sapien
tgccccagggacttcttcaccacca

SEQ ID NO: 84157 - DNA, 25 bp, Homo sapien
cgctcccggcgggtcaggctgtggc

SEQ ID NO: 84158 - DNA, 25 bp, Homo sapien
gtgccgcgatcttggtgtcgatcca

SEQ ID NO: 84159 - DNA, 25 bp, Homo sapien
gccgcgatcttggtgtcgatccata

SEQ ID NO: 84160 - DNA, 25 bp, Homo sapien
ccgcgatcttggtgtcgatccatag

SEQ ID NO: 84161 - DNA, 25 bp, Homo sapien
cgcgatcttggtgtcgatccatagc

SEQ ID NO: 84162 - DNA, 25 bp, Homo sapien
cggcgggtcaggctgtggccgttga

SEQ ID NO: 84163 - DNA, 25 bp, Homo sapien
gggacttctctactaccgagtcatc

SEQ ID NO: 84164 - DNA, 25 bp, Homo sapien
tgaggatgcgccagagcatgcgtgc

SEQ ID NO: 84165 - DNA, 25 bp, Homo sapien
caggcggaagccatggtagtagtgc

SEQ ID NO: 84166 - DNA, 25 bp, Homo sapien
ttcttgtccttcaaggacttgaggg

SEQ ID NO: 84167 - DNA, 25 bp, Homo sapien
cttgtccttcaaggacttgagggac

SEQ ID NO: 84168 - DNA, 25 bp, Homo sapien
aggacttgagggacttctctactac

SEQ ID NO: 84169 - DNA, 25 bp, Homo sapien
acttgagggacttctctactaccga

SEQ ID NO: 84170 - DNA, 25 bp, Homo sapien
tgagggacttctctactaccgagtc

SEQ ID NO: 84171 - DNA, 25 bp, Homo sapien
cccacgagtagaaaacggctcctgg

SEQ ID NO: 84172 - DNA, 25 bp, Homo sapien
cctcagtaagatggacgccatgtgc

SEQ ID NO: 84173 - DNA, 25 bp, Homo sapien
ggaggcgctctcctcaaggacccgg

SEQ ID NO: 84174 - DNA, 25 bp, Homo sapien
ttgtcccggcacagacgtccggagg

SEQ ID NO: 84175 - DNA, 25 bp, Homo sapien
cggactaccctgaggcgcggactac

SEQ ID NO: 84176 - DNA, 25 bp, Homo sapien
tgcatcctggttcccgtcgtaccgt

SEQ ID NO: 84177 - DNA, 25 bp, Homo sapien
gcgtgtgtccggaacttttctggga

SEQ ID NO: 84178 - DNA, 25 bp, Homo sapien
ggactaagtcctgcacccacgagta

SEQ ID NO: 84179 - DNA, 25 bp, Homo sapien
ccttcgagggacctcgcgctgcaaa

SEQ ID NO: 84180 - DNA, 25 bp, Homo sapien
agggacctcgcgctgcaaaatccga

SEQ ID NO: 84181 - DNA, 25 bp, Homo sapien
gggacctcgcgctgcaaaatccgaa

SEQ ID NO: 84182 - DNA, 25 bp, Homo sapien
gacctcgcgctgcaaaatccgaaga

SEQ ID NO: 84183 - DNA, 25 bp, Homo sapien
cctcgcgctgcaaaatccgaagagc

SEQ ID NO: 84184 - DNA, 25 bp, Homo sapien
ctcgcgctgcaaaatccgaagagcc

SEQ ID NO: 84185 - DNA, 25 bp, Homo sapien
cctagccagggcctccacggaagcg

SEQ ID NO: 84186 - DNA, 25 bp, Homo sapien
ttcgagggacctcgcgctgcaaaat

SEQ ID NO: 84187 - DNA, 25 bp, Homo sapien
gtttccgccagctgcacctacgaaa

SEQ ID NO: 84188 - DNA, 25 bp, Homo sapien
tctctaaggtgacactcgggtgcgc

SEQ ID NO: 84189 - DNA, 25 bp, Homo sapien
acatcgcagtagctgagtgacaggc

SEQ ID NO: 84190 - DNA, 25 bp, Homo sapien
tgccgaagcccgaaagcgagggacc

SEQ ID NO: 84191 - DNA, 25 bp, Homo sapien
tgttggctcatgtcaccgcctctgc

SEQ ID NO: 84192 - DNA, 25 bp, Homo sapien
actcgaacttgagcgggtgcccgaa

SEQ ID NO: 84193 - DNA, 25 bp, Homo sapien
cgccgacggggttaatgttggctca

SEQ ID NO: 84194 - DNA, 25 bp, Homo sapien
gctgctcctgtcgtctaagcgtcgg

SEQ ID NO: 84195 - DNA, 25 bp, Homo sapien
gcgcgcacttttcccgcggcttctg

SEQ ID NO: 84196 - DNA, 25 bp, Homo sapien
ccgaggatgcgacgcaccgcaggtc

SEQ ID NO: 84197 - DNA, 25 bp, Homo sapien
cgcggatcgtgacgtcactgagcgc

SEQ ID NO: 84198 - DNA, 25 bp, Homo sapien
attgggcgcggatcgtgacgtcact

SEQ ID NO: 84199 - DNA, 25 bp, Homo sapien
ccgcgcgcccaacgccagcctccgc

SEQ ID NO: 84200 - DNA, 25 bp, Homo sapien
ggacgccgctagcagcctcccgcgg

SEQ ID NO: 84201 - DNA, 25 bp, Homo sapien
ggatgcgacgcaccgcaggtcactg

SEQ ID NO: 84202 - DNA, 25 bp, Homo sapien
ccgcactgccgctccgcgaggcgga

SEQ ID NO: 84203 - DNA, 25 bp, Homo sapien
caagaagcagccgttttcgagtccc

SEQ ID NO: 84204 - DNA, 25 bp, Homo sapien
gctgtaaaccagacgcacctgctgt

SEQ ID NO: 84205 - DNA, 25 bp, Homo sapien
gctgttcccgctctttatgttaatg

SEQ ID NO: 84206 - DNA, 25 bp, Homo sapien
tgttaatgcgagtcaacgcctgacc

SEQ ID NO: 84207 - DNA, 25 bp, Homo sapien
ggctcactcgtcctctgcgaacagg

SEQ ID NO: 84208 - DNA, 25 bp, Homo sapien
gcacccgttttcaccaagaagcagc

SEQ ID NO: 84209 - DNA, 25 bp, Homo sapien
agctgattccactatcggggtcacg

SEQ ID NO: 84210 - DNA, 25 bp, Homo sapien
tcgaacagccatttagcacccgttt

SEQ ID NO: 84211 - DNA, 25 bp, Homo sapien
gcagcgtccgctgcgtctgcactga

SEQ ID NO: 84212 - DNA, 25 bp, Homo sapien
cgagcatgaactggcccggaggacc

SEQ ID NO: 84213 - DNA, 25 bp, Homo sapien
cacagacgtacaggcctcctcggga

SEQ ID NO: 84214 - DNA, 25 bp, Homo sapien
tcacagagggcaaatagcgccaggc

SEQ ID NO: 84215 - DNA, 25 bp, Homo sapien
agccgccaggacacagacgtacagg

SEQ ID NO: 84216 - DNA, 25 bp, Homo sapien
agctcgagccgccaggacacagacg

SEQ ID NO: 84217 - DNA, 25 bp, Homo sapien
tgagccatcctcagcagcgtccgct

SEQ ID NO: 84218 - DNA, 25 bp, Homo sapien
tccgctgcgtctgcactgatgaccg

SEQ ID NO: 84219 - DNA, 25 bp, Homo sapien
acggcaacagtcagggcgccagcag

SEQ ID NO: 84220 - DNA, 25 bp, Homo sapien
cgcctgcttcgggatgcctttgagt

SEQ ID NO: 84221 - DNA, 25 bp, Homo sapien
aagcacagccctgccttagtgacgg

SEQ ID NO: 84222 - DNA, 25 bp, Homo sapien
cacctccgcatctgtggacaaaaca

SEQ ID NO: 84223 - DNA, 25 bp, Homo sapien
gctcagagatgtccagcagctgcca

SEQ ID NO: 84224 - DNA, 25 bp, Homo sapien
gcgccaaccatatccagctcagaga

SEQ ID NO: 84225 - DNA, 25 bp, Homo sapien
ggaatcaaacagcttcccaggggag

SEQ ID NO: 84226 - DNA, 25 bp, Homo sapien
ctcttctaggctagcgccgcagagg

SEQ ID NO: 84227 - DNA, 25 bp, Homo sapien
cggcagaagatgctacgtggctgca

SEQ ID NO: 84228 - DNA, 25 bp, Homo sapien
tacgcctgccaagaggcaagcgcgc

SEQ ID NO: 84229 - DNA, 25 bp, Homo sapien
aaaccctacgcctgccaagaggcaa

SEQ ID NO: 84230 - DNA, 25 bp, Homo sapien
agaagatgctacgtggctgcaggaa

SEQ ID NO: 84231 - DNA, 25 bp, Homo sapien
cgcgatgcggcagaagatgctacgt

SEQ ID NO: 84232 - DNA, 25 bp, Homo sapien
tgcgcgatgcggcagaagatgctac

SEQ ID NO: 84233 - DNA, 25 bp, Homo sapien
acgcccgcccgagctgagtgcgcga

SEQ ID NO: 84234 - DNA, 25 bp, Homo sapien
gcacagcccggctgtttccagccag

SEQ ID NO: 84235 - DNA, 25 bp, Homo sapien
cgtcccgagtagcaacttgagcttc

SEQ ID NO: 84236 - DNA, 25 bp, Homo sapien
tcggcttccgtaaaacatcatggcg

SEQ ID NO: 84237 - DNA, 25 bp, Homo sapien
ccgctgagcaaggactatcggcttc

SEQ ID NO: 84238 - DNA, 25 bp, Homo sapien
ctttgtggcaaagccgagagccgga

SEQ ID NO: 84239 - DNA, 25 bp, Homo sapien
tatgaagacacctacgcgtccctcg

SEQ ID NO: 84240 - DNA, 25 bp, Homo sapien
acggatgttgtcgatgaccgcggcc

SEQ ID NO: 84241 - DNA, 25 bp, Homo sapien
acttgagcttcactgccgacgagag

SEQ ID NO: 84242 - DNA, 25 bp, Homo sapien
gctctcgggaagaccgcaaaaaatg

SEQ ID NO: 84243 - DNA, 25 bp, Homo sapien
ctggagcgtcctaggttcctctaaa

SEQ ID NO: 84244 - DNA, 25 bp, Homo sapien
tgcacggcgctctttaaggccaaca

SEQ ID NO: 84245 - DNA, 25 bp, Homo sapien
gttctccggtctccgaggacaccga

SEQ ID NO: 84246 - DNA, 25 bp, Homo sapien
ggccaagcgtttgcatgcgcagctc

SEQ ID NO: 84247 - DNA, 25 bp, Homo sapien
gtcctctagactgcatccgccatgg

SEQ ID NO: 84248 - DNA, 25 bp, Homo sapien
aggcacacccgattcctggagcgtc

SEQ ID NO: 84249 - DNA, 25 bp, Homo sapien
tccgaatgggcgttttctagatacg

SEQ ID NO: 84250 - DNA, 25 bp, Homo sapien
gccctgagttcacgggactgaaatc

SEQ ID NO: 84251 - DNA, 25 bp, Homo sapien
aacctgagtatccaagcggcggagg

SEQ ID NO: 84252 - DNA, 25 bp, Homo sapien
cttggcatctgaaatccggacggtc

SEQ ID NO: 84253 - DNA, 25 bp, Homo sapien
ggcgcctctcagcttggcatctgaa

SEQ ID NO: 84254 - DNA, 25 bp, Homo sapien
ctgcgttgggtgtgccctcctcgaa

SEQ ID NO: 84255 - DNA, 25 bp, Homo sapien
tgcccacgtccgctgcgttgggtgt

SEQ ID NO: 84256 - DNA, 25 bp, Homo sapien
ctcgaacctgagtatccaagcggcg

SEQ ID NO: 84257 - DNA, 25 bp, Homo sapien
gaaatccggacggtctcggccgctc

SEQ ID NO: 84258 - DNA, 25 bp, Homo sapien
tgtgccctcctcgaacctgagtatc

SEQ ID NO: 84259 - DNA, 25 bp, Homo sapien
ctacgacggcatcatggagcgcatc

SEQ ID NO: 84260 - DNA, 25 bp, Homo sapien
ccgcatcttctacgacggcatcatg

SEQ ID NO: 84261 - DNA, 25 bp, Homo sapien
cctcccgacatggtctgcgagacga

SEQ ID NO: 84262 - DNA, 25 bp, Homo sapien
tgcatgcattgtgggcctcccgaca

SEQ ID NO: 84263 - DNA, 25 bp, Homo sapien
aatttatgaggggaagacagccggc

SEQ ID NO: 84264 - DNA, 25 bp, Homo sapien
cctcccgctcggtgctaatttatga

SEQ ID NO: 84265 - DNA, 25 bp, Homo sapien
ccggcgagtgcctaaatataatctg

SEQ ID NO: 84266 - DNA, 25 bp, Homo sapien
tggagcgcatccctaacacggcctt

SEQ ID NO: 84267 - DNA, 25 bp, Homo sapien
gtggccgcccacaagctctacgagt

SEQ ID NO: 84268 - DNA, 25 bp, Homo sapien
ggctgttgttcttcggcgacacttt

SEQ ID NO: 84269 - DNA, 25 bp, Homo sapien
gcttcagacacatgggcgccagtga

SEQ ID NO: 84270 - DNA, 25 bp, Homo sapien
agttcgccgtggtgcacaactactc

SEQ ID NO: 84271 - DNA, 25 bp, Homo sapien
ctcacgtttccgaggcaagggcatc

SEQ ID NO: 84272 - DNA, 25 bp, Homo sapien
gcggatgtctgtggactcacgtttc

SEQ ID NO: 84273 - DNA, 25 bp, Homo sapien
cggcctgctttcagacgctcaattg

SEQ ID NO: 84274 - DNA, 25 bp, Homo sapien
agtgaccactacgtgctgccgggca

SEQ ID NO: 84275 - DNA, 25 bp, Homo sapien
ggaagctgcaatgaatcctcagctc

SEQ ID NO: 84276 - DNA, 25 bp, Homo sapien
gcagatgtggcgctaccgctcctgg

SEQ ID NO: 84277 - DNA, 25 bp, Homo sapien
cacccccgtcaggaagtgccgaaag

SEQ ID NO: 84278 - DNA, 25 bp, Homo sapien
gtgccgaaagaggaagagagtcgcc

SEQ ID NO: 84279 - DNA, 25 bp, Homo sapien
ggggaagctgcaatgaatcctcagc

SEQ ID NO: 84280 - DNA, 25 bp, Homo sapien
gctgcaatgaatcctcagctctggg

SEQ ID NO: 84281 - DNA, 25 bp, Homo sapien
tgcaatgaatcctcagctctgggcc

SEQ ID NO: 84282 - DNA, 25 bp, Homo sapien
gggtcactgaggcagatgtggcgct

SEQ ID NO: 84283 - DNA, 25 bp, Homo sapien
gacacctaagcacgctgacaaaaca

SEQ ID NO: 84284 - DNA, 25 bp, Homo sapien
caccgcgacgcggagaacagcagga

SEQ ID NO: 84285 - DNA, 25 bp, Homo sapien
gcgcggccacaattaagggtgcttc

SEQ ID NO: 84286 - DNA, 25 bp, Homo sapien
ggtcacccagctgtgacacctaagc

SEQ ID NO: 84287 - DNA, 25 bp, Homo sapien
gaatcgccgtcgacaccgagctgca

SEQ ID NO: 84288 - DNA, 25 bp, Homo sapien
cccgcgtcagtcacctcaggaagtt

SEQ ID NO: 84289 - DNA, 25 bp, Homo sapien
agttccgcttgcttctcgcaggagc

SEQ ID NO: 84290 - DNA, 25 bp, Homo sapien
gccagcggcaaaaccttccttcgga

SEQ ID NO: 84291 - DNA, 25 bp, Homo sapien
ccgggccgagaatgttgacagatgc

SEQ ID NO: 84292 - DNA, 25 bp, Homo sapien
gcttagcaacagcacgtggtggccc

SEQ ID NO: 84293 - DNA, 25 bp, Homo sapien
ttgttttctccctggcgaagtcgcc

SEQ ID NO: 84294 - DNA, 25 bp, Homo sapien
cggccgccgtgcatgttaagtaggc

SEQ ID NO: 84295 - DNA, 25 bp, Homo sapien
acgcaggagcgtctccgctacgaga

SEQ ID NO: 84296 - DNA, 25 bp, Homo sapien
ccggccgcgctagtaacaatttaga

SEQ ID NO: 84297 - DNA, 25 bp, Homo sapien
gccagagcggcctatgtaaaacagg

SEQ ID NO: 84298 - DNA, 25 bp, Homo sapien
cgcacaatggggtgcgagcgctacc

SEQ ID NO: 84299 - DNA, 25 bp, Homo sapien
ccgggcaggtccttctcctacaagg

SEQ ID NO: 84300 - DNA, 25 bp, Homo sapien
caaggcagtagtgtctgtcgccggc

SEQ ID NO: 84301 - DNA, 25 bp, Homo sapien
cacaagccagcaaagccttggaggc

SEQ ID NO: 84302 - DNA, 25 bp, Homo sapien
gccagcaaagccttggaggcaaagg

SEQ ID NO: 84303 - DNA, 25 bp, Homo sapien
cacgcatgcgccgtcagcggcgaga

SEQ ID NO: 84304 - DNA, 25 bp, Homo sapien
gcactctgtcttcttgcgcggagcg

SEQ ID NO: 84305 - DNA, 25 bp, Homo sapien
ctcctacaaggcagtagtgtctgtc

SEQ ID NO: 84306 - DNA, 25 bp, Homo sapien
caggtccttctcctacaaggcagta

SEQ ID NO: 84307 - DNA, 25 bp, Homo sapien
cccacgtggcgtgagtcttttcaca

SEQ ID NO: 84308 - DNA, 25 bp, Homo sapien
tctaatttagggacacagcctcgtg

SEQ ID NO: 84309 - DNA, 25 bp, Homo sapien
tggaatggaagacccaccgtgatct

SEQ ID NO: 84310 - DNA, 25 bp, Homo sapien
tcccaagtccgccagcaatggaatg

SEQ ID NO: 84311 - DNA, 25 bp, Homo sapien
acgcgcatctgcgtctgtctgcaga

SEQ ID NO: 84312 - DNA, 25 bp, Homo sapien
gggaaacatgcacaactgcctggta

SEQ ID NO: 84313 - DNA, 25 bp, Homo sapien
ccggcatacactggaaacgcgcatc

SEQ ID NO: 84314 - DNA, 25 bp, Homo sapien
agcctcgtgacgtaaaccctgcaga

SEQ ID NO: 84315 - DNA, 25 bp, Homo sapien
acaggcacgcggctcacaccagggg

SEQ ID NO: 84316 - DNA, 25 bp, Homo sapien
tctgcgtctcgtttcagcccggtgt

SEQ ID NO: 84317 - DNA, 25 bp, Homo sapien
tttcagcccggtgtgagccaggcag

SEQ ID NO: 84318 - DNA, 25 bp, Homo sapien
gccacagtggtcagcaaagagaagt

SEQ ID NO: 84319 - DNA, 25 bp, Homo sapien
gacaggcacccggaacatcagaaac

SEQ ID NO: 84320 - DNA, 25 bp, Homo sapien
aacatcagaaacagggaagcgggcc

SEQ ID NO: 84321 - DNA, 25 bp, Homo sapien
cacggccacgggtctgcgtctcgtt

SEQ ID NO: 84322 - DNA, 25 bp, Homo sapien
agccaggcagccacagtggtcagca

SEQ ID NO: 84323 - DNA, 25 bp, Homo sapien
tgaccgtggctgagagcttcatgcc

SEQ ID NO: 84324 - DNA, 25 bp, Homo sapien
cacgcaggaatgcagaaggcagttg

SEQ ID NO: 84325 - DNA, 25 bp, Homo sapien
gtcatccatgaagaacacgcgctcc

SEQ ID NO: 84326 - DNA, 25 bp, Homo sapien
acccaaatgggccagctggggactc

SEQ ID NO: 84327 - DNA, 25 bp, Homo sapien
ctccttttccgaggcgggcaagctg

SEQ ID NO: 84328 - DNA, 25 bp, Homo sapien
gttgttgctcaagtcctcctccttt

SEQ ID NO: 84329 - DNA, 25 bp, Homo sapien
ctcggcctcgagattgttgttgctc

SEQ ID NO: 84330 - DNA, 25 bp, Homo sapien
tgggcgatcatctcagccgtctctg

SEQ ID NO: 84331 - DNA, 25 bp, Homo sapien
acattcagagcaatcgtgagggcga

SEQ ID NO: 84332 - DNA, 25 bp, Homo sapien
cggggaacctgactgcgcacctcgg

SEQ ID NO: 84333 - DNA, 25 bp, Homo sapien
cttctctgtgtaggtgttcaggtcc

SEQ ID NO: 84334 - DNA, 25 bp, Homo sapien
aggctgcgcgtcagctccttggcca

SEQ ID NO: 84335 - DNA, 25 bp, Homo sapien
gggcgcatggccatgctctccagct

SEQ ID NO: 84336 - DNA, 25 bp, Homo sapien
ttcatgatgatggagccggcggcca

SEQ ID NO: 84337 - DNA, 25 bp, Homo sapien
ggacgtcgaagtgcctcagcgcttc

SEQ ID NO: 84338 - DNA, 25 bp, Homo sapien
ccgcaggaggtttttcttacattca

SEQ ID NO: 84339 - DNA, 25 bp, Homo sapien
tggacgcaggtgatgagcataacgt

SEQ ID NO: 84340 - DNA, 25 bp, Homo sapien
caggggtcagggtctccacatctcc

SEQ ID NO: 84341 - DNA, 25 bp, Homo sapien
agcctcagccacagagccggggtgt

SEQ ID NO: 84342 - DNA, 25 bp, Homo sapien
caaagtcgcgagagtaccgtggacc

SEQ ID NO: 84343 - DNA, 25 bp, Homo sapien
tcgccgcggcaaagtcgcgagagta

SEQ ID NO: 84344 - DNA, 25 bp, Homo sapien
tgttccgcgataccgcgataaaacc

SEQ ID NO: 84345 - DNA, 25 bp, Homo sapien
gctgtgttccgcgataccgcgataa

SEQ ID NO: 84346 - DNA, 25 bp, Homo sapien
agcataacgttgtgcattcccgccg

SEQ ID NO: 84347 - DNA, 25 bp, Homo sapien
tggccactaagaggcaccaccacgt

SEQ ID NO: 84348 - DNA, 25 bp, Homo sapien
agccgtaccagtcacgtgggccaca

SEQ ID NO: 84349 - DNA, 25 bp, Homo sapien
gggttgcatgccctgtcacccacgt

SEQ ID NO: 84350 - DNA, 25 bp, Homo sapien
aaacgctgccggacgtgagccgtac

SEQ ID NO: 84351 - DNA, 25 bp, Homo sapien
agcttcctcagcacaaggtggagga

SEQ ID NO: 84352 - DNA, 25 bp, Homo sapien
ggaagtgccggcaccacgcagcacg

SEQ ID NO: 84353 - DNA, 25 bp, Homo sapien
agcccgaggaagtgccggcaccacg

SEQ ID NO: 84354 - DNA, 25 bp, Homo sapien
atctggacccaaacgctgccggacg

SEQ ID NO: 84355 - DNA, 25 bp, Homo sapien
caccttgggtttgtagagccacttt

SEQ ID NO: 84356 - DNA, 25 bp, Homo sapien
agggcgatgaagatctgtccaagtc

SEQ ID NO: 84357 - DNA, 25 bp, Homo sapien
ttcggatccgcctcagagacagggc

SEQ ID NO: 84358 - DNA, 25 bp, Homo sapien
agggagatctattccgggcccagga

SEQ ID NO: 84359 - DNA, 25 bp, Homo sapien
ctctctggacatggaaggacgggtc

SEQ ID NO: 84360 - DNA, 25 bp, Homo sapien
cggaggacctgtcccggattccaga

SEQ ID NO: 84361 - DNA, 25 bp, Homo sapien
gagccactttcggaacctgttcatc

SEQ ID NO: 84362 - DNA, 25 bp, Homo sapien
cagggccatcaggatcctctctgga

SEQ ID NO: 84363 - DNA, 25 bp, Homo sapien
ccgccttccttccacggctcgcgcg

SEQ ID NO: 84364 - DNA, 25 bp, Homo sapien
gcgtgggtcacagccacaaagctcc

SEQ ID NO: 84365 - DNA, 25 bp, Homo sapien
ggagatccagaaaggccgggcatcc

SEQ ID NO: 84366 - DNA, 25 bp, Homo sapien
gaaggcaacaatgagccgggcggcc

SEQ ID NO: 84367 - DNA, 25 bp, Homo sapien
cccgcgcgtccgaattaagcggcgg

SEQ ID NO: 84368 - DNA, 25 bp, Homo sapien
taagtgcgggaggcgaacctacctc

SEQ ID NO: 84369 - DNA, 25 bp, Homo sapien
ccgcgcccctcgtctttgtgtggaa

SEQ ID NO: 84370 - DNA, 25 bp, Homo sapien
cggccgcgtgggtcacagccacaaa

SEQ ID NO: 84371 - DNA, 25 bp, Homo sapien
gcgcctcatgtgtagtaccgtggga

SEQ ID NO: 84372 - DNA, 25 bp, Homo sapien
agcagccctcgcgagtgtacacttg

SEQ ID NO: 84373 - DNA, 25 bp, Homo sapien
acacttgtgagcgtgcagttgtttg

SEQ ID NO: 84374 - DNA, 25 bp, Homo sapien
agattcagtcccatccaggcgggcc

SEQ ID NO: 84375 - DNA, 25 bp, Homo sapien
gggccacttcggtactgacactgag

SEQ ID NO: 84376 - DNA, 25 bp, Homo sapien
agccgtcttggcgtgggcacccact

SEQ ID NO: 84377 - DNA, 25 bp, Homo sapien
atcggtcggcttggcactgtcaccg

SEQ ID NO: 84378 - DNA, 25 bp, Homo sapien
cggcagtctagtgcgcctcatgtgt

SEQ ID NO: 84379 - DNA, 25 bp, Homo sapien
accaaacggcagactccggacagcg

SEQ ID NO: 84380 - DNA, 25 bp, Homo sapien
gcggactgcggtgaaatgccagaaa

SEQ ID NO: 84381 - DNA, 25 bp, Homo sapien
caaacggcagactgcggacagcaga

SEQ ID NO: 84382 - DNA, 25 bp, Homo sapien
cagcggactgcggtgaaatgccaga

SEQ ID NO: 84383 - DNA, 25 bp, Homo sapien
cgcaatacgtaaaccaaacggcaga

SEQ ID NO: 84384 - DNA, 25 bp, Homo sapien
cggactgcggtgaaatgccagaaaa

SEQ ID NO: 84385 - DNA, 25 bp, Homo sapien
ccaaacggcagactccggacagcgg

SEQ ID NO: 84386 - DNA, 25 bp, Homo sapien
cagcagactgcggtgaaatgccaga

SEQ ID NO: 84387 - DNA, 25 bp, Homo sapien
gtcgcttggacacgggtggcatcct

SEQ ID NO: 84388 - DNA, 25 bp, Homo sapien
tcgcccgccaggtgggaggaaaaga

SEQ ID NO: 84389 - DNA, 25 bp, Homo sapien
ctgtctgtcctaaatcattccggtg

SEQ ID NO: 84390 - DNA, 25 bp, Homo sapien
gtcctaaatcattccggtgaacctc

SEQ ID NO: 84391 - DNA, 25 bp, Homo sapien
tccggtgaacctctccggctgcgta

SEQ ID NO: 84392 - DNA, 25 bp, Homo sapien
ctcgctgtctgtcctaaatcattcc

SEQ ID NO: 84393 - DNA, 25 bp, Homo sapien
ccaataaagagtgcggcccgcggtg

SEQ ID NO: 84394 - DNA, 25 bp, Homo sapien
cgccctcgcaggacgagcgcgtgca

SEQ ID NO: 84395 - DNA, 25 bp, Homo sapien
gcagatgcgaggtttaggcagcttc

SEQ ID NO: 84396 - DNA, 25 bp, Homo sapien
tctcttgccggaaggtgcgagttag

SEQ ID NO: 84397 - DNA, 25 bp, Homo sapien
cagatggttttcttatccaatagga

SEQ ID NO: 84398 - DNA, 25 bp, Homo sapien
cggcatctttctcgaggagctctcc

SEQ ID NO: 84399 - DNA, 25 bp, Homo sapien
ctttgcgggaaagcagcggtaagtc

SEQ ID NO: 84400 - DNA, 25 bp, Homo sapien
tggggcttagttcctagcctaggaa

SEQ ID NO: 84401 - DNA, 25 bp, Homo sapien
tgacgacgcctcctttgtgtgttcg

SEQ ID NO: 84402 - DNA, 25 bp, Homo sapien
tgcggacctaactagctccaggtta

SEQ ID NO: 84403 - DNA, 25 bp, Homo sapien
aataaacctggacgcttggaccctg

SEQ ID NO: 84404 - DNA, 25 bp, Homo sapien
cccgtctgagggacggaactggctc

SEQ ID NO: 84405 - DNA, 25 bp, Homo sapien
cctccgttagatcagcggctggaga

SEQ ID NO: 84406 - DNA, 25 bp, Homo sapien
cgcgcttgtaattcgctcccggagc

SEQ ID NO: 84407 - DNA, 25 bp, Homo sapien
gaccagatgttccagttcgcctcca

SEQ ID NO: 84408 - DNA, 25 bp, Homo sapien
cctccatcgatgtggcgggcaacct

SEQ ID NO: 84409 - DNA, 25 bp, Homo sapien
ggcaacctggactacaaggcgctca

SEQ ID NO: 84410 - DNA, 25 bp, Homo sapien
aggcgctcagctacgtgatcaccca

SEQ ID NO: 84411 - DNA, 25 bp, Homo sapien
gactccttcgattgtagctctgtgc

SEQ ID NO: 84412 - DNA, 25 bp, Homo sapien
ttgcatcatccacgtggctccgttg

SEQ ID NO: 84413 - DNA, 25 bp, Homo sapien
ccgtggccagataggagtttgcatc

SEQ ID NO: 84414 - DNA, 25 bp, Homo sapien
agctctgtgctgtcggattggaaca

SEQ ID NO: 84415 - DNA, 25 bp, Homo sapien
tgtagtctgtgcgtgagactccttc

SEQ ID NO: 84416 - DNA, 25 bp, Homo sapien
ccgttagctcgtgtgcgtgtagtct

SEQ ID NO: 84417 - DNA, 25 bp, Homo sapien
cgagaagttgatgctcggcccacgc

SEQ ID NO: 84418 - DNA, 25 bp, Homo sapien
ttggaacagtagttcccgccaagtc

SEQ ID NO: 84419 - DNA, 25 bp, Homo sapien
cgccctcctgccttcgcagctgctc

SEQ ID NO: 84420 - DNA, 25 bp, Homo sapien
cggcggccgccacacgcactctcgc

SEQ ID NO: 84421 - DNA, 25 bp, Homo sapien
cacgcactctcgctcccgcagctcc

SEQ ID NO: 84422 - DNA, 25 bp, Homo sapien
cccgccctcgtacctggcgcatctg

SEQ ID NO: 84423 - DNA, 25 bp, Homo sapien
cagcgcgtccactagggacggcgcg

SEQ ID NO: 84424 - DNA, 25 bp, Homo sapien
cggaggcgagcgatgagggcgtcgc

SEQ ID NO: 84425 - DNA, 25 bp, Homo sapien
ccggcctcgtggtacagggtgcaga

SEQ ID NO: 84426 - DNA, 25 bp, Homo sapien
gtccactagggacggcgcggcgtcc

SEQ ID NO: 84427 - DNA, 25 bp, Homo sapien
ggacacgcgcccagaaccgtctggt

SEQ ID NO: 84428 - DNA, 25 bp, Homo sapien
tccgtattcatttcccgtgggctca

SEQ ID NO: 84429 - DNA, 25 bp, Homo sapien
ctcgaatcttataggatccgtattc

SEQ ID NO: 84430 - DNA, 25 bp, Homo sapien
cccagtgatgaaagctcgaatctta

SEQ ID NO: 84431 - DNA, 25 bp, Homo sapien
tctggtgacccagtgatgaaagctc

SEQ ID NO: 84432 - DNA, 25 bp, Homo sapien
cccatcagcgcatattcaggatgaa

SEQ ID NO: 84433 - DNA, 25 bp, Homo sapien
atcagcgcatattcaggatgaaccc

SEQ ID NO: 84434 - DNA, 25 bp, Homo sapien
ccctcgcggcgagtgtccacgagga

SEQ ID NO: 84435 - DNA, 25 bp, Homo sapien
aggcccgcgacaacgccagtcttcg

SEQ ID NO: 84436 - DNA, 25 bp, Homo sapien
cactcacgggcgagaactaagcacc

SEQ ID NO: 84437 - DNA, 25 bp, Homo sapien
taagcacctactgtggacccggcgt

SEQ ID NO: 84438 - DNA, 25 bp, Homo sapien
ctcacgggcgagaactaagcaccta

SEQ ID NO: 84439 - DNA, 25 bp, Homo sapien
ggagggacagacacgctacctcact

SEQ ID NO: 84440 - DNA, 25 bp, Homo sapien
acgctacctcactcacgggcgagaa

SEQ ID NO: 84441 - DNA, 25 bp, Homo sapien
ctacctcactcacgggcgagaacta

SEQ ID NO: 84442 - DNA, 25 bp, Homo sapien
gtggacccggcgtctaggcccgcga

SEQ ID NO: 84443 - DNA, 25 bp, Homo sapien
gagggcaagaaaagccgcccactgg

SEQ ID NO: 84444 - DNA, 25 bp, Homo sapien
ccggaatccaaacttccctctgcag

SEQ ID NO: 84445 - DNA, 25 bp, Homo sapien
tgcggcgggcactcgctctccgccc

SEQ ID NO: 84446 - DNA, 25 bp, Homo sapien
cggagggcaagaaaagccgcccact

SEQ ID NO: 84447 - DNA, 25 bp, Homo sapien
ttcacggagggcaagaaaagccgcc

SEQ ID NO: 84448 - DNA, 25 bp, Homo sapien
cttcacggagggcaagaaaagccgc

SEQ ID NO: 84449 - DNA, 25 bp, Homo sapien
cgcgcttcacggagggcaagaaaag

SEQ ID NO: 84450 - DNA, 25 bp, Homo sapien
ccgcgcttcacggagggcaagaaaa

SEQ ID NO: 84451 - DNA, 25 bp, Homo sapien
gtgccgttttgcagaggccactttc

SEQ ID NO: 84452 - DNA, 25 bp, Homo sapien
ccaacctccttgcagcgtggggaaa

SEQ ID NO: 84453 - DNA, 25 bp, Homo sapien
tccaggctgcaccaacagatgtggg

SEQ ID NO: 84454 - DNA, 25 bp, Homo sapien
aggcttcttgattccaggctgcacc

SEQ ID NO: 84455 - DNA, 25 bp, Homo sapien
cctcgtttgcatcgaaggcttcttg

SEQ ID NO: 84456 - DNA, 25 bp, Homo sapien
ttccaaccaagctgtgtggactggc

SEQ ID NO: 84457 - DNA, 25 bp, Homo sapien
cctccatgcaggtgccgttttgcag

SEQ ID NO: 84458 - DNA, 25 bp, Homo sapien
gcgccggccgtggatttccaaccaa

SEQ ID NO: 84459 - DNA, 25 bp, Homo sapien
cgccaggtagccctacggcgcaagg

SEQ ID NO: 84460 - DNA, 25 bp, Homo sapien
catcgtggataaggtgctcactcca

SEQ ID NO: 84461 - DNA, 25 bp, Homo sapien
atgccgtatatgaccacgctctctg

SEQ ID NO: 84462 - DNA, 25 bp, Homo sapien
atatgaccacgctctctggggcctg

SEQ ID NO: 84463 - DNA, 25 bp, Homo sapien
tgcacggctactatcggcgcctcag

SEQ ID NO: 84464 - DNA, 25 bp, Homo sapien
cccgcttcatcgtggataaggtgct

SEQ ID NO: 84465 - DNA, 25 bp, Homo sapien
tggtagccgaggcatcgagcgccat

SEQ ID NO: 84466 - DNA, 25 bp, Homo sapien
tctggggcctgcacggctactatcg

SEQ ID NO: 84467 - DNA, 25 bp, Homo sapien
gaagccatgacctggcgcccgaagc

SEQ ID NO: 84468 - DNA, 25 bp, Homo sapien
agcatcctgcttgtgagaccggttc

SEQ ID NO: 84469 - DNA, 25 bp, Homo sapien
ccgcagatctttcatcgggatagga

SEQ ID NO: 84470 - DNA, 25 bp, Homo sapien
ttcgcttctgaggtgaggctagcta

SEQ ID NO: 84471 - DNA, 25 bp, Homo sapien
tccggcggaggtcaatcacaatgaa

SEQ ID NO: 84472 - DNA, 25 bp, Homo sapien
caatcgcagggtacgttgctcggca

SEQ ID NO: 84473 - DNA, 25 bp, Homo sapien
acaatgaaaccgtgtccagcggacc

SEQ ID NO: 84474 - DNA, 25 bp, Homo sapien
gcgctgcccacgattcgcttctgag

SEQ ID NO: 84475 - DNA, 25 bp, Homo sapien
tggtgtccacgttgcccattgctcg

SEQ ID NO: 84476 - DNA, 25 bp, Homo sapien
ctcagccaccgtgtgtctgtggtgt

SEQ ID NO: 84477 - DNA, 25 bp, Homo sapien
actcctcgtgccgtgttgtcatgca

SEQ ID NO: 84478 - DNA, 25 bp, Homo sapien
accatggttgctggtgtccacgttg

SEQ ID NO: 84479 - DNA, 25 bp, Homo sapien
gggtcggaacccaccatggttgctg

SEQ ID NO: 84480 - DNA, 25 bp, Homo sapien
ttgtcatgcagatgccaccttcgga

SEQ ID NO: 84481 - DNA, 25 bp, Homo sapien
acatccatgtctctcgtgaagcccg

SEQ ID NO: 84482 - DNA, 25 bp, Homo sapien
tgtccctcggtctcgtacatccatg

SEQ ID NO: 84483 - DNA, 25 bp, Homo sapien
caggctccacgcttgggttggtcga

SEQ ID NO: 84484 - DNA, 25 bp, Homo sapien
ctgagaaggcgaccacagcagggaa

SEQ ID NO: 84485 - DNA, 25 bp, Homo sapien
gggttggtcgagtccttactgtctc

SEQ ID NO: 84486 - DNA, 25 bp, Homo sapien
ctgagcagatcagccgcatcacgga

SEQ ID NO: 84487 - DNA, 25 bp, Homo sapien
ctggccacgagcgacagccgagaag

SEQ ID NO: 84488 - DNA, 25 bp, Homo sapien
tgggtcctggccacgagcgacagcc

SEQ ID NO: 84489 - DNA, 25 bp, Homo sapien
ttactgtctccagagggtgggtcct

SEQ ID NO: 84490 - DNA, 25 bp, Homo sapien
tcgagtccttactgtctccagaggg

SEQ ID NO: 84491 - DNA, 25 bp, Homo sapien
acggacggtcgcacagacgcggaac

SEQ ID NO: 84492 - DNA, 25 bp, Homo sapien
cctcgtaacagcgagagaaaacttg

SEQ ID NO: 84493 - DNA, 25 bp, Homo sapien
cttggctgtgggttagcagcaccct

SEQ ID NO: 84494 - DNA, 25 bp, Homo sapien
tacatctctgcacgttctcttccgg

SEQ ID NO: 84495 - DNA, 25 bp, Homo sapien
caggcttcggggattgcacaaaaaa

SEQ ID NO: 84496 - DNA, 25 bp, Homo sapien
cgacagccggcgagcaccctaaagg

SEQ ID NO: 84497 - DNA, 25 bp, Homo sapien
cctgagagaccagggtgagcacatc

SEQ ID NO: 84498 - DNA, 25 bp, Homo sapien
aatagccgcaaaggcaacggtcctg

SEQ ID NO: 84499 - DNA, 25 bp, Homo sapien
ccatggtgtggggtctgactcaccg

SEQ ID NO: 84500 - DNA, 25 bp, Homo sapien
cccgacggagtccaggatccagatg

SEQ ID NO: 84501 - DNA, 25 bp, Homo sapien
ttgactctcctacccaaatgcgggg

SEQ ID NO: 84502 - DNA, 25 bp, Homo sapien
tctggggaggccttgactctcctac

SEQ ID NO: 84503 - DNA, 25 bp, Homo sapien
gggtctgactcaccgccgcacggag

SEQ ID NO: 84504 - DNA, 25 bp, Homo sapien
acgcacccaggatggtctgcgagga

SEQ ID NO: 84505 - DNA, 25 bp, Homo sapien
ggaccgggtcaggaacgctgccacc

SEQ ID NO: 84506 - DNA, 25 bp, Homo sapien
cgtagcacactcccggcaaagttca

SEQ ID NO: 84507 - DNA, 25 bp, Homo sapien
gctaagggtccacgagaagtcttga

SEQ ID NO: 84508 - DNA, 25 bp, Homo sapien
tggcaaacccagagcaagctgactc

SEQ ID NO: 84509 - DNA, 25 bp, Homo sapien
ggcctggagactctagtcacctgta

SEQ ID NO: 84510 - DNA, 25 bp, Homo sapien
caaggcagttacctccagtctcggg

SEQ ID NO: 84511 - DNA, 25 bp, Homo sapien
cgcccaggatcagtggtgcaatctg

SEQ ID NO: 84512 - DNA, 25 bp, Homo sapien
cccagggaatgcgttttatagctaa

SEQ ID NO: 84513 - DNA, 25 bp, Homo sapien
tgtgctggttctagcgaagactggc

SEQ ID NO: 84514 - DNA, 25 bp, Homo sapien
ccagtctcggggaattaggatctcc

SEQ ID NO: 84515 - DNA, 25 bp, Homo sapien
cctgtccgaagtgagccacggcatt

SEQ ID NO: 84516 - DNA, 25 bp, Homo sapien
cgcaggctcggcttactcgccgata

SEQ ID NO: 84517 - DNA, 25 bp, Homo sapien
cagcacctccgactcgcgagaagta

SEQ ID NO: 84518 - DNA, 25 bp, Homo sapien
gcctgtgccgctcaacgaggaaacc

SEQ ID NO: 84519 - DNA, 25 bp, Homo sapien
tccggcccaggatctggaacttctg

SEQ ID NO: 84520 - DNA, 25 bp, Homo sapien
tgcctgttaactttcacctcgaacg

SEQ ID NO: 84521 - DNA, 25 bp, Homo sapien
ctcgaacggattggagttggccttc

SEQ ID NO: 84522 - DNA, 25 bp, Homo sapien
ggaaccgcttcctcgtctcgcgaga

SEQ ID NO: 84523 - DNA, 25 bp, Homo sapien
tgcctcttcagctggggtgctcacc

SEQ ID NO: 84524 - DNA, 25 bp, Homo sapien
tcctgggctttagtggcgcttagga

SEQ ID NO: 84525 - DNA, 25 bp, Homo sapien
ggcgctgaaactgcacaagctgaga

SEQ ID NO: 84526 - DNA, 25 bp, Homo sapien
agctcacagcagtgcgtggtgcctc

SEQ ID NO: 84527 - DNA, 25 bp, Homo sapien
tgtgccagggcatgaagatttccca

SEQ ID NO: 84528 - DNA, 25 bp, Homo sapien
gctgcgcccagatccttagagaagg

SEQ ID NO: 84529 - DNA, 25 bp, Homo sapien
acttgggcctttttcctgaactgtg

SEQ ID NO: 84530 - DNA, 25 bp, Homo sapien
ctgaactgtgcttcgcaggatgggc

SEQ ID NO: 84531 - DNA, 25 bp, Homo sapien
tcggctcagagtccacggccggctg

SEQ ID NO: 84532 - DNA, 25 bp, Homo sapien
cggctcagagtccacggccggctgt

SEQ ID NO: 84533 - DNA, 25 bp, Homo sapien
gctcagagtccacggccggctgtcg

SEQ ID NO: 84534 - DNA, 25 bp, Homo sapien
cccgtgcagagagccccgcagctgg

SEQ ID NO: 84535 - DNA, 25 bp, Homo sapien
gccgaccacgcgcattctctgcgct

SEQ ID NO: 84536 - DNA, 25 bp, Homo sapien
ccacgcgcattctctgcgctctgcg

SEQ ID NO: 84537 - DNA, 25 bp, Homo sapien
tgagtatggctctggccacgggcca

SEQ ID NO: 84538 - DNA, 25 bp, Homo sapien
cccgcagctggctccccgcagggct

SEQ ID NO: 84539 - DNA, 25 bp, Homo sapien
ggttccctggccagccattggcaga

SEQ ID NO: 84540 - DNA, 25 bp, Homo sapien
tctgcttttacctgcggcccagagc

SEQ ID NO: 84541 - DNA, 25 bp, Homo sapien
aggttctgcttttacctgcggccca

SEQ ID NO: 84542 - DNA, 25 bp, Homo sapien
ggacggccgctcaggttctgctttt

SEQ ID NO: 84543 - DNA, 25 bp, Homo sapien
cgggtccaagatggacggccgctca

SEQ ID NO: 84544 - DNA, 25 bp, Homo sapien
agggctgtcaatcatgctggccggc

SEQ ID NO: 84545 - DNA, 25 bp, Homo sapien
cgcaggctagggctgtcaatcatgc

SEQ ID NO: 84546 - DNA, 25 bp, Homo sapien
gagtccgcaggctagggctgtcaat

SEQ ID NO: 84547 - DNA, 25 bp, Homo sapien
actgacacgaacacccttagctggg

SEQ ID NO: 84548 - DNA, 25 bp, Homo sapien
gtcctggcaggacttataacaacag

SEQ ID NO: 84549 - DNA, 25 bp, Homo sapien
cacccttatctccttggtcttaaag

SEQ ID NO: 84550 - DNA, 25 bp, Homo sapien
acaaatctctgcctggtggtgcctg

SEQ ID NO: 84551 - DNA, 25 bp, Homo sapien
tctaggcgttgggattcagagatca

SEQ ID NO: 84552 - DNA, 25 bp, Homo sapien
cattgtcattgacgtccagcactga

SEQ ID NO: 84553 - DNA, 25 bp, Homo sapien
aggatgtggccgtcagcctctccca

SEQ ID NO: 84554 - DNA, 25 bp, Homo sapien
cgtccactcgctcattcagttgttg

SEQ ID NO: 84555 - DNA, 25 bp, Homo sapien
tgcagttgctctgttgctatggaaa

SEQ ID NO: 84556 - DNA, 25 bp, Homo sapien
ttcgacgagctcaagcagaccaagc

SEQ ID NO: 84557 - DNA, 25 bp, Homo sapien
attcctgcctgtcagatgtaggccc

SEQ ID NO: 84558 - DNA, 25 bp, Homo sapien
atggccagcaagctcttcgagatga

SEQ ID NO: 84559 - DNA, 25 bp, Homo sapien
cccgcaactggacggacgccgagat

SEQ ID NO: 84560 - DNA, 25 bp, Homo sapien
cgcaacgccaaggtgtacgagaaga

SEQ ID NO: 84561 - DNA, 25 bp, Homo sapien
ccgcaatattgatggcccgtcagtg

SEQ ID NO: 84562 - DNA, 25 bp, Homo sapien
gtgcagccctgattcctgtgctttc

SEQ ID NO: 84563 - DNA, 25 bp, Homo sapien
tataaccagtgctcctacgaaggcc

SEQ ID NO: 84564 - DNA, 25 bp, Homo sapien
ggccctattacctagccattgatgg

SEQ ID NO: 84565 - DNA, 25 bp, Homo sapien
cgagtcctgtgatggcaaactgccg

SEQ ID NO: 84566 - DNA, 25 bp, Homo sapien
cattgatgggattctggccaaggtc

SEQ ID NO: 84567 - DNA, 25 bp, Homo sapien
tctgtacttcccgtataaccagtgc

SEQ ID NO: 84568 - DNA, 25 bp, Homo sapien
agtgctcctacgaaggccgcttcga

SEQ ID NO: 84569 - DNA, 25 bp, Homo sapien
ggccgcttcgaggatgatcgctccg

SEQ ID NO: 84570 - DNA, 25 bp, Homo sapien
tgatggcaaactgccggacagccag

SEQ ID NO: 84571 - DNA, 25 bp, Homo sapien
tgaacagcagcgacggatgcgtctc

SEQ ID NO: 84572 - DNA, 25 bp, Homo sapien
gcccatcaaggcaggtgacaggaaa

SEQ ID NO: 84573 - DNA, 25 bp, Homo sapien
ggacttcctcggacaccgacggcga

SEQ ID NO: 84574 - DNA, 25 bp, Homo sapien
cacagccaggtttcccgggcacaga

SEQ ID NO: 84575 - DNA, 25 bp, Homo sapien
gagaaaaccagcttgcgggaacgca

SEQ ID NO: 84576 - DNA, 25 bp, Homo sapien
tgcgggtacacaccgtgcgcaccag

SEQ ID NO: 84577 - DNA, 25 bp, Homo sapien
acaccgacggcgaaggacagagaca

SEQ ID NO: 84578 - DNA, 25 bp, Homo sapien
aggggaagcgttttgagcccatcaa

SEQ ID NO: 84579 - DNA, 25 bp, Homo sapien
ctcagggcaggtttagatgtgaagc

SEQ ID NO: 84580 - DNA, 25 bp, Homo sapien
tcaacagccggcgttagtaagaggc

SEQ ID NO: 84581 - DNA, 25 bp, Homo sapien
tcctcgacgcgagggattctgttca

SEQ ID NO: 84582 - DNA, 25 bp, Homo sapien
tggcactgaaatggcgaggcaccct

SEQ ID NO: 84583 - DNA, 25 bp, Homo sapien
cccgtttgcagattgtaagtcttgg

SEQ ID NO: 84584 - DNA, 25 bp, Homo sapien
gcggggctagcgattcgtacttatt

SEQ ID NO: 84585 - DNA, 25 bp, Homo sapien
cgattcgtacttatttccgcgggcg

SEQ ID NO: 84586 - DNA, 25 bp, Homo sapien
tagtaagaggctgtgtcctcgacgc

SEQ ID NO: 84587 - DNA, 25 bp, Homo sapien
tgcgggcagagcagaaaatccactc

SEQ ID NO: 84588 - DNA, 25 bp, Homo sapien
ccaatggctgtctggaattcccggc

SEQ ID NO: 84589 - DNA, 25 bp, Homo sapien
ggctccattgagcttccttccacga

SEQ ID NO: 84590 - DNA, 25 bp, Homo sapien
acctggagtccgacagcttgcaagc

SEQ ID NO: 84591 - DNA, 25 bp, Homo sapien
atcgtgggctacttaggctccattg

SEQ ID NO: 84592 - DNA, 25 bp, Homo sapien
tgcggacttcctgccacgtgttcat

SEQ ID NO: 84593 - DNA, 25 bp, Homo sapien
tggtggacccagacttgtttaatca

SEQ ID NO: 84594 - DNA, 25 bp, Homo sapien
gcagttcatctctgtcctgtaccga

SEQ ID NO: 84595 - DNA, 25 bp, Homo sapien
ctgagaagagatgcgtctgaagcgt

SEQ ID NO: 84596 - DNA, 25 bp, Homo sapien
aacgtgggaggacgatctgtctgac

SEQ ID NO: 84597 - DNA, 25 bp, Homo sapien
ctcactgagaagagatgcgtctgaa

SEQ ID NO: 84598 - DNA, 25 bp, Homo sapien
ctgactcactgagaagagatgcgtc

SEQ ID NO: 84599 - DNA, 25 bp, Homo sapien
gcccacagctgactcactgagaaga

SEQ ID NO: 84600 - DNA, 25 bp, Homo sapien
ggggcccacagctgactcactgaga

SEQ ID NO: 84601 - DNA, 25 bp, Homo sapien
aggacgatctgtctgactcccttcc

SEQ ID NO: 84602 - DNA, 25 bp, Homo sapien
ccagcctcgaccctgcctgcgctcg

SEQ ID NO: 84603 - DNA, 25 bp, Homo sapien
gggcagcaagttttcagacagcatc

SEQ ID NO: 84604 - DNA, 25 bp, Homo sapien
atcagacgaagcgaagggcgctgct

SEQ ID NO: 84605 - DNA, 25 bp, Homo sapien
tttcagacagcatcagacgaagcga

SEQ ID NO: 84606 - DNA, 25 bp, Homo sapien
gtgctgggcagcaagttttcagaca

SEQ ID NO: 84607 - DNA, 25 bp, Homo sapien
tgtgtctcatgagcactgcccagcg

SEQ ID NO: 84608 - DNA, 25 bp, Homo sapien
cctccgtgtcgtgtgtctcatgagc

SEQ ID NO: 84609 - DNA, 25 bp, Homo sapien
cgtctgcatgccgtacaggtgccct

SEQ ID NO: 84610 - DNA, 25 bp, Homo sapien
tgttgccgcaacacacgtctgcatg

SEQ ID NO: 84611 - DNA, 25 bp, Homo sapien
ctgaactgctgcttgttggcggtgg

SEQ ID NO: 84612 - DNA, 25 bp, Homo sapien
ttctgcgtgtaggagaatctgcttg

SEQ ID NO: 84613 - DNA, 25 bp, Homo sapien
aggagaatctgcttgggaaaccaca

SEQ ID NO: 84614 - DNA, 25 bp, Homo sapien
gcttgggaaaccacagccctgcctg

SEQ ID NO: 84615 - DNA, 25 bp, Homo sapien
acagccctgcctgccgtggagatgg

SEQ ID NO: 84616 - DNA, 25 bp, Homo sapien
cacactgcagggctccatgcgggag

SEQ ID NO: 84617 - DNA, 25 bp, Homo sapien
ggcgcacactgcagggctccatgcg

SEQ ID NO: 84618 - DNA, 25 bp, Homo sapien
tggagatggacgcagcgtcccgctc

SEQ ID NO: 84619 - DNA, 25 bp, Homo sapien
cagacagacgctcatgcagggcaga

SEQ ID NO: 84620 - DNA, 25 bp, Homo sapien
cacacagaggatgcggtgagacctg

SEQ ID NO: 84621 - DNA, 25 bp, Homo sapien
aggctcgaggcagacagacgctcat

SEQ ID NO: 84622 - DNA, 25 bp, Homo sapien
tggctgctggcgacacgcagcagtc

SEQ ID NO: 84623 - DNA, 25 bp, Homo sapien
gcgacacgcagcagtcactctggct

SEQ ID NO: 84624 - DNA, 25 bp, Homo sapien
cccatgccatttgactggaaccttc

SEQ ID NO: 84625 - DNA, 25 bp, Homo sapien
ttgactggaaccttcactcttccct

SEQ ID NO: 84626 - DNA, 25 bp, Homo sapien
tcttccctcgcgagtctaccacggg

SEQ ID NO: 84627 - DNA, 25 bp, Homo sapien
actggcttttcaccactgtcaggtc

SEQ ID NO: 84628 - DNA, 25 bp, Homo sapien
gctctgtgaacgcaggcatccctgt

SEQ ID NO: 84629 - DNA, 25 bp, Homo sapien
atccctgtctccgttgggcggatgt

SEQ ID NO: 84630 - DNA, 25 bp, Homo sapien
gaggctggttgaggttccttgcaac

SEQ ID NO: 84631 - DNA, 25 bp, Homo sapien
tgcaacgcttgccatcctacgcatg

SEQ ID NO: 84632 - DNA, 25 bp, Homo sapien
catcctacgcatgatgcagggaccc

SEQ ID NO: 84633 - DNA, 25 bp, Homo sapien
cgagctccgagtgctgggccagctt

SEQ ID NO: 84634 - DNA, 25 bp, Homo sapien
accttccacgacaggctcgattcgt

SEQ ID NO: 84635 - DNA, 25 bp, Homo sapien
gctgagcaagcccatcccgtggcta

SEQ ID NO: 84636 - DNA, 25 bp, Homo sapien
gagcaagcccatcccgtggctagga

SEQ ID NO: 84637 - DNA, 25 bp, Homo sapien
tcccgtggctaggagtcagcgacat

SEQ ID NO: 84638 - DNA, 25 bp, Homo sapien
cgtggctaggagtcagcgacatatg

SEQ ID NO: 84639 - DNA, 25 bp, Homo sapien
tgagtgctcgtaggggcacgccgcc

SEQ ID NO: 84640 - DNA, 25 bp, Homo sapien
gtggagccagtagccgcagcccttc

SEQ ID NO: 84641 - DNA, 25 bp, Homo sapien
cagcccttccgggaacgtgggattg

SEQ ID NO: 84642 - DNA, 25 bp, Homo sapien
cggccagcgtgtgctgagcaagccc

SEQ ID NO: 84643 - DNA, 25 bp, Homo sapien
gctgtgccatatcccacatcgggtc

SEQ ID NO: 84644 - DNA, 25 bp, Homo sapien
tcctgtaaatgagccgccgagccga

SEQ ID NO: 84645 - DNA, 25 bp, Homo sapien
agggcttagctctggacactgtgcc

SEQ ID NO: 84646 - DNA, 25 bp, Homo sapien
tcgtgttgagaaggagcccacatgc

SEQ ID NO: 84647 - DNA, 25 bp, Homo sapien
cttcgcatccggaaggtgagcctcg

SEQ ID NO: 84648 - DNA, 25 bp, Homo sapien
caccgtgggtcaggacgtaactcac

SEQ ID NO: 84649 - DNA, 25 bp, Homo sapien
taactcacgtggcatacgcggcgcc

SEQ ID NO: 84650 - DNA, 25 bp, Homo sapien
ggccgttttgcagacacgtcaggca

SEQ ID NO: 84651 - DNA, 25 bp, Homo sapien
gacacaagtgccagattgcgggctg

SEQ ID NO: 84652 - DNA, 25 bp, Homo sapien
ggctacttcgactgcaagtccgacg

SEQ ID NO: 84653 - DNA, 25 bp, Homo sapien
aacatgctctgtgccggctacttcg

SEQ ID NO: 84654 - DNA, 25 bp, Homo sapien
acaagtgcagcagccctgaggtcta

SEQ ID NO: 84655 - DNA, 25 bp, Homo sapien
ctggtcgccgaccacaagtgcagca

SEQ ID NO: 84656 - DNA, 25 bp, Homo sapien
cacgctgagggcattgtgtcccaca

SEQ ID NO: 84657 - DNA, 25 bp, Homo sapien
ctgtgccacacgctcgcagttcgtg

SEQ ID NO: 84658 - DNA, 25 bp, Homo sapien
gtcccacagacgtgagcggctactc

SEQ ID NO: 84659 - DNA, 25 bp, Homo sapien
cggcgcggaaccatgacagaagatg

SEQ ID NO: 84660 - DNA, 25 bp, Homo sapien
aggcccggggcagtaatgccagctt

SEQ ID NO: 84661 - DNA, 25 bp, Homo sapien
gtaatgccagcttgcccaaaatcgc

SEQ ID NO: 84662 - DNA, 25 bp, Homo sapien
ccgccaggcgctggtctgagcgtct

SEQ ID NO: 84663 - DNA, 25 bp, Homo sapien
tctgagcgtctgagcccagatggtg

SEQ ID NO: 84664 - DNA, 25 bp, Homo sapien
gagcccagatggtgcgcttgctcca

SEQ ID NO: 84665 - DNA, 25 bp, Homo sapien
cagggccctgcgagctattttgaaa

SEQ ID NO: 84666 - DNA, 25 bp, Homo sapien
ctgcgagctattttgaaagtgaccc

SEQ ID NO: 84667 - DNA, 25 bp, Homo sapien
caggccatcatgctgggctttgaca

SEQ ID NO: 84668 - DNA, 25 bp, Homo sapien
ctgctgatgctggtctacaaggaca

SEQ ID NO: 84669 - DNA, 25 bp, Homo sapien
acgctccttgcagactgcctgctga

SEQ ID NO: 84670 - DNA, 25 bp, Homo sapien
tttgacagccacgaggccatgtgtg

SEQ ID NO: 84671 - DNA, 25 bp, Homo sapien
ttggtccacacgctggccattgtct

SEQ ID NO: 84672 - DNA, 25 bp, Homo sapien
gcctgccctacgagggcttggtcca

SEQ ID NO: 84673 - DNA, 25 bp, Homo sapien
cgcagcagcctgacgctagaggaca

SEQ ID NO: 84674 - DNA, 25 bp, Homo sapien
acaagtcggagcgtatcaagggcct

SEQ ID NO: 84675 - DNA, 25 bp, Homo sapien
gtgtccctggaatctacagcctgtg

SEQ ID NO: 84676 - DNA, 25 bp, Homo sapien
acagcctgtgttccgtgaaggcaga

SEQ ID NO: 84677 - DNA, 25 bp, Homo sapien
cctgcgtacctttctttgggcaatg

SEQ ID NO: 84678 - DNA, 25 bp, Homo sapien
ttctttgggcaatgggcagaggccc

SEQ ID NO: 84679 - DNA, 25 bp, Homo sapien
tgacgccagccggagtgtccagccg

SEQ ID NO: 84680 - DNA, 25 bp, Homo sapien
gcttctccacgggtggcggctgcat

SEQ ID NO: 84681 - DNA, 25 bp, Homo sapien
gcggctgcatcgctctgccagtgac

SEQ ID NO: 84682 - DNA, 25 bp, Homo sapien
ggttctaatgccgagatttcccttc

SEQ ID NO: 84683 - DNA, 25 bp, Homo sapien
tctacgcccagatcgacatcatggc

SEQ ID NO: 84684 - DNA, 25 bp, Homo sapien
cagaattctttcaggggctggcgcc

SEQ ID NO: 84685 - DNA, 25 bp, Homo sapien
acatcatggccaccgagacggcgca

SEQ ID NO: 84686 - DNA, 25 bp, Homo sapien
tggccaccgagacggcgcacagagt

SEQ ID NO: 84687 - DNA, 25 bp, Homo sapien
cagtgaggtcacagcgccaggagct

SEQ ID NO: 84688 - DNA, 25 bp, Homo sapien
gccaggagctgaccgcaaacccggt

SEQ ID NO: 84689 - DNA, 25 bp, Homo sapien
ggctgccgctcactacagaattctt

SEQ ID NO: 84690 - DNA, 25 bp, Homo sapien
gctgaccgcaaacccggtgcgctgt

SEQ ID NO: 84691 - DNA, 25 bp, Homo sapien
ttcctctgccagagcggaacacgga

SEQ ID NO: 84692 - DNA, 25 bp, Homo sapien
agaccttttttctgagcctcgctgc

SEQ ID NO: 84693 - DNA, 25 bp, Homo sapien
cgggactttcgctacctgttgcgta

SEQ ID NO: 84694 - DNA, 25 bp, Homo sapien
gtcggttccgcatccagcctagcgt

SEQ ID NO: 84695 - DNA, 25 bp, Homo sapien
tgctcggatttcttctcggcgctcc

SEQ ID NO: 84696 - DNA, 25 bp, Homo sapien
cgttattgcttagaggcggctacct

SEQ ID NO: 84697 - DNA, 25 bp, Homo sapien
ctgcgacgataaggcctggcgttat

SEQ ID NO: 84698 - DNA, 25 bp, Homo sapien
cccgctgttcgtatgtccgaggtga

SEQ ID NO: 84699 - DNA, 25 bp, Homo sapien
cccgccatcgtcggcggcctccacg

SEQ ID NO: 84700 - DNA, 25 bp, Homo sapien
gagggactgagggtcccggagccac

SEQ ID NO: 84701 - DNA, 25 bp, Homo sapien
ccgtggcgttggagcagttgagcag

SEQ ID NO: 84702 - DNA, 25 bp, Homo sapien
cgttggagcagttgagcaggctgat

SEQ ID NO: 84703 - DNA, 25 bp, Homo sapien
tgagcaggctgatcgcgagcaggaa

SEQ ID NO: 84704 - DNA, 25 bp, Homo sapien
caggaacacccagcggcgcgcgtag

SEQ ID NO: 84705 - DNA, 25 bp, Homo sapien
aacacccagcggcgcgcgtaggtgc

SEQ ID NO: 84706 - DNA, 25 bp, Homo sapien
gctggtccgagggactgagggtccc

SEQ ID NO: 84707 - DNA, 25 bp, Homo sapien
ccaacgctggcacgggtgagcatct

SEQ ID NO: 84708 - DNA, 25 bp, Homo sapien
tgagcatctgtgactctgggaatac

SEQ ID NO: 84709 - DNA, 25 bp, Homo sapien
actctgggaatacccgtgccaggca

SEQ ID NO: 84710 - DNA, 25 bp, Homo sapien
aggcaggccacgttatcccgaacca

SEQ ID NO: 84711 - DNA, 25 bp, Homo sapien
taactgcctatcaacaggaagctcg

SEQ ID NO: 84712 - DNA, 25 bp, Homo sapien
aggaagctcgtacatcaccgcggcc

SEQ ID NO: 84713 - DNA, 25 bp, Homo sapien
taccagcagctcacatgtggggtgt

SEQ ID NO: 84714 - DNA, 25 bp, Homo sapien
acacacggatgggacctgggctcag

SEQ ID NO: 84715 - DNA, 25 bp, Homo sapien
cacggcagtcaacgcgtggacactg

SEQ ID NO: 84716 - DNA, 25 bp, Homo sapien
ccggagactgttgagacgccgactg

SEQ ID NO: 84717 - DNA, 25 bp, Homo sapien
acactggagactgctgagacgccga

SEQ ID NO: 84718 - DNA, 25 bp, Homo sapien
gacactggagactgctgagacgccg

SEQ ID NO: 84719 - DNA, 25 bp, Homo sapien
tgttgagacgccgactggagtcaca

SEQ ID NO: 84720 - DNA, 25 bp, Homo sapien
tggagtcacacacggcagtcaacgc

SEQ ID NO: 84721 - DNA, 25 bp, Homo sapien
ctggagtcacacacggcagtcaacg

SEQ ID NO: 84722 - DNA, 25 bp, Homo sapien
caacgcgtggacaccggagactgtt

SEQ ID NO: 84723 - DNA, 25 bp, Homo sapien
atggcgagccctgcaagcttgcagc

SEQ ID NO: 84724 - DNA, 25 bp, Homo sapien
cagtgtcgcgaggtggtgctcacca

SEQ ID NO: 84725 - DNA, 25 bp, Homo sapien
cgcgaggtggtgctcaccacatcca

SEQ ID NO: 84726 - DNA, 25 bp, Homo sapien
atccaaggccatcccggtgcaggtg

SEQ ID NO: 84727 - DNA, 25 bp, Homo sapien
aagcttgcagcctcacgcatccgca

SEQ ID NO: 84728 - DNA, 25 bp, Homo sapien
gccctgcgcaaccaggccaccatgg

SEQ ID NO: 84729 - DNA, 25 bp, Homo sapien
accatggtgcagaaggccaagcggc

SEQ ID NO: 84730 - DNA, 25 bp, Homo sapien
acatccaaggccatcccggtgcagg

SEQ ID NO: 84731 - DNA, 25 bp, Homo sapien
tccaggctcagacacgggaagggaa

SEQ ID NO: 84732 - DNA, 25 bp, Homo sapien
gagcctcttccaggctcagacacgg

SEQ ID NO: 84733 - DNA, 25 bp, Homo sapien
gcctcttccaggctcagacacggga

SEQ ID NO: 84734 - DNA, 25 bp, Homo sapien
tcagacacgggaagggaaccacgcc

SEQ ID NO: 84735 - DNA, 25 bp, Homo sapien
cctcttccaggctcagacacgggaa

SEQ ID NO: 84736 - DNA, 25 bp, Homo sapien
ctcagacacgggaagggaaccacgc

SEQ ID NO: 84737 - DNA, 25 bp, Homo sapien
tcagacacgggaagggaaccacgct

SEQ ID NO: 84738 - DNA, 25 bp, Homo sapien
cagacacgggaagggaaccacgctc

SEQ ID NO: 84739 - DNA, 25 bp, Homo sapien
cttcagagttcgttgtgccgagctc

SEQ ID NO: 84740 - DNA, 25 bp, Homo sapien
ctcagcctcatgtcaggagacgcgc

SEQ ID NO: 84741 - DNA, 25 bp, Homo sapien
tggacagaaacgtctcatcagctgg

SEQ ID NO: 84742 - DNA, 25 bp, Homo sapien
ctctggagatcctgccggacaggtc

SEQ ID NO: 84743 - DNA, 25 bp, Homo sapien
caagagcccaggtccttcacgctgg

SEQ ID NO: 84744 - DNA, 25 bp, Homo sapien
gctgtccacggaaatgccacggcca

SEQ ID NO: 84745 - DNA, 25 bp, Homo sapien
ctgcagtcaccagaaacaatccttc

SEQ ID NO: 84746 - DNA, 25 bp, Homo sapien
gcagatgcttcttcacctgtggaca

SEQ ID NO: 84747 - DNA, 25 bp, Homo sapien
tgggaggccatcacactagcaacgg

SEQ ID NO: 84748 - DNA, 25 bp, Homo sapien
gcgtgcctcagcttctcgtgcgcaa

SEQ ID NO: 84749 - DNA, 25 bp, Homo sapien
cgtgcgcaatctccagctgcttctg

SEQ ID NO: 84750 - DNA, 25 bp, Homo sapien
ctgcttctggtagtggttgtgcttc

SEQ ID NO: 84751 - DNA, 25 bp, Homo sapien
ggttgtgcttctcgattttggcttc

SEQ ID NO: 84752 - DNA, 25 bp, Homo sapien
ttgagctcctcctggaacaaggttt

SEQ ID NO: 84753 - DNA, 25 bp, Homo sapien
ccgggtgaactgcaaggacgccaaa

SEQ ID NO: 84754 - DNA, 25 bp, Homo sapien
caaggtttccataggtgagtgttcc

SEQ ID NO: 84755 - DNA, 25 bp, Homo sapien
gacgttctcgtggatttctgtaaaa

SEQ ID NO: 84756 - DNA, 25 bp, Homo sapien
gcgagtgaccttcacggagcagctc

SEQ ID NO: 84757 - DNA, 25 bp, Homo sapien
aggttcccgtcgctacaagcacctg

SEQ ID NO: 84758 - DNA, 25 bp, Homo sapien
cctggttgatgctgcgcagcttctc

SEQ ID NO: 84759 - DNA, 25 bp, Homo sapien
tgcccttgatgtcgctcaggtccga

SEQ ID NO: 84760 - DNA, 25 bp, Homo sapien
tgctggggagctcaaactcgctctc

SEQ ID NO: 84761 - DNA, 25 bp, Homo sapien
ctcgctctcatttctgggctgaaaa

SEQ ID NO: 84762 - DNA, 25 bp, Homo sapien
agaaacgaccgttggcacagcttcc

SEQ ID NO: 84763 - DNA, 25 bp, Homo sapien
accgagcccttagagctcctgggga

SEQ ID NO: 84764 - DNA, 25 bp, Homo sapien
tggacctcagcatggagggtgccaa

SEQ ID NO: 84765 - DNA, 25 bp, Homo sapien
ctgggttcttctgcatggaatggag

SEQ ID NO: 84766 - DNA, 25 bp, Homo sapien
ctgcatggaatggagtcacagagca

SEQ ID NO: 84767 - DNA, 25 bp, Homo sapien
gcctcaggagcaccgagcccttaga

SEQ ID NO: 84768 - DNA, 25 bp, Homo sapien
ctcctggggaggatgaacacggccc

SEQ ID NO: 84769 - DNA, 25 bp, Homo sapien
tccctgcctggggaagtcggacgcc

SEQ ID NO: 84770 - DNA, 25 bp, Homo sapien
ggaggacggacgtcatcccacacgc

SEQ ID NO: 84771 - DNA, 25 bp, Homo sapien
cgtaccattgaggttgcgtatgagt

SEQ ID NO: 84772 - DNA, 25 bp, Homo sapien
acgagcaggacggaccaggacacag

SEQ ID NO: 84773 - DNA, 25 bp, Homo sapien
gtatcttcagatcagcgtggagctc

SEQ ID NO: 84774 - DNA, 25 bp, Homo sapien
aggcgagttcgtccctctcctgtat

SEQ ID NO: 84775 - DNA, 25 bp, Homo sapien
gctttagtttcttccaggcgagttc

SEQ ID NO: 84776 - DNA, 25 bp, Homo sapien
tcgtccaagccgtcaagctttagtt

SEQ ID NO: 84777 - DNA, 25 bp, Homo sapien
gcgtatgagtctcgcttccttctcc

SEQ ID NO: 84778 - DNA, 25 bp, Homo sapien
gacacagcgagaaactgacctcgga

SEQ ID NO: 84779 - DNA, 25 bp, Homo sapien
attgtagttcctccgtgagcggccg

SEQ ID NO: 84780 - DNA, 25 bp, Homo sapien
ggagcccgcgcagaaacgacctgac

SEQ ID NO: 84781 - DNA, 25 bp, Homo sapien
ctctggcaggggatacaactggaga

SEQ ID NO: 84782 - DNA, 25 bp, Homo sapien
cacgggtacctttcctgctgcagaa

SEQ ID NO: 84783 - DNA, 25 bp, Homo sapien
cgctgcgcggagaaaacctagcctg

SEQ ID NO: 84784 - DNA, 25 bp, Homo sapien
ggcgcaagcgtttcccaggcaacca

SEQ ID NO: 84785 - DNA, 25 bp, Homo sapien
aatgctccggcttcacgcgcactga

SEQ ID NO: 84786 - DNA, 25 bp, Homo sapien
gacgccgactcttgcatgtccagtg

SEQ ID NO: 84787 - DNA, 25 bp, Homo sapien
ttgcagctgtgccatggtgacggca

SEQ ID NO: 84788 - DNA, 25 bp, Homo sapien
acagtcatgcgacattgcagctgtg

SEQ ID NO: 84789 - DNA, 25 bp, Homo sapien
cagctgtgccatggtgacggcaaga

SEQ ID NO: 84790 - DNA, 25 bp, Homo sapien
gcacaggcacgcgacattgcagctg

SEQ ID NO: 84791 - DNA, 25 bp, Homo sapien
cacaggcacgcgacattgcagctgt

SEQ ID NO: 84792 - DNA, 25 bp, Homo sapien
acaggcacgcgacattgcagctgtg

SEQ ID NO: 84793 - DNA, 25 bp, Homo sapien
tgcagctgtgccatggtgacggcaa

SEQ ID NO: 84794 - DNA, 25 bp, Homo sapien
agctgtgccatggtgacggcaagac

SEQ ID NO: 84795 - DNA, 25 bp, Homo sapien
gaaggcgcaaatgccgcccgtactg

SEQ ID NO: 84796 - DNA, 25 bp, Homo sapien
gccgccagcccagaacccgcaaacc

SEQ ID NO: 84797 - DNA, 25 bp, Homo sapien
tgccagtcccacgaaggcgcaaatg

SEQ ID NO: 84798 - DNA, 25 bp, Homo sapien
tctcaggacagtgccagtcccacga

SEQ ID NO: 84799 - DNA, 25 bp, Homo sapien
cagtggtctcgcttcccacccaaga

SEQ ID NO: 84800 - DNA, 25 bp, Homo sapien
caagcctccacactgcgcggtgccc

SEQ ID NO: 84801 - DNA, 25 bp, Homo sapien
gagctaatgactcccgactcctgct

SEQ ID NO: 84802 - DNA, 25 bp, Homo sapien
gggacgagctaatgactcccgactc

SEQ ID NO: 84803 - DNA, 25 bp, Homo sapien
cacgtgctctgtgagtcggtttcca

SEQ ID NO: 84804 - DNA, 25 bp, Homo sapien
cacttgctccgcgttggtccgtttc

SEQ ID NO: 84805 - DNA, 25 bp, Homo sapien
gtttcctgggactcccgcgtgctct

SEQ ID NO: 84806 - DNA, 25 bp, Homo sapien
atttccggggctctcacttgctccg

SEQ ID NO: 84807 - DNA, 25 bp, Homo sapien
atgaagcggtggctcccgcgtgctt

SEQ ID NO: 84808 - DNA, 25 bp, Homo sapien
cccgcgtgctctgcgttggtcgatt

SEQ ID NO: 84809 - DNA, 25 bp, Homo sapien
ctctgcgcaggtcggtttcctggga

SEQ ID NO: 84810 - DNA, 25 bp, Homo sapien
ctgtgagtcggtttccaggactctc

SEQ ID NO: 84811 - DNA, 25 bp, Homo sapien
cgcgcgttgtagataaggtgaagaa

SEQ ID NO: 84812 - DNA, 25 bp, Homo sapien
tgaactctgttcctcgcgcgttgta

SEQ ID NO: 84813 - DNA, 25 bp, Homo sapien
tcacctccgcggtcgccaaaaagaa

SEQ ID NO: 84814 - DNA, 25 bp, Homo sapien
caggatgcagcaccgaggcttcctc

SEQ ID NO: 84815 - DNA, 25 bp, Homo sapien
gccagggattcagactcgggctctc

SEQ ID NO: 84816 - DNA, 25 bp, Homo sapien
gccaccttagcagcccgacttgggg

SEQ ID NO: 84817 - DNA, 25 bp, Homo sapien
cggctcagaccggttctggagacaa

SEQ ID NO: 84818 - DNA, 25 bp, Homo sapien
gtcgggagaccaccgctcggaagat

SEQ ID NO: 84819 - DNA, 25 bp, Homo sapien
actgcagctccatcggtttaaaatg

SEQ ID NO: 84820 - DNA, 25 bp, Homo sapien
aattggctatttgtgctgctggccc

SEQ ID NO: 84821 - DNA, 25 bp, Homo sapien
gctcacggttcattctgcagctgtc

SEQ ID NO: 84822 - DNA, 25 bp, Homo sapien
cttccacgacacagcgtcatcgaga

SEQ ID NO: 84823 - DNA, 25 bp, Homo sapien
gtcatcgagacgtggtttcatctta

SEQ ID NO: 84824 - DNA, 25 bp, Homo sapien
ttcatcttagcgaacgctgtctgtc

SEQ ID NO: 84825 - DNA, 25 bp, Homo sapien
tccatcttcaaagccgagttgctgg

SEQ ID NO: 84826 - DNA, 25 bp, Homo sapien
tgctgctggcccaaacactggctgg

SEQ ID NO: 84827 - DNA, 25 bp, Homo sapien
tctgtctgtaggtttccacgtgccc

SEQ ID NO: 84828 - DNA, 25 bp, Homo sapien
cctgatcttcgtgttggccgcgcct

SEQ ID NO: 84829 - DNA, 25 bp, Homo sapien
gcgcctcgagctccagatgcaccat

SEQ ID NO: 84830 - DNA, 25 bp, Homo sapien
gcaccatccgcctacacgcctgaca

SEQ ID NO: 84831 - DNA, 25 bp, Homo sapien
ctgacaccctgcttggacaccgagg

SEQ ID NO: 84832 - DNA, 25 bp, Homo sapien
accctgcttggacaccgaggaagcg

SEQ ID NO: 84833 - DNA, 25 bp, Homo sapien
ctcagtctgtctgtaggtttccacg

SEQ ID NO: 84834 - DNA, 25 bp, Homo sapien
gtcgcccttttcctcagtctgtctg

SEQ ID NO: 84835 - DNA, 25 bp, Homo sapien
cgccgatcaaccatgctggccgagg

SEQ ID NO: 84836 - DNA, 25 bp, Homo sapien
ggggccctctccgtgagaatcagag

SEQ ID NO: 84837 - DNA, 25 bp, Homo sapien
agaggtcacacaagccacagctgta

SEQ ID NO: 84838 - DNA, 25 bp, Homo sapien
cagctgtaaacgctcatcaaagagc

SEQ ID NO: 84839 - DNA, 25 bp, Homo sapien
tcgacgagttctgccgctagtgaca

SEQ ID NO: 84840 - DNA, 25 bp, Homo sapien
ccgaggccagttcagctgccgatta

SEQ ID NO: 84841 - DNA, 25 bp, Homo sapien
ctgccgattaaccatgctggccggg

SEQ ID NO: 84842 - DNA, 25 bp, Homo sapien
gcacgataggccactcgacgagttc

SEQ ID NO: 84843 - DNA, 25 bp, Homo sapien
catgcgtgagtcatgctctcagaaa

SEQ ID NO: 84844 - DNA, 25 bp, Homo sapien
gcgtgcgtcatgctctcagaaacac

SEQ ID NO: 84845 - DNA, 25 bp, Homo sapien
tgcgtgcgtcatgctctcagaaaca

SEQ ID NO: 84846 - DNA, 25 bp, Homo sapien
cgcatgcgtgcgtcatgctctcaga

SEQ ID NO: 84847 - DNA, 25 bp, Homo sapien
cgcatgcgtgagtcatgctctcaga

SEQ ID NO: 84848 - DNA, 25 bp, Homo sapien
tgcgtgagtcatgctctcagaaaca

SEQ ID NO: 84849 - DNA, 25 bp, Homo sapien
atgcgtgcgtcatgctctcagaaac

SEQ ID NO: 84850 - DNA, 25 bp, Homo sapien
atgcgtgagtcatgctctcagaaac

SEQ ID NO: 84851 - DNA, 25 bp, Homo sapien
accatcgtggccgtgtggctcatct

SEQ ID NO: 84852 - DNA, 25 bp, Homo sapien
gacgcaggccgtcgagtacaacctg

SEQ ID NO: 84853 - DNA, 25 bp, Homo sapien
tcatggcctactggtacttcgggca

SEQ ID NO: 84854 - DNA, 25 bp, Homo sapien
tcatgcccttctcgttggccaacga

SEQ ID NO: 84855 - DNA, 25 bp, Homo sapien
cgctcgatgtgctgttttgcacctc

SEQ ID NO: 84856 - DNA, 25 bp, Homo sapien
accgctactggtcggtgacgcaggc

SEQ ID NO: 84857 - DNA, 25 bp, Homo sapien
ttgcacctcgtcgatcgtgcatctg

SEQ ID NO: 84858 - DNA, 25 bp, Homo sapien
tctgcacttacacgctcggcagctg

SEQ ID NO: 84859 - DNA, 25 bp, Homo sapien
tttttctatcacatccatcggcagg

SEQ ID NO: 84860 - DNA, 25 bp, Homo sapien
cacatccatcggcagggctcaaata

SEQ ID NO: 84861 - DNA, 25 bp, Homo sapien
gggctcaaatattccgtgccgtgtc

SEQ ID NO: 84862 - DNA, 25 bp, Homo sapien
ttccgtgccgtgtcggatcaaaaca

SEQ ID NO: 84863 - DNA, 25 bp, Homo sapien
tcggatcaaaacacacggcgcctgc

SEQ ID NO: 84864 - DNA, 25 bp, Homo sapien
ctgcaggcccatctcgaggctggtt

SEQ ID NO: 84865 - DNA, 25 bp, Homo sapien
tctcgaggctggttggacagccacg

SEQ ID NO: 84866 - DNA, 25 bp, Homo sapien
ggcagccggctgtatttttctatca

SEQ ID NO: 84867 - DNA, 25 bp, Homo sapien
gcgggagactcgacttgcactttaa

SEQ ID NO: 84868 - DNA, 25 bp, Homo sapien
tgcactttaataggctctcccagga

SEQ ID NO: 84869 - DNA, 25 bp, Homo sapien
tcccaggagccgttgtccagaggga

SEQ ID NO: 84870 - DNA, 25 bp, Homo sapien
gcgcggctcgaacactcacagagga

SEQ ID NO: 84871 - DNA, 25 bp, Homo sapien
ctcgaggtcatgtcctggtgaggaa

SEQ ID NO: 84872 - DNA, 25 bp, Homo sapien
ttacggtcccttttactgatgagga

SEQ ID NO: 84873 - DNA, 25 bp, Homo sapien
gacggcactgggtccaagttgccca

SEQ ID NO: 84874 - DNA, 25 bp, Homo sapien
cagctgtgcgccttgacgtaaaatc

SEQ ID NO: 84875 - DNA, 25 bp, Homo sapien
tctgggaaccctgcggggtgaccac

SEQ ID NO: 84876 - DNA, 25 bp, Homo sapien
ctgcggggtgaccacagcacgtgac

SEQ ID NO: 84877 - DNA, 25 bp, Homo sapien
ggggtgaccacagcacgtgacgggc

SEQ ID NO: 84878 - DNA, 25 bp, Homo sapien
aaccctgcggggtgaccacagcacg

SEQ ID NO: 84879 - DNA, 25 bp, Homo sapien
cctgcggggtgaccacagcacgtga

SEQ ID NO: 84880 - DNA, 25 bp, Homo sapien
ctctgggaaccctgcggggtgacca

SEQ ID NO: 84881 - DNA, 25 bp, Homo sapien
cggggtgaccacagcacgtgacggg

SEQ ID NO: 84882 - DNA, 25 bp, Homo sapien
gaaccctgcggggtgaccacagcac

SEQ ID NO: 84883 - DNA, 25 bp, Homo sapien
cccgagaccgcaggtcagtgagtcc

SEQ ID NO: 84884 - DNA, 25 bp, Homo sapien
ccgagaccgcaggtcagtgagtccg

SEQ ID NO: 84885 - DNA, 25 bp, Homo sapien
cgagaccgcaggtcagtgagtccgc

SEQ ID NO: 84886 - DNA, 25 bp, Homo sapien
agaccgcaggtcagtgagtccgccc

SEQ ID NO: 84887 - DNA, 25 bp, Homo sapien
gcccagacgcacaccgcgcatgctc

SEQ ID NO: 84888 - DNA, 25 bp, Homo sapien
ggagcccagacgcacaccgcgcatg

SEQ ID NO: 84889 - DNA, 25 bp, Homo sapien
gcgtgcgccttgctcgcccgcagcc

SEQ ID NO: 84890 - DNA, 25 bp, Homo sapien
cccgcgtgcgccttgctcgcccgca

SEQ ID NO: 84891 - DNA, 25 bp, Homo sapien
aagtgtccttatcagccacggggcg

SEQ ID NO: 84892 - DNA, 25 bp, Homo sapien
atggctgtcacacactcattgcctg

SEQ ID NO: 84893 - DNA, 25 bp, Homo sapien
ctgcttcgtcacaatctggatcttg

SEQ ID NO: 84894 - DNA, 25 bp, Homo sapien
cactgcctgagctggactcattgga

SEQ ID NO: 84895 - DNA, 25 bp, Homo sapien
ccgcttcttgcgcacctggttgcga

SEQ ID NO: 84896 - DNA, 25 bp, Homo sapien
gctctgcttcattagtgggctcttg

SEQ ID NO: 84897 - DNA, 25 bp, Homo sapien
cgtggcaggcacaatctcaatggct

SEQ ID NO: 84898 - DNA, 25 bp, Homo sapien
tggatcttggaccatctggaggctg

SEQ ID NO: 84899 - DNA, 25 bp, Homo sapien
accagaatttgcatgtctctgtcta

SEQ ID NO: 84900 - DNA, 25 bp, Homo sapien
cggtccacaccctgggctaggccct

SEQ ID NO: 84901 - DNA, 25 bp, Homo sapien
tcatagaccagaatttgcatgtctc

SEQ ID NO: 84902 - DNA, 25 bp, Homo sapien
atagaccagaatttgcatgtctctg

SEQ ID NO: 84903 - DNA, 25 bp, Homo sapien
agaccagaatttgcatgtctctgtc

SEQ ID NO: 84904 - DNA, 25 bp, Homo sapien
ccagaatttgcatgtctctgtctag

SEQ ID NO: 84905 - DNA, 25 bp, Homo sapien
cagaatttgcatgtctctgtctaga

SEQ ID NO: 84906 - DNA, 25 bp, Homo sapien
gaatttgcatgtctctgtctagagc

SEQ ID NO: 84907 - DNA, 25 bp, Homo sapien
tgctgacctgggattctacgagctc

SEQ ID NO: 84908 - DNA, 25 bp, Homo sapien
ccgtcactggctctctgaattgggg

SEQ ID NO: 84909 - DNA, 25 bp, Homo sapien
gaccctgcgaccgaggcgcttgcag

SEQ ID NO: 84910 - DNA, 25 bp, Homo sapien
cccggaaacgctgggtgacaagaag

SEQ ID NO: 84911 - DNA, 25 bp, Homo sapien
cgctgggtgacaagaagtgcctgcc

SEQ ID NO: 84912 - DNA, 25 bp, Homo sapien
tccgagcgtccgacggtctgtactc

SEQ ID NO: 84913 - DNA, 25 bp, Homo sapien
cggtctgtactcgtccctgcgtatt

SEQ ID NO: 84914 - DNA, 25 bp, Homo sapien
gcgcccgtcactggctctctgaatt

SEQ ID NO: 84915 - DNA, 25 bp, Homo sapien
cggcctcaaaggttccgctctcatg

SEQ ID NO: 84916 - DNA, 25 bp, Homo sapien
agctttgccggtggaagagttccca

SEQ ID NO: 84917 - DNA, 25 bp, Homo sapien
ccgctctcatgtcggcaagtgtgat

SEQ ID NO: 84918 - DNA, 25 bp, Homo sapien
ctgtgttctcttcgctgtttagtta

SEQ ID NO: 84919 - DNA, 25 bp, Homo sapien
gcccgcgaggagtccatcttggtac

SEQ ID NO: 84920 - DNA, 25 bp, Homo sapien
gaagcccaggaggaccaggattacc

SEQ ID NO: 84921 - DNA, 25 bp, Homo sapien
gtctggacctcctggcgtttggatt

SEQ ID NO: 84922 - DNA, 25 bp, Homo sapien
cgtttggattggagactgtgttctc

SEQ ID NO: 84923 - DNA, 25 bp, Homo sapien
cccagtggaagtgacgccaacggaa

SEQ ID NO: 84924 - DNA, 25 bp, Homo sapien
agaattcgcttctgaaccacccagc

SEQ ID NO: 84925 - DNA, 25 bp, Homo sapien
cctctcaggcttcgcggtgcagaat

SEQ ID NO: 84926 - DNA, 25 bp, Homo sapien
cgtctctgggcactcgaggataccc

SEQ ID NO: 84927 - DNA, 25 bp, Homo sapien
agcatttgctctgtgccgggcatca

SEQ ID NO: 84928 - DNA, 25 bp, Homo sapien
ctgtagttgagagtagcgcttaaga

SEQ ID NO: 84929 - DNA, 25 bp, Homo sapien
gaagggcatggacccaccgctcctt

SEQ ID NO: 84930 - DNA, 25 bp, Homo sapien
tctgtttccttccacgctgtagttg

SEQ ID NO: 84931 - DNA, 25 bp, Homo sapien
tttctcctttctaagcgcctcgcgc

SEQ ID NO: 84932 - DNA, 25 bp, Homo sapien
agcactaaggagcaccctgctctgg

SEQ ID NO: 84933 - DNA, 25 bp, Homo sapien
gcctccgccattgctgcgagcagga

SEQ ID NO: 84934 - DNA, 25 bp, Homo sapien
gggatgcccatctcccggagtacgc

SEQ ID NO: 84935 - DNA, 25 bp, Homo sapien
gatgagggtctagaaatacacagca

SEQ ID NO: 84936 - DNA, 25 bp, Homo sapien
gtctagaaatacacagcaccacccg

SEQ ID NO: 84937 - DNA, 25 bp, Homo sapien
ggccgtggagcccaatcgttcgctc

SEQ ID NO: 84938 - DNA, 25 bp, Homo sapien
aaggagcaccctgctctggtctccg

SEQ ID NO: 84939 - DNA, 25 bp, Homo sapien
ttgttccgcgtcttcacggtcttga

SEQ ID NO: 84940 - DNA, 25 bp, Homo sapien
ctggcccggaatagcagcgtgatgt

SEQ ID NO: 84941 - DNA, 25 bp, Homo sapien
agcgtgatgtccaccgccatagcga

SEQ ID NO: 84942 - DNA, 25 bp, Homo sapien
cgggcatcggtttctcccagcaaag

SEQ ID NO: 84943 - DNA, 25 bp, Homo sapien
cccagcaaagcttggagggtttagc

SEQ ID NO: 84944 - DNA, 25 bp, Homo sapien
agcgagctcttctgtgtctgtttgg

SEQ ID NO: 84945 - DNA, 25 bp, Homo sapien
aagctaggaggctccttcccttctg

SEQ ID NO: 84946 - DNA, 25 bp, Homo sapien
ctccctcactgagaccgggcggttt

SEQ ID NO: 84947 - DNA, 25 bp, Homo sapien
taacctcgtgggtgacagtgtgacc

SEQ ID NO: 84948 - DNA, 25 bp, Homo sapien
acagtgtgacctgggttttctccga

SEQ ID NO: 84949 - DNA, 25 bp, Homo sapien
cccagcgtaacctcgtgggtgacag

SEQ ID NO: 84950 - DNA, 25 bp, Homo sapien
tcccacgggcagaagagcctggcct

SEQ ID NO: 84951 - DNA, 25 bp, Homo sapien
cccagacgccgcagggcagacaaag

SEQ ID NO: 84952 - DNA, 25 bp, Homo sapien
cctcgggatcaagtgtcagcgccgc

SEQ ID NO: 84953 - DNA, 25 bp, Homo sapien
cctaatgagggactcgctgggcctc

SEQ ID NO: 84954 - DNA, 25 bp, Homo sapien
ttttctccgatacgcgcgatgtgcc

SEQ ID NO: 84955 - DNA, 25 bp, Homo sapien
ccggcgctttactgcttctcacgaa

SEQ ID NO: 84956 - DNA, 25 bp, Homo sapien
cgccggctgctccagaaatcgcaga

SEQ ID NO: 84957 - DNA, 25 bp, Homo sapien
gactgcctccaggaagaacttgctg

SEQ ID NO: 84958 - DNA, 25 bp, Homo sapien
ctcagcgacttgacagcagtgattc

SEQ ID NO: 84959 - DNA, 25 bp, Homo sapien
tgattcagacttcaacttgggcgga

SEQ ID NO: 84960 - DNA, 25 bp, Homo sapien
ttccagagaaaacgactgagcggta

SEQ ID NO: 84961 - DNA, 25 bp, Homo sapien
aggctgcgagacctacccacagaga

SEQ ID NO: 84962 - DNA, 25 bp, Homo sapien
ccgccttaggcgcagagattcagag

SEQ ID NO: 84963 - DNA, 25 bp, Homo sapien
ttgtgcccaacacttccgttgcggg

SEQ ID NO: 84964 - DNA, 25 bp, Homo sapien
aggcgaagatttggcaccgacattg

SEQ ID NO: 84965 - DNA, 25 bp, Homo sapien
cgggagaggagactccagagtccaa

SEQ ID NO: 84966 - DNA, 25 bp, Homo sapien
tcttgggcattcactccatggctct

SEQ ID NO: 84967 - DNA, 25 bp, Homo sapien
taggtcttcggttcttgggcattca

SEQ ID NO: 84968 - DNA, 25 bp, Homo sapien
ggcactgtgtttcccgagtcctcga

SEQ ID NO: 84969 - DNA, 25 bp, Homo sapien
ctcaaggtcgtagatggaggactcc

SEQ ID NO: 84970 - DNA, 25 bp, Homo sapien
cgcacctggagaagcctccgagagc

SEQ ID NO: 84971 - DNA, 25 bp, Homo sapien
ccgtgcatcgctgcagagggtgact

SEQ ID NO: 84972 - DNA, 25 bp, Homo sapien
cgtgctgtcgcctcatgaggacgcc

SEQ ID NO: 84973 - DNA, 25 bp, Homo sapien
tgcccgcccatgcatcgctggggag

SEQ ID NO: 84974 - DNA, 25 bp, Homo sapien
aggagcgcccgtgcatcgctgcaga

SEQ ID NO: 84975 - DNA, 25 bp, Homo sapien
ctgccggagtatgccaagcacgagg

SEQ ID NO: 84976 - DNA, 25 bp, Homo sapien
cctgctgccggagtatgccaagcac

SEQ ID NO: 84977 - DNA, 25 bp, Homo sapien
atgaggacgccgatgtggccctgct

SEQ ID NO: 84978 - DNA, 25 bp, Homo sapien
gtcgcctcatgaggacgccgatgtg

SEQ ID NO: 84979 - DNA, 25 bp, Homo sapien
gcaattagcgatgcggcccttttca

SEQ ID NO: 84980 - DNA, 25 bp, Homo sapien
gaggaatcgtgacacattgtttatc

SEQ ID NO: 84981 - DNA, 25 bp, Homo sapien
acatcctagtctgcctattaggcgc

SEQ ID NO: 84982 - DNA, 25 bp, Homo sapien
cgcgcttttctgacacggaattgag

SEQ ID NO: 84983 - DNA, 25 bp, Homo sapien
cactcttctcgcctagcaacgttta

SEQ ID NO: 84984 - DNA, 25 bp, Homo sapien
gacacgaacccaggccgaacctata

SEQ ID NO: 84985 - DNA, 25 bp, Homo sapien
cctataaagaagacaccgtggcgtt

SEQ ID NO: 84986 - DNA, 25 bp, Homo sapien
gccgctggcgccttaaaacaacatc

SEQ ID NO: 84987 - DNA, 25 bp, Homo sapien
ctacagcttttattgcgcccagtta

SEQ ID NO: 84988 - DNA, 25 bp, Homo sapien
agccggcccaactcgagctagaagc

SEQ ID NO: 84989 - DNA, 25 bp, Homo sapien
tgcccagtgcctgagttgcagtctt

SEQ ID NO: 84990 - DNA, 25 bp, Homo sapien
tgcagtcttgggtcctttagaaacc

SEQ ID NO: 84991 - DNA, 25 bp, Homo sapien
cctcagcatatctcggcggcctgtg

SEQ ID NO: 84992 - DNA, 25 bp, Homo sapien
tgtccctccgcgctcggataattac

SEQ ID NO: 84993 - DNA, 25 bp, Homo sapien
ccgcagtcatcaatggcagggccga

SEQ ID NO: 84994 - DNA, 25 bp, Homo sapien
tcagatgccggtattcccgaacttc

SEQ ID NO: 84995 - DNA, 25 bp, Homo sapien
gacttctttgccactcggtgtcaaa

SEQ ID NO: 84996 - DNA, 25 bp, Homo sapien
ccggctgctgacatgacttctttgc

SEQ ID NO: 84997 - DNA, 25 bp, Homo sapien
cctgcgtacctgcagccggtgctag

SEQ ID NO: 84998 - DNA, 25 bp, Homo sapien
ccggccagtgagtagccagaaccca

SEQ ID NO: 84999 - DNA, 25 bp, Homo sapien
gaagatgcgctcgtcaaagccgaga

SEQ ID NO: 85000 - DNA, 25 bp, Homo sapien
ggcctcgccttattagcaagttctc

SEQ ID NO: 85001 - DNA, 25 bp, Homo sapien
ctcatggccgaccacaggaagccgg

SEQ ID NO: 85002 - DNA, 25 bp, Homo sapien
ggggactcctcaagctgccagaaga

SEQ ID NO: 85003 - DNA, 25 bp, Homo sapien
ccaaggcaaagagactacaagaggc

SEQ ID NO: 85004 - DNA, 25 bp, Homo sapien
ctggagaagctgaagatggccgcca

SEQ ID NO: 85005 - DNA, 25 bp, Homo sapien
gtgcctcgctctacggtgcctctgg

SEQ ID NO: 85006 - DNA, 25 bp, Homo sapien
aagcagtacctgtccatcgccgagc

SEQ ID NO: 85007 - DNA, 25 bp, Homo sapien
tccgccagaagcagtacctgtccat

SEQ ID NO: 85008 - DNA, 25 bp, Homo sapien
caagacgaaccgtaagccgcggacg

SEQ ID NO: 85009 - DNA, 25 bp, Homo sapien
cgcaaacacaagacgaaccgtaagc

SEQ ID NO: 85010 - DNA, 25 bp, Homo sapien
aagatggccgccaagcccatgctgc

SEQ ID NO: 85011 - DNA, 25 bp, Homo sapien
ccggacagtctgcagtaagccgtta

SEQ ID NO: 85012 - DNA, 25 bp, Homo sapien
cttgaacaggggtgaacagcttcac

SEQ ID NO: 85013 - DNA, 25 bp, Homo sapien
ttaggtcggtctaggaattcccagc

SEQ ID NO: 85014 - DNA, 25 bp, Homo sapien
ggtacctggcgttggacttgaacag

SEQ ID NO: 85015 - DNA, 25 bp, Homo sapien
cgttaagccggaggtcagtagacta

SEQ ID NO: 85016 - DNA, 25 bp, Homo sapien
tccacgcaggatagcgccggacagt

SEQ ID NO: 85017 - DNA, 25 bp, Homo sapien
cgctctgttgtctttcgtgttcggg

SEQ ID NO: 85018 - DNA, 25 bp, Homo sapien
agatggttcgaaacctgggtacctg

SEQ ID NO: 85019 - DNA, 25 bp, Homo sapien
tgagcaacggctcaccctctgcaga

SEQ ID NO: 85020 - DNA, 25 bp, Homo sapien
ggtgcatctgacttttcttggctta

SEQ ID NO: 85021 - DNA, 25 bp, Homo sapien
ttcttggcttactgcgcgcccgcag

SEQ ID NO: 85022 - DNA, 25 bp, Homo sapien
tccgcgcgttcgtgatagggaaatg

SEQ ID NO: 85023 - DNA, 25 bp, Homo sapien
tggctccttggagtttggcaattta

SEQ ID NO: 85024 - DNA, 25 bp, Homo sapien
gggtagaggcaaatttagagcaaca

SEQ ID NO: 85025 - DNA, 25 bp, Homo sapien
taattgcggtaatgagcaacggctc

SEQ ID NO: 85026 - DNA, 25 bp, Homo sapien
acccagggaataccgggtgcatctg

SEQ ID NO: 85027 - DNA, 25 bp, Homo sapien
tagtttctcggatcgctgaacccgg

SEQ ID NO: 85028 - DNA, 25 bp, Homo sapien
tctgaatttaactccttgcgctcta

SEQ ID NO: 85029 - DNA, 25 bp, Homo sapien
gcgctctaaccacgaacaggcactg

SEQ ID NO: 85030 - DNA, 25 bp, Homo sapien
aggcactgtcccttgaggaatgata

SEQ ID NO: 85031 - DNA, 25 bp, Homo sapien
gccctgcacgctgtgaaagcgtttt

SEQ ID NO: 85032 - DNA, 25 bp, Homo sapien
tcagcttctgaccacgcagtcaaga

SEQ ID NO: 85033 - DNA, 25 bp, Homo sapien
ctcgcgctaagagcgccttacttta

SEQ ID NO: 85034 - DNA, 25 bp, Homo sapien
cctcgagctttgagcataggtccgc

SEQ ID NO: 85035 - DNA, 25 bp, Homo sapien
aggatgtttctcttccctacggagc

SEQ ID NO: 85036 - DNA, 25 bp, Homo sapien
cggaagaaacttcgcagccttgcag

SEQ ID NO: 85037 - DNA, 25 bp, Homo sapien
agagtgaagcatcgccgggacccaa

SEQ ID NO: 85038 - DNA, 25 bp, Homo sapien
ctacggagctcacccggattccttg

SEQ ID NO: 85039 - DNA, 25 bp, Homo sapien
gacccaaggatgtttctcttcccta

SEQ ID NO: 85040 - DNA, 25 bp, Homo sapien
cggggccagctgaacctcagttgtg

SEQ ID NO: 85041 - DNA, 25 bp, Homo sapien
gcggagtccgttgcggacaccctca

SEQ ID NO: 85042 - DNA, 25 bp, Homo sapien
ttcgcagccttgcagagtgaagcat

SEQ ID NO: 85043 - DNA, 25 bp, Homo sapien
ttcctgccctaggaattgatgccag

SEQ ID NO: 85044 - DNA, 25 bp, Homo sapien
attcctgccctaggaattgatgcca

SEQ ID NO: 85045 - DNA, 25 bp, Homo sapien
tcctgccctaggaattgatgccagc

SEQ ID NO: 85046 - DNA, 25 bp, Homo sapien
cctgccctaggaattgatgccagcg

SEQ ID NO: 85047 - DNA, 25 bp, Homo sapien
ctgccctaggaattgatgccagcgc

SEQ ID NO: 85048 - DNA, 25 bp, Homo sapien
gtggggaatcgagcgccccatccct

SEQ ID NO: 85049 - DNA, 25 bp, Homo sapien
cgcgtggggaatcgagcgccccatc

SEQ ID NO: 85050 - DNA, 25 bp, Homo sapien
ttgatgccagcgcccagtatggccc

SEQ ID NO: 85051 - DNA, 25 bp, Homo sapien
tttgactcacacttcaattcctgcc

SEQ ID NO: 85052 - DNA, 25 bp, Homo sapien
cccgacttatcggaataattgtctc

SEQ ID NO: 85053 - DNA, 25 bp, Homo sapien
ttgaacagaagcagaacgtgagtcc

SEQ ID NO: 85054 - DNA, 25 bp, Homo sapien
gttgtgtccattgaacagaagcaga

SEQ ID NO: 85055 - DNA, 25 bp, Homo sapien
agcacctgggatttgactcacactt

SEQ ID NO: 85056 - DNA, 25 bp, Homo sapien
aattgtctccattccgcttcggcgg

SEQ ID NO: 85057 - DNA, 25 bp, Homo sapien
tccgcttcggcggtgtctgttgtgt

SEQ ID NO: 85058 - DNA, 25 bp, Homo sapien
gcagaacgtgagtccgtatctgccc

SEQ ID NO: 85059 - DNA, 25 bp, Homo sapien
ccgccgctcaggagacatcaagcaa

SEQ ID NO: 85060 - DNA, 25 bp, Homo sapien
gttcaaggaaccacagccgagcgcc

SEQ ID NO: 85061 - DNA, 25 bp, Homo sapien
tccgttctaccgaccggcaggagaa

SEQ ID NO: 85062 - DNA, 25 bp, Homo sapien
catcaagcaagaagacggcgcaaaa

SEQ ID NO: 85063 - DNA, 25 bp, Homo sapien
ggcgcaaaagatcaccgaatacaag

SEQ ID NO: 85064 - DNA, 25 bp, Homo sapien
ccagacatcaaaggaggaacgccca

SEQ ID NO: 85065 - DNA, 25 bp, Homo sapien
cgcccaagcaatcgttcaaggaacc

SEQ ID NO: 85066 - DNA, 25 bp, Homo sapien
gagctcggtttgcagtccagcgaac

SEQ ID NO: 85067 - DNA, 25 bp, Homo sapien
cgaccgcccctttatgcaggctggg

SEQ ID NO: 85068 - DNA, 25 bp, Homo sapien
accgagggctccgagacctgcagga

SEQ ID NO: 85069 - DNA, 25 bp, Homo sapien
gctccgagacctgcaggaggttgaa

SEQ ID NO: 85070 - DNA, 25 bp, Homo sapien
ttgaagtcgcgggtgatctcctggc

SEQ ID NO: 85071 - DNA, 25 bp, Homo sapien
agtcgcgggtgatctcctggctcag

SEQ ID NO: 85072 - DNA, 25 bp, Homo sapien
ctcagggcccgcatgcgggagtagc

SEQ ID NO: 85073 - DNA, 25 bp, Homo sapien
cccgcatgcgggagtagcaggtcgg

SEQ ID NO: 85074 - DNA, 25 bp, Homo sapien
gtggggccagcgcaggctgcggtcc

SEQ ID NO: 85075 - DNA, 25 bp, Homo sapien
cgccgggtccacactcagtcatcgc

SEQ ID NO: 85076 - DNA, 25 bp, Homo sapien
gtcatcgccatccacgccgggtcca

SEQ ID NO: 85077 - DNA, 25 bp, Homo sapien
gccgggtccacactcagtcatcgcc

SEQ ID NO: 85078 - DNA, 25 bp, Homo sapien
gacatcgccatccacgccgggtcca

SEQ ID NO: 85079 - DNA, 25 bp, Homo sapien
cgtcatcacctgtctgcgctgggtc

SEQ ID NO: 85080 - DNA, 25 bp, Homo sapien
tgcgctgggtccacactcgcgtcat

SEQ ID NO: 85081 - DNA, 25 bp, Homo sapien
tcatcacctgtctgcgctgggtcca

SEQ ID NO: 85082 - DNA, 25 bp, Homo sapien
tcgcgtcatcacctgtctgcgctgg

SEQ ID NO: 85083 - DNA, 25 bp, Homo sapien
aggcatggccacttcgcccagcgaa

SEQ ID NO: 85084 - DNA, 25 bp, Homo sapien
cgcgtgcccacgacgcatttggtct

SEQ ID NO: 85085 - DNA, 25 bp, Homo sapien
aaccgaggtttccttgagagcctga

SEQ ID NO: 85086 - DNA, 25 bp, Homo sapien
gagttgaacccgaaacctgcacttg

SEQ ID NO: 85087 - DNA, 25 bp, Homo sapien
ctcctaggtacccagtgccgtttag

SEQ ID NO: 85088 - DNA, 25 bp, Homo sapien
cccagcgaatgcagtgtgtgcccga

SEQ ID NO: 85089 - DNA, 25 bp, Homo sapien
agcgagaggtgcgaattcccgcttc

SEQ ID NO: 85090 - DNA, 25 bp, Homo sapien
gcgcttctgctgaggcaactcctag

SEQ ID NO: 85091 - DNA, 25 bp, Homo sapien
ctctcagctgcgtggtccacatgtc

SEQ ID NO: 85092 - DNA, 25 bp, Homo sapien
agctgcgtggtccacatgtctctcg

SEQ ID NO: 85093 - DNA, 25 bp, Homo sapien
ccacatgtctctcggtggccgaatc

SEQ ID NO: 85094 - DNA, 25 bp, Homo sapien
atgtctctcggtggccgaatccagc

SEQ ID NO: 85095 - DNA, 25 bp, Homo sapien
tcggtggccgaatccagcagggcca

SEQ ID NO: 85096 - DNA, 25 bp, Homo sapien
tgaggctgtgggcagtaccacactc

SEQ ID NO: 85097 - DNA, 25 bp, Homo sapien
tgtgggcagtaccacactcaggagc

SEQ ID NO: 85098 - DNA, 25 bp, Homo sapien
gcaccatggccatcctcgccaggta

SEQ ID NO: 85099 - DNA, 25 bp, Homo sapien
tccttacctgcgtgctgctctcggg

SEQ ID NO: 85100 - DNA, 25 bp, Homo sapien
tgcttgcgcccaaaccgaatcagag

SEQ ID NO: 85101 - DNA, 25 bp, Homo sapien
tgtcgggacccgctacctcaaagcg

SEQ ID NO: 85102 - DNA, 25 bp, Homo sapien
acccgctacctcaaagcggcgggtg

SEQ ID NO: 85103 - DNA, 25 bp, Homo sapien
gagccgccgccgaaagttttctgga

SEQ ID NO: 85104 - DNA, 25 bp, Homo sapien
tttctggaacaaacacccgcatctg

SEQ ID NO: 85105 - DNA, 25 bp, Homo sapien
aaacacccgcatctggggcttggcg

SEQ ID NO: 85106 - DNA, 25 bp, Homo sapien
ggcctgggtttgcttgcgcccaaac

SEQ ID NO: 85107 - DNA, 25 bp, Homo sapien
ctctgcgactccttgagcctggttg

SEQ ID NO: 85108 - DNA, 25 bp, Homo sapien
gaacttcgcacgcaaccgcttaggc

SEQ ID NO: 85109 - DNA, 25 bp, Homo sapien
ctccttgagcctggttgggaacttc

SEQ ID NO: 85110 - DNA, 25 bp, Homo sapien
ccagcgcacgcgacaccaggtgggt

SEQ ID NO: 85111 - DNA, 25 bp, Homo sapien
ctcggcctcggcctttggcttggct

SEQ ID NO: 85112 - DNA, 25 bp, Homo sapien
cctgcaagagcgacgcgcggctgct

SEQ ID NO: 85113 - DNA, 25 bp, Homo sapien
cacgcaaccgcttaggcgtcgggtt

SEQ ID NO: 85114 - DNA, 25 bp, Homo sapien
tgggaacttcgcacgcaaccgctta

SEQ ID NO: 85115 - DNA, 25 bp, Homo sapien
ctgtctgactggaaccggcgctctc

SEQ ID NO: 85116 - DNA, 25 bp, Homo sapien
ggtccggacttccactccatcagta

SEQ ID NO: 85117 - DNA, 25 bp, Homo sapien
ttccactccatcagtaaaggcgggg

SEQ ID NO: 85118 - DNA, 25 bp, Homo sapien
gagcgctggatgatctttttccctc

SEQ ID NO: 85119 - DNA, 25 bp, Homo sapien
cttaccgtgatgtgcgggatgctct

SEQ ID NO: 85120 - DNA, 25 bp, Homo sapien
ggatgctcttcttgccctggtacga

SEQ ID NO: 85121 - DNA, 25 bp, Homo sapien
ttcttgccctggtacgacatggccc

SEQ ID NO: 85122 - DNA, 25 bp, Homo sapien
aaccaggaagcgcttcccttccgat

SEQ ID NO: 85123 - DNA, 25 bp, Homo sapien
tgctcccaagcagatttcgccggta

SEQ ID NO: 85124 - DNA, 25 bp, Homo sapien
tctgccggcagaaagtaaaaccctc

SEQ ID NO: 85125 - DNA, 25 bp, Homo sapien
ggcacccgttgcgaagccctggagc

SEQ ID NO: 85126 - DNA, 25 bp, Homo sapien
tttcgccggtacaaagcgccgcagc

SEQ ID NO: 85127 - DNA, 25 bp, Homo sapien
ttccacagtcgcgaagctcgagtgc

SEQ ID NO: 85128 - DNA, 25 bp, Homo sapien
ggccaaacagatcgctgctcccaag

SEQ ID NO: 85129 - DNA, 25 bp, Homo sapien
ctgccactggccaaacagatcgctg

SEQ ID NO: 85130 - DNA, 25 bp, Homo sapien
aatccttgcgcctgcgccgcagaaa

SEQ ID NO: 85131 - DNA, 25 bp, Homo sapien
atgctggcgttggtgacattgaccg

SEQ ID NO: 85132 - DNA, 25 bp, Homo sapien
tgacattgaccgcagttccagagga

SEQ ID NO: 85133 - DNA, 25 bp, Homo sapien
ttccagaggaactctccttgggaca

SEQ ID NO: 85134 - DNA, 25 bp, Homo sapien
actctccttgggacagctacgggcc

SEQ ID NO: 85135 - DNA, 25 bp, Homo sapien
agctacgggccgtgcacaaagcgcc

SEQ ID NO: 85136 - DNA, 25 bp, Homo sapien
ctagtactccaccacgctttgagga

SEQ ID NO: 85137 - DNA, 25 bp, Homo sapien
cacgctttgaggaaggccggaagaa

SEQ ID NO: 85138 - DNA, 25 bp, Homo sapien
ccaccacgctttgaggaaggccgga

SEQ ID NO: 85139 - DNA, 25 bp, Homo sapien
atggtcttgttctcgtaggcgccct

SEQ ID NO: 85140 - DNA, 25 bp, Homo sapien
ccagctctgggaacctcttgcatga

SEQ ID NO: 85141 - DNA, 25 bp, Homo sapien
tacctggccattgtcccggccgagg

SEQ ID NO: 85142 - DNA, 25 bp, Homo sapien
gcccacactgtaggcgtcgaagtcg

SEQ ID NO: 85143 - DNA, 25 bp, Homo sapien
gcaggtcgtcctcggtgttccacgc

SEQ ID NO: 85144 - DNA, 25 bp, Homo sapien
cgcggccagctacaaaggaccagga

SEQ ID NO: 85145 - DNA, 25 bp, Homo sapien
caggagccgtgtgcgtacactcgcg

SEQ ID NO: 85146 - DNA, 25 bp, Homo sapien
tcgtcgcgctctccgggagagctga

SEQ ID NO: 85147 - DNA, 25 bp, Homo sapien
cgagccaggacccttctgaagcctt

SEQ ID NO: 85148 - DNA, 25 bp, Homo sapien
tcttaggagcaaaacgtctggggcc

SEQ ID NO: 85149 - DNA, 25 bp, Homo sapien
cttaggtgtctatcggcgacgtgta

SEQ ID NO: 85150 - DNA, 25 bp, Homo sapien
ccgtactgtagcgaaagtgcgacta

SEQ ID NO: 85151 - DNA, 25 bp, Homo sapien
cgacgtgtacggtcactgcagctcc

SEQ ID NO: 85152 - DNA, 25 bp, Homo sapien
ggaaccactctttgtgccgcagctt

SEQ ID NO: 85153 - DNA, 25 bp, Homo sapien
caaacactaacgatggcggcgccgg

SEQ ID NO: 85154 - DNA, 25 bp, Homo sapien
gggtgcgacaactcgcggagtctta

SEQ ID NO: 85155 - DNA, 25 bp, Homo sapien
agcttcagcccatagatgcagcagc

SEQ ID NO: 85156 - DNA, 25 bp, Homo sapien
aggccaatctctgacagcttcagcc

SEQ ID NO: 85157 - DNA, 25 bp, Homo sapien
ccagtgcctcgtccttgcgccgcaa

SEQ ID NO: 85158 - DNA, 25 bp, Homo sapien
gcccatagatgcagcagcgcagctc

SEQ ID NO: 85159 - DNA, 25 bp, Homo sapien
cagtgaccaataggggcctgggctc

SEQ ID NO: 85160 - DNA, 25 bp, Homo sapien
cctctcgcaggcactggttttgctg

SEQ ID NO: 85161 - DNA, 25 bp, Homo sapien
ctgcaggccaatctctgacagcttc

SEQ ID NO: 85162 - DNA, 25 bp, Homo sapien
agaggcgccgcacgttgcgctccag

SEQ ID NO: 85163 - DNA, 25 bp, Homo sapien
cactcgcgcttgatgcggtgcacct

SEQ ID NO: 85164 - DNA, 25 bp, Homo sapien
ttggtcttctcctcatgcagcttgg

SEQ ID NO: 85165 - DNA, 25 bp, Homo sapien
agtttgcccacctgcagccagagcg

SEQ ID NO: 85166 - DNA, 25 bp, Homo sapien
ctccgaaatgtaggccgtgtgccgt

SEQ ID NO: 85167 - DNA, 25 bp, Homo sapien
gcacctcgtcttggtgcgcctggta

SEQ ID NO: 85168 - DNA, 25 bp, Homo sapien
agcagcgccgtcttgaccttgtcgg

SEQ ID NO: 85169 - DNA, 25 bp, Homo sapien
ggtcttgtcagcctgcatgcagtta

SEQ ID NO: 85170 - DNA, 25 bp, Homo sapien
gcttggccttgagctccgaaatgta

SEQ ID NO: 85171 - DNA, 25 bp, Homo sapien
ttccgtcactggttcacttgggttc

SEQ ID NO: 85172 - DNA, 25 bp, Homo sapien
gcgatcattaggagccagctggtca

SEQ ID NO: 85173 - DNA, 25 bp, Homo sapien
catccatgacgcgaagtgaactaac

SEQ ID NO: 85174 - DNA, 25 bp, Homo sapien
gagtgctggcctgaagcctccatgc

SEQ ID NO: 85175 - DNA, 25 bp, Homo sapien
acaggtgccgtttctgtgctagaaa

SEQ ID NO: 85176 - DNA, 25 bp, Homo sapien
ctggtcaggacacgatgcagtgttc

SEQ ID NO: 85177 - DNA, 25 bp, Homo sapien
gttcacggttcactgccgagttttc

SEQ ID NO: 85178 - DNA, 25 bp, Homo sapien
ccctcctgtgagagtccaaggtcca

SEQ ID NO: 85179 - DNA, 25 bp, Homo sapien
gtgctaaccagtcgcgcaggactca

SEQ ID NO: 85180 - DNA, 25 bp, Homo sapien
caccgtgctaaccagtcgcgcagga

SEQ ID NO: 85181 - DNA, 25 bp, Homo sapien
ttgctccggcctttcttcgacatgc

SEQ ID NO: 85182 - DNA, 25 bp, Homo sapien
cgcagctcctcgttggccatctgca

SEQ ID NO: 85183 - DNA, 25 bp, Homo sapien
gtggctaccagctccaccgtgctaa

SEQ ID NO: 85184 - DNA, 25 bp, Homo sapien
agagtgctgagatcctgcggtccac

SEQ ID NO: 85185 - DNA, 25 bp, Homo sapien
agatcctgcggtccacacctgttca

SEQ ID NO: 85186 - DNA, 25 bp, Homo sapien
agccagcaggcgtggctaccagctc

SEQ ID NO: 85187 - DNA, 25 bp, Homo sapien
agctccatcttctttgccacctggg

SEQ ID NO: 85188 - DNA, 25 bp, Homo sapien
cccgctccttggcttgagggcggaa

SEQ ID NO: 85189 - DNA, 25 bp, Homo sapien
aacggaacagaaaatgaatgcatgc

SEQ ID NO: 85190 - DNA, 25 bp, Homo sapien
aaagcaattgaggaggatggcagtc

SEQ ID NO: 85191 - DNA, 25 bp, Homo sapien
acctaccctgcggaagacacggagg

SEQ ID NO: 85192 - DNA, 25 bp, Homo sapien
gggactgtgacctaccctgcggaag

SEQ ID NO: 85193 - DNA, 25 bp, Homo sapien
ttctttgccacctgggcggagatct

SEQ ID NO: 85194 - DNA, 25 bp, Homo sapien
cggaatccggagaagagtggaaata

SEQ ID NO: 85195 - DNA, 25 bp, Homo sapien
gccactgagggcacttacgtaactg

SEQ ID NO: 85196 - DNA, 25 bp, Homo sapien
ggagcctgcctctgcaaagtccagg

SEQ ID NO: 85197 - DNA, 25 bp, Homo sapien
gccgcctgtgctgaaggagccacgc

SEQ ID NO: 85198 - DNA, 25 bp, Homo sapien
gcggctgacaacagccgagcggttc

SEQ ID NO: 85199 - DNA, 25 bp, Homo sapien
ggcgaacgacatgcagcggaactgc

SEQ ID NO: 85200 - DNA, 25 bp, Homo sapien
tccggagcacagcaacgcgcggagc

SEQ ID NO: 85201 - DNA, 25 bp, Homo sapien
ctgagggcacttacgtaactgcggg

SEQ ID NO: 85202 - DNA, 25 bp, Homo sapien
gccggagtccggagcacagcaacgc

SEQ ID NO: 85203 - DNA, 25 bp, Homo sapien
caggtcgagccgtttacggatggaa

SEQ ID NO: 85204 - DNA, 25 bp, Homo sapien
gagcttccagaaagtcccagggcac

SEQ ID NO: 85205 - DNA, 25 bp, Homo sapien
tagttttcgctgaagacggggctgc

SEQ ID NO: 85206 - DNA, 25 bp, Homo sapien
gctccagagcaagaagccatcgtgg

SEQ ID NO: 85207 - DNA, 25 bp, Homo sapien
gaggaaagcagctccttctggcttc

SEQ ID NO: 85208 - DNA, 25 bp, Homo sapien
tcccagccaggtggatgacagttcc

SEQ ID NO: 85209 - DNA, 25 bp, Homo sapien
gcgccctgcacacacgattgcattt

SEQ ID NO: 85210 - DNA, 25 bp, Homo sapien
tggatgacagttcccagcgcctcga

SEQ ID NO: 85211 - DNA, 25 bp, Homo sapien
gcgttcagctgctcccgaacaactt

SEQ ID NO: 85212 - DNA, 25 bp, Homo sapien
agtccgctcggaaactttcgctgtg

SEQ ID NO: 85213 - DNA, 25 bp, Homo sapien
attggcggctacaccggccactcag

SEQ ID NO: 85214 - DNA, 25 bp, Homo sapien
agatctcccgtttgcgccgcgttca

SEQ ID NO: 85215 - DNA, 25 bp, Homo sapien
gcctcgctaagcaactggacgttcc

SEQ ID NO: 85216 - DNA, 25 bp, Homo sapien
cgaacaacttttctgccggcccaga

SEQ ID NO: 85217 - DNA, 25 bp, Homo sapien
agagccctgaggcactgtcctcttc

SEQ ID NO: 85218 - DNA, 25 bp, Homo sapien
ggctcttcagcagcgagtgcagatt

SEQ ID NO: 85219 - DNA, 25 bp, Homo sapien
cagggcagcctcatcgagttcagca

SEQ ID NO: 85220 - DNA, 25 bp, Homo sapien
ggaggagctctgtcgccttaagctg

SEQ ID NO: 85221 - DNA, 25 bp, Homo sapien
tgagattaccgtgggcatgccattc

SEQ ID NO: 85222 - DNA, 25 bp, Homo sapien
ttcgaccgctacaagtttgagatta

SEQ ID NO: 85223 - DNA, 25 bp, Homo sapien
tacgtccgcgtgactgacatcgaca

SEQ ID NO: 85224 - DNA, 25 bp, Homo sapien
cgagttcagcaccatcctggagggc

SEQ ID NO: 85225 - DNA, 25 bp, Homo sapien
ctcccgttcttcatcggcgactgga

SEQ ID NO: 85226 - DNA, 25 bp, Homo sapien
agcgccgagtctgccatcaacatgc

SEQ ID NO: 85227 - DNA, 25 bp, Homo sapien
tgccagggatccaattcgagggtca

SEQ ID NO: 85228 - DNA, 25 bp, Homo sapien
catgacttgcagtgtgccagggaca

SEQ ID NO: 85229 - DNA, 25 bp, Homo sapien
tcgagggtcaaatgaaactctctgc

SEQ ID NO: 85230 - DNA, 25 bp, Homo sapien
acccgagccggctaacttgctaatg

SEQ ID NO: 85231 - DNA, 25 bp, Homo sapien
ggcgcatttttactctgcagggaaa

SEQ ID NO: 85232 - DNA, 25 bp, Homo sapien
gtacacgtcgtattcgccctggctg

SEQ ID NO: 85233 - DNA, 25 bp, Homo sapien
ctcgtggctctggaaagtgctgtac

SEQ ID NO: 85234 - DNA, 25 bp, Homo sapien
tctctgcagcttaaccggcccatga

SEQ ID NO: 85235 - DNA, 25 bp, Homo sapien
ccatcggagttcacctgggctgcac

SEQ ID NO: 85236 - DNA, 25 bp, Homo sapien
tgccaaagcgagctgagcagaattc

SEQ ID NO: 85237 - DNA, 25 bp, Homo sapien
ctgccagtagttgccaggacaaatg

SEQ ID NO: 85238 - DNA, 25 bp, Homo sapien
aggcggaaccttcacgctgattggc

SEQ ID NO: 85239 - DNA, 25 bp, Homo sapien
cctcagcctgtgtggccgtctataa

SEQ ID NO: 85240 - DNA, 25 bp, Homo sapien
cgctgggtcatccacaggcttgaga

SEQ ID NO: 85241 - DNA, 25 bp, Homo sapien
cgcctggcgattcctccggaaagtc

SEQ ID NO: 85242 - DNA, 25 bp, Homo sapien
cgcagagacgcgctgaagctactcg

SEQ ID NO: 85243 - DNA, 25 bp, Homo sapien
ggaatccgaggttcgcattgctctc

SEQ ID NO: 85244 - DNA, 25 bp, Homo sapien
cgcctgtcaaggctcggcaaacatc

SEQ ID NO: 85245 - DNA, 25 bp, Homo sapien
cggggaggtaacagcataactgtcc

SEQ ID NO: 85246 - DNA, 25 bp, Homo sapien
tgtccgactcgtcgctcccaaagag

SEQ ID NO: 85247 - DNA, 25 bp, Homo sapien
tcccaaagagatggctggaacaatt

SEQ ID NO: 85248 - DNA, 25 bp, Homo sapien
tagttccgctttcccagctagtcga

SEQ ID NO: 85249 - DNA, 25 bp, Homo sapien
tcactggtgcacctccggaatccga

SEQ ID NO: 85250 - DNA, 25 bp, Homo sapien
ttcggacgacctggccagctccttt

SEQ ID NO: 85251 - DNA, 25 bp, Homo sapien
gccgctctagatactgagtgtcatc

SEQ ID NO: 85252 - DNA, 25 bp, Homo sapien
gaagcccacagacctggctggaatg

SEQ ID NO: 85253 - DNA, 25 bp, Homo sapien
gagtgtcatccgctttgcaccaggc

SEQ ID NO: 85254 - DNA, 25 bp, Homo sapien
tttgcaccaggcactctgcgggcag

SEQ ID NO: 85255 - DNA, 25 bp, Homo sapien
ggcggccgtgaaaacgaagcccaca

SEQ ID NO: 85256 - DNA, 25 bp, Homo sapien
ctggctggaatgctcacgggcagat

SEQ ID NO: 85257 - DNA, 25 bp, Homo sapien
cgggcagatggaccacaagacgata

SEQ ID NO: 85258 - DNA, 25 bp, Homo sapien
gataaaccagcgaggtgactccaga

SEQ ID NO: 85259 - DNA, 25 bp, Homo sapien
ttcaccagattagccacagccgtgg

SEQ ID NO: 85260 - DNA, 25 bp, Homo sapien
gggcagggctgaaatggcaaatcca

SEQ ID NO: 85261 - DNA, 25 bp, Homo sapien
tcaccaggaataaaaaggccagccc

SEQ ID NO: 85262 - DNA, 25 bp, Homo sapien
gctgctcctgtctcaatataactca

SEQ ID NO: 85263 - DNA, 25 bp, Homo sapien
aaatcccgacagttagcccagctgc

SEQ ID NO: 85264 - DNA, 25 bp, Homo sapien
gatggcatgtcccacttttttggaa

SEQ ID NO: 85265 - DNA, 25 bp, Homo sapien
ccggaagttccaggcctgtaagaga

SEQ ID NO: 85266 - DNA, 25 bp, Homo sapien
acatcgcgcggtccaaaccttcgga

SEQ ID NO: 85267 - DNA, 25 bp, Homo sapien
aggcagggttccaagccggttctgt

SEQ ID NO: 85268 - DNA, 25 bp, Homo sapien
gtagacgctgctggatggtacccgc

SEQ ID NO: 85269 - DNA, 25 bp, Homo sapien
gccgggactgaactccgccgcattg

SEQ ID NO: 85270 - DNA, 25 bp, Homo sapien
gaactccgccgcattgggtcttacc

SEQ ID NO: 85271 - DNA, 25 bp, Homo sapien
ccgagacgctgtggctgacaccggt

SEQ ID NO: 85272 - DNA, 25 bp, Homo sapien
gcacttcggaccctagcagagccag

SEQ ID NO: 85273 - DNA, 25 bp, Homo sapien
gagtctcgcttctggcccgcgaaga

SEQ ID NO: 85274 - DNA, 25 bp, Homo sapien
ttctcggccgagacgctgtggctga

SEQ ID NO: 85275 - DNA, 25 bp, Homo sapien
tgtctgcagggacggtgtcccctga

SEQ ID NO: 85276 - DNA, 25 bp, Homo sapien
cctgagcgcataggatgcagggaac

SEQ ID NO: 85277 - DNA, 25 bp, Homo sapien
ggggtgtctgcagggacggtgtccc

SEQ ID NO: 85278 - DNA, 25 bp, Homo sapien
ctggggtgtctgcagggacggtgtc

SEQ ID NO: 85279 - DNA, 25 bp, Homo sapien
ctgagcgcacaggatgcagggaacc

SEQ ID NO: 85280 - DNA, 25 bp, Homo sapien
tgtccgcagggacggtgtcccctga

SEQ ID NO: 85281 - DNA, 25 bp, Homo sapien
ctgagcgcataggatgcagggaacc

SEQ ID NO: 85282 - DNA, 25 bp, Homo sapien
acggtgtcccctgagcgcacgggac

SEQ ID NO: 85283 - DNA, 25 bp, Homo sapien
gctcctgttgctgcgaccgccaggg

SEQ ID NO: 85284 - DNA, 25 bp, Homo sapien
ccacatggacgtgggctgggtctac

SEQ ID NO: 85285 - DNA, 25 bp, Homo sapien
gtgcaggtaggtgccgaccacgccc

SEQ ID NO: 85286 - DNA, 25 bp, Homo sapien
tacactgtgcaggtaggtgccgacc

SEQ ID NO: 85287 - DNA, 25 bp, Homo sapien
acgtgggctgggtctacactgtgca

SEQ ID NO: 85288 - DNA, 25 bp, Homo sapien
cgaccgccaggggtccagtccgccg

SEQ ID NO: 85289 - DNA, 25 bp, Homo sapien
ctctccccgcgggatctgagtgtgg

SEQ ID NO: 85290 - DNA, 25 bp, Homo sapien
tcggcgtccagccggcaaccaatgg

SEQ ID NO: 85291 - DNA, 25 bp, Homo sapien
gactccattttgttcgccgttactc

SEQ ID NO: 85292 - DNA, 25 bp, Homo sapien
gccggtgcctctctttctagacgtg

SEQ ID NO: 85293 - DNA, 25 bp, Homo sapien
ttactctgcgcgtaagtcgcttgtc

SEQ ID NO: 85294 - DNA, 25 bp, Homo sapien
cttgtccgtggcttctctgagaaga

SEQ ID NO: 85295 - DNA, 25 bp, Homo sapien
cgggctctctattgctaagcatagc

SEQ ID NO: 85296 - DNA, 25 bp, Homo sapien
gtgtcggttttctctctccaacaga

SEQ ID NO: 85297 - DNA, 25 bp, Homo sapien
tttcatcgagatgcaccggaatcgg

SEQ ID NO: 85298 - DNA, 25 bp, Homo sapien
ttcagtggaagggtcataaatctca

SEQ ID NO: 85299 - DNA, 25 bp, Homo sapien
cttcaagaacttgtcgcgggtgaca

SEQ ID NO: 85300 - DNA, 25 bp, Homo sapien
cggcggagacaagccagcggttccc

SEQ ID NO: 85301 - DNA, 25 bp, Homo sapien
ggtcacggtattcggtgcaaccttc

SEQ ID NO: 85302 - DNA, 25 bp, Homo sapien
gcaaccttccgtttctggtgcaaaa

SEQ ID NO: 85303 - DNA, 25 bp, Homo sapien
ctggtgcaaaaatcactcgcaactg

SEQ ID NO: 85304 - DNA, 25 bp, Homo sapien
atggcgcctgcacgatacgggaccc

SEQ ID NO: 85305 - DNA, 25 bp, Homo sapien
ctggagctgccgtgaaaggagcttc

SEQ ID NO: 85306 - DNA, 25 bp, Homo sapien
ccatttgggtgtggccttcgctgtt

SEQ ID NO: 85307 - DNA, 25 bp, Homo sapien
tggacacggaccaggcgagagcccg

SEQ ID NO: 85308 - DNA, 25 bp, Homo sapien
cgtggacacggaccaggcgagagcc

SEQ ID NO: 85309 - DNA, 25 bp, Homo sapien
aggctgtgcgccgaggcggagagga

SEQ ID NO: 85310 - DNA, 25 bp, Homo sapien
agcgcggggtggagctgagaccggc

SEQ ID NO: 85311 - DNA, 25 bp, Homo sapien
ggacacggaccaggcgagagcccgc

SEQ ID NO: 85312 - DNA, 25 bp, Homo sapien
ccgcaaagacccaggtggcccggcg

SEQ ID NO: 85313 - DNA, 25 bp, Homo sapien
gagctgagaccggcggggagtttcc

SEQ ID NO: 85314 - DNA, 25 bp, Homo sapien
ggcagcgcggggtggagctgagacc

SEQ ID NO: 85315 - DNA, 25 bp, Homo sapien
agagcctgctcgacgccatcaagag

SEQ ID NO: 85316 - DNA, 25 bp, Homo sapien
cgtggagctgcaccagcggatcgcc

SEQ ID NO: 85317 - DNA, 25 bp, Homo sapien
cagagcctgctcgacgccatcaaga

SEQ ID NO: 85318 - DNA, 25 bp, Homo sapien
gagatccagagcctgctcgacgcca

SEQ ID NO: 85319 - DNA, 25 bp, Homo sapien
tggagatccagagcctgctcgacgc

SEQ ID NO: 85320 - DNA, 25 bp, Homo sapien
gctggagatccagagcctgctcgac

SEQ ID NO: 85321 - DNA, 25 bp, Homo sapien
gctgctggagatccagagcctgctc

SEQ ID NO: 85322 - DNA, 25 bp, Homo sapien
atcgtggagctgcaccagcggatcg

SEQ ID NO: 85323 - DNA, 25 bp, Homo sapien
tgctcgtccagagccgggaatgttc

SEQ ID NO: 85324 - DNA, 25 bp, Homo sapien
acctggtaaagccagagctcgggga

SEQ ID NO: 85325 - DNA, 25 bp, Homo sapien
caggggccttgacctggtaaagcca

SEQ ID NO: 85326 - DNA, 25 bp, Homo sapien
cgcctcgtgacaggggccttgacct

SEQ ID NO: 85327 - DNA, 25 bp, Homo sapien
gtcctgcgtgccgtgctcgtccaga

SEQ ID NO: 85328 - DNA, 25 bp, Homo sapien
ccctgaagccatagcgggggtcgcc

SEQ ID NO: 85329 - DNA, 25 bp, Homo sapien
tccagagccgggaatgttcgcctcc

SEQ ID NO: 85330 - DNA, 25 bp, Homo sapien
cgtctcctggcacccaggtctcctc

SEQ ID NO: 85331 - DNA, 25 bp, Homo sapien
agcccattttggataccgtcctcgc

SEQ ID NO: 85332 - DNA, 25 bp, Homo sapien
tgacagcgaggcttccgcgctcgct

SEQ ID NO: 85333 - DNA, 25 bp, Homo sapien
ctagtctggtcgttggtgacagcga

SEQ ID NO: 85334 - DNA, 25 bp, Homo sapien
tcgctgcggaaagttggggcaacct

SEQ ID NO: 85335 - DNA, 25 bp, Homo sapien
tggccgacggctagtagcccatttt

SEQ ID NO: 85336 - DNA, 25 bp, Homo sapien
ccgcaggtgtcgtaaaagggccgca

SEQ ID NO: 85337 - DNA, 25 bp, Homo sapien
cccgaatgcggttctcgcttgctgc

SEQ ID NO: 85338 - DNA, 25 bp, Homo sapien
ggcaacctgttgctagtctggtcgt

SEQ ID NO: 85339 - DNA, 25 bp, Homo sapien
aactgcggcgccatctcatctcaca

SEQ ID NO: 85340 - DNA, 25 bp, Homo sapien
gtgcttacacgctggccaccaagct

SEQ ID NO: 85341 - DNA, 25 bp, Homo sapien
tgcgtgggcatttgcggctccacac

SEQ ID NO: 85342 - DNA, 25 bp, Homo sapien
gggagcgtccttaccgctgcccaca

SEQ ID NO: 85343 - DNA, 25 bp, Homo sapien
tgcccacactgtgccgatgccttcc

SEQ ID NO: 85344 - DNA, 25 bp, Homo sapien
tcacacaccggggaggcccacttgt

SEQ ID NO: 85345 - DNA, 25 bp, Homo sapien
actccggagagaggccctttccctg

SEQ ID NO: 85346 - DNA, 25 bp, Homo sapien
cccagtgtggccgtgcttacacgct

SEQ ID NO: 85347 - DNA, 25 bp, Homo sapien
cctttacggtcacgccttcggcaag

SEQ ID NO: 85348 - DNA, 25 bp, Homo sapien
ttttgcggccctttcacgacagagc

SEQ ID NO: 85349 - DNA, 25 bp, Homo sapien
tcgccgtggatgcacacaaataagc

SEQ ID NO: 85350 - DNA, 25 bp, Homo sapien
cgacccacacgctttgtcaattgta

SEQ ID NO: 85351 - DNA, 25 bp, Homo sapien
gactcgcttctctctattcgccaga

SEQ ID NO: 85352 - DNA, 25 bp, Homo sapien
attcgccagacgagctcgaccagca

SEQ ID NO: 85353 - DNA, 25 bp, Homo sapien
cctctaatttagatcggtggcggca

SEQ ID NO: 85354 - DNA, 25 bp, Homo sapien
tcaggcgcttccacctcgtctatgt

SEQ ID NO: 85355 - DNA, 25 bp, Homo sapien
ttcgtgggcatgctggacatgcttc

SEQ ID NO: 85356 - DNA, 25 bp, Homo sapien
agtggcactgtttcccagagccaca

SEQ ID NO: 85357 - DNA, 25 bp, Homo sapien
cctgcttaccagagtggacgagttc

SEQ ID NO: 85358 - DNA, 25 bp, Homo sapien
aggccacagcaagccggctacgaag

SEQ ID NO: 85359 - DNA, 25 bp, Homo sapien
gtgccctcgctctttagcaagtctg

SEQ ID NO: 85360 - DNA, 25 bp, Homo sapien
gaagctcctgcacacgatgaacgtg

SEQ ID NO: 85361 - DNA, 25 bp, Homo sapien
tgcggcgcatctacagcaggatcga

SEQ ID NO: 85362 - DNA, 25 bp, Homo sapien
actcgtcccacgtcgtcagcgaggg

SEQ ID NO: 85363 - DNA, 25 bp, Homo sapien
actcgggccttctgtttgcccacgg

SEQ ID NO: 85364 - DNA, 25 bp, Homo sapien
cgccctgtggggctttcataaagca

SEQ ID NO: 85365 - DNA, 25 bp, Homo sapien
gctttcataaagcagccctgttctc

SEQ ID NO: 85366 - DNA, 25 bp, Homo sapien
caggaagacgcacacgctgtgtgtg

SEQ ID NO: 85367 - DNA, 25 bp, Homo sapien
cccattgacttaggggcgatttgtt

SEQ ID NO: 85368 - DNA, 25 bp, Homo sapien
gacgcacacgctgtgtgtggccaga

SEQ ID NO: 85369 - DNA, 25 bp, Homo sapien
tgtggccagagaccggggcacctct

SEQ ID NO: 85370 - DNA, 25 bp, Homo sapien
ctgcgctttgctggcttccaggaag

SEQ ID NO: 85371 - DNA, 25 bp, Homo sapien
gccgctttacgtaaggcgcaggcca

SEQ ID NO: 85372 - DNA, 25 bp, Homo sapien
gccctctctactgcttgccctctca

SEQ ID NO: 85373 - DNA, 25 bp, Homo sapien
cttcggggtcagcccaagggagaca

SEQ ID NO: 85374 - DNA, 25 bp, Homo sapien
cagcttgcggctcttgcgcccgggt

SEQ ID NO: 85375 - DNA, 25 bp, Homo sapien
agaccgggccgctgttgatggctcc

SEQ ID NO: 85376 - DNA, 25 bp, Homo sapien
cgctgatgtaatcccggcacccggg

SEQ ID NO: 85377 - DNA, 25 bp, Homo sapien
tgtggacgatgagtccgcacaatgg

SEQ ID NO: 85378 - DNA, 25 bp, Homo sapien
accggccggcgctgatgtaatcccg

SEQ ID NO: 85379 - DNA, 25 bp, Homo sapien
tcgctgcagtgttagtgctctccgt

SEQ ID NO: 85380 - DNA, 25 bp, Homo sapien
tcgctgcagtgttagtgctcgccgt

SEQ ID NO: 85381 - DNA, 25 bp, Homo sapien
gtcgctgcagtgttagtgctctccg

SEQ ID NO: 85382 - DNA, 25 bp, Homo sapien
tgcagtgttagtgctctccgtggag

SEQ ID NO: 85383 - DNA, 25 bp, Homo sapien
gctgcagtgttagtgctctccgtgg

SEQ ID NO: 85384 - DNA, 25 bp, Homo sapien
ggtcgctgcagtgttagtgctctcc

SEQ ID NO: 85385 - DNA, 25 bp, Homo sapien
cgctgcagtgttagtgctctccgtg

SEQ ID NO: 85386 - DNA, 25 bp, Homo sapien
tcgctgcagtgttagtgttcgccgt

SEQ ID NO: 85387 - DNA, 25 bp, Homo sapien
ccggccgcttcccacttccaagatg

SEQ ID NO: 85388 - DNA, 25 bp, Homo sapien
cgggcacaaaggcccgctcaaggca

SEQ ID NO: 85389 - DNA, 25 bp, Homo sapien
gccactccggttggttctccggcaa

SEQ ID NO: 85390 - DNA, 25 bp, Homo sapien
ggagccgcgctaactccggtactga

SEQ ID NO: 85391 - DNA, 25 bp, Homo sapien
cgctaactccggtactgagagcctc

SEQ ID NO: 85392 - DNA, 25 bp, Homo sapien
tactgagagcctcccgcgagggccg

SEQ ID NO: 85393 - DNA, 25 bp, Homo sapien
tcccggcctgagaagaggcgcctcg

SEQ ID NO: 85394 - DNA, 25 bp, Homo sapien
agttttcctactccgacgcgaggct

SEQ ID NO: 85395 - DNA, 25 bp, Homo sapien
ggctatgactcggtaaagctctata

SEQ ID NO: 85396 - DNA, 25 bp, Homo sapien
cgtttcccaggacaggctatgactc

SEQ ID NO: 85397 - DNA, 25 bp, Homo sapien
cccgcagcgatgatgtctccgtctg

SEQ ID NO: 85398 - DNA, 25 bp, Homo sapien
tcggggattcctaccctggagatcg

SEQ ID NO: 85399 - DNA, 25 bp, Homo sapien
ctccagtccgtggactcggggattc

SEQ ID NO: 85400 - DNA, 25 bp, Homo sapien
cagggctttagaagaccggcacagc

SEQ ID NO: 85401 - DNA, 25 bp, Homo sapien
gtacgggcccaagctgaaactcagg

SEQ ID NO: 85402 - DNA, 25 bp, Homo sapien
gggaacagagcgtgcgcaaatcctc

SEQ ID NO: 85403 - DNA, 25 bp, Homo sapien
gctctcctccctggtactctttgtg

SEQ ID NO: 85404 - DNA, 25 bp, Homo sapien
gcccgcggctgaccagaagtaattt

SEQ ID NO: 85405 - DNA, 25 bp, Homo sapien
cctgaggtctcatcgacagcgtacc

SEQ ID NO: 85406 - DNA, 25 bp, Homo sapien
tgtgtgctccctgacgttttaaacc

SEQ ID NO: 85407 - DNA, 25 bp, Homo sapien
cacggtagcccgtaaaaactgctca

SEQ ID NO: 85408 - DNA, 25 bp, Homo sapien
tctgtcctcaacagccgaagcttgc

SEQ ID NO: 85409 - DNA, 25 bp, Homo sapien
gacccgacgtagtccttatggtgta

SEQ ID NO: 85410 - DNA, 25 bp, Homo sapien
cagctctcgggtgatctttaaggca

SEQ ID NO: 85411 - DNA, 25 bp, Homo sapien
cgccgaggagctgtttgcctccatc

SEQ ID NO: 85412 - DNA, 25 bp, Homo sapien
ctgaagctgttcgaggacatcctga

SEQ ID NO: 85413 - DNA, 25 bp, Homo sapien
ggaagagttcctgttccgcacggcc

SEQ ID NO: 85414 - DNA, 25 bp, Homo sapien
acctggcctgtcgtatctgggacgt

SEQ ID NO: 85415 - DNA, 25 bp, Homo sapien
cttcccacagcgtagccggcaagtg

SEQ ID NO: 85416 - DNA, 25 bp, Homo sapien
ccgaaacaagaagtgggctcaggtc

SEQ ID NO: 85417 - DNA, 25 bp, Homo sapien
atcgccacgatccagatgcagagcc

SEQ ID NO: 85418 - DNA, 25 bp, Homo sapien
ggacttcattcacatggcccagttc

SEQ ID NO: 85419 - DNA, 25 bp, Homo sapien
cggcaggacgctgttaggtttcccg

SEQ ID NO: 85420 - DNA, 25 bp, Homo sapien
ctcggctgccgttagccctttcggg

SEQ ID NO: 85421 - DNA, 25 bp, Homo sapien
gggtccttagtgtgctcagagctga

SEQ ID NO: 85422 - DNA, 25 bp, Homo sapien
attggccaggcgacaggccgtcgtc

SEQ ID NO: 85423 - DNA, 25 bp, Homo sapien
cgctgcccggcgagagcaagccaat

SEQ ID NO: 85424 - DNA, 25 bp, Homo sapien
ccgcgagctgacgataggcgagatt

SEQ ID NO: 85425 - DNA, 25 bp, Homo sapien
acgataggcgagattgattggaagc

SEQ ID NO: 85426 - DNA, 25 bp, Homo sapien
ccagagctggccttgatcttggacg

SEQ ID NO: 85427 - DNA, 25 bp, Homo sapien
ttcacttgacaattacgcgagaggc

SEQ ID NO: 85428 - DNA, 25 bp, Homo sapien
cacagccctcgtaggcgcttactta

SEQ ID NO: 85429 - DNA, 25 bp, Homo sapien
cggaatcgttcacatcgcagcaagc

SEQ ID NO: 85430 - DNA, 25 bp, Homo sapien
gcagccgtgtttccctctggaccag

SEQ ID NO: 85431 - DNA, 25 bp, Homo sapien
ccgccctagtcttggtaaatcgctg

SEQ ID NO: 85432 - DNA, 25 bp, Homo sapien
gcggcctgctctaagccgtttgaaa

SEQ ID NO: 85433 - DNA, 25 bp, Homo sapien
cccgcagtgtcctcgttctttattg

SEQ ID NO: 85434 - DNA, 25 bp, Homo sapien
cggaccgcccatcggacttttattg

SEQ ID NO: 85435 - DNA, 25 bp, Homo sapien
gtcagcctgagctgtggcacgtctc

SEQ ID NO: 85436 - DNA, 25 bp, Homo sapien
cctgcgttcactgcacatcacgggg

SEQ ID NO: 85437 - DNA, 25 bp, Homo sapien
acgtctccaacgtgcttgttccaga

SEQ ID NO: 85438 - DNA, 25 bp, Homo sapien
tctgcctctcatcacaacatcggga

SEQ ID NO: 85439 - DNA, 25 bp, Homo sapien
caacatcgggaagcggctaggaccc

SEQ ID NO: 85440 - DNA, 25 bp, Homo sapien
cccttctgctgtgcgctgcatcgtg

SEQ ID NO: 85441 - DNA, 25 bp, Homo sapien
gcatcgcccgggacaggagatgctc

SEQ ID NO: 85442 - DNA, 25 bp, Homo sapien
ggcgcaaaggcctgcgttcactgca

SEQ ID NO: 85443 - DNA, 25 bp, Homo sapien
cccgtgactacaatctggtgccagc

SEQ ID NO: 85444 - DNA, 25 bp, Homo sapien
gcgggctctctgtcaactatgatga

SEQ ID NO: 85445 - DNA, 25 bp, Homo sapien
ggcgctgaagcgcaagatcaccaag

SEQ ID NO: 85446 - DNA, 25 bp, Homo sapien
ccgctgtaccagttcatgtcatgca

SEQ ID NO: 85447 - DNA, 25 bp, Homo sapien
tccgggccaagatccgagaactgca

SEQ ID NO: 85448 - DNA, 25 bp, Homo sapien
ccggcgaaacgggatcaccaagatg

SEQ ID NO: 85449 - DNA, 25 bp, Homo sapien
tcgccgccattgagaaccttccagg

SEQ ID NO: 85450 - DNA, 25 bp, Homo sapien
tatgaccaggatgccgagacgctca

SEQ ID NO: 85451 - DNA, 25 bp, Homo sapien
ttacctgagagacaacgccaaagca

SEQ ID NO: 85452 - DNA, 25 bp, Homo sapien
agctcgagcttctttggtcgcttct

SEQ ID NO: 85453 - DNA, 25 bp, Homo sapien
ggtcgcttcttcaaccgcacaagtt

SEQ ID NO: 85454 - DNA, 25 bp, Homo sapien
gcaggcagctatacccacttttctg

SEQ ID NO: 85455 - DNA, 25 bp, Homo sapien
gcctcagccaatccgtaatcgcttt

SEQ ID NO: 85456 - DNA, 25 bp, Homo sapien
ccgtaatcgcttttcctgttatgga

SEQ ID NO: 85457 - DNA, 25 bp, Homo sapien
ctgttatggacaggcaatagtcacc

SEQ ID NO: 85458 - DNA, 25 bp, Homo sapien
tgggtcacggaagagcatctttccc

SEQ ID NO: 85459 - DNA, 25 bp, Homo sapien
attcgtacgcttgtctcaccgcagg

SEQ ID NO: 85460 - DNA, 25 bp, Homo sapien
tgggactctgggatttctgggttac

SEQ ID NO: 85461 - DNA, 25 bp, Homo sapien
gctcgaatcctgttctgggactctg

SEQ ID NO: 85462 - DNA, 25 bp, Homo sapien
gactccaccagctgagcgtcgcgtt

SEQ ID NO: 85463 - DNA, 25 bp, Homo sapien
ggtctcgctcatcagcacgtcgttc

SEQ ID NO: 85464 - DNA, 25 bp, Homo sapien
cgcaggggacattcccgcagatttc

SEQ ID NO: 85465 - DNA, 25 bp, Homo sapien
actggcctctggtcactggttactt

SEQ ID NO: 85466 - DNA, 25 bp, Homo sapien
accttcggaagcctgcaggtccttg

SEQ ID NO: 85467 - DNA, 25 bp, Homo sapien
ccctgacgccgttcagacctgtatc

SEQ ID NO: 85468 - DNA, 25 bp, Homo sapien
ccctgacgctgttcagacctgtatc

SEQ ID NO: 85469 - DNA, 25 bp, Homo sapien
ccctggctactgttcagacctgtat

SEQ ID NO: 85470 - DNA, 25 bp, Homo sapien
ccctggctgctgttcagacctgtat

SEQ ID NO: 85471 - DNA, 25 bp, Homo sapien
cctggctgctgttcagacctgtatc

SEQ ID NO: 85472 - DNA, 25 bp, Homo sapien
ctgacgctgttcagacctgtatccc

SEQ ID NO: 85473 - DNA, 25 bp, Homo sapien
cctggctactgttcagacctgtatc

SEQ ID NO: 85474 - DNA, 25 bp, Homo sapien
cctgacgctgttcagacctgtatcc

SEQ ID NO: 85475 - DNA, 25 bp, Homo sapien
ttgctccggactccgggtctttctc

SEQ ID NO: 85476 - DNA, 25 bp, Homo sapien
tcttgctccggactccgggtctttc

SEQ ID NO: 85477 - DNA, 25 bp, Homo sapien
cttgctccggactccgggtctttct

SEQ ID NO: 85478 - DNA, 25 bp, Homo sapien
tctcccgagttgttctccttccgga

SEQ ID NO: 85479 - DNA, 25 bp, Homo sapien
cgagttcttctccttccggactccg

SEQ ID NO: 85480 - DNA, 25 bp, Homo sapien
cgagttgttctccttccggactccg

SEQ ID NO: 85481 - DNA, 25 bp, Homo sapien
tctcgctccggactccgggtctttc

SEQ ID NO: 85482 - DNA, 25 bp, Homo sapien
tcgctccggactccgggtctttctc

SEQ ID NO: 85483 - DNA, 25 bp, Homo sapien
cccagattgaaaccgatgtggatgc

SEQ ID NO: 85484 - DNA, 25 bp, Homo sapien
cgaggttaaaacctggcttcatggt

SEQ ID NO: 85485 - DNA, 25 bp, Homo sapien
gctgcctcggcagtcccagattgaa

SEQ ID NO: 85486 - DNA, 25 bp, Homo sapien
ggcttcatggtttcggccagttcca

SEQ ID NO: 85487 - DNA, 25 bp, Homo sapien
cgagctgacttactccaggagggcg

SEQ ID NO: 85488 - DNA, 25 bp, Homo sapien
atgtggatgcaaacgccttcccttc

SEQ ID NO: 85489 - DNA, 25 bp, Homo sapien
gccgtcagggaagggcactcctcac

SEQ ID NO: 85490 - DNA, 25 bp, Homo sapien
gtcctgaactggagagtcctgcgcc

SEQ ID NO: 85491 - DNA, 25 bp, Homo sapien
atgggtttccttgagtcccgctgcc

SEQ ID NO: 85492 - DNA, 25 bp, Homo sapien
cggctcacgaggattaacgatgacg

SEQ ID NO: 85493 - DNA, 25 bp, Homo sapien
acggatggatgggtttccttgagtc

SEQ ID NO: 85494 - DNA, 25 bp, Homo sapien
tcacgaggattaacgatgacgaggg

SEQ ID NO: 85495 - DNA, 25 bp, Homo sapien
cgtagagcccgggagagctttctaa

SEQ ID NO: 85496 - DNA, 25 bp, Homo sapien
gcccgggagagctttctaaagcgcc

SEQ ID NO: 85497 - DNA, 25 bp, Homo sapien
cccacggcagtgatgaatcccggca

SEQ ID NO: 85498 - DNA, 25 bp, Homo sapien
gatgaatcccggcagaggcctctga

SEQ ID NO: 85499 - DNA, 25 bp, Homo sapien
gattccgggctaccgctggtgccgc

SEQ ID NO: 85500 - DNA, 25 bp, Homo sapien
tgtgcaggcgtgagctccgcacagc

SEQ ID NO: 85501 - DNA, 25 bp, Homo sapien
gtcagcaaacagctgtgcaggcgtg

SEQ ID NO: 85502 - DNA, 25 bp, Homo sapien
caggagataaactcccaggacgcaa

SEQ ID NO: 85503 - DNA, 25 bp, Homo sapien
ggcagccacggattccgggctaccg

SEQ ID NO: 85504 - DNA, 25 bp, Homo sapien
cagcaaatgggccttgcgcacccgg

SEQ ID NO: 85505 - DNA, 25 bp, Homo sapien
cgtgttcattcggtcagcaaatggg

SEQ ID NO: 85506 - DNA, 25 bp, Homo sapien
ccaggacgcaaggaagtcagcaaac

SEQ ID NO: 85507 - DNA, 25 bp, Homo sapien
gcctctctcctgtagattttcggta

SEQ ID NO: 85508 - DNA, 25 bp, Homo sapien
acgtcacctgcgcaatccacaattg

SEQ ID NO: 85509 - DNA, 25 bp, Homo sapien
ttgctccgagaagatgctgacagcc

SEQ ID NO: 85510 - DNA, 25 bp, Homo sapien
tctgaccgtgcaggacgattacatc

SEQ ID NO: 85511 - DNA, 25 bp, Homo sapien
ctggggcttttggaaattggcaaca

SEQ ID NO: 85512 - DNA, 25 bp, Homo sapien
acccgttcgcggcaaaaatggcatc

SEQ ID NO: 85513 - DNA, 25 bp, Homo sapien
ggcatcgctcagaaaagaggcaata

SEQ ID NO: 85514 - DNA, 25 bp, Homo sapien
ctacttcgcaggtcacggtttctga

SEQ ID NO: 85515 - DNA, 25 bp, Homo sapien
tatgatcctttacgaccggcttctg

SEQ ID NO: 85516 - DNA, 25 bp, Homo sapien
ctgcccgcacatacactgggcctgg

SEQ ID NO: 85517 - DNA, 25 bp, Homo sapien
ccatcttggcggctgtcacctggca

SEQ ID NO: 85518 - DNA, 25 bp, Homo sapien
gcgtctaggactggcgcagttccta

SEQ ID NO: 85519 - DNA, 25 bp, Homo sapien
actggcgcagttcctacctcagcga

SEQ ID NO: 85520 - DNA, 25 bp, Homo sapien
ctttacgaccggcttctgccaaggg

SEQ ID NO: 85521 - DNA, 25 bp, Homo sapien
gccgcccagtttatgatcctttacg

SEQ ID NO: 85522 - DNA, 25 bp, Homo sapien
cagacgccgcccagtttatgatcct

SEQ ID NO: 85523 - DNA, 25 bp, Homo sapien
tgagccagaaggacacacacctgtg

SEQ ID NO: 85524 - DNA, 25 bp, Homo sapien
aggacacacacctgtggactcgatg

SEQ ID NO: 85525 - DNA, 25 bp, Homo sapien
gtggactcgatgtccctgacttggg

SEQ ID NO: 85526 - DNA, 25 bp, Homo sapien
ctgacttgggctcgatggccagccc

SEQ ID NO: 85527 - DNA, 25 bp, Homo sapien
gcccgccagcgctttcttcaggctc

SEQ ID NO: 85528 - DNA, 25 bp, Homo sapien
tcaggctctccttgacctccgtcag

SEQ ID NO: 85529 - DNA, 25 bp, Homo sapien
caggctgacacgctccgcctccttc

SEQ ID NO: 85530 - DNA, 25 bp, Homo sapien
tcctgcctggaattcccagaaacgc

SEQ ID NO: 85531 - DNA, 25 bp, Homo sapien
gccacggagcggaatagacacaata

SEQ ID NO: 85532 - DNA, 25 bp, Homo sapien
tgtttagaatccaaacccgggatca

SEQ ID NO: 85533 - DNA, 25 bp, Homo sapien
cagccggaacgtcagaggatgttta

SEQ ID NO: 85534 - DNA, 25 bp, Homo sapien
gtcggtcctgtccttgtggaaaatg

SEQ ID NO: 85535 - DNA, 25 bp, Homo sapien
cgttcagatagcctgcggagacaca

SEQ ID NO: 85536 - DNA, 25 bp, Homo sapien
ggctgttggagagcacgttcagata

SEQ ID NO: 85537 - DNA, 25 bp, Homo sapien
cacaatatgggtcttcaggtcggtc

SEQ ID NO: 85538 - DNA, 25 bp, Homo sapien
gagcttgttatctttcactcggcac

SEQ ID NO: 85539 - DNA, 25 bp, Homo sapien
cattacactcgcgtcccaggcgggg

SEQ ID NO: 85540 - DNA, 25 bp, Homo sapien
gccgcagccgccttaacaatggagc

SEQ ID NO: 85541 - DNA, 25 bp, Homo sapien
acccgaggccgagacaaagcccagg

SEQ ID NO: 85542 - DNA, 25 bp, Homo sapien
tgggtccacgcaacaacctataggt

SEQ ID NO: 85543 - DNA, 25 bp, Homo sapien
tcaggaagccgtcatgcggggccaa

SEQ ID NO: 85544 - DNA, 25 bp, Homo sapien
taggtgacaaaacactcaggaagcc

SEQ ID NO: 85545 - DNA, 25 bp, Homo sapien
tcggtaagtcggacgaagcagtctc

SEQ ID NO: 85546 - DNA, 25 bp, Homo sapien
tgaacagccgacagagccgcagccg

SEQ ID NO: 85547 - DNA, 25 bp, Homo sapien
gacccacctgctggaattcagcctg

SEQ ID NO: 85548 - DNA, 25 bp, Homo sapien
acccagcacatttcacaggtgttta

SEQ ID NO: 85549 - DNA, 25 bp, Homo sapien
tggtgtctcagtgccattcccattc

SEQ ID NO: 85550 - DNA, 25 bp, Homo sapien
gctgccatctggtgttggtgtctca

SEQ ID NO: 85551 - DNA, 25 bp, Homo sapien
cctacattctggactgacttgactc

SEQ ID NO: 85552 - DNA, 25 bp, Homo sapien
agcctgcgtctccagtttcagaacc

SEQ ID NO: 85553 - DNA, 25 bp, Homo sapien
cgtggctttggaggaagctgccatc

SEQ ID NO: 85554 - DNA, 25 bp, Homo sapien
acggcctccagatgtaccgagaaca

SEQ ID NO: 85555 - DNA, 25 bp, Homo sapien
tgtactcgccctgccgcacgaagaa

SEQ ID NO: 85556 - DNA, 25 bp, Homo sapien
ggcagaggggaccatctccacgtcc

SEQ ID NO: 85557 - DNA, 25 bp, Homo sapien
agcgtgcagatgtactcgccctgcc

SEQ ID NO: 85558 - DNA, 25 bp, Homo sapien
agagcctctggtagtccagcgtgca

SEQ ID NO: 85559 - DNA, 25 bp, Homo sapien
gtgccgtagagcctctggtagtcca

SEQ ID NO: 85560 - DNA, 25 bp, Homo sapien
accctcaatgaactggtcgcagctg

SEQ ID NO: 85561 - DNA, 25 bp, Homo sapien
cacacacgaagcagtcggggtggta

SEQ ID NO: 85562 - DNA, 25 bp, Homo sapien
cggcagacggcacacacgaagcagt

SEQ ID NO: 85563 - DNA, 25 bp, Homo sapien
ccgggaggaaacctatacgagcatc

SEQ ID NO: 85564 - DNA, 25 bp, Homo sapien
tccgtaggtagagatgccaccggcc

SEQ ID NO: 85565 - DNA, 25 bp, Homo sapien
cgcagtctctgcgacatttaagcct

SEQ ID NO: 85566 - DNA, 25 bp, Homo sapien
catttaagcctgtcccacctgggtg

SEQ ID NO: 85567 - DNA, 25 bp, Homo sapien
tgggtgctgcccgacaccctagaca

SEQ ID NO: 85568 - DNA, 25 bp, Homo sapien
agcagccctggcgatggaaaaattc

SEQ ID NO: 85569 - DNA, 25 bp, Homo sapien
taagactgctcgactcgggttgctc

SEQ ID NO: 85570 - DNA, 25 bp, Homo sapien
gcaggcatttcttcctccgtaggta

SEQ ID NO: 85571 - DNA, 25 bp, Homo sapien
ggcaggacgagacaagcacacaacc

SEQ ID NO: 85572 - DNA, 25 bp, Homo sapien
atctgctggggagatggatatcctg

SEQ ID NO: 85573 - DNA, 25 bp, Homo sapien
cggcccacctagcatgcgctgattg

SEQ ID NO: 85574 - DNA, 25 bp, Homo sapien
tgagcctctaggagccaatcatgtc

SEQ ID NO: 85575 - DNA, 25 bp, Homo sapien
cttgcaatggcgtctctcgggctct

SEQ ID NO: 85576 - DNA, 25 bp, Homo sapien
gaagaagcttctgccaggcccgaga

SEQ ID NO: 85577 - DNA, 25 bp, Homo sapien
tctgggaaaaacctgcttccgaggc

SEQ ID NO: 85578 - DNA, 25 bp, Homo sapien
gagacccgcacttagttacctgaga

SEQ ID NO: 85579 - DNA, 25 bp, Homo sapien
gaggcctttcgcaatcgttcttaga

SEQ ID NO: 85580 - DNA, 25 bp, Homo sapien
gcggggcgatcggactacaagtccc

SEQ ID NO: 85581 - DNA, 25 bp, Homo sapien
cccagatctgctgcggagagtcctg

SEQ ID NO: 85582 - DNA, 25 bp, Homo sapien
tctcacctctgcgtgcctaggtctg

SEQ ID NO: 85583 - DNA, 25 bp, Homo sapien
aagaaggggcgccttccagacatcc

SEQ ID NO: 85584 - DNA, 25 bp, Homo sapien
ctcggggctgcaaaatcctggagca

SEQ ID NO: 85585 - DNA, 25 bp, Homo sapien
aagtgtaggcacctcgacgccaccg

SEQ ID NO: 85586 - DNA, 25 bp, Homo sapien
gccgggtctgacacatgcgggctcc

SEQ ID NO: 85587 - DNA, 25 bp, Homo sapien
gaccaggccgaccagagtcccaagg

SEQ ID NO: 85588 - DNA, 25 bp, Homo sapien
accagagtcccaaggcctgccgggt

SEQ ID NO: 85589 - DNA, 25 bp, Homo sapien
cgctgcgacgtgtcgcggtgtccca

SEQ ID NO: 85590 - DNA, 25 bp, Homo sapien
tctggactcgccttgcggcgagagc

SEQ ID NO: 85591 - DNA, 25 bp, Homo sapien
gtcgcacgccgtgtgtggcaccgac

SEQ ID NO: 85592 - DNA, 25 bp, Homo sapien
acgggcacacctatgccaacgtgtg

SEQ ID NO: 85593 - DNA, 25 bp, Homo sapien
gcgcctgcccgttgggtaagcgctc

SEQ ID NO: 85594 - DNA, 25 bp, Homo sapien
ctgtagcctcgggttttctcgacca

SEQ ID NO: 85595 - DNA, 25 bp, Homo sapien
tgaccgagtctcctctcctactgga

SEQ ID NO: 85596 - DNA, 25 bp, Homo sapien
cttcagcatcgcacctgaggtggtc

SEQ ID NO: 85597 - DNA, 25 bp, Homo sapien
cccgagatcaggacgaaggaccacc

SEQ ID NO: 85598 - DNA, 25 bp, Homo sapien
agcgtcagagcctgcagacaacgga

SEQ ID NO: 85599 - DNA, 25 bp, Homo sapien
gggaacgacgacctcctcttcagca

SEQ ID NO: 85600 - DNA, 25 bp, Homo sapien
ctctagtggactcgagtgagctgca

SEQ ID NO: 85601 - DNA, 25 bp, Homo sapien
gagtgttggatccacatcccggtgc

SEQ ID NO: 85602 - DNA, 25 bp, Homo sapien
cgtcaaggtcaacgggcgtcctcta

SEQ ID NO: 85603 - DNA, 25 bp, Homo sapien
caggaaggagggctatttacaattt

SEQ ID NO: 85604 - DNA, 25 bp, Homo sapien
cgggaatcgttctccgagtagagga

SEQ ID NO: 85605 - DNA, 25 bp, Homo sapien
ctccgagtagaggaatcccggtgcc

SEQ ID NO: 85606 - DNA, 25 bp, Homo sapien
gtaccagattctaccggggcctctc

SEQ ID NO: 85607 - DNA, 25 bp, Homo sapien
tttatgggtttagcgaccctcctca

SEQ ID NO: 85608 - DNA, 25 bp, Homo sapien
cgcacgcattcattcgcaccaagga

SEQ ID NO: 85609 - DNA, 25 bp, Homo sapien
cgccgcttaccgtgtgcgcagagca

SEQ ID NO: 85610 - DNA, 25 bp, Homo sapien
aggaatcccggtgcccaagtaccag

SEQ ID NO: 85611 - DNA, 25 bp, Homo sapien
cggcagggcggcaaacccagagcac

SEQ ID NO: 85612 - DNA, 25 bp, Homo sapien
tggccgagcacacttgtcgtcagaa

SEQ ID NO: 85613 - DNA, 25 bp, Homo sapien
tgacacgtcccgctgtgacacgcgt

SEQ ID NO: 85614 - DNA, 25 bp, Homo sapien
gctggcgtgtttgggatcactgttt

SEQ ID NO: 85615 - DNA, 25 bp, Homo sapien
tttaacagccatcggcctctgcgtc

SEQ ID NO: 85616 - DNA, 25 bp, Homo sapien
cacacggccctttttgtgcgtcttt

SEQ ID NO: 85617 - DNA, 25 bp, Homo sapien
ctggctgaaggacacacggcccttt

SEQ ID NO: 85618 - DNA, 25 bp, Homo sapien
gatcactgtttagaggacagtcctg

SEQ ID NO: 85619 - DNA, 25 bp, Homo sapien
tgtgtcggctcatgggtgacgctaa

SEQ ID NO: 85620 - DNA, 25 bp, Homo sapien
acaaagccaggacggcgctctccaa

SEQ ID NO: 85621 - DNA, 25 bp, Homo sapien
ctgggaacacaaagccaggacggcg

SEQ ID NO: 85622 - DNA, 25 bp, Homo sapien
tagagaacgcgacagcacccacggc

SEQ ID NO: 85623 - DNA, 25 bp, Homo sapien
taacatggatgtagagaacgcgaca

SEQ ID NO: 85624 - DNA, 25 bp, Homo sapien
ctctgggcggttgtgtaacatggat

SEQ ID NO: 85625 - DNA, 25 bp, Homo sapien
tgtcagtctgggtgatactaaggcg

SEQ ID NO: 85626 - DNA, 25 bp, Homo sapien
gtgtgtcagctctgggtgatgctaa

SEQ ID NO: 85627 - DNA, 25 bp, Homo sapien
tggtgcacgtgctcgtggaacctct

SEQ ID NO: 85628 - DNA, 25 bp, Homo sapien
tggaacctctggaccaccgtgagct

SEQ ID NO: 85629 - DNA, 25 bp, Homo sapien
acacgaacgcgggtctgcgttcccg

SEQ ID NO: 85630 - DNA, 25 bp, Homo sapien
aaggccagcgccaacggacggccgt

SEQ ID NO: 85631 - DNA, 25 bp, Homo sapien
tctggaccaccgtgagctccacgaa

SEQ ID NO: 85632 - DNA, 25 bp, Homo sapien
cctggaacacaggacggcaccgtga

SEQ ID NO: 85633 - DNA, 25 bp, Homo sapien
gaccacagggcgtacagagcactga

SEQ ID NO: 85634 - DNA, 25 bp, Homo sapien
ttctcaggaaacacgaacgcgggtc

SEQ ID NO: 85635 - DNA, 25 bp, Homo sapien
agacgcttcctgatgacgatgctga

SEQ ID NO: 85636 - DNA, 25 bp, Homo sapien
gggctgctatcacatccacggcgtc

SEQ ID NO: 85637 - DNA, 25 bp, Homo sapien
ctggagacggacaaggacacacgct

SEQ ID NO: 85638 - DNA, 25 bp, Homo sapien
tgccgtgtgaacaaggaagtagcct

SEQ ID NO: 85639 - DNA, 25 bp, Homo sapien
cttcggccacggctgttgtcctgtt

SEQ ID NO: 85640 - DNA, 25 bp, Homo sapien
agcaagcagtgatgcagacgcttcc

SEQ ID NO: 85641 - DNA, 25 bp, Homo sapien
ttaccgtcagaagctgtaacccagc

SEQ ID NO: 85642 - DNA, 25 bp, Homo sapien
tgttgtcctgttctttgccgtgtga

SEQ ID NO: 85643 - DNA, 25 bp, Homo sapien
cctggctgaccgactctggcgagtc

SEQ ID NO: 85644 - DNA, 25 bp, Homo sapien
cgccgtagttctgagatgcagttca

SEQ ID NO: 85645 - DNA, 25 bp, Homo sapien
tactgggactagctgcccgcacagc

SEQ ID NO: 85646 - DNA, 25 bp, Homo sapien
gcacagcgcagctgtctctggcctg

SEQ ID NO: 85647 - DNA, 25 bp, Homo sapien
cctcgttgccctggaaacgcggacg

SEQ ID NO: 85648 - DNA, 25 bp, Homo sapien
aagccacgaagcttcgccaggcgct

SEQ ID NO: 85649 - DNA, 25 bp, Homo sapien
cttctctgcttttaggcaaggcctg

SEQ ID NO: 85650 - DNA, 25 bp, Homo sapien
cgaccgactcggagtactgggacta

SEQ ID NO: 85651 - DNA, 25 bp, Homo sapien
agggcacggcatgttgcgaacttga

SEQ ID NO: 85652 - DNA, 25 bp, Homo sapien
aattcggagttgctggccttcctca

SEQ ID NO: 85653 - DNA, 25 bp, Homo sapien
ggctgtacacctgctggctgccatg

SEQ ID NO: 85654 - DNA, 25 bp, Homo sapien
ggatcagctacccaggcgcgcttct

SEQ ID NO: 85655 - DNA, 25 bp, Homo sapien
cgcaggtggcaaacaaacggctttg

SEQ ID NO: 85656 - DNA, 25 bp, Homo sapien
cccgccgcagatctggattcgcttt

SEQ ID NO: 85657 - DNA, 25 bp, Homo sapien
gatttctcccaaagtctcgcccgtg

SEQ ID NO: 85658 - DNA, 25 bp, Homo sapien
tgagctcgacgtggttctcagaacc

SEQ ID NO: 85659 - DNA, 25 bp, Homo sapien
gacatgcccttcacgctgctcggtg

SEQ ID NO: 85660 - DNA, 25 bp, Homo sapien
aacagaagcgcgcagagtcccatcc

SEQ ID NO: 85661 - DNA, 25 bp, Homo sapien
cagtgttaggaaagagacctccctc

SEQ ID NO: 85662 - DNA, 25 bp, Homo sapien
cggtgagcgcattcagcaccctgga

SEQ ID NO: 85663 - DNA, 25 bp, Homo sapien
cgcccgaagcagagccatgagaacc

SEQ ID NO: 85664 - DNA, 25 bp, Homo sapien
ttgttgcgcctacagcgctgagctc

SEQ ID NO: 85665 - DNA, 25 bp, Homo sapien
cgtcctcctggtgaatctgtctctg

SEQ ID NO: 85666 - DNA, 25 bp, Homo sapien
ccaagtcattggcttcctggacacc

SEQ ID NO: 85667 - DNA, 25 bp, Homo sapien
agctttgcgtgtgtcctgtggtgac

SEQ ID NO: 85668 - DNA, 25 bp, Homo sapien
tctgcgtgtgctgaaaccgcgcacc

SEQ ID NO: 85669 - DNA, 25 bp, Homo sapien
agcgtctgggacactgactggacca

SEQ ID NO: 85670 - DNA, 25 bp, Homo sapien
ctgggacactgactggaccagcctc

SEQ ID NO: 85671 - DNA, 25 bp, Homo sapien
tcccgcactttctgggtggctttgg

SEQ ID NO: 85672 - DNA, 25 bp, Homo sapien
ctttgggcaggtcagccagagcttt

SEQ ID NO: 85673 - DNA, 25 bp, Homo sapien
tcagccagagctttgcgtgtgtcct

SEQ ID NO: 85674 - DNA, 25 bp, Homo sapien
cagcgcctatgcatttctgcgtgtg

SEQ ID NO: 85675 - DNA, 25 bp, Homo sapien
acgtggagacttgatgcatttttga

SEQ ID NO: 85676 - DNA, 25 bp, Homo sapien
gtctgctatggctgtgctcctgagt

SEQ ID NO: 85677 - DNA, 25 bp, Homo sapien
cggacgcaaatactcacggcggagc

SEQ ID NO: 85678 - DNA, 25 bp, Homo sapien
gccgtggcgttcgtaagaagcaaaa

SEQ ID NO: 85679 - DNA, 25 bp, Homo sapien
cctggcccgaaacacgtggagactt

SEQ ID NO: 85680 - DNA, 25 bp, Homo sapien
ggcggcgcctgtcaagataaaactc

SEQ ID NO: 85681 - DNA, 25 bp, Homo sapien
tcatgaaggtcaatgccaagccacg

SEQ ID NO: 85682 - DNA, 25 bp, Homo sapien
gccaccaggtggattaggccacaca

SEQ ID NO: 85683 - DNA, 25 bp, Homo sapien
tgacctacagcaaggcggtggccga

SEQ ID NO: 85684 - DNA, 25 bp, Homo sapien
tggctgagttagctgctccgcttcc

SEQ ID NO: 85685 - DNA, 25 bp, Homo sapien
tggcggagctcgtgcccttcgtcac

SEQ ID NO: 85686 - DNA, 25 bp, Homo sapien
cttcgtcaccgtgaacgcccagtgg

SEQ ID NO: 85687 - DNA, 25 bp, Homo sapien
agcaagtgcctgacctacagcaagg

SEQ ID NO: 85688 - DNA, 25 bp, Homo sapien
aggtgctgtcactgtggctgagtta

SEQ ID NO: 85689 - DNA, 25 bp, Homo sapien
tcctggccggcatggtgcaccggct

SEQ ID NO: 85690 - DNA, 25 bp, Homo sapien
cagtggggcatcctcagcaagtgcc

SEQ ID NO: 85691 - DNA, 25 bp, Homo sapien
ctagccctaccggactacgagtatc

SEQ ID NO: 85692 - DNA, 25 bp, Homo sapien
cccggaacttgagtggccagctcca

SEQ ID NO: 85693 - DNA, 25 bp, Homo sapien
tccactttgcgacacggagactgtt

SEQ ID NO: 85694 - DNA, 25 bp, Homo sapien
acggagactgtttgtgtgacacctc

SEQ ID NO: 85695 - DNA, 25 bp, Homo sapien
ccatggcaacggagagagacggcaa

SEQ ID NO: 85696 - DNA, 25 bp, Homo sapien
tcaaaggatgctgagtccggagcgc

SEQ ID NO: 85697 - DNA, 25 bp, Homo sapien
cgtgcagacgaattaggccagggtc

SEQ ID NO: 85698 - DNA, 25 bp, Homo sapien
gactacgagtatctgggtaggaacc

SEQ ID NO: 85699 - DNA, 25 bp, Homo sapien
actccggcatttgcgtttggggcgc

SEQ ID NO: 85700 - DNA, 25 bp, Homo sapien
gagtgccacatcactgcgctggccg

SEQ ID NO: 85701 - DNA, 25 bp, Homo sapien
tgctccttacagtcctggtcgtcgc

SEQ ID NO: 85702 - DNA, 25 bp, Homo sapien
ggagtgtgatccgtcgcttcccagg

SEQ ID NO: 85703 - DNA, 25 bp, Homo sapien
ccgggagctttcttccagtaggtca

SEQ ID NO: 85704 - DNA, 25 bp, Homo sapien
tcttccagtaggtcacgcgcctatg

SEQ ID NO: 85705 - DNA, 25 bp, Homo sapien
cacgcgcctatggtcctggcgagaa

SEQ ID NO: 85706 - DNA, 25 bp, Homo sapien
cactgtaacccgactccggcatttg

SEQ ID NO: 85707 - DNA, 25 bp, Homo sapien
caactgcaaaagagccacaggagga

SEQ ID NO: 85708 - DNA, 25 bp, Homo sapien
tggcatcggaacaccgggaccacgc

SEQ ID NO: 85709 - DNA, 25 bp, Homo sapien
agctgcaaacccaggcaactgcaaa

SEQ ID NO: 85710 - DNA, 25 bp, Homo sapien
cgggctgcactcctcgttaaaagac

SEQ ID NO: 85711 - DNA, 25 bp, Homo sapien
cccgactggtctgaaaacacgttgc

SEQ ID NO: 85712 - DNA, 25 bp, Homo sapien
cacgttgcatgcgatttaaagaagc

SEQ ID NO: 85713 - DNA, 25 bp, Homo sapien
attacgggccggtgataaggcttcg

SEQ ID NO: 85714 - DNA, 25 bp, Homo sapien
caggagcgagccctcggtggaaacc

SEQ ID NO: 85715 - DNA, 25 bp, Homo sapien
cctctgtgcagctgaaggcgtccgt

SEQ ID NO: 85716 - DNA, 25 bp, Homo sapien
tggtaaatcccagcctgaccgagtg

SEQ ID NO: 85717 - DNA, 25 bp, Homo sapien
cttgtgaacaggagcgtttcggccc

SEQ ID NO: 85718 - DNA, 25 bp, Homo sapien
caccctggctctgtaggggcggcct

SEQ ID NO: 85719 - DNA, 25 bp, Homo sapien
cggcggccaacttgtgaacaggagc

SEQ ID NO: 85720 - DNA, 25 bp, Homo sapien
ccggctcctgaagcctgccgtggaa

SEQ ID NO: 85721 - DNA, 25 bp, Homo sapien
ccggtgaatggcagcagcgtccacc

SEQ ID NO: 85722 - DNA, 25 bp, Homo sapien
atcccagcctgaccgagtgttgacc

SEQ ID NO: 85723 - DNA, 25 bp, Homo sapien
tcccggacactgctgtcaatgggta

SEQ ID NO: 85724 - DNA, 25 bp, Homo sapien
gacactgctgtcaatgggtatttgg

SEQ ID NO: 85725 - DNA, 25 bp, Homo sapien
tgtcaatgggtatttggttctttcc

SEQ ID NO: 85726 - DNA, 25 bp, Homo sapien
caaggccactgcgtggcgccctgta

SEQ ID NO: 85727 - DNA, 25 bp, Homo sapien
aggattcgtccacgcctcgcgcagt

SEQ ID NO: 85728 - DNA, 25 bp, Homo sapien
cacgcctcgcgcagtggagcttacg

SEQ ID NO: 85729 - DNA, 25 bp, Homo sapien
tggagcttacgggagatgcgcgacc

SEQ ID NO: 85730 - DNA, 25 bp, Homo sapien
ggcgtcgctcctgtatcgcccaggt

SEQ ID NO: 85731 - DNA, 25 bp, Homo sapien
gcactgctcccgcatccatgtgaag

SEQ ID NO: 85732 - DNA, 25 bp, Homo sapien
cccgcatccatgtgaagatcacgag

SEQ ID NO: 85733 - DNA, 25 bp, Homo sapien
tctgcgatgggtgcagcactgctcc

SEQ ID NO: 85734 - DNA, 25 bp, Homo sapien
cccgcatccatgtgaagagcacgag

SEQ ID NO: 85735 - DNA, 25 bp, Homo sapien
ccgcatccatgtgaagatcacgagg

SEQ ID NO: 85736 - DNA, 25 bp, Homo sapien
gtctgcgatgggtgcagcactgctc

SEQ ID NO: 85737 - DNA, 25 bp, Homo sapien
tctgcgatgggtgcagcactgcgcc

SEQ ID NO: 85738 - DNA, 25 bp, Homo sapien
ccgcatccatgtgaagagcacgagg

SEQ ID NO: 85739 - DNA, 25 bp, Homo sapien
gagggcatggaatagggcggcttgt

SEQ ID NO: 85740 - DNA, 25 bp, Homo sapien
ttatctggcctgaggcggatactga

SEQ ID NO: 85741 - DNA, 25 bp, Homo sapien
ggttatctggcctgaggcggatact

SEQ ID NO: 85742 - DNA, 25 bp, Homo sapien
ttctcgcagagccaggccctccaac

SEQ ID NO: 85743 - DNA, 25 bp, Homo sapien
gccctccaacccgtgccacctcagc

SEQ ID NO: 85744 - DNA, 25 bp, Homo sapien
tccaacccgtgccacctcagcctct

SEQ ID NO: 85745 - DNA, 25 bp, Homo sapien
cccagaggggttatctggcctgagg

SEQ ID NO: 85746 - DNA, 25 bp, Homo sapien
atagggcggcttgtgcaggtcccgc

SEQ ID NO: 85747 - DNA, 25 bp, Homo sapien
tgctgggcttgtggctgccacgccc

SEQ ID NO: 85748 - DNA, 25 bp, Homo sapien
gggctgttccggacttcaacactca

SEQ ID NO: 85749 - DNA, 25 bp, Homo sapien
gctggagcggctggcttacctcctc

SEQ ID NO: 85750 - DNA, 25 bp, Homo sapien
gctggcttacctcctcgtggcttac

SEQ ID NO: 85751 - DNA, 25 bp, Homo sapien
ttacctcctcgtggcttacagcctg

SEQ ID NO: 85752 - DNA, 25 bp, Homo sapien
tcgtggcttacagcctggacgcctc

SEQ ID NO: 85753 - DNA, 25 bp, Homo sapien
gcttacagcctggacgcctcagtcg

SEQ ID NO: 85754 - DNA, 25 bp, Homo sapien
gtccgggctgttccggacttcaaca

SEQ ID NO: 85755 - DNA, 25 bp, Homo sapien
tccatcttggcgtacttggccttgc

SEQ ID NO: 85756 - DNA, 25 bp, Homo sapien
cctcctccgcctggcgcagcgcctc

SEQ ID NO: 85757 - DNA, 25 bp, Homo sapien
cccgctggactcagggccgccttcc

SEQ ID NO: 85758 - DNA, 25 bp, Homo sapien
gcgcaccttgtctcggatgccctgg

SEQ ID NO: 85759 - DNA, 25 bp, Homo sapien
accttgtctcggatgccctggcgca

SEQ ID NO: 85760 - DNA, 25 bp, Homo sapien
catcttggcgtacttggccttgcgc

SEQ ID NO: 85761 - DNA, 25 bp, Homo sapien
cttggcgtacttggccttgcgctcc

SEQ ID NO: 85762 - DNA, 25 bp, Homo sapien
cgtacttggccttgcgctcctcctc

SEQ ID NO: 85763 - DNA, 25 bp, Homo sapien
gatgctggcccaactcggattcttg

SEQ ID NO: 85764 - DNA, 25 bp, Homo sapien
cgatgaataaggattaggctgccca

SEQ ID NO: 85765 - DNA, 25 bp, Homo sapien
tctggatttcggtcttgttcggctc

SEQ ID NO: 85766 - DNA, 25 bp, Homo sapien
ccctgctcacgcaccttgttggttg

SEQ ID NO: 85767 - DNA, 25 bp, Homo sapien
acaccgtacgtgatgctggcccaac

SEQ ID NO: 85768 - DNA, 25 bp, Homo sapien
tgaagctcagatggacgcccaggga

SEQ ID NO: 85769 - DNA, 25 bp, Homo sapien
cggagagcctacctgatgaagctca

SEQ ID NO: 85770 - DNA, 25 bp, Homo sapien
tggaactgcgcgaagcctcttaaaa

SEQ ID NO: 85771 - DNA, 25 bp, Homo sapien
gacggagtgcccctcggatgcaagc

SEQ ID NO: 85772 - DNA, 25 bp, Homo sapien
acggagtgcccctcggatgcaagcc

SEQ ID NO: 85773 - DNA, 25 bp, Homo sapien
gagtgcccctcggatgcaagcccgt

SEQ ID NO: 85774 - DNA, 25 bp, Homo sapien
ccctcggatgcaagcccgtctggcc

SEQ ID NO: 85775 - DNA, 25 bp, Homo sapien
cctcggatgcaagcccgtctggccc

SEQ ID NO: 85776 - DNA, 25 bp, Homo sapien
tcggatgcaagcccgtctggcccag

SEQ ID NO: 85777 - DNA, 25 bp, Homo sapien
ttccttttctggttggacaacgaga

SEQ ID NO: 85778 - DNA, 25 bp, Homo sapien
tcttccttttctggttggacaacga

SEQ ID NO: 85779 - DNA, 25 bp, Homo sapien
ccttttctggttggacaacgagagt

SEQ ID NO: 85780 - DNA, 25 bp, Homo sapien
cgggaagtccttggcgccgggcttg

SEQ ID NO: 85781 - DNA, 25 bp, Homo sapien
cttccttttctggttggacaacgag

SEQ ID NO: 85782 - DNA, 25 bp, Homo sapien
tccttttctggttggacaacgagag

SEQ ID NO: 85783 - DNA, 25 bp, Homo sapien
cttttctggttggacaacgagagtt

SEQ ID NO: 85784 - DNA, 25 bp, Homo sapien
ttttctggttggacaacgagagttg

SEQ ID NO: 85785 - DNA, 25 bp, Homo sapien
ggtaaatgcatgtcggtgttagcta

SEQ ID NO: 85786 - DNA, 25 bp, Homo sapien
atctgccttgccaggcgcatggtag

SEQ ID NO: 85787 - DNA, 25 bp, Homo sapien
gcctggctcatggtaaatgcatgtc

SEQ ID NO: 85788 - DNA, 25 bp, Homo sapien
ggggatataatgatagctacctctt

SEQ ID NO: 85789 - DNA, 25 bp, Homo sapien
ctacctcttagggttgttgtcagag

SEQ ID NO: 85790 - DNA, 25 bp, Homo sapien
tgttacatctgccttgccaggcgca

SEQ ID NO: 85791 - DNA, 25 bp, Homo sapien
agcctgtggatcagtgcctggctca

SEQ ID NO: 85792 - DNA, 25 bp, Homo sapien
tcagagttgagtacaaaagcctgtg

SEQ ID NO: 85793 - DNA, 25 bp, Homo sapien
tctggccgtgtcagaccttttcgtg

SEQ ID NO: 85794 - DNA, 25 bp, Homo sapien
ctgaagttgggaccgcgcacagacc

SEQ ID NO: 85795 - DNA, 25 bp, Homo sapien
cttcatcgtgtctctggccgtgtca

SEQ ID NO: 85796 - DNA, 25 bp, Homo sapien
gccgtgtcagaccttttcgtggcgc

SEQ ID NO: 85797 - DNA, 25 bp, Homo sapien
tcatggtcggcctggcatggacctt

SEQ ID NO: 85798 - DNA, 25 bp, Homo sapien
tcggcctggcatggaccttgtccat

SEQ ID NO: 85799 - DNA, 25 bp, Homo sapien
ctggcatggaccttgtccatcctca

SEQ ID NO: 85800 - DNA, 25 bp, Homo sapien
cactggggccctcacaggtggtcac

SEQ ID NO: 85801 - DNA, 25 bp, Homo sapien
ctttcagcgaagttggcgagtgtcc

SEQ ID NO: 85802 - DNA, 25 bp, Homo sapien
gggcagctccacacgatcctttcag

SEQ ID NO: 85803 - DNA, 25 bp, Homo sapien
tgaggattcctgaaacgcagttttc

SEQ ID NO: 85804 - DNA, 25 bp, Homo sapien
ttgcgcacccgaaggtttccgcagg

SEQ ID NO: 85805 - DNA, 25 bp, Homo sapien
gacctgcaagtagggttccagtcca

SEQ ID NO: 85806 - DNA, 25 bp, Homo sapien
gccttccggaggagaagtctttgtc

SEQ ID NO: 85807 - DNA, 25 bp, Homo sapien
acctggaacgttccctcagctgggg

SEQ ID NO: 85808 - DNA, 25 bp, Homo sapien
accaccgacaggttgtagccgtaga

SEQ ID NO: 85809 - DNA, 25 bp, Homo sapien
taggagcttgccctcatccttcagc

SEQ ID NO: 85810 - DNA, 25 bp, Homo sapien
actcaccgagtagccgtcagcaacg

SEQ ID NO: 85811 - DNA, 25 bp, Homo sapien
ccgtcagcaacgctgaacactgtga

SEQ ID NO: 85812 - DNA, 25 bp, Homo sapien
tgctggcgtcgcacaccgcgaggaa

SEQ ID NO: 85813 - DNA, 25 bp, Homo sapien
cttgccctcatccttcagcgtggtg

SEQ ID NO: 85814 - DNA, 25 bp, Homo sapien
cagcgtggtgcccaggatggaatac

SEQ ID NO: 85815 - DNA, 25 bp, Homo sapien
tacaggcggacgttgccgtcctacg

SEQ ID NO: 85816 - DNA, 25 bp, Homo sapien
tgaacactgtgaccaccttgctggc

SEQ ID NO: 85817 - DNA, 25 bp, Homo sapien
gtgggtgcctttctgttgctagctt

SEQ ID NO: 85818 - DNA, 25 bp, Homo sapien
agcagccgcgtcagaatgcttctgg

SEQ ID NO: 85819 - DNA, 25 bp, Homo sapien
atatatagtcaagcgctcggctcgg

SEQ ID NO: 85820 - DNA, 25 bp, Homo sapien
tgcgaattacacctcgccgaggccg

SEQ ID NO: 85821 - DNA, 25 bp, Homo sapien
ccgcggcacttactgatctcgtacg

SEQ ID NO: 85822 - DNA, 25 bp, Homo sapien
gccgccgatgatcttggagacgccc

SEQ ID NO: 85823 - DNA, 25 bp, Homo sapien
aggctggcgaacaccttctctgcgg

SEQ ID NO: 85824 - DNA, 25 bp, Homo sapien
ttctctgcggagacacaaatgcggc

SEQ ID NO: 85825 - DNA, 25 bp, Homo sapien
tgactaaatgcgtcccgtgcacctg

SEQ ID NO: 85826 - DNA, 25 bp, Homo sapien
gtcccgtgcacctgactaaatgcgt

SEQ ID NO: 85827 - DNA, 25 bp, Homo sapien
atgcgtcccgtgcacctgactaaat

SEQ ID NO: 85828 - DNA, 25 bp, Homo sapien
gactaaatgcgtcccgtgcacctga

SEQ ID NO: 85829 - DNA, 25 bp, Homo sapien
tgcacctgactaaatgcgtcccgtg

SEQ ID NO: 85830 - DNA, 25 bp, Homo sapien
tcccgtgcacctgactaaatgcgtc

SEQ ID NO: 85831 - DNA, 25 bp, Homo sapien
tgcgtcccgtgcacctgactaaatg

SEQ ID NO: 85832 - DNA, 25 bp, Homo sapien
gcgtcccgtgcacctgactaaatgc

SEQ ID NO: 85833 - DNA, 25 bp, Homo sapien
cccacttctgggcttagagcttgac

SEQ ID NO: 85834 - DNA, 25 bp, Homo sapien
ggctttaaaaatggcctcctgacga

SEQ ID NO: 85835 - DNA, 25 bp, Homo sapien
cgcctgaggtctctaaggctgcgcc

SEQ ID NO: 85836 - DNA, 25 bp, Homo sapien
cttagagcttgacccaacacgttcg

SEQ ID NO: 85837 - DNA, 25 bp, Homo sapien
gcttcggtcacgtacacgcggatcc

SEQ ID NO: 85838 - DNA, 25 bp, Homo sapien
aggaggcatccttcataacgctggg

SEQ ID NO: 85839 - DNA, 25 bp, Homo sapien
gacgacacttcctgctcggcgcgga

SEQ ID NO: 85840 - DNA, 25 bp, Homo sapien
ccgccgggcttctaagctgtccaga

SEQ ID NO: 85841 - DNA, 25 bp, Homo sapien
cggcacagaacaggcttggcttcca

SEQ ID NO: 85842 - DNA, 25 bp, Homo sapien
gcgcagaactgcgtagactcgagta

SEQ ID NO: 85843 - DNA, 25 bp, Homo sapien
ccagagagggtgcatttagaaactc

SEQ ID NO: 85844 - DNA, 25 bp, Homo sapien
gtcccttgcctagaccagagctctg

SEQ ID NO: 85845 - DNA, 25 bp, Homo sapien
cgagggttcctgatgactgcagctc

SEQ ID NO: 85846 - DNA, 25 bp, Homo sapien
gcccagctcggcgtgtagagctcta

SEQ ID NO: 85847 - DNA, 25 bp, Homo sapien
cgcgcttccgaaaatcgggaatgta

SEQ ID NO: 85848 - DNA, 25 bp, Homo sapien
ttccggaggatgcagatcagaacca

SEQ ID NO: 85849 - DNA, 25 bp, Homo sapien
ggcttgcccaagatttccctctagt

SEQ ID NO: 85850 - DNA, 25 bp, Homo sapien
cgaggtttctctgcttcgcccgtgt

SEQ ID NO: 85851 - DNA, 25 bp, Homo sapien
ttagaaattggctcaggcgaggctc

SEQ ID NO: 85852 - DNA, 25 bp, Homo sapien
ccctgctaatctggggcgccttcta

SEQ ID NO: 85853 - DNA, 25 bp, Homo sapien
ttctaaggcctgagacgaacacgcg

SEQ ID NO: 85854 - DNA, 25 bp, Homo sapien
cccgctccgagttcttatttccaga

SEQ ID NO: 85855 - DNA, 25 bp, Homo sapien
agctgcacagcttgtttagaaattg

SEQ ID NO: 85856 - DNA, 25 bp, Homo sapien
gggagtcggctccattgcaaacttc

SEQ ID NO: 85857 - DNA, 25 bp, Homo sapien
ggggcagaagcagagacgtttcctc

SEQ ID NO: 85858 - DNA, 25 bp, Homo sapien
cgcgaacctggggagcgtcacagat

SEQ ID NO: 85859 - DNA, 25 bp, Homo sapien
gcaggctgcaaagccactaggctca

SEQ ID NO: 85860 - DNA, 25 bp, Homo sapien
acgtttcctctgcagacatcgggga

SEQ ID NO: 85861 - DNA, 25 bp, Homo sapien
gcggcacaggcggataaaccctctg

SEQ ID NO: 85862 - DNA, 25 bp, Homo sapien
gcacagaaacccaaagtgccatttg

SEQ ID NO: 85863 - DNA, 25 bp, Homo sapien
ctgcgggaagcttgttcctggcaca

SEQ ID NO: 85864 - DNA, 25 bp, Homo sapien
ggaagcatgagctgcatcccgcatc

SEQ ID NO: 85865 - DNA, 25 bp, Homo sapien
cactatggaccgagcacggtggccg

SEQ ID NO: 85866 - DNA, 25 bp, Homo sapien
aattcaaacgtgtactccgcgaacg

SEQ ID NO: 85867 - DNA, 25 bp, Homo sapien
ggggatacggcccactatggaccga

SEQ ID NO: 85868 - DNA, 25 bp, Homo sapien
cccggactcccgtgtgcaattatcg

SEQ ID NO: 85869 - DNA, 25 bp, Homo sapien
cgtttcccggactcccgtgtgcaat

SEQ ID NO: 85870 - DNA, 25 bp, Homo sapien
tcgtgaagccggtccactcctcagc

SEQ ID NO: 85871 - DNA, 25 bp, Homo sapien
gcctgtgcttcgtccgctcggcggt

SEQ ID NO: 85872 - DNA, 25 bp, Homo sapien
cccttcggagtcattaattcaaacg

SEQ ID NO: 85873 - DNA, 25 bp, Homo sapien
cagcgggaaaaagcgcagccagttc

SEQ ID NO: 85874 - DNA, 25 bp, Homo sapien
tgtagtccacattgagcctgccatc

SEQ ID NO: 85875 - DNA, 25 bp, Homo sapien
cgggttcatgctgtagactcgctca

SEQ ID NO: 85876 - DNA, 25 bp, Homo sapien
agccgtggctgtaatgctcctccca

SEQ ID NO: 85877 - DNA, 25 bp, Homo sapien
cctcccagtcgaagaagtggacctc

SEQ ID NO: 85878 - DNA, 25 bp, Homo sapien
tgcggcgacagctttaggaacctct

SEQ ID NO: 85879 - DNA, 25 bp, Homo sapien
tgtcccgcaggcagtaaaagccctt

SEQ ID NO: 85880 - DNA, 25 bp, Homo sapien
cgcccggcctttggactcatgtaag

SEQ ID NO: 85881 - DNA, 25 bp, Homo sapien
tagagcgcacctggagaggtcaagc

SEQ ID NO: 85882 - DNA, 25 bp, Homo sapien
taggcgttccaaccgcgggttcgca

SEQ ID NO: 85883 - DNA, 25 bp, Homo sapien
gagctggggtctaggcgttccaacc

SEQ ID NO: 85884 - DNA, 25 bp, Homo sapien
gtcaagctccgcgaataagaccctt

SEQ ID NO: 85885 - DNA, 25 bp, Homo sapien
atccgcctacgttctgggtctgtcc

SEQ ID NO: 85886 - DNA, 25 bp, Homo sapien
atcatccgcctacgttctgggtctg

SEQ ID NO: 85887 - DNA, 25 bp, Homo sapien
ccggcacccggctttggctccagct

SEQ ID NO: 85888 - DNA, 25 bp, Homo sapien
gcgaataagacccttcctgggagct

SEQ ID NO: 85889 - DNA, 25 bp, Homo sapien
tggtctgagcccgagtctacctctt

SEQ ID NO: 85890 - DNA, 25 bp, Homo sapien
tccaattcgctctgcagccggactg

SEQ ID NO: 85891 - DNA, 25 bp, Homo sapien
agccggcttcaaagagcgccctgtc

SEQ ID NO: 85892 - DNA, 25 bp, Homo sapien
cccacgtgagtctgcaccatgcgta

SEQ ID NO: 85893 - DNA, 25 bp, Homo sapien
tcttctctaagtcgccagctcggca

SEQ ID NO: 85894 - DNA, 25 bp, Homo sapien
actcccttacgcctgcttggtctga

SEQ ID NO: 85895 - DNA, 25 bp, Homo sapien
gtccggcgccctaaataggctccta

SEQ ID NO: 85896 - DNA, 25 bp, Homo sapien
ctcggcacttgtacccgggacctgt

SEQ ID NO: 85897 - DNA, 25 bp, Homo sapien
tcccttcaggagacagttggctaga

SEQ ID NO: 85898 - DNA, 25 bp, Homo sapien
cgtgaatacagtggagctccggcgc

SEQ ID NO: 85899 - DNA, 25 bp, Homo sapien
gaagcctcagtagcggccgtgaata

SEQ ID NO: 85900 - DNA, 25 bp, Homo sapien
cgacgattttcagttgccggtcctg

SEQ ID NO: 85901 - DNA, 25 bp, Homo sapien
agctttcaggcgttccatcaaattc

SEQ ID NO: 85902 - DNA, 25 bp, Homo sapien
cctcctcagagtccgacatggtgtc

SEQ ID NO: 85903 - DNA, 25 bp, Homo sapien
gaatcactcggcaagcgccatcttg

SEQ ID NO: 85904 - DNA, 25 bp, Homo sapien
tccctcttgagaaagtctctgaagg

SEQ ID NO: 85905 - DNA, 25 bp, Homo sapien
cttaaggatgcgaaaactactggga

SEQ ID NO: 85906 - DNA, 25 bp, Homo sapien
aggcaaggcgcaaacccgctggctt

SEQ ID NO: 85907 - DNA, 25 bp, Homo sapien
cgtgcgccacgaggcttaaggatgc

SEQ ID NO: 85908 - DNA, 25 bp, Homo sapien
tggctgcaaagacgctcgccaaagc

SEQ ID NO: 85909 - DNA, 25 bp, Homo sapien
ctctaagaccgcacccggattgggt

SEQ ID NO: 85910 - DNA, 25 bp, Homo sapien
gtcctagtgaggcagaactcgaccc

SEQ ID NO: 85911 - DNA, 25 bp, Homo sapien
cggggcaaaccgctgcaaagtccta

SEQ ID NO: 85912 - DNA, 25 bp, Homo sapien
caggctactgtgctccggggcaaac

SEQ ID NO: 85913 - DNA, 25 bp, Homo sapien
caccgtttcccgttcgagacgcaga

SEQ ID NO: 85914 - DNA, 25 bp, Homo sapien
tctgagccactgtgatcaccgtttc

SEQ ID NO: 85915 - DNA, 25 bp, Homo sapien
cagctctgtctctatgcggatgtca

SEQ ID NO: 85916 - DNA, 25 bp, Homo sapien
gcgctgctagcatgtgggaaattca

SEQ ID NO: 85917 - DNA, 25 bp, Homo sapien
cggcaccttggacatcccgcgttta

SEQ ID NO: 85918 - DNA, 25 bp, Homo sapien
tctcccgcgtacttgaaccaactta

SEQ ID NO: 85919 - DNA, 25 bp, Homo sapien
gtcctttctgctggaatcatcaatg

SEQ ID NO: 85920 - DNA, 25 bp, Homo sapien
gcctgcggccactagcccattttat

SEQ ID NO: 85921 - DNA, 25 bp, Homo sapien
gaaagcacagtgacctccttcgctc

SEQ ID NO: 85922 - DNA, 25 bp, Homo sapien
accgaaggactaggcggcatgccga

SEQ ID NO: 85923 - DNA, 25 bp, Homo sapien
ggtgctcttgcggaagccaaacttg

SEQ ID NO: 85924 - DNA, 25 bp, Homo sapien
gccgggaaagctgaaagcacagtga

SEQ ID NO: 85925 - DNA, 25 bp, Homo sapien
acgcgccgaggcgattagtcagtga

SEQ ID NO: 85926 - DNA, 25 bp, Homo sapien
ttagtcagtgaggtccgcactcggc

SEQ ID NO: 85927 - DNA, 25 bp, Homo sapien
actcggcgcagactgaagtgctcca

SEQ ID NO: 85928 - DNA, 25 bp, Homo sapien
ccaaacttgggctctccgaaacagg

SEQ ID NO: 85929 - DNA, 25 bp, Homo sapien
tcgagtgagagccacgccgaatttc

SEQ ID NO: 85930 - DNA, 25 bp, Homo sapien
gtcagccgggactacagatagcctc

SEQ ID NO: 85931 - DNA, 25 bp, Homo sapien
agcagtggcgcaagtgcttcctcca

SEQ ID NO: 85932 - DNA, 25 bp, Homo sapien
cgtgtgatccacagcagacgtcgga

SEQ ID NO: 85933 - DNA, 25 bp, Homo sapien
gaccttggcgcgtgatttcttctcc

SEQ ID NO: 85934 - DNA, 25 bp, Homo sapien
gcacctggtctcgttgacactcgtg

SEQ ID NO: 85935 - DNA, 25 bp, Homo sapien
gggtcatcgctgcttttacacaagg

SEQ ID NO: 85936 - DNA, 25 bp, Homo sapien
cccgcaaattcagggtgggctacgc

SEQ ID NO: 85937 - DNA, 25 bp, Homo sapien
ttcacacggaggacgcgatggctcc

SEQ ID NO: 85938 - DNA, 25 bp, Homo sapien
ccggagctccaagctggtttgaaca

SEQ ID NO: 85939 - DNA, 25 bp, Homo sapien
ccctccatgatcttcgcatagagca

SEQ ID NO: 85940 - DNA, 25 bp, Homo sapien
agacctccgagattgtattacgccc

SEQ ID NO: 85941 - DNA, 25 bp, Homo sapien
ccaagaagctctgtgcgaagggctc

SEQ ID NO: 85942 - DNA, 25 bp, Homo sapien
cctgtgcctgctgcttgaatatttc

SEQ ID NO: 85943 - DNA, 25 bp, Homo sapien
ttccgccttttagggtgctcgcgca

SEQ ID NO: 85944 - DNA, 25 bp, Homo sapien
ctggtttgaacaagccctgggcatg

SEQ ID NO: 85945 - DNA, 25 bp, Homo sapien
tacgcacgtcaagccgagtccatta

SEQ ID NO: 85946 - DNA, 25 bp, Homo sapien
ctccgcgctagcgaaaataatgttc

SEQ ID NO: 85947 - DNA, 25 bp, Homo sapien
aactggaacatgtctccgcgctagc

SEQ ID NO: 85948 - DNA, 25 bp, Homo sapien
tgcgatctgtcacaacaactggaac

SEQ ID NO: 85949 - DNA, 25 bp, Homo sapien
ccgtcattatggctgaaatgcgatc

SEQ ID NO: 85950 - DNA, 25 bp, Homo sapien
tctgtggatttaggtgtcaaaaacc

SEQ ID NO: 85951 - DNA, 25 bp, Homo sapien
agttcccgccgccacatatggtctg

SEQ ID NO: 85952 - DNA, 25 bp, Homo sapien
ccttgacgggcagaatcaaactaca

SEQ ID NO: 85953 - DNA, 25 bp, Homo sapien
tcctctgtggagaaacgtgcccacg

SEQ ID NO: 85954 - DNA, 25 bp, Homo sapien
tgcctgcagagtcccagagacggct

SEQ ID NO: 85955 - DNA, 25 bp, Homo sapien
attttggaacgcagtgcgtcgccgc

SEQ ID NO: 85956 - DNA, 25 bp, Homo sapien
ctggagacaaggtgatatcttgggc

SEQ ID NO: 85957 - DNA, 25 bp, Homo sapien
atatcttgggcgtgtggccatacgc

SEQ ID NO: 85958 - DNA, 25 bp, Homo sapien
gcacatccacacagggaagcccggg

SEQ ID NO: 85959 - DNA, 25 bp, Homo sapien
gagagccacaggcagacaaacgcgc

SEQ ID NO: 85960 - DNA, 25 bp, Homo sapien
cattttggaacgcaggcggcagcca

SEQ ID NO: 85961 - DNA, 25 bp, Homo sapien
cgggcgcacaaaccgcaactgctgg

SEQ ID NO: 85962 - DNA, 25 bp, Homo sapien
agcgggctttgagcctggagaactc

SEQ ID NO: 85963 - DNA, 25 bp, Homo sapien
tgcgtttcgcagtggccgcagattc

SEQ ID NO: 85964 - DNA, 25 bp, Homo sapien
cgcacgttcacgcaagcttggagga

SEQ ID NO: 85965 - DNA, 25 bp, Homo sapien
gcgagcttacctcgcgggaggctca

SEQ ID NO: 85966 - DNA, 25 bp, Homo sapien
caacacgaacagagtggtgcgtttc

SEQ ID NO: 85967 - DNA, 25 bp, Homo sapien
tgggtggccagaagccacgctccta

SEQ ID NO: 85968 - DNA, 25 bp, Homo sapien
gcctggagaactcgtcacgcacgtt

SEQ ID NO: 85969 - DNA, 25 bp, Homo sapien
gcccactcggaggtgttcttcacca

SEQ ID NO: 85970 - DNA, 25 bp, Homo sapien
agaacttcgggatttggccagcctc

SEQ ID NO: 85971 - DNA, 25 bp, Homo sapien
taggtcactggctacctgaggtctc

SEQ ID NO: 85972 - DNA, 25 bp, Homo sapien
ccctgcatcgagtttttggaccctg

SEQ ID NO: 85973 - DNA, 25 bp, Homo sapien
cccaatccgggatcttcggcctagg

SEQ ID NO: 85974 - DNA, 25 bp, Homo sapien
ctccagcagaaaggtccagcggtcc

SEQ ID NO: 85975 - DNA, 25 bp, Homo sapien
cgcgggctcagttcccgaagtgata

SEQ ID NO: 85976 - DNA, 25 bp, Homo sapien
ctggggccaaaggtatttagaatct

SEQ ID NO: 85977 - DNA, 25 bp, Homo sapien
tatcccggcgtaactacggagtcca

SEQ ID NO: 85978 - DNA, 25 bp, Homo sapien
ggcccattttttcctagtcttctgc

SEQ ID NO: 85979 - DNA, 25 bp, Homo sapien
cttctcctccgcagtttggatccta

SEQ ID NO: 85980 - DNA, 25 bp, Homo sapien
aggaactctgcaacctcccgacggg

SEQ ID NO: 85981 - DNA, 25 bp, Homo sapien
tgctgcccagcaacgaaaggccatg

SEQ ID NO: 85982 - DNA, 25 bp, Homo sapien
cctcagatgccggtgaccttgattg

SEQ ID NO: 85983 - DNA, 25 bp, Homo sapien
ggtgccttctgaacccggtgcttca

SEQ ID NO: 85984 - DNA, 25 bp, Homo sapien
tggttgtatgcccagagatatcccg

SEQ ID NO: 85985 - DNA, 25 bp, Homo sapien
caacgggatgttgttacggaaccag

SEQ ID NO: 85986 - DNA, 25 bp, Homo sapien
ggaaccagcggatccagagcaaccc

SEQ ID NO: 85987 - DNA, 25 bp, Homo sapien
gaggaaaagacggtgacaacattga

SEQ ID NO: 85988 - DNA, 25 bp, Homo sapien
acacctggggccctaggtctgagcg

SEQ ID NO: 85989 - DNA, 25 bp, Homo sapien
acattgacgaaagtccggcgacgga

SEQ ID NO: 85990 - DNA, 25 bp, Homo sapien
gttagggcttcgacccgcgcgacac

SEQ ID NO: 85991 - DNA, 25 bp, Homo sapien
aagagccagtttcgaccgtcgccgg

SEQ ID NO: 85992 - DNA, 25 bp, Homo sapien
cggagacgacaagactgtgctggtc

SEQ ID NO: 85993 - DNA, 25 bp, Homo sapien
ctggctcccaggaagtgaccgccgt

SEQ ID NO: 85994 - DNA, 25 bp, Homo sapien
agtgaccgccgtcaggtcacctgcg

SEQ ID NO: 85995 - DNA, 25 bp, Homo sapien
gccagaacctcgcagcccagcaagg

SEQ ID NO: 85996 - DNA, 25 bp, Homo sapien
cccgagtcgcgaagaagtccagcct

SEQ ID NO: 85997 - DNA, 25 bp, Homo sapien
aggccggggtaatcgcgtccacaat

SEQ ID NO: 85998 - DNA, 25 bp, Homo sapien
cgtccacaatggagtgcgcaaagcc

SEQ ID NO: 85999 - DNA, 25 bp, Homo sapien
acaaagacgacagctgcgtggcagg

SEQ ID NO: 86000 - DNA, 25 bp, Homo sapien
cgcaaagccgggtacaaagacgaca

SEQ ID NO: 86001 - DNA, 25 bp, Homo sapien
gggcgccttcagcagcctgcagagc

SEQ ID NO: 86002 - DNA, 25 bp, Homo sapien
gcagttcagcctcctgcatcagcag

SEQ ID NO: 86003 - DNA, 25 bp, Homo sapien
ctggcgcatcagcagaccatgcagg

SEQ ID NO: 86004 - DNA, 25 bp, Homo sapien
gaccatgcaggatgagctgcttctg

SEQ ID NO: 86005 - DNA, 25 bp, Homo sapien
ctgcttctggggctgacacagcagc

SEQ ID NO: 86006 - DNA, 25 bp, Homo sapien
gcacgatcgcgggtgtgacccacct

SEQ ID NO: 86007 - DNA, 25 bp, Homo sapien
caggacttcagtaagcggcagcagc

SEQ ID NO: 86008 - DNA, 25 bp, Homo sapien
cctgtcaccggcttcttagaggccg

SEQ ID NO: 86009 - DNA, 25 bp, Homo sapien
cgctccgttaccttgtcgcagtaga

SEQ ID NO: 86010 - DNA, 25 bp, Homo sapien
accagctgcttcatccgccagtgtg

SEQ ID NO: 86011 - DNA, 25 bp, Homo sapien
gggcggtgaagacgtccacttcttc

SEQ ID NO: 86012 - DNA, 25 bp, Homo sapien
ttcttcaggaaagggcgccatcgcc

SEQ ID NO: 86013 - DNA, 25 bp, Homo sapien
tgtcgtcttcataagccgcagaagg

SEQ ID NO: 86014 - DNA, 25 bp, Homo sapien
tgaccaatgcttctggccaggacct

SEQ ID NO: 86015 - DNA, 25 bp, Homo sapien
cccacccagcggttggtgaaccaga

SEQ ID NO: 86016 - DNA, 25 bp, Homo sapien
attggcccgtgccagatttttcctg

SEQ ID NO: 86017 - DNA, 25 bp, Homo sapien
tggcattcaaataactcccgcgaga

SEQ ID NO: 86018 - DNA, 25 bp, Homo sapien
cggtgtctcctagggtttcttgtca

SEQ ID NO: 86019 - DNA, 25 bp, Homo sapien
ccactacctgcttcgcctggttgtg

SEQ ID NO: 86020 - DNA, 25 bp, Homo sapien
agcagtctcttttcgctcccatggc

SEQ ID NO: 86021 - DNA, 25 bp, Homo sapien
gtccgctaaagcgaagcattccagg

SEQ ID NO: 86022 - DNA, 25 bp, Homo sapien
aggagcgattcagcgccactacctg

SEQ ID NO: 86023 - DNA, 25 bp, Homo sapien
cagagggccgatccagttcttttcg

SEQ ID NO: 86024 - DNA, 25 bp, Homo sapien
ccaccagctcagaggcagagttctc

SEQ ID NO: 86025 - DNA, 25 bp, Homo sapien
tcaccaccaggttcacgccgagaag

SEQ ID NO: 86026 - DNA, 25 bp, Homo sapien
acaaattcgcgtttgcctctgctcg

SEQ ID NO: 86027 - DNA, 25 bp, Homo sapien
gacagggctcgaagacctcatcttg

SEQ ID NO: 86028 - DNA, 25 bp, Homo sapien
ataagaaggtaacgcgacctggcgc

SEQ ID NO: 86029 - DNA, 25 bp, Homo sapien
cgccgccatcttacttagggacctg

SEQ ID NO: 86030 - DNA, 25 bp, Homo sapien
ccgtaaggacacacgccggaagtgc

SEQ ID NO: 86031 - DNA, 25 bp, Homo sapien
caaacaagctggaacccgctgggtg

SEQ ID NO: 86032 - DNA, 25 bp, Homo sapien
cccgccatcaccgttgtaatctatg

SEQ ID NO: 86033 - DNA, 25 bp, Homo sapien
ttctgcttctactgttgctgctggc

SEQ ID NO: 86034 - DNA, 25 bp, Homo sapien
cgggaaacggcaaacagcgagatat

SEQ ID NO: 86035 - DNA, 25 bp, Homo sapien
agagtcccgccctgcatcagtttgc

SEQ ID NO: 86036 - DNA, 25 bp, Homo sapien
agtaccgcgcactgctgagtcccga

SEQ ID NO: 86037 - DNA, 25 bp, Homo sapien
ctgcatcagtttgcggaaccgcctt

SEQ ID NO: 86038 - DNA, 25 bp, Homo sapien
gaaccgccttggtagaaggagagaa

SEQ ID NO: 86039 - DNA, 25 bp, Homo sapien
cagcgcacacttgcgggacatcttc

SEQ ID NO: 86040 - DNA, 25 bp, Homo sapien
agcgagatatccgagcgagagtccc

SEQ ID NO: 86041 - DNA, 25 bp, Homo sapien
cttcagggacggaatagaactcgca

SEQ ID NO: 86042 - DNA, 25 bp, Homo sapien
gcagggtgtcgctgacattttcaac

SEQ ID NO: 86043 - DNA, 25 bp, Homo sapien
agccctatggccaactgcgagttca

SEQ ID NO: 86044 - DNA, 25 bp, Homo sapien
tctaggagagcccaactctgtcttg

SEQ ID NO: 86045 - DNA, 25 bp, Homo sapien
ctgtcttggcgtcagtatcctggtc

SEQ ID NO: 86046 - DNA, 25 bp, Homo sapien
tatcctggtcctgatcctcgtcgtg

SEQ ID NO: 86047 - DNA, 25 bp, Homo sapien
ggcgcgatgcgtcaagtacactgaa

SEQ ID NO: 86048 - DNA, 25 bp, Homo sapien
gcccgctgtctctgacccgaaagtg

SEQ ID NO: 86049 - DNA, 25 bp, Homo sapien
ctgaaagcgaggaccaggtgctgta

SEQ ID NO: 86050 - DNA, 25 bp, Homo sapien
ccgaatgagggccaaggattacaac

SEQ ID NO: 86051 - DNA, 25 bp, Homo sapien
cacgcatcctctcctgaaagcgagg

SEQ ID NO: 86052 - DNA, 25 bp, Homo sapien
agcttggcactgtttgggtcactta

SEQ ID NO: 86053 - DNA, 25 bp, Homo sapien
tgctgtattgaagagctgggcgctc

SEQ ID NO: 86054 - DNA, 25 bp, Homo sapien
ggaaaccggcggctgcgccatctgc

SEQ ID NO: 86055 - DNA, 25 bp, Homo sapien
attacaactgtcctggaaaccggcg

SEQ ID NO: 86056 - DNA, 25 bp, Homo sapien
gtcacttattggcacgtccacctcg

SEQ ID NO: 86057 - DNA, 25 bp, Homo sapien
agactcgttcccaagaccctggcga

SEQ ID NO: 86058 - DNA, 25 bp, Homo sapien
cagaccctggctcgtgaattattta

SEQ ID NO: 86059 - DNA, 25 bp, Homo sapien
gcgggccaccactcagactaaaaag

SEQ ID NO: 86060 - DNA, 25 bp, Homo sapien
cggctgcacagtgttggcccatttc

SEQ ID NO: 86061 - DNA, 25 bp, Homo sapien
tccctagagtttcctttaccgcaga

SEQ ID NO: 86062 - DNA, 25 bp, Homo sapien
ttctacagccgtgaagctcctggtc

SEQ ID NO: 86063 - DNA, 25 bp, Homo sapien
ctccatctagcgatagccgcgggtc

SEQ ID NO: 86064 - DNA, 25 bp, Homo sapien
tcaagccaggggtgcatgctttctc

SEQ ID NO: 86065 - DNA, 25 bp, Homo sapien
gccggtcgctctcgtagaagcccag

SEQ ID NO: 86066 - DNA, 25 bp, Homo sapien
gctctcgtagaagcccagcgtctct

SEQ ID NO: 86067 - DNA, 25 bp, Homo sapien
cagcgtctctgtgagctgaggcgcc

SEQ ID NO: 86068 - DNA, 25 bp, Homo sapien
gccatgttccgagcacaacaaactg

SEQ ID NO: 86069 - DNA, 25 bp, Homo sapien
cgagccattggcgtcagcgacgcgt

SEQ ID NO: 86070 - DNA, 25 bp, Homo sapien
gcccgccaggtcttggcactgctgg

SEQ ID NO: 86071 - DNA, 25 bp, Homo sapien
tttctcgcgccgtggctggctcggc

SEQ ID NO: 86072 - DNA, 25 bp, Homo sapien
cccgctattttggttccatctcttc

SEQ ID NO: 86073 - DNA, 25 bp, Homo sapien
cttggccaatcggagaatcgaatca

SEQ ID NO: 86074 - DNA, 25 bp, Homo sapien
acaccgcgcacgcgagagaaagccg

SEQ ID NO: 86075 - DNA, 25 bp, Homo sapien
tcggagaatcgaatcatctgactca

SEQ ID NO: 86076 - DNA, 25 bp, Homo sapien
acctgcccgtgaccttgtcagcctc

SEQ ID NO: 86077 - DNA, 25 bp, Homo sapien
atgcggttgctagcggagcatttcc

SEQ ID NO: 86078 - DNA, 25 bp, Homo sapien
tagcggagcatttccgcggaactta

SEQ ID NO: 86079 - DNA, 25 bp, Homo sapien
gaatcatctgactcacccatcctat

SEQ ID NO: 86080 - DNA, 25 bp, Homo sapien
gcatttccgcggaacttacaggtcc

SEQ ID NO: 86081 - DNA, 25 bp, Homo sapien
cgagtcagagtaccctggagggata

SEQ ID NO: 86082 - DNA, 25 bp, Homo sapien
tggagggataatgctctgcaggtaa

SEQ ID NO: 86083 - DNA, 25 bp, Homo sapien
tcagagtaccctggagggataatgc

SEQ ID NO: 86084 - DNA, 25 bp, Homo sapien
gctgtttctagctctcgccatccct

SEQ ID NO: 86085 - DNA, 25 bp, Homo sapien
tcgcgctgtttctagctctcgccat

SEQ ID NO: 86086 - DNA, 25 bp, Homo sapien
cttctcgcgctgtttctagctctcg

SEQ ID NO: 86087 - DNA, 25 bp, Homo sapien
tgccttctcgcgctgtttctagctc

SEQ ID NO: 86088 - DNA, 25 bp, Homo sapien
taccctggagggataatgctctgca

SEQ ID NO: 86089 - DNA, 25 bp, Homo sapien
cccgcttgcagtaggaatacctgtg

SEQ ID NO: 86090 - DNA, 25 bp, Homo sapien
tatcgtttcgggatccgtatccata

SEQ ID NO: 86091 - DNA, 25 bp, Homo sapien
ttcgggatccgtatccatactttta

SEQ ID NO: 86092 - DNA, 25 bp, Homo sapien
cttgcagtaggaatacctgtgattc

SEQ ID NO: 86093 - DNA, 25 bp, Homo sapien
tccgtatccatacttttattttcac

SEQ ID NO: 86094 - DNA, 25 bp, Homo sapien
gcccagcttcccgtagccatcctcg

SEQ ID NO: 86095 - DNA, 25 bp, Homo sapien
gtgggttccaagtgccctttctcgc

SEQ ID NO: 86096 - DNA, 25 bp, Homo sapien
cgggatccgtatccatacttttatt

SEQ ID NO: 86097 - DNA, 25 bp, Homo sapien
gcagctccgaatgcctcgagccgga

SEQ ID NO: 86098 - DNA, 25 bp, Homo sapien
ggactgtaacttcggccaggccctg

SEQ ID NO: 86099 - DNA, 25 bp, Homo sapien
ggcccgaaaagcctgcacgcatcga

SEQ ID NO: 86100 - DNA, 25 bp, Homo sapien
gcattacccagttgcgggcccgaaa

SEQ ID NO: 86101 - DNA, 25 bp, Homo sapien
cgcgcacgtgcaagcaacacgagtc

SEQ ID NO: 86102 - DNA, 25 bp, Homo sapien
agacgcgtagacctgtgcgcgcacg

SEQ ID NO: 86103 - DNA, 25 bp, Homo sapien
gcacgcactcggaaacaggaataga

SEQ ID NO: 86104 - DNA, 25 bp, Homo sapien
agtcacgccggactttttgggtctg

SEQ ID NO: 86105 - DNA, 25 bp, Homo sapien
tgtgacgtcaccatatcggtcccgc

SEQ ID NO: 86106 - DNA, 25 bp, Homo sapien
cgggactgtcaaccgcgtccggaag

SEQ ID NO: 86107 - DNA, 25 bp, Homo sapien
ccgcggtttgatcccagcggtccag

SEQ ID NO: 86108 - DNA, 25 bp, Homo sapien
ggccgagccgacaagatgttcttgc

SEQ ID NO: 86109 - DNA, 25 bp, Homo sapien
cggagtctctccaccgcagacatga

SEQ ID NO: 86110 - DNA, 25 bp, Homo sapien
ctgggcgcccaagccaagttgcaaa

SEQ ID NO: 86111 - DNA, 25 bp, Homo sapien
aattctctccttgcggggatcggcc

SEQ ID NO: 86112 - DNA, 25 bp, Homo sapien
gtgatggttgtagccgccctttacc

SEQ ID NO: 86113 - DNA, 25 bp, Homo sapien
gttggagtcatctttcgaggtaata

SEQ ID NO: 86114 - DNA, 25 bp, Homo sapien
ttcgcttcttcaggcagctccaggc

SEQ ID NO: 86115 - DNA, 25 bp, Homo sapien
ttttctgaaacgtgaactgcgcgta

SEQ ID NO: 86116 - DNA, 25 bp, Homo sapien
ccagcagtactttggtggacgagtt

SEQ ID NO: 86117 - DNA, 25 bp, Homo sapien
atgggcgtctttgtccctagccttc

SEQ ID NO: 86118 - DNA, 25 bp, Homo sapien
acaccagccacgtgagcttctgagc

SEQ ID NO: 86119 - DNA, 25 bp, Homo sapien
gcagtggatctctcttgcgccattc

SEQ ID NO: 86120 - DNA, 25 bp, Homo sapien
ggcgctcctagaccttccagcagta

SEQ ID NO: 86121 - DNA, 25 bp, Homo sapien
acacacgacgttccctgtgctggcg

SEQ ID NO: 86122 - DNA, 25 bp, Homo sapien
tctttgggaacacgcattccggttc

SEQ ID NO: 86123 - DNA, 25 bp, Homo sapien
cggagccggcacagagcaagaatga

SEQ ID NO: 86124 - DNA, 25 bp, Homo sapien
gcaagaatgaggtggtgctcatccc

SEQ ID NO: 86125 - DNA, 25 bp, Homo sapien
gaatgaggtggtgctcatcccacac

SEQ ID NO: 86126 - DNA, 25 bp, Homo sapien
ggcgtcgaagcacctgcacaacgtt

SEQ ID NO: 86127 - DNA, 25 bp, Homo sapien
gcacaacgttgcttctttgggaaca

SEQ ID NO: 86128 - DNA, 25 bp, Homo sapien
gacgttccctgtgctggcgtcgaag

SEQ ID NO: 86129 - DNA, 25 bp, Homo sapien
gcaacccaaacagaaggtactgctg

SEQ ID NO: 86130 - DNA, 25 bp, Homo sapien
ccatgtcgtcgaaacgggcgctatg

SEQ ID NO: 86131 - DNA, 25 bp, Homo sapien
ggccgattatcttgggaagtgactt

SEQ ID NO: 86132 - DNA, 25 bp, Homo sapien
tcaggaagtctcaggggccgattat

SEQ ID NO: 86133 - DNA, 25 bp, Homo sapien
ccgagcaccgccaaagcgcgtgagt

SEQ ID NO: 86134 - DNA, 25 bp, Homo sapien
cccaggattggtaggctccaccgct

SEQ ID NO: 86135 - DNA, 25 bp, Homo sapien
cgctaggctaggtctgtgcgcagcc

SEQ ID NO: 86136 - DNA, 25 bp, Homo sapien
ggtgagagtctctctgagcaaccca

SEQ ID NO: 86137 - DNA, 25 bp, Homo sapien
tcagctgctggttctccactcgcag

SEQ ID NO: 86138 - DNA, 25 bp, Homo sapien
gatggcctcgttttccctctcgtag

SEQ ID NO: 86139 - DNA, 25 bp, Homo sapien
cgggcgtagtccttgctcagctgct

SEQ ID NO: 86140 - DNA, 25 bp, Homo sapien
tccgacttggtttcagggctctcct

SEQ ID NO: 86141 - DNA, 25 bp, Homo sapien
gagcctcctctcgtagtcagccttg

SEQ ID NO: 86142 - DNA, 25 bp, Homo sapien
agtcagccttgagctccagcatttc

SEQ ID NO: 86143 - DNA, 25 bp, Homo sapien
atttccctggagagcgtgaggactc

SEQ ID NO: 86144 - DNA, 25 bp, Homo sapien
tttccctctcgtaggtggcctgcag

SEQ ID NO: 86145 - DNA, 25 bp, Homo sapien
aagtttctgtctggatttggcccgg

SEQ ID NO: 86146 - DNA, 25 bp, Homo sapien
acattttcacgtgcatctggggatc

SEQ ID NO: 86147 - DNA, 25 bp, Homo sapien
ttggcctccgagacaaagtttctgt

SEQ ID NO: 86148 - DNA, 25 bp, Homo sapien
cccagccagtgcaggtttcgtgtgc

SEQ ID NO: 86149 - DNA, 25 bp, Homo sapien
cgctggcgatcagtctgcagttccc

SEQ ID NO: 86150 - DNA, 25 bp, Homo sapien
tttcctctcctgctggttctctggc

SEQ ID NO: 86151 - DNA, 25 bp, Homo sapien
ctgttgagagcagaagccatcgcta

SEQ ID NO: 86152 - DNA, 25 bp, Homo sapien
tctggggatcacagtccattctcca

SEQ ID NO: 86153 - DNA, 25 bp, Homo sapien
ggcagatctcccgttctcactcttg

SEQ ID NO: 86154 - DNA, 25 bp, Homo sapien
agcgtcgtctcccttctcagaggtg

SEQ ID NO: 86155 - DNA, 25 bp, Homo sapien
tcggccacaagggaggttgttatcc

SEQ ID NO: 86156 - DNA, 25 bp, Homo sapien
aaggttgaacctagacgcatgcgcc

SEQ ID NO: 86157 - DNA, 25 bp, Homo sapien
tcccaaagcgcttacggcagtctcg

SEQ ID NO: 86158 - DNA, 25 bp, Homo sapien
cttcgcgactcacttcatagggatc

SEQ ID NO: 86159 - DNA, 25 bp, Homo sapien
tccctggggctgtcatagaagacta

SEQ ID NO: 86160 - DNA, 25 bp, Homo sapien
tctcgcgggaattatttgaacgttc

SEQ ID NO: 86161 - DNA, 25 bp, Homo sapien
ggagcctcgagacaggaagaagcga

SEQ ID NO: 86162 - DNA, 25 bp, Homo sapien
gacggtgcgggcctgctccctacag

SEQ ID NO: 86163 - DNA, 25 bp, Homo sapien
agggcgcgtcactcgcaggcgctcc

SEQ ID NO: 86164 - DNA, 25 bp, Homo sapien
cagcgccgattctcctccaaacttc

SEQ ID NO: 86165 - DNA, 25 bp, Homo sapien
aggctttgccgcagcgccgattctc

SEQ ID NO: 86166 - DNA, 25 bp, Homo sapien
ctcggaggctttgccgcagcgccga

SEQ ID NO: 86167 - DNA, 25 bp, Homo sapien
gcccgcgtccgagcgtgacgagcac

SEQ ID NO: 86168 - DNA, 25 bp, Homo sapien
gtgcgggcctgctccctacagggtc

SEQ ID NO: 86169 - DNA, 25 bp, Homo sapien
caagagtcgagttcccgccggaatc

SEQ ID NO: 86170 - DNA, 25 bp, Homo sapien
ttctgccttcactacgggactccga

SEQ ID NO: 86171 - DNA, 25 bp, Homo sapien
gcggactagcaacgcctactttctg

SEQ ID NO: 86172 - DNA, 25 bp, Homo sapien
cgccaggatcccgaagctgaacttg

SEQ ID NO: 86173 - DNA, 25 bp, Homo sapien
gcgtctctcttacctacacagtgca

SEQ ID NO: 86174 - DNA, 25 bp, Homo sapien
gcaagcgggtccaaactaacagttc

SEQ ID NO: 86175 - DNA, 25 bp, Homo sapien
ctggagtttactcaggcgagccata

SEQ ID NO: 86176 - DNA, 25 bp, Homo sapien
tcatttacatacgagcagcgcaggc

SEQ ID NO: 86177 - DNA, 25 bp, Homo sapien
ttccctcggagcagcaagctaaaga

SEQ ID NO: 86178 - DNA, 25 bp, Homo sapien
tgcccagacatccttcagcgaagtg

SEQ ID NO: 86179 - DNA, 25 bp, Homo sapien
ttgatcggggccataatacctattg

SEQ ID NO: 86180 - DNA, 25 bp, Homo sapien
ctgtcttgtaccttcgccactggca

SEQ ID NO: 86181 - DNA, 25 bp, Homo sapien
tgcatcttagcagccgttggaagcc

SEQ ID NO: 86182 - DNA, 25 bp, Homo sapien
ttcatccttgggagacagaagacgc

SEQ ID NO: 86183 - DNA, 25 bp, Homo sapien
gtgggctctactgccttgttccata

SEQ ID NO: 86184 - DNA, 25 bp, Homo sapien
ctagtggatatttctgcccggctgc

SEQ ID NO: 86185 - DNA, 25 bp, Homo sapien
cggcttgcttcctgatctgttgcta

SEQ ID NO: 86186 - DNA, 25 bp, Homo sapien
caggcgactgggaacccgtcatcgt

SEQ ID NO: 86187 - DNA, 25 bp, Homo sapien
ctaaggacccttgagatcgtgagcg

SEQ ID NO: 86188 - DNA, 25 bp, Homo sapien
gctctccggacctcttattcgaaaa

SEQ ID NO: 86189 - DNA, 25 bp, Homo sapien
tccgcgacctcttaccattggttta

SEQ ID NO: 86190 - DNA, 25 bp, Homo sapien
ccattggtttagacgacgcagcgtg

SEQ ID NO: 86191 - DNA, 25 bp, Homo sapien
ttcgaaaaacatcctccaccacgtg

SEQ ID NO: 86192 - DNA, 25 bp, Homo sapien
ttggccgaccgagtgccggtcataa

SEQ ID NO: 86193 - DNA, 25 bp, Homo sapien
tcctccagctgagccgaaatgcttt

SEQ ID NO: 86194 - DNA, 25 bp, Homo sapien
ccgctcgcaagcttattgcatccta

SEQ ID NO: 86195 - DNA, 25 bp, Homo sapien
atcctaccgcctgtagagctggcct

SEQ ID NO: 86196 - DNA, 25 bp, Homo sapien
gctgagccgaaatgctttccaccct

SEQ ID NO: 86197 - DNA, 25 bp, Homo sapien
tcacattcatgtctagggacgcagg

SEQ ID NO: 86198 - DNA, 25 bp, Homo sapien
gagactcgagagtccaccggccagg

SEQ ID NO: 86199 - DNA, 25 bp, Homo sapien
tccacgggtctgcacgggagcgcac

SEQ ID NO: 86200 - DNA, 25 bp, Homo sapien
agcttattgcatcctaccgcctgta

SEQ ID NO: 86201 - DNA, 25 bp, Homo sapien
ctacagctccacacaaaggcgcgtg

SEQ ID NO: 86202 - DNA, 25 bp, Homo sapien
ggacatgctcctttgtccgctgcgg

SEQ ID NO: 86203 - DNA, 25 bp, Homo sapien
gcagctcggacgcagattcccttgc

SEQ ID NO: 86204 - DNA, 25 bp, Homo sapien
gattcccttgcctttccctgaactg

SEQ ID NO: 86205 - DNA, 25 bp, Homo sapien
ccatgccaagcacacgaggtctttc

SEQ ID NO: 86206 - DNA, 25 bp, Homo sapien
cgcgggagatactcacagggtgacc

SEQ ID NO: 86207 - DNA, 25 bp, Homo sapien
tgctccaaagttgagcggagagata

SEQ ID NO: 86208 - DNA, 25 bp, Homo sapien
ccgcgggaaggcagtaactcgtaga

SEQ ID NO: 86209 - DNA, 25 bp, Homo sapien
atgctgcggtccttggtggtctcca

SEQ ID NO: 86210 - DNA, 25 bp, Homo sapien
tcactgtgaccgtgtagacgccctc

SEQ ID NO: 86211 - DNA, 25 bp, Homo sapien
tggtcctcgcccacagggttcttca

SEQ ID NO: 86212 - DNA, 25 bp, Homo sapien
actgtgaggttgacctggtcctcgc

SEQ ID NO: 86213 - DNA, 25 bp, Homo sapien
tcaccgatgaccttgactgtgaggt

SEQ ID NO: 86214 - DNA, 25 bp, Homo sapien
aatgagcgaacggatgggccctcct

SEQ ID NO: 86215 - DNA, 25 bp, Homo sapien
ccgtgatgtttgtcgagtggctgaa

SEQ ID NO: 86216 - DNA, 25 bp, Homo sapien
ctcagggagcatgcccgtgatgttt

SEQ ID NO: 86217 - DNA, 25 bp, Homo sapien
ggggcagcagactacaacagttatt

SEQ ID NO: 86218 - DNA, 25 bp, Homo sapien
ggaacgcgacagaacctggagactg

SEQ ID NO: 86219 - DNA, 25 bp, Homo sapien
cttgagattgcagccattttaggga

SEQ ID NO: 86220 - DNA, 25 bp, Homo sapien
caggggacgcctctacttgagattg

SEQ ID NO: 86221 - DNA, 25 bp, Homo sapien
tagaccctgagcacatgcctgtctc

SEQ ID NO: 86222 - DNA, 25 bp, Homo sapien
gacagatgcctgtagactttcacca

SEQ ID NO: 86223 - DNA, 25 bp, Homo sapien
cgcccaccgagtagctaatgccttt

SEQ ID NO: 86224 - DNA, 25 bp, Homo sapien
gccggactgcattgcacagtcatca

SEQ ID NO: 86225 - DNA, 25 bp, Homo sapien
cgctagtgaacccagcccagagaga

SEQ ID NO: 86226 - DNA, 25 bp, Homo sapien
gcggccggaaccaacagctaaaatg

SEQ ID NO: 86227 - DNA, 25 bp, Homo sapien
gtcgaggacagccacttaactctgg

SEQ ID NO: 86228 - DNA, 25 bp, Homo sapien
cacgcttcttgccagaggggtaatc

SEQ ID NO: 86229 - DNA, 25 bp, Homo sapien
tgctgcccttggaagcgaatactcc

SEQ ID NO: 86230 - DNA, 25 bp, Homo sapien
agaaacaaaggctcgggctccagga

SEQ ID NO: 86231 - DNA, 25 bp, Homo sapien
gcttggacatcctcgcactcttcga

SEQ ID NO: 86232 - DNA, 25 bp, Homo sapien
gcactcttcgaacgggcagttatta

SEQ ID NO: 86233 - DNA, 25 bp, Homo sapien
tccacgtgcaccagttcggggacct

SEQ ID NO: 86234 - DNA, 25 bp, Homo sapien
atgctggcgctactgtgttcctgcc

SEQ ID NO: 86235 - DNA, 25 bp, Homo sapien
cccaactctgactcggcggagtgga

SEQ ID NO: 86236 - DNA, 25 bp, Homo sapien
ggagtggatccgagacatgtacgcc

SEQ ID NO: 86237 - DNA, 25 bp, Homo sapien
tcacggagatctggcaggaggtcat

SEQ ID NO: 86238 - DNA, 25 bp, Homo sapien
acttcggcaacttcgcggtccgcga

SEQ ID NO: 86239 - DNA, 25 bp, Homo sapien
cgggagcactcagagcgcaagaagc

SEQ ID NO: 86240 - DNA, 25 bp, Homo sapien
catgtacgccaaggtcacggagatc

SEQ ID NO: 86241 - DNA, 25 bp, Homo sapien
cggcacgatcctgggcacccaggaa

SEQ ID NO: 86242 - DNA, 25 bp, Homo sapien
cccggcgccagaggcaactccctcg

SEQ ID NO: 86243 - DNA, 25 bp, Homo sapien
ccactcacagggagctgatgtcgcc

SEQ ID NO: 86244 - DNA, 25 bp, Homo sapien
atgtcgcccggcacgatcctgggca

SEQ ID NO: 86245 - DNA, 25 bp, Homo sapien
cacccaggaagagcccacgcagatg

SEQ ID NO: 86246 - DNA, 25 bp, Homo sapien
ctccttggtacagctgcaagtggcg

SEQ ID NO: 86247 - DNA, 25 bp, Homo sapien
cgcagatgatagactccttggtaca

SEQ ID NO: 86248 - DNA, 25 bp, Homo sapien
gcccacgcagatgatagactccttg

SEQ ID NO: 86249 - DNA, 25 bp, Homo sapien
aagcgtctgccactgaccaggcgga

SEQ ID NO: 86250 - DNA, 25 bp, Homo sapien
gctgccatgctggtcccgatggtca

SEQ ID NO: 86251 - DNA, 25 bp, Homo sapien
cacgcacattggacgtgccagcacg

SEQ ID NO: 86252 - DNA, 25 bp, Homo sapien
gggatgtctggttcccgaaagcgtc

SEQ ID NO: 86253 - DNA, 25 bp, Homo sapien
cctggttggctgagccacgcacatt

SEQ ID NO: 86254 - DNA, 25 bp, Homo sapien
tcccgatggtcagccctggttggct

SEQ ID NO: 86255 - DNA, 25 bp, Homo sapien
acgtgccagcacgagacagcccggg

SEQ ID NO: 86256 - DNA, 25 bp, Homo sapien
tggttcccgaaagcgtctgccactg

SEQ ID NO: 86257 - DNA, 25 bp, Homo sapien
tggctgtcaggttcctcagatgatg

SEQ ID NO: 86258 - DNA, 25 bp, Homo sapien
cgccgcgatgggtcccagtcattaa

SEQ ID NO: 86259 - DNA, 25 bp, Homo sapien
gatagaagcttctcccacgcaggca

SEQ ID NO: 86260 - DNA, 25 bp, Homo sapien
cgcagatgcgcccaaatgttccaaa

SEQ ID NO: 86261 - DNA, 25 bp, Homo sapien
gggctcatttgtatgccgcaccctg

SEQ ID NO: 86262 - DNA, 25 bp, Homo sapien
tgccgcaccctggatacaagtgata

SEQ ID NO: 86263 - DNA, 25 bp, Homo sapien
cactccaaggagaccgcacagatga

SEQ ID NO: 86264 - DNA, 25 bp, Homo sapien
ccctaaagcgaggttcgtgctcatc

SEQ ID NO: 86265 - DNA, 25 bp, Homo sapien
ggcctgagccaagaccgtgggtaaa

SEQ ID NO: 86266 - DNA, 25 bp, Homo sapien
tcattcggcgtgacatgtgtgcgcc

SEQ ID NO: 86267 - DNA, 25 bp, Homo sapien
cgtgggtaaagcaagatcgggactt

SEQ ID NO: 86268 - DNA, 25 bp, Homo sapien
cctgtgcggtgacagccaggattta

SEQ ID NO: 86269 - DNA, 25 bp, Homo sapien
gcctcgattgctttctgacatgttc

SEQ ID NO: 86270 - DNA, 25 bp, Homo sapien
agccaggatttagtcgcctcgattg

SEQ ID NO: 86271 - DNA, 25 bp, Homo sapien
gttacctctgcagccgttgaagccg

SEQ ID NO: 86272 - DNA, 25 bp, Homo sapien
atgttcatagctcttccgggcgtta

SEQ ID NO: 86273 - DNA, 25 bp, Homo sapien
gaccttctcagatggcgctccagga

SEQ ID NO: 86274 - DNA, 25 bp, Homo sapien
gaagctctcgcggttcatgacagcg

SEQ ID NO: 86275 - DNA, 25 bp, Homo sapien
gaaccagaatgcaactcgccgcctg

SEQ ID NO: 86276 - DNA, 25 bp, Homo sapien
gacagctcggtaccttctccagaag

SEQ ID NO: 86277 - DNA, 25 bp, Homo sapien
cgttcgtgcacatgcgcagaccttc

SEQ ID NO: 86278 - DNA, 25 bp, Homo sapien
cgcgcttttcgctgacttttggcaa

SEQ ID NO: 86279 - DNA, 25 bp, Homo sapien
cggcagcgccttgggacaaaaaaca

SEQ ID NO: 86280 - DNA, 25 bp, Homo sapien
tctccagaagcagccgtatgaggtg

SEQ ID NO: 86281 - DNA, 25 bp, Homo sapien
tggtgaggtggcgtccgttctaccc

SEQ ID NO: 86282 - DNA, 25 bp, Homo sapien
gggagtccatggaggatccctccga

SEQ ID NO: 86283 - DNA, 25 bp, Homo sapien
gagccgctgctaccgcggatcgcct

SEQ ID NO: 86284 - DNA, 25 bp, Homo sapien
tctcccggagttcgtccgccgagct

SEQ ID NO: 86285 - DNA, 25 bp, Homo sapien
agagcccagtctctggcacctggct

SEQ ID NO: 86286 - DNA, 25 bp, Homo sapien
gcgccatgcagagcccagtctctgg

SEQ ID NO: 86287 - DNA, 25 bp, Homo sapien
cgggcacctagcttgctcgctcttt

SEQ ID NO: 86288 - DNA, 25 bp, Homo sapien
tgctctgatctggtctcagcgcgga

SEQ ID NO: 86289 - DNA, 25 bp, Homo sapien
caagctcctcctaagcgcctggggg

SEQ ID NO: 86290 - DNA, 25 bp, Homo sapien
aggtggtgcttcctttggatcctgc

SEQ ID NO: 86291 - DNA, 25 bp, Homo sapien
attcttgtttcgtactgaggctttc

SEQ ID NO: 86292 - DNA, 25 bp, Homo sapien
ttcgtactgaggctttcgggacggc

SEQ ID NO: 86293 - DNA, 25 bp, Homo sapien
tgtttcgtactgaggctttcgggac

SEQ ID NO: 86294 - DNA, 25 bp, Homo sapien
caccgctaggggccgcttaggtgca

SEQ ID NO: 86295 - DNA, 25 bp, Homo sapien
gtgcttcctttggatcctgccgtcc

SEQ ID NO: 86296 - DNA, 25 bp, Homo sapien
cagcattcttgtttcgtactgaggc

SEQ ID NO: 86297 - DNA, 25 bp, Homo sapien
acgagaactggaaggtgcccttgtc

SEQ ID NO: 86298 - DNA, 25 bp, Homo sapien
ctggtacaggcggatcttcttcttg

SEQ ID NO: 86299 - DNA, 25 bp, Homo sapien
cgcctccttgtgcttggacgagaac

SEQ ID NO: 86300 - DNA, 25 bp, Homo sapien
atcttcttgcggttgcccttctgga

SEQ ID NO: 86301 - DNA, 25 bp, Homo sapien
cgccatcttctggtaggtcatcttc

SEQ ID NO: 86302 - DNA, 25 bp, Homo sapien
tgacctcgcccgtcttgccgtagtt

SEQ ID NO: 86303 - DNA, 25 bp, Homo sapien
acttcgccgctgaactggtaggtga

SEQ ID NO: 86304 - DNA, 25 bp, Homo sapien
gcgagggcttaatgctatggccagc

SEQ ID NO: 86305 - DNA, 25 bp, Homo sapien
ttggccaacacagctggcgaggtga

SEQ ID NO: 86306 - DNA, 25 bp, Homo sapien
cgagcctgttcattcgggccacagg

SEQ ID NO: 86307 - DNA, 25 bp, Homo sapien
catgttgcgttttccgacctgtttc

SEQ ID NO: 86308 - DNA, 25 bp, Homo sapien
ctgtttcccatccttccgggtggtg

SEQ ID NO: 86309 - DNA, 25 bp, Homo sapien
gcagctcccgcaggagattattttc

SEQ ID NO: 86310 - DNA, 25 bp, Homo sapien
cgggatctcattgctttggccaaca

SEQ ID NO: 86311 - DNA, 25 bp, Homo sapien
caagaacaccgagcccgagcctgtt

SEQ ID NO: 86312 - DNA, 25 bp, Homo sapien
attttcctggtctggtcgcccaagc

SEQ ID NO: 86313 - DNA, 25 bp, Homo sapien
gggccaactactacggttcactgtc

SEQ ID NO: 86314 - DNA, 25 bp, Homo sapien
atccgccgggacatccgatgacttc

SEQ ID NO: 86315 - DNA, 25 bp, Homo sapien
tggtcccaggtctcaacaacacggc

SEQ ID NO: 86316 - DNA, 25 bp, Homo sapien
cgtggacttcctcatcggctatggc

SEQ ID NO: 86317 - DNA, 25 bp, Homo sapien
tggcctcaagaccaagtcgattgtg

SEQ ID NO: 86318 - DNA, 25 bp, Homo sapien
ctgaccgctgcgtggtcatcaagta

SEQ ID NO: 86319 - DNA, 25 bp, Homo sapien
cccaagcgtgcgctggatgagtcta

SEQ ID NO: 86320 - DNA, 25 bp, Homo sapien
tggccaacctactgcgtctgtcctg

SEQ ID NO: 86321 - DNA, 25 bp, Homo sapien
tgacagcggccagcctctttgcgca

SEQ ID NO: 86322 - DNA, 25 bp, Homo sapien
gagcttttctctcggcagcctggct

SEQ ID NO: 86323 - DNA, 25 bp, Homo sapien
ggcgaagtcgcgatgggttcattaa

SEQ ID NO: 86324 - DNA, 25 bp, Homo sapien
tcgccatatatacccggggcgctgc

SEQ ID NO: 86325 - DNA, 25 bp, Homo sapien
ggcgtgatgacagcggccagcctct

SEQ ID NO: 86326 - DNA, 25 bp, Homo sapien
ttgcgcaacaccttcgccatatata

SEQ ID NO: 86327 - DNA, 25 bp, Homo sapien
ccacttgcgggaatctcgtgcggac

SEQ ID NO: 86328 - DNA, 25 bp, Homo sapien
tcgcgatgggttcattaaggcggca

SEQ ID NO: 86329 - DNA, 25 bp, Homo sapien
cgcgtcctgccgaagaaactccaga

SEQ ID NO: 86330 - DNA, 25 bp, Homo sapien
ggctgggcaacatctctgccaagta

SEQ ID NO: 86331 - DNA, 25 bp, Homo sapien
tgccaagtatcgctggttcgccgtc

SEQ ID NO: 86332 - DNA, 25 bp, Homo sapien
atcttcttcttcctgatcccgctga

SEQ ID NO: 86333 - DNA, 25 bp, Homo sapien
atcccgctgacggtgtttggcctct

SEQ ID NO: 86334 - DNA, 25 bp, Homo sapien
catcatcctggtactgtgcctccga

SEQ ID NO: 86335 - DNA, 25 bp, Homo sapien
gatgccgtcgtctccaagttcaccg

SEQ ID NO: 86336 - DNA, 25 bp, Homo sapien
ggttcccgtcgtcttcatcatcatc

SEQ ID NO: 86337 - DNA, 25 bp, Homo sapien
atgagcacgagcgagagagcagctt

SEQ ID NO: 86338 - DNA, 25 bp, Homo sapien
gatccgggccggaacaggtcacctg

SEQ ID NO: 86339 - DNA, 25 bp, Homo sapien
cgctcaccaggtagcagagcaggag

SEQ ID NO: 86340 - DNA, 25 bp, Homo sapien
agggtccggcgctcaccaggtagca

SEQ ID NO: 86341 - DNA, 25 bp, Homo sapien
aagagagaaaactagcagcggcgtc

SEQ ID NO: 86342 - DNA, 25 bp, Homo sapien
agagcagcttggcaagtccggtcca

SEQ ID NO: 86343 - DNA, 25 bp, Homo sapien
ccgacccgggtctagagagagtcca

SEQ ID NO: 86344 - DNA, 25 bp, Homo sapien
tacctatcccaggtgccgggaacgc

SEQ ID NO: 86345 - DNA, 25 bp, Homo sapien
tgcagccatgtctgcgtgtgcgcag

SEQ ID NO: 86346 - DNA, 25 bp, Homo sapien
atgtgcgcaggtgtccgggtaacgc

SEQ ID NO: 86347 - DNA, 25 bp, Homo sapien
cctgtgcagccgtctgcatgtgcgc

SEQ ID NO: 86348 - DNA, 25 bp, Homo sapien
ccatgtctgcgtgtgcgcaggtgtc

SEQ ID NO: 86349 - DNA, 25 bp, Homo sapien
tgaccttgtgtagccgtctgcgtgt

SEQ ID NO: 86350 - DNA, 25 bp, Homo sapien
tggcaccgtgtgtgaccttgtgtag

SEQ ID NO: 86351 - DNA, 25 bp, Homo sapien
tgtgtagccgtctgcgtgtgcgcac

SEQ ID NO: 86352 - DNA, 25 bp, Homo sapien
tgtgtgaccttgtgtagccgtctgc

SEQ ID NO: 86353 - DNA, 25 bp, Homo sapien
ggctcccaggccttcaggatggatt

SEQ ID NO: 86354 - DNA, 25 bp, Homo sapien
aggccttcaggatggattttgaccc

SEQ ID NO: 86355 - DNA, 25 bp, Homo sapien
agttgtgccgcgcagctgcccggct

SEQ ID NO: 86356 - DNA, 25 bp, Homo sapien
gttgggactgcctccttgctggcat

SEQ ID NO: 86357 - DNA, 25 bp, Homo sapien
ccgcccgtgcaatgggtttttgtct

SEQ ID NO: 86358 - DNA, 25 bp, Homo sapien
cttgctggcatgtttgcagccgggc

SEQ ID NO: 86359 - DNA, 25 bp, Homo sapien
cctgccggctggttcgcggcacgtt

SEQ ID NO: 86360 - DNA, 25 bp, Homo sapien
gcggcacgttctggatgtttcccga

SEQ ID NO: 86361 - DNA, 25 bp, Homo sapien
ggttccctctcctgtaaactaagca

SEQ ID NO: 86362 - DNA, 25 bp, Homo sapien
cgacagagagcatctggcgcacggc

SEQ ID NO: 86363 - DNA, 25 bp, Homo sapien
cgcacggcggacagtcgctaattaa

SEQ ID NO: 86364 - DNA, 25 bp, Homo sapien
taaaaggattaattgcgcgagcgac

SEQ ID NO: 86365 - DNA, 25 bp, Homo sapien
ccgcgggaatcgagtgcagcaaaac

SEQ ID NO: 86366 - DNA, 25 bp, Homo sapien
tcggtaacctggtttccgagagtgc

SEQ ID NO: 86367 - DNA, 25 bp, Homo sapien
gtgcagcaaaacagctccaacctca

SEQ ID NO: 86368 - DNA, 25 bp, Homo sapien
gagtgactcgtccaaagccgcgcag

SEQ ID NO: 86369 - DNA, 25 bp, Homo sapien
agggttacaggcaaggccgctccag

SEQ ID NO: 86370 - DNA, 25 bp, Homo sapien
tcaccctgagggttacaggcaaggc

SEQ ID NO: 86371 - DNA, 25 bp, Homo sapien
aggcaaggccgctccaggcacgcag

SEQ ID NO: 86372 - DNA, 25 bp, Homo sapien
gggcagcagcgccattcgcaaagcc

SEQ ID NO: 86373 - DNA, 25 bp, Homo sapien
gcagcagcgccattcgcaaagccgg

SEQ ID NO: 86374 - DNA, 25 bp, Homo sapien
gccattcgcaaagccggcccgctcc

SEQ ID NO: 86375 - DNA, 25 bp, Homo sapien
ggattcaccctgagggttacaggca

SEQ ID NO: 86376 - DNA, 25 bp, Homo sapien
cagggctgcggagacaggaatcgca

SEQ ID NO: 86377 - DNA, 25 bp, Homo sapien
agagcctgacctctcactctccgta

SEQ ID NO: 86378 - DNA, 25 bp, Homo sapien
gcagcgacttccaacctcctggctt

SEQ ID NO: 86379 - DNA, 25 bp, Homo sapien
atccagcgtcacagggcgtgtgcgt

SEQ ID NO: 86380 - DNA, 25 bp, Homo sapien
tcgtcttccatccagcgtcacaggg

SEQ ID NO: 86381 - DNA, 25 bp, Homo sapien
gcgcggtgtctaacacgttttagga

SEQ ID NO: 86382 - DNA, 25 bp, Homo sapien
tttaggaaagtaccaggcttgtgga

SEQ ID NO: 86383 - DNA, 25 bp, Homo sapien
tcactctccgtaccggcagcgactt

SEQ ID NO: 86384 - DNA, 25 bp, Homo sapien
ggggctcctcctgccctagagcctg

SEQ ID NO: 86385 - DNA, 25 bp, Homo sapien
attttgcacgcctgtaacatccagc

SEQ ID NO: 86386 - DNA, 25 bp, Homo sapien
agtcggtcagatcccctgcctcggt

SEQ ID NO: 86387 - DNA, 25 bp, Homo sapien
ggctccgagtcggtcagatcccctg

SEQ ID NO: 86388 - DNA, 25 bp, Homo sapien
ctgtaacatccagccgggctccgag

SEQ ID NO: 86389 - DNA, 25 bp, Homo sapien
cccgtcaggggctggacggtcgtgg

SEQ ID NO: 86390 - DNA, 25 bp, Homo sapien
tgcacgcctgtaacatccagccggg

SEQ ID NO: 86391 - DNA, 25 bp, Homo sapien
tttgcacgcctgtaacatccagccg

SEQ ID NO: 86392 - DNA, 25 bp, Homo sapien
aatgcagagcccctcaggatggggt

SEQ ID NO: 86393 - DNA, 25 bp, Homo sapien
cgcccagggaacgtttgaatgaatg

SEQ ID NO: 86394 - DNA, 25 bp, Homo sapien
atgctccatcgcctgggtaggtttc

SEQ ID NO: 86395 - DNA, 25 bp, Homo sapien
tccctgtgcagtagtggtctcaaca

SEQ ID NO: 86396 - DNA, 25 bp, Homo sapien
gaagccgcttggaaaacacccattg

SEQ ID NO: 86397 - DNA, 25 bp, Homo sapien
ggccttggcttgacctcatttcaca

SEQ ID NO: 86398 - DNA, 25 bp, Homo sapien
ggctctcaattccaaggcagttttc

SEQ ID NO: 86399 - DNA, 25 bp, Homo sapien
cggcaagagctttgatcgggtcctc

SEQ ID NO: 86400 - DNA, 25 bp, Homo sapien
acccattgaggaggtgtttcatcta

SEQ ID NO: 86401 - DNA, 25 bp, Homo sapien
cccgcggatcaacaccttcattgtt

SEQ ID NO: 86402 - DNA, 25 bp, Homo sapien
gtttgctagcagttatttgatctca

SEQ ID NO: 86403 - DNA, 25 bp, Homo sapien
tatgctttagcagtagtttgctagc

SEQ ID NO: 86404 - DNA, 25 bp, Homo sapien
actttcctgaagtttatgctttagc

SEQ ID NO: 86405 - DNA, 25 bp, Homo sapien
gttattggcatctgtttctaactac

SEQ ID NO: 86406 - DNA, 25 bp, Homo sapien
tgaggctgtttagaaaaacattagt

SEQ ID NO: 86407 - DNA, 25 bp, Homo sapien
cagattattatatgaggctgtttag

SEQ ID NO: 86408 - DNA, 25 bp, Homo sapien
ccttcattgttgtcgtttcagatta

SEQ ID NO: 86409 - DNA, 25 bp, Homo sapien
cccggagaagtgtcactggccctga

SEQ ID NO: 86410 - DNA, 25 bp, Homo sapien
acggacacaaggctcggcagttgcc

SEQ ID NO: 86411 - DNA, 25 bp, Homo sapien
cagttgcctggtaacgcccgctgga

SEQ ID NO: 86412 - DNA, 25 bp, Homo sapien
agatgctgtggccttcaggcgctga

SEQ ID NO: 86413 - DNA, 25 bp, Homo sapien
cggaacgcagatgctgtggccttca

SEQ ID NO: 86414 - DNA, 25 bp, Homo sapien
tttccgccggcggaacgcagatgct

SEQ ID NO: 86415 - DNA, 25 bp, Homo sapien
ccgctggaggagtcccagtgtaata

SEQ ID NO: 86416 - DNA, 25 bp, Homo sapien
ccagtgtaataaggtcccggagaag

SEQ ID NO: 86417 - DNA, 25 bp, Homo sapien
gcagcttgagaactcgcgcacctgg

SEQ ID NO: 86418 - DNA, 25 bp, Homo sapien
gtcccggaacccagcagcttgagaa

SEQ ID NO: 86419 - DNA, 25 bp, Homo sapien
ggtctgtcccgacattccagggcca

SEQ ID NO: 86420 - DNA, 25 bp, Homo sapien
aagcgaaccaggctggaccaccctg

SEQ ID NO: 86421 - DNA, 25 bp, Homo sapien
cgtttccaccgaaggcagctctctg

SEQ ID NO: 86422 - DNA, 25 bp, Homo sapien
cccttgttagcgtttgtcgagagtc

SEQ ID NO: 86423 - DNA, 25 bp, Homo sapien
gtcagcgggaaaactcgatacctaa

SEQ ID NO: 86424 - DNA, 25 bp, Homo sapien
ctgaggggcttcaccatcaagagca

SEQ ID NO: 86425 - DNA, 25 bp, Homo sapien
agaggtcagcatctccgccggacgt

SEQ ID NO: 86426 - DNA, 25 bp, Homo sapien
cggagcgtggtactacgaccagcgc

SEQ ID NO: 86427 - DNA, 25 bp, Homo sapien
cttcgcggctcgctaaagcgttatc

SEQ ID NO: 86428 - DNA, 25 bp, Homo sapien
caacccgtgcagaggtcagcatctc

SEQ ID NO: 86429 - DNA, 25 bp, Homo sapien
atagcccggcgctcatgacaggtga

SEQ ID NO: 86430 - DNA, 25 bp, Homo sapien
gggcgactggctctgccgcaactgc

SEQ ID NO: 86431 - DNA, 25 bp, Homo sapien
ggaaccaatgaacgcagccgggatc

SEQ ID NO: 86432 - DNA, 25 bp, Homo sapien
tcgtgcaccgcctgaagacgccgta

SEQ ID NO: 86433 - DNA, 25 bp, Homo sapien
ggacccatttcccacgctggcttgg

SEQ ID NO: 86434 - DNA, 25 bp, Homo sapien
aggacgcgctgcaactccctagtca

SEQ ID NO: 86435 - DNA, 25 bp, Homo sapien
tgttctccatgcagcacacgtcgga

SEQ ID NO: 86436 - DNA, 25 bp, Homo sapien
tcatccgggaagaaatgtgcagcgc

SEQ ID NO: 86437 - DNA, 25 bp, Homo sapien
ctgcaccatattgccgcgcatcgga

SEQ ID NO: 86438 - DNA, 25 bp, Homo sapien
gggcttttctcgctgatgctgcaga

SEQ ID NO: 86439 - DNA, 25 bp, Homo sapien
gcggctgcctgaagtttgcaaaatc

SEQ ID NO: 86440 - DNA, 25 bp, Homo sapien
cgccagagccgcgagcaaatgcttt

SEQ ID NO: 86441 - DNA, 25 bp, Homo sapien
acaggcggtgtaagcgcctcttata

SEQ ID NO: 86442 - DNA, 25 bp, Homo sapien
atcatcttggcgtgctgctcgtacg

SEQ ID NO: 86443 - DNA, 25 bp, Homo sapien
cacagcactgtgtgcagcgtggaca

SEQ ID NO: 86444 - DNA, 25 bp, Homo sapien
tctgctcaccttgtcggggtgcaca

SEQ ID NO: 86445 - DNA, 25 bp, Homo sapien
cgcgcggcgatagtgcttcttcact

SEQ ID NO: 86446 - DNA, 25 bp, Homo sapien
tgcttcttcacttgctccggagcca

SEQ ID NO: 86447 - DNA, 25 bp, Homo sapien
ggttctcaaactccgaccaggcgtc

SEQ ID NO: 86448 - DNA, 25 bp, Homo sapien
caggcgtcattcagctccatgaaga

SEQ ID NO: 86449 - DNA, 25 bp, Homo sapien
tgactttcagcctggagtccggttc

SEQ ID NO: 86450 - DNA, 25 bp, Homo sapien
cgagaacgagtgcttcctggacttc

SEQ ID NO: 86451 - DNA, 25 bp, Homo sapien
cccttccgacagagcggggactaga

SEQ ID NO: 86452 - DNA, 25 bp, Homo sapien
tgtcccgtgaactgtgagtactgcg

SEQ ID NO: 86453 - DNA, 25 bp, Homo sapien
caacgtggcttcagacctgggcatc

SEQ ID NO: 86454 - DNA, 25 bp, Homo sapien
tccggttccgagtacctgaagatcg

SEQ ID NO: 86455 - DNA, 25 bp, Homo sapien
gatcgacaacctcactggcgagctg

SEQ ID NO: 86456 - DNA, 25 bp, Homo sapien
cgggcgattagcacccattgcatga

SEQ ID NO: 86457 - DNA, 25 bp, Homo sapien
agcgaaatccaaggggcggacacca

SEQ ID NO: 86458 - DNA, 25 bp, Homo sapien
agcgacaggggcattacccaccttc

SEQ ID NO: 86459 - DNA, 25 bp, Homo sapien
tgactgactcagaccgccgcgactt

SEQ ID NO: 86460 - DNA, 25 bp, Homo sapien
cgcagcatagttgggtgactgactc

SEQ ID NO: 86461 - DNA, 25 bp, Homo sapien
gcctccctggttccgcagcatagtt

SEQ ID NO: 86462 - DNA, 25 bp, Homo sapien
accagagccgagcactttgcgctga

SEQ ID NO: 86463 - DNA, 25 bp, Homo sapien
gcccacacgcgggagcgaaatccaa

SEQ ID NO: 86464 - DNA, 25 bp, Homo sapien
ttgcgctgaggaaatttacccggtg

SEQ ID NO: 86465 - DNA, 25 bp, Homo sapien
tcgggacgccttctggtacataaag

SEQ ID NO: 86466 - DNA, 25 bp, Homo sapien
gcaagttatttctgcgcccgagaga

SEQ ID NO: 86467 - DNA, 25 bp, Homo sapien
acggcgcagcttggctataaaaacc

SEQ ID NO: 86468 - DNA, 25 bp, Homo sapien
tgatgctttaaactctccgggtctg

SEQ ID NO: 86469 - DNA, 25 bp, Homo sapien
cgtcgaactttgaggctggattccc

SEQ ID NO: 86470 - DNA, 25 bp, Homo sapien
gagatccgctcccagaaaggttccg

SEQ ID NO: 86471 - DNA, 25 bp, Homo sapien
gccgtcctctaagccgcaagttatt

SEQ ID NO: 86472 - DNA, 25 bp, Homo sapien
ccgagcgtgtggattcccgaaaatt

SEQ ID NO: 86473 - DNA, 25 bp, Homo sapien
gcttcgtgcagggaacgccaggccc

SEQ ID NO: 86474 - DNA, 25 bp, Homo sapien
tttgctcactcagggcgcttcgtgc

SEQ ID NO: 86475 - DNA, 25 bp, Homo sapien
tcgagctttgctcactcagggcgct

SEQ ID NO: 86476 - DNA, 25 bp, Homo sapien
cagctcggggtccaggctcgagctt

SEQ ID NO: 86477 - DNA, 25 bp, Homo sapien
aggttcccacgctggcgcccggcga

SEQ ID NO: 86478 - DNA, 25 bp, Homo sapien
ccctggcgtggagcagagggacaca

SEQ ID NO: 86479 - DNA, 25 bp, Homo sapien
accgcggaccttcctggtggcgcgg

SEQ ID NO: 86480 - DNA, 25 bp, Homo sapien
ggtccaggctcgagctttgctcact

SEQ ID NO: 86481 - DNA, 25 bp, Homo sapien
agaggccaacaagcgcgtggatttt

SEQ ID NO: 86482 - DNA, 25 bp, Homo sapien
gaacttggctttggggcgagctttc

SEQ ID NO: 86483 - DNA, 25 bp, Homo sapien
agggctttagtcctgcggaacttgg

SEQ ID NO: 86484 - DNA, 25 bp, Homo sapien
gcgcgcgcaaagagggctttagtcc

SEQ ID NO: 86485 - DNA, 25 bp, Homo sapien
tactccagggtttcgagccctagcc

SEQ ID NO: 86486 - DNA, 25 bp, Homo sapien
gtcggacatcgtactccagggtttc

SEQ ID NO: 86487 - DNA, 25 bp, Homo sapien
tggattttctgcttcagtgcgcccg

SEQ ID NO: 86488 - DNA, 25 bp, Homo sapien
cggtcgtttgtgctcagaggccaac

SEQ ID NO: 86489 - DNA, 25 bp, Homo sapien
atcccgcggctgtgccagaaagcag

SEQ ID NO: 86490 - DNA, 25 bp, Homo sapien
taagaaggcacgtggcccatccatg

SEQ ID NO: 86491 - DNA, 25 bp, Homo sapien
ccggactccacctaagaaggcacgt

SEQ ID NO: 86492 - DNA, 25 bp, Homo sapien
gctaggccatggacacgccctcttt

SEQ ID NO: 86493 - DNA, 25 bp, Homo sapien
ctcccacgaagacagcagcggctag

SEQ ID NO: 86494 - DNA, 25 bp, Homo sapien
gacagccagttgttcagtgccggga

SEQ ID NO: 86495 - DNA, 25 bp, Homo sapien
ctggggaacacagatcctcggagga

SEQ ID NO: 86496 - DNA, 25 bp, Homo sapien
ctaagccggcacgaggtccactcat

SEQ ID NO: 86497 - DNA, 25 bp, Homo sapien
cagcggtagcacaagctcagcgatg

SEQ ID NO: 86498 - DNA, 25 bp, Homo sapien
ctcccatcccgagggcttggttaca

SEQ ID NO: 86499 - DNA, 25 bp, Homo sapien
ctgagacctttgcagagcagcgttc

SEQ ID NO: 86500 - DNA, 25 bp, Homo sapien
ccgcgtattcctttggccgctgaga

SEQ ID NO: 86501 - DNA, 25 bp, Homo sapien
ggcgcacgccttactgtcactcaga

SEQ ID NO: 86502 - DNA, 25 bp, Homo sapien
gccagaccctggacgctgtctagtt

SEQ ID NO: 86503 - DNA, 25 bp, Homo sapien
gcatgcggcacgttcagagttaggc

SEQ ID NO: 86504 - DNA, 25 bp, Homo sapien
tgctaggcttccttcgacctggccg

SEQ ID NO: 86505 - DNA, 25 bp, Homo sapien
cctgctataaataggccgccaagga

SEQ ID NO: 86506 - DNA, 25 bp, Homo sapien
agtgccacctgctgagagccactca

SEQ ID NO: 86507 - DNA, 25 bp, Homo sapien
tgagagccactcaggccgagcaagc

SEQ ID NO: 86508 - DNA, 25 bp, Homo sapien
ccaaggacagggtgtgcgactgtac

SEQ ID NO: 86509 - DNA, 25 bp, Homo sapien
gcgactgtacatcccgccacgaggg

SEQ ID NO: 86510 - DNA, 25 bp, Homo sapien
cccagggaaacgctgtgcccagatc

SEQ ID NO: 86511 - DNA, 25 bp, Homo sapien
cccacagacactggctgaggatggc

SEQ ID NO: 86512 - DNA, 25 bp, Homo sapien
ccaccacgtctgtttcggagggaga

SEQ ID NO: 86513 - DNA, 25 bp, Homo sapien
ctgcgcagccctgggcatctcggaa

SEQ ID NO: 86514 - DNA, 25 bp, Homo sapien
agactgaggctgtactcggggaccc

SEQ ID NO: 86515 - DNA, 25 bp, Homo sapien
tagcggcgcccatttcacagttggg

SEQ ID NO: 86516 - DNA, 25 bp, Homo sapien
tcattagtctcccagatccctgtgg

SEQ ID NO: 86517 - DNA, 25 bp, Homo sapien
gccgcgcgtttctcattcattagtc

SEQ ID NO: 86518 - DNA, 25 bp, Homo sapien
ccctcgcagaagtcggcttgcgctg

SEQ ID NO: 86519 - DNA, 25 bp, Homo sapien
gctggaacatttgtaaccttcgggc

SEQ ID NO: 86520 - DNA, 25 bp, Homo sapien
ggcccgcgatgtcaccattgttcag

SEQ ID NO: 86521 - DNA, 25 bp, Homo sapien
agttcaatcacgtcagcggcagccg

SEQ ID NO: 86522 - DNA, 25 bp, Homo sapien
acgagtgcatcgagaagttcaatca

SEQ ID NO: 86523 - DNA, 25 bp, Homo sapien
cggccctgatcgacgagtgcatcga

SEQ ID NO: 86524 - DNA, 25 bp, Homo sapien
cggtggcgcacaagaaggctccgcc

SEQ ID NO: 86525 - DNA, 25 bp, Homo sapien
ttccaagaagttcgaggtgctcttc

SEQ ID NO: 86526 - DNA, 25 bp, Homo sapien
gagttcgacgacacgttttccaaga

SEQ ID NO: 86527 - DNA, 25 bp, Homo sapien
tgcactgcccgtccgagttcgacga

SEQ ID NO: 86528 - DNA, 25 bp, Homo sapien
tgcgcaggcccatgcgcaagtcctt

SEQ ID NO: 86529 - DNA, 25 bp, Homo sapien
agcccggctgtgtgttttggaagca

SEQ ID NO: 86530 - DNA, 25 bp, Homo sapien
tgcaccgcgcctcgcaaagtaagtc

SEQ ID NO: 86531 - DNA, 25 bp, Homo sapien
cggctcggcttttctcttgcagtga

SEQ ID NO: 86532 - DNA, 25 bp, Homo sapien
tgcagtgagctgagtgcgctcagcc

SEQ ID NO: 86533 - DNA, 25 bp, Homo sapien
agccggctgatcgatggccctggca

SEQ ID NO: 86534 - DNA, 25 bp, Homo sapien
ctccggggaataatgagtgtctgtc

SEQ ID NO: 86535 - DNA, 25 bp, Homo sapien
tttgcgcgagtgactcggccgaccc

SEQ ID NO: 86536 - DNA, 25 bp, Homo sapien
actggagccctgacattgctgcgct

SEQ ID NO: 86537 - DNA, 25 bp, Homo sapien
cagccggggccaacacgagcttccc

SEQ ID NO: 86538 - DNA, 25 bp, Homo sapien
agcctctttgcgtgccgctgtctgt

SEQ ID NO: 86539 - DNA, 25 bp, Homo sapien
tttgcgtgccgctgtctgtcgtcag

SEQ ID NO: 86540 - DNA, 25 bp, Homo sapien
actgcacagcggtggcacagctggc

SEQ ID NO: 86541 - DNA, 25 bp, Homo sapien
agcagagaatccgacggccaccgca

SEQ ID NO: 86542 - DNA, 25 bp, Homo sapien
cgggactgatgtgcactccagccgg

SEQ ID NO: 86543 - DNA, 25 bp, Homo sapien
gaagccgggactgatgtgcactcca

SEQ ID NO: 86544 - DNA, 25 bp, Homo sapien
agcggaggctcagaccggccacgac

SEQ ID NO: 86545 - DNA, 25 bp, Homo sapien
cctcacggtgaacaagcggagttca

SEQ ID NO: 86546 - DNA, 25 bp, Homo sapien
tgcccgtcatccagccggtggtggt

SEQ ID NO: 86547 - DNA, 25 bp, Homo sapien
gagccagtggacctcacggtgaaca

SEQ ID NO: 86548 - DNA, 25 bp, Homo sapien
ttcggctgggaattcgccctcctct

SEQ ID NO: 86549 - DNA, 25 bp, Homo sapien
gaagttcccgtcctcacaccggaga

SEQ ID NO: 86550 - DNA, 25 bp, Homo sapien
cgctgtccatgccaccagtgatggc

SEQ ID NO: 86551 - DNA, 25 bp, Homo sapien
cagctgccctctcgcggcatggaat

SEQ ID NO: 86552 - DNA, 25 bp, Homo sapien
tctcgcggcatggaatacggagccc

SEQ ID NO: 86553 - DNA, 25 bp, Homo sapien
cagtggtcagggaggacccggctct

SEQ ID NO: 86554 - DNA, 25 bp, Homo sapien
acccgctgggcactcccgcgcgtac

SEQ ID NO: 86555 - DNA, 25 bp, Homo sapien
tccgggtccacgctcatgcacacac

SEQ ID NO: 86556 - DNA, 25 bp, Homo sapien
ctgcgttagtgagaagcagtggtca

SEQ ID NO: 86557 - DNA, 25 bp, Homo sapien
cgggacccacgaatcctgccctctg

SEQ ID NO: 86558 - DNA, 25 bp, Homo sapien
ggaacaccataccttggcgcctcgt

SEQ ID NO: 86559 - DNA, 25 bp, Homo sapien
tggtgggaacaccataccttggcgc

SEQ ID NO: 86560 - DNA, 25 bp, Homo sapien
actcggccgcctgagcggtaagagc

SEQ ID NO: 86561 - DNA, 25 bp, Homo sapien
gcgcccagcgatcccgggaaggtca

SEQ ID NO: 86562 - DNA, 25 bp, Homo sapien
gcgattcaggatcattcggtgcatc

SEQ ID NO: 86563 - DNA, 25 bp, Homo sapien
tctgctttgaagtgcgcgattcagg

SEQ ID NO: 86564 - DNA, 25 bp, Homo sapien
ggtgttgccattttatctgctttga

SEQ ID NO: 86565 - DNA, 25 bp, Homo sapien
accaggccctgtagcagccgctgga

SEQ ID NO: 86566 - DNA, 25 bp, Homo sapien
cagagggaaccgcaccgcgaagcct

SEQ ID NO: 86567 - DNA, 25 bp, Homo sapien
gtgaacgtcccgtctgagtgtcgcc

SEQ ID NO: 86568 - DNA, 25 bp, Homo sapien
cgagttcgtctccagcttcagcgtg

SEQ ID NO: 86569 - DNA, 25 bp, Homo sapien
gagcccgacgcggtaagtgcgactt

SEQ ID NO: 86570 - DNA, 25 bp, Homo sapien
cccactagctcctcttgccacagac

SEQ ID NO: 86571 - DNA, 25 bp, Homo sapien
tgaggctgcccggacagggtctagg

SEQ ID NO: 86572 - DNA, 25 bp, Homo sapien
aggggccgagcatcccactcagctc

SEQ ID NO: 86573 - DNA, 25 bp, Homo sapien
agtgcgacttccttctcggcatcgg

SEQ ID NO: 86574 - DNA, 25 bp, Homo sapien
cgacttccttctcggcatcggggag

SEQ ID NO: 86575 - DNA, 25 bp, Homo sapien
cgacgcggtaagtgcgacttccttc

SEQ ID NO: 86576 - DNA, 25 bp, Homo sapien
ggtaagtgcgacttccttctcggca

SEQ ID NO: 86577 - DNA, 25 bp, Homo sapien
accctctgatcgtacgcgcttctca

SEQ ID NO: 86578 - DNA, 25 bp, Homo sapien
caccctctgatcgtacgcgcttctc

SEQ ID NO: 86579 - DNA, 25 bp, Homo sapien
tctctgatcgtacacgcttctcaca

SEQ ID NO: 86580 - DNA, 25 bp, Homo sapien
ttctcataccctctctgatcgtacg

SEQ ID NO: 86581 - DNA, 25 bp, Homo sapien
caccctctctgatcgtacacgcttc

SEQ ID NO: 86582 - DNA, 25 bp, Homo sapien
cctctgatcgtacgcgcttctcaca

SEQ ID NO: 86583 - DNA, 25 bp, Homo sapien
tctctgatcgtacgcgcttctcaca

SEQ ID NO: 86584 - DNA, 25 bp, Homo sapien
ataccctctctgatcgtacgcgctt

SEQ ID NO: 86585 - DNA, 25 bp, Homo sapien
tcatagttcgcgtagcggctcgagc

SEQ ID NO: 86586 - DNA, 25 bp, Homo sapien
cccagggttagcgtctctgatgtca

SEQ ID NO: 86587 - DNA, 25 bp, Homo sapien
cccggacgaatctcatccaatcaga

SEQ ID NO: 86588 - DNA, 25 bp, Homo sapien
gatgtcatgtgattccaccctccgc

SEQ ID NO: 86589 - DNA, 25 bp, Homo sapien
ggcaccgcctttcaattagcactcg

SEQ ID NO: 86590 - DNA, 25 bp, Homo sapien
ttagcactcgctgattggtcgctgc

SEQ ID NO: 86591 - DNA, 25 bp, Homo sapien
gtgcgcctgcgtacttcatagttcg

SEQ ID NO: 86592 - DNA, 25 bp, Homo sapien
gcacgcgcctttgagggctcacaga

SEQ ID NO: 86593 - DNA, 25 bp, Homo sapien
gccgctgacatcgagaggaaccacg

SEQ ID NO: 86594 - DNA, 25 bp, Homo sapien
gagcccgcgatgcaatgaaagtttt

SEQ ID NO: 86595 - DNA, 25 bp, Homo sapien
tgaaagttttgcgtccagtgcccgg

SEQ ID NO: 86596 - DNA, 25 bp, Homo sapien
tctctgcctttgctagcctccggaa

SEQ ID NO: 86597 - DNA, 25 bp, Homo sapien
ggctcaggatccattcgcgccaaca

SEQ ID NO: 86598 - DNA, 25 bp, Homo sapien
aaccacggtgctttggtgtgagctc

SEQ ID NO: 86599 - DNA, 25 bp, Homo sapien
tccgatattggtttccttggcaggc

SEQ ID NO: 86600 - DNA, 25 bp, Homo sapien
ggccggttgaggaatctgttatcga

SEQ ID NO: 86601 - DNA, 25 bp, Homo sapien
tggacatttacatcaccgccagtgg

SEQ ID NO: 86602 - DNA, 25 bp, Homo sapien
taagtgacatctacaaccgctctgg

SEQ ID NO: 86603 - DNA, 25 bp, Homo sapien
cgagcgcttcctgcagttcgagatc

SEQ ID NO: 86604 - DNA, 25 bp, Homo sapien
ccgcggccatgagggaatacattgc

SEQ ID NO: 86605 - DNA, 25 bp, Homo sapien
ggacatccagtttctgcaggacatc

SEQ ID NO: 86606 - DNA, 25 bp, Homo sapien
ggaactacggcgacatggacattta

SEQ ID NO: 86607 - DNA, 25 bp, Homo sapien
gctacgactcggacagggacatcca

SEQ ID NO: 86608 - DNA, 25 bp, Homo sapien
tccgcgatggtcaccctgtattatc

SEQ ID NO: 86609 - DNA, 25 bp, Homo sapien
aggaaatgtctctacgctgcgggga

SEQ ID NO: 86610 - DNA, 25 bp, Homo sapien
agcttggctgcttgtcataaatgga

SEQ ID NO: 86611 - DNA, 25 bp, Homo sapien
tgcgcgacgcacgtaaggctaaagc

SEQ ID NO: 86612 - DNA, 25 bp, Homo sapien
tacttgtatcgcgtaaggggcctgc

SEQ ID NO: 86613 - DNA, 25 bp, Homo sapien
tcccagagcagatggtttcagattc

SEQ ID NO: 86614 - DNA, 25 bp, Homo sapien
tcagcccaaccctggaagtcctatg

SEQ ID NO: 86615 - DNA, 25 bp, Homo sapien
gcgagaattacgaggcccagcagtc

SEQ ID NO: 86616 - DNA, 25 bp, Homo sapien
ccctgcactgcgctagtcctaaaga

SEQ ID NO: 86617 - DNA, 25 bp, Homo sapien
ttcgtcatccaccactcagagcaag

SEQ ID NO: 86618 - DNA, 25 bp, Homo sapien
cggcagactgcctctgtcatcagga

SEQ ID NO: 86619 - DNA, 25 bp, Homo sapien
agactgcctctgtcatcaggaccct

SEQ ID NO: 86620 - DNA, 25 bp, Homo sapien
gtcatcaggaccctccgtccacgtc

SEQ ID NO: 86621 - DNA, 25 bp, Homo sapien
cggccagcgtcagagccatggcgat

SEQ ID NO: 86622 - DNA, 25 bp, Homo sapien
cgaggcaacgagagcacagccgacc

SEQ ID NO: 86623 - DNA, 25 bp, Homo sapien
accactcagagcaagcctacgcccg

SEQ ID NO: 86624 - DNA, 25 bp, Homo sapien
aggaagcccgagaccgaggcaacga

SEQ ID NO: 86625 - DNA, 25 bp, Homo sapien
aaaggcttttgcctgcgaaggcgga

SEQ ID NO: 86626 - DNA, 25 bp, Homo sapien
ggctgccacgcgttacactctgagt

SEQ ID NO: 86627 - DNA, 25 bp, Homo sapien
caagaattgttgtctagcagccctc

SEQ ID NO: 86628 - DNA, 25 bp, Homo sapien
tgtaggagctttgcgcgcctacctg

SEQ ID NO: 86629 - DNA, 25 bp, Homo sapien
ctagctgggcaaatccgctttggcc

SEQ ID NO: 86630 - DNA, 25 bp, Homo sapien
ggtccctatttccttcacggctcag

SEQ ID NO: 86631 - DNA, 25 bp, Homo sapien
cgatcgttcggacagcaccttccta

SEQ ID NO: 86632 - DNA, 25 bp, Homo sapien
agggaccgctcctatcccgatcgtt

SEQ ID NO: 86633 - DNA, 25 bp, Homo sapien
tcagcagtgataggcgcgtgccttc

SEQ ID NO: 86634 - DNA, 25 bp, Homo sapien
gttgaggctctcacagcatgagtgc

SEQ ID NO: 86635 - DNA, 25 bp, Homo sapien
acagcatgagtgcttcggagccaga

SEQ ID NO: 86636 - DNA, 25 bp, Homo sapien
ggagccagaggaaccgtccaccatg

SEQ ID NO: 86637 - DNA, 25 bp, Homo sapien
ccgtccaccatggtggaagtgttcg

SEQ ID NO: 86638 - DNA, 25 bp, Homo sapien
ctcagtcgctcacaggtttccgtaa

SEQ ID NO: 86639 - DNA, 25 bp, Homo sapien
agcattggccttgcttcagcagtga

SEQ ID NO: 86640 - DNA, 25 bp, Homo sapien
ccgctcacgtcctgtgttgaggctc

SEQ ID NO: 86641 - DNA, 25 bp, Homo sapien
atgagagcccacggcactcaccaaa

SEQ ID NO: 86642 - DNA, 25 bp, Homo sapien
ccaaacagcgagcaccctggaccct

SEQ ID NO: 86643 - DNA, 25 bp, Homo sapien
cgcgtcaagtgcacggggcaagcag

SEQ ID NO: 86644 - DNA, 25 bp, Homo sapien
ggggcagtcgccacatgagagccca

SEQ ID NO: 86645 - DNA, 25 bp, Homo sapien
ggcagtcgccacatgagagcccacg

SEQ ID NO: 86646 - DNA, 25 bp, Homo sapien
agcccacggcactcaccaaacagcg

SEQ ID NO: 86647 - DNA, 25 bp, Homo sapien
cacggcactcaccaaacagcgagca

SEQ ID NO: 86648 - DNA, 25 bp, Homo sapien
actcaccaaacagcgagcaccctgg

SEQ ID NO: 86649 - DNA, 25 bp, Homo sapien
ggagcaccgggcaagccacaggctc

SEQ ID NO: 86650 - DNA, 25 bp, Homo sapien
gagcacgtctccttgcaccgtgacg

SEQ ID NO: 86651 - DNA, 25 bp, Homo sapien
atgacgatgagcacgtctccttgca

SEQ ID NO: 86652 - DNA, 25 bp, Homo sapien
cgtgatagatgacgatgagcacgtc

SEQ ID NO: 86653 - DNA, 25 bp, Homo sapien
cgcccagagtggaccgggcgtgata

SEQ ID NO: 86654 - DNA, 25 bp, Homo sapien
ctcggtgagaagtgagcgcactgtg

SEQ ID NO: 86655 - DNA, 25 bp, Homo sapien
ccccccatgagcctaggcgtgagtg

SEQ ID NO: 86656 - DNA, 25 bp, Homo sapien
accgtgacgcccaggggaatcaccg

SEQ ID NO: 86657 - DNA, 25 bp, Homo sapien
ccctgtttccacatcggcagcagca

SEQ ID NO: 86658 - DNA, 25 bp, Homo sapien
attgcaaaacgccaacagcccatta

SEQ ID NO: 86659 - DNA, 25 bp, Homo sapien
gaagcgcccagtcaccacaggaagc

SEQ ID NO: 86660 - DNA, 25 bp, Homo sapien
agcccattaccacaggcaccgcaca

SEQ ID NO: 86661 - DNA, 25 bp, Homo sapien
gcccagtcaccacaggaagcatgtg

SEQ ID NO: 86662 - DNA, 25 bp, Homo sapien
aaggccggcgcctgagaaaacagga

SEQ ID NO: 86663 - DNA, 25 bp, Homo sapien
aggaagcatgtgtgcgccgcctccc

SEQ ID NO: 86664 - DNA, 25 bp, Homo sapien
accacaggaagcatgtgtgcgccgc

SEQ ID NO: 86665 - DNA, 25 bp, Homo sapien
gtgtctcccgttgcccgagctaaag

SEQ ID NO: 86666 - DNA, 25 bp, Homo sapien
atcgtctgtttcttcggcggcggac

SEQ ID NO: 86667 - DNA, 25 bp, Homo sapien
ggtgtctgttcaactctcccgcgta

SEQ ID NO: 86668 - DNA, 25 bp, Homo sapien
cgtggctgaggactgtgaagcaatc

SEQ ID NO: 86669 - DNA, 25 bp, Homo sapien
ctcttagccacaagacccggatctg

SEQ ID NO: 86670 - DNA, 25 bp, Homo sapien
gccaagcccgagaaacagccctgtt

SEQ ID NO: 86671 - DNA, 25 bp, Homo sapien
tcctcgacggagtctttagaatacc

SEQ ID NO: 86672 - DNA, 25 bp, Homo sapien
ctgttttgattcgagtgaccacgtc

SEQ ID NO: 86673 - DNA, 25 bp, Homo sapien
ccgaaccttcggtcagaggccagcg

SEQ ID NO: 86674 - DNA, 25 bp, Homo sapien
cagtgttcgtgtgctcaggtctgaa

SEQ ID NO: 86675 - DNA, 25 bp, Homo sapien
gtgattccacactgaggcgagcgcg

SEQ ID NO: 86676 - DNA, 25 bp, Homo sapien
tttcctgcgctagacacggcgttca

SEQ ID NO: 86677 - DNA, 25 bp, Homo sapien
gtgcagcgaatcaagcgggagttca

SEQ ID NO: 86678 - DNA, 25 bp, Homo sapien
cctgtgaggaagcagcagtgttccc

SEQ ID NO: 86679 - DNA, 25 bp, Homo sapien
acatggccaacatcgcggtgcagcg

SEQ ID NO: 86680 - DNA, 25 bp, Homo sapien
ctcccagagcgctaggatggacggt

SEQ ID NO: 86681 - DNA, 25 bp, Homo sapien
gtgtgacttgacaccacgatgcacg

SEQ ID NO: 86682 - DNA, 25 bp, Homo sapien
ccacgcctgcgcggctagcggatga

SEQ ID NO: 86683 - DNA, 25 bp, Homo sapien
gccgcacgagtgtgacttgacacca

SEQ ID NO: 86684 - DNA, 25 bp, Homo sapien
gcagatgccgcacgagtgtgacttg

SEQ ID NO: 86685 - DNA, 25 bp, Homo sapien
tggacttctgtgtgaagcacttgcc

SEQ ID NO: 86686 - DNA, 25 bp, Homo sapien
ctcccgagtgcaggttgaggtggtc

SEQ ID NO: 86687 - DNA, 25 bp, Homo sapien
ctaatggcaggcttgtgggcgaagc

SEQ ID NO: 86688 - DNA, 25 bp, Homo sapien
tggtcttgccgtgttgctccttgag

SEQ ID NO: 86689 - DNA, 25 bp, Homo sapien
agagccagggcagcatgtaggcgca

SEQ ID NO: 86690 - DNA, 25 bp, Homo sapien
ggagggtgtatagggcgcgctcgcg

SEQ ID NO: 86691 - DNA, 25 bp, Homo sapien
gcgggagggtgtatagggcgcgctc

SEQ ID NO: 86692 - DNA, 25 bp, Homo sapien
cagggcgggagggtgtatagggcgc

SEQ ID NO: 86693 - DNA, 25 bp, Homo sapien
cagggcagcatgtaggcgcagggcg

SEQ ID NO: 86694 - DNA, 25 bp, Homo sapien
ccagggcagcatgtaggcgcagggc

SEQ ID NO: 86695 - DNA, 25 bp, Homo sapien
agccagggcagcatgtaggcgcagg

SEQ ID NO: 86696 - DNA, 25 bp, Homo sapien
gagccagggcagcatgtaggcgcag

SEQ ID NO: 86697 - DNA, 25 bp, Homo sapien
cgtgcactgtgcatcagggagacct

SEQ ID NO: 86698 - DNA, 25 bp, Homo sapien
tgtcggccacaatggtcacgtcgca

SEQ ID NO: 86699 - DNA, 25 bp, Homo sapien
aacttgaggctgtcggccacaatgg

SEQ ID NO: 86700 - DNA, 25 bp, Homo sapien
cctcgaaacttgaggctgtcggcca

SEQ ID NO: 86701 - DNA, 25 bp, Homo sapien
aagatgaccttgtggcctcgaaact

SEQ ID NO: 86702 - DNA, 25 bp, Homo sapien
tgtgcatcagggagacctgcagctc

SEQ ID NO: 86703 - DNA, 25 bp, Homo sapien
gccacaatggtcacgtcgcagaacc

SEQ ID NO: 86704 - DNA, 25 bp, Homo sapien
cggccacgatgcgtgcactgtgcat

SEQ ID NO: 86705 - DNA, 25 bp, Homo sapien
cgagcaccagggtccgaagtttggc

SEQ ID NO: 86706 - DNA, 25 bp, Homo sapien
gggctcggcttaggccgcaaaacta

SEQ ID NO: 86707 - DNA, 25 bp, Homo sapien
tacctcctcctcatgcgggcggaag

SEQ ID NO: 86708 - DNA, 25 bp, Homo sapien
gagtttcccattccgcctttcacaa

SEQ ID NO: 86709 - DNA, 25 bp, Homo sapien
aaccagacccgaggcctatagggct

SEQ ID NO: 86710 - DNA, 25 bp, Homo sapien
gggctgcacacaaagcggctccgcg

SEQ ID NO: 86711 - DNA, 25 bp, Homo sapien
gccgaacagcgccaggagtttccca

SEQ ID NO: 86712 - DNA, 25 bp, Homo sapien
ttccttcaacttcggctgagggacc

SEQ ID NO: 86713 - DNA, 25 bp, Homo sapien
atggcgcccgcctctttgatcatct

SEQ ID NO: 86714 - DNA, 25 bp, Homo sapien
cgtccgcataatccggcagatctgg

SEQ ID NO: 86715 - DNA, 25 bp, Homo sapien
tgggccacctcaccgatgcacatgg

SEQ ID NO: 86716 - DNA, 25 bp, Homo sapien
cgggccacattagcgtccgcataat

SEQ ID NO: 86717 - DNA, 25 bp, Homo sapien
tcttcaggatggtcccgcctagaca

SEQ ID NO: 86718 - DNA, 25 bp, Homo sapien
cccgttctgcggattgcaatgccgg

SEQ ID NO: 86719 - DNA, 25 bp, Homo sapien
cacaggaagtgggtgcactcgaccc

SEQ ID NO: 86720 - DNA, 25 bp, Homo sapien
cgcctagacattgcgggccacatta

SEQ ID NO: 86721 - DNA, 25 bp, Homo sapien
agtgccgagggctagaaacagctgt

SEQ ID NO: 86722 - DNA, 25 bp, Homo sapien
cgaggccgaccttgtgtttgttttg

SEQ ID NO: 86723 - DNA, 25 bp, Homo sapien
ggccacggccctagtcaggcaatgc

SEQ ID NO: 86724 - DNA, 25 bp, Homo sapien
ccgcgccgcttattttggcaaaaat

SEQ ID NO: 86725 - DNA, 25 bp, Homo sapien
aattccgggcctgttgcaatgttcc

SEQ ID NO: 86726 - DNA, 25 bp, Homo sapien
ccgacactcgaagaagggcttgctc

SEQ ID NO: 86727 - DNA, 25 bp, Homo sapien
tgcccgctccagaagcaggtaaagg

SEQ ID NO: 86728 - DNA, 25 bp, Homo sapien
aaacagctgtggtttaccgcgccgc

SEQ ID NO: 86729 - DNA, 25 bp, Homo sapien
gcccgttctcttgcaccatgctgta

SEQ ID NO: 86730 - DNA, 25 bp, Homo sapien
agtccatcatgaggcgcagctcgta

SEQ ID NO: 86731 - DNA, 25 bp, Homo sapien
agccgcggttcttgccgtcaaagtc

SEQ ID NO: 86732 - DNA, 25 bp, Homo sapien
ggtgaccttggcaatctcctccagg

SEQ ID NO: 86733 - DNA, 25 bp, Homo sapien
cgaagccgcggttcttcatcttgtc

SEQ ID NO: 86734 - DNA, 25 bp, Homo sapien
aggttgcgcacgtagaggatcttca

SEQ ID NO: 86735 - DNA, 25 bp, Homo sapien
gttgaactggccgaagctcttcttg

SEQ ID NO: 86736 - DNA, 25 bp, Homo sapien
ccgttgaggttgttcatggcatgca

SEQ ID NO: 86737 - DNA, 25 bp, Homo sapien
aggcagcgaagttctctcgggctca

SEQ ID NO: 86738 - DNA, 25 bp, Homo sapien
ttaggagcgcagatacctttgctga

SEQ ID NO: 86739 - DNA, 25 bp, Homo sapien
ggccagtgccacattcctgttgttt

SEQ ID NO: 86740 - DNA, 25 bp, Homo sapien
tgaaattttatcctgctggctgagc

SEQ ID NO: 86741 - DNA, 25 bp, Homo sapien
gcaaggttgtctctcgtctactccc

SEQ ID NO: 86742 - DNA, 25 bp, Homo sapien
tccgcctcacagtagcaaggttgtc

SEQ ID NO: 86743 - DNA, 25 bp, Homo sapien
gagaaacccagccagaaccacgttg

SEQ ID NO: 86744 - DNA, 25 bp, Homo sapien
ggggacttgaccagacggacttctc

SEQ ID NO: 86745 - DNA, 25 bp, Homo sapien
ctccgctcgcggttgccatgaagac

SEQ ID NO: 86746 - DNA, 25 bp, Homo sapien
gttgccatgaagacccggtccggga

SEQ ID NO: 86747 - DNA, 25 bp, Homo sapien
aggctgagctttcctcggcctgagc

SEQ ID NO: 86748 - DNA, 25 bp, Homo sapien
cgaggcgcccaccacttcacgacac

SEQ ID NO: 86749 - DNA, 25 bp, Homo sapien
ttcacgacaccggagcgaaccgggc

SEQ ID NO: 86750 - DNA, 25 bp, Homo sapien
acaccggagcgaaccgggcgccaga

SEQ ID NO: 86751 - DNA, 25 bp, Homo sapien
agtggctgcatttgaaccaaacggc

SEQ ID NO: 86752 - DNA, 25 bp, Homo sapien
ggcaacaggtagcacccgccaaatc

SEQ ID NO: 86753 - DNA, 25 bp, Homo sapien
ggcgtgatggacccggccgatccct

SEQ ID NO: 86754 - DNA, 25 bp, Homo sapien
acccgggagtcaggctcgcccgctt

SEQ ID NO: 86755 - DNA, 25 bp, Homo sapien
gtccgactggtcctcatcagacctg

SEQ ID NO: 86756 - DNA, 25 bp, Homo sapien
ccggacaggccccttgtgacgtggc

SEQ ID NO: 86757 - DNA, 25 bp, Homo sapien
tgcccaaacggaagtgcgccctcta

SEQ ID NO: 86758 - DNA, 25 bp, Homo sapien
ggctctctcacttccgaccgaccct

SEQ ID NO: 86759 - DNA, 25 bp, Homo sapien
cgactggtcctcatcagacctgggc

SEQ ID NO: 86760 - DNA, 25 bp, Homo sapien
ccgcagcctggtcgatcgcggtccc

SEQ ID NO: 86761 - DNA, 25 bp, Homo sapien
gccaccatgtcacacatgtactcga

SEQ ID NO: 86762 - DNA, 25 bp, Homo sapien
cgctcctctgcttgctgaacagcgg

SEQ ID NO: 86763 - DNA, 25 bp, Homo sapien
cagcggcacgggtgtcatgaccacg

SEQ ID NO: 86764 - DNA, 25 bp, Homo sapien
acgggtgtcatgaccacggccctca

SEQ ID NO: 86765 - DNA, 25 bp, Homo sapien
ccctcaccaggatgggcttgctgtg

SEQ ID NO: 86766 - DNA, 25 bp, Homo sapien
agacgtgccgcgtcaccacgtgacg

SEQ ID NO: 86767 - DNA, 25 bp, Homo sapien
tctgcttgctgaacagcggcacggg

SEQ ID NO: 86768 - DNA, 25 bp, Homo sapien
acacatgtactcgatgtacctgggg

SEQ ID NO: 86769 - DNA, 25 bp, Homo sapien
tctgtccggtgggaaaagctcagct

SEQ ID NO: 86770 - DNA, 25 bp, Homo sapien
cgaggggcagacatgctgaattcca

SEQ ID NO: 86771 - DNA, 25 bp, Homo sapien
ttcgaacgaagaagatcccgagatc

SEQ ID NO: 86772 - DNA, 25 bp, Homo sapien
agctcagctggtgtgcccgaaaaaa

SEQ ID NO: 86773 - DNA, 25 bp, Homo sapien
acgggctatccggactccgtttatg

SEQ ID NO: 86774 - DNA, 25 bp, Homo sapien
tccgtttatgtcatggcagccaaca

SEQ ID NO: 86775 - DNA, 25 bp, Homo sapien
gcagccaacatttttcagggtattc

SEQ ID NO: 86776 - DNA, 25 bp, Homo sapien
tgctgaattccacgggcgaactgga

SEQ ID NO: 86777 - DNA, 25 bp, Homo sapien
agcgagcttgggctcgacccccgtt

SEQ ID NO: 86778 - DNA, 25 bp, Homo sapien
tccttccgaagtcgggcggggatgc

SEQ ID NO: 86779 - DNA, 25 bp, Homo sapien
acgcacctgcaaacaaaggagagcc

SEQ ID NO: 86780 - DNA, 25 bp, Homo sapien
gatgccgccccaggtgctacgacaa

SEQ ID NO: 86781 - DNA, 25 bp, Homo sapien
cgcagcctttgtcccgcaggtctcc

SEQ ID NO: 86782 - DNA, 25 bp, Homo sapien
cgtcgctcaagcagccgcgcgcact

SEQ ID NO: 86783 - DNA, 25 bp, Homo sapien
ggagagccgttccttcgccaacttc

SEQ ID NO: 86784 - DNA, 25 bp, Homo sapien
ccctgaacgcacctgcaaacaaagg

SEQ ID NO: 86785 - DNA, 25 bp, Homo sapien
gattccacttctccaggctttggca

SEQ ID NO: 86786 - DNA, 25 bp, Homo sapien
cggcgctgacgagattccacttctc

SEQ ID NO: 86787 - DNA, 25 bp, Homo sapien
atgctcagtgccgttccgcgagtcc

SEQ ID NO: 86788 - DNA, 25 bp, Homo sapien
gggctccggcaactgagcatgctca

SEQ ID NO: 86789 - DNA, 25 bp, Homo sapien
tcctacttgagaccagaacgggctc

SEQ ID NO: 86790 - DNA, 25 bp, Homo sapien
gcggttacagcgcactagcttccta

SEQ ID NO: 86791 - DNA, 25 bp, Homo sapien
agcgcccagatcagatgcggttaca

SEQ ID NO: 86792 - DNA, 25 bp, Homo sapien
aaagctgggctcaccagtggtgcgc

SEQ ID NO: 86793 - DNA, 25 bp, Homo sapien
cctgaaatgccctgacagtgacgtc

SEQ ID NO: 86794 - DNA, 25 bp, Homo sapien
tgacagtgacgtcgaaacggccacc

SEQ ID NO: 86795 - DNA, 25 bp, Homo sapien
tgggcacacaaaatccctgaaatgc

SEQ ID NO: 86796 - DNA, 25 bp, Homo sapien
ggaagtcactgcctgggcacacaaa

SEQ ID NO: 86797 - DNA, 25 bp, Homo sapien
acgccggagaagtcgggaagtcact

SEQ ID NO: 86798 - DNA, 25 bp, Homo sapien
gcaatcagccttccggaaacgggtc

SEQ ID NO: 86799 - DNA, 25 bp, Homo sapien
cacctgatgcaatcagccttccgga

SEQ ID NO: 86800 - DNA, 25 bp, Homo sapien
gtcgaaacggccaccaagcgttgcg

SEQ ID NO: 86801 - DNA, 25 bp, Homo sapien
cggcgctttatagctgcagcctggg

SEQ ID NO: 86802 - DNA, 25 bp, Homo sapien
gcggctccgctagctgtttttcgtc

SEQ ID NO: 86803 - DNA, 25 bp, Homo sapien
gcgggtgactctacgaaaccggtca

SEQ ID NO: 86804 - DNA, 25 bp, Homo sapien
cagctcaagccgatggagatcaacc

SEQ ID NO: 86805 - DNA, 25 bp, Homo sapien
cgctccgcgaagatgcagctcaagc

SEQ ID NO: 86806 - DNA, 25 bp, Homo sapien
cttgtctcctctccgcaggtgctgt

SEQ ID NO: 86807 - DNA, 25 bp, Homo sapien
ttcgtcttccctaggctatttctgc

SEQ ID NO: 86808 - DNA, 25 bp, Homo sapien
gccgagtcgctgatcggttcggttt

SEQ ID NO: 86809 - DNA, 25 bp, Homo sapien
acccttccggagcagagttggcagt

SEQ ID NO: 86810 - DNA, 25 bp, Homo sapien
cgcatttcggggtatcttgcttctg

SEQ ID NO: 86811 - DNA, 25 bp, Homo sapien
agacttcaccggtgctcgcatttcg

SEQ ID NO: 86812 - DNA, 25 bp, Homo sapien
agcgcagtgctagcaaagcgttgca

SEQ ID NO: 86813 - DNA, 25 bp, Homo sapien
ttagcgctttggcattggaatcccg

SEQ ID NO: 86814 - DNA, 25 bp, Homo sapien
gcgagccgcgaaaccttagcgcttt

SEQ ID NO: 86815 - DNA, 25 bp, Homo sapien
gctctcggtctggaagctcttcagc

SEQ ID NO: 86816 - DNA, 25 bp, Homo sapien
atttttagtccgtagctgtgctccc

SEQ ID NO: 86817 - DNA, 25 bp, Homo sapien
atcgcggtccctcttgtgttcgctc

SEQ ID NO: 86818 - DNA, 25 bp, Homo sapien
gtgttcgctctctccacactcagga

SEQ ID NO: 86819 - DNA, 25 bp, Homo sapien
cggtcacattttggcgtttgcggca

SEQ ID NO: 86820 - DNA, 25 bp, Homo sapien
ccagcatgtttgacatgcggtgtga

SEQ ID NO: 86821 - DNA, 25 bp, Homo sapien
cattttggcgtttgcggcaaaagga

SEQ ID NO: 86822 - DNA, 25 bp, Homo sapien
gcagttttccaagcccggtagcgcc

SEQ ID NO: 86823 - DNA, 25 bp, Homo sapien
acgggcgctgatcgcggtccctctt

SEQ ID NO: 86824 - DNA, 25 bp, Homo sapien
acactcaggagcaccagcatgtttg

SEQ ID NO: 86825 - DNA, 25 bp, Homo sapien
ggccctcaatgaaaaagccatggca

SEQ ID NO: 86826 - DNA, 25 bp, Homo sapien
gcgcgattactttaggccctcaatg

SEQ ID NO: 86827 - DNA, 25 bp, Homo sapien
cactaaggcggctttggcaccgttg

SEQ ID NO: 86828 - DNA, 25 bp, Homo sapien
gaacatactgctcttcactaaggcg

SEQ ID NO: 86829 - DNA, 25 bp, Homo sapien
caccgttgggtctttggagcgaaga

SEQ ID NO: 86830 - DNA, 25 bp, Homo sapien
agcgacgacaatagccttgggccta

SEQ ID NO: 86831 - DNA, 25 bp, Homo sapien
tttccctttattcttagcgcgatta

SEQ ID NO: 86832 - DNA, 25 bp, Homo sapien
ccgcaggattccagatcagaacata

SEQ ID NO: 86833 - DNA, 25 bp, Homo sapien
cgcgcctctgtgaggtcgatcttca

SEQ ID NO: 86834 - DNA, 25 bp, Homo sapien
tccaaggtcaggtcatacggcagcc

SEQ ID NO: 86835 - DNA, 25 bp, Homo sapien
aagcgcctttgggtggattgaaaca

SEQ ID NO: 86836 - DNA, 25 bp, Homo sapien
ccagctcctcccgagtgtagatgtc

SEQ ID NO: 86837 - DNA, 25 bp, Homo sapien
cggagtcctttctggcacaagcgcc

SEQ ID NO: 86838 - DNA, 25 bp, Homo sapien
agtatttctgatcggccatggggcc

SEQ ID NO: 86839 - DNA, 25 bp, Homo sapien
gggccctaggtccttctcactcgag

SEQ ID NO: 86840 - DNA, 25 bp, Homo sapien
gaggctccaggacttcgaatttcac

SEQ ID NO: 86841 - DNA, 25 bp, Homo sapien
gtagtctttaatctggcccgtgaca

SEQ ID NO: 86842 - DNA, 25 bp, Homo sapien
gggcgcgttcaaactcagaccgtga

SEQ ID NO: 86843 - DNA, 25 bp, Homo sapien
ttaaagccttctcttgaccagtgga

SEQ ID NO: 86844 - DNA, 25 bp, Homo sapien
tcttctcctgccgagtcactggact

SEQ ID NO: 86845 - DNA, 25 bp, Homo sapien
cgtcctatttttgccgggcgcgaga

SEQ ID NO: 86846 - DNA, 25 bp, Homo sapien
gagccgcaacgggagattaataccg

SEQ ID NO: 86847 - DNA, 25 bp, Homo sapien
cagcagattcatttcctggaggagc

SEQ ID NO: 86848 - DNA, 25 bp, Homo sapien
gtcactggactctcaatattcggca

SEQ ID NO: 86849 - DNA, 25 bp, Homo sapien
cccagccttgtgcttctttgcaggg

SEQ ID NO: 86850 - DNA, 25 bp, Homo sapien
caggctcgtttcaggtggttgcaaa

SEQ ID NO: 86851 - DNA, 25 bp, Homo sapien
cagggtgagtttcaggctcgtttca

SEQ ID NO: 86852 - DNA, 25 bp, Homo sapien
cagtaatggattaaacggggacagc

SEQ ID NO: 86853 - DNA, 25 bp, Homo sapien
gccgcggacgcagtaatggattaaa

SEQ ID NO: 86854 - DNA, 25 bp, Homo sapien
ttgcgcactaaactgccgcggacgc

SEQ ID NO: 86855 - DNA, 25 bp, Homo sapien
tgccaccgtgttttattgcgcacta

SEQ ID NO: 86856 - DNA, 25 bp, Homo sapien
tcaggtggttgcaaatcctcggggc

SEQ ID NO: 86857 - DNA, 25 bp, Homo sapien
tcgcactcatgcaggacaagggctc

SEQ ID NO: 86858 - DNA, 25 bp, Homo sapien
cggagggccacgcagtaccttttgt

SEQ ID NO: 86859 - DNA, 25 bp, Homo sapien
accttttgtgggatggccagatgcc

SEQ ID NO: 86860 - DNA, 25 bp, Homo sapien
tgggcagcgcttcatgctgaacatg

SEQ ID NO: 86861 - DNA, 25 bp, Homo sapien
ctgaacatgtacacggcggcctccg

SEQ ID NO: 86862 - DNA, 25 bp, Homo sapien
gcagacggccacagcagacgcggct

SEQ ID NO: 86863 - DNA, 25 bp, Homo sapien
agacagacacgtctcgcgtgcgcct

SEQ ID NO: 86864 - DNA, 25 bp, Homo sapien
tctgcggccgtaagcccagggctca

SEQ ID NO: 86865 - DNA, 25 bp, Homo sapien
ctttgtaccaggagacctttcagcg

SEQ ID NO: 86866 - DNA, 25 bp, Homo sapien
tgtaccaggagacctttcagcgccg

SEQ ID NO: 86867 - DNA, 25 bp, Homo sapien
accaggagacctttcagcgccgggc

SEQ ID NO: 86868 - DNA, 25 bp, Homo sapien
ggcccacacggtcggatgagcaaat

SEQ ID NO: 86869 - DNA, 25 bp, Homo sapien
agccttctcgcctttgtaccaggag

SEQ ID NO: 86870 - DNA, 25 bp, Homo sapien
gccgtgagccttctcgcctttgtac

SEQ ID NO: 86871 - DNA, 25 bp, Homo sapien
ccacacggtcggatgagcaaatgcg

SEQ ID NO: 86872 - DNA, 25 bp, Homo sapien
cgtgagccttctcgcctttgtacca

SEQ ID NO: 86873 - DNA, 25 bp, Homo sapien
tgcgcgcgaatcacgtctggcaggc

SEQ ID NO: 86874 - DNA, 25 bp, Homo sapien
gcagagatgggattacgaaacccta

SEQ ID NO: 86875 - DNA, 25 bp, Homo sapien
cgaatcacgtctggcaggctgctcc

SEQ ID NO: 86876 - DNA, 25 bp, Homo sapien
gggcctttgcgccaccgcaccaatt

SEQ ID NO: 86877 - DNA, 25 bp, Homo sapien
atttgcatccccaacgaatgcgcgc

SEQ ID NO: 86878 - DNA, 25 bp, Homo sapien
cctgggtggcctctacgggaatcct

SEQ ID NO: 86879 - DNA, 25 bp, Homo sapien
aacgaatgcgcgctgccctgatccc

SEQ ID NO: 86880 - DNA, 25 bp, Homo sapien
tggcctctacgggaatcctggggca

SEQ ID NO: 86881 - DNA, 25 bp, Homo sapien
atgcaccctgggtgcgcctggcctg

SEQ ID NO: 86882 - DNA, 25 bp, Homo sapien
tcgcgccagactcctccggtgagga

SEQ ID NO: 86883 - DNA, 25 bp, Homo sapien
actcctccggtgaggagcccgcaga

SEQ ID NO: 86884 - DNA, 25 bp, Homo sapien
agagctgctgaaaggggctttgaga

SEQ ID NO: 86885 - DNA, 25 bp, Homo sapien
cccttattagcatgcaccctgggtg

SEQ ID NO: 86886 - DNA, 25 bp, Homo sapien
ttagcatgcaccctgggtgcgcctg

SEQ ID NO: 86887 - DNA, 25 bp, Homo sapien
tttatgtcgcgccagactcctccgg

SEQ ID NO: 86888 - DNA, 25 bp, Homo sapien
cttattagcatgcaccctgggtgcg

SEQ ID NO: 86889 - DNA, 25 bp, Homo sapien
gaaaaactgatcgacgcaatggccc

SEQ ID NO: 86890 - DNA, 25 bp, Homo sapien
tcaaacgccctaacgaggagtccga

SEQ ID NO: 86891 - DNA, 25 bp, Homo sapien
ggcgcaggaaggaaaaactgatcga

SEQ ID NO: 86892 - DNA, 25 bp, Homo sapien
cgaggagtccgagcggccactgaaa

SEQ ID NO: 86893 - DNA, 25 bp, Homo sapien
ctgaaagcctccctgttcctgggca

SEQ ID NO: 86894 - DNA, 25 bp, Homo sapien
gcccgcggaagcaagagacagccct

SEQ ID NO: 86895 - DNA, 25 bp, Homo sapien
gagacagccctgatagtcttctaaa

SEQ ID NO: 86896 - DNA, 25 bp, Homo sapien
tgatagtcttctaaacccggtccag

SEQ ID NO: 86897 - DNA, 25 bp, Homo sapien
ggcttgggcctcagctccgaataat

SEQ ID NO: 86898 - DNA, 25 bp, Homo sapien
gagaatcgcccaggcggcttaggca

SEQ ID NO: 86899 - DNA, 25 bp, Homo sapien
gcagtgtgtccatcctggcgggaca

SEQ ID NO: 86900 - DNA, 25 bp, Homo sapien
atccatctccatccagttagcgacg

SEQ ID NO: 86901 - DNA, 25 bp, Homo sapien
tgggcctcagctccgaataatgaga

SEQ ID NO: 86902 - DNA, 25 bp, Homo sapien
cagctccgaataatgagaacaattg

SEQ ID NO: 86903 - DNA, 25 bp, Homo sapien
tgagaacaattgtctccccgcctgg

SEQ ID NO: 86904 - DNA, 25 bp, Homo sapien
gggacagtaattgccccgggtctga

SEQ ID NO: 86905 - DNA, 25 bp, Homo sapien
gagatttgagactcgcgctcctgca

SEQ ID NO: 86906 - DNA, 25 bp, Homo sapien
ggaagactccaataaatgcaacccg

SEQ ID NO: 86907 - DNA, 25 bp, Homo sapien
ctaaagagatttgagactcgcgctc

SEQ ID NO: 86908 - DNA, 25 bp, Homo sapien
ttgagactcgcgctcctgcactttc

SEQ ID NO: 86909 - DNA, 25 bp, Homo sapien
gctcctgcactttctatcccacgcg

SEQ ID NO: 86910 - DNA, 25 bp, Homo sapien
ccctgggaagactccaataaatgca

SEQ ID NO: 86911 - DNA, 25 bp, Homo sapien
caggcacagagtcctaaagagattt

SEQ ID NO: 86912 - DNA, 25 bp, Homo sapien
aaatgcaacccggcgccactcgatt

SEQ ID NO: 86913 - DNA, 25 bp, Homo sapien
tccagggacctgtacgctttccttg

SEQ ID NO: 86914 - DNA, 25 bp, Homo sapien
tgcccggaaaggattcccgtgctca

SEQ ID NO: 86915 - DNA, 25 bp, Homo sapien
atcctattcgttcttggcgggcaga

SEQ ID NO: 86916 - DNA, 25 bp, Homo sapien
atggccaggtcagataacaagctcg

SEQ ID NO: 86917 - DNA, 25 bp, Homo sapien
accggcagggttctcgccttaatct

SEQ ID NO: 86918 - DNA, 25 bp, Homo sapien
ctggacaggtgtcgaactgcacttc

SEQ ID NO: 86919 - DNA, 25 bp, Homo sapien
catagccggcctttgatctccaagc

SEQ ID NO: 86920 - DNA, 25 bp, Homo sapien
accgtcccgtaaatctgtcgctcag

SEQ ID NO: 86921 - DNA, 25 bp, Homo sapien
tcgaacagttttgtctctcccgcgc

SEQ ID NO: 86922 - DNA, 25 bp, Homo sapien
cgtctccttagtaatcgcgcgggca

SEQ ID NO: 86923 - DNA, 25 bp, Homo sapien
cccagaagggccagaattttccaga

SEQ ID NO: 86924 - DNA, 25 bp, Homo sapien
gggcttctgcacattgcccttggca

SEQ ID NO: 86925 - DNA, 25 bp, Homo sapien
ggctcagaagccgaccctccttgaa

SEQ ID NO: 86926 - DNA, 25 bp, Homo sapien
cccgagggcgattccgccagaaatc

SEQ ID NO: 86927 - DNA, 25 bp, Homo sapien
acttacgttgaaggtgcgcgcattc

SEQ ID NO: 86928 - DNA, 25 bp, Homo sapien
tgcgcgcattccagacggctctgac

SEQ ID NO: 86929 - DNA, 25 bp, Homo sapien
cgcgctgggcaaacgcgacaggacc

SEQ ID NO: 86930 - DNA, 25 bp, Homo sapien
cctctgagcctagagagtgaaggta

SEQ ID NO: 86931 - DNA, 25 bp, Homo sapien
tggacactaagaacacgtgagacga

SEQ ID NO: 86932 - DNA, 25 bp, Homo sapien
aagcgctttaatgtgctcctcccgc

SEQ ID NO: 86933 - DNA, 25 bp, Homo sapien
gtgcgagattcctgcccagctacta

SEQ ID NO: 86934 - DNA, 25 bp, Homo sapien
cagctactaggccacgactgggtga

SEQ ID NO: 86935 - DNA, 25 bp, Homo sapien
tcggcacccacaggagtggacacta

SEQ ID NO: 86936 - DNA, 25 bp, Homo sapien
aaaatggcggcacttccggcaccta

SEQ ID NO: 86937 - DNA, 25 bp, Homo sapien
cccacggaaatgaaaggagcacttc

SEQ ID NO: 86938 - DNA, 25 bp, Homo sapien
aagcaggaagcgttgcgagtcccga

SEQ ID NO: 86939 - DNA, 25 bp, Homo sapien
gcagggtagtctggcttgatttgca

SEQ ID NO: 86940 - DNA, 25 bp, Homo sapien
gcgtcgcagacgctagtgtgagccc

SEQ ID NO: 86941 - DNA, 25 bp, Homo sapien
ctttcttctctcttcgcggttgcgg

SEQ ID NO: 86942 - DNA, 25 bp, Homo sapien
gctgcaccaggcgagcgagaccctt

SEQ ID NO: 86943 - DNA, 25 bp, Homo sapien
tctttctggaaacaccgctttgatc

SEQ ID NO: 86944 - DNA, 25 bp, Homo sapien
tccgggttcggcaataacctggagc

SEQ ID NO: 86945 - DNA, 25 bp, Homo sapien
gtcgaagtcgaaggctccaagtacg

SEQ ID NO: 86946 - DNA, 25 bp, Homo sapien
acgtgtacgtgctcagaaacctcta

SEQ ID NO: 86947 - DNA, 25 bp, Homo sapien
tcccgtttagccaacgagctgcgtg

SEQ ID NO: 86948 - DNA, 25 bp, Homo sapien
tgaagatcccttcgttccacgtgta

SEQ ID NO: 86949 - DNA, 25 bp, Homo sapien
ggcatcatcagcctgcgaactctga

SEQ ID NO: 86950 - DNA, 25 bp, Homo sapien
ccagctcttcgtagtgaaccaggtc

SEQ ID NO: 86951 - DNA, 25 bp, Homo sapien
ttctggcgagtaccaacagcgacca

SEQ ID NO: 86952 - DNA, 25 bp, Homo sapien
ggcgagcgaccgatttaacttcatt

SEQ ID NO: 86953 - DNA, 25 bp, Homo sapien
tgcagtgcacgacgcagacgttctt

SEQ ID NO: 86954 - DNA, 25 bp, Homo sapien
agacgttcttgtggtcctgccgcag

SEQ ID NO: 86955 - DNA, 25 bp, Homo sapien
agccaggcgtgcatgttcctgcaga

SEQ ID NO: 86956 - DNA, 25 bp, Homo sapien
cctgcagatgttgtacagggtgtgc

SEQ ID NO: 86957 - DNA, 25 bp, Homo sapien
cttggtcagctaggagggacagcct

SEQ ID NO: 86958 - DNA, 25 bp, Homo sapien
tccgccagctggtgtcatgaacagg

SEQ ID NO: 86959 - DNA, 25 bp, Homo sapien
gtgtcatgaacaggcgtccacctgc

SEQ ID NO: 86960 - DNA, 25 bp, Homo sapien
ctcgagctcaccatgcagtgcacga

SEQ ID NO: 86961 - DNA, 25 bp, Homo sapien
ctggctccgtagaagccgaactgga

SEQ ID NO: 86962 - DNA, 25 bp, Homo sapien
gggtcctgacaggtctctgactctg

SEQ ID NO: 86963 - DNA, 25 bp, Homo sapien
tgatgccttctgcagccctagcatg

SEQ ID NO: 86964 - DNA, 25 bp, Homo sapien
ggccggattgcacctctgaagccta

SEQ ID NO: 86965 - DNA, 25 bp, Homo sapien
ctcacctccgcggttggaaattgcg

SEQ ID NO: 86966 - DNA, 25 bp, Homo sapien
ccacagatgtagctggtcctccctg

SEQ ID NO: 86967 - DNA, 25 bp, Homo sapien
tacctccacggcaggcgtcgctaaa

SEQ ID NO: 86968 - DNA, 25 bp, Homo sapien
tcggtgttcgctgatgtccagtcta

SEQ ID NO: 86969 - DNA, 25 bp, Homo sapien
aagccgcggagccacctgttaggcg

SEQ ID NO: 86970 - DNA, 25 bp, Homo sapien
ccagcgccggtctcttgctggggaa

SEQ ID NO: 86971 - DNA, 25 bp, Homo sapien
ctgggccatacctgacgacagcggc

SEQ ID NO: 86972 - DNA, 25 bp, Homo sapien
agagttggtacctgcgctgagctcc

SEQ ID NO: 86973 - DNA, 25 bp, Homo sapien
cggagtcctcaagtggccctgggat

SEQ ID NO: 86974 - DNA, 25 bp, Homo sapien
acacggcccagcacgggtaagtgtc

SEQ ID NO: 86975 - DNA, 25 bp, Homo sapien
atcctctcgaagtttccgggtgcgc

SEQ ID NO: 86976 - DNA, 25 bp, Homo sapien
cgctgcttgtagattttggggacgc

SEQ ID NO: 86977 - DNA, 25 bp, Homo sapien
tcctgctcctgtgacagataggggc

SEQ ID NO: 86978 - DNA, 25 bp, Homo sapien
gtactcgcacgtggggaacaaattc

SEQ ID NO: 86979 - DNA, 25 bp, Homo sapien
gacccaggcaggtctatgcgccttc

SEQ ID NO: 86980 - DNA, 25 bp, Homo sapien
agcacccaggcatcactgcgcgtaa

SEQ ID NO: 86981 - DNA, 25 bp, Homo sapien
tcgacacgctggacgctaccatctg

SEQ ID NO: 86982 - DNA, 25 bp, Homo sapien
ttccagtgcccagaggacttcgaca

SEQ ID NO: 86983 - DNA, 25 bp, Homo sapien
agggcaactaccacgagggcttcca

SEQ ID NO: 86984 - DNA, 25 bp, Homo sapien
tgctatcccacgcaggactggcttc

SEQ ID NO: 86985 - DNA, 25 bp, Homo sapien
ttcggaccgtatcacgactcaaagg

SEQ ID NO: 86986 - DNA, 25 bp, Homo sapien
ggggatcaactcttagcctccttag

SEQ ID NO: 86987 - DNA, 25 bp, Homo sapien
cctgcagccggggaaaagcaaactc

SEQ ID NO: 86988 - DNA, 25 bp, Homo sapien
cctaatggtcacactgcggtgcaaa

SEQ ID NO: 86989 - DNA, 25 bp, Homo sapien
agcctccttagtcctccagcgtttt

SEQ ID NO: 86990 - DNA, 25 bp, Homo sapien
ctccgccctgtggagttggttgacc

SEQ ID NO: 86991 - DNA, 25 bp, Homo sapien
ggatgcggtctcttccaggataaac

SEQ ID NO: 86992 - DNA, 25 bp, Homo sapien
tctgcacctgtcacggcgtggtaca

SEQ ID NO: 86993 - DNA, 25 bp, Homo sapien
ctggccaaagtactgtccgggacgc

SEQ ID NO: 86994 - DNA, 25 bp, Homo sapien
gcagccctcgtcgttgagagagttc

SEQ ID NO: 86995 - DNA, 25 bp, Homo sapien
cagcgtcgagtgcttggtcacataa

SEQ ID NO: 86996 - DNA, 25 bp, Homo sapien
cgctgctaccctgcgagacgttgtc

SEQ ID NO: 86997 - DNA, 25 bp, Homo sapien
cgcgagttgcttgtcccgcagataa

SEQ ID NO: 86998 - DNA, 25 bp, Homo sapien
agctggaaatactcggcctcgcgca

SEQ ID NO: 86999 - DNA, 25 bp, Homo sapien
gtgacccgagagagctgcactttct

SEQ ID NO: 87000 - DNA, 25 bp, Homo sapien
acgttcagctccactacttcaggga

SEQ ID NO: 87001 - DNA, 25 bp, Homo sapien
ttttagggagtcaatcgaaagcctc

SEQ ID NO: 87002 - DNA, 25 bp, Homo sapien
ccaagacgcgctgatgtcacgacag

SEQ ID NO: 87003 - DNA, 25 bp, Homo sapien
ttcgggttgcttccggatctggtac

SEQ ID NO: 87004 - DNA, 25 bp, Homo sapien
cccggggttcattgtcttcgcttca

SEQ ID NO: 87005 - DNA, 25 bp, Homo sapien
gtcttcgcttcacaggatctgtttg

SEQ ID NO: 87006 - DNA, 25 bp, Homo sapien
ttgcgtgtgggtaccctctcctgac

SEQ ID NO: 87007 - DNA, 25 bp, Homo sapien
aaaaacgggctatgctgctgttgcg

SEQ ID NO: 87008 - DNA, 25 bp, Homo sapien
gatctgtttgagtcctgtccaccgg

SEQ ID NO: 87009 - DNA, 25 bp, Homo sapien
tggaacagcgggaacaagcaacacc

SEQ ID NO: 87010 - DNA, 25 bp, Homo sapien
cttaccggcagacccaatggttctt

SEQ ID NO: 87011 - DNA, 25 bp, Homo sapien
tctcagcacaaaggccgcacagggc

SEQ ID NO: 87012 - DNA, 25 bp, Homo sapien
aaccaggtccgcgagtggcaatacg

SEQ ID NO: 87013 - DNA, 25 bp, Homo sapien
tcccgtaggcacaaatccggagagg

SEQ ID NO: 87014 - DNA, 25 bp, Homo sapien
cctggccctcacttggcaaaggaca

SEQ ID NO: 87015 - DNA, 25 bp, Homo sapien
cacggacccggatgcagataaaggc

SEQ ID NO: 87016 - DNA, 25 bp, Homo sapien
accgcctttaggacgcctgaggtga

SEQ ID NO: 87017 - DNA, 25 bp, Homo sapien
gacgtctccaaagcgcaaagtcctg

SEQ ID NO: 87018 - DNA, 25 bp, Homo sapien
gggccagctgagctatcccgtcaga

SEQ ID NO: 87019 - DNA, 25 bp, Homo sapien
agtgctgccgaagtaagacgtctcc

SEQ ID NO: 87020 - DNA, 25 bp, Homo sapien
ctggccgacgtcttcccgagtgaag

SEQ ID NO: 87021 - DNA, 25 bp, Homo sapien
actggctcctttgtggtggttcgag

SEQ ID NO: 87022 - DNA, 25 bp, Homo sapien
cgccggcgtgaacatgaccttaata

SEQ ID NO: 87023 - DNA, 25 bp, Homo sapien
cgcgccagtttgaatgaaagctcta

SEQ ID NO: 87024 - DNA, 25 bp, Homo sapien
cgcctgtgtgctaagaaaggggata

SEQ ID NO: 87025 - DNA, 25 bp, Homo sapien
tgctctacaccctgttccgcgggaa

SEQ ID NO: 87026 - DNA, 25 bp, Homo sapien
agtttcccacgctacagggctcaca

SEQ ID NO: 87027 - DNA, 25 bp, Homo sapien
gggtgctcttctacccgacgctgct

SEQ ID NO: 87028 - DNA, 25 bp, Homo sapien
gacgaggttcctgtgcaactcttca

SEQ ID NO: 87029 - DNA, 25 bp, Homo sapien
tgcgcggggtgatcaccatgaacga

SEQ ID NO: 87030 - DNA, 25 bp, Homo sapien
tcggcagctggtacaggacgagaac

SEQ ID NO: 87031 - DNA, 25 bp, Homo sapien
ggggtctccaccgtctttgctgagc

SEQ ID NO: 87032 - DNA, 25 bp, Homo sapien
ttgctgagccacctctttgcctcgg

SEQ ID NO: 87033 - DNA, 25 bp, Homo sapien
ccaacatcaccctactgtggagcga

SEQ ID NO: 87034 - DNA, 25 bp, Homo sapien
tcgatccctggtaactgaccgtcgc

SEQ ID NO: 87035 - DNA, 25 bp, Homo sapien
tggtaactgaccgtcgcccgcctgg

SEQ ID NO: 87036 - DNA, 25 bp, Homo sapien
cgcctggcactagcagcggcgcaga

SEQ ID NO: 87037 - DNA, 25 bp, Homo sapien
cctgacagagctgctgttgggtgtt

SEQ ID NO: 87038 - DNA, 25 bp, Homo sapien
tagtgtggcggtgatgccctagatc

SEQ ID NO: 87039 - DNA, 25 bp, Homo sapien
tgatgccctagatccctggggccgc

SEQ ID NO: 87040 - DNA, 25 bp, Homo sapien
cgatccctcgatccctggtaactga

SEQ ID NO: 87041 - DNA, 25 bp, Homo sapien
gggtcccggagctagccatttctcc

SEQ ID NO: 87042 - DNA, 25 bp, Homo sapien
ccctgctcttacagctgagataaga

SEQ ID NO: 87043 - DNA, 25 bp, Homo sapien
tcgcgggtaccttcttggcagaaac

SEQ ID NO: 87044 - DNA, 25 bp, Homo sapien
tgttcacgtttccaggctcttcaga

SEQ ID NO: 87045 - DNA, 25 bp, Homo sapien
tcgctcagcgctcaatgtgtatgta

SEQ ID NO: 87046 - DNA, 25 bp, Homo sapien
tgcgctgcaagactcggcaagtttg

SEQ ID NO: 87047 - DNA, 25 bp, Homo sapien
tgttccgactgtaactccggggatg

SEQ ID NO: 87048 - DNA, 25 bp, Homo sapien
tgcggtcacagaaaagcctggcttc

SEQ ID NO: 87049 - DNA, 25 bp, Homo sapien
ttagctgggtttccctgcgtgtttg

SEQ ID NO: 87050 - DNA, 25 bp, Homo sapien
atagacatggtctccgaagtgaata

SEQ ID NO: 87051 - DNA, 25 bp, Homo sapien
cggttcggcttacgcagatgggaaa

SEQ ID NO: 87052 - DNA, 25 bp, Homo sapien
tttcgacacacacgggctactgcgg

SEQ ID NO: 87053 - DNA, 25 bp, Homo sapien
ctactgcggtgttccaggggaaacg

SEQ ID NO: 87054 - DNA, 25 bp, Homo sapien
tgctcggcactattttgggaaggac

SEQ ID NO: 87055 - DNA, 25 bp, Homo sapien
ggcggagtctgagcgttactttagc

SEQ ID NO: 87056 - DNA, 25 bp, Homo sapien
tgcggatcgatgtcgccagcataga

SEQ ID NO: 87057 - DNA, 25 bp, Homo sapien
tcgcctgaaagtgaccatgcgttca

SEQ ID NO: 87058 - DNA, 25 bp, Homo sapien
taggatgcgggtcttccgtgcgttc

SEQ ID NO: 87059 - DNA, 25 bp, Homo sapien
tgaccatgcgttcaaacgttttaaa

SEQ ID NO: 87060 - DNA, 25 bp, Homo sapien
gaaccatcgcctgaaagtgaccatg

SEQ ID NO: 87061 - DNA, 25 bp, Homo sapien
agtgaccatgcgttcaaacgtttta

SEQ ID NO: 87062 - DNA, 25 bp, Homo sapien
aacccgcagagcaggtgctgacata

SEQ ID NO: 87063 - DNA, 25 bp, Homo sapien
ccgcagagcaggtgctgacatagga

SEQ ID NO: 87064 - DNA, 25 bp, Homo sapien
cgaccgaaccatcgcctgaaagtga

SEQ ID NO: 87065 - DNA, 25 bp, Homo sapien
aagtgctcacgagcgtgagcgaccc

SEQ ID NO: 87066 - DNA, 25 bp, Homo sapien
aatccggaatgagacgagtggctcg

SEQ ID NO: 87067 - DNA, 25 bp, Homo sapien
gtactcctatgacagcgccagcatc

SEQ ID NO: 87068 - DNA, 25 bp, Homo sapien
ctggaaatccggaatgagacgagtg

SEQ ID NO: 87069 - DNA, 25 bp, Homo sapien
ccaaggccaccatgtactcctatga

SEQ ID NO: 87070 - DNA, 25 bp, Homo sapien
atgacagcgccagcatccagtaccg

SEQ ID NO: 87071 - DNA, 25 bp, Homo sapien
tggaccggcacggggtacccagcaa

SEQ ID NO: 87072 - DNA, 25 bp, Homo sapien
gacgcccacggtaacattctcctca

SEQ ID NO: 87073 - DNA, 25 bp, Homo sapien
cgcttgcgcagagaccgaactaccg

SEQ ID NO: 87074 - DNA, 25 bp, Homo sapien
agaagtccctgtgcgcttgcgcaga

SEQ ID NO: 87075 - DNA, 25 bp, Homo sapien
ggcgtggacccaagaagtccctgtg

SEQ ID NO: 87076 - DNA, 25 bp, Homo sapien
acgccgggctgtcgcgaatcccagg

SEQ ID NO: 87077 - DNA, 25 bp, Homo sapien
tctaaagctacgactcgcccacgtg

SEQ ID NO: 87078 - DNA, 25 bp, Homo sapien
cttgggtcacgtgtcaaggctggcc

SEQ ID NO: 87079 - DNA, 25 bp, Homo sapien
caaggctggccgcttgtctaaagct

SEQ ID NO: 87080 - DNA, 25 bp, Homo sapien
gcgcagagaccgaactaccgctttc

SEQ ID NO: 87081 - DNA, 25 bp, Homo sapien
aggccaagcaaggttacgttataca

SEQ ID NO: 87082 - DNA, 25 bp, Homo sapien
ctcgaagccttcagtccgttgcgga

SEQ ID NO: 87083 - DNA, 25 bp, Homo sapien
gctaaaattttgctcgaagccttca

SEQ ID NO: 87084 - DNA, 25 bp, Homo sapien
tggtgttaaccagctaaaattttgc

SEQ ID NO: 87085 - DNA, 25 bp, Homo sapien
tgtgttagccgtggtggccgaaaac

SEQ ID NO: 87086 - DNA, 25 bp, Homo sapien
gcccagttcctaagggtgcaactta

SEQ ID NO: 87087 - DNA, 25 bp, Homo sapien
gggtgcaacttacggcaagcctgtc

SEQ ID NO: 87088 - DNA, 25 bp, Homo sapien
ggcaagcctgtccatcatggtgtta

SEQ ID NO: 87089 - DNA, 25 bp, Homo sapien
tttgcacgcagggacctacaagttc

SEQ ID NO: 87090 - DNA, 25 bp, Homo sapien
gactcgaacactgaaggaaaccctg

SEQ ID NO: 87091 - DNA, 25 bp, Homo sapien
ctctgcaggaaaggtggcatcaccc

SEQ ID NO: 87092 - DNA, 25 bp, Homo sapien
gccagttctgggatgccagcactta

SEQ ID NO: 87093 - DNA, 25 bp, Homo sapien
gggcagccgcaaattagaccttctt

SEQ ID NO: 87094 - DNA, 25 bp, Homo sapien
accctcgcggtagcaagcggattcc

SEQ ID NO: 87095 - DNA, 25 bp, Homo sapien
tgggtcccagtaagatccgacaaga

SEQ ID NO: 87096 - DNA, 25 bp, Homo sapien
gtgtgcagccaagtccactagatgc

SEQ ID NO: 87097 - DNA, 25 bp, Homo sapien
gaaagctacgtctccttaccgactg

SEQ ID NO: 87098 - DNA, 25 bp, Homo sapien
ccgccgggaaccaactgcagtggta

SEQ ID NO: 87099 - DNA, 25 bp, Homo sapien
cacacagtgccgaagacagaaagcc

SEQ ID NO: 87100 - DNA, 25 bp, Homo sapien
accgcggagcaagaagcacacagtg

SEQ ID NO: 87101 - DNA, 25 bp, Homo sapien
cgccgcggagatggactccatttcc

SEQ ID NO: 87102 - DNA, 25 bp, Homo sapien
gcggtcctgactagtaactgcctta

SEQ ID NO: 87103 - DNA, 25 bp, Homo sapien
gccgcttccttatccggtaaagtgc

SEQ ID NO: 87104 - DNA, 25 bp, Homo sapien
tgccagaaggaactgcgcccaccga

SEQ ID NO: 87105 - DNA, 25 bp, Homo sapien
gaggccgaccagtgtaaattaccgc

SEQ ID NO: 87106 - DNA, 25 bp, Homo sapien
cgctccgagagacgctgttgctcta

SEQ ID NO: 87107 - DNA, 25 bp, Homo sapien
gggcagctgctactcctgccagata

SEQ ID NO: 87108 - DNA, 25 bp, Homo sapien
ggggccctgagaattcgcaacaagc

SEQ ID NO: 87109 - DNA, 25 bp, Homo sapien
gagccctgccgagaaggtttgtgtc

SEQ ID NO: 87110 - DNA, 25 bp, Homo sapien
cagccaggcgttcaacacttattta

SEQ ID NO: 87111 - DNA, 25 bp, Homo sapien
gtgggactcccactcgattcgcgag

SEQ ID NO: 87112 - DNA, 25 bp, Homo sapien
gtccctctgagaaggacgtttcctc

SEQ ID NO: 87113 - DNA, 25 bp, Homo sapien
gggcagcgctcttctctgaactatc

SEQ ID NO: 87114 - DNA, 25 bp, Homo sapien
cctatggctgcgtcccagaacttga

SEQ ID NO: 87115 - DNA, 25 bp, Homo sapien
ccgctgcctagtctgcatctgagta

SEQ ID NO: 87116 - DNA, 25 bp, Homo sapien
cgcccggaagaagatctgctgcaca

SEQ ID NO: 87117 - DNA, 25 bp, Homo sapien
cgctcgctcgaaagactccctatgg

SEQ ID NO: 87118 - DNA, 25 bp, Homo sapien
gccctcgtcaaaagcttggctcaga

SEQ ID NO: 87119 - DNA, 25 bp, Homo sapien
ccaccttgagtcgtcttggaaacgg

SEQ ID NO: 87120 - DNA, 25 bp, Homo sapien
tgggaggcccatcaccctgtgcaat

SEQ ID NO: 87121 - DNA, 25 bp, Homo sapien
ctgaacttgccgcagggcggcctca

SEQ ID NO: 87122 - DNA, 25 bp, Homo sapien
agaagtggagaatctactgccggca

SEQ ID NO: 87123 - DNA, 25 bp, Homo sapien
gttggagaagtggagaatctactgc

SEQ ID NO: 87124 - DNA, 25 bp, Homo sapien
gtggagaatctactgccggcaggaa

SEQ ID NO: 87125 - DNA, 25 bp, Homo sapien
ccaacgctgaacttgccgcagggcg

SEQ ID NO: 87126 - DNA, 25 bp, Homo sapien
ggacgtgaccccaacgctgaacttg

SEQ ID NO: 87127 - DNA, 25 bp, Homo sapien
gccgcccaacccgaaaggaggcatc

SEQ ID NO: 87128 - DNA, 25 bp, Homo sapien
tcaggcctggaacttcaagaaaaag

SEQ ID NO: 87129 - DNA, 25 bp, Homo sapien
tgcggcgatttcaaggcaagtgacc

SEQ ID NO: 87130 - DNA, 25 bp, Homo sapien
gtgccacttgtggaagactacgtgc

SEQ ID NO: 87131 - DNA, 25 bp, Homo sapien
tcaaggcaagtgaccggaatgggtc

SEQ ID NO: 87132 - DNA, 25 bp, Homo sapien
tcggaagcgcgtcccggtgagtttc

SEQ ID NO: 87133 - DNA, 25 bp, Homo sapien
gactacgtgcctgtcggaattagga

SEQ ID NO: 87134 - DNA, 25 bp, Homo sapien
cggtgagtttcagggagcgtccctt

SEQ ID NO: 87135 - DNA, 25 bp, Homo sapien
tgtcggaattaggaaccgcacctcc

SEQ ID NO: 87136 - DNA, 25 bp, Homo sapien
cagccctgcggcgatttcaaggcaa

SEQ ID NO: 87137 - DNA, 25 bp, Homo sapien
gcctggtcctgctatatgccggcgc

SEQ ID NO: 87138 - DNA, 25 bp, Homo sapien
tatgccggcgcctcggctagagtga

SEQ ID NO: 87139 - DNA, 25 bp, Homo sapien
ccggcgcagatgaggcagttcggct

SEQ ID NO: 87140 - DNA, 25 bp, Homo sapien
tctgaggtcaccgactgggccggcc

SEQ ID NO: 87141 - DNA, 25 bp, Homo sapien
ggccgcgtcccacatccgccgacac

SEQ ID NO: 87142 - DNA, 25 bp, Homo sapien
cagggaccctccctagccagcccgg

SEQ ID NO: 87143 - DNA, 25 bp, Homo sapien
cacctccttgctagcggcgggcgag

SEQ ID NO: 87144 - DNA, 25 bp, Homo sapien
ttctgctggcctcccgttctgcagg

SEQ ID NO: 87145 - DNA, 25 bp, Homo sapien
ttgacggcgacatgaacctcaggta

SEQ ID NO: 87146 - DNA, 25 bp, Homo sapien
tctcatcccagacgcgcgtttacgg

SEQ ID NO: 87147 - DNA, 25 bp, Homo sapien
acctcaggtacggatctgtctattc

SEQ ID NO: 87148 - DNA, 25 bp, Homo sapien
cggcggcaatctctccaatcttatg

SEQ ID NO: 87149 - DNA, 25 bp, Homo sapien
tcgccttcaagctggacgaggtggc

SEQ ID NO: 87150 - DNA, 25 bp, Homo sapien
ctgcacggtggacgtgaaccacttc

SEQ ID NO: 87151 - DNA, 25 bp, Homo sapien
cgccatggacggcaacgacaacgtg

SEQ ID NO: 87152 - DNA, 25 bp, Homo sapien
tctgctgcgggacaactacaccctg

SEQ ID NO: 87153 - DNA, 25 bp, Homo sapien
tgtggaagaccgtgtactgcgtgtc

SEQ ID NO: 87154 - DNA, 25 bp, Homo sapien
cccagggatgttgtcaaaactatgg

SEQ ID NO: 87155 - DNA, 25 bp, Homo sapien
gaagtttcgctccatcctcaaaagg

SEQ ID NO: 87156 - DNA, 25 bp, Homo sapien
ttccaccgggacttacggatgaggc

SEQ ID NO: 87157 - DNA, 25 bp, Homo sapien
ctgcagggaacacaggggtgatatc

SEQ ID NO: 87158 - DNA, 25 bp, Homo sapien
ctgcgggaacaacaggggtgacacc

SEQ ID NO: 87159 - DNA, 25 bp, Homo sapien
gggatcgagtacttcccattgacta

SEQ ID NO: 87160 - DNA, 25 bp, Homo sapien
tcctcaaaagggtgctgccggaagc

SEQ ID NO: 87161 - DNA, 25 bp, Homo sapien
gcctggccctgtgactgcttcgggc

SEQ ID NO: 87162 - DNA, 25 bp, Homo sapien
cggctgcgcttccaggtaaagccta

SEQ ID NO: 87163 - DNA, 25 bp, Homo sapien
ccatcccgtcgaggcctggagcagg

SEQ ID NO: 87164 - DNA, 25 bp, Homo sapien
agcagccatcccgtcgaggcctgga

SEQ ID NO: 87165 - DNA, 25 bp, Homo sapien
ggcaccacgggtggcggctctttct

SEQ ID NO: 87166 - DNA, 25 bp, Homo sapien
atcgacgccgcggtacagtgctcgc

SEQ ID NO: 87167 - DNA, 25 bp, Homo sapien
tcgacagctaccagcgggagcggct

SEQ ID NO: 87168 - DNA, 25 bp, Homo sapien
gccgagtacttcgacagctaccagc

SEQ ID NO: 87169 - DNA, 25 bp, Homo sapien
gagaaagtaaaatgaagcgcctttc

SEQ ID NO: 87170 - DNA, 25 bp, Homo sapien
ccctggctccgttctcttgacaatg

SEQ ID NO: 87171 - DNA, 25 bp, Homo sapien
cgttctcttgacaatggcgcgtccc

SEQ ID NO: 87172 - DNA, 25 bp, Homo sapien
aggaataatccgatcggaaccgatc

SEQ ID NO: 87173 - DNA, 25 bp, Homo sapien
gatctgtggttaaacctccctccga

SEQ ID NO: 87174 - DNA, 25 bp, Homo sapien
ttttaaccggatttctctctcgctc

SEQ ID NO: 87175 - DNA, 25 bp, Homo sapien
ctggcgagggccgacgacctcgtct

SEQ ID NO: 87176 - DNA, 25 bp, Homo sapien
tttggtgtccgttacgagcgccggc

SEQ ID NO: 87177 - DNA, 25 bp, Homo sapien
gcttggttttccttgcagtcgcctg

SEQ ID NO: 87178 - DNA, 25 bp, Homo sapien
ccagccgccacgagaagaccagaga

SEQ ID NO: 87179 - DNA, 25 bp, Homo sapien
ggttgctgctcagtctgtaacggca

SEQ ID NO: 87180 - DNA, 25 bp, Homo sapien
ggtgcatcacaacagcccaaagtca

SEQ ID NO: 87181 - DNA, 25 bp, Homo sapien
tacgcatgcgtctattcctaggctg

SEQ ID NO: 87182 - DNA, 25 bp, Homo sapien
cgtaagtatacagtgcctccgggtc

SEQ ID NO: 87183 - DNA, 25 bp, Homo sapien
tctggatgacttcttgcggctgttc

SEQ ID NO: 87184 - DNA, 25 bp, Homo sapien
cccgcagtgaggtctgacgtcattt

SEQ ID NO: 87185 - DNA, 25 bp, Homo sapien
ggggacactgcactttctgatgcgg

SEQ ID NO: 87186 - DNA, 25 bp, Homo sapien
tgcactttctgatgcggtcggggaa

SEQ ID NO: 87187 - DNA, 25 bp, Homo sapien
aagccgggagtcagcctactggagt

SEQ ID NO: 87188 - DNA, 25 bp, Homo sapien
tactggagtccgctgccatccctgg

SEQ ID NO: 87189 - DNA, 25 bp, Homo sapien
cggccttcgaaggactgccctgcgg

SEQ ID NO: 87190 - DNA, 25 bp, Homo sapien
gaggccgagtccctcgttgccaagc

SEQ ID NO: 87191 - DNA, 25 bp, Homo sapien
ttcgtgggtgctgaccgacgaatgt

SEQ ID NO: 87192 - DNA, 25 bp, Homo sapien
ctcacctgtgtggtctgggtcgcct

SEQ ID NO: 87193 - DNA, 25 bp, Homo sapien
accactggtccggagttgcacttgt

SEQ ID NO: 87194 - DNA, 25 bp, Homo sapien
cctagtctaaacgagggcaccactg

SEQ ID NO: 87195 - DNA, 25 bp, Homo sapien
gcagccctgggattgtgcccaagga

SEQ ID NO: 87196 - DNA, 25 bp, Homo sapien
cgtgcccagagtggagatgcttatc

SEQ ID NO: 87197 - DNA, 25 bp, Homo sapien
gttcgggcccaatagcagagtcaga

SEQ ID NO: 87198 - DNA, 25 bp, Homo sapien
tcttcaagctgagtctgcgaggcgc

SEQ ID NO: 87199 - DNA, 25 bp, Homo sapien
gccctcgctgtggagagaaatcctc

SEQ ID NO: 87200 - DNA, 25 bp, Homo sapien
cgaattctcctcgtgtcggccttga

SEQ ID NO: 87201 - DNA, 25 bp, Homo sapien
gaaggtcaccgccatctccgacgtg

SEQ ID NO: 87202 - DNA, 25 bp, Homo sapien
gtttcgcaccagcatcaccgacagg

SEQ ID NO: 87203 - DNA, 25 bp, Homo sapien
agccacactgtgtcgccgtagtcga

SEQ ID NO: 87204 - DNA, 25 bp, Homo sapien
ctcgtcgcggttcttcatcagctta

SEQ ID NO: 87205 - DNA, 25 bp, Homo sapien
gtcgccgccaatgttgacgaactcg

SEQ ID NO: 87206 - DNA, 25 bp, Homo sapien
cgacagcgtcttacgcggcagcttg

SEQ ID NO: 87207 - DNA, 25 bp, Homo sapien
ccgtcgtcgtaaatcatggcctgca

SEQ ID NO: 87208 - DNA, 25 bp, Homo sapien
ccgatgttcacgtacaccttgtcga

SEQ ID NO: 87209 - DNA, 25 bp, Homo sapien
tctagtcttaaacttgacgtttgta

SEQ ID NO: 87210 - DNA, 25 bp, Homo sapien
gcgcctctagtcttaaacttgacgt

SEQ ID NO: 87211 - DNA, 25 bp, Homo sapien
cgtgcgcctctagtcttaaacttga

SEQ ID NO: 87212 - DNA, 25 bp, Homo sapien
cccgtgagcctcaggggatcccagg

SEQ ID NO: 87213 - DNA, 25 bp, Homo sapien
aacccgtgagcctcaggggatccca

SEQ ID NO: 87214 - DNA, 25 bp, Homo sapien
aggaacccgtgagcctcaggggatc

SEQ ID NO: 87215 - DNA, 25 bp, Homo sapien
ggccaggaggaacccgtgagcctca

SEQ ID NO: 87216 - DNA, 25 bp, Homo sapien
cctgtgggttggtgcaagggccagg

SEQ ID NO: 87217 - DNA, 25 bp, Homo sapien
agaccggggtatgtggccccaccag

SEQ ID NO: 87218 - DNA, 25 bp, Homo sapien
cacccaaaccatgctccgccatctg

SEQ ID NO: 87219 - DNA, 25 bp, Homo sapien
acccaaaccatgctccgccatctgg

SEQ ID NO: 87220 - DNA, 25 bp, Homo sapien
tgagcccgctcgcactcctagcatc

SEQ ID NO: 87221 - DNA, 25 bp, Homo sapien
gagcccgctcgcactcctagcatca

SEQ ID NO: 87222 - DNA, 25 bp, Homo sapien
agcccgctcgcactcctagcatcac

SEQ ID NO: 87223 - DNA, 25 bp, Homo sapien
gctcgcactcctagcatcacagaag

SEQ ID NO: 87224 - DNA, 25 bp, Homo sapien
tcgcactcctagcatcacagaagca

SEQ ID NO: 87225 - DNA, 25 bp, Homo sapien
agagatctggagctctgacagagga

SEQ ID NO: 87226 - DNA, 25 bp, Homo sapien
gcacacagcttcaggcgccgggcga

SEQ ID NO: 87227 - DNA, 25 bp, Homo sapien
gatagagatctggagctctgacaga

SEQ ID NO: 87228 - DNA, 25 bp, Homo sapien
caactcccgagctcgcccacactaa

SEQ ID NO: 87229 - DNA, 25 bp, Homo sapien
ccctggatagagatctggagctctg

SEQ ID NO: 87230 - DNA, 25 bp, Homo sapien
acccgagcttcagccgccttctgcg

SEQ ID NO: 87231 - DNA, 25 bp, Homo sapien
gcccacactaaccacatctcggaag

SEQ ID NO: 87232 - DNA, 25 bp, Homo sapien
ctggatagagatctggagctctgac

SEQ ID NO: 87233 - DNA, 25 bp, Homo sapien
gagccgcggtttagccaatggagaa

SEQ ID NO: 87234 - DNA, 25 bp, Homo sapien
gcatttccctacttccagcagctgg

SEQ ID NO: 87235 - DNA, 25 bp, Homo sapien
tttgggaaacacttcgcgtgctttg

SEQ ID NO: 87236 - DNA, 25 bp, Homo sapien
gtgctttgtttcagacgccgaccca

SEQ ID NO: 87237 - DNA, 25 bp, Homo sapien
ccatctttcttggtgggtctccagc

SEQ ID NO: 87238 - DNA, 25 bp, Homo sapien
aggtggaccaatttcccagcttcgc

SEQ ID NO: 87239 - DNA, 25 bp, Homo sapien
tgcctgaaaatgcactcggatgccg

SEQ ID NO: 87240 - DNA, 25 bp, Homo sapien
ggcgctatgggcactccttttgtca

SEQ ID NO: 87241 - DNA, 25 bp, Homo sapien
gtctgtgacgcagttgtctaatttc

SEQ ID NO: 87242 - DNA, 25 bp, Homo sapien
tctaatttctggctatcaggtgtgg

SEQ ID NO: 87243 - DNA, 25 bp, Homo sapien
tggtgccatggaacccgcttcctta

SEQ ID NO: 87244 - DNA, 25 bp, Homo sapien
acccgcttccttagagggatggccg

SEQ ID NO: 87245 - DNA, 25 bp, Homo sapien
ggtttgtctccagtcaacgggtatg

SEQ ID NO: 87246 - DNA, 25 bp, Homo sapien
gtcccgccgaattctgggacttgta

SEQ ID NO: 87247 - DNA, 25 bp, Homo sapien
tgctcggccaactcgtgctttattc

SEQ ID NO: 87248 - DNA, 25 bp, Homo sapien
agtccgtgggtttgatagtctgtga

SEQ ID NO: 87249 - DNA, 25 bp, Homo sapien
acagccaacagagacgaagctgtgc

SEQ ID NO: 87250 - DNA, 25 bp, Homo sapien
cagagacgaagctgtgcgcacagca

SEQ ID NO: 87251 - DNA, 25 bp, Homo sapien
caacagagacgaagctgtgcgcaca

SEQ ID NO: 87252 - DNA, 25 bp, Homo sapien
tacagccaacagagacgaagctgtg

SEQ ID NO: 87253 - DNA, 25 bp, Homo sapien
ttctacagccaacagagacgaagct

SEQ ID NO: 87254 - DNA, 25 bp, Homo sapien
ccattctacagccaacagagacgaa

SEQ ID NO: 87255 - DNA, 25 bp, Homo sapien
cgaagctgtgcgcacagcaggacga

SEQ ID NO: 87256 - DNA, 25 bp, Homo sapien
attctacagccaacagagacgaagc

SEQ ID NO: 87257 - DNA, 25 bp, Homo sapien
ctcaaaaatcgaggacgcttctccc

SEQ ID NO: 87258 - DNA, 25 bp, Homo sapien
ccatcgctgaaagatcggtgccatc

SEQ ID NO: 87259 - DNA, 25 bp, Homo sapien
gcgttgtattgcacaggggccagaa

SEQ ID NO: 87260 - DNA, 25 bp, Homo sapien
gaggctctctttgtttctcggacca

SEQ ID NO: 87261 - DNA, 25 bp, Homo sapien
ctgcagattcctcagaaagggcacc

SEQ ID NO: 87262 - DNA, 25 bp, Homo sapien
tctcggaccaaggtctccttggcta

SEQ ID NO: 87263 - DNA, 25 bp, Homo sapien
gccatccggagctgtgaggctctct

SEQ ID NO: 87264 - DNA, 25 bp, Homo sapien
ggccgatatcgagaccacaagtgga

SEQ ID NO: 87265 - DNA, 25 bp, Homo sapien
cgacctagcaatagggaagccctgc

SEQ ID NO: 87266 - DNA, 25 bp, Homo sapien
ttctggctgaaggagtacaacgtga

SEQ ID NO: 87267 - DNA, 25 bp, Homo sapien
cacagcccttgtcggggatttctta

SEQ ID NO: 87268 - DNA, 25 bp, Homo sapien
gttggtggccactttgcaaagcctc

SEQ ID NO: 87269 - DNA, 25 bp, Homo sapien
tgtgtacatgcccttgtctcagagc

SEQ ID NO: 87270 - DNA, 25 bp, Homo sapien
aagcctccgcggttgcgattcctaa

SEQ ID NO: 87271 - DNA, 25 bp, Homo sapien
aggaatgctgtagacgccctgctgc

SEQ ID NO: 87272 - DNA, 25 bp, Homo sapien
gccagggtatctatggccgggctca

SEQ ID NO: 87273 - DNA, 25 bp, Homo sapien
cgccacagtggtatgtgacgcctgc

SEQ ID NO: 87274 - DNA, 25 bp, Homo sapien
gcgctgcatcgacaaggctgagacc

SEQ ID NO: 87275 - DNA, 25 bp, Homo sapien
ttgtcccggttcagcgattcctatt

SEQ ID NO: 87276 - DNA, 25 bp, Homo sapien
aggctgccctcttgtcccggttcag

SEQ ID NO: 87277 - DNA, 25 bp, Homo sapien
aagctgtccaatgtggcgcgcaagg

SEQ ID NO: 87278 - DNA, 25 bp, Homo sapien
aaccgctccaagctgtccaatgtgg

SEQ ID NO: 87279 - DNA, 25 bp, Homo sapien
ggctgagaccgttcagcggatcatc

SEQ ID NO: 87280 - DNA, 25 bp, Homo sapien
gcggatcatctacatcgccacagtg

SEQ ID NO: 87281 - DNA, 25 bp, Homo sapien
gaggcgatgtttcggacagtcatta

SEQ ID NO: 87282 - DNA, 25 bp, Homo sapien
gtctaaaggttgcagcgatccctca

SEQ ID NO: 87283 - DNA, 25 bp, Homo sapien
tcccgagggttccaaccagatggca

SEQ ID NO: 87284 - DNA, 25 bp, Homo sapien
tccggctttcagtttggctgggaga

SEQ ID NO: 87285 - DNA, 25 bp, Homo sapien
ggcctcctgcttttccatttgattc

SEQ ID NO: 87286 - DNA, 25 bp, Homo sapien
tgattccctgcctctttctattcgg

SEQ ID NO: 87287 - DNA, 25 bp, Homo sapien
tctattcggactggaatgccgggcc

SEQ ID NO: 87288 - DNA, 25 bp, Homo sapien
tcaccgccatctttacaaggggaaa

SEQ ID NO: 87289 - DNA, 25 bp, Homo sapien
cctaggggctccgcacggagtctgc

SEQ ID NO: 87290 - DNA, 25 bp, Homo sapien
ggagccgagcgagagcgaagaggcg

SEQ ID NO: 87291 - DNA, 25 bp, Homo sapien
aggtcagctagagagggagccgagc

SEQ ID NO: 87292 - DNA, 25 bp, Homo sapien
gggaaagggaaggtcagctagagag

SEQ ID NO: 87293 - DNA, 25 bp, Homo sapien
tgagcccgcgatctggctccgggct

SEQ ID NO: 87294 - DNA, 25 bp, Homo sapien
gtctgagcccgcgatctggctccgg

SEQ ID NO: 87295 - DNA, 25 bp, Homo sapien
cgggttcggtctgagcccgcgatct

SEQ ID NO: 87296 - DNA, 25 bp, Homo sapien
tcgggttcggtctgagcccgcgatc

SEQ ID NO: 87297 - DNA, 25 bp, Homo sapien
gatcttcccgggattggctgagcta

SEQ ID NO: 87298 - DNA, 25 bp, Homo sapien
tgctactgcatgagccacacctagg

SEQ ID NO: 87299 - DNA, 25 bp, Homo sapien
ggaagtgcagctgcctcagttctta

SEQ ID NO: 87300 - DNA, 25 bp, Homo sapien
cgtctcttacgtctgcggaagtgca

SEQ ID NO: 87301 - DNA, 25 bp, Homo sapien
tgagctccaggagttcgtctcttac

SEQ ID NO: 87302 - DNA, 25 bp, Homo sapien
ggtctgggcaccgtaacaattttgc

SEQ ID NO: 87303 - DNA, 25 bp, Homo sapien
tgcatctccagtcttcggctttcgg

SEQ ID NO: 87304 - DNA, 25 bp, Homo sapien
ttgcccagagtcttcccgggattgg

SEQ ID NO: 87305 - DNA, 25 bp, Homo sapien
ggggtcatgcaattggctaagcacg

SEQ ID NO: 87306 - DNA, 25 bp, Homo sapien
ggagaagctctcgttccattggcca

SEQ ID NO: 87307 - DNA, 25 bp, Homo sapien
agacgtgtctgccaatcaccggatg

SEQ ID NO: 87308 - DNA, 25 bp, Homo sapien
ccgcgacaacactgggagacgtgtc

SEQ ID NO: 87309 - DNA, 25 bp, Homo sapien
ctgagagccttagcaggccgcgaca

SEQ ID NO: 87310 - DNA, 25 bp, Homo sapien
ccctggcacacaaggagcagaaata

SEQ ID NO: 87311 - DNA, 25 bp, Homo sapien
gttactcccgccaactggcagggga

SEQ ID NO: 87312 - DNA, 25 bp, Homo sapien
attggccatttttccggcctcaagc

SEQ ID NO: 87313 - DNA, 25 bp, Homo sapien
gtagacaacgaattcctggagccca

SEQ ID NO: 87314 - DNA, 25 bp, Homo sapien
caaagtagcggcgtgtctgccctag

SEQ ID NO: 87315 - DNA, 25 bp, Homo sapien
gccctagggaggcaaagcgcaaact

SEQ ID NO: 87316 - DNA, 25 bp, Homo sapien
aaagggcagaaacgcactcacagtg

SEQ ID NO: 87317 - DNA, 25 bp, Homo sapien
actcacagtgcaactccgagggata

SEQ ID NO: 87318 - DNA, 25 bp, Homo sapien
ccgagggataaactggccgacgatc

SEQ ID NO: 87319 - DNA, 25 bp, Homo sapien
gcacctccgcagacgtagacaacga

SEQ ID NO: 87320 - DNA, 25 bp, Homo sapien
ccgccaggccagaagaccaagaaga

SEQ ID NO: 87321 - DNA, 25 bp, Homo sapien
ctaagccggggagcaaacaccgctc

SEQ ID NO: 87322 - DNA, 25 bp, Homo sapien
cctgacgggagttgaggctgaacaa

SEQ ID NO: 87323 - DNA, 25 bp, Homo sapien
ggcgatgcgcctcattcagaacatg

SEQ ID NO: 87324 - DNA, 25 bp, Homo sapien
tgttgttatttcttaccgcggagcc

SEQ ID NO: 87325 - DNA, 25 bp, Homo sapien
cgcccagagcagacgccctaggttg

SEQ ID NO: 87326 - DNA, 25 bp, Homo sapien
tgggcttagccgttgtctacgccac

SEQ ID NO: 87327 - DNA, 25 bp, Homo sapien
cgcccgtacctgcacttatttattg

SEQ ID NO: 87328 - DNA, 25 bp, Homo sapien
agaacatgtgcaccatcgccgagta

SEQ ID NO: 87329 - DNA, 25 bp, Homo sapien
cggcagatgatgtcccgtaggatct

SEQ ID NO: 87330 - DNA, 25 bp, Homo sapien
ccgccgctgggacatgattagctgt

SEQ ID NO: 87331 - DNA, 25 bp, Homo sapien
gtccggcctttcagcaggcagctca

SEQ ID NO: 87332 - DNA, 25 bp, Homo sapien
caccaattgcgtcgggctcgaactc

SEQ ID NO: 87333 - DNA, 25 bp, Homo sapien
ctcgaactctcgcaggtgacagtca

SEQ ID NO: 87334 - DNA, 25 bp, Homo sapien
agaactcaccgcttccggaaattgg

SEQ ID NO: 87335 - DNA, 25 bp, Homo sapien
cacagtacacgtggtcggcctctga

SEQ ID NO: 87336 - DNA, 25 bp, Homo sapien
gcgctcggtgatgacgttaaactga

SEQ ID NO: 87337 - DNA, 25 bp, Homo sapien
cgcaaaatagcaaaccgggatccta

SEQ ID NO: 87338 - DNA, 25 bp, Homo sapien
ctatggcggtacgaaacttcctgtc

SEQ ID NO: 87339 - DNA, 25 bp, Homo sapien
atcgccgcgtttaagttgcgctcgg

SEQ ID NO: 87340 - DNA, 25 bp, Homo sapien
gagctttcttcgttcgttcgtcggc

SEQ ID NO: 87341 - DNA, 25 bp, Homo sapien
tcctgggattggagtctcgagcttt

SEQ ID NO: 87342 - DNA, 25 bp, Homo sapien
aggcgtctcgatcgcctagctgctg

SEQ ID NO: 87343 - DNA, 25 bp, Homo sapien
gacctgcgctggaggcttcatcttt

SEQ ID NO: 87344 - DNA, 25 bp, Homo sapien
ccgcggaagcgaagccacctatacg

SEQ ID NO: 87345 - DNA, 25 bp, Homo sapien
accttgtggtccctgtggatgatgg

SEQ ID NO: 87346 - DNA, 25 bp, Homo sapien
ggacccgcacacagaggccttggca

SEQ ID NO: 87347 - DNA, 25 bp, Homo sapien
actaccttgaggtccctgtggatga

SEQ ID NO: 87348 - DNA, 25 bp, Homo sapien
gctaccttgaggtccctgtggatga

SEQ ID NO: 87349 - DNA, 25 bp, Homo sapien
cgctaccttgaggtccctgtggatg

SEQ ID NO: 87350 - DNA, 25 bp, Homo sapien
gagccactaccttgaggtccctgtg

SEQ ID NO: 87351 - DNA, 25 bp, Homo sapien
gacccgcacacagaggccttggcag

SEQ ID NO: 87352 - DNA, 25 bp, Homo sapien
taaccgagtgggacccgcacacaga

SEQ ID NO: 87353 - DNA, 25 bp, Homo sapien
tccgggccttacacggtgacgtgac

SEQ ID NO: 87354 - DNA, 25 bp, Homo sapien
cccgacaccagacggacacagggga

SEQ ID NO: 87355 - DNA, 25 bp, Homo sapien
cggcgagtacttgagcagctgctcc

SEQ ID NO: 87356 - DNA, 25 bp, Homo sapien
tttcgtcgaaatccgccatcctgag

SEQ ID NO: 87357 - DNA, 25 bp, Homo sapien
tctcggctccggctacagaggggat

SEQ ID NO: 87358 - DNA, 25 bp, Homo sapien
acaatgtcaacatccgcccagaggc

SEQ ID NO: 87359 - DNA, 25 bp, Homo sapien
aggaaaccacagcaacagcccgagc

SEQ ID NO: 87360 - DNA, 25 bp, Homo sapien
agccggctacggcatcgcgagactt

SEQ ID NO: 87361 - DNA, 25 bp, Homo sapien
gagcggcttctccagcgtctcattt

SEQ ID NO: 87362 - DNA, 25 bp, Homo sapien
ctttacacgagcttgcgcgcagaca

SEQ ID NO: 87363 - DNA, 25 bp, Homo sapien
gcctttgcggatgggcttgttttga

SEQ ID NO: 87364 - DNA, 25 bp, Homo sapien
gggtcagtgcgatcgtttagatttc

SEQ ID NO: 87365 - DNA, 25 bp, Homo sapien
ggacagacttacaaccgtcctcggc

SEQ ID NO: 87366 - DNA, 25 bp, Homo sapien
tccttggtttcccagtgagaaataa

SEQ ID NO: 87367 - DNA, 25 bp, Homo sapien
tgtcgcgcagagagcacctcgcgca

SEQ ID NO: 87368 - DNA, 25 bp, Homo sapien
atgcgcatccgtcgcggagaggact

SEQ ID NO: 87369 - DNA, 25 bp, Homo sapien
gcggagattccactgcctcaccatg

SEQ ID NO: 87370 - DNA, 25 bp, Homo sapien
tgcctctgcttaagggccagttctc

SEQ ID NO: 87371 - DNA, 25 bp, Homo sapien
accgtagagtcagccacagaagttc

SEQ ID NO: 87372 - DNA, 25 bp, Homo sapien
cgtcacggcggataaaccagaggtt

SEQ ID NO: 87373 - DNA, 25 bp, Homo sapien
agcgtcttgacgtttttggctaagc

SEQ ID NO: 87374 - DNA, 25 bp, Homo sapien
cgcttggctcaaagggaggcgatca

SEQ ID NO: 87375 - DNA, 25 bp, Homo sapien
taatcctgtgacttcgcatcctgcg

SEQ ID NO: 87376 - DNA, 25 bp, Homo sapien
gcatcctgcgcatcgaagaccttta

SEQ ID NO: 87377 - DNA, 25 bp, Homo sapien
gcactttcacgtacatgagcggctg

SEQ ID NO: 87378 - DNA, 25 bp, Homo sapien
cggcgacgcctcatacctggatgag

SEQ ID NO: 87379 - DNA, 25 bp, Homo sapien
aaaggcccgcaaggctgagccgatc

SEQ ID NO: 87380 - DNA, 25 bp, Homo sapien
catctcgggagaatgaaaggcccgc

SEQ ID NO: 87381 - DNA, 25 bp, Homo sapien
caaagttcagaggatccgccgggca

SEQ ID NO: 87382 - DNA, 25 bp, Homo sapien
cctcagtgacgaagaaccaaagttc

SEQ ID NO: 87383 - DNA, 25 bp, Homo sapien
gaccggccaggatccacctcagtga

SEQ ID NO: 87384 - DNA, 25 bp, Homo sapien
tgacggtttctcttgcacatgcgct

SEQ ID NO: 87385 - DNA, 25 bp, Homo sapien
atggccctttgtaaccttctataga

SEQ ID NO: 87386 - DNA, 25 bp, Homo sapien
gcgtcctccaaatcagctgcctagg

SEQ ID NO: 87387 - DNA, 25 bp, Homo sapien
ctgcagctggtagcccattgggaaa

SEQ ID NO: 87388 - DNA, 25 bp, Homo sapien
gcctgcaggccatatttcgcgtcct

SEQ ID NO: 87389 - DNA, 25 bp, Homo sapien
gccgtatgcaaatggttcactatta

SEQ ID NO: 87390 - DNA, 25 bp, Homo sapien
atcgaggtactctgcatgacaaagc

SEQ ID NO: 87391 - DNA, 25 bp, Homo sapien
tctgcccacgtggaaagcctcgctt

SEQ ID NO: 87392 - DNA, 25 bp, Homo sapien
cgcccttgatcaccggcgcaggaaa

SEQ ID NO: 87393 - DNA, 25 bp, Homo sapien
aaacccgcctatgagcagtggtagg

SEQ ID NO: 87394 - DNA, 25 bp, Homo sapien
ctcgaaggatcttagaacgacactg

SEQ ID NO: 87395 - DNA, 25 bp, Homo sapien
cgtgggaccgatctcgaaggatctt

SEQ ID NO: 87396 - DNA, 25 bp, Homo sapien
gaaccagcctcggaccagccttaga

SEQ ID NO: 87397 - DNA, 25 bp, Homo sapien
cctcggaccagccttagaaggcgga

SEQ ID NO: 87398 - DNA, 25 bp, Homo sapien
cttagaaggcggaaaacaggattca

SEQ ID NO: 87399 - DNA, 25 bp, Homo sapien
acaggattcaaacccgcctatgagc

SEQ ID NO: 87400 - DNA, 25 bp, Homo sapien
atcttagaacgacactgggagagcg

SEQ ID NO: 87401 - DNA, 25 bp, Homo sapien
tctggttcctggagcatcagcgccc

SEQ ID NO: 87402 - DNA, 25 bp, Homo sapien
tgtcaattccaaggaattcgtaggg

SEQ ID NO: 87403 - DNA, 25 bp, Homo sapien
gaggcggtggtacgattcctcaaac

SEQ ID NO: 87404 - DNA, 25 bp, Homo sapien
gggctcagctgtcaattccaaggaa

SEQ ID NO: 87405 - DNA, 25 bp, Homo sapien
aacggagggagaatcaaaaggcatc

SEQ ID NO: 87406 - DNA, 25 bp, Homo sapien
gtttggggctcagctgtcaattcca

SEQ ID NO: 87407 - DNA, 25 bp, Homo sapien
gcctctcgccttgggcgcagggttt

SEQ ID NO: 87408 - DNA, 25 bp, Homo sapien
aggatcgtttcctcccgacactggc

SEQ ID NO: 87409 - DNA, 25 bp, Homo sapien
cggaggctaatctgggtcacctttc

SEQ ID NO: 87410 - DNA, 25 bp, Homo sapien
agtcgtttccaatcagctgcgcggc

SEQ ID NO: 87411 - DNA, 25 bp, Homo sapien
ttgtgcaacggtaacagtcgtttcc

SEQ ID NO: 87412 - DNA, 25 bp, Homo sapien
tacgaccctgcgttattgtgcaacg

SEQ ID NO: 87413 - DNA, 25 bp, Homo sapien
tgggacgtccttgtaattcaatgtg

SEQ ID NO: 87414 - DNA, 25 bp, Homo sapien
agccagtggactcctcgcaggctct

SEQ ID NO: 87415 - DNA, 25 bp, Homo sapien
accctagtagcgagtccggctgagc

SEQ ID NO: 87416 - DNA, 25 bp, Homo sapien
gcgtgggttgcacagaaccctagta

SEQ ID NO: 87417 - DNA, 25 bp, Homo sapien
gacctcggtgttggcctacagcaca

SEQ ID NO: 87418 - DNA, 25 bp, Homo sapien
ccctcctcggtggaatcatttctgc

SEQ ID NO: 87419 - DNA, 25 bp, Homo sapien
gctcggtcctctctagttggccttt

SEQ ID NO: 87420 - DNA, 25 bp, Homo sapien
tcagagccgtctgtgcgtacttctc

SEQ ID NO: 87421 - DNA, 25 bp, Homo sapien
ggcggcgtccatttggcattgaata

SEQ ID NO: 87422 - DNA, 25 bp, Homo sapien
gatcagctgttctattccgggaggg

SEQ ID NO: 87423 - DNA, 25 bp, Homo sapien
agtgtggcccaacccgagtacgttg

SEQ ID NO: 87424 - DNA, 25 bp, Homo sapien
ccctgagtgaagaagtcgtcgtcgc

SEQ ID NO: 87425 - DNA, 25 bp, Homo sapien
gagcttgcagttttgggttgaccca

SEQ ID NO: 87426 - DNA, 25 bp, Homo sapien
gaagccaagaatgaacccgtcgtta

SEQ ID NO: 87427 - DNA, 25 bp, Homo sapien
gccctggctcttgtttaaatcctta

SEQ ID NO: 87428 - DNA, 25 bp, Homo sapien
cgggctttccagctgcaaacacgtc

SEQ ID NO: 87429 - DNA, 25 bp, Homo sapien
gctgcgaccaggttatacgttgctg

SEQ ID NO: 87430 - DNA, 25 bp, Homo sapien
gataatctttcggtctcgcctgggg

SEQ ID NO: 87431 - DNA, 25 bp, Homo sapien
ctgccagatggttgtcgtttgctga

SEQ ID NO: 87432 - DNA, 25 bp, Homo sapien
cccaagtgcagctggacctcgttca

SEQ ID NO: 87433 - DNA, 25 bp, Homo sapien
accgtgcgactactcggcgaagcct

SEQ ID NO: 87434 - DNA, 25 bp, Homo sapien
tggaccagagctcggatcccatcgc

SEQ ID NO: 87435 - DNA, 25 bp, Homo sapien
ttaacacgtcgaaagagcaggggcc

SEQ ID NO: 87436 - DNA, 25 bp, Homo sapien
tactgcttcgcgtccagacaggtgg

SEQ ID NO: 87437 - DNA, 25 bp, Homo sapien
acccgtggagaccaatcgaaggctg

SEQ ID NO: 87438 - DNA, 25 bp, Homo sapien
cttccaaccgcaggcgctctttgtg

SEQ ID NO: 87439 - DNA, 25 bp, Homo sapien
ctgggattttctctgcgttctgctc

SEQ ID NO: 87440 - DNA, 25 bp, Homo sapien
agcgccttctcttgccgtgcgaggc

SEQ ID NO: 87441 - DNA, 25 bp, Homo sapien
aagtgcaggaccctcttcgccatcg

SEQ ID NO: 87442 - DNA, 25 bp, Homo sapien
ggttctttctcccagcgcctgtcta

SEQ ID NO: 87443 - DNA, 25 bp, Homo sapien
tatccaggctgccagacggactttc

SEQ ID NO: 87444 - DNA, 25 bp, Homo sapien
ggaaacgcagcgaccacacattgac

SEQ ID NO: 87445 - DNA, 25 bp, Homo sapien
agctggtgccgaaactctagagcgc

SEQ ID NO: 87446 - DNA, 25 bp, Homo sapien
cccaagtcgcccaggagagaacatc

SEQ ID NO: 87447 - DNA, 25 bp, Homo sapien
tcaccaggcgcgtcaaagtgcagga

SEQ ID NO: 87448 - DNA, 25 bp, Homo sapien
atgcccagaactcgggagccggttc

SEQ ID NO: 87449 - DNA, 25 bp, Homo sapien
tcctcttgcctcagcggagcgtccc

SEQ ID NO: 87450 - DNA, 25 bp, Homo sapien
ccgcgctcgctcctgaagttaggcg

SEQ ID NO: 87451 - DNA, 25 bp, Homo sapien
ggccaggtgacggtctccttccctg

SEQ ID NO: 87452 - DNA, 25 bp, Homo sapien
ctgcaggcggctgtgacactccgga

SEQ ID NO: 87453 - DNA, 25 bp, Homo sapien
ggctgtgacactccggaggcctcga

SEQ ID NO: 87454 - DNA, 25 bp, Homo sapien
cggagcgtcccacggcagtcccgga

SEQ ID NO: 87455 - DNA, 25 bp, Homo sapien
gggccaccctttcactccgcctcca

SEQ ID NO: 87456 - DNA, 25 bp, Homo sapien
actccgcctccatctgctctgtggt

SEQ ID NO: 87457 - DNA, 25 bp, Homo sapien
atgagaactacattggcgtcccagc

SEQ ID NO: 87458 - DNA, 25 bp, Homo sapien
ctgagctggcatgccgttaacgtga

SEQ ID NO: 87459 - DNA, 25 bp, Homo sapien
cgttaacgtgagaaccacatcggca

SEQ ID NO: 87460 - DNA, 25 bp, Homo sapien
acatcggcatcccagcagttgagct

SEQ ID NO: 87461 - DNA, 25 bp, Homo sapien
ctggcgtgccgttaacatgagaact

SEQ ID NO: 87462 - DNA, 25 bp, Homo sapien
actggcatctcagcagccgagccgg

SEQ ID NO: 87463 - DNA, 25 bp, Homo sapien
gtggcaagccattaacgtgagaacc

SEQ ID NO: 87464 - DNA, 25 bp, Homo sapien
gtcaccgaagcaacaaccgcgtcag

SEQ ID NO: 87465 - DNA, 25 bp, Homo sapien
gcaacgcatccgaatttaggcctgg

SEQ ID NO: 87466 - DNA, 25 bp, Homo sapien
ttaggcctggtcatgcgaatttagg

SEQ ID NO: 87467 - DNA, 25 bp, Homo sapien
tccctgtgggaaatggcaacgcatc

SEQ ID NO: 87468 - DNA, 25 bp, Homo sapien
atgtgaactggtagccgcacggagc

SEQ ID NO: 87469 - DNA, 25 bp, Homo sapien
agccgcttgcactcagctggaggaa

SEQ ID NO: 87470 - DNA, 25 bp, Homo sapien
ggctgcgcgatcttccaggacctga

SEQ ID NO: 87471 - DNA, 25 bp, Homo sapien
gacgtcccgctaggctgagaccggt

SEQ ID NO: 87472 - DNA, 25 bp, Homo sapien
caggaccaaggacctccgcggctga

SEQ ID NO: 87473 - DNA, 25 bp, Homo sapien
tggctgactccagtttagccgccgc

SEQ ID NO: 87474 - DNA, 25 bp, Homo sapien
gatgaagaccttagccaccggaaca

SEQ ID NO: 87475 - DNA, 25 bp, Homo sapien
gatggtgctgactgctccctaagcg

SEQ ID NO: 87476 - DNA, 25 bp, Homo sapien
cgagtcagcgccacgtaaccagagg

SEQ ID NO: 87477 - DNA, 25 bp, Homo sapien
ggcgctcgcactaatttgacctcta

SEQ ID NO: 87478 - DNA, 25 bp, Homo sapien
ctctaagagagactaagcgcaggga

SEQ ID NO: 87479 - DNA, 25 bp, Homo sapien
agcagaagtgaaggacctcgcagtc

SEQ ID NO: 87480 - DNA, 25 bp, Homo sapien
ctcaacctggcagaggacgtcacga

SEQ ID NO: 87481 - DNA, 25 bp, Homo sapien
ccgggtagtctagcaaccgaaagca

SEQ ID NO: 87482 - DNA, 25 bp, Homo sapien
cctcggaatcgaaaccgcattgatg

SEQ ID NO: 87483 - DNA, 25 bp, Homo sapien
ccgggaaggtctgcaacatgtatgg

SEQ ID NO: 87484 - DNA, 25 bp, Homo sapien
ggcaaggggacaaactcgctgcacc

SEQ ID NO: 87485 - DNA, 25 bp, Homo sapien
cttaagtacagaggccaagcagtgt

SEQ ID NO: 87486 - DNA, 25 bp, Homo sapien
ggcggccaccgcacttaagtacaga

SEQ ID NO: 87487 - DNA, 25 bp, Homo sapien
ccgtcccaagcagcacggatggctg

SEQ ID NO: 87488 - DNA, 25 bp, Homo sapien
tctgcaacatgtatggcgggcagcg

SEQ ID NO: 87489 - DNA, 25 bp, Homo sapien
actagaacgacacgccaaacttggg

SEQ ID NO: 87490 - DNA, 25 bp, Homo sapien
agccgcaagccgagtccgtgattgc

SEQ ID NO: 87491 - DNA, 25 bp, Homo sapien
ttttaaaccggcagccgcaagccga

SEQ ID NO: 87492 - DNA, 25 bp, Homo sapien
caaggaagccaaccggcactcggca

SEQ ID NO: 87493 - DNA, 25 bp, Homo sapien
agcgaaagctctctcggcacccggt

SEQ ID NO: 87494 - DNA, 25 bp, Homo sapien
tgctccaaacgtgcccgagtggtga

SEQ ID NO: 87495 - DNA, 25 bp, Homo sapien
cccattgggcgctgctccaaacgtg

SEQ ID NO: 87496 - DNA, 25 bp, Homo sapien
ggcggccagatttccttcgcgctct

SEQ ID NO: 87497 - DNA, 25 bp, Homo sapien
caagtgaagtcccagaagccaagta

SEQ ID NO: 87498 - DNA, 25 bp, Homo sapien
tgagggaaccctaccagtctccatc

SEQ ID NO: 87499 - DNA, 25 bp, Homo sapien
gtctccgctgggcatcaacgagcag

SEQ ID NO: 87500 - DNA, 25 bp, Homo sapien
cccgcggcaccagagaagccaagtg

SEQ ID NO: 87501 - DNA, 25 bp, Homo sapien
cagctctctgttcgcagcatctcgg

SEQ ID NO: 87502 - DNA, 25 bp, Homo sapien
ttaaatctcgcgcacaagtgggctg

SEQ ID NO: 87503 - DNA, 25 bp, Homo sapien
cggcgagccgccaacttttaaatct

SEQ ID NO: 87504 - DNA, 25 bp, Homo sapien
gctcctacgtcgctagttgccctgg

SEQ ID NO: 87505 - DNA, 25 bp, Homo sapien
agatgttaccttttcccgcacaggg

SEQ ID NO: 87506 - DNA, 25 bp, Homo sapien
ttcccgcacagggtcagtccacaga

SEQ ID NO: 87507 - DNA, 25 bp, Homo sapien
tcgctgcgatggcaggttcagcttc

SEQ ID NO: 87508 - DNA, 25 bp, Homo sapien
gccggcacctgggtagatgttacct

SEQ ID NO: 87509 - DNA, 25 bp, Homo sapien
ctctccgagagaccctttggatttt

SEQ ID NO: 87510 - DNA, 25 bp, Homo sapien
tggatttttctcttccacaccgcct

SEQ ID NO: 87511 - DNA, 25 bp, Homo sapien
gttcagcttcggttcactaatcgca

SEQ ID NO: 87512 - DNA, 25 bp, Homo sapien
gtcagtccacagacgtgcaccagca

SEQ ID NO: 87513 - DNA, 25 bp, Homo sapien
cggacagacgagctgacaggcacca

SEQ ID NO: 87514 - DNA, 25 bp, Homo sapien
cagtcccttgtcctcgggtctagga

SEQ ID NO: 87515 - DNA, 25 bp, Homo sapien
cgaagtttggtcagagcattctcca

SEQ ID NO: 87516 - DNA, 25 bp, Homo sapien
acgctttattgaggggcgtatccta

SEQ ID NO: 87517 - DNA, 25 bp, Homo sapien
ccgcttcccgttcaacgctttattg

SEQ ID NO: 87518 - DNA, 25 bp, Homo sapien
ggagtttgtcacgtgcccggatata

SEQ ID NO: 87519 - DNA, 25 bp, Homo sapien
gcttcttccttctctacgcggtcaa

SEQ ID NO: 87520 - DNA, 25 bp, Homo sapien
gtctattggccgctccctttttctc

SEQ ID NO: 87521 - DNA, 25 bp, Homo sapien
cgactcgtcaaggagcgtctgtgtg

SEQ ID NO: 87522 - DNA, 25 bp, Homo sapien
cgtgatatctgcgtttggggattac

SEQ ID NO: 87523 - DNA, 25 bp, Homo sapien
cggtaaagttgcaaaccggagattg

SEQ ID NO: 87524 - DNA, 25 bp, Homo sapien
attacgtggtgagcaggcgttcacc

SEQ ID NO: 87525 - DNA, 25 bp, Homo sapien
gtgaaggctactccgctgcagggac

SEQ ID NO: 87526 - DNA, 25 bp, Homo sapien
ggatgccagctcaggcaccagctga

SEQ ID NO: 87527 - DNA, 25 bp, Homo sapien
tttcaaactgctctagcgccggagc

SEQ ID NO: 87528 - DNA, 25 bp, Homo sapien
caccagctgaggtttggcatttgct

SEQ ID NO: 87529 - DNA, 25 bp, Homo sapien
agaaccagacctcaccgtccgggat

SEQ ID NO: 87530 - DNA, 25 bp, Homo sapien
agacctcaccgtccgggatcgcgga

SEQ ID NO: 87531 - DNA, 25 bp, Homo sapien
cggcaagggccagaaccagacctca

SEQ ID NO: 87532 - DNA, 25 bp, Homo sapien
agaatatgggacctcgcctgccttc

SEQ ID NO: 87533 - DNA, 25 bp, Homo sapien
gcaccccgggaacttgcggagaata

SEQ ID NO: 87534 - DNA, 25 bp, Homo sapien
ggcttgcgcgctttggatccccgca

SEQ ID NO: 87535 - DNA, 25 bp, Homo sapien
agccgctctgccagccggagcgcca

SEQ ID NO: 87536 - DNA, 25 bp, Homo sapien
agcaatggaggccacggccgactga

SEQ ID NO: 87537 - DNA, 25 bp, Homo sapien
ctggaggccaagtgcaagcggcaaa

SEQ ID NO: 87538 - DNA, 25 bp, Homo sapien
ggccctgcctggaccagaacggaca

SEQ ID NO: 87539 - DNA, 25 bp, Homo sapien
aacggacacccaggcgaggacaagc

SEQ ID NO: 87540 - DNA, 25 bp, Homo sapien
ccaacgtggcacgaagaggaaccca

SEQ ID NO: 87541 - DNA, 25 bp, Homo sapien
gaagaggaacccaatccgctggatt

SEQ ID NO: 87542 - DNA, 25 bp, Homo sapien
ccgctggattccgaggaagagagaa

SEQ ID NO: 87543 - DNA, 25 bp, Homo sapien
agactactggcgagaactggaggcc

SEQ ID NO: 87544 - DNA, 25 bp, Homo sapien
agagaagacgccaagaagactactg

SEQ ID NO: 87545 - DNA, 25 bp, Homo sapien
accaccgagggatgcaaatttgcca

SEQ ID NO: 87546 - DNA, 25 bp, Homo sapien
tccgcactcgcagaatgggcttcca

SEQ ID NO: 87547 - DNA, 25 bp, Homo sapien
agccagatcaaggacaccgcgtgca

SEQ ID NO: 87548 - DNA, 25 bp, Homo sapien
tcctgaagaacgcagagagtgaccc

SEQ ID NO: 87549 - DNA, 25 bp, Homo sapien
tccggagggaagcagattctctttc

SEQ ID NO: 87550 - DNA, 25 bp, Homo sapien
atgggcttccattcggtccagaatc

SEQ ID NO: 87551 - DNA, 25 bp, Homo sapien
tgcctgcctggcagaaattttccga

SEQ ID NO: 87552 - DNA, 25 bp, Homo sapien
ccgccagtcaatgcaaagttctcta

SEQ ID NO: 87553 - DNA, 25 bp, Homo sapien
catatcaggctttaaaaataccttc

SEQ ID NO: 87554 - DNA, 25 bp, Homo sapien
agcagttttctacaaaacataatgg

SEQ ID NO: 87555 - DNA, 25 bp, Homo sapien
ggccagcagttttctacaaaacata

SEQ ID NO: 87556 - DNA, 25 bp, Homo sapien
gcgtggccagcagttttctacaaaa

SEQ ID NO: 87557 - DNA, 25 bp, Homo sapien
caaattgacttgtggcgtggccagc

SEQ ID NO: 87558 - DNA, 25 bp, Homo sapien
atacaaattgacttgtggcgtggcc

SEQ ID NO: 87559 - DNA, 25 bp, Homo sapien
ccttcactaagtaaaatacaaattg

SEQ ID NO: 87560 - DNA, 25 bp, Homo sapien
tcaggctttaaaaataccttcacta

SEQ ID NO: 87561 - DNA, 25 bp, Homo sapien
ttccgcgtcgctacgtgacgtcagt

SEQ ID NO: 87562 - DNA, 25 bp, Homo sapien
caagtctcgcggattaggtttgatc

SEQ ID NO: 87563 - DNA, 25 bp, Homo sapien
ggtttgatcgcattcggccctttcc

SEQ ID NO: 87564 - DNA, 25 bp, Homo sapien
tagctcgtcgcggatacttctcaca

SEQ ID NO: 87565 - DNA, 25 bp, Homo sapien
cagcagctcccagaagccgtaaagc

SEQ ID NO: 87566 - DNA, 25 bp, Homo sapien
ccgtaaagctatcccagagcgaggc

SEQ ID NO: 87567 - DNA, 25 bp, Homo sapien
agcgaggcaccatacgtaaatcttc

SEQ ID NO: 87568 - DNA, 25 bp, Homo sapien
tgccgcgactcacttagcaagtctc

SEQ ID NO: 87569 - DNA, 25 bp, Homo sapien
tgtcgtgtctttctcctggcctcct

SEQ ID NO: 87570 - DNA, 25 bp, Homo sapien
cgcgaggatcaactgtgcaacgggt

SEQ ID NO: 87571 - DNA, 25 bp, Homo sapien
cggcctgtcgtgtctttctcctggc

SEQ ID NO: 87572 - DNA, 25 bp, Homo sapien
tcgcgagccgaacctactgtccggt

SEQ ID NO: 87573 - DNA, 25 bp, Homo sapien
tcagaggggcgcctacctagctcac

SEQ ID NO: 87574 - DNA, 25 bp, Homo sapien
acctagctcacggtcttgggccgga

SEQ ID NO: 87575 - DNA, 25 bp, Homo sapien
agctgtccgcccagtttcggaggcg

SEQ ID NO: 87576 - DNA, 25 bp, Homo sapien
cggccacgcgaggatcaactgtgca

SEQ ID NO: 87577 - DNA, 25 bp, Homo sapien
ttttccagcacccaacagtagcgta

SEQ ID NO: 87578 - DNA, 25 bp, Homo sapien
ttcgtccgatatccgcgtttcagtc

SEQ ID NO: 87579 - DNA, 25 bp, Homo sapien
ctccgagtccaccaacgagcgaggg

SEQ ID NO: 87580 - DNA, 25 bp, Homo sapien
ctgcctggaaagctgtatttgctgc

SEQ ID NO: 87581 - DNA, 25 bp, Homo sapien
ttgctgcacgtggaaatctccgtta

SEQ ID NO: 87582 - DNA, 25 bp, Homo sapien
tttagccttcatatgcccttccctg

SEQ ID NO: 87583 - DNA, 25 bp, Homo sapien
cccaggccgtcaagacttggtacgc

SEQ ID NO: 87584 - DNA, 25 bp, Homo sapien
tggtacgctccaacttctgagtcgc

SEQ ID NO: 87585 - DNA, 25 bp, Homo sapien
cgcgcgctctcaagaccgtcaataa

SEQ ID NO: 87586 - DNA, 25 bp, Homo sapien
ccctggttgcttacagccacgtgta

SEQ ID NO: 87587 - DNA, 25 bp, Homo sapien
cggtctcctggaaacaggctgcttt

SEQ ID NO: 87588 - DNA, 25 bp, Homo sapien
gagtccgacgcctcttttctccagg

SEQ ID NO: 87589 - DNA, 25 bp, Homo sapien
gctgaagacactcccaactcggcga

SEQ ID NO: 87590 - DNA, 25 bp, Homo sapien
actcggcgacgcttagcaatcatcg

SEQ ID NO: 87591 - DNA, 25 bp, Homo sapien
tgctttgagccgaaactggtgaccg

SEQ ID NO: 87592 - DNA, 25 bp, Homo sapien
cggtatggccagaacggcgacttca

SEQ ID NO: 87593 - DNA, 25 bp, Homo sapien
agggacgctttttctgcagcaatga

SEQ ID NO: 87594 - DNA, 25 bp, Homo sapien
agaagccctgcatccgcgaggtaag

SEQ ID NO: 87595 - DNA, 25 bp, Homo sapien
ggcccacgtggaaggctcttagcca

SEQ ID NO: 87596 - DNA, 25 bp, Homo sapien
taaggttgcttagactgcggcccac

SEQ ID NO: 87597 - DNA, 25 bp, Homo sapien
ctcgggattgaagccggagacgtca

SEQ ID NO: 87598 - DNA, 25 bp, Homo sapien
ccgaactgtcccacgtcctggttgg

SEQ ID NO: 87599 - DNA, 25 bp, Homo sapien
ttgggacctcttggtttcgcttggc

SEQ ID NO: 87600 - DNA, 25 bp, Homo sapien
tcagcgaatcggctgcaagaagccc

SEQ ID NO: 87601 - DNA, 25 bp, Homo sapien
ccgggactcctatgcaccttacgaa

SEQ ID NO: 87602 - DNA, 25 bp, Homo sapien
gcgcgaatggagaaccaagagtttc

SEQ ID NO: 87603 - DNA, 25 bp, Homo sapien
ggcagcccttatcgtatcgcgcaga

SEQ ID NO: 87604 - DNA, 25 bp, Homo sapien
tctaagttcatctgcgccgtccgag

SEQ ID NO: 87605 - DNA, 25 bp, Homo sapien
tgggcaggtctcaacagaaatatcc

SEQ ID NO: 87606 - DNA, 25 bp, Homo sapien
tccacttgctccgaagtcttccaga

SEQ ID NO: 87607 - DNA, 25 bp, Homo sapien
gaaaccgagttgcttcccagcgccg

SEQ ID NO: 87608 - DNA, 25 bp, Homo sapien
agcccattgtgctcaggattctcga

SEQ ID NO: 87609 - DNA, 25 bp, Homo sapien
tgtggacctgcacaactacgtcatc

SEQ ID NO: 87610 - DNA, 25 bp, Homo sapien
cagcaacggcagcattctcaacagg

SEQ ID NO: 87611 - DNA, 25 bp, Homo sapien
tctcaacaggaaagcccatcgcagg

SEQ ID NO: 87612 - DNA, 25 bp, Homo sapien
ccgagacgactgtccgcaaggtggt

SEQ ID NO: 87613 - DNA, 25 bp, Homo sapien
cggggccatcgagcctgtcctatac

SEQ ID NO: 87614 - DNA, 25 bp, Homo sapien
ctataccactgaggacaatgctgtc

SEQ ID NO: 87615 - DNA, 25 bp, Homo sapien
cgcagctgtgtcagtgtaaatccta

SEQ ID NO: 87616 - DNA, 25 bp, Homo sapien
gtggagcagttccagacccgcttgt

SEQ ID NO: 87617 - DNA, 25 bp, Homo sapien
agcgcccattcattgcccgcgagcg

SEQ ID NO: 87618 - DNA, 25 bp, Homo sapien
tggttgagcgcagcgcccattcatt

SEQ ID NO: 87619 - DNA, 25 bp, Homo sapien
cccgcgagcgtccatccatctgtcc

SEQ ID NO: 87620 - DNA, 25 bp, Homo sapien
tcctggagcgccttctgcccagaca

SEQ ID NO: 87621 - DNA, 25 bp, Homo sapien
ccagacacgacgacttcgctcggag

SEQ ID NO: 87622 - DNA, 25 bp, Homo sapien
acacgacgacttcgctcggaggcac

SEQ ID NO: 87623 - DNA, 25 bp, Homo sapien
gacgacttcgctcggaggcacatcg

SEQ ID NO: 87624 - DNA, 25 bp, Homo sapien
tgtcttggttgagcgcagcgcccat

SEQ ID NO: 87625 - DNA, 25 bp, Homo sapien
ccgggtgcttgtcgaccttgttgaa

SEQ ID NO: 87626 - DNA, 25 bp, Homo sapien
agagacgctgctcccaactcgcaga

SEQ ID NO: 87627 - DNA, 25 bp, Homo sapien
tgttgaagttgtactccaggatttc

SEQ ID NO: 87628 - DNA, 25 bp, Homo sapien
caggatttccacctggtcctctgtg

SEQ ID NO: 87629 - DNA, 25 bp, Homo sapien
gaactgtatccctgcctgcgacggg

SEQ ID NO: 87630 - DNA, 25 bp, Homo sapien
gcgagatagatgattccgcgggccc

SEQ ID NO: 87631 - DNA, 25 bp, Homo sapien
ccgacctccggctctaaggaaggag

SEQ ID NO: 87632 - DNA, 25 bp, Homo sapien
ccctggggacagacttgacagatcg

SEQ ID NO: 87633 - DNA, 25 bp, Homo sapien
tgttacctgcgccactcgcagggag

SEQ ID NO: 87634 - DNA, 25 bp, Homo sapien
cctgcgaaggtaactgccaggagca

SEQ ID NO: 87635 - DNA, 25 bp, Homo sapien
gctgtcttgcccctgcggtctgtta

SEQ ID NO: 87636 - DNA, 25 bp, Homo sapien
tgcggtctgttacctgcgccactcg

SEQ ID NO: 87637 - DNA, 25 bp, Homo sapien
tccgagcgctacctgcgaaggtaac

SEQ ID NO: 87638 - DNA, 25 bp, Homo sapien
cgctccgagcgctacctgcgaaggt

SEQ ID NO: 87639 - DNA, 25 bp, Homo sapien
gcgctacctgcgaaggtaactgcca

SEQ ID NO: 87640 - DNA, 25 bp, Homo sapien
cactcgcagggagcgctcgtgcgac

SEQ ID NO: 87641 - DNA, 25 bp, Homo sapien
cctcaccgaggaaggccggtaagtg

SEQ ID NO: 87642 - DNA, 25 bp, Homo sapien
gctgtccagggctgatttgcagata

SEQ ID NO: 87643 - DNA, 25 bp, Homo sapien
tttgcagatactgtggctccggcgg

SEQ ID NO: 87644 - DNA, 25 bp, Homo sapien
agcaggatcgggttacacagcagcc

SEQ ID NO: 87645 - DNA, 25 bp, Homo sapien
tccaccgagtcaggtcctttgaggc

SEQ ID NO: 87646 - DNA, 25 bp, Homo sapien
ctgctcgggcccgtagtcctgaaac

SEQ ID NO: 87647 - DNA, 25 bp, Homo sapien
gctggacagcgatttctgcgcttca

SEQ ID NO: 87648 - DNA, 25 bp, Homo sapien
ggctgcgcggtaactttccgtcctc

SEQ ID NO: 87649 - DNA, 25 bp, Homo sapien
aacggatgtgctacagctgtgcgcg

SEQ ID NO: 87650 - DNA, 25 bp, Homo sapien
gagaacggatgtgctacagctgtgc

SEQ ID NO: 87651 - DNA, 25 bp, Homo sapien
tggagaacggatgtgctacagctgt

SEQ ID NO: 87652 - DNA, 25 bp, Homo sapien
ccctggagaacggatgtgctacagc

SEQ ID NO: 87653 - DNA, 25 bp, Homo sapien
ctgccctggagaacggatgtgctac

SEQ ID NO: 87654 - DNA, 25 bp, Homo sapien
gcctctgccctggagaacggatgtg

SEQ ID NO: 87655 - DNA, 25 bp, Homo sapien
cgtggaggtgcatctgcctctgccc

SEQ ID NO: 87656 - DNA, 25 bp, Homo sapien
cgcgtggaggtgcatctgcctctgc

SEQ ID NO: 87657 - DNA, 25 bp, Homo sapien
cagcacgtcgtgtggtcaggtgtca

SEQ ID NO: 87658 - DNA, 25 bp, Homo sapien
cttacagaaacaggagacgccgtcc

SEQ ID NO: 87659 - DNA, 25 bp, Homo sapien
gctcacactggccttacagaaacag

SEQ ID NO: 87660 - DNA, 25 bp, Homo sapien
ctctgacttggttttgaggccagcc

SEQ ID NO: 87661 - DNA, 25 bp, Homo sapien
gccctgggacgtctttctctgactt

SEQ ID NO: 87662 - DNA, 25 bp, Homo sapien
aaaacaaacatctgccacgagaccc

SEQ ID NO: 87663 - DNA, 25 bp, Homo sapien
ccagacttcgattctgcataaaaac

SEQ ID NO: 87664 - DNA, 25 bp, Homo sapien
tgtggagacgtccttccagacttcg

SEQ ID NO: 87665 - DNA, 25 bp, Homo sapien
cgacaaaaccgaaaggaggcagatg

SEQ ID NO: 87666 - DNA, 25 bp, Homo sapien
cgctgcgacgcgtaatcaatattca

SEQ ID NO: 87667 - DNA, 25 bp, Homo sapien
gcgcacccttgccttctgaaggcga

SEQ ID NO: 87668 - DNA, 25 bp, Homo sapien
gccgcaagccctgagctcgagttca

SEQ ID NO: 87669 - DNA, 25 bp, Homo sapien
tcatatttcaaacgttcccggggca

SEQ ID NO: 87670 - DNA, 25 bp, Homo sapien
gcccgaacttcggtcatatttcaaa

SEQ ID NO: 87671 - DNA, 25 bp, Homo sapien
gggagactcaggatgcccgaacttc

SEQ ID NO: 87672 - DNA, 25 bp, Homo sapien
atccgctttcaaccagcggagcacg

SEQ ID NO: 87673 - DNA, 25 bp, Homo sapien
gaccaacgagactgataaattctag

SEQ ID NO: 87674 - DNA, 25 bp, Homo sapien
caagcagttctccaaagaccaacga

SEQ ID NO: 87675 - DNA, 25 bp, Homo sapien
gacaggaataacctaagaacagagg

SEQ ID NO: 87676 - DNA, 25 bp, Homo sapien
tctactccagagacagacaggaata

SEQ ID NO: 87677 - DNA, 25 bp, Homo sapien
tttcacttcctctactccagagaca

SEQ ID NO: 87678 - DNA, 25 bp, Homo sapien
gtgcatacaccactgcctttcactt

SEQ ID NO: 87679 - DNA, 25 bp, Homo sapien
acagatagctccagcatgcacggcc

SEQ ID NO: 87680 - DNA, 25 bp, Homo sapien
tgataaattctagacagactgatcc

SEQ ID NO: 87681 - DNA, 25 bp, Homo sapien
tcttccactccatagccggtcttgg

SEQ ID NO: 87682 - DNA, 25 bp, Homo sapien
ctcgcgtcccagactcgatgagtgc

SEQ ID NO: 87683 - DNA, 25 bp, Homo sapien
tgtccacggggtcataaggaagctc

SEQ ID NO: 87684 - DNA, 25 bp, Homo sapien
tccgggaacagaaaacgctcctgca

SEQ ID NO: 87685 - DNA, 25 bp, Homo sapien
tgcggctccggatccaggatgtact

SEQ ID NO: 87686 - DNA, 25 bp, Homo sapien
gaggtccactttgtttcccagcacg

SEQ ID NO: 87687 - DNA, 25 bp, Homo sapien
ccctgaccactgtgcgggaccagtt

SEQ ID NO: 87688 - DNA, 25 bp, Homo sapien
tccacgaaggaaaaggctcagcagc

SEQ ID NO: 87689 - DNA, 25 bp, Homo sapien
tttggcaatatgtacgacgcggatg

SEQ ID NO: 87690 - DNA, 25 bp, Homo sapien
ttaggagctcgagaaccgtttggca

SEQ ID NO: 87691 - DNA, 25 bp, Homo sapien
agttacttcgtctttagctcctggc

SEQ ID NO: 87692 - DNA, 25 bp, Homo sapien
cgcaggcgcagatcctaactttggc

SEQ ID NO: 87693 - DNA, 25 bp, Homo sapien
cggcccaagcttgacctacaatttg

SEQ ID NO: 87694 - DNA, 25 bp, Homo sapien
ttgcgggagctgtcctctcaatcag

SEQ ID NO: 87695 - DNA, 25 bp, Homo sapien
gtgaacgctcaaaacacacgccgtg

SEQ ID NO: 87696 - DNA, 25 bp, Homo sapien
cggcggcccacaatttacgcgtgtg

SEQ ID NO: 87697 - DNA, 25 bp, Homo sapien
cccgtcggatgtgcccttcgctggg

SEQ ID NO: 87698 - DNA, 25 bp, Homo sapien
gagcggctcttccaccctctggttt

SEQ ID NO: 87699 - DNA, 25 bp, Homo sapien
tcgcaccgcagtgcgagcggctctt

SEQ ID NO: 87700 - DNA, 25 bp, Homo sapien
tctcacgcccgcttcgcagagctca

SEQ ID NO: 87701 - DNA, 25 bp, Homo sapien
ttgcggctcttcacgcactccatgc

SEQ ID NO: 87702 - DNA, 25 bp, Homo sapien
cggctttacccttccgcctcttgcg

SEQ ID NO: 87703 - DNA, 25 bp, Homo sapien
tgctgacctgggtgatggccttctc

SEQ ID NO: 87704 - DNA, 25 bp, Homo sapien
gcacaccgggtagcggctcttgcac

SEQ ID NO: 87705 - DNA, 25 bp, Homo sapien
gcattgcctcttcccgactatgggg

SEQ ID NO: 87706 - DNA, 25 bp, Homo sapien
tcccgactcctttcgtgtagtgagc

SEQ ID NO: 87707 - DNA, 25 bp, Homo sapien
ccggtagatggtagcattgtgcagc

SEQ ID NO: 87708 - DNA, 25 bp, Homo sapien
gacgagtctcaatccacagcatggg

SEQ ID NO: 87709 - DNA, 25 bp, Homo sapien
ccaggcgtaaccgttgctttggata

SEQ ID NO: 87710 - DNA, 25 bp, Homo sapien
cgtgaccttgggacccgcaaatgtc

SEQ ID NO: 87711 - DNA, 25 bp, Homo sapien
accgtcgtcacacactgcgcaggag

SEQ ID NO: 87712 - DNA, 25 bp, Homo sapien
ttatttttagagactcccgcgcctg

SEQ ID NO: 87713 - DNA, 25 bp, Homo sapien
aggggagctgcgaaagacccattcc

SEQ ID NO: 87714 - DNA, 25 bp, Homo sapien
acagcggtgtctgttagtccacggc

SEQ ID NO: 87715 - DNA, 25 bp, Homo sapien
tgctgttgagtgcatcgccgtgaac

SEQ ID NO: 87716 - DNA, 25 bp, Homo sapien
gcgacgttgggaggtcccattagaa

SEQ ID NO: 87717 - DNA, 25 bp, Homo sapien
tctctgccaagggaagttgctgttg

SEQ ID NO: 87718 - DNA, 25 bp, Homo sapien
tgggagaggtttcggtctctgccaa

SEQ ID NO: 87719 - DNA, 25 bp, Homo sapien
cattagaagctccttgggcgggatc

SEQ ID NO: 87720 - DNA, 25 bp, Homo sapien
ggcgagtgagctactgagaactgca

SEQ ID NO: 87721 - DNA, 25 bp, Homo sapien
acccgccttcaggttgttgagcaac

SEQ ID NO: 87722 - DNA, 25 bp, Homo sapien
acgatctcagggaccggcgtttacg

SEQ ID NO: 87723 - DNA, 25 bp, Homo sapien
tgtttccttgactggggtctccacc

SEQ ID NO: 87724 - DNA, 25 bp, Homo sapien
aggcgaacatttggctctctttttc

SEQ ID NO: 87725 - DNA, 25 bp, Homo sapien
gcctgactccgaagttgtgcaactg

SEQ ID NO: 87726 - DNA, 25 bp, Homo sapien
cccagctatgactgccgcatgttaa

SEQ ID NO: 87727 - DNA, 25 bp, Homo sapien
gtctcttcggcagcgtcttttctta

SEQ ID NO: 87728 - DNA, 25 bp, Homo sapien
cttcgcactcttcataataggggtc

SEQ ID NO: 87729 - DNA, 25 bp, Homo sapien
ttgctgctccattgcgacacgctga

SEQ ID NO: 87730 - DNA, 25 bp, Homo sapien
tgcccaaggagcacagattgcagcg

SEQ ID NO: 87731 - DNA, 25 bp, Homo sapien
cccgcaggtggcaagcacagtgaac

SEQ ID NO: 87732 - DNA, 25 bp, Homo sapien
agtgaacgacatcctgcccttgctg

SEQ ID NO: 87733 - DNA, 25 bp, Homo sapien
agcacagattgcagcgcaaggtgcg

SEQ ID NO: 87734 - DNA, 25 bp, Homo sapien
aggaggcgctcttccacccagacat

SEQ ID NO: 87735 - DNA, 25 bp, Homo sapien
agctaccagaggagttcgcggtcca

SEQ ID NO: 87736 - DNA, 25 bp, Homo sapien
gcgacacgctgagcgcagcccagga

SEQ ID NO: 87737 - DNA, 25 bp, Homo sapien
atttgctcactacccggtgtctgcc

SEQ ID NO: 87738 - DNA, 25 bp, Homo sapien
gcagagggacgatatttgctcacta

SEQ ID NO: 87739 - DNA, 25 bp, Homo sapien
ggtgtctgccgctcattctcaggag

SEQ ID NO: 87740 - DNA, 25 bp, Homo sapien
tcattctcaggaggatccgcccgct

SEQ ID NO: 87741 - DNA, 25 bp, Homo sapien
ccctggccgaacatgagggcaaagt

SEQ ID NO: 87742 - DNA, 25 bp, Homo sapien
ttacctgttctaggtgtttgtgccc

SEQ ID NO: 87743 - DNA, 25 bp, Homo sapien
cgcgggcagttacctgttctaggtg

SEQ ID NO: 87744 - DNA, 25 bp, Homo sapien
ccctggtggtgcctacacgcagcat

SEQ ID NO: 87745 - DNA, 25 bp, Homo sapien
cgtccagcgcgctgagacctgaact

SEQ ID NO: 87746 - DNA, 25 bp, Homo sapien
gagactcgggagtcctccttgtccc

SEQ ID NO: 87747 - DNA, 25 bp, Homo sapien
gcgcacaggagaaggcacgtccaga

SEQ ID NO: 87748 - DNA, 25 bp, Homo sapien
gcgcgctgagacctgaactcccagg

SEQ ID NO: 87749 - DNA, 25 bp, Homo sapien
ccctaccttcgttgctggggctggc

SEQ ID NO: 87750 - DNA, 25 bp, Homo sapien
cccgtcgaggtgcagagtagcagcc

SEQ ID NO: 87751 - DNA, 25 bp, Homo sapien
cgaagggagactcgggagtcctcct

SEQ ID NO: 87752 - DNA, 25 bp, Homo sapien
cccgagcggctcagtccaccgcttc

SEQ ID NO: 87753 - DNA, 25 bp, Homo sapien
ggtgctcttttctcagcggccgcag

SEQ ID NO: 87754 - DNA, 25 bp, Homo sapien
cagactctatctgcgggaaccttcc

SEQ ID NO: 87755 - DNA, 25 bp, Homo sapien
ttctgtttctaaaacgcggggctca

SEQ ID NO: 87756 - DNA, 25 bp, Homo sapien
gatcccgggtttatggtcacctctc

SEQ ID NO: 87757 - DNA, 25 bp, Homo sapien
tcacctctccctcggttagggtgtc

SEQ ID NO: 87758 - DNA, 25 bp, Homo sapien
tagggtgtccgtctgtaaatctttg

SEQ ID NO: 87759 - DNA, 25 bp, Homo sapien
ttcgctcttcagtggcgacacttgg

SEQ ID NO: 87760 - DNA, 25 bp, Homo sapien
tagctccacgaagctccgttccagg

SEQ ID NO: 87761 - DNA, 25 bp, Homo sapien
ggctgtggcatcaacaaccttgtcg

SEQ ID NO: 87762 - DNA, 25 bp, Homo sapien
ttgtcgtcacatcgccgcgcattcg

SEQ ID NO: 87763 - DNA, 25 bp, Homo sapien
gtccctccgtttggcatcttgcctg

SEQ ID NO: 87764 - DNA, 25 bp, Homo sapien
cacccacggagggaagtaatctgga

SEQ ID NO: 87765 - DNA, 25 bp, Homo sapien
ttcgacgaagtcacacacccacgga

SEQ ID NO: 87766 - DNA, 25 bp, Homo sapien
tcgcagcctcgccagtgagaatcta

SEQ ID NO: 87767 - DNA, 25 bp, Homo sapien
gtcgaggttgaaactgcaccgccaa

SEQ ID NO: 87768 - DNA, 25 bp, Homo sapien
gctggtccgtggctagtttcttaaa

SEQ ID NO: 87769 - DNA, 25 bp, Homo sapien
cttcgccatcctctgggtggagtca

SEQ ID NO: 87770 - DNA, 25 bp, Homo sapien
cacgaagtcactctggtcgcggccg

SEQ ID NO: 87771 - DNA, 25 bp, Homo sapien
ggaggtgcaccatcttccgcctcga

SEQ ID NO: 87772 - DNA, 25 bp, Homo sapien
tgcgatgaacttccggctgtcaagc

SEQ ID NO: 87773 - DNA, 25 bp, Homo sapien
cgattcccgcccaggtagttcagcg

SEQ ID NO: 87774 - DNA, 25 bp, Homo sapien
agcctcccgtttgctgttagcgccg

SEQ ID NO: 87775 - DNA, 25 bp, Homo sapien
caggtgtctccggtttaagcgcttc

SEQ ID NO: 87776 - DNA, 25 bp, Homo sapien
acatggtctgttttgtgggaggctc

SEQ ID NO: 87777 - DNA, 25 bp, Homo sapien
ggaaggcgcgcgctaacaacactcc

SEQ ID NO: 87778 - DNA, 25 bp, Homo sapien
cgccctcaacaaacaagaacgcttg

SEQ ID NO: 87779 - DNA, 25 bp, Homo sapien
taaccttaagtctcaggcgactgcc

SEQ ID NO: 87780 - DNA, 25 bp, Homo sapien
ggccgcggccaagcaataaccttaa

SEQ ID NO: 87781 - DNA, 25 bp, Homo sapien
caggaagccgagcaagaaacgaatc

SEQ ID NO: 87782 - DNA, 25 bp, Homo sapien
cgcaactgtctgaggtggaagccca

SEQ ID NO: 87783 - DNA, 25 bp, Homo sapien
ttaccagaccggacgcagccatgtt

SEQ ID NO: 87784 - DNA, 25 bp, Homo sapien
ccgtccaataggaagcaagccgtta

SEQ ID NO: 87785 - DNA, 25 bp, Homo sapien
cagcgccttcccgtcaaccctaggg

SEQ ID NO: 87786 - DNA, 25 bp, Homo sapien
ggcgttactgttgcgactggcatcc

SEQ ID NO: 87787 - DNA, 25 bp, Homo sapien
caccgccgccggctactggaaggta

SEQ ID NO: 87788 - DNA, 25 bp, Homo sapien
gatccttccattgccgcctgagaca

SEQ ID NO: 87789 - DNA, 25 bp, Homo sapien
gccacaggctcggatccttccattg

SEQ ID NO: 87790 - DNA, 25 bp, Homo sapien
ctcaccttcgcccttctcgtcctct

SEQ ID NO: 87791 - DNA, 25 bp, Homo sapien
aagaagcagaaacccggagcctggg

SEQ ID NO: 87792 - DNA, 25 bp, Homo sapien
actgttgcgactggcatccgcatcc

SEQ ID NO: 87793 - DNA, 25 bp, Homo sapien
tttctaccgcgacgacgtgaccctg

SEQ ID NO: 87794 - DNA, 25 bp, Homo sapien
ttggccctggagacgaacctgaacc

SEQ ID NO: 87795 - DNA, 25 bp, Homo sapien
tgaataggacagcagtttgggcgcc

SEQ ID NO: 87796 - DNA, 25 bp, Homo sapien
tccagaagccgtcctgggatgaata

SEQ ID NO: 87797 - DNA, 25 bp, Homo sapien
cccagagtctgtggaagacgcaaaa

SEQ ID NO: 87798 - DNA, 25 bp, Homo sapien
ctgggcgcaaagcatgcagactctc

SEQ ID NO: 87799 - DNA, 25 bp, Homo sapien
agaaccacttcctaggccgcgaacg

SEQ ID NO: 87800 - DNA, 25 bp, Homo sapien
ggcagctgcgggcttcccttaccta

SEQ ID NO: 87801 - DNA, 25 bp, Homo sapien
gtgcaaaggaacgtgacgtgacgtc

SEQ ID NO: 87802 - DNA, 25 bp, Homo sapien
gtcagtccgtctgcccggatacgcg

SEQ ID NO: 87803 - DNA, 25 bp, Homo sapien
ctctctgggaacgtcacagtgcgga

SEQ ID NO: 87804 - DNA, 25 bp, Homo sapien
gtttacgcttcgttcctctctggga

SEQ ID NO: 87805 - DNA, 25 bp, Homo sapien
tcccgaaatgccctgcgctgtttac

SEQ ID NO: 87806 - DNA, 25 bp, Homo sapien
ggagcctgcttcctgcgcgaaacaa

SEQ ID NO: 87807 - DNA, 25 bp, Homo sapien
atacgcgcgtcgcacttggcctctt

SEQ ID NO: 87808 - DNA, 25 bp, Homo sapien
gccttctcgttagggctcagactcg

SEQ ID NO: 87809 - DNA, 25 bp, Homo sapien
cgctgctgtttagagccacgagtta

SEQ ID NO: 87810 - DNA, 25 bp, Homo sapien
agtccggagtcgctgtaaaacctga

SEQ ID NO: 87811 - DNA, 25 bp, Homo sapien
cgagttaccggagcgcctgattcct

SEQ ID NO: 87812 - DNA, 25 bp, Homo sapien
ttccagtagccgatcaggagtctgc

SEQ ID NO: 87813 - DNA, 25 bp, Homo sapien
tcaccggaatcgactggcgttaaag

SEQ ID NO: 87814 - DNA, 25 bp, Homo sapien
gcactcgagagtaagcgcattagcc

SEQ ID NO: 87815 - DNA, 25 bp, Homo sapien
cagcgccctctattggccatcggga

SEQ ID NO: 87816 - DNA, 25 bp, Homo sapien
tcaacgtgatctcgactaagggacc

SEQ ID NO: 87817 - DNA, 25 bp, Homo sapien
ctgttctcccgaggcgcccggtgag

SEQ ID NO: 87818 - DNA, 25 bp, Homo sapien
cgggaagctgttctcccgaggcgcc

SEQ ID NO: 87819 - DNA, 25 bp, Homo sapien
ggctaccctcgggaagctgttctcc

SEQ ID NO: 87820 - DNA, 25 bp, Homo sapien
ttcctgctgctgagctacccgagcg

SEQ ID NO: 87821 - DNA, 25 bp, Homo sapien
ccgctggtgccgaaagttgcagcga

SEQ ID NO: 87822 - DNA, 25 bp, Homo sapien
gcccaccgctggtgccgaaagttgc

SEQ ID NO: 87823 - DNA, 25 bp, Homo sapien
cctggtctctctcccgtcttgggct

SEQ ID NO: 87824 - DNA, 25 bp, Homo sapien
gcgccagcccgtggccgagaagaaa

SEQ ID NO: 87825 - DNA, 25 bp, Homo sapien
gggctcgggcctcgcaacttcacaa

SEQ ID NO: 87826 - DNA, 25 bp, Homo sapien
gcagcctcacgaaacctaccatggg

SEQ ID NO: 87827 - DNA, 25 bp, Homo sapien
ggggaacaaggcctcaacattcacc

SEQ ID NO: 87828 - DNA, 25 bp, Homo sapien
tgcccaaccgaccagagactcgagg

SEQ ID NO: 87829 - DNA, 25 bp, Homo sapien
aagacccgacgcctgggagagcttc

SEQ ID NO: 87830 - DNA, 25 bp, Homo sapien
gcttcccttgttccagggcccaata

SEQ ID NO: 87831 - DNA, 25 bp, Homo sapien
gcccacgtacctggctgtagctgcg

SEQ ID NO: 87832 - DNA, 25 bp, Homo sapien
ccagccggcggaaagcaagaagatg

SEQ ID NO: 87833 - DNA, 25 bp, Homo sapien
ggccagcgcctggattccttcatca

SEQ ID NO: 87834 - DNA, 25 bp, Homo sapien
ctgcacaatccgtatccaagcggtg

SEQ ID NO: 87835 - DNA, 25 bp, Homo sapien
tccctagcagcagaggagaccagaa

SEQ ID NO: 87836 - DNA, 25 bp, Homo sapien
gcttgcaccgctatcgcgagagctc

SEQ ID NO: 87837 - DNA, 25 bp, Homo sapien
ctggagtgattcaagacgagcgcta

SEQ ID NO: 87838 - DNA, 25 bp, Homo sapien
cccgcggccaacatgagcttcttgt

SEQ ID NO: 87839 - DNA, 25 bp, Homo sapien
agctctgccatgactcctaaccggg

SEQ ID NO: 87840 - DNA, 25 bp, Homo sapien
ctgccattggaactagctgagccga

SEQ ID NO: 87841 - DNA, 25 bp, Homo sapien
ggcgggactggcattgactgcacct

SEQ ID NO: 87842 - DNA, 25 bp, Homo sapien
cgggaggaagcgatgaatattcaga

SEQ ID NO: 87843 - DNA, 25 bp, Homo sapien
ttcccggcgctgggcacatctggcg

SEQ ID NO: 87844 - DNA, 25 bp, Homo sapien
ccggatccccggaaggcgacttgcg

SEQ ID NO: 87845 - DNA, 25 bp, Homo sapien
actggcattgactgcacctgcccga

SEQ ID NO: 87846 - DNA, 25 bp, Homo sapien
ccgattcgcgcgtccggggcacgtt

SEQ ID NO: 87847 - DNA, 25 bp, Homo sapien
cgccgctgccatgtctccggggaag

SEQ ID NO: 87848 - DNA, 25 bp, Homo sapien
attgactgcacctgcccgagcgtac

SEQ ID NO: 87849 - DNA, 25 bp, Homo sapien
tcggtaaggagcctccggaaatgtg

SEQ ID NO: 87850 - DNA, 25 bp, Homo sapien
cgcatctctctgcagcaactcggtg

SEQ ID NO: 87851 - DNA, 25 bp, Homo sapien
atctccatcgaagggaacatcggta

SEQ ID NO: 87852 - DNA, 25 bp, Homo sapien
tgaggggacccgcatcaagaaaatc

SEQ ID NO: 87853 - DNA, 25 bp, Homo sapien
cgcccaagagaagctgcccgtcttt

SEQ ID NO: 87854 - DNA, 25 bp, Homo sapien
tgggccgccacaagactaaggaatg

SEQ ID NO: 87855 - DNA, 25 bp, Homo sapien
agctcactagctgacccggcaggtc

SEQ ID NO: 87856 - DNA, 25 bp, Homo sapien
agcaactcggtgagggctttccctc

SEQ ID NO: 87857 - DNA, 25 bp, Homo sapien
ccgcgcaccacacaggctgtgtaga

SEQ ID NO: 87858 - DNA, 25 bp, Homo sapien
caaagtagagtagacgcccgcgctc

SEQ ID NO: 87859 - DNA, 25 bp, Homo sapien
tactagcaggaacatcagagatccc

SEQ ID NO: 87860 - DNA, 25 bp, Homo sapien
cactgctgcagtgttagttactagc

SEQ ID NO: 87861 - DNA, 25 bp, Homo sapien
ctttaaatatggatcgcaggctcgc

SEQ ID NO: 87862 - DNA, 25 bp, Homo sapien
cgaggccacttacggctttaaatat

SEQ ID NO: 87863 - DNA, 25 bp, Homo sapien
tggaggctgcttccgcggaaaagta

SEQ ID NO: 87864 - DNA, 25 bp, Homo sapien
caggcggcaaagttgtgactacttg

SEQ ID NO: 87865 - DNA, 25 bp, Homo sapien
caggcacgcgtgcacaggcgccgag

SEQ ID NO: 87866 - DNA, 25 bp, Homo sapien
ccaggcacgcgtgcacaggcgccga

SEQ ID NO: 87867 - DNA, 25 bp, Homo sapien
cggcccctgtagagaacagacagcc

SEQ ID NO: 87868 - DNA, 25 bp, Homo sapien
tagagaacagacagccccaggcacg

SEQ ID NO: 87869 - DNA, 25 bp, Homo sapien
gacagccccaggcacgtgtgcacgg

SEQ ID NO: 87870 - DNA, 25 bp, Homo sapien
agcgcggcccctgtagagaacagac

SEQ ID NO: 87871 - DNA, 25 bp, Homo sapien
cccaggcacgcgtgcacaggcgccg

SEQ ID NO: 87872 - DNA, 25 bp, Homo sapien
gagcgcggcccctgtagagaacaga

SEQ ID NO: 87873 - DNA, 25 bp, Homo sapien
cggccccgtaggagacagccccagg

SEQ ID NO: 87874 - DNA, 25 bp, Homo sapien
catacgtgcacaggtgccgagactg

SEQ ID NO: 87875 - DNA, 25 bp, Homo sapien
ggcatacgtgcacaggtgccgagac

SEQ ID NO: 87876 - DNA, 25 bp, Homo sapien
atacgtgcacaggtgccgagactga

SEQ ID NO: 87877 - DNA, 25 bp, Homo sapien
tacgtgcacaggtgccgagactgag

SEQ ID NO: 87878 - DNA, 25 bp, Homo sapien
acgtgcacaggtgccgagactgagg

SEQ ID NO: 87879 - DNA, 25 bp, Homo sapien
tgcacgggccccgagagcgagagcg

SEQ ID NO: 87880 - DNA, 25 bp, Homo sapien
gcatacgtgcacaggtgccgagact

SEQ ID NO: 87881 - DNA, 25 bp, Homo sapien
cgcgctcggattctgagtttcacaa

SEQ ID NO: 87882 - DNA, 25 bp, Homo sapien
ttcacaagaatgtacctgggtgccc

SEQ ID NO: 87883 - DNA, 25 bp, Homo sapien
agaggtaacagcatgggccagtttg

SEQ ID NO: 87884 - DNA, 25 bp, Homo sapien
gtgcctcctggaaagtgacgtctca

SEQ ID NO: 87885 - DNA, 25 bp, Homo sapien
gacgtctcatctgcaccggacaagg

SEQ ID NO: 87886 - DNA, 25 bp, Homo sapien
cccttagcgggatatgaatagcttc

SEQ ID NO: 87887 - DNA, 25 bp, Homo sapien
ccggcagactgcgaaaagtagctgg

SEQ ID NO: 87888 - DNA, 25 bp, Homo sapien
agcagggacagaacctgttgctgca

SEQ ID NO: 87889 - DNA, 25 bp, Homo sapien
ggagtcgtaacctcccgtgcaactc

SEQ ID NO: 87890 - DNA, 25 bp, Homo sapien
gtggtactcccaggacacgtgtcta

SEQ ID NO: 87891 - DNA, 25 bp, Homo sapien
ggacccagcgtccagaacttcattc

SEQ ID NO: 87892 - DNA, 25 bp, Homo sapien
aactggctgcggtttgtcactagga

SEQ ID NO: 87893 - DNA, 25 bp, Homo sapien
aatgtcgcagactggtgaagcccta

SEQ ID NO: 87894 - DNA, 25 bp, Homo sapien
cctaggtgtgacaagactgggctcc

SEQ ID NO: 87895 - DNA, 25 bp, Homo sapien
actgtcaaatcctagcccggccgtg

SEQ ID NO: 87896 - DNA, 25 bp, Homo sapien
cacgtgtctactggatctctccctg

SEQ ID NO: 87897 - DNA, 25 bp, Homo sapien
aagtattagcgagagagacgagcga

SEQ ID NO: 87898 - DNA, 25 bp, Homo sapien
ggctcctgttgctcgcagcgcggca

SEQ ID NO: 87899 - DNA, 25 bp, Homo sapien
ctcgcagcgcggcagtctgctggct

SEQ ID NO: 87900 - DNA, 25 bp, Homo sapien
cgctaataaggcgtccggagctccc

SEQ ID NO: 87901 - DNA, 25 bp, Homo sapien
cccgcaccgtgtcaggattggagac

SEQ ID NO: 87902 - DNA, 25 bp, Homo sapien
ccgggctcgacctcccaccctggag

SEQ ID NO: 87903 - DNA, 25 bp, Homo sapien
cctggagcctctccttctccgccta

SEQ ID NO: 87904 - DNA, 25 bp, Homo sapien
cgcccacgtcatgcggggcccgaac

SEQ ID NO: 87905 - DNA, 25 bp, Homo sapien
cacagcatttctgcaccacggcgga

SEQ ID NO: 87906 - DNA, 25 bp, Homo sapien
cgtgcgatcgaaaaccctgagtgaa

SEQ ID NO: 87907 - DNA, 25 bp, Homo sapien
accctgagtgaatgtcggccttcct

SEQ ID NO: 87908 - DNA, 25 bp, Homo sapien
accagccgttcgcatgtactgcaga

SEQ ID NO: 87909 - DNA, 25 bp, Homo sapien
cccgctgctagggtgtagttagtcc

SEQ ID NO: 87910 - DNA, 25 bp, Homo sapien
cgggcctcacaatccagcggacata

SEQ ID NO: 87911 - DNA, 25 bp, Homo sapien
ggcctactgcgcacacgcgaaagtt

SEQ ID NO: 87912 - DNA, 25 bp, Homo sapien
ttgaccttcccagtcaagccggtga

SEQ ID NO: 87913 - DNA, 25 bp, Homo sapien
cgcgagctcccggatttcttctctt

SEQ ID NO: 87914 - DNA, 25 bp, Homo sapien
tggccgaaaggcgaaagtgagattt

SEQ ID NO: 87915 - DNA, 25 bp, Homo sapien
cttcttccttcctggcttgtgatta

SEQ ID NO: 87916 - DNA, 25 bp, Homo sapien
ttgtgattagaacgcagccgcaggc

SEQ ID NO: 87917 - DNA, 25 bp, Homo sapien
aagcgcggtccagacactttgctga

SEQ ID NO: 87918 - DNA, 25 bp, Homo sapien
ctcacctcgtctcgcgatactaagg

SEQ ID NO: 87919 - DNA, 25 bp, Homo sapien
gcgattgcaaccagagcgcccgcga

SEQ ID NO: 87920 - DNA, 25 bp, Homo sapien
agtgacgccatcagccgtcgcctga

SEQ ID NO: 87921 - DNA, 25 bp, Homo sapien
agggaaaccagtgccctgtctctgc

SEQ ID NO: 87922 - DNA, 25 bp, Homo sapien
ggctgggactccgcgagtcactcac

SEQ ID NO: 87923 - DNA, 25 bp, Homo sapien
cgttgttcggctgaacttgcttcgc

SEQ ID NO: 87924 - DNA, 25 bp, Homo sapien
acttgcttcgcggtttgttctcggc

SEQ ID NO: 87925 - DNA, 25 bp, Homo sapien
ttgttctcggctgggtcaggaactc

SEQ ID NO: 87926 - DNA, 25 bp, Homo sapien
agtcactcacctgtaggggaggtcc

SEQ ID NO: 87927 - DNA, 25 bp, Homo sapien
tagagggaaaccagtgccctgtctc

SEQ ID NO: 87928 - DNA, 25 bp, Homo sapien
ctcccagagcatggctcagctgggc

SEQ ID NO: 87929 - DNA, 25 bp, Homo sapien
ctggcactggggtgcatcccagcct

SEQ ID NO: 87930 - DNA, 25 bp, Homo sapien
cagcggtgagagctcctggcactgg

SEQ ID NO: 87931 - DNA, 25 bp, Homo sapien
ccagcggtgagagctcctggcactg

SEQ ID NO: 87932 - DNA, 25 bp, Homo sapien
gccagcggtgagagctcctggcact

SEQ ID NO: 87933 - DNA, 25 bp, Homo sapien
cccgcgaaccctctcttgaccacta

SEQ ID NO: 87934 - DNA, 25 bp, Homo sapien
caggaacccgcgaaccctctcttga

SEQ ID NO: 87935 - DNA, 25 bp, Homo sapien
ccagctcaggaacccgcgaaccctc

SEQ ID NO: 87936 - DNA, 25 bp, Homo sapien
tcaggaacccgcgaaccctctcttg

SEQ ID NO: 87937 - DNA, 25 bp, Homo sapien
aacgcagccacgtccaatcagagga

SEQ ID NO: 87938 - DNA, 25 bp, Homo sapien
tgggtttaaatcacccgcgcttcgc

SEQ ID NO: 87939 - DNA, 25 bp, Homo sapien
gaaagaactcatagcgccgccgatc

SEQ ID NO: 87940 - DNA, 25 bp, Homo sapien
atagttggatactcggccatctgcc

SEQ ID NO: 87941 - DNA, 25 bp, Homo sapien
tcaggttctccctatcgaagcggtc

SEQ ID NO: 87942 - DNA, 25 bp, Homo sapien
gccgcgttgaccacatccgaaaata

SEQ ID NO: 87943 - DNA, 25 bp, Homo sapien
tgttgctctggtaaggcgttgccca

SEQ ID NO: 87944 - DNA, 25 bp, Homo sapien
tcccgcccaacaaacacaggtgttg

SEQ ID NO: 87945 - DNA, 25 bp, Homo sapien
ttgatgtcgcctgcagatcacctga

SEQ ID NO: 87946 - DNA, 25 bp, Homo sapien
agactttccctcctgacagagccta

SEQ ID NO: 87947 - DNA, 25 bp, Homo sapien
gactttccctcctgacagagcctaa

SEQ ID NO: 87948 - DNA, 25 bp, Homo sapien
agggcgtcctagaggaggtcgtatt

SEQ ID NO: 87949 - DNA, 25 bp, Homo sapien
ctagaggaggtcgtattggaggcat

SEQ ID NO: 87950 - DNA, 25 bp, Homo sapien
cattgagaagacgtaggagctgacc

SEQ ID NO: 87951 - DNA, 25 bp, Homo sapien
tgagaagacgtaggagctgaccaca

SEQ ID NO: 87952 - DNA, 25 bp, Homo sapien
gaagacgtaggagctgaccacaatg

SEQ ID NO: 87953 - DNA, 25 bp, Homo sapien
ttattgcgcgcgtgctgagtctgcg

SEQ ID NO: 87954 - DNA, 25 bp, Homo sapien
agctgctcttattgcgcgcgtgctg

SEQ ID NO: 87955 - DNA, 25 bp, Homo sapien
tcatgatcgcagctgctcttattgc

SEQ ID NO: 87956 - DNA, 25 bp, Homo sapien
tctaggatcatgatcgcagctgctc

SEQ ID NO: 87957 - DNA, 25 bp, Homo sapien
cagaaaccaggctgggagggccagc

SEQ ID NO: 87958 - DNA, 25 bp, Homo sapien
gatgctgttcttggcgttgctgctc

SEQ ID NO: 87959 - DNA, 25 bp, Homo sapien
caggagatgctgttcttggcgttgc

SEQ ID NO: 87960 - DNA, 25 bp, Homo sapien
ccacccgccaggagatgctgttctt

SEQ ID NO: 87961 - DNA, 25 bp, Homo sapien
aggcgcgggctgcatcagtggaccc

SEQ ID NO: 87962 - DNA, 25 bp, Homo sapien
tcgctcagtcagtgagtctcttctt

SEQ ID NO: 87963 - DNA, 25 bp, Homo sapien
cctcgctcagtcagtgagtctcttc

SEQ ID NO: 87964 - DNA, 25 bp, Homo sapien
gccgacagcctcgctcagtcagtga

SEQ ID NO: 87965 - DNA, 25 bp, Homo sapien
ctggggtaggcacccagcgccgaca

SEQ ID NO: 87966 - DNA, 25 bp, Homo sapien
cacagccgccagacccgcctgctga

SEQ ID NO: 87967 - DNA, 25 bp, Homo sapien
ttccgctcctctcacagccgccaga

SEQ ID NO: 87968 - DNA, 25 bp, Homo sapien
acctcctcgccagctcttccgctcc

SEQ ID NO: 87969 - DNA, 25 bp, Homo sapien
caggtctatcccgagtactgaagaa

SEQ ID NO: 87970 - DNA, 25 bp, Homo sapien
gccacccatactcctagggaagaag

SEQ ID NO: 87971 - DNA, 25 bp, Homo sapien
gctccaggtctatcccgagtactga

SEQ ID NO: 87972 - DNA, 25 bp, Homo sapien
ggagctccaggtctatcccgagtac

SEQ ID NO: 87973 - DNA, 25 bp, Homo sapien
catgggccacccatactcctaggga

SEQ ID NO: 87974 - DNA, 25 bp, Homo sapien
aagcactggcaaggcagttcatggg

SEQ ID NO: 87975 - DNA, 25 bp, Homo sapien
cggcgcagttcaccgggctcagaag

SEQ ID NO: 87976 - DNA, 25 bp, Homo sapien
caaggcagttcatgggccacccata

SEQ ID NO: 87977 - DNA, 25 bp, Homo sapien
ctcttcatggatgagggcggtgaca

SEQ ID NO: 87978 - DNA, 25 bp, Homo sapien
acgcgggctctacctccacatgggg

SEQ ID NO: 87979 - DNA, 25 bp, Homo sapien
cctcggctcacccagtggaagtctt

SEQ ID NO: 87980 - DNA, 25 bp, Homo sapien
gaagtcttctcgtttgacctccacg

SEQ ID NO: 87981 - DNA, 25 bp, Homo sapien
tccacgagccactcagcaaggagcg

SEQ ID NO: 87982 - DNA, 25 bp, Homo sapien
cttcagcgacggagtctacgccatc

SEQ ID NO: 87983 - DNA, 25 bp, Homo sapien
cgcttctcatcctggacatctggtg

SEQ ID NO: 87984 - DNA, 25 bp, Homo sapien
ctgcacattccaggcctcttcatgg

SEQ ID NO: 87985 - DNA, 25 bp, Homo sapien
cggagctcatgctgcggcagagctt

SEQ ID NO: 87986 - DNA, 25 bp, Homo sapien
cctgaagtggacaccgaggaactgc

SEQ ID NO: 87987 - DNA, 25 bp, Homo sapien
agtccggaagcctgaagtggacacc

SEQ ID NO: 87988 - DNA, 25 bp, Homo sapien
tttattcccggctgtccttccagtc

SEQ ID NO: 87989 - DNA, 25 bp, Homo sapien
gagcctcgccggcacgttttattcc

SEQ ID NO: 87990 - DNA, 25 bp, Homo sapien
ctgtggccaatgactcctgagcctc

SEQ ID NO: 87991 - DNA, 25 bp, Homo sapien
ctcagtgctcagtgcgatgggaaac

SEQ ID NO: 87992 - DNA, 25 bp, Homo sapien
cggcagagcttccagcaggatctca

SEQ ID NO: 87993 - DNA, 25 bp, Homo sapien
ctgggatgcacctctgtgcccgagt

SEQ ID NO: 87994 - DNA, 25 bp, Homo sapien
tcaccgctggcgatgggccctggct

SEQ ID NO: 87995 - DNA, 25 bp, Homo sapien
cgcgccatgcgctctcaccgctggc

SEQ ID NO: 87996 - DNA, 25 bp, Homo sapien
tagtggtcaagagagcgctgcgagc

SEQ ID NO: 87997 - DNA, 25 bp, Homo sapien
ctgtgcccgagtgcgagtgcgtccc

SEQ ID NO: 87998 - DNA, 25 bp, Homo sapien
acctctgtgcccgagtgcgagtgcg

SEQ ID NO: 87999 - DNA, 25 bp, Homo sapien
gatgcacctctgtgcccgagtgcga

SEQ ID NO: 88000 - DNA, 25 bp, Homo sapien
aggctgggatgcacctctgtgcccg

SEQ ID NO: 88001 - DNA, 25 bp, Homo sapien
ctttttatgcatggttgagactgga

SEQ ID NO: 88002 - DNA, 25 bp, Homo sapien
ggggaccttacattcacactttgga

SEQ ID NO: 88003 - DNA, 25 bp, Homo sapien
ggaccttacattcacactttggatg

SEQ ID NO: 88004 - DNA, 25 bp, Homo sapien
ctcagcagacgcgtcgggaagctgt

SEQ ID NO: 88005 - DNA, 25 bp, Homo sapien
ccctttttatgcatggttgagactg

SEQ ID NO: 88006 - DNA, 25 bp, Homo sapien
ctccagatcgatccggagtcccgaa

SEQ ID NO: 88007 - DNA, 25 bp, Homo sapien
gggagcccactggtgacgcctacgc

SEQ ID NO: 88008 - DNA, 25 bp, Homo sapien
tcgggaagctgtgcgagaagcggga

SEQ ID NO: 88009 - DNA, 25 bp, Homo sapien
tagggaccgcgctacatccttaccg

SEQ ID NO: 88010 - DNA, 25 bp, Homo sapien
aggcgcttcgtgaacccagtgcagt

SEQ ID NO: 88011 - DNA, 25 bp, Homo sapien
ataccgagataaccgcctgcgagga

SEQ ID NO: 88012 - DNA, 25 bp, Homo sapien
cgccgctctcagagataccgagata

SEQ ID NO: 88013 - DNA, 25 bp, Homo sapien
cccgccaactgtgggatgttctctt

SEQ ID NO: 88014 - DNA, 25 bp, Homo sapien
gtctgactgtcttgcgtaactcccg

SEQ ID NO: 88015 - DNA, 25 bp, Homo sapien
actcacgagtgacgtccgggtctga

SEQ ID NO: 88016 - DNA, 25 bp, Homo sapien
ttagacccacgtagggaccgcgcta

SEQ ID NO: 88017 - DNA, 25 bp, Homo sapien
cactctgcgtgtctgccggaacctg

SEQ ID NO: 88018 - DNA, 25 bp, Homo sapien
gctgggaagcgctacttgctgccct

SEQ ID NO: 88019 - DNA, 25 bp, Homo sapien
aagcacagcaccctccgtaagggca

SEQ ID NO: 88020 - DNA, 25 bp, Homo sapien
ggcagaagcacagcaccctccgtaa

SEQ ID NO: 88021 - DNA, 25 bp, Homo sapien
agtcgccaggccacactgcacgctt

SEQ ID NO: 88022 - DNA, 25 bp, Homo sapien
gacccggcactctgtcagttccgtc

SEQ ID NO: 88023 - DNA, 25 bp, Homo sapien
tgcacgcttccacatcctcagaggg

SEQ ID NO: 88024 - DNA, 25 bp, Homo sapien
cgttgggcagaagcacagcaccctc

SEQ ID NO: 88025 - DNA, 25 bp, Homo sapien
ccgctgcgaaggaccaatgagagcc

SEQ ID NO: 88026 - DNA, 25 bp, Homo sapien
cgtggttttcgggtagcaccttctg

SEQ ID NO: 88027 - DNA, 25 bp, Homo sapien
tcccggctgagcctataaagcggca

SEQ ID NO: 88028 - DNA, 25 bp, Homo sapien
cagacgttcgcacacctgggtgcca

SEQ ID NO: 88029 - DNA, 25 bp, Homo sapien
caagccttcgagagcggcgcacact

SEQ ID NO: 88030 - DNA, 25 bp, Homo sapien
aacacccgctcgttttggcggcagc

SEQ ID NO: 88031 - DNA, 25 bp, Homo sapien
tcgtgtcccagagaccgagttgccc

SEQ ID NO: 88032 - DNA, 25 bp, Homo sapien
cgctcttgatactcggctcaggtga

SEQ ID NO: 88033 - DNA, 25 bp, Homo sapien
tcctccgggccacaggtggagcgcc

SEQ ID NO: 88034 - DNA, 25 bp, Homo sapien
ggatgccactggttccaccctgcat

SEQ ID NO: 88035 - DNA, 25 bp, Homo sapien
tactcctctggcagcatcccacggc

SEQ ID NO: 88036 - DNA, 25 bp, Homo sapien
agtggctactcctctggcagcatcc

SEQ ID NO: 88037 - DNA, 25 bp, Homo sapien
gtaagtggctactcctctggcagca

SEQ ID NO: 88038 - DNA, 25 bp, Homo sapien
gtgtaagtggctactcctctggcag

SEQ ID NO: 88039 - DNA, 25 bp, Homo sapien
ccctcgatcattggcgccctctcgt

SEQ ID NO: 88040 - DNA, 25 bp, Homo sapien
ttcttcgagccctcgatcattggcg

SEQ ID NO: 88041 - DNA, 25 bp, Homo sapien
ctgagagggtgcctggaaactaatc

SEQ ID NO: 88042 - DNA, 25 bp, Homo sapien
cagactttcctcctggtttccagtg

SEQ ID NO: 88043 - DNA, 25 bp, Homo sapien
ctgtgcgcacaagtcagcagctggc

SEQ ID NO: 88044 - DNA, 25 bp, Homo sapien
tcttgtccagatgccagctcggttc

SEQ ID NO: 88045 - DNA, 25 bp, Homo sapien
aacgaaactacttcccaggctggca

SEQ ID NO: 88046 - DNA, 25 bp, Homo sapien
caggctggcaccctggctacaaggc

SEQ ID NO: 88047 - DNA, 25 bp, Homo sapien
gccttctcacgcgtctagggactgc

SEQ ID NO: 88048 - DNA, 25 bp, Homo sapien
caggtgcccaattgccagatcttta

SEQ ID NO: 88049 - DNA, 25 bp, Homo sapien
tggtcaggctcgcaatcgtcactgg

SEQ ID NO: 88050 - DNA, 25 bp, Homo sapien
tcttagctgcgtgttcgaacccaga

SEQ ID NO: 88051 - DNA, 25 bp, Homo sapien
caaggcttctctttcttcaccaggg

SEQ ID NO: 88052 - DNA, 25 bp, Homo sapien
tcggagcgcactctgccaaagtacg

SEQ ID NO: 88053 - DNA, 25 bp, Homo sapien
tgcgcggccactggcattttcagtt

SEQ ID NO: 88054 - DNA, 25 bp, Homo sapien
cagacttcttgttgccgttgggccc

SEQ ID NO: 88055 - DNA, 25 bp, Homo sapien
gttcgcatctgggaaggcttcagca

SEQ ID NO: 88056 - DNA, 25 bp, Homo sapien
cggcgtcccttcctagttatgctta

SEQ ID NO: 88057 - DNA, 25 bp, Homo sapien
cgttgacgttagtcgcagtcttcgc

SEQ ID NO: 88058 - DNA, 25 bp, Homo sapien
cccagcggccactagcgacaatatg

SEQ ID NO: 88059 - DNA, 25 bp, Homo sapien
gacgcagtctccgtcgttgacgtta

SEQ ID NO: 88060 - DNA, 25 bp, Homo sapien
cagtcttcgctgctaacggtaataa

SEQ ID NO: 88061 - DNA, 25 bp, Homo sapien
aatctcagggcgtagttcggcgcga

SEQ ID NO: 88062 - DNA, 25 bp, Homo sapien
actgggcgcatcgttacctgtgacg

SEQ ID NO: 88063 - DNA, 25 bp, Homo sapien
gagaagctgcgcctctctagcacac

SEQ ID NO: 88064 - DNA, 25 bp, Homo sapien
tatggctcctaagcacgtgacccgg

SEQ ID NO: 88065 - DNA, 25 bp, Homo sapien
gtccgccgcaagctcacacttagga

SEQ ID NO: 88066 - DNA, 25 bp, Homo sapien
ggtttccctcatagcatcgccgctg

SEQ ID NO: 88067 - DNA, 25 bp, Homo sapien
tgcaaaatgcgatacggtttccctc

SEQ ID NO: 88068 - DNA, 25 bp, Homo sapien
gaggcgattgtgatgcccacgcgaa

SEQ ID NO: 88069 - DNA, 25 bp, Homo sapien
acacgccttggttctcgtcaggagg

SEQ ID NO: 88070 - DNA, 25 bp, Homo sapien
cgagtcgtcacgagccatgattggc

SEQ ID NO: 88071 - DNA, 25 bp, Homo sapien
ccgcatgctgtcgtcgtcaaggcaa

SEQ ID NO: 88072 - DNA, 25 bp, Homo sapien
tcagaatgcgttcacggcaggcacc

SEQ ID NO: 88073 - DNA, 25 bp, Homo sapien
tgcgtgtcagctgcaccatcatctt

SEQ ID NO: 88074 - DNA, 25 bp, Homo sapien
cccaaggatgtgaaggagaggttca

SEQ ID NO: 88075 - DNA, 25 bp, Homo sapien
tcactcttcctgcatgtgcgcaagg

SEQ ID NO: 88076 - DNA, 25 bp, Homo sapien
tgctgaacacgctctcgctggcctt

SEQ ID NO: 88077 - DNA, 25 bp, Homo sapien
catcttccagctggccatgtggacc

SEQ ID NO: 88078 - DNA, 25 bp, Homo sapien
gcaggttcagtgtgggcatcttcca

SEQ ID NO: 88079 - DNA, 25 bp, Homo sapien
gtgggcatcttccacctcatgcaga

SEQ ID NO: 88080 - DNA, 25 bp, Homo sapien
catgtgctcatgttcgccaagctgg

SEQ ID NO: 88081 - DNA, 25 bp, Homo sapien
tcacctagaggaaagactggtcttc

SEQ ID NO: 88082 - DNA, 25 bp, Homo sapien
cccggattctgtttccgtgcacaga

SEQ ID NO: 88083 - DNA, 25 bp, Homo sapien
gaggccgccactttcgcatctgcgt

SEQ ID NO: 88084 - DNA, 25 bp, Homo sapien
taagcttccatcagcgcgccttcgg

SEQ ID NO: 88085 - DNA, 25 bp, Homo sapien
ggagccggcaagaacaatgtctctg

SEQ ID NO: 88086 - DNA, 25 bp, Homo sapien
cggagcgcgaatggaatgtcccttt

SEQ ID NO: 88087 - DNA, 25 bp, Homo sapien
agccgcgagttcgtctgcctcacaa

SEQ ID NO: 88088 - DNA, 25 bp, Homo sapien
ctctccgctccgaaggaacaaggta

SEQ ID NO: 88089 - DNA, 25 bp, Homo sapien
ttcgagccgccacgtaatgccacgt

SEQ ID NO: 88090 - DNA, 25 bp, Homo sapien
cgcttggcgacgattaaacaccctg

SEQ ID NO: 88091 - DNA, 25 bp, Homo sapien
ggcttcggcggaacctagctaagag

SEQ ID NO: 88092 - DNA, 25 bp, Homo sapien
taaacctggtggctgaacggcaaga

SEQ ID NO: 88093 - DNA, 25 bp, Homo sapien
caagatgaatttcctccgcggggta

SEQ ID NO: 88094 - DNA, 25 bp, Homo sapien
cgcagctctgtaggccctgaagctc

SEQ ID NO: 88095 - DNA, 25 bp, Homo sapien
tttctctttcgctcgtctgcactgg

SEQ ID NO: 88096 - DNA, 25 bp, Homo sapien
cctgcaagtcgaaacgcgtagtcta

SEQ ID NO: 88097 - DNA, 25 bp, Homo sapien
cctccttggtagctatgcagcccgg

SEQ ID NO: 88098 - DNA, 25 bp, Homo sapien
gcaacttggagacctgcagccgctg

SEQ ID NO: 88099 - DNA, 25 bp, Homo sapien
ctgacccggaatggctcaaggactg

SEQ ID NO: 88100 - DNA, 25 bp, Homo sapien
aacttgaaagccgaacctgccgcgc

SEQ ID NO: 88101 - DNA, 25 bp, Homo sapien
ggcggcagccaaaaccagttctcca

SEQ ID NO: 88102 - DNA, 25 bp, Homo sapien
tttaaagcactctgagcagcgcgcg

SEQ ID NO: 88103 - DNA, 25 bp, Homo sapien
gcgcgcaccaagtccaagtcgtagt

SEQ ID NO: 88104 - DNA, 25 bp, Homo sapien
accgagtccaggctcacgttgaagc

SEQ ID NO: 88105 - DNA, 25 bp, Homo sapien
gcggttcctaaagcgagctatgcta

SEQ ID NO: 88106 - DNA, 25 bp, Homo sapien
tatgctacggaagcctcagagtgtc

SEQ ID NO: 88107 - DNA, 25 bp, Homo sapien
ttttggctgcagacagacttcgcgg

SEQ ID NO: 88108 - DNA, 25 bp, Homo sapien
gacttcgcggcgagcagttttaaaa

SEQ ID NO: 88109 - DNA, 25 bp, Homo sapien
cagcttggactcgtgtttccgggta

SEQ ID NO: 88110 - DNA, 25 bp, Homo sapien
tgaccggaaatagcgcatgggactc

SEQ ID NO: 88111 - DNA, 25 bp, Homo sapien
cggcgggtctcgcttgattagattc

SEQ ID NO: 88112 - DNA, 25 bp, Homo sapien
gcaggcgacaccttagcggttccta

SEQ ID NO: 88113 - DNA, 25 bp, Homo sapien
gggaagcaacctccaatttctctga

SEQ ID NO: 88114 - DNA, 25 bp, Homo sapien
gggaaaccgccagtcagatcaccga

SEQ ID NO: 88115 - DNA, 25 bp, Homo sapien
ctgtggaaactcacgcgcggcaagc

SEQ ID NO: 88116 - DNA, 25 bp, Homo sapien
ccgctcaagccagggccctgtggaa

SEQ ID NO: 88117 - DNA, 25 bp, Homo sapien
aagtaggttactcctgcgacgcgca

SEQ ID NO: 88118 - DNA, 25 bp, Homo sapien
tgcctctaaagtctccgcgtcggcg

SEQ ID NO: 88119 - DNA, 25 bp, Homo sapien
gagttccgcctcctttctgacctag

SEQ ID NO: 88120 - DNA, 25 bp, Homo sapien
ttgaaggccatgtcgcgaaagcagg

SEQ ID NO: 88121 - DNA, 25 bp, Homo sapien
gccttgctgaatagcctattatgaa

SEQ ID NO: 88122 - DNA, 25 bp, Homo sapien
gctgaatagcctattatgaacagta

SEQ ID NO: 88123 - DNA, 25 bp, Homo sapien
gtacacacatagagaacatctgctg

SEQ ID NO: 88124 - DNA, 25 bp, Homo sapien
catagagaacatctgctgtgatatt

SEQ ID NO: 88125 - DNA, 25 bp, Homo sapien
ctgctgtgatattaaaagttatacc

SEQ ID NO: 88126 - DNA, 25 bp, Homo sapien
tgatattaaaagttatacctccctg

SEQ ID NO: 88127 - DNA, 25 bp, Homo sapien
cctccctgggatattgtgaataata

SEQ ID NO: 88128 - DNA, 25 bp, Homo sapien
tacctccctgggatattgtgaataa

SEQ ID NO: 88129 - DNA, 25 bp, Homo sapien
gctcgcaagttagcggggacaccgt

SEQ ID NO: 88130 - DNA, 25 bp, Homo sapien
cccgccagggatccaactgcaagga

SEQ ID NO: 88131 - DNA, 25 bp, Homo sapien
ttccgcagataggtctgagggcctc

SEQ ID NO: 88132 - DNA, 25 bp, Homo sapien
ccttctcgatactctggtctacagc

SEQ ID NO: 88133 - DNA, 25 bp, Homo sapien
ccgaaattgccgaacctggttcaca

SEQ ID NO: 88134 - DNA, 25 bp, Homo sapien
gtctacagccttctggaagacccgg

SEQ ID NO: 88135 - DNA, 25 bp, Homo sapien
cccgccgtgtagaagcagcatcggc

SEQ ID NO: 88136 - DNA, 25 bp, Homo sapien
ccctgctctagaggcgctcgcaagt

SEQ ID NO: 88137 - DNA, 25 bp, Homo sapien
tgatgagcaaaaaacgcctgatcca

SEQ ID NO: 88138 - DNA, 25 bp, Homo sapien
tgcaggtccaggtaaacactcagcg

SEQ ID NO: 88139 - DNA, 25 bp, Homo sapien
cgttttttgaaacgatgatgagcaa

SEQ ID NO: 88140 - DNA, 25 bp, Homo sapien
cctgatccagtctatggcgcgtttc

SEQ ID NO: 88141 - DNA, 25 bp, Homo sapien
gccttcccagcagagtaaaacgtga

SEQ ID NO: 88142 - DNA, 25 bp, Homo sapien
caaataccggcagcggtggttgtgc

SEQ ID NO: 88143 - DNA, 25 bp, Homo sapien
tggccgcgaagctagggccaccatg

SEQ ID NO: 88144 - DNA, 25 bp, Homo sapien
ctagggccaccatggcggaccgcag

SEQ ID NO: 88145 - DNA, 25 bp, Homo sapien
gcctctagctgaccgcgttgctgct

SEQ ID NO: 88146 - DNA, 25 bp, Homo sapien
agttccaggaagctctcggcctcta

SEQ ID NO: 88147 - DNA, 25 bp, Homo sapien
cagttgtgcgcacttgggttcttca

SEQ ID NO: 88148 - DNA, 25 bp, Homo sapien
gagtgcccggcgcagaaaccgtaaa

SEQ ID NO: 88149 - DNA, 25 bp, Homo sapien
gtgactccagggcacatctgccaga

SEQ ID NO: 88150 - DNA, 25 bp, Homo sapien
atctgccagagctttgaggttcatc

SEQ ID NO: 88151 - DNA, 25 bp, Homo sapien
tacgcgcaggcaggtttcttgtctg

SEQ ID NO: 88152 - DNA, 25 bp, Homo sapien
ttcttgtctggtcctccaagggccg

SEQ ID NO: 88153 - DNA, 25 bp, Homo sapien
gcttgtacctgcaaccaacacctaa

SEQ ID NO: 88154 - DNA, 25 bp, Homo sapien
agtcgctccgggtcctcagaagaac

SEQ ID NO: 88155 - DNA, 25 bp, Homo sapien
ggagtcaaatcctggagccctgccc

SEQ ID NO: 88156 - DNA, 25 bp, Homo sapien
taatcctaagacaccggccacatct

SEQ ID NO: 88157 - DNA, 25 bp, Homo sapien
acctacgtcgacctggcggctggga

SEQ ID NO: 88158 - DNA, 25 bp, Homo sapien
tggggcatccgagcgtcgaagtccc

SEQ ID NO: 88159 - DNA, 25 bp, Homo sapien
gtacccagcccggagtcaaatcctg

SEQ ID NO: 88160 - DNA, 25 bp, Homo sapien
ttccagaaatgaacacgagtcgctc

SEQ ID NO: 88161 - DNA, 25 bp, Homo sapien
ttctcaggttctggccgagtggact

SEQ ID NO: 88162 - DNA, 25 bp, Homo sapien
taccttcgctttaatggtcttcaca

SEQ ID NO: 88163 - DNA, 25 bp, Homo sapien
tggtcttcacagcacgtcgtgttta

SEQ ID NO: 88164 - DNA, 25 bp, Homo sapien
cgtgtttatgagtcagaggacccta

SEQ ID NO: 88165 - DNA, 25 bp, Homo sapien
gaggaccctagagcgacacttgttg

SEQ ID NO: 88166 - DNA, 25 bp, Homo sapien
aggacaccacagcacgacaggcagc

SEQ ID NO: 88167 - DNA, 25 bp, Homo sapien
ccagcgcggtggaaaccggttctca

SEQ ID NO: 88168 - DNA, 25 bp, Homo sapien
gacgctgtgttcttctttaccttcg

SEQ ID NO: 88169 - DNA, 25 bp, Homo sapien
gctctcgggactctcggcctgttgg

SEQ ID NO: 88170 - DNA, 25 bp, Homo sapien
tgtctactcaccgtgcctgcagccc

SEQ ID NO: 88171 - DNA, 25 bp, Homo sapien
tagagcttggcatcgggtctgggca

SEQ ID NO: 88172 - DNA, 25 bp, Homo sapien
caccacctcaggacacccgcgggga

SEQ ID NO: 88173 - DNA, 25 bp, Homo sapien
agcaggcacagggtacgcacctggc

SEQ ID NO: 88174 - DNA, 25 bp, Homo sapien
tccagcaccacagagcgggccgtgc

SEQ ID NO: 88175 - DNA, 25 bp, Homo sapien
cggggtcactcgcacggacacgtag

SEQ ID NO: 88176 - DNA, 25 bp, Homo sapien
gtcactcgcacggacacgtaggcca

SEQ ID NO: 88177 - DNA, 25 bp, Homo sapien
gcttcctgtgggattacctggtggc

SEQ ID NO: 88178 - DNA, 25 bp, Homo sapien
agctcccgggccaatccgggaggct

SEQ ID NO: 88179 - DNA, 25 bp, Homo sapien
ccgcccattgttgagcgcgttgggc

SEQ ID NO: 88180 - DNA, 25 bp, Homo sapien
ctgctttctggagcgcgtctatttc

SEQ ID NO: 88181 - DNA, 25 bp, Homo sapien
tgaaatgcaaatccggtcctgagct

SEQ ID NO: 88182 - DNA, 25 bp, Homo sapien
tgccattgaaatgcaaatccggtcc

SEQ ID NO: 88183 - DNA, 25 bp, Homo sapien
tagggagccttctttgccattgaaa

SEQ ID NO: 88184 - DNA, 25 bp, Homo sapien
gcgcgtctatttcgggctctgcggc

SEQ ID NO: 88185 - DNA, 25 bp, Homo sapien
gggccacctcctttcgacgtcgaga

SEQ ID NO: 88186 - DNA, 25 bp, Homo sapien
tgaagcagttccagcagagcgccct

SEQ ID NO: 88187 - DNA, 25 bp, Homo sapien
ctcccgagcagaagaagcgctccta

SEQ ID NO: 88188 - DNA, 25 bp, Homo sapien
gccgtctcttcgagcgcgatggcaa

SEQ ID NO: 88189 - DNA, 25 bp, Homo sapien
cgcgcctaccggaacagcatcaagg

SEQ ID NO: 88190 - DNA, 25 bp, Homo sapien
ggcaacggggagcagcacttcaaaa

SEQ ID NO: 88191 - DNA, 25 bp, Homo sapien
agcacacattcgtttctctgagtca

SEQ ID NO: 88192 - DNA, 25 bp, Homo sapien
cccgcagagaaatgggatgcgtttc

SEQ ID NO: 88193 - DNA, 25 bp, Homo sapien
tcttaatgatgagcgtctgccgggc

SEQ ID NO: 88194 - DNA, 25 bp, Homo sapien
ccagggctgagaaaacgcgcgaccc

SEQ ID NO: 88195 - DNA, 25 bp, Homo sapien
ctctggaaggatcgagctccgctac

SEQ ID NO: 88196 - DNA, 25 bp, Homo sapien
ggcggctcctctcagaagaaaggca

SEQ ID NO: 88197 - DNA, 25 bp, Homo sapien
tagcgccaaggggaaacattcgttg

SEQ ID NO: 88198 - DNA, 25 bp, Homo sapien
ccagggtgttcgcattagcgccaag

SEQ ID NO: 88199 - DNA, 25 bp, Homo sapien
tgctgcgcctaaaagcaatcccagg

SEQ ID NO: 88200 - DNA, 25 bp, Homo sapien
tcgcaacatttctggccctgagctc

SEQ ID NO: 88201 - DNA, 25 bp, Homo sapien
tcccggcagtacagccaggttgttc

SEQ ID NO: 88202 - DNA, 25 bp, Homo sapien
cgggagtccattgcaagctgcgtcg

SEQ ID NO: 88203 - DNA, 25 bp, Homo sapien
cgaccgagttgacgaagcccttgaa

SEQ ID NO: 88204 - DNA, 25 bp, Homo sapien
tctcggagaaagctcttgaagtggc

SEQ ID NO: 88205 - DNA, 25 bp, Homo sapien
ccaggttgttctggaggcattccca

SEQ ID NO: 88206 - DNA, 25 bp, Homo sapien
tctcctcttgagcaccacgtacttg

SEQ ID NO: 88207 - DNA, 25 bp, Homo sapien
cctcacagcgaaagttcccgggata

SEQ ID NO: 88208 - DNA, 25 bp, Homo sapien
aagtccagtagtgcctcctggctca

SEQ ID NO: 88209 - DNA, 25 bp, Homo sapien
aagacttgcggaagggcaattcttc

SEQ ID NO: 88210 - DNA, 25 bp, Homo sapien
ccgagcactagcagcagccggagtc

SEQ ID NO: 88211 - DNA, 25 bp, Homo sapien
ccaggggctcagttacgtgatgcaa

SEQ ID NO: 88212 - DNA, 25 bp, Homo sapien
cgcccaggcttttactcagattcca

SEQ ID NO: 88213 - DNA, 25 bp, Homo sapien
acaggctgtcggcatctcatggcag

SEQ ID NO: 88214 - DNA, 25 bp, Homo sapien
tcctggggaagcgaatggtcccttc

SEQ ID NO: 88215 - DNA, 25 bp, Homo sapien
cgggtggccatgttgctctaataaa

SEQ ID NO: 88216 - DNA, 25 bp, Homo sapien
ggggctaactttccgccacgtgctg

SEQ ID NO: 88217 - DNA, 25 bp, Homo sapien
ccggcagagctgtaggcctcacagt

SEQ ID NO: 88218 - DNA, 25 bp, Homo sapien
cacctcattctcataggcgcgcgga

SEQ ID NO: 88219 - DNA, 25 bp, Homo sapien
ctgggtcggtcagcgaattagttcc

SEQ ID NO: 88220 - DNA, 25 bp, Homo sapien
gcccactccttgtaaactacgcgga

SEQ ID NO: 88221 - DNA, 25 bp, Homo sapien
tcccggtccaacgaaagtacagaga

SEQ ID NO: 88222 - DNA, 25 bp, Homo sapien
ggaggacgttttctcgtggctaaga

SEQ ID NO: 88223 - DNA, 25 bp, Homo sapien
aggtccgtggactcattttccttga

SEQ ID NO: 88224 - DNA, 25 bp, Homo sapien
gcttgcagaccgcacggtgacgtca

SEQ ID NO: 88225 - DNA, 25 bp, Homo sapien
ccgttgctgacagaagcctgggaca

SEQ ID NO: 88226 - DNA, 25 bp, Homo sapien
ttgctgacagaagcctgggacacgg

SEQ ID NO: 88227 - DNA, 25 bp, Homo sapien
tggcttcggcctccaagcagttgag

SEQ ID NO: 88228 - DNA, 25 bp, Homo sapien
cttcggcctccaagcagttgagggg

SEQ ID NO: 88229 - DNA, 25 bp, Homo sapien
gtcgccacggtcttagcttcggtgt

SEQ ID NO: 88230 - DNA, 25 bp, Homo sapien
acggtcttagcttcggtgtccatgc

SEQ ID NO: 88231 - DNA, 25 bp, Homo sapien
cttagcttcggtgtccatgccaggt

SEQ ID NO: 88232 - DNA, 25 bp, Homo sapien
aggttcctccatgccatccggggcc

SEQ ID NO: 88233 - DNA, 25 bp, Homo sapien
cgcctctcgggtaagtccggaatcg

SEQ ID NO: 88234 - DNA, 25 bp, Homo sapien
acctgcgagacaggtttggaagccc

SEQ ID NO: 88235 - DNA, 25 bp, Homo sapien
ttggtaccatgcgagtgcctcggtg

SEQ ID NO: 88236 - DNA, 25 bp, Homo sapien
gcccgcgatggacagatagatgctc

SEQ ID NO: 88237 - DNA, 25 bp, Homo sapien
ctaggttaagggcagtctccgcctc

SEQ ID NO: 88238 - DNA, 25 bp, Homo sapien
cccgctcgtgttgtcacggggactt

SEQ ID NO: 88239 - DNA, 25 bp, Homo sapien
cgtggtgcttctcgaattgacagcc

SEQ ID NO: 88240 - DNA, 25 bp, Homo sapien
gcttctttgttcagtcgcgagactc

SEQ ID NO: 88241 - DNA, 25 bp, Homo sapien
cgccgggcttcgaggacagtgaccc

SEQ ID NO: 88242 - DNA, 25 bp, Homo sapien
gccacaaagcgggagggacacgcca

SEQ ID NO: 88243 - DNA, 25 bp, Homo sapien
ttcgcccgcctctgaagagacgcgg

SEQ ID NO: 88244 - DNA, 25 bp, Homo sapien
caacactctcggtcctactcggagg

SEQ ID NO: 88245 - DNA, 25 bp, Homo sapien
ctcggtcctactcggaggcaaaaga

SEQ ID NO: 88246 - DNA, 25 bp, Homo sapien
ggcaaaagaacactctacctcattc

SEQ ID NO: 88247 - DNA, 25 bp, Homo sapien
cgcagacgcagacgcaaacacaaac

SEQ ID NO: 88248 - DNA, 25 bp, Homo sapien
tcacctgcattcagcgcgccggggt

SEQ ID NO: 88249 - DNA, 25 bp, Homo sapien
tctttgcggattctagaacggaacc

SEQ ID NO: 88250 - DNA, 25 bp, Homo sapien
aacgcaatccggagtgcccaacatg

SEQ ID NO: 88251 - DNA, 25 bp, Homo sapien
tcccgaaggtggttaaccagccata

SEQ ID NO: 88252 - DNA, 25 bp, Homo sapien
ttaaccagccataccggaaccacga

SEQ ID NO: 88253 - DNA, 25 bp, Homo sapien
aacacacagggtcctgggcaacacg

SEQ ID NO: 88254 - DNA, 25 bp, Homo sapien
tgggcaacacggaggactaacagta

SEQ ID NO: 88255 - DNA, 25 bp, Homo sapien
taggaacaatttcgtgaacgcaatc

SEQ ID NO: 88256 - DNA, 25 bp, Homo sapien
caacaggatcgtattttcccgaagg

SEQ ID NO: 88257 - DNA, 25 bp, Homo sapien
aggagccgcacgtcttcctgcagac

SEQ ID NO: 88258 - DNA, 25 bp, Homo sapien
gtgcgccaggtccagggaaagaccc

SEQ ID NO: 88259 - DNA, 25 bp, Homo sapien
cggaagctctgcgtcttgctgaagc

SEQ ID NO: 88260 - DNA, 25 bp, Homo sapien
taccggactccggagttgcctgtgt

SEQ ID NO: 88261 - DNA, 25 bp, Homo sapien
ccgcgtcgtcgccatcaaagatctt

SEQ ID NO: 88262 - DNA, 25 bp, Homo sapien
ggaactggcttcttctcaccgcgtc

SEQ ID NO: 88263 - DNA, 25 bp, Homo sapien
acaccgtgacgaggcggaactggct

SEQ ID NO: 88264 - DNA, 25 bp, Homo sapien
gcggcctccacgatgcggaagctct

SEQ ID NO: 88265 - DNA, 25 bp, Homo sapien
gcagtattgcctcatcattccgaag

SEQ ID NO: 88266 - DNA, 25 bp, Homo sapien
tcctctgaagcttccgaacagtctg

SEQ ID NO: 88267 - DNA, 25 bp, Homo sapien
ctgcacagtttccagcgagcggacc

SEQ ID NO: 88268 - DNA, 25 bp, Homo sapien
gccaggatttccactgtcggggacc

SEQ ID NO: 88269 - DNA, 25 bp, Homo sapien
ggaagatcccatcggccagtgacca

SEQ ID NO: 88270 - DNA, 25 bp, Homo sapien
gaccagcaactttccggcgagattt

SEQ ID NO: 88271 - DNA, 25 bp, Homo sapien
gcctgagcagcgagtgaattgaacc

SEQ ID NO: 88272 - DNA, 25 bp, Homo sapien
ggccctagcgttggcggaatttgca

SEQ ID NO: 88273 - DNA, 25 bp, Homo sapien
cattcattattcatccagctgcggg

SEQ ID NO: 88274 - DNA, 25 bp, Homo sapien
ctgcgggaagaagagttcacctgcc

SEQ ID NO: 88275 - DNA, 25 bp, Homo sapien
ctcccgggagtcgagctctggcgca

SEQ ID NO: 88276 - DNA, 25 bp, Homo sapien
ggaggacaaagctctgcctcgggtc

SEQ ID NO: 88277 - DNA, 25 bp, Homo sapien
ccggctccattcattattcatccag

SEQ ID NO: 88278 - DNA, 25 bp, Homo sapien
gacggcttaatccacagcgcctggc

SEQ ID NO: 88279 - DNA, 25 bp, Homo sapien
gctgggaggaagacggcttaatcca

SEQ ID NO: 88280 - DNA, 25 bp, Homo sapien
agccgcaaaccagagccgcggctgg

SEQ ID NO: 88281 - DNA, 25 bp, Homo sapien
taactggtcgaatcggttggtgacc

SEQ ID NO: 88282 - DNA, 25 bp, Homo sapien
tcctctttcttgtcaaccacgccaa

SEQ ID NO: 88283 - DNA, 25 bp, Homo sapien
ggcagcgggttcttgcggtctttct

SEQ ID NO: 88284 - DNA, 25 bp, Homo sapien
ttgcggtctttctgggactccttgc

SEQ ID NO: 88285 - DNA, 25 bp, Homo sapien
ctttctgggactccttgcgcagctg

SEQ ID NO: 88286 - DNA, 25 bp, Homo sapien
ctgccttcagcacctcgaaggggtc

SEQ ID NO: 88287 - DNA, 25 bp, Homo sapien
ttgcctgccgcgttggagttggtct

SEQ ID NO: 88288 - DNA, 25 bp, Homo sapien
ctgtaagtgcccaggcatgatggtg

SEQ ID NO: 88289 - DNA, 25 bp, Homo sapien
tcgtcagaggcgacgctgcgagtgt

SEQ ID NO: 88290 - DNA, 25 bp, Homo sapien
atcgcggcaccgtccgggaaagcct

SEQ ID NO: 88291 - DNA, 25 bp, Homo sapien
tcctggaactctttgaattcagtgc

SEQ ID NO: 88292 - DNA, 25 bp, Homo sapien
ctggaactctttgaattcagtgcgg

SEQ ID NO: 88293 - DNA, 25 bp, Homo sapien
ggaactctttgaattcagtgcggtc

SEQ ID NO: 88294 - DNA, 25 bp, Homo sapien
actctttgaattcagtgcggtcctc

SEQ ID NO: 88295 - DNA, 25 bp, Homo sapien
tctttgaattcagtgcggtcctcct

SEQ ID NO: 88296 - DNA, 25 bp, Homo sapien
tttgaattcagtgcggtcctcctcg

SEQ ID NO: 88297 - DNA, 25 bp, Homo sapien
gcagtttgttcgcagtttactcgca

SEQ ID NO: 88298 - DNA, 25 bp, Homo sapien
tcgctcgcagtttgttcgcagttta

SEQ ID NO: 88299 - DNA, 25 bp, Homo sapien
gcagtttactcgcacaccagtttcc

SEQ ID NO: 88300 - DNA, 25 bp, Homo sapien
ccaccgcgctttgggtaagttcagc

SEQ ID NO: 88301 - DNA, 25 bp, Homo sapien
cgctttgggtaagttcagcctcccg

SEQ ID NO: 88302 - DNA, 25 bp, Homo sapien
acagccgcctgctgacgggtggctt

SEQ ID NO: 88303 - DNA, 25 bp, Homo sapien
cgcgagtgcagctcgaccctgggca

SEQ ID NO: 88304 - DNA, 25 bp, Homo sapien
gacaccttcgctcgcagtttgttcg

SEQ ID NO: 88305 - DNA, 25 bp, Homo sapien
cggcgggaccatgaagaagttctct

SEQ ID NO: 88306 - DNA, 25 bp, Homo sapien
cctcagcaggggtaaagttgttggc

SEQ ID NO: 88307 - DNA, 25 bp, Homo sapien
acctccctgcttgaagtcgggcctg

SEQ ID NO: 88308 - DNA, 25 bp, Homo sapien
tttgtggcctgagacgtctagccca

SEQ ID NO: 88309 - DNA, 25 bp, Homo sapien
gcctggaaaactggctaagaaacga

SEQ ID NO: 88310 - DNA, 25 bp, Homo sapien
agttctctcggatgcccaagtcgga

SEQ ID NO: 88311 - DNA, 25 bp, Homo sapien
ccacgtgacaagagccggaaccgtc

SEQ ID NO: 88312 - DNA, 25 bp, Homo sapien
agcgactcccggtcgagatgacgga

SEQ ID NO: 88313 - DNA, 25 bp, Homo sapien
accggccagtactggtagctgccca

SEQ ID NO: 88314 - DNA, 25 bp, Homo sapien
ctctcacgctgtgttttggcggcgc

SEQ ID NO: 88315 - DNA, 25 bp, Homo sapien
ccgggcgtctctcacgctgtgtttt

SEQ ID NO: 88316 - DNA, 25 bp, Homo sapien
cagcttctgatgcatcgttcccggc

SEQ ID NO: 88317 - DNA, 25 bp, Homo sapien
atctgctcgtaggtgtacaggcgga

SEQ ID NO: 88318 - DNA, 25 bp, Homo sapien
tagctgcccagctcgatgtaatgcg

SEQ ID NO: 88319 - DNA, 25 bp, Homo sapien
agctcgatgtaatgcgcgctcttca

SEQ ID NO: 88320 - DNA, 25 bp, Homo sapien
ccgtcggtgatgtacgggttgtcct

SEQ ID NO: 88321 - DNA, 25 bp, Homo sapien
tgctagcttacacctggacgcgcgg

SEQ ID NO: 88322 - DNA, 25 bp, Homo sapien
cgcgccgcgctgaaacattcatgtc

SEQ ID NO: 88323 - DNA, 25 bp, Homo sapien
atgtcagcgacaacctgctagctta

SEQ ID NO: 88324 - DNA, 25 bp, Homo sapien
ttcatgtctcggaggacttcccgcc

SEQ ID NO: 88325 - DNA, 25 bp, Homo sapien
acggttttgccgctctcaactacct

SEQ ID NO: 88326 - DNA, 25 bp, Homo sapien
tccgctgacaatccggccgctagct

SEQ ID NO: 88327 - DNA, 25 bp, Homo sapien
cgagagtgagaccaaaacggttttg

SEQ ID NO: 88328 - DNA, 25 bp, Homo sapien
tgccgccgctgcaaacagatgtcag

SEQ ID NO: 88329 - DNA, 25 bp, Homo sapien
tcccgattccggagagttcctgcag

SEQ ID NO: 88330 - DNA, 25 bp, Homo sapien
ccgaacgcgcttgccctttgaaaga

SEQ ID NO: 88331 - DNA, 25 bp, Homo sapien
acgcggcgacggcagaacaaactag

SEQ ID NO: 88332 - DNA, 25 bp, Homo sapien
cttgtccaggacgaagtagagatca

SEQ ID NO: 88333 - DNA, 25 bp, Homo sapien
tcctgagaggacaaagggagtctcc

SEQ ID NO: 88334 - DNA, 25 bp, Homo sapien
ttcctgcagacaatgcgggcccacg

SEQ ID NO: 88335 - DNA, 25 bp, Homo sapien
atcccagtggaagcgcgatccagtc

SEQ ID NO: 88336 - DNA, 25 bp, Homo sapien
tgccgccggaactcttgacgaatcc

SEQ ID NO: 88337 - DNA, 25 bp, Homo sapien
agggcggaacagtttctggaccaga

SEQ ID NO: 88338 - DNA, 25 bp, Homo sapien
ttccgctggaaagcggtaatgccca

SEQ ID NO: 88339 - DNA, 25 bp, Homo sapien
ttctggaccagagcacccgcgagaa

SEQ ID NO: 88340 - DNA, 25 bp, Homo sapien
gagcctgagcgttccggtacccaac

SEQ ID NO: 88341 - DNA, 25 bp, Homo sapien
ggctccagatggcttctccttgcgc

SEQ ID NO: 88342 - DNA, 25 bp, Homo sapien
acacacgcagtacttggggcgactg

SEQ ID NO: 88343 - DNA, 25 bp, Homo sapien
acttgagaacggcaggcctccgctc

SEQ ID NO: 88344 - DNA, 25 bp, Homo sapien
ctgccctgtaatcggcgggacttga

SEQ ID NO: 88345 - DNA, 25 bp, Homo sapien
tccgggcatcagttacctcgtcctg

SEQ ID NO: 88346 - DNA, 25 bp, Homo sapien
tttctaacgtggcaccgcgaccctg

SEQ ID NO: 88347 - DNA, 25 bp, Homo sapien
acagactgacttatccgcgtttcta

SEQ ID NO: 88348 - DNA, 25 bp, Homo sapien
gtcgcccggatcagcctttaacaga

SEQ ID NO: 88349 - DNA, 25 bp, Homo sapien
ctggagtttaccatcaacgtgttca

SEQ ID NO: 88350 - DNA, 25 bp, Homo sapien
acaaagctccagtgccagtggtgta

SEQ ID NO: 88351 - DNA, 25 bp, Homo sapien
tgcgcgtggggaaaacgtaaagctc

SEQ ID NO: 88352 - DNA, 25 bp, Homo sapien
atgcttctcatcctacggagtcgcc

SEQ ID NO: 88353 - DNA, 25 bp, Homo sapien
acctgcagcctgaacgcatcaggga

SEQ ID NO: 88354 - DNA, 25 bp, Homo sapien
tccacatgacgaggggccgcccaag

SEQ ID NO: 88355 - DNA, 25 bp, Homo sapien
cgcccaagccagtgtggaatcacca

SEQ ID NO: 88356 - DNA, 25 bp, Homo sapien
ggaatcaccagggtgtcggccacca

SEQ ID NO: 88357 - DNA, 25 bp, Homo sapien
agggtgtcggccaccaccaggacca

SEQ ID NO: 88358 - DNA, 25 bp, Homo sapien
acccggggaactgcatcattaggaa

SEQ ID NO: 88359 - DNA, 25 bp, Homo sapien
gcatcattaggaacagggcgtcaga

SEQ ID NO: 88360 - DNA, 25 bp, Homo sapien
agcctcgggccgtccacatgacgag

SEQ ID NO: 88361 - DNA, 25 bp, Homo sapien
tagagaatccctggagctaaccgca

SEQ ID NO: 88362 - DNA, 25 bp, Homo sapien
gcgcctggcccagcaaagagttaaa

SEQ ID NO: 88363 - DNA, 25 bp, Homo sapien
tggtaccttcctttccaatcctgaa

SEQ ID NO: 88364 - DNA, 25 bp, Homo sapien
ggaaaggccctctccaatcattttg

SEQ ID NO: 88365 - DNA, 25 bp, Homo sapien
ctctctgtcacagcttctccaagtg

SEQ ID NO: 88366 - DNA, 25 bp, Homo sapien
cccaggcaactagctgcgcaaatca

SEQ ID NO: 88367 - DNA, 25 bp, Homo sapien
ctcctgaagagagacgacgcccgtt

SEQ ID NO: 88368 - DNA, 25 bp, Homo sapien
tctccaagtgcctagtgaaacgggg

SEQ ID NO: 88369 - DNA, 25 bp, Homo sapien
ggccgccagacaatgcctgcctaga

SEQ ID NO: 88370 - DNA, 25 bp, Homo sapien
aatgcctgcctagagggacgggcca

SEQ ID NO: 88371 - DNA, 25 bp, Homo sapien
gccggctctggggtatattcccagg

SEQ ID NO: 88372 - DNA, 25 bp, Homo sapien
ttgcgtggcaaaggcgaccgcacgc

SEQ ID NO: 88373 - DNA, 25 bp, Homo sapien
tcttgcccagcggttattgtgatgg

SEQ ID NO: 88374 - DNA, 25 bp, Homo sapien
agcagcgaccggctttcagaaagcc

SEQ ID NO: 88375 - DNA, 25 bp, Homo sapien
gctgcgactccgaccgctattagcg

SEQ ID NO: 88376 - DNA, 25 bp, Homo sapien
gagctgtgaaacgttgcgtggcaaa

SEQ ID NO: 88377 - DNA, 25 bp, Homo sapien
ctatgtcatgctcttccgagggcgg

SEQ ID NO: 88378 - DNA, 25 bp, Homo sapien
tatgtcatgctcttccgagggcggc

SEQ ID NO: 88379 - DNA, 25 bp, Homo sapien
atgtcatgctcttccgagggcggca

SEQ ID NO: 88380 - DNA, 25 bp, Homo sapien
aaaggagggtgtcgcacgccagggc

SEQ ID NO: 88381 - DNA, 25 bp, Homo sapien
tgtcatgctcttccgagggcggcag

SEQ ID NO: 88382 - DNA, 25 bp, Homo sapien
tcatgctcttccgagggcggcagca

SEQ ID NO: 88383 - DNA, 25 bp, Homo sapien
cctatgtcatgctcttccgagggcg

SEQ ID NO: 88384 - DNA, 25 bp, Homo sapien
cagggcaaaggagggtgtcgcacgc

SEQ ID NO: 88385 - DNA, 25 bp, Homo sapien
tgggcacaaggcctgccaggagcag

SEQ ID NO: 88386 - DNA, 25 bp, Homo sapien
cctttgagttgagcttttctcttac

SEQ ID NO: 88387 - DNA, 25 bp, Homo sapien
gttgagcttttctcttacaaggtaa

SEQ ID NO: 88388 - DNA, 25 bp, Homo sapien
atgccttgattttagatctctccac

SEQ ID NO: 88389 - DNA, 25 bp, Homo sapien
ctgggaaagccacccctatgtcatg

SEQ ID NO: 88390 - DNA, 25 bp, Homo sapien
tgacggctgcgatctgaaggggccc

SEQ ID NO: 88391 - DNA, 25 bp, Homo sapien
cacggagcggcctaagccgggcacc

SEQ ID NO: 88392 - DNA, 25 bp, Homo sapien
cacgccagggcagaagcactgggta

SEQ ID NO: 88393 - DNA, 25 bp, Homo sapien
ccaaggaggatctggtgtgcacacc

SEQ ID NO: 88394 - DNA, 25 bp, Homo sapien
gcctccaaggaggatctggtgtgca

SEQ ID NO: 88395 - DNA, 25 bp, Homo sapien
tgtgcacaccgcagcagtaccgagc

SEQ ID NO: 88396 - DNA, 25 bp, Homo sapien
agtaccgagcctcgggcagctactt

SEQ ID NO: 88397 - DNA, 25 bp, Homo sapien
ctacttcggcctggaagagaacggc

SEQ ID NO: 88398 - DNA, 25 bp, Homo sapien
cgcgccgccaagtcccgagacgggc

SEQ ID NO: 88399 - DNA, 25 bp, Homo sapien
gcagcgccttcgtggaggtgaagaa

SEQ ID NO: 88400 - DNA, 25 bp, Homo sapien
gagctgagtcccgacggcatcgcca

SEQ ID NO: 88401 - DNA, 25 bp, Homo sapien
tgaggtcgcaccacaaaaaggagta

SEQ ID NO: 88402 - DNA, 25 bp, Homo sapien
gcaggaataaacacgcgagaacatc

SEQ ID NO: 88403 - DNA, 25 bp, Homo sapien
gaactggtgcgccaagtgcaatgcc

SEQ ID NO: 88404 - DNA, 25 bp, Homo sapien
tccgcatgacctccgacctggtgta

SEQ ID NO: 88405 - DNA, 25 bp, Homo sapien
acctggtgtaccatatgaggtcgca

SEQ ID NO: 88406 - DNA, 25 bp, Homo sapien
agtatgcgatggagcccttggtgaa

SEQ ID NO: 88407 - DNA, 25 bp, Homo sapien
ccaggcacatgacctcgcataattg

SEQ ID NO: 88408 - DNA, 25 bp, Homo sapien
cacagttaagccacctgcaggaata

SEQ ID NO: 88409 - DNA, 25 bp, Homo sapien
gtgcgccactcaagcgctggggcca

SEQ ID NO: 88410 - DNA, 25 bp, Homo sapien
ccgcgtattgcagccgcagtcgtgc

SEQ ID NO: 88411 - DNA, 25 bp, Homo sapien
tcgtgcgcgggctagttgtaagcac

SEQ ID NO: 88412 - DNA, 25 bp, Homo sapien
tgcccagggaacatgaccctgaacg

SEQ ID NO: 88413 - DNA, 25 bp, Homo sapien
acccagggccagtcacactcagaaa

SEQ ID NO: 88414 - DNA, 25 bp, Homo sapien
cacactcagaaaagggctgggaaac

SEQ ID NO: 88415 - DNA, 25 bp, Homo sapien
ctccaatttcgagggcaggatctcc

SEQ ID NO: 88416 - DNA, 25 bp, Homo sapien
tccgtcgccagtcggcctggacttt

SEQ ID NO: 88417 - DNA, 25 bp, Homo sapien
gatcactggcgttataaatatcccg

SEQ ID NO: 88418 - DNA, 25 bp, Homo sapien
ggctctggtcctagtcggggaatcc

SEQ ID NO: 88419 - DNA, 25 bp, Homo sapien
cgtggccctggtatgggcgcaccca

SEQ ID NO: 88420 - DNA, 25 bp, Homo sapien
tgcacggagcagtgagatcactggc

SEQ ID NO: 88421 - DNA, 25 bp, Homo sapien
ataaatatcccggtgccagcgcgga

SEQ ID NO: 88422 - DNA, 25 bp, Homo sapien
aggctatgtccacccggtgcggcga

SEQ ID NO: 88423 - DNA, 25 bp, Homo sapien
gagctcgtttccacgcggctctggt

SEQ ID NO: 88424 - DNA, 25 bp, Homo sapien
ccgcaccggccagtgagtacacaaa

SEQ ID NO: 88425 - DNA, 25 bp, Homo sapien
tggcgctggacagctcagctgtcag

SEQ ID NO: 88426 - DNA, 25 bp, Homo sapien
gcgaggtgaattgccgcgtccttac

SEQ ID NO: 88427 - DNA, 25 bp, Homo sapien
aaagccgctggcgaggtgaattgcc

SEQ ID NO: 88428 - DNA, 25 bp, Homo sapien
ctcgagttcccgcttcgtgggctgg

SEQ ID NO: 88429 - DNA, 25 bp, Homo sapien
ttcgggaccgcgacactaaagccgc

SEQ ID NO: 88430 - DNA, 25 bp, Homo sapien
agttcccgcttcgtgggctggtcgc

SEQ ID NO: 88431 - DNA, 25 bp, Homo sapien
accgcgacactaaagccgctggcga

SEQ ID NO: 88432 - DNA, 25 bp, Homo sapien
ctagagtcacccagcgcagaaacgc

SEQ ID NO: 88433 - DNA, 25 bp, Homo sapien
ccttcagcttgtccggccggttgaa

SEQ ID NO: 88434 - DNA, 25 bp, Homo sapien
ggccggttgaacaacttaccgcagc

SEQ ID NO: 88435 - DNA, 25 bp, Homo sapien
acgacgatggaaagctccgcgttca

SEQ ID NO: 88436 - DNA, 25 bp, Homo sapien
gaggacatgggccttcagcttgtcc

SEQ ID NO: 88437 - DNA, 25 bp, Homo sapien
ctgccctcttctcgcgggcggtggt

SEQ ID NO: 88438 - DNA, 25 bp, Homo sapien
aacttaccgcagcttgtgtgcgtcg

SEQ ID NO: 88439 - DNA, 25 bp, Homo sapien
gcaccacccacgacgatggaaagct

SEQ ID NO: 88440 - DNA, 25 bp, Homo sapien
ctccgcgttcagctctgcgaagggc

SEQ ID NO: 88441 - DNA, 25 bp, Homo sapien
aaaaggcaatcgagcgccctccgga

SEQ ID NO: 88442 - DNA, 25 bp, Homo sapien
cctggcgcccaaaacagagctagtc

SEQ ID NO: 88443 - DNA, 25 bp, Homo sapien
agatcttgaaaacacccgggccaca

SEQ ID NO: 88444 - DNA, 25 bp, Homo sapien
acagctctttctcagcgttggagtg

SEQ ID NO: 88445 - DNA, 25 bp, Homo sapien
gctgcagccgcaagacaaggtctct

SEQ ID NO: 88446 - DNA, 25 bp, Homo sapien
tctctgaacacatgctgcggctcta

SEQ ID NO: 88447 - DNA, 25 bp, Homo sapien
tctatgacaggtacagcacggtcca

SEQ ID NO: 88448 - DNA, 25 bp, Homo sapien
tggtttggagttcaaccctcggctc

SEQ ID NO: 88449 - DNA, 25 bp, Homo sapien
cagtcgctccggctacgtgtgagcc

SEQ ID NO: 88450 - DNA, 25 bp, Homo sapien
aactttccaggtgcgcagcttgtca

SEQ ID NO: 88451 - DNA, 25 bp, Homo sapien
agacagccgggtaactttccaggtg

SEQ ID NO: 88452 - DNA, 25 bp, Homo sapien
gctactgcctggatagttgggcgcc

SEQ ID NO: 88453 - DNA, 25 bp, Homo sapien
tcgcgcaacgcattcacagcatgca

SEQ ID NO: 88454 - DNA, 25 bp, Homo sapien
gtccacactcgaacagcacaagcaa

SEQ ID NO: 88455 - DNA, 25 bp, Homo sapien
cgaatgcaacgcgtacacacgtcca

SEQ ID NO: 88456 - DNA, 25 bp, Homo sapien
aacgctgccacaccgagcgaatgca

SEQ ID NO: 88457 - DNA, 25 bp, Homo sapien
ctcccacagtgggtcccggaaagcg

SEQ ID NO: 88458 - DNA, 25 bp, Homo sapien
tgagcgtcaccttccggaagctgtg

SEQ ID NO: 88459 - DNA, 25 bp, Homo sapien
tccacgtgggctcggtttgaccgca

SEQ ID NO: 88460 - DNA, 25 bp, Homo sapien
ggtacactgcttccgactgcgcctg

SEQ ID NO: 88461 - DNA, 25 bp, Homo sapien
ctcccacgcgagacgcggatgctgt

SEQ ID NO: 88462 - DNA, 25 bp, Homo sapien
tggggtcttcgcacgcgcagacttg

SEQ ID NO: 88463 - DNA, 25 bp, Homo sapien
ccgctcgcgaaccagccgtggggaa

SEQ ID NO: 88464 - DNA, 25 bp, Homo sapien
gaccgctgtcctcactgcaacgggg

SEQ ID NO: 88465 - DNA, 25 bp, Homo sapien
tatctgtaaataccggcccgactcg

SEQ ID NO: 88466 - DNA, 25 bp, Homo sapien
gagcccagcgcagcggtgtttaaca

SEQ ID NO: 88467 - DNA, 25 bp, Homo sapien
taacagcgttggtcaggctggctcc

SEQ ID NO: 88468 - DNA, 25 bp, Homo sapien
ctgtgcgcgtttcctcttgagtgca

SEQ ID NO: 88469 - DNA, 25 bp, Homo sapien
cctacctgcaggtgaactccgagtc

SEQ ID NO: 88470 - DNA, 25 bp, Homo sapien
gcgcgcccacaaatgcgaccaaagg

SEQ ID NO: 88471 - DNA, 25 bp, Homo sapien
tctgtctaaccagtcgggttccttg

SEQ ID NO: 88472 - DNA, 25 bp, Homo sapien
tatactgaaactacggcagccgccg

SEQ ID NO: 88473 - DNA, 25 bp, Homo sapien
tcggtttcgtgaaggagattccaca

SEQ ID NO: 88474 - DNA, 25 bp, Homo sapien
ggccacagccgagtcggtttcgtga

SEQ ID NO: 88475 - DNA, 25 bp, Homo sapien
gaggagaaagaagccacccgccagc

SEQ ID NO: 88476 - DNA, 25 bp, Homo sapien
gaagactccgaggtttgctccgcga

SEQ ID NO: 88477 - DNA, 25 bp, Homo sapien
cacggggaagactccgaggtttgct

SEQ ID NO: 88478 - DNA, 25 bp, Homo sapien
tggggaagaccagcaacaggatccc

SEQ ID NO: 88479 - DNA, 25 bp, Homo sapien
gattccacatctcggcgcgagcaga

SEQ ID NO: 88480 - DNA, 25 bp, Homo sapien
caacaggatcccactcggcagctga

SEQ ID NO: 88481 - DNA, 25 bp, Homo sapien
gctgctgccagatgccagtggcccg

SEQ ID NO: 88482 - DNA, 25 bp, Homo sapien
tcctctgaatgtcactattaccata

SEQ ID NO: 88483 - DNA, 25 bp, Homo sapien
actcttgcaacactgccgggcggga

SEQ ID NO: 88484 - DNA, 25 bp, Homo sapien
ggcgggagcagacgccttaagctcc

SEQ ID NO: 88485 - DNA, 25 bp, Homo sapien
cagacgccttaagctccgagggaga

SEQ ID NO: 88486 - DNA, 25 bp, Homo sapien
tcgctctgctgactgacccgggaga

SEQ ID NO: 88487 - DNA, 25 bp, Homo sapien
agagtcgctgctgccagatgccagt

SEQ ID NO: 88488 - DNA, 25 bp, Homo sapien
ccgcgctagccttttcctctgaatg

SEQ ID NO: 88489 - DNA, 25 bp, Homo sapien
tgacgatcatgtacagctgcattgc

SEQ ID NO: 88490 - DNA, 25 bp, Homo sapien
gcacgtgcgccacctaggggacaga

SEQ ID NO: 88491 - DNA, 25 bp, Homo sapien
tgtcccgtcaaacgcgccgctaggg

SEQ ID NO: 88492 - DNA, 25 bp, Homo sapien
agaggagcctttccttcactggccc

SEQ ID NO: 88493 - DNA, 25 bp, Homo sapien
ctggcccgcctgctatgacgatcat

SEQ ID NO: 88494 - DNA, 25 bp, Homo sapien
tgcattgctaatggccgagcggtcc

SEQ ID NO: 88495 - DNA, 25 bp, Homo sapien
gtcctagcggagctgacactgactg

SEQ ID NO: 88496 - DNA, 25 bp, Homo sapien
ttcttaccaggtacctccggatcca

SEQ ID NO: 88497 - DNA, 25 bp, Homo sapien
gctctctcccgctgcactaaaaaag

SEQ ID NO: 88498 - DNA, 25 bp, Homo sapien
gcgcgcactgattgccgcagctact

SEQ ID NO: 88499 - DNA, 25 bp, Homo sapien
ttacgcactggaggagggaattagc

SEQ ID NO: 88500 - DNA, 25 bp, Homo sapien
ctgcggcggcttaagcctggattta

SEQ ID NO: 88501 - DNA, 25 bp, Homo sapien
tccgaggattcctggagtccactca

SEQ ID NO: 88502 - DNA, 25 bp, Homo sapien
gaaccggaagtgtcgtgagctaaga

SEQ ID NO: 88503 - DNA, 25 bp, Homo sapien
gccgcggaccacctaaaatggccga

SEQ ID NO: 88504 - DNA, 25 bp, Homo sapien
tgaggttttcgtctatcgccgctgg

SEQ ID NO: 88505 - DNA, 25 bp, Homo sapien
tgctcccgcgttcgcttctttgttc

SEQ ID NO: 88506 - DNA, 25 bp, Homo sapien
aggcccattttgacggatccagttc

SEQ ID NO: 88507 - DNA, 25 bp, Homo sapien
ggccacagtccctcttgccttggga

SEQ ID NO: 88508 - DNA, 25 bp, Homo sapien
gcggccagtctgctccggaaaaagg

SEQ ID NO: 88509 - DNA, 25 bp, Homo sapien
cgcacgcgtgttttgtcctcgagct

SEQ ID NO: 88510 - DNA, 25 bp, Homo sapien
gggctggccagatgactgtatctat

SEQ ID NO: 88511 - DNA, 25 bp, Homo sapien
tttttctgccctcggttcgccagtg

SEQ ID NO: 88512 - DNA, 25 bp, Homo sapien
cgctcgctcaacctgtctgcggagg

SEQ ID NO: 88513 - DNA, 25 bp, Homo sapien
gagccggcaccgactcctggacttg

SEQ ID NO: 88514 - DNA, 25 bp, Homo sapien
ccgactcctggacttgccggggagc

SEQ ID NO: 88515 - DNA, 25 bp, Homo sapien
ggcaccgactcctggacttgccggg

SEQ ID NO: 88516 - DNA, 25 bp, Homo sapien
cctacctgctctggtgcggcggggc

SEQ ID NO: 88517 - DNA, 25 bp, Homo sapien
agagccggcaccgactcctggactt

SEQ ID NO: 88518 - DNA, 25 bp, Homo sapien
ggcagagccggcaccgactcctgga

SEQ ID NO: 88519 - DNA, 25 bp, Homo sapien
gccggctcgggcgttcgcaggtcgc

SEQ ID NO: 88520 - DNA, 25 bp, Homo sapien
caccgactcctggacttgccgggga

SEQ ID NO: 88521 - DNA, 25 bp, Homo sapien
tctccatcgggaagccggcaaatgc

SEQ ID NO: 88522 - DNA, 25 bp, Homo sapien
tcccaagggacggaaaactggatgc

SEQ ID NO: 88523 - DNA, 25 bp, Homo sapien
gagcaagctcatcaggacgacattc

SEQ ID NO: 88524 - DNA, 25 bp, Homo sapien
gagcccggcacggatttcttccttg

SEQ ID NO: 88525 - DNA, 25 bp, Homo sapien
ccttggcgtcgcagaaagggatctt

SEQ ID NO: 88526 - DNA, 25 bp, Homo sapien
cggcaaatgcgcttcctcaggcaga

SEQ ID NO: 88527 - DNA, 25 bp, Homo sapien
ccgtgcggcgcttatagacaaaggc

SEQ ID NO: 88528 - DNA, 25 bp, Homo sapien
agccctgcttagctacagccaatca

SEQ ID NO: 88529 - DNA, 25 bp, Homo sapien
ggcctgggctctacctcaaagctta

SEQ ID NO: 88530 - DNA, 25 bp, Homo sapien
acacttccgggagcgacatctttcc

SEQ ID NO: 88531 - DNA, 25 bp, Homo sapien
gttccgttccaacgtggcagccgca

SEQ ID NO: 88532 - DNA, 25 bp, Homo sapien
cttttgctcagcagtggagacgtcg

SEQ ID NO: 88533 - DNA, 25 bp, Homo sapien
ctcaaagcttaaggaccggcgaaga

SEQ ID NO: 88534 - DNA, 25 bp, Homo sapien
agtccagatgccaggcgttgttccg

SEQ ID NO: 88535 - DNA, 25 bp, Homo sapien
ggaacgccacgtagcactagtcctg

SEQ ID NO: 88536 - DNA, 25 bp, Homo sapien
atcctgcgttagtgcagcgctcgtc

SEQ ID NO: 88537 - DNA, 25 bp, Homo sapien
ttccaccagtgcgtatgggagcagc

SEQ ID NO: 88538 - DNA, 25 bp, Homo sapien
gatgacccgaagttgctccgcagtg

SEQ ID NO: 88539 - DNA, 25 bp, Homo sapien
gcggagctaaagtggtcgtgattca

SEQ ID NO: 88540 - DNA, 25 bp, Homo sapien
aggagcggtcaaatgcacgtcttca

SEQ ID NO: 88541 - DNA, 25 bp, Homo sapien
aaataaaggtcgtagccgcagagtc

SEQ ID NO: 88542 - DNA, 25 bp, Homo sapien
agcccgcctttcgtgacaaataaag

SEQ ID NO: 88543 - DNA, 25 bp, Homo sapien
acgtggcctgtcattggctacggca

SEQ ID NO: 88544 - DNA, 25 bp, Homo sapien
cgtgattcatgctgtcgcgggaacc

SEQ ID NO: 88545 - DNA, 25 bp, Homo sapien
ttttgcccgtgcacgatagctctgg

SEQ ID NO: 88546 - DNA, 25 bp, Homo sapien
acgccaaaggaagtcgcgccacctg

SEQ ID NO: 88547 - DNA, 25 bp, Homo sapien
tgcaagtgcacacgggctacgccga

SEQ ID NO: 88548 - DNA, 25 bp, Homo sapien
aaccttcaaacgcacaagggccgtg

SEQ ID NO: 88549 - DNA, 25 bp, Homo sapien
aggcgcacacccacatatccgggga

SEQ ID NO: 88550 - DNA, 25 bp, Homo sapien
aagatccgccattttcacctcgtca

SEQ ID NO: 88551 - DNA, 25 bp, Homo sapien
tttgtccaaactggagcgctccagg

SEQ ID NO: 88552 - DNA, 25 bp, Homo sapien
cagcagcttcctttcccagtttgtc

SEQ ID NO: 88553 - DNA, 25 bp, Homo sapien
gctttccgagtcatcggtcctcaga

SEQ ID NO: 88554 - DNA, 25 bp, Homo sapien
gagtcatcggtcctcagagcagccc

SEQ ID NO: 88555 - DNA, 25 bp, Homo sapien
aaggaagcggggctccaagccctgc

SEQ ID NO: 88556 - DNA, 25 bp, Homo sapien
ggaaccggcagtgcagcccgaagcc

SEQ ID NO: 88557 - DNA, 25 bp, Homo sapien
cccgcacctggtgcatgtggacgcg

SEQ ID NO: 88558 - DNA, 25 bp, Homo sapien
cgggcgaagcgttcttctgagcgct

SEQ ID NO: 88559 - DNA, 25 bp, Homo sapien
gtcacatggggtgcgcgcccagact

SEQ ID NO: 88560 - DNA, 25 bp, Homo sapien
cttctgagcgctttccgagtcatcg

SEQ ID NO: 88561 - DNA, 25 bp, Homo sapien
cctttgcccttggagagagtcactc

SEQ ID NO: 88562 - DNA, 25 bp, Homo sapien
ccaggccgttctcatgtttgtaaca

SEQ ID NO: 88563 - DNA, 25 bp, Homo sapien
ggctccctttgagcccgatgatatc

SEQ ID NO: 88564 - DNA, 25 bp, Homo sapien
gacacgcgtgacctgtgctcctttc

SEQ ID NO: 88565 - DNA, 25 bp, Homo sapien
gcactgggcacggtcttcatatttt

SEQ ID NO: 88566 - DNA, 25 bp, Homo sapien
agtgacgacgtttaagctcctaatc

SEQ ID NO: 88567 - DNA, 25 bp, Homo sapien
cctttcgagccgcagacgtcacagt

SEQ ID NO: 88568 - DNA, 25 bp, Homo sapien
ttagccaacagagcagccagcttcg

SEQ ID NO: 88569 - DNA, 25 bp, Homo sapien
acggaatgttccatcggactgaagc

SEQ ID NO: 88570 - DNA, 25 bp, Homo sapien
ccggtcaaagcgatcgcacggaatg

SEQ ID NO: 88571 - DNA, 25 bp, Homo sapien
ctccagttccacgtgacgccgagtg

SEQ ID NO: 88572 - DNA, 25 bp, Homo sapien
gtttgttcaaaatcacgcgcccagc

SEQ ID NO: 88573 - DNA, 25 bp, Homo sapien
gtcgcgcagtgtgcgtgtcaacagc

SEQ ID NO: 88574 - DNA, 25 bp, Homo sapien
tgacacagcagcaaaaccggttccc

SEQ ID NO: 88575 - DNA, 25 bp, Homo sapien
cgtgcacctcgggaacattatgaca

SEQ ID NO: 88576 - DNA, 25 bp, Homo sapien
ttgtttaccgttgctggccaagcta

SEQ ID NO: 88577 - DNA, 25 bp, Homo sapien
ccagttgcagggacaggtctgaagc

SEQ ID NO: 88578 - DNA, 25 bp, Homo sapien
gtctcctctgctgggaccagacctg

SEQ ID NO: 88579 - DNA, 25 bp, Homo sapien
cctgcctgccggtaaattcttaaga

SEQ ID NO: 88580 - DNA, 25 bp, Homo sapien
aattcttaagagcagcccgcgcaga

SEQ ID NO: 88581 - DNA, 25 bp, Homo sapien
ccgcgcagaatctatcccaaggaga

SEQ ID NO: 88582 - DNA, 25 bp, Homo sapien
gcaatcagggaactgcgtctgcgga

SEQ ID NO: 88583 - DNA, 25 bp, Homo sapien
agccgatcattcagggcgtgcatga

SEQ ID NO: 88584 - DNA, 25 bp, Homo sapien
ccgcccatttttgctggggcaatca

SEQ ID NO: 88585 - DNA, 25 bp, Homo sapien
tcctttaggagactgtcccgactgc

SEQ ID NO: 88586 - DNA, 25 bp, Homo sapien
gtggcacccgcaggatgcaatccta

SEQ ID NO: 88587 - DNA, 25 bp, Homo sapien
acgagctcggattgacgtcattccc

SEQ ID NO: 88588 - DNA, 25 bp, Homo sapien
tgtccaaccgcatgaggcgcaagta

SEQ ID NO: 88589 - DNA, 25 bp, Homo sapien
cgcactcaccaatgggcttgtccaa

SEQ ID NO: 88590 - DNA, 25 bp, Homo sapien
tacttgcaaattcccgggctgcccg

SEQ ID NO: 88591 - DNA, 25 bp, Homo sapien
tcaaagtgtcccgaggtgattcgcc

SEQ ID NO: 88592 - DNA, 25 bp, Homo sapien
cgactcggaggctgctacttgcaaa

SEQ ID NO: 88593 - DNA, 25 bp, Homo sapien
acgacgtcctgtgcttgcgcaggtc

SEQ ID NO: 88594 - DNA, 25 bp, Homo sapien
agcgcagcagcatcttgggctcacc

SEQ ID NO: 88595 - DNA, 25 bp, Homo sapien
gagtcgagagctctagcacttcctc

SEQ ID NO: 88596 - DNA, 25 bp, Homo sapien
ggcggtcacgttcacttacgaaatc

SEQ ID NO: 88597 - DNA, 25 bp, Homo sapien
caggcttcctgacgcacgtgttctg

SEQ ID NO: 88598 - DNA, 25 bp, Homo sapien
gctctcgtgggaacccagcgtttcc

SEQ ID NO: 88599 - DNA, 25 bp, Homo sapien
cgactcccagatcccattctgatgg

SEQ ID NO: 88600 - DNA, 25 bp, Homo sapien
tgaagaagtccaggtccacgacgtc

SEQ ID NO: 88601 - DNA, 25 bp, Homo sapien
tttgaacggggtactcgagcccaca

SEQ ID NO: 88602 - DNA, 25 bp, Homo sapien
ttcatccatggcaaggacccagggc

SEQ ID NO: 88603 - DNA, 25 bp, Homo sapien
gggccctattcagacgtcgttctca

SEQ ID NO: 88604 - DNA, 25 bp, Homo sapien
gtgacccagacgctaagcccatatg

SEQ ID NO: 88605 - DNA, 25 bp, Homo sapien
caagttagctctcagggctcgcgga

SEQ ID NO: 88606 - DNA, 25 bp, Homo sapien
gcggaccggaagcacgcataaactt

SEQ ID NO: 88607 - DNA, 25 bp, Homo sapien
gctgcgcatgcgtattgaaaaacct

SEQ ID NO: 88608 - DNA, 25 bp, Homo sapien
ggcggatgcgggaaccacattcatc

SEQ ID NO: 88609 - DNA, 25 bp, Homo sapien
ctggttttgcaaacgcctgtcgggc

SEQ ID NO: 88610 - DNA, 25 bp, Homo sapien
ctgcgaattgcttttggtggcctgc

SEQ ID NO: 88611 - DNA, 25 bp, Homo sapien
catgtcggtaccactgcagagggct

SEQ ID NO: 88612 - DNA, 25 bp, Homo sapien
cgccgcctcaggctacacaagagga

SEQ ID NO: 88613 - DNA, 25 bp, Homo sapien
gcgccgagcacaaagcccgagagca

SEQ ID NO: 88614 - DNA, 25 bp, Homo sapien
gacgctccgtgaactttccatcttt

SEQ ID NO: 88615 - DNA, 25 bp, Homo sapien
tgctctgcatgaaaaagtccgcctg

SEQ ID NO: 88616 - DNA, 25 bp, Homo sapien
acgcccaagtttccacagctacagg

SEQ ID NO: 88617 - DNA, 25 bp, Homo sapien
gggaagatcctttccacctggctga

SEQ ID NO: 88618 - DNA, 25 bp, Homo sapien
gctggttctcggcttcatcctttta

SEQ ID NO: 88619 - DNA, 25 bp, Homo sapien
tcttcccttcgcagaggtgagtgcc

SEQ ID NO: 88620 - DNA, 25 bp, Homo sapien
ggaaggaaggatattgccgtaattc

SEQ ID NO: 88621 - DNA, 25 bp, Homo sapien
tcgcaatcgccacccagaggaaatc

SEQ ID NO: 88622 - DNA, 25 bp, Homo sapien
tcatctgctgagttgtcgcaatcgc

SEQ ID NO: 88623 - DNA, 25 bp, Homo sapien
accggtgtgccaaagtgcggtgctc

SEQ ID NO: 88624 - DNA, 25 bp, Homo sapien
tgggctaagtactgccagggagctc

SEQ ID NO: 88625 - DNA, 25 bp, Homo sapien
ctctgactcagctccggatttgtgc

SEQ ID NO: 88626 - DNA, 25 bp, Homo sapien
tttcggagccagaagtctcgagctc

SEQ ID NO: 88627 - DNA, 25 bp, Homo sapien
cagcgcagatgcaaacagctttctc

SEQ ID NO: 88628 - DNA, 25 bp, Homo sapien
ggagaaagtttcctctctgagccga

SEQ ID NO: 88629 - DNA, 25 bp, Homo sapien
acgccctagctgtgtgcgtttcggg

SEQ ID NO: 88630 - DNA, 25 bp, Homo sapien
tgccattctgcaagagtacctgcta

SEQ ID NO: 88631 - DNA, 25 bp, Homo sapien
tattcaaacgccctcgcttgcgggg

SEQ ID NO: 88632 - DNA, 25 bp, Homo sapien
tacctgctatctcgaaaatcttttg

SEQ ID NO: 88633 - DNA, 25 bp, Homo sapien
gagcgtactgtgctgggctctaccc

SEQ ID NO: 88634 - DNA, 25 bp, Homo sapien
gctacgtctccgaagcttgcgctga

SEQ ID NO: 88635 - DNA, 25 bp, Homo sapien
ccgcggaaactagcacagtgtgcct

SEQ ID NO: 88636 - DNA, 25 bp, Homo sapien
gtctgcgaattgcaaggcccggcct

SEQ ID NO: 88637 - DNA, 25 bp, Homo sapien
agcgacgctctggtatccgctgtcc

SEQ ID NO: 88638 - DNA, 25 bp, Homo sapien
cccagtttcattctctgcgaagcca

SEQ ID NO: 88639 - DNA, 25 bp, Homo sapien
gcatgggaagctcaggctacgtctc

SEQ ID NO: 88640 - DNA, 25 bp, Homo sapien
agggcgttagccacatcagaggtgc

SEQ ID NO: 88641 - DNA, 25 bp, Homo sapien
atacaggtatcgtgtggcagacgtg

SEQ ID NO: 88642 - DNA, 25 bp, Homo sapien
gtcctgggatcacccacgcagcaag

SEQ ID NO: 88643 - DNA, 25 bp, Homo sapien
cgttctaattgccttagtcctggga

SEQ ID NO: 88644 - DNA, 25 bp, Homo sapien
acaggttgtgcgatggatacaggta

SEQ ID NO: 88645 - DNA, 25 bp, Homo sapien
ccgtctgggcttaaagccatcgata

SEQ ID NO: 88646 - DNA, 25 bp, Homo sapien
agcaaactacacaagccagccaatc

SEQ ID NO: 88647 - DNA, 25 bp, Homo sapien
ccagccaatcccgagcgttctaatt

SEQ ID NO: 88648 - DNA, 25 bp, Homo sapien
taggcgcagccgctttacaggttgt

SEQ ID NO: 88649 - DNA, 25 bp, Homo sapien
cccaactgtggtagatttcagttga

SEQ ID NO: 88650 - DNA, 25 bp, Homo sapien
cctgaggatagtagactgtccggag

SEQ ID NO: 88651 - DNA, 25 bp, Homo sapien
gggcagcatcaactttcatgtgaca

SEQ ID NO: 88652 - DNA, 25 bp, Homo sapien
ctagtggacaagtgaaaatagcacc

SEQ ID NO: 88653 - DNA, 25 bp, Homo sapien
ccgtgtcttaatgacttctagtgga

SEQ ID NO: 88654 - DNA, 25 bp, Homo sapien
tcttaaagactgcaaccgtgtctta

SEQ ID NO: 88655 - DNA, 25 bp, Homo sapien
ctgtccggagagctaatcttaaaga

SEQ ID NO: 88656 - DNA, 25 bp, Homo sapien
catgtgacattaatagccttactgc

SEQ ID NO: 88657 - DNA, 25 bp, Homo sapien
catgaagaccaggacgccgagcaga

SEQ ID NO: 88658 - DNA, 25 bp, Homo sapien
ttgtagttcttgacgagcaggaggc

SEQ ID NO: 88659 - DNA, 25 bp, Homo sapien
ccagcaggcactcaagcgagttgaa

SEQ ID NO: 88660 - DNA, 25 bp, Homo sapien
gctggtagtccttcagctggcggca

SEQ ID NO: 88661 - DNA, 25 bp, Homo sapien
ggcctgcgacgacttgtagttcttg

SEQ ID NO: 88662 - DNA, 25 bp, Homo sapien
ttgcgctccaccagggacacggtgt

SEQ ID NO: 88663 - DNA, 25 bp, Homo sapien
ctccgagcccaacgagaagcacttg

SEQ ID NO: 88664 - DNA, 25 bp, Homo sapien
cagtagtgcgagtacttgcgctcca

SEQ ID NO: 88665 - DNA, 25 bp, Homo sapien
gtcctcagctgggaccagcagctca

SEQ ID NO: 88666 - DNA, 25 bp, Homo sapien
ccatgctgaggctcgggactgagcc

SEQ ID NO: 88667 - DNA, 25 bp, Homo sapien
ctgaccagtacgtcctcagctggga

SEQ ID NO: 88668 - DNA, 25 bp, Homo sapien
cagcagctcaacctcgcctatgtgg

SEQ ID NO: 88669 - DNA, 25 bp, Homo sapien
tcaacctcgcctatgtgggcgccgt

SEQ ID NO: 88670 - DNA, 25 bp, Homo sapien
acagccaggctgaccagtacgtcct

SEQ ID NO: 88671 - DNA, 25 bp, Homo sapien
tcctgggcttgaacgtgtgtgtcag

SEQ ID NO: 88672 - DNA, 25 bp, Homo sapien
gcgctgccagccatgctgaggctcg

SEQ ID NO: 88673 - DNA, 25 bp, Homo sapien
cgctgctggacttgtgcttcttcaa

SEQ ID NO: 88674 - DNA, 25 bp, Homo sapien
ttctcggccgtcaaagtcagtctcc

SEQ ID NO: 88675 - DNA, 25 bp, Homo sapien
ggtgagcgtgaacccttccacagca

SEQ ID NO: 88676 - DNA, 25 bp, Homo sapien
ccagaggcttattgtagtcgtcgtc

SEQ ID NO: 88677 - DNA, 25 bp, Homo sapien
ttcaggatgagctctccggctcgga

SEQ ID NO: 88678 - DNA, 25 bp, Homo sapien
ggtggtctttcttgccttatcaacc

SEQ ID NO: 88679 - DNA, 25 bp, Homo sapien
catttacgcagtgcatttggtggtc

SEQ ID NO: 88680 - DNA, 25 bp, Homo sapien
ctgcgggtttcagtagcgacattta

SEQ ID NO: 88681 - DNA, 25 bp, Homo sapien
ggctctgcatcactccgggccagaa

SEQ ID NO: 88682 - DNA, 25 bp, Homo sapien
agctgttcaaagtgcgctacttctc

SEQ ID NO: 88683 - DNA, 25 bp, Homo sapien
gagtcctagattcgatccctggcta

SEQ ID NO: 88684 - DNA, 25 bp, Homo sapien
aggcagtcctttcgttccgcgagtc

SEQ ID NO: 88685 - DNA, 25 bp, Homo sapien
tgcgcagcagagatgtccaaaccct

SEQ ID NO: 88686 - DNA, 25 bp, Homo sapien
tgaaccaaaaatgccgctgccggga

SEQ ID NO: 88687 - DNA, 25 bp, Homo sapien
aggcgagctgccaactgaaccaaaa

SEQ ID NO: 88688 - DNA, 25 bp, Homo sapien
ggccggctcaggatatcgttgatgc

SEQ ID NO: 88689 - DNA, 25 bp, Homo sapien
gtctacagctgggagcggtgacaac

SEQ ID NO: 88690 - DNA, 25 bp, Homo sapien
gggacccgagtcctggtcccgctga

SEQ ID NO: 88691 - DNA, 25 bp, Homo sapien
tcccgcgtagagcagcgtgtattgc

SEQ ID NO: 88692 - DNA, 25 bp, Homo sapien
gtgtattgcagacgcacgctgggca

SEQ ID NO: 88693 - DNA, 25 bp, Homo sapien
tgcctcctgccaggtgctagttgta

SEQ ID NO: 88694 - DNA, 25 bp, Homo sapien
agttgtagtggatctgctgcctgtc

SEQ ID NO: 88695 - DNA, 25 bp, Homo sapien
cgctctaactgcgtggttgaaacca

SEQ ID NO: 88696 - DNA, 25 bp, Homo sapien
cggtgacaacgatggagcgtcctcg

SEQ ID NO: 88697 - DNA, 25 bp, Homo sapien
ccgagagcaccagcgacaaagtaag

SEQ ID NO: 88698 - DNA, 25 bp, Homo sapien
gctgttaacatttagcgggcgtctt

SEQ ID NO: 88699 - DNA, 25 bp, Homo sapien
cgggcgtctttgagtagctcctcca

SEQ ID NO: 88700 - DNA, 25 bp, Homo sapien
ggactagcctgcaagttctcaacgc

SEQ ID NO: 88701 - DNA, 25 bp, Homo sapien
ctaaagcgggtcaagcgtcctcctt

SEQ ID NO: 88702 - DNA, 25 bp, Homo sapien
gcgctctctcgttgatgccgttttg

SEQ ID NO: 88703 - DNA, 25 bp, Homo sapien
ggcggcgaccacgaaaccgagagca

SEQ ID NO: 88704 - DNA, 25 bp, Homo sapien
gcagcagtgttgagcgctgttaaca

SEQ ID NO: 88705 - DNA, 25 bp, Homo sapien
ggtttcttctctccatcaaggccgg

SEQ ID NO: 88706 - DNA, 25 bp, Homo sapien
cgaagggcttccagcgtagggcgta

SEQ ID NO: 88707 - DNA, 25 bp, Homo sapien
ggagaggcccgaagccctggagaca

SEQ ID NO: 88708 - DNA, 25 bp, Homo sapien
actgcttcccacaggtaacgtccag

SEQ ID NO: 88709 - DNA, 25 bp, Homo sapien
gaaatatcccggttccgctccgctc

SEQ ID NO: 88710 - DNA, 25 bp, Homo sapien
cccgagctcgattctgcggccgcga

SEQ ID NO: 88711 - DNA, 25 bp, Homo sapien
ccgcagggaccatcccggaaagtga

SEQ ID NO: 88712 - DNA, 25 bp, Homo sapien
ctcgggtttcttctctccatcaagg

SEQ ID NO: 88713 - DNA, 25 bp, Homo sapien
tccgaagaacgcgaaaagccaggcc

SEQ ID NO: 88714 - DNA, 25 bp, Homo sapien
tgagcctctggctagtccgaagaac

SEQ ID NO: 88715 - DNA, 25 bp, Homo sapien
ccagaaggttttggcgaagctcttg

SEQ ID NO: 88716 - DNA, 25 bp, Homo sapien
tcagagtcgcctacaggagttgagc

SEQ ID NO: 88717 - DNA, 25 bp, Homo sapien
gagggtgacacaccatgctcacggc

SEQ ID NO: 88718 - DNA, 25 bp, Homo sapien
cgagtagctccagcggccacgctga

SEQ ID NO: 88719 - DNA, 25 bp, Homo sapien
caggcccaaggcactggttgtcatg

SEQ ID NO: 88720 - DNA, 25 bp, Homo sapien
cgctaggaactctgccgctcggtca

SEQ ID NO: 88721 - DNA, 25 bp, Homo sapien
tcacacgggagcctcaacaaagggc

SEQ ID NO: 88722 - DNA, 25 bp, Homo sapien
tgcgctaagcgcacatggccgcgca

SEQ ID NO: 88723 - DNA, 25 bp, Homo sapien
tgcacgccgattcggggcgagtccc

SEQ ID NO: 88724 - DNA, 25 bp, Homo sapien
ctccgactcgccaggaatgcgctgt

SEQ ID NO: 88725 - DNA, 25 bp, Homo sapien
ctcgccaggaatgcgctgtgtgcgc

SEQ ID NO: 88726 - DNA, 25 bp, Homo sapien
actgaggtaagagcgcgctgcgcta

SEQ ID NO: 88727 - DNA, 25 bp, Homo sapien
gggagcctcaacaaagggctttgtg

SEQ ID NO: 88728 - DNA, 25 bp, Homo sapien
cccttgcacgccgattcggggcgag

SEQ ID NO: 88729 - DNA, 25 bp, Homo sapien
tttcccaccgcaacaggtcagggga

SEQ ID NO: 88730 - DNA, 25 bp, Homo sapien
acgctgactcaagtcgctggcgttc

SEQ ID NO: 88731 - DNA, 25 bp, Homo sapien
ttgcgtaatgagtcccagaagtttc

SEQ ID NO: 88732 - DNA, 25 bp, Homo sapien
cccaagtcagacgtttgcctgtgca

SEQ ID NO: 88733 - DNA, 25 bp, Homo sapien
aaaagtggggttcttctctcctgca

SEQ ID NO: 88734 - DNA, 25 bp, Homo sapien
tgggacctgctacttgagttgcgta

SEQ ID NO: 88735 - DNA, 25 bp, Homo sapien
acccttccctgtgcctgtcgtggag

SEQ ID NO: 88736 - DNA, 25 bp, Homo sapien
tgataatgcttttttccctcgggtg

SEQ ID NO: 88737 - DNA, 25 bp, Homo sapien
tattattcacaatatcccagggagg

SEQ ID NO: 88738 - DNA, 25 bp, Homo sapien
tactgttcataataggctattcagc

SEQ ID NO: 88739 - DNA, 25 bp, Homo sapien
ttcacaatatcccagggaggtataa

SEQ ID NO: 88740 - DNA, 25 bp, Homo sapien
cagggaggtataacttttaatatca

SEQ ID NO: 88741 - DNA, 25 bp, Homo sapien
acttttaatatcacagcagatgttc

SEQ ID NO: 88742 - DNA, 25 bp, Homo sapien
aatatcacagcagatgttctctatg

SEQ ID NO: 88743 - DNA, 25 bp, Homo sapien
ttcataataggctattcagcaaggc

SEQ ID NO: 88744 - DNA, 25 bp, Homo sapien
cagcagatgttctctatgtgtgtac

SEQ ID NO: 88745 - DNA, 25 bp, Homo sapien
cagcccagtcaaggtaagccgtgca

SEQ ID NO: 88746 - DNA, 25 bp, Homo sapien
taccaccgcaactttcttgacaggg

SEQ ID NO: 88747 - DNA, 25 bp, Homo sapien
gagcgccctgcccatttaagtaggc

SEQ ID NO: 88748 - DNA, 25 bp, Homo sapien
cccagtgcccggatgtccatcagga

SEQ ID NO: 88749 - DNA, 25 bp, Homo sapien
ccatcaggattagcgcgagccaata

SEQ ID NO: 88750 - DNA, 25 bp, Homo sapien
ctcgagagcaggtagtcccgtaaca

SEQ ID NO: 88751 - DNA, 25 bp, Homo sapien
ccctggctctataagctgaattatg

SEQ ID NO: 88752 - DNA, 25 bp, Homo sapien
ttcaagtgagcccagaggcaatttc

SEQ ID NO: 88753 - DNA, 25 bp, Homo sapien
cggcactctgggaagtgtggttctc

SEQ ID NO: 88754 - DNA, 25 bp, Homo sapien
ggaggcactctccacaaggtctaca

SEQ ID NO: 88755 - DNA, 25 bp, Homo sapien
tgtcgctaaggttgcagccacgtta

SEQ ID NO: 88756 - DNA, 25 bp, Homo sapien
accctgttcttcctgatgtcgctaa

SEQ ID NO: 88757 - DNA, 25 bp, Homo sapien
ggagacgagcgtcccgttacctcga

SEQ ID NO: 88758 - DNA, 25 bp, Homo sapien
cggacggcaccgcacaaaggaagag

SEQ ID NO: 88759 - DNA, 25 bp, Homo sapien
cgagggctcgaatttcctccgcaca

SEQ ID NO: 88760 - DNA, 25 bp, Homo sapien
ctgcggttcctggttccacatcagg

SEQ ID NO: 88761 - DNA, 25 bp, Homo sapien
gtagcacgttgcagcagcccacagc

SEQ ID NO: 88762 - DNA, 25 bp, Homo sapien
agccacgctcgagccaaagcgcttg

SEQ ID NO: 88763 - DNA, 25 bp, Homo sapien
agtggctgtcttcaccaggctcttg

SEQ ID NO: 88764 - DNA, 25 bp, Homo sapien
acgcttcgctgtaggtcgtggaaca

SEQ ID NO: 88765 - DNA, 25 bp, Homo sapien
cgaactctgtggcatcctcgtagaa

SEQ ID NO: 88766 - DNA, 25 bp, Homo sapien
tgctggtgaccacgtcgcacacgtt

SEQ ID NO: 88767 - DNA, 25 bp, Homo sapien
gaagtccttgttggcatagtacagc

SEQ ID NO: 88768 - DNA, 25 bp, Homo sapien
gctcagccatgtgaggaccaccatg

SEQ ID NO: 88769 - DNA, 25 bp, Homo sapien
gacaggtcctagtgcccatcagata

SEQ ID NO: 88770 - DNA, 25 bp, Homo sapien
gccggcaacgcacgacctttgcttt

SEQ ID NO: 88771 - DNA, 25 bp, Homo sapien
tgtgactatcaggtcctcgcgctgc

SEQ ID NO: 88772 - DNA, 25 bp, Homo sapien
aggcacagctactcccgttcgggaa

SEQ ID NO: 88773 - DNA, 25 bp, Homo sapien
gagggctcttgatctgtgatttata

SEQ ID NO: 88774 - DNA, 25 bp, Homo sapien
tctggatttttctcgatgcactggg

SEQ ID NO: 88775 - DNA, 25 bp, Homo sapien
gcgccattacgcagagagaaagtta

SEQ ID NO: 88776 - DNA, 25 bp, Homo sapien
gcggaggcaccaactaagagcgacc

SEQ ID NO: 88777 - DNA, 25 bp, Homo sapien
aagaaaggaacatggctcctgaggc

SEQ ID NO: 88778 - DNA, 25 bp, Homo sapien
aacatggctcctgaggcgcacagcg

SEQ ID NO: 88779 - DNA, 25 bp, Homo sapien
ccagtgaccgcgatggtgaactcca

SEQ ID NO: 88780 - DNA, 25 bp, Homo sapien
ggtgaactccagtcgcgtgcagcct

SEQ ID NO: 88781 - DNA, 25 bp, Homo sapien
ctggagatcgagatgcagcgcatcc

SEQ ID NO: 88782 - DNA, 25 bp, Homo sapien
gacccgcagcggcagatgcacgaac

SEQ ID NO: 88783 - DNA, 25 bp, Homo sapien
atgcacgaaccagaacggccggcgc

SEQ ID NO: 88784 - DNA, 25 bp, Homo sapien
ttccacttggaacgcggactcggga

SEQ ID NO: 88785 - DNA, 25 bp, Homo sapien
acccggacatccaggggacgagctc

SEQ ID NO: 88786 - DNA, 25 bp, Homo sapien
acgctgacgcacaggttgcccagtc

SEQ ID NO: 88787 - DNA, 25 bp, Homo sapien
cgctcattgggctgatcagtacctc

SEQ ID NO: 88788 - DNA, 25 bp, Homo sapien
tacgagaatcaccaggcgctcattg

SEQ ID NO: 88789 - DNA, 25 bp, Homo sapien
ccgtgacacgcagggacaagccaaa

SEQ ID NO: 88790 - DNA, 25 bp, Homo sapien
cggctgaaagcgcacacgtgtcctg

SEQ ID NO: 88791 - DNA, 25 bp, Homo sapien
gcagcgctgacacgaacttcctaag

SEQ ID NO: 88792 - DNA, 25 bp, Homo sapien
ccggaaccttttgagtgggcacagc

SEQ ID NO: 88793 - DNA, 25 bp, Homo sapien
ctccaaagggaagaaagcgacgctc

SEQ ID NO: 88794 - DNA, 25 bp, Homo sapien
cccgcggctgctatttgacttcgca

SEQ ID NO: 88795 - DNA, 25 bp, Homo sapien
ttttctcccgcagttgaccagatgg

SEQ ID NO: 88796 - DNA, 25 bp, Homo sapien
ctcggatctccgaagcaagcagtca

SEQ ID NO: 88797 - DNA, 25 bp, Homo sapien
agagtgccttctccgtcgtctcgga

SEQ ID NO: 88798 - DNA, 25 bp, Homo sapien
tggatggctacgtccctgaaaaatg

SEQ ID NO: 88799 - DNA, 25 bp, Homo sapien
tccgcgaccgccaataaagaacagc

SEQ ID NO: 88800 - DNA, 25 bp, Homo sapien
tcacagatgccgatgggaacgagcc

SEQ ID NO: 88801 - DNA, 25 bp, Homo sapien
cgcagaagcgggatgtacttctgtt

SEQ ID NO: 88802 - DNA, 25 bp, Homo sapien
ctctcgtgcggagacaacagcaggg

SEQ ID NO: 88803 - DNA, 25 bp, Homo sapien
ggctgagctactgcaggcggccagc

SEQ ID NO: 88804 - DNA, 25 bp, Homo sapien
ccagtcaccagcgttcgggagcctg

SEQ ID NO: 88805 - DNA, 25 bp, Homo sapien
ccgacggaatccggagcaggcgaca

SEQ ID NO: 88806 - DNA, 25 bp, Homo sapien
ctgtcgcagcgggaccgacggaatc

SEQ ID NO: 88807 - DNA, 25 bp, Homo sapien
acagggtcctctcgtgcggagacaa

SEQ ID NO: 88808 - DNA, 25 bp, Homo sapien
accagcgttcgggagcctgtcgcag

SEQ ID NO: 88809 - DNA, 25 bp, Homo sapien
tccgggcgcacagctctggctcttt

SEQ ID NO: 88810 - DNA, 25 bp, Homo sapien
gatactggcgaccagcggatcctcc

SEQ ID NO: 88811 - DNA, 25 bp, Homo sapien
gctgtcttttatcccggtcagtgtc

SEQ ID NO: 88812 - DNA, 25 bp, Homo sapien
gacggcgcacctgagctgtctttta

SEQ ID NO: 88813 - DNA, 25 bp, Homo sapien
cgcctggctcggatagtttcgccga

SEQ ID NO: 88814 - DNA, 25 bp, Homo sapien
ggcgttctctcctctcgcctctggg

SEQ ID NO: 88815 - DNA, 25 bp, Homo sapien
cggatcctccgctcagcaaagtggc

SEQ ID NO: 88816 - DNA, 25 bp, Homo sapien
ctcggatagtttcgccgacggcgca

SEQ ID NO: 88817 - DNA, 25 bp, Homo sapien
gcttcgagccattcccgcaggctgg

SEQ ID NO: 88818 - DNA, 25 bp, Homo sapien
agcgagttacctgagcggcttcttg

SEQ ID NO: 88819 - DNA, 25 bp, Homo sapien
tgcagcgtgctccactcagcatggt

SEQ ID NO: 88820 - DNA, 25 bp, Homo sapien
aagggccaaggccagcgagttacct

SEQ ID NO: 88821 - DNA, 25 bp, Homo sapien
tccagaatgtggcagcggagagtac

SEQ ID NO: 88822 - DNA, 25 bp, Homo sapien
ctttggttccgagggtgcttctgct

SEQ ID NO: 88823 - DNA, 25 bp, Homo sapien
agggtgcttctgctccgactgcttt

SEQ ID NO: 88824 - DNA, 25 bp, Homo sapien
cggagagtacctgaccgacctacaa

SEQ ID NO: 88825 - DNA, 25 bp, Homo sapien
tcccgagtagagaacgcaagcaccc

SEQ ID NO: 88826 - DNA, 25 bp, Homo sapien
tcggcggaacgaggataacccagta

SEQ ID NO: 88827 - DNA, 25 bp, Homo sapien
ataacccagtagagccggacccagg

SEQ ID NO: 88828 - DNA, 25 bp, Homo sapien
gatcccgtggttttcatgtctcttc

SEQ ID NO: 88829 - DNA, 25 bp, Homo sapien
gggtcactatttggcccttccagaa

SEQ ID NO: 88830 - DNA, 25 bp, Homo sapien
cttccagaatctcagggtccggttc

SEQ ID NO: 88831 - DNA, 25 bp, Homo sapien
gggcacaacacttggcctctcgctg

SEQ ID NO: 88832 - DNA, 25 bp, Homo sapien
atgcgcataaaagcccactcccggg

SEQ ID NO: 88833 - DNA, 25 bp, Homo sapien
ggagaagggcgttctggacgagggc

SEQ ID NO: 88834 - DNA, 25 bp, Homo sapien
ctggagaagggcgttctggacgagg

SEQ ID NO: 88835 - DNA, 25 bp, Homo sapien
tcctggagaagggcgttctggacga

SEQ ID NO: 88836 - DNA, 25 bp, Homo sapien
tggagaagggcgttctggacgaggg

SEQ ID NO: 88837 - DNA, 25 bp, Homo sapien
acaacatcgcctgggaccactcttt

SEQ ID NO: 88838 - DNA, 25 bp, Homo sapien
agaagggcgttctggacgagggcgt

SEQ ID NO: 88839 - DNA, 25 bp, Homo sapien
gaagggcgttctggacgagggcgtc

SEQ ID NO: 88840 - DNA, 25 bp, Homo sapien
gagaagggcgttctggacgagggcg

SEQ ID NO: 88841 - DNA, 25 bp, Homo sapien
tccgatttcggctgacacacccgtg

SEQ ID NO: 88842 - DNA, 25 bp, Homo sapien
caagccttcaaaatgggagcgcctc

SEQ ID NO: 88843 - DNA, 25 bp, Homo sapien
aacctgaataggcaaccgctgatcg

SEQ ID NO: 88844 - DNA, 25 bp, Homo sapien
cccgccagtgaaaagcaatcttatt

SEQ ID NO: 88845 - DNA, 25 bp, Homo sapien
gctctatgtcttgcagtccgatttc

SEQ ID NO: 88846 - DNA, 25 bp, Homo sapien
tgtgacagtcggagtcccaagctgc

SEQ ID NO: 88847 - DNA, 25 bp, Homo sapien
gggcgcggacgctttcaattgaaat

SEQ ID NO: 88848 - DNA, 25 bp, Homo sapien
ccttattattgtgacgccgaaaacg

SEQ ID NO: 88849 - DNA, 25 bp, Homo sapien
tgcctcatgatcctcgctcgggcta

SEQ ID NO: 88850 - DNA, 25 bp, Homo sapien
ccctagggagaaaagagcctcgtcg

SEQ ID NO: 88851 - DNA, 25 bp, Homo sapien
gggtctcccaggtgctgtcgatttt

SEQ ID NO: 88852 - DNA, 25 bp, Homo sapien
ctgtcgattttgcaaagggtccgtc

SEQ ID NO: 88853 - DNA, 25 bp, Homo sapien
agggtccgtctctacagcgactgtg

SEQ ID NO: 88854 - DNA, 25 bp, Homo sapien
tgacgagtttcggagcatcagcacc

SEQ ID NO: 88855 - DNA, 25 bp, Homo sapien
caggagactccatttgcgcttagtg

SEQ ID NO: 88856 - DNA, 25 bp, Homo sapien
gtgagtggaacccacgcagcgccta

SEQ ID NO: 88857 - DNA, 25 bp, Homo sapien
agcgagctccgtgcgttcaggaact

SEQ ID NO: 88858 - DNA, 25 bp, Homo sapien
ggggcttcccgtcgcatatcccaag

SEQ ID NO: 88859 - DNA, 25 bp, Homo sapien
ccaagcaccgtctctcggcgccaca

SEQ ID NO: 88860 - DNA, 25 bp, Homo sapien
agctgaggtccttctcagcccggtc

SEQ ID NO: 88861 - DNA, 25 bp, Homo sapien
tccgtgcgttcaggaactgaaatta

SEQ ID NO: 88862 - DNA, 25 bp, Homo sapien
gttcaggaactgaaattactatgcc

SEQ ID NO: 88863 - DNA, 25 bp, Homo sapien
aattactatgccaagagcagaggcg

SEQ ID NO: 88864 - DNA, 25 bp, Homo sapien
gcccgcgagctgaggtccttctcag

SEQ ID NO: 88865 - DNA, 25 bp, Homo sapien
cggatccagggccaaacgacaaggt

SEQ ID NO: 88866 - DNA, 25 bp, Homo sapien
ggacgcacagcacactgcacgagca

SEQ ID NO: 88867 - DNA, 25 bp, Homo sapien
gggactcgtccatcctgttgcgtca

SEQ ID NO: 88868 - DNA, 25 bp, Homo sapien
cccaccatgaggcaaagcaggctga

SEQ ID NO: 88869 - DNA, 25 bp, Homo sapien
gctgaagatgcccacggagacatgc

SEQ ID NO: 88870 - DNA, 25 bp, Homo sapien
gagacatgccgtgaggtgcccatga

SEQ ID NO: 88871 - DNA, 25 bp, Homo sapien
tgcagcccggccagcaatgagtagg

SEQ ID NO: 88872 - DNA, 25 bp, Homo sapien
gatgccgatgaccagcccagacatg

SEQ ID NO: 88873 - DNA, 25 bp, Homo sapien
tgctcctcgtccctatctcggatgg

SEQ ID NO: 88874 - DNA, 25 bp, Homo sapien
agttctccgctcacgagggtggaaa

SEQ ID NO: 88875 - DNA, 25 bp, Homo sapien
ggcaaacccgctaacctgtcgtcga

SEQ ID NO: 88876 - DNA, 25 bp, Homo sapien
gttaagtttagggtcacgagcactc

SEQ ID NO: 88877 - DNA, 25 bp, Homo sapien
acgagcactcttgtggagatcggga

SEQ ID NO: 88878 - DNA, 25 bp, Homo sapien
gccctcgcatcgctgaaatttaatc

SEQ ID NO: 88879 - DNA, 25 bp, Homo sapien
gcgcttttgcgcctcacgttaagtt

SEQ ID NO: 88880 - DNA, 25 bp, Homo sapien
tcgtcgaatggccactcccagttct

SEQ ID NO: 88881 - DNA, 25 bp, Homo sapien
ctgcttgtcctctggcgccagtttc

SEQ ID NO: 88882 - DNA, 25 bp, Homo sapien
actcgcgtcccgcaggtagaggcga

SEQ ID NO: 88883 - DNA, 25 bp, Homo sapien
cacgctgctgcgtggtttgctgcct

SEQ ID NO: 88884 - DNA, 25 bp, Homo sapien
ccgggaggagccttaacaagcgcac

SEQ ID NO: 88885 - DNA, 25 bp, Homo sapien
cccgaagacataaatccctgagtgc

SEQ ID NO: 88886 - DNA, 25 bp, Homo sapien
aacgcagctggactctgtgcaactg

SEQ ID NO: 88887 - DNA, 25 bp, Homo sapien
tctcaacatgactgactgggaagcg

SEQ ID NO: 88888 - DNA, 25 bp, Homo sapien
aatagtcgccgacctactgccaatc

SEQ ID NO: 88889 - DNA, 25 bp, Homo sapien
tgcggatgaacgtgcacagctcctg

SEQ ID NO: 88890 - DNA, 25 bp, Homo sapien
ctggactccaggttcatcatgagca

SEQ ID NO: 88891 - DNA, 25 bp, Homo sapien
tttctggagcgagtggccagcacct

SEQ ID NO: 88892 - DNA, 25 bp, Homo sapien
cggaagatccggtaagtcctgagca

SEQ ID NO: 88893 - DNA, 25 bp, Homo sapien
cttccggcttctcgttgcggatgaa

SEQ ID NO: 88894 - DNA, 25 bp, Homo sapien
ccctggagtatcttagaagcaactc

SEQ ID NO: 88895 - DNA, 25 bp, Homo sapien
cagctgcgtcttggctcgttccagc

SEQ ID NO: 88896 - DNA, 25 bp, Homo sapien
catcctcgaagatcacaggcctgga

SEQ ID NO: 88897 - DNA, 25 bp, Homo sapien
cttggctttatgatccttgcgtgta

SEQ ID NO: 88898 - DNA, 25 bp, Homo sapien
acttgctaatccgtgagagctgagc

SEQ ID NO: 88899 - DNA, 25 bp, Homo sapien
gggctgcgcgtcattatcatgcaca

SEQ ID NO: 88900 - DNA, 25 bp, Homo sapien
aacaggtggttttgcaacgtgagcc

SEQ ID NO: 88901 - DNA, 25 bp, Homo sapien
ccgcgactctgagaaggactgccga

SEQ ID NO: 88902 - DNA, 25 bp, Homo sapien
agccttttctgcgttaatgcgacga

SEQ ID NO: 88903 - DNA, 25 bp, Homo sapien
cggcagtgtcgccaaggactgattg

SEQ ID NO: 88904 - DNA, 25 bp, Homo sapien
gctcccgaggtctgcttagcagata

SEQ ID NO: 88905 - DNA, 25 bp, Homo sapien
ccattggctgagaagacacgcgacc

SEQ ID NO: 88906 - DNA, 25 bp, Homo sapien
gcctccgagcctttgcagtgcaatg

SEQ ID NO: 88907 - DNA, 25 bp, Homo sapien
tcaacgccttgtccgagctgctaca

SEQ ID NO: 88908 - DNA, 25 bp, Homo sapien
cgcgccgcccagtatttgctacatt

SEQ ID NO: 88909 - DNA, 25 bp, Homo sapien
tgcatgggctgaaccacgccttcga

SEQ ID NO: 88910 - DNA, 25 bp, Homo sapien
gccttcgaccagctgcgcaatgtta

SEQ ID NO: 88911 - DNA, 25 bp, Homo sapien
aaactctttgattggctgctcgcac

SEQ ID NO: 88912 - DNA, 25 bp, Homo sapien
cgcagcgccttcagcaaccggagaa

SEQ ID NO: 88913 - DNA, 25 bp, Homo sapien
aagagcatcctcctgcgcaagcgga

SEQ ID NO: 88914 - DNA, 25 bp, Homo sapien
tggtgagcgcactctcctttcaggc

SEQ ID NO: 88915 - DNA, 25 bp, Homo sapien
agctgtgcggccacatttaacacca

SEQ ID NO: 88916 - DNA, 25 bp, Homo sapien
gagctcacagtagcgagcgtctctc

SEQ ID NO: 88917 - DNA, 25 bp, Homo sapien
agcaaccagcccagcacgcaaagaa

SEQ ID NO: 88918 - DNA, 25 bp, Homo sapien
cacgcaaagaagctgcgcaaagtta

SEQ ID NO: 88919 - DNA, 25 bp, Homo sapien
agcggagacgcaaacgcgctcctga

SEQ ID NO: 88920 - DNA, 25 bp, Homo sapien
tgaggcacctgaagcagtgaaccag

SEQ ID NO: 88921 - DNA, 25 bp, Homo sapien
cactgaggctacaagatcgtaagta

SEQ ID NO: 88922 - DNA, 25 bp, Homo sapien
cacggtagcacagggagcttctctt

SEQ ID NO: 88923 - DNA, 25 bp, Homo sapien
agcttcctctcagctgggatcgcgc

SEQ ID NO: 88924 - DNA, 25 bp, Homo sapien
agggtcagctcgtggtttcagtaag

SEQ ID NO: 88925 - DNA, 25 bp, Homo sapien
cgcgctcttaaggtttctccgtggt

SEQ ID NO: 88926 - DNA, 25 bp, Homo sapien
aggctgcgtgttgcgtcatcattac

SEQ ID NO: 88927 - DNA, 25 bp, Homo sapien
gaattaccatgacaacagcgcgcgc

SEQ ID NO: 88928 - DNA, 25 bp, Homo sapien
cctggcaggtcctttctcgaggcag

SEQ ID NO: 88929 - DNA, 25 bp, Homo sapien
gctcaaaatccgctaagactactcc

SEQ ID NO: 88930 - DNA, 25 bp, Homo sapien
atggctcctcaggtgctttctgggc

SEQ ID NO: 88931 - DNA, 25 bp, Homo sapien
aagaaccggccgctgtgcgccgaac

SEQ ID NO: 88932 - DNA, 25 bp, Homo sapien
gcctctcggatctccggtgggagaa

SEQ ID NO: 88933 - DNA, 25 bp, Homo sapien
accgcgagtcacttgtcagcccttg

SEQ ID NO: 88934 - DNA, 25 bp, Homo sapien
cctttgccaggtagcgctcaaaatc

SEQ ID NO: 88935 - DNA, 25 bp, Homo sapien
accgaaactcggtagcgcagttgtc

SEQ ID NO: 88936 - DNA, 25 bp, Homo sapien
tagcgcagttgtctttccgcagctg

SEQ ID NO: 88937 - DNA, 25 bp, Homo sapien
ccaagtgcgttgagaagtgtaatcc

SEQ ID NO: 88938 - DNA, 25 bp, Homo sapien
ggctctcagtctccaatcactagtg

SEQ ID NO: 88939 - DNA, 25 bp, Homo sapien
tctccaatcactagtgggagctgga

SEQ ID NO: 88940 - DNA, 25 bp, Homo sapien
gaagtgtaatccctccgctaagtac

SEQ ID NO: 88941 - DNA, 25 bp, Homo sapien
ctcccgagacccagccttgccgtgg

SEQ ID NO: 88942 - DNA, 25 bp, Homo sapien
gttgagaagtgtaatccctccgcta

SEQ ID NO: 88943 - DNA, 25 bp, Homo sapien
ggccgctccaagtgcgttgagaagt

SEQ ID NO: 88944 - DNA, 25 bp, Homo sapien
cgctaagtacttggctctcagtctc

SEQ ID NO: 88945 - DNA, 25 bp, Homo sapien
cgcgctccatctcgccggcccagtc

SEQ ID NO: 88946 - DNA, 25 bp, Homo sapien
gcagccgcgcggtcttagcggctca

SEQ ID NO: 88947 - DNA, 25 bp, Homo sapien
agccgcgcggtcttagcggctcacg

SEQ ID NO: 88948 - DNA, 25 bp, Homo sapien
cggccgcgcggtgaatgagcccgtt

SEQ ID NO: 88949 - DNA, 25 bp, Homo sapien
aatgagcccgttgtgcggccgccgc

SEQ ID NO: 88950 - DNA, 25 bp, Homo sapien
ggtggctcgtctgcgtctccggccc

SEQ ID NO: 88951 - DNA, 25 bp, Homo sapien
gtcggtctctcaaggcccctcccaa

SEQ ID NO: 88952 - DNA, 25 bp, Homo sapien
cggggtctacaagggctgacgcgcc

SEQ ID NO: 88953 - DNA, 25 bp, Homo sapien
aaagggcacaagacactccaggctc

SEQ ID NO: 88954 - DNA, 25 bp, Homo sapien
catcatgcgcttcggggtgcatcta

SEQ ID NO: 88955 - DNA, 25 bp, Homo sapien
tgcatctacggtatgtcacacagcc

SEQ ID NO: 88956 - DNA, 25 bp, Homo sapien
atgcaacaacgtgcgcgtgcggagc

SEQ ID NO: 88957 - DNA, 25 bp, Homo sapien
cctccgtgtgtgcaatatgcaacaa

SEQ ID NO: 88958 - DNA, 25 bp, Homo sapien
ctcccacacgtatggagacggatcg

SEQ ID NO: 88959 - DNA, 25 bp, Homo sapien
agacggatcggctgcgtgtccacac

SEQ ID NO: 88960 - DNA, 25 bp, Homo sapien
ggagcctctgcgcatcatgcgcttc

SEQ ID NO: 88961 - DNA, 25 bp, Homo sapien
ttgaaggtccctctttcccaatgcc

SEQ ID NO: 88962 - DNA, 25 bp, Homo sapien
ttcacatcctagagtagggcgcacg

SEQ ID NO: 88963 - DNA, 25 bp, Homo sapien
ggcgctctggtctccaatctcagtg

SEQ ID NO: 88964 - DNA, 25 bp, Homo sapien
accagctgtgggtttgcccgctgaa

SEQ ID NO: 88965 - DNA, 25 bp, Homo sapien
ttctaactgacgtctcccgcgagcg

SEQ ID NO: 88966 - DNA, 25 bp, Homo sapien
atctcagtgttctcacgccggcgga

SEQ ID NO: 88967 - DNA, 25 bp, Homo sapien
gcacgccgaagtctggactgctctc

SEQ ID NO: 88968 - DNA, 25 bp, Homo sapien
cccgcccgccttatgtaagcaagga

SEQ ID NO: 88969 - DNA, 25 bp, Homo sapien
cccggtgcttccggccctgactccg

SEQ ID NO: 88970 - DNA, 25 bp, Homo sapien
cggagcatgcgcaccgagcagccac

SEQ ID NO: 88971 - DNA, 25 bp, Homo sapien
tcggagcatgcgcaccgagcagcca

SEQ ID NO: 88972 - DNA, 25 bp, Homo sapien
cagtctctagggagcgaagtggagg

SEQ ID NO: 88973 - DNA, 25 bp, Homo sapien
cccagtctctagggagcgaagtgga

SEQ ID NO: 88974 - DNA, 25 bp, Homo sapien
gggcccagtctctagggagcgaagt

SEQ ID NO: 88975 - DNA, 25 bp, Homo sapien
accgagcagccaccctttcccggct

SEQ ID NO: 88976 - DNA, 25 bp, Homo sapien
gcccacttctctccgcccggaagcc

SEQ ID NO: 88977 - DNA, 25 bp, Homo sapien
gcaaagttgccggatttctccagtc

SEQ ID NO: 88978 - DNA, 25 bp, Homo sapien
tcgctgccgggacctttgtttctaa

SEQ ID NO: 88979 - DNA, 25 bp, Homo sapien
tagagcagccttaagtgtcccaatg

SEQ ID NO: 88980 - DNA, 25 bp, Homo sapien
tgtcccaatgacacgcctgctatcg

SEQ ID NO: 88981 - DNA, 25 bp, Homo sapien
gtcctttccaacttcgtcagctctg

SEQ ID NO: 88982 - DNA, 25 bp, Homo sapien
ctctgctagcagatcgggctcaata

SEQ ID NO: 88983 - DNA, 25 bp, Homo sapien
gagcaacatgggtaagtcatccttc

SEQ ID NO: 88984 - DNA, 25 bp, Homo sapien
gggaagcatttctcgcgcaaagttg

SEQ ID NO: 88985 - DNA, 25 bp, Homo sapien
cgaagcaccgttgctcggagcagcc

SEQ ID NO: 88986 - DNA, 25 bp, Homo sapien
agcccgagtttggagctccgaagca

SEQ ID NO: 88987 - DNA, 25 bp, Homo sapien
tcctctgggttcatgaagacacttg

SEQ ID NO: 88988 - DNA, 25 bp, Homo sapien
ggagcgctccaacttacccaaaata

SEQ ID NO: 88989 - DNA, 25 bp, Homo sapien
aggcgaatgcctctatgctgctccg

SEQ ID NO: 88990 - DNA, 25 bp, Homo sapien
ggacccttgtagtgcttcccggaca

SEQ ID NO: 88991 - DNA, 25 bp, Homo sapien
cgtcgcgaatcgatcggccacaata

SEQ ID NO: 88992 - DNA, 25 bp, Homo sapien
ggccacaatagttggaatcccagga

SEQ ID NO: 88993 - DNA, 25 bp, Homo sapien
acggcaggggccctcgagtgtacac

SEQ ID NO: 88994 - DNA, 25 bp, Homo sapien
gcaggggccctcgagtgtacacccg

SEQ ID NO: 88995 - DNA, 25 bp, Homo sapien
accatctgcagccagttcttccagc

SEQ ID NO: 88996 - DNA, 25 bp, Homo sapien
cggaaggcttgcagtccctgaccat

SEQ ID NO: 88997 - DNA, 25 bp, Homo sapien
agcgcggaaggcttgcagtccctga

SEQ ID NO: 88998 - DNA, 25 bp, Homo sapien
gtcagcgcggaaggcttgcagtccc

SEQ ID NO: 88999 - DNA, 25 bp, Homo sapien
gtcgctagaatttcctgagccccca

SEQ ID NO: 89000 - DNA, 25 bp, Homo sapien
gcgctggcctctggcgctgcaagtt

SEQ ID NO: 89001 - DNA, 25 bp, Homo sapien
ggccaaaggcaatactcaccggttc

SEQ ID NO: 89002 - DNA, 25 bp, Homo sapien
tccctcattctacttggagagcttc

SEQ ID NO: 89003 - DNA, 25 bp, Homo sapien
gccctgcgccttcctatcatgaaga

SEQ ID NO: 89004 - DNA, 25 bp, Homo sapien
ccggttcgacagtcgccatcttaga

SEQ ID NO: 89005 - DNA, 25 bp, Homo sapien
gattcaaaccggattggccagcttc

SEQ ID NO: 89006 - DNA, 25 bp, Homo sapien
ctgcgtgagtaacgagaggcttctg

SEQ ID NO: 89007 - DNA, 25 bp, Homo sapien
tctccggcgcgctggattaacagac

SEQ ID NO: 89008 - DNA, 25 bp, Homo sapien
cttctggccacgtgacggatatgtc

SEQ ID NO: 89009 - DNA, 25 bp, Homo sapien
cgcgctagacctccgcgttctgggg

SEQ ID NO: 89010 - DNA, 25 bp, Homo sapien
actgtaggcacagagagtgcgccgc

SEQ ID NO: 89011 - DNA, 25 bp, Homo sapien
tggccgacgcccgaaggcgccgaat

SEQ ID NO: 89012 - DNA, 25 bp, Homo sapien
agcagtgaggccaagctccagtgtc

SEQ ID NO: 89013 - DNA, 25 bp, Homo sapien
cagtgtcccacttgcatcaagctgg

SEQ ID NO: 89014 - DNA, 25 bp, Homo sapien
gggctcgtacttctgctcgcaggta

SEQ ID NO: 89015 - DNA, 25 bp, Homo sapien
caggtcgcgttctctgctggccgac

SEQ ID NO: 89016 - DNA, 25 bp, Homo sapien
gactgtcttatctgactgtaggcac

SEQ ID NO: 89017 - DNA, 25 bp, Homo sapien
cggcgccggtttcattgctaaaatc

SEQ ID NO: 89018 - DNA, 25 bp, Homo sapien
gatagcagcctagtcccatgccatg

SEQ ID NO: 89019 - DNA, 25 bp, Homo sapien
aagttgtgcgttccagggtgcactc

SEQ ID NO: 89020 - DNA, 25 bp, Homo sapien
tgcgtgccgctaagttgtgcgttcc

SEQ ID NO: 89021 - DNA, 25 bp, Homo sapien
ttgcaatggctccaaccggaagggc

SEQ ID NO: 89022 - DNA, 25 bp, Homo sapien
catgttcacggattctggtcggcgc

SEQ ID NO: 89023 - DNA, 25 bp, Homo sapien
cctcgttcgccatgttcacggattc

SEQ ID NO: 89024 - DNA, 25 bp, Homo sapien
atccgacggacttgttgcagaactc

SEQ ID NO: 89025 - DNA, 25 bp, Homo sapien
gcctggttacggctcacgcttcctt

SEQ ID NO: 89026 - DNA, 25 bp, Homo sapien
tacgtcatcgaactgcggccatttc

SEQ ID NO: 89027 - DNA, 25 bp, Homo sapien
acgggattaagctgtctctggcgaa

SEQ ID NO: 89028 - DNA, 25 bp, Homo sapien
atcgacgtcatttccttcagcaaga

SEQ ID NO: 89029 - DNA, 25 bp, Homo sapien
cccggaagcccttgttgctagtagg

SEQ ID NO: 89030 - DNA, 25 bp, Homo sapien
gcgccaaccagtgccaggacactta

SEQ ID NO: 89031 - DNA, 25 bp, Homo sapien
tcccagccagcaaacgcatttcaga

SEQ ID NO: 89032 - DNA, 25 bp, Homo sapien
ccctttgcgtccagagaataccata

SEQ ID NO: 89033 - DNA, 25 bp, Homo sapien
tggctttgctctcactgcgtacatt

SEQ ID NO: 89034 - DNA, 25 bp, Homo sapien
cgtcggacatgctgaccactgtgta

SEQ ID NO: 89035 - DNA, 25 bp, Homo sapien
tggtgggatgtatccatgacttctc

SEQ ID NO: 89036 - DNA, 25 bp, Homo sapien
tttgaactcgtgttcccgctgcatc

SEQ ID NO: 89037 - DNA, 25 bp, Homo sapien
ccgctgcatcttcttggaaatgaca

SEQ ID NO: 89038 - DNA, 25 bp, Homo sapien
cagactggaggcgaacttggacttc

SEQ ID NO: 89039 - DNA, 25 bp, Homo sapien
ctgcgtacattcaggggctccaaaa

SEQ ID NO: 89040 - DNA, 25 bp, Homo sapien
aagactggagatttggagcccgcca

SEQ ID NO: 89041 - DNA, 25 bp, Homo sapien
ctacctggacaacgggctctgcagc

SEQ ID NO: 89042 - DNA, 25 bp, Homo sapien
tggtctacgtcacgcgctacctgga

SEQ ID NO: 89043 - DNA, 25 bp, Homo sapien
ccgcggtgctgatctacgcgagcga

SEQ ID NO: 89044 - DNA, 25 bp, Homo sapien
gggaccgtcctggacagcaaccaca

SEQ ID NO: 89045 - DNA, 25 bp, Homo sapien
acgacaatgccttcctgagctacca

SEQ ID NO: 89046 - DNA, 25 bp, Homo sapien
tacgcgctcctgagcaacgacaatg

SEQ ID NO: 89047 - DNA, 25 bp, Homo sapien
cgcgcagcatcagaacctgctactg

SEQ ID NO: 89048 - DNA, 25 bp, Homo sapien
tggacacccgcaggtcatcgcgcag

SEQ ID NO: 89049 - DNA, 25 bp, Homo sapien
acgttgttgtcctcgaaatcccagc

SEQ ID NO: 89050 - DNA, 25 bp, Homo sapien
gtcgtcgtcctcttcggtcagactg

SEQ ID NO: 89051 - DNA, 25 bp, Homo sapien
tcttcggtcagactggtgatgtccc

SEQ ID NO: 89052 - DNA, 25 bp, Homo sapien
ggtctcgtcgctgccaccaaaggaa

SEQ ID NO: 89053 - DNA, 25 bp, Homo sapien
cgtcgctgccaccaaaggaagcata

SEQ ID NO: 89054 - DNA, 25 bp, Homo sapien
aggaagcataatccacgaacgagta

SEQ ID NO: 89055 - DNA, 25 bp, Homo sapien
gtagatcacgttgttgtcctcgaaa

SEQ ID NO: 89056 - DNA, 25 bp, Homo sapien
atccacgaacgagtagatcacgttg

SEQ ID NO: 89057 - DNA, 25 bp, Homo sapien
attgccggcattggtagcgccgtgc

SEQ ID NO: 89058 - DNA, 25 bp, Homo sapien
cgccagcaggctcgaagcggacctg

SEQ ID NO: 89059 - DNA, 25 bp, Homo sapien
cgtccgagctgactcggtggtccgc

SEQ ID NO: 89060 - DNA, 25 bp, Homo sapien
ctccggcagcgcagctaagaagggc

SEQ ID NO: 89061 - DNA, 25 bp, Homo sapien
atagcttgctccttcttccgtttcc

SEQ ID NO: 89062 - DNA, 25 bp, Homo sapien
ccgggcgatctcgacacatttctca

SEQ ID NO: 89063 - DNA, 25 bp, Homo sapien
ggtagagcttctcggccttctgcag

SEQ ID NO: 89064 - DNA, 25 bp, Homo sapien
agaagggacgctgaggtctcaccgc

SEQ ID NO: 89065 - DNA, 25 bp, Homo sapien
tatagaattaccaaggcggcgcgcc

SEQ ID NO: 89066 - DNA, 25 bp, Homo sapien
gactgcacgaacaactactgacctg

SEQ ID NO: 89067 - DNA, 25 bp, Homo sapien
ttctaaatcctgtctccgcgcgttc

SEQ ID NO: 89068 - DNA, 25 bp, Homo sapien
atcgagcgtctctgcgaagtttacc

SEQ ID NO: 89069 - DNA, 25 bp, Homo sapien
gctccctttatactgcagaatgttc

SEQ ID NO: 89070 - DNA, 25 bp, Homo sapien
cgcgtccttgagacttcagccaatg

SEQ ID NO: 89071 - DNA, 25 bp, Homo sapien
cgcttctaatctcaagccgcgattg

SEQ ID NO: 89072 - DNA, 25 bp, Homo sapien
tactgacctgcaagccggctctctg

SEQ ID NO: 89073 - DNA, 25 bp, Homo sapien
gcggagccgcaacctgaaactaact

SEQ ID NO: 89074 - DNA, 25 bp, Homo sapien
gaaccggcctctgcaactcaatttg

SEQ ID NO: 89075 - DNA, 25 bp, Homo sapien
aacggcctttcctgagcgctggaaa

SEQ ID NO: 89076 - DNA, 25 bp, Homo sapien
atttgcaaaagcaggcgagtcgtgc

SEQ ID NO: 89077 - DNA, 25 bp, Homo sapien
agaggctcctaaaatgcccggcgtc

SEQ ID NO: 89078 - DNA, 25 bp, Homo sapien
ctagcggaggaactcctttgccaaa

SEQ ID NO: 89079 - DNA, 25 bp, Homo sapien
gctctgtttccttcgcgaggcgcaa

SEQ ID NO: 89080 - DNA, 25 bp, Homo sapien
ttcgcaaaacttggaagcgacctgc

SEQ ID NO: 89081 - DNA, 25 bp, Homo sapien
atgctgcagtttacgtgggaattca

SEQ ID NO: 89082 - DNA, 25 bp, Homo sapien
tacgtgggaattcaggtatctcttc

SEQ ID NO: 89083 - DNA, 25 bp, Homo sapien
ggaattcaggtatctcttcaaaata

SEQ ID NO: 89084 - DNA, 25 bp, Homo sapien
taaataatgctgcagtttacgtggg

SEQ ID NO: 89085 - DNA, 25 bp, Homo sapien
ggtatctcttcaaaatactaacttc

SEQ ID NO: 89086 - DNA, 25 bp, Homo sapien
tgctggatcagatggtagttttatc

SEQ ID NO: 89087 - DNA, 25 bp, Homo sapien
tcattccacatagtgggattgctgg

SEQ ID NO: 89088 - DNA, 25 bp, Homo sapien
ccttttattcattccacatagtggg

SEQ ID NO: 89089 - DNA, 25 bp, Homo sapien
agcaggcggaatgaggttatcactt

SEQ ID NO: 89090 - DNA, 25 bp, Homo sapien
ctttaagagcaatgacaggtcggcg

SEQ ID NO: 89091 - DNA, 25 bp, Homo sapien
acgagtggagaaccctttaagagca

SEQ ID NO: 89092 - DNA, 25 bp, Homo sapien
gttatcacttgggaggtgtgcacga

SEQ ID NO: 89093 - DNA, 25 bp, Homo sapien
agcccgttacaaaaaggatgccagg

SEQ ID NO: 89094 - DNA, 25 bp, Homo sapien
taataggaatccaacagcccgttac

SEQ ID NO: 89095 - DNA, 25 bp, Homo sapien
cgaagaggaggcaataataggaatc

SEQ ID NO: 89096 - DNA, 25 bp, Homo sapien
gtgtgcacgagtggagaacccttta

SEQ ID NO: 89097 - DNA, 25 bp, Homo sapien
tctgttttcttccagctgccggacc

SEQ ID NO: 89098 - DNA, 25 bp, Homo sapien
cacttttgctggcaggccgagatta

SEQ ID NO: 89099 - DNA, 25 bp, Homo sapien
gtccctgctcaggtgtcacttttgc

SEQ ID NO: 89100 - DNA, 25 bp, Homo sapien
agggcgcatcactcagtgccaggtg

SEQ ID NO: 89101 - DNA, 25 bp, Homo sapien
gagttcctcgcgttcattggctaga

SEQ ID NO: 89102 - DNA, 25 bp, Homo sapien
ggagaagcgcacacacgagcaccca

SEQ ID NO: 89103 - DNA, 25 bp, Homo sapien
attttctgagcacgcctcccggttc

SEQ ID NO: 89104 - DNA, 25 bp, Homo sapien
ggccaggattaagaccgatcacatg

SEQ ID NO: 89105 - DNA, 25 bp, Homo sapien
gctgcgtttcctgagacctggccgc

SEQ ID NO: 89106 - DNA, 25 bp, Homo sapien
agagccgagggccaaaggaagagaa

SEQ ID NO: 89107 - DNA, 25 bp, Homo sapien
ggccatcgttagacaactgcactcg

SEQ ID NO: 89108 - DNA, 25 bp, Homo sapien
cacgggccatcgttagacaactgca

SEQ ID NO: 89109 - DNA, 25 bp, Homo sapien
gagaccacgggccatcgttagacaa

SEQ ID NO: 89110 - DNA, 25 bp, Homo sapien
gcccccaggtgggtagtcgcgcatt

SEQ ID NO: 89111 - DNA, 25 bp, Homo sapien
ttcaaccgccacaatgctgccagca

SEQ ID NO: 89112 - DNA, 25 bp, Homo sapien
agaaaatcgcggggagtctctggcc

SEQ ID NO: 89113 - DNA, 25 bp, Homo sapien
tgcgtacatatgctcctcccggata

SEQ ID NO: 89114 - DNA, 25 bp, Homo sapien
tccgctccggcgctctttacaaata

SEQ ID NO: 89115 - DNA, 25 bp, Homo sapien
tctctgacaggtccgcggtgaaact

SEQ ID NO: 89116 - DNA, 25 bp, Homo sapien
ctgcgtgtcaacgtaagactcggtc

SEQ ID NO: 89117 - DNA, 25 bp, Homo sapien
tctgctttattctctccgccgcaaa

SEQ ID NO: 89118 - DNA, 25 bp, Homo sapien
caggctccagaaacgctgcgtggca

SEQ ID NO: 89119 - DNA, 25 bp, Homo sapien
ctggttctccgacgccttcgaaaga

SEQ ID NO: 89120 - DNA, 25 bp, Homo sapien
cttggcaagttaatcggaagcactc

SEQ ID NO: 89121 - DNA, 25 bp, Homo sapien
ctgagaggcacatgggattagcgac

SEQ ID NO: 89122 - DNA, 25 bp, Homo sapien
tcggacttcctcattcctgcgctaa

SEQ ID NO: 89123 - DNA, 25 bp, Homo sapien
agcgccctgctaggaagccagagcc

SEQ ID NO: 89124 - DNA, 25 bp, Homo sapien
agagagagaagtgcaccagcgagcc

SEQ ID NO: 89125 - DNA, 25 bp, Homo sapien
tccgtctgtctgtatgctctctcga

SEQ ID NO: 89126 - DNA, 25 bp, Homo sapien
ctctcgacgtcagtgggaatttcca

SEQ ID NO: 89127 - DNA, 25 bp, Homo sapien
ttcctgcgctaaccgctgggctaga

SEQ ID NO: 89128 - DNA, 25 bp, Homo sapien
gggaaagacacatccggacctcgca

SEQ ID NO: 89129 - DNA, 25 bp, Homo sapien
aagctgtaactgagctccgcggcgg

SEQ ID NO: 89130 - DNA, 25 bp, Homo sapien
tggaacaaggcgctgtgcacgcagc

SEQ ID NO: 89131 - DNA, 25 bp, Homo sapien
ccagcgagccgttcccattgcagat

SEQ ID NO: 89132 - DNA, 25 bp, Homo sapien
gttcccattgcagatgctccagttg

SEQ ID NO: 89133 - DNA, 25 bp, Homo sapien
tgctccagttgccacgcaagctgta

SEQ ID NO: 89134 - DNA, 25 bp, Homo sapien
aggtggaggcgcatcttgagatccc

SEQ ID NO: 89135 - DNA, 25 bp, Homo sapien
cgcgccaccgagatgtggagagatc

SEQ ID NO: 89136 - DNA, 25 bp, Homo sapien
ggcattgcggtctgagccttccctc

SEQ ID NO: 89137 - DNA, 25 bp, Homo sapien
cctcgccagctgtccgggaagttca

SEQ ID NO: 89138 - DNA, 25 bp, Homo sapien
cgcatgttgacgtctattacgatga

SEQ ID NO: 89139 - DNA, 25 bp, Homo sapien
tagttcgggccttgaggagtcccac

SEQ ID NO: 89140 - DNA, 25 bp, Homo sapien
ggcctcaggtgggaacatacctttg

SEQ ID NO: 89141 - DNA, 25 bp, Homo sapien
ttgtcattcccgtcactagcaggtg

SEQ ID NO: 89142 - DNA, 25 bp, Homo sapien
ccgtgaggtttgtgttgcaagactg

SEQ ID NO: 89143 - DNA, 25 bp, Homo sapien
tgcccggtagcggagattgaatcgc

SEQ ID NO: 89144 - DNA, 25 bp, Homo sapien
tggccaaaggcaccaggtaacccga

SEQ ID NO: 89145 - DNA, 25 bp, Homo sapien
gccgtcccgagcacaggaccgatgt

SEQ ID NO: 89146 - DNA, 25 bp, Homo sapien
tggcggaaacccttaggctcagaga

SEQ ID NO: 89147 - DNA, 25 bp, Homo sapien
tgatgtgtattgctatcctcgcagc

SEQ ID NO: 89148 - DNA, 25 bp, Homo sapien
ttctcggaacagcaccttcttacta

SEQ ID NO: 89149 - DNA, 25 bp, Homo sapien
agccacaagatgtccgctctgacgg

SEQ ID NO: 89150 - DNA, 25 bp, Homo sapien
ccgagtgaatacgtgtcaagccctt

SEQ ID NO: 89151 - DNA, 25 bp, Homo sapien
gctctgacggaactactgccagctg

SEQ ID NO: 89152 - DNA, 25 bp, Homo sapien
tcctcgcagcgagctattctgtgtc

SEQ ID NO: 89153 - DNA, 25 bp, Homo sapien
tgcatatctgaagcggctcccagtc

SEQ ID NO: 89154 - DNA, 25 bp, Homo sapien
catccttgcacgttcgccaagcggg

SEQ ID NO: 89155 - DNA, 25 bp, Homo sapien
aggagggcctcgctacccgccagtt

SEQ ID NO: 89156 - DNA, 25 bp, Homo sapien
tcgctaggctcacaggtaatcctcc

SEQ ID NO: 89157 - DNA, 25 bp, Homo sapien
cattaccgggttcgctaggctcaca

SEQ ID NO: 89158 - DNA, 25 bp, Homo sapien
tcccagtccctgaaagcattaccgg

SEQ ID NO: 89159 - DNA, 25 bp, Homo sapien
tgcagctccctgcatatctgaagcg

SEQ ID NO: 89160 - DNA, 25 bp, Homo sapien
tggcccgtatcgtgaaggtgcagct

SEQ ID NO: 89161 - DNA, 25 bp, Homo sapien
cggcagacccgggactagcgccaaa

SEQ ID NO: 89162 - DNA, 25 bp, Homo sapien
cccggatagacttccgcgcaggggc

SEQ ID NO: 89163 - DNA, 25 bp, Homo sapien
cggcagcgcgtttaagtgacgtctt

SEQ ID NO: 89164 - DNA, 25 bp, Homo sapien
agcccagtgaccgttgcgtaagcca

SEQ ID NO: 89165 - DNA, 25 bp, Homo sapien
ggccgtacctacaacttctttcgca

SEQ ID NO: 89166 - DNA, 25 bp, Homo sapien
ggtgacgcgaaagcccggatagact

SEQ ID NO: 89167 - DNA, 25 bp, Homo sapien
ttaagtgacgtcttggctgtccgcg

SEQ ID NO: 89168 - DNA, 25 bp, Homo sapien
cggcctaccgcaaggaaacgatcgc

SEQ ID NO: 89169 - DNA, 25 bp, Homo sapien
gccacctccgaagttgcagcctctg

SEQ ID NO: 89170 - DNA, 25 bp, Homo sapien
tgctctcagtgctccggacccgaag

SEQ ID NO: 89171 - DNA, 25 bp, Homo sapien
cgccgggcctcatctagcggcccag

SEQ ID NO: 89172 - DNA, 25 bp, Homo sapien
ggaggaacccgccgggcctcatcta

SEQ ID NO: 89173 - DNA, 25 bp, Homo sapien
tcccaagcttgctcagtcccagccg

SEQ ID NO: 89174 - DNA, 25 bp, Homo sapien
gtcagccttcccaagcttgctcagt

SEQ ID NO: 89175 - DNA, 25 bp, Homo sapien
caggcagtcagccttcccaagcttg

SEQ ID NO: 89176 - DNA, 25 bp, Homo sapien
cagtgctccggacccgaagccgtcc

SEQ ID NO: 89177 - DNA, 25 bp, Homo sapien
ctccggagtaagcatgggttggtcc

SEQ ID NO: 89178 - DNA, 25 bp, Homo sapien
cgaccaggctccgtctgaacgatta

SEQ ID NO: 89179 - DNA, 25 bp, Homo sapien
cgttgactgcagataaacggtctca

SEQ ID NO: 89180 - DNA, 25 bp, Homo sapien
ttcccggagatgacgagacaccgcg

SEQ ID NO: 89181 - DNA, 25 bp, Homo sapien
ttcccggaaagcttacccagagagc

SEQ ID NO: 89182 - DNA, 25 bp, Homo sapien
accgcgcggtctttcagctgcttat

SEQ ID NO: 89183 - DNA, 25 bp, Homo sapien
ttacccttagtgtctctggggcctc

SEQ ID NO: 89184 - DNA, 25 bp, Homo sapien
gcccgtcaccgggtgtacaaacaga

SEQ ID NO: 89185 - DNA, 25 bp, Homo sapien
acgtcatgggccattccacgtgcgg

SEQ ID NO: 89186 - DNA, 25 bp, Homo sapien
cgccgcatctgattgagccgtggcc

SEQ ID NO: 89187 - DNA, 25 bp, Homo sapien
taaaatttcccaaacgccgcatctg

SEQ ID NO: 89188 - DNA, 25 bp, Homo sapien
ggaagcagcggctcctggaaacatc

SEQ ID NO: 89189 - DNA, 25 bp, Homo sapien
ctggtcccaggaaaatggccaggac

SEQ ID NO: 89190 - DNA, 25 bp, Homo sapien
ctatcaggctgaactggtcccagga

SEQ ID NO: 89191 - DNA, 25 bp, Homo sapien
ctcctggaaacatcgtaggcctcgc

SEQ ID NO: 89192 - DNA, 25 bp, Homo sapien
gcggccggcacttcagggctcacag

SEQ ID NO: 89193 - DNA, 25 bp, Homo sapien
cgatgcgccaggacggctgcacgaa

SEQ ID NO: 89194 - DNA, 25 bp, Homo sapien
gccaggacggctgcacgaactggtt

SEQ ID NO: 89195 - DNA, 25 bp, Homo sapien
ctgcacgaactggttggtgaggttg

SEQ ID NO: 89196 - DNA, 25 bp, Homo sapien
cacaggcagtcccagcgcggaaggg

SEQ ID NO: 89197 - DNA, 25 bp, Homo sapien
agaggttgccagcttggtccagcag

SEQ ID NO: 89198 - DNA, 25 bp, Homo sapien
ttgccagcttggtccagcagttgca

SEQ ID NO: 89199 - DNA, 25 bp, Homo sapien
gcttggtccagcagttgcagccacc

SEQ ID NO: 89200 - DNA, 25 bp, Homo sapien
cggtcaggttcacggcgtctgcacc

SEQ ID NO: 89201 - DNA, 25 bp, Homo sapien
agcgctccatttccgagttgtaatc

SEQ ID NO: 89202 - DNA, 25 bp, Homo sapien
ggcaaaggagcggtagcgctccatt

SEQ ID NO: 89203 - DNA, 25 bp, Homo sapien
taatccacaaggctgttcagagccc

SEQ ID NO: 89204 - DNA, 25 bp, Homo sapien
agtggctttccttgggcaagcccgg

SEQ ID NO: 89205 - DNA, 25 bp, Homo sapien
catttccgagttgtaatccacaagg

SEQ ID NO: 89206 - DNA, 25 bp, Homo sapien
gtgatgcgcgcgatcttggccgcct

SEQ ID NO: 89207 - DNA, 25 bp, Homo sapien
cggtggccgcgttgtcgcagttcca

SEQ ID NO: 89208 - DNA, 25 bp, Homo sapien
cgggcaagtggctttccttgggcaa

SEQ ID NO: 89209 - DNA, 25 bp, Homo sapien
gcgggccagcgctccttttcacaaa

SEQ ID NO: 89210 - DNA, 25 bp, Homo sapien
ctgcaaattacacggggaacaagag

SEQ ID NO: 89211 - DNA, 25 bp, Homo sapien
ttggctgcaaattacacggggaaca

SEQ ID NO: 89212 - DNA, 25 bp, Homo sapien
gacacctactgatgattggctgcaa

SEQ ID NO: 89213 - DNA, 25 bp, Homo sapien
ggacgtggacacctactgatgattg

SEQ ID NO: 89214 - DNA, 25 bp, Homo sapien
aggacgcagggacgtggacacctac

SEQ ID NO: 89215 - DNA, 25 bp, Homo sapien
ggcagaggagccacgttttccctgc

SEQ ID NO: 89216 - DNA, 25 bp, Homo sapien
acgttttccctgctcgcctgcggat

SEQ ID NO: 89217 - DNA, 25 bp, Homo sapien
gtgagggcagcccaggtctccactg

SEQ ID NO: 89218 - DNA, 25 bp, Homo sapien
ccgctcgcatgcaagtcacgtccgc

SEQ ID NO: 89219 - DNA, 25 bp, Homo sapien
ggtcccgctcgcatgcaagtcacgt

SEQ ID NO: 89220 - DNA, 25 bp, Homo sapien
tgcggggggctaattccctgggagc

SEQ ID NO: 89221 - DNA, 25 bp, Homo sapien
cactgcacggcgtgagggcagccca

SEQ ID NO: 89222 - DNA, 25 bp, Homo sapien
cagccctggcccctactccgcgctg

SEQ ID NO: 89223 - DNA, 25 bp, Homo sapien
aaccttcgcgcttgctctgcttctt

SEQ ID NO: 89224 - DNA, 25 bp, Homo sapien
cagcggcgagagcttgggcggccgc

SEQ ID NO: 89225 - DNA, 25 bp, Homo sapien
ttcttacgcctctaggaaggccggc

SEQ ID NO: 89226 - DNA, 25 bp, Homo sapien
tggcgtcaatgacggtcctgctgtg

SEQ ID NO: 89227 - DNA, 25 bp, Homo sapien
gcagcagcgcgctcatggcgtcaat

SEQ ID NO: 89228 - DNA, 25 bp, Homo sapien
ctcctcagtgtggtacagggccata

SEQ ID NO: 89229 - DNA, 25 bp, Homo sapien
tcctcactgagttgtgtgaaccggg

SEQ ID NO: 89230 - DNA, 25 bp, Homo sapien
agctcccgcagtaggaggtttctta

SEQ ID NO: 89231 - DNA, 25 bp, Homo sapien
ctggattaggcatccgcaaagttcc

SEQ ID NO: 89232 - DNA, 25 bp, Homo sapien
ctcggcgaacctccgggagctactt

SEQ ID NO: 89233 - DNA, 25 bp, Homo sapien
ccaggtccggacaggccgagatgac

SEQ ID NO: 89234 - DNA, 25 bp, Homo sapien
gttccacgtgttagtgacggcgccc

SEQ ID NO: 89235 - DNA, 25 bp, Homo sapien
cggtatctcccagttccacgtgtta

SEQ ID NO: 89236 - DNA, 25 bp, Homo sapien
ggagggcggtatctcccagttccac

SEQ ID NO: 89237 - DNA, 25 bp, Homo sapien
gtctgcctttgatacccacagcttc

SEQ ID NO: 89238 - DNA, 25 bp, Homo sapien
agtgtaaaccctttgtctgcctttg

SEQ ID NO: 89239 - DNA, 25 bp, Homo sapien
gcgccaggaatccagacggtgtttg

SEQ ID NO: 89240 - DNA, 25 bp, Homo sapien
ccgctaatggcgcaggcgattatct

SEQ ID NO: 89241 - DNA, 25 bp, Homo sapien
agcagtcagtctagggcacgcaacc

SEQ ID NO: 89242 - DNA, 25 bp, Homo sapien
cgcaaccgcccgtaaattatgattc

SEQ ID NO: 89243 - DNA, 25 bp, Homo sapien
tggccggctccgaaagcaggaaaac

SEQ ID NO: 89244 - DNA, 25 bp, Homo sapien
ccggtccgccggattatgaatgacg

SEQ ID NO: 89245 - DNA, 25 bp, Homo sapien
gccggcgcgagtattttccacataa

SEQ ID NO: 89246 - DNA, 25 bp, Homo sapien
cataaggtggctgtcgtttttctcc

SEQ ID NO: 89247 - DNA, 25 bp, Homo sapien
ggcagccttggaattccagctcgga

SEQ ID NO: 89248 - DNA, 25 bp, Homo sapien
ctgcgaccaggtaaagagggcgctc

SEQ ID NO: 89249 - DNA, 25 bp, Homo sapien
cgcgcctgaactagacggctcttca

SEQ ID NO: 89250 - DNA, 25 bp, Homo sapien
cggcgtgctgtgacaggttccaaca

SEQ ID NO: 89251 - DNA, 25 bp, Homo sapien
ggacccgctgcccaacatggatttt

SEQ ID NO: 89252 - DNA, 25 bp, Homo sapien
cacactcactgtcttgggtcacttt

SEQ ID NO: 89253 - DNA, 25 bp, Homo sapien
gaggtgacgcgcgaaacatccctta

SEQ ID NO: 89254 - DNA, 25 bp, Homo sapien
cggctcttcactggggaagcttcca

SEQ ID NO: 89255 - DNA, 25 bp, Homo sapien
gggcctctccatttggttttcttga

SEQ ID NO: 89256 - DNA, 25 bp, Homo sapien
tccatccagaagttgggccaccgca

SEQ ID NO: 89257 - DNA, 25 bp, Homo sapien
cacctgctgtagcggcggcaaaggc

SEQ ID NO: 89258 - DNA, 25 bp, Homo sapien
gaagcccatcgctgcgtttcctcgg

SEQ ID NO: 89259 - DNA, 25 bp, Homo sapien
cgtttcctcggtgtctgcgataaac

SEQ ID NO: 89260 - DNA, 25 bp, Homo sapien
acctgctgtagcggcggcaaaggcg

SEQ ID NO: 89261 - DNA, 25 bp, Homo sapien
tgtgcacctgctgtagcggcggcaa

SEQ ID NO: 89262 - DNA, 25 bp, Homo sapien
acgtggtggggtgtgcacctgctgt

SEQ ID NO: 89263 - DNA, 25 bp, Homo sapien
gtgcacctgctgtagcggcggcaaa

SEQ ID NO: 89264 - DNA, 25 bp, Homo sapien
gtttcctcggtgtctgcgataaacg

SEQ ID NO: 89265 - DNA, 25 bp, Homo sapien
tctcggcggtttaactctcctctta

SEQ ID NO: 89266 - DNA, 25 bp, Homo sapien
ccagtccttggtacatgcccgcaga

SEQ ID NO: 89267 - DNA, 25 bp, Homo sapien
gggcttgcagattgtgttccctcaa

SEQ ID NO: 89268 - DNA, 25 bp, Homo sapien
cttaattgatcaggaggcccgcatc

SEQ ID NO: 89269 - DNA, 25 bp, Homo sapien
ggggacccaggaccctatgaactca

SEQ ID NO: 89270 - DNA, 25 bp, Homo sapien
cccggaccgaatcctcgagatctga

SEQ ID NO: 89271 - DNA, 25 bp, Homo sapien
gtctcacgcctcaggacagaaatta

SEQ ID NO: 89272 - DNA, 25 bp, Homo sapien
cgcgaactgccgatctgtgagctct

SEQ ID NO: 89273 - DNA, 25 bp, Homo sapien
cggcaccgagcctagctctgagcta

SEQ ID NO: 89274 - DNA, 25 bp, Homo sapien
tgcgcgttattgctcagtttgactt

SEQ ID NO: 89275 - DNA, 25 bp, Homo sapien
ccagcttacccagttctgcgcgtta

SEQ ID NO: 89276 - DNA, 25 bp, Homo sapien
ggaggtttcagcaagcgccagttca

SEQ ID NO: 89277 - DNA, 25 bp, Homo sapien
caggtttcagcacccggaggtttca

SEQ ID NO: 89278 - DNA, 25 bp, Homo sapien
gcctggaatgcagtcgtggaacctc

SEQ ID NO: 89279 - DNA, 25 bp, Homo sapien
ggaagctcctgtttctgcagccgca

SEQ ID NO: 89280 - DNA, 25 bp, Homo sapien
tgactttcttgcacaggctcccggg

SEQ ID NO: 89281 - DNA, 25 bp, Homo sapien
acgggtgagtcactgtttggaaatg

SEQ ID NO: 89282 - DNA, 25 bp, Homo sapien
ccctggccaccagcgggtaaggagc

SEQ ID NO: 89283 - DNA, 25 bp, Homo sapien
tcttcttaagaagtcgcgcaggttt

SEQ ID NO: 89284 - DNA, 25 bp, Homo sapien
gcgcaggtttttcgagctccactct

SEQ ID NO: 89285 - DNA, 25 bp, Homo sapien
agcaggaacgggcactgctgccacc

SEQ ID NO: 89286 - DNA, 25 bp, Homo sapien
atgaatgatgtcaagagcgcgctgg

SEQ ID NO: 89287 - DNA, 25 bp, Homo sapien
gagcaaactttctagcggcttcggc

SEQ ID NO: 89288 - DNA, 25 bp, Homo sapien
ccttcccgggagcaagtgccttcag

SEQ ID NO: 89289 - DNA, 25 bp, Homo sapien
tgggcaacttcggtcacgtgctgct

SEQ ID NO: 89290 - DNA, 25 bp, Homo sapien
cagcaggccgaggtcttcagcgacc

SEQ ID NO: 89291 - DNA, 25 bp, Homo sapien
ggtcctcagcgacttccacagcgtg

SEQ ID NO: 89292 - DNA, 25 bp, Homo sapien
gcagcatcttcagcttctttatcgg

SEQ ID NO: 89293 - DNA, 25 bp, Homo sapien
tagcccgcgtgtacggcagcatctt

SEQ ID NO: 89294 - DNA, 25 bp, Homo sapien
ttgatccctcggtcataggcccgca

SEQ ID NO: 89295 - DNA, 25 bp, Homo sapien
accagggccgcagggattgatccct

SEQ ID NO: 89296 - DNA, 25 bp, Homo sapien
cgctcatctccatcgtgaccaagga

SEQ ID NO: 89297 - DNA, 25 bp, Homo sapien
atcgtcaagcacgtgacggtcatcg

SEQ ID NO: 89298 - DNA, 25 bp, Homo sapien
aggtcccgctgctcagcaggtctca

SEQ ID NO: 89299 - DNA, 25 bp, Homo sapien
cgtgtatacccgctcaacgctggga

SEQ ID NO: 89300 - DNA, 25 bp, Homo sapien
ctgggacgttacagccagggccaat

SEQ ID NO: 89301 - DNA, 25 bp, Homo sapien
ggccttcgtcaccaggcagttcatg

SEQ ID NO: 89302 - DNA, 25 bp, Homo sapien
ggcctcggccaagaagataatcgtc

SEQ ID NO: 89303 - DNA, 25 bp, Homo sapien
gcctcccgggtgtagttgaaatatc

SEQ ID NO: 89304 - DNA, 25 bp, Homo sapien
agttcatgcgttccgtgtcctcctc

SEQ ID NO: 89305 - DNA, 25 bp, Homo sapien
cccggatgccgacttagtagtttgt

SEQ ID NO: 89306 - DNA, 25 bp, Homo sapien
gcggaaaccctctccactgtagtta

SEQ ID NO: 89307 - DNA, 25 bp, Homo sapien
gctctgtaatctccgctccgctgtg

SEQ ID NO: 89308 - DNA, 25 bp, Homo sapien
gtccttgaaggggatcatctcgtcc

SEQ ID NO: 89309 - DNA, 25 bp, Homo sapien
atcgccttcctcttcgggatgactg

SEQ ID NO: 89310 - DNA, 25 bp, Homo sapien
cttgatgtcagctaaatcgccttcc

SEQ ID NO: 89311 - DNA, 25 bp, Homo sapien
gccgggatgatttcagactcgttca

SEQ ID NO: 89312 - DNA, 25 bp, Homo sapien
acccacgctggagatgtccgtttta

SEQ ID NO: 89313 - DNA, 25 bp, Homo sapien
gcaagttgttcgtgtgaactcgagc

SEQ ID NO: 89314 - DNA, 25 bp, Homo sapien
cgggcggtcttttctaattcgtgtg

SEQ ID NO: 89315 - DNA, 25 bp, Homo sapien
ctcccttacggattcagtgtagttc

SEQ ID NO: 89316 - DNA, 25 bp, Homo sapien
tgatattaacataagcagccgcctc

SEQ ID NO: 89317 - DNA, 25 bp, Homo sapien
ataagcagccgcctcttcgggtgcg

SEQ ID NO: 89318 - DNA, 25 bp, Homo sapien
ctcggatgttagaggcaagttgttc

SEQ ID NO: 89319 - DNA, 25 bp, Homo sapien
taagcaattctgtcaccgggcggtc

SEQ ID NO: 89320 - DNA, 25 bp, Homo sapien
gtagttcctggcataagcaattctg

SEQ ID NO: 89321 - DNA, 25 bp, Homo sapien
cttcacccggagacgaaagctgtgg

SEQ ID NO: 89322 - DNA, 25 bp, Homo sapien
ctgtgggcatcttcagtttaacgga

SEQ ID NO: 89323 - DNA, 25 bp, Homo sapien
gcacacgtcctaaggctgcccaagg

SEQ ID NO: 89324 - DNA, 25 bp, Homo sapien
cccacgcacggggaatgcctagaac

SEQ ID NO: 89325 - DNA, 25 bp, Homo sapien
agctggagtcattttgcgggccaca

SEQ ID NO: 89326 - DNA, 25 bp, Homo sapien
ggactctctcccagctacgactttg

SEQ ID NO: 89327 - DNA, 25 bp, Homo sapien
taatgtgactccagaggcggaaccc

SEQ ID NO: 89328 - DNA, 25 bp, Homo sapien
gggccacaggactgctcatttcgtg

SEQ ID NO: 89329 - DNA, 25 bp, Homo sapien
ccttatatgggcacgttcgggtgct

SEQ ID NO: 89330 - DNA, 25 bp, Homo sapien
atgggtgacgtgtgcccgcagactc

SEQ ID NO: 89331 - DNA, 25 bp, Homo sapien
ccgcagactcatgcccgccatgttc

SEQ ID NO: 89332 - DNA, 25 bp, Homo sapien
cgccatgttccaggatccgggcaca

SEQ ID NO: 89333 - DNA, 25 bp, Homo sapien
ccctttgggcgtgttgaccactcag

SEQ ID NO: 89334 - DNA, 25 bp, Homo sapien
ggcgtgttgaccactcaggattgtc

SEQ ID NO: 89335 - DNA, 25 bp, Homo sapien
cactcaggattgtccgcgctgtgtc

SEQ ID NO: 89336 - DNA, 25 bp, Homo sapien
gctgtgtccaccagtcctgaggctt

SEQ ID NO: 89337 - DNA, 25 bp, Homo sapien
gctttacggatctgcgggtcctttc

SEQ ID NO: 89338 - DNA, 25 bp, Homo sapien
atcaccggaggtaactcgggctgtc

SEQ ID NO: 89339 - DNA, 25 bp, Homo sapien
ggtggtggtgtcttacttcctcatc

SEQ ID NO: 89340 - DNA, 25 bp, Homo sapien
agtgctcgaatgtcccaacctgaag

SEQ ID NO: 89341 - DNA, 25 bp, Homo sapien
tgctgccaccaacatggagactttg

SEQ ID NO: 89342 - DNA, 25 bp, Homo sapien
ccgtcggccatgactgtgtatgctc

SEQ ID NO: 89343 - DNA, 25 bp, Homo sapien
accgtgtcccgttcttagtgctcga

SEQ ID NO: 89344 - DNA, 25 bp, Homo sapien
aagaagccgccctggttgcacatgc

SEQ ID NO: 89345 - DNA, 25 bp, Homo sapien
agcgctagttcagcggcgggttaca

SEQ ID NO: 89346 - DNA, 25 bp, Homo sapien
tacccaagctcaggtgggacgactg

SEQ ID NO: 89347 - DNA, 25 bp, Homo sapien
tgcgcccggccaagtcgtaaatctc

SEQ ID NO: 89348 - DNA, 25 bp, Homo sapien
ctggacacagaagcgctagttcagc

SEQ ID NO: 89349 - DNA, 25 bp, Homo sapien
ttggctccgcgtgagagacgttcct

SEQ ID NO: 89350 - DNA, 25 bp, Homo sapien
acgttcctcggcgacgccatagagg

SEQ ID NO: 89351 - DNA, 25 bp, Homo sapien
cctgttcgcgcagagtctggccttt

SEQ ID NO: 89352 - DNA, 25 bp, Homo sapien
tcctcgtagcttacaggcgacggcg

SEQ ID NO: 89353 - DNA, 25 bp, Homo sapien
gttatccctcctggcgttctcttgc

SEQ ID NO: 89354 - DNA, 25 bp, Homo sapien
cggtggcgtcaactagctaggatca

SEQ ID NO: 89355 - DNA, 25 bp, Homo sapien
cagagtgtcccgcttactgtacagc

SEQ ID NO: 89356 - DNA, 25 bp, Homo sapien
agggtgcccttacccgatgtgcttc

SEQ ID NO: 89357 - DNA, 25 bp, Homo sapien
tctgcacttacttccgggccagggt

SEQ ID NO: 89358 - DNA, 25 bp, Homo sapien
tctccaccttctgcactcgttattg

SEQ ID NO: 89359 - DNA, 25 bp, Homo sapien
gctgcagcgcatcgtttgttcccta

SEQ ID NO: 89360 - DNA, 25 bp, Homo sapien
ccttttaagtctggctctggcgttg

SEQ ID NO: 89361 - DNA, 25 bp, Homo sapien
aggtcgattcctccaaagttcagtc

SEQ ID NO: 89362 - DNA, 25 bp, Homo sapien
acaactagttggtggagtcaagccc

SEQ ID NO: 89363 - DNA, 25 bp, Homo sapien
ctggaagtgaaaagcaccctccgtc

SEQ ID NO: 89364 - DNA, 25 bp, Homo sapien
cgcctctgtgagtttgccttatttc

SEQ ID NO: 89365 - DNA, 25 bp, Homo sapien
tacctactcggtgtctttcggcacg

SEQ ID NO: 89366 - DNA, 25 bp, Homo sapien
gcgtgcgcgatccttaaataccctt

SEQ ID NO: 89367 - DNA, 25 bp, Homo sapien
gcaggagcccgccttattatcataa

SEQ ID NO: 89368 - DNA, 25 bp, Homo sapien
tcaagcccacgagcggatacggacc

SEQ ID NO: 89369 - DNA, 25 bp, Homo sapien
ctcgcggagaagcttgggtacctga

SEQ ID NO: 89370 - DNA, 25 bp, Homo sapien
atcaacccgcggctctcaagttccc

SEQ ID NO: 89371 - DNA, 25 bp, Homo sapien
tctgccctaggtggaagcgggccac

SEQ ID NO: 89372 - DNA, 25 bp, Homo sapien
ttcacccactgaggcccagtccttt

SEQ ID NO: 89373 - DNA, 25 bp, Homo sapien
cagtcctttcgcctcaacacgaagg

SEQ ID NO: 89374 - DNA, 25 bp, Homo sapien
ttcgcctcaacacgaaggcacctgg

SEQ ID NO: 89375 - DNA, 25 bp, Homo sapien
cagcgctggactcgcggagaagctt

SEQ ID NO: 89376 - DNA, 25 bp, Homo sapien
gtcgcctgagctccgaacatcaacc

SEQ ID NO: 89377 - DNA, 25 bp, Homo sapien
tgtttatgtaatgcgaccccaggcc

SEQ ID NO: 89378 - DNA, 25 bp, Homo sapien
ccttggctgcgagagctggccagaa

SEQ ID NO: 89379 - DNA, 25 bp, Homo sapien
cagttacctagcctggacgcgggcg

SEQ ID NO: 89380 - DNA, 25 bp, Homo sapien
aacccagttacctagcctggacgcg

SEQ ID NO: 89381 - DNA, 25 bp, Homo sapien
tgaaaagctgggagcccacgtagta

SEQ ID NO: 89382 - DNA, 25 bp, Homo sapien
ggcgactgaaaagctgggagcccac

SEQ ID NO: 89383 - DNA, 25 bp, Homo sapien
cctcgggcgagtaggggcgactgaa

SEQ ID NO: 89384 - DNA, 25 bp, Homo sapien
tggccagaagccgaggccgctgagt

SEQ ID NO: 89385 - DNA, 25 bp, Homo sapien
agtcaactgcgttttgctggctgcc

SEQ ID NO: 89386 - DNA, 25 bp, Homo sapien
accaccagacttcggcctgggagca

SEQ ID NO: 89387 - DNA, 25 bp, Homo sapien
tctccaagctcggtggggaaaacaa

SEQ ID NO: 89388 - DNA, 25 bp, Homo sapien
gagcacgcagcaccgggaattaaca

SEQ ID NO: 89389 - DNA, 25 bp, Homo sapien
tgaaatctagagctcgcaaggtgtg

SEQ ID NO: 89390 - DNA, 25 bp, Homo sapien
gcccggatgcgtagagagccgacaa

SEQ ID NO: 89391 - DNA, 25 bp, Homo sapien
tccagatgccggacgctgttttcgt

SEQ ID NO: 89392 - DNA, 25 bp, Homo sapien
cgttggacaactttggcgggagcaa

SEQ ID NO: 89393 - DNA, 25 bp, Homo sapien
cctgagcgcttcaatccaagagtgc

SEQ ID NO: 89394 - DNA, 25 bp, Homo sapien
tcgggctggtccttcccagagttaa

SEQ ID NO: 89395 - DNA, 25 bp, Homo sapien
cgaggccgagctcattgcagccaaa

SEQ ID NO: 89396 - DNA, 25 bp, Homo sapien
aagagtgcaacttctccaggccgcc

SEQ ID NO: 89397 - DNA, 25 bp, Homo sapien
tcttagactgaagcgcgaaaccgtc

SEQ ID NO: 89398 - DNA, 25 bp, Homo sapien
ccaacatttcaaacggccaggtgtg

SEQ ID NO: 89399 - DNA, 25 bp, Homo sapien
gttttcattatgactcggcggaaca

SEQ ID NO: 89400 - DNA, 25 bp, Homo sapien
aggccgccctgcaaagccgaaggaa

SEQ ID NO: 89401 - DNA, 25 bp, Homo sapien
ggcgcgagagcagggccatgcgcgc

SEQ ID NO: 89402 - DNA, 25 bp, Homo sapien
ggagcacggcgcgtcagcggcgcac

SEQ ID NO: 89403 - DNA, 25 bp, Homo sapien
gcccgctcacctggaccagcgcgcc

SEQ ID NO: 89404 - DNA, 25 bp, Homo sapien
atctcgctgtctttacgtgaaccgc

SEQ ID NO: 89405 - DNA, 25 bp, Homo sapien
caggatctcgctgtctttacgtgaa

SEQ ID NO: 89406 - DNA, 25 bp, Homo sapien
aaagcacgagccctcgctgggcccg

SEQ ID NO: 89407 - DNA, 25 bp, Homo sapien
ctcaggatctcgctgtctttacgtg

SEQ ID NO: 89408 - DNA, 25 bp, Homo sapien
ggccctcaggatctcgctgtcttta

SEQ ID NO: 89409 - DNA, 25 bp, Homo sapien
aacgccgttccggatggtcttcagg

SEQ ID NO: 89410 - DNA, 25 bp, Homo sapien
atgaacgccgttccggatggtcttc

SEQ ID NO: 89411 - DNA, 25 bp, Homo sapien
gtgtctatcttatgaacgccgttcc

SEQ ID NO: 89412 - DNA, 25 bp, Homo sapien
caggtacgtgtctatcttatgaacg

SEQ ID NO: 89413 - DNA, 25 bp, Homo sapien
cggcgttcaggtacgtgtctatctt

SEQ ID NO: 89414 - DNA, 25 bp, Homo sapien
ccgtcactgcatttatactggcaga

SEQ ID NO: 89415 - DNA, 25 bp, Homo sapien
tcgcctcccaggaggtccaaggcgg

SEQ ID NO: 89416 - DNA, 25 bp, Homo sapien
ctgcatttatactggcagagaccgt

SEQ ID NO: 89417 - DNA, 25 bp, Homo sapien
tagaagccggaggatttgaaaatgc

SEQ ID NO: 89418 - DNA, 25 bp, Homo sapien
tttgaaaatgctggacgtggaaccc

SEQ ID NO: 89419 - DNA, 25 bp, Homo sapien
atgctggacgtggaacccaactgcc

SEQ ID NO: 89420 - DNA, 25 bp, Homo sapien
ctggacgtggaacccaactgccgga

SEQ ID NO: 89421 - DNA, 25 bp, Homo sapien
cggtgcgaagaccttgctgtctgta

SEQ ID NO: 89422 - DNA, 25 bp, Homo sapien
tctgtagggggaggagatactaatc

SEQ ID NO: 89423 - DNA, 25 bp, Homo sapien
agatactaatcatggggcggcaagg

SEQ ID NO: 89424 - DNA, 25 bp, Homo sapien
cggtaaccgaggaggttccagcgcg

SEQ ID NO: 89425 - DNA, 25 bp, Homo sapien
tgaactttacagatcgccagacccg

SEQ ID NO: 89426 - DNA, 25 bp, Homo sapien
gtgcgttgggcttgaactttacaga

SEQ ID NO: 89427 - DNA, 25 bp, Homo sapien
ttctggtttccagttgaagagggca

SEQ ID NO: 89428 - DNA, 25 bp, Homo sapien
gcagccgccgcaaatggccattggg

SEQ ID NO: 89429 - DNA, 25 bp, Homo sapien
ctgcggtctcgacccttagtgtcca

SEQ ID NO: 89430 - DNA, 25 bp, Homo sapien
aacgccgaggtctatctgcggtctc

SEQ ID NO: 89431 - DNA, 25 bp, Homo sapien
tgacaaacatgtgcggagaagaccc

SEQ ID NO: 89432 - DNA, 25 bp, Homo sapien
gccggctggaggatatgacaaacat

SEQ ID NO: 89433 - DNA, 25 bp, Homo sapien
tccaccatcgatgtgggcggccaga

SEQ ID NO: 89434 - DNA, 25 bp, Homo sapien
cgacggctcctacctcaataagctg

SEQ ID NO: 89435 - DNA, 25 bp, Homo sapien
ccagaagtttgtggtgctgcccacg

SEQ ID NO: 89436 - DNA, 25 bp, Homo sapien
ggggaccacgtccttccagtgcaag

SEQ ID NO: 89437 - DNA, 25 bp, Homo sapien
cacctacaaggtggatgtgatccgt

SEQ ID NO: 89438 - DNA, 25 bp, Homo sapien
ggcaaatacacctgccgcgtgtcga

SEQ ID NO: 89439 - DNA, 25 bp, Homo sapien
tggcgccaacaccatgggctacagc

SEQ ID NO: 89440 - DNA, 25 bp, Homo sapien
gcatgtacatctgccttggcgccaa

SEQ ID NO: 89441 - DNA, 25 bp, Homo sapien
tactcgtctacagggaaatctcctc

SEQ ID NO: 89442 - DNA, 25 bp, Homo sapien
tccgcatccaccgtaggaggaaatg

SEQ ID NO: 89443 - DNA, 25 bp, Homo sapien
aagcgcttgatttcgagtgttctcc

SEQ ID NO: 89444 - DNA, 25 bp, Homo sapien
cctcgtgcgatttgagaaattaacc

SEQ ID NO: 89445 - DNA, 25 bp, Homo sapien
gccgccttgctttgaatgaagtttc

SEQ ID NO: 89446 - DNA, 25 bp, Homo sapien
tcaggcgaaagcatcacgtaccagt

SEQ ID NO: 89447 - DNA, 25 bp, Homo sapien
actgacatgttcattggggctgatc

SEQ ID NO: 89448 - DNA, 25 bp, Homo sapien
tcggagtcgctacgtgttctctata

SEQ ID NO: 89449 - DNA, 25 bp, Homo sapien
caaaaagcaggagtacgtggtggtc

SEQ ID NO: 89450 - DNA, 25 bp, Homo sapien
caagtccggaggtgtttcgagtaca

SEQ ID NO: 89451 - DNA, 25 bp, Homo sapien
ctgcacctccgggagaccaggatca

SEQ ID NO: 89452 - DNA, 25 bp, Homo sapien
ggaggaggacacctacacgggcacc

SEQ ID NO: 89453 - DNA, 25 bp, Homo sapien
gtccactacgacctgcacgtgaagc

SEQ ID NO: 89454 - DNA, 25 bp, Homo sapien
tttcgactgccggacttcgtcaacc

SEQ ID NO: 89455 - DNA, 25 bp, Homo sapien
gagcggacagtggaaaaactttcga

SEQ ID NO: 89456 - DNA, 25 bp, Homo sapien
ggcttgaccagatcgtgtgactcca

SEQ ID NO: 89457 - DNA, 25 bp, Homo sapien
acaggcagcctcatgcgggtgccca

SEQ ID NO: 89458 - DNA, 25 bp, Homo sapien
ctggcagccttgacagcatcgaact

SEQ ID NO: 89459 - DNA, 25 bp, Homo sapien
gcccgcctgttctcaggattccgtg

SEQ ID NO: 89460 - DNA, 25 bp, Homo sapien
tcgggctagtgcctcctccaggtca

SEQ ID NO: 89461 - DNA, 25 bp, Homo sapien
tctcaaaataaatggcgcacttggc

SEQ ID NO: 89462 - DNA, 25 bp, Homo sapien
ctgggttccgcccaccgagatttct

SEQ ID NO: 89463 - DNA, 25 bp, Homo sapien
cctcgaggaccttgcggagcagcca

SEQ ID NO: 89464 - DNA, 25 bp, Homo sapien
ccgttccctctaggatgcaggagca

SEQ ID NO: 89465 - DNA, 25 bp, Homo sapien
tcctagtgcctctgaaaataccgtc

SEQ ID NO: 89466 - DNA, 25 bp, Homo sapien
ggtcctggtcacctgtccaaacatc

SEQ ID NO: 89467 - DNA, 25 bp, Homo sapien
ttcatgggtccaaaaggtcctggtc

SEQ ID NO: 89468 - DNA, 25 bp, Homo sapien
ggctgcgtggtacccacggaattca

SEQ ID NO: 89469 - DNA, 25 bp, Homo sapien
ctgcacctcgggtcgttctaaggga

SEQ ID NO: 89470 - DNA, 25 bp, Homo sapien
ggtttagacggccaatgaagtccta

SEQ ID NO: 89471 - DNA, 25 bp, Homo sapien
ttcagtcaatggaaagcggtagggc

SEQ ID NO: 89472 - DNA, 25 bp, Homo sapien
gcaaacttctagtgcccgggccaag

SEQ ID NO: 89473 - DNA, 25 bp, Homo sapien
catccggcaaggtcctaggatcccg

SEQ ID NO: 89474 - DNA, 25 bp, Homo sapien
ccggtccactgcatactggcaagca

SEQ ID NO: 89475 - DNA, 25 bp, Homo sapien
gtgctgctttgctttcagtctcagg

SEQ ID NO: 89476 - DNA, 25 bp, Homo sapien
cgtagccgaagctggagtgctgctt

SEQ ID NO: 89477 - DNA, 25 bp, Homo sapien
ggttctgcacgctggcgtagccgaa

SEQ ID NO: 89478 - DNA, 25 bp, Homo sapien
catactggcaagcactcaggttgga

SEQ ID NO: 89479 - DNA, 25 bp, Homo sapien
acacgggccggtccactgcatactg

SEQ ID NO: 89480 - DNA, 25 bp, Homo sapien
gctcgagttacacgtgtccctataa

SEQ ID NO: 89481 - DNA, 25 bp, Homo sapien
taccagggccagctttcagttactg

SEQ ID NO: 89482 - DNA, 25 bp, Homo sapien
ccgaacgcatggagacctgcggacg

SEQ ID NO: 89483 - DNA, 25 bp, Homo sapien
caaacctcagccgaacgcatggaga

SEQ ID NO: 89484 - DNA, 25 bp, Homo sapien
gactcggagctacgccacaaacctc

SEQ ID NO: 89485 - DNA, 25 bp, Homo sapien
acctggtctgctctggcctgcgagc

SEQ ID NO: 89486 - DNA, 25 bp, Homo sapien
caagcgcaggagacctggtctgctc

SEQ ID NO: 89487 - DNA, 25 bp, Homo sapien
gctttcagttactggcccgggtctc

SEQ ID NO: 89488 - DNA, 25 bp, Homo sapien
tccaccaagcgcaggagacctggtc

SEQ ID NO: 89489 - DNA, 25 bp, Homo sapien
ctgcagcggcacattcacttttata

SEQ ID NO: 89490 - DNA, 25 bp, Homo sapien
gagcgcgacgctctactagtccttg

SEQ ID NO: 89491 - DNA, 25 bp, Homo sapien
aagcgggcctttcatgcagttcatg

SEQ ID NO: 89492 - DNA, 25 bp, Homo sapien
tgcggggtagtcaaaattccggctc

SEQ ID NO: 89493 - DNA, 25 bp, Homo sapien
cggcagaattgctcgcgcccttagc

SEQ ID NO: 89494 - DNA, 25 bp, Homo sapien
tctgaaggtcctcgaatcaagatgc

SEQ ID NO: 89495 - DNA, 25 bp, Homo sapien
caggcaatttcctaacgagtggagc

SEQ ID NO: 89496 - DNA, 25 bp, Homo sapien
gcctcttcgcgaagggcatttctga

SEQ ID NO: 89497 - DNA, 25 bp, Homo sapien
gccgctctaacaactgctgcatata

SEQ ID NO: 89498 - DNA, 25 bp, Homo sapien
cgcagggactgactactttcggaca

SEQ ID NO: 89499 - DNA, 25 bp, Homo sapien
acgcgacctgtgaagaccacttttg

SEQ ID NO: 89500 - DNA, 25 bp, Homo sapien
gtcagcagcgaggaacgcgacctgt

SEQ ID NO: 89501 - DNA, 25 bp, Homo sapien
agaaactttgtgtaccgagtcagca

SEQ ID NO: 89502 - DNA, 25 bp, Homo sapien
ggaataacagccgaaccagccttaa

SEQ ID NO: 89503 - DNA, 25 bp, Homo sapien
tgcatatattagcagcgggcggtga

SEQ ID NO: 89504 - DNA, 25 bp, Homo sapien
cggggcacctttcaagtgagctgca

SEQ ID NO: 89505 - DNA, 25 bp, Homo sapien
aggtcgctgttggaccacttttcca

SEQ ID NO: 89506 - DNA, 25 bp, Homo sapien
cactggcgatttggttctgatttcc

SEQ ID NO: 89507 - DNA, 25 bp, Homo sapien
agagacattcaacggccgccggctg

SEQ ID NO: 89508 - DNA, 25 bp, Homo sapien
ggctgcctcttttcggctctcagga

SEQ ID NO: 89509 - DNA, 25 bp, Homo sapien
ggaagaacttgctgctggctgcctc

SEQ ID NO: 89510 - DNA, 25 bp, Homo sapien
cggccttaccattggcgccaggatg

SEQ ID NO: 89511 - DNA, 25 bp, Homo sapien
ccagaggcggagtgtctaagttcaa

SEQ ID NO: 89512 - DNA, 25 bp, Homo sapien
tctaagttcaagcagcaggcgcgtc

SEQ ID NO: 89513 - DNA, 25 bp, Homo sapien
ctctggccaaggtcgctgcctacag

SEQ ID NO: 89514 - DNA, 25 bp, Homo sapien
cctgcctctggcctgagtaccgttt

SEQ ID NO: 89515 - DNA, 25 bp, Homo sapien
ggggactctgccgattcgatccttg

SEQ ID NO: 89516 - DNA, 25 bp, Homo sapien
tgagtaccgtttccctgcgtctcgg

SEQ ID NO: 89517 - DNA, 25 bp, Homo sapien
aacgcagcgagccaagcatttaacg

SEQ ID NO: 89518 - DNA, 25 bp, Homo sapien
gttttcaaccacaacgcagcgagcc

SEQ ID NO: 89519 - DNA, 25 bp, Homo sapien
cgggcgagccaaatctttttcacgt

SEQ ID NO: 89520 - DNA, 25 bp, Homo sapien
agagccgcggttgctttaaagacaa

SEQ ID NO: 89521 - DNA, 25 bp, Homo sapien
tggttttcccacctgcgcagtagga

SEQ ID NO: 89522 - DNA, 25 bp, Homo sapien
actgaacaggccgtgctggaccgtc

SEQ ID NO: 89523 - DNA, 25 bp, Homo sapien
ataaaaaatctgtccgcgagcgggc

SEQ ID NO: 89524 - DNA, 25 bp, Homo sapien
tggggcagggagaccttatttacac

SEQ ID NO: 89525 - DNA, 25 bp, Homo sapien
tattgacagacacaacacgtatgta

SEQ ID NO: 89526 - DNA, 25 bp, Homo sapien
acacgtatgtatgtgcgtcgcagca

SEQ ID NO: 89527 - DNA, 25 bp, Homo sapien
ccggacgctcatgatcccagggata

SEQ ID NO: 89528 - DNA, 25 bp, Homo sapien
agccagggcacaggaggcaccatgt

SEQ ID NO: 89529 - DNA, 25 bp, Homo sapien
ccatcttacccggtcagcaggaggg

SEQ ID NO: 89530 - DNA, 25 bp, Homo sapien
cgtccgagtgccctcccagccaccc

SEQ ID NO: 89531 - DNA, 25 bp, Homo sapien
tgcattcagcaaagcgtgaggccca

SEQ ID NO: 89532 - DNA, 25 bp, Homo sapien
tcgtgcattcagcaaagcgtgaggc

SEQ ID NO: 89533 - DNA, 25 bp, Homo sapien
ccctcgtgcattcagcaaagcgtga

SEQ ID NO: 89534 - DNA, 25 bp, Homo sapien
tccgttagcctcgtaagaaaaggca

SEQ ID NO: 89535 - DNA, 25 bp, Homo sapien
atcttacccggtcagcaggaggggt

SEQ ID NO: 89536 - DNA, 25 bp, Homo sapien
tgctggcgtgcagcgcgcttcctga

SEQ ID NO: 89537 - DNA, 25 bp, Homo sapien
cgccgcagacactgcgctgagcttt

SEQ ID NO: 89538 - DNA, 25 bp, Homo sapien
ttcagaggtttgcaaaccagggctg

SEQ ID NO: 89539 - DNA, 25 bp, Homo sapien
ctgagcttttgggtcctcgccttgc

SEQ ID NO: 89540 - DNA, 25 bp, Homo sapien
aaagatacgcgcgtgcaactccctc

SEQ ID NO: 89541 - DNA, 25 bp, Homo sapien
ggctcgggaagctcacgttcctctc

SEQ ID NO: 89542 - DNA, 25 bp, Homo sapien
tgcgctgaaaagacgcaaagatacg

SEQ ID NO: 89543 - DNA, 25 bp, Homo sapien
ttctgtctggagtctcgcccgccag

SEQ ID NO: 89544 - DNA, 25 bp, Homo sapien
ccctttcaggtttcagaggtttgca

SEQ ID NO: 89545 - DNA, 25 bp, Homo sapien
gtttccgagcccacacctagcgtgt

SEQ ID NO: 89546 - DNA, 25 bp, Homo sapien
ggctggtacttcaggcgcccaggcc

SEQ ID NO: 89547 - DNA, 25 bp, Homo sapien
gcgtccggcagaggattctcaggct

SEQ ID NO: 89548 - DNA, 25 bp, Homo sapien
gggctcggaggaaatgccctccata

SEQ ID NO: 89549 - DNA, 25 bp, Homo sapien
gtgccctgcgccaggtttaggagac

SEQ ID NO: 89550 - DNA, 25 bp, Homo sapien
ccctccatagcggtgatttatttaa

SEQ ID NO: 89551 - DNA, 25 bp, Homo sapien
agcctcacttgtaaacacttctttt

SEQ ID NO: 89552 - DNA, 25 bp, Homo sapien
tctttttcaacttcgagtccgtgcc

SEQ ID NO: 89553 - DNA, 25 bp, Homo sapien
agagccctgctacactcactgctta

SEQ ID NO: 89554 - DNA, 25 bp, Homo sapien
ctgcttagcagacgtcagactggtg

SEQ ID NO: 89555 - DNA, 25 bp, Homo sapien
tggacgcagtgcttcggactgcttc

SEQ ID NO: 89556 - DNA, 25 bp, Homo sapien
ctttgttccctagcgcctcgtcttt

SEQ ID NO: 89557 - DNA, 25 bp, Homo sapien
gccgctggagtaaacactgcctttg

SEQ ID NO: 89558 - DNA, 25 bp, Homo sapien
gtccgcacgcaggaattgaaccgtc

SEQ ID NO: 89559 - DNA, 25 bp, Homo sapien
ttcctagtcaggtcaaggtccaaca

SEQ ID NO: 89560 - DNA, 25 bp, Homo sapien
acgaggatgcccgaaactgcaatga

SEQ ID NO: 89561 - DNA, 25 bp, Homo sapien
cgcggaggttttcaggctccgcccg

SEQ ID NO: 89562 - DNA, 25 bp, Homo sapien
ctctcccggctcagagcgaggggaa

SEQ ID NO: 89563 - DNA, 25 bp, Homo sapien
tggtgcgcggtacaccgacccggac

SEQ ID NO: 89564 - DNA, 25 bp, Homo sapien
ttcctctcgaggtgacccggcagct

SEQ ID NO: 89565 - DNA, 25 bp, Homo sapien
cctttgtaaagagcgcagcggtggc

SEQ ID NO: 89566 - DNA, 25 bp, Homo sapien
aaccgagccagggaccagtgaccgc

SEQ ID NO: 89567 - DNA, 25 bp, Homo sapien
tcctccgcgcgggtaagtgtgagcc

SEQ ID NO: 89568 - DNA, 25 bp, Homo sapien
tcagttctctggcagggtttggtgc

SEQ ID NO: 89569 - DNA, 25 bp, Homo sapien
ggacgcctcctaagcggagccattg

SEQ ID NO: 89570 - DNA, 25 bp, Homo sapien
ccttccctcggcaggtggctgcgga

SEQ ID NO: 89571 - DNA, 25 bp, Homo sapien
ggatcccttccctcggcaggtggct

SEQ ID NO: 89572 - DNA, 25 bp, Homo sapien
gagtgcagcctgcaccggatccctt

SEQ ID NO: 89573 - DNA, 25 bp, Homo sapien
ctcctaagcggagccattggcagcc

SEQ ID NO: 89574 - DNA, 25 bp, Homo sapien
gcgttggttgaatccaataaaccga

SEQ ID NO: 89575 - DNA, 25 bp, Homo sapien
ggtcgtgccgccaccgatgtcgtca

SEQ ID NO: 89576 - DNA, 25 bp, Homo sapien
ggagccattggcagccgtagcatca

SEQ ID NO: 89577 - DNA, 25 bp, Homo sapien
tggaaaacttctgcaggtcgccaaa

SEQ ID NO: 89578 - DNA, 25 bp, Homo sapien
cccgcaggtggttattcgccaagcc

SEQ ID NO: 89579 - DNA, 25 bp, Homo sapien
ggtcgccaaaggtctccacaagttg

SEQ ID NO: 89580 - DNA, 25 bp, Homo sapien
gcccgaatctccgtgaactcaggta

SEQ ID NO: 89581 - DNA, 25 bp, Homo sapien
tgggctcgacgtctctggaaaactt

SEQ ID NO: 89582 - DNA, 25 bp, Homo sapien
tttccgcctggctcacgatgttcca

SEQ ID NO: 89583 - DNA, 25 bp, Homo sapien
acttgacctctgtgggacacccgga

SEQ ID NO: 89584 - DNA, 25 bp, Homo sapien
aagttgcagccagccacgccaattg

SEQ ID NO: 89585 - DNA, 25 bp, Homo sapien
cgcgattcaagagctgcccgcttta

SEQ ID NO: 89586 - DNA, 25 bp, Homo sapien
caaccagctcaagggtgtgcaatgc

SEQ ID NO: 89587 - DNA, 25 bp, Homo sapien
agcccggccctttagcagcctgtga

SEQ ID NO: 89588 - DNA, 25 bp, Homo sapien
ttcctgggccatcggactaggcttt

SEQ ID NO: 89589 - DNA, 25 bp, Homo sapien
ggtgcccagaagtcacaaccagctc

SEQ ID NO: 89590 - DNA, 25 bp, Homo sapien
ccttcttggcactcagatggatgta

SEQ ID NO: 89591 - DNA, 25 bp, Homo sapien
gcgcctctccgcacttaggaaaacg

SEQ ID NO: 89592 - DNA, 25 bp, Homo sapien
tggcagtccgcctctctactttttt

SEQ ID NO: 89593 - DNA, 25 bp, Homo sapien
tccaaggtctcggatttgacgaaca

SEQ ID NO: 89594 - DNA, 25 bp, Homo sapien
tccagttaacgcgaagctgcttgtg

SEQ ID NO: 89595 - DNA, 25 bp, Homo sapien
agcggtggctcgaatacttacttag

SEQ ID NO: 89596 - DNA, 25 bp, Homo sapien
cggcctccgcgacaaagattctgcg

SEQ ID NO: 89597 - DNA, 25 bp, Homo sapien
acagaggcgcgatcttcgtgtcaca

SEQ ID NO: 89598 - DNA, 25 bp, Homo sapien
ggccgatccgagcagcactaacacg

SEQ ID NO: 89599 - DNA, 25 bp, Homo sapien
tggctctaactgtgcctcagcgttg

SEQ ID NO: 89600 - DNA, 25 bp, Homo sapien
cccaggcagtgctaaccaaggtcag

SEQ ID NO: 89601 - DNA, 25 bp, Homo sapien
tgctagtacagctctcggcggagga

SEQ ID NO: 89602 - DNA, 25 bp, Homo sapien
tttctcgagcgcctaccgagtgcca

SEQ ID NO: 89603 - DNA, 25 bp, Homo sapien
ctgcgataacgcagttgctagtaca

SEQ ID NO: 89604 - DNA, 25 bp, Homo sapien
tggtagaaacgaccctgcgataacg

SEQ ID NO: 89605 - DNA, 25 bp, Homo sapien
ggcctgcctggtagaaacgaccctg

SEQ ID NO: 89606 - DNA, 25 bp, Homo sapien
caccaggcgcgaaccagacagctgt

SEQ ID NO: 89607 - DNA, 25 bp, Homo sapien
cagcgttagcaccaggcgcgaacca

SEQ ID NO: 89608 - DNA, 25 bp, Homo sapien
cctagcgaggcgcagcgttagcacc

SEQ ID NO: 89609 - DNA, 25 bp, Homo sapien
agccggagcgctgacaggtgtgcag

SEQ ID NO: 89610 - DNA, 25 bp, Homo sapien
ctgccgcacctgagcgttttcagga

SEQ ID NO: 89611 - DNA, 25 bp, Homo sapien
acctgagcgttttcaggacgcgctc

SEQ ID NO: 89612 - DNA, 25 bp, Homo sapien
gcgttttcaggacgcgctctggtcc

SEQ ID NO: 89613 - DNA, 25 bp, Homo sapien
tctcggggttacactcccttcctgc

SEQ ID NO: 89614 - DNA, 25 bp, Homo sapien
gctcccaagacagccggccaccggg

SEQ ID NO: 89615 - DNA, 25 bp, Homo sapien
cgagggcagccgattcacggcgggc

SEQ ID NO: 89616 - DNA, 25 bp, Homo sapien
gacagtggatttggggtctcctcga

SEQ ID NO: 89617 - DNA, 25 bp, Homo sapien
cgctgacttttaggaccagccattt

SEQ ID NO: 89618 - DNA, 25 bp, Homo sapien
agagcgcacagcttcatgcccttga

SEQ ID NO: 89619 - DNA, 25 bp, Homo sapien
cttagcaagttctggcctgtggagc

SEQ ID NO: 89620 - DNA, 25 bp, Homo sapien
tgccggctaattgcagcgttaaata

SEQ ID NO: 89621 - DNA, 25 bp, Homo sapien
ggtcccttccagttcgtttctgctg

SEQ ID NO: 89622 - DNA, 25 bp, Homo sapien
aaggtcacctcttcggcctctctgg

SEQ ID NO: 89623 - DNA, 25 bp, Homo sapien
cgtcttagaacctaggatgagtctc

SEQ ID NO: 89624 - DNA, 25 bp, Homo sapien
acgcgggtgcacgtgaattaattca

SEQ ID NO: 89625 - DNA, 25 bp, Homo sapien
ggccatcccgatgccgtttcccgca

SEQ ID NO: 89626 - DNA, 25 bp, Homo sapien
ctctgttcggcggtctccagcctga

SEQ ID NO: 89627 - DNA, 25 bp, Homo sapien
cctggcctgtgttcctggctgtctc

SEQ ID NO: 89628 - DNA, 25 bp, Homo sapien
gtgttcctggctgtctcttgcctgg

SEQ ID NO: 89629 - DNA, 25 bp, Homo sapien
ggctccctcgtcacatctgcacgtc

SEQ ID NO: 89630 - DNA, 25 bp, Homo sapien
gtccacactcccaagaacaaaattg

SEQ ID NO: 89631 - DNA, 25 bp, Homo sapien
ccgtgtgcttcgaggacttgaggca

SEQ ID NO: 89632 - DNA, 25 bp, Homo sapien
tccgtcacggcagcacgcgtctgtg

SEQ ID NO: 89633 - DNA, 25 bp, Homo sapien
ttgcggtccactctatcatctatcg

SEQ ID NO: 89634 - DNA, 25 bp, Homo sapien
cgttttcagacagtaagggcgcata

SEQ ID NO: 89635 - DNA, 25 bp, Homo sapien
agtcttcggcagcacttgtagttcc

SEQ ID NO: 89636 - DNA, 25 bp, Homo sapien
ttctcccgcgaaacaacgtgacgtc

SEQ ID NO: 89637 - DNA, 25 bp, Homo sapien
cgtgacgtcattaacgcgggacctc

SEQ ID NO: 89638 - DNA, 25 bp, Homo sapien
ttcttccttggcttcgagtctctca

SEQ ID NO: 89639 - DNA, 25 bp, Homo sapien
gcctagttatctatgcgcacgcgca

SEQ ID NO: 89640 - DNA, 25 bp, Homo sapien
ctggaaccacctcgcctgtgacgta

SEQ ID NO: 89641 - DNA, 25 bp, Homo sapien
gagcggggccgacacgagccaactt

SEQ ID NO: 89642 - DNA, 25 bp, Homo sapien
ctcccgagggaacgtccgccagtga

SEQ ID NO: 89643 - DNA, 25 bp, Homo sapien
ccgagggaacgtccgccagtgatgc

SEQ ID NO: 89644 - DNA, 25 bp, Homo sapien
cccgaactccggcagtcagtggtgc

SEQ ID NO: 89645 - DNA, 25 bp, Homo sapien
gggccgacacgagccaacttggcta

SEQ ID NO: 89646 - DNA, 25 bp, Homo sapien
acacgagccaacttggctacatcgc

SEQ ID NO: 89647 - DNA, 25 bp, Homo sapien
cggattcgtcaggtgggtgcacaaa

SEQ ID NO: 89648 - DNA, 25 bp, Homo sapien
ttcgtcaggtgggtgcacaaagtgc

SEQ ID NO: 89649 - DNA, 25 bp, Homo sapien
agctcctcgaaaagctgatactcgt

SEQ ID NO: 89650 - DNA, 25 bp, Homo sapien
atgccgggcaaaggtgcttactttc

SEQ ID NO: 89651 - DNA, 25 bp, Homo sapien
gatactcgtccgtgaacctggtgca

SEQ ID NO: 89652 - DNA, 25 bp, Homo sapien
ttgcgaaacgatccgcactggagca

SEQ ID NO: 89653 - DNA, 25 bp, Homo sapien
ttcctggtccgaaagtagctcgccc

SEQ ID NO: 89654 - DNA, 25 bp, Homo sapien
tgcaggttgtggtcgaagccatcct

SEQ ID NO: 89655 - DNA, 25 bp, Homo sapien
ggtgcttactttccaagctcctcga

SEQ ID NO: 89656 - DNA, 25 bp, Homo sapien
ggccgctcttactttcctggtccga

SEQ ID NO: 89657 - DNA, 25 bp, Homo sapien
taaactgccgtagtggaccggcctc

SEQ ID NO: 89658 - DNA, 25 bp, Homo sapien
gctgactctcctgggagtgctggta

SEQ ID NO: 89659 - DNA, 25 bp, Homo sapien
gaagaagccgtttcctgatctccct

SEQ ID NO: 89660 - DNA, 25 bp, Homo sapien
agcccgcttggtctttgcgtagttg

SEQ ID NO: 89661 - DNA, 25 bp, Homo sapien
tctccactttcccagggctattttc

SEQ ID NO: 89662 - DNA, 25 bp, Homo sapien
cgtcgcgtctggctctgatcagaca

SEQ ID NO: 89663 - DNA, 25 bp, Homo sapien
cctttcctaggcgtttgccaatctc

SEQ ID NO: 89664 - DNA, 25 bp, Homo sapien
tccgcagaaactccgggcagcaatt

SEQ ID NO: 89665 - DNA, 25 bp, Homo sapien
tcggccgaggaccttgtacttgacc

SEQ ID NO: 89666 - DNA, 25 bp, Homo sapien
ggttctctcgcgtttgtgcgctcaa

SEQ ID NO: 89667 - DNA, 25 bp, Homo sapien
atatggcatccgttcgagggttctc

SEQ ID NO: 89668 - DNA, 25 bp, Homo sapien
catagcgcccgcgatcctgtttctg

SEQ ID NO: 89669 - DNA, 25 bp, Homo sapien
caggtcccttctgtcccggatacaa

SEQ ID NO: 89670 - DNA, 25 bp, Homo sapien
tgattcagcgcacaaacacaggtcc

SEQ ID NO: 89671 - DNA, 25 bp, Homo sapien
aggacacggttaaagcattgctatc

SEQ ID NO: 89672 - DNA, 25 bp, Homo sapien
acgaaggcgcgtctgcatccatgcc

SEQ ID NO: 89673 - DNA, 25 bp, Homo sapien
cccgaccaggccgagtactctattg

SEQ ID NO: 89674 - DNA, 25 bp, Homo sapien
cctggcaagggacaagaacttcatc

SEQ ID NO: 89675 - DNA, 25 bp, Homo sapien
ggtcatcgcctccttcaaggtcctg

SEQ ID NO: 89676 - DNA, 25 bp, Homo sapien
acttcatgtcgcaggagaccaccga

SEQ ID NO: 89677 - DNA, 25 bp, Homo sapien
tccaagccttcatcgacttcatgtc

SEQ ID NO: 89678 - DNA, 25 bp, Homo sapien
tgaggccgagttcaaccgcatcatg

SEQ ID NO: 89679 - DNA, 25 bp, Homo sapien
tattgcccgcatggtgccctaccag

SEQ ID NO: 89680 - DNA, 25 bp, Homo sapien
ccatagcggccttgtgaccttccaa

SEQ ID NO: 89681 - DNA, 25 bp, Homo sapien
tgcttagcccttcagtgccaccgga

SEQ ID NO: 89682 - DNA, 25 bp, Homo sapien
acgcgtggccttcattctcctcggt

SEQ ID NO: 89683 - DNA, 25 bp, Homo sapien
ccatacccgggcgacttgaaatgcg

SEQ ID NO: 89684 - DNA, 25 bp, Homo sapien
cccgaaaggtagtgtgaactagcca

SEQ ID NO: 89685 - DNA, 25 bp, Homo sapien
cgagagcgtgactcccaggtgcact

SEQ ID NO: 89686 - DNA, 25 bp, Homo sapien
tcctgctgcgtccactggatcctga

SEQ ID NO: 89687 - DNA, 25 bp, Homo sapien
cactggatcctgagcgccataggta

SEQ ID NO: 89688 - DNA, 25 bp, Homo sapien
caccggaacgaacgtctgggcgctt

SEQ ID NO: 89689 - DNA, 25 bp, Homo sapien
gtgaagtccacatacaaacagcccg

SEQ ID NO: 89690 - DNA, 25 bp, Homo sapien
cttttgcctcggtgtcccggagctg

SEQ ID NO: 89691 - DNA, 25 bp, Homo sapien
acgctcgcacaaagtgaagtccaca

SEQ ID NO: 89692 - DNA, 25 bp, Homo sapien
gctcgcacaaagtgaagtccacata

SEQ ID NO: 89693 - DNA, 25 bp, Homo sapien
tcgcacaaagtgaagtccacataca

SEQ ID NO: 89694 - DNA, 25 bp, Homo sapien
gaagtccacatacaaacagcccgac

SEQ ID NO: 89695 - DNA, 25 bp, Homo sapien
ctcacttttgcctcggtgtcccgga

SEQ ID NO: 89696 - DNA, 25 bp, Homo sapien
acttttgcctcggtgtcccggagct

SEQ ID NO: 89697 - DNA, 25 bp, Homo sapien
tggacgagcccatcctcttcttcca

SEQ ID NO: 89698 - DNA, 25 bp, Homo sapien
acggctcagactagacggcgggtac

SEQ ID NO: 89699 - DNA, 25 bp, Homo sapien
gacacggggaccacggctcagacta

SEQ ID NO: 89700 - DNA, 25 bp, Homo sapien
tggccgccaccagtctagggatggg

SEQ ID NO: 89701 - DNA, 25 bp, Homo sapien
ggcgccactcctcatcgccgggtct

SEQ ID NO: 89702 - DNA, 25 bp, Homo sapien
tggccgccgacatggacgagcccat

SEQ ID NO: 89703 - DNA, 25 bp, Homo sapien
ttgtcgtcaaacaccggcctccgcg

SEQ ID NO: 89704 - DNA, 25 bp, Homo sapien
ctcaccgtcctccttgtcgtcaaac

SEQ ID NO: 89705 - DNA, 25 bp, Homo sapien
tgggagccctggctcgccgtcagca

SEQ ID NO: 89706 - DNA, 25 bp, Homo sapien
caccgcttcttaaacggccgcgtct

SEQ ID NO: 89707 - DNA, 25 bp, Homo sapien
ctgctgttgtcgtccggtgctctgc

SEQ ID NO: 89708 - DNA, 25 bp, Homo sapien
tctacactgccatctggggcgctgg

SEQ ID NO: 89709 - DNA, 25 bp, Homo sapien
gcacaggtgcggtctacactgccat

SEQ ID NO: 89710 - DNA, 25 bp, Homo sapien
tggctcgccgtcagcaggcacaggt

SEQ ID NO: 89711 - DNA, 25 bp, Homo sapien
ctcgactccctctcggagacggaga

SEQ ID NO: 89712 - DNA, 25 bp, Homo sapien
ggggatctcgactccctctcggaga

SEQ ID NO: 89713 - DNA, 25 bp, Homo sapien
cagaaggaagctggagcgaaaaccg

SEQ ID NO: 89714 - DNA, 25 bp, Homo sapien
aggctctgggcgtggcatcactctc

SEQ ID NO: 89715 - DNA, 25 bp, Homo sapien
aaggaagctggagcgaaaaccgcga

SEQ ID NO: 89716 - DNA, 25 bp, Homo sapien
tgcagaatcgcctgtgcagaaggaa

SEQ ID NO: 89717 - DNA, 25 bp, Homo sapien
aggggtctgcagaatcgcctgtgca

SEQ ID NO: 89718 - DNA, 25 bp, Homo sapien
gagtgcagtgtgtggaaagggatgc

SEQ ID NO: 89719 - DNA, 25 bp, Homo sapien
gggcgtggcatcactctcggtccct

SEQ ID NO: 89720 - DNA, 25 bp, Homo sapien
tgagcacggggcagggcaaaatacg

SEQ ID NO: 89721 - DNA, 25 bp, Homo sapien
cattccaaggctcacggctcgggtt

SEQ ID NO: 89722 - DNA, 25 bp, Homo sapien
agcaaaggcgggaggtgcctccatc

SEQ ID NO: 89723 - DNA, 25 bp, Homo sapien
tcctgggactaacgaagcaaaggcg

SEQ ID NO: 89724 - DNA, 25 bp, Homo sapien
cgctcgtcctgggactaacgaagca

SEQ ID NO: 89725 - DNA, 25 bp, Homo sapien
acagaggggactccgatgcgaaccg

SEQ ID NO: 89726 - DNA, 25 bp, Homo sapien
agcacagaggggactccgatgcgaa

SEQ ID NO: 89727 - DNA, 25 bp, Homo sapien
caaggctcacggctcgggtttctgg

SEQ ID NO: 89728 - DNA, 25 bp, Homo sapien
ctggtggcgactcagacctctcggg

SEQ ID NO: 89729 - DNA, 25 bp, Homo sapien
gcggtgatcttcaacgttgatcgtc

SEQ ID NO: 89730 - DNA, 25 bp, Homo sapien
gatcgtcgcatcttcaaactcgctg

SEQ ID NO: 89731 - DNA, 25 bp, Homo sapien
gatactcaccggcgagccgcagctg

SEQ ID NO: 89732 - DNA, 25 bp, Homo sapien
atcccgaagtcagtcccgggtcgca

SEQ ID NO: 89733 - DNA, 25 bp, Homo sapien
ttgcgagcggtgatcttcaacgttg

SEQ ID NO: 89734 - DNA, 25 bp, Homo sapien
cttcaacgttgatcgtcgcatcttc

SEQ ID NO: 89735 - DNA, 25 bp, Homo sapien
cccatggtggcgcttcccggatact

SEQ ID NO: 89736 - DNA, 25 bp, Homo sapien
taaatcaaaggcgagggccgagctg

SEQ ID NO: 89737 - DNA, 25 bp, Homo sapien
ggcggcatctcgaccagacaagttt

SEQ ID NO: 89738 - DNA, 25 bp, Homo sapien
cagaaacccgatccgggcgccttgg

SEQ ID NO: 89739 - DNA, 25 bp, Homo sapien
cgtggttctccagcgcaggagtccc

SEQ ID NO: 89740 - DNA, 25 bp, Homo sapien
aagacgtttcatccttggcggccgc

SEQ ID NO: 89741 - DNA, 25 bp, Homo sapien
tccctggccgcacaagacgtttcat

SEQ ID NO: 89742 - DNA, 25 bp, Homo sapien
caggagcaccacaggaagggaccgc

SEQ ID NO: 89743 - DNA, 25 bp, Homo sapien
ccctggtccagtgccaacggcagga

SEQ ID NO: 89744 - DNA, 25 bp, Homo sapien
ccagacaagtttctcgcggcttgga

SEQ ID NO: 89745 - DNA, 25 bp, Homo sapien
caaagcctctttgacggcccaggtc

SEQ ID NO: 89746 - DNA, 25 bp, Homo sapien
gcgccggccttcacagaggcgaatt

SEQ ID NO: 89747 - DNA, 25 bp, Homo sapien
ggccttcacagaggcgaattccttc

SEQ ID NO: 89748 - DNA, 25 bp, Homo sapien
ttcacagaggcgaattccttctctg

SEQ ID NO: 89749 - DNA, 25 bp, Homo sapien
tgacggcccaggtccaacagcgggc

SEQ ID NO: 89750 - DNA, 25 bp, Homo sapien
ctgttcacagctttttcctccgttt

SEQ ID NO: 89751 - DNA, 25 bp, Homo sapien
ctccaagacaatcggcacccggctc

SEQ ID NO: 89752 - DNA, 25 bp, Homo sapien
ttccttctctgttcacagctttttc

SEQ ID NO: 89753 - DNA, 25 bp, Homo sapien
catgcgcggacttgagtgctcatta

SEQ ID NO: 89754 - DNA, 25 bp, Homo sapien
ccttaagtttacaagcatgcgcgga

SEQ ID NO: 89755 - DNA, 25 bp, Homo sapien
ggcctcggcctttcacattcgggaa

SEQ ID NO: 89756 - DNA, 25 bp, Homo sapien
ccggaatagcgtcatcagttctata

SEQ ID NO: 89757 - DNA, 25 bp, Homo sapien
tgacccgctcagacgtggaccatgt

SEQ ID NO: 89758 - DNA, 25 bp, Homo sapien
accttttggctctcgtatgtgcgca

SEQ ID NO: 89759 - DNA, 25 bp, Homo sapien
tttcgctatgcgagaaccttttggc

SEQ ID NO: 89760 - DNA, 25 bp, Homo sapien
acaccggtaagcgtcaggatctttc

SEQ ID NO: 89761 - DNA, 25 bp, Homo sapien
gcgcaggcacgagcccgggaactct

SEQ ID NO: 89762 - DNA, 25 bp, Homo sapien
cgtcggggctccgacaaaagttgtg

SEQ ID NO: 89763 - DNA, 25 bp, Homo sapien
cgacaaaagttgtggcgctgtcctc

SEQ ID NO: 89764 - DNA, 25 bp, Homo sapien
cgaagtccgtcacgctgacccatgg

SEQ ID NO: 89765 - DNA, 25 bp, Homo sapien
ggacagaatcaaagccgaccacttc

SEQ ID NO: 89766 - DNA, 25 bp, Homo sapien
ctaacatcagggctagcacgaagcg

SEQ ID NO: 89767 - DNA, 25 bp, Homo sapien
gtctccgtagaaacaccagggtctg

SEQ ID NO: 89768 - DNA, 25 bp, Homo sapien
cttgccacgggcgtctccgtagaaa

SEQ ID NO: 89769 - DNA, 25 bp, Homo sapien
cggtgaattttgttccacagactcg

SEQ ID NO: 89770 - DNA, 25 bp, Homo sapien
actctgttcgtaagctcccggtgaa

SEQ ID NO: 89771 - DNA, 25 bp, Homo sapien
cggcagaagttacggcgacagctcc

SEQ ID NO: 89772 - DNA, 25 bp, Homo sapien
catggatagccgcttgcaggagatc

SEQ ID NO: 89773 - DNA, 25 bp, Homo sapien
cggaagtctctactgaggaaagcta

SEQ ID NO: 89774 - DNA, 25 bp, Homo sapien
gttcactggagattgacaagtactc

SEQ ID NO: 89775 - DNA, 25 bp, Homo sapien
acttccgggccaagcgagccaattc

SEQ ID NO: 89776 - DNA, 25 bp, Homo sapien
cgtcacatagcaagcgtccagaagg

SEQ ID NO: 89777 - DNA, 25 bp, Homo sapien
agaaccgtattttctcggcgcagcc

SEQ ID NO: 89778 - DNA, 25 bp, Homo sapien
cgtcgtggctaaatcagaaccgtat

SEQ ID NO: 89779 - DNA, 25 bp, Homo sapien
cgggaaagtacacgatctggaccta

SEQ ID NO: 89780 - DNA, 25 bp, Homo sapien
ttaccgtttaaaggcgaatctggca

SEQ ID NO: 89781 - DNA, 25 bp, Homo sapien
tctggcacgtgtacacgcacatttg

SEQ ID NO: 89782 - DNA, 25 bp, Homo sapien
gatgacgtacccgtgcaatgcacta

SEQ ID NO: 89783 - DNA, 25 bp, Homo sapien
tgcactacagaggaaggaacgccca

SEQ ID NO: 89784 - DNA, 25 bp, Homo sapien
aagcagcctggcaacgtgtaacgcg

SEQ ID NO: 89785 - DNA, 25 bp, Homo sapien
ctgttgatcgcaggtgtcactggcc

SEQ ID NO: 89786 - DNA, 25 bp, Homo sapien
gaaggcctgtatttctctacctgga

SEQ ID NO: 89787 - DNA, 25 bp, Homo sapien
tcctcgcgcaaggagggtagagctc

SEQ ID NO: 89788 - DNA, 25 bp, Homo sapien
gtctccgaaactagccctctggttg

SEQ ID NO: 89789 - DNA, 25 bp, Homo sapien
gcctgaccgggacactctcattcta

SEQ ID NO: 89790 - DNA, 25 bp, Homo sapien
ttcagacgccagaggtcacgcagcc

SEQ ID NO: 89791 - DNA, 25 bp, Homo sapien
ctccgaggaagccaactgtatcgcg

SEQ ID NO: 89792 - DNA, 25 bp, Homo sapien
cgcaggtccagaaagccgggaaatc

SEQ ID NO: 89793 - DNA, 25 bp, Homo sapien
cctgcagcttcgtaacaaccctaga

SEQ ID NO: 89794 - DNA, 25 bp, Homo sapien
cccaggcagatagctggttattcag

SEQ ID NO: 89795 - DNA, 25 bp, Homo sapien
gacactaagtcaatgggcccgccta

SEQ ID NO: 89796 - DNA, 25 bp, Homo sapien
ggcctccgccttgacactaagtcaa

SEQ ID NO: 89797 - DNA, 25 bp, Homo sapien
ctgcctccgtgaccgctggcatgaa

SEQ ID NO: 89798 - DNA, 25 bp, Homo sapien
tccggaatgcactctgaacctactc

SEQ ID NO: 89799 - DNA, 25 bp, Homo sapien
ccgcaccggaaactgagcggagtcc

SEQ ID NO: 89800 - DNA, 25 bp, Homo sapien
gactttggtgttcgccgcaccggaa

SEQ ID NO: 89801 - DNA, 25 bp, Homo sapien
gcgcggcccagcactcaattattca

SEQ ID NO: 89802 - DNA, 25 bp, Homo sapien
gtaaaatggccaccgagacgactgc

SEQ ID NO: 89803 - DNA, 25 bp, Homo sapien
acgactgcctagagaaactgccttg

SEQ ID NO: 89804 - DNA, 25 bp, Homo sapien
accggggcgaaactgacgcaattca

SEQ ID NO: 89805 - DNA, 25 bp, Homo sapien
ggaagcccgtgcagaattcgtccca

SEQ ID NO: 89806 - DNA, 25 bp, Homo sapien
ccagtggggagctctggacacagaa

SEQ ID NO: 89807 - DNA, 25 bp, Homo sapien
ctcaacccgaggtgtcggctggaaa

SEQ ID NO: 89808 - DNA, 25 bp, Homo sapien
attcgtcccaccgtcggcaaacagg

SEQ ID NO: 89809 - DNA, 25 bp, Homo sapien
gctcttgcggcgtcacggaaggcgc

SEQ ID NO: 89810 - DNA, 25 bp, Homo sapien
cttgtgaggtcgcaggggaccgcca

SEQ ID NO: 89811 - DNA, 25 bp, Homo sapien
cgctcttgtgaggtcgcaggggacc

SEQ ID NO: 89812 - DNA, 25 bp, Homo sapien
tgtgaggtcgcaggggaccgccact

SEQ ID NO: 89813 - DNA, 25 bp, Homo sapien
cgctcttgcggcgtcacggaaggcg

SEQ ID NO: 89814 - DNA, 25 bp, Homo sapien
aggcgcgctcttgcggcgtcacgga

SEQ ID NO: 89815 - DNA, 25 bp, Homo sapien
gaaggcgcgctcttgcggcgtcacg

SEQ ID NO: 89816 - DNA, 25 bp, Homo sapien
ctcttgtgaggtcgcaggggaccgc

SEQ ID NO: 89817 - DNA, 25 bp, Homo sapien
ctcgcttagagttgaggtttctacc

SEQ ID NO: 89818 - DNA, 25 bp, Homo sapien
ccgtgagcacggatgtatgaaaata

SEQ ID NO: 89819 - DNA, 25 bp, Homo sapien
ggcaaccgcactcactttggcaagg

SEQ ID NO: 89820 - DNA, 25 bp, Homo sapien
gcagagctctacttttggcggcaca

SEQ ID NO: 89821 - DNA, 25 bp, Homo sapien
ctctggaccagaaagagctggcctc

SEQ ID NO: 89822 - DNA, 25 bp, Homo sapien
tgcgcagccgcctccaaaaggacag

SEQ ID NO: 89823 - DNA, 25 bp, Homo sapien
gtgggtcctcttcttacctggtggc

SEQ ID NO: 89824 - DNA, 25 bp, Homo sapien
catcaattcctcaggcttcggggca

SEQ ID NO: 89825 - DNA, 25 bp, Homo sapien
gtgggcctactgagccgtcacgact

SEQ ID NO: 89826 - DNA, 25 bp, Homo sapien
attggcctgcgcgagaacttacaga

SEQ ID NO: 89827 - DNA, 25 bp, Homo sapien
cttacagaagaactcggccacgatt

SEQ ID NO: 89828 - DNA, 25 bp, Homo sapien
gggacacaaacaaaagcacgcgctt

SEQ ID NO: 89829 - DNA, 25 bp, Homo sapien
ttcaaaagtaacgacgcagcacgtc

SEQ ID NO: 89830 - DNA, 25 bp, Homo sapien
agcacgtcgtcaggtcctttgcgca

SEQ ID NO: 89831 - DNA, 25 bp, Homo sapien
tcagccttcctgtgatgtcgcggga

SEQ ID NO: 89832 - DNA, 25 bp, Homo sapien
ggcctgcagctccacgttagcaacg

SEQ ID NO: 89833 - DNA, 25 bp, Homo sapien
ccatgccgtcctgaacccgggagga

SEQ ID NO: 89834 - DNA, 25 bp, Homo sapien
caggcggcacatcgaaatttggggt

SEQ ID NO: 89835 - DNA, 25 bp, Homo sapien
cagggagaacctgtccggcacgtac

SEQ ID NO: 89836 - DNA, 25 bp, Homo sapien
agctcacacccgtaaccgaggaaga

SEQ ID NO: 89837 - DNA, 25 bp, Homo sapien
ttcgccaacgcaaagacgcagctca

SEQ ID NO: 89838 - DNA, 25 bp, Homo sapien
gcgtttctagccacattaattcatc

SEQ ID NO: 89839 - DNA, 25 bp, Homo sapien
ccgcatggaaagttaggcgtttcta

SEQ ID NO: 89840 - DNA, 25 bp, Homo sapien
ccggcacgtacatgcccagcatttt

SEQ ID NO: 89841 - DNA, 25 bp, Homo sapien
ccaagaggaaacgagaggcgcgcca

SEQ ID NO: 89842 - DNA, 25 bp, Homo sapien
agcacaaacgttgtctgcagagccc

SEQ ID NO: 89843 - DNA, 25 bp, Homo sapien
atccagcctttgttccaaggcagcc

SEQ ID NO: 89844 - DNA, 25 bp, Homo sapien
gtggtccacgcagcacaggactggt

SEQ ID NO: 89845 - DNA, 25 bp, Homo sapien
gtggtcggtgctgccgtgctatccc

SEQ ID NO: 89846 - DNA, 25 bp, Homo sapien
agccttgcttggctggaagcacaaa

SEQ ID NO: 89847 - DNA, 25 bp, Homo sapien
ccagagtgaggcacaatccagcctt

SEQ ID NO: 89848 - DNA, 25 bp, Homo sapien
tgctatcccggctggcaggacttac

SEQ ID NO: 89849 - DNA, 25 bp, Homo sapien
cgatgctcgcctaccacgcagagga

SEQ ID NO: 89850 - DNA, 25 bp, Homo sapien
cgggcaaagtaagtgtccaggctaa

SEQ ID NO: 89851 - DNA, 25 bp, Homo sapien
ggccgcccagcttcgaaagcagcta

SEQ ID NO: 89852 - DNA, 25 bp, Homo sapien
tcatgccctcagctcctacggatag

SEQ ID NO: 89853 - DNA, 25 bp, Homo sapien
atagggcgcccttgagaagcttctt

SEQ ID NO: 89854 - DNA, 25 bp, Homo sapien
aacgctccttgtgctaggtctcagg

SEQ ID NO: 89855 - DNA, 25 bp, Homo sapien
accaagaactcgtgcgctgcctgga

SEQ ID NO: 89856 - DNA, 25 bp, Homo sapien
tagcttttcgccctacacgcagacg

SEQ ID NO: 89857 - DNA, 25 bp, Homo sapien
atgttcgcggttcaaataaagttct

SEQ ID NO: 89858 - DNA, 25 bp, Homo sapien
cacgtagaacaccagagcattgcca

SEQ ID NO: 89859 - DNA, 25 bp, Homo sapien
cgcagccggtacagagcgatgaact

SEQ ID NO: 89860 - DNA, 25 bp, Homo sapien
cgatgaactgctcccgcgtcaggtt

SEQ ID NO: 89861 - DNA, 25 bp, Homo sapien
ctgctccggggtaatgttaagcgcc

SEQ ID NO: 89862 - DNA, 25 bp, Homo sapien
agccaaagcactgggagactcgatc

SEQ ID NO: 89863 - DNA, 25 bp, Homo sapien
tctcagtgaccaaaaaatgttcgcg

SEQ ID NO: 89864 - DNA, 25 bp, Homo sapien
cttgctgcgggtcaccacgtagaac

SEQ ID NO: 89865 - DNA, 25 bp, Homo sapien
caaagttgtgggtaaatccagcgca

SEQ ID NO: 89866 - DNA, 25 bp, Homo sapien
ggccttacctgtgccatggcgacta

SEQ ID NO: 89867 - DNA, 25 bp, Homo sapien
tcacccagactgtgggacccaagtg

SEQ ID NO: 89868 - DNA, 25 bp, Homo sapien
tccggcagctgcacctagactgatc

SEQ ID NO: 89869 - DNA, 25 bp, Homo sapien
tctgtgaccgcaggaaccgtagcct

SEQ ID NO: 89870 - DNA, 25 bp, Homo sapien
cgtagcctcacttgggtgctcaaca

SEQ ID NO: 89871 - DNA, 25 bp, Homo sapien
gctcaacatagtgcgtgggcgtctt

SEQ ID NO: 89872 - DNA, 25 bp, Homo sapien
gtccctcgtcgcagcatacaaagtt

SEQ ID NO: 89873 - DNA, 25 bp, Homo sapien
agcgacttccctaggagcgaacttc

SEQ ID NO: 89874 - DNA, 25 bp, Homo sapien
cggctccgaggaaacgcgccaagga

SEQ ID NO: 89875 - DNA, 25 bp, Homo sapien
ccgagatcctctcaggtgctcttga

SEQ ID NO: 89876 - DNA, 25 bp, Homo sapien
agctgaggaaatccggcgcagactc

SEQ ID NO: 89877 - DNA, 25 bp, Homo sapien
cgggtcacaccgcttgctctcggga

SEQ ID NO: 89878 - DNA, 25 bp, Homo sapien
gccacggagttcttcagctgcttga

SEQ ID NO: 89879 - DNA, 25 bp, Homo sapien
ccaggtagagcagcaagttgagttc

SEQ ID NO: 89880 - DNA, 25 bp, Homo sapien
ttgagttcccactccatgctggagg

SEQ ID NO: 89881 - DNA, 25 bp, Homo sapien
agccgcaatggcttctcgcagctcg

SEQ ID NO: 89882 - DNA, 25 bp, Homo sapien
gcagtagctgcagcccaagccattt

SEQ ID NO: 89883 - DNA, 25 bp, Homo sapien
tgaaggaaacgccactctcaaactg

SEQ ID NO: 89884 - DNA, 25 bp, Homo sapien
tgacgtaattttcctgcgcctcggg

SEQ ID NO: 89885 - DNA, 25 bp, Homo sapien
ggccggtgacccaacaccatgaagg

SEQ ID NO: 89886 - DNA, 25 bp, Homo sapien
cgggtctcaaggtgtggactgatac

SEQ ID NO: 89887 - DNA, 25 bp, Homo sapien
aagaaggtatggtttggtgcccgca

SEQ ID NO: 89888 - DNA, 25 bp, Homo sapien
ccgccgcgccttgatgacgtaattt

SEQ ID NO: 89889 - DNA, 25 bp, Homo sapien
agccatggcaacgagcagcggaacc

SEQ ID NO: 89890 - DNA, 25 bp, Homo sapien
cgagacagtcgcatagagcgtcagc

SEQ ID NO: 89891 - DNA, 25 bp, Homo sapien
ggcccgcctgcgagacagtcgcata

SEQ ID NO: 89892 - DNA, 25 bp, Homo sapien
ccacagagaggatgagctggctaga

SEQ ID NO: 89893 - DNA, 25 bp, Homo sapien
cagctcagagtgcagggtttccctc

SEQ ID NO: 89894 - DNA, 25 bp, Homo sapien
tgcagtgcccgagggtccaggtcca

SEQ ID NO: 89895 - DNA, 25 bp, Homo sapien
ttgcgaacgcggaatggtccatgtc

SEQ ID NO: 89896 - DNA, 25 bp, Homo sapien
ccggaagccgtacacaggccacaga

SEQ ID NO: 89897 - DNA, 25 bp, Homo sapien
cgcaggcgagtgaagggtaaaccaa

SEQ ID NO: 89898 - DNA, 25 bp, Homo sapien
gctcgcggccttgacgtcattcaag

SEQ ID NO: 89899 - DNA, 25 bp, Homo sapien
ccgggttgatattctcctggtcctc

SEQ ID NO: 89900 - DNA, 25 bp, Homo sapien
agcgccgtctgctgcaatgctagca

SEQ ID NO: 89901 - DNA, 25 bp, Homo sapien
caaagaatagtcgtagccgccggtc

SEQ ID NO: 89902 - DNA, 25 bp, Homo sapien
ttgcagttcaagtatcccgcgacta

SEQ ID NO: 89903 - DNA, 25 bp, Homo sapien
gcgctgccttttccgggttgatatt

SEQ ID NO: 89904 - DNA, 25 bp, Homo sapien
atggaccaatgaaagcgctcgcggc

SEQ ID NO: 89905 - DNA, 25 bp, Homo sapien
taagcagcgccggacaagaacagga

SEQ ID NO: 89906 - DNA, 25 bp, Homo sapien
agctcctggcgaccgagactttcgt

SEQ ID NO: 89907 - DNA, 25 bp, Homo sapien
tgacagcgtgttccaatcagaggcg

SEQ ID NO: 89908 - DNA, 25 bp, Homo sapien
ctgcgtgacgtcagtacgctgctgc

SEQ ID NO: 89909 - DNA, 25 bp, Homo sapien
cccttgggtttacctgcagataatc

SEQ ID NO: 89910 - DNA, 25 bp, Homo sapien
ctttcgtcagtggaaggaaggaatc

SEQ ID NO: 89911 - DNA, 25 bp, Homo sapien
ggagacccatacagggcggtttcca

SEQ ID NO: 89912 - DNA, 25 bp, Homo sapien
gcaggcctccgacccagtcagaagg

SEQ ID NO: 89913 - DNA, 25 bp, Homo sapien
cttcgtatttctggcagtgcgccgc

SEQ ID NO: 89914 - DNA, 25 bp, Homo sapien
tggtgccgcggtcattgaacatgaa

SEQ ID NO: 89915 - DNA, 25 bp, Homo sapien
tgaaggagtcgtgcctctgcttctc

SEQ ID NO: 89916 - DNA, 25 bp, Homo sapien
gacgttcagcgtcttggactcctcc

SEQ ID NO: 89917 - DNA, 25 bp, Homo sapien
taagcgtagaagtcgtcgtcctgca

SEQ ID NO: 89918 - DNA, 25 bp, Homo sapien
gcagcatgtgcaccacttcgtattt

SEQ ID NO: 89919 - DNA, 25 bp, Homo sapien
gcccatgtagtccacgcagttgacg

SEQ ID NO: 89920 - DNA, 25 bp, Homo sapien
caccactgggatgttgccgtactcg

SEQ ID NO: 89921 - DNA, 25 bp, Homo sapien
ctcgccaggatgcttgtctgaagtc

SEQ ID NO: 89922 - DNA, 25 bp, Homo sapien
ctccaaatcgaactgcctggccgta

SEQ ID NO: 89923 - DNA, 25 bp, Homo sapien
gcgccgaccgctccttcgtttagaa

SEQ ID NO: 89924 - DNA, 25 bp, Homo sapien
ctctaatacagggagtggctgctcg

SEQ ID NO: 89925 - DNA, 25 bp, Homo sapien
gaggcgcctgggcaaaccttcaacc

SEQ ID NO: 89926 - DNA, 25 bp, Homo sapien
cctcaggggaccctatagggcttcg

SEQ ID NO: 89927 - DNA, 25 bp, Homo sapien
tgggaaccgcagtcaaagttatcac

SEQ ID NO: 89928 - DNA, 25 bp, Homo sapien
tcgtgcgagctcctcggctctaata

SEQ ID NO: 89929 - DNA, 25 bp, Homo sapien
gacgttgctgcctgacgcaggcgca

SEQ ID NO: 89930 - DNA, 25 bp, Homo sapien
cagagcttcgcaggctgcatccggc

SEQ ID NO: 89931 - DNA, 25 bp, Homo sapien
agggatttcgggctgcctcggcact

SEQ ID NO: 89932 - DNA, 25 bp, Homo sapien
gctaaagggtgtgggcaccggcaga

SEQ ID NO: 89933 - DNA, 25 bp, Homo sapien
ctggcgtgtgacgttgctgcctgac

SEQ ID NO: 89934 - DNA, 25 bp, Homo sapien
cagggcttgagtggcgcacctcgag

SEQ ID NO: 89935 - DNA, 25 bp, Homo sapien
cttcgcaggctgcatccggctcggt

SEQ ID NO: 89936 - DNA, 25 bp, Homo sapien
caccggcagagcttcgcaggctgca

SEQ ID NO: 89937 - DNA, 25 bp, Homo sapien
ctgcactgtctgtgacgggaagaga

SEQ ID NO: 89938 - DNA, 25 bp, Homo sapien
cctctcagagcggaacacgcagtcg

SEQ ID NO: 89939 - DNA, 25 bp, Homo sapien
cggtcacgtgttccgtcagggtgct

SEQ ID NO: 89940 - DNA, 25 bp, Homo sapien
acatggaagcgctgcctgtctgctc

SEQ ID NO: 89941 - DNA, 25 bp, Homo sapien
aagcgctgcctgtctgctcctcagt

SEQ ID NO: 89942 - DNA, 25 bp, Homo sapien
ctggctcgtcgccaaggacgatgca

SEQ ID NO: 89943 - DNA, 25 bp, Homo sapien
tggtgctcatggctgcactgtctgt

SEQ ID NO: 89944 - DNA, 25 bp, Homo sapien
aagccgcggtgcctctcagagcgga

SEQ ID NO: 89945 - DNA, 25 bp, Homo sapien
cttttgaaagatgcggccctgaccc

SEQ ID NO: 89946 - DNA, 25 bp, Homo sapien
acgcctgcgatggtcggcgtctctt

SEQ ID NO: 89947 - DNA, 25 bp, Homo sapien
ttctccagaagggtaaggcggccag

SEQ ID NO: 89948 - DNA, 25 bp, Homo sapien
cagttggacccggtccttgtgttcg

SEQ ID NO: 89949 - DNA, 25 bp, Homo sapien
ttcggagaacagagtcacccaggcc

SEQ ID NO: 89950 - DNA, 25 bp, Homo sapien
cgtctcttccctaggtgacgcaaga

SEQ ID NO: 89951 - DNA, 25 bp, Homo sapien
ccggcctccgagacggttagtgatt

SEQ ID NO: 89952 - DNA, 25 bp, Homo sapien
gcgacgcgaggcctcttttgaaaga

SEQ ID NO: 89953 - DNA, 25 bp, Homo sapien
ctccagctgtgtctcttagcaacta

SEQ ID NO: 89954 - DNA, 25 bp, Homo sapien
tgctgtcccagccagaatcgcgtct

SEQ ID NO: 89955 - DNA, 25 bp, Homo sapien
tggcgtttttggtgttgctgtccca

SEQ ID NO: 89956 - DNA, 25 bp, Homo sapien
ttcgcacatgcgcaaactgcggacg

SEQ ID NO: 89957 - DNA, 25 bp, Homo sapien
agtcttcacagctcactggcggttg

SEQ ID NO: 89958 - DNA, 25 bp, Homo sapien
ctgagttattgacatccagttcatc

SEQ ID NO: 89959 - DNA, 25 bp, Homo sapien
tctactccctaccaatagcgtgacg

SEQ ID NO: 89960 - DNA, 25 bp, Homo sapien
cggcgttaagcggaacttctctctc

SEQ ID NO: 89961 - DNA, 25 bp, Homo sapien
gtccgcggagacacccatccgtgaa

SEQ ID NO: 89962 - DNA, 25 bp, Homo sapien
acaacctgtcgcgtcggggatgccc

SEQ ID NO: 89963 - DNA, 25 bp, Homo sapien
ggggtgtgccaatttgccctgtaaa

SEQ ID NO: 89964 - DNA, 25 bp, Homo sapien
gaccctagcgctccgtgtggtttct

SEQ ID NO: 89965 - DNA, 25 bp, Homo sapien
tccatttcgtgggttctcgcccgct

SEQ ID NO: 89966 - DNA, 25 bp, Homo sapien
catggcagccgggagcatcaccacg

SEQ ID NO: 89967 - DNA, 25 bp, Homo sapien
atgtagaagatgtgacgccgcggcc

SEQ ID NO: 89968 - DNA, 25 bp, Homo sapien
cccaagcggctgtactgcaaaaacg

SEQ ID NO: 89969 - DNA, 25 bp, Homo sapien
cttgccctgcaagcccttctggaag

SEQ ID NO: 89970 - DNA, 25 bp, Homo sapien
agcccttctggaaggcggcagcgtc

SEQ ID NO: 89971 - DNA, 25 bp, Homo sapien
atcgcacgctccaactggcggattc

SEQ ID NO: 89972 - DNA, 25 bp, Homo sapien
tttcattagaaaagctctggagccc

SEQ ID NO: 89973 - DNA, 25 bp, Homo sapien
tttccctctgggctcgacagtggtg

SEQ ID NO: 89974 - DNA, 25 bp, Homo sapien
tggcggattccgcacgtaaccctgt

SEQ ID NO: 89975 - DNA, 25 bp, Homo sapien
gccgcggttatttcattagaaaagc

SEQ ID NO: 89976 - DNA, 25 bp, Homo sapien
tcgacagtggtgcacagagcgacta

SEQ ID NO: 89977 - DNA, 25 bp, Homo sapien
cacggtgaggacctagccattcttc

SEQ ID NO: 89978 - DNA, 25 bp, Homo sapien
ttcccagatttcagggccctttggc

SEQ ID NO: 89979 - DNA, 25 bp, Homo sapien
tggctttgtgcctgaatcctttctg

SEQ ID NO: 89980 - DNA, 25 bp, Homo sapien
ttttgccaaactggcgcgcacggtg

SEQ ID NO: 89981 - DNA, 25 bp, Homo sapien
ttgcggggcaggattttgccaaact

SEQ ID NO: 89982 - DNA, 25 bp, Homo sapien
cacctggtggaagcatcccaggccg

SEQ ID NO: 89983 - DNA, 25 bp, Homo sapien
atcccaggccgccactggctttgtg

SEQ ID NO: 89984 - DNA, 25 bp, Homo sapien
cctttggccggcactggccaggagc

SEQ ID NO: 89985 - DNA, 25 bp, Homo sapien
tagggtaccttgtgaccatgtcttc

SEQ ID NO: 89986 - DNA, 25 bp, Homo sapien
gctggatcagacttcgcggcaacct

SEQ ID NO: 89987 - DNA, 25 bp, Homo sapien
cacgggctccttctgctggatcaga

SEQ ID NO: 89988 - DNA, 25 bp, Homo sapien
tgctgcttcctcttgtgcggaggca

SEQ ID NO: 89989 - DNA, 25 bp, Homo sapien
gaaaatggttcgtccttgccctctg

SEQ ID NO: 89990 - DNA, 25 bp, Homo sapien
cggttgaaccaaagcgcggaaaatg

SEQ ID NO: 89991 - DNA, 25 bp, Homo sapien
ttccaagaagaatagaaagcggttg

SEQ ID NO: 89992 - DNA, 25 bp, Homo sapien
cttgtgaccatgtcttccaagaaga

SEQ ID NO: 89993 - DNA, 25 bp, Homo sapien
cttgcccaacgtgcggaatcggcta

SEQ ID NO: 89994 - DNA, 25 bp, Homo sapien
gacctcccgaggtggatgttactga

SEQ ID NO: 89995 - DNA, 25 bp, Homo sapien
agggacattcacgagcttctatctc

SEQ ID NO: 89996 - DNA, 25 bp, Homo sapien
attctctgtcgcaggcatttcggcc

SEQ ID NO: 89997 - DNA, 25 bp, Homo sapien
ctcgaacgcccgtgacgtggatttt

SEQ ID NO: 89998 - DNA, 25 bp, Homo sapien
ttccttgcgaggagcgactagaacc

SEQ ID NO: 89999 - DNA, 25 bp, Homo sapien
tttttcgctcgtcaggaagccgcca

SEQ ID NO: 90000 - DNA, 25 bp, Homo sapien
ttttctgagacttgggaagccttcc

SEQ ID NO: 90001 - DNA, 25 bp, Homo sapien
tagctccggtcaagtccacttcttg

SEQ ID NO: 90002 - DNA, 25 bp, Homo sapien
tttgtgtagtcaggcagaacgctcg

SEQ ID NO: 90003 - DNA, 25 bp, Homo sapien
ccgcgcgcattgagtttgtgtagtc

SEQ ID NO: 90004 - DNA, 25 bp, Homo sapien
ccattgtctgggcaaccgggcttaa

SEQ ID NO: 90005 - DNA, 25 bp, Homo sapien
atctgcctttgttggttttagctcc

SEQ ID NO: 90006 - DNA, 25 bp, Homo sapien
gacccgcttgttgactcagtgcccg

SEQ ID NO: 90007 - DNA, 25 bp, Homo sapien
caccgcgcgtcaaaggagccattca

SEQ ID NO: 90008 - DNA, 25 bp, Homo sapien
tttgcatttcaatgcgacccgcttg

SEQ ID NO: 90009 - DNA, 25 bp, Homo sapien
tcccagcagaatcggtcgtgctcgc

SEQ ID NO: 90010 - DNA, 25 bp, Homo sapien
tgccagttccagctttcccagcaga

SEQ ID NO: 90011 - DNA, 25 bp, Homo sapien
gctgccgctgttagggactctcagt

SEQ ID NO: 90012 - DNA, 25 bp, Homo sapien
gggactctcagtctcagacacttgc

SEQ ID NO: 90013 - DNA, 25 bp, Homo sapien
ttgcttcgctgagaagtcgctgcca

SEQ ID NO: 90014 - DNA, 25 bp, Homo sapien
cactgggccctgatccttcctttgt

SEQ ID NO: 90015 - DNA, 25 bp, Homo sapien
ggctgcgttctcacgtctccgagct

SEQ ID NO: 90016 - DNA, 25 bp, Homo sapien
agggcagtaactgtctcaggcagcc

SEQ ID NO: 90017 - DNA, 25 bp, Homo sapien
tggcgctccttaatccctgtaaata

SEQ ID NO: 90018 - DNA, 25 bp, Homo sapien
gctcccgttgcacactctatcagta

SEQ ID NO: 90019 - DNA, 25 bp, Homo sapien
ctcttcacgttcttcgctgcgggta

SEQ ID NO: 90020 - DNA, 25 bp, Homo sapien
cccgggtgaaaacgctcagactatc

SEQ ID NO: 90021 - DNA, 25 bp, Homo sapien
ctccgcgttcaactggctacctaga

SEQ ID NO: 90022 - DNA, 25 bp, Homo sapien
tgctacttgcttttgccggactgga

SEQ ID NO: 90023 - DNA, 25 bp, Homo sapien
gccggactggaggttctttgaaata

SEQ ID NO: 90024 - DNA, 25 bp, Homo sapien
gctgaatctttgctggcgctcctta

SEQ ID NO: 90025 - DNA, 25 bp, Homo sapien
gtctttctggaagcatctgacttgg

SEQ ID NO: 90026 - DNA, 25 bp, Homo sapien
tctgacttgggattcgccttagtgc

SEQ ID NO: 90027 - DNA, 25 bp, Homo sapien
agtgcagcgtgtcctgttacacagg

SEQ ID NO: 90028 - DNA, 25 bp, Homo sapien
agcgagtctccagtgggcatgtttc

SEQ ID NO: 90029 - DNA, 25 bp, Homo sapien
acccagacgtggaagaccgggcagc

SEQ ID NO: 90030 - DNA, 25 bp, Homo sapien
cagtggaagacaccggagaaaccca

SEQ ID NO: 90031 - DNA, 25 bp, Homo sapien
tgaagagctgcatcccgcactaggc

SEQ ID NO: 90032 - DNA, 25 bp, Homo sapien
ttccagaatcgggtgccagcgatcc

SEQ ID NO: 90033 - DNA, 25 bp, Homo sapien
gcgtgctttcctcgcatgctgagtg

SEQ ID NO: 90034 - DNA, 25 bp, Homo sapien
gctgagtgtctaacctcggcttctg

SEQ ID NO: 90035 - DNA, 25 bp, Homo sapien
ctcatcagcccaggtcgtcgctttg

SEQ ID NO: 90036 - DNA, 25 bp, Homo sapien
tcgtcgctttgctgagttgctcaac

SEQ ID NO: 90037 - DNA, 25 bp, Homo sapien
acagacgctttcctggggcaacaaa

SEQ ID NO: 90038 - DNA, 25 bp, Homo sapien
gcgggcggcactaaacagacgcttt

SEQ ID NO: 90039 - DNA, 25 bp, Homo sapien
ccgctgcttccctggttgtggataa

SEQ ID NO: 90040 - DNA, 25 bp, Homo sapien
cgtgatctctaaatacggcagtttc

SEQ ID NO: 90041 - DNA, 25 bp, Homo sapien
ccatcatgcatcgtgagcctgcgaa

SEQ ID NO: 90042 - DNA, 25 bp, Homo sapien
aagagccactttctcgccagtacga

SEQ ID NO: 90043 - DNA, 25 bp, Homo sapien
ccagtacgatgctgcagcggttttc

SEQ ID NO: 90044 - DNA, 25 bp, Homo sapien
ttagccactgctgccggtttttata

SEQ ID NO: 90045 - DNA, 25 bp, Homo sapien
gctgtttgacgcctcatccttcggg

SEQ ID NO: 90046 - DNA, 25 bp, Homo sapien
caggcgtcgtcgaagcagatcagcc

SEQ ID NO: 90047 - DNA, 25 bp, Homo sapien
tcgcggcagctgtgtccaagacagc

SEQ ID NO: 90048 - DNA, 25 bp, Homo sapien
cgtagctcccgtactcatttttagc

SEQ ID NO: 90049 - DNA, 25 bp, Homo sapien
gacctcggctttctcaactgctaca

SEQ ID NO: 90050 - DNA, 25 bp, Homo sapien
agcacgcctccggttgccaaaacaa

SEQ ID NO: 90051 - DNA, 25 bp, Homo sapien
tttctgcttagcgacttggggtccc

SEQ ID NO: 90052 - DNA, 25 bp, Homo sapien
taccgaagggttcagtaccagcagc

SEQ ID NO: 90053 - DNA, 25 bp, Homo sapien
cccgtaagtgcctctgctgagcatc

SEQ ID NO: 90054 - DNA, 25 bp, Homo sapien
ctgtctgctcgcttcctcggatttt

SEQ ID NO: 90055 - DNA, 25 bp, Homo sapien
ggacagcatcctgccgccgtgacaa

SEQ ID NO: 90056 - DNA, 25 bp, Homo sapien
aggagtcgcaatcccagcagcaata

SEQ ID NO: 90057 - DNA, 25 bp, Homo sapien
caagcggcgggagattttcaaaatg

SEQ ID NO: 90058 - DNA, 25 bp, Homo sapien
actttccgtggtttcagcgtcgtcg

SEQ ID NO: 90059 - DNA, 25 bp, Homo sapien
ctcggaaggtgtcagggagaacttt

SEQ ID NO: 90060 - DNA, 25 bp, Homo sapien
cggagcgatccatctcgttacgtca

SEQ ID NO: 90061 - DNA, 25 bp, Homo sapien
gctaatccggagaacccaggccaga

SEQ ID NO: 90062 - DNA, 25 bp, Homo sapien
gcctggaaatatggcgacctgcatc

SEQ ID NO: 90063 - DNA, 25 bp, Homo sapien
aggcactgcggctttctttcagcaa

SEQ ID NO: 90064 - DNA, 25 bp, Homo sapien
cttctccaaggggatggcggttatc

SEQ ID NO: 90065 - DNA, 25 bp, Homo sapien
tcgcatcaacttctaccaggaaagc

SEQ ID NO: 90066 - DNA, 25 bp, Homo sapien
tccgcacgggccaggttcgcattcg

SEQ ID NO: 90067 - DNA, 25 bp, Homo sapien
gacccttcgccctacccgcctgctc

SEQ ID NO: 90068 - DNA, 25 bp, Homo sapien
gcctaggactcgcaaacctggtccc

SEQ ID NO: 90069 - DNA, 25 bp, Homo sapien
catcaacttctaccaggaaagcctc

SEQ ID NO: 90070 - DNA, 25 bp, Homo sapien
cgccgcccttcctcgcatcaacttc

SEQ ID NO: 90071 - DNA, 25 bp, Homo sapien
gggccaggttcgcattcgcgcctct

SEQ ID NO: 90072 - DNA, 25 bp, Homo sapien
caacttctaccaggaaagcctccgg

SEQ ID NO: 90073 - DNA, 25 bp, Homo sapien
tccggttaagtagtaggtgcgctaa

SEQ ID NO: 90074 - DNA, 25 bp, Homo sapien
ctgcttccaggtgtgtcgcctaaga

SEQ ID NO: 90075 - DNA, 25 bp, Homo sapien
ggctcctgttcactttcgttccgca

SEQ ID NO: 90076 - DNA, 25 bp, Homo sapien
ttcctggaaaggttaccggagctgc

SEQ ID NO: 90077 - DNA, 25 bp, Homo sapien
gttacactccctacaaggcgtcttg

SEQ ID NO: 90078 - DNA, 25 bp, Homo sapien
aacaagcctgtaagtgcgcgtgcgc

SEQ ID NO: 90079 - DNA, 25 bp, Homo sapien
gctgtatctagcatttcggttcctg

SEQ ID NO: 90080 - DNA, 25 bp, Homo sapien
tcctacgttgggagcgaatctcctc

SEQ ID NO: 90081 - DNA, 25 bp, Homo sapien
ggcgaatccgtcagctcccgcggga

SEQ ID NO: 90082 - DNA, 25 bp, Homo sapien
caactcgggtaaagctcctcggcct

SEQ ID NO: 90083 - DNA, 25 bp, Homo sapien
cctcagccagtgagccgggagtcgt

SEQ ID NO: 90084 - DNA, 25 bp, Homo sapien
cagagggacgatgtctactcgcgcc

SEQ ID NO: 90085 - DNA, 25 bp, Homo sapien
gttaccagctttggctgctcgcgcc

SEQ ID NO: 90086 - DNA, 25 bp, Homo sapien
ccgcgggcagttaccagctttggct

SEQ ID NO: 90087 - DNA, 25 bp, Homo sapien
cggtgagtagccacgtcacgctcct

SEQ ID NO: 90088 - DNA, 25 bp, Homo sapien
aaggacccggtgagtagccacgtca

SEQ ID NO: 90089 - DNA, 25 bp, Homo sapien
ttgctgcctttggtcacgtcgaaga

SEQ ID NO: 90090 - DNA, 25 bp, Homo sapien
aagtcccgcttcttcatgcgaggca

SEQ ID NO: 90091 - DNA, 25 bp, Homo sapien
ggtaacgttgtctcggatctcccgc

SEQ ID NO: 90092 - DNA, 25 bp, Homo sapien
gggcctctcagccaataacgtgaga

SEQ ID NO: 90093 - DNA, 25 bp, Homo sapien
cgaagactttcccattgaccgcgag

SEQ ID NO: 90094 - DNA, 25 bp, Homo sapien
agcctccgctaggttaagtagacga

SEQ ID NO: 90095 - DNA, 25 bp, Homo sapien
agaaaagatgctacgacggccgcgc

SEQ ID NO: 90096 - DNA, 25 bp, Homo sapien
ggaatcgcttcccttcctaggcctg

SEQ ID NO: 90097 - DNA, 25 bp, Homo sapien
ccctgtggcagcagtgacccagaaa

SEQ ID NO: 90098 - DNA, 25 bp, Homo sapien
gccaaacgccagaccgagagtgcct

SEQ ID NO: 90099 - DNA, 25 bp, Homo sapien
ccgaactcatgcagctccgagcgag

SEQ ID NO: 90100 - DNA, 25 bp, Homo sapien
agtgacccagaaatgagtttgattc

SEQ ID NO: 90101 - DNA, 25 bp, Homo sapien
agtttgattcacatagtccttcctc

SEQ ID NO: 90102 - DNA, 25 bp, Homo sapien
ctgcgaagagttaacgagggaccga

SEQ ID NO: 90103 - DNA, 25 bp, Homo sapien
caccctctcgttttggcaagggatt

SEQ ID NO: 90104 - DNA, 25 bp, Homo sapien
tttggcaagggattaaagtgctccc

SEQ ID NO: 90105 - DNA, 25 bp, Homo sapien
ttgtagcccgcctctggtgtttgag

SEQ ID NO: 90106 - DNA, 25 bp, Homo sapien
tgtcatcactgcaccggggctaatt

SEQ ID NO: 90107 - DNA, 25 bp, Homo sapien
tgcgccacgagaaggtgtcatcact

SEQ ID NO: 90108 - DNA, 25 bp, Homo sapien
ctgggatccttagccttctcacgtc

SEQ ID NO: 90109 - DNA, 25 bp, Homo sapien
tcccgcgctgttgtttctgtcgcct

SEQ ID NO: 90110 - DNA, 25 bp, Homo sapien
gtttgatttgcaactggggccgagc

SEQ ID NO: 90111 - DNA, 25 bp, Homo sapien
cgcaggcgtttgtttgttggttccg

SEQ ID NO: 90112 - DNA, 25 bp, Homo sapien
gagcgtcacctaacggtcccagctg

SEQ ID NO: 90113 - DNA, 25 bp, Homo sapien
tggggactccacgttcaaccgaatc

SEQ ID NO: 90114 - DNA, 25 bp, Homo sapien
tgtcaagcgctccagcggtgcaatc

SEQ ID NO: 90115 - DNA, 25 bp, Homo sapien
ccctggtgagagactgaagattgct

SEQ ID NO: 90116 - DNA, 25 bp, Homo sapien
cgccctgcgactttgaaaccggtgc

SEQ ID NO: 90117 - DNA, 25 bp, Homo sapien
ggagcttacgccatcgcgcgtccta

SEQ ID NO: 90118 - DNA, 25 bp, Homo sapien
gtcctagagtcctagcacgctattg

SEQ ID NO: 90119 - DNA, 25 bp, Homo sapien
cacgctattggctggctgtcaagca

SEQ ID NO: 90120 - DNA, 25 bp, Homo sapien
tgcaatctgcatcctactcacgcgg

SEQ ID NO: 90121 - DNA, 25 bp, Homo sapien
tcagtatgtgcccatctgtgtctgt

SEQ ID NO: 90122 - DNA, 25 bp, Homo sapien
tgcctgtctgtgtgaccacttctga

SEQ ID NO: 90123 - DNA, 25 bp, Homo sapien
tgtgaccacttctgactccctctta

SEQ ID NO: 90124 - DNA, 25 bp, Homo sapien
tgactccctcttacgactctattta

SEQ ID NO: 90125 - DNA, 25 bp, Homo sapien
tacgactctatttatctctctctcc

SEQ ID NO: 90126 - DNA, 25 bp, Homo sapien
gcgctctttccattgcccgctcttt

SEQ ID NO: 90127 - DNA, 25 bp, Homo sapien
gctctttctatctctgcccatcagt

SEQ ID NO: 90128 - DNA, 25 bp, Homo sapien
tgcccatcagtatgtgcccatctgt

SEQ ID NO: 90129 - DNA, 25 bp, Homo sapien
aggccgcatctgcagggtgagctca

SEQ ID NO: 90130 - DNA, 25 bp, Homo sapien
gaccagaatgcgtagtaatcaccta

SEQ ID NO: 90131 - DNA, 25 bp, Homo sapien
ccgctgtgagtactgtgtgaccaga

SEQ ID NO: 90132 - DNA, 25 bp, Homo sapien
agccggcatcacaggcccgctgtga

SEQ ID NO: 90133 - DNA, 25 bp, Homo sapien
agattcacccgctgaagccggcatc

SEQ ID NO: 90134 - DNA, 25 bp, Homo sapien
ctctggacctgacggagattcaccc

SEQ ID NO: 90135 - DNA, 25 bp, Homo sapien
ctcaggcccggaattcatctctgga

SEQ ID NO: 90136 - DNA, 25 bp, Homo sapien
atcacctaacgcaggatgtggcggc

SEQ ID NO: 90137 - DNA, 25 bp, Homo sapien
ggcaaacaaacccagcgacagattg

SEQ ID NO: 90138 - DNA, 25 bp, Homo sapien
gcgacagattgtgccgcggctcatt

SEQ ID NO: 90139 - DNA, 25 bp, Homo sapien
gaggcagctcggcaaacaaacccag

SEQ ID NO: 90140 - DNA, 25 bp, Homo sapien
tccgcatcttgtgatatttcgctcc

SEQ ID NO: 90141 - DNA, 25 bp, Homo sapien
tcagcgtctgtctccgcatcttgtg

SEQ ID NO: 90142 - DNA, 25 bp, Homo sapien
atgacagcacacctgagtcagcccg

SEQ ID NO: 90143 - DNA, 25 bp, Homo sapien
cagcttcggggttccgcctgccttg

SEQ ID NO: 90144 - DNA, 25 bp, Homo sapien
attgtgccgcggctcattccgggga

SEQ ID NO: 90145 - DNA, 25 bp, Homo sapien
taggactgcgctgtgtcagcgtgga

SEQ ID NO: 90146 - DNA, 25 bp, Homo sapien
cgcctggcctgagttacaggtggtt

SEQ ID NO: 90147 - DNA, 25 bp, Homo sapien
acgcctggcctgagttacgggtggt

SEQ ID NO: 90148 - DNA, 25 bp, Homo sapien
actgtgctgtgtcagcgtggacgcc

SEQ ID NO: 90149 - DNA, 25 bp, Homo sapien
gacgcctggcctgagttacgggtgg

SEQ ID NO: 90150 - DNA, 25 bp, Homo sapien
gcctggcctgagttacaggtggttt

SEQ ID NO: 90151 - DNA, 25 bp, Homo sapien
ctgtgtcagcgtggacgcctggcct

SEQ ID NO: 90152 - DNA, 25 bp, Homo sapien
ctgtgctgtgtcagcgtggacgcct

SEQ ID NO: 90153 - DNA, 25 bp, Homo sapien
tgctgtcagcgtggacgcctggcct

SEQ ID NO: 90154 - DNA, 25 bp, Homo sapien
tggtttcgtaggactatgctgtcag

SEQ ID NO: 90155 - DNA, 25 bp, Homo sapien
ttcgtaggactatgctgtcagcgtg

SEQ ID NO: 90156 - DNA, 25 bp, Homo sapien
tcgtaggactatgctgtcagcgtgg

SEQ ID NO: 90157 - DNA, 25 bp, Homo sapien
actatgctgtcagcgtggacgcctg

SEQ ID NO: 90158 - DNA, 25 bp, Homo sapien
ggtttcgtaggactatgctgtcagc

SEQ ID NO: 90159 - DNA, 25 bp, Homo sapien
ggactatgctgtcagcgtggacgcc

SEQ ID NO: 90160 - DNA, 25 bp, Homo sapien
taggactatgctgtcagcgtggacg

SEQ ID NO: 90161 - DNA, 25 bp, Homo sapien
ctcgcacccgcttgtaaatgcacta

SEQ ID NO: 90162 - DNA, 25 bp, Homo sapien
ggcatacacacaccgggcacatatt

SEQ ID NO: 90163 - DNA, 25 bp, Homo sapien
tcccgcctcctagtggtcgagaaag

SEQ ID NO: 90164 - DNA, 25 bp, Homo sapien
cagacatgcacgctggcggactttc

SEQ ID NO: 90165 - DNA, 25 bp, Homo sapien
gcacgctcatatgcactcgatcttg

SEQ ID NO: 90166 - DNA, 25 bp, Homo sapien
taacgggcaagcatcctgagtcaca

SEQ ID NO: 90167 - DNA, 25 bp, Homo sapien
cgaacacagtcctccgggtcgctta

SEQ ID NO: 90168 - DNA, 25 bp, Homo sapien
ttcttatagtcgcacactgggcttg

SEQ ID NO: 90169 - DNA, 25 bp, Homo sapien
ggctgcgacgcagacgcccactttg

SEQ ID NO: 90170 - DNA, 25 bp, Homo sapien
gacggacagagatacttgccccatc

SEQ ID NO: 90171 - DNA, 25 bp, Homo sapien
ctttgacggacagagatacttgccc

SEQ ID NO: 90172 - DNA, 25 bp, Homo sapien
acctttgacggacagagatacttgc

SEQ ID NO: 90173 - DNA, 25 bp, Homo sapien
tactacctttgacggacagagatac

SEQ ID NO: 90174 - DNA, 25 bp, Homo sapien
ggacttctatactacctttgacgga

SEQ ID NO: 90175 - DNA, 25 bp, Homo sapien
gctggacttctatactacctttgac

SEQ ID NO: 90176 - DNA, 25 bp, Homo sapien
ctatactacctttgacggacagaga

SEQ ID NO: 90177 - DNA, 25 bp, Homo sapien
agccacgaacgccagcatttgagtg

SEQ ID NO: 90178 - DNA, 25 bp, Homo sapien
tgactcagccacgaacgccagcatt

SEQ ID NO: 90179 - DNA, 25 bp, Homo sapien
gactcagccacgaacgccagcattt

SEQ ID NO: 90180 - DNA, 25 bp, Homo sapien
ctcagccacgaacgccagcatttga

SEQ ID NO: 90181 - DNA, 25 bp, Homo sapien
gccacgaacgccagcatttgagtga

SEQ ID NO: 90182 - DNA, 25 bp, Homo sapien
cacgaacgccagcatttgagtgaca

SEQ ID NO: 90183 - DNA, 25 bp, Homo sapien
cgaacgccagcatttgagtgacaga

SEQ ID NO: 90184 - DNA, 25 bp, Homo sapien
actcagccacgaacgccagcatttg

SEQ ID NO: 90185 - DNA, 25 bp, Homo sapien
agctaggtcctcgagtgagttaatc

SEQ ID NO: 90186 - DNA, 25 bp, Homo sapien
cccgctcctaggagaggatatcgca

SEQ ID NO: 90187 - DNA, 25 bp, Homo sapien
gcgctactttttcccttctcgatga

SEQ ID NO: 90188 - DNA, 25 bp, Homo sapien
tctgcccgtctgtaagcgctgtcat

SEQ ID NO: 90189 - DNA, 25 bp, Homo sapien
tcagtcactgatgaacgcgctcacg

SEQ ID NO: 90190 - DNA, 25 bp, Homo sapien
agcggctcaaatcaactcctcagtc

SEQ ID NO: 90191 - DNA, 25 bp, Homo sapien
ccgcacaaggcgcagggatatcaga

SEQ ID NO: 90192 - DNA, 25 bp, Homo sapien
ttgccaattagtgggccctgcgcta

SEQ ID NO: 90193 - DNA, 25 bp, Homo sapien
tgcgctctccaccagtaagtcgatc

SEQ ID NO: 90194 - DNA, 25 bp, Homo sapien
ggctggtaacgccactgtcaacatc

SEQ ID NO: 90195 - DNA, 25 bp, Homo sapien
cagatccagggcatgagcgtcttca

SEQ ID NO: 90196 - DNA, 25 bp, Homo sapien
tggcgcctacatctacgcggtgagc

SEQ ID NO: 90197 - DNA, 25 bp, Homo sapien
ctgaaaacaacgtgcctggcgccta

SEQ ID NO: 90198 - DNA, 25 bp, Homo sapien
ccagccggtctacgacgtgtatgtg

SEQ ID NO: 90199 - DNA, 25 bp, Homo sapien
ggagacgtgcctttccgcctcaagt

SEQ ID NO: 90200 - DNA, 25 bp, Homo sapien
taccaagtgtacgtgcaagccaagg

SEQ ID NO: 90201 - DNA, 25 bp, Homo sapien
cgggatagcgcacctggctcatcac

SEQ ID NO: 90202 - DNA, 25 bp, Homo sapien
gatagcgcacctggctcatcacgga

SEQ ID NO: 90203 - DNA, 25 bp, Homo sapien
agctccacggtctcgggatagcgca

SEQ ID NO: 90204 - DNA, 25 bp, Homo sapien
tagcgcacctggctcatcacggaac

SEQ ID NO: 90205 - DNA, 25 bp, Homo sapien
acagctccacggtctcgggatagcg

SEQ ID NO: 90206 - DNA, 25 bp, Homo sapien
gcacctggctcatcacggaaccaag

SEQ ID NO: 90207 - DNA, 25 bp, Homo sapien
cacagctccacggtctcgggatagc

SEQ ID NO: 90208 - DNA, 25 bp, Homo sapien
gggatagcgcacctggctcatcacg

SEQ ID NO: 90209 - DNA, 25 bp, Homo sapien
aagtaatcgtgaaacgccgcacggg

SEQ ID NO: 90210 - DNA, 25 bp, Homo sapien
gaacgaatggaacagcagccgctgt

SEQ ID NO: 90211 - DNA, 25 bp, Homo sapien
cagccgctgtgtcactgagtattac

SEQ ID NO: 90212 - DNA, 25 bp, Homo sapien
tgagtattacatcacacccagccta

SEQ ID NO: 90213 - DNA, 25 bp, Homo sapien
acccagcctacacacgcacggggcc

SEQ ID NO: 90214 - DNA, 25 bp, Homo sapien
ggaggacagccagcacgcaccgacg

SEQ ID NO: 90215 - DNA, 25 bp, Homo sapien
actcgggaggagaaagtaatcgtga

SEQ ID NO: 90216 - DNA, 25 bp, Homo sapien
acgcaccgacgcagcaccgacgcag

SEQ ID NO: 90217 - DNA, 25 bp, Homo sapien
cagtctttccttcgcgtaatgccgc

SEQ ID NO: 90218 - DNA, 25 bp, Homo sapien
tcggcagtctttccttcgcgtaatg

SEQ ID NO: 90219 - DNA, 25 bp, Homo sapien
tgctgcgccgcactcggcagtcttt

SEQ ID NO: 90220 - DNA, 25 bp, Homo sapien
tgtcaccttttgagcagcgtgcctc

SEQ ID NO: 90221 - DNA, 25 bp, Homo sapien
gatctcctacagcttgtcacctttt

SEQ ID NO: 90222 - DNA, 25 bp, Homo sapien
gatgcaacatgtgatctcctacagc

SEQ ID NO: 90223 - DNA, 25 bp, Homo sapien
tcggacgtagatgcaacatgtgatc

SEQ ID NO: 90224 - DNA, 25 bp, Homo sapien
tttgggaatcggacgtagatgcaac

SEQ ID NO: 90225 - DNA, 25 bp, Homo sapien
tcaggcatgattttttaaactacac

SEQ ID NO: 90226 - DNA, 25 bp, Homo sapien
gttgagtttttgagccacgaatttc

SEQ ID NO: 90227 - DNA, 25 bp, Homo sapien
ggcatgattttttaaactacaccta

SEQ ID NO: 90228 - DNA, 25 bp, Homo sapien
aactggttgagtttttgagccacga

SEQ ID NO: 90229 - DNA, 25 bp, Homo sapien
aagttcgattctctaagcttttgta

SEQ ID NO: 90230 - DNA, 25 bp, Homo sapien
ccacgaatttctctttatatcagta

SEQ ID NO: 90231 - DNA, 25 bp, Homo sapien
gctcggggcccaatatcaggcatga

SEQ ID NO: 90232 - DNA, 25 bp, Homo sapien
agtttttgagccacgaatttctctt

SEQ ID NO: 90233 - DNA, 25 bp, Homo sapien
tgggccgccaaagcaccgcaccagc

SEQ ID NO: 90234 - DNA, 25 bp, Homo sapien
gaacccagcgccctcggtaagctgg

SEQ ID NO: 90235 - DNA, 25 bp, Homo sapien
aggccatgcagctgaccaggtcgct

SEQ ID NO: 90236 - DNA, 25 bp, Homo sapien
atgcagctgaccaggtcgctggctg

SEQ ID NO: 90237 - DNA, 25 bp, Homo sapien
gaagcggcgcgccactcttactttc

SEQ ID NO: 90238 - DNA, 25 bp, Homo sapien
tcaggcttggcggtcacactgatgc

SEQ ID NO: 90239 - DNA, 25 bp, Homo sapien
cactcttactttccgccctgggccg

SEQ ID NO: 90240 - DNA, 25 bp, Homo sapien
catggccgtccggagtgtcaggctt

SEQ ID NO: 90241 - DNA, 25 bp, Homo sapien
gctcacgcagacaacgtggctccag

SEQ ID NO: 90242 - DNA, 25 bp, Homo sapien
atgcggctctgcaggacatcgggaa

SEQ ID NO: 90243 - DNA, 25 bp, Homo sapien
gcccagctctttgcacagctttcta

SEQ ID NO: 90244 - DNA, 25 bp, Homo sapien
tctggtaacatgagggactgaaaca

SEQ ID NO: 90245 - DNA, 25 bp, Homo sapien
taaatgggctcacatctcacaagga

SEQ ID NO: 90246 - DNA, 25 bp, Homo sapien
tctcacaaggaacatggaaatgctg

SEQ ID NO: 90247 - DNA, 25 bp, Homo sapien
ccctttgcataacacttctggtaac

SEQ ID NO: 90248 - DNA, 25 bp, Homo sapien
atccaaatatagtgctggcgtggcc

SEQ ID NO: 90249 - DNA, 25 bp, Homo sapien
accctgaagaaagtgtccgtgacca

SEQ ID NO: 90250 - DNA, 25 bp, Homo sapien
tggcggtgaactgcatgctgattcg

SEQ ID NO: 90251 - DNA, 25 bp, Homo sapien
catgctgattcgtgaggcccagagc

SEQ ID NO: 90252 - DNA, 25 bp, Homo sapien
ccagagctacgtctgggctgccacg

SEQ ID NO: 90253 - DNA, 25 bp, Homo sapien
ttggctgcgtgaccacagacttccc

SEQ ID NO: 90254 - DNA, 25 bp, Homo sapien
ggctgccacggctgtttcaagacaa

SEQ ID NO: 90255 - DNA, 25 bp, Homo sapien
gaccatcagtgacgacggcaccctg

SEQ ID NO: 90256 - DNA, 25 bp, Homo sapien
cgtctgacatgagccgagtgttctg

SEQ ID NO: 90257 - DNA, 25 bp, Homo sapien
cgcccacaggcggtgctttattgtg

SEQ ID NO: 90258 - DNA, 25 bp, Homo sapien
gcatgtttcatagtccgcggcggct

SEQ ID NO: 90259 - DNA, 25 bp, Homo sapien
gaccgcctgcggattctatctataa

SEQ ID NO: 90260 - DNA, 25 bp, Homo sapien
acgtaggccgtctgccactctgaca

SEQ ID NO: 90261 - DNA, 25 bp, Homo sapien
aggcggacgccttttgctgtatcca

SEQ ID NO: 90262 - DNA, 25 bp, Homo sapien
ttaacgcatcacacactgccgaggg

SEQ ID NO: 90263 - DNA, 25 bp, Homo sapien
gttttaatcatcgtcgcctcgccca

SEQ ID NO: 90264 - DNA, 25 bp, Homo sapien
tgttcccgaacaggtgagtgcaccc

SEQ ID NO: 90265 - DNA, 25 bp, Homo sapien
ttccatgcgtacattgtcagcttca

SEQ ID NO: 90266 - DNA, 25 bp, Homo sapien
ttcactcccgcccaatcttcattgg

SEQ ID NO: 90267 - DNA, 25 bp, Homo sapien
gtgcccttccgctgcagcagtggcg

SEQ ID NO: 90268 - DNA, 25 bp, Homo sapien
ctgcggccacttccgtgtttacact

SEQ ID NO: 90269 - DNA, 25 bp, Homo sapien
cctccaattccatgcgtacattgtc

SEQ ID NO: 90270 - DNA, 25 bp, Homo sapien
ttccctccaattccatgcgtacatt

SEQ ID NO: 90271 - DNA, 25 bp, Homo sapien
gcgtacattgtcagcttcactcccg

SEQ ID NO: 90272 - DNA, 25 bp, Homo sapien
catgcgtacattgtcagcttcactc

SEQ ID NO: 90273 - DNA, 25 bp, Homo sapien
cccagaaatcaacgttctaatttgg

SEQ ID NO: 90274 - DNA, 25 bp, Homo sapien
gttctgtcctttccgaggcgcttcc

SEQ ID NO: 90275 - DNA, 25 bp, Homo sapien
gtccgttctgtcctttccgaggcgc

SEQ ID NO: 90276 - DNA, 25 bp, Homo sapien
tgtcaatcccgtccgttctgtcctt

SEQ ID NO: 90277 - DNA, 25 bp, Homo sapien
gaaccagaggcctgtcaatcccgtc

SEQ ID NO: 90278 - DNA, 25 bp, Homo sapien
agcagattggaaccagaggcctgtc

SEQ ID NO: 90279 - DNA, 25 bp, Homo sapien
tcagagagcagattggaaccagagg

SEQ ID NO: 90280 - DNA, 25 bp, Homo sapien
aacgttctaatttggaacacctcag

SEQ ID NO: 90281 - DNA, 25 bp, Homo sapien
aggcaggttactctccaaggtgatc

SEQ ID NO: 90282 - DNA, 25 bp, Homo sapien
cctggttcctcagcaactggggtga

SEQ ID NO: 90283 - DNA, 25 bp, Homo sapien
tccttgcgcgtcctccgacaggaag

SEQ ID NO: 90284 - DNA, 25 bp, Homo sapien
agagacgtcgccatgtttatcccgg

SEQ ID NO: 90285 - DNA, 25 bp, Homo sapien
acttcctgattcgtcgcctccatta

SEQ ID NO: 90286 - DNA, 25 bp, Homo sapien
tgactgtgaggtggacactgtaccc

SEQ ID NO: 90287 - DNA, 25 bp, Homo sapien
cacagactgctacaggggagtcacc

SEQ ID NO: 90288 - DNA, 25 bp, Homo sapien
cttaccggcccgaatgagcagatcc

SEQ ID NO: 90289 - DNA, 25 bp, Homo sapien
ccctgacatggatttctataccaca

SEQ ID NO: 90290 - DNA, 25 bp, Homo sapien
ttcattaatcccaagatacacattt

SEQ ID NO: 90291 - DNA, 25 bp, Homo sapien
ggatttctataccacaactcacctc

SEQ ID NO: 90292 - DNA, 25 bp, Homo sapien
ctccatttttcacaggcctcatatt

SEQ ID NO: 90293 - DNA, 25 bp, Homo sapien
cacaggcctcatattttaatgttta

SEQ ID NO: 90294 - DNA, 25 bp, Homo sapien
acaactcacctccatttttcacagg

SEQ ID NO: 90295 - DNA, 25 bp, Homo sapien
caggaaagattcataattgcaaatc

SEQ ID NO: 90296 - DNA, 25 bp, Homo sapien
ttcccagtaaatgagagtttcagga

SEQ ID NO: 90297 - DNA, 25 bp, Homo sapien
cccgagccgctccacagggagagaa

SEQ ID NO: 90298 - DNA, 25 bp, Homo sapien
ggactctcgcccttctccggagacg

SEQ ID NO: 90299 - DNA, 25 bp, Homo sapien
aagacgctcgtcacttgtccggctc

SEQ ID NO: 90300 - DNA, 25 bp, Homo sapien
gccttcccaggtaaagacgctcgtc

SEQ ID NO: 90301 - DNA, 25 bp, Homo sapien
agcgcctgtcaaacgcgggccggct

SEQ ID NO: 90302 - DNA, 25 bp, Homo sapien
tgctctccgcgacgcctgggaagac

SEQ ID NO: 90303 - DNA, 25 bp, Homo sapien
acagtcgggcagtctgacagttaca

SEQ ID NO: 90304 - DNA, 25 bp, Homo sapien
cagcccgccgaacctgcttcttttg

SEQ ID NO: 90305 - DNA, 25 bp, Homo sapien
ctctgactgcggtgctgagatcgaa

SEQ ID NO: 90306 - DNA, 25 bp, Homo sapien
caaccacctgtacggggtggccgag

SEQ ID NO: 90307 - DNA, 25 bp, Homo sapien
gtgtccagctccgacgtgacctgcg

SEQ ID NO: 90308 - DNA, 25 bp, Homo sapien
gagttcctgcggctcaacgctaacc

SEQ ID NO: 90309 - DNA, 25 bp, Homo sapien
cggctgctcacagagcacgtgtttc

SEQ ID NO: 90310 - DNA, 25 bp, Homo sapien
tgttcaacaacagcctggcctcgct

SEQ ID NO: 90311 - DNA, 25 bp, Homo sapien
tctaccgagatctgcctgccgaaga

SEQ ID NO: 90312 - DNA, 25 bp, Homo sapien
acgcgcctactgaggacgactactg

SEQ ID NO: 90313 - DNA, 25 bp, Homo sapien
cggaggaacgcaccgcgagcaccaa

SEQ ID NO: 90314 - DNA, 25 bp, Homo sapien
cgcagtacacgtgcccgcagttggt

SEQ ID NO: 90315 - DNA, 25 bp, Homo sapien
tgaggctgaagcacgacgtcctgtg

SEQ ID NO: 90316 - DNA, 25 bp, Homo sapien
gcagcgattacagaacacccagttg

SEQ ID NO: 90317 - DNA, 25 bp, Homo sapien
ccacgcgaagcccacgcaaggttgg

SEQ ID NO: 90318 - DNA, 25 bp, Homo sapien
cgtctcccaggtcgtttgggctgga

SEQ ID NO: 90319 - DNA, 25 bp, Homo sapien
tgtcttggcggtcctcaggtgtttt

SEQ ID NO: 90320 - DNA, 25 bp, Homo sapien
ctgcgcaaagtcgacggcagccctg

SEQ ID NO: 90321 - DNA, 25 bp, Homo sapien
ttactcaccgtcctttccgagcggc

SEQ ID NO: 90322 - DNA, 25 bp, Homo sapien
gcggagatacatcgcgcccgctgtc

SEQ ID NO: 90323 - DNA, 25 bp, Homo sapien
agagtcttggagaccgccctgcgga

SEQ ID NO: 90324 - DNA, 25 bp, Homo sapien
ggaggcacgtcgaccttcatccagc

SEQ ID NO: 90325 - DNA, 25 bp, Homo sapien
tctccgggctagacctccttactca

SEQ ID NO: 90326 - DNA, 25 bp, Homo sapien
cgggcgaaatctgcacccgaggcgc

SEQ ID NO: 90327 - DNA, 25 bp, Homo sapien
gcttctgctgctctgggtcgggttt

SEQ ID NO: 90328 - DNA, 25 bp, Homo sapien
gaccgccctgcggagatacatcgcg

SEQ ID NO: 90329 - DNA, 25 bp, Homo sapien
tcgtctgccggcgaaggtcactgca

SEQ ID NO: 90330 - DNA, 25 bp, Homo sapien
aaggtcactgcaggacgaacccggg

SEQ ID NO: 90331 - DNA, 25 bp, Homo sapien
taatctgagggtcgagtcggcctgc

SEQ ID NO: 90332 - DNA, 25 bp, Homo sapien
cctgcacgaggaggatactcacggc

SEQ ID NO: 90333 - DNA, 25 bp, Homo sapien
gacggcgccatcttgcgtggcccag

SEQ ID NO: 90334 - DNA, 25 bp, Homo sapien
tcagtctctccgagttggcaacaga

SEQ ID NO: 90335 - DNA, 25 bp, Homo sapien
tggcaacagaaccagcgccacctgg

SEQ ID NO: 90336 - DNA, 25 bp, Homo sapien
ggggcgtcaacgtgaattccagcac

SEQ ID NO: 90337 - DNA, 25 bp, Homo sapien
tcagttaccacgtgaaccgccgacg

SEQ ID NO: 90338 - DNA, 25 bp, Homo sapien
ggcttctagactgccggttctcatt

SEQ ID NO: 90339 - DNA, 25 bp, Homo sapien
gcattgctttgctccctctctgtgg

SEQ ID NO: 90340 - DNA, 25 bp, Homo sapien
tgcgctcttcaagcggatcttggta

SEQ ID NO: 90341 - DNA, 25 bp, Homo sapien
ctgcctctgtcggtctgttcagtta

SEQ ID NO: 90342 - DNA, 25 bp, Homo sapien
gtctgaaccgtacttgcctagcctc

SEQ ID NO: 90343 - DNA, 25 bp, Homo sapien
ctcgtcaggccgaatgcattgcttt

SEQ ID NO: 90344 - DNA, 25 bp, Homo sapien
tcgagggtaccacgcactgaaatga

SEQ ID NO: 90345 - DNA, 25 bp, Homo sapien
ccgcacatgtgtcagcgtgcggtga

SEQ ID NO: 90346 - DNA, 25 bp, Homo sapien
tcaccgccgcacatgtgtcagcgtg

SEQ ID NO: 90347 - DNA, 25 bp, Homo sapien
tcaggagccagaccacgcgagcggc

SEQ ID NO: 90348 - DNA, 25 bp, Homo sapien
gcctgggtcaggagccagaccacgc

SEQ ID NO: 90349 - DNA, 25 bp, Homo sapien
ccagtgtcctgtggagagaaaacag

SEQ ID NO: 90350 - DNA, 25 bp, Homo sapien
cgtggtcctggcgacatcggtctca

SEQ ID NO: 90351 - DNA, 25 bp, Homo sapien
tcctggcgacatcggtctcacgtgt

SEQ ID NO: 90352 - DNA, 25 bp, Homo sapien
acatcggtctcacgtgtgggaagac

SEQ ID NO: 90353 - DNA, 25 bp, Homo sapien
tctctggggcgaccaaacgatacgt

SEQ ID NO: 90354 - DNA, 25 bp, Homo sapien
cgtccttaccgttgctctccaggta

SEQ ID NO: 90355 - DNA, 25 bp, Homo sapien
tcaagataatcgtgatcggcgactc

SEQ ID NO: 90356 - DNA, 25 bp, Homo sapien
gcggcaagctgaagaaacctgtctc

SEQ ID NO: 90357 - DNA, 25 bp, Homo sapien
tcgctcgaggcaagcttttcgtcca

SEQ ID NO: 90358 - DNA, 25 bp, Homo sapien
cggtggcgtaatctctcagcctttc

SEQ ID NO: 90359 - DNA, 25 bp, Homo sapien
gtggtacctccttcctctcagttgt

SEQ ID NO: 90360 - DNA, 25 bp, Homo sapien
cggcgactccaatgtgggcaagaca

SEQ ID NO: 90361 - DNA, 25 bp, Homo sapien
atctcgtcgtcgctatccatggcgg

SEQ ID NO: 90362 - DNA, 25 bp, Homo sapien
cccggagaaatgcttgtaccttcca

SEQ ID NO: 90363 - DNA, 25 bp, Homo sapien
ctctttgttatcgagcagctgatcc

SEQ ID NO: 90364 - DNA, 25 bp, Homo sapien
tccctcgctgattgacagttccctg

SEQ ID NO: 90365 - DNA, 25 bp, Homo sapien
ggcccgtcagcgtttctcttttgct

SEQ ID NO: 90366 - DNA, 25 bp, Homo sapien
ttgtgccgggagcaacttgaaagtc

SEQ ID NO: 90367 - DNA, 25 bp, Homo sapien
cttgaaagtccgtcgtgcactgtcc

SEQ ID NO: 90368 - DNA, 25 bp, Homo sapien
tgcactgtccgtgttccctcgagac

SEQ ID NO: 90369 - DNA, 25 bp, Homo sapien
tcttgcgagcggcttttgtagccag

SEQ ID NO: 90370 - DNA, 25 bp, Homo sapien
cgcactcttgcgagcggcttttgta

SEQ ID NO: 90371 - DNA, 25 bp, Homo sapien
tttaccaccggtcgatttgcgggca

SEQ ID NO: 90372 - DNA, 25 bp, Homo sapien
tcctgggtgctttaccaccggtcga

SEQ ID NO: 90373 - DNA, 25 bp, Homo sapien
ctgggtgctttaccaccggtcgatt

SEQ ID NO: 90374 - DNA, 25 bp, Homo sapien
tggtacagagacctccttacttacc

SEQ ID NO: 90375 - DNA, 25 bp, Homo sapien
agggcgcactcttgcgagcggcttt

SEQ ID NO: 90376 - DNA, 25 bp, Homo sapien
taccaccggtcgatttgcgggcagt

SEQ ID NO: 90377 - DNA, 25 bp, Homo sapien
tgagttctctctccattgccgtgta

SEQ ID NO: 90378 - DNA, 25 bp, Homo sapien
tggagccaggcagtcaagtgttact

SEQ ID NO: 90379 - DNA, 25 bp, Homo sapien
gcctggcaactgagagcacaatacc

SEQ ID NO: 90380 - DNA, 25 bp, Homo sapien
gatggacatcacacacgacagcctg

SEQ ID NO: 90381 - DNA, 25 bp, Homo sapien
ggctcagagtccttgcaatcgcttg

SEQ ID NO: 90382 - DNA, 25 bp, Homo sapien
ctccgactgacactgaactggtttc

SEQ ID NO: 90383 - DNA, 25 bp, Homo sapien
tagcctctcgactccagcctatatg

SEQ ID NO: 90384 - DNA, 25 bp, Homo sapien
ctcgcagatggcttaatcagggctc

SEQ ID NO: 90385 - DNA, 25 bp, Homo sapien
catgcggatcctgcgttcaccagcg

SEQ ID NO: 90386 - DNA, 25 bp, Homo sapien
tcggagtcgcttccatgcggatcct

SEQ ID NO: 90387 - DNA, 25 bp, Homo sapien
ctcccaagccgcagaggcgtggaaa

SEQ ID NO: 90388 - DNA, 25 bp, Homo sapien
agcaactcgaaaacccacagcctga

SEQ ID NO: 90389 - DNA, 25 bp, Homo sapien
tcaggaggattttcatttatcagga

SEQ ID NO: 90390 - DNA, 25 bp, Homo sapien
gctgccgtttctattggagagacaa

SEQ ID NO: 90391 - DNA, 25 bp, Homo sapien
gcctcagcgagacgtgctgccgttt

SEQ ID NO: 90392 - DNA, 25 bp, Homo sapien
ttcaccagcgcccaaaagaggaggc

SEQ ID NO: 90393 - DNA, 25 bp, Homo sapien
ctctgaagagttccctggggacacg

SEQ ID NO: 90394 - DNA, 25 bp, Homo sapien
aagcctgcatttccgggggcttcca

SEQ ID NO: 90395 - DNA, 25 bp, Homo sapien
cgagtatcccaaagacgccagcaac

SEQ ID NO: 90396 - DNA, 25 bp, Homo sapien
atggcgggctgctcccgagtatccc

SEQ ID NO: 90397 - DNA, 25 bp, Homo sapien
agacgccagcaaccctcgctcactg

SEQ ID NO: 90398 - DNA, 25 bp, Homo sapien
tgctctgaagagttccctggggaca

SEQ ID NO: 90399 - DNA, 25 bp, Homo sapien
ccacggcaggacgttggtccagtcc

SEQ ID NO: 90400 - DNA, 25 bp, Homo sapien
gctgctcccgagtatcccaaagacg

SEQ ID NO: 90401 - DNA, 25 bp, Homo sapien
ctggtcgcaaactctactcatcttg

SEQ ID NO: 90402 - DNA, 25 bp, Homo sapien
ggagcccatttctccgcaatccatg

SEQ ID NO: 90403 - DNA, 25 bp, Homo sapien
tggcacgggaattttggagcctccc

SEQ ID NO: 90404 - DNA, 25 bp, Homo sapien
cccaaaggttgtgagagattctgtg

SEQ ID NO: 90405 - DNA, 25 bp, Homo sapien
actcatcttgccgtgtccagagacc

SEQ ID NO: 90406 - DNA, 25 bp, Homo sapien
caatccatgcgcgtggggtgtacaa

SEQ ID NO: 90407 - DNA, 25 bp, Homo sapien
actgggaacggcactggcttttgtt

SEQ ID NO: 90408 - DNA, 25 bp, Homo sapien
gaggtaaacgccacagcagtccttg

SEQ ID NO: 90409 - DNA, 25 bp, Homo sapien
caccgtggatatcttggaaatggca

SEQ ID NO: 90410 - DNA, 25 bp, Homo sapien
ccgcggatatcatggaaatggcacc

SEQ ID NO: 90411 - DNA, 25 bp, Homo sapien
cgccgtggatatcatggaaatagca

SEQ ID NO: 90412 - DNA, 25 bp, Homo sapien
atagcacccatagcgagagtttaga

SEQ ID NO: 90413 - DNA, 25 bp, Homo sapien
caccgacgaggagagcttagaatgc

SEQ ID NO: 90414 - DNA, 25 bp, Homo sapien
gaacgccgtgcatatcatggaaatg

SEQ ID NO: 90415 - DNA, 25 bp, Homo sapien
caccgatggggagagtttagaacac

SEQ ID NO: 90416 - DNA, 25 bp, Homo sapien
ctcaggacgccgtggatatcatgga

SEQ ID NO: 90417 - DNA, 25 bp, Homo sapien
atcaatatttccacgcacccggcgg

SEQ ID NO: 90418 - DNA, 25 bp, Homo sapien
tcaggggttcactctttcaaatcgg

SEQ ID NO: 90419 - DNA, 25 bp, Homo sapien
gtgcgccctcaccatgatcagcgtg

SEQ ID NO: 90420 - DNA, 25 bp, Homo sapien
ccaccgtgcaaatcagacccttgta

SEQ ID NO: 90421 - DNA, 25 bp, Homo sapien
gggaaacttttccagcacctcactc

SEQ ID NO: 90422 - DNA, 25 bp, Homo sapien
ttctcgcagttgacgtggtgccgac

SEQ ID NO: 90423 - DNA, 25 bp, Homo sapien
gagcctgctggtacctgttctcgca

SEQ ID NO: 90424 - DNA, 25 bp, Homo sapien
tagcgacgacggcagctttttccct

SEQ ID NO: 90425 - DNA, 25 bp, Homo sapien
gaatcctcctgtgggcctcggcatt

SEQ ID NO: 90426 - DNA, 25 bp, Homo sapien
atccagcaattagcacgcgaggagg

SEQ ID NO: 90427 - DNA, 25 bp, Homo sapien
tttccctgaccgaagtcccagtaga

SEQ ID NO: 90428 - DNA, 25 bp, Homo sapien
gtcccagtagagtatccagcaatta

SEQ ID NO: 90429 - DNA, 25 bp, Homo sapien
cattttcctcctgctggtctgtgtg

SEQ ID NO: 90430 - DNA, 25 bp, Homo sapien
gcccgcggtcaggtcaaggaatcct

SEQ ID NO: 90431 - DNA, 25 bp, Homo sapien
ccagagctgttcctaggcggatctt

SEQ ID NO: 90432 - DNA, 25 bp, Homo sapien
gaggctttgtgtattcggaaccgga

SEQ ID NO: 90433 - DNA, 25 bp, Homo sapien
cgtgtattctcgagtcaggattggc

SEQ ID NO: 90434 - DNA, 25 bp, Homo sapien
gggattcttctcacggcgcacgttc

SEQ ID NO: 90435 - DNA, 25 bp, Homo sapien
ccaggcgactagagctgcatcctca

SEQ ID NO: 90436 - DNA, 25 bp, Homo sapien
ggcagaacccttgcgcgacctcttt

SEQ ID NO: 90437 - DNA, 25 bp, Homo sapien
tcaggcccaggcgttctttgggaga

SEQ ID NO: 90438 - DNA, 25 bp, Homo sapien
cggtccctgacgcagacatcgtgta

SEQ ID NO: 90439 - DNA, 25 bp, Homo sapien
gcagctaatgcgcaggcgtgtattc

SEQ ID NO: 90440 - DNA, 25 bp, Homo sapien
gctctcggctctggaattggactgc

SEQ ID NO: 90441 - DNA, 25 bp, Homo sapien
ttgcggcctgttttcggcagtgaca

SEQ ID NO: 90442 - DNA, 25 bp, Homo sapien
ctcgtttgggtttctgtaaggagca

SEQ ID NO: 90443 - DNA, 25 bp, Homo sapien
agtcaagaccctagctcgctgcagc

SEQ ID NO: 90444 - DNA, 25 bp, Homo sapien
ggctgcaatggcaaccgctggaata

SEQ ID NO: 90445 - DNA, 25 bp, Homo sapien
gggtcccttcgcttccacataggtg

SEQ ID NO: 90446 - DNA, 25 bp, Homo sapien
ccacataggtggagactgagacagc

SEQ ID NO: 90447 - DNA, 25 bp, Homo sapien
tgagacagccgagcctattttgatc

SEQ ID NO: 90448 - DNA, 25 bp, Homo sapien
cagctcagatgtccaagtcgttgcc

SEQ ID NO: 90449 - DNA, 25 bp, Homo sapien
ccgccgcttactggtttgagttatc

SEQ ID NO: 90450 - DNA, 25 bp, Homo sapien
gttcacctgcttggtcctcatggcc

SEQ ID NO: 90451 - DNA, 25 bp, Homo sapien
ggtgatcagcaagttcacctgcttg

SEQ ID NO: 90452 - DNA, 25 bp, Homo sapien
gcgaccagggtgatcagcaagttca

SEQ ID NO: 90453 - DNA, 25 bp, Homo sapien
tgaacaacgcgacggcgaccagggt

SEQ ID NO: 90454 - DNA, 25 bp, Homo sapien
gcaagagaagctgaacaacgcgacg

SEQ ID NO: 90455 - DNA, 25 bp, Homo sapien
tgagttatcctgtagatggagaagc

SEQ ID NO: 90456 - DNA, 25 bp, Homo sapien
tgcttggtcctcatggccctggcca

SEQ ID NO: 90457 - DNA, 25 bp, Homo sapien
cctctgctcggcagttctgcgcttt

SEQ ID NO: 90458 - DNA, 25 bp, Homo sapien
agttctgcgcttttgtcctaatgag

SEQ ID NO: 90459 - DNA, 25 bp, Homo sapien
cgcagcgctaggaggcgctactccg

SEQ ID NO: 90460 - DNA, 25 bp, Homo sapien
cgacctctctccagcgttagcaata

SEQ ID NO: 90461 - DNA, 25 bp, Homo sapien
tgcttgaagggagtgttccgtcgtt

SEQ ID NO: 90462 - DNA, 25 bp, Homo sapien
gtctgggcgtccctagtatctgagc

SEQ ID NO: 90463 - DNA, 25 bp, Homo sapien
ctagttcttccgctcctgtgaggtg

SEQ ID NO: 90464 - DNA, 25 bp, Homo sapien
gtcgtttccgttgccggctgtttgc

SEQ ID NO: 90465 - DNA, 25 bp, Homo sapien
tgtccgccgggcagcaaacccgatt

SEQ ID NO: 90466 - DNA, 25 bp, Homo sapien
gacttatatagctgggccgctcccg

SEQ ID NO: 90467 - DNA, 25 bp, Homo sapien
cagcaaacccgatttctgttttttg

SEQ ID NO: 90468 - DNA, 25 bp, Homo sapien
cctacccaccctcgcgccagcagga

SEQ ID NO: 90469 - DNA, 25 bp, Homo sapien
ggccgcgcgaggtctcagaagaccc

SEQ ID NO: 90470 - DNA, 25 bp, Homo sapien
gcaggaccctctgcgttccggtctt

SEQ ID NO: 90471 - DNA, 25 bp, Homo sapien
cattctcgctcggtgcctcgggagc

SEQ ID NO: 90472 - DNA, 25 bp, Homo sapien
ccggtcttccgctgggacttatata

SEQ ID NO: 90473 - DNA, 25 bp, Homo sapien
caggatgaagtatgggttggccctc

SEQ ID NO: 90474 - DNA, 25 bp, Homo sapien
gtttgtgcggactcggtaccaccgc

SEQ ID NO: 90475 - DNA, 25 bp, Homo sapien
ttggccctctcggtgatccacagcg

SEQ ID NO: 90476 - DNA, 25 bp, Homo sapien
gaagtggtatagctcagtcccggga

SEQ ID NO: 90477 - DNA, 25 bp, Homo sapien
caggcgccactagggaagcccagct

SEQ ID NO: 90478 - DNA, 25 bp, Homo sapien
atccacagcgcgttggccagcaaca

SEQ ID NO: 90479 - DNA, 25 bp, Homo sapien
gaatgacgacaacgcggctcacttg

SEQ ID NO: 90480 - DNA, 25 bp, Homo sapien
tccggacactgcgaatgaatgacga

SEQ ID NO: 90481 - DNA, 25 bp, Homo sapien
ggcaaccgcatggtctcgcgataca

SEQ ID NO: 90482 - DNA, 25 bp, Homo sapien
cgagccctcgggataccattggcta

SEQ ID NO: 90483 - DNA, 25 bp, Homo sapien
tataggctggcctccgaacaactgg

SEQ ID NO: 90484 - DNA, 25 bp, Homo sapien
caagtcctgagcgtctggttacccg

SEQ ID NO: 90485 - DNA, 25 bp, Homo sapien
tgcacccagagcttccgcgtttcta

SEQ ID NO: 90486 - DNA, 25 bp, Homo sapien
gattcgccatcgtgagttccaggtg

SEQ ID NO: 90487 - DNA, 25 bp, Homo sapien
ctccggagtgacctaacacaggata

SEQ ID NO: 90488 - DNA, 25 bp, Homo sapien
tgccttcaggtgaccacggattcgc

SEQ ID NO: 90489 - DNA, 25 bp, Homo sapien
ggtgaggctgcagataacgcttgca

SEQ ID NO: 90490 - DNA, 25 bp, Homo sapien
cgagtttaaaggacgggcagagcaa

SEQ ID NO: 90491 - DNA, 25 bp, Homo sapien
tcgcaaattgaggatcccggacaca

SEQ ID NO: 90492 - DNA, 25 bp, Homo sapien
gcaagcctactgaaagccagccgaa

SEQ ID NO: 90493 - DNA, 25 bp, Homo sapien
tcccggacacagagtgcagagaccc

SEQ ID NO: 90494 - DNA, 25 bp, Homo sapien
cttctcctaggaggccggaatttct

SEQ ID NO: 90495 - DNA, 25 bp, Homo sapien
tgggagactccaggcttcgaaattc

SEQ ID NO: 90496 - DNA, 25 bp, Homo sapien
tctccgggaaaaaggcaggcgcata

SEQ ID NO: 90497 - DNA, 25 bp, Homo sapien
ttctcggccacggtaaagtccaggc

SEQ ID NO: 90498 - DNA, 25 bp, Homo sapien
gaacgcgttccggatcttatccctg

SEQ ID NO: 90499 - DNA, 25 bp, Homo sapien
atccctgtacgtgcagttgcccttg

SEQ ID NO: 90500 - DNA, 25 bp, Homo sapien
ggctatccagttcttgccgcgggtc

SEQ ID NO: 90501 - DNA, 25 bp, Homo sapien
ggcggtgtaccattcctccttctcg

SEQ ID NO: 90502 - DNA, 25 bp, Homo sapien
gcagcacgcttggatgagagacatt

SEQ ID NO: 90503 - DNA, 25 bp, Homo sapien
tgttggagcccacgttgaagatgac

SEQ ID NO: 90504 - DNA, 25 bp, Homo sapien
acattgccatctttatccgccgggg

SEQ ID NO: 90505 - DNA, 25 bp, Homo sapien
tagtgtccggaatcggctgtcagcc

SEQ ID NO: 90506 - DNA, 25 bp, Homo sapien
tgctgtcgtaaaaggacgtccggtc

SEQ ID NO: 90507 - DNA, 25 bp, Homo sapien
ccgtcctatgacgtcagccgtaagg

SEQ ID NO: 90508 - DNA, 25 bp, Homo sapien
tccacgagttggatttactgctgtc

SEQ ID NO: 90509 - DNA, 25 bp, Homo sapien
agccgtaaggcgctgctgtcgtaaa

SEQ ID NO: 90510 - DNA, 25 bp, Homo sapien
ggtccgtctcctagtgtccggaatc

SEQ ID NO: 90511 - DNA, 25 bp, Homo sapien
ctcccggcgaaagtgagcgaggttt

SEQ ID NO: 90512 - DNA, 25 bp, Homo sapien
tccctggctgttagtaccttctttc

SEQ ID NO: 90513 - DNA, 25 bp, Homo sapien
catctgggctttttcccgtcggtca

SEQ ID NO: 90514 - DNA, 25 bp, Homo sapien
tcagcaaaggcatctgggctttttc

SEQ ID NO: 90515 - DNA, 25 bp, Homo sapien
cgcgtgcggccatcttttcagcaaa

SEQ ID NO: 90516 - DNA, 25 bp, Homo sapien
aaggcatctgggctttttcccgtcg

SEQ ID NO: 90517 - DNA, 25 bp, Homo sapien
cttttcagcaaaggcatctgggctt

SEQ ID NO: 90518 - DNA, 25 bp, Homo sapien
gtcagcgggtgactccttcctccgt

SEQ ID NO: 90519 - DNA, 25 bp, Homo sapien
agcgggtgactccttcctccgtcgt

SEQ ID NO: 90520 - DNA, 25 bp, Homo sapien
gcgtgcggccatcttttcagcaaag

SEQ ID NO: 90521 - DNA, 25 bp, Homo sapien
tttctacgtaagagccggagctgcc

SEQ ID NO: 90522 - DNA, 25 bp, Homo sapien
cctcggacacaacctagggactgga

SEQ ID NO: 90523 - DNA, 25 bp, Homo sapien
gatggcaccatagcaacctcggaca

SEQ ID NO: 90524 - DNA, 25 bp, Homo sapien
caacgtgtgcattcatcagaggcca

SEQ ID NO: 90525 - DNA, 25 bp, Homo sapien
agcggcgtttctggaactggaccaa

SEQ ID NO: 90526 - DNA, 25 bp, Homo sapien
tcagcctcttcttcgagctcggggc

SEQ ID NO: 90527 - DNA, 25 bp, Homo sapien
gacgcagttatcagggacgcactca

SEQ ID NO: 90528 - DNA, 25 bp, Homo sapien
cgtttctccgcacagtcgcagagtg

SEQ ID NO: 90529 - DNA, 25 bp, Homo sapien
agcgcagatcgcaggtccctttgcc

SEQ ID NO: 90530 - DNA, 25 bp, Homo sapien
ccaagctgcgggtttctgagaagac

SEQ ID NO: 90531 - DNA, 25 bp, Homo sapien
aggtgtttgtcttcgcctatgctcc

SEQ ID NO: 90532 - DNA, 25 bp, Homo sapien
ccggtctatcctactggccgagctg

SEQ ID NO: 90533 - DNA, 25 bp, Homo sapien
ccgccttctcatggggaaaacttag

SEQ ID NO: 90534 - DNA, 25 bp, Homo sapien
ggaagcttcccacatggtgcccgtc

SEQ ID NO: 90535 - DNA, 25 bp, Homo sapien
atgacacttctgaggctctcctagc

SEQ ID NO: 90536 - DNA, 25 bp, Homo sapien
gggatgcggctatccttgtgccttc

SEQ ID NO: 90537 - DNA, 25 bp, Homo sapien
tcccaatgtcaccagcgaccgagta

SEQ ID NO: 90538 - DNA, 25 bp, Homo sapien
gatcccaggcgggtaattacctctc

SEQ ID NO: 90539 - DNA, 25 bp, Homo sapien
agcctgactttcctgcgttcgcttg

SEQ ID NO: 90540 - DNA, 25 bp, Homo sapien
aggaggagctgtaacctgctattta

SEQ ID NO: 90541 - DNA, 25 bp, Homo sapien
cagagaagttgtcaccagcgcggct

SEQ ID NO: 90542 - DNA, 25 bp, Homo sapien
acccagactgggctgtgggatcacc

SEQ ID NO: 90543 - DNA, 25 bp, Homo sapien
agcgcagtccctagaccgagggttt

SEQ ID NO: 90544 - DNA, 25 bp, Homo sapien
ttatagaccgaagcctcagtacccg

SEQ ID NO: 90545 - DNA, 25 bp, Homo sapien
ttcacttcctgtttgccggcacttc

SEQ ID NO: 90546 - DNA, 25 bp, Homo sapien
agggccttgtgagttcctcgcatcc

SEQ ID NO: 90547 - DNA, 25 bp, Homo sapien
cagcgtggcgacaatggacaagatc

SEQ ID NO: 90548 - DNA, 25 bp, Homo sapien
aggtgtcggttcttaggctctccag

SEQ ID NO: 90549 - DNA, 25 bp, Homo sapien
aggaccggcttcttctcacgacctg

SEQ ID NO: 90550 - DNA, 25 bp, Homo sapien
cggcacttcaaaatccgggtcaaag

SEQ ID NO: 90551 - DNA, 25 bp, Homo sapien
atgtttgacctgacgacccggctca

SEQ ID NO: 90552 - DNA, 25 bp, Homo sapien
cggaagaccgcctgtgactcgacac

SEQ ID NO: 90553 - DNA, 25 bp, Homo sapien
ctccggcggagtttcagagaaagtc

SEQ ID NO: 90554 - DNA, 25 bp, Homo sapien
tcgctccgggcgcatcgaaaccgag

SEQ ID NO: 90555 - DNA, 25 bp, Homo sapien
gctgtgtctgtttcggaaagcgctc

SEQ ID NO: 90556 - DNA, 25 bp, Homo sapien
aaggacagaagctccggcaccgagt

SEQ ID NO: 90557 - DNA, 25 bp, Homo sapien
cagagtcccgctgagtccgagcgct

SEQ ID NO: 90558 - DNA, 25 bp, Homo sapien
cggctcgcgttctgttcaggttcgt

SEQ ID NO: 90559 - DNA, 25 bp, Homo sapien
gactcgaactcgtggaacccgcgca

SEQ ID NO: 90560 - DNA, 25 bp, Homo sapien
gcccttgttgttttggctggaagca

SEQ ID NO: 90561 - DNA, 25 bp, Homo sapien
gccttggcggtttgctgcgagagga

SEQ ID NO: 90562 - DNA, 25 bp, Homo sapien
cttggcggtttgctgcgagaggagg

SEQ ID NO: 90563 - DNA, 25 bp, Homo sapien
ttggcggtttgctgcgagaggaggg

SEQ ID NO: 90564 - DNA, 25 bp, Homo sapien
ccttggcggtttgctgcgagaggag

SEQ ID NO: 90565 - DNA, 25 bp, Homo sapien
agccttggcggtttgctgcgagagg

SEQ ID NO: 90566 - DNA, 25 bp, Homo sapien
gagccttggcggtttgctgcgagag

SEQ ID NO: 90567 - DNA, 25 bp, Homo sapien
cccgggagccttggcggtttgctgc

SEQ ID NO: 90568 - DNA, 25 bp, Homo sapien
ggagccttggcggtttgctgcgaga

SEQ ID NO: 90569 - DNA, 25 bp, Homo sapien
agaaaagttattacgcgccctgccg

SEQ ID NO: 90570 - DNA, 25 bp, Homo sapien
cagggttcacattttcgcggttttg

SEQ ID NO: 90571 - DNA, 25 bp, Homo sapien
ttgcttagcagggttcacattttcg

SEQ ID NO: 90572 - DNA, 25 bp, Homo sapien
ttattacgcgccctgccgtttgctt

SEQ ID NO: 90573 - DNA, 25 bp, Homo sapien
tcgaacgcgcgcaaaagggaaagaa

SEQ ID NO: 90574 - DNA, 25 bp, Homo sapien
gacaagcatatcgaacgcgcgcaaa

SEQ ID NO: 90575 - DNA, 25 bp, Homo sapien
tggtagtagagacaagcatatcgaa

SEQ ID NO: 90576 - DNA, 25 bp, Homo sapien
tgccgtttgcttagcagggttcaca

SEQ ID NO: 90577 - DNA, 25 bp, Homo sapien
acacagcgagaaccgtgagccgtta

SEQ ID NO: 90578 - DNA, 25 bp, Homo sapien
tccaccagtttattgcgacgtagca

SEQ ID NO: 90579 - DNA, 25 bp, Homo sapien
ggggccagacacaagacttccaagt

SEQ ID NO: 90580 - DNA, 25 bp, Homo sapien
gggcagcgcaaaacccagacaagtt

SEQ ID NO: 90581 - DNA, 25 bp, Homo sapien
cagacaagttttccggtagtgccgc

SEQ ID NO: 90582 - DNA, 25 bp, Homo sapien
gccaataaggaatctcgcgagtgtt

SEQ ID NO: 90583 - DNA, 25 bp, Homo sapien
tcaggacccagtcagtgagccaata

SEQ ID NO: 90584 - DNA, 25 bp, Homo sapien
gcgaagcgttttcccagcctcagtc

SEQ ID NO: 90585 - DNA, 25 bp, Homo sapien
caagtctgggccaagagcagcggcc

SEQ ID NO: 90586 - DNA, 25 bp, Homo sapien
gccggaccctgccattggctggaga

SEQ ID NO: 90587 - DNA, 25 bp, Homo sapien
gacgtcctcgtccaagtctgggcca

SEQ ID NO: 90588 - DNA, 25 bp, Homo sapien
caagactcagcacgggacgtcctcg

SEQ ID NO: 90589 - DNA, 25 bp, Homo sapien
agctgggcccgcaagactcagcacg

SEQ ID NO: 90590 - DNA, 25 bp, Homo sapien
cttgcagcgtgcgtggcaacagcag

SEQ ID NO: 90591 - DNA, 25 bp, Homo sapien
tgtctgcgcccagtaccgtgggtaa

SEQ ID NO: 90592 - DNA, 25 bp, Homo sapien
ctgccattggctggagattacagga

SEQ ID NO: 90593 - DNA, 25 bp, Homo sapien
cgcgctgctgataggcccgcagacg

SEQ ID NO: 90594 - DNA, 25 bp, Homo sapien
gaagaagctggaccgcctctggagc

SEQ ID NO: 90595 - DNA, 25 bp, Homo sapien
cttcgacaaactgtgccttggcttc

SEQ ID NO: 90596 - DNA, 25 bp, Homo sapien
cttggcttctaggagtagtggtatc

SEQ ID NO: 90597 - DNA, 25 bp, Homo sapien
agagtcgggctccaccatggacata

SEQ ID NO: 90598 - DNA, 25 bp, Homo sapien
gttccctccagcttcaacgacgttg

SEQ ID NO: 90599 - DNA, 25 bp, Homo sapien
gctgcggcattttgtagaccagatg

SEQ ID NO: 90600 - DNA, 25 bp, Homo sapien
cttcaacgacgttggccaggactgg

SEQ ID NO: 90601 - DNA, 25 bp, Homo sapien
agcagtagctgctgtccagtcggta

SEQ ID NO: 90602 - DNA, 25 bp, Homo sapien
ctccagctgggagaagaccaagtcc

SEQ ID NO: 90603 - DNA, 25 bp, Homo sapien
ttcgcagcttctccactaccaaagg

SEQ ID NO: 90604 - DNA, 25 bp, Homo sapien
gaaagcctcacagtctacgcccttg

SEQ ID NO: 90605 - DNA, 25 bp, Homo sapien
caccatcatgggcacgtagtcacgg

SEQ ID NO: 90606 - DNA, 25 bp, Homo sapien
gaagtccagcactctcctgtctatg

SEQ ID NO: 90607 - DNA, 25 bp, Homo sapien
acccggagtccagggttggcaatca

SEQ ID NO: 90608 - DNA, 25 bp, Homo sapien
accaaaggcctgttacgcgtcacca

SEQ ID NO: 90609 - DNA, 25 bp, Homo sapien
tgaggaaagcccagcgacgccgggc

SEQ ID NO: 90610 - DNA, 25 bp, Homo sapien
gaggcgacgtctccttcttcacgta

SEQ ID NO: 90611 - DNA, 25 bp, Homo sapien
gcgacgtctccttcttcacgtactt

SEQ ID NO: 90612 - DNA, 25 bp, Homo sapien
ctcggccggcttggacacttcgttt

SEQ ID NO: 90613 - DNA, 25 bp, Homo sapien
cccgcagggactgccgcatgttcag

SEQ ID NO: 90614 - DNA, 25 bp, Homo sapien
gactgccgcatgttcagggcgctaa

SEQ ID NO: 90615 - DNA, 25 bp, Homo sapien
ccttcccggaagtcggcccgctctg

SEQ ID NO: 90616 - DNA, 25 bp, Homo sapien
cgaagcagaggcgacgtctccttct

SEQ ID NO: 90617 - DNA, 25 bp, Homo sapien
actttctttcggagcctcagcttgg

SEQ ID NO: 90618 - DNA, 25 bp, Homo sapien
ccacctgcggcccaagaacttgtgt

SEQ ID NO: 90619 - DNA, 25 bp, Homo sapien
ggcccggcttattcccgaacacatg

SEQ ID NO: 90620 - DNA, 25 bp, Homo sapien
gcacacgcgtctgtgccacttcagt

SEQ ID NO: 90621 - DNA, 25 bp, Homo sapien
cctccggcgaggatgagtctccaaa

SEQ ID NO: 90622 - DNA, 25 bp, Homo sapien
gaggacttgagcttcacgttgaaaa

SEQ ID NO: 90623 - DNA, 25 bp, Homo sapien
ggttcagcaccctcgaggctggttc

SEQ ID NO: 90624 - DNA, 25 bp, Homo sapien
cctactcaacggcatctgggatgtc

SEQ ID NO: 90625 - DNA, 25 bp, Homo sapien
gacgtactggttcttcctccacatg

SEQ ID NO: 90626 - DNA, 25 bp, Homo sapien
ctggggttttccatcacctgggagc

SEQ ID NO: 90627 - DNA, 25 bp, Homo sapien
ctctggcggaacagatggactctcc

SEQ ID NO: 90628 - DNA, 25 bp, Homo sapien
tgcccgtgaaggtgatgctgtattt

SEQ ID NO: 90629 - DNA, 25 bp, Homo sapien
ctggtgttagagtctcccgacgtca

SEQ ID NO: 90630 - DNA, 25 bp, Homo sapien
tccacatgctgtagtcggagctatg

SEQ ID NO: 90631 - DNA, 25 bp, Homo sapien
tcgcgcagcccgttactgacgtact

SEQ ID NO: 90632 - DNA, 25 bp, Homo sapien
gcgctcggcaaacattctggtgtta

SEQ ID NO: 90633 - DNA, 25 bp, Homo sapien
caagggtcgcagctcaatgacgtca

SEQ ID NO: 90634 - DNA, 25 bp, Homo sapien
ttgaaaccggagaggcgaatgcatc

SEQ ID NO: 90635 - DNA, 25 bp, Homo sapien
tgcatctgtttacgctaggaccacg

SEQ ID NO: 90636 - DNA, 25 bp, Homo sapien
ccgttagctgccatctgccaggttg

SEQ ID NO: 90637 - DNA, 25 bp, Homo sapien
tggctgcttgccgaaactcagattc

SEQ ID NO: 90638 - DNA, 25 bp, Homo sapien
ctccgcaaggggatcgttttctcca

SEQ ID NO: 90639 - DNA, 25 bp, Homo sapien
tttctccaggtacgtgaatagcccg

SEQ ID NO: 90640 - DNA, 25 bp, Homo sapien
gctcgacgtcggagaaaagcccaca

SEQ ID NO: 90641 - DNA, 25 bp, Homo sapien
agcccagaatttgttttcgctttcg

SEQ ID NO: 90642 - DNA, 25 bp, Homo sapien
actacaagtccctacagcgcgggcg

SEQ ID NO: 90643 - DNA, 25 bp, Homo sapien
cttggcagccgcaggaagtcggctt

SEQ ID NO: 90644 - DNA, 25 bp, Homo sapien
ttgttttcgctttcggcccgacagc

SEQ ID NO: 90645 - DNA, 25 bp, Homo sapien
cctcgcagcccagaatttgttttcg

SEQ ID NO: 90646 - DNA, 25 bp, Homo sapien
acagcacctcgcagcccagaatttg

SEQ ID NO: 90647 - DNA, 25 bp, Homo sapien
ggagagaacagcacctcgcagccca

SEQ ID NO: 90648 - DNA, 25 bp, Homo sapien
ctttcggcccgacagcggagaggac

SEQ ID NO: 90649 - DNA, 25 bp, Homo sapien
tgacgccagcgcgaccagatcaatc

SEQ ID NO: 90650 - DNA, 25 bp, Homo sapien
ccagatcaatccaggctccaggaga

SEQ ID NO: 90651 - DNA, 25 bp, Homo sapien
ggagcgaacctgctaccacgtcttc

SEQ ID NO: 90652 - DNA, 25 bp, Homo sapien
cctggtgtctttgttgggtcttctg

SEQ ID NO: 90653 - DNA, 25 bp, Homo sapien
cttctgctgtgggaagcccagttcc

SEQ ID NO: 90654 - DNA, 25 bp, Homo sapien
tcaaggaaagttcgcaccgagatcc

SEQ ID NO: 90655 - DNA, 25 bp, Homo sapien
ttattcaaaggtttggcggcggcgc

SEQ ID NO: 90656 - DNA, 25 bp, Homo sapien
gcaagcctctttggggtcgaggtca

SEQ ID NO: 90657 - DNA, 25 bp, Homo sapien
ccgtccgactcgagggtgtcgcgaa

SEQ ID NO: 90658 - DNA, 25 bp, Homo sapien
gtcaggtggcacttccgtggcttcg

SEQ ID NO: 90659 - DNA, 25 bp, Homo sapien
ggcgcagagcttccgcagcctgctg

SEQ ID NO: 90660 - DNA, 25 bp, Homo sapien
gccagagaacttcccggcgcagagc

SEQ ID NO: 90661 - DNA, 25 bp, Homo sapien
tttcatgtggatcttaaaaagggca

SEQ ID NO: 90662 - DNA, 25 bp, Homo sapien
ctcgaacttcggaggcgaaagattt

SEQ ID NO: 90663 - DNA, 25 bp, Homo sapien
ccacattttaagtttccaaggagcg

SEQ ID NO: 90664 - DNA, 25 bp, Homo sapien
cggtctgtcaaacgtaacgcgtctc

SEQ ID NO: 90665 - DNA, 25 bp, Homo sapien
agcgaattggctccgacagtcgcgg

SEQ ID NO: 90666 - DNA, 25 bp, Homo sapien
cgccgccgggaagcgaattggctcc

SEQ ID NO: 90667 - DNA, 25 bp, Homo sapien
tattcagagcggtcacccagcagag

SEQ ID NO: 90668 - DNA, 25 bp, Homo sapien
tctttgtattcagagcggtcaccca

SEQ ID NO: 90669 - DNA, 25 bp, Homo sapien
cgcaggggcgtgagaaatgctcttt

SEQ ID NO: 90670 - DNA, 25 bp, Homo sapien
agcctgtcccttgtatctgggagcc

SEQ ID NO: 90671 - DNA, 25 bp, Homo sapien
gggctccggcgtcacagagcctgtc

SEQ ID NO: 90672 - DNA, 25 bp, Homo sapien
ggcgtgagaaatgctctttgtattc

SEQ ID NO: 90673 - DNA, 25 bp, Homo sapien
tggaactctggcaaacgcgcagctc

SEQ ID NO: 90674 - DNA, 25 bp, Homo sapien
agccgacgcatagccggagacccta

SEQ ID NO: 90675 - DNA, 25 bp, Homo sapien
gggcaagttcaaggctaccctacga

SEQ ID NO: 90676 - DNA, 25 bp, Homo sapien
cctttccgtatcaggtgacccacga

SEQ ID NO: 90677 - DNA, 25 bp, Homo sapien
gggcaccaggctttgcacctcggaa

SEQ ID NO: 90678 - DNA, 25 bp, Homo sapien
ggctttgggttcaagcgctccagga

SEQ ID NO: 90679 - DNA, 25 bp, Homo sapien
tccggtcaccggcaaatgagcagcc

SEQ ID NO: 90680 - DNA, 25 bp, Homo sapien
tctggcggctgctgactttataagg

SEQ ID NO: 90681 - DNA, 25 bp, Homo sapien
tcgcacttgtagtggttgcccaggc

SEQ ID NO: 90682 - DNA, 25 bp, Homo sapien
tggcagatccggcacttgtactcca

SEQ ID NO: 90683 - DNA, 25 bp, Homo sapien
tccagctccagctggttggccttca

SEQ ID NO: 90684 - DNA, 25 bp, Homo sapien
ttggccttcaccgtctggcagatcc

SEQ ID NO: 90685 - DNA, 25 bp, Homo sapien
gcacctgccggggaaagcaacgcaa

SEQ ID NO: 90686 - DNA, 25 bp, Homo sapien
tagccgcactggtcgcacttgtagt

SEQ ID NO: 90687 - DNA, 25 bp, Homo sapien
cgcgcacgtgctcgatgagcttgtt

SEQ ID NO: 90688 - DNA, 25 bp, Homo sapien
gtcttgaggtggcactccatggcag

SEQ ID NO: 90689 - DNA, 25 bp, Homo sapien
cgagcccgagacaccataaccttaa

SEQ ID NO: 90690 - DNA, 25 bp, Homo sapien
tccgtgaacttcaggtgaccgacca

SEQ ID NO: 90691 - DNA, 25 bp, Homo sapien
ttccctgcattcaaggagccgggcg

SEQ ID NO: 90692 - DNA, 25 bp, Homo sapien
gctttagcagcatctcgaaacactc

SEQ ID NO: 90693 - DNA, 25 bp, Homo sapien
tgtgatgcactttagtcctggactc

SEQ ID NO: 90694 - DNA, 25 bp, Homo sapien
ggactctgctcaggctcgccaagga

SEQ ID NO: 90695 - DNA, 25 bp, Homo sapien
cccgcattttattgcggccaggagc

SEQ ID NO: 90696 - DNA, 25 bp, Homo sapien
tgcctgtctgcagcggaaaagcaca

SEQ ID NO: 90697 - DNA, 25 bp, Homo sapien
tggctgcgcctgaccacaggaatta

SEQ ID NO: 90698 - DNA, 25 bp, Homo sapien
ccaaggttttctgtgcgtatgcgtg

SEQ ID NO: 90699 - DNA, 25 bp, Homo sapien
gcgtccaagctctccgcgcatggaa

SEQ ID NO: 90700 - DNA, 25 bp, Homo sapien
cccgattgtatggtcttaagtccta

SEQ ID NO: 90701 - DNA, 25 bp, Homo sapien
taccaagttgtcaggtcgaggaacc

SEQ ID NO: 90702 - DNA, 25 bp, Homo sapien
tggactcgcctgtcttaccaagttg

SEQ ID NO: 90703 - DNA, 25 bp, Homo sapien
cgctttcggttttggctgggatcat

SEQ ID NO: 90704 - DNA, 25 bp, Homo sapien
tggcgtccgagatcaattcaggttg

SEQ ID NO: 90705 - DNA, 25 bp, Homo sapien
gcctcagaatacacgcgcacaaacg

SEQ ID NO: 90706 - DNA, 25 bp, Homo sapien
accaactaagctactcgcgggcgga

SEQ ID NO: 90707 - DNA, 25 bp, Homo sapien
cgtccgctacaacccaaggaaggtg

SEQ ID NO: 90708 - DNA, 25 bp, Homo sapien
tccacgacgctagcgctgacgtatg

SEQ ID NO: 90709 - DNA, 25 bp, Homo sapien
cttcttcgggacattacggcgcttc

SEQ ID NO: 90710 - DNA, 25 bp, Homo sapien
caagggatttctccgttgaagctgc

SEQ ID NO: 90711 - DNA, 25 bp, Homo sapien
cctctcttttgctgtgccatgactc

SEQ ID NO: 90712 - DNA, 25 bp, Homo sapien
cgagacctgcggaaccttctgaatg

SEQ ID NO: 90713 - DNA, 25 bp, Homo sapien
gcctgctctcgcacctgctcgcctt

SEQ ID NO: 90714 - DNA, 25 bp, Homo sapien
actctgtttttgtcccagcgcgcgc

SEQ ID NO: 90715 - DNA, 25 bp, Homo sapien
gctcctgaggacagcggtcccatct

SEQ ID NO: 90716 - DNA, 25 bp, Homo sapien
ttcccactctgtttttgtcccagcg

SEQ ID NO: 90717 - DNA, 25 bp, Homo sapien
cgcttccgggagctgaccacccgag

SEQ ID NO: 90718 - DNA, 25 bp, Homo sapien
gaaaccgctattccgcccggctgag

SEQ ID NO: 90719 - DNA, 25 bp, Homo sapien
gtcccatcttgaaaccgctattccg

SEQ ID NO: 90720 - DNA, 25 bp, Homo sapien
ggacagcggtcccatcttgaaaccg

SEQ ID NO: 90721 - DNA, 25 bp, Homo sapien
gaatgtgggtcagcgtttccaagtc

SEQ ID NO: 90722 - DNA, 25 bp, Homo sapien
gggcggcttgcacagcttagcttct

SEQ ID NO: 90723 - DNA, 25 bp, Homo sapien
cagcctcgctggtggcctggtttct

SEQ ID NO: 90724 - DNA, 25 bp, Homo sapien
tgtggccggcctcgcaggaaccact

SEQ ID NO: 90725 - DNA, 25 bp, Homo sapien
gtcagcgtttccaagtctggcccgg

SEQ ID NO: 90726 - DNA, 25 bp, Homo sapien
cgtcctctggagatggcccgaggct

SEQ ID NO: 90727 - DNA, 25 bp, Homo sapien
aggctggtgcccatgactcaatgtc

SEQ ID NO: 90728 - DNA, 25 bp, Homo sapien
agcttagcttcttcctggcccgggt

SEQ ID NO: 90729 - DNA, 25 bp, Homo sapien
ttatgacctgggatgttgcctgtgc

SEQ ID NO: 90730 - DNA, 25 bp, Homo sapien
atgcggagagcctgtcttccaaccc

SEQ ID NO: 90731 - DNA, 25 bp, Homo sapien
gagcgtaatgtgtgccttctactta

SEQ ID NO: 90732 - DNA, 25 bp, Homo sapien
gcgtacaattccctgctgagcgtaa

SEQ ID NO: 90733 - DNA, 25 bp, Homo sapien
tcggcttctttctgtggcttccctc

SEQ ID NO: 90734 - DNA, 25 bp, Homo sapien
tcaggcatccgttcagactgacagc

SEQ ID NO: 90735 - DNA, 25 bp, Homo sapien
gtggagcccaagtactcggcactgc

SEQ ID NO: 90736 - DNA, 25 bp, Homo sapien
tcgttgtgtctacaggctcactttc

SEQ ID NO: 90737 - DNA, 25 bp, Homo sapien
gaggacccgaatactcagcggaatg

SEQ ID NO: 90738 - DNA, 25 bp, Homo sapien
agccgcaggctcgtccaaggatccg

SEQ ID NO: 90739 - DNA, 25 bp, Homo sapien
ttcgccgcccatttggccgaggtag

SEQ ID NO: 90740 - DNA, 25 bp, Homo sapien
gacacacgggtcaaaattgcgtttg

SEQ ID NO: 90741 - DNA, 25 bp, Homo sapien
agcggaatgtcaccctggccgggtt

SEQ ID NO: 90742 - DNA, 25 bp, Homo sapien
tccggggccatcctacggaatccag

SEQ ID NO: 90743 - DNA, 25 bp, Homo sapien
tttctccagagccagacagcagacg

SEQ ID NO: 90744 - DNA, 25 bp, Homo sapien
atcgacctcgctgccttctggcttt

SEQ ID NO: 90745 - DNA, 25 bp, Homo sapien
ggacgccgagagcgtctccacggaa

SEQ ID NO: 90746 - DNA, 25 bp, Homo sapien
ctcagtgattccgaagcctggctcc

SEQ ID NO: 90747 - DNA, 25 bp, Homo sapien
cagttttccgttccgccgaagtcag

SEQ ID NO: 90748 - DNA, 25 bp, Homo sapien
tgcactggcccagggaaacaactcc

SEQ ID NO: 90749 - DNA, 25 bp, Homo sapien
tgccgtcacgaacctcggtgcactg

SEQ ID NO: 90750 - DNA, 25 bp, Homo sapien
agctcccagactcttcgggcttggg

SEQ ID NO: 90751 - DNA, 25 bp, Homo sapien
cctctctcagtgattccgaagcctg

SEQ ID NO: 90752 - DNA, 25 bp, Homo sapien
attggggcagctcccagactcttcg

SEQ ID NO: 90753 - DNA, 25 bp, Homo sapien
caagtctttcttatcggggactggg

SEQ ID NO: 90754 - DNA, 25 bp, Homo sapien
tgcccaggaggttttctgaagccgg

SEQ ID NO: 90755 - DNA, 25 bp, Homo sapien
acgagagctgggaacgttctggccc

SEQ ID NO: 90756 - DNA, 25 bp, Homo sapien
tgcgctgcggacacgtgtagagttc

SEQ ID NO: 90757 - DNA, 25 bp, Homo sapien
gcgtacagtcatcccgctggtctga

SEQ ID NO: 90758 - DNA, 25 bp, Homo sapien
ttttctttttcgtgcgagccctcgc

SEQ ID NO: 90759 - DNA, 25 bp, Homo sapien
cccgctggtctgacgattgtggaga

SEQ ID NO: 90760 - DNA, 25 bp, Homo sapien
ctccacggtcggtgcaagtctttct

SEQ ID NO: 90761 - DNA, 25 bp, Homo sapien
agcgctccatctccgaaactgcgtg

SEQ ID NO: 90762 - DNA, 25 bp, Homo sapien
atgctcgccatcatgtcgggaccga

SEQ ID NO: 90763 - DNA, 25 bp, Homo sapien
gcgctcatacgggttccagtcttcg

SEQ ID NO: 90764 - DNA, 25 bp, Homo sapien
tccactatcggactgccgccttgag

SEQ ID NO: 90765 - DNA, 25 bp, Homo sapien
tgacagttctcagcggcctccacta

SEQ ID NO: 90766 - DNA, 25 bp, Homo sapien
ggagctctccggtctttgtcagccc

SEQ ID NO: 90767 - DNA, 25 bp, Homo sapien
ataagggatgctcgctgtacagacg

SEQ ID NO: 90768 - DNA, 25 bp, Homo sapien
ggtcatcctatacgcggttaccttc

SEQ ID NO: 90769 - DNA, 25 bp, Homo sapien
gaagcggaaaagagctgaaagtctt

SEQ ID NO: 90770 - DNA, 25 bp, Homo sapien
gaatcgactgaagagacgcctgcca

SEQ ID NO: 90771 - DNA, 25 bp, Homo sapien
ccagtttggcgctgacgacgaatca

SEQ ID NO: 90772 - DNA, 25 bp, Homo sapien
gacgaatcacctgcctcagacagca

SEQ ID NO: 90773 - DNA, 25 bp, Homo sapien
cccgtgcgaaagaatgaggagatcc

SEQ ID NO: 90774 - DNA, 25 bp, Homo sapien
aatgaggagatcctggggccttacc

SEQ ID NO: 90775 - DNA, 25 bp, Homo sapien
gggccttacctactagcggaatcga

SEQ ID NO: 90776 - DNA, 25 bp, Homo sapien
ctgaaagtcttggtttggccttggg

SEQ ID NO: 90777 - DNA, 25 bp, Homo sapien
tgcaaggaccgcgacaccagctcgt

SEQ ID NO: 90778 - DNA, 25 bp, Homo sapien
ctgtgcgtgagcataggagaacgtc

SEQ ID NO: 90779 - DNA, 25 bp, Homo sapien
cattcccgcaggagcgaccactgtg

SEQ ID NO: 90780 - DNA, 25 bp, Homo sapien
cttccagggaccagacaactgctca

SEQ ID NO: 90781 - DNA, 25 bp, Homo sapien
tctctcgatgctacacttccaggga

SEQ ID NO: 90782 - DNA, 25 bp, Homo sapien
tcaccacttgtatggccaaagggaa

SEQ ID NO: 90783 - DNA, 25 bp, Homo sapien
ccgcgagttcgacatggcagtcacc

SEQ ID NO: 90784 - DNA, 25 bp, Homo sapien
ctttcgactgcaagaccctgttgta

SEQ ID NO: 90785 - DNA, 25 bp, Homo sapien
ggggtccctggaatcattcctcctc

SEQ ID NO: 90786 - DNA, 25 bp, Homo sapien
aggacgggaagaacctcatcgctgc

SEQ ID NO: 90787 - DNA, 25 bp, Homo sapien
aggactcggctctacgggacatgtc

SEQ ID NO: 90788 - DNA, 25 bp, Homo sapien
tcacgaagcggaactcgagaggacc

SEQ ID NO: 90789 - DNA, 25 bp, Homo sapien
ctcatcgctgcgacgaaaagtaagc

SEQ ID NO: 90790 - DNA, 25 bp, Homo sapien
cagccagaggaacggggaattcatt

SEQ ID NO: 90791 - DNA, 25 bp, Homo sapien
attcctcctcgaggcagcgcggcga

SEQ ID NO: 90792 - DNA, 25 bp, Homo sapien
actgctacctcgacagcccgtggtt

SEQ ID NO: 90793 - DNA, 25 bp, Homo sapien
ggatctcagcttcttgcaaaatcta

SEQ ID NO: 90794 - DNA, 25 bp, Homo sapien
cagttagttaagctccgggattccg

SEQ ID NO: 90795 - DNA, 25 bp, Homo sapien
agacttgaactctcagccgctccag

SEQ ID NO: 90796 - DNA, 25 bp, Homo sapien
ccggagtcagcatcagtgacgtata

SEQ ID NO: 90797 - DNA, 25 bp, Homo sapien
gcccacccaaatgctgcagttacta

SEQ ID NO: 90798 - DNA, 25 bp, Homo sapien
tcggttgtctgcatgaagaaatttc

SEQ ID NO: 90799 - DNA, 25 bp, Homo sapien
gctccgcaagcgttgccgaattatt

SEQ ID NO: 90800 - DNA, 25 bp, Homo sapien
tgggcatcgatctcacgtcggcaga

SEQ ID NO: 90801 - DNA, 25 bp, Homo sapien
cgtctttttgcggacgccctcggag

SEQ ID NO: 90802 - DNA, 25 bp, Homo sapien
attatttcccgctagggccgcgctc

SEQ ID NO: 90803 - DNA, 25 bp, Homo sapien
cactggacaatgacctgggcagctc

SEQ ID NO: 90804 - DNA, 25 bp, Homo sapien
cacggagcaagtcgcactggacaat

SEQ ID NO: 90805 - DNA, 25 bp, Homo sapien
gcgttaagggccctcgcagtcagac

SEQ ID NO: 90806 - DNA, 25 bp, Homo sapien
gcaggccctcagctcggagaagaag

SEQ ID NO: 90807 - DNA, 25 bp, Homo sapien
ctggagcactttgaggaacgggaca

SEQ ID NO: 90808 - DNA, 25 bp, Homo sapien
tgtttgccatctccagcgaccgctt

SEQ ID NO: 90809 - DNA, 25 bp, Homo sapien
cagacgggcgaagccgcctgctgca

SEQ ID NO: 90810 - DNA, 25 bp, Homo sapien
ctgcagacgggcgaagccgcctgct

SEQ ID NO: 90811 - DNA, 25 bp, Homo sapien
tgcgcctgagttcgcgggtcctccg

SEQ ID NO: 90812 - DNA, 25 bp, Homo sapien
ctggcgccgccaccgagactgagcc

SEQ ID NO: 90813 - DNA, 25 bp, Homo sapien
ccgccaccgagactgagcctcctgc

SEQ ID NO: 90814 - DNA, 25 bp, Homo sapien
agcctcctgcagacgggcgaagccg

SEQ ID NO: 90815 - DNA, 25 bp, Homo sapien
cccaggaagccagccctctgctcgg

SEQ ID NO: 90816 - DNA, 25 bp, Homo sapien
cctgctgcaggcctccctctcttca

SEQ ID NO: 90817 - DNA, 25 bp, Homo sapien
aatcgcgtgagcaggccagaccctg

SEQ ID NO: 90818 - DNA, 25 bp, Homo sapien
gacacgtcctgtcatggggcacccg

SEQ ID NO: 90819 - DNA, 25 bp, Homo sapien
tgcccactcactgtggaatcgcgtg

SEQ ID NO: 90820 - DNA, 25 bp, Homo sapien
ccagaccctgcgtcgtaaggacaga

SEQ ID NO: 90821 - DNA, 25 bp, Homo sapien
tggtcactcccacggtctttaccag

SEQ ID NO: 90822 - DNA, 25 bp, Homo sapien
gagcacagcccgtctggtcatccgg

SEQ ID NO: 90823 - DNA, 25 bp, Homo sapien
tcgtaaggacagagcaggacacgtc

SEQ ID NO: 90824 - DNA, 25 bp, Homo sapien
cggtctttaccagccgggtgccagt

SEQ ID NO: 90825 - DNA, 25 bp, Homo sapien
cgacgaagcgaccacctcgagagtg

SEQ ID NO: 90826 - DNA, 25 bp, Homo sapien
aggggcaaggatgcgagaaaactta

SEQ ID NO: 90827 - DNA, 25 bp, Homo sapien
cgagaaaacttagccgagcttgaca

SEQ ID NO: 90828 - DNA, 25 bp, Homo sapien
gcggcggagccatgcgaaccaactc

SEQ ID NO: 90829 - DNA, 25 bp, Homo sapien
tgtttgcaaacactcactctcggga

SEQ ID NO: 90830 - DNA, 25 bp, Homo sapien
cgggccattcgcgaaccagacgcaa

SEQ ID NO: 90831 - DNA, 25 bp, Homo sapien
cctagatccttaggcggcgaggcgt

SEQ ID NO: 90832 - DNA, 25 bp, Homo sapien
ggcgggaaagctccgcaccctctat

SEQ ID NO: 90833 - DNA, 25 bp, Homo sapien
gtggtgcaaatcactccggcgttca

SEQ ID NO: 90834 - DNA, 25 bp, Homo sapien
tcgggctatctctcagcgcgtaaga

SEQ ID NO: 90835 - DNA, 25 bp, Homo sapien
agatgggcgtcttcaacttcgtgga

SEQ ID NO: 90836 - DNA, 25 bp, Homo sapien
accgaatttgaggtggtgctctacc

SEQ ID NO: 90837 - DNA, 25 bp, Homo sapien
ccgctcaggccaagctggtttacca

SEQ ID NO: 90838 - DNA, 25 bp, Homo sapien
ccttggatccctcaacgtattgcga

SEQ ID NO: 90839 - DNA, 25 bp, Homo sapien
cggctgccgaaacaagtgcctctca

SEQ ID NO: 90840 - DNA, 25 bp, Homo sapien
ggagcgcaccgcctctttcgaaagc

SEQ ID NO: 90841 - DNA, 25 bp, Homo sapien
ttccactgggatacctcggcagctg

SEQ ID NO: 90842 - DNA, 25 bp, Homo sapien
cttggagaagaacacctgaggcacc

SEQ ID NO: 90843 - DNA, 25 bp, Homo sapien
tgcgttgcctaggtgtctcattgga

SEQ ID NO: 90844 - DNA, 25 bp, Homo sapien
gcgctcctgctgttgttaagttacc

SEQ ID NO: 90845 - DNA, 25 bp, Homo sapien
ggtgaggatgctactgccacagctc

SEQ ID NO: 90846 - DNA, 25 bp, Homo sapien
ctgaggcacctctacgagccagaga

SEQ ID NO: 90847 - DNA, 25 bp, Homo sapien
gcggctgcacagaactccatggctt

SEQ ID NO: 90848 - DNA, 25 bp, Homo sapien
ctcggcggagacttggagatttcca

SEQ ID NO: 90849 - DNA, 25 bp, Homo sapien
tgcacggcagtggacacagctgtaa

SEQ ID NO: 90850 - DNA, 25 bp, Homo sapien
acacagctgtaagtgcggtgacagc

SEQ ID NO: 90851 - DNA, 25 bp, Homo sapien
cagatagctgcggaaagtcttggtg

SEQ ID NO: 90852 - DNA, 25 bp, Homo sapien
taagctcatcgtgtttggccaggtg

SEQ ID NO: 90853 - DNA, 25 bp, Homo sapien
cgcgtaccttggaaataagctcatc

SEQ ID NO: 90854 - DNA, 25 bp, Homo sapien
ccgcttcgcgtaccttggaaataag

SEQ ID NO: 90855 - DNA, 25 bp, Homo sapien
cccgcagagacggtcgcaggtgaag

SEQ ID NO: 90856 - DNA, 25 bp, Homo sapien
ctcatcgtgtttggccaggtgtgca

SEQ ID NO: 90857 - DNA, 25 bp, Homo sapien
agcaccatggcggttggcaagaaca

SEQ ID NO: 90858 - DNA, 25 bp, Homo sapien
tttggctctctgaccagcaccatgg

SEQ ID NO: 90859 - DNA, 25 bp, Homo sapien
gtacgcctaagttctcgcgcgactc

SEQ ID NO: 90860 - DNA, 25 bp, Homo sapien
tctactgtcccggaattcttgaggc

SEQ ID NO: 90861 - DNA, 25 bp, Homo sapien
tgagtgggcgtctcgttttacagaa

SEQ ID NO: 90862 - DNA, 25 bp, Homo sapien
caggtaaccagacgcctgcacgtca

SEQ ID NO: 90863 - DNA, 25 bp, Homo sapien
tggcgatgtcgcaaccacagtagaa

SEQ ID NO: 90864 - DNA, 25 bp, Homo sapien
gactgtcgtggcgtcttgctttttg

SEQ ID NO: 90865 - DNA, 25 bp, Homo sapien
ccgtagagctccaccgcggatcggg

SEQ ID NO: 90866 - DNA, 25 bp, Homo sapien
tggaaatggccacctccgcgaactc

SEQ ID NO: 90867 - DNA, 25 bp, Homo sapien
aagttcgcggcgctcgcgtagctct

SEQ ID NO: 90868 - DNA, 25 bp, Homo sapien
gagagttaaagaagccggtcccatc

SEQ ID NO: 90869 - DNA, 25 bp, Homo sapien
tctggcctctgagagttaaagaagc

SEQ ID NO: 90870 - DNA, 25 bp, Homo sapien
ggatggcgatggaaatgccaccctc

SEQ ID NO: 90871 - DNA, 25 bp, Homo sapien
gggtctgaatttcctcgggctcggc

SEQ ID NO: 90872 - DNA, 25 bp, Homo sapien
tggaaacaccagctcgacccaaaca

SEQ ID NO: 90873 - DNA, 25 bp, Homo sapien
tgtggaaactttccctcagaggctc

SEQ ID NO: 90874 - DNA, 25 bp, Homo sapien
atgttccaaacgaggtcgctgcgtc

SEQ ID NO: 90875 - DNA, 25 bp, Homo sapien
gcgttgtccgactccttccactagg

SEQ ID NO: 90876 - DNA, 25 bp, Homo sapien
gcagaacccgagagacgagcctttg

SEQ ID NO: 90877 - DNA, 25 bp, Homo sapien
actgcgcccagctcaagtttctgtg

SEQ ID NO: 90878 - DNA, 25 bp, Homo sapien
gcaccttcgaaaagttgcgctccga

SEQ ID NO: 90879 - DNA, 25 bp, Homo sapien
cccgggaccgcagagcaaactttct

SEQ ID NO: 90880 - DNA, 25 bp, Homo sapien
tttctggactatctgaggacacttg

SEQ ID NO: 90881 - DNA, 25 bp, Homo sapien
ttgtgattcgaagcctgccggaacc

SEQ ID NO: 90882 - DNA, 25 bp, Homo sapien
ggctcggaccggaagactactattc

SEQ ID NO: 90883 - DNA, 25 bp, Homo sapien
atgcattaaaaacgccataggctcg

SEQ ID NO: 90884 - DNA, 25 bp, Homo sapien
gtgactcagcctcactatgccgcga

SEQ ID NO: 90885 - DNA, 25 bp, Homo sapien
ctattcccggcgagcattgtgattc

SEQ ID NO: 90886 - DNA, 25 bp, Homo sapien
ccagggtcttggtcaggtgactcag

SEQ ID NO: 90887 - DNA, 25 bp, Homo sapien
gccgccattgtaactccagggtctt

SEQ ID NO: 90888 - DNA, 25 bp, Homo sapien
gaaagcccaacgtcttccacggcag

SEQ ID NO: 90889 - DNA, 25 bp, Homo sapien
gcctgccgatgacgcaagtcaccta

SEQ ID NO: 90890 - DNA, 25 bp, Homo sapien
ggttcatacactccggggcaagatg

SEQ ID NO: 90891 - DNA, 25 bp, Homo sapien
tcagcgttctctcaccgcggagcag

SEQ ID NO: 90892 - DNA, 25 bp, Homo sapien
gactggatctctcggatgctccttc

SEQ ID NO: 90893 - DNA, 25 bp, Homo sapien
gggctctcgcctcactccagagaga

SEQ ID NO: 90894 - DNA, 25 bp, Homo sapien
gctctgatgacgctccaagggaaga

SEQ ID NO: 90895 - DNA, 25 bp, Homo sapien
ctgaggcttcctccgctggcctttt

SEQ ID NO: 90896 - DNA, 25 bp, Homo sapien
gatgctccttcgctctcagtctcag

SEQ ID NO: 90897 - DNA, 25 bp, Homo sapien
tccggtggctgagaaagcagctttc

SEQ ID NO: 90898 - DNA, 25 bp, Homo sapien
tcgacttagaagctaccgagttacc

SEQ ID NO: 90899 - DNA, 25 bp, Homo sapien
agcagctttcgctcttctgtggtag

SEQ ID NO: 90900 - DNA, 25 bp, Homo sapien
cctggagaccttcgacctctcaaga

SEQ ID NO: 90901 - DNA, 25 bp, Homo sapien
agggccagggacaacgctacttccg

SEQ ID NO: 90902 - DNA, 25 bp, Homo sapien
ttccgctcagtttttgccagggttg

SEQ ID NO: 90903 - DNA, 25 bp, Homo sapien
cgggactggaataaccttcttcgtg

SEQ ID NO: 90904 - DNA, 25 bp, Homo sapien
cgcgcattaggtcgctgccagaaaa

SEQ ID NO: 90905 - DNA, 25 bp, Homo sapien
aacttctgggcgcagcgtgctaaac

SEQ ID NO: 90906 - DNA, 25 bp, Homo sapien
tacccggccacggagaacagcgatc

SEQ ID NO: 90907 - DNA, 25 bp, Homo sapien
cccgcgtctggagaacgagctgcat

SEQ ID NO: 90908 - DNA, 25 bp, Homo sapien
tggctaagactttcagatcaaccgc

SEQ ID NO: 90909 - DNA, 25 bp, Homo sapien
ctctgtttttctcagcggctcgacc

SEQ ID NO: 90910 - DNA, 25 bp, Homo sapien
ctcccttttggcagagccgcagtgc

SEQ ID NO: 90911 - DNA, 25 bp, Homo sapien
tcagcctccaaacaaggggtgtccc

SEQ ID NO: 90912 - DNA, 25 bp, Homo sapien
gcacctgggcggttgactattagtc

SEQ ID NO: 90913 - DNA, 25 bp, Homo sapien
tggagagctcctcccgggctacaac

SEQ ID NO: 90914 - DNA, 25 bp, Homo sapien
gcgcccacaggacggacgacgacaa

SEQ ID NO: 90915 - DNA, 25 bp, Homo sapien
gcgctggggacgataccttccacag

SEQ ID NO: 90916 - DNA, 25 bp, Homo sapien
cgtggtctctatccgcctcgggctt

SEQ ID NO: 90917 - DNA, 25 bp, Homo sapien
caactggtcactggcgtggtctcta

SEQ ID NO: 90918 - DNA, 25 bp, Homo sapien
ccacacactctggtccgagggtttc

SEQ ID NO: 90919 - DNA, 25 bp, Homo sapien
acgacgacaagcgacacgaggccca

SEQ ID NO: 90920 - DNA, 25 bp, Homo sapien
accagtctctgcagtgccagggcca

SEQ ID NO: 90921 - DNA, 25 bp, Homo sapien
agcatgcgcaaggtcatgcccatca

SEQ ID NO: 90922 - DNA, 25 bp, Homo sapien
tcacgccagaactccgtgcggaggg

SEQ ID NO: 90923 - DNA, 25 bp, Homo sapien
tactgtgtggtcacgccagaactcc

SEQ ID NO: 90924 - DNA, 25 bp, Homo sapien
ctggaggcgaccagagctgtcatcc

SEQ ID NO: 90925 - DNA, 25 bp, Homo sapien
tgcggaccctgaccgcctcagagaa

SEQ ID NO: 90926 - DNA, 25 bp, Homo sapien
gcctcagagaacgagagcatgcgca

SEQ ID NO: 90927 - DNA, 25 bp, Homo sapien
ccagcagcacagatactgtgtggtc

SEQ ID NO: 90928 - DNA, 25 bp, Homo sapien
aaggtcatgcccatcaccaagtcca

SEQ ID NO: 90929 - DNA, 25 bp, Homo sapien
tcactcggacagtgtcgcagcggca

SEQ ID NO: 90930 - DNA, 25 bp, Homo sapien
tgagaacagatcttcctcccgtggc

SEQ ID NO: 90931 - DNA, 25 bp, Homo sapien
cctcctctcgaagcatgagaacaga

SEQ ID NO: 90932 - DNA, 25 bp, Homo sapien
tgtcccgagctttgcccggaacaca

SEQ ID NO: 90933 - DNA, 25 bp, Homo sapien
ccctgagagtcccaaagaagagccc

SEQ ID NO: 90934 - DNA, 25 bp, Homo sapien
actccgagggccctgagagtcccaa

SEQ ID NO: 90935 - DNA, 25 bp, Homo sapien
agcagcactttgaggcgagccagca

SEQ ID NO: 90936 - DNA, 25 bp, Homo sapien
cgctcccaaggacagcagcactttg

SEQ ID NO: 90937 - DNA, 25 bp, Homo sapien
tccggcaaactacacatcccaaagg

SEQ ID NO: 90938 - DNA, 25 bp, Homo sapien
cggacgcgcactgccgaagcctggt

SEQ ID NO: 90939 - DNA, 25 bp, Homo sapien
ctccctccggctgcacgaataatga

SEQ ID NO: 90940 - DNA, 25 bp, Homo sapien
cacctttggcgtcacgttcaaaaca

SEQ ID NO: 90941 - DNA, 25 bp, Homo sapien
gcgtcacgttcaaaacaatcctttg

SEQ ID NO: 90942 - DNA, 25 bp, Homo sapien
ttagcgagtgcacccgctctcggct

SEQ ID NO: 90943 - DNA, 25 bp, Homo sapien
gcaagtgcggaactgcgtttgtttc

SEQ ID NO: 90944 - DNA, 25 bp, Homo sapien
cgcgtgtcctttcacagcgcaagtg

SEQ ID NO: 90945 - DNA, 25 bp, Homo sapien
cgcgcttcgggacgcaattggaaac

SEQ ID NO: 90946 - DNA, 25 bp, Homo sapien
cgcgtctgggtttctttgagatctc

SEQ ID NO: 90947 - DNA, 25 bp, Homo sapien
ctcgaaacgagatgaggccagtgtt

SEQ ID NO: 90948 - DNA, 25 bp, Homo sapien
ccggccctttttgaagatggagaga

SEQ ID NO: 90949 - DNA, 25 bp, Homo sapien
tggggatccacacacaaaggaaata

SEQ ID NO: 90950 - DNA, 25 bp, Homo sapien
ccgggcttggaaccgccctatgctt

SEQ ID NO: 90951 - DNA, 25 bp, Homo sapien
ggcgcttaaagcttccagaccggtg

SEQ ID NO: 90952 - DNA, 25 bp, Homo sapien
agatctcagcgcctttgggatttca

SEQ ID NO: 90953 - DNA, 25 bp, Homo sapien
cccgctgcctgatgtcgtgagctag

SEQ ID NO: 90954 - DNA, 25 bp, Homo sapien
agcctgcccagagtccatttccgga

SEQ ID NO: 90955 - DNA, 25 bp, Homo sapien
ctgttcccgcgaagcgagtcgccgt

SEQ ID NO: 90956 - DNA, 25 bp, Homo sapien
ccgctgagcagcagaacctggacgc

SEQ ID NO: 90957 - DNA, 25 bp, Homo sapien
agtttcaccttcagatcgcctgagg

SEQ ID NO: 90958 - DNA, 25 bp, Homo sapien
cggccttagataaagcagtttcacc

SEQ ID NO: 90959 - DNA, 25 bp, Homo sapien
cgctcgctcagaaaacggccttaga

SEQ ID NO: 90960 - DNA, 25 bp, Homo sapien
agtcgccgtctcgtagtaagtcgtg

SEQ ID NO: 90961 - DNA, 25 bp, Homo sapien
accgcaggatggaatcgtagaggtc

SEQ ID NO: 90962 - DNA, 25 bp, Homo sapien
gttatgaccgcaggatggaatcgta

SEQ ID NO: 90963 - DNA, 25 bp, Homo sapien
gtgaaagcccctagggctccgcctg

SEQ ID NO: 90964 - DNA, 25 bp, Homo sapien
agagcctgcggggtgaaagccccta

SEQ ID NO: 90965 - DNA, 25 bp, Homo sapien
gcctgttgctatggagcccgggccc

SEQ ID NO: 90966 - DNA, 25 bp, Homo sapien
ccggcgcgcaatcgccatctgggtg

SEQ ID NO: 90967 - DNA, 25 bp, Homo sapien
aataccggcgcgcaatcgccatctg

SEQ ID NO: 90968 - DNA, 25 bp, Homo sapien
cccaggtcggtggttatgaccgcag

SEQ ID NO: 90969 - DNA, 25 bp, Homo sapien
agacccgcaagcatgtacagcactg

SEQ ID NO: 90970 - DNA, 25 bp, Homo sapien
tcgggacgatcttaaccaccaacgc

SEQ ID NO: 90971 - DNA, 25 bp, Homo sapien
accaacgccgttgcctcagagacag

SEQ ID NO: 90972 - DNA, 25 bp, Homo sapien
gcagaccatcatcgggcagcccatg

SEQ ID NO: 90973 - DNA, 25 bp, Homo sapien
aacggcacctatgagtttttgtaca

SEQ ID NO: 90974 - DNA, 25 bp, Homo sapien
atccgatccgctgatgtgtctccca

SEQ ID NO: 90975 - DNA, 25 bp, Homo sapien
agcggccacgtcaagcagaaagctg

SEQ ID NO: 90976 - DNA, 25 bp, Homo sapien
cgggagaacgaccagctggatttca

SEQ ID NO: 90977 - DNA, 25 bp, Homo sapien
ctcggctgcatgtggatcccggcct

SEQ ID NO: 90978 - DNA, 25 bp, Homo sapien
ggagacggaggcagctctgcaaccc

SEQ ID NO: 90979 - DNA, 25 bp, Homo sapien
tgcaacccgtccactgagacgcgga

SEQ ID NO: 90980 - DNA, 25 bp, Homo sapien
cccgcggcgtagtcggcgccaaaat

SEQ ID NO: 90981 - DNA, 25 bp, Homo sapien
aaaatcaaacgcgtcctggcctgtc

SEQ ID NO: 90982 - DNA, 25 bp, Homo sapien
cgcgccatggtaaggactgaggcta

SEQ ID NO: 90983 - DNA, 25 bp, Homo sapien
tgaggctacggtcccgcgtcttctt

SEQ ID NO: 90984 - DNA, 25 bp, Homo sapien
ttcctccctagtgtgtgggcttcgc

SEQ ID NO: 90985 - DNA, 25 bp, Homo sapien
gcggcaaccacccaaaagttcatga

SEQ ID NO: 90986 - DNA, 25 bp, Homo sapien
tgaacctcctgctgggcgtcttcca

SEQ ID NO: 90987 - DNA, 25 bp, Homo sapien
ggtaatctctcgaccgtggcccaag

SEQ ID NO: 90988 - DNA, 25 bp, Homo sapien
cccgcgggttcgcattgtccacttt

SEQ ID NO: 90989 - DNA, 25 bp, Homo sapien
tatctgcggcgcacacgcgctcaga

SEQ ID NO: 90990 - DNA, 25 bp, Homo sapien
tggcccaagcgcctcgacaaagcgg

SEQ ID NO: 90991 - DNA, 25 bp, Homo sapien
acttggcaaaagtgggccgctagtc

SEQ ID NO: 90992 - DNA, 25 bp, Homo sapien
gctctttcttttagggaactgctga

SEQ ID NO: 90993 - DNA, 25 bp, Homo sapien
ttcctgcagcgattgagccgttgcc

SEQ ID NO: 90994 - DNA, 25 bp, Homo sapien
ctgaacacctggcaacggtggcctt

SEQ ID NO: 90995 - DNA, 25 bp, Homo sapien
cgttcgggccactttgcaaggcaaa

SEQ ID NO: 90996 - DNA, 25 bp, Homo sapien
ctgcccactcaggtgaggacgacca

SEQ ID NO: 90997 - DNA, 25 bp, Homo sapien
cagaagaaggggaactcctgctgcc

SEQ ID NO: 90998 - DNA, 25 bp, Homo sapien
gcgtgcattaaaaacgtggtgtatt

SEQ ID NO: 90999 - DNA, 25 bp, Homo sapien
acaggaagcgtttctttagcgtgca

SEQ ID NO: 91000 - DNA, 25 bp, Homo sapien
tgcaaggcaaataaacgttaggggc

SEQ ID NO: 91001 - DNA, 25 bp, Homo sapien
ctcaggtgactgctcggagttctcc

SEQ ID NO: 91002 - DNA, 25 bp, Homo sapien
ggtgcttctttgcacggcccagcgc

SEQ ID NO: 91003 - DNA, 25 bp, Homo sapien
gtcgcagcctagctcacggtcaagg

SEQ ID NO: 91004 - DNA, 25 bp, Homo sapien
actcagcgcgaggtccagagttccc

SEQ ID NO: 91005 - DNA, 25 bp, Homo sapien
tcgattcgcttttctctgacctgga

SEQ ID NO: 91006 - DNA, 25 bp, Homo sapien
aggccgcctctagcgtctcgattcg

SEQ ID NO: 91007 - DNA, 25 bp, Homo sapien
agttctcccaggtacgtcgtgcgct

SEQ ID NO: 91008 - DNA, 25 bp, Homo sapien
tgcttacttcctagtcccgggcagg

SEQ ID NO: 91009 - DNA, 25 bp, Homo sapien
tgcctcagtttgaccatctgccaag

SEQ ID NO: 91010 - DNA, 25 bp, Homo sapien
tgtgagacccttgctcacccgtggc

SEQ ID NO: 91011 - DNA, 25 bp, Homo sapien
acgcgacctggtggcgtcaagacac

SEQ ID NO: 91012 - DNA, 25 bp, Homo sapien
cacgcacctgcttgacggtgaagtc

SEQ ID NO: 91013 - DNA, 25 bp, Homo sapien
gtcacgcagtcgctgtggaagagca

SEQ ID NO: 91014 - DNA, 25 bp, Homo sapien
tctgccaaggatgacaccagctgtg

SEQ ID NO: 91015 - DNA, 25 bp, Homo sapien
gctccacgccatccgacaagtaagg

SEQ ID NO: 91016 - DNA, 25 bp, Homo sapien
cacgttgaagccgaaggccttggcc

SEQ ID NO: 91017 - DNA, 25 bp, Homo sapien
ccattgtcgccgataaagcgtcttg

SEQ ID NO: 91018 - DNA, 25 bp, Homo sapien
catcttccagaaggtcatgcgtccg

SEQ ID NO: 91019 - DNA, 25 bp, Homo sapien
ttccagaaggtcatgcgtccgtccc

SEQ ID NO: 91020 - DNA, 25 bp, Homo sapien
ataaagcgtcttgagccctaccggg

SEQ ID NO: 91021 - DNA, 25 bp, Homo sapien
attcagccagccattgtcgccgata

SEQ ID NO: 91022 - DNA, 25 bp, Homo sapien
cggttccttcagaacctcaggcctc

SEQ ID NO: 91023 - DNA, 25 bp, Homo sapien
ttggagaccagtctgtgcagcctgc

SEQ ID NO: 91024 - DNA, 25 bp, Homo sapien
tcttgagccctaccgggtgcgtgtg

SEQ ID NO: 91025 - DNA, 25 bp, Homo sapien
tcacggttagcgctacggctccaag

SEQ ID NO: 91026 - DNA, 25 bp, Homo sapien
ttggctcttcaagtccgggcgtccc

SEQ ID NO: 91027 - DNA, 25 bp, Homo sapien
tacattggctcttcaagtccgggcg

SEQ ID NO: 91028 - DNA, 25 bp, Homo sapien
gctacggctccaaggctggcgcctg

SEQ ID NO: 91029 - DNA, 25 bp, Homo sapien
ttccctctcacggttagcgctacgg

SEQ ID NO: 91030 - DNA, 25 bp, Homo sapien
ccttaggcttccctctcacggttag

SEQ ID NO: 91031 - DNA, 25 bp, Homo sapien
ctgccaccgcctcaggtcgcgcgct

SEQ ID NO: 91032 - DNA, 25 bp, Homo sapien
ggagcctcgccctacattggctctt

SEQ ID NO: 91033 - DNA, 25 bp, Homo sapien
gtccgaagtttctgctgggttgcca

SEQ ID NO: 91034 - DNA, 25 bp, Homo sapien
ctgcttcatgaccagcgggatccaa

SEQ ID NO: 91035 - DNA, 25 bp, Homo sapien
ttgggcagccgcatgttctggtatt

SEQ ID NO: 91036 - DNA, 25 bp, Homo sapien
ttctggtattcgatgccgtggcaca

SEQ ID NO: 91037 - DNA, 25 bp, Homo sapien
tgggcttgcaattgctgcgcttgta

SEQ ID NO: 91038 - DNA, 25 bp, Homo sapien
ctggggcacagccagagttttcttg

SEQ ID NO: 91039 - DNA, 25 bp, Homo sapien
cacgcgcttgctggaagggaattct

SEQ ID NO: 91040 - DNA, 25 bp, Homo sapien
aacttcttggtgtccgggtggcact

SEQ ID NO: 91041 - DNA, 25 bp, Homo sapien
cggaacccacgccacttagtctggt

SEQ ID NO: 91042 - DNA, 25 bp, Homo sapien
acagggcaataacctcccgcggagg

SEQ ID NO: 91043 - DNA, 25 bp, Homo sapien
tgcttttgggctaagaccggtccaa

SEQ ID NO: 91044 - DNA, 25 bp, Homo sapien
ggcacggagctctgcccatatgagc

SEQ ID NO: 91045 - DNA, 25 bp, Homo sapien
gtgtccacctctggccagcttgttt

SEQ ID NO: 91046 - DNA, 25 bp, Homo sapien
cggctgcattgttttgggagccctc

SEQ ID NO: 91047 - DNA, 25 bp, Homo sapien
cttgttgggagttcaaggagcccga

SEQ ID NO: 91048 - DNA, 25 bp, Homo sapien
cggtccaattgatcactggggaaca

SEQ ID NO: 91049 - DNA, 25 bp, Homo sapien
cctgctccgggtgagtattttttca

SEQ ID NO: 91050 - DNA, 25 bp, Homo sapien
tttccgagaacgagaccagagtctg

SEQ ID NO: 91051 - DNA, 25 bp, Homo sapien
cccatcggttcagacgcggatttcc

SEQ ID NO: 91052 - DNA, 25 bp, Homo sapien
gtgcacctccgtgtacgcttctgct

SEQ ID NO: 91053 - DNA, 25 bp, Homo sapien
ggatgacctcattccttcgcctttg

SEQ ID NO: 91054 - DNA, 25 bp, Homo sapien
ggttcctttacgctgagatccctta

SEQ ID NO: 91055 - DNA, 25 bp, Homo sapien
ggcgccatttcccaaaacagagatt

SEQ ID NO: 91056 - DNA, 25 bp, Homo sapien
gctcttgcgcgtatctccttaaata

SEQ ID NO: 91057 - DNA, 25 bp, Homo sapien
tgagcacaaccacgggctgcgtctc

SEQ ID NO: 91058 - DNA, 25 bp, Homo sapien
ccgcgggtgaatggagaactttccg

SEQ ID NO: 91059 - DNA, 25 bp, Homo sapien
cccaggctgccgttgaggaacagca

SEQ ID NO: 91060 - DNA, 25 bp, Homo sapien
ttccgcacgtgcgaggtacaaggct

SEQ ID NO: 91061 - DNA, 25 bp, Homo sapien
gcgtggtctgggatattctaatctc

SEQ ID NO: 91062 - DNA, 25 bp, Homo sapien
cgctgggtggttgtcattgacatcc

SEQ ID NO: 91063 - DNA, 25 bp, Homo sapien
ccagggctctgtcgatggcaaagac

SEQ ID NO: 91064 - DNA, 25 bp, Homo sapien
actgttatgttgacctcggtgctgc

SEQ ID NO: 91065 - DNA, 25 bp, Homo sapien
ggtgctgcttgtttaaatctccgag

SEQ ID NO: 91066 - DNA, 25 bp, Homo sapien
cctcacataatcttggcgaacgttc

SEQ ID NO: 91067 - DNA, 25 bp, Homo sapien
ttcacatttccagtcagcgtggctc

SEQ ID NO: 91068 - DNA, 25 bp, Homo sapien
agcgtggctcattttatttcccaga

SEQ ID NO: 91069 - DNA, 25 bp, Homo sapien
cagatgtttttacactccgaggcca

SEQ ID NO: 91070 - DNA, 25 bp, Homo sapien
cacggacgccaagcggcactatttt

SEQ ID NO: 91071 - DNA, 25 bp, Homo sapien
tgcaactacaaccacaggatcgcgg

SEQ ID NO: 91072 - DNA, 25 bp, Homo sapien
cgccctctgtgagaagccacacaaa

SEQ ID NO: 91073 - DNA, 25 bp, Homo sapien
tcgttgacgcgaatctccacctgca

SEQ ID NO: 91074 - DNA, 25 bp, Homo sapien
cgcggtactcgtcctgctcaaagac

SEQ ID NO: 91075 - DNA, 25 bp, Homo sapien
cgcggatgtcacctaccagcgtgtc

SEQ ID NO: 91076 - DNA, 25 bp, Homo sapien
ctgaccgcccatggggtgtatctct

SEQ ID NO: 91077 - DNA, 25 bp, Homo sapien
tagcgcaactggaagaacgggcctg

SEQ ID NO: 91078 - DNA, 25 bp, Homo sapien
ggcgagtggtcattcacgtcgttga

SEQ ID NO: 91079 - DNA, 25 bp, Homo sapien
gtcctccgacagaaagaagccgctc

SEQ ID NO: 91080 - DNA, 25 bp, Homo sapien
tgtagccctgagtgctgaacagtcc

SEQ ID NO: 91081 - DNA, 25 bp, Homo sapien
cctcgtagcctcttttctctctgga

SEQ ID NO: 91082 - DNA, 25 bp, Homo sapien
ggacactttccagctcccaagagtc

SEQ ID NO: 91083 - DNA, 25 bp, Homo sapien
attatctcaggcttcgcgcccaggc

SEQ ID NO: 91084 - DNA, 25 bp, Homo sapien
gactcgggttctcatccggcttcta

SEQ ID NO: 91085 - DNA, 25 bp, Homo sapien
gtgtcactttacctcgaccatgatg

SEQ ID NO: 91086 - DNA, 25 bp, Homo sapien
ctccggcagggaagaaactctaatc

SEQ ID NO: 91087 - DNA, 25 bp, Homo sapien
agctgtgcagcaccttccggaattg

SEQ ID NO: 91088 - DNA, 25 bp, Homo sapien
tcgaccatgatgctaccgtgtatcc

SEQ ID NO: 91089 - DNA, 25 bp, Homo sapien
gattggacagacaccagagcctggg

SEQ ID NO: 91090 - DNA, 25 bp, Homo sapien
agacgcggaggtatcaggtaatccc

SEQ ID NO: 91091 - DNA, 25 bp, Homo sapien
tcgagtcccggagattggacagaca

SEQ ID NO: 91092 - DNA, 25 bp, Homo sapien
aacgttgagcgtgaggctcgtgctc

SEQ ID NO: 91093 - DNA, 25 bp, Homo sapien
tgagcagtgcctaacgttgagcgtg

SEQ ID NO: 91094 - DNA, 25 bp, Homo sapien
gcggccttgagcagtgcctaacgtt

SEQ ID NO: 91095 - DNA, 25 bp, Homo sapien
tcggccagtaggtgtctctgctcct

SEQ ID NO: 91096 - DNA, 25 bp, Homo sapien
gtgcggagccctgttttctgggctc

SEQ ID NO: 91097 - DNA, 25 bp, Homo sapien
cggggacactgtagctgtcattcct

SEQ ID NO: 91098 - DNA, 25 bp, Homo sapien
gctctttctaaatctcgccgccaga

SEQ ID NO: 91099 - DNA, 25 bp, Homo sapien
cagtctgtctgagtgttgaccagga

SEQ ID NO: 91100 - DNA, 25 bp, Homo sapien
agtcgaccgctcagcacagtctgtc

SEQ ID NO: 91101 - DNA, 25 bp, Homo sapien
tcattccttcttctgcaggcgggta

SEQ ID NO: 91102 - DNA, 25 bp, Homo sapien
gcgctgagacccaagcggatcttgc

SEQ ID NO: 91103 - DNA, 25 bp, Homo sapien
cttgcttggcctgtatgcgttactg

SEQ ID NO: 91104 - DNA, 25 bp, Homo sapien
cctggtgacgcattcgcatgtattt

SEQ ID NO: 91105 - DNA, 25 bp, Homo sapien
gtcgggcgcaacagagcaactccag

SEQ ID NO: 91106 - DNA, 25 bp, Homo sapien
ggccacgagatgaacacgttgctca

SEQ ID NO: 91107 - DNA, 25 bp, Homo sapien
ctcagtcctgtcctgggttgggacc

SEQ ID NO: 91108 - DNA, 25 bp, Homo sapien
tggcagcacacacacggcaactgct

SEQ ID NO: 91109 - DNA, 25 bp, Homo sapien
caagtccgatgatgcccaaggtctc

SEQ ID NO: 91110 - DNA, 25 bp, Homo sapien
cactttaggttcacgtggcagcaca

SEQ ID NO: 91111 - DNA, 25 bp, Homo sapien
gagcgggtttgaagcttcccaagga

SEQ ID NO: 91112 - DNA, 25 bp, Homo sapien
cagcccaggaagagacaagcacgtg

SEQ ID NO: 91113 - DNA, 25 bp, Homo sapien
ctgtttcccttttaccgctctgcgg

SEQ ID NO: 91114 - DNA, 25 bp, Homo sapien
cttctctgaggcaggacggcactgc

SEQ ID NO: 91115 - DNA, 25 bp, Homo sapien
ctgcggaaccggaagtgccgtacca

SEQ ID NO: 91116 - DNA, 25 bp, Homo sapien
cagcgcgagccgcatgaatgagaca

SEQ ID NO: 91117 - DNA, 25 bp, Homo sapien
gccttggaaacggacgacgagtaga

SEQ ID NO: 91118 - DNA, 25 bp, Homo sapien
aacgggttagagacggccactcagc

SEQ ID NO: 91119 - DNA, 25 bp, Homo sapien
ttcttttcggtttcagcggtcgtca

SEQ ID NO: 91120 - DNA, 25 bp, Homo sapien
tgaatgagacaaacgtgcgccgcgc

SEQ ID NO: 91121 - DNA, 25 bp, Homo sapien
gccgtctccgggaggttatgcttaa

SEQ ID NO: 91122 - DNA, 25 bp, Homo sapien
aggcgcacgggcaaagaacttagca

SEQ ID NO: 91123 - DNA, 25 bp, Homo sapien
taggaccaccctcgaggaggcattg

SEQ ID NO: 91124 - DNA, 25 bp, Homo sapien
atgaatcttgctttcctggcgggcg

SEQ ID NO: 91125 - DNA, 25 bp, Homo sapien
ccgccgtttttcatgccaaccgttg

SEQ ID NO: 91126 - DNA, 25 bp, Homo sapien
ccaaccgttggaagcttcgtactca

SEQ ID NO: 91127 - DNA, 25 bp, Homo sapien
ctcgggttcaaatcaccggcgcgca

SEQ ID NO: 91128 - DNA, 25 bp, Homo sapien
gtccatgtgaccctgaagccggaga

SEQ ID NO: 91129 - DNA, 25 bp, Homo sapien
cgttattgtcaaagtggccagcatc

SEQ ID NO: 91130 - DNA, 25 bp, Homo sapien
gcgtctcatcctgggcgttattgtc

SEQ ID NO: 91131 - DNA, 25 bp, Homo sapien
ggtggtctccaacaagcgtctcatc

SEQ ID NO: 91132 - DNA, 25 bp, Homo sapien
cgtgttgcccacatgatgcccgaca

SEQ ID NO: 91133 - DNA, 25 bp, Homo sapien
tctacctaggagacaaccgtgttgc

SEQ ID NO: 91134 - DNA, 25 bp, Homo sapien
ccggctgcttgtagcactggtctca

SEQ ID NO: 91135 - DNA, 25 bp, Homo sapien
tcccgcggcgataaagaatcactgt

SEQ ID NO: 91136 - DNA, 25 bp, Homo sapien
aagccagtagtgcaaccgggatccc

SEQ ID NO: 91137 - DNA, 25 bp, Homo sapien
gcaccactcctcgtggggctgctta

SEQ ID NO: 91138 - DNA, 25 bp, Homo sapien
cggggtcactaccagaccactgcta

SEQ ID NO: 91139 - DNA, 25 bp, Homo sapien
cccacctgtgctgcatttcgtgtta

SEQ ID NO: 91140 - DNA, 25 bp, Homo sapien
cccgaagctaatccctgattggatg

SEQ ID NO: 91141 - DNA, 25 bp, Homo sapien
tgcacagggaagatagctcgcctct

SEQ ID NO: 91142 - DNA, 25 bp, Homo sapien
tttcctgacacgcttacgccgacga

SEQ ID NO: 91143 - DNA, 25 bp, Homo sapien
tcctagtcgtttgcgtggagttcta

SEQ ID NO: 91144 - DNA, 25 bp, Homo sapien
ggactgagcctcgaactttactttg

SEQ ID NO: 91145 - DNA, 25 bp, Homo sapien
gtgcaatcctgctggcgcttttccg

SEQ ID NO: 91146 - DNA, 25 bp, Homo sapien
ggcgcaaacgcccagagtatcaaac

SEQ ID NO: 91147 - DNA, 25 bp, Homo sapien
gctgagagaccctggacactgttcc

SEQ ID NO: 91148 - DNA, 25 bp, Homo sapien
gcagcctctgcacctgttttcttgt

SEQ ID NO: 91149 - DNA, 25 bp, Homo sapien
cggacttgcctttgggcaccttcca

SEQ ID NO: 91150 - DNA, 25 bp, Homo sapien
gtcggctggctaatcatcggacaga

SEQ ID NO: 91151 - DNA, 25 bp, Homo sapien
ggacagacggactgcacacatcttg

SEQ ID NO: 91152 - DNA, 25 bp, Homo sapien
atttggtgaagtcggcctcaagtcc

SEQ ID NO: 91153 - DNA, 25 bp, Homo sapien
tccgcgaccctgagaatcaagagcc

SEQ ID NO: 91154 - DNA, 25 bp, Homo sapien
cgaagctttcgcgatgagccgcatt

SEQ ID NO: 91155 - DNA, 25 bp, Homo sapien
gcggttgctaggaaacagcgtcttc

SEQ ID NO: 91156 - DNA, 25 bp, Homo sapien
ccaagcatcgggtaggagctgctca

SEQ ID NO: 91157 - DNA, 25 bp, Homo sapien
gcgccgtatgctgagcaccagcgaa

SEQ ID NO: 91158 - DNA, 25 bp, Homo sapien
tgagccgcattaaaatcgcggtttc

SEQ ID NO: 91159 - DNA, 25 bp, Homo sapien
tcgcggtttcccgtactcggagcag

SEQ ID NO: 91160 - DNA, 25 bp, Homo sapien
gtccaagcgcggtctctgtccggat

SEQ ID NO: 91161 - DNA, 25 bp, Homo sapien
gctctctttctccattcgcagtgcg

SEQ ID NO: 91162 - DNA, 25 bp, Homo sapien
ccaccaagtaagtggtcgctgcatc

SEQ ID NO: 91163 - DNA, 25 bp, Homo sapien
ccgaggtgtgcgaagccaccaagta

SEQ ID NO: 91164 - DNA, 25 bp, Homo sapien
tctgttttcgttaggactgcggctc

SEQ ID NO: 91165 - DNA, 25 bp, Homo sapien
catgagcgacccaagcgtaagtgcc

SEQ ID NO: 91166 - DNA, 25 bp, Homo sapien
atacagtttccgaggcacgccgcgt

SEQ ID NO: 91167 - DNA, 25 bp, Homo sapien
tcctgagaaaccttcggtacgctcc

SEQ ID NO: 91168 - DNA, 25 bp, Homo sapien
gcgtcccgcctagcctgttgaacag

SEQ ID NO: 91169 - DNA, 25 bp, Homo sapien
agcgggtccctgacgctcaagtctc

SEQ ID NO: 91170 - DNA, 25 bp, Homo sapien
acatcaagtaagtggccggctaccc

SEQ ID NO: 91171 - DNA, 25 bp, Homo sapien
cccgcagtacggatttgtgaatcac

SEQ ID NO: 91172 - DNA, 25 bp, Homo sapien
ggtgaaaggttaagccagcgccatg

SEQ ID NO: 91173 - DNA, 25 bp, Homo sapien
cacgatccgactcctttagtgcata

SEQ ID NO: 91174 - DNA, 25 bp, Homo sapien
caccatggtaagtgctctcagccgg

SEQ ID NO: 91175 - DNA, 25 bp, Homo sapien
ggctcccggtgcagacaccatggta

SEQ ID NO: 91176 - DNA, 25 bp, Homo sapien
ccctggagttgctggtgatccgcaa

SEQ ID NO: 91177 - DNA, 25 bp, Homo sapien
cgcccgcgcggcctgttttctcttt

SEQ ID NO: 91178 - DNA, 25 bp, Homo sapien
cgcacgtccattgcggcgcccggct

SEQ ID NO: 91179 - DNA, 25 bp, Homo sapien
gcagcgcccgcacgtccattgcggc

SEQ ID NO: 91180 - DNA, 25 bp, Homo sapien
gcagccacggcagcgcccgcacgtc

SEQ ID NO: 91181 - DNA, 25 bp, Homo sapien
ggcggcttcacgctcgcggctccgc

SEQ ID NO: 91182 - DNA, 25 bp, Homo sapien
gcagagccacgggtgcccacgagca

SEQ ID NO: 91183 - DNA, 25 bp, Homo sapien
gtgcccacgagcagggtcagctctc

SEQ ID NO: 91184 - DNA, 25 bp, Homo sapien
ctcgggggccctcttccgcagccca

SEQ ID NO: 91185 - DNA, 25 bp, Homo sapien
ccaaagttcaccttgttcgggctcg

SEQ ID NO: 91186 - DNA, 25 bp, Homo sapien
gagcgccgcagcacggattccggca

SEQ ID NO: 91187 - DNA, 25 bp, Homo sapien
attccggcacctggcttgagttttc

SEQ ID NO: 91188 - DNA, 25 bp, Homo sapien
tgagttttccgcgaccaaagttcac

SEQ ID NO: 91189 - DNA, 25 bp, Homo sapien
gctcctcaaagcctggggcaattcg

SEQ ID NO: 91190 - DNA, 25 bp, Homo sapien
gggctccgcgctaacctcggggcta

SEQ ID NO: 91191 - DNA, 25 bp, Homo sapien
ttggccgcccactggctgtcaacag

SEQ ID NO: 91192 - DNA, 25 bp, Homo sapien
tgtcaacaggtgctgcgcagacagg

SEQ ID NO: 91193 - DNA, 25 bp, Homo sapien
gaatagacgcctttgcggaaacagc

SEQ ID NO: 91194 - DNA, 25 bp, Homo sapien
ctttgcggaaacagcgggtcaagcc

SEQ ID NO: 91195 - DNA, 25 bp, Homo sapien
cgcctccgggtaagtgccaggagct

SEQ ID NO: 91196 - DNA, 25 bp, Homo sapien
ggcccggagcctccacgatctcgcc

SEQ ID NO: 91197 - DNA, 25 bp, Homo sapien
gctgcacccttagcagccactgcca

SEQ ID NO: 91198 - DNA, 25 bp, Homo sapien
acgttgctctgtcgggacacctctt

SEQ ID NO: 91199 - DNA, 25 bp, Homo sapien
cgatgccgtgacgttgctctgtcgg

SEQ ID NO: 91200 - DNA, 25 bp, Homo sapien
tctgaggacgggaatagacgccttt

SEQ ID NO: 91201 - DNA, 25 bp, Homo sapien
acggtaacccgtgtgactttgactg

SEQ ID NO: 91202 - DNA, 25 bp, Homo sapien
ctactcgtgaggaaactgccgccgc

SEQ ID NO: 91203 - DNA, 25 bp, Homo sapien
tggcggtcttggcacctctaattgc

SEQ ID NO: 91204 - DNA, 25 bp, Homo sapien
tccgtgtctgccgttggtaattttc

SEQ ID NO: 91205 - DNA, 25 bp, Homo sapien
cgcttgtcattggatgcctcaggca

SEQ ID NO: 91206 - DNA, 25 bp, Homo sapien
ttccgtcgccttatgagaacgttca

SEQ ID NO: 91207 - DNA, 25 bp, Homo sapien
gggttctgacctaccacagcgttca

SEQ ID NO: 91208 - DNA, 25 bp, Homo sapien
agaggccgtacgtttgcgatatagc

SEQ ID NO: 91209 - DNA, 25 bp, Homo sapien
caagacgggacggagcttgcatgaa

SEQ ID NO: 91210 - DNA, 25 bp, Homo sapien
gccacaccaggcaatgtgcaacggg

SEQ ID NO: 91211 - DNA, 25 bp, Homo sapien
cagtgaagcctccatggacgaagca

SEQ ID NO: 91212 - DNA, 25 bp, Homo sapien
gttgtcaaaaccactgccaatccgg

SEQ ID NO: 91213 - DNA, 25 bp, Homo sapien
catgaatgggcacaggagagaactc

SEQ ID NO: 91214 - DNA, 25 bp, Homo sapien
agagaactcggagccggcctaccta

SEQ ID NO: 91215 - DNA, 25 bp, Homo sapien
cccggccgacttgatgtcgatgttg

SEQ ID NO: 91216 - DNA, 25 bp, Homo sapien
tcctcagtgtggcagtgaagcctcc

SEQ ID NO: 91217 - DNA, 25 bp, Homo sapien
gcttctacacagcagccggagatca

SEQ ID NO: 91218 - DNA, 25 bp, Homo sapien
tcagctttgctgcatttggtccagg

SEQ ID NO: 91219 - DNA, 25 bp, Homo sapien
tttggtccaggttggagcatctccg

SEQ ID NO: 91220 - DNA, 25 bp, Homo sapien
ggttggagcatctccgcagcagctg

SEQ ID NO: 91221 - DNA, 25 bp, Homo sapien
tgcaacagccgcacgaaggtagctc

SEQ ID NO: 91222 - DNA, 25 bp, Homo sapien
ttagcaattcggcttctacacagca

SEQ ID NO: 91223 - DNA, 25 bp, Homo sapien
ttcgccgccaacaattagcaattcg

SEQ ID NO: 91224 - DNA, 25 bp, Homo sapien
agccggagatcagctttgctgcatt

SEQ ID NO: 91225 - DNA, 25 bp, Homo sapien
gctgttacataacgcccacccgagg

SEQ ID NO: 91226 - DNA, 25 bp, Homo sapien
tgggatctggccgagtttgaaaatc

SEQ ID NO: 91227 - DNA, 25 bp, Homo sapien
cggcgcgctttgttctcaggtagct

SEQ ID NO: 91228 - DNA, 25 bp, Homo sapien
cgctgatcagccattttagtctttg

SEQ ID NO: 91229 - DNA, 25 bp, Homo sapien
gagctccatgttctcctctttggga

SEQ ID NO: 91230 - DNA, 25 bp, Homo sapien
gcagtcgggctgttggacaaatccc

SEQ ID NO: 91231 - DNA, 25 bp, Homo sapien
cctgcccacagagaacacgttgttc

SEQ ID NO: 91232 - DNA, 25 bp, Homo sapien
tcctgctcagttgcgcttccgctta

SEQ ID NO: 91233 - DNA, 25 bp, Homo sapien
cctaagcccaacttttcaagaatag

SEQ ID NO: 91234 - DNA, 25 bp, Homo sapien
taagcccaacttttcaagaatagtc

SEQ ID NO: 91235 - DNA, 25 bp, Homo sapien
gcttgtttatgcaaatagtgttatt

SEQ ID NO: 91236 - DNA, 25 bp, Homo sapien
ttctttatacttgtttgcttgttta

SEQ ID NO: 91237 - DNA, 25 bp, Homo sapien
caggagaacgaaattaaggtgagtt

SEQ ID NO: 91238 - DNA, 25 bp, Homo sapien
aaagcaggagaacgaaattaaggtg

SEQ ID NO: 91239 - DNA, 25 bp, Homo sapien
gctccctaagcccaacttttcaaga

SEQ ID NO: 91240 - DNA, 25 bp, Homo sapien
caagaatagtcagtacaataagata

SEQ ID NO: 91241 - DNA, 25 bp, Homo sapien
ttgtccccgcagaaagtaaaggctg

SEQ ID NO: 91242 - DNA, 25 bp, Homo sapien
gggtcacgggtgctagagccctccc

SEQ ID NO: 91243 - DNA, 25 bp, Homo sapien
tctgggtcacgggtgctagagccct

SEQ ID NO: 91244 - DNA, 25 bp, Homo sapien
tccggctccacactggcacgtagtg

SEQ ID NO: 91245 - DNA, 25 bp, Homo sapien
acgtagagggaatgagtcaggctcc

SEQ ID NO: 91246 - DNA, 25 bp, Homo sapien
cccagcacgtagagggaatgagtca

SEQ ID NO: 91247 - DNA, 25 bp, Homo sapien
gctcttcgcgagcaccctgggaacg

SEQ ID NO: 91248 - DNA, 25 bp, Homo sapien
ctcccggccggtgtatgggaaattg

SEQ ID NO: 91249 - DNA, 25 bp, Homo sapien
cagagttcttgctttccggcaggtg

SEQ ID NO: 91250 - DNA, 25 bp, Homo sapien
tttggtacatgacccggaagcctcg

SEQ ID NO: 91251 - DNA, 25 bp, Homo sapien
caatcgatctcgaagggcactcgta

SEQ ID NO: 91252 - DNA, 25 bp, Homo sapien
attcaccttaggcaactcacggctc

SEQ ID NO: 91253 - DNA, 25 bp, Homo sapien
ttcgggacagccaatcatatgagtc

SEQ ID NO: 91254 - DNA, 25 bp, Homo sapien
cgagaagccgaaccgacaccaactg

SEQ ID NO: 91255 - DNA, 25 bp, Homo sapien
agcagcggacagtcctcctgttgtg

SEQ ID NO: 91256 - DNA, 25 bp, Homo sapien
tgtcttttaaccactcgcgcccaaa

SEQ ID NO: 91257 - DNA, 25 bp, Homo sapien
tacaagggcgctggatcgatctagc

SEQ ID NO: 91258 - DNA, 25 bp, Homo sapien
caccaccgatggcattgatacaagg

SEQ ID NO: 91259 - DNA, 25 bp, Homo sapien
ggcttttccgcgagcgtcagactcc

SEQ ID NO: 91260 - DNA, 25 bp, Homo sapien
gacgggtgcgacatcttgacttgca

SEQ ID NO: 91261 - DNA, 25 bp, Homo sapien
tgaccggccacttccgacgcaagaa

SEQ ID NO: 91262 - DNA, 25 bp, Homo sapien
cgcaagaaccggaagccatggcctg

SEQ ID NO: 91263 - DNA, 25 bp, Homo sapien
gtgtttcaaagagcctgagcgactc

SEQ ID NO: 91264 - DNA, 25 bp, Homo sapien
cctccgatgtccacgtcaaagaaga

SEQ ID NO: 91265 - DNA, 25 bp, Homo sapien
cctgaacaaagcgaggacccaagtt

SEQ ID NO: 91266 - DNA, 25 bp, Homo sapien
cagagttactcagtcgcagcggccc

SEQ ID NO: 91267 - DNA, 25 bp, Homo sapien
tcagtcatatgaccggcagccggcg

SEQ ID NO: 91268 - DNA, 25 bp, Homo sapien
ctcccgcaggagataactgtcagcg

SEQ ID NO: 91269 - DNA, 25 bp, Homo sapien
tgtgcgaaagaacccaggctccgtg

SEQ ID NO: 91270 - DNA, 25 bp, Homo sapien
cctagctgcatgctcgctgtgcgaa

SEQ ID NO: 91271 - DNA, 25 bp, Homo sapien
gacccaagttcaggggctttgtctc

SEQ ID NO: 91272 - DNA, 25 bp, Homo sapien
tcttcaacaaaaggggcagcagcgg

SEQ ID NO: 91273 - DNA, 25 bp, Homo sapien
tggttgcagcacaaagcaacaagcc

SEQ ID NO: 91274 - DNA, 25 bp, Homo sapien
tgccactcgtacctccctaaaaata

SEQ ID NO: 91275 - DNA, 25 bp, Homo sapien
gacgcggaagatccaagtgattctc

SEQ ID NO: 91276 - DNA, 25 bp, Homo sapien
ggccgagcccagtagacagagacca

SEQ ID NO: 91277 - DNA, 25 bp, Homo sapien
gctgtcactcattcctcaccatggt

SEQ ID NO: 91278 - DNA, 25 bp, Homo sapien
cccgcgcagacgaggaacaaagttg

SEQ ID NO: 91279 - DNA, 25 bp, Homo sapien
tcctcaccatggttgcagcacaaag

SEQ ID NO: 91280 - DNA, 25 bp, Homo sapien
aggaacaaagttgccgagagcgact

SEQ ID NO: 91281 - DNA, 25 bp, Homo sapien
tccaaagtcggtgccattgaatttc

SEQ ID NO: 91282 - DNA, 25 bp, Homo sapien
ctacacgcggaggagccaaaagaca

SEQ ID NO: 91283 - DNA, 25 bp, Homo sapien
tccgagtccgaggtctccaaggagt

SEQ ID NO: 91284 - DNA, 25 bp, Homo sapien
ttcccgcgtttctcaggtaactaca

SEQ ID NO: 91285 - DNA, 25 bp, Homo sapien
tacgcagcaacgctttccgaagagc

SEQ ID NO: 91286 - DNA, 25 bp, Homo sapien
atttcagagtttccagctgagcggc

SEQ ID NO: 91287 - DNA, 25 bp, Homo sapien
cggcaggcttaacctccacggtctg

SEQ ID NO: 91288 - DNA, 25 bp, Homo sapien
gctcacggctctctccagaaataga

SEQ ID NO: 91289 - DNA, 25 bp, Homo sapien
ccgctccctgcttgcaaagtggttg

SEQ ID NO: 91290 - DNA, 25 bp, Homo sapien
aggcgaccgttgttatcgagcattg

SEQ ID NO: 91291 - DNA, 25 bp, Homo sapien
tccctagcactagctgacgcgtcta

SEQ ID NO: 91292 - DNA, 25 bp, Homo sapien
gttccgaagacaggaagcgctattc

SEQ ID NO: 91293 - DNA, 25 bp, Homo sapien
tcttagaaaccacggcagtctcatg

SEQ ID NO: 91294 - DNA, 25 bp, Homo sapien
acgtgctcgtgggttccgaagtatt

SEQ ID NO: 91295 - DNA, 25 bp, Homo sapien
tttccgctgtaggagcagagcttcc

SEQ ID NO: 91296 - DNA, 25 bp, Homo sapien
tcgttgcccagtttccgctcagtgg

SEQ ID NO: 91297 - DNA, 25 bp, Homo sapien
tatcggggcgcagcgccacactcga

SEQ ID NO: 91298 - DNA, 25 bp, Homo sapien
cgcggctcgattgcagccgagaagc

SEQ ID NO: 91299 - DNA, 25 bp, Homo sapien
ccgagaagcgcggaacccgcaagtg

SEQ ID NO: 91300 - DNA, 25 bp, Homo sapien
atcccagccagttactccgcgaaaa

SEQ ID NO: 91301 - DNA, 25 bp, Homo sapien
cgaaaactccggtgcggccagagcc

SEQ ID NO: 91302 - DNA, 25 bp, Homo sapien
agccagctcaagacacgtaaggaaa

SEQ ID NO: 91303 - DNA, 25 bp, Homo sapien
ccttcggcaggagcccgcgaacggt

SEQ ID NO: 91304 - DNA, 25 bp, Homo sapien
gatgattaaaagcttcgggtgtcta

SEQ ID NO: 91305 - DNA, 25 bp, Homo sapien
gctctaaggtttgcgctcctgtttg

SEQ ID NO: 91306 - DNA, 25 bp, Homo sapien
agggctcaaccctagcgggtctctg

SEQ ID NO: 91307 - DNA, 25 bp, Homo sapien
gaattctttcgtgccgagcaggtcc

SEQ ID NO: 91308 - DNA, 25 bp, Homo sapien
gagggtactgggctgaattctttcg

SEQ ID NO: 91309 - DNA, 25 bp, Homo sapien
cacttgtcaggagtgaagagacagc

SEQ ID NO: 91310 - DNA, 25 bp, Homo sapien
gtcacgtgttctcgagacgccgtta

SEQ ID NO: 91311 - DNA, 25 bp, Homo sapien
agcgcccaaacagcggcgtaggtct

SEQ ID NO: 91312 - DNA, 25 bp, Homo sapien
gtggcttctccctagagcgcccaaa

SEQ ID NO: 91313 - DNA, 25 bp, Homo sapien
tctgggtctgtctgtttatacttca

SEQ ID NO: 91314 - DNA, 25 bp, Homo sapien
cctctgcctgaaggcctgagctcag

SEQ ID NO: 91315 - DNA, 25 bp, Homo sapien
tttggcaaagcaaacggcgccgcag

SEQ ID NO: 91316 - DNA, 25 bp, Homo sapien
ctgcactgcagcacgacgtgagctg

SEQ ID NO: 91317 - DNA, 25 bp, Homo sapien
accagaggcacacgtggccctgatg

SEQ ID NO: 91318 - DNA, 25 bp, Homo sapien
agcacctgcacggtcttcacgtcgg

SEQ ID NO: 91319 - DNA, 25 bp, Homo sapien
gcgtcgttggccatcatctctcttt

SEQ ID NO: 91320 - DNA, 25 bp, Homo sapien
catctctcttttgtcggtttggcaa

SEQ ID NO: 91321 - DNA, 25 bp, Homo sapien
cgcctggaccttagagttccgcgtc

SEQ ID NO: 91322 - DNA, 25 bp, Homo sapien
gcgtccgagtgctgaagtgctcaca

SEQ ID NO: 91323 - DNA, 25 bp, Homo sapien
agccaacaccgagcggcccttttga

SEQ ID NO: 91324 - DNA, 25 bp, Homo sapien
cttgtctgaagaggttgctgcgctc

SEQ ID NO: 91325 - DNA, 25 bp, Homo sapien
ctgtccgttgggctagagcttaaaa

SEQ ID NO: 91326 - DNA, 25 bp, Homo sapien
cacgggcgaaaaagacgcggtctca

SEQ ID NO: 91327 - DNA, 25 bp, Homo sapien
cgctttagagaaacgcactcgcctc

SEQ ID NO: 91328 - DNA, 25 bp, Homo sapien
tgctcctgcggttggtgagattacc

SEQ ID NO: 91329 - DNA, 25 bp, Homo sapien
acctactgctgcgtctgtgtgttca

SEQ ID NO: 91330 - DNA, 25 bp, Homo sapien
tctgtgtgttcaagaccggctgcgt

SEQ ID NO: 91331 - DNA, 25 bp, Homo sapien
tgcgtggagatcaccgccaacaatc

SEQ ID NO: 91332 - DNA, 25 bp, Homo sapien
cgccaacaatcagagcaaacgcatc

SEQ ID NO: 91333 - DNA, 25 bp, Homo sapien
atcacgcggtcctatgtgcccttca

SEQ ID NO: 91334 - DNA, 25 bp, Homo sapien
tgcccttcactcttgaaggggaata

SEQ ID NO: 91335 - DNA, 25 bp, Homo sapien
tatctgatcggcgatgccgccacga

SEQ ID NO: 91336 - DNA, 25 bp, Homo sapien
actggggtgtttcgcaattgtgaga

SEQ ID NO: 91337 - DNA, 25 bp, Homo sapien
cagcgctctcctttggtaatcggtc

SEQ ID NO: 91338 - DNA, 25 bp, Homo sapien
gcgcgggcattctcccatcctttgt

SEQ ID NO: 91339 - DNA, 25 bp, Homo sapien
ctggccgcaggaacacaatgacatc

SEQ ID NO: 91340 - DNA, 25 bp, Homo sapien
ccgtgactagtaccacgccggtgta

SEQ ID NO: 91341 - DNA, 25 bp, Homo sapien
cctgtgaagtggctgtcatcgactc

SEQ ID NO: 91342 - DNA, 25 bp, Homo sapien
tgtgtcttccgtactcagcgctctc

SEQ ID NO: 91343 - DNA, 25 bp, Homo sapien
gcgcatcagcgctaaacccaagaca

SEQ ID NO: 91344 - DNA, 25 bp, Homo sapien
acagttgcagtgaacccgactcagg

SEQ ID NO: 91345 - DNA, 25 bp, Homo sapien
agaccttatacgctgaccggcggcc

SEQ ID NO: 91346 - DNA, 25 bp, Homo sapien
gggcgagccaaactgcgttcctggt

SEQ ID NO: 91347 - DNA, 25 bp, Homo sapien
cgccatggcagtgtctctttgctca

SEQ ID NO: 91348 - DNA, 25 bp, Homo sapien
ctttgctcagacatccagggacgac

SEQ ID NO: 91349 - DNA, 25 bp, Homo sapien
gcagcgccatgtaccacagtggatg

SEQ ID NO: 91350 - DNA, 25 bp, Homo sapien
ccaatcctgggagaagcgaatcgtt

SEQ ID NO: 91351 - DNA, 25 bp, Homo sapien
gaatcgttttctccgcgtgccctgt

SEQ ID NO: 91352 - DNA, 25 bp, Homo sapien
tcgggtctccctaacagaccttata

SEQ ID NO: 91353 - DNA, 25 bp, Homo sapien
cccgagcgtcgttgtcactccaagt

SEQ ID NO: 91354 - DNA, 25 bp, Homo sapien
tgccggcccagaagacctggactgt

SEQ ID NO: 91355 - DNA, 25 bp, Homo sapien
gaaactcgccaccttctgggacctg

SEQ ID NO: 91356 - DNA, 25 bp, Homo sapien
gacctgtaagcctctggccgcgaaa

SEQ ID NO: 91357 - DNA, 25 bp, Homo sapien
tgccagttccgggatcaaagacgta

SEQ ID NO: 91358 - DNA, 25 bp, Homo sapien
gcgcatcacgtgaagctgccagttc

SEQ ID NO: 91359 - DNA, 25 bp, Homo sapien
ctctagagccaaggcaagggacctc

SEQ ID NO: 91360 - DNA, 25 bp, Homo sapien
acctcaccaggaagggagattcgcc

SEQ ID NO: 91361 - DNA, 25 bp, Homo sapien
gtacacgcccgcgaagcagagcagc

SEQ ID NO: 91362 - DNA, 25 bp, Homo sapien
cctggccaggcggtgacttaaaacg

SEQ ID NO: 91363 - DNA, 25 bp, Homo sapien
agcccgagaggagccacaatggaga

SEQ ID NO: 91364 - DNA, 25 bp, Homo sapien
ttggtcggtgcctgcgttctgaagc

SEQ ID NO: 91365 - DNA, 25 bp, Homo sapien
gccgccctttttctgcacggagaac

SEQ ID NO: 91366 - DNA, 25 bp, Homo sapien
ccgagcattattacgccgtgcgttc

SEQ ID NO: 91367 - DNA, 25 bp, Homo sapien
agcagcaagtggataccgagcatta

SEQ ID NO: 91368 - DNA, 25 bp, Homo sapien
cgcggacggaaactcagcctggcca

SEQ ID NO: 91369 - DNA, 25 bp, Homo sapien
tgcctcccgccgtactgcttggagt

SEQ ID NO: 91370 - DNA, 25 bp, Homo sapien
cctgctctgaagagctctagggaca

SEQ ID NO: 91371 - DNA, 25 bp, Homo sapien
gaggcggtgcaaagcccagtatccc

SEQ ID NO: 91372 - DNA, 25 bp, Homo sapien
aactttgcgcagttcgccgcctgcg

SEQ ID NO: 91373 - DNA, 25 bp, Homo sapien
cacgtctttgcccattcttttcggg

SEQ ID NO: 91374 - DNA, 25 bp, Homo sapien
ctgaagggacttaacaaggatggca

SEQ ID NO: 91375 - DNA, 25 bp, Homo sapien
cacgtgtcctggtcgtccagttcca

SEQ ID NO: 91376 - DNA, 25 bp, Homo sapien
gcgcggcaagtgacagtagcgtctc

SEQ ID NO: 91377 - DNA, 25 bp, Homo sapien
ggccggcgcaattctgcctctcaga

SEQ ID NO: 91378 - DNA, 25 bp, Homo sapien
ttccctgtggtgacaatccggtttc

SEQ ID NO: 91379 - DNA, 25 bp, Homo sapien
ccgaagtgggaagccgaatcagtcc

SEQ ID NO: 91380 - DNA, 25 bp, Homo sapien
tcagtccgaataggtccgagtcctc

SEQ ID NO: 91381 - DNA, 25 bp, Homo sapien
tcctcacgagggcttccgagagact

SEQ ID NO: 91382 - DNA, 25 bp, Homo sapien
ctggacggctctaggcagattctcg

SEQ ID NO: 91383 - DNA, 25 bp, Homo sapien
tgccaccgtctctacgtgagcgaga

SEQ ID NO: 91384 - DNA, 25 bp, Homo sapien
cccttcgtcaggagacgcgaaaatg

SEQ ID NO: 91385 - DNA, 25 bp, Homo sapien
ccaataacgacaggacgggccgcct

SEQ ID NO: 91386 - DNA, 25 bp, Homo sapien
aggttggaacacctggcgagtcctc

SEQ ID NO: 91387 - DNA, 25 bp, Homo sapien
acagcgcaggctctcactgggaatc

SEQ ID NO: 91388 - DNA, 25 bp, Homo sapien
tcgttcgcgcgagtcacacgatgtc

SEQ ID NO: 91389 - DNA, 25 bp, Homo sapien
acgatgtcggcaactgcacagacca

SEQ ID NO: 91390 - DNA, 25 bp, Homo sapien
acagaccaatcaccgcgccgagaag

SEQ ID NO: 91391 - DNA, 25 bp, Homo sapien
ggctctgcaggtctcactatcctca

SEQ ID NO: 91392 - DNA, 25 bp, Homo sapien
gggagctctcgcaggccaataacga

SEQ ID NO: 91393 - DNA, 25 bp, Homo sapien
ctcctggtcatcgagctgtccgaca

SEQ ID NO: 91394 - DNA, 25 bp, Homo sapien
tgacactcattcagccggggaaggt

SEQ ID NO: 91395 - DNA, 25 bp, Homo sapien
ggacggcatctccttcgagtaccac

SEQ ID NO: 91396 - DNA, 25 bp, Homo sapien
cgccatcagcaggatttacacggtg

SEQ ID NO: 91397 - DNA, 25 bp, Homo sapien
gcagacaaaagaggccgcccgcgta

SEQ ID NO: 91398 - DNA, 25 bp, Homo sapien
cgccatttggctgttgacgtggttc

SEQ ID NO: 91399 - DNA, 25 bp, Homo sapien
tgacgtggttccgagccagcaaata

SEQ ID NO: 91400 - DNA, 25 bp, Homo sapien
gctgcagcaagaggacggcatctcc

SEQ ID NO: 91401 - DNA, 25 bp, Homo sapien
gccacgggcctcgaaaagtcgattc

SEQ ID NO: 91402 - DNA, 25 bp, Homo sapien
ctcatctaggtaagctcggagaagc

SEQ ID NO: 91403 - DNA, 25 bp, Homo sapien
gtcgattctgaaccgcggcacgtca

SEQ ID NO: 91404 - DNA, 25 bp, Homo sapien
gacgaatattcatccgcgcagcctt

SEQ ID NO: 91405 - DNA, 25 bp, Homo sapien
atccgcgcagccttaaggttgcttc

SEQ ID NO: 91406 - DNA, 25 bp, Homo sapien
aggttgcttcctgcatcggctcttc

SEQ ID NO: 91407 - DNA, 25 bp, Homo sapien
ttcggaggagacagcgatcagattc

SEQ ID NO: 91408 - DNA, 25 bp, Homo sapien
tcggctcttccgtgatgaaaatcta

SEQ ID NO: 91409 - DNA, 25 bp, Homo sapien
cgcctccgagtgcagagttccttac

SEQ ID NO: 91410 - DNA, 25 bp, Homo sapien
cgtgtaaagccggtaagtggctctc

SEQ ID NO: 91411 - DNA, 25 bp, Homo sapien
caggcagtgcttgccctctctactg

SEQ ID NO: 91412 - DNA, 25 bp, Homo sapien
tgtcccggcggcatccacatgtttc

SEQ ID NO: 91413 - DNA, 25 bp, Homo sapien
acatgtttccggacacctgagcacc

SEQ ID NO: 91414 - DNA, 25 bp, Homo sapien
ggattgttttctacggggagctatg

SEQ ID NO: 91415 - DNA, 25 bp, Homo sapien
tctgcgctggcctcgattatgatta

SEQ ID NO: 91416 - DNA, 25 bp, Homo sapien
agactatagattacaaggacccgtg

SEQ ID NO: 91417 - DNA, 25 bp, Homo sapien
gtccgacttccttgtcatactgaga

SEQ ID NO: 91418 - DNA, 25 bp, Homo sapien
ggaatttgttccactgtccgacttc

SEQ ID NO: 91419 - DNA, 25 bp, Homo sapien
ggtgagccattgtttatcatccaga

SEQ ID NO: 91420 - DNA, 25 bp, Homo sapien
accttgttgtgagccagcactgtgc

SEQ ID NO: 91421 - DNA, 25 bp, Homo sapien
tcgctgctttctggagctgctgcac

SEQ ID NO: 91422 - DNA, 25 bp, Homo sapien
cgcggaacttacgtctcggaatttg

SEQ ID NO: 91423 - DNA, 25 bp, Homo sapien
agagactgactgcaccaagcggctg

SEQ ID NO: 91424 - DNA, 25 bp, Homo sapien
gtacggctgacaccttgagcatctg

SEQ ID NO: 91425 - DNA, 25 bp, Homo sapien
tccctgtccggtccgttgaagaaga

SEQ ID NO: 91426 - DNA, 25 bp, Homo sapien
tccgttgaagaagacctagaactcc

SEQ ID NO: 91427 - DNA, 25 bp, Homo sapien
agacctagaactcccgctagacagc

SEQ ID NO: 91428 - DNA, 25 bp, Homo sapien
ccaggctcttcccaagggacatccc

SEQ ID NO: 91429 - DNA, 25 bp, Homo sapien
tcaccgcggactcaggaccggtggt

SEQ ID NO: 91430 - DNA, 25 bp, Homo sapien
tcaggaccggtggtgtccaaagacc

SEQ ID NO: 91431 - DNA, 25 bp, Homo sapien
tggtgtccaaagacccgcgagctgc

SEQ ID NO: 91432 - DNA, 25 bp, Homo sapien
cacggccttgcgatcccaggaggtt

SEQ ID NO: 91433 - DNA, 25 bp, Homo sapien
gcctgagtttttatctagggagtta

SEQ ID NO: 91434 - DNA, 25 bp, Homo sapien
ccgcccggtccatctggatgttgaa

SEQ ID NO: 91435 - DNA, 25 bp, Homo sapien
tctccaccgcgaggccttttcgatt

SEQ ID NO: 91436 - DNA, 25 bp, Homo sapien
agcagccagcgcctgagtttttatc

SEQ ID NO: 91437 - DNA, 25 bp, Homo sapien
cctgctaggtccaaagagcttcgga

SEQ ID NO: 91438 - DNA, 25 bp, Homo sapien
ggccgccgaacctgctaggtccaaa

SEQ ID NO: 91439 - DNA, 25 bp, Homo sapien
caccgcgaggccttttcgatttccg

SEQ ID NO: 91440 - DNA, 25 bp, Homo sapien
ggatgttgaaggaatcctagaaccc

SEQ ID NO: 91441 - DNA, 25 bp, Homo sapien
ccctcggcgagacgcggcgcattcg

SEQ ID NO: 91442 - DNA, 25 bp, Homo sapien
ggcactccgacacactccgcgcaca

SEQ ID NO: 91443 - DNA, 25 bp, Homo sapien
ggcctctcaccgagcctgagtcgtg

SEQ ID NO: 91444 - DNA, 25 bp, Homo sapien
tcaccgagcctgagtcgtggccgct

SEQ ID NO: 91445 - DNA, 25 bp, Homo sapien
agcgcggctgccagttaattttctc

SEQ ID NO: 91446 - DNA, 25 bp, Homo sapien
ggctgccagttaattttctccgttg

SEQ ID NO: 91447 - DNA, 25 bp, Homo sapien
ccagttaattttctccgttgcattc

SEQ ID NO: 91448 - DNA, 25 bp, Homo sapien
ccgttgcattctgcaaacgagatcg

SEQ ID NO: 91449 - DNA, 25 bp, Homo sapien
ccacctgggcgccattcaaaggaag

SEQ ID NO: 91450 - DNA, 25 bp, Homo sapien
acaagagactcgtcagcgcactttc

SEQ ID NO: 91451 - DNA, 25 bp, Homo sapien
ttaatcttggccacgctccctgagg

SEQ ID NO: 91452 - DNA, 25 bp, Homo sapien
acgggagaagatgctctgctgccac

SEQ ID NO: 91453 - DNA, 25 bp, Homo sapien
tcaaaggaagtttgcgcgtaactcg

SEQ ID NO: 91454 - DNA, 25 bp, Homo sapien
gtctgcatcatcttggcagggccca

SEQ ID NO: 91455 - DNA, 25 bp, Homo sapien
gatgacatcattccctggcagctgg

SEQ ID NO: 91456 - DNA, 25 bp, Homo sapien
agctccagataggaatgtctgcatc

SEQ ID NO: 91457 - DNA, 25 bp, Homo sapien
cgtcgcctgccacccgcttcggcca

SEQ ID NO: 91458 - DNA, 25 bp, Homo sapien
gtccagcctcccgtcgcccatgtcc

SEQ ID NO: 91459 - DNA, 25 bp, Homo sapien
ggacaggcgtcccactgctcgtcgc

SEQ ID NO: 91460 - DNA, 25 bp, Homo sapien
ggtgcccgacgtgttcccactgccg

SEQ ID NO: 91461 - DNA, 25 bp, Homo sapien
cttcgcgcagcccttcggcgctgag

SEQ ID NO: 91462 - DNA, 25 bp, Homo sapien
ccaagcagttcatcgccgcgcagaa

SEQ ID NO: 91463 - DNA, 25 bp, Homo sapien
ccgcgcagaacctcgggcccgcgtc

SEQ ID NO: 91464 - DNA, 25 bp, Homo sapien
gcggccttcctcagcgctctgctgc

SEQ ID NO: 91465 - DNA, 25 bp, Homo sapien
agaaagactcctaggcgcgagggtt

SEQ ID NO: 91466 - DNA, 25 bp, Homo sapien
ctcccgggagaaccaatcagaacag

SEQ ID NO: 91467 - DNA, 25 bp, Homo sapien
ggcctacgtcgtccggcatacgtca

SEQ ID NO: 91468 - DNA, 25 bp, Homo sapien
ggcttcagcacccacatgcactggg

SEQ ID NO: 91469 - DNA, 25 bp, Homo sapien
ccttgtatccctgcgggcttcagca

SEQ ID NO: 91470 - DNA, 25 bp, Homo sapien
ggcccaaagtcaggacttcccgtca

SEQ ID NO: 91471 - DNA, 25 bp, Homo sapien
gccctggcccaactcctttgaagaa

SEQ ID NO: 91472 - DNA, 25 bp, Homo sapien
ctccgccagcatagactttgcaggc

SEQ ID NO: 91473 - DNA, 25 bp, Homo sapien
ctgcacgcggctacatcgagtaacc

SEQ ID NO: 91474 - DNA, 25 bp, Homo sapien
gagacgcattctacccttggaacgg

SEQ ID NO: 91475 - DNA, 25 bp, Homo sapien
ggagattttctttaggcgcctggac

SEQ ID NO: 91476 - DNA, 25 bp, Homo sapien
tggaccgcggccatacaactggaca

SEQ ID NO: 91477 - DNA, 25 bp, Homo sapien
taactgggccacagctctgccaatg

SEQ ID NO: 91478 - DNA, 25 bp, Homo sapien
tcctgcagccgcacaatagtaatgc

SEQ ID NO: 91479 - DNA, 25 bp, Homo sapien
cctgtagtcttgacgcatgagagca

SEQ ID NO: 91480 - DNA, 25 bp, Homo sapien
gcgggtttctgcacgagacgcattc

SEQ ID NO: 91481 - DNA, 25 bp, Homo sapien
ggaagcagctttctagcccagccaa

SEQ ID NO: 91482 - DNA, 25 bp, Homo sapien
aacgcgcctgaaaaatggagccacc

SEQ ID NO: 91483 - DNA, 25 bp, Homo sapien
gacggacgccttctccctgaggaga

SEQ ID NO: 91484 - DNA, 25 bp, Homo sapien
gggaatgtcgagaccaccgccttct

SEQ ID NO: 91485 - DNA, 25 bp, Homo sapien
ctctacacgactgcgggaagttttc

SEQ ID NO: 91486 - DNA, 25 bp, Homo sapien
gcccagccaagataaggcgacagtc

SEQ ID NO: 91487 - DNA, 25 bp, Homo sapien
tgcgcaggcttaagttgcgaaactc

SEQ ID NO: 91488 - DNA, 25 bp, Homo sapien
agagaccgcgccatccgggaagcag

SEQ ID NO: 91489 - DNA, 25 bp, Homo sapien
tgcctcgcaacagcggctctagatt

SEQ ID NO: 91490 - DNA, 25 bp, Homo sapien
gggaagctacttgactgccacgtgc

SEQ ID NO: 91491 - DNA, 25 bp, Homo sapien
ggtcccaaaaccctggagcgaatgc

SEQ ID NO: 91492 - DNA, 25 bp, Homo sapien
gacaactgctcgagaggccagggta

SEQ ID NO: 91493 - DNA, 25 bp, Homo sapien
acgcccgtaagacaggtcgacacta

SEQ ID NO: 91494 - DNA, 25 bp, Homo sapien
cacagaggtcgttgctagtggccac

SEQ ID NO: 91495 - DNA, 25 bp, Homo sapien
ctctccaacttcacagaggtcgttg

SEQ ID NO: 91496 - DNA, 25 bp, Homo sapien
cagcggctctagattccgagttatg

SEQ ID NO: 91497 - DNA, 25 bp, Homo sapien
gactccgagatcgtcttcccactgg

SEQ ID NO: 91498 - DNA, 25 bp, Homo sapien
catcaacatggagcgcgtggtcttc

SEQ ID NO: 91499 - DNA, 25 bp, Homo sapien
gtcttcaaggtcctgcggcgcctct

SEQ ID NO: 91500 - DNA, 25 bp, Homo sapien
ttcatgtaccgccagcgcaacggcg

SEQ ID NO: 91501 - DNA, 25 bp, Homo sapien
gccgagctggccaccaggcttttca

SEQ ID NO: 91502 - DNA, 25 bp, Homo sapien
tcttcccactggacatcggggtcgt

SEQ ID NO: 91503 - DNA, 25 bp, Homo sapien
tgggccacgtggctcagaccaaaaa

SEQ ID NO: 91504 - DNA, 25 bp, Homo sapien
aggcttttcagcgtgcagccggaca

SEQ ID NO: 91505 - DNA, 25 bp, Homo sapien
gctgccgcctggtcagctggtaaac

SEQ ID NO: 91506 - DNA, 25 bp, Homo sapien
gcttccctggcttctgcgttttgcg

SEQ ID NO: 91507 - DNA, 25 bp, Homo sapien
gttccaccgatcagcttcgccgttt

SEQ ID NO: 91508 - DNA, 25 bp, Homo sapien
ccgttccagagtcatcagctcttcg

SEQ ID NO: 91509 - DNA, 25 bp, Homo sapien
agcttcgccgttttctcagatccgc

SEQ ID NO: 91510 - DNA, 25 bp, Homo sapien
tctcagatccgcatctcattttctc

SEQ ID NO: 91511 - DNA, 25 bp, Homo sapien
atcagctcttcgtcggtgtctggcc

SEQ ID NO: 91512 - DNA, 25 bp, Homo sapien
gggtggcactgcttccctggcttct

SEQ ID NO: 91513 - DNA, 25 bp, Homo sapien
tgagtgactgacgtgagctaatcgc

SEQ ID NO: 91514 - DNA, 25 bp, Homo sapien
aaggctgacgctcgccagagtttca

SEQ ID NO: 91515 - DNA, 25 bp, Homo sapien
tcgacggctgccaatactttttatt

SEQ ID NO: 91516 - DNA, 25 bp, Homo sapien
cagagtttcacaagctgctcccgga

SEQ ID NO: 91517 - DNA, 25 bp, Homo sapien
gccagcgtctgttgcctcacgaaaa

SEQ ID NO: 91518 - DNA, 25 bp, Homo sapien
tcccagtgttctagttcgcccgtga

SEQ ID NO: 91519 - DNA, 25 bp, Homo sapien
acggccgttcacgtcaacgtagtga

SEQ ID NO: 91520 - DNA, 25 bp, Homo sapien
ctctcgctagagtggatccgaactc

SEQ ID NO: 91521 - DNA, 25 bp, Homo sapien
cgccaccgccgaccattctgcagct

SEQ ID NO: 91522 - DNA, 25 bp, Homo sapien
cctgagacctggcaccggacgcgtt

SEQ ID NO: 91523 - DNA, 25 bp, Homo sapien
tgcagcgccagcagaattccccgat

SEQ ID NO: 91524 - DNA, 25 bp, Homo sapien
ttcaaaagcctccaagccgaatttc

SEQ ID NO: 91525 - DNA, 25 bp, Homo sapien
aaaagcctccaagccgaatttcagc

SEQ ID NO: 91526 - DNA, 25 bp, Homo sapien
gctcgccaatttaggggaaaggctc

SEQ ID NO: 91527 - DNA, 25 bp, Homo sapien
acctggcaccggacgcgttgaggcc

SEQ ID NO: 91528 - DNA, 25 bp, Homo sapien
acagcctttccggcagtacctgcgg

SEQ ID NO: 91529 - DNA, 25 bp, Homo sapien
agcttgccgggctcctggatccacg

SEQ ID NO: 91530 - DNA, 25 bp, Homo sapien
cagaagggacttcgaagtgtgcgca

SEQ ID NO: 91531 - DNA, 25 bp, Homo sapien
tgtgcgcagcggactccgcggttcc

SEQ ID NO: 91532 - DNA, 25 bp, Homo sapien
gggtccgccatgtagctgttggaaa

SEQ ID NO: 91533 - DNA, 25 bp, Homo sapien
gtccgccatgtagctgttggaaatg

SEQ ID NO: 91534 - DNA, 25 bp, Homo sapien
ccgccatgtagctgttggaaatgcg

SEQ ID NO: 91535 - DNA, 25 bp, Homo sapien
ccgggctcctggatccacgtccagg

SEQ ID NO: 91536 - DNA, 25 bp, Homo sapien
ccatgtagctgttggaaatgcgggt

SEQ ID NO: 91537 - DNA, 25 bp, Homo sapien
ggagtcccgcattcagtccgctcag

SEQ ID NO: 91538 - DNA, 25 bp, Homo sapien
ggagcttcccacctacaggagcctg

SEQ ID NO: 91539 - DNA, 25 bp, Homo sapien
acggatctcgaagcatcctgcgacc

SEQ ID NO: 91540 - DNA, 25 bp, Homo sapien
aaggttacggttcgagcccaggatg

SEQ ID NO: 91541 - DNA, 25 bp, Homo sapien
ctgaggcacagcgatgagagagatc

SEQ ID NO: 91542 - DNA, 25 bp, Homo sapien
gcattcacgttctccggagccctgg

SEQ ID NO: 91543 - DNA, 25 bp, Homo sapien
gcactcctgcggcatcaggacacgg

SEQ ID NO: 91544 - DNA, 25 bp, Homo sapien
gcgcctcacagcgttgcgagctgcg

SEQ ID NO: 91545 - DNA, 25 bp, Homo sapien
tctggttgcccaaggttgatgtagc

SEQ ID NO: 91546 - DNA, 25 bp, Homo sapien
ggtggactttccacattgacgctcc

SEQ ID NO: 91547 - DNA, 25 bp, Homo sapien
gccgggtcaggcattgctgtgccaa

SEQ ID NO: 91548 - DNA, 25 bp, Homo sapien
aggagctttagcaactctcagtctc

SEQ ID NO: 91549 - DNA, 25 bp, Homo sapien
cctctctgttcctggcaaactggca

SEQ ID NO: 91550 - DNA, 25 bp, Homo sapien
ctctagagaggcacgattgcatcga

SEQ ID NO: 91551 - DNA, 25 bp, Homo sapien
actggcaaagtagtgcctctgaccc

SEQ ID NO: 91552 - DNA, 25 bp, Homo sapien
cgcggtctctcgtcacgacatcgaa

SEQ ID NO: 91553 - DNA, 25 bp, Homo sapien
aggcttgtcctcttttccgattggc

SEQ ID NO: 91554 - DNA, 25 bp, Homo sapien
tgtcgcgagacacagccgtttaacg

SEQ ID NO: 91555 - DNA, 25 bp, Homo sapien
aggtcactttgggattgtcgcgaga

SEQ ID NO: 91556 - DNA, 25 bp, Homo sapien
ccaggctacttctgcggcctaaaga

SEQ ID NO: 91557 - DNA, 25 bp, Homo sapien
agaggtgcgatttcttctcacccgc

SEQ ID NO: 91558 - DNA, 25 bp, Homo sapien
cgcagccagtctagggtttgcgtga

SEQ ID NO: 91559 - DNA, 25 bp, Homo sapien
cccttgtggtatcagtggctcctca

SEQ ID NO: 91560 - DNA, 25 bp, Homo sapien
gggaccactagcagccgcgtgctga

SEQ ID NO: 91561 - DNA, 25 bp, Homo sapien
gtgatcctaatcctcgggaaccatc

SEQ ID NO: 91562 - DNA, 25 bp, Homo sapien
cggatcatcgccctcagagcgcagg

SEQ ID NO: 91563 - DNA, 25 bp, Homo sapien
aatgactcttgacctcgccgctggg

SEQ ID NO: 91564 - DNA, 25 bp, Homo sapien
ttgacctcgccgctgggaatcaccg

SEQ ID NO: 91565 - DNA, 25 bp, Homo sapien
ccggaagtgcccgtgatcctaatcc

SEQ ID NO: 91566 - DNA, 25 bp, Homo sapien
cccggctggacgctgcgttcggtct

SEQ ID NO: 91567 - DNA, 25 bp, Homo sapien
ctcgggaaccatctggcggcgactt

SEQ ID NO: 91568 - DNA, 25 bp, Homo sapien
gctgcgttcggtctcccggtcctaa

SEQ ID NO: 91569 - DNA, 25 bp, Homo sapien
agctctgtcttgcttcgggatcctc

SEQ ID NO: 91570 - DNA, 25 bp, Homo sapien
ctgctgcctgagaactctgagcctc

SEQ ID NO: 91571 - DNA, 25 bp, Homo sapien
ttgcagacccaaataaagccgcctt

SEQ ID NO: 91572 - DNA, 25 bp, Homo sapien
ggaattcctgggacaaccgcctgca

SEQ ID NO: 91573 - DNA, 25 bp, Homo sapien
tcgcgtccgggtctgtttatatagc

SEQ ID NO: 91574 - DNA, 25 bp, Homo sapien
ctgtgggttcgttcagttgccagaa

SEQ ID NO: 91575 - DNA, 25 bp, Homo sapien
ggcagagcgctcacttctcagagga

SEQ ID NO: 91576 - DNA, 25 bp, Homo sapien
tggcatccctgtcggtcccagatta

SEQ ID NO: 91577 - DNA, 25 bp, Homo sapien
agtcaggcgcctcggaacattagtt

SEQ ID NO: 91578 - DNA, 25 bp, Homo sapien
ttagcgctgacattccttggatttg

SEQ ID NO: 91579 - DNA, 25 bp, Homo sapien
ctgggacgcatttgtctgccgccca

SEQ ID NO: 91580 - DNA, 25 bp, Homo sapien
gaacattagttacccggagccgcgc

SEQ ID NO: 91581 - DNA, 25 bp, Homo sapien
aggcgagatgccgatgccgccaccg

SEQ ID NO: 91582 - DNA, 25 bp, Homo sapien
gcctccggctcttacggagagcgcg

SEQ ID NO: 91583 - DNA, 25 bp, Homo sapien
tccttggatttggagggtttagtca

SEQ ID NO: 91584 - DNA, 25 bp, Homo sapien
ggcgcgagtgttagcgctgacattc

SEQ ID NO: 91585 - DNA, 25 bp, Homo sapien
cggaggctaacgattggtcagtgtc

SEQ ID NO: 91586 - DNA, 25 bp, Homo sapien
caacttgacgagctaggccacgggc

SEQ ID NO: 91587 - DNA, 25 bp, Homo sapien
ccggcgtgaactggtttatctctaa

SEQ ID NO: 91588 - DNA, 25 bp, Homo sapien
gagcttttcctcagagtcccgcaga

SEQ ID NO: 91589 - DNA, 25 bp, Homo sapien
gtgaccgacattgaaaactcccaga

SEQ ID NO: 91590 - DNA, 25 bp, Homo sapien
ggaatgtactgctcgatcctgattg

SEQ ID NO: 91591 - DNA, 25 bp, Homo sapien
attcttgcctggtgcgagcttttcc

SEQ ID NO: 91592 - DNA, 25 bp, Homo sapien
gtcgcccaggtcgttaactcccaga

SEQ ID NO: 91593 - DNA, 25 bp, Homo sapien
agagtagttttcttgcagcccggca

SEQ ID NO: 91594 - DNA, 25 bp, Homo sapien
cactgtttcggtgccagcagagacc

SEQ ID NO: 91595 - DNA, 25 bp, Homo sapien
gtgccgctgtctaacttggtgtgca

SEQ ID NO: 91596 - DNA, 25 bp, Homo sapien
cggcttcacgcctgacgagatgagc

SEQ ID NO: 91597 - DNA, 25 bp, Homo sapien
ctctgcgaccgggacacgaaacaaa

SEQ ID NO: 91598 - DNA, 25 bp, Homo sapien
agcccggcagctcttctggaatgga

SEQ ID NO: 91599 - DNA, 25 bp, Homo sapien
ggcgcctttgttttgctgcccaagc

SEQ ID NO: 91600 - DNA, 25 bp, Homo sapien
agcatctcccagaagaaggtgaaga

SEQ ID NO: 91601 - DNA, 25 bp, Homo sapien
cccgttcatgatcggaggtcggacg

SEQ ID NO: 91602 - DNA, 25 bp, Homo sapien
cagtggcacccagacctgctgtggc

SEQ ID NO: 91603 - DNA, 25 bp, Homo sapien
caggcgaccacgtggtggtaccttc

SEQ ID NO: 91604 - DNA, 25 bp, Homo sapien
ggtaccttctcatggatctcctgcg

SEQ ID NO: 91605 - DNA, 25 bp, Homo sapien
tcggaggtcggacgcctgcaagaca

SEQ ID NO: 91606 - DNA, 25 bp, Homo sapien
ctgcaagacagaggcaagtgctcag

SEQ ID NO: 91607 - DNA, 25 bp, Homo sapien
ggcaagtgctcagccttgcaccact

SEQ ID NO: 91608 - DNA, 25 bp, Homo sapien
acccactgtgcacgggccaacgagg

SEQ ID NO: 91609 - DNA, 25 bp, Homo sapien
agcccaggttggatctgaagcattc

SEQ ID NO: 91610 - DNA, 25 bp, Homo sapien
acaagcccaggttggatctgaagca

SEQ ID NO: 91611 - DNA, 25 bp, Homo sapien
agcattcttacgacggtgggtcaca

SEQ ID NO: 91612 - DNA, 25 bp, Homo sapien
tcctgcgtcacggaaacaagcccag

SEQ ID NO: 91613 - DNA, 25 bp, Homo sapien
ccaggttggatctgaagcattctta

SEQ ID NO: 91614 - DNA, 25 bp, Homo sapien
ttggatctgaagcattcttacgacg

SEQ ID NO: 91615 - DNA, 25 bp, Homo sapien
cccagatgtttcctgcgtcacggaa

SEQ ID NO: 91616 - DNA, 25 bp, Homo sapien
tgaagcattcttacgacggtgggtc

SEQ ID NO: 91617 - DNA, 25 bp, Homo sapien
cggcgatcttaaaagcaaggatcta

SEQ ID NO: 91618 - DNA, 25 bp, Homo sapien
gaaacctgctctcggacgccgtgac

SEQ ID NO: 91619 - DNA, 25 bp, Homo sapien
tgcttccgggtctcggcaagcactt

SEQ ID NO: 91620 - DNA, 25 bp, Homo sapien
cgagctccgcgcttaccgattatca

SEQ ID NO: 91621 - DNA, 25 bp, Homo sapien
acaaatggtgaaggagattggcgcc

SEQ ID NO: 91622 - DNA, 25 bp, Homo sapien
ggaacagtaacaaccgtggccgata

SEQ ID NO: 91623 - DNA, 25 bp, Homo sapien
taaatccactcgaggtctctccagg

SEQ ID NO: 91624 - DNA, 25 bp, Homo sapien
cggggtgcaaatgcgaaacctgctc

SEQ ID NO: 91625 - DNA, 25 bp, Homo sapien
cggtgtctagtccagtccagggtaa

SEQ ID NO: 91626 - DNA, 25 bp, Homo sapien
agggtaactgggctctctgagagtc

SEQ ID NO: 91627 - DNA, 25 bp, Homo sapien
tcgagttcagatgctgggaaccgtc

SEQ ID NO: 91628 - DNA, 25 bp, Homo sapien
tcgccgtcatcaagcccggctatga

SEQ ID NO: 91629 - DNA, 25 bp, Homo sapien
ccggctatgagcagggctttaaatc

SEQ ID NO: 91630 - DNA, 25 bp, Homo sapien
cgcgaggttttccagcagctcattc

SEQ ID NO: 91631 - DNA, 25 bp, Homo sapien
agctctcagacatgctgcgctgcgg

SEQ ID NO: 91632 - DNA, 25 bp, Homo sapien
gcctcagtcctgttacggtggcgga

SEQ ID NO: 91633 - DNA, 25 bp, Homo sapien
atttccttccttcccgagtgagctc

SEQ ID NO: 91634 - DNA, 25 bp, Homo sapien
ggctgccgggcaaaaacctcattta

SEQ ID NO: 91635 - DNA, 25 bp, Homo sapien
agcgctttgcaaagccggcctctgc

SEQ ID NO: 91636 - DNA, 25 bp, Homo sapien
cccgggagcacgacggatagaatgc

SEQ ID NO: 91637 - DNA, 25 bp, Homo sapien
ctgaacctcgcgagtagagcctggc

SEQ ID NO: 91638 - DNA, 25 bp, Homo sapien
actgaaggcggcatctgcctgaata

SEQ ID NO: 91639 - DNA, 25 bp, Homo sapien
agctaaatctcactcgcggggagga

SEQ ID NO: 91640 - DNA, 25 bp, Homo sapien
gcgggagcttcggaagctaaatctc

SEQ ID NO: 91641 - DNA, 25 bp, Homo sapien
ccatcagcggcagaagggcagcaat

SEQ ID NO: 91642 - DNA, 25 bp, Homo sapien
ttatcctggtacgcgggaactggct

SEQ ID NO: 91643 - DNA, 25 bp, Homo sapien
ggcatctcccatacccacccggctg

SEQ ID NO: 91644 - DNA, 25 bp, Homo sapien
aaaaagcgcgaaaccgccaggcatc

SEQ ID NO: 91645 - DNA, 25 bp, Homo sapien
tcgcaatcaaaaggcggaaaaagcg

SEQ ID NO: 91646 - DNA, 25 bp, Homo sapien
gctgctcccactcgcaatcaaaagg

SEQ ID NO: 91647 - DNA, 25 bp, Homo sapien
aatggccacacaccgaagcaccttg

SEQ ID NO: 91648 - DNA, 25 bp, Homo sapien
cggcagaagggcagcaatggccaca

SEQ ID NO: 91649 - DNA, 25 bp, Homo sapien
acgaggagaaaacgagcaaagtcta

SEQ ID NO: 91650 - DNA, 25 bp, Homo sapien
gctgacgttacgcagaggcgcaccg

SEQ ID NO: 91651 - DNA, 25 bp, Homo sapien
cgcatagttcgacaaagccctactt

SEQ ID NO: 91652 - DNA, 25 bp, Homo sapien
gccctactttgcttccctgggtctg

SEQ ID NO: 91653 - DNA, 25 bp, Homo sapien
tgcgccgtagtgcttagcaagctgg

SEQ ID NO: 91654 - DNA, 25 bp, Homo sapien
ctcgggcggggtcacaattacacct

SEQ ID NO: 91655 - DNA, 25 bp, Homo sapien
gtcacaattacacctcggctccagg

SEQ ID NO: 91656 - DNA, 25 bp, Homo sapien
agagaaattttgtgcgccgtagtgc

SEQ ID NO: 91657 - DNA, 25 bp, Homo sapien
tggtctccactttgccgttcgaaaa

SEQ ID NO: 91658 - DNA, 25 bp, Homo sapien
cgtctacgctattagcagccaggta

SEQ ID NO: 91659 - DNA, 25 bp, Homo sapien
gctgggccaaggtattctctgcttc

SEQ ID NO: 91660 - DNA, 25 bp, Homo sapien
ttgccgttcgaaaatgcctaggttg

SEQ ID NO: 91661 - DNA, 25 bp, Homo sapien
ggtattctctgcttccgcctttgtg

SEQ ID NO: 91662 - DNA, 25 bp, Homo sapien
cttttctgctcaggagtgtttggcc

SEQ ID NO: 91663 - DNA, 25 bp, Homo sapien
cggcttcccgagatacgctagagtt

SEQ ID NO: 91664 - DNA, 25 bp, Homo sapien
gtggatcgaccctccgcggagcaaa

SEQ ID NO: 91665 - DNA, 25 bp, Homo sapien
tctgatcatcaaagcggcccaaatg

SEQ ID NO: 91666 - DNA, 25 bp, Homo sapien
ccgtttagcggttccaggctgattg

SEQ ID NO: 91667 - DNA, 25 bp, Homo sapien
ttagccctcagaccgaagccgttta

SEQ ID NO: 91668 - DNA, 25 bp, Homo sapien
gtcggatactcggtgctctttaacc

SEQ ID NO: 91669 - DNA, 25 bp, Homo sapien
tgcacttcgcgatgggaactggctt

SEQ ID NO: 91670 - DNA, 25 bp, Homo sapien
cagagcggccgggaataaatttgta

SEQ ID NO: 91671 - DNA, 25 bp, Homo sapien
gtgcggcactaatcactcccagatg

SEQ ID NO: 91672 - DNA, 25 bp, Homo sapien
ttcggtgcacgtaagtcggatactc

SEQ ID NO: 91673 - DNA, 25 bp, Homo sapien
ttcaagatttcgttctggacagagg

SEQ ID NO: 91674 - DNA, 25 bp, Homo sapien
gttttcttgtcgttgctgctcactg

SEQ ID NO: 91675 - DNA, 25 bp, Homo sapien
ctgctcactgtgcttttcaagattt

SEQ ID NO: 91676 - DNA, 25 bp, Homo sapien
ttcagagaggatacctggttccaca

SEQ ID NO: 91677 - DNA, 25 bp, Homo sapien
gcgctgcagcgctcaacaaccggat

SEQ ID NO: 91678 - DNA, 25 bp, Homo sapien
aaggttagcgctaccctagccggcg

SEQ ID NO: 91679 - DNA, 25 bp, Homo sapien
ccctgcagagaagctaccaaggtta

SEQ ID NO: 91680 - DNA, 25 bp, Homo sapien
ggggccttttctcttactccagatg

SEQ ID NO: 91681 - DNA, 25 bp, Homo sapien
ccagccatggaagtaggggttctcc

SEQ ID NO: 91682 - DNA, 25 bp, Homo sapien
ccctgaatgagccttggagctcgaa

SEQ ID NO: 91683 - DNA, 25 bp, Homo sapien
tcagatcctctcctttcggggcaag

SEQ ID NO: 91684 - DNA, 25 bp, Homo sapien
ttttagctgcgagtaacgtgtcctc

SEQ ID NO: 91685 - DNA, 25 bp, Homo sapien
ctggcaccgaagctaacccggaatc

SEQ ID NO: 91686 - DNA, 25 bp, Homo sapien
tggggaaaaccacctaccagactca

SEQ ID NO: 91687 - DNA, 25 bp, Homo sapien
gggtcgactgctcactgcaaagcta

SEQ ID NO: 91688 - DNA, 25 bp, Homo sapien
tctcgtgctcatacaaaggtgccgg

SEQ ID NO: 91689 - DNA, 25 bp, Homo sapien
cctacgaagaccttgggcgattttg

SEQ ID NO: 91690 - DNA, 25 bp, Homo sapien
ccgaatctgtagtgtggctggtatc

SEQ ID NO: 91691 - DNA, 25 bp, Homo sapien
ggccttggtgatcttgaacgcatta

SEQ ID NO: 91692 - DNA, 25 bp, Homo sapien
ccgtgtggcatgagcttcttgagaa

SEQ ID NO: 91693 - DNA, 25 bp, Homo sapien
gggcgaacatgtcaagccgattgta

SEQ ID NO: 91694 - DNA, 25 bp, Homo sapien
tccacttgtaagtcaccgggccgcg

SEQ ID NO: 91695 - DNA, 25 bp, Homo sapien
caccttgagcatcgccctttggagg

SEQ ID NO: 91696 - DNA, 25 bp, Homo sapien
tggctcacgttattgcggcaaactt

SEQ ID NO: 91697 - DNA, 25 bp, Homo sapien
cgggatcactgcagaccgctcggct

SEQ ID NO: 91698 - DNA, 25 bp, Homo sapien
agaccgctcggctgcgtcagaaccg

SEQ ID NO: 91699 - DNA, 25 bp, Homo sapien
ctgcagaccgctcggctgcgtcaga

SEQ ID NO: 91700 - DNA, 25 bp, Homo sapien
actgcagaccgctcggctgcgtcag

SEQ ID NO: 91701 - DNA, 25 bp, Homo sapien
ggatcactgcagaccgctcggctgc

SEQ ID NO: 91702 - DNA, 25 bp, Homo sapien
cctcgtcagaaccgcgtgggggact

SEQ ID NO: 91703 - DNA, 25 bp, Homo sapien
ctcggctgcgtcagaaccgcctggg

SEQ ID NO: 91704 - DNA, 25 bp, Homo sapien
gatcactgcagaccgctcggctgcg

SEQ ID NO: 91705 - DNA, 25 bp, Homo sapien
ggcggcaaaagcgtagatcttgtca

SEQ ID NO: 91706 - DNA, 25 bp, Homo sapien
caattacgggttggcttgtggctac

SEQ ID NO: 91707 - DNA, 25 bp, Homo sapien
ggtctcattaggaaaccctcaccgc

SEQ ID NO: 91708 - DNA, 25 bp, Homo sapien
caggaaggggttaaccatgagcctc

SEQ ID NO: 91709 - DNA, 25 bp, Homo sapien
gggcaaatctgcagccgctcgcttt

SEQ ID NO: 91710 - DNA, 25 bp, Homo sapien
tttccagtcactgcgatggccactg

SEQ ID NO: 91711 - DNA, 25 bp, Homo sapien
tccgttctagctgcctgaagaccca

SEQ ID NO: 91712 - DNA, 25 bp, Homo sapien
agctgctctcccaactcgcatgggg

SEQ ID NO: 91713 - DNA, 25 bp, Homo sapien
gggaggaacgcccttgccaacctca

SEQ ID NO: 91714 - DNA, 25 bp, Homo sapien
cagcctttttgatcttccgcgggca

SEQ ID NO: 91715 - DNA, 25 bp, Homo sapien
ttccgcgggcagagactcatcagag

SEQ ID NO: 91716 - DNA, 25 bp, Homo sapien
agagccaggaggactgtaactaccc

SEQ ID NO: 91717 - DNA, 25 bp, Homo sapien
gtgtaccgccgaagcctgaagaggc

SEQ ID NO: 91718 - DNA, 25 bp, Homo sapien
ggctggttgggccaaaatagcagtc

SEQ ID NO: 91719 - DNA, 25 bp, Homo sapien
tagcagtcgctgcaggcaccagttt

SEQ ID NO: 91720 - DNA, 25 bp, Homo sapien
tgcaggcaccagtttcagcccgtca

SEQ ID NO: 91721 - DNA, 25 bp, Homo sapien
aaccggcttctttgctggtggctgc

SEQ ID NO: 91722 - DNA, 25 bp, Homo sapien
ccctgtcgtgctgggcctttgaaac

SEQ ID NO: 91723 - DNA, 25 bp, Homo sapien
gttgcatatgctccgttttcctctc

SEQ ID NO: 91724 - DNA, 25 bp, Homo sapien
agctcccagctttgaaggtcttgcg

SEQ ID NO: 91725 - DNA, 25 bp, Homo sapien
agtgacgttaggctccgactcttaa

SEQ ID NO: 91726 - DNA, 25 bp, Homo sapien
gactcttaacggagacgcattttta

SEQ ID NO: 91727 - DNA, 25 bp, Homo sapien
gaactgccgactatcccaattttga

SEQ ID NO: 91728 - DNA, 25 bp, Homo sapien
cggagtcgctcttcacaggagtctt

SEQ ID NO: 91729 - DNA, 25 bp, Homo sapien
gcgccaatctcattcccacaggatg

SEQ ID NO: 91730 - DNA, 25 bp, Homo sapien
gccgcactcgggaacataccaaacg

SEQ ID NO: 91731 - DNA, 25 bp, Homo sapien
aagagggctgcttgcgccaatctca

SEQ ID NO: 91732 - DNA, 25 bp, Homo sapien
ccggcggtactaaaagagggctgct

SEQ ID NO: 91733 - DNA, 25 bp, Homo sapien
ttttaaaggcttggctagcgtgccc

SEQ ID NO: 91734 - DNA, 25 bp, Homo sapien
ctgaatacctgcaaaccgagggctc

SEQ ID NO: 91735 - DNA, 25 bp, Homo sapien
cacaggatgcaagtacagaagcaga

SEQ ID NO: 91736 - DNA, 25 bp, Homo sapien
aacgcgccttagcttgccctgaata

SEQ ID NO: 91737 - DNA, 25 bp, Homo sapien
ggaggaaactgtcaagccagcgccc

SEQ ID NO: 91738 - DNA, 25 bp, Homo sapien
agtgtgtgggcagagaaatttccgc

SEQ ID NO: 91739 - DNA, 25 bp, Homo sapien
gatctttgccttccggactcgcaga

SEQ ID NO: 91740 - DNA, 25 bp, Homo sapien
gagcgccaagcttcgcgatctttgc

SEQ ID NO: 91741 - DNA, 25 bp, Homo sapien
ccctgagcgttctggagcgccaagc

SEQ ID NO: 91742 - DNA, 25 bp, Homo sapien
ggggaacccacgactgtgtcacctg

SEQ ID NO: 91743 - DNA, 25 bp, Homo sapien
cgcctctgcaaaggctctgcctatg

SEQ ID NO: 91744 - DNA, 25 bp, Homo sapien
taccttggcgcccttaagcagcagc

SEQ ID NO: 91745 - DNA, 25 bp, Homo sapien
aatcacgaccgcacagcgggacgga

SEQ ID NO: 91746 - DNA, 25 bp, Homo sapien
aaccaaacggcgactggagcgaggt

SEQ ID NO: 91747 - DNA, 25 bp, Homo sapien
acaggccacttacgacggtaggcgg

SEQ ID NO: 91748 - DNA, 25 bp, Homo sapien
gtgacaggccacttacgacggtagg

SEQ ID NO: 91749 - DNA, 25 bp, Homo sapien
cgggacggagtgacaggccacttac

SEQ ID NO: 91750 - DNA, 25 bp, Homo sapien
gaccaatcacgaccgcacagcggga

SEQ ID NO: 91751 - DNA, 25 bp, Homo sapien
gaaagaggacgcctctccacctgct

SEQ ID NO: 91752 - DNA, 25 bp, Homo sapien
caaacaaaccaaacggcgactggag

SEQ ID NO: 91753 - DNA, 25 bp, Homo sapien
tccagggatggcgagtgctttctcc

SEQ ID NO: 91754 - DNA, 25 bp, Homo sapien
cagggatggcgagtgctttctcctc

SEQ ID NO: 91755 - DNA, 25 bp, Homo sapien
gcggaagagcagcatctcccctgcg

SEQ ID NO: 91756 - DNA, 25 bp, Homo sapien
ccagtccagggatggcgagtgcttt

SEQ ID NO: 91757 - DNA, 25 bp, Homo sapien
atacgccagtccagggatggcgagt

SEQ ID NO: 91758 - DNA, 25 bp, Homo sapien
gggatggcgagtgctttctcctccc

SEQ ID NO: 91759 - DNA, 25 bp, Homo sapien
ccctgcgcctgtggatacgccagtc

SEQ ID NO: 91760 - DNA, 25 bp, Homo sapien
agcatctcccctgcgcctgtggata

SEQ ID NO: 91761 - DNA, 25 bp, Homo sapien
ctcttcgaggtgactcgtgggaccc

SEQ ID NO: 91762 - DNA, 25 bp, Homo sapien
accctgcgtcctagtgctgggtgtg

SEQ ID NO: 91763 - DNA, 25 bp, Homo sapien
tgctgggtgtgaatcggctatttca

SEQ ID NO: 91764 - DNA, 25 bp, Homo sapien
agctgcctccgctaagcaccgaata

SEQ ID NO: 91765 - DNA, 25 bp, Homo sapien
cgcagtcacattcctggagctattc

SEQ ID NO: 91766 - DNA, 25 bp, Homo sapien
ctgcctggaaacttgagcgaagctg

SEQ ID NO: 91767 - DNA, 25 bp, Homo sapien
accgtccagtgacccgagccagtgt

SEQ ID NO: 91768 - DNA, 25 bp, Homo sapien
tcggctatttcacacccagttcttc

SEQ ID NO: 91769 - DNA, 25 bp, Homo sapien
gacgcagtctgaggccgaggaacat

SEQ ID NO: 91770 - DNA, 25 bp, Homo sapien
ctgaggccgaggaacattcattttc

SEQ ID NO: 91771 - DNA, 25 bp, Homo sapien
tttctttctataatgcccattcccg

SEQ ID NO: 91772 - DNA, 25 bp, Homo sapien
ataatgcccattcccgaggccgagc

SEQ ID NO: 91773 - DNA, 25 bp, Homo sapien
cgcgcactcacccatggcccgaggt

SEQ ID NO: 91774 - DNA, 25 bp, Homo sapien
cgaggtcctgcttctctgcagtccc

SEQ ID NO: 91775 - DNA, 25 bp, Homo sapien
ctgcgcggggccaagttctccaagc

SEQ ID NO: 91776 - DNA, 25 bp, Homo sapien
tcgcgccctggcaagtgacagcctc

SEQ ID NO: 91777 - DNA, 25 bp, Homo sapien
gctctgacctccctgtgatcgcgga

SEQ ID NO: 91778 - DNA, 25 bp, Homo sapien
tgatcgcggaccagggtaatgtacg

SEQ ID NO: 91779 - DNA, 25 bp, Homo sapien
ggcgctccaatcagcgacctgtgta

SEQ ID NO: 91780 - DNA, 25 bp, Homo sapien
ctcctccaggtaagaagccggtggg

SEQ ID NO: 91781 - DNA, 25 bp, Homo sapien
gatgctggaactgtcgcggcgtcat

SEQ ID NO: 91782 - DNA, 25 bp, Homo sapien
taccaaggcaagctcaggattgatg

SEQ ID NO: 91783 - DNA, 25 bp, Homo sapien
cgtcatgcgagaggggctctgacct

SEQ ID NO: 91784 - DNA, 25 bp, Homo sapien
acctgtgtagctgtcacgtgggcct

SEQ ID NO: 91785 - DNA, 25 bp, Homo sapien
cggcagccatgacgctttctgggtt

SEQ ID NO: 91786 - DNA, 25 bp, Homo sapien
agctgctagctgtggcgaaagtgac

SEQ ID NO: 91787 - DNA, 25 bp, Homo sapien
gctgccgcagtctgtgtcaaatacc

SEQ ID NO: 91788 - DNA, 25 bp, Homo sapien
agacacttcttaggcctccctcgga

SEQ ID NO: 91789 - DNA, 25 bp, Homo sapien
tttctgggttgctgcggcaacagca

SEQ ID NO: 91790 - DNA, 25 bp, Homo sapien
cccgtacttccgctttactcagatt

SEQ ID NO: 91791 - DNA, 25 bp, Homo sapien
tactcagattttggaccgcggggcc

SEQ ID NO: 91792 - DNA, 25 bp, Homo sapien
ctcttcggcgcatgcggatagacca

SEQ ID NO: 91793 - DNA, 25 bp, Homo sapien
gacgtcgcaggcttttccggcgtcc

SEQ ID NO: 91794 - DNA, 25 bp, Homo sapien
ctcgtgggagacgatcgcgatgaac

SEQ ID NO: 91795 - DNA, 25 bp, Homo sapien
ctgtcgcgggcgaactcactgttcg

SEQ ID NO: 91796 - DNA, 25 bp, Homo sapien
ttcaaagacaggagcgtcccggtgc

SEQ ID NO: 91797 - DNA, 25 bp, Homo sapien
gatcgccctcctgagcggcagttcg

SEQ ID NO: 91798 - DNA, 25 bp, Homo sapien
tccctcactcgtcgctgattggtgg

SEQ ID NO: 91799 - DNA, 25 bp, Homo sapien
attttgagcgttcctcaggtcggtg

SEQ ID NO: 91800 - DNA, 25 bp, Homo sapien
gcacgtctcgcggatcatgctgtga

SEQ ID NO: 91801 - DNA, 25 bp, Homo sapien
gcctcgcggttggtctcctggttcc

SEQ ID NO: 91802 - DNA, 25 bp, Homo sapien
tgttccgcacgttctaaaccgcctg

SEQ ID NO: 91803 - DNA, 25 bp, Homo sapien
gggcctggtgttccgcacgttctaa

SEQ ID NO: 91804 - DNA, 25 bp, Homo sapien
agcaagtgcgagctgcccatcgaga

SEQ ID NO: 91805 - DNA, 25 bp, Homo sapien
aggcccttgttgagcaagtgcgagc

SEQ ID NO: 91806 - DNA, 25 bp, Homo sapien
agcggcaggcccttgttgagcaagt

SEQ ID NO: 91807 - DNA, 25 bp, Homo sapien
aggcccttttgtgtcacctgcacgg

SEQ ID NO: 91808 - DNA, 25 bp, Homo sapien
ttttgtgtcacctgcacgggccgcg

SEQ ID NO: 91809 - DNA, 25 bp, Homo sapien
cgcggtccgcgtcggtgtagctttt

SEQ ID NO: 91810 - DNA, 25 bp, Homo sapien
agggcatgactgacgcgccctctgc

SEQ ID NO: 91811 - DNA, 25 bp, Homo sapien
gcctcacaggaaaccggacatccga

SEQ ID NO: 91812 - DNA, 25 bp, Homo sapien
agcggcgagcagagaacacgccaca

SEQ ID NO: 91813 - DNA, 25 bp, Homo sapien
gccacagagaagaagcccagcaagt

SEQ ID NO: 91814 - DNA, 25 bp, Homo sapien
ccagcaagtgcatggtggaaggacc

SEQ ID NO: 91815 - DNA, 25 bp, Homo sapien
tccgcgttcccaactttgcagggcg

SEQ ID NO: 91816 - DNA, 25 bp, Homo sapien
gcgggtgtcaggtaaaagcctcaca

SEQ ID NO: 91817 - DNA, 25 bp, Homo sapien
ctctgaatggagagaagattcgcgc

SEQ ID NO: 91818 - DNA, 25 bp, Homo sapien
aggaccaggctgtactctgaatgga

SEQ ID NO: 91819 - DNA, 25 bp, Homo sapien
gccctgcaatcggtgggccacagtg

SEQ ID NO: 91820 - DNA, 25 bp, Homo sapien
cgttgagttgcacagcggtattctc

SEQ ID NO: 91821 - DNA, 25 bp, Homo sapien
agacgcgcgcgagatttgaatttcc

SEQ ID NO: 91822 - DNA, 25 bp, Homo sapien
ccacgcgcgtttgcgttttcttaat

SEQ ID NO: 91823 - DNA, 25 bp, Homo sapien
tcgcagcctccacggttgtggtctc

SEQ ID NO: 91824 - DNA, 25 bp, Homo sapien
ccgtagggagcgacctcaacagcta

SEQ ID NO: 91825 - DNA, 25 bp, Homo sapien
aagtctgggaaagcgcgaaagcgcc

SEQ ID NO: 91826 - DNA, 25 bp, Homo sapien
acaggggactcccatgagaaggaag

SEQ ID NO: 91827 - DNA, 25 bp, Homo sapien
atcaggccaaatccctggagacttc

SEQ ID NO: 91828 - DNA, 25 bp, Homo sapien
gctcatttgcggatcaggccaaatc

SEQ ID NO: 91829 - DNA, 25 bp, Homo sapien
ttttggccgcttcctcgtccaggct

SEQ ID NO: 91830 - DNA, 25 bp, Homo sapien
cgaagagtaaagtaccgcactcagt

SEQ ID NO: 91831 - DNA, 25 bp, Homo sapien
cctaagcagttttggccgcttcctc

SEQ ID NO: 91832 - DNA, 25 bp, Homo sapien
tcctgggaaccaagcctaagcagtt

SEQ ID NO: 91833 - DNA, 25 bp, Homo sapien
gcactagggcctggcagagcagaaa

SEQ ID NO: 91834 - DNA, 25 bp, Homo sapien
cggcacgagaagcacaggcaagttc

SEQ ID NO: 91835 - DNA, 25 bp, Homo sapien
acaggcaagttcgacttccgcgcca

SEQ ID NO: 91836 - DNA, 25 bp, Homo sapien
tgaccaccgaagagaccagcgcgag

SEQ ID NO: 91837 - DNA, 25 bp, Homo sapien
gcacctgcttcggttgcattcttaa

SEQ ID NO: 91838 - DNA, 25 bp, Homo sapien
aactctcgcgagacgaggcgtccct

SEQ ID NO: 91839 - DNA, 25 bp, Homo sapien
gcagccagcgatcgccgaacaatta

SEQ ID NO: 91840 - DNA, 25 bp, Homo sapien
ttaaagggccaagtgttgacgacca

SEQ ID NO: 91841 - DNA, 25 bp, Homo sapien
ggctgcacctttcccgagagtcggg

SEQ ID NO: 91842 - DNA, 25 bp, Homo sapien
tggtccgcagactcccacttcattg

SEQ ID NO: 91843 - DNA, 25 bp, Homo sapien
gctcgaaagtggaggcagcctaacc

SEQ ID NO: 91844 - DNA, 25 bp, Homo sapien
cgtagcgctgaaaccaccattcaca

SEQ ID NO: 91845 - DNA, 25 bp, Homo sapien
ccctgtcttctgtggataaacggtg

SEQ ID NO: 91846 - DNA, 25 bp, Homo sapien
tggctaggaagcgactgagccttct

SEQ ID NO: 91847 - DNA, 25 bp, Homo sapien
gactggagctggaaagttcaaacta

SEQ ID NO: 91848 - DNA, 25 bp, Homo sapien
aaacgtgttgctctcgccgagtgcc

SEQ ID NO: 91849 - DNA, 25 bp, Homo sapien
tcttctcccgctccagtttttattg

SEQ ID NO: 91850 - DNA, 25 bp, Homo sapien
ggctgcgttcacaccgcaaagtcac

SEQ ID NO: 91851 - DNA, 25 bp, Homo sapien
agagcggccagaggcttgcaaaaca

SEQ ID NO: 91852 - DNA, 25 bp, Homo sapien
gcgatgtcttgcatttcttctcccg

SEQ ID NO: 91853 - DNA, 25 bp, Homo sapien
gtttttattgctgcggagggcacga

SEQ ID NO: 91854 - DNA, 25 bp, Homo sapien
agggcacgacgtgagctgcccgcca

SEQ ID NO: 91855 - DNA, 25 bp, Homo sapien
ggcttgcaaaacagacagcgatgtc

SEQ ID NO: 91856 - DNA, 25 bp, Homo sapien
attatcccgagcacgaccggctgcg

SEQ ID NO: 91857 - DNA, 25 bp, Homo sapien
catttgcgcttttcggtctcggacg

SEQ ID NO: 91858 - DNA, 25 bp, Homo sapien
cggcaagagccattcatcagcgtga

SEQ ID NO: 91859 - DNA, 25 bp, Homo sapien
cgaacgtggttcagtccggcaaatc

SEQ ID NO: 91860 - DNA, 25 bp, Homo sapien
atgcccaccctacggaagatcaaga

SEQ ID NO: 91861 - DNA, 25 bp, Homo sapien
cgggtgactcagctgacctgaaatg

SEQ ID NO: 91862 - DNA, 25 bp, Homo sapien
cggaatccgtcttcccggcagtgtc

SEQ ID NO: 91863 - DNA, 25 bp, Homo sapien
gcgggtcattttcagaggctctgca

SEQ ID NO: 91864 - DNA, 25 bp, Homo sapien
cattagtgttttcaatcggcggcgg

SEQ ID NO: 91865 - DNA, 25 bp, Homo sapien
tgggctcggttcctcacggccacag

SEQ ID NO: 91866 - DNA, 25 bp, Homo sapien
atgcttttgtgagcacgggaaagta

SEQ ID NO: 91867 - DNA, 25 bp, Homo sapien
tagcgctgccggagaacagctctga

SEQ ID NO: 91868 - DNA, 25 bp, Homo sapien
ctctgaggcgggatcaaaagccgcc

SEQ ID NO: 91869 - DNA, 25 bp, Homo sapien
gccgggtgtaaacagaggagcctca

SEQ ID NO: 91870 - DNA, 25 bp, Homo sapien
aggagcctcagcctatcatgtctgg

SEQ ID NO: 91871 - DNA, 25 bp, Homo sapien
gcgctgtaacacgatacgctccaga

SEQ ID NO: 91872 - DNA, 25 bp, Homo sapien
gacacctcggatgcgggacgcatga

SEQ ID NO: 91873 - DNA, 25 bp, Homo sapien
atcaacgtgacggtgtcgcagtcca

SEQ ID NO: 91874 - DNA, 25 bp, Homo sapien
ccacggtcaagtcgctgatcggcaa

SEQ ID NO: 91875 - DNA, 25 bp, Homo sapien
cgcgtgcagaccaacgtgctcaaca

SEQ ID NO: 91876 - DNA, 25 bp, Homo sapien
tcgccaacgaggactgcatcaaggt

SEQ ID NO: 91877 - DNA, 25 bp, Homo sapien
ctgcacttcaccatcgagggcaagg

SEQ ID NO: 91878 - DNA, 25 bp, Homo sapien
tcctgtggcacaacccgagtgggac

SEQ ID NO: 91879 - DNA, 25 bp, Homo sapien
gcagcccatcttcggagtccagcag

SEQ ID NO: 91880 - DNA, 25 bp, Homo sapien
tggcggccgtgctcaacaacgcctt

SEQ ID NO: 91881 - DNA, 25 bp, Homo sapien
atgtcccggaagaacggatcactta

SEQ ID NO: 91882 - DNA, 25 bp, Homo sapien
cttctgcggacatggaaaagccgtc

SEQ ID NO: 91883 - DNA, 25 bp, Homo sapien
tgccctccgagtttcacacttaaag

SEQ ID NO: 91884 - DNA, 25 bp, Homo sapien
ggtaagatttccctgcacgtcgagc

SEQ ID NO: 91885 - DNA, 25 bp, Homo sapien
atgccgcgttgctctcactcacaga

SEQ ID NO: 91886 - DNA, 25 bp, Homo sapien
ctcacagatcgaaataaggcccttc

SEQ ID NO: 91887 - DNA, 25 bp, Homo sapien
tcctgtcgctggaaagaatgtcccg

SEQ ID NO: 91888 - DNA, 25 bp, Homo sapien
cgcagcgcctgaaaacagtgatttc

SEQ ID NO: 91889 - DNA, 25 bp, Homo sapien
cgcgcctgttacacggcggacggca

SEQ ID NO: 91890 - DNA, 25 bp, Homo sapien
gcctcgcctgctgtgacaactctgt

SEQ ID NO: 91891 - DNA, 25 bp, Homo sapien
tgtgacaactctgtctggctctggg

SEQ ID NO: 91892 - DNA, 25 bp, Homo sapien
acacaagttcttgggtcgtaagcac

SEQ ID NO: 91893 - DNA, 25 bp, Homo sapien
cttgggtcgtaagcacaggctggca

SEQ ID NO: 91894 - DNA, 25 bp, Homo sapien
acaggctggcagtcccagatcggga

SEQ ID NO: 91895 - DNA, 25 bp, Homo sapien
catgcatctgctcccgacctgagtc

SEQ ID NO: 91896 - DNA, 25 bp, Homo sapien
ctggcagtcccagatcgggaggccc

SEQ ID NO: 91897 - DNA, 25 bp, Homo sapien
cggcagtgattggttcgcgccttct

SEQ ID NO: 91898 - DNA, 25 bp, Homo sapien
cccgctaatgttttggccgcttcaa

SEQ ID NO: 91899 - DNA, 25 bp, Homo sapien
cgccggtcgctagttaggaactgta

SEQ ID NO: 91900 - DNA, 25 bp, Homo sapien
ggcctgaacccggtagcgaattcaa

SEQ ID NO: 91901 - DNA, 25 bp, Homo sapien
ctgatggcacccagcgacctttttg

SEQ ID NO: 91902 - DNA, 25 bp, Homo sapien
gcggctcagttgtccatgaccctga

SEQ ID NO: 91903 - DNA, 25 bp, Homo sapien
cgacctttttgatgggcgtcaccaa

SEQ ID NO: 91904 - DNA, 25 bp, Homo sapien
tgaaatacagctcttgccgtccggc

SEQ ID NO: 91905 - DNA, 25 bp, Homo sapien
tcacacactggatggggcagggaac

SEQ ID NO: 91906 - DNA, 25 bp, Homo sapien
ggtggctgggtcacagtttcacaca

SEQ ID NO: 91907 - DNA, 25 bp, Homo sapien
ccaagaatctagtgccgtgaaactg

SEQ ID NO: 91908 - DNA, 25 bp, Homo sapien
ccgtgttccatcaactgcttagaga

SEQ ID NO: 91909 - DNA, 25 bp, Homo sapien
tcagagcccgagcacaaactacttc

SEQ ID NO: 91910 - DNA, 25 bp, Homo sapien
ccgcattctccgatctaaaggctga

SEQ ID NO: 91911 - DNA, 25 bp, Homo sapien
cgccgagaaatcgaccctggagtga

SEQ ID NO: 91912 - DNA, 25 bp, Homo sapien
atgtggtgttcagacgcccagcacc

SEQ ID NO: 91913 - DNA, 25 bp, Homo sapien
cgttctcccgcgacatcaaatggca

SEQ ID NO: 91914 - DNA, 25 bp, Homo sapien
tcaaatggcagcatgcgggactaca

SEQ ID NO: 91915 - DNA, 25 bp, Homo sapien
tgcgggactacaccaaatgcggaaa

SEQ ID NO: 91916 - DNA, 25 bp, Homo sapien
caccaaatgcggaaaggcgccttcc

SEQ ID NO: 91917 - DNA, 25 bp, Homo sapien
gggctgcctgcgcagatgtcattcc

SEQ ID NO: 91918 - DNA, 25 bp, Homo sapien
gatgtcattcccacaagatgcaagt

SEQ ID NO: 91919 - DNA, 25 bp, Homo sapien
caagtaaagaagcaccgcggacgcc

SEQ ID NO: 91920 - DNA, 25 bp, Homo sapien
ctgccctgagtatctgcaaacccgg

SEQ ID NO: 91921 - DNA, 25 bp, Homo sapien
cgcgaacagcgtttcctgaggcacc

SEQ ID NO: 91922 - DNA, 25 bp, Homo sapien
ccgacgcagacatggtggactgatc

SEQ ID NO: 91923 - DNA, 25 bp, Homo sapien
cgggcgcatgctaatcgcatgcaaa

SEQ ID NO: 91924 - DNA, 25 bp, Homo sapien
cagaaactctaaaacctctcggcgt

SEQ ID NO: 91925 - DNA, 25 bp, Homo sapien
gaaggttgcggagacttttgcaatc

SEQ ID NO: 91926 - DNA, 25 bp, Homo sapien
ccctagaagacgaaagaggttgaga

SEQ ID NO: 91927 - DNA, 25 bp, Homo sapien
ctttgtgccctctccgcttgttgag

SEQ ID NO: 91928 - DNA, 25 bp, Homo sapien
tgaggttttttctccggaggagagc

SEQ ID NO: 91929 - DNA, 25 bp, Homo sapien
tgactcagcgcaccctaaactcgga

SEQ ID NO: 91930 - DNA, 25 bp, Homo sapien
gtcctagcggcaacagagcctccta

SEQ ID NO: 91931 - DNA, 25 bp, Homo sapien
cgaagtcggagatcgcaaggtccta

SEQ ID NO: 91932 - DNA, 25 bp, Homo sapien
cccgggagagactgcattctgagaa

SEQ ID NO: 91933 - DNA, 25 bp, Homo sapien
aaaaagcacgccgagcccactggga

SEQ ID NO: 91934 - DNA, 25 bp, Homo sapien
atgtctgtccttaagcctcgatttg

SEQ ID NO: 91935 - DNA, 25 bp, Homo sapien
gccttagtggctggcttccacccag

SEQ ID NO: 91936 - DNA, 25 bp, Homo sapien
gcctcctagcgatggcagcgagcct

SEQ ID NO: 91937 - DNA, 25 bp, Homo sapien
gcagcagctcatctccttttccatg

SEQ ID NO: 91938 - DNA, 25 bp, Homo sapien
cgcctcgttttgtgtgccacctgca

SEQ ID NO: 91939 - DNA, 25 bp, Homo sapien
gtcccaggccagctcgacttgcagt

SEQ ID NO: 91940 - DNA, 25 bp, Homo sapien
tagtcctgcctgtctcccggtgcag

SEQ ID NO: 91941 - DNA, 25 bp, Homo sapien
cgacggcgagactgacaaacactgg

SEQ ID NO: 91942 - DNA, 25 bp, Homo sapien
caccgccgggattttttgcttcgca

SEQ ID NO: 91943 - DNA, 25 bp, Homo sapien
cgctgttgtttggtctttaggcctg

SEQ ID NO: 91944 - DNA, 25 bp, Homo sapien
cgctgcctccgctagcacggatgaa

SEQ ID NO: 91945 - DNA, 25 bp, Homo sapien
tcctccgagcgtttcaagaagctgc

SEQ ID NO: 91946 - DNA, 25 bp, Homo sapien
ctcctccgagcgtttcaagaagctg

SEQ ID NO: 91947 - DNA, 25 bp, Homo sapien
cctcctccgagcgtttcaagaagct

SEQ ID NO: 91948 - DNA, 25 bp, Homo sapien
cctccgagcgtttcaagaagctgca

SEQ ID NO: 91949 - DNA, 25 bp, Homo sapien
ctccgagcgtttcaagaagctgcac

SEQ ID NO: 91950 - DNA, 25 bp, Homo sapien
tccgagcgtttcaagaagctgcacg

SEQ ID NO: 91951 - DNA, 25 bp, Homo sapien
gtcgctgtgatagccacggggctgg

SEQ ID NO: 91952 - DNA, 25 bp, Homo sapien
gcggcggtcgctgtgatagccacgg

SEQ ID NO: 91953 - DNA, 25 bp, Homo sapien
agcagcaactgtactcgtcggccgc

SEQ ID NO: 91954 - DNA, 25 bp, Homo sapien
ggctgctcacctgctacgtgcagga

SEQ ID NO: 91955 - DNA, 25 bp, Homo sapien
cgtgcaggactaccttgagtgcgtg

SEQ ID NO: 91956 - DNA, 25 bp, Homo sapien
cccacgacatgcagaggaacgtgtc

SEQ ID NO: 91957 - DNA, 25 bp, Homo sapien
tctgtgctgcgagagctggacaaca

SEQ ID NO: 91958 - DNA, 25 bp, Homo sapien
caagcatttgttcaggcgctggccc

SEQ ID NO: 91959 - DNA, 25 bp, Homo sapien
ccgctgaggggaatcagccatttta

SEQ ID NO: 91960 - DNA, 25 bp, Homo sapien
acggcactcgtagcatctggggact

SEQ ID NO: 91961 - DNA, 25 bp, Homo sapien
ctgggaagtgcagcgtctccctgac

SEQ ID NO: 91962 - DNA, 25 bp, Homo sapien
aagttccgggacagcgattggtgta

SEQ ID NO: 91963 - DNA, 25 bp, Homo sapien
tcgttggcactcatcgcgccggtcg

SEQ ID NO: 91964 - DNA, 25 bp, Homo sapien
tcttggcactggcagacgccaactg

SEQ ID NO: 91965 - DNA, 25 bp, Homo sapien
aagtctcgcctgttggaactggctg

SEQ ID NO: 91966 - DNA, 25 bp, Homo sapien
gattggtgtagagcgcggtcactca

SEQ ID NO: 91967 - DNA, 25 bp, Homo sapien
gggccacggcgttctgtgacatccc

SEQ ID NO: 91968 - DNA, 25 bp, Homo sapien
agcggacggcgttcgcaacaacgaa

SEQ ID NO: 91969 - DNA, 25 bp, Homo sapien
gtttccgcagcggttagaccggcca

SEQ ID NO: 91970 - DNA, 25 bp, Homo sapien
tttcggaagcacaatgcagaacgcc

SEQ ID NO: 91971 - DNA, 25 bp, Homo sapien
caggaaactcctgtggcttttcgga

SEQ ID NO: 91972 - DNA, 25 bp, Homo sapien
cgccgctgcggttcgcaggaaactc

SEQ ID NO: 91973 - DNA, 25 bp, Homo sapien
gggccttcaataggggctgtcgcca

SEQ ID NO: 91974 - DNA, 25 bp, Homo sapien
agagacctgcagaaactcgtgcgcg

SEQ ID NO: 91975 - DNA, 25 bp, Homo sapien
gacctcgggacaatgagcctttctg

SEQ ID NO: 91976 - DNA, 25 bp, Homo sapien
cagaacgcccggtgagggtttgcaa

SEQ ID NO: 91977 - DNA, 25 bp, Homo sapien
gtagatgcgaaatcaagcccggatg

SEQ ID NO: 91978 - DNA, 25 bp, Homo sapien
agcaggaggcgctatcaggatcaaa

SEQ ID NO: 91979 - DNA, 25 bp, Homo sapien
agcaacggtggtagatgcgaaatca

SEQ ID NO: 91980 - DNA, 25 bp, Homo sapien
tcaaaggcgggaccgtgggtcttca

SEQ ID NO: 91981 - DNA, 25 bp, Homo sapien
ggtcttcagggccacatccgtgaga

SEQ ID NO: 91982 - DNA, 25 bp, Homo sapien
atccgtgagaatcgctgacgtccgc

SEQ ID NO: 91983 - DNA, 25 bp, Homo sapien
tgcagttcccaaggccgtgagcagg

SEQ ID NO: 91984 - DNA, 25 bp, Homo sapien
agcccggatggcgaggcagtcccac

SEQ ID NO: 91985 - DNA, 25 bp, Homo sapien
cttcttcctgggctggatcgacgag

SEQ ID NO: 91986 - DNA, 25 bp, Homo sapien
agaagtttctgcagatcgcgcctca

SEQ ID NO: 91987 - DNA, 25 bp, Homo sapien
gcaccacatcggctacgagatcttc

SEQ ID NO: 91988 - DNA, 25 bp, Homo sapien
caaagccgagaacatgcagcacttc

SEQ ID NO: 91989 - DNA, 25 bp, Homo sapien
agcaggtcctgctgatccagggcaa

SEQ ID NO: 91990 - DNA, 25 bp, Homo sapien
cttccacatccgctgcctgggtgag

SEQ ID NO: 91991 - DNA, 25 bp, Homo sapien
gattggggaacttcctggcaccgaa

SEQ ID NO: 91992 - DNA, 25 bp, Homo sapien
agatcttcgccgacttcaaagccga

SEQ ID NO: 91993 - DNA, 25 bp, Homo sapien
ctccttcatgcctgcgttctgcgta

SEQ ID NO: 91994 - DNA, 25 bp, Homo sapien
ttctgcgtaaccgtggcgcgttctg

SEQ ID NO: 91995 - DNA, 25 bp, Homo sapien
agggccttttcccttgcactgggag

SEQ ID NO: 91996 - DNA, 25 bp, Homo sapien
gcactgggagcaaagggttcctgtc

SEQ ID NO: 91997 - DNA, 25 bp, Homo sapien
cgttcccgcgtagaacttgaatgca

SEQ ID NO: 91998 - DNA, 25 bp, Homo sapien
cttgaatgcagctaagggacgtcca

SEQ ID NO: 91999 - DNA, 25 bp, Homo sapien
taagggacgtccagagaggcctttc

SEQ ID NO: 92000 - DNA, 25 bp, Homo sapien
cctttccttttctggtggcggtctg

SEQ ID NO: 92001 - DNA, 25 bp, Homo sapien
agaaagcgcgaaacctccaggcacc

SEQ ID NO: 92002 - DNA, 25 bp, Homo sapien
gacacgggaactggccgtggactga

SEQ ID NO: 92003 - DNA, 25 bp, Homo sapien
ccctttagatttcacgcagacgcgg

SEQ ID NO: 92004 - DNA, 25 bp, Homo sapien
acaggggacgcccatgagcgggaaa

SEQ ID NO: 92005 - DNA, 25 bp, Homo sapien
caagtccctttagatttcacgcaga

SEQ ID NO: 92006 - DNA, 25 bp, Homo sapien
tgtgatcaggccaagtccctttaga

SEQ ID NO: 92007 - DNA, 25 bp, Homo sapien
agctcatttgtgatcaggccaagtc

SEQ ID NO: 92008 - DNA, 25 bp, Homo sapien
ccgccagcgcgctggcaatcaaaag

SEQ ID NO: 92009 - DNA, 25 bp, Homo sapien
tggccaagcactcctgcgctgaatc

SEQ ID NO: 92010 - DNA, 25 bp, Homo sapien
cggggacacgactcggacactgtca

SEQ ID NO: 92011 - DNA, 25 bp, Homo sapien
atgaagactgtctcccggggactgc

SEQ ID NO: 92012 - DNA, 25 bp, Homo sapien
cccgctcgagcctctgtgatgaaga

SEQ ID NO: 92013 - DNA, 25 bp, Homo sapien
cctcggccagtaagtaggagcatgc

SEQ ID NO: 92014 - DNA, 25 bp, Homo sapien
aggcagcctggtgattagcatgaga

SEQ ID NO: 92015 - DNA, 25 bp, Homo sapien
ccgcgttctaacttaaggcagcctg

SEQ ID NO: 92016 - DNA, 25 bp, Homo sapien
cgggagggaccatcctaaaaatatg

SEQ ID NO: 92017 - DNA, 25 bp, Homo sapien
cgcaggaatctgacagctgcttgtg

SEQ ID NO: 92018 - DNA, 25 bp, Homo sapien
ctgtgctgaagatgccgagaatgta

SEQ ID NO: 92019 - DNA, 25 bp, Homo sapien
cagctgcttgtgactgtgctgaaga

SEQ ID NO: 92020 - DNA, 25 bp, Homo sapien
acagcaaggagcgagccctctgagc

SEQ ID NO: 92021 - DNA, 25 bp, Homo sapien
tctgggtttgcttctcccggtttga

SEQ ID NO: 92022 - DNA, 25 bp, Homo sapien
gccttgaattctgggtttgcttctc

SEQ ID NO: 92023 - DNA, 25 bp, Homo sapien
caggctgggccagccttgaattctg

SEQ ID NO: 92024 - DNA, 25 bp, Homo sapien
atgccgagaatgtaggcagagcccg

SEQ ID NO: 92025 - DNA, 25 bp, Homo sapien
agccagggcacacacccggctgacg

SEQ ID NO: 92026 - DNA, 25 bp, Homo sapien
agaagctgcgccacggggaacgtga

SEQ ID NO: 92027 - DNA, 25 bp, Homo sapien
agccgcggtggagaaactgctggaa

SEQ ID NO: 92028 - DNA, 25 bp, Homo sapien
tgctggaaggtttccctgaagctgc

SEQ ID NO: 92029 - DNA, 25 bp, Homo sapien
aggtttccctgaagctgcgagttca

SEQ ID NO: 92030 - DNA, 25 bp, Homo sapien
ccctgaagctgcgagttcagagtca

SEQ ID NO: 92031 - DNA, 25 bp, Homo sapien
ttcagagtcagccatgtgtcctcgc

SEQ ID NO: 92032 - DNA, 25 bp, Homo sapien
gtgtcctcgcacctcagcgagggtc

SEQ ID NO: 92033 - DNA, 25 bp, Homo sapien
cgcttcttagggaacaaggaggaga

SEQ ID NO: 92034 - DNA, 25 bp, Homo sapien
cccagcaagtttcctctggccgtgg

SEQ ID NO: 92035 - DNA, 25 bp, Homo sapien
gcaccaaccatgttcggccagcggg

SEQ ID NO: 92036 - DNA, 25 bp, Homo sapien
aagggtccggcctacacagactgac

SEQ ID NO: 92037 - DNA, 25 bp, Homo sapien
ctacacagactgacccgggcgtttc

SEQ ID NO: 92038 - DNA, 25 bp, Homo sapien
gggcgtttcacctggtgcccgacca

SEQ ID NO: 92039 - DNA, 25 bp, Homo sapien
cgcgctgggacaagtgcaatgacaa

SEQ ID NO: 92040 - DNA, 25 bp, Homo sapien
ggcatgagttacacccgcgaccctt

SEQ ID NO: 92041 - DNA, 25 bp, Homo sapien
cagcagctcattggcgggcagcgcc

SEQ ID NO: 92042 - DNA, 25 bp, Homo sapien
ggcagcgccgctttcatcatttctc

SEQ ID NO: 92043 - DNA, 25 bp, Homo sapien
gccgctttcatcatttctcggaaaa

SEQ ID NO: 92044 - DNA, 25 bp, Homo sapien
acccgagtctccatcctcagggtgg

SEQ ID NO: 92045 - DNA, 25 bp, Homo sapien
tcatttctcggaaaagtcaatttca

SEQ ID NO: 92046 - DNA, 25 bp, Homo sapien
aacaagcagcggctcgtgagtccgc

SEQ ID NO: 92047 - DNA, 25 bp, Homo sapien
cacgtgcggctagaacgtccgagtc

SEQ ID NO: 92048 - DNA, 25 bp, Homo sapien
cgccgcagcagctcattggcgggca

SEQ ID NO: 92049 - DNA, 25 bp, Homo sapien
cgtccgtttcccagcttgccgctgc

SEQ ID NO: 92050 - DNA, 25 bp, Homo sapien
gagccgcgtctgcactgcttccgcg

SEQ ID NO: 92051 - DNA, 25 bp, Homo sapien
cacaatagcacccatccgctaggag

SEQ ID NO: 92052 - DNA, 25 bp, Homo sapien
tccgccttccagaccgggcaggtac

SEQ ID NO: 92053 - DNA, 25 bp, Homo sapien
cgggcgaggtggcaaaacaaacact

SEQ ID NO: 92054 - DNA, 25 bp, Homo sapien
ccaagtctctcgctccgcgggcttc

SEQ ID NO: 92055 - DNA, 25 bp, Homo sapien
caggtccctctccctaaatcaaaag

SEQ ID NO: 92056 - DNA, 25 bp, Homo sapien
taaatcaaaagccttaacccgctgc

SEQ ID NO: 92057 - DNA, 25 bp, Homo sapien
cgtatggctttgtgcaccgtctgca

SEQ ID NO: 92058 - DNA, 25 bp, Homo sapien
atcgccagttttccggcgccagaaa

SEQ ID NO: 92059 - DNA, 25 bp, Homo sapien
tctggttattacagcgcaacggagc

SEQ ID NO: 92060 - DNA, 25 bp, Homo sapien
aagcagttcaagctggtctccggcc

SEQ ID NO: 92061 - DNA, 25 bp, Homo sapien
agactcactactttggacggcactc

SEQ ID NO: 92062 - DNA, 25 bp, Homo sapien
tctggcaaaccgcaggcaatacgta

SEQ ID NO: 92063 - DNA, 25 bp, Homo sapien
ccagccggatttatgctccagttta

SEQ ID NO: 92064 - DNA, 25 bp, Homo sapien
gaccagcattctagagcgcgttttg

SEQ ID NO: 92065 - DNA, 25 bp, Homo sapien
ccactgactgcatggagaggtcgca

SEQ ID NO: 92066 - DNA, 25 bp, Homo sapien
accagctctggcattcgaaaatacc

SEQ ID NO: 92067 - DNA, 25 bp, Homo sapien
gcccataagcgtgttggtcggaaga

SEQ ID NO: 92068 - DNA, 25 bp, Homo sapien
agctccgaagcccataagcgtgttg

SEQ ID NO: 92069 - DNA, 25 bp, Homo sapien
cgcacgtactgtcggaagtcaacca

SEQ ID NO: 92070 - DNA, 25 bp, Homo sapien
ttggtcggaagagtacgcacgtact

SEQ ID NO: 92071 - DNA, 25 bp, Homo sapien
tgagtgctgcaaaagctccgaagcc

SEQ ID NO: 92072 - DNA, 25 bp, Homo sapien
tttgggtctcgtggcgtaccagaag

SEQ ID NO: 92073 - DNA, 25 bp, Homo sapien
cctggccggaagaccttttctgtct

SEQ ID NO: 92074 - DNA, 25 bp, Homo sapien
cgccggctctggatgctatttaagg

SEQ ID NO: 92075 - DNA, 25 bp, Homo sapien
cagactgcctcggatttcataatga

SEQ ID NO: 92076 - DNA, 25 bp, Homo sapien
cccgcgactcagacacaggaagctg

SEQ ID NO: 92077 - DNA, 25 bp, Homo sapien
tcagacacaggaagctgcggcagca

SEQ ID NO: 92078 - DNA, 25 bp, Homo sapien
gggtacattggaccgcctcagctca

SEQ ID NO: 92079 - DNA, 25 bp, Homo sapien
gcagaattctgctgcgagggccctg

SEQ ID NO: 92080 - DNA, 25 bp, Homo sapien
ggctcggccctgaagggcaacgtca

SEQ ID NO: 92081 - DNA, 25 bp, Homo sapien
catgtgcccatgcgtgttggtgcct

SEQ ID NO: 92082 - DNA, 25 bp, Homo sapien
acatgtgcccatgcgtgttggtgcc

SEQ ID NO: 92083 - DNA, 25 bp, Homo sapien
gtgcccatgcgtgttggtgcctgat

SEQ ID NO: 92084 - DNA, 25 bp, Homo sapien
atgcgtgttggcgcctggtatgtat

SEQ ID NO: 92085 - DNA, 25 bp, Homo sapien
ccatgcgtgttggcgcctggtatgt

SEQ ID NO: 92086 - DNA, 25 bp, Homo sapien
tgtgcccatgcgtgttggtgcctga

SEQ ID NO: 92087 - DNA, 25 bp, Homo sapien
catgcgtgttggtgcctgatgtgta

SEQ ID NO: 92088 - DNA, 25 bp, Homo sapien
atgcgtgttggtgcctgatgtgtat

SEQ ID NO: 92089 - DNA, 25 bp, Homo sapien
tgcctttccaaccactcttttttgc

SEQ ID NO: 92090 - DNA, 25 bp, Homo sapien
gcctaccggcgactaggatgctttc

SEQ ID NO: 92091 - DNA, 25 bp, Homo sapien
cacacccgagtttttatttcctgct

SEQ ID NO: 92092 - DNA, 25 bp, Homo sapien
tgctttcgctttcgctctcgctttc

SEQ ID NO: 92093 - DNA, 25 bp, Homo sapien
gcgcgagactcaagctgccacagtg

SEQ ID NO: 92094 - DNA, 25 bp, Homo sapien
aaccgggagaatagaagcaggcaag

SEQ ID NO: 92095 - DNA, 25 bp, Homo sapien
actcttttttgcacgccaacaggtg

SEQ ID NO: 92096 - DNA, 25 bp, Homo sapien
tcgctttccaatactcgggactggg

SEQ ID NO: 92097 - DNA, 25 bp, Homo sapien
cgtgattctgtcgtgccgctttcaa

SEQ ID NO: 92098 - DNA, 25 bp, Homo sapien
agcacagtggctgacacgaggtcga

SEQ ID NO: 92099 - DNA, 25 bp, Homo sapien
cagcacggccgtgttgctgatgcgc

SEQ ID NO: 92100 - DNA, 25 bp, Homo sapien
ggcccactgctcttgggcggcagca

SEQ ID NO: 92101 - DNA, 25 bp, Homo sapien
tggcctcacggctaagcacagtggc

SEQ ID NO: 92102 - DNA, 25 bp, Homo sapien
agcgcttgttctggcacagctgcga

SEQ ID NO: 92103 - DNA, 25 bp, Homo sapien
agagtctgtcctcccatggttgggc

SEQ ID NO: 92104 - DNA, 25 bp, Homo sapien
tgccgctttcaaaccgtagagcaca

SEQ ID NO: 92105 - DNA, 25 bp, Homo sapien
ggcggacgtactgactccctgttca

SEQ ID NO: 92106 - DNA, 25 bp, Homo sapien
tgtcccgccaagaaacggccaaatc

SEQ ID NO: 92107 - DNA, 25 bp, Homo sapien
cattaaaacactgcagccagagcgg

SEQ ID NO: 92108 - DNA, 25 bp, Homo sapien
ttcaaccactagagggcaccagcca

SEQ ID NO: 92109 - DNA, 25 bp, Homo sapien
agccaaccctcgatggatccaaatg

SEQ ID NO: 92110 - DNA, 25 bp, Homo sapien
tggatccaaatgtgcccacgtcgtg

SEQ ID NO: 92111 - DNA, 25 bp, Homo sapien
cagcctctccttagaagcggcagaa

SEQ ID NO: 92112 - DNA, 25 bp, Homo sapien
gcggcagaaccgcttcaaccactag

SEQ ID NO: 92113 - DNA, 25 bp, Homo sapien
acaccggcagtaagaggatcaacgc

SEQ ID NO: 92114 - DNA, 25 bp, Homo sapien
ctttgtgtgcgagtgaatatcctga

SEQ ID NO: 92115 - DNA, 25 bp, Homo sapien
ggttcgcgtttaatctctttgtgtg

SEQ ID NO: 92116 - DNA, 25 bp, Homo sapien
gtgtgcgcgctcctttttacccatt

SEQ ID NO: 92117 - DNA, 25 bp, Homo sapien
gccttgagccaagcgccgagaccaa

SEQ ID NO: 92118 - DNA, 25 bp, Homo sapien
tgcacgcgggtacttttagccctgg

SEQ ID NO: 92119 - DNA, 25 bp, Homo sapien
cgttccaggtttcgcaggtagtgct

SEQ ID NO: 92120 - DNA, 25 bp, Homo sapien
ccctatcctgaagcggagggcgttc

SEQ ID NO: 92121 - DNA, 25 bp, Homo sapien
cgggctttctcgttcctccagcaga

SEQ ID NO: 92122 - DNA, 25 bp, Homo sapien
ctgagtgttcccgagagctctacta

SEQ ID NO: 92123 - DNA, 25 bp, Homo sapien
agagcactgcactccgctgattttc

SEQ ID NO: 92124 - DNA, 25 bp, Homo sapien
agatcctcgagatgaccgttcagta

SEQ ID NO: 92125 - DNA, 25 bp, Homo sapien
ctccttttgcagagttccgggaagc

SEQ ID NO: 92126 - DNA, 25 bp, Homo sapien
gggacaggatcaaccgctgcttgaa

SEQ ID NO: 92127 - DNA, 25 bp, Homo sapien
gcgtgcctcgccagtctctaagact

SEQ ID NO: 92128 - DNA, 25 bp, Homo sapien
tggccttggcgaagcaggtaacgtt

SEQ ID NO: 92129 - DNA, 25 bp, Homo sapien
gtctcctggactgcggcgacgaagc

SEQ ID NO: 92130 - DNA, 25 bp, Homo sapien
ctccagtcgcctggggatgcgctgc

SEQ ID NO: 92131 - DNA, 25 bp, Homo sapien
cccttgcggagattcggcctggaaa

SEQ ID NO: 92132 - DNA, 25 bp, Homo sapien
agattcggcctggaaagctccgcgg

SEQ ID NO: 92133 - DNA, 25 bp, Homo sapien
tcctagttcagagcgctggtggcgt

SEQ ID NO: 92134 - DNA, 25 bp, Homo sapien
ccctttactgttcccggaggagctg

SEQ ID NO: 92135 - DNA, 25 bp, Homo sapien
ttctcctgcggtctcctggactgcg

SEQ ID NO: 92136 - DNA, 25 bp, Homo sapien
gtggcgttacccacagccgcggaat

SEQ ID NO: 92137 - DNA, 25 bp, Homo sapien
gtgctataaatacgcggcccacatg

SEQ ID NO: 92138 - DNA, 25 bp, Homo sapien
tgccctttaaacgtcccaagttgca

SEQ ID NO: 92139 - DNA, 25 bp, Homo sapien
gctgagagcgtcgagctgtcaccat

SEQ ID NO: 92140 - DNA, 25 bp, Homo sapien
caggccggagggtcaagaactctcc

SEQ ID NO: 92141 - DNA, 25 bp, Homo sapien
ttggagcttcctaaaggacttcctg

SEQ ID NO: 92142 - DNA, 25 bp, Homo sapien
cctaaggctgcctgtgctataaata

SEQ ID NO: 92143 - DNA, 25 bp, Homo sapien
catgggtgatcacgcttggagcttc

SEQ ID NO: 92144 - DNA, 25 bp, Homo sapien
ccacatgccgcggtgacacggtgtt

SEQ ID NO: 92145 - DNA, 25 bp, Homo sapien
caagtaggaagaagtcgtcagggcc

SEQ ID NO: 92146 - DNA, 25 bp, Homo sapien
gcgggacccgccattctcacagggg

SEQ ID NO: 92147 - DNA, 25 bp, Homo sapien
gtccgcgcaggcttcgttaaaccca

SEQ ID NO: 92148 - DNA, 25 bp, Homo sapien
gcacactagaagagccgcggaagaa

SEQ ID NO: 92149 - DNA, 25 bp, Homo sapien
tgccatggcgccctagaggcgttac

SEQ ID NO: 92150 - DNA, 25 bp, Homo sapien
agaggcgttactgctgctcccggct

SEQ ID NO: 92151 - DNA, 25 bp, Homo sapien
tagggctgatcctgaccctcaaagc

SEQ ID NO: 92152 - DNA, 25 bp, Homo sapien
ggtcgcggcccaatctcaatttagg

SEQ ID NO: 92153 - DNA, 25 bp, Homo sapien
ccagaccttcggtgtcgcttgccgt

SEQ ID NO: 92154 - DNA, 25 bp, Homo sapien
tcctcagtcacaaccctaagggtgt

SEQ ID NO: 92155 - DNA, 25 bp, Homo sapien
gctctgtagtcactcgacaaccatc

SEQ ID NO: 92156 - DNA, 25 bp, Homo sapien
tactgggctctgtagtcactcgaca

SEQ ID NO: 92157 - DNA, 25 bp, Homo sapien
gatgcgcgttatttactgggctctg

SEQ ID NO: 92158 - DNA, 25 bp, Homo sapien
aggagatgcgcgttatttactgggc

SEQ ID NO: 92159 - DNA, 25 bp, Homo sapien
cggcatgcccttgtcgaagcgggaa

SEQ ID NO: 92160 - DNA, 25 bp, Homo sapien
atgcccttgtcgaagcgggaagccg

SEQ ID NO: 92161 - DNA, 25 bp, Homo sapien
cgcgtggctcccagtttcctggtta

SEQ ID NO: 92162 - DNA, 25 bp, Homo sapien
agagcccgagcttttgtcctgcagg

SEQ ID NO: 92163 - DNA, 25 bp, Homo sapien
gcaggctcaagcttctagattcgtc

SEQ ID NO: 92164 - DNA, 25 bp, Homo sapien
agcctgcgcattcttacctgtcggg

SEQ ID NO: 92165 - DNA, 25 bp, Homo sapien
ggctccacgtgccagtgtttgtgta

SEQ ID NO: 92166 - DNA, 25 bp, Homo sapien
cgtgtcaaactcagcgcgcctcatg

SEQ ID NO: 92167 - DNA, 25 bp, Homo sapien
gcgcactaccgggagacgtgtcaaa

SEQ ID NO: 92168 - DNA, 25 bp, Homo sapien
ggactcttgtcatctgccttaggcg

SEQ ID NO: 92169 - DNA, 25 bp, Homo sapien
ctgacgcctgcccaaaagttccggg

SEQ ID NO: 92170 - DNA, 25 bp, Homo sapien
agagatactcaccatgtccgcgacg

SEQ ID NO: 92171 - DNA, 25 bp, Homo sapien
gctcccgcagcgcagttaacgtgga

SEQ ID NO: 92172 - DNA, 25 bp, Homo sapien
ccttctgtgtgttcttcgatgcgga

SEQ ID NO: 92173 - DNA, 25 bp, Homo sapien
cacagcgtgcttggaatggattctc

SEQ ID NO: 92174 - DNA, 25 bp, Homo sapien
cccggggcaacacatcacacaataa

SEQ ID NO: 92175 - DNA, 25 bp, Homo sapien
ttaacgtggacaagctggggcaacc

SEQ ID NO: 92176 - DNA, 25 bp, Homo sapien
tgcacacttgtgtagggcactttcc

SEQ ID NO: 92177 - DNA, 25 bp, Homo sapien
cggtgagccaccacatcgaggcggt

SEQ ID NO: 92178 - DNA, 25 bp, Homo sapien
aatgcgtgtctccagttcgcgctgc

SEQ ID NO: 92179 - DNA, 25 bp, Homo sapien
tcgcgctgcggacactgatcatgct

SEQ ID NO: 92180 - DNA, 25 bp, Homo sapien
atggcgggtcgcttctctgcatcaa

SEQ ID NO: 92181 - DNA, 25 bp, Homo sapien
tgcatcaaggaaccagggaaacaca

SEQ ID NO: 92182 - DNA, 25 bp, Homo sapien
accagagcgtgccattccgagcgcg

SEQ ID NO: 92183 - DNA, 25 bp, Homo sapien
cccgccgagtggcttttgcaaggcg

SEQ ID NO: 92184 - DNA, 25 bp, Homo sapien
gccgggcatttgcatgaagcgactc

SEQ ID NO: 92185 - DNA, 25 bp, Homo sapien
ggagccgcctgctgaatgcccttct

SEQ ID NO: 92186 - DNA, 25 bp, Homo sapien
agcctgtaagccacagcggacgcag

SEQ ID NO: 92187 - DNA, 25 bp, Homo sapien
gtccaactcttacccgggctcatcg

SEQ ID NO: 92188 - DNA, 25 bp, Homo sapien
gccgcggctcatctctctcgcaacc

SEQ ID NO: 92189 - DNA, 25 bp, Homo sapien
cgcagggcatcctgtcgccaggtaa

SEQ ID NO: 92190 - DNA, 25 bp, Homo sapien
gtccgggacgggcttgctcacactc

SEQ ID NO: 92191 - DNA, 25 bp, Homo sapien
gctcacactcggactcgctgcggta

SEQ ID NO: 92192 - DNA, 25 bp, Homo sapien
ggcagaccacgtagccagcctgtaa

SEQ ID NO: 92193 - DNA, 25 bp, Homo sapien
agcacctgctgcgttgcggctacta

SEQ ID NO: 92194 - DNA, 25 bp, Homo sapien
acgagagcgccaagctgtgcaagcg

SEQ ID NO: 92195 - DNA, 25 bp, Homo sapien
agcgccggatcgagcacctcaaaga

SEQ ID NO: 92196 - DNA, 25 bp, Homo sapien
tcaaagagcatagcagcgaccagcc

SEQ ID NO: 92197 - DNA, 25 bp, Homo sapien
gatcgcatgatggtggagcacctgc

SEQ ID NO: 92198 - DNA, 25 bp, Homo sapien
ttgcggctactacaacacggctgtc

SEQ ID NO: 92199 - DNA, 25 bp, Homo sapien
acaacacggctgtcaagctggcgcg

SEQ ID NO: 92200 - DNA, 25 bp, Homo sapien
aagaggaagcgcatggatcgcatga

SEQ ID NO: 92201 - DNA, 25 bp, Homo sapien
cacccgggacccatcatttgttacg

SEQ ID NO: 92202 - DNA, 25 bp, Homo sapien
gctctcctcggaaagtcgctgcgga

SEQ ID NO: 92203 - DNA, 25 bp, Homo sapien
acagcgcgctgctgaacttttcatc

SEQ ID NO: 92204 - DNA, 25 bp, Homo sapien
tgggacacctttagagcggactttg

SEQ ID NO: 92205 - DNA, 25 bp, Homo sapien
ctccaactttggaagcgagagccgc

SEQ ID NO: 92206 - DNA, 25 bp, Homo sapien
ggactttgtcaaatctctgagccgc

SEQ ID NO: 92207 - DNA, 25 bp, Homo sapien
agaatgccgacacctaccctggtga

SEQ ID NO: 92208 - DNA, 25 bp, Homo sapien
tccggacgagaaaaacgctcagatg

SEQ ID NO: 92209 - DNA, 25 bp, Homo sapien
gggaagctatcgcagtcgtcgttta

SEQ ID NO: 92210 - DNA, 25 bp, Homo sapien
ggctgctcatcgctggtgacttcaa

SEQ ID NO: 92211 - DNA, 25 bp, Homo sapien
tggagtcctcctcacataacaggga

SEQ ID NO: 92212 - DNA, 25 bp, Homo sapien
tcctggtcgctgtcggaaaactcca

SEQ ID NO: 92213 - DNA, 25 bp, Homo sapien
cgctctcgtactgcagaatcctgga

SEQ ID NO: 92214 - DNA, 25 bp, Homo sapien
cagatttctgcgttttgccgggcca

SEQ ID NO: 92215 - DNA, 25 bp, Homo sapien
tcgtcgtttaggagatcgtcacagc

SEQ ID NO: 92216 - DNA, 25 bp, Homo sapien
agggagcccatgctttccgacttga

SEQ ID NO: 92217 - DNA, 25 bp, Homo sapien
gaggggtgcagaaactggttcatta

SEQ ID NO: 92218 - DNA, 25 bp, Homo sapien
acttctccgagtcgggagctagaaa

SEQ ID NO: 92219 - DNA, 25 bp, Homo sapien
tcccttggaacaggtgtcggagttg

SEQ ID NO: 92220 - DNA, 25 bp, Homo sapien
ctctgggcggaaccgcgaggacacc

SEQ ID NO: 92221 - DNA, 25 bp, Homo sapien
gaaccgcgaggacaccctggcagcg

SEQ ID NO: 92222 - DNA, 25 bp, Homo sapien
ggacccagacgcctcgggagcgatc

SEQ ID NO: 92223 - DNA, 25 bp, Homo sapien
gaggggctaccagtgacttctccga

SEQ ID NO: 92224 - DNA, 25 bp, Homo sapien
cggccaggttcccttggaacaggtg

SEQ ID NO: 92225 - DNA, 25 bp, Homo sapien
gaaccctgttccttacgctgcctga

SEQ ID NO: 92226 - DNA, 25 bp, Homo sapien
gccgggtgtgttgaacgtagcaacc

SEQ ID NO: 92227 - DNA, 25 bp, Homo sapien
tgtccactgtcgaggcatgaaggct

SEQ ID NO: 92228 - DNA, 25 bp, Homo sapien
catgaaggctgctgtgctggacctt

SEQ ID NO: 92229 - DNA, 25 bp, Homo sapien
tcttggccaaactcttcgagacctc

SEQ ID NO: 92230 - DNA, 25 bp, Homo sapien
ggaccctgctctcttggcccagtag

SEQ ID NO: 92231 - DNA, 25 bp, Homo sapien
ccagtagccctagagcgggtaaagc

SEQ ID NO: 92232 - DNA, 25 bp, Homo sapien
acctggggcccaattagcctggagc

SEQ ID NO: 92233 - DNA, 25 bp, Homo sapien
atcgggtgagtctcatccggcagca

SEQ ID NO: 92234 - DNA, 25 bp, Homo sapien
agcagggctcgccttctggccgctc

SEQ ID NO: 92235 - DNA, 25 bp, Homo sapien
atgtgcgcggtgttctccgcccgcg

SEQ ID NO: 92236 - DNA, 25 bp, Homo sapien
gcaggcactcgggaagcgtcaggcc

SEQ ID NO: 92237 - DNA, 25 bp, Homo sapien
tcacgcggggaagcgttcgccgcca

SEQ ID NO: 92238 - DNA, 25 bp, Homo sapien
agcgttcgccgccaaagggactcct

SEQ ID NO: 92239 - DNA, 25 bp, Homo sapien
aagggactccttcgtcactgcggtc

SEQ ID NO: 92240 - DNA, 25 bp, Homo sapien
gctgatcgtaatcgggtgagtctca

SEQ ID NO: 92241 - DNA, 25 bp, Homo sapien
tgcctggtgcgtattttggaaaata

SEQ ID NO: 92242 - DNA, 25 bp, Homo sapien
gcgccagtctggtcctgagcctgct

SEQ ID NO: 92243 - DNA, 25 bp, Homo sapien
agtgcaatcactacgccctggggcc

SEQ ID NO: 92244 - DNA, 25 bp, Homo sapien
ggaatcccgcacgtagagcaacctc

SEQ ID NO: 92245 - DNA, 25 bp, Homo sapien
gggtagctgacttccctaacgtgtc

SEQ ID NO: 92246 - DNA, 25 bp, Homo sapien
taaccacctcattgagctcccagtg

SEQ ID NO: 92247 - DNA, 25 bp, Homo sapien
tacctggctcataaccacctcattg

SEQ ID NO: 92248 - DNA, 25 bp, Homo sapien
caggtcttggctcttctgcgagtac

SEQ ID NO: 92249 - DNA, 25 bp, Homo sapien
gtgtctcataaacgggtcagctggt

SEQ ID NO: 92250 - DNA, 25 bp, Homo sapien
cggcgatggtcacgctcactccaag

SEQ ID NO: 92251 - DNA, 25 bp, Homo sapien
cccaggttctgtgcagctgaagctt

SEQ ID NO: 92252 - DNA, 25 bp, Homo sapien
gctgaagcttgtaccattttgtgac

SEQ ID NO: 92253 - DNA, 25 bp, Homo sapien
gcctcctagggacaaacttcggtca

SEQ ID NO: 92254 - DNA, 25 bp, Homo sapien
tcggtcagcatttgaatcagccctg

SEQ ID NO: 92255 - DNA, 25 bp, Homo sapien
ggtgttcgctgccagccaaacctaa

SEQ ID NO: 92256 - DNA, 25 bp, Homo sapien
tcagccctgactcggtgacagtgtc

SEQ ID NO: 92257 - DNA, 25 bp, Homo sapien
ggccagtacacagcatccactcggg

SEQ ID NO: 92258 - DNA, 25 bp, Homo sapien
tccactcaggagtgacgcgcatgtg

SEQ ID NO: 92259 - DNA, 25 bp, Homo sapien
gggccagtacacagcatccactcag

SEQ ID NO: 92260 - DNA, 25 bp, Homo sapien
tggccagtacacagcatccactcgg

SEQ ID NO: 92261 - DNA, 25 bp, Homo sapien
actgacgcgcgtggtgaataacaca

SEQ ID NO: 92262 - DNA, 25 bp, Homo sapien
agtacacagcatccactcgggagtg

SEQ ID NO: 92263 - DNA, 25 bp, Homo sapien
gccagtacacagcatccactcggga

SEQ ID NO: 92264 - DNA, 25 bp, Homo sapien
ggccagtacacagcatccactcagg

SEQ ID NO: 92265 - DNA, 25 bp, Homo sapien
ccaaagtcatcctttattccgagta

SEQ ID NO: 92266 - DNA, 25 bp, Homo sapien
atcacgtgcggtttcttaatgtccc

SEQ ID NO: 92267 - DNA, 25 bp, Homo sapien
ttaatgtccctggtggcggatacgc

SEQ ID NO: 92268 - DNA, 25 bp, Homo sapien
cggatacgccgagtcctcggaagga

SEQ ID NO: 92269 - DNA, 25 bp, Homo sapien
ttgcaggggcgacatccgccaaagt

SEQ ID NO: 92270 - DNA, 25 bp, Homo sapien
caggaatgcagtaaacgtccacgtc

SEQ ID NO: 92271 - DNA, 25 bp, Homo sapien
ttagagcatagcgacatcacgtgcg

SEQ ID NO: 92272 - DNA, 25 bp, Homo sapien
tcggaaggacatctggacaccactt

SEQ ID NO: 92273 - DNA, 25 bp, Homo sapien
acatgcgcggaagcaacaggccgga

SEQ ID NO: 92274 - DNA, 25 bp, Homo sapien
tctcgctacagtcgggtaagggaag

SEQ ID NO: 92275 - DNA, 25 bp, Homo sapien
acgccgcggcattggcgaatgcctc

SEQ ID NO: 92276 - DNA, 25 bp, Homo sapien
ggaggttctcgctacagtcgggtaa

SEQ ID NO: 92277 - DNA, 25 bp, Homo sapien
tggcgaatgcctctgctacacacta

SEQ ID NO: 92278 - DNA, 25 bp, Homo sapien
ctctgctacacactacatgcgcgga

SEQ ID NO: 92279 - DNA, 25 bp, Homo sapien
cttcggaatgcatggcagggaagcc

SEQ ID NO: 92280 - DNA, 25 bp, Homo sapien
ggaagccgctccctttgtctgcgga

SEQ ID NO: 92281 - DNA, 25 bp, Homo sapien
gtaaccatcatacttcctaacgccg

SEQ ID NO: 92282 - DNA, 25 bp, Homo sapien
ttcctaacgccgcacacacggcatt

SEQ ID NO: 92283 - DNA, 25 bp, Homo sapien
gcacacacggcattacccacccata

SEQ ID NO: 92284 - DNA, 25 bp, Homo sapien
tcgtaaccatcatacttcctaacgc

SEQ ID NO: 92285 - DNA, 25 bp, Homo sapien
ccacacacggcattacccactcata

SEQ ID NO: 92286 - DNA, 25 bp, Homo sapien
ataaccatcatacttcctaacgccg

SEQ ID NO: 92287 - DNA, 25 bp, Homo sapien
ttacccactcgtaaccatcatactt

SEQ ID NO: 92288 - DNA, 25 bp, Homo sapien
actcataaccatcatacttcctaac

SEQ ID NO: 92289 - DNA, 25 bp, Homo sapien
ttgagaaggtaacacggcgaagccc

SEQ ID NO: 92290 - DNA, 25 bp, Homo sapien
cgccgttggaaggaacgtgaggcac

SEQ ID NO: 92291 - DNA, 25 bp, Homo sapien
gcaagctcgccatgttgagaaggta

SEQ ID NO: 92292 - DNA, 25 bp, Homo sapien
gctctactgaggaggtcggtgagca

SEQ ID NO: 92293 - DNA, 25 bp, Homo sapien
aaaggcgaaggcgacgtgacgtcca

SEQ ID NO: 92294 - DNA, 25 bp, Homo sapien
gacgtgacgtccagcaagctcgcca

SEQ ID NO: 92295 - DNA, 25 bp, Homo sapien
acgtccagcaagctcgccatgttga

SEQ ID NO: 92296 - DNA, 25 bp, Homo sapien
tgaggcacagttggaagcaggcaac

SEQ ID NO: 92297 - DNA, 25 bp, Homo sapien
acggtttagacggacatgtcacttc

SEQ ID NO: 92298 - DNA, 25 bp, Homo sapien
tcttggatgactgcggtcaatgttg

SEQ ID NO: 92299 - DNA, 25 bp, Homo sapien
atgtcacttccgtagaatccgcgtc

SEQ ID NO: 92300 - DNA, 25 bp, Homo sapien
gtcctgaaaccacacggaagatctt

SEQ ID NO: 92301 - DNA, 25 bp, Homo sapien
tgaagccctgagaatgtcctgaaac

SEQ ID NO: 92302 - DNA, 25 bp, Homo sapien
tatatcctgtttccggggtgaagcc

SEQ ID NO: 92303 - DNA, 25 bp, Homo sapien
ggtgcccacgcctatatcctgtttc

SEQ ID NO: 92304 - DNA, 25 bp, Homo sapien
agaatccgcgtctcatcttggatga

SEQ ID NO: 92305 - DNA, 25 bp, Homo sapien
cctgagcttcttgttccgatacacc

SEQ ID NO: 92306 - DNA, 25 bp, Homo sapien
gttgccctgcatggtccctgtgcgc

SEQ ID NO: 92307 - DNA, 25 bp, Homo sapien
aggttgcccaggatgtccaccacga

SEQ ID NO: 92308 - DNA, 25 bp, Homo sapien
cgacaggatgaccaggaggttgccc

SEQ ID NO: 92309 - DNA, 25 bp, Homo sapien
agaggcctctcctcgtgggcgcacg

SEQ ID NO: 92310 - DNA, 25 bp, Homo sapien
ttgttccgatacaccgacaggatga

SEQ ID NO: 92311 - DNA, 25 bp, Homo sapien
gacgccacggccaggtgacacctgg

SEQ ID NO: 92312 - DNA, 25 bp, Homo sapien
ccacgatggtgaagatgaggacgca

SEQ ID NO: 92313 - DNA, 25 bp, Homo sapien
gaagttgcacttcgtcgccacagga

SEQ ID NO: 92314 - DNA, 25 bp, Homo sapien
gaatcccgattttccaggctccctg

SEQ ID NO: 92315 - DNA, 25 bp, Homo sapien
tgccgcttgccgaattgtaaatctc

SEQ ID NO: 92316 - DNA, 25 bp, Homo sapien
cggccataattgctccaagtgctta

SEQ ID NO: 92317 - DNA, 25 bp, Homo sapien
ctgcccaccagttggaatacacata

SEQ ID NO: 92318 - DNA, 25 bp, Homo sapien
tgtgccgattcgtagccctatattc

SEQ ID NO: 92319 - DNA, 25 bp, Homo sapien
ttttacatctgtctgggaatcccga

SEQ ID NO: 92320 - DNA, 25 bp, Homo sapien
cctcgaaagtgggtgacctgatctc

SEQ ID NO: 92321 - DNA, 25 bp, Homo sapien
gacctctccgtttggacaatcccga

SEQ ID NO: 92322 - DNA, 25 bp, Homo sapien
cgcgtctaaactaagccgaggcgca

SEQ ID NO: 92323 - DNA, 25 bp, Homo sapien
tctggcaggacagcgcgcgtctaaa

SEQ ID NO: 92324 - DNA, 25 bp, Homo sapien
gcacttcgctaaggggacctctccg

SEQ ID NO: 92325 - DNA, 25 bp, Homo sapien
cgcccggctctacgtgaggcgtttt

SEQ ID NO: 92326 - DNA, 25 bp, Homo sapien
ctcgttctcattcatgggcggcgct

SEQ ID NO: 92327 - DNA, 25 bp, Homo sapien
tccttaggggtcctccacagcatgc

SEQ ID NO: 92328 - DNA, 25 bp, Homo sapien
taagccgaggcgcacttcgctaagg

SEQ ID NO: 92329 - DNA, 25 bp, Homo sapien
cggacgccaccatttcacatgaaga

SEQ ID NO: 92330 - DNA, 25 bp, Homo sapien
ggacgccaccatttcacatggaaga

SEQ ID NO: 92331 - DNA, 25 bp, Homo sapien
cggaccgcaccatttcacatgaaga

SEQ ID NO: 92332 - DNA, 25 bp, Homo sapien
tttcacatggaagaggcaggcgaca

SEQ ID NO: 92333 - DNA, 25 bp, Homo sapien
aggaggaacccttgacgccactatt

SEQ ID NO: 92334 - DNA, 25 bp, Homo sapien
gaggaaccctggacgccaccatttc

SEQ ID NO: 92335 - DNA, 25 bp, Homo sapien
gggcgccaccatttcacatggaaga

SEQ ID NO: 92336 - DNA, 25 bp, Homo sapien
tggacgccaccatttcacatgaaga

SEQ ID NO: 92337 - DNA, 25 bp, Homo sapien
cggacgccaccatttcacatgaaga

SEQ ID NO: 92338 - DNA, 25 bp, Homo sapien
ggacgccaccatttcacatggaaga

SEQ ID NO: 92339 - DNA, 25 bp, Homo sapien
gaggaaccctggacgccaccatttc

SEQ ID NO: 92340 - DNA, 25 bp, Homo sapien
cggaccgcaccatttcacatgaaga

SEQ ID NO: 92341 - DNA, 25 bp, Homo sapien
tggacgccaccatttcacatgaaga

SEQ ID NO: 92342 - DNA, 25 bp, Homo sapien
ggacgccactatttcacatgaagag

SEQ ID NO: 92343 - DNA, 25 bp, Homo sapien
ccggacgccaccatttcacatgaag

SEQ ID NO: 92344 - DNA, 25 bp, Homo sapien
tttcacatggaagaggcaggcgaca

SEQ ID NO: 92345 - DNA, 25 bp, Homo sapien
tggacgccaccatttcacatgaaga

SEQ ID NO: 92346 - DNA, 25 bp, Homo sapien
cggacgccaccatttcacatgaaga

SEQ ID NO: 92347 - DNA, 25 bp, Homo sapien
tgacgccactatttcacatggaaga

SEQ ID NO: 92348 - DNA, 25 bp, Homo sapien
tttcacatggaagaggcaggcgaca

SEQ ID NO: 92349 - DNA, 25 bp, Homo sapien
gaggaaccctggacgccactatttc

SEQ ID NO: 92350 - DNA, 25 bp, Homo sapien
ggacgccaccatttcacatggaaga

SEQ ID NO: 92351 - DNA, 25 bp, Homo sapien
ctggacgccaccatttcacatgaag

SEQ ID NO: 92352 - DNA, 25 bp, Homo sapien
tggacgccaccatttcacatggaag

SEQ ID NO: 92353 - DNA, 25 bp, Homo sapien
tccttcgtggggagcttccttcgtg

SEQ ID NO: 92354 - DNA, 25 bp, Homo sapien
gttctcaaggctgtcctggagcttc

SEQ ID NO: 92355 - DNA, 25 bp, Homo sapien
tgggaattccttcgtcgttctcaag

SEQ ID NO: 92356 - DNA, 25 bp, Homo sapien
tcaaggcttcctgggaattccttcg

SEQ ID NO: 92357 - DNA, 25 bp, Homo sapien
gagctctagaacttccttcgtggta

SEQ ID NO: 92358 - DNA, 25 bp, Homo sapien
accagacttttcttagagctctaga

SEQ ID NO: 92359 - DNA, 25 bp, Homo sapien
gtcaaacacatgaaaaccagacttt

SEQ ID NO: 92360 - DNA, 25 bp, Homo sapien
cttcatggggagcttccttcgtggt

SEQ ID NO: 92361 - DNA, 25 bp, Homo sapien
atacaatgtatatattagctcctgc

SEQ ID NO: 92362 - DNA, 25 bp, Homo sapien
atatattagctcctgcatacgcggg

SEQ ID NO: 92363 - DNA, 25 bp, Homo sapien
ggccgttctctgttcttgcacttgg

SEQ ID NO: 92364 - DNA, 25 bp, Homo sapien
ccggccgttctctgttcttgcactt

SEQ ID NO: 92365 - DNA, 25 bp, Homo sapien
catacgcggggaaaagtgagggaag

SEQ ID NO: 92366 - DNA, 25 bp, Homo sapien
ttagctcctgcatacgcggggaaaa

SEQ ID NO: 92367 - DNA, 25 bp, Homo sapien
gttcttgcacttggccgcgcacgga

SEQ ID NO: 92368 - DNA, 25 bp, Homo sapien
agctcctgcatacgcggggaaaagt

SEQ ID NO: 92369 - DNA, 25 bp, Homo sapien
accacgccttggtgtcctcacgttc

SEQ ID NO: 92370 - DNA, 25 bp, Homo sapien
gaagttcatgctcccagcggccttc

SEQ ID NO: 92371 - DNA, 25 bp, Homo sapien
ggccttacctgctcagaagttcatg

SEQ ID NO: 92372 - DNA, 25 bp, Homo sapien
gtgtcctcacgttcccgcacctctc

SEQ ID NO: 92373 - DNA, 25 bp, Homo sapien
ccgcacctctcagaagcgcttcctc

SEQ ID NO: 92374 - DNA, 25 bp, Homo sapien
acggcggccttacctgctcagaagt

SEQ ID NO: 92375 - DNA, 25 bp, Homo sapien
ccctctctccctcaccacgccttgg

SEQ ID NO: 92376 - DNA, 25 bp, Homo sapien
ctcagaagttcatgctcccagcggc

SEQ ID NO: 92377 - DNA, 25 bp, Homo sapien
acaccgggacgaacgcggcgtcgca

SEQ ID NO: 92378 - DNA, 25 bp, Homo sapien
gctctcgggtgactccgcaacctgt

SEQ ID NO: 92379 - DNA, 25 bp, Homo sapien
gtgactccgcaacctgtcgctcagg

SEQ ID NO: 92380 - DNA, 25 bp, Homo sapien
ccgaggcgcgaacagacggacgcac

SEQ ID NO: 92381 - DNA, 25 bp, Homo sapien
aacagacggacgcaccggcgagcgc

SEQ ID NO: 92382 - DNA, 25 bp, Homo sapien
tcagtttacccggtggcgatgggac

SEQ ID NO: 92383 - DNA, 25 bp, Homo sapien
acgcggggcttctggttcaggacac

SEQ ID NO: 92384 - DNA, 25 bp, Homo sapien
gcagctaggccctgcccaaggaaga

SEQ ID NO: 92385 - DNA, 25 bp, Homo sapien
gctggcttcgaaccgtcctggcttc

SEQ ID NO: 92386 - DNA, 25 bp, Homo sapien
actcgcctgaggttgaccctggtaa

SEQ ID NO: 92387 - DNA, 25 bp, Homo sapien
tgaccctggtaagcggttgccgcct

SEQ ID NO: 92388 - DNA, 25 bp, Homo sapien
ttgccgcctgcagacacggcgcatg

SEQ ID NO: 92389 - DNA, 25 bp, Homo sapien
tgcgagcgttgaggaaacggaaatc

SEQ ID NO: 92390 - DNA, 25 bp, Homo sapien
ggaaatccagcgcacacgtgaaaac

SEQ ID NO: 92391 - DNA, 25 bp, Homo sapien
tcgaaccgtggctgccatgtgcctc

SEQ ID NO: 92392 - DNA, 25 bp, Homo sapien
cgctgctctactcgcctgaggttga

SEQ ID NO: 92393 - DNA, 25 bp, Homo sapien
ctgatgggtggctgtagcctgatta

SEQ ID NO: 92394 - DNA, 25 bp, Homo sapien
agcctgattagaccgcgtcagtccg

SEQ ID NO: 92395 - DNA, 25 bp, Homo sapien
gtagcctgattagaccgcgtcagtc

SEQ ID NO: 92396 - DNA, 25 bp, Homo sapien
tgggtggctgtagcctgattagacc

SEQ ID NO: 92397 - DNA, 25 bp, Homo sapien
ctccctaaccctggcggagctgatg

SEQ ID NO: 92398 - DNA, 25 bp, Homo sapien
ctccgggcagagagtgaacgcgcgg

SEQ ID NO: 92399 - DNA, 25 bp, Homo sapien
tgccacgtggcggatgcgcagtgcc

SEQ ID NO: 92400 - DNA, 25 bp, Homo sapien
ggctgtagcctgattagaccgcgtc

SEQ ID NO: 92401 - DNA, 25 bp, Homo sapien
cggaaccgcggttcagtcaccaaca

SEQ ID NO: 92402 - DNA, 25 bp, Homo sapien
ttcagtcaccaacatgcagttcttg

SEQ ID NO: 92403 - DNA, 25 bp, Homo sapien
ctcaggcagcgccactggagggctt

SEQ ID NO: 92404 - DNA, 25 bp, Homo sapien
cgactgcccgggaggccaagtccgt

SEQ ID NO: 92405 - DNA, 25 bp, Homo sapien
ctgggaaagtgacaggtcagactct

SEQ ID NO: 92406 - DNA, 25 bp, Homo sapien
gtcagactcttgctaaggtggccaa

SEQ ID NO: 92407 - DNA, 25 bp, Homo sapien
ctaaggtggccaagcgagaagacag

SEQ ID NO: 92408 - DNA, 25 bp, Homo sapien
ggtgcggtaccaccggcgctttgtc

SEQ ID NO: 92409 - DNA, 25 bp, Homo sapien
ggtcaggcctcgtcttcacgcacga

SEQ ID NO: 92410 - DNA, 25 bp, Homo sapien
gctcctgatgctgacctgggcgcat

SEQ ID NO: 92411 - DNA, 25 bp, Homo sapien
cgagtgttccacagaaggcccattt

SEQ ID NO: 92412 - DNA, 25 bp, Homo sapien
aggcctgcaacgaggtcccttctgt

SEQ ID NO: 92413 - DNA, 25 bp, Homo sapien
cccttctgtgcctgagagggctaaa

SEQ ID NO: 92414 - DNA, 25 bp, Homo sapien
gagtcagcctccgtctccttgaggg

SEQ ID NO: 92415 - DNA, 25 bp, Homo sapien
gcgactccatatccacctgcagtgg

SEQ ID NO: 92416 - DNA, 25 bp, Homo sapien
cggcaagtccctgcccttgcgtgga

SEQ ID NO: 92417 - DNA, 25 bp, Homo sapien
atggactcacgggttcacctccttc

SEQ ID NO: 92418 - DNA, 25 bp, Homo sapien
acctccttccggtctgaacagtgaa

SEQ ID NO: 92419 - DNA, 25 bp, Homo sapien
cacctccttccggtctgaacagtga

SEQ ID NO: 92420 - DNA, 25 bp, Homo sapien
tccttccggtctgaacagtgaactc

SEQ ID NO: 92421 - DNA, 25 bp, Homo sapien
tccggtctgaacagtgaactcctcc

SEQ ID NO: 92422 - DNA, 25 bp, Homo sapien
ttccggtctgaacagtgaactcctc

SEQ ID NO: 92423 - DNA, 25 bp, Homo sapien
tccggtctaaacagtgaacgcctcc

SEQ ID NO: 92424 - DNA, 25 bp, Homo sapien
tcctccgcatggactcacgggttca

SEQ ID NO: 92425 - DNA, 25 bp, Homo sapien
ccctttgctcgcagtgggtcttgta

SEQ ID NO: 92426 - DNA, 25 bp, Homo sapien
gccagctccttgtttgcagacactc

SEQ ID NO: 92427 - DNA, 25 bp, Homo sapien
agacactcctctgcgagtctgacga

SEQ ID NO: 92428 - DNA, 25 bp, Homo sapien
attgtgcccttgcttaatcctcgga

SEQ ID NO: 92429 - DNA, 25 bp, Homo sapien
agggacttgcttctcgttggctcag

SEQ ID NO: 92430 - DNA, 25 bp, Homo sapien
cctgggacatcggtctctgcttcac

SEQ ID NO: 92431 - DNA, 25 bp, Homo sapien
cgcggcatgcaaagtcgagccttct

SEQ ID NO: 92432 - DNA, 25 bp, Homo sapien
ctcccgctcagtgattaaacaggtg

SEQ ID NO: 92433 - DNA, 25 bp, Homo sapien
aatgctacctgtactccacgttcct

SEQ ID NO: 92434 - DNA, 25 bp, Homo sapien
tgctaattctactccacgttcctgc

SEQ ID NO: 92435 - DNA, 25 bp, Homo sapien
atgcccaagtgctaattctactcca

SEQ ID NO: 92436 - DNA, 25 bp, Homo sapien
tactccacgttcctgcaccggttga

SEQ ID NO: 92437 - DNA, 25 bp, Homo sapien
gcgatgcccgaatgctacttctact

SEQ ID NO: 92438 - DNA, 25 bp, Homo sapien
gaatgctacctgtactccacgttcc

SEQ ID NO: 92439 - DNA, 25 bp, Homo sapien
gatgcccaagtgctaattctactcc

SEQ ID NO: 92440 - DNA, 25 bp, Homo sapien
tactccacgttcctacaccggttga

SEQ ID NO: 92441 - DNA, 25 bp, Homo sapien
tggccagctccttaggcgtgtccgt

SEQ ID NO: 92442 - DNA, 25 bp, Homo sapien
agcttcctgcaggttcgcgccagct

SEQ ID NO: 92443 - DNA, 25 bp, Homo sapien
cgcgatctgccgtctgagttcaatg

SEQ ID NO: 92444 - DNA, 25 bp, Homo sapien
agttcaatgcgactccggaaggacg

SEQ ID NO: 92445 - DNA, 25 bp, Homo sapien
cccatgacagcagacgcgggtgacg

SEQ ID NO: 92446 - DNA, 25 bp, Homo sapien
tgctcatggttcaatcgggaaatta

SEQ ID NO: 92447 - DNA, 25 bp, Homo sapien
gagcaccctggctttatctggttta

SEQ ID NO: 92448 - DNA, 25 bp, Homo sapien
tgacactcagggcaaagcggctcca

SEQ ID NO: 92449 - DNA, 25 bp, Homo sapien
aggtactctaatgcgggcccacagg

SEQ ID NO: 92450 - DNA, 25 bp, Homo sapien
caggtgctctaatgcgggcccacag

SEQ ID NO: 92451 - DNA, 25 bp, Homo sapien
gcaggtactctaatgcgggcccaca

SEQ ID NO: 92452 - DNA, 25 bp, Homo sapien
gtgctctaatgagggcccacaggtc

SEQ ID NO: 92453 - DNA, 25 bp, Homo sapien
gcaggtgctctaatgagggcccaca

SEQ ID NO: 92454 - DNA, 25 bp, Homo sapien
tggcaggtactctaatgcgggccca

SEQ ID NO: 92455 - DNA, 25 bp, Homo sapien
actggcaggtactctaatgcgggcc

SEQ ID NO: 92456 - DNA, 25 bp, Homo sapien
acggcggactggcaggtactctaat

SEQ ID NO: 92457 - DNA, 25 bp, Homo sapien
tagcccccgaaaccactgaggctgt

SEQ ID NO: 92458 - DNA, 25 bp, Homo sapien
agcccccgaaaccactgaggctgtg

SEQ ID NO: 92459 - DNA, 25 bp, Homo sapien
ctagcccccgaaaccactgaggctg

SEQ ID NO: 92460 - DNA, 25 bp, Homo sapien
tgaggctgtgcagggcggacgcacc

SEQ ID NO: 92461 - DNA, 25 bp, Homo sapien
gcccccgaaaccactgaggctgtgc

SEQ ID NO: 92462 - DNA, 25 bp, Homo sapien
cccgaaaccactgagcctgtgcagg

SEQ ID NO: 92463 - DNA, 25 bp, Homo sapien
cgaaaccactgagcctgtgcagggc

SEQ ID NO: 92464 - DNA, 25 bp, Homo sapien
cccgaaaccactgaggctgtgcagg

SEQ ID NO: 92465 - DNA, 25 bp, Homo sapien
tgaactgtctgcaccgcctacgcgt

SEQ ID NO: 92466 - DNA, 25 bp, Homo sapien
tcagttctgcaaaaccgcgcagggg

SEQ ID NO: 92467 - DNA, 25 bp, Homo sapien
agtggttaaagacatcaggctgccc

SEQ ID NO: 92468 - DNA, 25 bp, Homo sapien
ggtgcccacctcaaaaaagtagcgc

SEQ ID NO: 92469 - DNA, 25 bp, Homo sapien
ccgaggagacgccacttcgtgattc

SEQ ID NO: 92470 - DNA, 25 bp, Homo sapien
agccgcccacgaattgaactgtctg

SEQ ID NO: 92471 - DNA, 25 bp, Homo sapien
gtggcaaacgtgaatcctcagttct

SEQ ID NO: 92472 - DNA, 25 bp, Homo sapien
acgcgtgtcttagccctgaacccaa

SEQ ID NO: 92473 - DNA, 25 bp, Homo sapien
ccacgtcagtgtgcgtgaactcccg

SEQ ID NO: 92474 - DNA, 25 bp, Homo sapien
cagtgtgcgtgacctcccacgtcag

SEQ ID NO: 92475 - DNA, 25 bp, Homo sapien
gcggcagtgtgcgtgacctcccacg

SEQ ID NO: 92476 - DNA, 25 bp, Homo sapien
ctcccacgtcagtgtgcgtgaactc

SEQ ID NO: 92477 - DNA, 25 bp, Homo sapien
gcagtgtgcgtgacctcccacgtca

SEQ ID NO: 92478 - DNA, 25 bp, Homo sapien
aacacaaacccggacaacagcggca

SEQ ID NO: 92479 - DNA, 25 bp, Homo sapien
acaacagcggcagtgtgcgcggcct

SEQ ID NO: 92480 - DNA, 25 bp, Homo sapien
aactcccgcggcagtgtgcgtgacc

SEQ ID NO: 92481 - DNA, 25 bp, Homo sapien
agcggggtgaacagatgctgacgaa

SEQ ID NO: 92482 - DNA, 25 bp, Homo sapien
gggtgaacagatgctgacgaaggca

SEQ ID NO: 92483 - DNA, 25 bp, Homo sapien
gggtgaacagatgctaaggaaggcc

SEQ ID NO: 92484 - DNA, 25 bp, Homo sapien
cagcggggtgaacagatgctgacga

SEQ ID NO: 92485 - DNA, 25 bp, Homo sapien
ggtgaacagatgctgacgaaggcag

SEQ ID NO: 92486 - DNA, 25 bp, Homo sapien
ggcggggtgaacagatgctgacgaa

SEQ ID NO: 92487 - DNA, 25 bp, Homo sapien
gcggggtgaacagatgctaaggaag

SEQ ID NO: 92488 - DNA, 25 bp, Homo sapien
ggcggggtgaacagatgctaaggaa

SEQ ID NO: 92489 - DNA, 25 bp, Homo sapien
tattcccgcggtgtttcgggctgag

SEQ ID NO: 92490 - DNA, 25 bp, Homo sapien
cgtattcccgcggtgtttcgggctg

SEQ ID NO: 92491 - DNA, 25 bp, Homo sapien
ttattcttccggtgtcccaggctga

SEQ ID NO: 92492 - DNA, 25 bp, Homo sapien
cgggcttattcttccggtgtcccag

SEQ ID NO: 92493 - DNA, 25 bp, Homo sapien
cggtgttcttccggtgttccgagct

SEQ ID NO: 92494 - DNA, 25 bp, Homo sapien
gctgggcgtgttcccgcggtgtccc

SEQ ID NO: 92495 - DNA, 25 bp, Homo sapien
attcccgcagtgttccaggctgagg

SEQ ID NO: 92496 - DNA, 25 bp, Homo sapien
cgtattcccgcagtgttccaggctg

SEQ ID NO: 92497 - DNA, 25 bp, Homo sapien
ctctcctattctccgtgccgtgtcc

SEQ ID NO: 92498 - DNA, 25 bp, Homo sapien
ctcggctctctcctattctccgtgc

SEQ ID NO: 92499 - DNA, 25 bp, Homo sapien
cctattctccgtgccgtgtccctcg

SEQ ID NO: 92500 - DNA, 25 bp, Homo sapien
ctctcccattctccgtgccgtgtcc

SEQ ID NO: 92501 - DNA, 25 bp, Homo sapien
attctccttgcgtgtccctcggctc

SEQ ID NO: 92502 - DNA, 25 bp, Homo sapien
cctcggctctctcctattctccgtg

SEQ ID NO: 92503 - DNA, 25 bp, Homo sapien
tctctcctattctctgtgccgtgtc

SEQ ID NO: 92504 - DNA, 25 bp, Homo sapien
ctcccattctccgtgccgtgtccct

SEQ ID NO: 92505 - DNA, 25 bp, Homo sapien
ctgatatgtcctcgacgcggtctga

SEQ ID NO: 92506 - DNA, 25 bp, Homo sapien
ctgcagcgaagtcggaaccacgtcc

SEQ ID NO: 92507 - DNA, 25 bp, Homo sapien
gtgcccggaaaccaaagacaacgca

SEQ ID NO: 92508 - DNA, 25 bp, Homo sapien
tcaaggcgcccatcctcttgatggc

SEQ ID NO: 92509 - DNA, 25 bp, Homo sapien
ttggcgaaacccgaggaggcccaca

SEQ ID NO: 92510 - DNA, 25 bp, Homo sapien
gccggtcagaagtagggagaatcac

SEQ ID NO: 92511 - DNA, 25 bp, Homo sapien
cgaggagcctctccgcaaagaaata

SEQ ID NO: 92512 - DNA, 25 bp, Homo sapien
ccgagcagggatgaacctggctcca

SEQ ID NO: 92513 - DNA, 25 bp, Homo sapien
ttgaggatcccaaactgccgcagcc

SEQ ID NO: 92514 - DNA, 25 bp, Homo sapien
ccctggagtggcattcttgttgccc

SEQ ID NO: 92515 - DNA, 25 bp, Homo sapien
agggctaatgcgatgtactgtaaga

SEQ ID NO: 92516 - DNA, 25 bp, Homo sapien
tgcattttacgcgacaggggactcg

SEQ ID NO: 92517 - DNA, 25 bp, Homo sapien
acgtttctggttggattgtgtctaa

SEQ ID NO: 92518 - DNA, 25 bp, Homo sapien
agcttccggatcgttccgccgttcg

SEQ ID NO: 92519 - DNA, 25 bp, Homo sapien
cttctctcggaagtgacggctgacc

SEQ ID NO: 92520 - DNA, 25 bp, Homo sapien
ccaaatcaaatgagcgaggcccgga

SEQ ID NO: 92521 - DNA, 25 bp, Homo sapien
gcacgatttctctagtcccgattga

SEQ ID NO: 92522 - DNA, 25 bp, Homo sapien
cccgccaccatgttgttgggagcaa

SEQ ID NO: 92523 - DNA, 25 bp, Homo sapien
ccggatctgtgtccacctctggata

SEQ ID NO: 92524 - DNA, 25 bp, Homo sapien
gggccattcgccattccagagcagg

SEQ ID NO: 92525 - DNA, 25 bp, Homo sapien
tgccttctctacacacgtgcgtggt

SEQ ID NO: 92526 - DNA, 25 bp, Homo sapien
cactccacagtatggggccctctga

SEQ ID NO: 92527 - DNA, 25 bp, Homo sapien
ggccttacaggtctgagctggctta

SEQ ID NO: 92528 - DNA, 25 bp, Homo sapien
tgtcagcaccatcccgttagcacga

SEQ ID NO: 92529 - DNA, 25 bp, Homo sapien
gccagtctgagtagcatcgccgttg

SEQ ID NO: 92530 - DNA, 25 bp, Homo sapien
cctggacctcaaaaggagaggctac

SEQ ID NO: 92531 - DNA, 25 bp, Homo sapien
caaaaggagaggctactgctgctgc

SEQ ID NO: 92532 - DNA, 25 bp, Homo sapien
tctgagtagcatcgccgttgggaag

SEQ ID NO: 92533 - DNA, 25 bp, Homo sapien
ctcgccagtctgagtagcatcgccg

SEQ ID NO: 92534 - DNA, 25 bp, Homo sapien
ttcctggactcgcagcgatgtgtcc

SEQ ID NO: 92535 - DNA, 25 bp, Homo sapien
acagtgcctggacctcaaaaggaga

SEQ ID NO: 92536 - DNA, 25 bp, Homo sapien
aaggccgaggcagtgccaccggcac

SEQ ID NO: 92537 - DNA, 25 bp, Homo sapien
tcacagatttgggtttggatcaggg

SEQ ID NO: 92538 - DNA, 25 bp, Homo sapien
accgggctggatcatggactgtgga

SEQ ID NO: 92539 - DNA, 25 bp, Homo sapien
ggttgatcacagatttgggtttgga

SEQ ID NO: 92540 - DNA, 25 bp, Homo sapien
gttgatcacagatttgggtttggat

SEQ ID NO: 92541 - DNA, 25 bp, Homo sapien
ttgatcacagatttgggtttggatc

SEQ ID NO: 92542 - DNA, 25 bp, Homo sapien
tgatcacagatttgggtttggatca

SEQ ID NO: 92543 - DNA, 25 bp, Homo sapien
gatcacagatttgggtttggatcag

SEQ ID NO: 92544 - DNA, 25 bp, Homo sapien
ccgggctggatcatggactgtggag

SEQ ID NO: 92545 - DNA, 25 bp, Homo sapien
aggtgtcgcgaaggatgcagtccac

SEQ ID NO: 92546 - DNA, 25 bp, Homo sapien
tcctcggaggtgtcgcgaaggatgc

SEQ ID NO: 92547 - DNA, 25 bp, Homo sapien
gtcctcggaggtgtcgcgaaggatg

SEQ ID NO: 92548 - DNA, 25 bp, Homo sapien
gcccgaaggccaggttcacggcgtc

SEQ ID NO: 92549 - DNA, 25 bp, Homo sapien
cgcccgaaggccaggttcacggcgt

SEQ ID NO: 92550 - DNA, 25 bp, Homo sapien
agcggcgcccgaaggccaggttcac

SEQ ID NO: 92551 - DNA, 25 bp, Homo sapien
cagcggcgcccgaaggccaggttca

SEQ ID NO: 92552 - DNA, 25 bp, Homo sapien
acagcggcgcccgaaggccaggttc

SEQ ID NO: 92553 - DNA, 25 bp, Homo sapien
cccggaagcagttacctgtagtagc

SEQ ID NO: 92554 - DNA, 25 bp, Homo sapien
gccgctggtagcctttgatataatt

SEQ ID NO: 92555 - DNA, 25 bp, Homo sapien
ggtagcctttgatataattggtcca

SEQ ID NO: 92556 - DNA, 25 bp, Homo sapien
tggtccatttgaagagccagccctc

SEQ ID NO: 92557 - DNA, 25 bp, Homo sapien
catttgaagagccagccctctcgag

SEQ ID NO: 92558 - DNA, 25 bp, Homo sapien
gaaccatcgccgctggtagcctttg

SEQ ID NO: 92559 - DNA, 25 bp, Homo sapien
cctgtagtagctcaggagcccgttg

SEQ ID NO: 92560 - DNA, 25 bp, Homo sapien
ggagcccgttgctcagcacgaacca

SEQ ID NO: 92561 - DNA, 25 bp, Homo sapien
ctacgggcaaccaggctgtgcacgc

SEQ ID NO: 92562 - DNA, 25 bp, Homo sapien
ctgtcctgtctacgggcaaccaggc

SEQ ID NO: 92563 - DNA, 25 bp, Homo sapien
cctgtctacgggcaaccaggctgtg

SEQ ID NO: 92564 - DNA, 25 bp, Homo sapien
ctgtctacgggcaaccaggctgtgc

SEQ ID NO: 92565 - DNA, 25 bp, Homo sapien
gtctacgggcaaccaggctgtgcac

SEQ ID NO: 92566 - DNA, 25 bp, Homo sapien
tctacgggcaaccaggctgtgcacg

SEQ ID NO: 92567 - DNA, 25 bp, Homo sapien
cctgtcctgtctacgggcaaccagg

SEQ ID NO: 92568 - DNA, 25 bp, Homo sapien
ctgaccgcatcccaccctgtcctgt

SEQ ID NO: 92569 - DNA, 25 bp, Homo sapien
cgtctccacatggtcatgcacaagg

SEQ ID NO: 92570 - DNA, 25 bp, Homo sapien
tccgtctccacatggtcatgcacaa

SEQ ID NO: 92571 - DNA, 25 bp, Homo sapien
actgtctgcggtgccggctctggta

SEQ ID NO: 92572 - DNA, 25 bp, Homo sapien
gcgacactgtctgcggtgccggctc

SEQ ID NO: 92573 - DNA, 25 bp, Homo sapien
ctcgcagggcgacactgtctgcggt

SEQ ID NO: 92574 - DNA, 25 bp, Homo sapien
tcatgcacaaggttggcgtgctggt

SEQ ID NO: 92575 - DNA, 25 bp, Homo sapien
catggtcatgcacaaggttggcgtg

SEQ ID NO: 92576 - DNA, 25 bp, Homo sapien
ccacatggtcatgcacaaggttggc

SEQ ID NO: 92577 - DNA, 25 bp, Homo sapien
cagtgcagtcatcggtcggctccaa

SEQ ID NO: 92578 - DNA, 25 bp, Homo sapien
ggtcagcttgttgcggtcagcccag

SEQ ID NO: 92579 - DNA, 25 bp, Homo sapien
cagctcccgctctgactggttgcag

SEQ ID NO: 92580 - DNA, 25 bp, Homo sapien
ctggtaggagcacatccgtctgcac

SEQ ID NO: 92581 - DNA, 25 bp, Homo sapien
gagcacatccgtctgcaccatggtg

SEQ ID NO: 92582 - DNA, 25 bp, Homo sapien
tccgtctgcaccatggtgtctgccg

SEQ ID NO: 92583 - DNA, 25 bp, Homo sapien
gaagggcacctccatggcatccagg

SEQ ID NO: 92584 - DNA, 25 bp, Homo sapien
ccagcagcaggtcggtctccgcagc

SEQ ID NO: 92585 - DNA, 25 bp, Homo sapien
cagaacctcttcctgagacgcaggt

SEQ ID NO: 92586 - DNA, 25 bp, Homo sapien
agaacctcttcctgagacgcaggta

SEQ ID NO: 92587 - DNA, 25 bp, Homo sapien
cattccagaaaccattactactatg

SEQ ID NO: 92588 - DNA, 25 bp, Homo sapien
aacctcttcctgagacgcaggtact

SEQ ID NO: 92589 - DNA, 25 bp, Homo sapien
gaggggatggtgaatgctgcgctcc

SEQ ID NO: 92590 - DNA, 25 bp, Homo sapien
ccagaacctcttcctgagacgcagg

SEQ ID NO: 92591 - DNA, 25 bp, Homo sapien
ggggatggtgaatgctgcgctccgc

SEQ ID NO: 92592 - DNA, 25 bp, Homo sapien
gaacctcttcctgagacgcaggtac

SEQ ID NO: 92593 - DNA, 25 bp, Homo sapien
cgcggctgaccagagttagagtcca

SEQ ID NO: 92594 - DNA, 25 bp, Homo sapien
aactgaagtccgtgctgcccgtgca

SEQ ID NO: 92595 - DNA, 25 bp, Homo sapien
ccttgggctagtctagttctggtcc

SEQ ID NO: 92596 - DNA, 25 bp, Homo sapien
gagttccgcctctctgaccggtgtc

SEQ ID NO: 92597 - DNA, 25 bp, Homo sapien
gaggcaaactacacggctggcggca

SEQ ID NO: 92598 - DNA, 25 bp, Homo sapien
tggaccacgattcccgtcaggcctt

SEQ ID NO: 92599 - DNA, 25 bp, Homo sapien
cggctctgcttttccctttgcttgc

SEQ ID NO: 92600 - DNA, 25 bp, Homo sapien
tgccgttaacgtgcctcggcgcgca

SEQ ID NO: 92601 - DNA, 25 bp, Homo sapien
tgaatcgcgcgtccacacaggtcca

SEQ ID NO: 92602 - DNA, 25 bp, Homo sapien
gtggggcgtcccattacattctaga

SEQ ID NO: 92603 - DNA, 25 bp, Homo sapien
cgcttcaggtcgaaggtggattcca

SEQ ID NO: 92604 - DNA, 25 bp, Homo sapien
tctgcgcccgcagaaagggcacgga

SEQ ID NO: 92605 - DNA, 25 bp, Homo sapien
ctcccgaggtatctaggaggccgca

SEQ ID NO: 92606 - DNA, 25 bp, Homo sapien
ctttcgtggtagagcaccggcacgc

SEQ ID NO: 92607 - DNA, 25 bp, Homo sapien
tcccattacattctagaggcgctcc

SEQ ID NO: 92608 - DNA, 25 bp, Homo sapien
ccctgttcgagtggggatccagcct

SEQ ID NO: 92609 - DNA, 25 bp, Homo sapien
tgagcttcgacagggctgagacttc

SEQ ID NO: 92610 - DNA, 25 bp, Homo sapien
ttcggcaagattgaggcttcctctg

SEQ ID NO: 92611 - DNA, 25 bp, Homo sapien
cctcgccctacgtgagcttccgcag

SEQ ID NO: 92612 - DNA, 25 bp, Homo sapien
ctgaccttccgcttcggcaagattg

SEQ ID NO: 92613 - DNA, 25 bp, Homo sapien
cttccgcttcggcaagattgaggct

SEQ ID NO: 92614 - DNA, 25 bp, Homo sapien
acaggactgacgcttcctccgctga

SEQ ID NO: 92615 - DNA, 25 bp, Homo sapien
ccgcttcggcaagattgaggcttcc

SEQ ID NO: 92616 - DNA, 25 bp, Homo sapien
cctgagcttcgacagggctgagact

SEQ ID NO: 92617 - DNA, 25 bp, Homo sapien
ctgaggcttcctctgctgagctcgc

SEQ ID NO: 92618 - DNA, 25 bp, Homo sapien
cctccctgagcttcggcggggctga

SEQ ID NO: 92619 - DNA, 25 bp, Homo sapien
ctccctgagcttcggcggggctgag

SEQ ID NO: 92620 - DNA, 25 bp, Homo sapien
ccctgagcttcggcggggctgaggc

SEQ ID NO: 92621 - DNA, 25 bp, Homo sapien
ccctccctgagcttcggcggggctg

SEQ ID NO: 92622 - DNA, 25 bp, Homo sapien
tcaccctccctgagcttcggcgggg

SEQ ID NO: 92623 - DNA, 25 bp, Homo sapien
accctccctgagcttccgcagggct

SEQ ID NO: 92624 - DNA, 25 bp, Homo sapien
tcaccctccctgagcttccgcaggg

SEQ ID NO: 92625 - DNA, 25 bp, Homo sapien
ccagcaaatgcgcagggaggaagtc

SEQ ID NO: 92626 - DNA, 25 bp, Homo sapien
gatggcccagaacgggcggcgacga

SEQ ID NO: 92627 - DNA, 25 bp, Homo sapien
gagaggatggcccagaacgggcggc

SEQ ID NO: 92628 - DNA, 25 bp, Homo sapien
cgtgggtaccagcgcgctgcgcctc

SEQ ID NO: 92629 - DNA, 25 bp, Homo sapien
atagccaccgtgcgcccgtgggtac

SEQ ID NO: 92630 - DNA, 25 bp, Homo sapien
caaatgcgcagggaggaagtcgggc

SEQ ID NO: 92631 - DNA, 25 bp, Homo sapien
ggcgacgagcccgaagtcccccagc

SEQ ID NO: 92632 - DNA, 25 bp, Homo sapien
catagccaccgtgcgcccgtgggta

SEQ ID NO: 92633 - DNA, 25 bp, Homo sapien
acacggctaccgcatcagccaccgc

SEQ ID NO: 92634 - DNA, 25 bp, Homo sapien
attggtgccgctgagtgtcacttga

SEQ ID NO: 92635 - DNA, 25 bp, Homo sapien
gctgagtgtcacttgaggaagaccc

SEQ ID NO: 92636 - DNA, 25 bp, Homo sapien
cccgcggatattggcatttctctcg

SEQ ID NO: 92637 - DNA, 25 bp, Homo sapien
attggcatttctctcgggcctgtca

SEQ ID NO: 92638 - DNA, 25 bp, Homo sapien
tttctctcgggcctgtcattctaca

SEQ ID NO: 92639 - DNA, 25 bp, Homo sapien
tctcgggcctgtcattctacagcgc

SEQ ID NO: 92640 - DNA, 25 bp, Homo sapien
aagaaggacgtcgattggtgccgct

SEQ ID NO: 92641 - DNA, 25 bp, Homo sapien
tgcctccgtttcttcgctctaaagg

SEQ ID NO: 92642 - DNA, 25 bp, Homo sapien
gggctcctccctccatgttgttgat

SEQ ID NO: 92643 - DNA, 25 bp, Homo sapien
ctcccatatctgcagcgggaagttc

SEQ ID NO: 92644 - DNA, 25 bp, Homo sapien
ccggcgtcgacttcagacttaccta

SEQ ID NO: 92645 - DNA, 25 bp, Homo sapien
cggcttcacccgatgcgagttattt

SEQ ID NO: 92646 - DNA, 25 bp, Homo sapien
ggcaagcctggaattccttcactga

SEQ ID NO: 92647 - DNA, 25 bp, Homo sapien
tgggaggacttttccagggactcta

SEQ ID NO: 92648 - DNA, 25 bp, Homo sapien
ggcctgggttcgcagagacaaaatg

SEQ ID NO: 92649 - DNA, 25 bp, Homo sapien
ttccggtcccaagaacggtgctctc

SEQ ID NO: 92650 - DNA, 25 bp, Homo sapien
aggctctgatgtgacctctccaaga

SEQ ID NO: 92651 - DNA, 25 bp, Homo sapien
cagcatctgcgcgttttaagccgga

SEQ ID NO: 92652 - DNA, 25 bp, Homo sapien
ttaagccggataagacgcttccttc

SEQ ID NO: 92653 - DNA, 25 bp, Homo sapien
ctgggtttctttctcggttgctcaa

SEQ ID NO: 92654 - DNA, 25 bp, Homo sapien
ggcaccaacagcaggcgagtgacta

SEQ ID NO: 92655 - DNA, 25 bp, Homo sapien
aggaattactgtctgccggcccgaa

SEQ ID NO: 92656 - DNA, 25 bp, Homo sapien
gcgcacgattggtcttaagagttta

SEQ ID NO: 92657 - DNA, 25 bp, Homo sapien
ctcggtagacgctccgacacctggg

SEQ ID NO: 92658 - DNA, 25 bp, Homo sapien
cacgtgccagagctcctcggtagac

SEQ ID NO: 92659 - DNA, 25 bp, Homo sapien
aggccgcgatgctccacgtgccaga

SEQ ID NO: 92660 - DNA, 25 bp, Homo sapien
acagagctgctcaggccgcgatgct

SEQ ID NO: 92661 - DNA, 25 bp, Homo sapien
tctagaagacttgacggatgggctg

SEQ ID NO: 92662 - DNA, 25 bp, Homo sapien
acatggtggagcacttagccaactc

SEQ ID NO: 92663 - DNA, 25 bp, Homo sapien
acctgctgtcccacatggtggagca

SEQ ID NO: 92664 - DNA, 25 bp, Homo sapien
agccaactcgggttcttctagaaga

SEQ ID NO: 92665 - DNA, 25 bp, Homo sapien
tttctggccacgtcatactctttgc

SEQ ID NO: 92666 - DNA, 25 bp, Homo sapien
tggtcacgcaaaaggttggtgtgct

SEQ ID NO: 92667 - DNA, 25 bp, Homo sapien
tcacgcaaaaggttggtgtgctggt

SEQ ID NO: 92668 - DNA, 25 bp, Homo sapien
cgcccgtgtttctggccacgtcata

SEQ ID NO: 92669 - DNA, 25 bp, Homo sapien
gtttctggccacgtcatactctttg

SEQ ID NO: 92670 - DNA, 25 bp, Homo sapien
cagctcgtagggtggcactgtctgt

SEQ ID NO: 92671 - DNA, 25 bp, Homo sapien
tgtctccacatggtcacgcaaaagg

SEQ ID NO: 92672 - DNA, 25 bp, Homo sapien
cacatggtcacgcaaaaggttggtg

SEQ ID NO: 92673 - DNA, 25 bp, Homo sapien
catgccggctggcatggggacaacc

SEQ ID NO: 92674 - DNA, 25 bp, Homo sapien
cgagctcttcttgcatccccgccgc

SEQ ID NO: 92675 - DNA, 25 bp, Homo sapien
cctctctggtctgaggtcctgcatc

SEQ ID NO: 92676 - DNA, 25 bp, Homo sapien
gtcctctctggtctgaggtcctgca

SEQ ID NO: 92677 - DNA, 25 bp, Homo sapien
atgccggctggcatggggacaaccc

SEQ ID NO: 92678 - DNA, 25 bp, Homo sapien
agtggccagcatgccggctggcatg

SEQ ID NO: 92679 - DNA, 25 bp, Homo sapien
tctctggtctgaggtcctgcatctg

SEQ ID NO: 92680 - DNA, 25 bp, Homo sapien
ctctctggtctgaggtcctgcatct

SEQ ID NO: 92681 - DNA, 25 bp, Homo sapien
tgaacggttccttccggcttgtcta

SEQ ID NO: 92682 - DNA, 25 bp, Homo sapien
gcttcggtgcttgtgccctcaccta

SEQ ID NO: 92683 - DNA, 25 bp, Homo sapien
actgcgcgctgagactcatgctgtc

SEQ ID NO: 92684 - DNA, 25 bp, Homo sapien
ttttgtggctccatggtaagcaccc

SEQ ID NO: 92685 - DNA, 25 bp, Homo sapien
acggctcttaaaccatgcgcaatgc

SEQ ID NO: 92686 - DNA, 25 bp, Homo sapien
gctggttcctcgttcactctttcta

SEQ ID NO: 92687 - DNA, 25 bp, Homo sapien
tgtctaaatcttccatctttcgggg

SEQ ID NO: 92688 - DNA, 25 bp, Homo sapien
tgtgagcgcttatcgcacccatggc

SEQ ID NO: 92689 - DNA, 25 bp, Homo sapien
cgcgggaacaaaacgtatgtgtgtg

SEQ ID NO: 92690 - DNA, 25 bp, Homo sapien
cgcgaagtttccagagggaggattt

SEQ ID NO: 92691 - DNA, 25 bp, Homo sapien
ctccaggaactgaaacgtgaagggg

SEQ ID NO: 92692 - DNA, 25 bp, Homo sapien
ccgggctttcgttcccggctgtgtg

SEQ ID NO: 92693 - DNA, 25 bp, Homo sapien
agaatgagaacctcggagcgctcgg

SEQ ID NO: 92694 - DNA, 25 bp, Homo sapien
gcggacgccgcaaagagaatgagaa

SEQ ID NO: 92695 - DNA, 25 bp, Homo sapien
ttgggcttcgcgagcccaagcggac

SEQ ID NO: 92696 - DNA, 25 bp, Homo sapien
gctcgctgttgtgtctccaaggtca

SEQ ID NO: 92697 - DNA, 25 bp, Homo sapien
gctggtgttccagacctgcgacatc

SEQ ID NO: 92698 - DNA, 25 bp, Homo sapien
tcctctcagaggtaggtccattccg

SEQ ID NO: 92699 - DNA, 25 bp, Homo sapien
atgacactggtctcgtctgcagcaa

SEQ ID NO: 92700 - DNA, 25 bp, Homo sapien
gtggccatcgtggtctactccgtca

SEQ ID NO: 92701 - DNA, 25 bp, Homo sapien
tactccgtcattgggttccgcgcca

SEQ ID NO: 92702 - DNA, 25 bp, Homo sapien
catcaacgggttcgacctgcctgaa

SEQ ID NO: 92703 - DNA, 25 bp, Homo sapien
tcatcaacggcttcacatcggtgta

SEQ ID NO: 92704 - DNA, 25 bp, Homo sapien
cccaggagaactttgtggacatgca

SEQ ID NO: 92705 - DNA, 25 bp, Homo sapien
ggtcacttccggtcgcaacagctca

SEQ ID NO: 92706 - DNA, 25 bp, Homo sapien
gctcaaagtgatgacggcgcccgtt

SEQ ID NO: 92707 - DNA, 25 bp, Homo sapien
cagggctgtgatttatgtggctcaa

SEQ ID NO: 92708 - DNA, 25 bp, Homo sapien
ggcagtttttccaacgtccgactca

SEQ ID NO: 92709 - DNA, 25 bp, Homo sapien
tttgaagaatcctgcgcttagcctg

SEQ ID NO: 92710 - DNA, 25 bp, Homo sapien
gcggagaaaacccttgtgattgtca

SEQ ID NO: 92711 - DNA, 25 bp, Homo sapien
gctcacctcgtagcggaacattctt

SEQ ID NO: 92712 - DNA, 25 bp, Homo sapien
gtggtatttttaagcgccaggctca

SEQ ID NO: 92713 - DNA, 25 bp, Homo sapien
cgacgactcctcgtcctcagtagga

SEQ ID NO: 92714 - DNA, 25 bp, Homo sapien
gccacagtcagttctccctaggagg

SEQ ID NO: 92715 - DNA, 25 bp, Homo sapien
ctttgcgatcgtctcccagccttag

SEQ ID NO: 92716 - DNA, 25 bp, Homo sapien
ccctgaggctgtgcttaagaaaaaa

SEQ ID NO: 92717 - DNA, 25 bp, Homo sapien
gctacgggtcttttcctgttacaga

SEQ ID NO: 92718 - DNA, 25 bp, Homo sapien
agccacgcgagctatgggcagaatc

SEQ ID NO: 92719 - DNA, 25 bp, Homo sapien
tgtggtgccaagtagcgactatctc

SEQ ID NO: 92720 - DNA, 25 bp, Homo sapien
gcagaatcggggcaacggtaatatc

SEQ ID NO: 92721 - DNA, 25 bp, Homo sapien
taagcagcgacctcaccgaaggttc

SEQ ID NO: 92722 - DNA, 25 bp, Homo sapien
aactttctgcagagaccatcgggca

SEQ ID NO: 92723 - DNA, 25 bp, Homo sapien
cctcggtccagctaaaccgtgtgta

SEQ ID NO: 92724 - DNA, 25 bp, Homo sapien
cgttctggagtagtgaaggttcctc

SEQ ID NO: 92725 - DNA, 25 bp, Homo sapien
gttccaagcgcctgctccgttaata

SEQ ID NO: 92726 - DNA, 25 bp, Homo sapien
tggcgcctttgccatccgtgccgaa

SEQ ID NO: 92727 - DNA, 25 bp, Homo sapien
aattgccttggtgatcggtgccttc

SEQ ID NO: 92728 - DNA, 25 bp, Homo sapien
aggctgtgcactgtcttggctcaga

SEQ ID NO: 92729 - DNA, 25 bp, Homo sapien
acagcctggcgttattctggcctca

SEQ ID NO: 92730 - DNA, 25 bp, Homo sapien
gctcgcgagatcttcagggtctata

SEQ ID NO: 92731 - DNA, 25 bp, Homo sapien
agcagcgttcttttatctccgtccg

SEQ ID NO: 92732 - DNA, 25 bp, Homo sapien
tgccgccacccgatggaagattcga

SEQ ID NO: 92733 - DNA, 25 bp, Homo sapien
gctccaggcgtggtttattttctaa

SEQ ID NO: 92734 - DNA, 25 bp, Homo sapien
ttcaccgggaagcatgggcctgctt

SEQ ID NO: 92735 - DNA, 25 bp, Homo sapien
agctgccggacgtagacttacctcg

SEQ ID NO: 92736 - DNA, 25 bp, Homo sapien
tctaacggcggtggttcataggctt

SEQ ID NO: 92737 - DNA, 25 bp, Homo sapien
ctccatctgtttcccgcaggtgttt

SEQ ID NO: 92738 - DNA, 25 bp, Homo sapien
cgcatcctcattgtgccggctcggg

SEQ ID NO: 92739 - DNA, 25 bp, Homo sapien
cctggctgtctgtccgtatgcctgt

SEQ ID NO: 92740 - DNA, 25 bp, Homo sapien
atgcctgtgccctgtacctctgtct

SEQ ID NO: 92741 - DNA, 25 bp, Homo sapien
gccggagagcgcaactcggcttcca

SEQ ID NO: 92742 - DNA, 25 bp, Homo sapien
gactcttcgactgcgtgtctgtctg

SEQ ID NO: 92743 - DNA, 25 bp, Homo sapien
ggtgtttacacttcctgctgctgtg

SEQ ID NO: 92744 - DNA, 25 bp, Homo sapien
tcggttcacctgactcttcgactgc

SEQ ID NO: 92745 - DNA, 25 bp, Homo sapien
gctgagtcaccgcttccacaggagc

SEQ ID NO: 92746 - DNA, 25 bp, Homo sapien
cgcgtcaggcgctttgttctcctgc

SEQ ID NO: 92747 - DNA, 25 bp, Homo sapien
atattggtgacggttcagctggcgc

SEQ ID NO: 92748 - DNA, 25 bp, Homo sapien
caggcccaacctgctttgagttttc

SEQ ID NO: 92749 - DNA, 25 bp, Homo sapien
cctgctttgagttttcggctcgttt

SEQ ID NO: 92750 - DNA, 25 bp, Homo sapien
ctgcgtgctgttcccggcatcttga

SEQ ID NO: 92751 - DNA, 25 bp, Homo sapien
tcattaatattggtgacggttcagc

SEQ ID NO: 92752 - DNA, 25 bp, Homo sapien
gccgtctgcgtgctgttcccggcat

SEQ ID NO: 92753 - DNA, 25 bp, Homo sapien
cagaagcccttcaagtacacgacgg

SEQ ID NO: 92754 - DNA, 25 bp, Homo sapien
gtacacgacggtgaccaagaggtcc

SEQ ID NO: 92755 - DNA, 25 bp, Homo sapien
gacgtgcatttcatgaagcgctacc

SEQ ID NO: 92756 - DNA, 25 bp, Homo sapien
cgggagaaccagcaggacgtgcatt

SEQ ID NO: 92757 - DNA, 25 bp, Homo sapien
tacgtgggcttcaccaagaaggggc

SEQ ID NO: 92758 - DNA, 25 bp, Homo sapien
taagtactccggctggtacgtgggc

SEQ ID NO: 92759 - DNA, 25 bp, Homo sapien
cggccctgatgtcggctaagtactc

SEQ ID NO: 92760 - DNA, 25 bp, Homo sapien
tgaccaagaggtcccgtcggatccg

SEQ ID NO: 92761 - DNA, 25 bp, Homo sapien
agcctgtgcgcaggagatcccgtcc

SEQ ID NO: 92762 - DNA, 25 bp, Homo sapien
acccgctccgtcaggagtggccatt

SEQ ID NO: 92763 - DNA, 25 bp, Homo sapien
tgctctaggggccagagcgcgctcc

SEQ ID NO: 92764 - DNA, 25 bp, Homo sapien
gcggcgtctccctcatttccataag

SEQ ID NO: 92765 - DNA, 25 bp, Homo sapien
cccagcgcctctgtctgggtggagc

SEQ ID NO: 92766 - DNA, 25 bp, Homo sapien
cgtcctcgagtggaacgccaaagaa

SEQ ID NO: 92767 - DNA, 25 bp, Homo sapien
cgccaaagaagatgcctgctctagg

SEQ ID NO: 92768 - DNA, 25 bp, Homo sapien
gaagatgcctgctctaggggccaga

SEQ ID NO: 92769 - DNA, 25 bp, Homo sapien
tacgtgtcccagaaagccgtgcgcc

SEQ ID NO: 92770 - DNA, 25 bp, Homo sapien
tgtccttccggctagcttctcttga

SEQ ID NO: 92771 - DNA, 25 bp, Homo sapien
ggaccgagcctctgacaccaggttg

SEQ ID NO: 92772 - DNA, 25 bp, Homo sapien
cgcagtacgcagatcggggactaca

SEQ ID NO: 92773 - DNA, 25 bp, Homo sapien
agctcgatggtcttgtcctcaatca

SEQ ID NO: 92774 - DNA, 25 bp, Homo sapien
tctacagcataaacgagcgagggtc

SEQ ID NO: 92775 - DNA, 25 bp, Homo sapien
agagcgagtgcgacctaagtctaca

SEQ ID NO: 92776 - DNA, 25 bp, Homo sapien
aggtcctgcgtatgcgacccatttc

SEQ ID NO: 92777 - DNA, 25 bp, Homo sapien
ctgcttgatcttctcacgctgctca

SEQ ID NO: 92778 - DNA, 25 bp, Homo sapien
tgtacatggccatgcgcgtcttgcc

SEQ ID NO: 92779 - DNA, 25 bp, Homo sapien
tgtggaggctcttcttgtacatggc

SEQ ID NO: 92780 - DNA, 25 bp, Homo sapien
gatcttctcacgctgctcagctgcg

SEQ ID NO: 92781 - DNA, 25 bp, Homo sapien
ttgccctcactcctctggatcttgg

SEQ ID NO: 92782 - DNA, 25 bp, Homo sapien
gcaccttcagctgctctatcatgcg

SEQ ID NO: 92783 - DNA, 25 bp, Homo sapien
gctgctctatcatgcgctggttgta

SEQ ID NO: 92784 - DNA, 25 bp, Homo sapien
tggttgtagcgctgcatctgctccc

SEQ ID NO: 92785 - DNA, 25 bp, Homo sapien
cgcagcccgacctcggtcaagtgtg

SEQ ID NO: 92786 - DNA, 25 bp, Homo sapien
acgtgctcatattcgcgggactttc

SEQ ID NO: 92787 - DNA, 25 bp, Homo sapien
taaaccttgccgaaggcgccgtcgc

SEQ ID NO: 92788 - DNA, 25 bp, Homo sapien
cgagagcccacggatcgttgtcagc

SEQ ID NO: 92789 - DNA, 25 bp, Homo sapien
cgacttggcatttcgcgagagccca

SEQ ID NO: 92790 - DNA, 25 bp, Homo sapien
tctcttctcgaaggtagacaggcgc

SEQ ID NO: 92791 - DNA, 25 bp, Homo sapien
ccgcgtggctcccaaaacttttatg

SEQ ID NO: 92792 - DNA, 25 bp, Homo sapien
cgcagggcactctggaaactgtagt

SEQ ID NO: 92793 - DNA, 25 bp, Homo sapien
gagcccggcacagacagcgaatgac

SEQ ID NO: 92794 - DNA, 25 bp, Homo sapien
tagaacactcgactgccacccaatg

SEQ ID NO: 92795 - DNA, 25 bp, Homo sapien
ccgcctagcaaggagtcggctaaga

SEQ ID NO: 92796 - DNA, 25 bp, Homo sapien
ggatcccgctactcggaatgccttc

SEQ ID NO: 92797 - DNA, 25 bp, Homo sapien
agcgaatgaccgcagccagacagtc

SEQ ID NO: 92798 - DNA, 25 bp, Homo sapien
gacagtcgctcttgctcttcctcgg

SEQ ID NO: 92799 - DNA, 25 bp, Homo sapien
atgaaggaccgtctggagcagctga

SEQ ID NO: 92800 - DNA, 25 bp, Homo sapien
tcttatttgttttcgggagcttgtc

SEQ ID NO: 92801 - DNA, 25 bp, Homo sapien
cttggtgacggtctgggaccagaca

SEQ ID NO: 92802 - DNA, 25 bp, Homo sapien
cgtttattaacaggtgactcgcgta

SEQ ID NO: 92803 - DNA, 25 bp, Homo sapien
cgtccagggtatgcgtttattaaca

SEQ ID NO: 92804 - DNA, 25 bp, Homo sapien
tgccttccgagcacgtccagggtat

SEQ ID NO: 92805 - DNA, 25 bp, Homo sapien
ctgtctgtgagcacagcctgctcta

SEQ ID NO: 92806 - DNA, 25 bp, Homo sapien
tggttcttacccgagagcctgtctg

SEQ ID NO: 92807 - DNA, 25 bp, Homo sapien
ccagacacaggagcagaaggcgtcc

SEQ ID NO: 92808 - DNA, 25 bp, Homo sapien
tgactcgcgtaacaccttgggtacg

SEQ ID NO: 92809 - DNA, 25 bp, Homo sapien
ctggggcccggctacacgaggctcc

SEQ ID NO: 92810 - DNA, 25 bp, Homo sapien
cgccgctcgctcagcaagtcccccg

SEQ ID NO: 92811 - DNA, 25 bp, Homo sapien
cctggaggcccccaagcgcagtaat

SEQ ID NO: 92812 - DNA, 25 bp, Homo sapien
aagcgcagtaatgtcagggttccgg

SEQ ID NO: 92813 - DNA, 25 bp, Homo sapien
agtaatgtcagggttccgggcggcg

SEQ ID NO: 92814 - DNA, 25 bp, Homo sapien
ggcgttgacggcaggggacaaggac

SEQ ID NO: 92815 - DNA, 25 bp, Homo sapien
ccaagcgcagtaatgtcagggttcc

SEQ ID NO: 92816 - DNA, 25 bp, Homo sapien
gacaaggacgggagcgcatgcagca

SEQ ID NO: 92817 - DNA, 25 bp, Homo sapien
ccagaagggcagcttcgggtccgac

SEQ ID NO: 92818 - DNA, 25 bp, Homo sapien
tcaataattaaacggcctggagagg

SEQ ID NO: 92819 - DNA, 25 bp, Homo sapien
ccggcgctcagaggacttttcttca

SEQ ID NO: 92820 - DNA, 25 bp, Homo sapien
ctcagaggacttttcttcagggctg

SEQ ID NO: 92821 - DNA, 25 bp, Homo sapien
ctccgagttctcgttgaggctgccc

SEQ ID NO: 92822 - DNA, 25 bp, Homo sapien
agttctcgttgaggctgcccgagga

SEQ ID NO: 92823 - DNA, 25 bp, Homo sapien
tcctgatcctcaataattaaacggc

SEQ ID NO: 92824 - DNA, 25 bp, Homo sapien
aggagtcgtgctgggcgcccacaca

SEQ ID NO: 92825 - DNA, 25 bp, Homo sapien
accgagaagtagtcgtggaagactc

SEQ ID NO: 92826 - DNA, 25 bp, Homo sapien
ctttgaatttgtatggcgctccgtg

SEQ ID NO: 92827 - DNA, 25 bp, Homo sapien
ccagcgccctttgaatttgtatggc

SEQ ID NO: 92828 - DNA, 25 bp, Homo sapien
cgaacgttgaggtcccagcgccctt

SEQ ID NO: 92829 - DNA, 25 bp, Homo sapien
aagtagtcgtggaagactcgcaggc

SEQ ID NO: 92830 - DNA, 25 bp, Homo sapien
cgaaatcgagttcctggctcctcgg

SEQ ID NO: 92831 - DNA, 25 bp, Homo sapien
agtgtcctggccgaacgttgaggtc

SEQ ID NO: 92832 - DNA, 25 bp, Homo sapien
tatggcgctccgtgggttggtaccc

SEQ ID NO: 92833 - DNA, 25 bp, Homo sapien
caggagtctcgaatcccacgggcgt

SEQ ID NO: 92834 - DNA, 25 bp, Homo sapien
ggcgtacggcttcaggagtctcgaa

SEQ ID NO: 92835 - DNA, 25 bp, Homo sapien
gtctcgaatcccacgggcgtacggc

SEQ ID NO: 92836 - DNA, 25 bp, Homo sapien
tcaggagtctcgaatcccacgggcg

SEQ ID NO: 92837 - DNA, 25 bp, Homo sapien
aatcccacgggcgtacggcttcagg

SEQ ID NO: 92838 - DNA, 25 bp, Homo sapien
atcccacgggcgtacggcttcagga

SEQ ID NO: 92839 - DNA, 25 bp, Homo sapien
agtctcgaatcccacgggcgtacgg

SEQ ID NO: 92840 - DNA, 25 bp, Homo sapien
aggagtctcgaatcccacgggcgta

SEQ ID NO: 92841 - DNA, 25 bp, Homo sapien
ttctcctccatgtcggggtctgaga

SEQ ID NO: 92842 - DNA, 25 bp, Homo sapien
tgttgttctccagcgctgctgcttc

SEQ ID NO: 92843 - DNA, 25 bp, Homo sapien
tgagatctcctcgtagcctgctgac

SEQ ID NO: 92844 - DNA, 25 bp, Homo sapien
agtccatgacaccatgcggtgcgtc

SEQ ID NO: 92845 - DNA, 25 bp, Homo sapien
ccctccgacttgatgatggattctt

SEQ ID NO: 92846 - DNA, 25 bp, Homo sapien
ccagaaagttgggtctcgacgcgtt

SEQ ID NO: 92847 - DNA, 25 bp, Homo sapien
gacatgtctgaagatgccttcctca

SEQ ID NO: 92848 - DNA, 25 bp, Homo sapien
gcctgctgacgcagacatgtctgaa

SEQ ID NO: 92849 - DNA, 25 bp, Homo sapien
cacataatgcttgttgggcacccgc

SEQ ID NO: 92850 - DNA, 25 bp, Homo sapien
acctggagctgagcgcaatcgcagc

SEQ ID NO: 92851 - DNA, 25 bp, Homo sapien
cttcacctccacgatgctgcgccgc

SEQ ID NO: 92852 - DNA, 25 bp, Homo sapien
gtctagcaccttcacctccacgatg

SEQ ID NO: 92853 - DNA, 25 bp, Homo sapien
ataatgcttgttgggcacccgccgc

SEQ ID NO: 92854 - DNA, 25 bp, Homo sapien
gcgccgcactcacataatgcttgtt

SEQ ID NO: 92855 - DNA, 25 bp, Homo sapien
cagggaacctggagctgagcgcaat

SEQ ID NO: 92856 - DNA, 25 bp, Homo sapien
acccgccgcttctgcacgtctagca

SEQ ID NO: 92857 - DNA, 25 bp, Homo sapien
tcattctcccggctttggccagatg

SEQ ID NO: 92858 - DNA, 25 bp, Homo sapien
gccagatgcgcaaaaagggccgctg

SEQ ID NO: 92859 - DNA, 25 bp, Homo sapien
cgagggcgctgatgagcaaactcaa

SEQ ID NO: 92860 - DNA, 25 bp, Homo sapien
agccacccgtggtgccaagactgca

SEQ ID NO: 92861 - DNA, 25 bp, Homo sapien
cacatgctgccgtgctttggccacg

SEQ ID NO: 92862 - DNA, 25 bp, Homo sapien
gtgtccgctccactggggactcctt

SEQ ID NO: 92863 - DNA, 25 bp, Homo sapien
ggaggccttactggaaaatacatgg

SEQ ID NO: 92864 - DNA, 25 bp, Homo sapien
aattgtgggaacagatcagcggtcc

SEQ ID NO: 92865 - DNA, 25 bp, Homo sapien
tgtctacggcatcaccgacgaggtg

SEQ ID NO: 92866 - DNA, 25 bp, Homo sapien
ctctgggcgctcattgatgtctacg

SEQ ID NO: 92867 - DNA, 25 bp, Homo sapien
acggccgcgtgttctacagcgtgaa

SEQ ID NO: 92868 - DNA, 25 bp, Homo sapien
aaggcactgcccgagaacctggcgc

SEQ ID NO: 92869 - DNA, 25 bp, Homo sapien
gcgcacgatccgtcgctcatgagcg

SEQ ID NO: 92870 - DNA, 25 bp, Homo sapien
gcctaaccgtgctgcctgtgtcttt

SEQ ID NO: 92871 - DNA, 25 bp, Homo sapien
gcttccacgcgcaggccaaaggcaa

SEQ ID NO: 92872 - DNA, 25 bp, Homo sapien
agcttctgcaatggcgtcacgttca

SEQ ID NO: 92873 - DNA, 25 bp, Homo sapien
tgctgtgcgtcgacaccacgcaggc

SEQ ID NO: 92874 - DNA, 25 bp, Homo sapien
cggcgacgtgctcctgggcatcaac

SEQ ID NO: 92875 - DNA, 25 bp, Homo sapien
cgcgctgctcgaccgcaaagagtac

SEQ ID NO: 92876 - DNA, 25 bp, Homo sapien
ggccttcggcatcacgtcgtgcgac

SEQ ID NO: 92877 - DNA, 25 bp, Homo sapien
ggccgaccgcaaagtggcctgcgca

SEQ ID NO: 92878 - DNA, 25 bp, Homo sapien
gaacaaccaggtggtggccaagctg

SEQ ID NO: 92879 - DNA, 25 bp, Homo sapien
ttcgacaacaacgagctcgagaaca

SEQ ID NO: 92880 - DNA, 25 bp, Homo sapien
tccgcacagagagcgccttcgctga

SEQ ID NO: 92881 - DNA, 25 bp, Homo sapien
agcagcctccacatggtcacgggcg

SEQ ID NO: 92882 - DNA, 25 bp, Homo sapien
ccgcagagtcccgacggaagcgaaa

SEQ ID NO: 92883 - DNA, 25 bp, Homo sapien
cggaagttgtgttcactcgggtcca

SEQ ID NO: 92884 - DNA, 25 bp, Homo sapien
agcggcgcactagcgcgagccagca

SEQ ID NO: 92885 - DNA, 25 bp, Homo sapien
aatcggctcaggacaccgctcagtg

SEQ ID NO: 92886 - DNA, 25 bp, Homo sapien
gcggcgctccactacctagctgtaa

SEQ ID NO: 92887 - DNA, 25 bp, Homo sapien
aggttgagttcctgcggtcaaaggc

SEQ ID NO: 92888 - DNA, 25 bp, Homo sapien
tgcacccaggtaagcagcggcgctc

SEQ ID NO: 92889 - DNA, 25 bp, Homo sapien
ggtcatctacacgtgtggacacatg

SEQ ID NO: 92890 - DNA, 25 bp, Homo sapien
acgtgtggacacatgtgcctgtgcc

SEQ ID NO: 92891 - DNA, 25 bp, Homo sapien
gaggtggacacggtcatctacacgt

SEQ ID NO: 92892 - DNA, 25 bp, Homo sapien
atcaagaatggcgagtgcacggtgt

SEQ ID NO: 92893 - DNA, 25 bp, Homo sapien
caccggagccggcaggcatcaagaa

SEQ ID NO: 92894 - DNA, 25 bp, Homo sapien
atctgccggcggcccatcaaggacg

SEQ ID NO: 92895 - DNA, 25 bp, Homo sapien
cacatgtgcctgtgccacagctgcg

SEQ ID NO: 92896 - DNA, 25 bp, Homo sapien
acagctgcggcctgcggctcaagcg

SEQ ID NO: 92897 - DNA, 25 bp, Homo sapien
ttgcccaacgccttgcccaccgacg

SEQ ID NO: 92898 - DNA, 25 bp, Homo sapien
caacgctttacccaccaacgccttg

SEQ ID NO: 92899 - DNA, 25 bp, Homo sapien
gcgcccaacgccttgcccgccgacg

SEQ ID NO: 92900 - DNA, 25 bp, Homo sapien
gaaatgccggccaacgctttaccca

SEQ ID NO: 92901 - DNA, 25 bp, Homo sapien
caacgccttgttcgccaatgccttg

SEQ ID NO: 92902 - DNA, 25 bp, Homo sapien
cgcagagctggaaatgccggccaac

SEQ ID NO: 92903 - DNA, 25 bp, Homo sapien
tgctgatgccttgcccaacgccttg

SEQ ID NO: 92904 - DNA, 25 bp, Homo sapien
tttcctgctgatgccttgcccaacg

SEQ ID NO: 92905 - DNA, 25 bp, Homo sapien
gatgcgcgcatcagcccattctacg

SEQ ID NO: 92906 - DNA, 25 bp, Homo sapien
gccgggcagccctattgttcagcca

SEQ ID NO: 92907 - DNA, 25 bp, Homo sapien
aacagcgcgtctcttggggccaaac

SEQ ID NO: 92908 - DNA, 25 bp, Homo sapien
tggggccaaacgcattccattcatg

SEQ ID NO: 92909 - DNA, 25 bp, Homo sapien
agcgcacaggctcactggcgatccg

SEQ ID NO: 92910 - DNA, 25 bp, Homo sapien
atccgggcccgacttgcttagggag

SEQ ID NO: 92911 - DNA, 25 bp, Homo sapien
tggagaagtcagatgagcagatccc

SEQ ID NO: 92912 - DNA, 25 bp, Homo sapien
agcagatcccgcttgatatcccgaa

SEQ ID NO: 92913 - DNA, 25 bp, Homo sapien
gggcaatgctttcctgtttcccaga

SEQ ID NO: 92914 - DNA, 25 bp, Homo sapien
tgcgccgaaccaaaagccgcttttg

SEQ ID NO: 92915 - DNA, 25 bp, Homo sapien
agcccaaatgtccttcgcagcgagc

SEQ ID NO: 92916 - DNA, 25 bp, Homo sapien
gggcttcctgtgcttttgcatactc

SEQ ID NO: 92917 - DNA, 25 bp, Homo sapien
tttcctcatcactaacaggcgggga

SEQ ID NO: 92918 - DNA, 25 bp, Homo sapien
tctgccgatagaaaagtcgtcccta

SEQ ID NO: 92919 - DNA, 25 bp, Homo sapien
ctcccaccgggaaataatgctattc

SEQ ID NO: 92920 - DNA, 25 bp, Homo sapien
agcgactgacttgcccagaaccaca

SEQ ID NO: 92921 - DNA, 25 bp, Homo sapien
ggcacgatgccctttgacttcagga

SEQ ID NO: 92922 - DNA, 25 bp, Homo sapien
cctttgacttcaggaggtgagtgtg

SEQ ID NO: 92923 - DNA, 25 bp, Homo sapien
cggcggcacgatgccctttgacttc

SEQ ID NO: 92924 - DNA, 25 bp, Homo sapien
cagtcgggagttccctcagcgggca

SEQ ID NO: 92925 - DNA, 25 bp, Homo sapien
ccgccctgtgcatgcctccgcaggc

SEQ ID NO: 92926 - DNA, 25 bp, Homo sapien
cctgccgcacacgaagccagccaga

SEQ ID NO: 92927 - DNA, 25 bp, Homo sapien
agcgggagacaaatccacccacctt

SEQ ID NO: 92928 - DNA, 25 bp, Homo sapien
tgcgcggagcgtcacttcccggcag

SEQ ID NO: 92929 - DNA, 25 bp, Homo sapien
ctcacagctccgtcgggaccagaga

SEQ ID NO: 92930 - DNA, 25 bp, Homo sapien
tccaggcagtcttccaggggtcggc

SEQ ID NO: 92931 - DNA, 25 bp, Homo sapien
aaagtgtcggcctagccagtggttg

SEQ ID NO: 92932 - DNA, 25 bp, Homo sapien
ttacacccagggtccgcgcaaagtg

SEQ ID NO: 92933 - DNA, 25 bp, Homo sapien
gcgtggttgatctccctcacagctc

SEQ ID NO: 92934 - DNA, 25 bp, Homo sapien
agagtcgagacccagagcccttttc

SEQ ID NO: 92935 - DNA, 25 bp, Homo sapien
gttcttaacccgaagagagtcgaga

SEQ ID NO: 92936 - DNA, 25 bp, Homo sapien
gtccgcgcaaagtgtcggcctagcc

SEQ ID NO: 92937 - DNA, 25 bp, Homo sapien
cggccctgcgcactcagggtctgag

SEQ ID NO: 92938 - DNA, 25 bp, Homo sapien
ccgtgagaccctgccctatgtgtcg

SEQ ID NO: 92939 - DNA, 25 bp, Homo sapien
ttctcggacagtgaactctaccgcc

SEQ ID NO: 92940 - DNA, 25 bp, Homo sapien
ggctggagttttctcggacagtgaa

SEQ ID NO: 92941 - DNA, 25 bp, Homo sapien
cactcagggtctgaggcagctagta

SEQ ID NO: 92942 - DNA, 25 bp, Homo sapien
ttgcgcggcacggaaactcacttcc

SEQ ID NO: 92943 - DNA, 25 bp, Homo sapien
ggaaactcacttccggccctgcgca

SEQ ID NO: 92944 - DNA, 25 bp, Homo sapien
gcgcttgcgcggcacggaaactcac

SEQ ID NO: 92945 - DNA, 25 bp, Homo sapien
ggcgctcggacaccgttgcctaaga

SEQ ID NO: 92946 - DNA, 25 bp, Homo sapien
ggacgacgaggtccaggtacgtctc

SEQ ID NO: 92947 - DNA, 25 bp, Homo sapien
gacgaggtccaggtacgtctccctc

SEQ ID NO: 92948 - DNA, 25 bp, Homo sapien
tcggacaccgttgcctaagaacgtc

SEQ ID NO: 92949 - DNA, 25 bp, Homo sapien
gacaccgttgcctaagaacgtcatg

SEQ ID NO: 92950 - DNA, 25 bp, Homo sapien
caccgttgcctaagaacgtcatgcg

SEQ ID NO: 92951 - DNA, 25 bp, Homo sapien
gtccaggtacgtctccctccggcgc

SEQ ID NO: 92952 - DNA, 25 bp, Homo sapien
ctccggcgctagtggcgctcggaca

SEQ ID NO: 92953 - DNA, 25 bp, Homo sapien
tctccaaggagctgcggcagaagta

SEQ ID NO: 92954 - DNA, 25 bp, Homo sapien
gcagaagtacaatgtccgctccatg

SEQ ID NO: 92955 - DNA, 25 bp, Homo sapien
gagctgcggcagaagtacaatgtcc

SEQ ID NO: 92956 - DNA, 25 bp, Homo sapien
gaagtacaatgtccgctccatgccc

SEQ ID NO: 92957 - DNA, 25 bp, Homo sapien
ctcacacgtgcgcaggaagatcatg

SEQ ID NO: 92958 - DNA, 25 bp, Homo sapien
cgcagtaaaaaccgcaaacgtcact

SEQ ID NO: 92959 - DNA, 25 bp, Homo sapien
gctccatgcccatccgcaaggacga

SEQ ID NO: 92960 - DNA, 25 bp, Homo sapien
cacacgtgcgcaggaagatcatgtc

SEQ ID NO: 92961 - DNA, 25 bp, Homo sapien
cggcctcactgtgcctctcattgtg

SEQ ID NO: 92962 - DNA, 25 bp, Homo sapien
gtcggcttcttggtgccttggttca

SEQ ID NO: 92963 - DNA, 25 bp, Homo sapien
tgccttggttcatccctaagggtcc

SEQ ID NO: 92964 - DNA, 25 bp, Homo sapien
ttgtgttccttttcgcagcagcttc

SEQ ID NO: 92965 - DNA, 25 bp, Homo sapien
gcgaccatggcgtatcacggcctca

SEQ ID NO: 92966 - DNA, 25 bp, Homo sapien
cccacacgggtcagagaacgttgca

SEQ ID NO: 92967 - DNA, 25 bp, Homo sapien
cttgcacacgctggtcacgcggtca

SEQ ID NO: 92968 - DNA, 25 bp, Homo sapien
tcacgcggtcagctattgacacttc

SEQ ID NO: 92969 - DNA, 25 bp, Homo sapien
ctgtggaacgcctcgcgattggccc

SEQ ID NO: 92970 - DNA, 25 bp, Homo sapien
caaaacaaacccgaggcagcatgga

SEQ ID NO: 92971 - DNA, 25 bp, Homo sapien
gcagacggcccacgcccacactgca

SEQ ID NO: 92972 - DNA, 25 bp, Homo sapien
gcgagtcacgcgatttccgggaacc

SEQ ID NO: 92973 - DNA, 25 bp, Homo sapien
ccctgcagcggaaccggacccagtc

SEQ ID NO: 92974 - DNA, 25 bp, Homo sapien
acaaacccgaggcagcatggagagg

SEQ ID NO: 92975 - DNA, 25 bp, Homo sapien
ccctccggcgacacgtgacaggggt

SEQ ID NO: 92976 - DNA, 25 bp, Homo sapien
gctgccgggtatcgcagacggccca

SEQ ID NO: 92977 - DNA, 25 bp, Homo sapien
atccgctttgggaaaacaagtgttg

SEQ ID NO: 92978 - DNA, 25 bp, Homo sapien
ggccgcgcattcttccaggacctga

SEQ ID NO: 92979 - DNA, 25 bp, Homo sapien
tgttgcagcttctgccgctcggcct

SEQ ID NO: 92980 - DNA, 25 bp, Homo sapien
cctgctgaccctgctgttgcagctt

SEQ ID NO: 92981 - DNA, 25 bp, Homo sapien
taagccatggcttcctcagggagag

SEQ ID NO: 92982 - DNA, 25 bp, Homo sapien
aacgcgggcgcctaagccatggctt

SEQ ID NO: 92983 - DNA, 25 bp, Homo sapien
agtggccactactccgcgggctgac

SEQ ID NO: 92984 - DNA, 25 bp, Homo sapien
cctgatccgctttgggaaaacaagt

SEQ ID NO: 92985 - DNA, 25 bp, Homo sapien
cactaattggttaggctgtgccgga

SEQ ID NO: 92986 - DNA, 25 bp, Homo sapien
cagccatgttagatgggaggggacc

SEQ ID NO: 92987 - DNA, 25 bp, Homo sapien
ctccctcccgggatttgtttatatg

SEQ ID NO: 92988 - DNA, 25 bp, Homo sapien
tctcaaagcagcttgaagcggctga

SEQ ID NO: 92989 - DNA, 25 bp, Homo sapien
ccctcagagctgagtggcaggctct

SEQ ID NO: 92990 - DNA, 25 bp, Homo sapien
ggcggatggagacttctgcaccaat

SEQ ID NO: 92991 - DNA, 25 bp, Homo sapien
tgtttatatgtcttctcaaagcagc

SEQ ID NO: 92992 - DNA, 25 bp, Homo sapien
agacttctgcaccaatgggcgtggg

SEQ ID NO: 92993 - DNA, 25 bp, Homo sapien
gcctgagctcggaatgcttcccgga

SEQ ID NO: 92994 - DNA, 25 bp, Homo sapien
ctgatttggccgaacctgtgcctgc

SEQ ID NO: 92995 - DNA, 25 bp, Homo sapien
aggacgggagctattctgatttggc

SEQ ID NO: 92996 - DNA, 25 bp, Homo sapien
cgtggcgtcgacttaaggtgaaatc

SEQ ID NO: 92997 - DNA, 25 bp, Homo sapien
gtatttagatacacaccgtggcgtc

SEQ ID NO: 92998 - DNA, 25 bp, Homo sapien
gagtcagcggtgaaacctgcggctt

SEQ ID NO: 92999 - DNA, 25 bp, Homo sapien
gaccgcgtgatgtttccgagtcagc

SEQ ID NO: 93000 - DNA, 25 bp, Homo sapien
tgcctgcgggctgggaatgacccaa

SEQ ID NO: 93001 - DNA, 25 bp, Homo sapien
attttccacgtcgagctcgccatcg

SEQ ID NO: 93002 - DNA, 25 bp, Homo sapien
cccgtacctcagtggagtaggtagg

SEQ ID NO: 93003 - DNA, 25 bp, Homo sapien
agtaggtaggccaccgtcctcgctt

SEQ ID NO: 93004 - DNA, 25 bp, Homo sapien
tcctcgcttgccctgactgaggctg

SEQ ID NO: 93005 - DNA, 25 bp, Homo sapien
cgcttgccctgactgaggctgccag

SEQ ID NO: 93006 - DNA, 25 bp, Homo sapien
tccatgcctgtggtacggaagcggc

SEQ ID NO: 93007 - DNA, 25 bp, Homo sapien
tcatcgcgctggtcttcgaggggat

SEQ ID NO: 93008 - DNA, 25 bp, Homo sapien
tcagtggagtaggtaggccaccgtc

SEQ ID NO: 93009 - DNA, 25 bp, Homo sapien
ccgcggtagcgcagcatttcctaac

SEQ ID NO: 93010 - DNA, 25 bp, Homo sapien
catttgtagaaagtcaggctggctc

SEQ ID NO: 93011 - DNA, 25 bp, Homo sapien
cgcacagtaatggtaagggatcctc

SEQ ID NO: 93012 - DNA, 25 bp, Homo sapien
cactgctagggacggtcttatctca

SEQ ID NO: 93013 - DNA, 25 bp, Homo sapien
gcccgaatttgttcccaggcctctg

SEQ ID NO: 93014 - DNA, 25 bp, Homo sapien
accgacacgtctcactcagcatttg

SEQ ID NO: 93015 - DNA, 25 bp, Homo sapien
tgatgctctggggtgaactgaatta

SEQ ID NO: 93016 - DNA, 25 bp, Homo sapien
tcctcgaattggtagcgatcagttc

SEQ ID NO: 93017 - DNA, 25 bp, Homo sapien
gcccgccttgcctttgaagattgtt

SEQ ID NO: 93018 - DNA, 25 bp, Homo sapien
gtgagcggacgcctgaaatattacc

SEQ ID NO: 93019 - DNA, 25 bp, Homo sapien
cctgggagcgctgttaagtgaatct

SEQ ID NO: 93020 - DNA, 25 bp, Homo sapien
tctagtctgtggaggatgccttttc

SEQ ID NO: 93021 - DNA, 25 bp, Homo sapien
cattggcctgatgttgggacttttc

SEQ ID NO: 93022 - DNA, 25 bp, Homo sapien
ccagaacgtacatcttgggtgctca

SEQ ID NO: 93023 - DNA, 25 bp, Homo sapien
gcggcgcagggccaaaaactaccta

SEQ ID NO: 93024 - DNA, 25 bp, Homo sapien
cggctcgcgatgacagtttgaaaga

SEQ ID NO: 93025 - DNA, 25 bp, Homo sapien
tcgggactcgcctcattcaggtggc

SEQ ID NO: 93026 - DNA, 25 bp, Homo sapien
cgagcgcattctccgtgaataaatt

SEQ ID NO: 93027 - DNA, 25 bp, Homo sapien
agcactttttcggactactgtatca

SEQ ID NO: 93028 - DNA, 25 bp, Homo sapien
atccgcggctttatcttcaacaacg

SEQ ID NO: 93029 - DNA, 25 bp, Homo sapien
tcattaatgcgctggggagacgtcc

SEQ ID NO: 93030 - DNA, 25 bp, Homo sapien
agctggaactatcaccgggaatgtc

SEQ ID NO: 93031 - DNA, 25 bp, Homo sapien
tttccacgcttgttcagtgcccacg

SEQ ID NO: 93032 - DNA, 25 bp, Homo sapien
cagggctggtcgcaaaaggtatata

SEQ ID NO: 93033 - DNA, 25 bp, Homo sapien
acaagctgcgcgataccggagcaaa

SEQ ID NO: 93034 - DNA, 25 bp, Homo sapien
ccgagggagtcgctttcagacttcc

SEQ ID NO: 93035 - DNA, 25 bp, Homo sapien
gggcgttctgcgctccaagcaaatt

SEQ ID NO: 93036 - DNA, 25 bp, Homo sapien
cagtctcgtataattcggcgcaagc

SEQ ID NO: 93037 - DNA, 25 bp, Homo sapien
gtgcgttaccgcagccaagtttcca

SEQ ID NO: 93038 - DNA, 25 bp, Homo sapien
ggaatcagttcctcggagtcccgtc

SEQ ID NO: 93039 - DNA, 25 bp, Homo sapien
cggagagaatcgagacgctggaatc

SEQ ID NO: 93040 - DNA, 25 bp, Homo sapien
aactgccgcctgtttttgtgcccgc

SEQ ID NO: 93041 - DNA, 25 bp, Homo sapien
ctttaggcagggaacatcttttgtc

SEQ ID NO: 93042 - DNA, 25 bp, Homo sapien
gacgccacccgcattaggacctaga

SEQ ID NO: 93043 - DNA, 25 bp, Homo sapien
acgccgcctgtcaaaggagacgcca

SEQ ID NO: 93044 - DNA, 25 bp, Homo sapien
tgtctctccgcaagaagctttcctc

SEQ ID NO: 93045 - DNA, 25 bp, Homo sapien
cacacgtttgtgcactctaagcgtc

SEQ ID NO: 93046 - DNA, 25 bp, Homo sapien
gctgctctgggaacacacacgtttg

SEQ ID NO: 93047 - DNA, 25 bp, Homo sapien
ctttccaagggcacagaagaccata

SEQ ID NO: 93048 - DNA, 25 bp, Homo sapien
ggcgccctaagtgcacagtcacttt

SEQ ID NO: 93049 - DNA, 25 bp, Homo sapien
ctccagtgtttcctagagcactctc

SEQ ID NO: 93050 - DNA, 25 bp, Homo sapien
agttgtgccgcccatgcccggctgg

SEQ ID NO: 93051 - DNA, 25 bp, Homo sapien
gacgtgtggttgctccagtgtttcc

SEQ ID NO: 93052 - DNA, 25 bp, Homo sapien
gtttcctagagcactctcagccacg

SEQ ID NO: 93053 - DNA, 25 bp, Homo sapien
cgctgcaggaaccagcccgccgcca

SEQ ID NO: 93054 - DNA, 25 bp, Homo sapien
ctgtgcgcggatgcctgcagacgcc

SEQ ID NO: 93055 - DNA, 25 bp, Homo sapien
cggatgcctgcagacgccgagctgc

SEQ ID NO: 93056 - DNA, 25 bp, Homo sapien
atgcccggctggtttgaaggtgccc

SEQ ID NO: 93057 - DNA, 25 bp, Homo sapien
tgcctttgcccgcttgataaaaaac

SEQ ID NO: 93058 - DNA, 25 bp, Homo sapien
aatcgctgctcagtgcgtgaaaggc

SEQ ID NO: 93059 - DNA, 25 bp, Homo sapien
tctatttcctccaccgacagagcgg

SEQ ID NO: 93060 - DNA, 25 bp, Homo sapien
tccgtgtgaagaggtcttcaaaccc

SEQ ID NO: 93061 - DNA, 25 bp, Homo sapien
gcttgataaaaaacgcgcggtgttc

SEQ ID NO: 93062 - DNA, 25 bp, Homo sapien
tgttctctctccatggccgccaggt

SEQ ID NO: 93063 - DNA, 25 bp, Homo sapien
tgtggaataggaaacgaatcgctgc

SEQ ID NO: 93064 - DNA, 25 bp, Homo sapien
gagtcccgtagagacctggccgtcc

SEQ ID NO: 93065 - DNA, 25 bp, Homo sapien
cgcaggcgcaagaggagcacaccgt

SEQ ID NO: 93066 - DNA, 25 bp, Homo sapien
accgttgccattgcagaccgtcact

SEQ ID NO: 93067 - DNA, 25 bp, Homo sapien
gaccgtcactccctgaggagcctga

SEQ ID NO: 93068 - DNA, 25 bp, Homo sapien
ctgggctcctggctatccctgtgat

SEQ ID NO: 93069 - DNA, 25 bp, Homo sapien
aggagcacaccgttgccattgcaga

SEQ ID NO: 93070 - DNA, 25 bp, Homo sapien
aactcggactgggtcctggacgagc

SEQ ID NO: 93071 - DNA, 25 bp, Homo sapien
gtagctcagcgagatctggggacct

SEQ ID NO: 93072 - DNA, 25 bp, Homo sapien
tccctgtgatggtagctcagcgaga

SEQ ID NO: 93073 - DNA, 25 bp, Homo sapien
tggtctgagcaactgccctatcttc

SEQ ID NO: 93074 - DNA, 25 bp, Homo sapien
cctggccttgtgacactttgcatta

SEQ ID NO: 93075 - DNA, 25 bp, Homo sapien
tggtgcctcaaatatccctggaagc

SEQ ID NO: 93076 - DNA, 25 bp, Homo sapien
ttgaagcagtttcctaggcacaatg

SEQ ID NO: 93077 - DNA, 25 bp, Homo sapien
ccgccgtttggaattcagtgagatt

SEQ ID NO: 93078 - DNA, 25 bp, Homo sapien
ccagcccagaggacttgataaattg

SEQ ID NO: 93079 - DNA, 25 bp, Homo sapien
agagcatgtgaccaggccgttagca

SEQ ID NO: 93080 - DNA, 25 bp, Homo sapien
cgctcggcacacatggttcttggta

SEQ ID NO: 93081 - DNA, 25 bp, Homo sapien
agtcccggcggaagctgtcaaaaag

SEQ ID NO: 93082 - DNA, 25 bp, Homo sapien
ctccacgatgagagcgatgagctgc

SEQ ID NO: 93083 - DNA, 25 bp, Homo sapien
gcccacaagggagaacgactatagc

SEQ ID NO: 93084 - DNA, 25 bp, Homo sapien
cgactatagcttcttctccaggaca

SEQ ID NO: 93085 - DNA, 25 bp, Homo sapien
aacgttgacctttgcattgtggggc

SEQ ID NO: 93086 - DNA, 25 bp, Homo sapien
cgggaagttttctgtggccatctcc

SEQ ID NO: 93087 - DNA, 25 bp, Homo sapien
gcggcctagccgagagaaactacaa

SEQ ID NO: 93088 - DNA, 25 bp, Homo sapien
ccatctccggcgttctttataggca

SEQ ID NO: 93089 - DNA, 25 bp, Homo sapien
ggttgtcatttcactcggctcggtc

SEQ ID NO: 93090 - DNA, 25 bp, Homo sapien
gccttcgtgagcgaggaatccgttc

SEQ ID NO: 93091 - DNA, 25 bp, Homo sapien
tgctcctcctgcaaagcccagttag

SEQ ID NO: 93092 - DNA, 25 bp, Homo sapien
ggcgtctctggaggtaacttttcga

SEQ ID NO: 93093 - DNA, 25 bp, Homo sapien
gtggcctcgcctgagttctaacaga

SEQ ID NO: 93094 - DNA, 25 bp, Homo sapien
tccctcttcgaaccggaagtgtctc

SEQ ID NO: 93095 - DNA, 25 bp, Homo sapien
cagatgattggtcttccggcaggta

SEQ ID NO: 93096 - DNA, 25 bp, Homo sapien
gtcgagtctcgctaatccctcctga

SEQ ID NO: 93097 - DNA, 25 bp, Homo sapien
gcaggaggcgtccacacgatcccaa

SEQ ID NO: 93098 - DNA, 25 bp, Homo sapien
tcccaacaggggcaggaggcgtcca

SEQ ID NO: 93099 - DNA, 25 bp, Homo sapien
ccaacaggggcaggaggcgtccaca

SEQ ID NO: 93100 - DNA, 25 bp, Homo sapien
aggaggcgtccacacgatcccaaca

SEQ ID NO: 93101 - DNA, 25 bp, Homo sapien
caacaggggcaggaggcgtccacac

SEQ ID NO: 93102 - DNA, 25 bp, Homo sapien
ggcaggaggcgtccacacgatccca

SEQ ID NO: 93103 - DNA, 25 bp, Homo sapien
gggcaggaggcgtccacacgatccc

SEQ ID NO: 93104 - DNA, 25 bp, Homo sapien
caggaggcgtccacacgatcccaac

SEQ ID NO: 93105 - DNA, 25 bp, Homo sapien
cctcgcctgcacagtgggcagtctg

SEQ ID NO: 93106 - DNA, 25 bp, Homo sapien
gcagggtggtctggccctaaccgct

SEQ ID NO: 93107 - DNA, 25 bp, Homo sapien
cccagctgcgggcatcgagagttca

SEQ ID NO: 93108 - DNA, 25 bp, Homo sapien
tcggcgcgcttcgtctatgtgacgc

SEQ ID NO: 93109 - DNA, 25 bp, Homo sapien
agttcagagcggcaccagacagtcg

SEQ ID NO: 93110 - DNA, 25 bp, Homo sapien
atgtgacgcgcttcggctcgcatca

SEQ ID NO: 93111 - DNA, 25 bp, Homo sapien
tcgcatcagtgcagtggcgtcctgc

SEQ ID NO: 93112 - DNA, 25 bp, Homo sapien
atcctcacgcggtggtctggcccta

SEQ ID NO: 93113 - DNA, 25 bp, Homo sapien
actggacgctgggaagactttcacc

SEQ ID NO: 93114 - DNA, 25 bp, Homo sapien
cgctgattgtggtgttatttgtgca

SEQ ID NO: 93115 - DNA, 25 bp, Homo sapien
cccgcaaacgcgagctcctttgttt

SEQ ID NO: 93116 - DNA, 25 bp, Homo sapien
cattcaacccgccagtcaaaggagg

SEQ ID NO: 93117 - DNA, 25 bp, Homo sapien
agagggacggccgacattcaacccg

SEQ ID NO: 93118 - DNA, 25 bp, Homo sapien
ggcagatcttccagctaggcccaga

SEQ ID NO: 93119 - DNA, 25 bp, Homo sapien
atgcctgtctctgccgaagccgaag

SEQ ID NO: 93120 - DNA, 25 bp, Homo sapien
ggtcgaggcctcctagcgacttgcc

SEQ ID NO: 93121 - DNA, 25 bp, Homo sapien
ctgcttctgatacccgggctcggta

SEQ ID NO: 93122 - DNA, 25 bp, Homo sapien
ctcggggttacaaacgctgcgttct

SEQ ID NO: 93123 - DNA, 25 bp, Homo sapien
cgctggggttacaaactagccttcg

SEQ ID NO: 93124 - DNA, 25 bp, Homo sapien
tcccattagggcgaattgtcattcc

SEQ ID NO: 93125 - DNA, 25 bp, Homo sapien
ctctgggagcgagcttgtcccatta

SEQ ID NO: 93126 - DNA, 25 bp, Homo sapien
ctcccattaggaggaattgtcactc

SEQ ID NO: 93127 - DNA, 25 bp, Homo sapien
gcgcgcagtgctccacagtttgcaa

SEQ ID NO: 93128 - DNA, 25 bp, Homo sapien
ataggccgctaacgagctcccatta

SEQ ID NO: 93129 - DNA, 25 bp, Homo sapien
gtggtccgtttctacagccctcggc

SEQ ID NO: 93130 - DNA, 25 bp, Homo sapien
tggcttctccgtccaaaggcaatga

SEQ ID NO: 93131 - DNA, 25 bp, Homo sapien
gcaatgacttgttttcgcccgacga

SEQ ID NO: 93132 - DNA, 25 bp, Homo sapien
tggaggcgctcatgtccgacaagaa

SEQ ID NO: 93133 - DNA, 25 bp, Homo sapien
cgcctcggtcaagtcggaaaattca

SEQ ID NO: 93134 - DNA, 25 bp, Homo sapien
cgtgcgctacactcccgggaaagca

SEQ ID NO: 93135 - DNA, 25 bp, Homo sapien
tgagactccctcgacatacagattg

SEQ ID NO: 93136 - DNA, 25 bp, Homo sapien
cccgtctccgcagcaaaaaagtttg

SEQ ID NO: 93137 - DNA, 25 bp, Homo sapien
gcgaggacttcttgctgcgtaaaca

SEQ ID NO: 93138 - DNA, 25 bp, Homo sapien
tgtggcggcaaaaggactctccctc

SEQ ID NO: 93139 - DNA, 25 bp, Homo sapien
tgtgcccgcacgcactttgaaagtg

SEQ ID NO: 93140 - DNA, 25 bp, Homo sapien
cagaagtgatccaaaccgaggggtc

SEQ ID NO: 93141 - DNA, 25 bp, Homo sapien
acctacctgaaagcgcgtctctgca

SEQ ID NO: 93142 - DNA, 25 bp, Homo sapien
aagcctttcccggtttcgtcatcag

SEQ ID NO: 93143 - DNA, 25 bp, Homo sapien
cgtggttcagaggtttcacaagctc

SEQ ID NO: 93144 - DNA, 25 bp, Homo sapien
gctccgggttaagactctgctcgtc

SEQ ID NO: 93145 - DNA, 25 bp, Homo sapien
tcccgaaggtctctgcctaatcaca

SEQ ID NO: 93146 - DNA, 25 bp, Homo sapien
gctccaccggcacggaagatcgcag

SEQ ID NO: 93147 - DNA, 25 bp, Homo sapien
cctggcaagccagcaagggagtgac

SEQ ID NO: 93148 - DNA, 25 bp, Homo sapien
cccatagaaccgtgggcgtcgcagg

SEQ ID NO: 93149 - DNA, 25 bp, Homo sapien
gaatgcggccgggttatcaatcacc

SEQ ID NO: 93150 - DNA, 25 bp, Homo sapien
atcacccagctggatcccgaaggtc

SEQ ID NO: 93151 - DNA, 25 bp, Homo sapien
taaatacgcactgacaccggcccgg

SEQ ID NO: 93152 - DNA, 25 bp, Homo sapien
cacatttaattgctcgtggaggccc

SEQ ID NO: 93153 - DNA, 25 bp, Homo sapien
ctctgttccacgtcatccaggtaca

SEQ ID NO: 93154 - DNA, 25 bp, Homo sapien
ctctttctgctggtgctcttggacg

SEQ ID NO: 93155 - DNA, 25 bp, Homo sapien
acagaccgtggtcccacattcgcta

SEQ ID NO: 93156 - DNA, 25 bp, Homo sapien
gggtacagaccgtggtcccacattc

SEQ ID NO: 93157 - DNA, 25 bp, Homo sapien
caacaagcatcgcagggcactgtcc

SEQ ID NO: 93158 - DNA, 25 bp, Homo sapien
ctccaacaagcatcgcagggcactg

SEQ ID NO: 93159 - DNA, 25 bp, Homo sapien
ggctgggcagctggccaccacttct

SEQ ID NO: 93160 - DNA, 25 bp, Homo sapien
ggcatccgcagtccgtctggtcgtc

SEQ ID NO: 93161 - DNA, 25 bp, Homo sapien
gaagccctggcctggttaccattcg

SEQ ID NO: 93162 - DNA, 25 bp, Homo sapien
tatccgcgcgagtctctagcacagc

SEQ ID NO: 93163 - DNA, 25 bp, Homo sapien
gctcttgggcgttagaaccccgcga

SEQ ID NO: 93164 - DNA, 25 bp, Homo sapien
cctgtccctgtgctaagagggtgac

SEQ ID NO: 93165 - DNA, 25 bp, Homo sapien
tccctgtgctaagagggtgacgcga

SEQ ID NO: 93166 - DNA, 25 bp, Homo sapien
tgacgcgagtgcccgaagccctggc

SEQ ID NO: 93167 - DNA, 25 bp, Homo sapien
tggcctggttaccattcgcgactcc

SEQ ID NO: 93168 - DNA, 25 bp, Homo sapien
cgtatccgcgcgagtctctagcaca

SEQ ID NO: 93169 - DNA, 25 bp, Homo sapien
ctccgcgccaaaatggatgggtctc

SEQ ID NO: 93170 - DNA, 25 bp, Homo sapien
cagctgtgctcagactgtgaaatcc

SEQ ID NO: 93171 - DNA, 25 bp, Homo sapien
cgccgcgttctcaggtacacaaatg

SEQ ID NO: 93172 - DNA, 25 bp, Homo sapien
tttccactgtaaagagtgtcagccg

SEQ ID NO: 93173 - DNA, 25 bp, Homo sapien
ccggcgcacaaaagcttcatatatt

SEQ ID NO: 93174 - DNA, 25 bp, Homo sapien
gccgtgagggagacttaattctctc

SEQ ID NO: 93175 - DNA, 25 bp, Homo sapien
acggatacaaatgcgccgccgcgtt

SEQ ID NO: 93176 - DNA, 25 bp, Homo sapien
gccggctcggctttgattagcaaca

SEQ ID NO: 93177 - DNA, 25 bp, Homo sapien
cggtcctcgcttgacaggcagagtt

SEQ ID NO: 93178 - DNA, 25 bp, Homo sapien
cctgaaaacagggaagcggaatctt

SEQ ID NO: 93179 - DNA, 25 bp, Homo sapien
gcggaatcttctccactcaggactc

SEQ ID NO: 93180 - DNA, 25 bp, Homo sapien
tcactcacaagggttccagcgaccg

SEQ ID NO: 93181 - DNA, 25 bp, Homo sapien
gtccgacctgcgttgtctccaagtg

SEQ ID NO: 93182 - DNA, 25 bp, Homo sapien
ccggtccatgactgccagaacctga

SEQ ID NO: 93183 - DNA, 25 bp, Homo sapien
ggcccgcgaggcaaatccaatgtca

SEQ ID NO: 93184 - DNA, 25 bp, Homo sapien
tagccggacccaaagccctaagcga

SEQ ID NO: 93185 - DNA, 25 bp, Homo sapien
gcggccggacaacaccacgcttcca

SEQ ID NO: 93186 - DNA, 25 bp, Homo sapien
tcgctccggggacaccaagatggct

SEQ ID NO: 93187 - DNA, 25 bp, Homo sapien
ccacaccaccgtgaggatgggcttg

SEQ ID NO: 93188 - DNA, 25 bp, Homo sapien
acgcttccagcatcccgaggcccag

SEQ ID NO: 93189 - DNA, 25 bp, Homo sapien
tcgctaagccagaagcggagtcgcg

SEQ ID NO: 93190 - DNA, 25 bp, Homo sapien
cggtcgctaagccagaagcggagtc

SEQ ID NO: 93191 - DNA, 25 bp, Homo sapien
atgggcttggagttcctcttggacc

SEQ ID NO: 93192 - DNA, 25 bp, Homo sapien
ggcgaactcgctccggggacaccaa

SEQ ID NO: 93193 - DNA, 25 bp, Homo sapien
ctgtcggagcatggagcaactttct

SEQ ID NO: 93194 - DNA, 25 bp, Homo sapien
cggatgaccgatgaccggagccaca

SEQ ID NO: 93195 - DNA, 25 bp, Homo sapien
ggaggcttctatgtctcaggaaacc

SEQ ID NO: 93196 - DNA, 25 bp, Homo sapien
tgcggagccaatacccgcggcagca

SEQ ID NO: 93197 - DNA, 25 bp, Homo sapien
agtttccttgtctgtgaccgcgggg

SEQ ID NO: 93198 - DNA, 25 bp, Homo sapien
tggaaagtgcacttgcgccgaaaca

SEQ ID NO: 93199 - DNA, 25 bp, Homo sapien
aggaaaccagaacgacctgccttca

SEQ ID NO: 93200 - DNA, 25 bp, Homo sapien
agcaactttctgctaaagggaagcc

SEQ ID NO: 93201 - DNA, 25 bp, Homo sapien
cctgactggtgagcgcacagctccg

SEQ ID NO: 93202 - DNA, 25 bp, Homo sapien
tatcgaccatgttcgggaccgtgga

SEQ ID NO: 93203 - DNA, 25 bp, Homo sapien
gctccgtgtattgcagagtgcctcg

SEQ ID NO: 93204 - DNA, 25 bp, Homo sapien
gctgttcaccttggggctatcgacc

SEQ ID NO: 93205 - DNA, 25 bp, Homo sapien
gctcttcttcgggatgctgttcacc

SEQ ID NO: 93206 - DNA, 25 bp, Homo sapien
tgtgggccatgctcttcttcgggat

SEQ ID NO: 93207 - DNA, 25 bp, Homo sapien
ggagaccgacctccacatgccgggg

SEQ ID NO: 93208 - DNA, 25 bp, Homo sapien
ctggccttcgtcgtcttcacggaga

SEQ ID NO: 93209 - DNA, 25 bp, Homo sapien
tatgcgcagcacgtctggaacaggg

SEQ ID NO: 93210 - DNA, 25 bp, Homo sapien
tggaacagggcccttggtgattaaa

SEQ ID NO: 93211 - DNA, 25 bp, Homo sapien
ttggtgattaaaacgcctcgggaca

SEQ ID NO: 93212 - DNA, 25 bp, Homo sapien
cctcgggacagaaaagccgaactga

SEQ ID NO: 93213 - DNA, 25 bp, Homo sapien
ccgaactgaaacattggtgaaaata

SEQ ID NO: 93214 - DNA, 25 bp, Homo sapien
agcggcatcgacagggacatctcca

SEQ ID NO: 93215 - DNA, 25 bp, Homo sapien
gcagcagcaggcaggatttatttcc

SEQ ID NO: 93216 - DNA, 25 bp, Homo sapien
atttccggcgttgtttatgcgcagc

SEQ ID NO: 93217 - DNA, 25 bp, Homo sapien
aacaggcacagaacggtcccggctc

SEQ ID NO: 93218 - DNA, 25 bp, Homo sapien
accgggtccctatcgggtcagcact

SEQ ID NO: 93219 - DNA, 25 bp, Homo sapien
tgcagcctccaacaggttcgtagaa

SEQ ID NO: 93220 - DNA, 25 bp, Homo sapien
ttctcccagagaggtgtcaccggcg

SEQ ID NO: 93221 - DNA, 25 bp, Homo sapien
agagcttcctagaggcggcttcctc

SEQ ID NO: 93222 - DNA, 25 bp, Homo sapien
ccagctcagaatcgcggacttccaa

SEQ ID NO: 93223 - DNA, 25 bp, Homo sapien
ggctggcagctgcaatcactgactc

SEQ ID NO: 93224 - DNA, 25 bp, Homo sapien
cccggaacatccctagaaagtgtga

SEQ ID NO: 93225 - DNA, 25 bp, Homo sapien
ctacttctggctgtgcttaacccga

SEQ ID NO: 93226 - DNA, 25 bp, Homo sapien
ccctgccagaagcaaatgagtgttg

SEQ ID NO: 93227 - DNA, 25 bp, Homo sapien
cttccgcttttcagccggagtcggc

SEQ ID NO: 93228 - DNA, 25 bp, Homo sapien
tgtcctctcttctggccgggaaacg

SEQ ID NO: 93229 - DNA, 25 bp, Homo sapien
ccaccgggagatccaggacagagct

SEQ ID NO: 93230 - DNA, 25 bp, Homo sapien
tgctctcgttctcgtcggcctcaat

SEQ ID NO: 93231 - DNA, 25 bp, Homo sapien
gaacaactttgagctcgcgggagtg

SEQ ID NO: 93232 - DNA, 25 bp, Homo sapien
gggacgtcgatctaagctacttctg

SEQ ID NO: 93233 - DNA, 25 bp, Homo sapien
cgtcgcaactccaggccaccgagtg

SEQ ID NO: 93234 - DNA, 25 bp, Homo sapien
tgcatcccaagcacgtagcgcgacg

SEQ ID NO: 93235 - DNA, 25 bp, Homo sapien
gccaccgagtgcaccttggcgctgt

SEQ ID NO: 93236 - DNA, 25 bp, Homo sapien
tacaaatcccggtatgcagcgcgtg

SEQ ID NO: 93237 - DNA, 25 bp, Homo sapien
cgaggctaggcgacgcccgtcgcaa

SEQ ID NO: 93238 - DNA, 25 bp, Homo sapien
agacgctggccgtcttgtcgaagga

SEQ ID NO: 93239 - DNA, 25 bp, Homo sapien
ggcagctcaccaaccggtccttctc

SEQ ID NO: 93240 - DNA, 25 bp, Homo sapien
gaactcgcgcgtcttgctgtggccc

SEQ ID NO: 93241 - DNA, 25 bp, Homo sapien
catcttcttcatcgagggcggcgtc

SEQ ID NO: 93242 - DNA, 25 bp, Homo sapien
ttcccgcagacggtgcagatcctca

SEQ ID NO: 93243 - DNA, 25 bp, Homo sapien
ggcctcatccacctaggctttggca

SEQ ID NO: 93244 - DNA, 25 bp, Homo sapien
tccacctaggctttggcagcgtgct

SEQ ID NO: 93245 - DNA, 25 bp, Homo sapien
tttggcagcgtgctgctcatggttc

SEQ ID NO: 93246 - DNA, 25 bp, Homo sapien
tgctgctcatggttcgccgcggcca

SEQ ID NO: 93247 - DNA, 25 bp, Homo sapien
ggtgcagatcctcatcggcctcatc

SEQ ID NO: 93248 - DNA, 25 bp, Homo sapien
ccacgtgggcatcttcttcatcgag

SEQ ID NO: 93249 - DNA, 25 bp, Homo sapien
catcacaagaagaaaagcgcttatc

SEQ ID NO: 93250 - DNA, 25 bp, Homo sapien
tcacaagaagaaaagcgcttatcag

SEQ ID NO: 93251 - DNA, 25 bp, Homo sapien
acaagaagaaaagcgcttatcaggg

SEQ ID NO: 93252 - DNA, 25 bp, Homo sapien
agaagaaaagcgcttatcagggcgc

SEQ ID NO: 93253 - DNA, 25 bp, Homo sapien
gctgcccatcacaagaagaaaagcg

SEQ ID NO: 93254 - DNA, 25 bp, Homo sapien
tgcccatcacaagaagaaaagcgct

SEQ ID NO: 93255 - DNA, 25 bp, Homo sapien
cccatcacaagaagaaaagcgctta

SEQ ID NO: 93256 - DNA, 25 bp, Homo sapien
agaaaagcgcttatcagggcgctgt

SEQ ID NO: 93257 - DNA, 25 bp, Homo sapien
gccatgccaatgctctccaagctga

SEQ ID NO: 93258 - DNA, 25 bp, Homo sapien
gcaatctgagctgctgtacgccctg

SEQ ID NO: 93259 - DNA, 25 bp, Homo sapien
gactcctgggcaatctgagctgctg

SEQ ID NO: 93260 - DNA, 25 bp, Homo sapien
ggacactgtgggcatggcacctctg

SEQ ID NO: 93261 - DNA, 25 bp, Homo sapien
gtcgcgcagaaaggacggtggttct

SEQ ID NO: 93262 - DNA, 25 bp, Homo sapien
gcagcaccggatgtctccttcgccc

SEQ ID NO: 93263 - DNA, 25 bp, Homo sapien
cacggggccaccttcgcgctggccc

SEQ ID NO: 93264 - DNA, 25 bp, Homo sapien
tgctgtacgccctgctctggtctct

SEQ ID NO: 93265 - DNA, 25 bp, Homo sapien
cgcaccggatgtcgtctttgccatc

SEQ ID NO: 93266 - DNA, 25 bp, Homo sapien
cttgggacaaccacgctgggaactc

SEQ ID NO: 93267 - DNA, 25 bp, Homo sapien
cagggactccagagcactcagcggc

SEQ ID NO: 93268 - DNA, 25 bp, Homo sapien
tacttttgtgagcagcctcggcgca

SEQ ID NO: 93269 - DNA, 25 bp, Homo sapien
cagccagcaagacttacttttgtga

SEQ ID NO: 93270 - DNA, 25 bp, Homo sapien
gcactctgggccacctttgcactgg

SEQ ID NO: 93271 - DNA, 25 bp, Homo sapien
cccagcgcaagcagaaaggtgcttc

SEQ ID NO: 93272 - DNA, 25 bp, Homo sapien
ggaactcccactgcgctaggttctg

SEQ ID NO: 93273 - DNA, 25 bp, Homo sapien
ttcacgctttcgtcggttggaagca

SEQ ID NO: 93274 - DNA, 25 bp, Homo sapien
ccgcgccgccacgaagcacagcgac

SEQ ID NO: 93275 - DNA, 25 bp, Homo sapien
ctcagaagcaggaaccgaagtcgtc

SEQ ID NO: 93276 - DNA, 25 bp, Homo sapien
agcaggaaccgaagtcgtcgccgcc

SEQ ID NO: 93277 - DNA, 25 bp, Homo sapien
ggacgacagcggctctgagagctcc

SEQ ID NO: 93278 - DNA, 25 bp, Homo sapien
cggccgagcacatggacgagctcct

SEQ ID NO: 93279 - DNA, 25 bp, Homo sapien
acatggacgagctcctggcgcgcct

SEQ ID NO: 93280 - DNA, 25 bp, Homo sapien
cctcacttcacgctttcgtcggttg

SEQ ID NO: 93281 - DNA, 25 bp, Homo sapien
agttgttgtccacgatcgcgagacc

SEQ ID NO: 93282 - DNA, 25 bp, Homo sapien
gcagtctggacccaagccattgtga

SEQ ID NO: 93283 - DNA, 25 bp, Homo sapien
agctgcagggcattcccggagagaa

SEQ ID NO: 93284 - DNA, 25 bp, Homo sapien
cccaagacccactaggtagcagtac

SEQ ID NO: 93285 - DNA, 25 bp, Homo sapien
aggtagcagtaccacccagcgggca

SEQ ID NO: 93286 - DNA, 25 bp, Homo sapien
cagctccgagtgtggaatccgccag

SEQ ID NO: 93287 - DNA, 25 bp, Homo sapien
tgttcacctgtgatcctgctgccgc

SEQ ID NO: 93288 - DNA, 25 bp, Homo sapien
gcactgcagataaagcctccggaga

SEQ ID NO: 93289 - DNA, 25 bp, Homo sapien
cgcgagcgtttaaggaattcgccaa

SEQ ID NO: 93290 - DNA, 25 bp, Homo sapien
attcaggactgcaaaggcggcgttc

SEQ ID NO: 93291 - DNA, 25 bp, Homo sapien
ttcatcctctggaagacctacttcg

SEQ ID NO: 93292 - DNA, 25 bp, Homo sapien
ctccacgccatgaggctcgggtgtt

SEQ ID NO: 93293 - DNA, 25 bp, Homo sapien
gtgaccacggaacggccctgctggt

SEQ ID NO: 93294 - DNA, 25 bp, Homo sapien
tgcgactccgcgcatgtggccaagg

SEQ ID NO: 93295 - DNA, 25 bp, Homo sapien
gaagacctacttcggccgcggccga

SEQ ID NO: 93296 - DNA, 25 bp, Homo sapien
catgcctgcctgtcccaggacgggt

SEQ ID NO: 93297 - DNA, 25 bp, Homo sapien
cagctaatgaggctgtggtcccgca

SEQ ID NO: 93298 - DNA, 25 bp, Homo sapien
gaggtaccaaaaggctcctgctgtc

SEQ ID NO: 93299 - DNA, 25 bp, Homo sapien
gcggtctggctgacccttcctgaaa

SEQ ID NO: 93300 - DNA, 25 bp, Homo sapien
cagactctgaacctagcctggctgg

SEQ ID NO: 93301 - DNA, 25 bp, Homo sapien
gggctcccggtctcacagactctga

SEQ ID NO: 93302 - DNA, 25 bp, Homo sapien
tggttactgctttcctgacgcccgg

SEQ ID NO: 93303 - DNA, 25 bp, Homo sapien
gactcaaccttgatgccgctgtgta

SEQ ID NO: 93304 - DNA, 25 bp, Homo sapien
ctcgcgtcaggagaagctctacccg

SEQ ID NO: 93305 - DNA, 25 bp, Homo sapien
gcctctgtctctcagacctcgtgta

SEQ ID NO: 93306 - DNA, 25 bp, Homo sapien
ctgtaaccaaacttctgcctccggg

SEQ ID NO: 93307 - DNA, 25 bp, Homo sapien
ccggttcagacgctttcggttgaca

SEQ ID NO: 93308 - DNA, 25 bp, Homo sapien
gccttccgtcgagcattccggttca

SEQ ID NO: 93309 - DNA, 25 bp, Homo sapien
ccgatttagcgtggtcccaggcatg

SEQ ID NO: 93310 - DNA, 25 bp, Homo sapien
ccaggttctgccgtaccgatttagc

SEQ ID NO: 93311 - DNA, 25 bp, Homo sapien
cgactcccaggatgcaacgagcatt

SEQ ID NO: 93312 - DNA, 25 bp, Homo sapien
cgtgcacaaggctttgcgggcattt

SEQ ID NO: 93313 - DNA, 25 bp, Homo sapien
agccagcgctctcagctcatgatgc

SEQ ID NO: 93314 - DNA, 25 bp, Homo sapien
ggggcaacagccagcgctctcagct

SEQ ID NO: 93315 - DNA, 25 bp, Homo sapien
gcgcacccggatcgccgcccagggt

SEQ ID NO: 93316 - DNA, 25 bp, Homo sapien
tctcagctcatgatgcgcacccgga

SEQ ID NO: 93317 - DNA, 25 bp, Homo sapien
aacagccagcgctctcagctcatga

SEQ ID NO: 93318 - DNA, 25 bp, Homo sapien
ggcggccgccctcacctacggcctc

SEQ ID NO: 93319 - DNA, 25 bp, Homo sapien
tctactccttccaccggggcaacag

SEQ ID NO: 93320 - DNA, 25 bp, Homo sapien
tcagctcatgatgcgcacccggatc

SEQ ID NO: 93321 - DNA, 25 bp, Homo sapien
tccgctgtgatccagagatcttggc

SEQ ID NO: 93322 - DNA, 25 bp, Homo sapien
tccagagatcttggctttggggaag

SEQ ID NO: 93323 - DNA, 25 bp, Homo sapien
cgactcgacctaccctcgccgccct

SEQ ID NO: 93324 - DNA, 25 bp, Homo sapien
tccctccgctgtgatccagagatct

SEQ ID NO: 93325 - DNA, 25 bp, Homo sapien
aagcgagacccaaagcggggaatga

SEQ ID NO: 93326 - DNA, 25 bp, Homo sapien
acccaaagcggggaatgacctgcgg

SEQ ID NO: 93327 - DNA, 25 bp, Homo sapien
cctgctgtttcccagttgctttgtc

SEQ ID NO: 93328 - DNA, 25 bp, Homo sapien
ggcccgacctgctgtttcccagttg

SEQ ID NO: 93329 - DNA, 25 bp, Homo sapien
cacagagtggccgtaccgtgcacag

SEQ ID NO: 93330 - DNA, 25 bp, Homo sapien
aagccctcgtcgttctctatgcctg

SEQ ID NO: 93331 - DNA, 25 bp, Homo sapien
tgcaatctcgctctcctgctgggcc

SEQ ID NO: 93332 - DNA, 25 bp, Homo sapien
cgctctccgacgacgagaagaagcc

SEQ ID NO: 93333 - DNA, 25 bp, Homo sapien
gaagccaaagtcatcagccattttc

SEQ ID NO: 93334 - DNA, 25 bp, Homo sapien
ggacacctgggctaggcactgctcc

SEQ ID NO: 93335 - DNA, 25 bp, Homo sapien
taccgtgcacagagctgcgacagga

SEQ ID NO: 93336 - DNA, 25 bp, Homo sapien
cgtcgaggacacctgggctaggcac

SEQ ID NO: 93337 - DNA, 25 bp, Homo sapien
gtggccgaagtctgcccacagcttc

SEQ ID NO: 93338 - DNA, 25 bp, Homo sapien
gcagatcctttcgtcgcctaaatgg

SEQ ID NO: 93339 - DNA, 25 bp, Homo sapien
ccgagtccagatcttcctgcaagtg

SEQ ID NO: 93340 - DNA, 25 bp, Homo sapien
ggtctcctttcgtcgcctaatctta

SEQ ID NO: 93341 - DNA, 25 bp, Homo sapien
ctctcggctctgcaagactgcactg

SEQ ID NO: 93342 - DNA, 25 bp, Homo sapien
gtctcccgagaaacctccaagagta

SEQ ID NO: 93343 - DNA, 25 bp, Homo sapien
tcccgagagatggtcaggagctttt

SEQ ID NO: 93344 - DNA, 25 bp, Homo sapien
gcgccagtatccagagcccttcgga

SEQ ID NO: 93345 - DNA, 25 bp, Homo sapien
ctcccggttgtggtccaagcctggg

SEQ ID NO: 93346 - DNA, 25 bp, Homo sapien
gctcccggttgtggtccaagcctgg

SEQ ID NO: 93347 - DNA, 25 bp, Homo sapien
tgggctcccggttgtggtccaagcc

SEQ ID NO: 93348 - DNA, 25 bp, Homo sapien
aagcctgggtgcgagctgggctccc

SEQ ID NO: 93349 - DNA, 25 bp, Homo sapien
tgggctcccggttgtcgtccaagcc

SEQ ID NO: 93350 - DNA, 25 bp, Homo sapien
ccggttgtcgtccaagcctgggtgc

SEQ ID NO: 93351 - DNA, 25 bp, Homo sapien
ctcccggttgtcgtccaagcctggg

SEQ ID NO: 93352 - DNA, 25 bp, Homo sapien
ggctcccggttgtcgtccaagcctg

SEQ ID NO: 93353 - DNA, 25 bp, Homo sapien
gggtgcctgtctggatcctttaaga

SEQ ID NO: 93354 - DNA, 25 bp, Homo sapien
ggtgccgcctgagatactgaagtgc

SEQ ID NO: 93355 - DNA, 25 bp, Homo sapien
cggggccgcatatcctgacataaag

SEQ ID NO: 93356 - DNA, 25 bp, Homo sapien
ccggccacacgttgactcctttgtt

SEQ ID NO: 93357 - DNA, 25 bp, Homo sapien
accgatcggctgcaactcgaacttg

SEQ ID NO: 93358 - DNA, 25 bp, Homo sapien
tcacaacattcgaagcggcggggtc

SEQ ID NO: 93359 - DNA, 25 bp, Homo sapien
cctgccgaagaaatgggtcccgcca

SEQ ID NO: 93360 - DNA, 25 bp, Homo sapien
cctttaagaactgtccgcggcggca

SEQ ID NO: 93361 - DNA, 25 bp, Homo sapien
tctgcggaatggaattgatgatacc

SEQ ID NO: 93362 - DNA, 25 bp, Homo sapien
tccagtgacaacaaaacgaggcggc

SEQ ID NO: 93363 - DNA, 25 bp, Homo sapien
gaccctcacttttcaagtctgcgga

SEQ ID NO: 93364 - DNA, 25 bp, Homo sapien
gctttgggccattctctgaccctca

SEQ ID NO: 93365 - DNA, 25 bp, Homo sapien
cccatggtcgttcagagaatcttcg

SEQ ID NO: 93366 - DNA, 25 bp, Homo sapien
agtgacttcgttttctcgcctgtga

SEQ ID NO: 93367 - DNA, 25 bp, Homo sapien
tccgtgaccttggaggagtgacttc

SEQ ID NO: 93368 - DNA, 25 bp, Homo sapien
cgagacatcgggagggattacgttc

SEQ ID NO: 93369 - DNA, 25 bp, Homo sapien
ctggacacgggctcggccttcggct

SEQ ID NO: 93370 - DNA, 25 bp, Homo sapien
tggcggccgtgctcctcgatctgtc

SEQ ID NO: 93371 - DNA, 25 bp, Homo sapien
ctcgatctgtcgctccagatgcttc

SEQ ID NO: 93372 - DNA, 25 bp, Homo sapien
cagatgcttctggatggccatgccc

SEQ ID NO: 93373 - DNA, 25 bp, Homo sapien
cgtcctgcggagacatggggctcac

SEQ ID NO: 93374 - DNA, 25 bp, Homo sapien
tcacggccactgagacgcaggcctg

SEQ ID NO: 93375 - DNA, 25 bp, Homo sapien
cgccttggtgaagttgtcgcgagtc

SEQ ID NO: 93376 - DNA, 25 bp, Homo sapien
ctttctggccgagactggaggcctc

SEQ ID NO: 93377 - DNA, 25 bp, Homo sapien
ggcgaggagcctggaaacagacacc

SEQ ID NO: 93378 - DNA, 25 bp, Homo sapien
gccctcgcctggcttgaccaaggag

SEQ ID NO: 93379 - DNA, 25 bp, Homo sapien
ggcgcgccgtctagcagatcttaga

SEQ ID NO: 93380 - DNA, 25 bp, Homo sapien
gcgcttaccaggcagtgccgctgct

SEQ ID NO: 93381 - DNA, 25 bp, Homo sapien
gccatgccgaacaaagccagcgggc

SEQ ID NO: 93382 - DNA, 25 bp, Homo sapien
tcgctccggggaagatgaatcaacg

SEQ ID NO: 93383 - DNA, 25 bp, Homo sapien
ccacactggttgtgtgacggcgagt

SEQ ID NO: 93384 - DNA, 25 bp, Homo sapien
gcgggttcccacttcacagacaggg

SEQ ID NO: 93385 - DNA, 25 bp, Homo sapien
ggggactctccatgccacaatcaca

SEQ ID NO: 93386 - DNA, 25 bp, Homo sapien
catatggacccacggacaggcacgc

SEQ ID NO: 93387 - DNA, 25 bp, Homo sapien
agtgctgatcctgatccgctcaagg

SEQ ID NO: 93388 - DNA, 25 bp, Homo sapien
tgcggctctggctacagacagatta

SEQ ID NO: 93389 - DNA, 25 bp, Homo sapien
cacactcgggttcgcgcatatggac

SEQ ID NO: 93390 - DNA, 25 bp, Homo sapien
ccagctggcactttagggactagca

SEQ ID NO: 93391 - DNA, 25 bp, Homo sapien
tagctttattcatggactctcgggg

SEQ ID NO: 93392 - DNA, 25 bp, Homo sapien
ggagaggtctttcagcgctcgaatg

SEQ ID NO: 93393 - DNA, 25 bp, Homo sapien
gcagacgctccaacgcgcacgaata

SEQ ID NO: 93394 - DNA, 25 bp, Homo sapien
aacgccctccttggccatggacagg

SEQ ID NO: 93395 - DNA, 25 bp, Homo sapien
ttcatgaacacgtccatcctggcgg

SEQ ID NO: 93396 - DNA, 25 bp, Homo sapien
cggagagtcctagcgtccttgaaac

SEQ ID NO: 93397 - DNA, 25 bp, Homo sapien
cgcgaatatccaggacccgcctgta

SEQ ID NO: 93398 - DNA, 25 bp, Homo sapien
gggcagctgcaaacaccggagcata

SEQ ID NO: 93399 - DNA, 25 bp, Homo sapien
gagcatactcacatactccggggtg

SEQ ID NO: 93400 - DNA, 25 bp, Homo sapien
ttatccgggccctgcaaactgcagc

SEQ ID NO: 93401 - DNA, 25 bp, Homo sapien
ctccctgggacgtagagcccggcgt

SEQ ID NO: 93402 - DNA, 25 bp, Homo sapien
ccgggagcttccgactcagctgcgt

SEQ ID NO: 93403 - DNA, 25 bp, Homo sapien
cagtcagcgtcgtccccgggagctt

SEQ ID NO: 93404 - DNA, 25 bp, Homo sapien
tggtcttgaagtctgagggcagtgc

SEQ ID NO: 93405 - DNA, 25 bp, Homo sapien
ggccatcagtccaggatggtcttga

SEQ ID NO: 93406 - DNA, 25 bp, Homo sapien
ggtggccatcagtccaggatggtct

SEQ ID NO: 93407 - DNA, 25 bp, Homo sapien
tagagcccggcgtgacagggctgct

SEQ ID NO: 93408 - DNA, 25 bp, Homo sapien
agcttccgactcagctgcgtctggg

SEQ ID NO: 93409 - DNA, 25 bp, Homo sapien
cgtcccgggcgggtctgcaggacgc

SEQ ID NO: 93410 - DNA, 25 bp, Homo sapien
tctgcaggacgctgggaaacgcggc

SEQ ID NO: 93411 - DNA, 25 bp, Homo sapien
gctgcgaggaggtccgaatcaggct

SEQ ID NO: 93412 - DNA, 25 bp, Homo sapien
aggcgggactccaaagggactgagg

SEQ ID NO: 93413 - DNA, 25 bp, Homo sapien
cgctctgtgtggccgaggccatgaa

SEQ ID NO: 93414 - DNA, 25 bp, Homo sapien
caggcgggactgagttgatctatgg

SEQ ID NO: 93415 - DNA, 25 bp, Homo sapien
ctccggcgccatcagccggcgtccc

SEQ ID NO: 93416 - DNA, 25 bp, Homo sapien
ggacagcagggctccgggcaaggag

SEQ ID NO: 93417 - DNA, 25 bp, Homo sapien
atttattactggaggccgcagaacc

SEQ ID NO: 93418 - DNA, 25 bp, Homo sapien
gaaggcatccggtcagggcctcgcc

SEQ ID NO: 93419 - DNA, 25 bp, Homo sapien
tctcagggaggcgtctcagccgagc

SEQ ID NO: 93420 - DNA, 25 bp, Homo sapien
aaccagcggcgtggagtgcgcctcc

SEQ ID NO: 93421 - DNA, 25 bp, Homo sapien
ccgctgcaatttattactggaggcc

SEQ ID NO: 93422 - DNA, 25 bp, Homo sapien
gggttcgagtcgcagcctccagcct

SEQ ID NO: 93423 - DNA, 25 bp, Homo sapien
ccctgtcggggttcgagtcgcagcc

SEQ ID NO: 93424 - DNA, 25 bp, Homo sapien
agccgccgctgtcggagaaaggcac

SEQ ID NO: 93425 - DNA, 25 bp, Homo sapien
gcgcttaagaggcattcggcgttta

SEQ ID NO: 93426 - DNA, 25 bp, Homo sapien
ccatggaaggagctgcaaggtactc

SEQ ID NO: 93427 - DNA, 25 bp, Homo sapien
cgacaacggcaaattagtgcgctta

SEQ ID NO: 93428 - DNA, 25 bp, Homo sapien
ccaggaggcctgtttaccagcacga

SEQ ID NO: 93429 - DNA, 25 bp, Homo sapien
cgctgtccgccttgggtacagaagc

SEQ ID NO: 93430 - DNA, 25 bp, Homo sapien
ggggaaatccagtgccattcctttg

SEQ ID NO: 93431 - DNA, 25 bp, Homo sapien
ttcggcgtttatcccggcaaacatg

SEQ ID NO: 93432 - DNA, 25 bp, Homo sapien
actctgggaccagaattctctctgc

SEQ ID NO: 93433 - DNA, 25 bp, Homo sapien
ggcccttgtggagttcgagtcgaac

SEQ ID NO: 93434 - DNA, 25 bp, Homo sapien
gtctcctccgagtgtgcagcgggct

SEQ ID NO: 93435 - DNA, 25 bp, Homo sapien
cgcggcgactcctgacgtcatagga

SEQ ID NO: 93436 - DNA, 25 bp, Homo sapien
tcgagtcgaacccagaagaaacgag

SEQ ID NO: 93437 - DNA, 25 bp, Homo sapien
gagagcctcacctcagtttcgcgga

SEQ ID NO: 93438 - DNA, 25 bp, Homo sapien
gctgggaggcctaaggcccgaatcc

SEQ ID NO: 93439 - DNA, 25 bp, Homo sapien
gtgtggaaacttaccggctgagcca

SEQ ID NO: 93440 - DNA, 25 bp, Homo sapien
ggctgagccatggatacaccgttaa

SEQ ID NO: 93441 - DNA, 25 bp, Homo sapien
agctctggtggccagggcacctctg

SEQ ID NO: 93442 - DNA, 25 bp, Homo sapien
atcgcccagagggattcccggtgct

SEQ ID NO: 93443 - DNA, 25 bp, Homo sapien
cgggctgaggcgctaaagccgccct

SEQ ID NO: 93444 - DNA, 25 bp, Homo sapien
tcctgggcatagtcctcgccgcttg

SEQ ID NO: 93445 - DNA, 25 bp, Homo sapien
gggcatagtcctcgccgcttggctc

SEQ ID NO: 93446 - DNA, 25 bp, Homo sapien
tgcgcgcgaacgctcgctgctctgg

SEQ ID NO: 93447 - DNA, 25 bp, Homo sapien
cgagagcccggatccggagcaccga

SEQ ID NO: 93448 - DNA, 25 bp, Homo sapien
tcaggcatcgcccagagggattccc

SEQ ID NO: 93449 - DNA, 25 bp, Homo sapien
caaatgtgcccgtcactggcgggta

SEQ ID NO: 93450 - DNA, 25 bp, Homo sapien
cccgctgtctaggtagcttggtacg

SEQ ID NO: 93451 - DNA, 25 bp, Homo sapien
cggggtaattaacgcgctgcaaact

SEQ ID NO: 93452 - DNA, 25 bp, Homo sapien
cccgccggattagcggctctttgtt

SEQ ID NO: 93453 - DNA, 25 bp, Homo sapien
ctgttaacaagttcctggctgagcg

SEQ ID NO: 93454 - DNA, 25 bp, Homo sapien
cgcagggcttctcaggcgatcttgt

SEQ ID NO: 93455 - DNA, 25 bp, Homo sapien
tcctcagcgcgtgtctctggcttcg

SEQ ID NO: 93456 - DNA, 25 bp, Homo sapien
caggcgatcttgtgcctggggcttc

SEQ ID NO: 93457 - DNA, 25 bp, Homo sapien
ggagctgcaccaacccggcgcctct

SEQ ID NO: 93458 - DNA, 25 bp, Homo sapien
cgctttctgtgaggggcagaatgtc

SEQ ID NO: 93459 - DNA, 25 bp, Homo sapien
aatgtccagaaaacagcctgcgcca

SEQ ID NO: 93460 - DNA, 25 bp, Homo sapien
cagtccttctctgtccggccagtga

SEQ ID NO: 93461 - DNA, 25 bp, Homo sapien
acgtggaccgagtggtccgtctgca

SEQ ID NO: 93462 - DNA, 25 bp, Homo sapien
tctctgtccggccagtgaacggtgg

SEQ ID NO: 93463 - DNA, 25 bp, Homo sapien
ccctgtgcccaggtaccagcggcca

SEQ ID NO: 93464 - DNA, 25 bp, Homo sapien
ctgggccagtgtatctgaggacgcc

SEQ ID NO: 93465 - DNA, 25 bp, Homo sapien
ctgcttctgtttgcgccggtggcct

SEQ ID NO: 93466 - DNA, 25 bp, Homo sapien
caagctgcttctgtttgcgccggtg

SEQ ID NO: 93467 - DNA, 25 bp, Homo sapien
acgatgcactcaaggtatctcccgc

SEQ ID NO: 93468 - DNA, 25 bp, Homo sapien
ccctcgagtacaacatccgggtcta

SEQ ID NO: 93469 - DNA, 25 bp, Homo sapien
acatccgggtctactgcctgcatga

SEQ ID NO: 93470 - DNA, 25 bp, Homo sapien
tactgcctgcatgacacccacgatg

SEQ ID NO: 93471 - DNA, 25 bp, Homo sapien
tgacacccacgatgcactcaaggta

SEQ ID NO: 93472 - DNA, 25 bp, Homo sapien
gccgccaagcgcctcaagctgcttc

SEQ ID NO: 93473 - DNA, 25 bp, Homo sapien
gcagccacggcagtcaccatcgcca

SEQ ID NO: 93474 - DNA, 25 bp, Homo sapien
atcatggttcaaccggaatggggcc

SEQ ID NO: 93475 - DNA, 25 bp, Homo sapien
accgcagccagttgatcatggttca

SEQ ID NO: 93476 - DNA, 25 bp, Homo sapien
cttggccatggccttccgcatctgt

SEQ ID NO: 93477 - DNA, 25 bp, Homo sapien
tgcctgaaccgcagccagttgatca

SEQ ID NO: 93478 - DNA, 25 bp, Homo sapien
ttccgcatctgtgcctgaaccgcag

SEQ ID NO: 93479 - DNA, 25 bp, Homo sapien
atggccttccgcatctgtgcctgaa

SEQ ID NO: 93480 - DNA, 25 bp, Homo sapien
gcccggacgaaagtgggcagcatgc

SEQ ID NO: 93481 - DNA, 25 bp, Homo sapien
cgctctgtagaccttctccgggttg

SEQ ID NO: 93482 - DNA, 25 bp, Homo sapien
tcgtctaggacgatagggatctcca

SEQ ID NO: 93483 - DNA, 25 bp, Homo sapien
ggcgctgcctaagcacctggaaacg

SEQ ID NO: 93484 - DNA, 25 bp, Homo sapien
caaagcccaacctggcgttccgagg

SEQ ID NO: 93485 - DNA, 25 bp, Homo sapien
gtccgatgccagagacacgctctcg

SEQ ID NO: 93486 - DNA, 25 bp, Homo sapien
gcagcgcgcggagacttaaccaacc

SEQ ID NO: 93487 - DNA, 25 bp, Homo sapien
ggagccatccgggacgtaccaactg

SEQ ID NO: 93488 - DNA, 25 bp, Homo sapien
cggcaaccgaaggtgcaaagcccaa

SEQ ID NO: 93489 - DNA, 25 bp, Homo sapien
agaggctctctaccggtgagggttt

SEQ ID NO: 93490 - DNA, 25 bp, Homo sapien
gcagcgcccaaacctcgcgagattt

SEQ ID NO: 93491 - DNA, 25 bp, Homo sapien
aaatctcgcgatacctaggcgcctg

SEQ ID NO: 93492 - DNA, 25 bp, Homo sapien
tctgaggtaccagaggtagcaaagc

SEQ ID NO: 93493 - DNA, 25 bp, Homo sapien
tgttggctgggccaagtaccaccca

SEQ ID NO: 93494 - DNA, 25 bp, Homo sapien
ccgggccttacagcagctcggagtt

SEQ ID NO: 93495 - DNA, 25 bp, Homo sapien
aatccacggcacacgctctgaggta

SEQ ID NO: 93496 - DNA, 25 bp, Homo sapien
tcagcgacaggtttccgaatccacg

SEQ ID NO: 93497 - DNA, 25 bp, Homo sapien
tgcagcctggctgccgtgaaatcgg

SEQ ID NO: 93498 - DNA, 25 bp, Homo sapien
ggaaacggcccgtggcccatcgcat

SEQ ID NO: 93499 - DNA, 25 bp, Homo sapien
tgcctgactctgtgtttggaaacgg

SEQ ID NO: 93500 - DNA, 25 bp, Homo sapien
cgagccccagcggatttgaatcaga

SEQ ID NO: 93501 - DNA, 25 bp, Homo sapien
tgggccttccacgtgcctgactctg

SEQ ID NO: 93502 - DNA, 25 bp, Homo sapien
ctgccgtgaaatcggggcccagctc

SEQ ID NO: 93503 - DNA, 25 bp, Homo sapien
ggattcctgggccttccacgtgcct

SEQ ID NO: 93504 - DNA, 25 bp, Homo sapien
actctgtgtttggaaacggcccgtg

SEQ ID NO: 93505 - DNA, 25 bp, Homo sapien
cggtaaatcagtaacccgcagtgca

SEQ ID NO: 93506 - DNA, 25 bp, Homo sapien
agccaggtgagcaggaccctgtgct

SEQ ID NO: 93507 - DNA, 25 bp, Homo sapien
gagctggttactcattgcccaccga

SEQ ID NO: 93508 - DNA, 25 bp, Homo sapien
ttactcattgcccaccgaggcgggg

SEQ ID NO: 93509 - DNA, 25 bp, Homo sapien
tgtgcagctaccctcgggacccatt

SEQ ID NO: 93510 - DNA, 25 bp, Homo sapien
gctaccctcgggacccattgattcg

SEQ ID NO: 93511 - DNA, 25 bp, Homo sapien
gcgcttgtccctgcggctgtcttcg

SEQ ID NO: 93512 - DNA, 25 bp, Homo sapien
ccgcagtgcacacagggccttttgt

SEQ ID NO: 93513 - DNA, 25 bp, Homo sapien
tcacatgtgacagcctgactccagc

SEQ ID NO: 93514 - DNA, 25 bp, Homo sapien
acatcatcctgtacgcgtcgggctc

SEQ ID NO: 93515 - DNA, 25 bp, Homo sapien
ctgactccagcaggcagaaccaagt

SEQ ID NO: 93516 - DNA, 25 bp, Homo sapien
gagtcaggctcttccggcaagtcaa

SEQ ID NO: 93517 - DNA, 25 bp, Homo sapien
ggcaagtcaagctcatccctggtac

SEQ ID NO: 93518 - DNA, 25 bp, Homo sapien
cggcctcgtgagtctagatctacct

SEQ ID NO: 93519 - DNA, 25 bp, Homo sapien
agatctacctctcgacccactatgg

SEQ ID NO: 93520 - DNA, 25 bp, Homo sapien
cgaggccaggtatacggacatcatc

SEQ ID NO: 93521 - DNA, 25 bp, Homo sapien
caccaggcagactttgtgcgccgcg

SEQ ID NO: 93522 - DNA, 25 bp, Homo sapien
tggcccacggccaagaagtaggtga

SEQ ID NO: 93523 - DNA, 25 bp, Homo sapien
ttgagcaccgctagtgcccaaagca

SEQ ID NO: 93524 - DNA, 25 bp, Homo sapien
aatagggcaccgtgttgagcaccgc

SEQ ID NO: 93525 - DNA, 25 bp, Homo sapien
gtgtcccggaacacgaaatagggca

SEQ ID NO: 93526 - DNA, 25 bp, Homo sapien
tgtagtagcacataatgcgcccgtc

SEQ ID NO: 93527 - DNA, 25 bp, Homo sapien
ttcaggagcagcacattgtagtagc

SEQ ID NO: 93528 - DNA, 25 bp, Homo sapien
agcgccgcagcttgcgcagcatgtc

SEQ ID NO: 93529 - DNA, 25 bp, Homo sapien
cggcgcaacccaacgtacaaagatg

SEQ ID NO: 93530 - DNA, 25 bp, Homo sapien
atgatcttttctgaggctccaccgc

SEQ ID NO: 93531 - DNA, 25 bp, Homo sapien
tgattggcccgtggcagccacctga

SEQ ID NO: 93532 - DNA, 25 bp, Homo sapien
agccacctgaccgaacggaccaata

SEQ ID NO: 93533 - DNA, 25 bp, Homo sapien
cggaccaataggaggcgttctccca

SEQ ID NO: 93534 - DNA, 25 bp, Homo sapien
taggaggcgttctcccaggaatgcg

SEQ ID NO: 93535 - DNA, 25 bp, Homo sapien
ctggccacgtgcacccggctggatt

SEQ ID NO: 93536 - DNA, 25 bp, Homo sapien
cccaacgtacaaagatgatcttttc

SEQ ID NO: 93537 - DNA, 25 bp, Homo sapien
ttgggcggcgctctcacaagcccga

SEQ ID NO: 93538 - DNA, 25 bp, Homo sapien
cctcgcgggcgtcgagcctgagaca

SEQ ID NO: 93539 - DNA, 25 bp, Homo sapien
gctgctgcctccattttgtttcctg

SEQ ID NO: 93540 - DNA, 25 bp, Homo sapien
tgtttcctgctcagcttggtctgtg

SEQ ID NO: 93541 - DNA, 25 bp, Homo sapien
agcctgggctgtaacctaagatgga

SEQ ID NO: 93542 - DNA, 25 bp, Homo sapien
acctaagatggaggccgggactgac

SEQ ID NO: 93543 - DNA, 25 bp, Homo sapien
ggacgatcggacaggcctcagccgc

SEQ ID NO: 93544 - DNA, 25 bp, Homo sapien
aggggatcggaatgccacccacgac

SEQ ID NO: 93545 - DNA, 25 bp, Homo sapien
cagaggatgcttgtgtccgagccca

SEQ ID NO: 93546 - DNA, 25 bp, Homo sapien
atccagcaccaccttgtctttaaag

SEQ ID NO: 93547 - DNA, 25 bp, Homo sapien
cggttgtgaaacatggagttgccga

SEQ ID NO: 93548 - DNA, 25 bp, Homo sapien
gtaatctttggacgtcatgccctcg

SEQ ID NO: 93549 - DNA, 25 bp, Homo sapien
gtcatgccctcgacgttcggcttct

SEQ ID NO: 93550 - DNA, 25 bp, Homo sapien
ggccacaggacacctccatgatgca

SEQ ID NO: 93551 - DNA, 25 bp, Homo sapien
atgatgcagttcacgacctcggcgg

SEQ ID NO: 93552 - DNA, 25 bp, Homo sapien
ccttggcggcgaacatgcagaggat

SEQ ID NO: 93553 - DNA, 25 bp, Homo sapien
gtgcagctcgctactccgtcattcg

SEQ ID NO: 93554 - DNA, 25 bp, Homo sapien
ccgggcgccgattatccttcgaaga

SEQ ID NO: 93555 - DNA, 25 bp, Homo sapien
gctagtcttgcccacgtactccttg

SEQ ID NO: 93556 - DNA, 25 bp, Homo sapien
gtagcgctccaccaggctagtcttg

SEQ ID NO: 93557 - DNA, 25 bp, Homo sapien
accagaaagcggtcgtgcacgtagc

SEQ ID NO: 93558 - DNA, 25 bp, Homo sapien
ctccggatgcactcacgttctgata

SEQ ID NO: 93559 - DNA, 25 bp, Homo sapien
atcggggccataggtgcagattacc

SEQ ID NO: 93560 - DNA, 25 bp, Homo sapien
taagctccgttctggctgggaatcc

SEQ ID NO: 93561 - DNA, 25 bp, Homo sapien
ctgagcgctcagaggagaggcctga

SEQ ID NO: 93562 - DNA, 25 bp, Homo sapien
ccgccgccgtgcgagtagctgtgct

SEQ ID NO: 93563 - DNA, 25 bp, Homo sapien
gagtccagactgtccgcccgcagcc

SEQ ID NO: 93564 - DNA, 25 bp, Homo sapien
tctgagtctgagcgctcagaggaga

SEQ ID NO: 93565 - DNA, 25 bp, Homo sapien
ggcactcaccttggtctgagtctga

SEQ ID NO: 93566 - DNA, 25 bp, Homo sapien
ctcggggcactcaccttggtctgag

SEQ ID NO: 93567 - DNA, 25 bp, Homo sapien
agaagacctggctcgccccgagggc

SEQ ID NO: 93568 - DNA, 25 bp, Homo sapien
gggtccggtcagaagacctggctcg

SEQ ID NO: 93569 - DNA, 25 bp, Homo sapien
attactgtcctagggcggtgcatcc

SEQ ID NO: 93570 - DNA, 25 bp, Homo sapien
tcaggctaaccggtgctgcttcttg

SEQ ID NO: 93571 - DNA, 25 bp, Homo sapien
gccgcccggaattcagccaagggtc

SEQ ID NO: 93572 - DNA, 25 bp, Homo sapien
gtctcagactttccaggggcaggta

SEQ ID NO: 93573 - DNA, 25 bp, Homo sapien
ggcgtctttgatctcagcttccagc

SEQ ID NO: 93574 - DNA, 25 bp, Homo sapien
ggcttctcaaggatcgctgttgtca

SEQ ID NO: 93575 - DNA, 25 bp, Homo sapien
ctgatccacacgttcgggcgggaaa

SEQ ID NO: 93576 - DNA, 25 bp, Homo sapien
gcggctgcagcacttttgttacaaa

SEQ ID NO: 93577 - DNA, 25 bp, Homo sapien
atggaacaggacagccggccacggt

SEQ ID NO: 93578 - DNA, 25 bp, Homo sapien
gagctgaaacggcagcacgggccgg

SEQ ID NO: 93579 - DNA, 25 bp, Homo sapien
cccgtggggtcgtccacgttgtctg

SEQ ID NO: 93580 - DNA, 25 bp, Homo sapien
cgccggaggcgccactcagtagaag

SEQ ID NO: 93581 - DNA, 25 bp, Homo sapien
gcgccactcagtagaagcgcttgtt

SEQ ID NO: 93582 - DNA, 25 bp, Homo sapien
acggcgcagacaacgatgcccagga

SEQ ID NO: 93583 - DNA, 25 bp, Homo sapien
cgcagacaacgatgcccaggagagc

SEQ ID NO: 93584 - DNA, 25 bp, Homo sapien
tcaggggcccgctgcggaagttccc

SEQ ID NO: 93585 - DNA, 25 bp, Homo sapien
gtcaatgcagttcttccactcgttc

SEQ ID NO: 93586 - DNA, 25 bp, Homo sapien
atcaccgagatgtacgggaacacgc

SEQ ID NO: 93587 - DNA, 25 bp, Homo sapien
cactcgttcttgtcctccaggtcgg

SEQ ID NO: 93588 - DNA, 25 bp, Homo sapien
tccaggtcggtcatcacctgcaggg

SEQ ID NO: 93589 - DNA, 25 bp, Homo sapien
ccatccttgctgtggtcgtaggaca

SEQ ID NO: 93590 - DNA, 25 bp, Homo sapien
gggagccattgttcaccatcaccga

SEQ ID NO: 93591 - DNA, 25 bp, Homo sapien
aacacgcgctgggaccaagacatcg

SEQ ID NO: 93592 - DNA, 25 bp, Homo sapien
ggcgcactcccgtgatgtcaatgca

SEQ ID NO: 93593 - DNA, 25 bp, Homo sapien
caagccgagccatgtttccggggcc

SEQ ID NO: 93594 - DNA, 25 bp, Homo sapien
tgcaggctcaaacgctcggcgcaca

SEQ ID NO: 93595 - DNA, 25 bp, Homo sapien
ggtcacacgacagggacaggaatga

SEQ ID NO: 93596 - DNA, 25 bp, Homo sapien
ggtgtccagcgtcagtagtaacttg

SEQ ID NO: 93597 - DNA, 25 bp, Homo sapien
agagagatacaagcgtgtgagagcc

SEQ ID NO: 93598 - DNA, 25 bp, Homo sapien
aaatccttttgtatcgggagagaga

SEQ ID NO: 93599 - DNA, 25 bp, Homo sapien
caggaatgagaatcggataaaatcc

SEQ ID NO: 93600 - DNA, 25 bp, Homo sapien
tagtaacttggagctgacaagctgc

SEQ ID NO: 93601 - DNA, 25 bp, Homo sapien
ggggtcccatctattggcctccggc

SEQ ID NO: 93602 - DNA, 25 bp, Homo sapien
tcgccagggagtcaaaaagcaaagc

SEQ ID NO: 93603 - DNA, 25 bp, Homo sapien
catcctggttgagtgcagtttcatc

SEQ ID NO: 93604 - DNA, 25 bp, Homo sapien
ttagaggctccaaggcacacgccgg

SEQ ID NO: 93605 - DNA, 25 bp, Homo sapien
cagcaatgggttctttcgagcgaca

SEQ ID NO: 93606 - DNA, 25 bp, Homo sapien
tcacggaacagcacgttaggcttgc

SEQ ID NO: 93607 - DNA, 25 bp, Homo sapien
gcggattcgcgaagactaggacgtc

SEQ ID NO: 93608 - DNA, 25 bp, Homo sapien
actcggggcatgctggaatttgtag

SEQ ID NO: 93609 - DNA, 25 bp, Homo sapien
tagcgtagcgcttcacgtgggaatg

SEQ ID NO: 93610 - DNA, 25 bp, Homo sapien
agattagggacatggcgccgtcacc

SEQ ID NO: 93611 - DNA, 25 bp, Homo sapien
agccaacactcactggagcagatta

SEQ ID NO: 93612 - DNA, 25 bp, Homo sapien
gggactagcttctgagcctccgcga

SEQ ID NO: 93613 - DNA, 25 bp, Homo sapien
tttccggattgactcggctcgttcc

SEQ ID NO: 93614 - DNA, 25 bp, Homo sapien
gctcgttccgtaaagcgccggagga

SEQ ID NO: 93615 - DNA, 25 bp, Homo sapien
accggcctcagtaatgtctgcgaca

SEQ ID NO: 93616 - DNA, 25 bp, Homo sapien
cactatgtaaactgcggggcactgc

SEQ ID NO: 93617 - DNA, 25 bp, Homo sapien
tgcagaggaaccttgcggccgcgca

SEQ ID NO: 93618 - DNA, 25 bp, Homo sapien
ccgtgggaagcaccgactttcgttg

SEQ ID NO: 93619 - DNA, 25 bp, Homo sapien
agtggggactttctcctgtcgccgt

SEQ ID NO: 93620 - DNA, 25 bp, Homo sapien
ctctgccgccctcggagtggggact

SEQ ID NO: 93621 - DNA, 25 bp, Homo sapien
cgtctccgaggctgggaacaccgtg

SEQ ID NO: 93622 - DNA, 25 bp, Homo sapien
tcctgtcgccgtgggaagcaccgac

SEQ ID NO: 93623 - DNA, 25 bp, Homo sapien
cctcggagtggggactttctcctgt

SEQ ID NO: 93624 - DNA, 25 bp, Homo sapien
ctttcgttgggggatttgactctgc

SEQ ID NO: 93625 - DNA, 25 bp, Homo sapien
ccggacatgtttcgggcacagcagc

SEQ ID NO: 93626 - DNA, 25 bp, Homo sapien
ctgtacccacagaagccgaagctga

SEQ ID NO: 93627 - DNA, 25 bp, Homo sapien
gcagatctgcgagtctgtgcccacg

SEQ ID NO: 93628 - DNA, 25 bp, Homo sapien
tcggcagccctgacgccacgaggaa

SEQ ID NO: 93629 - DNA, 25 bp, Homo sapien
agctatgcgcgcttcgtcaagtccc

SEQ ID NO: 93630 - DNA, 25 bp, Homo sapien
ttgatgaagttcgacagctatgcgc

SEQ ID NO: 93631 - DNA, 25 bp, Homo sapien
cctggcggggagtctgaactacaaa

SEQ ID NO: 93632 - DNA, 25 bp, Homo sapien
acagcagcttcaggtgggcgatcct

SEQ ID NO: 93633 - DNA, 25 bp, Homo sapien
tgcggtttccttgcagacttccctg

SEQ ID NO: 93634 - DNA, 25 bp, Homo sapien
cacaggctactttgccatggtggtg

SEQ ID NO: 93635 - DNA, 25 bp, Homo sapien
cacagttgcctgacggagccaggct

SEQ ID NO: 93636 - DNA, 25 bp, Homo sapien
gccaggctgagaaaggccttcaatc

SEQ ID NO: 93637 - DNA, 25 bp, Homo sapien
aagcaactgcagtgggagcaaaccc

SEQ ID NO: 93638 - DNA, 25 bp, Homo sapien
ttcacctgggtcacaggctactttg

SEQ ID NO: 93639 - DNA, 25 bp, Homo sapien
gccagcatgaccttcgtggtccaga

SEQ ID NO: 93640 - DNA, 25 bp, Homo sapien
ggccttcaatccaggagcaaagagg

SEQ ID NO: 93641 - DNA, 25 bp, Homo sapien
tcggggaaatatagaggcgccacgc

SEQ ID NO: 93642 - DNA, 25 bp, Homo sapien
gtcacagtttatttggcccgcgcta

SEQ ID NO: 93643 - DNA, 25 bp, Homo sapien
gcagcccgcgtatgagttcgtgcac

SEQ ID NO: 93644 - DNA, 25 bp, Homo sapien
ttcgtgcaccgtcttgttgaggatg

SEQ ID NO: 93645 - DNA, 25 bp, Homo sapien
cgcgaagcccacacgcagctgttgt

SEQ ID NO: 93646 - DNA, 25 bp, Homo sapien
agctgttgtccgcatggcccacgat

SEQ ID NO: 93647 - DNA, 25 bp, Homo sapien
gcactgcactgatgtagaccttcca

SEQ ID NO: 93648 - DNA, 25 bp, Homo sapien
agccgcgcccaggtcacagtttatt

SEQ ID NO: 93649 - DNA, 25 bp, Homo sapien
aatcaccctgggtcggaaacacgca

SEQ ID NO: 93650 - DNA, 25 bp, Homo sapien
cctgcaggaagctggcatattcctc

SEQ ID NO: 93651 - DNA, 25 bp, Homo sapien
gagaggaacggtacctgcgcctcct

SEQ ID NO: 93652 - DNA, 25 bp, Homo sapien
gccaaccgggctaagagctcacctg

SEQ ID NO: 93653 - DNA, 25 bp, Homo sapien
gctcagcgctgtggacctgagattt

SEQ ID NO: 93654 - DNA, 25 bp, Homo sapien
ctgatgatgccttgcagggtgagcc

SEQ ID NO: 93655 - DNA, 25 bp, Homo sapien
cttgttgcggtcaccacagcccgat

SEQ ID NO: 93656 - DNA, 25 bp, Homo sapien
cctgagatttgtgcctgacggcctc

SEQ ID NO: 93657 - DNA, 25 bp, Homo sapien
tcgcggttcagcacgaagcaccacg

SEQ ID NO: 93658 - DNA, 25 bp, Homo sapien
agcaccaccgtcagatcctcgggtg

SEQ ID NO: 93659 - DNA, 25 bp, Homo sapien
gctctcagacctggccacaagcgtt

SEQ ID NO: 93660 - DNA, 25 bp, Homo sapien
gtgccaggtcgcagtactcccagct

SEQ ID NO: 93661 - DNA, 25 bp, Homo sapien
tcacagctgtggttacggcgttcct

SEQ ID NO: 93662 - DNA, 25 bp, Homo sapien
gtccgggttcctgtagccacacgac

SEQ ID NO: 93663 - DNA, 25 bp, Homo sapien
cgcgggtcatcgaagacagactctt

SEQ ID NO: 93664 - DNA, 25 bp, Homo sapien
caacgtctggcacggctcacagctg

SEQ ID NO: 93665 - DNA, 25 bp, Homo sapien
gacggacgtcttcttcacccaatca

SEQ ID NO: 93666 - DNA, 25 bp, Homo sapien
tgtctctccctctttcgatgtgcgc

SEQ ID NO: 93667 - DNA, 25 bp, Homo sapien
cctagaaaagccgtctgcgagccaa

SEQ ID NO: 93668 - DNA, 25 bp, Homo sapien
tgcagtacttgagatgacggacgtc

SEQ ID NO: 93669 - DNA, 25 bp, Homo sapien
ctcggccctaattggcagtttggta

SEQ ID NO: 93670 - DNA, 25 bp, Homo sapien
gtttggtatcctacgaaagcctaga

SEQ ID NO: 93671 - DNA, 25 bp, Homo sapien
ctgcccggtgattggtcaaatgagg

SEQ ID NO: 93672 - DNA, 25 bp, Homo sapien
ttcaggcgacgacccaatcaaaatg

SEQ ID NO: 93673 - DNA, 25 bp, Homo sapien
gttccacatctaccacatgggccag

SEQ ID NO: 93674 - DNA, 25 bp, Homo sapien
gaagcgcgggccgtcttctacgccg

SEQ ID NO: 93675 - DNA, 25 bp, Homo sapien
gggccgtcttctacgccgccgagat

SEQ ID NO: 93676 - DNA, 25 bp, Homo sapien
ggcctacgcctatgagaccaaggac

SEQ ID NO: 93677 - DNA, 25 bp, Homo sapien
gcctatgagaccaaggacgcgctgt

SEQ ID NO: 93678 - DNA, 25 bp, Homo sapien
ttctacgccgccgagatctgctgtg

SEQ ID NO: 93679 - DNA, 25 bp, Homo sapien
ccgccgagatctgctgtggcctgga

SEQ ID NO: 93680 - DNA, 25 bp, Homo sapien
acaggtgagcttggcctacgcctat

SEQ ID NO: 93681 - DNA, 25 bp, Homo sapien
aagaatgaacggtacacgttcagcc

SEQ ID NO: 93682 - DNA, 25 bp, Homo sapien
tgcctcctgtacgagatgatcgcag

SEQ ID NO: 93683 - DNA, 25 bp, Homo sapien
agccctgactggtgggcgctcggct

SEQ ID NO: 93684 - DNA, 25 bp, Homo sapien
aacggtacacgttcagccctgactg

SEQ ID NO: 93685 - DNA, 25 bp, Homo sapien
ggtacacgttcagccctgactggtg

SEQ ID NO: 93686 - DNA, 25 bp, Homo sapien
acacgttcagccctgactggtgggc

SEQ ID NO: 93687 - DNA, 25 bp, Homo sapien
cacgttcagccctgactggtgggcg

SEQ ID NO: 93688 - DNA, 25 bp, Homo sapien
cctcctgtacgagatgatcgcaggc

SEQ ID NO: 93689 - DNA, 25 bp, Homo sapien
gcagccacgatgagacagcaccaca

SEQ ID NO: 93690 - DNA, 25 bp, Homo sapien
tgtgagcacgctgatgctcgacatc

SEQ ID NO: 93691 - DNA, 25 bp, Homo sapien
atcgcacactgcagccacgacgaga

SEQ ID NO: 93692 - DNA, 25 bp, Homo sapien
ctgatgctcgacatcgcacactgca

SEQ ID NO: 93693 - DNA, 25 bp, Homo sapien
cagacgggacagcagtgtgagcaca

SEQ ID NO: 93694 - DNA, 25 bp, Homo sapien
tgtgagcacactgatgctcgacatc

SEQ ID NO: 93695 - DNA, 25 bp, Homo sapien
gatgctcgacatcgcacactgcagc

SEQ ID NO: 93696 - DNA, 25 bp, Homo sapien
gcaccacacacccatcaggatgggg

SEQ ID NO: 93697 - DNA, 25 bp, Homo sapien
catgcggagaaggtaaaccagcgcc

SEQ ID NO: 93698 - DNA, 25 bp, Homo sapien
actgacaccctgtctccgggaggct

SEQ ID NO: 93699 - DNA, 25 bp, Homo sapien
cgcccagcgtgcgaaacaaaccggg

SEQ ID NO: 93700 - DNA, 25 bp, Homo sapien
gctcccggcacaggcttcgattgtg

SEQ ID NO: 93701 - DNA, 25 bp, Homo sapien
cttcgattgtgaggaaggccggcta

SEQ ID NO: 93702 - DNA, 25 bp, Homo sapien
aggccggctagtctccgagctcatc

SEQ ID NO: 93703 - DNA, 25 bp, Homo sapien
gacgcgccgttcgaaatagcacatg

SEQ ID NO: 93704 - DNA, 25 bp, Homo sapien
tcagcgaagtcgcacgtgaaggata

SEQ ID NO: 93705 - DNA, 25 bp, Homo sapien
ttcagcatagctgaggctcgaaccc

SEQ ID NO: 93706 - DNA, 25 bp, Homo sapien
ccacagcagcgggaaggatacatcc

SEQ ID NO: 93707 - DNA, 25 bp, Homo sapien
ggatacatccacgtggcgagttcca

SEQ ID NO: 93708 - DNA, 25 bp, Homo sapien
gcgagttccacaacggatgccattc

SEQ ID NO: 93709 - DNA, 25 bp, Homo sapien
acgcacagctgaggcgttcagcata

SEQ ID NO: 93710 - DNA, 25 bp, Homo sapien
tcctgcctgatctcactcacatgga

SEQ ID NO: 93711 - DNA, 25 bp, Homo sapien
tctcactcacatggagaccgggaga

SEQ ID NO: 93712 - DNA, 25 bp, Homo sapien
gccattcatggacagaacgcacagc

SEQ ID NO: 93713 - DNA, 25 bp, Homo sapien
cggaagatggtcccaggactgagcc

SEQ ID NO: 93714 - DNA, 25 bp, Homo sapien
gggtgtgcctgcctccacagcccgt

SEQ ID NO: 93715 - DNA, 25 bp, Homo sapien
ggcacgagctggctcccacgtggct

SEQ ID NO: 93716 - DNA, 25 bp, Homo sapien
ttgccacagcaacggggttgcgctc

SEQ ID NO: 93717 - DNA, 25 bp, Homo sapien
ttcgcttggaaacggttgccacagc

SEQ ID NO: 93718 - DNA, 25 bp, Homo sapien
ccaccagttcgcttggaaacggttg

SEQ ID NO: 93719 - DNA, 25 bp, Homo sapien
ctgcagtcgtcgcagcagggctcct

SEQ ID NO: 93720 - DNA, 25 bp, Homo sapien
cagcacccgccgtgtacgcgcccgt

SEQ ID NO: 93721 - DNA, 25 bp, Homo sapien
tggggtctcatcgtcctgctctgct

SEQ ID NO: 93722 - DNA, 25 bp, Homo sapien
gcgagcagaacctgcgcgccctaga

SEQ ID NO: 93723 - DNA, 25 bp, Homo sapien
aaggtgagtaccgacctccgccagg

SEQ ID NO: 93724 - DNA, 25 bp, Homo sapien
ggctcgctgcttaccctcagggctt

SEQ ID NO: 93725 - DNA, 25 bp, Homo sapien
gcgcacgacttgagacctgccacgg

SEQ ID NO: 93726 - DNA, 25 bp, Homo sapien
gcccagtgtccagtgaagcgtctga

SEQ ID NO: 93727 - DNA, 25 bp, Homo sapien
agggcacctacacgttcctcacgtg

SEQ ID NO: 93728 - DNA, 25 bp, Homo sapien
gcttctggctcatctggggtctcat

SEQ ID NO: 93729 - DNA, 25 bp, Homo sapien
agagcccacgggtgccaaacacaca

SEQ ID NO: 93730 - DNA, 25 bp, Homo sapien
ctgctcccagaactgctctcggtta

SEQ ID NO: 93731 - DNA, 25 bp, Homo sapien
aggctcacctgtgctcctcgatctg

SEQ ID NO: 93732 - DNA, 25 bp, Homo sapien
atggcacccgcgtctatgtcttcca

SEQ ID NO: 93733 - DNA, 25 bp, Homo sapien
cttccgcaagaagacggcagtgctc

SEQ ID NO: 93734 - DNA, 25 bp, Homo sapien
ctgcagtgtcgaaggacccagcata

SEQ ID NO: 93735 - DNA, 25 bp, Homo sapien
agctgcatccgtcttctggtaggtg

SEQ ID NO: 93736 - DNA, 25 bp, Homo sapien
ctgctggcgttcacgatcacgtcga

SEQ ID NO: 93737 - DNA, 25 bp, Homo sapien
ggccgacgtacccattctgctgcgg

SEQ ID NO: 93738 - DNA, 25 bp, Homo sapien
gcccggatcttgttctgagcttcga

SEQ ID NO: 93739 - DNA, 25 bp, Homo sapien
atgtccacccgcatacctgctgagg

SEQ ID NO: 93740 - DNA, 25 bp, Homo sapien
gccagcctcgtaccttctgcggttt

SEQ ID NO: 93741 - DNA, 25 bp, Homo sapien
tctcagtccacgcaggaccgagggc

SEQ ID NO: 93742 - DNA, 25 bp, Homo sapien
ccatttgggagtggcgatctcagtc

SEQ ID NO: 93743 - DNA, 25 bp, Homo sapien
tacatctatttggaggctacgggga

SEQ ID NO: 93744 - DNA, 25 bp, Homo sapien
atgtgtgtgaggctacccgcattct

SEQ ID NO: 93745 - DNA, 25 bp, Homo sapien
cctcggggactgcagaatctgtaaa

SEQ ID NO: 93746 - DNA, 25 bp, Homo sapien
ggctgggaccctcaagcatagcttg

SEQ ID NO: 93747 - DNA, 25 bp, Homo sapien
ccagtgccctttgtggtcctcagca

SEQ ID NO: 93748 - DNA, 25 bp, Homo sapien
gaccgacctgggacatagtagtctc

SEQ ID NO: 93749 - DNA, 25 bp, Homo sapien
tgctactccgaaaaatgggacgatc

SEQ ID NO: 93750 - DNA, 25 bp, Homo sapien
gggacgatcatactcgcctcgcagg

SEQ ID NO: 93751 - DNA, 25 bp, Homo sapien
ggtggtgcctcccacacagaactgc

SEQ ID NO: 93752 - DNA, 25 bp, Homo sapien
agtgtcggtatcgtaggcgcaaccc

SEQ ID NO: 93753 - DNA, 25 bp, Homo sapien
agctcaagtcctggccgttgtggta

SEQ ID NO: 93754 - DNA, 25 bp, Homo sapien
actgggcctccagggtactgtcgtt

SEQ ID NO: 93755 - DNA, 25 bp, Homo sapien
cgtagagcccggacgccagatcgtt

SEQ ID NO: 93756 - DNA, 25 bp, Homo sapien
cacacaggttctcatagaggtgctc

SEQ ID NO: 93757 - DNA, 25 bp, Homo sapien
tcatagaggtgctcattgcctgggg

SEQ ID NO: 93758 - DNA, 25 bp, Homo sapien
cactggcacgcttgcacactgaagc

SEQ ID NO: 93759 - DNA, 25 bp, Homo sapien
ttgcacactgaagcgtagagcccgg

SEQ ID NO: 93760 - DNA, 25 bp, Homo sapien
agatcgttgggctccgggcctagca

SEQ ID NO: 93761 - DNA, 25 bp, Homo sapien
gggttccgactcctccattctttgc

SEQ ID NO: 93762 - DNA, 25 bp, Homo sapien
tgcgtgagacccaatccgatgtgaa

SEQ ID NO: 93763 - DNA, 25 bp, Homo sapien
gttacgcgacagttgccaggaccga

SEQ ID NO: 93764 - DNA, 25 bp, Homo sapien
cccattggaagaggaagacgtacgc

SEQ ID NO: 93765 - DNA, 25 bp, Homo sapien
acctctcccagagcatggcgtcttg

SEQ ID NO: 93766 - DNA, 25 bp, Homo sapien
cacatacgttcactggtggggcacg

SEQ ID NO: 93767 - DNA, 25 bp, Homo sapien
cgccctggtgtactgaagctcactc

SEQ ID NO: 93768 - DNA, 25 bp, Homo sapien
gccgtaacggcacatagggcacgta

SEQ ID NO: 93769 - DNA, 25 bp, Homo sapien
tcccggatctcggtatagttccgac

SEQ ID NO: 93770 - DNA, 25 bp, Homo sapien
ggctccgtgctgttgatgaattcca

SEQ ID NO: 93771 - DNA, 25 bp, Homo sapien
tatagttccgactcgtcggggcagc

SEQ ID NO: 93772 - DNA, 25 bp, Homo sapien
ttccgcctggtcagcctcgagcgga

SEQ ID NO: 93773 - DNA, 25 bp, Homo sapien
atgggcagctcctctttccgcctgg

SEQ ID NO: 93774 - DNA, 25 bp, Homo sapien
atccacatctcggtggtccacggcg

SEQ ID NO: 93775 - DNA, 25 bp, Homo sapien
cagcagctcatccacatctcggtgg

SEQ ID NO: 93776 - DNA, 25 bp, Homo sapien
tgttgatgaattccagcagctcatc

SEQ ID NO: 93777 - DNA, 25 bp, Homo sapien
tgaataaggtcaccacccggagttc

SEQ ID NO: 93778 - DNA, 25 bp, Homo sapien
gaacgcgtgtaatgcggtggtaatc

SEQ ID NO: 93779 - DNA, 25 bp, Homo sapien
ggccgcctgcgccattttgaataag

SEQ ID NO: 93780 - DNA, 25 bp, Homo sapien
gcagcttcagcctagtcgcaggagc

SEQ ID NO: 93781 - DNA, 25 bp, Homo sapien
gcaccaggttgggttcgtcatcctc

SEQ ID NO: 93782 - DNA, 25 bp, Homo sapien
tcacaggacaacagccaatatggcg

SEQ ID NO: 93783 - DNA, 25 bp, Homo sapien
tccgcctgctgccaacaggtcagag

SEQ ID NO: 93784 - DNA, 25 bp, Homo sapien
agtcccagtcccagtgtgggtgtac

SEQ ID NO: 93785 - DNA, 25 bp, Homo sapien
taaggcttccttcaccttgcacgac

SEQ ID NO: 93786 - DNA, 25 bp, Homo sapien
tcctctgttgcttccagggacgtgg

SEQ ID NO: 93787 - DNA, 25 bp, Homo sapien
cccgctccattgtctgggaattgca

SEQ ID NO: 93788 - DNA, 25 bp, Homo sapien
cccgccttctgtgggaaggatgtgc

SEQ ID NO: 93789 - DNA, 25 bp, Homo sapien
atgcccgggagccaccaacctttgg

SEQ ID NO: 93790 - DNA, 25 bp, Homo sapien
tctcggactgaaccctgagcggggt

SEQ ID NO: 93791 - DNA, 25 bp, Homo sapien
agagttcttgccctcgggaacctgc

SEQ ID NO: 93792 - DNA, 25 bp, Homo sapien
agcgccctgaaggtcggagagttct

SEQ ID NO: 93793 - DNA, 25 bp, Homo sapien
taccggacgcagctgtatgacaagc

SEQ ID NO: 93794 - DNA, 25 bp, Homo sapien
tgcttccctcaaggaaactaccgga

SEQ ID NO: 93795 - DNA, 25 bp, Homo sapien
gggatgcgagacagtcagctctcta

SEQ ID NO: 93796 - DNA, 25 bp, Homo sapien
cgagtttggaacgtgaccgtggtct

SEQ ID NO: 93797 - DNA, 25 bp, Homo sapien
agtgctttattgaggagatcccgga

SEQ ID NO: 93798 - DNA, 25 bp, Homo sapien
gcgcgctctactttcacatcggaga

SEQ ID NO: 93799 - DNA, 25 bp, Homo sapien
ccaatcaggtactgccgcgccaggg

SEQ ID NO: 93800 - DNA, 25 bp, Homo sapien
acatctcgggatttgtggtccaccc

SEQ ID NO: 93801 - DNA, 25 bp, Homo sapien
ctggacctgcaccattcggacacgg

SEQ ID NO: 93802 - DNA, 25 bp, Homo sapien
catgccacatccagatcaccgaggg

SEQ ID NO: 93803 - DNA, 25 bp, Homo sapien
ttaaacgagaaggacatgccacatc

SEQ ID NO: 93804 - DNA, 25 bp, Homo sapien
tggccaggatctcctcacgcagacg

SEQ ID NO: 93805 - DNA, 25 bp, Homo sapien
ccagtgcaggaacttggccaggatc

SEQ ID NO: 93806 - DNA, 25 bp, Homo sapien
tgcaccattcggacacggggacacc

SEQ ID NO: 93807 - DNA, 25 bp, Homo sapien
gacacggggacaccgcatatccagc

SEQ ID NO: 93808 - DNA, 25 bp, Homo sapien
actcatcagccagtgcaggaacttg

SEQ ID NO: 93809 - DNA, 25 bp, Homo sapien
ctgttccggtttctgtctgtccctg

SEQ ID NO: 93810 - DNA, 25 bp, Homo sapien
cgtctccatgtctgcgggtttctgt

SEQ ID NO: 93811 - DNA, 25 bp, Homo sapien
cgaggccatcacgtctccatgtctg

SEQ ID NO: 93812 - DNA, 25 bp, Homo sapien
atctgggaacccgaggccatcacgt

SEQ ID NO: 93813 - DNA, 25 bp, Homo sapien
cccagtgatttgttgggaggccctg

SEQ ID NO: 93814 - DNA, 25 bp, Homo sapien
aaagaggacggagatgcagattctc

SEQ ID NO: 93815 - DNA, 25 bp, Homo sapien
ccgagccgtgagcttggctttgccc

SEQ ID NO: 93816 - DNA, 25 bp, Homo sapien
ggctgtcagctgaactcagcgccga

SEQ ID NO: 93817 - DNA, 25 bp, Homo sapien
gtgttccgtcttccacctgttcgtg

SEQ ID NO: 93818 - DNA, 25 bp, Homo sapien
tccctcggaagtgttccgtcttcca

SEQ ID NO: 93819 - DNA, 25 bp, Homo sapien
caagggcaggagacctcgggccctc

SEQ ID NO: 93820 - DNA, 25 bp, Homo sapien
caggaagaagatccggcaccacatc

SEQ ID NO: 93821 - DNA, 25 bp, Homo sapien
ccacatctacgtgctcaaccaggtg

SEQ ID NO: 93822 - DNA, 25 bp, Homo sapien
caggtggaccacttcaggtagcgcc

SEQ ID NO: 93823 - DNA, 25 bp, Homo sapien
cttgctccaggtccgggttgctctc

SEQ ID NO: 93824 - DNA, 25 bp, Homo sapien
tgcccttccgcgaacgcttcgagga

SEQ ID NO: 93825 - DNA, 25 bp, Homo sapien
gacgacgagttctaccggcgcatta

SEQ ID NO: 93826 - DNA, 25 bp, Homo sapien
aagcacccggggcttattcagaggc

SEQ ID NO: 93827 - DNA, 25 bp, Homo sapien
cactcccgagcggtaggagaccaaa

SEQ ID NO: 93828 - DNA, 25 bp, Homo sapien
atgggccgagtgacgctgcttgtct

SEQ ID NO: 93829 - DNA, 25 bp, Homo sapien
tgccgcccgcactgcagaagtgcag

SEQ ID NO: 93830 - DNA, 25 bp, Homo sapien
atgggatgtccaaccgcttctgggg

SEQ ID NO: 93831 - DNA, 25 bp, Homo sapien
ttctaccggcgcattaagggagctg

SEQ ID NO: 93832 - DNA, 25 bp, Homo sapien
ctctgtgtcagtgcaatgggatgtc

SEQ ID NO: 93833 - DNA, 25 bp, Homo sapien
tccaaccgacgaaagcgtgaagtga

SEQ ID NO: 93834 - DNA, 25 bp, Homo sapien
cgacgacttcggttcctgcttctga

SEQ ID NO: 93835 - DNA, 25 bp, Homo sapien
ctgcttccaaccgacgaaagcgtga

SEQ ID NO: 93836 - DNA, 25 bp, Homo sapien
acttcggttcctgcttctgaggtgg

SEQ ID NO: 93837 - DNA, 25 bp, Homo sapien
aggcgcgccaggagctcgtccatgt

SEQ ID NO: 93838 - DNA, 25 bp, Homo sapien
ggagctctcagagccgctgtcgtcc

SEQ ID NO: 93839 - DNA, 25 bp, Homo sapien
caggagctcgtccatgtgctcggcc

SEQ ID NO: 93840 - DNA, 25 bp, Homo sapien
cgaagaattacgcgctcccgctttc

SEQ ID NO: 93841 - DNA, 25 bp, Homo sapien
aagacgcctggagagtcactcgctc

SEQ ID NO: 93842 - DNA, 25 bp, Homo sapien
gaagccgaccgcctgactttgctgc

SEQ ID NO: 93843 - DNA, 25 bp, Homo sapien
cctccttccgaagagagatctggtg

SEQ ID NO: 93844 - DNA, 25 bp, Homo sapien
ccaggacgcgcagtttgcagttgca

SEQ ID NO: 93845 - DNA, 25 bp, Homo sapien
tacctggtctgagggtctgctcctc

SEQ ID NO: 93846 - DNA, 25 bp, Homo sapien
gatcctgatccctggcgctgggcaa

SEQ ID NO: 93847 - DNA, 25 bp, Homo sapien
ggcaatccacaggatgagactcatc

SEQ ID NO: 93848 - DNA, 25 bp, Homo sapien
ccaggaccacggacggaaaatcgca

SEQ ID NO: 93849 - DNA, 25 bp, Homo sapien
acgcgctgcataccgggatttgtag

SEQ ID NO: 93850 - DNA, 25 bp, Homo sapien
ccagcgtcttcttgctggagaagga

SEQ ID NO: 93851 - DNA, 25 bp, Homo sapien
gtccttcgacaagacggccagcgtc

SEQ ID NO: 93852 - DNA, 25 bp, Homo sapien
cctagcctcggggtccttcgacaag

SEQ ID NO: 93853 - DNA, 25 bp, Homo sapien
gttgcgacgggcgtcgcctagcctc

SEQ ID NO: 93854 - DNA, 25 bp, Homo sapien
acagcgccaaggtgcactcggtggc

SEQ ID NO: 93855 - DNA, 25 bp, Homo sapien
ctgttccggggccacagcaagacgc

SEQ ID NO: 93856 - DNA, 25 bp, Homo sapien
cgtcgcgctacgtgcttgggatgca

SEQ ID NO: 93857 - DNA, 25 bp, Homo sapien
agccgctgagtgctctggagtccct

SEQ ID NO: 93858 - DNA, 25 bp, Homo sapien
cagtgcaaaggtggcccagagtgcc

SEQ ID NO: 93859 - DNA, 25 bp, Homo sapien
ccaacagtgacagagcagggcgcgc

SEQ ID NO: 93860 - DNA, 25 bp, Homo sapien
cccactggggatggcaaagacgaca

SEQ ID NO: 93861 - DNA, 25 bp, Homo sapien
caaagacgacatccggtgcgccgag

SEQ ID NO: 93862 - DNA, 25 bp, Homo sapien
aggcgcccgcatcggccagtgcaaa

SEQ ID NO: 93863 - DNA, 25 bp, Homo sapien
gaagcacctttctgcttgcgctggg

SEQ ID NO: 93864 - DNA, 25 bp, Homo sapien
tgcgccgaggctgctcacaaaagta

SEQ ID NO: 93865 - DNA, 25 bp, Homo sapien
cccagaggtgccatgcccacagtgt

SEQ ID NO: 93866 - DNA, 25 bp, Homo sapien
cccaggttagtggtggccttcccag

SEQ ID NO: 93867 - DNA, 25 bp, Homo sapien
cagcagctcagattgcccaggagtc

SEQ ID NO: 93868 - DNA, 25 bp, Homo sapien
ccagagcagggcgtacagcagctca

SEQ ID NO: 93869 - DNA, 25 bp, Homo sapien
cagagaccagagcagggcgtacagc

SEQ ID NO: 93870 - DNA, 25 bp, Homo sapien
cacagtgtccctcgggtccaccaag

SEQ ID NO: 93871 - DNA, 25 bp, Homo sapien
tcctctcctacatgccgcctgcgtg

SEQ ID NO: 93872 - DNA, 25 bp, Homo sapien
gaaccaccgtcctttctgcgcgacc

SEQ ID NO: 93873 - DNA, 25 bp, Homo sapien
gagaaacaggagctgctggtgatta

SEQ ID NO: 93874 - DNA, 25 bp, Homo sapien
cggatgtctgcgtttgagaaacagg

SEQ ID NO: 93875 - DNA, 25 bp, Homo sapien
aacccgctgcagaggcgtcggatga

SEQ ID NO: 93876 - DNA, 25 bp, Homo sapien
ggctgccacctgcagtaccagcggg

SEQ ID NO: 93877 - DNA, 25 bp, Homo sapien
ggctgctagacgtgtcccacctcgt

SEQ ID NO: 93878 - DNA, 25 bp, Homo sapien
acgcccgcgtgctggactcgcgtgt

SEQ ID NO: 93879 - DNA, 25 bp, Homo sapien
ctcgcgtgtagcctctctggagggt

SEQ ID NO: 93880 - DNA, 25 bp, Homo sapien
cggtgatcgaggcacagcgccagtc

SEQ ID NO: 93881 - DNA, 25 bp, Homo sapien
catggctgacattgaggagggagct

SEQ ID NO: 93882 - DNA, 25 bp, Homo sapien
acgatggccatggtgacactgagga

SEQ ID NO: 93883 - DNA, 25 bp, Homo sapien
gaacgatggccatggtgacactgag

SEQ ID NO: 93884 - DNA, 25 bp, Homo sapien
tggctgacattcaggagggagcgtg

SEQ ID NO: 93885 - DNA, 25 bp, Homo sapien
gcgtggcagagggaacgatggccat

SEQ ID NO: 93886 - DNA, 25 bp, Homo sapien
tggccatggctgacattgaggaggg

SEQ ID NO: 93887 - DNA, 25 bp, Homo sapien
agctggcagagggaacgatggccat

SEQ ID NO: 93888 - DNA, 25 bp, Homo sapien
ccatggctgacattgaggagggagc

SEQ ID NO: 93889 - DNA, 25 bp, Homo sapien
gctagtgaaactgacctggcaaagc

SEQ ID NO: 93890 - DNA, 25 bp, Homo sapien
cctggcaaagcatgatgaagaagac

SEQ ID NO: 93891 - DNA, 25 bp, Homo sapien
ggaacagatgtatcaggacaaactg

SEQ ID NO: 93892 - DNA, 25 bp, Homo sapien
ggacaaactggcttctctcgagagg

SEQ ID NO: 93893 - DNA, 25 bp, Homo sapien
cagttgcaacaactacaagaaggta

SEQ ID NO: 93894 - DNA, 25 bp, Homo sapien
ctctcgagaggcagttgcaacaact

SEQ ID NO: 93895 - DNA, 25 bp, Homo sapien
tcggacgaagacactgaggatgcta

SEQ ID NO: 93896 - DNA, 25 bp, Homo sapien
cccgtaatcgcagttattcaggagg

SEQ ID NO: 93897 - DNA, 25 bp, Homo sapien
cgagcggacgttgctgtcactcact

SEQ ID NO: 93898 - DNA, 25 bp, Homo sapien
tccagacactcacgggccaagatga

SEQ ID NO: 93899 - DNA, 25 bp, Homo sapien
gtcactcactggctaaggaacgctg

SEQ ID NO: 93900 - DNA, 25 bp, Homo sapien
tcgtgagtctccacatcttcatctg

SEQ ID NO: 93901 - DNA, 25 bp, Homo sapien
cgatttcaaactcgacaccgcggag

SEQ ID NO: 93902 - DNA, 25 bp, Homo sapien
caccgcaggtttgcgcgatttcaaa

SEQ ID NO: 93903 - DNA, 25 bp, Homo sapien
cgccaggcagcaccgtcagagctgg

SEQ ID NO: 93904 - DNA, 25 bp, Homo sapien
ctggccacgtggtgctccagacact

SEQ ID NO: 93905 - DNA, 25 bp, Homo sapien
tggttccgacccaagagagctcgtc

SEQ ID NO: 93906 - DNA, 25 bp, Homo sapien
ctcccgagcaagattagagggtttc

SEQ ID NO: 93907 - DNA, 25 bp, Homo sapien
ctcggctttgtcctcgttaaacttg

SEQ ID NO: 93908 - DNA, 25 bp, Homo sapien
cgcacagaatctgcccttttaaagg

SEQ ID NO: 93909 - DNA, 25 bp, Homo sapien
cacgacggagcaggtccctttgcat

SEQ ID NO: 93910 - DNA, 25 bp, Homo sapien
aggtgcaattttcgctgggccgacg

SEQ ID NO: 93911 - DNA, 25 bp, Homo sapien
tccagcagaccctcgacggaacgtt

SEQ ID NO: 93912 - DNA, 25 bp, Homo sapien
cagagtccggccatccagaagtgcc

SEQ ID NO: 93913 - DNA, 25 bp, Homo sapien
agcctgcagcctgttcagtccaggg

SEQ ID NO: 93914 - DNA, 25 bp, Homo sapien
tcccgcaggggcgtcagagggtcgg

SEQ ID NO: 93915 - DNA, 25 bp, Homo sapien
gcctgcagcctgttcagtccagggc

SEQ ID NO: 93916 - DNA, 25 bp, Homo sapien
aagcctgcagcctgttcagtccagg

SEQ ID NO: 93917 - DNA, 25 bp, Homo sapien
ggctgggttgctggggcgccagtct

SEQ ID NO: 93918 - DNA, 25 bp, Homo sapien
aagggctgtctagggcgcacgcctc

SEQ ID NO: 93919 - DNA, 25 bp, Homo sapien
aaagcctgcagcctgttcagtccag

SEQ ID NO: 93920 - DNA, 25 bp, Homo sapien
gtcgcccaggctgggttgctggggc

SEQ ID NO: 93921 - DNA, 25 bp, Homo sapien
accctcagaccaggtaggctgtgca

SEQ ID NO: 93922 - DNA, 25 bp, Homo sapien
attgcccagcgccagggatcaggat

SEQ ID NO: 93923 - DNA, 25 bp, Homo sapien
gagtgactctccaggcgtcttccgc

SEQ ID NO: 93924 - DNA, 25 bp, Homo sapien
aggtgtccaggaggagcagaccctc

SEQ ID NO: 93925 - DNA, 25 bp, Homo sapien
tgcaactgcaaactgcgcgtcctgg

SEQ ID NO: 93926 - DNA, 25 bp, Homo sapien
atgagtctcatcctgtggattgccc

SEQ ID NO: 93927 - DNA, 25 bp, Homo sapien
ctgcgattttccgtccgtggtcctg

SEQ ID NO: 93928 - DNA, 25 bp, Homo sapien
agcaccagatctctcttcggaagga

SEQ ID NO: 93929 - DNA, 25 bp, Homo sapien
aatgacgattttgcgccggctgctc

SEQ ID NO: 93930 - DNA, 25 bp, Homo sapien
ggctgctcagaagataccgtgaatc

SEQ ID NO: 93931 - DNA, 25 bp, Homo sapien
aactcccgtcagcagatccggaagc

SEQ ID NO: 93932 - DNA, 25 bp, Homo sapien
tccgcaagcctgtgacggtccattc

SEQ ID NO: 93933 - DNA, 25 bp, Homo sapien
ggctcgatgccggaaaaacaccttg

SEQ ID NO: 93934 - DNA, 25 bp, Homo sapien
ccataggtgagcagaagggtacagc

SEQ ID NO: 93935 - DNA, 25 bp, Homo sapien
tccggaagctcatcaaagacgggct

SEQ ID NO: 93936 - DNA, 25 bp, Homo sapien
tgcccgaatgccagagaaggtcaca

SEQ ID NO: 93937 - DNA, 25 bp, Homo sapien
aggcgcagccggtccaggtttcgcc

SEQ ID NO: 93938 - DNA, 25 bp, Homo sapien
gcaggcggcaggctaccttgctctc

SEQ ID NO: 93939 - DNA, 25 bp, Homo sapien
ccttggcaaagctgctgtcccgctg

SEQ ID NO: 93940 - DNA, 25 bp, Homo sapien
tgttttcgggcgtccttggcaaagc

SEQ ID NO: 93941 - DNA, 25 bp, Homo sapien
cgagcgcgtcgccaccatggtaagt

SEQ ID NO: 93942 - DNA, 25 bp, Homo sapien
cgccttgcaggagggttcaaatccg

SEQ ID NO: 93943 - DNA, 25 bp, Homo sapien
ccgacgccttgcaggagggttcaaa

SEQ ID NO: 93944 - DNA, 25 bp, Homo sapien
ctgcaaacgcgctttccagggagca

SEQ ID NO: 93945 - DNA, 25 bp, Homo sapien
gcgggcagcgctgtaagcgtaacca

SEQ ID NO: 93946 - DNA, 25 bp, Homo sapien
gggcttgttctcttcgcagttgtcg

SEQ ID NO: 93947 - DNA, 25 bp, Homo sapien
gagtcccagactcataggtcccggc

SEQ ID NO: 93948 - DNA, 25 bp, Homo sapien
gttgctcggactcaaacgtccagtc

SEQ ID NO: 93949 - DNA, 25 bp, Homo sapien
cggcttccggttccgatgacagtgg

SEQ ID NO: 93950 - DNA, 25 bp, Homo sapien
cccgaacaatctgcccttgggcttg

SEQ ID NO: 93951 - DNA, 25 bp, Homo sapien
tcggaacctggaaacgaccaggcgc

SEQ ID NO: 93952 - DNA, 25 bp, Homo sapien
tgtaagcgtaaccacttggggcttg

SEQ ID NO: 93953 - DNA, 25 bp, Homo sapien
ccaggtcatcagctgcgcgagaagc

SEQ ID NO: 93954 - DNA, 25 bp, Homo sapien
tttattttggtcatcgcagcggccg

SEQ ID NO: 93955 - DNA, 25 bp, Homo sapien
gtctccgactcagcccaatcgttga

SEQ ID NO: 93956 - DNA, 25 bp, Homo sapien
ggccgctgaaacctagtcccaggga

SEQ ID NO: 93957 - DNA, 25 bp, Homo sapien
tcaccgctgcaacgacagaagagtc

SEQ ID NO: 93958 - DNA, 25 bp, Homo sapien
catttgtagagcttccgcgtgaggc

SEQ ID NO: 93959 - DNA, 25 bp, Homo sapien
ttgacgcccagcttcgtaactacgg

SEQ ID NO: 93960 - DNA, 25 bp, Homo sapien
acgcggtccacagctttaggcatca

SEQ ID NO: 93961 - DNA, 25 bp, Homo sapien
tagcggcccaggtacacgtcggcca

SEQ ID NO: 93962 - DNA, 25 bp, Homo sapien
ccaggaataccagcgcggcgcgcgt

SEQ ID NO: 93963 - DNA, 25 bp, Homo sapien
gcctgctcgccggtccagttgaagt

SEQ ID NO: 93964 - DNA, 25 bp, Homo sapien
tgctgttgaggtacagcacgaggtt

SEQ ID NO: 93965 - DNA, 25 bp, Homo sapien
gcgacgcgggcatctctccgcagaa

SEQ ID NO: 93966 - DNA, 25 bp, Homo sapien
ggccgagtagcagcaggcccgcgta

SEQ ID NO: 93967 - DNA, 25 bp, Homo sapien
tcacctggtcggcaccgaaggaggt

SEQ ID NO: 93968 - DNA, 25 bp, Homo sapien
cgcgggcatctctccgcagaaggag

SEQ ID NO: 93969 - DNA, 25 bp, Homo sapien
actcagcggtcatggcgagcatagc

SEQ ID NO: 93970 - DNA, 25 bp, Homo sapien
gcggctcgcgcctgcgcgaatcaaa

SEQ ID NO: 93971 - DNA, 25 bp, Homo sapien
gcgcctgcgcgaatcaaaagccaga

SEQ ID NO: 93972 - DNA, 25 bp, Homo sapien
catggcgagcatagcggtgaagcac

SEQ ID NO: 93973 - DNA, 25 bp, Homo sapien
gcatagcggtgaagcacctgagcca

SEQ ID NO: 93974 - DNA, 25 bp, Homo sapien
gaccaggagctattcaacgagtact

SEQ ID NO: 93975 - DNA, 25 bp, Homo sapien
aacgagtactagttcagcgtggccc

SEQ ID NO: 93976 - DNA, 25 bp, Homo sapien
tcagcgtggcccgacttgtggagct

SEQ ID NO: 93977 - DNA, 25 bp, Homo sapien
tccgggtcacagtagcggcaggccc

SEQ ID NO: 93978 - DNA, 25 bp, Homo sapien
gaagccgtagctcgccgcatcgtct

SEQ ID NO: 93979 - DNA, 25 bp, Homo sapien
aacagaagccgtagctcgccgcatc

SEQ ID NO: 93980 - DNA, 25 bp, Homo sapien
cgggcagtaacagaagccgtagctc

SEQ ID NO: 93981 - DNA, 25 bp, Homo sapien
tgcccgggcagtaacagaagccgta

SEQ ID NO: 93982 - DNA, 25 bp, Homo sapien
ccgcttgcgcttgtgactgcccggg

SEQ ID NO: 93983 - DNA, 25 bp, Homo sapien
gcgcttgtgactgcccgggcagtaa

SEQ ID NO: 93984 - DNA, 25 bp, Homo sapien
gcaagggctcgcctcggctggccca

SEQ ID NO: 93985 - DNA, 25 bp, Homo sapien
cgcctcggcctagcatgtcggaagc

SEQ ID NO: 93986 - DNA, 25 bp, Homo sapien
ccggctccggcattataaagggcgc

SEQ ID NO: 93987 - DNA, 25 bp, Homo sapien
agtgacggacttgagcagccaatga

SEQ ID NO: 93988 - DNA, 25 bp, Homo sapien
ataaagggcgccacgagtcggcatt

SEQ ID NO: 93989 - DNA, 25 bp, Homo sapien
ctgaagctaggttgagtgacggact

SEQ ID NO: 93990 - DNA, 25 bp, Homo sapien
aaagcccgcccaggtctagagcgcg

SEQ ID NO: 93991 - DNA, 25 bp, Homo sapien
caccgagaacggacatgaggccgtc

SEQ ID NO: 93992 - DNA, 25 bp, Homo sapien
gcagtttgttgcgatgtggcacccg

SEQ ID NO: 93993 - DNA, 25 bp, Homo sapien
tctgtgcccgcgaatccactgggag

SEQ ID NO: 93994 - DNA, 25 bp, Homo sapien
caggacgcagcgctgcctgaaactc

SEQ ID NO: 93995 - DNA, 25 bp, Homo sapien
ttctctttgcaggttctcaggcggc

SEQ ID NO: 93996 - DNA, 25 bp, Homo sapien
gacacaggcccgtcatttctctttg

SEQ ID NO: 93997 - DNA, 25 bp, Homo sapien
cgacttgggctccttgacacaggcc

SEQ ID NO: 93998 - DNA, 25 bp, Homo sapien
ggacgaacccgaggacgcattgctc

SEQ ID NO: 93999 - DNA, 25 bp, Homo sapien
cgggcaccacgaatgccggacgtga

SEQ ID NO: 94000 - DNA, 25 bp, Homo sapien
aatctgttaatcacccaccggggcg

SEQ ID NO: 94001 - DNA, 25 bp, Homo sapien
tcactcaccctacacgtgacaggga

SEQ ID NO: 94002 - DNA, 25 bp, Homo sapien
tcactcaccctacacctgagaggga

SEQ ID NO: 94003 - DNA, 25 bp, Homo sapien
tcaccctgcacgtgacagggacacg

SEQ ID NO: 94004 - DNA, 25 bp, Homo sapien
actcaccctgcacgtgacagggaca

SEQ ID NO: 94005 - DNA, 25 bp, Homo sapien
cgtcaatcaccctgcacgtgacagg

SEQ ID NO: 94006 - DNA, 25 bp, Homo sapien
tcaccctgaacgtgacagggacacc

SEQ ID NO: 94007 - DNA, 25 bp, Homo sapien
tcactcaccctgcacgtgacaggga

SEQ ID NO: 94008 - DNA, 25 bp, Homo sapien
actcaccctacacgtgacagggaca

SEQ ID NO: 94009 - DNA, 25 bp, Homo sapien
aaggtcaccctccttgtctgcatgg

SEQ ID NO: 94010 - DNA, 25 bp, Homo sapien
acaccgccgagttagcaattctgca

SEQ ID NO: 94011 - DNA, 25 bp, Homo sapien
tggctgaccacgtgcacctgcaaaa

SEQ ID NO: 94012 - DNA, 25 bp, Homo sapien
gcacctggccgtcaacacacaatta

SEQ ID NO: 94013 - DNA, 25 bp, Homo sapien
tcctggcacaatcaacgaacacttt

SEQ ID NO: 94014 - DNA, 25 bp, Homo sapien
gtggccctcttcatacctaaagatg

SEQ ID NO: 94015 - DNA, 25 bp, Homo sapien
gggacttcttctagctgccacggta

SEQ ID NO: 94016 - DNA, 25 bp, Homo sapien
tctgcatggccggaagtcttacatg

SEQ ID NO: 94017 - DNA, 25 bp, Homo sapien
ctcgggccctagaagctccagcggg

SEQ ID NO: 94018 - DNA, 25 bp, Homo sapien
gtcgtgccttggcagtcccgcgcag

SEQ ID NO: 94019 - DNA, 25 bp, Homo sapien
ttcatttcttcgcttgcccactggg

SEQ ID NO: 94020 - DNA, 25 bp, Homo sapien
cccgcgttgcggtggttcatttctt

SEQ ID NO: 94021 - DNA, 25 bp, Homo sapien
tgccgtgacgccacgcggagacgtc

SEQ ID NO: 94022 - DNA, 25 bp, Homo sapien
gggtacctgatgagccgttgcctca

SEQ ID NO: 94023 - DNA, 25 bp, Homo sapien
ctgacacagccgaacagcggtgagg

SEQ ID NO: 94024 - DNA, 25 bp, Homo sapien
tgcctcagggccagcgtgtcggcct

SEQ ID NO: 94025 - DNA, 25 bp, Homo sapien
gagcacggcttcaatccacctgtgt

SEQ ID NO: 94026 - DNA, 25 bp, Homo sapien
cggagcacggcttcaatccacctgt

SEQ ID NO: 94027 - DNA, 25 bp, Homo sapien
ggagcacggcttcaatccacctgtg

SEQ ID NO: 94028 - DNA, 25 bp, Homo sapien
ttcaatccacctctgtgtgcgccgg

SEQ ID NO: 94029 - DNA, 25 bp, Homo sapien
gccggagcacggcttcaatccacct

SEQ ID NO: 94030 - DNA, 25 bp, Homo sapien
tcaatccacctctgtgtgcgccgga

SEQ ID NO: 94031 - DNA, 25 bp, Homo sapien
aatccacctctgtgtgcgccggagc

SEQ ID NO: 94032 - DNA, 25 bp, Homo sapien
ggcttcaatccacctctgtgtgcgc

SEQ ID NO: 94033 - DNA, 25 bp, Homo sapien
cggcctcgctcatctgagaggggtc

SEQ ID NO: 94034 - DNA, 25 bp, Homo sapien
cgaggagagcatgcgtgttcctgtc

SEQ ID NO: 94035 - DNA, 25 bp, Homo sapien
cgtgtgggccacgacacattgcgcc

SEQ ID NO: 94036 - DNA, 25 bp, Homo sapien
tgggccacgacacattgcgccaggc

SEQ ID NO: 94037 - DNA, 25 bp, Homo sapien
ggtctgagtgtggagccatcctccc

SEQ ID NO: 94038 - DNA, 25 bp, Homo sapien
acagcctgcgtgcacttgctggagc

SEQ ID NO: 94039 - DNA, 25 bp, Homo sapien
cgtgcacttgctggagcgcagagac

SEQ ID NO: 94040 - DNA, 25 bp, Homo sapien
tcgctcatctgagaggggtctgagt

SEQ ID NO: 94041 - DNA, 25 bp, Homo sapien
ctccaaacgtccaggcttggttccg

SEQ ID NO: 94042 - DNA, 25 bp, Homo sapien
agctccaaacgtccaggcttggttc

SEQ ID NO: 94043 - DNA, 25 bp, Homo sapien
ggctctcagctccaaacgtccaggc

SEQ ID NO: 94044 - DNA, 25 bp, Homo sapien
ctctcagctccaaacgtccaggctt

SEQ ID NO: 94045 - DNA, 25 bp, Homo sapien
gctccaaacgtccaggcttggttcc

SEQ ID NO: 94046 - DNA, 25 bp, Homo sapien
cggctgtcctccgagagtctctccc

SEQ ID NO: 94047 - DNA, 25 bp, Homo sapien
ctcagctccaaacgtccaggcttgg

SEQ ID NO: 94048 - DNA, 25 bp, Homo sapien
tctcagctccaaacgtccaggcttg

SEQ ID NO: 94049 - DNA, 25 bp, Homo sapien
ctcaggggcagaacgttgtcagcac

SEQ ID NO: 94050 - DNA, 25 bp, Homo sapien
aggggcagaacgttgtcagcacaga

SEQ ID NO: 94051 - DNA, 25 bp, Homo sapien
gcagtccttttcaccaattttatca

SEQ ID NO: 94052 - DNA, 25 bp, Homo sapien
cttgtagtctgcagtccttttcacc

SEQ ID NO: 94053 - DNA, 25 bp, Homo sapien
gctgaacagcatcttgtagtctgca

SEQ ID NO: 94054 - DNA, 25 bp, Homo sapien
gcagttctttctgctgaacagcatc

SEQ ID NO: 94055 - DNA, 25 bp, Homo sapien
gagccttctcaacagcagttctttc

SEQ ID NO: 94056 - DNA, 25 bp, Homo sapien
cttcgagccttctcaacagcagttc

SEQ ID NO: 94057 - DNA, 25 bp, Homo sapien
cccgaaggctaagctcacatggctg

SEQ ID NO: 94058 - DNA, 25 bp, Homo sapien
aaggctaagctcacatggctggtaa

SEQ ID NO: 94059 - DNA, 25 bp, Homo sapien
catggctggtaagaaatggcgacac

SEQ ID NO: 94060 - DNA, 25 bp, Homo sapien
atggctggtaagaaatggcgacaca

SEQ ID NO: 94061 - DNA, 25 bp, Homo sapien
gctcacatggctggtaagaaatggc

SEQ ID NO: 94062 - DNA, 25 bp, Homo sapien
ggctaagctcacatggctggtaaga

SEQ ID NO: 94063 - DNA, 25 bp, Homo sapien
gaaggctaagctcacatggctggta

SEQ ID NO: 94064 - DNA, 25 bp, Homo sapien
ccgaaggctaagctcacatggctgg

SEQ ID NO: 94065 - DNA, 25 bp, Homo sapien
tctgtccgcggcgacatgggagaca

SEQ ID NO: 94066 - DNA, 25 bp, Homo sapien
tcccgcagcgtcttggtcaccgcct

SEQ ID NO: 94067 - DNA, 25 bp, Homo sapien
cccactgaccttgggctccggcgcc

SEQ ID NO: 94068 - DNA, 25 bp, Homo sapien
ctgcgtcgccaccacgcggcccggg

SEQ ID NO: 94069 - DNA, 25 bp, Homo sapien
ctcccgatgcggctcgggctgcgtc

SEQ ID NO: 94070 - DNA, 25 bp, Homo sapien
catgggagacagagccgcgtgtccg

SEQ ID NO: 94071 - DNA, 25 bp, Homo sapien
gagctgggacttcccagacccgagc

SEQ ID NO: 94072 - DNA, 25 bp, Homo sapien
ccgcgtgtccgaggcgcggcataaa

SEQ ID NO: 94073 - DNA, 25 bp, Homo sapien
tgtgcgatgacacttgggacctgga

SEQ ID NO: 94074 - DNA, 25 bp, Homo sapien
gccgggaacaccagcgtagcagcta

SEQ ID NO: 94075 - DNA, 25 bp, Homo sapien
acgcccacgtggtgtgcaggcaact

SEQ ID NO: 94076 - DNA, 25 bp, Homo sapien
attcccagtcttgcctaccgggcta

SEQ ID NO: 94077 - DNA, 25 bp, Homo sapien
acatgccaggttcacagggtcccta

SEQ ID NO: 94078 - DNA, 25 bp, Homo sapien
atctgagcgtttccttggatctggc

SEQ ID NO: 94079 - DNA, 25 bp, Homo sapien
tcacctgtgcaggtacgagcgcacc

SEQ ID NO: 94080 - DNA, 25 bp, Homo sapien
cgacctcgagtcatttccagatctg

SEQ ID NO: 94081 - DNA, 25 bp, Homo sapien
ggcgctcctcgctcagcccaactcc

SEQ ID NO: 94082 - DNA, 25 bp, Homo sapien
gccgcctgggttcggctttggacca

SEQ ID NO: 94083 - DNA, 25 bp, Homo sapien
gctgttcctgatcctcgaactctct

SEQ ID NO: 94084 - DNA, 25 bp, Homo sapien
ttcggctttggaccaggcgagcagc

SEQ ID NO: 94085 - DNA, 25 bp, Homo sapien
gcgcctgtgtccctagcgcggtact

SEQ ID NO: 94086 - DNA, 25 bp, Homo sapien
gtccctagcgcggtactgcttctgc

SEQ ID NO: 94087 - DNA, 25 bp, Homo sapien
ccgggctgttcctgatcctcgaact

SEQ ID NO: 94088 - DNA, 25 bp, Homo sapien
cgcgccgttcattcccgcgtcctgg

SEQ ID NO: 94089 - DNA, 25 bp, Homo sapien
tgcaaatagaccctgccagaaaagg

SEQ ID NO: 94090 - DNA, 25 bp, Homo sapien
gggcagtttcctctatgcaaataga

SEQ ID NO: 94091 - DNA, 25 bp, Homo sapien
cacagcggccactttgggcagtttc

SEQ ID NO: 94092 - DNA, 25 bp, Homo sapien
gtctgttactccaaagtccctggtc

SEQ ID NO: 94093 - DNA, 25 bp, Homo sapien
gttagcctccgggtagcagcggatc

SEQ ID NO: 94094 - DNA, 25 bp, Homo sapien
cgttcgtcgcgcgtggactctccga

SEQ ID NO: 94095 - DNA, 25 bp, Homo sapien
agacgtgcccatctctgggacggcc

SEQ ID NO: 94096 - DNA, 25 bp, Homo sapien
cctgccagaaaaggagcagggaccc

SEQ ID NO: 94097 - DNA, 25 bp, Homo sapien
agggttaaccaacagccgcgctcgc

SEQ ID NO: 94098 - DNA, 25 bp, Homo sapien
tgcctttggcgcactcaagacaggg

SEQ ID NO: 94099 - DNA, 25 bp, Homo sapien
ggggcaaatgcttgactctggaaaa

SEQ ID NO: 94100 - DNA, 25 bp, Homo sapien
acggctctcgaagggtctcccgaca

SEQ ID NO: 94101 - DNA, 25 bp, Homo sapien
cgacacctggctcggagacctaaag

SEQ ID NO: 94102 - DNA, 25 bp, Homo sapien
tcggccgagaaatgtcgccaaactg

SEQ ID NO: 94103 - DNA, 25 bp, Homo sapien
aacgcgcctgcgtgacagaaccttg

SEQ ID NO: 94104 - DNA, 25 bp, Homo sapien
ccaggggaagacttgatctccgaca

SEQ ID NO: 94105 - DNA, 25 bp, Homo sapien
tcggcgccagctggcactgccagca

SEQ ID NO: 94106 - DNA, 25 bp, Homo sapien
gcctcaagcctttcccagccggttc

SEQ ID NO: 94107 - DNA, 25 bp, Homo sapien
gcgcgccctcacagggattcgggag

SEQ ID NO: 94108 - DNA, 25 bp, Homo sapien
agcccgcggaccagagcagcgctgg

SEQ ID NO: 94109 - DNA, 25 bp, Homo sapien
agtggcagcagcgacccgctgagcc

SEQ ID NO: 94110 - DNA, 25 bp, Homo sapien
cgctgagttcctcggcgccagctgg

SEQ ID NO: 94111 - DNA, 25 bp, Homo sapien
ccactgcaccgctcaggaaactgag

SEQ ID NO: 94112 - DNA, 25 bp, Homo sapien
tttcccagccggttcctctctctcc

SEQ ID NO: 94113 - DNA, 25 bp, Homo sapien
cccggcctgtgtcaggattcgcact

SEQ ID NO: 94114 - DNA, 25 bp, Homo sapien
acacggcgtcctgcatgtggatcca

SEQ ID NO: 94115 - DNA, 25 bp, Homo sapien
tgtgcggcacataccgaactgctgc

SEQ ID NO: 94116 - DNA, 25 bp, Homo sapien
cgaactgctgcagggagtacacggc

SEQ ID NO: 94117 - DNA, 25 bp, Homo sapien
catgtggatccagaagcgcagccgc

SEQ ID NO: 94118 - DNA, 25 bp, Homo sapien
cccagtgagaccttgtcgtaggaca

SEQ ID NO: 94119 - DNA, 25 bp, Homo sapien
agaccttgtcgtaggacacggtgag

SEQ ID NO: 94120 - DNA, 25 bp, Homo sapien
aggattcgcacttggatgcccgagg

SEQ ID NO: 94121 - DNA, 25 bp, Homo sapien
gaaatggagtccacgagaggacacc

SEQ ID NO: 94122 - DNA, 25 bp, Homo sapien
agccggacgcgggtgcaccagcaac

SEQ ID NO: 94123 - DNA, 25 bp, Homo sapien
ccagcgcccacaaaggctttcggag

SEQ ID NO: 94124 - DNA, 25 bp, Homo sapien
acctccctaagctcgagcgtcccgg

SEQ ID NO: 94125 - DNA, 25 bp, Homo sapien
tccacgagaggacacctgcattcgg

SEQ ID NO: 94126 - DNA, 25 bp, Homo sapien
ttccatgcgtttgaggcggggtccc

SEQ ID NO: 94127 - DNA, 25 bp, Homo sapien
cacaaaggctttcggagcctcggca

SEQ ID NO: 94128 - DNA, 25 bp, Homo sapien
cctgcattcggggaagtgtagttcc

SEQ ID NO: 94129 - DNA, 25 bp, Homo sapien
tccatttcctagaggccttagcggc

SEQ ID NO: 94130 - DNA, 25 bp, Homo sapien
ttagcggccgccttgctcctctagg

SEQ ID NO: 94131 - DNA, 25 bp, Homo sapien
agcgtcctcccgtggactccatttc

SEQ ID NO: 94132 - DNA, 25 bp, Homo sapien
ggcccggtttctgagtcagtcccca

SEQ ID NO: 94133 - DNA, 25 bp, Homo sapien
cgcgccaggacttggactctcgccc

SEQ ID NO: 94134 - DNA, 25 bp, Homo sapien
ctctgcggagctttcgctgcccggt

SEQ ID NO: 94135 - DNA, 25 bp, Homo sapien
agcttcctgcttgcagagtgcggcg

SEQ ID NO: 94136 - DNA, 25 bp, Homo sapien
gtcacgaggctggagcttcctgctt

SEQ ID NO: 94137 - DNA, 25 bp, Homo sapien
cgcgccatccgtgagtcttgtaggc

SEQ ID NO: 94138 - DNA, 25 bp, Homo sapien
tggacacaccgatgacctgcagagg

SEQ ID NO: 94139 - DNA, 25 bp, Homo sapien
ctggatctcattccgagagcgctgg

SEQ ID NO: 94140 - DNA, 25 bp, Homo sapien
acccgcggacatcccggggattctg

SEQ ID NO: 94141 - DNA, 25 bp, Homo sapien
gggcccaaggttccaagagtcgctc

SEQ ID NO: 94142 - DNA, 25 bp, Homo sapien
cgctgcgaccgtggagcgaacctaa

SEQ ID NO: 94143 - DNA, 25 bp, Homo sapien
gcagctgagtgtccttcggcgctgt

SEQ ID NO: 94144 - DNA, 25 bp, Homo sapien
gcagcatctgccctttgtgtaaacc

SEQ ID NO: 94145 - DNA, 25 bp, Homo sapien
gcccagggtttcctctcaggtgata

SEQ ID NO: 94146 - DNA, 25 bp, Homo sapien
ggcagcactgtctccgccgattgtc

SEQ ID NO: 94147 - DNA, 25 bp, Homo sapien
cccggaatgtatgtctgagatttga

SEQ ID NO: 94148 - DNA, 25 bp, Homo sapien
accaggcacggtggtcaaagccgca

SEQ ID NO: 94149 - DNA, 25 bp, Homo sapien
ctgcagactccagctcattgtgttc

SEQ ID NO: 94150 - DNA, 25 bp, Homo sapien
gcagccctgagacttgtgggaattc

SEQ ID NO: 94151 - DNA, 25 bp, Homo sapien
cgcttgccaggccaaggggcaattc

SEQ ID NO: 94152 - DNA, 25 bp, Homo sapien
tgttgccttccaggccttttcggcg

SEQ ID NO: 94153 - DNA, 25 bp, Homo sapien
caggcctcgcatgtgaactcgtcca

SEQ ID NO: 94154 - DNA, 25 bp, Homo sapien
aggaccagctcaggcgcaccacagg

SEQ ID NO: 94155 - DNA, 25 bp, Homo sapien
caggctgcacagagacgagggcacc

SEQ ID NO: 94156 - DNA, 25 bp, Homo sapien
ggtacccgtcacaggcctcgcagtg

SEQ ID NO: 94157 - DNA, 25 bp, Homo sapien
caccaccgtggtagtggccacgatg

SEQ ID NO: 94158 - DNA, 25 bp, Homo sapien
ttgtaccgcacgaaggtggccacca

SEQ ID NO: 94159 - DNA, 25 bp, Homo sapien
gtccacctggaagcggtacccgtca

SEQ ID NO: 94160 - DNA, 25 bp, Homo sapien
ccaggctcagccaccatgaggaagg

SEQ ID NO: 94161 - DNA, 25 bp, Homo sapien
taccggatgtgacccccttgcaacg

SEQ ID NO: 94162 - DNA, 25 bp, Homo sapien
gcgcgcctctgagttaccacgacat

SEQ ID NO: 94163 - DNA, 25 bp, Homo sapien
tgagttaccacgacatcgtgccaca

SEQ ID NO: 94164 - DNA, 25 bp, Homo sapien
cactgggcggagaccaggccgctct

SEQ ID NO: 94165 - DNA, 25 bp, Homo sapien
cgaggactcgctctgtacacagctc

SEQ ID NO: 94166 - DNA, 25 bp, Homo sapien
cttccgagtggccagcgaggactcg

SEQ ID NO: 94167 - DNA, 25 bp, Homo sapien
agaccaggccgctctgggctagtgc

SEQ ID NO: 94168 - DNA, 25 bp, Homo sapien
caatcaccggcctctgccaggatga

SEQ ID NO: 94169 - DNA, 25 bp, Homo sapien
gtgggcaatggcgtacaccgcatca

SEQ ID NO: 94170 - DNA, 25 bp, Homo sapien
gacagctcgaatgtactgcagaagc

SEQ ID NO: 94171 - DNA, 25 bp, Homo sapien
tagggatgcccagagaaagtgtgcc

SEQ ID NO: 94172 - DNA, 25 bp, Homo sapien
ctgcagaagcatccgcccatcagtg

SEQ ID NO: 94173 - DNA, 25 bp, Homo sapien
gttcctcgcctgtcctagggatgcc

SEQ ID NO: 94174 - DNA, 25 bp, Homo sapien
cgtacaccgcatcaatcacaaactg

SEQ ID NO: 94175 - DNA, 25 bp, Homo sapien
catcagtgggttccatcgccgggca

SEQ ID NO: 94176 - DNA, 25 bp, Homo sapien
cctcctgctcgtaggtggagtcccg

SEQ ID NO: 94177 - DNA, 25 bp, Homo sapien
tcgggctcaactgacagggcttctt

SEQ ID NO: 94178 - DNA, 25 bp, Homo sapien
cagggcttctttgacgctgtgtgaa

SEQ ID NO: 94179 - DNA, 25 bp, Homo sapien
cgctgtgtgaattcgagtgattaaa

SEQ ID NO: 94180 - DNA, 25 bp, Homo sapien
tcaccgcaaacaggcgcagcacgtt

SEQ ID NO: 94181 - DNA, 25 bp, Homo sapien
agcacgttggcgaccatgatggaga

SEQ ID NO: 94182 - DNA, 25 bp, Homo sapien
agcgcctgctccagcgcgtaggtgt

SEQ ID NO: 94183 - DNA, 25 bp, Homo sapien
cggtccagcgcgtacagcatggcct

SEQ ID NO: 94184 - DNA, 25 bp, Homo sapien
cttccacttcggctctggggagtta

SEQ ID NO: 94185 - DNA, 25 bp, Homo sapien
ctgtggttctctctcggacaccgta

SEQ ID NO: 94186 - DNA, 25 bp, Homo sapien
acaccgtaagtggtggtgccgcagc

SEQ ID NO: 94187 - DNA, 25 bp, Homo sapien
ccgcagcgacgtctgggaaatgaag

SEQ ID NO: 94188 - DNA, 25 bp, Homo sapien
caaaatgccgcctcggttcagggtc

SEQ ID NO: 94189 - DNA, 25 bp, Homo sapien
aacgctgcggttcagccagggaaac

SEQ ID NO: 94190 - DNA, 25 bp, Homo sapien
agcgacgggaaacgtctctgaatta

SEQ ID NO: 94191 - DNA, 25 bp, Homo sapien
ggaaacggctccagaacagaaactg

SEQ ID NO: 94192 - DNA, 25 bp, Homo sapien
ctctgaattaggtgttccgctcgcc

SEQ ID NO: 94193 - DNA, 25 bp, Homo sapien
aagcaatagctgatgcccgccgaga

SEQ ID NO: 94194 - DNA, 25 bp, Homo sapien
ctgttcccgctctgtcaggaggaga

SEQ ID NO: 94195 - DNA, 25 bp, Homo sapien
tccgcgcatccctgctaacagatag

SEQ ID NO: 94196 - DNA, 25 bp, Homo sapien
cagactagcgcatcgcccgaacgaa

SEQ ID NO: 94197 - DNA, 25 bp, Homo sapien
gatgccagccttttgtcgttgttca

SEQ ID NO: 94198 - DNA, 25 bp, Homo sapien
cgcactgtcgcctttgagagctctc

SEQ ID NO: 94199 - DNA, 25 bp, Homo sapien
ttgcttaacaagtgcgcgggctgta

SEQ ID NO: 94200 - DNA, 25 bp, Homo sapien
cgttgttcattctgcgattttcttc

SEQ ID NO: 94201 - DNA, 25 bp, Homo sapien
aagcgggccatagttccacgagtca

SEQ ID NO: 94202 - DNA, 25 bp, Homo sapien
ttccacgagtcagaaggacacgctc

SEQ ID NO: 94203 - DNA, 25 bp, Homo sapien
ttggcagccaatcccgttacctttc

SEQ ID NO: 94204 - DNA, 25 bp, Homo sapien
gcgcaccgctcagcccaaggagaga

SEQ ID NO: 94205 - DNA, 25 bp, Homo sapien
ggctccatgcaacagtcagcgccga

SEQ ID NO: 94206 - DNA, 25 bp, Homo sapien
ggagtgctacatggatcgcggctca

SEQ ID NO: 94207 - DNA, 25 bp, Homo sapien
ctcctgcaaccacgacagatctttg

SEQ ID NO: 94208 - DNA, 25 bp, Homo sapien
aagccgtctgcacttggaaacctca

SEQ ID NO: 94209 - DNA, 25 bp, Homo sapien
gggtcagcaccctaacctgtgaaga

SEQ ID NO: 94210 - DNA, 25 bp, Homo sapien
agacgggcaaactgtgctcgggaca

SEQ ID NO: 94211 - DNA, 25 bp, Homo sapien
cagcgccctaacctgtgaacagatg

SEQ ID NO: 94212 - DNA, 25 bp, Homo sapien
gcgccctaacctgtgaacagatggc

SEQ ID NO: 94213 - DNA, 25 bp, Homo sapien
gtcagcgccctaacctgtgaacaga

SEQ ID NO: 94214 - DNA, 25 bp, Homo sapien
gcagggtcggcaccctaacctgtga

SEQ ID NO: 94215 - DNA, 25 bp, Homo sapien
aacctgtgaacagatggccacgcac

SEQ ID NO: 94216 - DNA, 25 bp, Homo sapien
cgggcaaactgtgctcgggacagca

SEQ ID NO: 94217 - DNA, 25 bp, Homo sapien
cgggccgggcgtcattgcagtgctt

SEQ ID NO: 94218 - DNA, 25 bp, Homo sapien
ccaatgatcagggcagagctcgctg

SEQ ID NO: 94219 - DNA, 25 bp, Homo sapien
caggccgggcgtcattgcagtgctt

SEQ ID NO: 94220 - DNA, 25 bp, Homo sapien
gttgtgtagcggctgaatgcagcgc

SEQ ID NO: 94221 - DNA, 25 bp, Homo sapien
tgtccaccctcagttttggagctga

SEQ ID NO: 94222 - DNA, 25 bp, Homo sapien
accctcagttttggagctgaggaca

SEQ ID NO: 94223 - DNA, 25 bp, Homo sapien
gtcgtgtagcggctgaatgcagcgc

SEQ ID NO: 94224 - DNA, 25 bp, Homo sapien
ggattgcgtacctgggaccagggcc

SEQ ID NO: 94225 - DNA, 25 bp, Homo sapien
cggcactgctcctcgcggaagtcag

SEQ ID NO: 94226 - DNA, 25 bp, Homo sapien
gtcgccgtgctcgaagtacaggtcc

SEQ ID NO: 94227 - DNA, 25 bp, Homo sapien
cgtgctcgaagtacaggtcccactg

SEQ ID NO: 94228 - DNA, 25 bp, Homo sapien
tacaggtcccactggcggcactgct

SEQ ID NO: 94229 - DNA, 25 bp, Homo sapien
cctcgcggaagtcagccagggagtc

SEQ ID NO: 94230 - DNA, 25 bp, Homo sapien
ctgcagagctggaagtcgtaggcaa

SEQ ID NO: 94231 - DNA, 25 bp, Homo sapien
ggagaaagcaaaggccttgccgctc

SEQ ID NO: 94232 - DNA, 25 bp, Homo sapien
cgaagtacaggtcccactggcggca

SEQ ID NO: 94233 - DNA, 25 bp, Homo sapien
cgagcgtgttcacacgtgctgctga

SEQ ID NO: 94234 - DNA, 25 bp, Homo sapien
cgtgttcacacgtgctgctgaggga

SEQ ID NO: 94235 - DNA, 25 bp, Homo sapien
gaggctgtcccactgcgggatccct

SEQ ID NO: 94236 - DNA, 25 bp, Homo sapien
ggagccgtgactgcgggtcctctct

SEQ ID NO: 94237 - DNA, 25 bp, Homo sapien
gcagccgggacgcacccggagccct

SEQ ID NO: 94238 - DNA, 25 bp, Homo sapien
tgactgcgggtcctctctggctccg

SEQ ID NO: 94239 - DNA, 25 bp, Homo sapien
ccagagcaaggagagcagcccgagt

SEQ ID NO: 94240 - DNA, 25 bp, Homo sapien
agcagcccgagtgaacaggacccag

SEQ ID NO: 94241 - DNA, 25 bp, Homo sapien
gttctgttccaatcgttgctctccg

SEQ ID NO: 94242 - DNA, 25 bp, Homo sapien
tgaaggaatgaacacgagcaccctc

SEQ ID NO: 94243 - DNA, 25 bp, Homo sapien
aggcttggcacacgacacctcgctt

SEQ ID NO: 94244 - DNA, 25 bp, Homo sapien
tcctaccttccggatgacgaactgc

SEQ ID NO: 94245 - DNA, 25 bp, Homo sapien
acaactgaaaggactcgcctgagtc

SEQ ID NO: 94246 - DNA, 25 bp, Homo sapien
tgctctccgacatttccattgtttg

SEQ ID NO: 94247 - DNA, 25 bp, Homo sapien
ctctggaaggagctgaattatctat

SEQ ID NO: 94248 - DNA, 25 bp, Homo sapien
gacgaactgcgtctcagacaactga

SEQ ID NO: 94249 - DNA, 25 bp, Homo sapien
ccatgaagttcgtagggccaagacc

SEQ ID NO: 94250 - DNA, 25 bp, Homo sapien
cggcttcctgcgaagcgctgactga

SEQ ID NO: 94251 - DNA, 25 bp, Homo sapien
cccggctgttccaaggtccatgaag

SEQ ID NO: 94252 - DNA, 25 bp, Homo sapien
cccgaaatggcacgcagagctgagc

SEQ ID NO: 94253 - DNA, 25 bp, Homo sapien
agttgctgactctttgtgccgtccc

SEQ ID NO: 94254 - DNA, 25 bp, Homo sapien
cccgcctagaggcacaagttgctga

SEQ ID NO: 94255 - DNA, 25 bp, Homo sapien
tctggcacctcgaagcgaaacacac

SEQ ID NO: 94256 - DNA, 25 bp, Homo sapien
ttaggagtcacccaacgcctggacc

SEQ ID NO: 94257 - DNA, 25 bp, Homo sapien
ctgacatccgtaggcgccatcctga

SEQ ID NO: 94258 - DNA, 25 bp, Homo sapien
gcgggcggattgtctgtatctcctt

SEQ ID NO: 94259 - DNA, 25 bp, Homo sapien
tatctccttggtgggagcagttggc

SEQ ID NO: 94260 - DNA, 25 bp, Homo sapien
tggccgtggagtctacatcggtttc

SEQ ID NO: 94261 - DNA, 25 bp, Homo sapien
acatcggtttccttcctggccgtca

SEQ ID NO: 94262 - DNA, 25 bp, Homo sapien
ggccgtcatttacagggagagcatg

SEQ ID NO: 94263 - DNA, 25 bp, Homo sapien
tgtgcgcttactgcagccatgcggt

SEQ ID NO: 94264 - DNA, 25 bp, Homo sapien
tgggtgcacgctaccaccgtcttct

SEQ ID NO: 94265 - DNA, 25 bp, Homo sapien
tacagatgggcttcatcgctgcctc

SEQ ID NO: 94266 - DNA, 25 bp, Homo sapien
ggctcccgctgatgcgctacagatg

SEQ ID NO: 94267 - DNA, 25 bp, Homo sapien
tcagtgccgcatccaacagctctgt

SEQ ID NO: 94268 - DNA, 25 bp, Homo sapien
ccggaactgggcaccagatgcacca

SEQ ID NO: 94269 - DNA, 25 bp, Homo sapien
acagaacctcagacccggaactggg

SEQ ID NO: 94270 - DNA, 25 bp, Homo sapien
aggacatccaggcacgggtataggt

SEQ ID NO: 94271 - DNA, 25 bp, Homo sapien
gaccgcaggtttcgcctcacagaaa

SEQ ID NO: 94272 - DNA, 25 bp, Homo sapien
gctgcctccaagaacaacaggacga

SEQ ID NO: 94273 - DNA, 25 bp, Homo sapien
cgcgcggagtttgcccaagtcaggc

SEQ ID NO: 94274 - DNA, 25 bp, Homo sapien
cctaccgtccttggcaggacgtgga

SEQ ID NO: 94275 - DNA, 25 bp, Homo sapien
tgctcggaagccattccgggttggc

SEQ ID NO: 94276 - DNA, 25 bp, Homo sapien
ggtggaacagggtccctccgatctc

SEQ ID NO: 94277 - DNA, 25 bp, Homo sapien
cagggtccctccgatctccggggat

SEQ ID NO: 94278 - DNA, 25 bp, Homo sapien
tccttagggcccaaggctacgcgct

SEQ ID NO: 94279 - DNA, 25 bp, Homo sapien
aggagccgccagtgctccgaggctc

SEQ ID NO: 94280 - DNA, 25 bp, Homo sapien
ttgcccaagtcaggctggacgacgc

SEQ ID NO: 94281 - DNA, 25 bp, Homo sapien
acattggggcagagagcacgcagga

SEQ ID NO: 94282 - DNA, 25 bp, Homo sapien
agcacagagtacgtcagggcagaga

SEQ ID NO: 94283 - DNA, 25 bp, Homo sapien
agctcagaggacatcggggcagaga

SEQ ID NO: 94284 - DNA, 25 bp, Homo sapien
cagggcagagagctcagaggacatc

SEQ ID NO: 94285 - DNA, 25 bp, Homo sapien
atcagggcagagagctcagaggaca

SEQ ID NO: 94286 - DNA, 25 bp, Homo sapien
cagagtacgtcagggcagagagcaa

SEQ ID NO: 94287 - DNA, 25 bp, Homo sapien
acagagtacgtcagggcagagagca

SEQ ID NO: 94288 - DNA, 25 bp, Homo sapien
cacagagtacgtcagggcagagagc

SEQ ID NO: 94289 - DNA, 25 bp, Homo sapien
tcagcgctggtcctcatttcacctg

SEQ ID NO: 94290 - DNA, 25 bp, Homo sapien
agacctgctcccaaatgccctgggg

SEQ ID NO: 94291 - DNA, 25 bp, Homo sapien
cgcggatccgaatcggagcttccga

SEQ ID NO: 94292 - DNA, 25 bp, Homo sapien
agcttccgagggtgatctgagatcc

SEQ ID NO: 94293 - DNA, 25 bp, Homo sapien
aggctgcagtcagggccgacttcac

SEQ ID NO: 94294 - DNA, 25 bp, Homo sapien
ccaaagtcaggagtcttctgcatcc

SEQ ID NO: 94295 - DNA, 25 bp, Homo sapien
gcatcctgccctttgtcagcgctgg

SEQ ID NO: 94296 - DNA, 25 bp, Homo sapien
atcgccggagcctggtttcctcact

SEQ ID NO: 94297 - DNA, 25 bp, Homo sapien
acacgaaacggagccagcactgttc

SEQ ID NO: 94298 - DNA, 25 bp, Homo sapien
cgggcttcggaactctgtagtaact

SEQ ID NO: 94299 - DNA, 25 bp, Homo sapien
tgctctcccactaactaggtgaagg

SEQ ID NO: 94300 - DNA, 25 bp, Homo sapien
tttgagatcgtggaccgaagccagc

SEQ ID NO: 94301 - DNA, 25 bp, Homo sapien
tgggtcacatgacacggccaagatg

SEQ ID NO: 94302 - DNA, 25 bp, Homo sapien
gccgggaatacgcacactttttatg

SEQ ID NO: 94303 - DNA, 25 bp, Homo sapien
gttctgcttttcagccgttcagtgc

SEQ ID NO: 94304 - DNA, 25 bp, Homo sapien
gggtgcacaactgtcctcggagaaa

SEQ ID NO: 94305 - DNA, 25 bp, Homo sapien
gacgcctgccagaccaccaagtggg

SEQ ID NO: 94306 - DNA, 25 bp, Homo sapien
aggtgtgcaccacgtagaccacgaa

SEQ ID NO: 94307 - DNA, 25 bp, Homo sapien
tagacgatgccgtacatgacccagc

SEQ ID NO: 94308 - DNA, 25 bp, Homo sapien
ccacagctccgaactgggacgggaa

SEQ ID NO: 94309 - DNA, 25 bp, Homo sapien
gaaaggttccatctcgactcgcgcg

SEQ ID NO: 94310 - DNA, 25 bp, Homo sapien
gtcgtggtgtacacgctcagctgga

SEQ ID NO: 94311 - DNA, 25 bp, Homo sapien
aggccctggcaggacgcactcaaat

SEQ ID NO: 94312 - DNA, 25 bp, Homo sapien
actcaaatcccacggccagctggag

SEQ ID NO: 94313 - DNA, 25 bp, Homo sapien
tacttacctgcgaatcccggttgcc

SEQ ID NO: 94314 - DNA, 25 bp, Homo sapien
accagctccgtaggagaggccttga

SEQ ID NO: 94315 - DNA, 25 bp, Homo sapien
tggactcgcccaataggaatgtttg

SEQ ID NO: 94316 - DNA, 25 bp, Homo sapien
cctctaagagcttggggcagggctt

SEQ ID NO: 94317 - DNA, 25 bp, Homo sapien
aggtagcgcccttccattggtcaaa

SEQ ID NO: 94318 - DNA, 25 bp, Homo sapien
gcctctagggatcagggactactta

SEQ ID NO: 94319 - DNA, 25 bp, Homo sapien
cttctcaccgttgcccggagtctga

SEQ ID NO: 94320 - DNA, 25 bp, Homo sapien
gagtcttgctaaagccgtcgccgta

SEQ ID NO: 94321 - DNA, 25 bp, Homo sapien
agtttcggccgaaagagcaaatccg

SEQ ID NO: 94322 - DNA, 25 bp, Homo sapien
atgtgcgcacatcgggtggtgtccc

SEQ ID NO: 94323 - DNA, 25 bp, Homo sapien
caaatccgggttggactgtgtgatt

SEQ ID NO: 94324 - DNA, 25 bp, Homo sapien
tttcagccgaaagagcaaatccggg

SEQ ID NO: 94325 - DNA, 25 bp, Homo sapien
cggccgaaagagcaaatccggggct

SEQ ID NO: 94326 - DNA, 25 bp, Homo sapien
tgccgaagactagcggaggctccga

SEQ ID NO: 94327 - DNA, 25 bp, Homo sapien
cggaaattgccgaagactagcggag

SEQ ID NO: 94328 - DNA, 25 bp, Homo sapien
tcctttcacactcaccggtggtcgg

SEQ ID NO: 94329 - DNA, 25 bp, Homo sapien
acacgcttgggttttgggctcagca

SEQ ID NO: 94330 - DNA, 25 bp, Homo sapien
ccgccggcggattattacacgcttg

SEQ ID NO: 94331 - DNA, 25 bp, Homo sapien
agagctctggcgcatgcgtaatttc

SEQ ID NO: 94332 - DNA, 25 bp, Homo sapien
acccaccgtggtcgctgaactgcaa

SEQ ID NO: 94333 - DNA, 25 bp, Homo sapien
ataaggtcccttgtgcgagttctgc

SEQ ID NO: 94334 - DNA, 25 bp, Homo sapien
cgggcgcctgcgcaacctaaataag

SEQ ID NO: 94335 - DNA, 25 bp, Homo sapien
cgcgacttctgcgtggctaagacga

SEQ ID NO: 94336 - DNA, 25 bp, Homo sapien
gccgcctgttccctatgggactgta

SEQ ID NO: 94337 - DNA, 25 bp, Homo sapien
agacggtcctcaaccagctgcgcta

SEQ ID NO: 94338 - DNA, 25 bp, Homo sapien
gcaggtgccactcagcgagccaggt

SEQ ID NO: 94339 - DNA, 25 bp, Homo sapien
accaggagaagattcggcagcggca

SEQ ID NO: 94340 - DNA, 25 bp, Homo sapien
cggccgcagaccctgaagtagggca

SEQ ID NO: 94341 - DNA, 25 bp, Homo sapien
tgcacgaggacatcgagagcgcgtt

SEQ ID NO: 94342 - DNA, 25 bp, Homo sapien
gtccacttcttccactgcgatgagg

SEQ ID NO: 94343 - DNA, 25 bp, Homo sapien
agagcaagccggatgtccacttctt

SEQ ID NO: 94344 - DNA, 25 bp, Homo sapien
gccgtgctggctcagaagatagaga

SEQ ID NO: 94345 - DNA, 25 bp, Homo sapien
taaacgaattgtggattcagacacc

SEQ ID NO: 94346 - DNA, 25 bp, Homo sapien
cccactgttgtgttgaaggagaccg

SEQ ID NO: 94347 - DNA, 25 bp, Homo sapien
cacggtccgcccttgcggctgggat

SEQ ID NO: 94348 - DNA, 25 bp, Homo sapien
gagtccggctccacaaccacgtaaa

SEQ ID NO: 94349 - DNA, 25 bp, Homo sapien
tcagacaccatgagcggcggaaaca

SEQ ID NO: 94350 - DNA, 25 bp, Homo sapien
tgaggagggaccgagcacgccctct

SEQ ID NO: 94351 - DNA, 25 bp, Homo sapien
tcctccaggcggacaacgcaggcgg

SEQ ID NO: 94352 - DNA, 25 bp, Homo sapien
aggagaccgtccttccgacgccgag

SEQ ID NO: 94353 - DNA, 25 bp, Homo sapien
agggcccttcacttccgaatcaact

SEQ ID NO: 94354 - DNA, 25 bp, Homo sapien
acgcctcgacatgcgccagacggta

SEQ ID NO: 94355 - DNA, 25 bp, Homo sapien
cgccagacggtatgtctagtattta

SEQ ID NO: 94356 - DNA, 25 bp, Homo sapien
ccgtgacctggtagagcttggaatt

SEQ ID NO: 94357 - DNA, 25 bp, Homo sapien
cttcgcttgttctcgcccgaggcta

SEQ ID NO: 94358 - DNA, 25 bp, Homo sapien
gcccgaggctactttgaggttctaa

SEQ ID NO: 94359 - DNA, 25 bp, Homo sapien
ggaagccaagccaagtcacatacgg

SEQ ID NO: 94360 - DNA, 25 bp, Homo sapien
acggcacgcgcactggatcaaaata

SEQ ID NO: 94361 - DNA, 25 bp, Homo sapien
attttgatccagtgcgcgtgccgta

SEQ ID NO: 94362 - DNA, 25 bp, Homo sapien
gaacggggagtcacttagaacctca

SEQ ID NO: 94363 - DNA, 25 bp, Homo sapien
tagaacctcaaagtagcctcgggcg

SEQ ID NO: 94364 - DNA, 25 bp, Homo sapien
aattccaagctctaccaggtcacgg

SEQ ID NO: 94365 - DNA, 25 bp, Homo sapien
ggacctttcattttcagccctgctc

SEQ ID NO: 94366 - DNA, 25 bp, Homo sapien
gtcgaggcgtgtattattttgatcc

SEQ ID NO: 94367 - DNA, 25 bp, Homo sapien
acccggcgagtagaggcaacaccaa

SEQ ID NO: 94368 - DNA, 25 bp, Homo sapien
ccgtatgtgacttggcttggcttcc

SEQ ID NO: 94369 - DNA, 25 bp, Homo sapien
cctatctgggccatgtcggctgcaa

SEQ ID NO: 94370 - DNA, 25 bp, Homo sapien
ctcgtagccgagcactcgaaggttg

SEQ ID NO: 94371 - DNA, 25 bp, Homo sapien
ccgcgagatgtgatcggcccaaaac

SEQ ID NO: 94372 - DNA, 25 bp, Homo sapien
aacacttggcttttggaccgctgca

SEQ ID NO: 94373 - DNA, 25 bp, Homo sapien
gcagcttcaggtagttgttctcctc

SEQ ID NO: 94374 - DNA, 25 bp, Homo sapien
cagtcagcatgtctatgagcagttc

SEQ ID NO: 94375 - DNA, 25 bp, Homo sapien
atgcgcgccatggtctcagtcagca

SEQ ID NO: 94376 - DNA, 25 bp, Homo sapien
ggcctttattgcgtcactgcgagtc

SEQ ID NO: 94377 - DNA, 25 bp, Homo sapien
ccaagtctcggctccaggaaccaga

SEQ ID NO: 94378 - DNA, 25 bp, Homo sapien
aggcaccacagcaaccgacgcggga

SEQ ID NO: 94379 - DNA, 25 bp, Homo sapien
gcctctctctttactgcggcgcggg

SEQ ID NO: 94380 - DNA, 25 bp, Homo sapien
ctgatggccgatcgtcggactccta

SEQ ID NO: 94381 - DNA, 25 bp, Homo sapien
tgcaacgggcccttcctgatggccg

SEQ ID NO: 94382 - DNA, 25 bp, Homo sapien
acagcgcggagcagtgcacgccaat

SEQ ID NO: 94383 - DNA, 25 bp, Homo sapien
ccgagccatgactctgcaggaactg

SEQ ID NO: 94384 - DNA, 25 bp, Homo sapien
tcacactccacgaagaatagccgta

SEQ ID NO: 94385 - DNA, 25 bp, Homo sapien
gcccttcgcttgagaattcctttta

SEQ ID NO: 94386 - DNA, 25 bp, Homo sapien
gagctggagcgccaacacaccttcg

SEQ ID NO: 94387 - DNA, 25 bp, Homo sapien
cgaaaacgcttcctctgacgcggat

SEQ ID NO: 94388 - DNA, 25 bp, Homo sapien
tgtgcaggaaaccaatagccgcctc

SEQ ID NO: 94389 - DNA, 25 bp, Homo sapien
aatagccgcctcttggacgggctcc

SEQ ID NO: 94390 - DNA, 25 bp, Homo sapien
ggccggttcttccttctctgattgg

SEQ ID NO: 94391 - DNA, 25 bp, Homo sapien
ccttcagcgggtgctgtgcaggaaa

SEQ ID NO: 94392 - DNA, 25 bp, Homo sapien
cagtcgtgatgcacaaggtctctta

SEQ ID NO: 94393 - DNA, 25 bp, Homo sapien
cattaaagttctagtgaccgagacc

SEQ ID NO: 94394 - DNA, 25 bp, Homo sapien
cgcatcctagtctctatcattaaag

SEQ ID NO: 94395 - DNA, 25 bp, Homo sapien
cgggaaagaagagccggagcctcca

SEQ ID NO: 94396 - DNA, 25 bp, Homo sapien
agcccagcgcctttggggattcggt

SEQ ID NO: 94397 - DNA, 25 bp, Homo sapien
ggtcgccggcatcttctttcatgaa

SEQ ID NO: 94398 - DNA, 25 bp, Homo sapien
cagggtgaactgcagcgagtacttc

SEQ ID NO: 94399 - DNA, 25 bp, Homo sapien
gactggatccggtcttcacctccta

SEQ ID NO: 94400 - DNA, 25 bp, Homo sapien
tggctgcgaaggaacgagccctccc

SEQ ID NO: 94401 - DNA, 25 bp, Homo sapien
tctggctcacaggaagctgccctca

SEQ ID NO: 94402 - DNA, 25 bp, Homo sapien
gctcgctccttgctgcgcaagtgca

SEQ ID NO: 94403 - DNA, 25 bp, Homo sapien
ctgttgccaccgagtgactgactga

SEQ ID NO: 94404 - DNA, 25 bp, Homo sapien
taccgtgtctctctgctcagccagg

SEQ ID NO: 94405 - DNA, 25 bp, Homo sapien
agctgccctcatggaacggggtgca

SEQ ID NO: 94406 - DNA, 25 bp, Homo sapien
cactggagcgttttacccaaatgta

SEQ ID NO: 94407 - DNA, 25 bp, Homo sapien
aggatcccttggacagggccgtgtc

SEQ ID NO: 94408 - DNA, 25 bp, Homo sapien
tgcactggcttctgtgacgctcgct

SEQ ID NO: 94409 - DNA, 25 bp, Homo sapien
gcgaacggttccgggcctcaggcac

SEQ ID NO: 94410 - DNA, 25 bp, Homo sapien
ggcccaagcccgacgccaggcagaa

SEQ ID NO: 94411 - DNA, 25 bp, Homo sapien
gctcttctaaaacggcctgactggg

SEQ ID NO: 94412 - DNA, 25 bp, Homo sapien
gcgcccaagtaaaagctcttctaaa

SEQ ID NO: 94413 - DNA, 25 bp, Homo sapien
gggcgcccaagtaaaagctcttcta

SEQ ID NO: 94414 - DNA, 25 bp, Homo sapien
gcgggcgcccaagtaaaagctcttc

SEQ ID NO: 94415 - DNA, 25 bp, Homo sapien
cgacgccaggcagaaccctttgggc

SEQ ID NO: 94416 - DNA, 25 bp, Homo sapien
acgccaggcagaaccctttgggcgg

SEQ ID NO: 94417 - DNA, 25 bp, Homo sapien
cgatcagcaccacgatgaccgagtc

SEQ ID NO: 94418 - DNA, 25 bp, Homo sapien
tgagaccagggaacctacaaccagc

SEQ ID NO: 94419 - DNA, 25 bp, Homo sapien
tgtgagccgttccacggcttcaatc

SEQ ID NO: 94420 - DNA, 25 bp, Homo sapien
gaactcccgctggtaaacgtccaca

SEQ ID NO: 94421 - DNA, 25 bp, Homo sapien
ctcagctcggagatgagcgagtgca

SEQ ID NO: 94422 - DNA, 25 bp, Homo sapien
ctccttggagcgcttgaggctctcc

SEQ ID NO: 94423 - DNA, 25 bp, Homo sapien
acgtccacaacgtcgcctgcaggtg

SEQ ID NO: 94424 - DNA, 25 bp, Homo sapien
tgtcagtcaggtacgagtgcacctc

SEQ ID NO: 94425 - DNA, 25 bp, Homo sapien
cagagacacgttgcaggccagagcg

SEQ ID NO: 94426 - DNA, 25 bp, Homo sapien
ctcttggaggactcccgaagcccga

SEQ ID NO: 94427 - DNA, 25 bp, Homo sapien
agtcctccttccgttgctccaggag

SEQ ID NO: 94428 - DNA, 25 bp, Homo sapien
cgccctgttctcgaggccgaatgac

SEQ ID NO: 94429 - DNA, 25 bp, Homo sapien
gcgcgtacagggacgactctttcga

SEQ ID NO: 94430 - DNA, 25 bp, Homo sapien
tctgggccgttaccacgtagttgta

SEQ ID NO: 94431 - DNA, 25 bp, Homo sapien
acgtagttgtacgacatgtcgaggc

SEQ ID NO: 94432 - DNA, 25 bp, Homo sapien
ggactcgagcgcgacactagaaaga

SEQ ID NO: 94433 - DNA, 25 bp, Homo sapien
cattgcggagcctcatctcctcggg

SEQ ID NO: 94434 - DNA, 25 bp, Homo sapien
gggcgcaagctttgtgccctgtact

SEQ ID NO: 94435 - DNA, 25 bp, Homo sapien
gccctgtactcagggaagaggaaca

SEQ ID NO: 94436 - DNA, 25 bp, Homo sapien
gcaggtatcaggctcactgcagata

SEQ ID NO: 94437 - DNA, 25 bp, Homo sapien
ctcactgcagatatcaggggcgcgg

SEQ ID NO: 94438 - DNA, 25 bp, Homo sapien
agcagcgtcaggaaggtgccattgc

SEQ ID NO: 94439 - DNA, 25 bp, Homo sapien
cgctcacctttctggccgctgagtg

SEQ ID NO: 94440 - DNA, 25 bp, Homo sapien
tgagtgccgcgtaccaggacagcga

SEQ ID NO: 94441 - DNA, 25 bp, Homo sapien
gcgctcctagagaaggccatgccga

SEQ ID NO: 94442 - DNA, 25 bp, Homo sapien
gagcctcccgtcttcgatgggcttg

SEQ ID NO: 94443 - DNA, 25 bp, Homo sapien
cttttcaggaccttgcgcactcagg

SEQ ID NO: 94444 - DNA, 25 bp, Homo sapien
cgcactcaggctggccctatgcttt

SEQ ID NO: 94445 - DNA, 25 bp, Homo sapien
caggccacttctgacgcgggtgcga

SEQ ID NO: 94446 - DNA, 25 bp, Homo sapien
cccgagctggaacttcggcaggttc

SEQ ID NO: 94447 - DNA, 25 bp, Homo sapien
tgctccgcgtcgtgcctttagacac

SEQ ID NO: 94448 - DNA, 25 bp, Homo sapien
tgcctttagacaccgccgggcgttc

SEQ ID NO: 94449 - DNA, 25 bp, Homo sapien
gcttccaggcgcactaccgcggtga

SEQ ID NO: 94450 - DNA, 25 bp, Homo sapien
gggcctccgcgttcgctacaaaagc

SEQ ID NO: 94451 - DNA, 25 bp, Homo sapien
tcgctatggcgtcgctcaccgtgaa

SEQ ID NO: 94452 - DNA, 25 bp, Homo sapien
cgagattcgccgcttcagcttctgc

SEQ ID NO: 94453 - DNA, 25 bp, Homo sapien
ggcactcgggttacactgacacctt

SEQ ID NO: 94454 - DNA, 25 bp, Homo sapien
tgacaccttgctgcgccaggtggtg

SEQ ID NO: 94455 - DNA, 25 bp, Homo sapien
tgggttcagataatgccctggagga

SEQ ID NO: 94456 - DNA, 25 bp, Homo sapien
ctaccttctgggcaaggaggacgcg

SEQ ID NO: 94457 - DNA, 25 bp, Homo sapien
ggtacgagacggaatttgagggctc

SEQ ID NO: 94458 - DNA, 25 bp, Homo sapien
gtcccgctatcgcacaggcagatgg

SEQ ID NO: 94459 - DNA, 25 bp, Homo sapien
agatggtacgagacggaatttgagg

SEQ ID NO: 94460 - DNA, 25 bp, Homo sapien
gagagtacgggtcccgctatggcac

SEQ ID NO: 94461 - DNA, 25 bp, Homo sapien
gcagatggtacgagacggaatttga

SEQ ID NO: 94462 - DNA, 25 bp, Homo sapien
cacaggcagatggtacgagacggaa

SEQ ID NO: 94463 - DNA, 25 bp, Homo sapien
ctatggcacaggcagatggtacgag

SEQ ID NO: 94464 - DNA, 25 bp, Homo sapien
agagtacgggtcccgctatggcaca

SEQ ID NO: 94465 - DNA, 25 bp, Homo sapien
cagttagcctttgaaccggagcccg

SEQ ID NO: 94466 - DNA, 25 bp, Homo sapien
ccgtgcttttaggtagcagcgaaca

SEQ ID NO: 94467 - DNA, 25 bp, Homo sapien
tctcactgaaactgcgacagcgcta

SEQ ID NO: 94468 - DNA, 25 bp, Homo sapien
tgcccgcatcttcctaaggcactgg

SEQ ID NO: 94469 - DNA, 25 bp, Homo sapien
gtctcgcatgcgcttatactcttcg

SEQ ID NO: 94470 - DNA, 25 bp, Homo sapien
tgaagcgacgccatccctgcttgtg

SEQ ID NO: 94471 - DNA, 25 bp, Homo sapien
catcccggagccattcgagacaaca

SEQ ID NO: 94472 - DNA, 25 bp, Homo sapien
gctctgcgtaaaggatgctatactc

SEQ ID NO: 94473 - DNA, 25 bp, Homo sapien
cttggcctgagggaaaagcgcatca

SEQ ID NO: 94474 - DNA, 25 bp, Homo sapien
cgccacgcccgtactcgaagaagtg

SEQ ID NO: 94475 - DNA, 25 bp, Homo sapien
ttggctgtgcggtacatgcacacgc

SEQ ID NO: 94476 - DNA, 25 bp, Homo sapien
agcaagtgtggccttcctcgcaatt

SEQ ID NO: 94477 - DNA, 25 bp, Homo sapien
gaggcctaggccaccgcggaagcct

SEQ ID NO: 94478 - DNA, 25 bp, Homo sapien
gcggaagcctcgtgaacactccaga

SEQ ID NO: 94479 - DNA, 25 bp, Homo sapien
tttcatcttctccttggcctgaggg

SEQ ID NO: 94480 - DNA, 25 bp, Homo sapien
gtggatgtgccatgactcctctttc

SEQ ID NO: 94481 - DNA, 25 bp, Homo sapien
ctcgccaactttcggcggtgagatc

SEQ ID NO: 94482 - DNA, 25 bp, Homo sapien
cgcgcgcctctcacccgtaaggccg

SEQ ID NO: 94483 - DNA, 25 bp, Homo sapien
cccggcgtcgctgcagcacgaagaa

SEQ ID NO: 94484 - DNA, 25 bp, Homo sapien
cagcgcattggccaccagcacctcc

SEQ ID NO: 94485 - DNA, 25 bp, Homo sapien
gctcagccacatcgcggagccgctc

SEQ ID NO: 94486 - DNA, 25 bp, Homo sapien
ctgggtccagaacggaacggcccag

SEQ ID NO: 94487 - DNA, 25 bp, Homo sapien
cggaacggcccagtccgcagacagg

SEQ ID NO: 94488 - DNA, 25 bp, Homo sapien
cggtctcgccaactttcggcggtga

SEQ ID NO: 94489 - DNA, 25 bp, Homo sapien
tcagccgctggtgctggttgtttct

SEQ ID NO: 94490 - DNA, 25 bp, Homo sapien
cgggctcctgcaccgtcacgttgat

SEQ ID NO: 94491 - DNA, 25 bp, Homo sapien
cccgcggtcgatgcgaaacgtgagc

SEQ ID NO: 94492 - DNA, 25 bp, Homo sapien
gtgtagtactcctggctcgcgttgt

SEQ ID NO: 94493 - DNA, 25 bp, Homo sapien
tgtttctctgtcaggcgtgatagcc

SEQ ID NO: 94494 - DNA, 25 bp, Homo sapien
ccaccgaatgggaggcgcctcgcaa

SEQ ID NO: 94495 - DNA, 25 bp, Homo sapien
ccgtcacgttgatgagcgccgtgta

SEQ ID NO: 94496 - DNA, 25 bp, Homo sapien
gggtcagcggaacacaaagtccctc

SEQ ID NO: 94497 - DNA, 25 bp, Homo sapien
cgcagcgtcctaatagccctcggaa

SEQ ID NO: 94498 - DNA, 25 bp, Homo sapien
ggactcatccacacacggcatgacc

SEQ ID NO: 94499 - DNA, 25 bp, Homo sapien
tcctaatagccctcggaacagcacg

SEQ ID NO: 94500 - DNA, 25 bp, Homo sapien
acaacatgaccgcagcgtcctaata

SEQ ID NO: 94501 - DNA, 25 bp, Homo sapien
aacatgaccgcagcgtcctaatagc

SEQ ID NO: 94502 - DNA, 25 bp, Homo sapien
acggactcatccacacacaacatga

SEQ ID NO: 94503 - DNA, 25 bp, Homo sapien
cctaatagccctcggaacagcacgg

SEQ ID NO: 94504 - DNA, 25 bp, Homo sapien
cagcgtcctaatagccctcggaaca

SEQ ID NO: 94505 - DNA, 25 bp, Homo sapien
aggagcaaatctgacgcccagcact

SEQ ID NO: 94506 - DNA, 25 bp, Homo sapien
aaagggacgcaggtcggtgggcgat

SEQ ID NO: 94507 - DNA, 25 bp, Homo sapien
gagcgcgaaggagcaaatctgacgc

SEQ ID NO: 94508 - DNA, 25 bp, Homo sapien
cgaaggagcaaatctgacgcccagc

SEQ ID NO: 94509 - DNA, 25 bp, Homo sapien
gagcaaatctgacgcccagcactcg

SEQ ID NO: 94510 - DNA, 25 bp, Homo sapien
aaatctgacgcccagcactcgggac

SEQ ID NO: 94511 - DNA, 25 bp, Homo sapien
aatctgacgcccagcactcgggacg

SEQ ID NO: 94512 - DNA, 25 bp, Homo sapien
cgcgaaggagcaaatctgacgccca

SEQ ID NO: 94513 - DNA, 25 bp, Homo sapien
cagtggggacgctccttatcgtgaa

SEQ ID NO: 94514 - DNA, 25 bp, Homo sapien
ttatacacaaggtgggcttccaccg

SEQ ID NO: 94515 - DNA, 25 bp, Homo sapien
tgcggcacggtgcttatacacaagg

SEQ ID NO: 94516 - DNA, 25 bp, Homo sapien
ttcactgtcctgaagaaggcaggcc

SEQ ID NO: 94517 - DNA, 25 bp, Homo sapien
ttggggacgacagcgccttcactgt

SEQ ID NO: 94518 - DNA, 25 bp, Homo sapien
gggatcggctcaacttcggcctggc

SEQ ID NO: 94519 - DNA, 25 bp, Homo sapien
actacactggggatcggctcaactt

SEQ ID NO: 94520 - DNA, 25 bp, Homo sapien
tccttatcgtgaagaactacactgg

SEQ ID NO: 94521 - DNA, 25 bp, Homo sapien
gcacgtccaggctttccggggactc

SEQ ID NO: 94522 - DNA, 25 bp, Homo sapien
ggcaccggcgcccaccgaaacgcac

SEQ ID NO: 94523 - DNA, 25 bp, Homo sapien
actcgggactcggttgtcgtggtgc

SEQ ID NO: 94524 - DNA, 25 bp, Homo sapien
tcctccctcgctgggtgggtgaccc

SEQ ID NO: 94525 - DNA, 25 bp, Homo sapien
caccgaaacgcaccgggaaggcgca

SEQ ID NO: 94526 - DNA, 25 bp, Homo sapien
cccgagcccacctgtcccactctgg

SEQ ID NO: 94527 - DNA, 25 bp, Homo sapien
agcgctcgcccagagaaggctcgcg

SEQ ID NO: 94528 - DNA, 25 bp, Homo sapien
tcgcccagagaaggctcgcgggctc

SEQ ID NO: 94529 - DNA, 25 bp, Homo sapien
ctcggcagtgcctgattccttgata

SEQ ID NO: 94530 - DNA, 25 bp, Homo sapien
tccttgataggccagaaagcggctg

SEQ ID NO: 94531 - DNA, 25 bp, Homo sapien
atgcggcccacgacgtccttaaggt

SEQ ID NO: 94532 - DNA, 25 bp, Homo sapien
cgatagtcgactcttcctggaagtc

SEQ ID NO: 94533 - DNA, 25 bp, Homo sapien
aaggtctcggtccactcggccaaca

SEQ ID NO: 94534 - DNA, 25 bp, Homo sapien
gccatctcttgctctggcctttctg

SEQ ID NO: 94535 - DNA, 25 bp, Homo sapien
gcctttctgcggttgacggctccat

SEQ ID NO: 94536 - DNA, 25 bp, Homo sapien
cgtccttaaggtgcccgatagtcga

SEQ ID NO: 94537 - DNA, 25 bp, Homo sapien
cagatgtctgcactgactgggatcc

SEQ ID NO: 94538 - DNA, 25 bp, Homo sapien
cggctcctggaacaccgctgtggct

SEQ ID NO: 94539 - DNA, 25 bp, Homo sapien
tctgtggtcctggacgccagcccag

SEQ ID NO: 94540 - DNA, 25 bp, Homo sapien
gtcttgaggacctgacgcgagctct

SEQ ID NO: 94541 - DNA, 25 bp, Homo sapien
ctcacctgtgtggacctgatggggc

SEQ ID NO: 94542 - DNA, 25 bp, Homo sapien
tgtggctgcgcattcgcgcccatct

SEQ ID NO: 94543 - DNA, 25 bp, Homo sapien
ggggaactgcccagaatgtggctca

SEQ ID NO: 94544 - DNA, 25 bp, Homo sapien
gcgacacgaggagccacggcagcca

SEQ ID NO: 94545 - DNA, 25 bp, Homo sapien
ggctacccgtccatcacaggctggg

SEQ ID NO: 94546 - DNA, 25 bp, Homo sapien
ccacgggcagcctttcgacgcccaa

SEQ ID NO: 94547 - DNA, 25 bp, Homo sapien
tccctgaccagacgaaggctccgcc

SEQ ID NO: 94548 - DNA, 25 bp, Homo sapien
tgcccaggacgtccagaccctgtag

SEQ ID NO: 94549 - DNA, 25 bp, Homo sapien
caggacgtccagaccctgtagcgtc

SEQ ID NO: 94550 - DNA, 25 bp, Homo sapien
gacgcccaacctgcaaaccgcctgg

SEQ ID NO: 94551 - DNA, 25 bp, Homo sapien
ctgccctcagggatctcacccgcgc

SEQ ID NO: 94552 - DNA, 25 bp, Homo sapien
ccctgtagcgtctcagctccagctc

SEQ ID NO: 94553 - DNA, 25 bp, Homo sapien
cctcgtggcactcaggcagcgcgga

SEQ ID NO: 94554 - DNA, 25 bp, Homo sapien
tctggactggccacctaggttgtct

SEQ ID NO: 94555 - DNA, 25 bp, Homo sapien
ggttctctggactggccacctaggt

SEQ ID NO: 94556 - DNA, 25 bp, Homo sapien
gttcaccctctctcctcaagactgg

SEQ ID NO: 94557 - DNA, 25 bp, Homo sapien
aagcgtcccgccctgcgttcaggcc

SEQ ID NO: 94558 - DNA, 25 bp, Homo sapien
cccagcctacacctcacctggtggg

SEQ ID NO: 94559 - DNA, 25 bp, Homo sapien
tcggccgcgcaccactcaccggctc

SEQ ID NO: 94560 - DNA, 25 bp, Homo sapien
tggccacctaggttgtctgtgtccc

SEQ ID NO: 94561 - DNA, 25 bp, Homo sapien
actggcggcgctgcgtgctagtcac

SEQ ID NO: 94562 - DNA, 25 bp, Homo sapien
tgcgtgctagtcactcctggctccg

SEQ ID NO: 94563 - DNA, 25 bp, Homo sapien
ccgcggcgcccggtctgacagaccc

SEQ ID NO: 94564 - DNA, 25 bp, Homo sapien
ctgacagaccctcgcgccgaccaat

SEQ ID NO: 94565 - DNA, 25 bp, Homo sapien
gagacgcaggcattgcgcggcccac

SEQ ID NO: 94566 - DNA, 25 bp, Homo sapien
ggcccaccggctgagcccgctctcc

SEQ ID NO: 94567 - DNA, 25 bp, Homo sapien
gggcctcgcactcggttgctcgctg

SEQ ID NO: 94568 - DNA, 25 bp, Homo sapien
tcgcactcggttgctcgctgcggcg

SEQ ID NO: 94569 - DNA, 25 bp, Homo sapien
tgttcagaaaggaaaacgctcgctc

SEQ ID NO: 94570 - DNA, 25 bp, Homo sapien
tcaccgccggctcttacagggaaat

SEQ ID NO: 94571 - DNA, 25 bp, Homo sapien
cggtccttacagtagcgcagcgcca

SEQ ID NO: 94572 - DNA, 25 bp, Homo sapien
tgcccacggtgttggtgacgcccac

SEQ ID NO: 94573 - DNA, 25 bp, Homo sapien
gtctcgcgagagatggagctgccca

SEQ ID NO: 94574 - DNA, 25 bp, Homo sapien
taccttggtgctggccacgccgatc

SEQ ID NO: 94575 - DNA, 25 bp, Homo sapien
atctccggccctgcgttgatgtgga

SEQ ID NO: 94576 - DNA, 25 bp, Homo sapien
aaacgctcgctcaacagccttttcg

SEQ ID NO: 94577 - DNA, 25 bp, Homo sapien
tgtcgtgacaacgacgggacccggc

SEQ ID NO: 94578 - DNA, 25 bp, Homo sapien
tagggcaaccaacggcccgagttca

SEQ ID NO: 94579 - DNA, 25 bp, Homo sapien
cttataacccggagccctccgagag

SEQ ID NO: 94580 - DNA, 25 bp, Homo sapien
ctcaaccagagtaggcgtggaagcc

SEQ ID NO: 94581 - DNA, 25 bp, Homo sapien
tgcccgttcggacgctggggctcct

SEQ ID NO: 94582 - DNA, 25 bp, Homo sapien
ttctcgggctccttcgcggctcgag

SEQ ID NO: 94583 - DNA, 25 bp, Homo sapien
tcaccgcacatcgtggctgcttctc

SEQ ID NO: 94584 - DNA, 25 bp, Homo sapien
ccctcactgtgtccgagaccaggag

SEQ ID NO: 94585 - DNA, 25 bp, Homo sapien
acaaagagcagcgactaaggcggca

SEQ ID NO: 94586 - DNA, 25 bp, Homo sapien
gtgtcccgggactcgtggccaagat

SEQ ID NO: 94587 - DNA, 25 bp, Homo sapien
tggcaacttttgagaagcgcctctg

SEQ ID NO: 94588 - DNA, 25 bp, Homo sapien
gccgccgccatgatgcttgtttgct

SEQ ID NO: 94589 - DNA, 25 bp, Homo sapien
acggcgcccaatgagcggccaggat

SEQ ID NO: 94590 - DNA, 25 bp, Homo sapien
gttgtgcccggcgacggcgcccaat

SEQ ID NO: 94591 - DNA, 25 bp, Homo sapien
tgtttgctttcaatgaaaacgaggg

SEQ ID NO: 94592 - DNA, 25 bp, Homo sapien
cgtggccaagatgggtggcaacttt

SEQ ID NO: 94593 - DNA, 25 bp, Homo sapien
cagcagcagcgtgtttcagtcgagc

SEQ ID NO: 94594 - DNA, 25 bp, Homo sapien
tttggatccagcagcagcgtgtttc

SEQ ID NO: 94595 - DNA, 25 bp, Homo sapien
gggcgacttctgtcatttggatcca

SEQ ID NO: 94596 - DNA, 25 bp, Homo sapien
ccagccagggcgacttctgtcattt

SEQ ID NO: 94597 - DNA, 25 bp, Homo sapien
aggagagcaggagcgtctacaccgc

SEQ ID NO: 94598 - DNA, 25 bp, Homo sapien
gggaaatcctgtccaaacggctaca

SEQ ID NO: 94599 - DNA, 25 bp, Homo sapien
cgggaactagctcctgggccagcag

SEQ ID NO: 94600 - DNA, 25 bp, Homo sapien
acagggcttcatcgcgggaactagc

SEQ ID NO: 94601 - DNA, 25 bp, Homo sapien
tgccgctcccgaggttcctaggaga

SEQ ID NO: 94602 - DNA, 25 bp, Homo sapien
gaagacactgccctgaatgcctaca

SEQ ID NO: 94603 - DNA, 25 bp, Homo sapien
ccctaagtcagctagcggcgacgct

SEQ ID NO: 94604 - DNA, 25 bp, Homo sapien
tgttcaggtgaacgcgaagcctccc

SEQ ID NO: 94605 - DNA, 25 bp, Homo sapien
tccaggactgctgcgatgcatcagc

SEQ ID NO: 94606 - DNA, 25 bp, Homo sapien
tctccaagtccgaagtcagggtcca

SEQ ID NO: 94607 - DNA, 25 bp, Homo sapien
cccgaacagcgaaagctccaacatg

SEQ ID NO: 94608 - DNA, 25 bp, Homo sapien
ccttcttataggctcgcagcacttc

SEQ ID NO: 94609 - DNA, 25 bp, Homo sapien
ctggaaggacctgggatccacgatc

SEQ ID NO: 94610 - DNA, 25 bp, Homo sapien
ttgcaggatgaggagccggtctcca

SEQ ID NO: 94611 - DNA, 25 bp, Homo sapien
gacactcgcgctgcgccttgcagga

SEQ ID NO: 94612 - DNA, 25 bp, Homo sapien
cggaaggaccggtgaactctgtgca

SEQ ID NO: 94613 - DNA, 25 bp, Homo sapien
gcccactaagaaagcagcagctgca

SEQ ID NO: 94614 - DNA, 25 bp, Homo sapien
ctgggagccctctatgaggtggttc

SEQ ID NO: 94615 - DNA, 25 bp, Homo sapien
agctcagccacacacttctgggagc

SEQ ID NO: 94616 - DNA, 25 bp, Homo sapien
aggccacgaggcttcttatacccgg

SEQ ID NO: 94617 - DNA, 25 bp, Homo sapien
tccacttcctttcggagcactgggc

SEQ ID NO: 94618 - DNA, 25 bp, Homo sapien
cacttcctttcggagcactgggcct

SEQ ID NO: 94619 - DNA, 25 bp, Homo sapien
cacttcctttcggagcactgggccc

SEQ ID NO: 94620 - DNA, 25 bp, Homo sapien
atccacttcctttcggagcactggg

SEQ ID NO: 94621 - DNA, 25 bp, Homo sapien
acttcctttcggagcactgggcctg

SEQ ID NO: 94622 - DNA, 25 bp, Homo sapien
tcctttcggagcactgggtcccgct

SEQ ID NO: 94623 - DNA, 25 bp, Homo sapien
tccacttcctttcggagcactgggt

SEQ ID NO: 94624 - DNA, 25 bp, Homo sapien
ctttcggagcactgggcctgccggt

SEQ ID NO: 94625 - DNA, 25 bp, Homo sapien
ggtattcgcattgctcctccagagg

SEQ ID NO: 94626 - DNA, 25 bp, Homo sapien
gcagctcactgatttggccatacca

SEQ ID NO: 94627 - DNA, 25 bp, Homo sapien
accactgtggcttgggcagaacttt

SEQ ID NO: 94628 - DNA, 25 bp, Homo sapien
ggcgggcaccttattctttatctta

SEQ ID NO: 94629 - DNA, 25 bp, Homo sapien
cggtaccgacaaggatcacgatctc

SEQ ID NO: 94630 - DNA, 25 bp, Homo sapien
ggtggccacaagaaagcgttaactg

SEQ ID NO: 94631 - DNA, 25 bp, Homo sapien
ggctggcatcgtaggacaggtattc

SEQ ID NO: 94632 - DNA, 25 bp, Homo sapien
ccctggctgaggttctaggtaccca

SEQ ID NO: 94633 - DNA, 25 bp, Homo sapien
ttgagccactcgacgctgatgaagg

SEQ ID NO: 94634 - DNA, 25 bp, Homo sapien
cggcagccggacatccgcagactgg

SEQ ID NO: 94635 - DNA, 25 bp, Homo sapien
gactgacccgtcgtggactgaccag

SEQ ID NO: 94636 - DNA, 25 bp, Homo sapien
tcactgtaaatccaggactgacccg

SEQ ID NO: 94637 - DNA, 25 bp, Homo sapien
tgatgaagggattttctgccggaca

SEQ ID NO: 94638 - DNA, 25 bp, Homo sapien
gctgccagcttcacgggcagcttca

SEQ ID NO: 94639 - DNA, 25 bp, Homo sapien
ctgccggacaggagaagtcactgta

SEQ ID NO: 94640 - DNA, 25 bp, Homo sapien
gccagggctgttaccactggaactc

SEQ ID NO: 94641 - DNA, 25 bp, Homo sapien
tcaagattcgtctcaagtgccagcg

SEQ ID NO: 94642 - DNA, 25 bp, Homo sapien
tctcaagtgccagcgtgcacctgca

SEQ ID NO: 94643 - DNA, 25 bp, Homo sapien
gcgtcgggaagtgcgcacccaagtc

SEQ ID NO: 94644 - DNA, 25 bp, Homo sapien
gaagtgcgcacccaagtccggggcc

SEQ ID NO: 94645 - DNA, 25 bp, Homo sapien
agccaccgacggagacgcggattca

SEQ ID NO: 94646 - DNA, 25 bp, Homo sapien
tcaccgtccaggagtcccaggcaga

SEQ ID NO: 94647 - DNA, 25 bp, Homo sapien
ggcagagccacagtcgcaggcacag

SEQ ID NO: 94648 - DNA, 25 bp, Homo sapien
cgcgattcgcctcctcaagattcgt

SEQ ID NO: 94649 - DNA, 25 bp, Homo sapien
ttaaggcgagtctgggacaggaccc

SEQ ID NO: 94650 - DNA, 25 bp, Homo sapien
gcgccggacgagctcctttatcaga

SEQ ID NO: 94651 - DNA, 25 bp, Homo sapien
tcgttgtcctcgcagcgttaaggcg

SEQ ID NO: 94652 - DNA, 25 bp, Homo sapien
ctccggatctgtggcatcctccagg

SEQ ID NO: 94653 - DNA, 25 bp, Homo sapien
tgtggcatcctccaggactccggcg

SEQ ID NO: 94654 - DNA, 25 bp, Homo sapien
gtgctcccaggtcggaggattccca

SEQ ID NO: 94655 - DNA, 25 bp, Homo sapien
cgaggtctttcctgggtgctcccag

SEQ ID NO: 94656 - DNA, 25 bp, Homo sapien
ctttatcagaaagggcagccgcaga

SEQ ID NO: 94657 - DNA, 25 bp, Homo sapien
ccgagggccgataatgcagcagctt

SEQ ID NO: 94658 - DNA, 25 bp, Homo sapien
ttgcggccaaaggtcatcgttcttg

SEQ ID NO: 94659 - DNA, 25 bp, Homo sapien
tggcccgaaagtactcgaagaagtc

SEQ ID NO: 94660 - DNA, 25 bp, Homo sapien
tgcccgcagtcctggctaacgatga

SEQ ID NO: 94661 - DNA, 25 bp, Homo sapien
agcgccgaacagtgctgcggtcaca

SEQ ID NO: 94662 - DNA, 25 bp, Homo sapien
ttgccgttgtcattccaggccgaga

SEQ ID NO: 94663 - DNA, 25 bp, Homo sapien
atccagtcgtcccagaaggcctttg

SEQ ID NO: 94664 - DNA, 25 bp, Homo sapien
cgcgatcttgtagtagccctggaac

SEQ ID NO: 94665 - DNA, 25 bp, Homo sapien
cttcctctaacagctggaggcccgg

SEQ ID NO: 94666 - DNA, 25 bp, Homo sapien
tccctggcgcaaccctgagggtgga

SEQ ID NO: 94667 - DNA, 25 bp, Homo sapien
gcccggggccgagtttcacaacatc

SEQ ID NO: 94668 - DNA, 25 bp, Homo sapien
aagcagaaggcggagttccaacctc

SEQ ID NO: 94669 - DNA, 25 bp, Homo sapien
agttccaacctctcggctcgggaag

SEQ ID NO: 94670 - DNA, 25 bp, Homo sapien
ctcgggaagggactaacgcgcagct

SEQ ID NO: 94671 - DNA, 25 bp, Homo sapien
tctcgctagcactcatgggcaccgg

SEQ ID NO: 94672 - DNA, 25 bp, Homo sapien
actaacgcgcagctggcaccgggtc

SEQ ID NO: 94673 - DNA, 25 bp, Homo sapien
gctccttcagacgtcggactcctga

SEQ ID NO: 94674 - DNA, 25 bp, Homo sapien
tgcttgacctggtttctcaaaaagg

SEQ ID NO: 94675 - DNA, 25 bp, Homo sapien
tgctgtttctcgctgcctctcttga

SEQ ID NO: 94676 - DNA, 25 bp, Homo sapien
ccctctgacaggtgctgttggtacc

SEQ ID NO: 94677 - DNA, 25 bp, Homo sapien
cggactcctgagtttcgaacctgcc

SEQ ID NO: 94678 - DNA, 25 bp, Homo sapien
ctcacgctgaatccaggggagccgc

SEQ ID NO: 94679 - DNA, 25 bp, Homo sapien
gcctgagactgttctacagccactg

SEQ ID NO: 94680 - DNA, 25 bp, Homo sapien
cctctcttgacgaggcagggccctt

SEQ ID NO: 94681 - DNA, 25 bp, Homo sapien
ttagaaccggcctatgcgccaagcg

SEQ ID NO: 94682 - DNA, 25 bp, Homo sapien
cgcacacccgggtggttctggctac

SEQ ID NO: 94683 - DNA, 25 bp, Homo sapien
tctggctacgggtacccggacctgc

SEQ ID NO: 94684 - DNA, 25 bp, Homo sapien
tcaggcacgtcctcgacctcagttg

SEQ ID NO: 94685 - DNA, 25 bp, Homo sapien
cttccggacacaggccgggagaaga

SEQ ID NO: 94686 - DNA, 25 bp, Homo sapien
cgcagcttcctggtttcggccatgt

SEQ ID NO: 94687 - DNA, 25 bp, Homo sapien
tcaggccgcggtgttcttgtaaatt

SEQ ID NO: 94688 - DNA, 25 bp, Homo sapien
ttgaagggactctccggcctcaggc

SEQ ID NO: 94689 - DNA, 25 bp, Homo sapien
acatccgagcgagggccacttgcgg

SEQ ID NO: 94690 - DNA, 25 bp, Homo sapien
ttctctagcgttagggacgtcgcgc

SEQ ID NO: 94691 - DNA, 25 bp, Homo sapien
tgtcccagagcttgacctaaaccct

SEQ ID NO: 94692 - DNA, 25 bp, Homo sapien
tgagtcgctggtccctttcccttcg

SEQ ID NO: 94693 - DNA, 25 bp, Homo sapien
gtccagctccgggtgaccacagagt

SEQ ID NO: 94694 - DNA, 25 bp, Homo sapien
tggtcaccgttatcccttaggtctg

SEQ ID NO: 94695 - DNA, 25 bp, Homo sapien
ccaacgcccggtagtctgagagcct

SEQ ID NO: 94696 - DNA, 25 bp, Homo sapien
agcgtatgctgccacggggactgaa

SEQ ID NO: 94697 - DNA, 25 bp, Homo sapien
tccttagtagatagtccgcgtccgg

SEQ ID NO: 94698 - DNA, 25 bp, Homo sapien
gctcggtccttagtagatagtccgc

SEQ ID NO: 94699 - DNA, 25 bp, Homo sapien
gcaacagcagacatgtcgggggtcc

SEQ ID NO: 94700 - DNA, 25 bp, Homo sapien
ggagcgcgggacctcagcgttccct

SEQ ID NO: 94701 - DNA, 25 bp, Homo sapien
gaacagggcccgctctacctcggtc

SEQ ID NO: 94702 - DNA, 25 bp, Homo sapien
gttcaggcccttcggtctgggcgat

SEQ ID NO: 94703 - DNA, 25 bp, Homo sapien
ccctctgtgcgggttgtcctgagga

SEQ ID NO: 94704 - DNA, 25 bp, Homo sapien
tccgcgtccgggtgaaggtcacaac

SEQ ID NO: 94705 - DNA, 25 bp, Homo sapien
gcctcagggtcccatgtggcgctat

SEQ ID NO: 94706 - DNA, 25 bp, Homo sapien
cgctatcttcggacgcccagggctg

SEQ ID NO: 94707 - DNA, 25 bp, Homo sapien
ccttccacgcgggaactgtctgggc

SEQ ID NO: 94708 - DNA, 25 bp, Homo sapien
ggtccgagacgtcgcggatctagac

SEQ ID NO: 94709 - DNA, 25 bp, Homo sapien
acccgcgactgttggcgactttgga

SEQ ID NO: 94710 - DNA, 25 bp, Homo sapien
tgcccacccggttctgagcctggag

SEQ ID NO: 94711 - DNA, 25 bp, Homo sapien
taagccggtgactgcaccaggtgcc

SEQ ID NO: 94712 - DNA, 25 bp, Homo sapien
gcctcgggctcttatccagtagaca

SEQ ID NO: 94713 - DNA, 25 bp, Homo sapien
catcgcttcccacaggctttgcccg

SEQ ID NO: 94714 - DNA, 25 bp, Homo sapien
ctttgcccgcgaccgaacagggcga

SEQ ID NO: 94715 - DNA, 25 bp, Homo sapien
gaacagggcgagcaggcattttcct

SEQ ID NO: 94716 - DNA, 25 bp, Homo sapien
tttccttcacgtaggcctgaaaagc

SEQ ID NO: 94717 - DNA, 25 bp, Homo sapien
cgtaggcctgaaaagccacgtcacc

SEQ ID NO: 94718 - DNA, 25 bp, Homo sapien
agccgctgcagcgttctacgcggtc

SEQ ID NO: 94719 - DNA, 25 bp, Homo sapien
cgttctacgcggtccgggacgcact

SEQ ID NO: 94720 - DNA, 25 bp, Homo sapien
accagcgactacggcttgggctcca

SEQ ID NO: 94721 - DNA, 25 bp, Homo sapien
gtcgttacgccctcggagcttcaca

SEQ ID NO: 94722 - DNA, 25 bp, Homo sapien
acagatgtcagggttgaccggctgc

SEQ ID NO: 94723 - DNA, 25 bp, Homo sapien
ccacggaggctagtgcacagatgtc

SEQ ID NO: 94724 - DNA, 25 bp, Homo sapien
ttcatatggacaaaagcggaggtgc

SEQ ID NO: 94725 - DNA, 25 bp, Homo sapien
cgttacgagggtttattccagcgcg

SEQ ID NO: 94726 - DNA, 25 bp, Homo sapien
catctaaaggctgtgggtcccgtta

SEQ ID NO: 94727 - DNA, 25 bp, Homo sapien
tacccggagcctctgcgtggaagag

SEQ ID NO: 94728 - DNA, 25 bp, Homo sapien
ttccagacgtgttcgtacccggagc

SEQ ID NO: 94729 - DNA, 25 bp, Homo sapien
agtgacacctggctacagccctatg

SEQ ID NO: 94730 - DNA, 25 bp, Homo sapien
cccgaagagaacgacagtgacacct

SEQ ID NO: 94731 - DNA, 25 bp, Homo sapien
cgctctgtgcgtacttcaggcccag

SEQ ID NO: 94732 - DNA, 25 bp, Homo sapien
tccttcttcaacgtgtccgacggct

SEQ ID NO: 94733 - DNA, 25 bp, Homo sapien
aggccggagagctgtccttcttcaa

SEQ ID NO: 94734 - DNA, 25 bp, Homo sapien
aacggctgcgagtacttcgtcctgg

SEQ ID NO: 94735 - DNA, 25 bp, Homo sapien
acccgcagcggttctcggagcagac

SEQ ID NO: 94736 - DNA, 25 bp, Homo sapien
ggcactaacgctgtggctctgcgca

SEQ ID NO: 94737 - DNA, 25 bp, Homo sapien
ccaacaaggcgtcgaggcgaatcca

SEQ ID NO: 94738 - DNA, 25 bp, Homo sapien
ggggaagccttctgcactctttaaa

SEQ ID NO: 94739 - DNA, 25 bp, Homo sapien
actcagaaagtcacccacattggcc

SEQ ID NO: 94740 - DNA, 25 bp, Homo sapien
gccttctgcactctttaaagaaaga

SEQ ID NO: 94741 - DNA, 25 bp, Homo sapien
ccacattggccctctttggggaggc

SEQ ID NO: 94742 - DNA, 25 bp, Homo sapien
gaatccacagggcatcgcagaacca

SEQ ID NO: 94743 - DNA, 25 bp, Homo sapien
accgccttccagcaggattcgctgg

SEQ ID NO: 94744 - DNA, 25 bp, Homo sapien
aagcgcaggtctcgggatttgcttt

SEQ ID NO: 94745 - DNA, 25 bp, Homo sapien
ggcgtccgcaaaagtcctcgctgtc

SEQ ID NO: 94746 - DNA, 25 bp, Homo sapien
tggaaatccgggtgcacctccgccc

SEQ ID NO: 94747 - DNA, 25 bp, Homo sapien
cggcgtccgcaaaagtcctcgctgt

SEQ ID NO: 94748 - DNA, 25 bp, Homo sapien
gcgactggaaatccgggtgcacctc

SEQ ID NO: 94749 - DNA, 25 bp, Homo sapien
ccgcgactggaaatccgggtgcacc

SEQ ID NO: 94750 - DNA, 25 bp, Homo sapien
cgtgggacccgcgactggaaatccg

SEQ ID NO: 94751 - DNA, 25 bp, Homo sapien
gcagcaggctcgggttgctcatgaa

SEQ ID NO: 94752 - DNA, 25 bp, Homo sapien
gcgacgcggtgcgacgggacgagct

SEQ ID NO: 94753 - DNA, 25 bp, Homo sapien
tctcagaaaccggtgccagcgcgtc

SEQ ID NO: 94754 - DNA, 25 bp, Homo sapien
ccgaggatgcgatacggatacttcc

SEQ ID NO: 94755 - DNA, 25 bp, Homo sapien
acggatacttcctccgtcatttcca

SEQ ID NO: 94756 - DNA, 25 bp, Homo sapien
tgaagctccgtctccacgcccgaac

SEQ ID NO: 94757 - DNA, 25 bp, Homo sapien
acaccctctcgtccggtctcccatg

SEQ ID NO: 94758 - DNA, 25 bp, Homo sapien
cacagttccgcgtccgccgtctcct

SEQ ID NO: 94759 - DNA, 25 bp, Homo sapien
gcaaaccgaggatgcgatacggata

SEQ ID NO: 94760 - DNA, 25 bp, Homo sapien
tttctccaggccctgaagctccgtc

SEQ ID NO: 94761 - DNA, 25 bp, Homo sapien
gggattgctcgttatcccgtttctc

SEQ ID NO: 94762 - DNA, 25 bp, Homo sapien
ccgtggtgctgggaatcctactcag

SEQ ID NO: 94763 - DNA, 25 bp, Homo sapien
cgagaaaaagaagctcatcgctgcc

SEQ ID NO: 94764 - DNA, 25 bp, Homo sapien
ggagcctgcgcaaacacaccgagaa

SEQ ID NO: 94765 - DNA, 25 bp, Homo sapien
gctttttggattcggagcctgcgca

SEQ ID NO: 94766 - DNA, 25 bp, Homo sapien
gtgctgtgtgatgctgctttttgga

SEQ ID NO: 94767 - DNA, 25 bp, Homo sapien
caagtaacctgttcttccgagcggg

SEQ ID NO: 94768 - DNA, 25 bp, Homo sapien
gggaatcctactcagcaagatgctg

SEQ ID NO: 94769 - DNA, 25 bp, Homo sapien
cacttccggcatgcgcagggacgca

SEQ ID NO: 94770 - DNA, 25 bp, Homo sapien
tgaggagagagaacgttctagcgtc

SEQ ID NO: 94771 - DNA, 25 bp, Homo sapien
tatggcgcgacggaaaagtcccacc

SEQ ID NO: 94772 - DNA, 25 bp, Homo sapien
tcctagtggccctaggacggcgttg

SEQ ID NO: 94773 - DNA, 25 bp, Homo sapien
cggactaggcccgaagcgcgcgaac

SEQ ID NO: 94774 - DNA, 25 bp, Homo sapien
aatggcggtgtctacagtgttctcg

SEQ ID NO: 94775 - DNA, 25 bp, Homo sapien
gtgttctcgacttcgtcgctggtga

SEQ ID NO: 94776 - DNA, 25 bp, Homo sapien
tgcgaagaatgaccgcggcgaagcc

SEQ ID NO: 94777 - DNA, 25 bp, Homo sapien
tggagaaatgcaccgagctgaaacc

SEQ ID NO: 94778 - DNA, 25 bp, Homo sapien
caagcaaagttacccgacggcgagt

SEQ ID NO: 94779 - DNA, 25 bp, Homo sapien
ggttacactgctcacgacccaggta

SEQ ID NO: 94780 - DNA, 25 bp, Homo sapien
cggagcagcctgaaacgctttgaaa

SEQ ID NO: 94781 - DNA, 25 bp, Homo sapien
ctgctgatctcaatcgccaggtgga

SEQ ID NO: 94782 - DNA, 25 bp, Homo sapien
cgccttcaatgcgtggagaaatgca

SEQ ID NO: 94783 - DNA, 25 bp, Homo sapien
cctggcctggaacaacgtggttaca

SEQ ID NO: 94784 - DNA, 25 bp, Homo sapien
acgacccaggtagtgcagcccaagc

SEQ ID NO: 94785 - DNA, 25 bp, Homo sapien
gcgcgctgccaagggaatccagatc

SEQ ID NO: 94786 - DNA, 25 bp, Homo sapien
ggttgtgtaactcgcaccttgacag

SEQ ID NO: 94787 - DNA, 25 bp, Homo sapien
gcccgtaagaaaggcgctgctctca

SEQ ID NO: 94788 - DNA, 25 bp, Homo sapien
gtgttaattgctctgaccctggtca

SEQ ID NO: 94789 - DNA, 25 bp, Homo sapien
tcttcagtcgtacccagtgctagtg

SEQ ID NO: 94790 - DNA, 25 bp, Homo sapien
ctgccttggcacagctgtagattcc

SEQ ID NO: 94791 - DNA, 25 bp, Homo sapien
agcaggatccgtgcgttttgtttcc

SEQ ID NO: 94792 - DNA, 25 bp, Homo sapien
ggcccaaggcgagttccaatgaatc

SEQ ID NO: 94793 - DNA, 25 bp, Homo sapien
cgtctgagttttccgggctgaaatc

SEQ ID NO: 94794 - DNA, 25 bp, Homo sapien
tgacagagactcgaaaccagggccc

SEQ ID NO: 94795 - DNA, 25 bp, Homo sapien
aagcgtcggttctgcaacacacttc

SEQ ID NO: 94796 - DNA, 25 bp, Homo sapien
actcgggctgaagacagtgcctgta

SEQ ID NO: 94797 - DNA, 25 bp, Homo sapien
ccagaggtcactcgcaaagaggctc

SEQ ID NO: 94798 - DNA, 25 bp, Homo sapien
gggtcctaatccagcttcttgcgaa

SEQ ID NO: 94799 - DNA, 25 bp, Homo sapien
ttgcgaacaggcttccgcccagcgt

SEQ ID NO: 94800 - DNA, 25 bp, Homo sapien
ctccgattctcgcacagtaagcgtc

SEQ ID NO: 94801 - DNA, 25 bp, Homo sapien
cctggggaatgggaggccacgagtt

SEQ ID NO: 94802 - DNA, 25 bp, Homo sapien
gacgcgctggcaccggtttctgaga

SEQ ID NO: 94803 - DNA, 25 bp, Homo sapien
catgggagaccggacgagagggtgt

SEQ ID NO: 94804 - DNA, 25 bp, Homo sapien
aactgtgcggggttggcagtgggct

SEQ ID NO: 94805 - DNA, 25 bp, Homo sapien
acgagagggtgtggcagcgaccgca

SEQ ID NO: 94806 - DNA, 25 bp, Homo sapien
accgcagggagaggagacggcggac

SEQ ID NO: 94807 - DNA, 25 bp, Homo sapien
ggagacggcggacgcggaactgtgc

SEQ ID NO: 94808 - DNA, 25 bp, Homo sapien
ggcaccggtttctgagaggggacat

SEQ ID NO: 94809 - DNA, 25 bp, Homo sapien
cggggactcgctcagagcttttttg

SEQ ID NO: 94810 - DNA, 25 bp, Homo sapien
cactgttcactgaggacttgggctc

SEQ ID NO: 94811 - DNA, 25 bp, Homo sapien
cttcgatgattatggggaccgcctg

SEQ ID NO: 94812 - DNA, 25 bp, Homo sapien
ttaagccgtcaggtagctcgccact

SEQ ID NO: 94813 - DNA, 25 bp, Homo sapien
cgacttctacagtggggtgatcttc

SEQ ID NO: 94814 - DNA, 25 bp, Homo sapien
ccgagcgaatccatcccggtcttga

SEQ ID NO: 94815 - DNA, 25 bp, Homo sapien
gggctcactttctacacttccgtta

SEQ ID NO: 94816 - DNA, 25 bp, Homo sapien
ttttcgaaccttgagctaccctgga

SEQ ID NO: 94817 - DNA, 25 bp, Homo sapien
acagcgtagaaggacacggctccca

SEQ ID NO: 94818 - DNA, 25 bp, Homo sapien
ggcgcatgtcctccacagcgtagaa

SEQ ID NO: 94819 - DNA, 25 bp, Homo sapien
cccgtggagcaaacagagaaaagcg

SEQ ID NO: 94820 - DNA, 25 bp, Homo sapien
acggcccagtactggccgccgttga

SEQ ID NO: 94821 - DNA, 25 bp, Homo sapien
gaacacgcgctcctggaagttgacg

SEQ ID NO: 94822 - DNA, 25 bp, Homo sapien
gccaaaggcccagccgtccttagag

SEQ ID NO: 94823 - DNA, 25 bp, Homo sapien
acgcgcgacaggtgcccgcagctga

SEQ ID NO: 94824 - DNA, 25 bp, Homo sapien
ggcgcacgcccttaagatccagaga

SEQ ID NO: 94825 - DNA, 25 bp, Homo sapien
cactggacctcacaggacgcggagc

SEQ ID NO: 94826 - DNA, 25 bp, Homo sapien
gggcctcctgatcgacaggctgttc

SEQ ID NO: 94827 - DNA, 25 bp, Homo sapien
ctcacgaaagagctctaggcagatg

SEQ ID NO: 94828 - DNA, 25 bp, Homo sapien
agcttgaagggttcgccatgctgcc

SEQ ID NO: 94829 - DNA, 25 bp, Homo sapien
cgtcgtcctggcagtagagcttgaa

SEQ ID NO: 94830 - DNA, 25 bp, Homo sapien
ccaggctagaggctccgaacagaca

SEQ ID NO: 94831 - DNA, 25 bp, Homo sapien
actcgacggacaccggctcacgaaa

SEQ ID NO: 94832 - DNA, 25 bp, Homo sapien
caggcggcccagtatctggcccaga

SEQ ID NO: 94833 - DNA, 25 bp, Homo sapien
cgactttcacgtcgggcagaggtgc

SEQ ID NO: 94834 - DNA, 25 bp, Homo sapien
gccgcatcatggcacgtgggtttcc

SEQ ID NO: 94835 - DNA, 25 bp, Homo sapien
cgggcttactctcctgccagtagcg

SEQ ID NO: 94836 - DNA, 25 bp, Homo sapien
ccagtagcgctgtcctagggatccc

SEQ ID NO: 94837 - DNA, 25 bp, Homo sapien
cccgaagccgacgagctgcaagtga

SEQ ID NO: 94838 - DNA, 25 bp, Homo sapien
ttccctgagattgctgaagaggccc

SEQ ID NO: 94839 - DNA, 25 bp, Homo sapien
tcacgccttggagaggctgatggtc

SEQ ID NO: 94840 - DNA, 25 bp, Homo sapien
tgcgaacccaaaagccgtgtcagtg

SEQ ID NO: 94841 - DNA, 25 bp, Homo sapien
cctgtgatctaggttgtggaactac

SEQ ID NO: 94842 - DNA, 25 bp, Homo sapien
atctatcgccgctgcaagccttgca

SEQ ID NO: 94843 - DNA, 25 bp, Homo sapien
caaggctgaccctggagcgtcacgt

SEQ ID NO: 94844 - DNA, 25 bp, Homo sapien
gaactgttctcccaagcttcagatc

SEQ ID NO: 94845 - DNA, 25 bp, Homo sapien
atccacgcgtgtcttgggcagtttt

SEQ ID NO: 94846 - DNA, 25 bp, Homo sapien
gggcagtttttccaggtatctcaca

SEQ ID NO: 94847 - DNA, 25 bp, Homo sapien
tctctggttccagcaagaactgttc

SEQ ID NO: 94848 - DNA, 25 bp, Homo sapien
gcccaaccgttcgagacctaagtca

SEQ ID NO: 94849 - DNA, 25 bp, Homo sapien
cctgaagacacacacggctgagacg

SEQ ID NO: 94850 - DNA, 25 bp, Homo sapien
ccgcggccggctgagcggtgtccag

SEQ ID NO: 94851 - DNA, 25 bp, Homo sapien
agctctaggcaagcgcccttgtagg

SEQ ID NO: 94852 - DNA, 25 bp, Homo sapien
atagctctaggcaagcgcccttgta

SEQ ID NO: 94853 - DNA, 25 bp, Homo sapien
gccgggatagctctaggcaagcgcc

SEQ ID NO: 94854 - DNA, 25 bp, Homo sapien
agacggccgggatagctctaggcaa

SEQ ID NO: 94855 - DNA, 25 bp, Homo sapien
tgaagacacacacggctgagacggc

SEQ ID NO: 94856 - DNA, 25 bp, Homo sapien
cggtgtccaggttctggagccggac

SEQ ID NO: 94857 - DNA, 25 bp, Homo sapien
tcctgtaatggcctagcatagttca

SEQ ID NO: 94858 - DNA, 25 bp, Homo sapien
catagttcacccacgagggttcgtg

SEQ ID NO: 94859 - DNA, 25 bp, Homo sapien
ttggcgcgtttgatctgacatactc

SEQ ID NO: 94860 - DNA, 25 bp, Homo sapien
tctgacatactcagaggcctgacca

SEQ ID NO: 94861 - DNA, 25 bp, Homo sapien
ctaggaagcgcgacgtccatctgga

SEQ ID NO: 94862 - DNA, 25 bp, Homo sapien
tccatctggagttttcccgcgagcc

SEQ ID NO: 94863 - DNA, 25 bp, Homo sapien
ttcgtggtttttggcgcgtttgatc

SEQ ID NO: 94864 - DNA, 25 bp, Homo sapien
agccgagtccgcaggtcctgtaatg

SEQ ID NO: 94865 - DNA, 25 bp, Homo sapien
tgaccatgggcatcgccgagtccac

SEQ ID NO: 94866 - DNA, 25 bp, Homo sapien
agccgcctgcagaagctgtatgtga

SEQ ID NO: 94867 - DNA, 25 bp, Homo sapien
tggcgctggacttcaacaagctcga

SEQ ID NO: 94868 - DNA, 25 bp, Homo sapien
ccgacttcgcgcagttgcagagcct

SEQ ID NO: 94869 - DNA, 25 bp, Homo sapien
ctgcctctggatcgagggcaacttc

SEQ ID NO: 94870 - DNA, 25 bp, Homo sapien
ggctctacggcaaccgcttcgagga

SEQ ID NO: 94871 - DNA, 25 bp, Homo sapien
acgggtcgctaagctgcgagtcagc

SEQ ID NO: 94872 - DNA, 25 bp, Homo sapien
agtcagcgcgaaccctagccagtcg

SEQ ID NO: 94873 - DNA, 25 bp, Homo sapien
gggtaggatggcgtctggccgatgc

SEQ ID NO: 94874 - DNA, 25 bp, Homo sapien
gtgatagcaccgaaagcagacggcc

SEQ ID NO: 94875 - DNA, 25 bp, Homo sapien
gatagcaccgaaagcagacggccgc

SEQ ID NO: 94876 - DNA, 25 bp, Homo sapien
cgatgcggtgatagcaccgaaagca

SEQ ID NO: 94877 - DNA, 25 bp, Homo sapien
ggccgatgcggtgatagcaccgaaa

SEQ ID NO: 94878 - DNA, 25 bp, Homo sapien
tgcggtgatagcaccgaaagcagac

SEQ ID NO: 94879 - DNA, 25 bp, Homo sapien
ctggccgatgcggtgatagcaccga

SEQ ID NO: 94880 - DNA, 25 bp, Homo sapien
ttccggcatcggctgtggggagtac

SEQ ID NO: 94881 - DNA, 25 bp, Homo sapien
gtaggcggttcctctgttctttctg

SEQ ID NO: 94882 - DNA, 25 bp, Homo sapien
cggactagagcgtctcctcgccatt

SEQ ID NO: 94883 - DNA, 25 bp, Homo sapien
ctagtgcggactagagcgtctcctc

SEQ ID NO: 94884 - DNA, 25 bp, Homo sapien
ccgccctgttctctagtgcggacta

SEQ ID NO: 94885 - DNA, 25 bp, Homo sapien
agacgcgggcctccaccgtcctagc

SEQ ID NO: 94886 - DNA, 25 bp, Homo sapien
cccgcggcctcttaccacagagacg

SEQ ID NO: 94887 - DNA, 25 bp, Homo sapien
gttcctctgttctttctgcgttccc

SEQ ID NO: 94888 - DNA, 25 bp, Homo sapien
tcctcgccatttcctgtcgccctgg

SEQ ID NO: 94889 - DNA, 25 bp, Homo sapien
actaagatggctgccgttgccatga

SEQ ID NO: 94890 - DNA, 25 bp, Homo sapien
tcgccagggcgtcggtagggaagac

SEQ ID NO: 94891 - DNA, 25 bp, Homo sapien
accgaacctctacactggctggctg

SEQ ID NO: 94892 - DNA, 25 bp, Homo sapien
tgccatgacacccaaccctgtgcag

SEQ ID NO: 94893 - DNA, 25 bp, Homo sapien
ctggacactaagatggctgccgttg

SEQ ID NO: 94894 - DNA, 25 bp, Homo sapien
atggctgccgttgccatgacaccca

SEQ ID NO: 94895 - DNA, 25 bp, Homo sapien
ctcgattacttcacggaccccgtgt

SEQ ID NO: 94896 - DNA, 25 bp, Homo sapien
acactggctggctggacactaagat

SEQ ID NO: 94897 - DNA, 25 bp, Homo sapien
ctccggccggcactactgggaggta

SEQ ID NO: 94898 - DNA, 25 bp, Homo sapien
ttctcggccgactgctgcgtactgg

SEQ ID NO: 94899 - DNA, 25 bp, Homo sapien
ggttgctgaccatcccaagcgcttc

SEQ ID NO: 94900 - DNA, 25 bp, Homo sapien
ggtgctgcccgtgaatcaacccatc

SEQ ID NO: 94901 - DNA, 25 bp, Homo sapien
tcaacccatcataaggaaaaggtgg

SEQ ID NO: 94902 - DNA, 25 bp, Homo sapien
atgccagctcctcgcgccatcacca

SEQ ID NO: 94903 - DNA, 25 bp, Homo sapien
catcataaggaaaaggtgggccctg

SEQ ID NO: 94904 - DNA, 25 bp, Homo sapien
ggcaggaggttgctgaccatcccaa

SEQ ID NO: 94905 - DNA, 25 bp, Homo sapien
gcagcgtagctcattcacactgcag

SEQ ID NO: 94906 - DNA, 25 bp, Homo sapien
agctctctcgcgtgtcttctcgttt

SEQ ID NO: 94907 - DNA, 25 bp, Homo sapien
gcgtgtcttctcgtttgctctaaga

SEQ ID NO: 94908 - DNA, 25 bp, Homo sapien
tttgctctaagaccacccttccagg

SEQ ID NO: 94909 - DNA, 25 bp, Homo sapien
cacccttccaggtggggattgcggc

SEQ ID NO: 94910 - DNA, 25 bp, Homo sapien
gtggatgcagcgtagctcattcaca

SEQ ID NO: 94911 - DNA, 25 bp, Homo sapien
tgtgcacgcagctctctcgcgtgtc

SEQ ID NO: 94912 - DNA, 25 bp, Homo sapien
attgcggcatccactgggatgagcc

SEQ ID NO: 94913 - DNA, 25 bp, Homo sapien
ggaaatacccgctcgaccatgcaaa

SEQ ID NO: 94914 - DNA, 25 bp, Homo sapien
cccggccacactacgaaggagaagg

SEQ ID NO: 94915 - DNA, 25 bp, Homo sapien
tgcgagctgatgtacacgtaggttc

SEQ ID NO: 94916 - DNA, 25 bp, Homo sapien
atacatttctgctcaagatggcggc

SEQ ID NO: 94917 - DNA, 25 bp, Homo sapien
tcatctgcaatgtggttcgcccggg

SEQ ID NO: 94918 - DNA, 25 bp, Homo sapien
gccctgcaatctcgggtcctgaaat

SEQ ID NO: 94919 - DNA, 25 bp, Homo sapien
ccacgaagggtcatctgctcagtca

SEQ ID NO: 94920 - DNA, 25 bp, Homo sapien
tgccgccgccttgcagtgaaagaga

SEQ ID NO: 94921 - DNA, 25 bp, Homo sapien
gccctcgggcacaaataggtgaacg

SEQ ID NO: 94922 - DNA, 25 bp, Homo sapien
cggccgtcaacagcactagatcaca

SEQ ID NO: 94923 - DNA, 25 bp, Homo sapien
tgtcctcgagaacacggggtttctc

SEQ ID NO: 94924 - DNA, 25 bp, Homo sapien
cgccgaggagttccaatttgtcctc

SEQ ID NO: 94925 - DNA, 25 bp, Homo sapien
ctcccgctgtggactgagattcgcg

SEQ ID NO: 94926 - DNA, 25 bp, Homo sapien
ggtttctccattcgcggccgtcaac

SEQ ID NO: 94927 - DNA, 25 bp, Homo sapien
ggttttgtcttagagcccgtgtgga

SEQ ID NO: 94928 - DNA, 25 bp, Homo sapien
tcttaaacgttccacagggagtcca

SEQ ID NO: 94929 - DNA, 25 bp, Homo sapien
gcacacgctctggagagacgctcta

SEQ ID NO: 94930 - DNA, 25 bp, Homo sapien
taccctcagggtgtgccctacactg

SEQ ID NO: 94931 - DNA, 25 bp, Homo sapien
caaaatgacgtctcgctcctgcaca

SEQ ID NO: 94932 - DNA, 25 bp, Homo sapien
cggaggaccacgtctctatggtgtg

SEQ ID NO: 94933 - DNA, 25 bp, Homo sapien
ccagctgggctagtgctgcacattc

SEQ ID NO: 94934 - DNA, 25 bp, Homo sapien
agacccagccctgtttctgcttgcg

SEQ ID NO: 94935 - DNA, 25 bp, Homo sapien
gctcaagttcccttcggtgctgccg

SEQ ID NO: 94936 - DNA, 25 bp, Homo sapien
cctgcccgaggcgacgcaaaatgac

SEQ ID NO: 94937 - DNA, 25 bp, Homo sapien
acccagtgagcctcgcaaggccatt

SEQ ID NO: 94938 - DNA, 25 bp, Homo sapien
cccagtgagcctcgcaaggccatta

SEQ ID NO: 94939 - DNA, 25 bp, Homo sapien
cgcaaggccattagcagcgcgcctg

SEQ ID NO: 94940 - DNA, 25 bp, Homo sapien
gcaaggccattagcagcgcgcctgc

SEQ ID NO: 94941 - DNA, 25 bp, Homo sapien
caaggccattagcagcgcgcctgca

SEQ ID NO: 94942 - DNA, 25 bp, Homo sapien
aggccattagcagcgcgcctgcacc

SEQ ID NO: 94943 - DNA, 25 bp, Homo sapien
gacccagtgagcctcgcaaggccat

SEQ ID NO: 94944 - DNA, 25 bp, Homo sapien
aaggccattagcagcgcgcctgcac

SEQ ID NO: 94945 - DNA, 25 bp, Homo sapien
ctcctcgcggctggtctagagccag

SEQ ID NO: 94946 - DNA, 25 bp, Homo sapien
ctcggcgcacccgtggtgacagtgc

SEQ ID NO: 94947 - DNA, 25 bp, Homo sapien
aggcgggggaccacagcaacatccc

SEQ ID NO: 94948 - DNA, 25 bp, Homo sapien
cgtccaggttgaacgcctgacaggc

SEQ ID NO: 94949 - DNA, 25 bp, Homo sapien
gtgagcttttccacgtccaggttga

SEQ ID NO: 94950 - DNA, 25 bp, Homo sapien
gtccacggcgtagccgaagtagctg

SEQ ID NO: 94951 - DNA, 25 bp, Homo sapien
tggctgctacccaggagcgcgagcc

SEQ ID NO: 94952 - DNA, 25 bp, Homo sapien
gggccgctgtacactgtgagctttt

SEQ ID NO: 94953 - DNA, 25 bp, Homo sapien
tctcccacgtccacgaggcctcggg

SEQ ID NO: 94954 - DNA, 25 bp, Homo sapien
cgctcaagacttcccaccacactct

SEQ ID NO: 94955 - DNA, 25 bp, Homo sapien
gtggagaagggcagatcccctcctc

SEQ ID NO: 94956 - DNA, 25 bp, Homo sapien
tccaagagaggagtggagaagggca

SEQ ID NO: 94957 - DNA, 25 bp, Homo sapien
aaaccgaggcggatccaagagagga

SEQ ID NO: 94958 - DNA, 25 bp, Homo sapien
ctggctcactgggcggtcttccgcg

SEQ ID NO: 94959 - DNA, 25 bp, Homo sapien
ccactcgatacaagttggttggatc

SEQ ID NO: 94960 - DNA, 25 bp, Homo sapien
cccgcccactcgatacaagttggtt

SEQ ID NO: 94961 - DNA, 25 bp, Homo sapien
tcgcagtttccacaccgtgagctgc

SEQ ID NO: 94962 - DNA, 25 bp, Homo sapien
agtttccacaccgtgagctgctgag

SEQ ID NO: 94963 - DNA, 25 bp, Homo sapien
cacccgcgtgagtgtcgcagtttcc

SEQ ID NO: 94964 - DNA, 25 bp, Homo sapien
cgcagtttccacaccgtgagctgct

SEQ ID NO: 94965 - DNA, 25 bp, Homo sapien
ccgcgtgagtgtcgcagtttccaca

SEQ ID NO: 94966 - DNA, 25 bp, Homo sapien
acccgcgtgagtgtcgcagtttcca

SEQ ID NO: 94967 - DNA, 25 bp, Homo sapien
cccgcgtgagtgtcgcagtttccac

SEQ ID NO: 94968 - DNA, 25 bp, Homo sapien
gtttccacaccgtgagctgctgaga

SEQ ID NO: 94969 - DNA, 25 bp, Homo sapien
ttcgccgacgctgccgtcctcttgc

SEQ ID NO: 94970 - DNA, 25 bp, Homo sapien
ggacaggtcaccttcgccgacgctg

SEQ ID NO: 94971 - DNA, 25 bp, Homo sapien
gcaggacaggtcaccttcgccgacg

SEQ ID NO: 94972 - DNA, 25 bp, Homo sapien
atgcaggacaggtcaccttcgccga

SEQ ID NO: 94973 - DNA, 25 bp, Homo sapien
aggatgcaggacaggtcaccttcgc

SEQ ID NO: 94974 - DNA, 25 bp, Homo sapien
tcttgaggatgcaggacaggtcacc

SEQ ID NO: 94975 - DNA, 25 bp, Homo sapien
tgaggatgcaggacaggtcaccttc

SEQ ID NO: 94976 - DNA, 25 bp, Homo sapien
cgtcttgaggatgcaggacaggtca

SEQ ID NO: 94977 - DNA, 25 bp, Homo sapien
acccccagggccgtcttgaggatgc

SEQ ID NO: 94978 - DNA, 25 bp, Homo sapien
caatggctcggaataggtcggtcac

SEQ ID NO: 94979 - DNA, 25 bp, Homo sapien
gtcggtcacggtgagctctgccacc

SEQ ID NO: 94980 - DNA, 25 bp, Homo sapien
aataggtcggtcacggtgagctctg

SEQ ID NO: 94981 - DNA, 25 bp, Homo sapien
cttggtcaatggctcggaataggtc

SEQ ID NO: 94982 - DNA, 25 bp, Homo sapien
cttctcctcttggtcaatggctcgg

SEQ ID NO: 94983 - DNA, 25 bp, Homo sapien
cgggctcaccgaatgtgatcttccc

SEQ ID NO: 94984 - DNA, 25 bp, Homo sapien
actcctgcgggctcaccgaatgtga

SEQ ID NO: 94985 - DNA, 25 bp, Homo sapien
ctgtgatcttgtgagcgtttgctcc

SEQ ID NO: 94986 - DNA, 25 bp, Homo sapien
gcagcgctttcctctgaggtcccga

SEQ ID NO: 94987 - DNA, 25 bp, Homo sapien
ctgggctccctcagatgggccagct

SEQ ID NO: 94988 - DNA, 25 bp, Homo sapien
gatgggccagctcttctacctggtt

SEQ ID NO: 94989 - DNA, 25 bp, Homo sapien
gctgcagcgcgctgtgatcttgtga

SEQ ID NO: 94990 - DNA, 25 bp, Homo sapien
gagcgtttgctccaccctccgagaa

SEQ ID NO: 94991 - DNA, 25 bp, Homo sapien
ctcagggaagaaacgctgacgcctc

SEQ ID NO: 94992 - DNA, 25 bp, Homo sapien
caccctccgagaagtgggctgcctg

SEQ ID NO: 94993 - DNA, 25 bp, Homo sapien
tgctattataacattgcgcacgagc

SEQ ID NO: 94994 - DNA, 25 bp, Homo sapien
ctgctgtaacatcgcgcaccagctg

SEQ ID NO: 94995 - DNA, 25 bp, Homo sapien
gagggacactttctgctgtaacatc

SEQ ID NO: 94996 - DNA, 25 bp, Homo sapien
tgcgcacgagctggaagacatccgt

SEQ ID NO: 94997 - DNA, 25 bp, Homo sapien
ctgtggagggacacttgctattata

SEQ ID NO: 94998 - DNA, 25 bp, Homo sapien
agggacactttctgctgtaacatcg

SEQ ID NO: 94999 - DNA, 25 bp, Homo sapien
attgcgcacgagctggaagacatcc

SEQ ID NO: 95000 - DNA, 25 bp, Homo sapien
cgtctgtggagggacacttgctatt

SEQ ID NO: 95001 - DNA, 25 bp, Homo sapien
tgcgcccgtctcttgatttcttcta

SEQ ID NO: 95002 - DNA, 25 bp, Homo sapien
cgcgaagttcgcatctttcggaata

SEQ ID NO: 95003 - DNA, 25 bp, Homo sapien
cacaatcagggctacgtgcattacc

SEQ ID NO: 95004 - DNA, 25 bp, Homo sapien
tgtggccactttccgttggactgcg

SEQ ID NO: 95005 - DNA, 25 bp, Homo sapien
atcacgtggaatgcacggctcccgc

SEQ ID NO: 95006 - DNA, 25 bp, Homo sapien
cacaggccgtatatactggatcaga

SEQ ID NO: 95007 - DNA, 25 bp, Homo sapien
atcctggtctgaccgggacacgaac

SEQ ID NO: 95008 - DNA, 25 bp, Homo sapien
gttttcctgcgagaatcctggtctg

SEQ ID NO: 95009 - DNA, 25 bp, Homo sapien
gctgcgctctcacctacgaaggagg

SEQ ID NO: 95010 - DNA, 25 bp, Homo sapien
gatggaggacatcgtcatggtcaca

SEQ ID NO: 95011 - DNA, 25 bp, Homo sapien
catgatggccttcagcaggaagtcc

SEQ ID NO: 95012 - DNA, 25 bp, Homo sapien
ggaagtccacaaccctgcaaaagag

SEQ ID NO: 95013 - DNA, 25 bp, Homo sapien
ccggcgaaccacatggtgcgcatga

SEQ ID NO: 95014 - DNA, 25 bp, Homo sapien
ctgggacatctgcttgagggaagaa

SEQ ID NO: 95015 - DNA, 25 bp, Homo sapien
ttgagggaagaaaagacgccgcgcc

SEQ ID NO: 95016 - DNA, 25 bp, Homo sapien
agtctcggagtctgtgtgaggcaca

SEQ ID NO: 95017 - DNA, 25 bp, Homo sapien
cgctgaggcgcagctcgtgcacgaa

SEQ ID NO: 95018 - DNA, 25 bp, Homo sapien
cgtccaggcaaagccgctccggagt

SEQ ID NO: 95019 - DNA, 25 bp, Homo sapien
cgctgagggaccaggatgcgcgtgc

SEQ ID NO: 95020 - DNA, 25 bp, Homo sapien
tcctgcagccactggagcacaggga

SEQ ID NO: 95021 - DNA, 25 bp, Homo sapien
agttccgctacctggtggtttctct

SEQ ID NO: 95022 - DNA, 25 bp, Homo sapien
accagccggagttccgctacctggt

SEQ ID NO: 95023 - DNA, 25 bp, Homo sapien
gggcgtccctggaagcctcgcctcc

SEQ ID NO: 95024 - DNA, 25 bp, Homo sapien
agctcgtgcacgaaggggttccgcc

SEQ ID NO: 95025 - DNA, 25 bp, Homo sapien
cagcgacacacagctcccttgtgtt

SEQ ID NO: 95026 - DNA, 25 bp, Homo sapien
gggccacgatgctgacccagcgaca

SEQ ID NO: 95027 - DNA, 25 bp, Homo sapien
ggcctgccgcgacggactcacagat

SEQ ID NO: 95028 - DNA, 25 bp, Homo sapien
agctcccttgtgttcccgctggacg

SEQ ID NO: 95029 - DNA, 25 bp, Homo sapien
cctcggtgcatgaagccagcacagc

SEQ ID NO: 95030 - DNA, 25 bp, Homo sapien
acagccctggaaatcccgtgcaaca

SEQ ID NO: 95031 - DNA, 25 bp, Homo sapien
tggaaatcccgtgcaacaaaaagcc

SEQ ID NO: 95032 - DNA, 25 bp, Homo sapien
acggactcacagatgggcgcctgga

SEQ ID NO: 95033 - DNA, 25 bp, Homo sapien
ccggacattttctccaagcgctttc

SEQ ID NO: 95034 - DNA, 25 bp, Homo sapien
gacattttctccaagcgctttcctg

SEQ ID NO: 95035 - DNA, 25 bp, Homo sapien
aagcgctttcctggcacagcgcgca

SEQ ID NO: 95036 - DNA, 25 bp, Homo sapien
ggccggacattttctccaagcgctt

SEQ ID NO: 95037 - DNA, 25 bp, Homo sapien
gcgctttcctggcacagcgcgcagg

SEQ ID NO: 95038 - DNA, 25 bp, Homo sapien
cggcctgcgccaaagctctggcttc

SEQ ID NO: 95039 - DNA, 25 bp, Homo sapien
cgccaaagctctggcttcctccagg

SEQ ID NO: 95040 - DNA, 25 bp, Homo sapien
cggggccggacattttctccaagcg

SEQ ID NO: 95041 - DNA, 25 bp, Homo sapien
tcccggagaccacgcatttcctgcg

SEQ ID NO: 95042 - DNA, 25 bp, Homo sapien
agaggtctctcgtcgctgcaggcgc

SEQ ID NO: 95043 - DNA, 25 bp, Homo sapien
gagtcggcctgagaggtctctcgtc

SEQ ID NO: 95044 - DNA, 25 bp, Homo sapien
cccggaagtggtgataatgccaggc

SEQ ID NO: 95045 - DNA, 25 bp, Homo sapien
gtgaccatcccggagaccacgcatt

SEQ ID NO: 95046 - DNA, 25 bp, Homo sapien
ctggcaacttagctgcgaggggatt

SEQ ID NO: 95047 - DNA, 25 bp, Homo sapien
gcgttgcctggcaacttagctgcga

SEQ ID NO: 95048 - DNA, 25 bp, Homo sapien
aagtggtgataatgccaggccctgc

SEQ ID NO: 95049 - DNA, 25 bp, Homo sapien
ctcacacggtaatgctctggcggga

SEQ ID NO: 95050 - DNA, 25 bp, Homo sapien
cacacagtaatgcttggacaggagg

SEQ ID NO: 95051 - DNA, 25 bp, Homo sapien
cacagtaatgcttggacaggaggcg

SEQ ID NO: 95052 - DNA, 25 bp, Homo sapien
cagtaatgcttggacaggaggcgga

SEQ ID NO: 95053 - DNA, 25 bp, Homo sapien
tcacacagtaatgcttggacaggag

SEQ ID NO: 95054 - DNA, 25 bp, Homo sapien
cacacggtaatgctctggcgggagg

SEQ ID NO: 95055 - DNA, 25 bp, Homo sapien
tcacacggtaatgctctggcgggag

SEQ ID NO: 95056 - DNA, 25 bp, Homo sapien
acacagtaatgcttggacaggaggc

SEQ ID NO: 95057 - DNA, 25 bp, Homo sapien
ggatgaatgtccctcctgacggtct

SEQ ID NO: 95058 - DNA, 25 bp, Homo sapien
ctaccggcgccctcaggggatgaat

SEQ ID NO: 95059 - DNA, 25 bp, Homo sapien
cgccaaaggcgtagcacctcggaca

SEQ ID NO: 95060 - DNA, 25 bp, Homo sapien
atggactaatcctgctcgttaattc

SEQ ID NO: 95061 - DNA, 25 bp, Homo sapien
aaaaggagccgtttgtgcttgtaca

SEQ ID NO: 95062 - DNA, 25 bp, Homo sapien
tgcttgtacaaacccaagagccagg

SEQ ID NO: 95063 - DNA, 25 bp, Homo sapien
gggctctattctcagtctgcgcgtg

SEQ ID NO: 95064 - DNA, 25 bp, Homo sapien
ctgacggtctctttacttattgatg

SEQ ID NO: 95065 - DNA, 25 bp, Homo sapien
tgcacaaagcgcacctgcggacggt

SEQ ID NO: 95066 - DNA, 25 bp, Homo sapien
cctctggcctctagtgagcgggtgt

SEQ ID NO: 95067 - DNA, 25 bp, Homo sapien
ctgaccgatgtagggcgggccctat

SEQ ID NO: 95068 - DNA, 25 bp, Homo sapien
tgaccctcggtctccggcctgtgag

SEQ ID NO: 95069 - DNA, 25 bp, Homo sapien
tagtggaggcgcctcgcctgcacaa

SEQ ID NO: 95070 - DNA, 25 bp, Homo sapien
tcagcaggcgcgacaggacccagac

SEQ ID NO: 95071 - DNA, 25 bp, Homo sapien
gtcgtgaccttcaccggactacctg

SEQ ID NO: 95072 - DNA, 25 bp, Homo sapien
ccgaacgtccagatcgcagggaatg

SEQ ID NO: 95073 - DNA, 25 bp, Homo sapien
ggcgcttggagacaatgtcccgtgc

SEQ ID NO: 95074 - DNA, 25 bp, Homo sapien
agacaatgtcccgtgctgcgacccg

SEQ ID NO: 95075 - DNA, 25 bp, Homo sapien
gcttggagacaatgtcccgtgctgc

SEQ ID NO: 95076 - DNA, 25 bp, Homo sapien
ttgtccgggatgcacaggccgcctg

SEQ ID NO: 95077 - DNA, 25 bp, Homo sapien
cgttgtccgggatgcacaggccgcc

SEQ ID NO: 95078 - DNA, 25 bp, Homo sapien
gcgacccctcagagcgacaccgctt

SEQ ID NO: 95079 - DNA, 25 bp, Homo sapien
gccgctgggctgaagcgcctgcggc

SEQ ID NO: 95080 - DNA, 25 bp, Homo sapien
tggagacaatgtcccgtgctgcgac

SEQ ID NO: 95081 - DNA, 25 bp, Homo sapien
gggaacgaactaacgcgctgcagtg

SEQ ID NO: 95082 - DNA, 25 bp, Homo sapien
ctcagtgatcctggcgggaaagacc

SEQ ID NO: 95083 - DNA, 25 bp, Homo sapien
gcacggtcatgctcagcctcagtga

SEQ ID NO: 95084 - DNA, 25 bp, Homo sapien
gcagacatccaactcgccagcagga

SEQ ID NO: 95085 - DNA, 25 bp, Homo sapien
actccagctgagcaagcgtcttctc

SEQ ID NO: 95086 - DNA, 25 bp, Homo sapien
cccaggagctgacgctattcggttt

SEQ ID NO: 95087 - DNA, 25 bp, Homo sapien
gcagtgtcgggaaacacggcccaca

SEQ ID NO: 95088 - DNA, 25 bp, Homo sapien
agaaattcttcgcacacccaccagg

SEQ ID NO: 95089 - DNA, 25 bp, Homo sapien
ctgcgctgagcatctgcggacgcct

SEQ ID NO: 95090 - DNA, 25 bp, Homo sapien
tgcgctgagcatctgcggacgcctc

SEQ ID NO: 95091 - DNA, 25 bp, Homo sapien
gcgctgagcatctgcggacgcctcc

SEQ ID NO: 95092 - DNA, 25 bp, Homo sapien
tgagcatctgcggacgcctccgtgg

SEQ ID NO: 95093 - DNA, 25 bp, Homo sapien
agcatctgcggacgcctccgtgggt

SEQ ID NO: 95094 - DNA, 25 bp, Homo sapien
tctgcggacgcctccgtgggtgacg

SEQ ID NO: 95095 - DNA, 25 bp, Homo sapien
atctgcggacgcctccgtgggtgac

SEQ ID NO: 95096 - DNA, 25 bp, Homo sapien
gctgcgctgagcatctgcggacgcc

SEQ ID NO: 95097 - DNA, 25 bp, Homo sapien
cctgtcttcggtttaggctcaggcg

SEQ ID NO: 95098 - DNA, 25 bp, Homo sapien
ccctgtcttcggtttaggctcaggc

SEQ ID NO: 95099 - DNA, 25 bp, Homo sapien
ctgtcttcggtttaggctcaggcgg

SEQ ID NO: 95100 - DNA, 25 bp, Homo sapien
gccctgtcttcggtttaggctcagg

SEQ ID NO: 95101 - DNA, 25 bp, Homo sapien
gggcagctgcctgaacgcgcacagc

SEQ ID NO: 95102 - DNA, 25 bp, Homo sapien
gcagctgcctgaacgcgcacagcgg

SEQ ID NO: 95103 - DNA, 25 bp, Homo sapien
gcctgaacgcgcacagcggctcctg

SEQ ID NO: 95104 - DNA, 25 bp, Homo sapien
gtcttcggtttaggctcaggcggaa

SEQ ID NO: 95105 - DNA, 25 bp, Homo sapien
tgtctccttacggttgagggctggc

SEQ ID NO: 95106 - DNA, 25 bp, Homo sapien
gttggtgaggacgaacctgtgtccc

SEQ ID NO: 95107 - DNA, 25 bp, Homo sapien
caaagtccctcccagatggtgagtg

SEQ ID NO: 95108 - DNA, 25 bp, Homo sapien
gtggcctgtcttctctttcatgcta

SEQ ID NO: 95109 - DNA, 25 bp, Homo sapien
tgctattacaatgggctccactggc

SEQ ID NO: 95110 - DNA, 25 bp, Homo sapien
gctccactggctgcatcttgttaca

SEQ ID NO: 95111 - DNA, 25 bp, Homo sapien
gcatcttgttacattgtgtcacatc

SEQ ID NO: 95112 - DNA, 25 bp, Homo sapien
gtcacatcatgagacactaagatcc

SEQ ID NO: 95113 - DNA, 25 bp, Homo sapien
cgactaagtgcggactcctggcctc

SEQ ID NO: 95114 - DNA, 25 bp, Homo sapien
cttctgggcttttgctccaactctc

SEQ ID NO: 95115 - DNA, 25 bp, Homo sapien
tgggacagacacttctctctcgcgc

SEQ ID NO: 95116 - DNA, 25 bp, Homo sapien
ctcgtgggcggtagatgcagccaac

SEQ ID NO: 95117 - DNA, 25 bp, Homo sapien
tgcagccaacgcgtccgtcaaagcg

SEQ ID NO: 95118 - DNA, 25 bp, Homo sapien
gcagtgggcccgaccgagcctcagt

SEQ ID NO: 95119 - DNA, 25 bp, Homo sapien
gccaagccagggattccgctgtgcc

SEQ ID NO: 95120 - DNA, 25 bp, Homo sapien
tccgtcaaagcggttcaggggcgct

SEQ ID NO: 95121 - DNA, 25 bp, Homo sapien
tttataaagctcaaggccacacggc

SEQ ID NO: 95122 - DNA, 25 bp, Homo sapien
gccgagtcattgtcgattgtgctga

SEQ ID NO: 95123 - DNA, 25 bp, Homo sapien
acccattgtgccgatgcgtcattga

SEQ ID NO: 95124 - DNA, 25 bp, Homo sapien
tcgatcctaatggtctgtcaaagcc

SEQ ID NO: 95125 - DNA, 25 bp, Homo sapien
acaggttgaagcgatgtccgatttc

SEQ ID NO: 95126 - DNA, 25 bp, Homo sapien
tgcccaggactggacaacaggttga

SEQ ID NO: 95127 - DNA, 25 bp, Homo sapien
tcattgaaagttacacgcgtgccca

SEQ ID NO: 95128 - DNA, 25 bp, Homo sapien
cacacggcagcggaagagcagtcct

SEQ ID NO: 95129 - DNA, 25 bp, Homo sapien
ctccctgatctgcttacctaacaga

SEQ ID NO: 95130 - DNA, 25 bp, Homo sapien
tgcttacctaacagacctcggacgg

SEQ ID NO: 95131 - DNA, 25 bp, Homo sapien
tgctcgccggctgtgttgttaaaca

SEQ ID NO: 95132 - DNA, 25 bp, Homo sapien
ctcgccggctgtgttgttaaacatc

SEQ ID NO: 95133 - DNA, 25 bp, Homo sapien
ccggctgtgttgttaaacatcttca

SEQ ID NO: 95134 - DNA, 25 bp, Homo sapien
gttaaacatcttcatgcaccagccc

SEQ ID NO: 95135 - DNA, 25 bp, Homo sapien
gagtgctcgggttcagaccgagtca

SEQ ID NO: 95136 - DNA, 25 bp, Homo sapien
ctcgggttcagaccgagtcagggtc

SEQ ID NO: 95137 - DNA, 25 bp, Homo sapien
ccctgcatttctttcccgcggttga

SEQ ID NO: 95138 - DNA, 25 bp, Homo sapien
gcccacgcgaattcctaggcgtacg

SEQ ID NO: 95139 - DNA, 25 bp, Homo sapien
cccgtcaggaggcactcttggggaa

SEQ ID NO: 95140 - DNA, 25 bp, Homo sapien
gggaatcgcgcagccatacaacttt

SEQ ID NO: 95141 - DNA, 25 bp, Homo sapien
atacaactttagagctggccttggc

SEQ ID NO: 95142 - DNA, 25 bp, Homo sapien
ttggctgggagaggaaaatccatct

SEQ ID NO: 95143 - DNA, 25 bp, Homo sapien
tgaccctgactctgttagtgcctga

SEQ ID NO: 95144 - DNA, 25 bp, Homo sapien
aatccatctgaactcacccggaatg

SEQ ID NO: 95145 - DNA, 25 bp, Homo sapien
cctggtcgcttttccaccgaatgtc

SEQ ID NO: 95146 - DNA, 25 bp, Homo sapien
tggtcgcttttccaccgaatgtccg

SEQ ID NO: 95147 - DNA, 25 bp, Homo sapien
ccctggtcgcttttccaccgaatgt

SEQ ID NO: 95148 - DNA, 25 bp, Homo sapien
tccctggtcgcttttccaccgaatg

SEQ ID NO: 95149 - DNA, 25 bp, Homo sapien
ctggtcgcttttccaccgaatgtcc

SEQ ID NO: 95150 - DNA, 25 bp, Homo sapien
tgtccctggtcgcttttccaccgaa

SEQ ID NO: 95151 - DNA, 25 bp, Homo sapien
ggcgccttctgtccctggtcgcttt

SEQ ID NO: 95152 - DNA, 25 bp, Homo sapien
tggcggcgccttctgtccctggtcg

SEQ ID NO: 95153 - DNA, 25 bp, Homo sapien
tgcttgtttggggaaagcggaaaca

SEQ ID NO: 95154 - DNA, 25 bp, Homo sapien
ttttctcgcctcaagagccgccagg

SEQ ID NO: 95155 - DNA, 25 bp, Homo sapien
tctccagggtgcttgtttggggaaa

SEQ ID NO: 95156 - DNA, 25 bp, Homo sapien
ctgttaaaatgtcagcagccaagga

SEQ ID NO: 95157 - DNA, 25 bp, Homo sapien
aatgtcagcagccaaggaagaagca

SEQ ID NO: 95158 - DNA, 25 bp, Homo sapien
agaagcagcgacctggcgtctgctc

SEQ ID NO: 95159 - DNA, 25 bp, Homo sapien
tctgctcgggccaggtgacctttat

SEQ ID NO: 95160 - DNA, 25 bp, Homo sapien
tctcgcctcaagagccgccaggtgg

SEQ ID NO: 95161 - DNA, 25 bp, Homo sapien
agagcttgcggcgttgcccgacacc

SEQ ID NO: 95162 - DNA, 25 bp, Homo sapien
caatctggcgctcagagcttgcggc

SEQ ID NO: 95163 - DNA, 25 bp, Homo sapien
ggcaatctggcgctcagagcttgcg

SEQ ID NO: 95164 - DNA, 25 bp, Homo sapien
ccggggcaatctggcgctcagagct

SEQ ID NO: 95165 - DNA, 25 bp, Homo sapien
agcagcggcagacggttctccggcc

SEQ ID NO: 95166 - DNA, 25 bp, Homo sapien
cgaagcagcggcagacggttctccg

SEQ ID NO: 95167 - DNA, 25 bp, Homo sapien
gcgaagcagcggcagacggttctcc

SEQ ID NO: 95168 - DNA, 25 bp, Homo sapien
ccggcgggcgcacagacggtcccca

SEQ ID NO: 95169 - DNA, 25 bp, Homo sapien
ctggtaacacagaggcggagtaaac

SEQ ID NO: 95170 - DNA, 25 bp, Homo sapien
gcggagtaaacgcacattaaggagc

SEQ ID NO: 95171 - DNA, 25 bp, Homo sapien
acgcacattaaggagcgccggcccg

SEQ ID NO: 95172 - DNA, 25 bp, Homo sapien
ccgcgtgcccttatctgcatgtgca

SEQ ID NO: 95173 - DNA, 25 bp, Homo sapien
gcatgtgcaggtcggctagatccat

SEQ ID NO: 95174 - DNA, 25 bp, Homo sapien
ggtcggctagatccatcactgcagg

SEQ ID NO: 95175 - DNA, 25 bp, Homo sapien
tagatccatcactgcaggggcggcc

SEQ ID NO: 95176 - DNA, 25 bp, Homo sapien
cggaccgcgcgctgaaatgcagccg

SEQ ID NO: 95177 - DNA, 25 bp, Homo sapien
gcagaacgagtctccaagtgccgcg

SEQ ID NO: 95178 - DNA, 25 bp, Homo sapien
gcctgggtgcagaacgagtctccaa

SEQ ID NO: 95179 - DNA, 25 bp, Homo sapien
tggcctttgccgatggacctcgggt

SEQ ID NO: 95180 - DNA, 25 bp, Homo sapien
tgggtgcagaacgagtctccaagtg

SEQ ID NO: 95181 - DNA, 25 bp, Homo sapien
tccagacccagcctgtgtgcagagg

SEQ ID NO: 95182 - DNA, 25 bp, Homo sapien
ctcgctggcctttgccgatggacct

SEQ ID NO: 95183 - DNA, 25 bp, Homo sapien
tccaagtgccgcgtgagcgagggtg

SEQ ID NO: 95184 - DNA, 25 bp, Homo sapien
tgccgatggacctcgggtgtgtcca

SEQ ID NO: 95185 - DNA, 25 bp, Homo sapien
ggggtctccatcacggctgtatctc

SEQ ID NO: 95186 - DNA, 25 bp, Homo sapien
cccacgctcactaatgcctagatag

SEQ ID NO: 95187 - DNA, 25 bp, Homo sapien
cagacagcaggcactaggacagatg

SEQ ID NO: 95188 - DNA, 25 bp, Homo sapien
tatctccctcggaggtcgggtagca

SEQ ID NO: 95189 - DNA, 25 bp, Homo sapien
tcttctgatccattagcggggtctc

SEQ ID NO: 95190 - DNA, 25 bp, Homo sapien
tgtcgcatgatccatccggtgcctc

SEQ ID NO: 95191 - DNA, 25 bp, Homo sapien
gcacccgcatttccgtgtcgcatga

SEQ ID NO: 95192 - DNA, 25 bp, Homo sapien
gctggcatatcgtgcggataaactg

SEQ ID NO: 95193 - DNA, 25 bp, Homo sapien
gcgtcagggcgcaatgccgcctgct

SEQ ID NO: 95194 - DNA, 25 bp, Homo sapien
cccacacggctgcttttaggccagg

SEQ ID NO: 95195 - DNA, 25 bp, Homo sapien
cgacgggaaacagagtcaggacaca

SEQ ID NO: 95196 - DNA, 25 bp, Homo sapien
agcggcgcctcagatccagcaggga

SEQ ID NO: 95197 - DNA, 25 bp, Homo sapien
acgtaacgtgacgtgacgtgacgtg

SEQ ID NO: 95198 - DNA, 25 bp, Homo sapien
tgaaggcaccaagcacggcagacgc

SEQ ID NO: 95199 - DNA, 25 bp, Homo sapien
acagagcctggaaccgcggccaagg

SEQ ID NO: 95200 - DNA, 25 bp, Homo sapien
tggctgtgaaggaccctcgtcactc

SEQ ID NO: 95201 - DNA, 25 bp, Homo sapien
tggcgacgaccctggtcagacttcc

SEQ ID NO: 95202 - DNA, 25 bp, Homo sapien
accctggtcagacttccaggagcgc

SEQ ID NO: 95203 - DNA, 25 bp, Homo sapien
ccctgcgggtaaagtcacatgtacg

SEQ ID NO: 95204 - DNA, 25 bp, Homo sapien
aagtcacatgtacgctctgttctgg

SEQ ID NO: 95205 - DNA, 25 bp, Homo sapien
tctgttctgggctcagcaaccgagt

SEQ ID NO: 95206 - DNA, 25 bp, Homo sapien
tcagcaaccgagtcgtaggagagac

SEQ ID NO: 95207 - DNA, 25 bp, Homo sapien
gccacgaagcagctcacaccgaggg

SEQ ID NO: 95208 - DNA, 25 bp, Homo sapien
ttggccacgaagcagctcacaccga

SEQ ID NO: 95209 - DNA, 25 bp, Homo sapien
tgcctctgaccaccacgtttgctgg

SEQ ID NO: 95210 - DNA, 25 bp, Homo sapien
cctgcctgtccgctaaataagaacc

SEQ ID NO: 95211 - DNA, 25 bp, Homo sapien
ttccagtctcgtctgctaagcagtt

SEQ ID NO: 95212 - DNA, 25 bp, Homo sapien
acgcttgccttgaacgaggagaatg

SEQ ID NO: 95213 - DNA, 25 bp, Homo sapien
tactaggctttgttgcagaaatccc

SEQ ID NO: 95214 - DNA, 25 bp, Homo sapien
ggaccggaggttttcatgtgcattc

SEQ ID NO: 95215 - DNA, 25 bp, Homo sapien
cgtttgctgggacatctttgggacc

SEQ ID NO: 95216 - DNA, 25 bp, Homo sapien
accactgggtactcctaatcgctga

SEQ ID NO: 95217 - DNA, 25 bp, Homo sapien
agcattttcccaggcagccggtcgt

SEQ ID NO: 95218 - DNA, 25 bp, Homo sapien
aggcagtcctgagtcagcaggaccc

SEQ ID NO: 95219 - DNA, 25 bp, Homo sapien
cattttcccaggcagccggtcgtca

SEQ ID NO: 95220 - DNA, 25 bp, Homo sapien
ttttcccaggcagccggtcgtcatc

SEQ ID NO: 95221 - DNA, 25 bp, Homo sapien
caggcagccggtcgtcatcctcctc

SEQ ID NO: 95222 - DNA, 25 bp, Homo sapien
tgcgccctctcacgaggcgctgggg

SEQ ID NO: 95223 - DNA, 25 bp, Homo sapien
cctggtgcggaaggatttacaggga

SEQ ID NO: 95224 - DNA, 25 bp, Homo sapien
tttacagggaaggaatgtcgggctc

SEQ ID NO: 95225 - DNA, 25 bp, Homo sapien
ccgaggtcacgtaggcaaggtcaaa

SEQ ID NO: 95226 - DNA, 25 bp, Homo sapien
tcacgtaggcaaggtcaaaggacga

SEQ ID NO: 95227 - DNA, 25 bp, Homo sapien
tcacgtagggaaggtcaaaggacga

SEQ ID NO: 95228 - DNA, 25 bp, Homo sapien
caaaggacgatgtggcggttgcagg

SEQ ID NO: 95229 - DNA, 25 bp, Homo sapien
cgtaggcaaggtcaaaggacgatgt

SEQ ID NO: 95230 - DNA, 25 bp, Homo sapien
cacgtaggcaaggtcaaaggacgat

SEQ ID NO: 95231 - DNA, 25 bp, Homo sapien
gtcaaaggacgatgtggcggttgca

SEQ ID NO: 95232 - DNA, 25 bp, Homo sapien
acccgaggtcacgtaggcaaggtca

SEQ ID NO: 95233 - DNA, 25 bp, Homo sapien
ccagggctgcatttattgctggaca

SEQ ID NO: 95234 - DNA, 25 bp, Homo sapien
tggggccatcacgtaggcaaggtca

SEQ ID NO: 95235 - DNA, 25 bp, Homo sapien
ctgacgacgtccttagggtccctga

SEQ ID NO: 95236 - DNA, 25 bp, Homo sapien
ctggacatttgtcacggtctgagcc

SEQ ID NO: 95237 - DNA, 25 bp, Homo sapien
cgtgaagaagccaccgggaatcatg

SEQ ID NO: 95238 - DNA, 25 bp, Homo sapien
gcaactgcaaggactcgcgtgaaga

SEQ ID NO: 95239 - DNA, 25 bp, Homo sapien
ggacgatttctctccgaccgaagga

SEQ ID NO: 95240 - DNA, 25 bp, Homo sapien
cggctttgcacgcaagctgtatttt

SEQ ID NO: 95241 - DNA, 25 bp, Homo sapien
cacgacggaaactcagtctggctca

SEQ ID NO: 95242 - DNA, 25 bp, Homo sapien
gcctgttcccgacgctacgaaaagc

SEQ ID NO: 95243 - DNA, 25 bp, Homo sapien
gcctggttcaaagtgctgtgcctga

SEQ ID NO: 95244 - DNA, 25 bp, Homo sapien
gaccttggcgcttgagcatgcacga

SEQ ID NO: 95245 - DNA, 25 bp, Homo sapien
ccagatgcgcggcttagcctccagg

SEQ ID NO: 95246 - DNA, 25 bp, Homo sapien
gggtcgaagtcgtccaagtcactaa

SEQ ID NO: 95247 - DNA, 25 bp, Homo sapien
ccgtccaccattatgaggcctgttc

SEQ ID NO: 95248 - DNA, 25 bp, Homo sapien
ttctgagactggttaccggggagtc

SEQ ID NO: 95249 - DNA, 25 bp, Homo sapien
cagccagttccaccaagatccgggg

SEQ ID NO: 95250 - DNA, 25 bp, Homo sapien
ggggtccacgcctcgattttcagtg

SEQ ID NO: 95251 - DNA, 25 bp, Homo sapien
gggagcccatttcctgcggctaaga

SEQ ID NO: 95252 - DNA, 25 bp, Homo sapien
cctgttcccttgtcgagcctgaata

SEQ ID NO: 95253 - DNA, 25 bp, Homo sapien
tgctgctgtcagactcgcttaatga

SEQ ID NO: 95254 - DNA, 25 bp, Homo sapien
ccctccttggtgtgtttgaattcgc

SEQ ID NO: 95255 - DNA, 25 bp, Homo sapien
gagccgtatatctcccgcgcctgtt

SEQ ID NO: 95256 - DNA, 25 bp, Homo sapien
ccgacttcggaattgtcctgcctga

SEQ ID NO: 95257 - DNA, 25 bp, Homo sapien
gccgagcctagtgagtccctccaag

SEQ ID NO: 95258 - DNA, 25 bp, Homo sapien
aagtacgagttctgggtctcacacc

SEQ ID NO: 95259 - DNA, 25 bp, Homo sapien
ggacacggctctgggaatttagaaa

SEQ ID NO: 95260 - DNA, 25 bp, Homo sapien
gccggctttccgagcagagctgatt

SEQ ID NO: 95261 - DNA, 25 bp, Homo sapien
gcggcctgtgaagctctgagcattt

SEQ ID NO: 95262 - DNA, 25 bp, Homo sapien
agcccggatttctgagcgtagccac

SEQ ID NO: 95263 - DNA, 25 bp, Homo sapien
agacagtcctgcgtctccggctatc

SEQ ID NO: 95264 - DNA, 25 bp, Homo sapien
cttgggttgaaccagctgcttttgg

SEQ ID NO: 95265 - DNA, 25 bp, Homo sapien
tcgtctgcgcacttgttccgcggcg

SEQ ID NO: 95266 - DNA, 25 bp, Homo sapien
gggccgcttctcgtctgcgcacttg

SEQ ID NO: 95267 - DNA, 25 bp, Homo sapien
tccgcggcggccacgtcatcttgtt

SEQ ID NO: 95268 - DNA, 25 bp, Homo sapien
gcggcggccacgtcatcttgttctc

SEQ ID NO: 95269 - DNA, 25 bp, Homo sapien
tctcgtctgcgcacttgttccgcgg

SEQ ID NO: 95270 - DNA, 25 bp, Homo sapien
gtctgcgcacttgttccgcggcggc

SEQ ID NO: 95271 - DNA, 25 bp, Homo sapien
gccgcttctcgtctgcgcacttgtt

SEQ ID NO: 95272 - DNA, 25 bp, Homo sapien
ttctcgtctgcgcacttgttccgcg

SEQ ID NO: 95273 - DNA, 25 bp, Homo sapien
acacgttgtccttgggctgttgagg

SEQ ID NO: 95274 - DNA, 25 bp, Homo sapien
ccagccgccgaacgccgcggccaca

SEQ ID NO: 95275 - DNA, 25 bp, Homo sapien
gtccttgtggggacactgcgaagcc

SEQ ID NO: 95276 - DNA, 25 bp, Homo sapien
ggacactgcgaagccggtcccagac

SEQ ID NO: 95277 - DNA, 25 bp, Homo sapien
tgcgaagccggtcccagacatccag

SEQ ID NO: 95278 - DNA, 25 bp, Homo sapien
ccgcgcttacctgggctggccgcct

SEQ ID NO: 95279 - DNA, 25 bp, Homo sapien
agcgggctgcacctagccgcggagc

SEQ ID NO: 95280 - DNA, 25 bp, Homo sapien
cgccacacacgttgtccttgggctg

SEQ ID NO: 95281 - DNA, 25 bp, Homo sapien
aaacgcccgcgatactgtcagagac

SEQ ID NO: 95282 - DNA, 25 bp, Homo sapien
cagatcaagaagacgggaacagcac

SEQ ID NO: 95283 - DNA, 25 bp, Homo sapien
cccgcgatactgtcagagacggaga

SEQ ID NO: 95284 - DNA, 25 bp, Homo sapien
caaacgcccgcgatactgtcagaga

SEQ ID NO: 95285 - DNA, 25 bp, Homo sapien
aagacgggaacagcacgaggcactg

SEQ ID NO: 95286 - DNA, 25 bp, Homo sapien
gaagacgggaacagcacgaggcact

SEQ ID NO: 95287 - DNA, 25 bp, Homo sapien
aacgcccgcgatactgtcagagacg

SEQ ID NO: 95288 - DNA, 25 bp, Homo sapien
acgcccgcgatactgtcagagacgg

SEQ ID NO: 95289 - DNA, 25 bp, Homo sapien
ttgcagcaaacgcagcggcctctgg

SEQ ID NO: 95290 - DNA, 25 bp, Homo sapien
gagcccggaaatagccacccttgtc

SEQ ID NO: 95291 - DNA, 25 bp, Homo sapien
tttggccaaacgctaagctcgctgc

SEQ ID NO: 95292 - DNA, 25 bp, Homo sapien
ggcgcgcgagccagatttggccaaa

SEQ ID NO: 95293 - DNA, 25 bp, Homo sapien
gggaggtcacacagccctaacagga

SEQ ID NO: 95294 - DNA, 25 bp, Homo sapien
ccggcgacaactaatggagacattt

SEQ ID NO: 95295 - DNA, 25 bp, Homo sapien
cccttaagcgcaagagcaatcctcg

SEQ ID NO: 95296 - DNA, 25 bp, Homo sapien
gcctagcgacgggtagcaaactttg

SEQ ID NO: 95297 - DNA, 25 bp, Homo sapien
cctccgagccgtaggtcacgtagtt

SEQ ID NO: 95298 - DNA, 25 bp, Homo sapien
gcccgtcggattttcttagcgcctc

SEQ ID NO: 95299 - DNA, 25 bp, Homo sapien
acccaggccttgctagctcggaagc

SEQ ID NO: 95300 - DNA, 25 bp, Homo sapien
tttccaaggcctctgacgccatttg

SEQ ID NO: 95301 - DNA, 25 bp, Homo sapien
ctttccactagcttgtgcgcgtctg

SEQ ID NO: 95302 - DNA, 25 bp, Homo sapien
tggtggccatcaagaactgcagaga

SEQ ID NO: 95303 - DNA, 25 bp, Homo sapien
cagcctgagccttgtggttcaaaca

SEQ ID NO: 95304 - DNA, 25 bp, Homo sapien
cgtagttgccatagccctgcgatcc

SEQ ID NO: 95305 - DNA, 25 bp, Homo sapien
acgagttctccgatcgcgttggacc

SEQ ID NO: 95306 - DNA, 25 bp, Homo sapien
cctgctcttttgacagctcggttga

SEQ ID NO: 95307 - DNA, 25 bp, Homo sapien
cctctgggctctagtgcaacagctc

SEQ ID NO: 95308 - DNA, 25 bp, Homo sapien
agccgctccatgcaaattattcaga

SEQ ID NO: 95309 - DNA, 25 bp, Homo sapien
ttagcgtcggtagccgcgagaaata

SEQ ID NO: 95310 - DNA, 25 bp, Homo sapien
gtggcttgtcctttcctcacctata

SEQ ID NO: 95311 - DNA, 25 bp, Homo sapien
gacctgaggctggtgcatttccttc

SEQ ID NO: 95312 - DNA, 25 bp, Homo sapien
ccaccggggtttctcgctagaaatg

SEQ ID NO: 95313 - DNA, 25 bp, Homo sapien
gaggaatcttggatcgcccgaggct

SEQ ID NO: 95314 - DNA, 25 bp, Homo sapien
gcttcgtttggaatgtgcctttgcc

SEQ ID NO: 95315 - DNA, 25 bp, Homo sapien
ctgagtcaaaaagggatcgcgcgca

SEQ ID NO: 95316 - DNA, 25 bp, Homo sapien
ccacgaagcgcagacacaggaggtt

SEQ ID NO: 95317 - DNA, 25 bp, Homo sapien
gtcagtgctgcggagaatcccagac

SEQ ID NO: 95318 - DNA, 25 bp, Homo sapien
tgggactcccgaaggccttaccaga

SEQ ID NO: 95319 - DNA, 25 bp, Homo sapien
cccgtagacttgattggcaggccct

SEQ ID NO: 95320 - DNA, 25 bp, Homo sapien
gagggccgtttctgtccgtccacac

SEQ ID NO: 95321 - DNA, 25 bp, Homo sapien
cacgtgactgatgaattccgggccc

SEQ ID NO: 95322 - DNA, 25 bp, Homo sapien
atgcccacactgaatccgtgcaggg

SEQ ID NO: 95323 - DNA, 25 bp, Homo sapien
aagttgtgccgagtgtctgccaccc

SEQ ID NO: 95324 - DNA, 25 bp, Homo sapien
ttcgcatcaggtgacaagttgtgcc

SEQ ID NO: 95325 - DNA, 25 bp, Homo sapien
tagccctggcgagtgtttcgcatca

SEQ ID NO: 95326 - DNA, 25 bp, Homo sapien
gtcacacgggactggcttagccctg

SEQ ID NO: 95327 - DNA, 25 bp, Homo sapien
ctgctcagctgtggacacggagctc

SEQ ID NO: 95328 - DNA, 25 bp, Homo sapien
ctgccttctcgggagtcacacggga

SEQ ID NO: 95329 - DNA, 25 bp, Homo sapien
ggcagcttcacgacctcaccaagtg

SEQ ID NO: 95330 - DNA, 25 bp, Homo sapien
agtcaccatgcgctctgaaacagcc

SEQ ID NO: 95331 - DNA, 25 bp, Homo sapien
cccggggacatgcagagtcaccatg

SEQ ID NO: 95332 - DNA, 25 bp, Homo sapien
gcaaagatggatggcgtagtctcta

SEQ ID NO: 95333 - DNA, 25 bp, Homo sapien
aagtgcccgccgctctcacgagaga

SEQ ID NO: 95334 - DNA, 25 bp, Homo sapien
cgcattgaatatgcttgggagaggc

SEQ ID NO: 95335 - DNA, 25 bp, Homo sapien
tcacacccagtgctgagcgcgagtc

SEQ ID NO: 95336 - DNA, 25 bp, Homo sapien
ggtggttatggttgcgcattgaata

SEQ ID NO: 95337 - DNA, 25 bp, Homo sapien
acaatgaatgttggagagcctctcc

SEQ ID NO: 95338 - DNA, 25 bp, Homo sapien
taccggcagcgtctgaaattccagc

SEQ ID NO: 95339 - DNA, 25 bp, Homo sapien
ggggtctccgtttccatgaaactga

SEQ ID NO: 95340 - DNA, 25 bp, Homo sapien
tgaacgacacgcagcctctgactcg

SEQ ID NO: 95341 - DNA, 25 bp, Homo sapien
ggctgtcttgggattttcctttcaa

SEQ ID NO: 95342 - DNA, 25 bp, Homo sapien
agtccgtttgtctgtctcttgttta

SEQ ID NO: 95343 - DNA, 25 bp, Homo sapien
tcagcctgagggaaacgtgttccca

SEQ ID NO: 95344 - DNA, 25 bp, Homo sapien
cagttgccttcaagcagtccgtttg

SEQ ID NO: 95345 - DNA, 25 bp, Homo sapien
ctggcgtgcggctgtgaatgcttct

SEQ ID NO: 95346 - DNA, 25 bp, Homo sapien
gattgcgtgaacttgcttcctggcg

SEQ ID NO: 95347 - DNA, 25 bp, Homo sapien
ttgcgtgaacttgcttcctggcgtg

SEQ ID NO: 95348 - DNA, 25 bp, Homo sapien
tgcttcctggcgtgcggctgtgaat

SEQ ID NO: 95349 - DNA, 25 bp, Homo sapien
tgcggctgtgaatgcttctcggctc

SEQ ID NO: 95350 - DNA, 25 bp, Homo sapien
gctgtgaatgcttctcggctcgcct

SEQ ID NO: 95351 - DNA, 25 bp, Homo sapien
gtgaatgcttctcggctcgcctggc

SEQ ID NO: 95352 - DNA, 25 bp, Homo sapien
tgaacttgcttcctggcgtgcggct

SEQ ID NO: 95353 - DNA, 25 bp, Homo sapien
ccaacaggtggcacaaacgcatttg

SEQ ID NO: 95354 - DNA, 25 bp, Homo sapien
cggagccaacaggtggcacaaacgc

SEQ ID NO: 95355 - DNA, 25 bp, Homo sapien
acccgagtctgggtcaagccatggc

SEQ ID NO: 95356 - DNA, 25 bp, Homo sapien
aggatctgacccgagtctgggtcaa

SEQ ID NO: 95357 - DNA, 25 bp, Homo sapien
tttgacttgggcatcgatcgccgcg

SEQ ID NO: 95358 - DNA, 25 bp, Homo sapien
aacgcatttgacttgggcatcgatc

SEQ ID NO: 95359 - DNA, 25 bp, Homo sapien
aggtggcacaaacgcatttgacttg

SEQ ID NO: 95360 - DNA, 25 bp, Homo sapien
aggcgcagtgctcttctctccgcgg

SEQ ID NO: 95361 - DNA, 25 bp, Homo sapien
tctggcttgagctgaacaacttaac

SEQ ID NO: 95362 - DNA, 25 bp, Homo sapien
aagcccatggctcagaacaccgaga

SEQ ID NO: 95363 - DNA, 25 bp, Homo sapien
gccgccttttgaaagccggagtgca

SEQ ID NO: 95364 - DNA, 25 bp, Homo sapien
gcgcggggcgtaatgaaccctaata

SEQ ID NO: 95365 - DNA, 25 bp, Homo sapien
cgggtgccctccaaattagccacaa

SEQ ID NO: 95366 - DNA, 25 bp, Homo sapien
ttccgccgcggagattacttgttgt

SEQ ID NO: 95367 - DNA, 25 bp, Homo sapien
attgatcgcctccttgcattgtgtg

SEQ ID NO: 95368 - DNA, 25 bp, Homo sapien
ttagccacaaagaagccagtctgtc

SEQ ID NO: 95369 - DNA, 25 bp, Homo sapien
gtgcatgagtggacagaggtgaccg

SEQ ID NO: 95370 - DNA, 25 bp, Homo sapien
taggcattgcttgcgtgggtgggca

SEQ ID NO: 95371 - DNA, 25 bp, Homo sapien
acagaggtgactaggcattgcttgc

SEQ ID NO: 95372 - DNA, 25 bp, Homo sapien
ggacagaggtgactaggcattgctt

SEQ ID NO: 95373 - DNA, 25 bp, Homo sapien
ggcagaagtgactgggcgtgcgtgt

SEQ ID NO: 95374 - DNA, 25 bp, Homo sapien
accgggtccacgtgcgtgcctggac

SEQ ID NO: 95375 - DNA, 25 bp, Homo sapien
tggacagacgtgactaggcgcgagt

SEQ ID NO: 95376 - DNA, 25 bp, Homo sapien
tggacagaagtgactaggcacgtgc

SEQ ID NO: 95377 - DNA, 25 bp, Homo sapien
ggggtacgtgccctgcaacatccta

SEQ ID NO: 95378 - DNA, 25 bp, Homo sapien
tgcaacatcctaggcgaggcgcgac

SEQ ID NO: 95379 - DNA, 25 bp, Homo sapien
ctcatgcagcacatggacgaggtca

SEQ ID NO: 95380 - DNA, 25 bp, Homo sapien
caacgacgagctcatccggaaaatc

SEQ ID NO: 95381 - DNA, 25 bp, Homo sapien
atcagcaacatcagggcgcagccac

SEQ ID NO: 95382 - DNA, 25 bp, Homo sapien
tcacctacgagtcgggtccggacga

SEQ ID NO: 95383 - DNA, 25 bp, Homo sapien
ttctccctcaacaaggaggagctga

SEQ ID NO: 95384 - DNA, 25 bp, Homo sapien
caggatcgtggagaacctgggcatc

SEQ ID NO: 95385 - DNA, 25 bp, Homo sapien
cacggcaggagagctccacgcggcc

SEQ ID NO: 95386 - DNA, 25 bp, Homo sapien
ccaccttcacggcaggagagctcca

SEQ ID NO: 95387 - DNA, 25 bp, Homo sapien
ttcacggcaggagagctccacgcgg

SEQ ID NO: 95388 - DNA, 25 bp, Homo sapien
tcacggcaggagagctccacgcggc

SEQ ID NO: 95389 - DNA, 25 bp, Homo sapien
acggcaggagagctccacgcggccc

SEQ ID NO: 95390 - DNA, 25 bp, Homo sapien
accttcacggcaggagagctccacg

SEQ ID NO: 95391 - DNA, 25 bp, Homo sapien
cttcacggcaggagagctccacgcg

SEQ ID NO: 95392 - DNA, 25 bp, Homo sapien
ccttcacggcaggagagctccacgc

SEQ ID NO: 95393 - DNA, 25 bp, Homo sapien
ccggagcgtggactccacgtggccc

SEQ ID NO: 95394 - DNA, 25 bp, Homo sapien
cgtgaacataccggccagcagacac

SEQ ID NO: 95395 - DNA, 25 bp, Homo sapien
tcccggagcgtggactccacgtggc

SEQ ID NO: 95396 - DNA, 25 bp, Homo sapien
tgaacataccggccagcagacacct

SEQ ID NO: 95397 - DNA, 25 bp, Homo sapien
ataccggccagcagacacctcgggg

SEQ ID NO: 95398 - DNA, 25 bp, Homo sapien
taccggccagcagacacctcggggg

SEQ ID NO: 95399 - DNA, 25 bp, Homo sapien
cagcagacacctcgggggcgagagg

SEQ ID NO: 95400 - DNA, 25 bp, Homo sapien
gggcgagagggtggcacccacctcc

SEQ ID NO: 95401 - DNA, 25 bp, Homo sapien
agaacgcgtgcccattctcaggtgt

SEQ ID NO: 95402 - DNA, 25 bp, Homo sapien
cgttaggcagaacgcgtgcccattc

SEQ ID NO: 95403 - DNA, 25 bp, Homo sapien
aacgcgtgcccattctcaggtgtgc

SEQ ID NO: 95404 - DNA, 25 bp, Homo sapien
cacacgtgtgccgtgcgcctcagaa

SEQ ID NO: 95405 - DNA, 25 bp, Homo sapien
ccattctcaggtgtgctcggcgtgt

SEQ ID NO: 95406 - DNA, 25 bp, Homo sapien
acacgtgtgccgtgcgcctcagaag

SEQ ID NO: 95407 - DNA, 25 bp, Homo sapien
ggcagaacgcgtgcccattctcagg

SEQ ID NO: 95408 - DNA, 25 bp, Homo sapien
attctcaggtgtgctcggcgtgtgt

SEQ ID NO: 95409 - DNA, 25 bp, Homo sapien
gcactacagctggcggtaatgcagg

SEQ ID NO: 95410 - DNA, 25 bp, Homo sapien
gagcactacagctggcggtaatgca

SEQ ID NO: 95411 - DNA, 25 bp, Homo sapien
agggagcactacagctggcggtaat

SEQ ID NO: 95412 - DNA, 25 bp, Homo sapien
ggcggtaacgcagggagcactacag

SEQ ID NO: 95413 - DNA, 25 bp, Homo sapien
cggctggcggtaacgcagggagcac

SEQ ID NO: 95414 - DNA, 25 bp, Homo sapien
agcactacagctggcggtaatgcag

SEQ ID NO: 95415 - DNA, 25 bp, Homo sapien
ggagcactacagctggcggtaatgc

SEQ ID NO: 95416 - DNA, 25 bp, Homo sapien
ctggcggtaacgcagggagcactac

SEQ ID NO: 95417 - DNA, 25 bp, Homo sapien
cttgatgaccagctgggagtgtctc

SEQ ID NO: 95418 - DNA, 25 bp, Homo sapien
tccgagcttaggtcaaagcaaaggc

SEQ ID NO: 95419 - DNA, 25 bp, Homo sapien
caggagtctccgagcttaggtcaaa

SEQ ID NO: 95420 - DNA, 25 bp, Homo sapien
accagctgggagtgtctctgtcgct

SEQ ID NO: 95421 - DNA, 25 bp, Homo sapien
cagggcaagtgtgtcttgatgacca

SEQ ID NO: 95422 - DNA, 25 bp, Homo sapien
cgttcccagggcaagtgtgtcttga

SEQ ID NO: 95423 - DNA, 25 bp, Homo sapien
gatgccggcgacgttcccagggcaa

SEQ ID NO: 95424 - DNA, 25 bp, Homo sapien
cctgcccaggagtctccgagcttag

SEQ ID NO: 95425 - DNA, 25 bp, Homo sapien
aagcggcgtcgaaaactcatgaaca

SEQ ID NO: 95426 - DNA, 25 bp, Homo sapien
tcaggctgacttcagggtctcggtc

SEQ ID NO: 95427 - DNA, 25 bp, Homo sapien
agccaccaccttggggccgcagaag

SEQ ID NO: 95428 - DNA, 25 bp, Homo sapien
acctgcgactgttcggttctcccga

SEQ ID NO: 95429 - DNA, 25 bp, Homo sapien
ccgactggccttggtcgttgccttt

SEQ ID NO: 95430 - DNA, 25 bp, Homo sapien
ctcggtgtgaccaactaagcagaca

SEQ ID NO: 95431 - DNA, 25 bp, Homo sapien
cgagcgcagcagaaatacggtgtgc

SEQ ID NO: 95432 - DNA, 25 bp, Homo sapien
caggcaggacccgaaacaggagaga

SEQ ID NO: 95433 - DNA, 25 bp, Homo sapien
cagagccgagttccttaaagggatc

SEQ ID NO: 95434 - DNA, 25 bp, Homo sapien
tggcagccttagttcctcaacagga

SEQ ID NO: 95435 - DNA, 25 bp, Homo sapien
tcacccggcataccgtggaaacggc

SEQ ID NO: 95436 - DNA, 25 bp, Homo sapien
agggtgcccacaatcctgaattctc

SEQ ID NO: 95437 - DNA, 25 bp, Homo sapien
gcctccgacgtgcttcctgaagttt

SEQ ID NO: 95438 - DNA, 25 bp, Homo sapien
ccggcatcctttagcgctctgcaaa

SEQ ID NO: 95439 - DNA, 25 bp, Homo sapien
ttaactgccctgttttcagctccgg

SEQ ID NO: 95440 - DNA, 25 bp, Homo sapien
gggacctcgtattcagctaaccagc

SEQ ID NO: 95441 - DNA, 25 bp, Homo sapien
cacgagtgatccgtgagcgagtcca

SEQ ID NO: 95442 - DNA, 25 bp, Homo sapien
ccgcagagttgtaccgcaggagacc

SEQ ID NO: 95443 - DNA, 25 bp, Homo sapien
agcgccgcgttcaagttcccgtagt

SEQ ID NO: 95444 - DNA, 25 bp, Homo sapien
agcggcgcctccaagccggtaagcg

SEQ ID NO: 95445 - DNA, 25 bp, Homo sapien
tcgtcgtcctccaggtcgtcatact

SEQ ID NO: 95446 - DNA, 25 bp, Homo sapien
gtcatacttgtccttgcactccgag

SEQ ID NO: 95447 - DNA, 25 bp, Homo sapien
actccgagcccgattcgcacagggg

SEQ ID NO: 95448 - DNA, 25 bp, Homo sapien
aggaatcgctcgctcaaatcccggc

SEQ ID NO: 95449 - DNA, 25 bp, Homo sapien
tgcagtgggcattacaggtagctca

SEQ ID NO: 95450 - DNA, 25 bp, Homo sapien
gccgggtccaattaggggactcaca

SEQ ID NO: 95451 - DNA, 25 bp, Homo sapien
ccctgtgtccaatccggaagtcgca

SEQ ID NO: 95452 - DNA, 25 bp, Homo sapien
ctgaagcctcccagtcacgtcgaga

SEQ ID NO: 95453 - DNA, 25 bp, Homo sapien
gcccactccgaagggtcacctatgg

SEQ ID NO: 95454 - DNA, 25 bp, Homo sapien
agcaggtgcctctatcctcggaagc

SEQ ID NO: 95455 - DNA, 25 bp, Homo sapien
tgctggcctattgggagcacccacc

SEQ ID NO: 95456 - DNA, 25 bp, Homo sapien
ttgcgaattgccaggagggccctga

SEQ ID NO: 95457 - DNA, 25 bp, Homo sapien
tgcaggaggaacgttgtccaaaacg

SEQ ID NO: 95458 - DNA, 25 bp, Homo sapien
aagctgcgctgttttgaggttcaaa

SEQ ID NO: 95459 - DNA, 25 bp, Homo sapien
cgcacggcccacacgtgtttgcaaa

SEQ ID NO: 95460 - DNA, 25 bp, Homo sapien
gctgcatctgtcatcggggaacaca

SEQ ID NO: 95461 - DNA, 25 bp, Homo sapien
ggcgttcatccaaccgcagaagacg

SEQ ID NO: 95462 - DNA, 25 bp, Homo sapien
tgaataatgtattcccaggcactgc

SEQ ID NO: 95463 - DNA, 25 bp, Homo sapien
aaccgcaccgtagggtaatgatgca

SEQ ID NO: 95464 - DNA, 25 bp, Homo sapien
gcagcactgccaaggcgttctgtgg

SEQ ID NO: 95465 - DNA, 25 bp, Homo sapien
catgcacttttcatgcgtcctggca

SEQ ID NO: 95466 - DNA, 25 bp, Homo sapien
gtcctggcaggttcacactgtgctc

SEQ ID NO: 95467 - DNA, 25 bp, Homo sapien
tcggtgccgccatgcacttttcatg

SEQ ID NO: 95468 - DNA, 25 bp, Homo sapien
tttgaaatgatgtttcggtgccgcc

SEQ ID NO: 95469 - DNA, 25 bp, Homo sapien
ctacaaccggaagcgaaatgaaagg

SEQ ID NO: 95470 - DNA, 25 bp, Homo sapien
atggctttgatagcgccaataaccg

SEQ ID NO: 95471 - DNA, 25 bp, Homo sapien
tgcttcttctcagaaatggctttga

SEQ ID NO: 95472 - DNA, 25 bp, Homo sapien
cgcaggagcggtctaaagtgtttac

SEQ ID NO: 95473 - DNA, 25 bp, Homo sapien
ccgtgcttctcctggttcagaagga

SEQ ID NO: 95474 - DNA, 25 bp, Homo sapien
cgtaggggtgatttcactagcgttg

SEQ ID NO: 95475 - DNA, 25 bp, Homo sapien
gtgatttcactagcgttggggcagc

SEQ ID NO: 95476 - DNA, 25 bp, Homo sapien
ggaacccgtgcacgctgcgccagaa

SEQ ID NO: 95477 - DNA, 25 bp, Homo sapien
cgctgcgccagaatcccaggtttct

SEQ ID NO: 95478 - DNA, 25 bp, Homo sapien
ggtcatcttgactctccttggaaaa

SEQ ID NO: 95479 - DNA, 25 bp, Homo sapien
agagccgcactctgagcctgcacgt

SEQ ID NO: 95480 - DNA, 25 bp, Homo sapien
ggttcagaaggacgcggagctctcc

SEQ ID NO: 95481 - DNA, 25 bp, Homo sapien
acccgggtggccctcgtcatagaag

SEQ ID NO: 95482 - DNA, 25 bp, Homo sapien
tgggaccactggtccacgcgatgcc

SEQ ID NO: 95483 - DNA, 25 bp, Homo sapien
cctcgtcatagaaggctgtgttgcc

SEQ ID NO: 95484 - DNA, 25 bp, Homo sapien
ttcaccagccttgaggctgatcctc

SEQ ID NO: 95485 - DNA, 25 bp, Homo sapien
cggcggctttcaccagccttgaggc

SEQ ID NO: 95486 - DNA, 25 bp, Homo sapien
ccgagcttatctgggaccactggtc

SEQ ID NO: 95487 - DNA, 25 bp, Homo sapien
aattggtggccgagcttatctggga

SEQ ID NO: 95488 - DNA, 25 bp, Homo sapien
ccaggaagggttcaggcttggaaat

SEQ ID NO: 95489 - DNA, 25 bp, Homo sapien
agcccgcgtgagcagacaaattacc

SEQ ID NO: 95490 - DNA, 25 bp, Homo sapien
gacgaggcgtctccgctcttaatag

SEQ ID NO: 95491 - DNA, 25 bp, Homo sapien
aggcgtctccgctcttaatagctga

SEQ ID NO: 95492 - DNA, 25 bp, Homo sapien
tgagcagacaaattaccgcggacct

SEQ ID NO: 95493 - DNA, 25 bp, Homo sapien
ttgaagtctttctctgcaacttgga

SEQ ID NO: 95494 - DNA, 25 bp, Homo sapien
cccaacattgaagtctttctctgca

SEQ ID NO: 95495 - DNA, 25 bp, Homo sapien
caaattaccgcggacctgagaggac

SEQ ID NO: 95496 - DNA, 25 bp, Homo sapien
tcttaatagctgagcgcccgcaaac

SEQ ID NO: 95497 - DNA, 25 bp, Homo sapien
cgggcgctgcgtcttaattcaatgt

SEQ ID NO: 95498 - DNA, 25 bp, Homo sapien
tgtcgggctgcaataatgcattact

SEQ ID NO: 95499 - DNA, 25 bp, Homo sapien
atagctaacaagtatgtcgggctgc

SEQ ID NO: 95500 - DNA, 25 bp, Homo sapien
cgaggctgcgtgtataattcaattt

SEQ ID NO: 95501 - DNA, 25 bp, Homo sapien
gttcggtaacgaggctgcgtgtata

SEQ ID NO: 95502 - DNA, 25 bp, Homo sapien
gtgtgcacatggtcgataaactgta

SEQ ID NO: 95503 - DNA, 25 bp, Homo sapien
gccgggccctgaagtgtgtgcacat

SEQ ID NO: 95504 - DNA, 25 bp, Homo sapien
tcaatgttccggcttcagagcagcc

SEQ ID NO: 95505 - DNA, 25 bp, Homo sapien
ctggggactagcaggagctctaatc

SEQ ID NO: 95506 - DNA, 25 bp, Homo sapien
ggagctctaatctcgcgctgcgtca

SEQ ID NO: 95507 - DNA, 25 bp, Homo sapien
gctgaccagtcatccgacgttgcgg

SEQ ID NO: 95508 - DNA, 25 bp, Homo sapien
cactgacctgggcttgtcgagctct

SEQ ID NO: 95509 - DNA, 25 bp, Homo sapien
tctcccgcgagcttatgggaaacgc

SEQ ID NO: 95510 - DNA, 25 bp, Homo sapien
ggacttctcaggcttctcggcccga

SEQ ID NO: 95511 - DNA, 25 bp, Homo sapien
tcagggcttgcctttgaggcccagg

SEQ ID NO: 95512 - DNA, 25 bp, Homo sapien
tcggcccgagggagaaacattttga

SEQ ID NO: 95513 - DNA, 25 bp, Homo sapien
tgtcccaggctctgttctcagcagg

SEQ ID NO: 95514 - DNA, 25 bp, Homo sapien
caatgtccctgtgggcctgtcccag

SEQ ID NO: 95515 - DNA, 25 bp, Homo sapien
aggagaccagtaatgacctctgtcc

SEQ ID NO: 95516 - DNA, 25 bp, Homo sapien
ctctgttctcagcaggctgggctca

SEQ ID NO: 95517 - DNA, 25 bp, Homo sapien
agttaattccagaggcagtggggtt

SEQ ID NO: 95518 - DNA, 25 bp, Homo sapien
catgcactcccagacaggcaatgtc

SEQ ID NO: 95519 - DNA, 25 bp, Homo sapien
cccagccttggcaggagaccagtaa

SEQ ID NO: 95520 - DNA, 25 bp, Homo sapien
ttgctcctgttgtctgtgcagactg

SEQ ID NO: 95521 - DNA, 25 bp, Homo sapien
gccttgcttcgggatggcattgatt

SEQ ID NO: 95522 - DNA, 25 bp, Homo sapien
agcaaccgtctggtgacatcaaata

SEQ ID NO: 95523 - DNA, 25 bp, Homo sapien
caccgctgctgttgttcatattgga

SEQ ID NO: 95524 - DNA, 25 bp, Homo sapien
cggggcgctcattgtagactattct

SEQ ID NO: 95525 - DNA, 25 bp, Homo sapien
gagcctagggaaccatcgagtcgca

SEQ ID NO: 95526 - DNA, 25 bp, Homo sapien
ggactgtctgactattgcctcaatg

SEQ ID NO: 95527 - DNA, 25 bp, Homo sapien
gctacacctgtactgagagaattta

SEQ ID NO: 95528 - DNA, 25 bp, Homo sapien
ggtgcgaagtcctagtgcgttttta

SEQ ID NO: 95529 - DNA, 25 bp, Homo sapien
gccttctgggccacgtgccttgggt

SEQ ID NO: 95530 - DNA, 25 bp, Homo sapien
ggagctccgattccgctgcgcagcg

SEQ ID NO: 95531 - DNA, 25 bp, Homo sapien
cccattgccgagcttcgcggggtct

SEQ ID NO: 95532 - DNA, 25 bp, Homo sapien
gaggagctccgattccgctgcgcag

SEQ ID NO: 95533 - DNA, 25 bp, Homo sapien
agcaggaggagctccgattccgctg

SEQ ID NO: 95534 - DNA, 25 bp, Homo sapien
tccggactggatccccggcgctaag

SEQ ID NO: 95535 - DNA, 25 bp, Homo sapien
gcccaagggcttccggactggatcc

SEQ ID NO: 95536 - DNA, 25 bp, Homo sapien
attgccgagcttcgcggggtcttgc

SEQ ID NO: 95537 - DNA, 25 bp, Homo sapien
cgctggtgtcttttcagaggttcca

SEQ ID NO: 95538 - DNA, 25 bp, Homo sapien
ggctctttaaaactccacagatggg

SEQ ID NO: 95539 - DNA, 25 bp, Homo sapien
tttacacttgggctccacggactgc

SEQ ID NO: 95540 - DNA, 25 bp, Homo sapien
accgcgggagtccagagcaaattgc

SEQ ID NO: 95541 - DNA, 25 bp, Homo sapien
tccgggacatcagcatcagtgggtt

SEQ ID NO: 95542 - DNA, 25 bp, Homo sapien
cagcaggcaccttcaggaggctttg

SEQ ID NO: 95543 - DNA, 25 bp, Homo sapien
ttccaaaactgccagcgaggatgtg

SEQ ID NO: 95544 - DNA, 25 bp, Homo sapien
cgactcagcgttgaatgcgtgaaaa

SEQ ID NO: 95545 - DNA, 25 bp, Homo sapien
gcagacgatcggttactacccagta

SEQ ID NO: 95546 - DNA, 25 bp, Homo sapien
acagcatgccgactctggcccgatg

SEQ ID NO: 95547 - DNA, 25 bp, Homo sapien
cgccagagtgcgctgctgaaattcc

SEQ ID NO: 95548 - DNA, 25 bp, Homo sapien
aggcccgtgcacttggcatcttctc

SEQ ID NO: 95549 - DNA, 25 bp, Homo sapien
gttcgcgcgttccacacaagtttcc

SEQ ID NO: 95550 - DNA, 25 bp, Homo sapien
tgcacacctggtggacaaaccgggc

SEQ ID NO: 95551 - DNA, 25 bp, Homo sapien
gcgggatttgccctcgctcaaagtt

SEQ ID NO: 95552 - DNA, 25 bp, Homo sapien
tccaggatacgggtggctcaaacca

SEQ ID NO: 95553 - DNA, 25 bp, Homo sapien
ctcgagtccattgaagcggctgctt

SEQ ID NO: 95554 - DNA, 25 bp, Homo sapien
gggcagttcctgaagtcagctcatg

SEQ ID NO: 95555 - DNA, 25 bp, Homo sapien
ccactgtcggtgaaagggcagttcc

SEQ ID NO: 95556 - DNA, 25 bp, Homo sapien
gcactgtttgtggaacttttctaga

SEQ ID NO: 95557 - DNA, 25 bp, Homo sapien
gctctgggccctttacgtttggaga

SEQ ID NO: 95558 - DNA, 25 bp, Homo sapien
ggctcccagcccttgcgttaatatt

SEQ ID NO: 95559 - DNA, 25 bp, Homo sapien
gctagtgtttgctccctccagatca

SEQ ID NO: 95560 - DNA, 25 bp, Homo sapien
gaggcctaggatactgaaccggttc

SEQ ID NO: 95561 - DNA, 25 bp, Homo sapien
aagaagccagctcggtttctgcgtg

SEQ ID NO: 95562 - DNA, 25 bp, Homo sapien
tctgcgtgcgtgtttatgatctacc

SEQ ID NO: 95563 - DNA, 25 bp, Homo sapien
cagccctttcgatgagggaagaagc

SEQ ID NO: 95564 - DNA, 25 bp, Homo sapien
tgacgccaaggtcggtgaaatcttc

SEQ ID NO: 95565 - DNA, 25 bp, Homo sapien
cgccctcaggcagaacgcaatggtg

SEQ ID NO: 95566 - DNA, 25 bp, Homo sapien
tttatccagagtcccgagcgcaatg

SEQ ID NO: 95567 - DNA, 25 bp, Homo sapien
gcctgaatggtgaccacgcggagtc

SEQ ID NO: 95568 - DNA, 25 bp, Homo sapien
tttatgatctacctgtgagcgcggc

SEQ ID NO: 95569 - DNA, 25 bp, Homo sapien
aagcccgttgagtgtcttcagctga

SEQ ID NO: 95570 - DNA, 25 bp, Homo sapien
gtcggcctatttcactaggaaaatc

SEQ ID NO: 95571 - DNA, 25 bp, Homo sapien
ggccttgggcttgtcggcctatttc

SEQ ID NO: 95572 - DNA, 25 bp, Homo sapien
ggaaaatcagatccggccaccgtgg

SEQ ID NO: 95573 - DNA, 25 bp, Homo sapien
ccaccgtggctaggatgctcgtggc

SEQ ID NO: 95574 - DNA, 25 bp, Homo sapien
agctgcagtgaaaggaagcccgttg

SEQ ID NO: 95575 - DNA, 25 bp, Homo sapien
tgtcttcagctgatgttatcggccg

SEQ ID NO: 95576 - DNA, 25 bp, Homo sapien
cgctcgggaggaatgctaatcgccc

SEQ ID NO: 95577 - DNA, 25 bp, Homo sapien
cgctgtccagcccatggtgggagaa

SEQ ID NO: 95578 - DNA, 25 bp, Homo sapien
cggcaccctgtctgtattgcgtatt

SEQ ID NO: 95579 - DNA, 25 bp, Homo sapien
tgtattgcgtattggcttgctcagc

SEQ ID NO: 95580 - DNA, 25 bp, Homo sapien
tcagctatactgtgtgcatttccta

SEQ ID NO: 95581 - DNA, 25 bp, Homo sapien
ccgcgacgcattgtatttttcctaa

SEQ ID NO: 95582 - DNA, 25 bp, Homo sapien
gccgcgtctgaacgtacctcttctg

SEQ ID NO: 95583 - DNA, 25 bp, Homo sapien
gcagatgaggctccgatcgcactcc

SEQ ID NO: 95584 - DNA, 25 bp, Homo sapien
catttcctaagaaagacggagcagc

SEQ ID NO: 95585 - DNA, 25 bp, Homo sapien
tcatgaccttccacgtacgagggtc

SEQ ID NO: 95586 - DNA, 25 bp, Homo sapien
agggttacgccctcatgaccttccg

SEQ ID NO: 95587 - DNA, 25 bp, Homo sapien
gcgtacgagggttacgccctcatga

SEQ ID NO: 95588 - DNA, 25 bp, Homo sapien
cgccctcatgaccttccgcgtacga

SEQ ID NO: 95589 - DNA, 25 bp, Homo sapien
ccgcgtacgagggttacgccctcat

SEQ ID NO: 95590 - DNA, 25 bp, Homo sapien
gccctcatgaccttccgcgtacgag

SEQ ID NO: 95591 - DNA, 25 bp, Homo sapien
cgcgtacgagggttacgccctcatg

SEQ ID NO: 95592 - DNA, 25 bp, Homo sapien
cctcatgaccttccgcgtacgaggg

SEQ ID NO: 95593 - DNA, 25 bp, Homo sapien
ctccaccttggtgcggtggtggcca

SEQ ID NO: 95594 - DNA, 25 bp, Homo sapien
cacaggcggcgtggttttcctggaa

SEQ ID NO: 95595 - DNA, 25 bp, Homo sapien
agaagactcgcctccaccttggtgc

SEQ ID NO: 95596 - DNA, 25 bp, Homo sapien
gcccgcggaagactcggctctccct

SEQ ID NO: 95597 - DNA, 25 bp, Homo sapien
agcggcgttagtgaatcggggcctt

SEQ ID NO: 95598 - DNA, 25 bp, Homo sapien
ttcctggaacgggtctcagaagact

SEQ ID NO: 95599 - DNA, 25 bp, Homo sapien
ccatggtcaccgctggcggcggaga

SEQ ID NO: 95600 - DNA, 25 bp, Homo sapien
acgggtctcagaagactcgcctcca

SEQ ID NO: 95601 - DNA, 25 bp, Homo sapien
ccggaggtccatgctgagcatcgcc

SEQ ID NO: 95602 - DNA, 25 bp, Homo sapien
ctcggagcgctcctggatgaagccc

SEQ ID NO: 95603 - DNA, 25 bp, Homo sapien
ggcagcctctccaactgtgtggtcc

SEQ ID NO: 95604 - DNA, 25 bp, Homo sapien
agccactgcagtagctggagtcccg

SEQ ID NO: 95605 - DNA, 25 bp, Homo sapien
gcctttaaaggcaggtccgcggctc

SEQ ID NO: 95606 - DNA, 25 bp, Homo sapien
ccagagcgaggcacgcgcctttaaa

SEQ ID NO: 95607 - DNA, 25 bp, Homo sapien
agcgccgccacatctcggggcaaat

SEQ ID NO: 95608 - DNA, 25 bp, Homo sapien
gcgccgcacggagcttcagtaataa

SEQ ID NO: 95609 - DNA, 25 bp, Homo sapien
tgatggagccatccctcaccgaggt

SEQ ID NO: 95610 - DNA, 25 bp, Homo sapien
tccacatcagatgtggggccgcttc

SEQ ID NO: 95611 - DNA, 25 bp, Homo sapien
ggcacacacacgaccgtggctggga

SEQ ID NO: 95612 - DNA, 25 bp, Homo sapien
gaggtctctttgtccctgcccagct

SEQ ID NO: 95613 - DNA, 25 bp, Homo sapien
ctgcccagctggtccgtggggaact

SEQ ID NO: 95614 - DNA, 25 bp, Homo sapien
gcacacggcgggtgcactatgactc

SEQ ID NO: 95615 - DNA, 25 bp, Homo sapien
tgcactatgactcggagccagtccc

SEQ ID NO: 95616 - DNA, 25 bp, Homo sapien
gggccgcttctatcagagtgatgga

SEQ ID NO: 95617 - DNA, 25 bp, Homo sapien
aaatcacgcactttcctgtcctgga

SEQ ID NO: 95618 - DNA, 25 bp, Homo sapien
ggtggcaataaaggatcgaccctta

SEQ ID NO: 95619 - DNA, 25 bp, Homo sapien
cctgtcgtacagcaaggtggcaata

SEQ ID NO: 95620 - DNA, 25 bp, Homo sapien
tctcaggcgtctggagcttacgtca

SEQ ID NO: 95621 - DNA, 25 bp, Homo sapien
gcgcctatccctctagctgtaaatc

SEQ ID NO: 95622 - DNA, 25 bp, Homo sapien
cagtggtaggaatgcaccttcgatc

SEQ ID NO: 95623 - DNA, 25 bp, Homo sapien
gcgtttctttttagtgcctgaggca

SEQ ID NO: 95624 - DNA, 25 bp, Homo sapien
accgcccacatagcggaggccttta

SEQ ID NO: 95625 - DNA, 25 bp, Homo sapien
tccacggttcgtggtcctcagcgtc

SEQ ID NO: 95626 - DNA, 25 bp, Homo sapien
cctcgagagtgttctgagccttcac

SEQ ID NO: 95627 - DNA, 25 bp, Homo sapien
gaagaacgtcgcacggacgaccctg

SEQ ID NO: 95628 - DNA, 25 bp, Homo sapien
ttcgaaacgacctcatggggcaggc

SEQ ID NO: 95629 - DNA, 25 bp, Homo sapien
tgaaatgcccaggacgaagaacgtc

SEQ ID NO: 95630 - DNA, 25 bp, Homo sapien
cggctggctggtctcacttaaaact

SEQ ID NO: 95631 - DNA, 25 bp, Homo sapien
tcactttacctgttcgggtctacac

SEQ ID NO: 95632 - DNA, 25 bp, Homo sapien
cgcttcctgggaagctcaggatcca

SEQ ID NO: 95633 - DNA, 25 bp, Homo sapien
cccttggaagcgaagctgctgggca

SEQ ID NO: 95634 - DNA, 25 bp, Homo sapien
ggcttaggatttgggatgcaggagc

SEQ ID NO: 95635 - DNA, 25 bp, Homo sapien
ggccctgtgcgtgcgcttccactgg

SEQ ID NO: 95636 - DNA, 25 bp, Homo sapien
tgacccttggaagcgaagctgctgg

SEQ ID NO: 95637 - DNA, 25 bp, Homo sapien
ctcgtgacccttggaagcgaagctg

SEQ ID NO: 95638 - DNA, 25 bp, Homo sapien
tacttggggaagctcgtgacccttg

SEQ ID NO: 95639 - DNA, 25 bp, Homo sapien
cttccactggggaagttgtcccctg

SEQ ID NO: 95640 - DNA, 25 bp, Homo sapien
gcaggagcttcctctaggggtgcgc

SEQ ID NO: 95641 - DNA, 25 bp, Homo sapien
cgtttgagaaccaatcactgagctg

SEQ ID NO: 95642 - DNA, 25 bp, Homo sapien
gagccggtcccaacacgaacgtgga

SEQ ID NO: 95643 - DNA, 25 bp, Homo sapien
gagagctctcacctgccctcgagga

SEQ ID NO: 95644 - DNA, 25 bp, Homo sapien
cgaccacttcgatttcaccggaatg

SEQ ID NO: 95645 - DNA, 25 bp, Homo sapien
tggcggtgacacctgccagcttcag

SEQ ID NO: 95646 - DNA, 25 bp, Homo sapien
cagcctcgctttgctggcgcacaga

SEQ ID NO: 95647 - DNA, 25 bp, Homo sapien
gaggagcacgcagcagcatttcctg

SEQ ID NO: 95648 - DNA, 25 bp, Homo sapien
ctcgagtggggctacagttccacct

SEQ ID NO: 95649 - DNA, 25 bp, Homo sapien
gggccgccactcacagcttttggtt

SEQ ID NO: 95650 - DNA, 25 bp, Homo sapien
ccaggtgctcctctaggtggtcaaa

SEQ ID NO: 95651 - DNA, 25 bp, Homo sapien
cacagcttttggttgagcccggcct

SEQ ID NO: 95652 - DNA, 25 bp, Homo sapien
gccctctgaacacagccaggaaagg

SEQ ID NO: 95653 - DNA, 25 bp, Homo sapien
ttccgtccggacagatacgacttcc

SEQ ID NO: 95654 - DNA, 25 bp, Homo sapien
tcactgacgatgatgccgagctgcc

SEQ ID NO: 95655 - DNA, 25 bp, Homo sapien
ccgagctgccgaatgttctccacga

SEQ ID NO: 95656 - DNA, 25 bp, Homo sapien
aggtggtcaaacttctccgccatcg

SEQ ID NO: 95657 - DNA, 25 bp, Homo sapien
catgaaggagaccaacaccgagttc

SEQ ID NO: 95658 - DNA, 25 bp, Homo sapien
cgtctctctggtatcggtctctgcc

SEQ ID NO: 95659 - DNA, 25 bp, Homo sapien
gcgccagcaacactgcacgcaggtg

SEQ ID NO: 95660 - DNA, 25 bp, Homo sapien
ttagcgaccgcttcatctccgtgga

SEQ ID NO: 95661 - DNA, 25 bp, Homo sapien
ttcgactggaacgtgaagctgcacc

SEQ ID NO: 95662 - DNA, 25 bp, Homo sapien
cgcctacaccgtggaggccgtcatg

SEQ ID NO: 95663 - DNA, 25 bp, Homo sapien
ggcgccatctgcatggagctgctca

SEQ ID NO: 95664 - DNA, 25 bp, Homo sapien
tggacgagagcctgttcgactggaa

SEQ ID NO: 95665 - DNA, 25 bp, Homo sapien
gcacctgcacgcctaggagggcgca

SEQ ID NO: 95666 - DNA, 25 bp, Homo sapien
cgtctggtcttttttattcactgca

SEQ ID NO: 95667 - DNA, 25 bp, Homo sapien
ctgcatattaaggtgcgtgcggcct

SEQ ID NO: 95668 - DNA, 25 bp, Homo sapien
cctggactaggcctgagcgcctcaa

SEQ ID NO: 95669 - DNA, 25 bp, Homo sapien
tttgaagggcgccagttcccagccg

SEQ ID NO: 95670 - DNA, 25 bp, Homo sapien
ggcaacctgcaaagacctcacgtca

SEQ ID NO: 95671 - DNA, 25 bp, Homo sapien
cgtcacagaaacttgcggcgtttgc

SEQ ID NO: 95672 - DNA, 25 bp, Homo sapien
ggggacctcgacaacagcgcctttg

SEQ ID NO: 95673 - DNA, 25 bp, Homo sapien
agcgcacaacccgtctttcagaaaa

SEQ ID NO: 95674 - DNA, 25 bp, Homo sapien
cgtctttcagaaaagcggcgtgaca

SEQ ID NO: 95675 - DNA, 25 bp, Homo sapien
cggcgtgacagggaaaacagcgaac

SEQ ID NO: 95676 - DNA, 25 bp, Homo sapien
cagcgaacagctctaaggggaaaaa

SEQ ID NO: 95677 - DNA, 25 bp, Homo sapien
caggaagcagccacaaaggcgtctc

SEQ ID NO: 95678 - DNA, 25 bp, Homo sapien
gtctccgcgcgaagcgcccaggttt

SEQ ID NO: 95679 - DNA, 25 bp, Homo sapien
cccggagaagcctgacttgagaacc

SEQ ID NO: 95680 - DNA, 25 bp, Homo sapien
cgtccaggaataagcccaaagcgca

SEQ ID NO: 95681 - DNA, 25 bp, Homo sapien
gtgactccatgcagtacgtgctcta

SEQ ID NO: 95682 - DNA, 25 bp, Homo sapien
gtctataacccgcacgaggcctgct

SEQ ID NO: 95683 - DNA, 25 bp, Homo sapien
aggcctgctccctgaacctggtgga

SEQ ID NO: 95684 - DNA, 25 bp, Homo sapien
ggcatcctgctgagctgcatgatcg

SEQ ID NO: 95685 - DNA, 25 bp, Homo sapien
ctgcatgatcgctgagatggccatc

SEQ ID NO: 95686 - DNA, 25 bp, Homo sapien
atggccatcatctggctgagcatgc

SEQ ID NO: 95687 - DNA, 25 bp, Homo sapien
tgctcttcggcctggtctataaccc

SEQ ID NO: 95688 - DNA, 25 bp, Homo sapien
cctgtgacaggtttgtgatcctgtc

SEQ ID NO: 95689 - DNA, 25 bp, Homo sapien
agtcagtaatggctcaacgccaccg

SEQ ID NO: 95690 - DNA, 25 bp, Homo sapien
cgcatgtctgcacgccggggtctgc

SEQ ID NO: 95691 - DNA, 25 bp, Homo sapien
cccaacgccggcctagtcagtaatg

SEQ ID NO: 95692 - DNA, 25 bp, Homo sapien
tcgccgccgagagtgtcttttcacc

SEQ ID NO: 95693 - DNA, 25 bp, Homo sapien
tttgaaatcggtcgcgcgtgcgcac

SEQ ID NO: 95694 - DNA, 25 bp, Homo sapien
taaccacggcggcagtgtctagtga

SEQ ID NO: 95695 - DNA, 25 bp, Homo sapien
cagtcgcgtagcttctgacgccgtc

SEQ ID NO: 95696 - DNA, 25 bp, Homo sapien
gtgacaccggccctagcgcgcatgt

SEQ ID NO: 95697 - DNA, 25 bp, Homo sapien
ccctgtgatgatgatgtgtcggcta

SEQ ID NO: 95698 - DNA, 25 bp, Homo sapien
tccaagtgtgctttgagaaggcctc

SEQ ID NO: 95699 - DNA, 25 bp, Homo sapien
cccgaggcagcagttctccaagtgt

SEQ ID NO: 95700 - DNA, 25 bp, Homo sapien
tcggctagatccacacagacctttt

SEQ ID NO: 95701 - DNA, 25 bp, Homo sapien
cacatcttcgtgatgctggcgcgca

SEQ ID NO: 95702 - DNA, 25 bp, Homo sapien
ccgacggctgatgtgagtatgttct

SEQ ID NO: 95703 - DNA, 25 bp, Homo sapien
tgaaagacctttggccgacggctga

SEQ ID NO: 95704 - DNA, 25 bp, Homo sapien
cagaccttttctcgttggcccgagg

SEQ ID NO: 95705 - DNA, 25 bp, Homo sapien
ccgccgctgatcactctgcatgttt

SEQ ID NO: 95706 - DNA, 25 bp, Homo sapien
ctgcatgtttcttcgtgtggtggtc

SEQ ID NO: 95707 - DNA, 25 bp, Homo sapien
gtggtcgcgtccatcttcaagaaca

SEQ ID NO: 95708 - DNA, 25 bp, Homo sapien
agctcgttgtgctcatctgtgaagc

SEQ ID NO: 95709 - DNA, 25 bp, Homo sapien
tgtgaagccttattaaacgtggacg

SEQ ID NO: 95710 - DNA, 25 bp, Homo sapien
gtggacgttgttttctgccttccca

SEQ ID NO: 95711 - DNA, 25 bp, Homo sapien
ggacgtgaacatgcgcttgcggttt

SEQ ID NO: 95712 - DNA, 25 bp, Homo sapien
ttgaggtagccgtgtctgttccttc

SEQ ID NO: 95713 - DNA, 25 bp, Homo sapien
gctctgccgatgttttccgcccaca

SEQ ID NO: 95714 - DNA, 25 bp, Homo sapien
ttagaccaccgagggtccagagtgg

SEQ ID NO: 95715 - DNA, 25 bp, Homo sapien
ggtgccttagaccaccgagggtcca

SEQ ID NO: 95716 - DNA, 25 bp, Homo sapien
gcctctgggtgccttagaccaccga

SEQ ID NO: 95717 - DNA, 25 bp, Homo sapien
tcagccgcctctgggtgccttagac

SEQ ID NO: 95718 - DNA, 25 bp, Homo sapien
gagtccaaggctcccagtcagccgc

SEQ ID NO: 95719 - DNA, 25 bp, Homo sapien
tctacgcgctgctccgagtccaagg

SEQ ID NO: 95720 - DNA, 25 bp, Homo sapien
cccgaggcaggacacactccaccgc

SEQ ID NO: 95721 - DNA, 25 bp, Homo sapien
aagtatcccgccttctgcttgtgtg

SEQ ID NO: 95722 - DNA, 25 bp, Homo sapien
atcccgccttctgcttgtgtgggtt

SEQ ID NO: 95723 - DNA, 25 bp, Homo sapien
ctgcagaaacagtaaagtatcccgc

SEQ ID NO: 95724 - DNA, 25 bp, Homo sapien
caggccgaggacgatgatcccgccg

SEQ ID NO: 95725 - DNA, 25 bp, Homo sapien
cttcctcctcaggacgccggtctcc

SEQ ID NO: 95726 - DNA, 25 bp, Homo sapien
cccgcccgttcctggcttcctcgat

SEQ ID NO: 95727 - DNA, 25 bp, Homo sapien
acgggatcccgcgtgacgagtgttt

SEQ ID NO: 95728 - DNA, 25 bp, Homo sapien
ttgtgtgggttgttgcacccatgga

SEQ ID NO: 95729 - DNA, 25 bp, Homo sapien
cgcccgtggcgcagcctcgggtctc

SEQ ID NO: 95730 - DNA, 25 bp, Homo sapien
cgccttgagattggccataagcgcc

SEQ ID NO: 95731 - DNA, 25 bp, Homo sapien
cttgagattggccataagcgccggt

SEQ ID NO: 95732 - DNA, 25 bp, Homo sapien
ttgagattggccataagcgccggtg

SEQ ID NO: 95733 - DNA, 25 bp, Homo sapien
tgagattggccataagcgccggtgg

SEQ ID NO: 95734 - DNA, 25 bp, Homo sapien
agattggccataagcgccggtggcg

SEQ ID NO: 95735 - DNA, 25 bp, Homo sapien
ccgtggcgcagcctcgggtctctct

SEQ ID NO: 95736 - DNA, 25 bp, Homo sapien
gagattggccataagcgccggtggc

SEQ ID NO: 95737 - DNA, 25 bp, Homo sapien
tctgacccgcgtactaaaggaggga

SEQ ID NO: 95738 - DNA, 25 bp, Homo sapien
ggctggacggcaaaccggtgcccac

SEQ ID NO: 95739 - DNA, 25 bp, Homo sapien
gctgtcctctgacccgcgtactaaa

SEQ ID NO: 95740 - DNA, 25 bp, Homo sapien
cctgcccgctgaccttgaggtagtg

SEQ ID NO: 95741 - DNA, 25 bp, Homo sapien
ccttaggctgtgttctcacttcgta

SEQ ID NO: 95742 - DNA, 25 bp, Homo sapien
ctgtgttctcacttcgtagcgggga

SEQ ID NO: 95743 - DNA, 25 bp, Homo sapien
cccacgctgcactcgggatagggca

SEQ ID NO: 95744 - DNA, 25 bp, Homo sapien
gctacctgcgggaccgctccgagga

SEQ ID NO: 95745 - DNA, 25 bp, Homo sapien
cctgagctgtactctttggggccca

SEQ ID NO: 95746 - DNA, 25 bp, Homo sapien
tgctgtcccgacagagccactgtgc

SEQ ID NO: 95747 - DNA, 25 bp, Homo sapien
cttctccgaagagcaccgggtccta

SEQ ID NO: 95748 - DNA, 25 bp, Homo sapien
gcaccgggtcctatctgagcattcc

SEQ ID NO: 95749 - DNA, 25 bp, Homo sapien
tgatcgcagctaagacacccattcg

SEQ ID NO: 95750 - DNA, 25 bp, Homo sapien
ctgacactggtagtcgcctgagctg

SEQ ID NO: 95751 - DNA, 25 bp, Homo sapien
ttctttccttgctagcctgggcctg

SEQ ID NO: 95752 - DNA, 25 bp, Homo sapien
acatcctcgtcccaggggttcagct

SEQ ID NO: 95753 - DNA, 25 bp, Homo sapien
gcggtagtagtagctgtgctctttg

SEQ ID NO: 95754 - DNA, 25 bp, Homo sapien
tcgactacacctggggtctctcctt

SEQ ID NO: 95755 - DNA, 25 bp, Homo sapien
gtcgttgcctggaaaccgccgcctg

SEQ ID NO: 95756 - DNA, 25 bp, Homo sapien
tctgtgttcggtcgttgcctggaaa

SEQ ID NO: 95757 - DNA, 25 bp, Homo sapien
cgtctagcccgcgtctgtgttcggt

SEQ ID NO: 95758 - DNA, 25 bp, Homo sapien
caggcctcaggttgctcagcgccag

SEQ ID NO: 95759 - DNA, 25 bp, Homo sapien
cccagtcggagtctgcaggcctcag

SEQ ID NO: 95760 - DNA, 25 bp, Homo sapien
cgtggacgcggtggtctcctcctcg

SEQ ID NO: 95761 - DNA, 25 bp, Homo sapien
gcaacacgtgtgtgcaagacagaca

SEQ ID NO: 95762 - DNA, 25 bp, Homo sapien
gcgcaatgtgattggcccaggtccc

SEQ ID NO: 95763 - DNA, 25 bp, Homo sapien
ttctattggtcctgggtaccgagca

SEQ ID NO: 95764 - DNA, 25 bp, Homo sapien
cgccctgcactaatctcctgggaga

SEQ ID NO: 95765 - DNA, 25 bp, Homo sapien
ggggtctctcctcatgttctgcctt

SEQ ID NO: 95766 - DNA, 25 bp, Homo sapien
tgcctttggttctaggcgctttcca

SEQ ID NO: 95767 - DNA, 25 bp, Homo sapien
gccaggtctttgacacccagccgga

SEQ ID NO: 95768 - DNA, 25 bp, Homo sapien
tccaggcctagggaaaccgcactcg

SEQ ID NO: 95769 - DNA, 25 bp, Homo sapien
cctgagctcgcgcactgagctgctg

SEQ ID NO: 95770 - DNA, 25 bp, Homo sapien
ggccacctcttctacattgaccctg

SEQ ID NO: 95771 - DNA, 25 bp, Homo sapien
gacagcctgtccaagcactcacagg

SEQ ID NO: 95772 - DNA, 25 bp, Homo sapien
cgcccagtcctcaggtgctggaatt

SEQ ID NO: 95773 - DNA, 25 bp, Homo sapien
agtccctgtacagcttcgactcgcg

SEQ ID NO: 95774 - DNA, 25 bp, Homo sapien
ctctcggacactgagtccctgtaca

SEQ ID NO: 95775 - DNA, 25 bp, Homo sapien
tccacgctgtgctggagcgtgatga

SEQ ID NO: 95776 - DNA, 25 bp, Homo sapien
ggtgctggaattcgccgagttcatc

SEQ ID NO: 95777 - DNA, 25 bp, Homo sapien
tcctattggtcccaggtgtcgagca

SEQ ID NO: 95778 - DNA, 25 bp, Homo sapien
cacggccctcttcgagatgaaagta

SEQ ID NO: 95779 - DNA, 25 bp, Homo sapien
tcgagcatgcgcactttggtcgtgg

SEQ ID NO: 95780 - DNA, 25 bp, Homo sapien
ccctcggaccgagattcctattggt

SEQ ID NO: 95781 - DNA, 25 bp, Homo sapien
cgcgcacgcgtaacacgaggagaca

SEQ ID NO: 95782 - DNA, 25 bp, Homo sapien
ccatcctaagggactggcgttccag

SEQ ID NO: 95783 - DNA, 25 bp, Homo sapien
tgtggtcgttccgagcttccacctg

SEQ ID NO: 95784 - DNA, 25 bp, Homo sapien
gggctctttggctctagacgctttc

SEQ ID NO: 95785 - DNA, 25 bp, Homo sapien
acagaccagtgtgcgcacctttccg

SEQ ID NO: 95786 - DNA, 25 bp, Homo sapien
cagcccgtgcactagctcaactgtg

SEQ ID NO: 95787 - DNA, 25 bp, Homo sapien
gcacaggcgggtacacaaacttcca

SEQ ID NO: 95788 - DNA, 25 bp, Homo sapien
ctgctgatggatcccacccgagatc

SEQ ID NO: 95789 - DNA, 25 bp, Homo sapien
ccctactcgctgagttccagaatgg

SEQ ID NO: 95790 - DNA, 25 bp, Homo sapien
caaagttgggtgtccaagccagctc

SEQ ID NO: 95791 - DNA, 25 bp, Homo sapien
gccttcccggcaagtagatcggcgc

SEQ ID NO: 95792 - DNA, 25 bp, Homo sapien
cggtcgtcctaatcctgtacgcgca

SEQ ID NO: 95793 - DNA, 25 bp, Homo sapien
tactgtctggcgtgaaattagtctc

SEQ ID NO: 95794 - DNA, 25 bp, Homo sapien
ggcgccctttcctcatcatcaagga

SEQ ID NO: 95795 - DNA, 25 bp, Homo sapien
agtagaaacataagtcccgcgcgtc

SEQ ID NO: 95796 - DNA, 25 bp, Homo sapien
attccggttgttgcaccatggcgtc

SEQ ID NO: 95797 - DNA, 25 bp, Homo sapien
cgaaggccgccgattccagaagata

SEQ ID NO: 95798 - DNA, 25 bp, Homo sapien
cttgggacccactatcgagaaacta

SEQ ID NO: 95799 - DNA, 25 bp, Homo sapien
cgcgagatttccaacagcgttttta

SEQ ID NO: 95800 - DNA, 25 bp, Homo sapien
gggaccctcgccttcgatgaatatg

SEQ ID NO: 95801 - DNA, 25 bp, Homo sapien
ggacaacgtatcacttttatgaaag

SEQ ID NO: 95802 - DNA, 25 bp, Homo sapien
tcagcttctgaaaacggactatggg

SEQ ID NO: 95803 - DNA, 25 bp, Homo sapien
tgggaagttccttacccgtgcacgc

SEQ ID NO: 95804 - DNA, 25 bp, Homo sapien
cgtgcacgcggcaaagaccttcttt

SEQ ID NO: 95805 - DNA, 25 bp, Homo sapien
ttgccatagtcagaacacacgcggg

SEQ ID NO: 95806 - DNA, 25 bp, Homo sapien
gctgctgttctgcaaggacaacgta

SEQ ID NO: 95807 - DNA, 25 bp, Homo sapien
gaccagtggctccagtcgtagcctc

SEQ ID NO: 95808 - DNA, 25 bp, Homo sapien
tcgtagcctcctgggagagccaagc

SEQ ID NO: 95809 - DNA, 25 bp, Homo sapien
ttcctgcacgctcttagcgccagag

SEQ ID NO: 95810 - DNA, 25 bp, Homo sapien
cccgggcactcatgtctagaaaaaa

SEQ ID NO: 95811 - DNA, 25 bp, Homo sapien
gcttgcggttcgtctgctccaacga

SEQ ID NO: 95812 - DNA, 25 bp, Homo sapien
gaagccaagcatattcgaactccga

SEQ ID NO: 95813 - DNA, 25 bp, Homo sapien
ggagctctttcaagcttcctgcacg

SEQ ID NO: 95814 - DNA, 25 bp, Homo sapien
actcgtgacaccaaaggagctcttt

SEQ ID NO: 95815 - DNA, 25 bp, Homo sapien
tggttggtctgcaacactgcccaga

SEQ ID NO: 95816 - DNA, 25 bp, Homo sapien
acccacgaattcagggcgctgagtc

SEQ ID NO: 95817 - DNA, 25 bp, Homo sapien
ggtcggggaagcctcgatgagaggc

SEQ ID NO: 95818 - DNA, 25 bp, Homo sapien
cggggaagcctcgatgagaggccgg

SEQ ID NO: 95819 - DNA, 25 bp, Homo sapien
gcctcgatgagaggccgggtggtca

SEQ ID NO: 95820 - DNA, 25 bp, Homo sapien
tcagggaaggctcgatgagaggcag

SEQ ID NO: 95821 - DNA, 25 bp, Homo sapien
tcggggaagcctcgatgagaggccg

SEQ ID NO: 95822 - DNA, 25 bp, Homo sapien
gtcagggaaggctcgatgagaggcc

SEQ ID NO: 95823 - DNA, 25 bp, Homo sapien
agccttgatgagaggccgggtggtc

SEQ ID NO: 95824 - DNA, 25 bp, Homo sapien
gtcggggaagcctcgatgagaggcc

SEQ ID NO: 95825 - DNA, 25 bp, Homo sapien
acacggagtccacccgggcagtcag

SEQ ID NO: 95826 - DNA, 25 bp, Homo sapien
tggaggccctcagtcacggagtcca

SEQ ID NO: 95827 - DNA, 25 bp, Homo sapien
gtcagtcacggagtccacccgggca

SEQ ID NO: 95828 - DNA, 25 bp, Homo sapien
agacacggagtccacccgggcagtc

SEQ ID NO: 95829 - DNA, 25 bp, Homo sapien
tcacggagtccacccgggcagtcag

SEQ ID NO: 95830 - DNA, 25 bp, Homo sapien
cacccgggcagtcagcgactgagga

SEQ ID NO: 95831 - DNA, 25 bp, Homo sapien
agtcagcgactgaggaagagcgccc

SEQ ID NO: 95832 - DNA, 25 bp, Homo sapien
ggaggccctcagtcacggagtccac

SEQ ID NO: 95833 - DNA, 25 bp, Homo sapien
gtccttctgcctattgctcgccagg

SEQ ID NO: 95834 - DNA, 25 bp, Homo sapien
tttgtctttctttacgtccttctgc

SEQ ID NO: 95835 - DNA, 25 bp, Homo sapien
agcggaaggtgaccctctgcgcgcc

SEQ ID NO: 95836 - DNA, 25 bp, Homo sapien
cagacaagatggacaccgcggagga

SEQ ID NO: 95837 - DNA, 25 bp, Homo sapien
gtgtcgctcgctttctgtcagcctc

SEQ ID NO: 95838 - DNA, 25 bp, Homo sapien
tcagctcctgattaggtttcggccc

SEQ ID NO: 95839 - DNA, 25 bp, Homo sapien
gggcctttgtctcgcacgtcggctg

SEQ ID NO: 95840 - DNA, 25 bp, Homo sapien
gcgggagctaggttctcgcagcctc

SEQ ID NO: 95841 - DNA, 25 bp, Homo sapien
cacattcggcggtgggaaaccgatc

SEQ ID NO: 95842 - DNA, 25 bp, Homo sapien
gcagttggtccgaatttctcccgaa

SEQ ID NO: 95843 - DNA, 25 bp, Homo sapien
ccttctgcggagagcgatgccgctt

SEQ ID NO: 95844 - DNA, 25 bp, Homo sapien
gacaccatgttctgcgctcagcaga

SEQ ID NO: 95845 - DNA, 25 bp, Homo sapien
gctgccggacatcctgaagcaattc

SEQ ID NO: 95846 - DNA, 25 bp, Homo sapien
gagctgtccggtctacatgcccaag

SEQ ID NO: 95847 - DNA, 25 bp, Homo sapien
gagtccttcgtgagttcgccgctca

SEQ ID NO: 95848 - DNA, 25 bp, Homo sapien
ccgaagatgcttttgtaggcgaaac

SEQ ID NO: 95849 - DNA, 25 bp, Homo sapien
ctgctcctctgaagcggcgggagaa

SEQ ID NO: 95850 - DNA, 25 bp, Homo sapien
cccgctgactacgaagagtttgagg

SEQ ID NO: 95851 - DNA, 25 bp, Homo sapien
ctcgggttcggcttctttagtgatt

SEQ ID NO: 95852 - DNA, 25 bp, Homo sapien
agtgattgcttctgcttctcccgcg

SEQ ID NO: 95853 - DNA, 25 bp, Homo sapien
tggctctgaactctggccaggaagg

SEQ ID NO: 95854 - DNA, 25 bp, Homo sapien
ctcgctcagcctccggagacttttt

SEQ ID NO: 95855 - DNA, 25 bp, Homo sapien
ccggagacttttttctttgagcgca

SEQ ID NO: 95856 - DNA, 25 bp, Homo sapien
gaggacttctcgagtctgccagaca

SEQ ID NO: 95857 - DNA, 25 bp, Homo sapien
cccgcaagcctaggactgcccagcg

SEQ ID NO: 95858 - DNA, 25 bp, Homo sapien
tcaagcctgggacggtctcgcgtcc

SEQ ID NO: 95859 - DNA, 25 bp, Homo sapien
cctcaagcctgggacggtctcgcgt

SEQ ID NO: 95860 - DNA, 25 bp, Homo sapien
cccacagaggccaagcggcccttcg

SEQ ID NO: 95861 - DNA, 25 bp, Homo sapien
tcccgtgcaagacgaaggcgaggac

SEQ ID NO: 95862 - DNA, 25 bp, Homo sapien
cttgtcccgtgcaagacgaaggcga

SEQ ID NO: 95863 - DNA, 25 bp, Homo sapien
tcgtgacatcttgtcccgtgcaaga

SEQ ID NO: 95864 - DNA, 25 bp, Homo sapien
cggaatcgtgacatcttgtcccgtg

SEQ ID NO: 95865 - DNA, 25 bp, Homo sapien
ccaagtggcggtacaaggaggccaa

SEQ ID NO: 95866 - DNA, 25 bp, Homo sapien
tcgccgcaggagtgggccacttaca

SEQ ID NO: 95867 - DNA, 25 bp, Homo sapien
agtgggccacttacacgggccgcgt

SEQ ID NO: 95868 - DNA, 25 bp, Homo sapien
gcgtggatgccgtccgtctcatgca

SEQ ID NO: 95869 - DNA, 25 bp, Homo sapien
gcagttctgggagaagtaccggccc

SEQ ID NO: 95870 - DNA, 25 bp, Homo sapien
tgtgccctgagagccctccgagcgt

SEQ ID NO: 95871 - DNA, 25 bp, Homo sapien
ttccgctccatggaccacggggctg

SEQ ID NO: 95872 - DNA, 25 bp, Homo sapien
ctcacagactgcgtgctgtccgtgc

SEQ ID NO: 95873 - DNA, 25 bp, Homo sapien
atggctcctgcagcgaacgcgctca

SEQ ID NO: 95874 - DNA, 25 bp, Homo sapien
cgcgagccaagcatacggtgcgtgc

SEQ ID NO: 95875 - DNA, 25 bp, Homo sapien
ttcccttcgggaggcgaagacatga

SEQ ID NO: 95876 - DNA, 25 bp, Homo sapien
taatgaagcgcggaaaggagagccc

SEQ ID NO: 95877 - DNA, 25 bp, Homo sapien
ccgggtgagtgccactgccgttaag

SEQ ID NO: 95878 - DNA, 25 bp, Homo sapien
ggccgagagagcaggaatttgttaa

SEQ ID NO: 95879 - DNA, 25 bp, Homo sapien
cgcggtcctcaggaagaaacgcttc

SEQ ID NO: 95880 - DNA, 25 bp, Homo sapien
cgggtgtccagctttagtctctagt

SEQ ID NO: 95881 - DNA, 25 bp, Homo sapien
agaggagagaacacgcgcacttagc

SEQ ID NO: 95882 - DNA, 25 bp, Homo sapien
cttcgcttctgctcaagccgggctg

SEQ ID NO: 95883 - DNA, 25 bp, Homo sapien
ccaggtggcagcgagcctttacctg

SEQ ID NO: 95884 - DNA, 25 bp, Homo sapien
gccgtggcatacagctcctgcgagt

SEQ ID NO: 95885 - DNA, 25 bp, Homo sapien
tcctgcgagtgcttgctgtactgct

SEQ ID NO: 95886 - DNA, 25 bp, Homo sapien
ctgtactgctcggacgcgtggacca

SEQ ID NO: 95887 - DNA, 25 bp, Homo sapien
cggccgaggacacgacgatgttgat

SEQ ID NO: 95888 - DNA, 25 bp, Homo sapien
cgcacttagcgagggagaagcacac

SEQ ID NO: 95889 - DNA, 25 bp, Homo sapien
gcgcgcgttccacttctcctggttt

SEQ ID NO: 95890 - DNA, 25 bp, Homo sapien
tccgcttttgttgtctgagcgcggc

SEQ ID NO: 95891 - DNA, 25 bp, Homo sapien
ggcgacagctcctcagtccgggaag

SEQ ID NO: 95892 - DNA, 25 bp, Homo sapien
gcagggcagccacttggtaaccgct

SEQ ID NO: 95893 - DNA, 25 bp, Homo sapien
ggtaaccgctccaagaaaggcacta

SEQ ID NO: 95894 - DNA, 25 bp, Homo sapien
tgaccttgcccaactgcagcatctt

SEQ ID NO: 95895 - DNA, 25 bp, Homo sapien
cgttccacttctcctggttttcgcg

SEQ ID NO: 95896 - DNA, 25 bp, Homo sapien
ccaactgcagcatcttccgcttttg

SEQ ID NO: 95897 - DNA, 25 bp, Homo sapien
cggcgaagaggcattctgacctcca

SEQ ID NO: 95898 - DNA, 25 bp, Homo sapien
atgtccttggatgtgtgatgcccta

SEQ ID NO: 95899 - DNA, 25 bp, Homo sapien
gagccctgcaaacaaccgtcatagg

SEQ ID NO: 95900 - DNA, 25 bp, Homo sapien
cgcaaccaggctgtcgcagctcaga

SEQ ID NO: 95901 - DNA, 25 bp, Homo sapien
cttctgtgtcgagtcaggcaacgca

SEQ ID NO: 95902 - DNA, 25 bp, Homo sapien
tctgggccaagccatgcatctgggc

SEQ ID NO: 95903 - DNA, 25 bp, Homo sapien
tgctcgccgaagcagcatcgttctg

SEQ ID NO: 95904 - DNA, 25 bp, Homo sapien
aggtgccacactgctggttccaaca

SEQ ID NO: 95905 - DNA, 25 bp, Homo sapien
cccatgggttccgtctggacgggca

SEQ ID NO: 95906 - DNA, 25 bp, Homo sapien
tggacgggcaggtgtcctcaccatc

SEQ ID NO: 95907 - DNA, 25 bp, Homo sapien
tccctgtgggccgagagcgcagcca

SEQ ID NO: 95908 - DNA, 25 bp, Homo sapien
tcgggcgccacatagtagtcgaagg

SEQ ID NO: 95909 - DNA, 25 bp, Homo sapien
ccatcgggcgccacatagtagtcga

SEQ ID NO: 95910 - DNA, 25 bp, Homo sapien
ccacatagtagtcgaaggcggtgtc

SEQ ID NO: 95911 - DNA, 25 bp, Homo sapien
acatagtagtcgaaggcggtgtccc

SEQ ID NO: 95912 - DNA, 25 bp, Homo sapien
ggcaggtgtcctcaccatcgggcgc

SEQ ID NO: 95913 - DNA, 25 bp, Homo sapien
ccggctagccggctgtttgctgctc

SEQ ID NO: 95914 - DNA, 25 bp, Homo sapien
cgagcgcgcacagtaccagtttgtc

SEQ ID NO: 95915 - DNA, 25 bp, Homo sapien
gcgctccgctgggactcgtagcgct

SEQ ID NO: 95916 - DNA, 25 bp, Homo sapien
tgtttgctgctcctgccgttgccat

SEQ ID NO: 95917 - DNA, 25 bp, Homo sapien
catggcgacgggcaatgctccgcct

SEQ ID NO: 95918 - DNA, 25 bp, Homo sapien
ggctcccgagctacttgcatgctcg

SEQ ID NO: 95919 - DNA, 25 bp, Homo sapien
ctacttgcatgctcggggccggctc

SEQ ID NO: 95920 - DNA, 25 bp, Homo sapien
taccagtttgtccatggcgctgtgc

SEQ ID NO: 95921 - DNA, 25 bp, Homo sapien
ctgggccctcgctggaagctctgct

SEQ ID NO: 95922 - DNA, 25 bp, Homo sapien
ccaactcctggacgggagaggtgtc

SEQ ID NO: 95923 - DNA, 25 bp, Homo sapien
cctcctgggaatgtcttggctctga

SEQ ID NO: 95924 - DNA, 25 bp, Homo sapien
cccgtgttacggttgtgcagcattt

SEQ ID NO: 95925 - DNA, 25 bp, Homo sapien
tccacagtcaggtcaggcaattctg

SEQ ID NO: 95926 - DNA, 25 bp, Homo sapien
gggcgtcccaggcttctcagagcat

SEQ ID NO: 95927 - DNA, 25 bp, Homo sapien
tgcagcatttcctggatccacagtc

SEQ ID NO: 95928 - DNA, 25 bp, Homo sapien
ttgacgtaaaacttgcaaaggcatt

SEQ ID NO: 95929 - DNA, 25 bp, Homo sapien
tgagccattgtctccggggacgacc

SEQ ID NO: 95930 - DNA, 25 bp, Homo sapien
ttgcttggccctctagcctgtcatc

SEQ ID NO: 95931 - DNA, 25 bp, Homo sapien
agcagccgggtttctttgcttggcc

SEQ ID NO: 95932 - DNA, 25 bp, Homo sapien
ctggctgatttgtacctggaccctc

SEQ ID NO: 95933 - DNA, 25 bp, Homo sapien
cgggaaattggtctttgatctgtgc

SEQ ID NO: 95934 - DNA, 25 bp, Homo sapien
tctttgtctctttcgctggaggacc

SEQ ID NO: 95935 - DNA, 25 bp, Homo sapien
cggccttcttccgatccggtgagtg

SEQ ID NO: 95936 - DNA, 25 bp, Homo sapien
ccggccttggtctacacttctgtga

SEQ ID NO: 95937 - DNA, 25 bp, Homo sapien
ccacatgatcggggcccagagctcg

SEQ ID NO: 95938 - DNA, 25 bp, Homo sapien
aggactccgacgacagtgcggccac

SEQ ID NO: 95939 - DNA, 25 bp, Homo sapien
tccgtctccagcaatgacgccagtc

SEQ ID NO: 95940 - DNA, 25 bp, Homo sapien
gacgccagtccacccgcatccgtgg

SEQ ID NO: 95941 - DNA, 25 bp, Homo sapien
aagaagctggcgcacaagcacaaga

SEQ ID NO: 95942 - DNA, 25 bp, Homo sapien
aagaagagccgcgaggtccgcaaga

SEQ ID NO: 95943 - DNA, 25 bp, Homo sapien
ggctcgcagaaggactccgacgaca

SEQ ID NO: 95944 - DNA, 25 bp, Homo sapien
ggcaacaccctgcgcaagtggctca

SEQ ID NO: 95945 - DNA, 25 bp, Homo sapien
gggcgcattccttaccttcctggtg

SEQ ID NO: 95946 - DNA, 25 bp, Homo sapien
acctcgatgggcacggggaccacct

SEQ ID NO: 95947 - DNA, 25 bp, Homo sapien
gcagccgtagaaagccgccatgaag

SEQ ID NO: 95948 - DNA, 25 bp, Homo sapien
gtgaaagccatctcactcagcgaga

SEQ ID NO: 95949 - DNA, 25 bp, Homo sapien
gcatcccttatcgaggcaaccgaag

SEQ ID NO: 95950 - DNA, 25 bp, Homo sapien
aggagaccctcacccagccgggata

SEQ ID NO: 95951 - DNA, 25 bp, Homo sapien
cgagaaaccgagcaaagggcgcatt

SEQ ID NO: 95952 - DNA, 25 bp, Homo sapien
ccgggatacagccaccgtgaaagcc

SEQ ID NO: 95953 - DNA, 25 bp, Homo sapien
acccagaaacctcgggcctcagtga

SEQ ID NO: 95954 - DNA, 25 bp, Homo sapien
gaatcccgatctaaccactccagtg

SEQ ID NO: 95955 - DNA, 25 bp, Homo sapien
tgtcaaggtcatgggctcgcttatg

SEQ ID NO: 95956 - DNA, 25 bp, Homo sapien
gtggacaccaccgagcaattgaaga

SEQ ID NO: 95957 - DNA, 25 bp, Homo sapien
ctcggaccttggaaaatcgcacctc

SEQ ID NO: 95958 - DNA, 25 bp, Homo sapien
tgcggctggtgcactacagatacaa

SEQ ID NO: 95959 - DNA, 25 bp, Homo sapien
aacccaggccagttcgagagcgaca

SEQ ID NO: 95960 - DNA, 25 bp, Homo sapien
acctgcgcgccaaggaacacgtgca

SEQ ID NO: 95961 - DNA, 25 bp, Homo sapien
ccctggcaaggatactgaccgcatg

SEQ ID NO: 95962 - DNA, 25 bp, Homo sapien
tgggaccaggctaaccctcctgcgg

SEQ ID NO: 95963 - DNA, 25 bp, Homo sapien
gcggctgttctcactaactcggctg

SEQ ID NO: 95964 - DNA, 25 bp, Homo sapien
agctctaaacgccaccgcggctgtt

SEQ ID NO: 95965 - DNA, 25 bp, Homo sapien
gcagtccacccagagcaacggggta

SEQ ID NO: 95966 - DNA, 25 bp, Homo sapien
cgcggtcccttctctcggcaaggag

SEQ ID NO: 95967 - DNA, 25 bp, Homo sapien
tactgaccgcatgagcacgtgctcc

SEQ ID NO: 95968 - DNA, 25 bp, Homo sapien
gccagcgagcagtccgtgcagtcca

SEQ ID NO: 95969 - DNA, 25 bp, Homo sapien
atgaaaagtgccaaggaggtcgccg

SEQ ID NO: 95970 - DNA, 25 bp, Homo sapien
tgacagaccactgcagaccacgggc

SEQ ID NO: 95971 - DNA, 25 bp, Homo sapien
cttgaataagggaggccaagctgct

SEQ ID NO: 95972 - DNA, 25 bp, Homo sapien
agcctcggaggtctccgcagttctg

SEQ ID NO: 95973 - DNA, 25 bp, Homo sapien
tgtgcttcccaatcaacgggccttc

SEQ ID NO: 95974 - DNA, 25 bp, Homo sapien
cccaagatgtttcccggggagcagc

SEQ ID NO: 95975 - DNA, 25 bp, Homo sapien
cggatccgcccaagtggaattccca

SEQ ID NO: 95976 - DNA, 25 bp, Homo sapien
tcaacgggccttcgatgaaaagtgc

SEQ ID NO: 95977 - DNA, 25 bp, Homo sapien
tcagaagccgagagtggcaccgcga

SEQ ID NO: 95978 - DNA, 25 bp, Homo sapien
ggagcaactagcctggcccgacagc

SEQ ID NO: 95979 - DNA, 25 bp, Homo sapien
gttgaactagttcgtcttctccgcc

SEQ ID NO: 95980 - DNA, 25 bp, Homo sapien
gcagccgcgcttcacagctgaggaa

SEQ ID NO: 95981 - DNA, 25 bp, Homo sapien
gcacacgtgtatgcgcatgcgccgc

SEQ ID NO: 95982 - DNA, 25 bp, Homo sapien
ccggatcgttcggagccggctgaac

SEQ ID NO: 95983 - DNA, 25 bp, Homo sapien
tgcttaaccgggtcgagttgaacta

SEQ ID NO: 95984 - DNA, 25 bp, Homo sapien
gcgtcagcatccttcacacctaaga

SEQ ID NO: 95985 - DNA, 25 bp, Homo sapien
gggcttacctgctccccgaagtcga

SEQ ID NO: 95986 - DNA, 25 bp, Homo sapien
gaatttcaccatagtccccgccgtg

SEQ ID NO: 95987 - DNA, 25 bp, Homo sapien
agcgccgggaatttcaccatagtcc

SEQ ID NO: 95988 - DNA, 25 bp, Homo sapien
cgtgagcgccgggaatttcaccata

SEQ ID NO: 95989 - DNA, 25 bp, Homo sapien
gatcaggggccagtagtgcgtgagc

SEQ ID NO: 95990 - DNA, 25 bp, Homo sapien
tcgatggctatgttggtgatgccca

SEQ ID NO: 95991 - DNA, 25 bp, Homo sapien
tgtccgggcgtgtaaggccaaggca

SEQ ID NO: 95992 - DNA, 25 bp, Homo sapien
ccaggggcaccaagaaccggatcag

SEQ ID NO: 95993 - DNA, 25 bp, Homo sapien
cggccgtctggaagacttggcagcc

SEQ ID NO: 95994 - DNA, 25 bp, Homo sapien
tctggaagacttggcagccggggca

SEQ ID NO: 95995 - DNA, 25 bp, Homo sapien
cagccggggcaagcgacgtgggctc

SEQ ID NO: 95996 - DNA, 25 bp, Homo sapien
aagcgacgtgggctcggacgcgcga

SEQ ID NO: 95997 - DNA, 25 bp, Homo sapien
ccgggaggtatggaggtgccgctcc

SEQ ID NO: 95998 - DNA, 25 bp, Homo sapien
gcccgtgtccctggaggacatgcgc

SEQ ID NO: 95999 - DNA, 25 bp, Homo sapien
aggacatgcgccagggcagcaggga

SEQ ID NO: 96000 - DNA, 25 bp, Homo sapien
gcccggccgtctggaagacttggca

SEQ ID NO: 96001 - DNA, 25 bp, Homo sapien
ggtcgctagtcttcactcgctccgg

SEQ ID NO: 96002 - DNA, 25 bp, Homo sapien
cgttgcttcgctccgaagggttcgc

SEQ ID NO: 96003 - DNA, 25 bp, Homo sapien
ggcgcctggcgctaacaaaagtccg

SEQ ID NO: 96004 - DNA, 25 bp, Homo sapien
cccagcgcggattgtaagtgctgca

SEQ ID NO: 96005 - DNA, 25 bp, Homo sapien
atgtgcagctaacggtcccgtcggg

SEQ ID NO: 96006 - DNA, 25 bp, Homo sapien
gtgcgccgcagctatggagtgtccc

SEQ ID NO: 96007 - DNA, 25 bp, Homo sapien
tgggcgcgaacaatggcaaacagta

SEQ ID NO: 96008 - DNA, 25 bp, Homo sapien
cggggctccagctgtgattgacgct

SEQ ID NO: 96009 - DNA, 25 bp, Homo sapien
aggccagcatagaccggctcccgga

SEQ ID NO: 96010 - DNA, 25 bp, Homo sapien
ggaccactccatggtgcagatcttc

SEQ ID NO: 96011 - DNA, 25 bp, Homo sapien
ggctctggaggactatccgcctgac

SEQ ID NO: 96012 - DNA, 25 bp, Homo sapien
accgtaactgtcagtggctgcaggc

SEQ ID NO: 96013 - DNA, 25 bp, Homo sapien
cgtgtgtctcatgctggaaaccgta

SEQ ID NO: 96014 - DNA, 25 bp, Homo sapien
ggctgtacaccatcgcccagtgctg

SEQ ID NO: 96015 - DNA, 25 bp, Homo sapien
gcggctcacagaccgagggctgtac

SEQ ID NO: 96016 - DNA, 25 bp, Homo sapien
acgggcgagaccatcaacgtggacc

SEQ ID NO: 96017 - DNA, 25 bp, Homo sapien
ctacctggacatgacggactgcttc

SEQ ID NO: 96018 - DNA, 25 bp, Homo sapien
ctttgacctccagacgctgaatgtc

SEQ ID NO: 96019 - DNA, 25 bp, Homo sapien
tcaagtcctgcgagagcatcaccgg

SEQ ID NO: 96020 - DNA, 25 bp, Homo sapien
tgtggagtacctcgccaagaactgc

SEQ ID NO: 96021 - DNA, 25 bp, Homo sapien
cgtggccaagtactgcagcaagctg

SEQ ID NO: 96022 - DNA, 25 bp, Homo sapien
aaggcctgcgctacctggtgatcta

SEQ ID NO: 96023 - DNA, 25 bp, Homo sapien
ggaggccctgcgctttgtcaaacgc

SEQ ID NO: 96024 - DNA, 25 bp, Homo sapien
aaatgccctttggtatccgacacgg

SEQ ID NO: 96025 - DNA, 25 bp, Homo sapien
gacccctgcaatggggcttggctgc

SEQ ID NO: 96026 - DNA, 25 bp, Homo sapien
gcacctacgcgcttctcggggaaaa

SEQ ID NO: 96027 - DNA, 25 bp, Homo sapien
cacctacgcgcttctcggggaaaag

SEQ ID NO: 96028 - DNA, 25 bp, Homo sapien
gtcggtctgtgtgcgggtgacccag

SEQ ID NO: 96029 - DNA, 25 bp, Homo sapien
cagcgtctgtgtggggccgctcctg

SEQ ID NO: 96030 - DNA, 25 bp, Homo sapien
gtcagctgctgggacacccggggcg

SEQ ID NO: 96031 - DNA, 25 bp, Homo sapien
agcgctgctcgcacgcgaggcctgg

SEQ ID NO: 96032 - DNA, 25 bp, Homo sapien
cgctgcgggagcgacccctgcaatg

SEQ ID NO: 96033 - DNA, 25 bp, Homo sapien
tgcggctctcgtgagctgggaagta

SEQ ID NO: 96034 - DNA, 25 bp, Homo sapien
acaccgagcgcgtctcgggctggtc

SEQ ID NO: 96035 - DNA, 25 bp, Homo sapien
ccgaattcggctgcgcgtgagagcc

SEQ ID NO: 96036 - DNA, 25 bp, Homo sapien
ctctgatggaggcggcgccgaattc

SEQ ID NO: 96037 - DNA, 25 bp, Homo sapien
atgcggaaggttctgcagctgcggc

SEQ ID NO: 96038 - DNA, 25 bp, Homo sapien
aaagctcatggttgtgccgccgccg

SEQ ID NO: 96039 - DNA, 25 bp, Homo sapien
tcaaagctcatggttgtgccgccgc

SEQ ID NO: 96040 - DNA, 25 bp, Homo sapien
cgccctcaaagctcatggttgtgcc

SEQ ID NO: 96041 - DNA, 25 bp, Homo sapien
ggccacccgccgctaagctgagaag

SEQ ID NO: 96042 - DNA, 25 bp, Homo sapien
caggagcgtctagccctctggatct

SEQ ID NO: 96043 - DNA, 25 bp, Homo sapien
gggtcctcgcatctccgtctggaac

SEQ ID NO: 96044 - DNA, 25 bp, Homo sapien
gcaggcgcctagcacaaccggaaaa

SEQ ID NO: 96045 - DNA, 25 bp, Homo sapien
acttgtagtcctgcgatttcgggtg

SEQ ID NO: 96046 - DNA, 25 bp, Homo sapien
ctggttgccatgagagcagccgtct

SEQ ID NO: 96047 - DNA, 25 bp, Homo sapien
cgaaccaagctttagccgccgaggc

SEQ ID NO: 96048 - DNA, 25 bp, Homo sapien
agggtcgctgagagactctgttctc

SEQ ID NO: 96049 - DNA, 25 bp, Homo sapien
cggcacacgtcggaagttattcaca

SEQ ID NO: 96050 - DNA, 25 bp, Homo sapien
ggccttcttctccagctcaacgtga

SEQ ID NO: 96051 - DNA, 25 bp, Homo sapien
ggcaaacttcttactgcaaacggtg

SEQ ID NO: 96052 - DNA, 25 bp, Homo sapien
cagtccgtcttatagtgggcccgct

SEQ ID NO: 96053 - DNA, 25 bp, Homo sapien
cgcggaacgccacccggcaagttat

SEQ ID NO: 96054 - DNA, 25 bp, Homo sapien
tatgcaggtgtacgtcgccattgcc

SEQ ID NO: 96055 - DNA, 25 bp, Homo sapien
acgccgacttcctgattgtcactga

SEQ ID NO: 96056 - DNA, 25 bp, Homo sapien
tggccgcgttcatggcatccttgtc

SEQ ID NO: 96057 - DNA, 25 bp, Homo sapien
ccttttcccttgcagcggcgggaga

SEQ ID NO: 96058 - DNA, 25 bp, Homo sapien
acctcgcatctgaggctggatccgc

SEQ ID NO: 96059 - DNA, 25 bp, Homo sapien
atccgcacacggagaacgacaactg

SEQ ID NO: 96060 - DNA, 25 bp, Homo sapien
acgacaactgctcacagggacgtgc

SEQ ID NO: 96061 - DNA, 25 bp, Homo sapien
gcggtgagtgtctacctgttcgaga

SEQ ID NO: 96062 - DNA, 25 bp, Homo sapien
agctctcaccagaacagcaggttgg

SEQ ID NO: 96063 - DNA, 25 bp, Homo sapien
cgccatcttcagctgtgcttccaga

SEQ ID NO: 96064 - DNA, 25 bp, Homo sapien
gccttgtgacgccacaggccacgga

SEQ ID NO: 96065 - DNA, 25 bp, Homo sapien
tccggatgccacttgttcgctggtc

SEQ ID NO: 96066 - DNA, 25 bp, Homo sapien
cagggaccgctcgatattccggaca

SEQ ID NO: 96067 - DNA, 25 bp, Homo sapien
tcatcgacctcctcctctgggtagg

SEQ ID NO: 96068 - DNA, 25 bp, Homo sapien
ctcctctgaagagtcatcgctggtc

SEQ ID NO: 96069 - DNA, 25 bp, Homo sapien
ggcaccaccgtgtcgttcatgtatg

SEQ ID NO: 96070 - DNA, 25 bp, Homo sapien
agtcatcctggtcgtagtcgtagtc

SEQ ID NO: 96071 - DNA, 25 bp, Homo sapien
tggcaccgtcctcatagtcatcctg

SEQ ID NO: 96072 - DNA, 25 bp, Homo sapien
tgaagttgggcttctcctcgcatgc

SEQ ID NO: 96073 - DNA, 25 bp, Homo sapien
cctgcccgggcttactcatcagaga

SEQ ID NO: 96074 - DNA, 25 bp, Homo sapien
caagttcctcactactgggcgcagc

SEQ ID NO: 96075 - DNA, 25 bp, Homo sapien
tatccattgttccagcgcagtcccg

SEQ ID NO: 96076 - DNA, 25 bp, Homo sapien
acctcggtgaagaagttatccattg

SEQ ID NO: 96077 - DNA, 25 bp, Homo sapien
ggagactcccagaaagttgcgcctt

SEQ ID NO: 96078 - DNA, 25 bp, Homo sapien
tacctcccggagcaaaatgcgagcg

SEQ ID NO: 96079 - DNA, 25 bp, Homo sapien
cgcaaacggaaacgcaccttcgcta

SEQ ID NO: 96080 - DNA, 25 bp, Homo sapien
gttgcgccttccagggcttaggaaa

SEQ ID NO: 96081 - DNA, 25 bp, Homo sapien
tgcattcccgtgttgactttctgtc

SEQ ID NO: 96082 - DNA, 25 bp, Homo sapien
tcccgtgttgactttctgtcctgca

SEQ ID NO: 96083 - DNA, 25 bp, Homo sapien
cgtgttgactttctgtcctgcagtc

SEQ ID NO: 96084 - DNA, 25 bp, Homo sapien
actttctgtcctgcagtcgggtttg

SEQ ID NO: 96085 - DNA, 25 bp, Homo sapien
ctgtcctgcagtcgggtttgcttaa

SEQ ID NO: 96086 - DNA, 25 bp, Homo sapien
cctgcagtcgggtttgcttaagacg

SEQ ID NO: 96087 - DNA, 25 bp, Homo sapien
tgcttaagacgtttgcgtaacagcg

SEQ ID NO: 96088 - DNA, 25 bp, Homo sapien
cagtcgggtttgcttaagacgtttg

SEQ ID NO: 96089 - DNA, 25 bp, Homo sapien
ccagccgaggtagcggaatcgtagt

SEQ ID NO: 96090 - DNA, 25 bp, Homo sapien
tgtatgtccctcttgccaacaggta

SEQ ID NO: 96091 - DNA, 25 bp, Homo sapien
ggctattctgtgtcccggtgctaaa

SEQ ID NO: 96092 - DNA, 25 bp, Homo sapien
ggttggccctagctttgactcgagc

SEQ ID NO: 96093 - DNA, 25 bp, Homo sapien
gtcttctcaatattggtggcctcca

SEQ ID NO: 96094 - DNA, 25 bp, Homo sapien
tggcctccattaaagcacagacatc

SEQ ID NO: 96095 - DNA, 25 bp, Homo sapien
aagttccgagagcatcctccgaggg

SEQ ID NO: 96096 - DNA, 25 bp, Homo sapien
gccgcccaaggtgcgcaactcgttt

SEQ ID NO: 96097 - DNA, 25 bp, Homo sapien
gggctctcccttcatgcagcgggca

SEQ ID NO: 96098 - DNA, 25 bp, Homo sapien
tgcctcggagcagtttgttttttcg

SEQ ID NO: 96099 - DNA, 25 bp, Homo sapien
cgtcagtggcggaattgccttccta

SEQ ID NO: 96100 - DNA, 25 bp, Homo sapien
acacggcgacgtgcactcagaagca

SEQ ID NO: 96101 - DNA, 25 bp, Homo sapien
ggccaaggaatacgaggttcacacg

SEQ ID NO: 96102 - DNA, 25 bp, Homo sapien
tggttccaagaatgcgccaggcgcc

SEQ ID NO: 96103 - DNA, 25 bp, Homo sapien
agcgcttccgtcatcggagccctta

SEQ ID NO: 96104 - DNA, 25 bp, Homo sapien
gttttctcgacccatgggactcctg

SEQ ID NO: 96105 - DNA, 25 bp, Homo sapien
cacacttgcctagtaaccgccgttt

SEQ ID NO: 96106 - DNA, 25 bp, Homo sapien
ttgctttgcaaaatgcagctttttg

SEQ ID NO: 96107 - DNA, 25 bp, Homo sapien
cccttgctttgcaaaatgcagcttt

SEQ ID NO: 96108 - DNA, 25 bp, Homo sapien
gctttgcaaaatgcagctttttgtg

SEQ ID NO: 96109 - DNA, 25 bp, Homo sapien
gcaaaatgcagctttttgtggtccc

SEQ ID NO: 96110 - DNA, 25 bp, Homo sapien
aaatgcagctttttgtggtccccac

SEQ ID NO: 96111 - DNA, 25 bp, Homo sapien
ttgtggtccccacacttgcctagta

SEQ ID NO: 96112 - DNA, 25 bp, Homo sapien
cacttgcctagtaaccgccgttttg

SEQ ID NO: 96113 - DNA, 25 bp, Homo sapien
tgtgtttgcttccagaactccaaga

SEQ ID NO: 96114 - DNA, 25 bp, Homo sapien
ttgcttccagaactccaagatggga

SEQ ID NO: 96115 - DNA, 25 bp, Homo sapien
gttttgtgtttgcttccagaactcc

SEQ ID NO: 96116 - DNA, 25 bp, Homo sapien
aaggagaagcccgaccaggacgccg

SEQ ID NO: 96117 - DNA, 25 bp, Homo sapien
agaaagacaagaaggccgagggcgc

SEQ ID NO: 96118 - DNA, 25 bp, Homo sapien
ggaggcaagctcagcaagaagaaga

SEQ ID NO: 96119 - DNA, 25 bp, Homo sapien
tccaagatgggaggcaagctcagca

SEQ ID NO: 96120 - DNA, 25 bp, Homo sapien
ttccagaactccaagatgggaggca

SEQ ID NO: 96121 - DNA, 25 bp, Homo sapien
cggcagctaattccgaccaaaccgt

SEQ ID NO: 96122 - DNA, 25 bp, Homo sapien
gcagctaattccgaccaaaccgtaa

SEQ ID NO: 96123 - DNA, 25 bp, Homo sapien
cacggaagcgcctagttccacaccc

SEQ ID NO: 96124 - DNA, 25 bp, Homo sapien
gcagccacggaagcgcctagttcca

SEQ ID NO: 96125 - DNA, 25 bp, Homo sapien
actcaaaacccggcagctcggaggc

SEQ ID NO: 96126 - DNA, 25 bp, Homo sapien
tcagactcaaaacccggcagctcgg

SEQ ID NO: 96127 - DNA, 25 bp, Homo sapien
gcttcagactcaaaacccggcagct

SEQ ID NO: 96128 - DNA, 25 bp, Homo sapien
cagcttcagactcaaaacccggcag

SEQ ID NO: 96129 - DNA, 25 bp, Homo sapien
tacaagtccttaggaaggcaccatg

SEQ ID NO: 96130 - DNA, 25 bp, Homo sapien
tggcctaggttaccctccagttaca

SEQ ID NO: 96131 - DNA, 25 bp, Homo sapien
tgactcacccaacggtgtgttcgtg

SEQ ID NO: 96132 - DNA, 25 bp, Homo sapien
gtgttttcttgaaggtgactcaccc

SEQ ID NO: 96133 - DNA, 25 bp, Homo sapien
cggcccggactcagaggcacaggca

SEQ ID NO: 96134 - DNA, 25 bp, Homo sapien
gtggagtccgcgcacagtaccagcc

SEQ ID NO: 96135 - DNA, 25 bp, Homo sapien
ggtgggtatcatccctccacgtgga

SEQ ID NO: 96136 - DNA, 25 bp, Homo sapien
gagcgttcgcgccttaactggaaga

SEQ ID NO: 96137 - DNA, 25 bp, Homo sapien
ggtcctcgctaagtgtatgccattc

SEQ ID NO: 96138 - DNA, 25 bp, Homo sapien
ccatcctcgagaatgggctcctttc

SEQ ID NO: 96139 - DNA, 25 bp, Homo sapien
ctccgcggaatagctgaagacctcg

SEQ ID NO: 96140 - DNA, 25 bp, Homo sapien
ccagtcttcacacgacgcaggggtc

SEQ ID NO: 96141 - DNA, 25 bp, Homo sapien
aatcccttatgtacgccagcggccg

SEQ ID NO: 96142 - DNA, 25 bp, Homo sapien
ggcaacaggtatgatcaggcgcctc

SEQ ID NO: 96143 - DNA, 25 bp, Homo sapien
ggctcggagtgcgtaactctgtctc

SEQ ID NO: 96144 - DNA, 25 bp, Homo sapien
cgctgatgttgtacaccttacggtc

SEQ ID NO: 96145 - DNA, 25 bp, Homo sapien
gcctttagtcctggtggtagtcctg

SEQ ID NO: 96146 - DNA, 25 bp, Homo sapien
ttaaaagataacctacacagagcct

SEQ ID NO: 96147 - DNA, 25 bp, Homo sapien
tccaccactcctgctctgagaatta

SEQ ID NO: 96148 - DNA, 25 bp, Homo sapien
gatactcacttccatcaccactatt

SEQ ID NO: 96149 - DNA, 25 bp, Homo sapien
agtctgttatcctcactgatactca

SEQ ID NO: 96150 - DNA, 25 bp, Homo sapien
agctaagttgaagcagtctgttatc

SEQ ID NO: 96151 - DNA, 25 bp, Homo sapien
gaacgtccatctctctacttttaag

SEQ ID NO: 96152 - DNA, 25 bp, Homo sapien
cgactctcgtggaagaacgtccatc

SEQ ID NO: 96153 - DNA, 25 bp, Homo sapien
tgtaggcgacgccctttttctggcg

SEQ ID NO: 96154 - DNA, 25 bp, Homo sapien
taggcgacgccctttttctggcggc

SEQ ID NO: 96155 - DNA, 25 bp, Homo sapien
cggcaccctctccacggaggcggcg

SEQ ID NO: 96156 - DNA, 25 bp, Homo sapien
ccggcaccctctccacggaggcggc

SEQ ID NO: 96157 - DNA, 25 bp, Homo sapien
tccggcaccctctccacggaggcgg

SEQ ID NO: 96158 - DNA, 25 bp, Homo sapien
ctccggcaccctctccacggaggcg

SEQ ID NO: 96159 - DNA, 25 bp, Homo sapien
tctccggcaccctctccacggaggc

SEQ ID NO: 96160 - DNA, 25 bp, Homo sapien
aggcgacgccctttttctggcggct

SEQ ID NO: 96161 - DNA, 25 bp, Homo sapien
cttgtagcggtgaggcttcttgatc

SEQ ID NO: 96162 - DNA, 25 bp, Homo sapien
gccagctgcatgtctcggggcataa

SEQ ID NO: 96163 - DNA, 25 bp, Homo sapien
tcggggcataattgtgacgcgcctg

SEQ ID NO: 96164 - DNA, 25 bp, Homo sapien
gacgcgcctggcatggatggcacac

SEQ ID NO: 96165 - DNA, 25 bp, Homo sapien
agcagctgcgtggacttctggtact

SEQ ID NO: 96166 - DNA, 25 bp, Homo sapien
actttctgatttcccgcagcgccag

SEQ ID NO: 96167 - DNA, 25 bp, Homo sapien
cggtgaggcttcttgatccctcctg

SEQ ID NO: 96168 - DNA, 25 bp, Homo sapien
cgtggacttctggtactttctgatt

SEQ ID NO: 96169 - DNA, 25 bp, Homo sapien
atgtcgcggggccttagcctctccc

SEQ ID NO: 96170 - DNA, 25 bp, Homo sapien
tgtcgcggggccttagcctctcccc

SEQ ID NO: 96171 - DNA, 25 bp, Homo sapien
tcgcggggccttagcctctcccctg

SEQ ID NO: 96172 - DNA, 25 bp, Homo sapien
cgcggggccttagcctctcccctgt

SEQ ID NO: 96173 - DNA, 25 bp, Homo sapien
ccatgtcgcggggccttagcctctc

SEQ ID NO: 96174 - DNA, 25 bp, Homo sapien
gccatgtcgcggggccttagcctct

SEQ ID NO: 96175 - DNA, 25 bp, Homo sapien
gcgccatgtcgcggggccttagcct

SEQ ID NO: 96176 - DNA, 25 bp, Homo sapien
cggcgccctttttccggctgctttg

SEQ ID NO: 96177 - DNA, 25 bp, Homo sapien
ctgggttgaacacacaaaggatgct

SEQ ID NO: 96178 - DNA, 25 bp, Homo sapien
tatgctggataatgtgtttaatata

SEQ ID NO: 96179 - DNA, 25 bp, Homo sapien
gtaggggagatcctcacgctgtgtt

SEQ ID NO: 96180 - DNA, 25 bp, Homo sapien
cttcaacttatttcaatccatcata

SEQ ID NO: 96181 - DNA, 25 bp, Homo sapien
ttccacttgtatacaggtacctata

SEQ ID NO: 96182 - DNA, 25 bp, Homo sapien
aggatgctacaattttccacttgta

SEQ ID NO: 96183 - DNA, 25 bp, Homo sapien
tacaggtacctatattaaaacttca

SEQ ID NO: 96184 - DNA, 25 bp, Homo sapien
ccgacagtgttctgaactgggttga

SEQ ID NO: 96185 - DNA, 25 bp, Homo sapien
tgccggaccggaactaagaccagac

SEQ ID NO: 96186 - DNA, 25 bp, Homo sapien
ctgtgcaataaatctggtcaactta

SEQ ID NO: 96187 - DNA, 25 bp, Homo sapien
tcttctggagtaagtgtgacataaa

SEQ ID NO: 96188 - DNA, 25 bp, Homo sapien
cggaactaagaccagaccattttct

SEQ ID NO: 96189 - DNA, 25 bp, Homo sapien
tgtggctttatattttggcatttaa

SEQ ID NO: 96190 - DNA, 25 bp, Homo sapien
tggcatttaatcctttgcaaaattt

SEQ ID NO: 96191 - DNA, 25 bp, Homo sapien
ttttaaaccattgtggaaactgtgc

SEQ ID NO: 96192 - DNA, 25 bp, Homo sapien
tgtggaaactgtgcaataaatctgg

SEQ ID NO: 96193 - DNA, 25 bp, Homo sapien
cagtgtgcgtgtgaccaccatggac

SEQ ID NO: 96194 - DNA, 25 bp, Homo sapien
agtgtgcgtgtgaccaccatggacg

SEQ ID NO: 96195 - DNA, 25 bp, Homo sapien
caacagaggcggctcttgcctgggt

SEQ ID NO: 96196 - DNA, 25 bp, Homo sapien
atgcccaaaacgatcagtgtgcgtg

SEQ ID NO: 96197 - DNA, 25 bp, Homo sapien
cccaaaacgatcagtgtgcgtgtga

SEQ ID NO: 96198 - DNA, 25 bp, Homo sapien
gatcagtgtgcgtgtgaccaccatg

SEQ ID NO: 96199 - DNA, 25 bp, Homo sapien
gcggctcaacagaggcggctcttgc

SEQ ID NO: 96200 - DNA, 25 bp, Homo sapien
aacgatcagtgtgcgtgtgaccacc

SEQ ID NO: 96201 - DNA, 25 bp, Homo sapien
ttagcaggaagcctaacagtcgccc

SEQ ID NO: 96202 - DNA, 25 bp, Homo sapien
aactccgctgcctttgccgccacca

SEQ ID NO: 96203 - DNA, 25 bp, Homo sapien
tgcccgacagtcctagctaaacttc

SEQ ID NO: 96204 - DNA, 25 bp, Homo sapien
agcactgcccgacagtcctagctaa

SEQ ID NO: 96205 - DNA, 25 bp, Homo sapien
tagtgagggacccaatctgagtccc

SEQ ID NO: 96206 - DNA, 25 bp, Homo sapien
cccgacgctagtgagggacccaatc

SEQ ID NO: 96207 - DNA, 25 bp, Homo sapien
aagtcgtggcccgttagcaggaagc

SEQ ID NO: 96208 - DNA, 25 bp, Homo sapien
cgctagtgagggacccaatctgagt

SEQ ID NO: 96209 - DNA, 25 bp, Homo sapien
tttagcagccgctctgggcagccat

SEQ ID NO: 96210 - DNA, 25 bp, Homo sapien
cacttagcaggagggcacgcacagg

SEQ ID NO: 96211 - DNA, 25 bp, Homo sapien
cgtcgaccatgagcacttagcagga

SEQ ID NO: 96212 - DNA, 25 bp, Homo sapien
ttgacgtcgaccatgagcacttagc

SEQ ID NO: 96213 - DNA, 25 bp, Homo sapien
tcccgaggtgtcacgctgtcaacaa

SEQ ID NO: 96214 - DNA, 25 bp, Homo sapien
tccctggggtttagcagccgctctg

SEQ ID NO: 96215 - DNA, 25 bp, Homo sapien
ccatgagcacttagcaggagggcac

SEQ ID NO: 96216 - DNA, 25 bp, Homo sapien
gctgtcaacaacacaaagtcgtagt

SEQ ID NO: 96217 - DNA, 25 bp, Homo sapien
cctgactggacaccctggttggact

SEQ ID NO: 96218 - DNA, 25 bp, Homo sapien
tactgagtttcgtccacaccgccgg

SEQ ID NO: 96219 - DNA, 25 bp, Homo sapien
agtgttccagtcagagcctccagtt

SEQ ID NO: 96220 - DNA, 25 bp, Homo sapien
cttgggagaccctagtgtagacacc

SEQ ID NO: 96221 - DNA, 25 bp, Homo sapien
gtccctcgatctctaaagccttctg

SEQ ID NO: 96222 - DNA, 25 bp, Homo sapien
cgcaagcacgcggagaatggatttt

SEQ ID NO: 96223 - DNA, 25 bp, Homo sapien
ggggccactgtgttctccaacgcaa

SEQ ID NO: 96224 - DNA, 25 bp, Homo sapien
cgtccggtcgtcaagttctggatca

SEQ ID NO: 96225 - DNA, 25 bp, Homo sapien
tgagcgcaggttctcgttcctcatg

SEQ ID NO: 96226 - DNA, 25 bp, Homo sapien
gagcgcaggttctcgttcctcatgg

SEQ ID NO: 96227 - DNA, 25 bp, Homo sapien
agcgcaggttctcgttcctcatggc

SEQ ID NO: 96228 - DNA, 25 bp, Homo sapien
aatgcggtccgtccacggacctttg

SEQ ID NO: 96229 - DNA, 25 bp, Homo sapien
gtccgtccacggacctttgcacata

SEQ ID NO: 96230 - DNA, 25 bp, Homo sapien
aggctgagcgcaggttctcgttcct

SEQ ID NO: 96231 - DNA, 25 bp, Homo sapien
cgcaggttctcgttcctcatggcgc

SEQ ID NO: 96232 - DNA, 25 bp, Homo sapien
gctgagcgcaggttctcgttcctca

SEQ ID NO: 96233 - DNA, 25 bp, Homo sapien
cctgtagggaaggaaagtgcatcta

SEQ ID NO: 96234 - DNA, 25 bp, Homo sapien
aacagggcaagcatctaccgcgcgc

SEQ ID NO: 96235 - DNA, 25 bp, Homo sapien
agcccgctggccttcgaaagatcct

SEQ ID NO: 96236 - DNA, 25 bp, Homo sapien
tgggccaaacagacctccggcgctg

SEQ ID NO: 96237 - DNA, 25 bp, Homo sapien
tcatcgggcactacgctggagaaga

SEQ ID NO: 96238 - DNA, 25 bp, Homo sapien
cgaaagatcctcctgggccaatggc

SEQ ID NO: 96239 - DNA, 25 bp, Homo sapien
caaatggtccatccagcacccgggg

SEQ ID NO: 96240 - DNA, 25 bp, Homo sapien
ctctgctgatcgctgtggaaactcg

SEQ ID NO: 96241 - DNA, 25 bp, Homo sapien
tgccacactgcagtgcggacgacga

SEQ ID NO: 96242 - DNA, 25 bp, Homo sapien
ttgggaggtggtcgccgtctttcat

SEQ ID NO: 96243 - DNA, 25 bp, Homo sapien
gtatcccgctcgtgcgagtgtcctc

SEQ ID NO: 96244 - DNA, 25 bp, Homo sapien
agaaaatgcacgcagtcacgctcgg

SEQ ID NO: 96245 - DNA, 25 bp, Homo sapien
caggcatcagcagaggatggagaca

SEQ ID NO: 96246 - DNA, 25 bp, Homo sapien
ggacgacgaggccaacataaagaca

SEQ ID NO: 96247 - DNA, 25 bp, Homo sapien
ttcgtttactgaatgcccggcgccc

SEQ ID NO: 96248 - DNA, 25 bp, Homo sapien
ccaacataaagacagcaggcatcag

SEQ ID NO: 96249 - DNA, 25 bp, Homo sapien
ccaggggagctctggcatttgcaaa

SEQ ID NO: 96250 - DNA, 25 bp, Homo sapien
tgcctttctctacgccggcagaggc

SEQ ID NO: 96251 - DNA, 25 bp, Homo sapien
ttgcaaagttggctggtcaattacc

SEQ ID NO: 96252 - DNA, 25 bp, Homo sapien
tggtcaattaccaaagggcgctggt

SEQ ID NO: 96253 - DNA, 25 bp, Homo sapien
gggctccgttggctatgcatacatc

SEQ ID NO: 96254 - DNA, 25 bp, Homo sapien
ggctatgcatacatctccctttttt

SEQ ID NO: 96255 - DNA, 25 bp, Homo sapien
tctgtagcgttgatagaagccaatc

SEQ ID NO: 96256 - DNA, 25 bp, Homo sapien
ctcctggtaagaccgatccgccgtg

SEQ ID NO: 96257 - DNA, 25 bp, Homo sapien
acgggcgcaaaaacatgagtgactc

SEQ ID NO: 96258 - DNA, 25 bp, Homo sapien
accgcaggtaccaagacagtggcac

SEQ ID NO: 96259 - DNA, 25 bp, Homo sapien
tggcgcgtcaacgaaagcgatggac

SEQ ID NO: 96260 - DNA, 25 bp, Homo sapien
cgatggacgtctagaccaatcgtca

SEQ ID NO: 96261 - DNA, 25 bp, Homo sapien
caatcgtcagcaaaagaccctttgg

SEQ ID NO: 96262 - DNA, 25 bp, Homo sapien
gctttactgcaaaactgacgggcgc

SEQ ID NO: 96263 - DNA, 25 bp, Homo sapien
caaagccaggctactaccgcaggta

SEQ ID NO: 96264 - DNA, 25 bp, Homo sapien
cgagatcgccgtcagagcaaagcca

SEQ ID NO: 96265 - DNA, 25 bp, Homo sapien
cccaccttgttattcctgcagggga

SEQ ID NO: 96266 - DNA, 25 bp, Homo sapien
tgggcggcgcaaactcctctagcat

SEQ ID NO: 96267 - DNA, 25 bp, Homo sapien
gtactcaagacagggccgggacctc

SEQ ID NO: 96268 - DNA, 25 bp, Homo sapien
cggcctcaggtaatgtcttggggac

SEQ ID NO: 96269 - DNA, 25 bp, Homo sapien
tccctcgggcttgtttcatctctca

SEQ ID NO: 96270 - DNA, 25 bp, Homo sapien
gcctctttgcccagatgagacgtta

SEQ ID NO: 96271 - DNA, 25 bp, Homo sapien
gtgtgtgcccaggaaagtttagcta

SEQ ID NO: 96272 - DNA, 25 bp, Homo sapien
tacaaatccgggtgcgggaatccca

SEQ ID NO: 96273 - DNA, 25 bp, Homo sapien
ggccgcctgcaggtgattaggctaa

SEQ ID NO: 96274 - DNA, 25 bp, Homo sapien
cagactggggctgaatccacaaatg

SEQ ID NO: 96275 - DNA, 25 bp, Homo sapien
tctgatctgatccaggtcgggtgca

SEQ ID NO: 96276 - DNA, 25 bp, Homo sapien
tctcaggcgaaagcctcaggttttc

SEQ ID NO: 96277 - DNA, 25 bp, Homo sapien
actggaggtaggaaatcggcttctc

SEQ ID NO: 96278 - DNA, 25 bp, Homo sapien
ggagatttagccacagcctcggagg

SEQ ID NO: 96279 - DNA, 25 bp, Homo sapien
gaggaaccctccgaaggtgacttca

SEQ ID NO: 96280 - DNA, 25 bp, Homo sapien
gccttcgggaagtcctgcaggagcc

SEQ ID NO: 96281 - DNA, 25 bp, Homo sapien
ggcggcgcctttccaatatggcggc

SEQ ID NO: 96282 - DNA, 25 bp, Homo sapien
tggcacctacctggagctcacctgg

SEQ ID NO: 96283 - DNA, 25 bp, Homo sapien
cccggctgacgtcaccggaggatgt

SEQ ID NO: 96284 - DNA, 25 bp, Homo sapien
aggagcacttcctccatcagggtca

SEQ ID NO: 96285 - DNA, 25 bp, Homo sapien
gcgtttccttggagtcgcccttgtc

SEQ ID NO: 96286 - DNA, 25 bp, Homo sapien
cagtcatgaggaaacaggtcagggc

SEQ ID NO: 96287 - DNA, 25 bp, Homo sapien
tgtcttttctttggcgttcctgcgc

SEQ ID NO: 96288 - DNA, 25 bp, Homo sapien
cggccctcggtgcttgtcttttctt

SEQ ID NO: 96289 - DNA, 25 bp, Homo sapien
ccgccctcatgctttctctgattgg

SEQ ID NO: 96290 - DNA, 25 bp, Homo sapien
cagagagcgttctctccggactttc

SEQ ID NO: 96291 - DNA, 25 bp, Homo sapien
acccattcttgagtgcacttggaga

SEQ ID NO: 96292 - DNA, 25 bp, Homo sapien
caacgattggatggcgaggataaaa

SEQ ID NO: 96293 - DNA, 25 bp, Homo sapien
tcaggagagtttgacccgccgagat

SEQ ID NO: 96294 - DNA, 25 bp, Homo sapien
tacgtacgacacgaaggagggcttg

SEQ ID NO: 96295 - DNA, 25 bp, Homo sapien
tgggctcactgagaaagtccagagg

SEQ ID NO: 96296 - DNA, 25 bp, Homo sapien
tttcctccaaccaatccagagagcg

SEQ ID NO: 96297 - DNA, 25 bp, Homo sapien
tcccatggcgggacaagagacacag

SEQ ID NO: 96298 - DNA, 25 bp, Homo sapien
cagggcatatgggaatcatgggctc

SEQ ID NO: 96299 - DNA, 25 bp, Homo sapien
gtcgcatcgacaggatccggaccga

SEQ ID NO: 96300 - DNA, 25 bp, Homo sapien
ccgttacctatattgggccgcagcc

SEQ ID NO: 96301 - DNA, 25 bp, Homo sapien
agtagttgccggtcgccattttggc

SEQ ID NO: 96302 - DNA, 25 bp, Homo sapien
cgcgggccacattagactcaccata

SEQ ID NO: 96303 - DNA, 25 bp, Homo sapien
gccgcaggaggccattttagttaag

SEQ ID NO: 96304 - DNA, 25 bp, Homo sapien
cccgctgtgggtgaatccaaagtag

SEQ ID NO: 96305 - DNA, 25 bp, Homo sapien
ggcgcgtgcggttacctactcttcc

SEQ ID NO: 96306 - DNA, 25 bp, Homo sapien
ggaaatggcggctctgccttacctc

SEQ ID NO: 96307 - DNA, 25 bp, Homo sapien
ctcgccggcaatggccgcgggaaat

SEQ ID NO: 96308 - DNA, 25 bp, Homo sapien
tcgactgctagagccgagcgaagcg

SEQ ID NO: 96309 - DNA, 25 bp, Homo sapien
cgaccaagagggtgttcgactgcta

SEQ ID NO: 96310 - DNA, 25 bp, Homo sapien
tggctgccgtcacttccggttctct

SEQ ID NO: 96311 - DNA, 25 bp, Homo sapien
aaatggcgcttggtgcaaatcccgc

SEQ ID NO: 96312 - DNA, 25 bp, Homo sapien
cggttctctgtcagtcgcgagcgaa

SEQ ID NO: 96313 - DNA, 25 bp, Homo sapien
ggcgcaggctttgccgattatgaaa

SEQ ID NO: 96314 - DNA, 25 bp, Homo sapien
ccgcggtttgctgactcgtccgtaa

SEQ ID NO: 96315 - DNA, 25 bp, Homo sapien
gtccgtaatgtcactaccctgtaga

SEQ ID NO: 96316 - DNA, 25 bp, Homo sapien
cgccgggctagtccacaacttggca

SEQ ID NO: 96317 - DNA, 25 bp, Homo sapien
cgcacgtggcctgggatacaaaacc

SEQ ID NO: 96318 - DNA, 25 bp, Homo sapien
tagatcccaatgtcagcggctgccc

SEQ ID NO: 96319 - DNA, 25 bp, Homo sapien
tgcttctccagttctcggctttcga

SEQ ID NO: 96320 - DNA, 25 bp, Homo sapien
ccaggctgtctgtgccgaattccta

SEQ ID NO: 96321 - DNA, 25 bp, Homo sapien
gcgatgctcctctggtcacggactt

SEQ ID NO: 96322 - DNA, 25 bp, Homo sapien
ctcggagtaaaaaacgcagcgtctg

SEQ ID NO: 96323 - DNA, 25 bp, Homo sapien
ttgtgacacctccagaagttgaacc

SEQ ID NO: 96324 - DNA, 25 bp, Homo sapien
cagtaggcacagaaggtccagttcc

SEQ ID NO: 96325 - DNA, 25 bp, Homo sapien
gtgtagcccgttcacattgcaaatg

SEQ ID NO: 96326 - DNA, 25 bp, Homo sapien
tgtcagaattctcccgcccagtgta

SEQ ID NO: 96327 - DNA, 25 bp, Homo sapien
aatttgtggacacggacgcctagtc

SEQ ID NO: 96328 - DNA, 25 bp, Homo sapien
ctcgcctttgggagcaacaagtttc

SEQ ID NO: 96329 - DNA, 25 bp, Homo sapien
ccaggtggcttacgaggattcagac

SEQ ID NO: 96330 - DNA, 25 bp, Homo sapien
tgagtactcgcacctcacgcgcgtg

SEQ ID NO: 96331 - DNA, 25 bp, Homo sapien
cccaggatgactcgtacttgttttc

SEQ ID NO: 96332 - DNA, 25 bp, Homo sapien
ggacgcttcctctctatcttttggc

SEQ ID NO: 96333 - DNA, 25 bp, Homo sapien
tcgtgcgcaatatccaggccagtga

SEQ ID NO: 96334 - DNA, 25 bp, Homo sapien
gagggtttgcacacgtccatctaca

SEQ ID NO: 96335 - DNA, 25 bp, Homo sapien
ggaactgctacttcaccctcgaggg

SEQ ID NO: 96336 - DNA, 25 bp, Homo sapien
tgacattgcagagaaggacgcttcc

SEQ ID NO: 96337 - DNA, 25 bp, Homo sapien
gccggcttccaggttcttgactcca

SEQ ID NO: 96338 - DNA, 25 bp, Homo sapien
cctggggacacaacacgcacctgtt

SEQ ID NO: 96339 - DNA, 25 bp, Homo sapien
cttatggcttccttaccgtggcgtc

SEQ ID NO: 96340 - DNA, 25 bp, Homo sapien
agccgcgcgtcctgcaacgtcaaat

SEQ ID NO: 96341 - DNA, 25 bp, Homo sapien
cgtcaaatccagtgcgcccagaggg

SEQ ID NO: 96342 - DNA, 25 bp, Homo sapien
tgtgaacagccttcaaaccatgggc

SEQ ID NO: 96343 - DNA, 25 bp, Homo sapien
cacgcacgagtcctggggatcccag

SEQ ID NO: 96344 - DNA, 25 bp, Homo sapien
gcgctcgatgaccagccacttgtcg

SEQ ID NO: 96345 - DNA, 25 bp, Homo sapien
ctccgcgacctgatttcctagaagg

SEQ ID NO: 96346 - DNA, 25 bp, Homo sapien
tttcgggttctctcatcgcttcgtc

SEQ ID NO: 96347 - DNA, 25 bp, Homo sapien
tagggcgcctttcgattgcatcagc

SEQ ID NO: 96348 - DNA, 25 bp, Homo sapien
accctggactccatcccgggatttg

SEQ ID NO: 96349 - DNA, 25 bp, Homo sapien
gttatccattggctgctcgttccgc

SEQ ID NO: 96350 - DNA, 25 bp, Homo sapien
tgtccgggaaggtccatgattgttc

SEQ ID NO: 96351 - DNA, 25 bp, Homo sapien
agggctctgtcacccgaaaagattt

SEQ ID NO: 96352 - DNA, 25 bp, Homo sapien
cgcttcgtcgttcgccaatgtttga

SEQ ID NO: 96353 - DNA, 25 bp, Homo sapien
gggtccaggtcaccgtcactgttcc

SEQ ID NO: 96354 - DNA, 25 bp, Homo sapien
gcctgtctgtggaccgagtgctcat

SEQ ID NO: 96355 - DNA, 25 bp, Homo sapien
gcagccactgacacgggcctgtctg

SEQ ID NO: 96356 - DNA, 25 bp, Homo sapien
cgttttccagatgctgcggtcgtta

SEQ ID NO: 96357 - DNA, 25 bp, Homo sapien
gcctgaccttgtggttggacacgaa

SEQ ID NO: 96358 - DNA, 25 bp, Homo sapien
aatgtccacagaggtagacgcgccg

SEQ ID NO: 96359 - DNA, 25 bp, Homo sapien
cggtcgttatcaaaggacagcagca

SEQ ID NO: 96360 - DNA, 25 bp, Homo sapien
ggcggtcatgcagaagcgcatttcc

SEQ ID NO: 96361 - DNA, 25 bp, Homo sapien
accatggggaaagtgttggcagtca

SEQ ID NO: 96362 - DNA, 25 bp, Homo sapien
ccaggaccagtgtgggtcgaggttt

SEQ ID NO: 96363 - DNA, 25 bp, Homo sapien
tctcccatcgcaggtgaccatgggg

SEQ ID NO: 96364 - DNA, 25 bp, Homo sapien
catcgcaggtgaccatggggaaagt

SEQ ID NO: 96365 - DNA, 25 bp, Homo sapien
ggggaaagtgttggcagtcagctcc

SEQ ID NO: 96366 - DNA, 25 bp, Homo sapien
gccctagcatccaggcttcaggctg

SEQ ID NO: 96367 - DNA, 25 bp, Homo sapien
ctagcatccaggcttcaggctgccg

SEQ ID NO: 96368 - DNA, 25 bp, Homo sapien
cgccaccacctgtgccggccctcgt

SEQ ID NO: 96369 - DNA, 25 bp, Homo sapien
cagaaaggagctagacacctttttc

SEQ ID NO: 96370 - DNA, 25 bp, Homo sapien
ccctgtgcttttttaagcagaaagg

SEQ ID NO: 96371 - DNA, 25 bp, Homo sapien
gcgactgcaaagctgcccgcgatct

SEQ ID NO: 96372 - DNA, 25 bp, Homo sapien
cctaaaaggggagtgattcagctga

SEQ ID NO: 96373 - DNA, 25 bp, Homo sapien
cccggcgtgcttaaatacaagctca

SEQ ID NO: 96374 - DNA, 25 bp, Homo sapien
cccgcgatctccctgtgctttttta

SEQ ID NO: 96375 - DNA, 25 bp, Homo sapien
cgcgagaaggcagcgactgcaaagc

SEQ ID NO: 96376 - DNA, 25 bp, Homo sapien
tcagctgacagtgtccgctttcggc

SEQ ID NO: 96377 - DNA, 25 bp, Homo sapien
gcagccacgatagccaccatgaata

SEQ ID NO: 96378 - DNA, 25 bp, Homo sapien
cggggacaagctagcagaactcttc

SEQ ID NO: 96379 - DNA, 25 bp, Homo sapien
ggctggcgcaagtcctctatcaacc

SEQ ID NO: 96380 - DNA, 25 bp, Homo sapien
ttcggcaaggccatgtgtaagatcg

SEQ ID NO: 96381 - DNA, 25 bp, Homo sapien
cggattctcatcagcgtggtgtact

SEQ ID NO: 96382 - DNA, 25 bp, Homo sapien
gccatgagtgtgacgcgctaccatt

SEQ ID NO: 96383 - DNA, 25 bp, Homo sapien
tgccgctgggcatcattatcttgtg

SEQ ID NO: 96384 - DNA, 25 bp, Homo sapien
agcgtgttcttcctcactgccatga

SEQ ID NO: 96385 - DNA, 25 bp, Homo sapien
cgcggctgcttcaggtccagcacta

SEQ ID NO: 96386 - DNA, 25 bp, Homo sapien
ccaggaccatagcacagaacgggcc

SEQ ID NO: 96387 - DNA, 25 bp, Homo sapien
aggtccagcactagcgagcgcttgc

SEQ ID NO: 96388 - DNA, 25 bp, Homo sapien
agcagcacatccgaccgcttgcaca

SEQ ID NO: 96389 - DNA, 25 bp, Homo sapien
tcaccgcggcggaagggctccagca

SEQ ID NO: 96390 - DNA, 25 bp, Homo sapien
catagcacagaacgggcccggggcc

SEQ ID NO: 96391 - DNA, 25 bp, Homo sapien
cccgaagtcagccaggaccatagca

SEQ ID NO: 96392 - DNA, 25 bp, Homo sapien
tgcagcctcgatcgaacggccaggc

SEQ ID NO: 96393 - DNA, 25 bp, Homo sapien
ccgcctcccggctgaacttggagga

SEQ ID NO: 96394 - DNA, 25 bp, Homo sapien
cctgactcgcggaatttggggccgc

SEQ ID NO: 96395 - DNA, 25 bp, Homo sapien
ggcagcccactgtctgcggagagca

SEQ ID NO: 96396 - DNA, 25 bp, Homo sapien
acccggagatgcaccctggagtctg

SEQ ID NO: 96397 - DNA, 25 bp, Homo sapien
caggacgcggggtccgctattgttc

SEQ ID NO: 96398 - DNA, 25 bp, Homo sapien
gggtccgctattgttcctcctctga

SEQ ID NO: 96399 - DNA, 25 bp, Homo sapien
gaatgaatgagcagacccggagatg

SEQ ID NO: 96400 - DNA, 25 bp, Homo sapien
ccgggtcacctgactcgcggaattt

SEQ ID NO: 96401 - DNA, 25 bp, Homo sapien
ccgcacacgtcgcagctttaaataa

SEQ ID NO: 96402 - DNA, 25 bp, Homo sapien
cgtcagggcttacagacttgccgca

SEQ ID NO: 96403 - DNA, 25 bp, Homo sapien
ccatggcaacggtattgtctccttg

SEQ ID NO: 96404 - DNA, 25 bp, Homo sapien
cgtagcgttccgttcccatggcaac

SEQ ID NO: 96405 - DNA, 25 bp, Homo sapien
gcgcactcgcgcgttctcttagagc

SEQ ID NO: 96406 - DNA, 25 bp, Homo sapien
cccttccatccttggacggaatgta

SEQ ID NO: 96407 - DNA, 25 bp, Homo sapien
gtggccaggatcgtcgccgaataca

SEQ ID NO: 96408 - DNA, 25 bp, Homo sapien
taggcgccagacaacagggactctc

SEQ ID NO: 96409 - DNA, 25 bp, Homo sapien
cgagtgcggaaaccctacctttgcg

SEQ ID NO: 96410 - DNA, 25 bp, Homo sapien
ttagagccgccgaaccatagagatc

SEQ ID NO: 96411 - DNA, 25 bp, Homo sapien
gctctgtgcgccttttcttgggtta

SEQ ID NO: 96412 - DNA, 25 bp, Homo sapien
ggttttagcaattctcccggccaga

SEQ ID NO: 96413 - DNA, 25 bp, Homo sapien
tgggcacggagtttgcagctaatcc

SEQ ID NO: 96414 - DNA, 25 bp, Homo sapien
gctaatccttgtgcacgtggccgtc

SEQ ID NO: 96415 - DNA, 25 bp, Homo sapien
ggcccggagtgtccagataatcctc

SEQ ID NO: 96416 - DNA, 25 bp, Homo sapien
cgcgggacagcatcgcttactagtc

SEQ ID NO: 96417 - DNA, 25 bp, Homo sapien
gggaactcggaactcagacctgccc

SEQ ID NO: 96418 - DNA, 25 bp, Homo sapien
accacgagggagcagtcgggaactc

SEQ ID NO: 96419 - DNA, 25 bp, Homo sapien
gggaaaactgcagtccaacaacctc

SEQ ID NO: 96420 - DNA, 25 bp, Homo sapien
acctggcggcctaggagctccttgc

SEQ ID NO: 96421 - DNA, 25 bp, Homo sapien
tggccctgaaatggcacccgggtaa

SEQ ID NO: 96422 - DNA, 25 bp, Homo sapien
ctatcggaagctggccctgaaatgg

SEQ ID NO: 96423 - DNA, 25 bp, Homo sapien
gtcgggcgatgaagtgtcactatga

SEQ ID NO: 96424 - DNA, 25 bp, Homo sapien
agcgcagcctctcggtgtttttcct

SEQ ID NO: 96425 - DNA, 25 bp, Homo sapien
cacgagtgtttcacgacacgctgca

SEQ ID NO: 96426 - DNA, 25 bp, Homo sapien
cgtctcttggccactgtgaccaacg

SEQ ID NO: 96427 - DNA, 25 bp, Homo sapien
cccaccacgtttgctgcccactctc

SEQ ID NO: 96428 - DNA, 25 bp, Homo sapien
tcacgacacgctgcacgtgagcggc

SEQ ID NO: 96429 - DNA, 25 bp, Homo sapien
gcatacctgggcacacgagtgtttc

SEQ ID NO: 96430 - DNA, 25 bp, Homo sapien
gaccaacgcatacctgggcacacga

SEQ ID NO: 96431 - DNA, 25 bp, Homo sapien
ggccactgtgaccaacgcatacctg

SEQ ID NO: 96432 - DNA, 25 bp, Homo sapien
cacgcaccgggccatgctgcccagc

SEQ ID NO: 96433 - DNA, 25 bp, Homo sapien
aacacgattttctgtcctctgcggc

SEQ ID NO: 96434 - DNA, 25 bp, Homo sapien
gcctttcgcctagttccagcctgga

SEQ ID NO: 96435 - DNA, 25 bp, Homo sapien
caccggctgaaccatgtcggagatc

SEQ ID NO: 96436 - DNA, 25 bp, Homo sapien
tggttcctggcgagtttctaagccc

SEQ ID NO: 96437 - DNA, 25 bp, Homo sapien
gctcaggtcttacccgccagcaggt

SEQ ID NO: 96438 - DNA, 25 bp, Homo sapien
ccagcaggtggcgaaacacgatttt

SEQ ID NO: 96439 - DNA, 25 bp, Homo sapien
tacgcttccatagcaaagggttgcc

SEQ ID NO: 96440 - DNA, 25 bp, Homo sapien
tgtgccagtggctcaacaaggagtt

SEQ ID NO: 96441 - DNA, 25 bp, Homo sapien
gtccgatctcgccagacagcgtctg

SEQ ID NO: 96442 - DNA, 25 bp, Homo sapien
ctgcggacgctatgcacaggtaaac

SEQ ID NO: 96443 - DNA, 25 bp, Homo sapien
tcaccactcagcagccaaggacttg

SEQ ID NO: 96444 - DNA, 25 bp, Homo sapien
ccaggttctgggatccacgctcaga

SEQ ID NO: 96445 - DNA, 25 bp, Homo sapien
cgctggcgatcaccagaaggcctgc

SEQ ID NO: 96446 - DNA, 25 bp, Homo sapien
tgcgggctcccgagaaaggaaaatc

SEQ ID NO: 96447 - DNA, 25 bp, Homo sapien
tccgtctacagtccagcggctgaca

SEQ ID NO: 96448 - DNA, 25 bp, Homo sapien
ggcgagcagctctgcagttaatgca

SEQ ID NO: 96449 - DNA, 25 bp, Homo sapien
gctggtttcacgcaaatccgtttgg

SEQ ID NO: 96450 - DNA, 25 bp, Homo sapien
ctctcggagttctgcgcaggcgctg

SEQ ID NO: 96451 - DNA, 25 bp, Homo sapien
ggcactctcggagttctgcgcaggc

SEQ ID NO: 96452 - DNA, 25 bp, Homo sapien
gcaggcgcggcactctcggagttct

SEQ ID NO: 96453 - DNA, 25 bp, Homo sapien
cgcaaatccgtttggggcgagcctc

SEQ ID NO: 96454 - DNA, 25 bp, Homo sapien
ggggacctgcttcctccatctcaaa

SEQ ID NO: 96455 - DNA, 25 bp, Homo sapien
tttcacgcaaatccgtttggggcga

SEQ ID NO: 96456 - DNA, 25 bp, Homo sapien
cagcgcgggaggtcaaggtccccaa

SEQ ID NO: 96457 - DNA, 25 bp, Homo sapien
ccaggctaactctatcggccaatca

SEQ ID NO: 96458 - DNA, 25 bp, Homo sapien
tcctccgagagctccgcgtaacggt

SEQ ID NO: 96459 - DNA, 25 bp, Homo sapien
ctcacgcctgcataatggctgcttc

SEQ ID NO: 96460 - DNA, 25 bp, Homo sapien
gaagcctcggtagcaagtcatcgtg

SEQ ID NO: 96461 - DNA, 25 bp, Homo sapien
ctgctcgaactcgtaccgggtggtt

SEQ ID NO: 96462 - DNA, 25 bp, Homo sapien
agctgcttcaggtcctcctccgaga

SEQ ID NO: 96463 - DNA, 25 bp, Homo sapien
ctaagtccctgcatgaaccactgtc

SEQ ID NO: 96464 - DNA, 25 bp, Homo sapien
taacggtaccgctgctgctcgaact

SEQ ID NO: 96465 - DNA, 25 bp, Homo sapien
agcgagcctcatagtggccaccagg

SEQ ID NO: 96466 - DNA, 25 bp, Homo sapien
cgggagatgagaaatctacgagatc

SEQ ID NO: 96467 - DNA, 25 bp, Homo sapien
ccgagggagggctccgaatgaatac

SEQ ID NO: 96468 - DNA, 25 bp, Homo sapien
caaagcagtcgggacgtgtcacgcc

SEQ ID NO: 96469 - DNA, 25 bp, Homo sapien
tggagcaacaatggccggctctgtg

SEQ ID NO: 96470 - DNA, 25 bp, Homo sapien
gctccgaatgaatacgctgacaata

SEQ ID NO: 96471 - DNA, 25 bp, Homo sapien
ggtggtcccagaactggagcaacaa

SEQ ID NO: 96472 - DNA, 25 bp, Homo sapien
caggctgccgtcagtcgagcggcct

SEQ ID NO: 96473 - DNA, 25 bp, Homo sapien
gggtggagacgtcccacctcacctg

SEQ ID NO: 96474 - DNA, 25 bp, Homo sapien
caggacaggtaaaaccggtctgcca

SEQ ID NO: 96475 - DNA, 25 bp, Homo sapien
agcctcctccggaccaggacaggta

SEQ ID NO: 96476 - DNA, 25 bp, Homo sapien
gcaaaacgaagagagtagtcgacta

SEQ ID NO: 96477 - DNA, 25 bp, Homo sapien
ttgggagtgtcaggtagcaaaacga

SEQ ID NO: 96478 - DNA, 25 bp, Homo sapien
ggatttgctttctgcggctttggga

SEQ ID NO: 96479 - DNA, 25 bp, Homo sapien
gctggagcccgtgctcgaccagctg

SEQ ID NO: 96480 - DNA, 25 bp, Homo sapien
taaaaccggtctgccaggtctcagg

SEQ ID NO: 96481 - DNA, 25 bp, Homo sapien
cggctctcaaaaggcaaggtgtacg

SEQ ID NO: 96482 - DNA, 25 bp, Homo sapien
gctccctaaagctaacgacgacctg

SEQ ID NO: 96483 - DNA, 25 bp, Homo sapien
ctgtcggcctccaggaaaataaaga

SEQ ID NO: 96484 - DNA, 25 bp, Homo sapien
cgctctgaagcatcgacaatactgg

SEQ ID NO: 96485 - DNA, 25 bp, Homo sapien
ctgcagggacaccatttaaaacggg

SEQ ID NO: 96486 - DNA, 25 bp, Homo sapien
cccttggattcagacgccgattcgc

SEQ ID NO: 96487 - DNA, 25 bp, Homo sapien
gcccggattatagtctctcgccaca

SEQ ID NO: 96488 - DNA, 25 bp, Homo sapien
acttccggtcggcattttgttctga

SEQ ID NO: 96489 - DNA, 25 bp, Homo sapien
ccgcctttgattcgtgactgggtca

SEQ ID NO: 96490 - DNA, 25 bp, Homo sapien
ccctcaggacagaagcagggctctg

SEQ ID NO: 96491 - DNA, 25 bp, Homo sapien
gcaaggcagagagcgttcagcaccc

SEQ ID NO: 96492 - DNA, 25 bp, Homo sapien
gtgactgggtcacggtcctcactca

SEQ ID NO: 96493 - DNA, 25 bp, Homo sapien
gccgccttctgtccctagtctccgg

SEQ ID NO: 96494 - DNA, 25 bp, Homo sapien
tctccagaacgggaaggctgtactg

SEQ ID NO: 96495 - DNA, 25 bp, Homo sapien
atgcgccgtagctctccagaacggg

SEQ ID NO: 96496 - DNA, 25 bp, Homo sapien
tgggtcacggtcctcactcattcct

SEQ ID NO: 96497 - DNA, 25 bp, Homo sapien
cctccggatcctgctcgagaagctg

SEQ ID NO: 96498 - DNA, 25 bp, Homo sapien
ttcacttctcccagttaacgcgttc

SEQ ID NO: 96499 - DNA, 25 bp, Homo sapien
cctgcccgacagaagagtagatgag

SEQ ID NO: 96500 - DNA, 25 bp, Homo sapien
gtgaagacgccaggccgacagctgc

SEQ ID NO: 96501 - DNA, 25 bp, Homo sapien
gcgcctgctcagaaccggccgggaa

SEQ ID NO: 96502 - DNA, 25 bp, Homo sapien
ttaacgcgttcctcggacgctgcta

SEQ ID NO: 96503 - DNA, 25 bp, Homo sapien
aattgacgttctattcctccggatc

SEQ ID NO: 96504 - DNA, 25 bp, Homo sapien
acgctgctagtttgagcgcacaggc

SEQ ID NO: 96505 - DNA, 25 bp, Homo sapien
gatgagccgtccagcattttccaga

SEQ ID NO: 96506 - DNA, 25 bp, Homo sapien
tcctcttgcaactgacggtcgatga

SEQ ID NO: 96507 - DNA, 25 bp, Homo sapien
atcgccgcgcccaacaaagaagacg

SEQ ID NO: 96508 - DNA, 25 bp, Homo sapien
ctcggaaatcgtagacaccagggtc

SEQ ID NO: 96509 - DNA, 25 bp, Homo sapien
gaagttagcttagatccgccgccta

SEQ ID NO: 96510 - DNA, 25 bp, Homo sapien
ttggcgcctcgacatgacgcacttc

SEQ ID NO: 96511 - DNA, 25 bp, Homo sapien
cgcttcatccggtggggaactggaa

SEQ ID NO: 96512 - DNA, 25 bp, Homo sapien
cgggtacatgcggtcctcttgcaac

SEQ ID NO: 96513 - DNA, 25 bp, Homo sapien
cgggaatcccacctgagggtcttca

SEQ ID NO: 96514 - DNA, 25 bp, Homo sapien
ccgcctgagggtcttcacggggtct

SEQ ID NO: 96515 - DNA, 25 bp, Homo sapien
cggaacccgcctgagggtcttcgcg

SEQ ID NO: 96516 - DNA, 25 bp, Homo sapien
gcgggaatcccacctgagggtcttc

SEQ ID NO: 96517 - DNA, 25 bp, Homo sapien
gcgccattgccggagcgggaatccc

SEQ ID NO: 96518 - DNA, 25 bp, Homo sapien
cctcctgagggtcttcacggggtct

SEQ ID NO: 96519 - DNA, 25 bp, Homo sapien
tccggaacccgcctgagggtcttca

SEQ ID NO: 96520 - DNA, 25 bp, Homo sapien
gccggaacccgcctgagggtcgtca

SEQ ID NO: 96521 - DNA, 25 bp, Homo sapien
tgcggaaggcgccgctcttggcttc

SEQ ID NO: 96522 - DNA, 25 bp, Homo sapien
gtcaccatgggcttcacggggttcg

SEQ ID NO: 96523 - DNA, 25 bp, Homo sapien
ggtcaccatgggcttcacggggttc

SEQ ID NO: 96524 - DNA, 25 bp, Homo sapien
gcactaactaggccgcctctctttt

SEQ ID NO: 96525 - DNA, 25 bp, Homo sapien
gcgccgcactaactaggccgcctct

SEQ ID NO: 96526 - DNA, 25 bp, Homo sapien
atggagcgctctgggcccagcgaag

SEQ ID NO: 96527 - DNA, 25 bp, Homo sapien
aggcgccgctcttggcttcggcggc

SEQ ID NO: 96528 - DNA, 25 bp, Homo sapien
agccatggagcgctctgggcccagc

SEQ ID NO: 96529 - DNA, 25 bp, Homo sapien
agggaacggttcttacagtcactgc

SEQ ID NO: 96530 - DNA, 25 bp, Homo sapien
ggcactcctgccctccttgcaagtc

SEQ ID NO: 96531 - DNA, 25 bp, Homo sapien
ggagagaaccgcagaatgcacgtta

SEQ ID NO: 96532 - DNA, 25 bp, Homo sapien
tcatcttaaagtcccgtccggcggc

SEQ ID NO: 96533 - DNA, 25 bp, Homo sapien
cacgacatcccataacttcatctta

SEQ ID NO: 96534 - DNA, 25 bp, Homo sapien
agtcactgctcagcgcgaagggcgc

SEQ ID NO: 96535 - DNA, 25 bp, Homo sapien
ttacagtcactgctcagcgcgaagg

SEQ ID NO: 96536 - DNA, 25 bp, Homo sapien
agaatgcacgttaagcctgggctcc

SEQ ID NO: 96537 - DNA, 25 bp, Homo sapien
aggcccgagagcacccgaattgcta

SEQ ID NO: 96538 - DNA, 25 bp, Homo sapien
ggacttcccagagatcggacacttg

SEQ ID NO: 96539 - DNA, 25 bp, Homo sapien
atgtagctttgccagacctcgcccg

SEQ ID NO: 96540 - DNA, 25 bp, Homo sapien
acctcaatggcctagtggagtctca

SEQ ID NO: 96541 - DNA, 25 bp, Homo sapien
accaccagtgcggaattagcctcga

SEQ ID NO: 96542 - DNA, 25 bp, Homo sapien
cactgagcaagagtcgagcgcgttc

SEQ ID NO: 96543 - DNA, 25 bp, Homo sapien
tacttgttgaaaaggcgccaccttc

SEQ ID NO: 96544 - DNA, 25 bp, Homo sapien
tgggacacttctcgcaggcaaactg

SEQ ID NO: 96545 - DNA, 25 bp, Homo sapien
ggagcgttacatgtgtgtggactcg

SEQ ID NO: 96546 - DNA, 25 bp, Homo sapien
aggcccgggagcgttacatgtgtgt

SEQ ID NO: 96547 - DNA, 25 bp, Homo sapien
cccgggagcgttacatgtgtgtgga

SEQ ID NO: 96548 - DNA, 25 bp, Homo sapien
gggagcgttacatgtgtgtggactc

SEQ ID NO: 96549 - DNA, 25 bp, Homo sapien
agcgttacatgtgtgtggactcggg

SEQ ID NO: 96550 - DNA, 25 bp, Homo sapien
gttacatgtgtgtggactcggggag

SEQ ID NO: 96551 - DNA, 25 bp, Homo sapien
cgttacatgtgtgtggactcgggga

SEQ ID NO: 96552 - DNA, 25 bp, Homo sapien
cgggagcgttacatgtgtgtggact

SEQ ID NO: 96553 - DNA, 25 bp, Homo sapien
aggtaatgcgctcctccgcccagag

SEQ ID NO: 96554 - DNA, 25 bp, Homo sapien
cggctgcagtcctacctcttggaac

SEQ ID NO: 96555 - DNA, 25 bp, Homo sapien
cccgggacttggtgaaactttgcag

SEQ ID NO: 96556 - DNA, 25 bp, Homo sapien
ctcaagttgccttcctctgccggga

SEQ ID NO: 96557 - DNA, 25 bp, Homo sapien
cgccggctgcgaaatggatttaatc

SEQ ID NO: 96558 - DNA, 25 bp, Homo sapien
ggaccaactacagcaacctttgagg

SEQ ID NO: 96559 - DNA, 25 bp, Homo sapien
gcggccatccgaaaaccaggtaatg

SEQ ID NO: 96560 - DNA, 25 bp, Homo sapien
cccaagatttcagggtgaggaccgc

SEQ ID NO: 96561 - DNA, 25 bp, Homo sapien
tgccgctgcaaacagtgccttgagg

SEQ ID NO: 96562 - DNA, 25 bp, Homo sapien
gagccatctagtcttgcctcggagg

SEQ ID NO: 96563 - DNA, 25 bp, Homo sapien
gccgagcccaggcaaatcctcgaga

SEQ ID NO: 96564 - DNA, 25 bp, Homo sapien
gccgagagtatcctggagccatcta

SEQ ID NO: 96565 - DNA, 25 bp, Homo sapien
ttgttgggactttgcgaattaccta

SEQ ID NO: 96566 - DNA, 25 bp, Homo sapien
gaggccgctctcagaaggtcatgga

SEQ ID NO: 96567 - DNA, 25 bp, Homo sapien
ctcccagaggcaacggtaacggcca

SEQ ID NO: 96568 - DNA, 25 bp, Homo sapien
gttttcgccgcctctgtaaccactg

SEQ ID NO: 96569 - DNA, 25 bp, Homo sapien
ctgttgtagccgaagaaactttgtc

SEQ ID NO: 96570 - DNA, 25 bp, Homo sapien
cggacagggcgtttctggatagaac

SEQ ID NO: 96571 - DNA, 25 bp, Homo sapien
ttcgttgctctggacgccaaatgga

SEQ ID NO: 96572 - DNA, 25 bp, Homo sapien
caggcctcatcggtcactcggctta

SEQ ID NO: 96573 - DNA, 25 bp, Homo sapien
gtgcgggaaagaatccgacaacttc

SEQ ID NO: 96574 - DNA, 25 bp, Homo sapien
cctgaagattttcggacggggatct

SEQ ID NO: 96575 - DNA, 25 bp, Homo sapien
gacgggaaattgcaaaagacctcac

SEQ ID NO: 96576 - DNA, 25 bp, Homo sapien
caggagtgccaagagtgcgcagcaa

SEQ ID NO: 96577 - DNA, 25 bp, Homo sapien
tgctctgaagccctgccatagacgg

SEQ ID NO: 96578 - DNA, 25 bp, Homo sapien
tcccacgaggaaagtcccattgatg

SEQ ID NO: 96579 - DNA, 25 bp, Homo sapien
cggaagccgtcgtccaaatgcaggc

SEQ ID NO: 96580 - DNA, 25 bp, Homo sapien
cgctgcgcacagttttagactcctt

SEQ ID NO: 96581 - DNA, 25 bp, Homo sapien
agcctcgcccttgatcttcagaatg

SEQ ID NO: 96582 - DNA, 25 bp, Homo sapien
ccgacccaaggtctgcaaggagttc

SEQ ID NO: 96583 - DNA, 25 bp, Homo sapien
gccgccatattgacgggtttcagtc

SEQ ID NO: 96584 - DNA, 25 bp, Homo sapien
cccattgatgcgagttggcagtgta

SEQ ID NO: 96585 - DNA, 25 bp, Homo sapien
tgtgttcggggagaagtcaaaagcc

SEQ ID NO: 96586 - DNA, 25 bp, Homo sapien
actcccggcgagagatatggttcta

SEQ ID NO: 96587 - DNA, 25 bp, Homo sapien
atggttctaatcagatgctggcagc

SEQ ID NO: 96588 - DNA, 25 bp, Homo sapien
actgtttattaactcgcgctgcagc

SEQ ID NO: 96589 - DNA, 25 bp, Homo sapien
ctcgcttaaatagccgccggccggg

SEQ ID NO: 96590 - DNA, 25 bp, Homo sapien
tgcctccgtgaagcgagcatgactt

SEQ ID NO: 96591 - DNA, 25 bp, Homo sapien
gcctccaggctacagcgcagcggat

SEQ ID NO: 96592 - DNA, 25 bp, Homo sapien
ccaggaatgtgccaggatgtttttg

SEQ ID NO: 96593 - DNA, 25 bp, Homo sapien
tatgccagttgctaatctatttaaa

SEQ ID NO: 96594 - DNA, 25 bp, Homo sapien
attgatccacttaatagagcacagg

SEQ ID NO: 96595 - DNA, 25 bp, Homo sapien
tgtgctatcttttaggctttattga

SEQ ID NO: 96596 - DNA, 25 bp, Homo sapien
ctgcgctatggatagatgtgctatc

SEQ ID NO: 96597 - DNA, 25 bp, Homo sapien
aatattcagtgaactgcgctatgga

SEQ ID NO: 96598 - DNA, 25 bp, Homo sapien
tcagcaagtctcaatagtgggctta

SEQ ID NO: 96599 - DNA, 25 bp, Homo sapien
gcatctttctttcttatcagcaagt

SEQ ID NO: 96600 - DNA, 25 bp, Homo sapien
tccatccagccttgatagcacaggg

SEQ ID NO: 96601 - DNA, 25 bp, Homo sapien
ccggtcagtaggtctcagacgcctg

SEQ ID NO: 96602 - DNA, 25 bp, Homo sapien
cagtaggtctcagacgcctgggctc

SEQ ID NO: 96603 - DNA, 25 bp, Homo sapien
tgcccgcggccggtcagtaggtctc

SEQ ID NO: 96604 - DNA, 25 bp, Homo sapien
gcgcccaggcgtccgttcccagcgc

SEQ ID NO: 96605 - DNA, 25 bp, Homo sapien
cgcgcggacctacccgctccacatc

SEQ ID NO: 96606 - DNA, 25 bp, Homo sapien
ctgcaagtcggctcgcctgcaggca

SEQ ID NO: 96607 - DNA, 25 bp, Homo sapien
agtctcctggctgcaagtcggctcg

SEQ ID NO: 96608 - DNA, 25 bp, Homo sapien
gagaccacggcgctcggagggaacc

SEQ ID NO: 96609 - DNA, 25 bp, Homo sapien
actatcatgtccactcccggggtca

SEQ ID NO: 96610 - DNA, 25 bp, Homo sapien
catcccggcggtgatgttcatcttc

SEQ ID NO: 96611 - DNA, 25 bp, Homo sapien
ggagacgaccttctacacgctggta

SEQ ID NO: 96612 - DNA, 25 bp, Homo sapien
gcgcgggtctaacaccttacaagtg

SEQ ID NO: 96613 - DNA, 25 bp, Homo sapien
atcagtgtatcgtttctcgggcgcg

SEQ ID NO: 96614 - DNA, 25 bp, Homo sapien
gagcgcgctctccaaattgcttttg

SEQ ID NO: 96615 - DNA, 25 bp, Homo sapien
ctagcgagctacttttcccttgaga

SEQ ID NO: 96616 - DNA, 25 bp, Homo sapien
ccgcagttggtaagtggctacaatc

SEQ ID NO: 96617 - DNA, 25 bp, Homo sapien
ctgggcgttcgaacagtccacagaa

SEQ ID NO: 96618 - DNA, 25 bp, Homo sapien
tccctggattcctggtttcctaaga

SEQ ID NO: 96619 - DNA, 25 bp, Homo sapien
ccactgcatgaccttctgggatttg

SEQ ID NO: 96620 - DNA, 25 bp, Homo sapien
agcctagctgatgaggtcggccaga

SEQ ID NO: 96621 - DNA, 25 bp, Homo sapien
cccgaaggggtttatagcctagctg

SEQ ID NO: 96622 - DNA, 25 bp, Homo sapien
gatttgtagtagtcagggccacgcg

SEQ ID NO: 96623 - DNA, 25 bp, Homo sapien
cagactcgcttgtccctggagacca

SEQ ID NO: 96624 - DNA, 25 bp, Homo sapien
tggagaccaaccctagcgaccaggc

SEQ ID NO: 96625 - DNA, 25 bp, Homo sapien
gccactgctttctaaccttgatttt

SEQ ID NO: 96626 - DNA, 25 bp, Homo sapien
cttgttacgagagccgcgtgaatta

SEQ ID NO: 96627 - DNA, 25 bp, Homo sapien
gaagcccgcttgagtgatgcacatc

SEQ ID NO: 96628 - DNA, 25 bp, Homo sapien
tcctggaacgattaggcggaccgtc

SEQ ID NO: 96629 - DNA, 25 bp, Homo sapien
gtcgcagaagaccatccagagggga

SEQ ID NO: 96630 - DNA, 25 bp, Homo sapien
acctgggaaagtttgcaccttcgca

SEQ ID NO: 96631 - DNA, 25 bp, Homo sapien
cccagaatgtagtggccgatcttca

SEQ ID NO: 96632 - DNA, 25 bp, Homo sapien
tcgtgtttctgcttctcggctgtcg

SEQ ID NO: 96633 - DNA, 25 bp, Homo sapien
accgtcgattactgtcttctaggca

SEQ ID NO: 96634 - DNA, 25 bp, Homo sapien
tgtgcgcctgggataatccctttta

SEQ ID NO: 96635 - DNA, 25 bp, Homo sapien
tttcgcacgttagcagtcagatctg

SEQ ID NO: 96636 - DNA, 25 bp, Homo sapien
gccgacgctgactttccctgcgaga

SEQ ID NO: 96637 - DNA, 25 bp, Homo sapien
ccctgagggccgtttagattacagt

SEQ ID NO: 96638 - DNA, 25 bp, Homo sapien
ctggtgctactgctactactgatcg

SEQ ID NO: 96639 - DNA, 25 bp, Homo sapien
gccgatcgcgtttcagtgccggaaa

SEQ ID NO: 96640 - DNA, 25 bp, Homo sapien
gcacttccgctatatcacgctcaga

SEQ ID NO: 96641 - DNA, 25 bp, Homo sapien
gcagcggctagtcagccttcggaga

SEQ ID NO: 96642 - DNA, 25 bp, Homo sapien
cagccttcggagagccccacggcgg

SEQ ID NO: 96643 - DNA, 25 bp, Homo sapien
agagggcagcggctagtcagccttc

SEQ ID NO: 96644 - DNA, 25 bp, Homo sapien
cagcggctagtcagccttcggagag

SEQ ID NO: 96645 - DNA, 25 bp, Homo sapien
agcggctagtcagccttcggagagc

SEQ ID NO: 96646 - DNA, 25 bp, Homo sapien
cggctagtcagccttcggagagccc

SEQ ID NO: 96647 - DNA, 25 bp, Homo sapien
gctagtcagccttcggagagcccca

SEQ ID NO: 96648 - DNA, 25 bp, Homo sapien
agtcagccttcggagagccccacgg

SEQ ID NO: 96649 - DNA, 25 bp, Homo sapien
tgcaggaaggagtccacggacttgc

SEQ ID NO: 96650 - DNA, 25 bp, Homo sapien
cgggagcgttacatgtgtgtggact

SEQ ID NO: 96651 - DNA, 25 bp, Homo sapien
ccacggacttgctgctgaggcggaa

SEQ ID NO: 96652 - DNA, 25 bp, Homo sapien
tagggaatctgcgtgcgggccctct

SEQ ID NO: 96653 - DNA, 25 bp, Homo sapien
tccagggcctcgtccggagaaaaca

SEQ ID NO: 96654 - DNA, 25 bp, Homo sapien
ctcgtccggagaaaacacagggttg

SEQ ID NO: 96655 - DNA, 25 bp, Homo sapien
cacagggttgtcaattcctaggaga

SEQ ID NO: 96656 - DNA, 25 bp, Homo sapien
ttgtcaattcctaggagagagggca

SEQ ID NO: 96657 - DNA, 25 bp, Homo sapien
catacggtccgcaagggtttgcttt

SEQ ID NO: 96658 - DNA, 25 bp, Homo sapien
cgagcagtaaacatacggtccgcaa

SEQ ID NO: 96659 - DNA, 25 bp, Homo sapien
gagcagtaaacatacggtccgcaag

SEQ ID NO: 96660 - DNA, 25 bp, Homo sapien
gcagtaaacatacggtccgcaaggg

SEQ ID NO: 96661 - DNA, 25 bp, Homo sapien
acatacggtccgcaagggtttgctt

SEQ ID NO: 96662 - DNA, 25 bp, Homo sapien
aacatacggtccgcaagggtttgct

SEQ ID NO: 96663 - DNA, 25 bp, Homo sapien
cagtaaacatacggtccgcaagggt

SEQ ID NO: 96664 - DNA, 25 bp, Homo sapien
agcagtaaacatacggtccgcaagg

SEQ ID NO: 96665 - DNA, 25 bp, Homo sapien
cctgggcgaagtgtgttgccaacac

SEQ ID NO: 96666 - DNA, 25 bp, Homo sapien
ccagggatagactcaggtccttgca

SEQ ID NO: 96667 - DNA, 25 bp, Homo sapien
actttcatcactcttcgggaagcgc

SEQ ID NO: 96668 - DNA, 25 bp, Homo sapien
tgtagccgagaatctatcaaatccg

SEQ ID NO: 96669 - DNA, 25 bp, Homo sapien
tttcaagggcagctatcacgccgcc

SEQ ID NO: 96670 - DNA, 25 bp, Homo sapien
ccgatacgaaatggtgccctctgcc

SEQ ID NO: 96671 - DNA, 25 bp, Homo sapien
gcacttggaccagactcgagacagc

SEQ ID NO: 96672 - DNA, 25 bp, Homo sapien
tccgcccaattccatgccagggata

SEQ ID NO: 96673 - DNA, 25 bp, Homo sapien
tcggctaatttcagctcgtttttcc

SEQ ID NO: 96674 - DNA, 25 bp, Homo sapien
agttgccatccagtcggctaatttc

SEQ ID NO: 96675 - DNA, 25 bp, Homo sapien
ctgtgcatgctctccggcagagttg

SEQ ID NO: 96676 - DNA, 25 bp, Homo sapien
cgcgcctacctggaatggctaaatt

SEQ ID NO: 96677 - DNA, 25 bp, Homo sapien
accacttagtggcagataaagcagg

SEQ ID NO: 96678 - DNA, 25 bp, Homo sapien
gaaaacgccaggaagcccaaggcta

SEQ ID NO: 96679 - DNA, 25 bp, Homo sapien
agacgagtttccctcccgcgggcat

SEQ ID NO: 96680 - DNA, 25 bp, Homo sapien
gggcatcgtggcaagttaccactta

SEQ ID NO: 96681 - DNA, 25 bp, Homo sapien
aagttcctctcagcgcctcaggtgt

SEQ ID NO: 96682 - DNA, 25 bp, Homo sapien
ccgcactttaccttgtaccaggttg

SEQ ID NO: 96683 - DNA, 25 bp, Homo sapien
tggtccacgttcttcctgcccatgg

SEQ ID NO: 96684 - DNA, 25 bp, Homo sapien
atcgcgtctcgctccatcagggaag

SEQ ID NO: 96685 - DNA, 25 bp, Homo sapien
ggggcgcaaacctacccgctgttgc

SEQ ID NO: 96686 - DNA, 25 bp, Homo sapien
ctctgcccagagatccaacatcggg

SEQ ID NO: 96687 - DNA, 25 bp, Homo sapien
cagcctcaggttctgggcctctaga

SEQ ID NO: 96688 - DNA, 25 bp, Homo sapien
cccggtgaactcgagcagagccatg

SEQ ID NO: 96689 - DNA, 25 bp, Homo sapien
accaaccaggagaggtccgccctag

SEQ ID NO: 96690 - DNA, 25 bp, Homo sapien
gctcaggcccacatacagcaactta

SEQ ID NO: 96691 - DNA, 25 bp, Homo sapien
cgtcaccaagctgtcttccaagagg

SEQ ID NO: 96692 - DNA, 25 bp, Homo sapien
agagagctgacttccgattgggtca

SEQ ID NO: 96693 - DNA, 25 bp, Homo sapien
gctggctccctattggcttacagga

SEQ ID NO: 96694 - DNA, 25 bp, Homo sapien
gagaggcgtgtctcaacgtcacacc

SEQ ID NO: 96695 - DNA, 25 bp, Homo sapien
ctagtctccttgctgctcaggatta

SEQ ID NO: 96696 - DNA, 25 bp, Homo sapien
agcaacttagcgaagctgccggtga

SEQ ID NO: 96697 - DNA, 25 bp, Homo sapien
tgacgcgctagcgtggctctaagac

SEQ ID NO: 96698 - DNA, 25 bp, Homo sapien
gtggctctaagacgcgtcacccacg

SEQ ID NO: 96699 - DNA, 25 bp, Homo sapien
ttctggcagtcagtgagcaaggaga

SEQ ID NO: 96700 - DNA, 25 bp, Homo sapien
tggaagaccttctggcagtcagtga

SEQ ID NO: 96701 - DNA, 25 bp, Homo sapien
catcctcagcggctggaagaccttc

SEQ ID NO: 96702 - DNA, 25 bp, Homo sapien
aggcggccatcctcagcggctggaa

SEQ ID NO: 96703 - DNA, 25 bp, Homo sapien
cgcccttcagcgactggggccgcct

SEQ ID NO: 96704 - DNA, 25 bp, Homo sapien
agccgcgcagcggaacaaactcgcc

SEQ ID NO: 96705 - DNA, 25 bp, Homo sapien
gacgtcctgccgttagcaatgaaaa

SEQ ID NO: 96706 - DNA, 25 bp, Homo sapien
tggtggaaccagtacgagaacctgc

SEQ ID NO: 96707 - DNA, 25 bp, Homo sapien
aagcgctgacatcatggtccctgga

SEQ ID NO: 96708 - DNA, 25 bp, Homo sapien
gcggactgcagccagtgaaactgaa

SEQ ID NO: 96709 - DNA, 25 bp, Homo sapien
tcggcgcctctctgtagggaaaggt

SEQ ID NO: 96710 - DNA, 25 bp, Homo sapien
ttctacgtgacgctggtcgtgaccc

SEQ ID NO: 96711 - DNA, 25 bp, Homo sapien
ggtgacagaacccttggggctctcg

SEQ ID NO: 96712 - DNA, 25 bp, Homo sapien
tcagcaccgcagtctacaagcgctt

SEQ ID NO: 96713 - DNA, 25 bp, Homo sapien
cgcgcagctcagttgagagtgacac

SEQ ID NO: 96714 - DNA, 25 bp, Homo sapien
tcgcttctgcaacctggatctgggg

SEQ ID NO: 96715 - DNA, 25 bp, Homo sapien
ttcgccttcgcttctgcaacctgga

SEQ ID NO: 96716 - DNA, 25 bp, Homo sapien
tcgaactggcctccttgaacgtccg

SEQ ID NO: 96717 - DNA, 25 bp, Homo sapien
ctctccgcagcagttctcgaactgg

SEQ ID NO: 96718 - DNA, 25 bp, Homo sapien
agcaactcggaatgcttggcccggg

SEQ ID NO: 96719 - DNA, 25 bp, Homo sapien
ggaagacttcatcccagcaactcgg

SEQ ID NO: 96720 - DNA, 25 bp, Homo sapien
gagagtgacacgcaccaactccagc

SEQ ID NO: 96721 - DNA, 25 bp, Homo sapien
tcctgaatgagtgtacgtgtgcgct

SEQ ID NO: 96722 - DNA, 25 bp, Homo sapien
gctttatatatagcccgaggggatg

SEQ ID NO: 96723 - DNA, 25 bp, Homo sapien
ggaaattgtggcgagccgacctccc

SEQ ID NO: 96724 - DNA, 25 bp, Homo sapien
gagtgacagccaccagtccgcatga

SEQ ID NO: 96725 - DNA, 25 bp, Homo sapien
tccggagacagttttgttaaagtca

SEQ ID NO: 96726 - DNA, 25 bp, Homo sapien
cgggcgacagacgaaccatcacact

SEQ ID NO: 96727 - DNA, 25 bp, Homo sapien
ccagcttttgacacactagtggttg

SEQ ID NO: 96728 - DNA, 25 bp, Homo sapien
gtttctgtttgccatcatctgcctg

SEQ ID NO: 96729 - DNA, 25 bp, Homo sapien
acaggagcgcgttctttggattccc

SEQ ID NO: 96730 - DNA, 25 bp, Homo sapien
ggaggcttccttgtgcagcataggc

SEQ ID NO: 96731 - DNA, 25 bp, Homo sapien
ccctcttcgaagactggtcgcggga

SEQ ID NO: 96732 - DNA, 25 bp, Homo sapien
gcggcgtgcacaaccttcggacgaa

SEQ ID NO: 96733 - DNA, 25 bp, Homo sapien
ccagaatcagcggtactggggcttc

SEQ ID NO: 96734 - DNA, 25 bp, Homo sapien
tgtccgccaagaagaccgcagcctg

SEQ ID NO: 96735 - DNA, 25 bp, Homo sapien
tgggccaccactctgagaaccagaa

SEQ ID NO: 96736 - DNA, 25 bp, Homo sapien
ttcggacgaagagtccacgcctgcc

SEQ ID NO: 96737 - DNA, 25 bp, Homo sapien
gtccgaggagacctttcagagtgtc

SEQ ID NO: 96738 - DNA, 25 bp, Homo sapien
cccttgcttcgtggacagacgactg

SEQ ID NO: 96739 - DNA, 25 bp, Homo sapien
tccggcaccggcaaataggagtagc

SEQ ID NO: 96740 - DNA, 25 bp, Homo sapien
cagacgccctaagaaggtgtccacc

SEQ ID NO: 96741 - DNA, 25 bp, Homo sapien
tgcagattgcatgcgcttgagggca

SEQ ID NO: 96742 - DNA, 25 bp, Homo sapien
cgaagccaccaaccgaagttccaag

SEQ ID NO: 96743 - DNA, 25 bp, Homo sapien
aggggctcaaagtcgcccgctctga

SEQ ID NO: 96744 - DNA, 25 bp, Homo sapien
cgcagcgcactttgagaaggggctc

SEQ ID NO: 96745 - DNA, 25 bp, Homo sapien
ggtgccagcgaaacactgcagtttg

SEQ ID NO: 96746 - DNA, 25 bp, Homo sapien
tccgtacgacaagtgctgtggcaga

SEQ ID NO: 96747 - DNA, 25 bp, Homo sapien
ctcacatctgcaacctgggtgctgc

SEQ ID NO: 96748 - DNA, 25 bp, Homo sapien
cggagaccaggaaactatgtgtagc

SEQ ID NO: 96749 - DNA, 25 bp, Homo sapien
ctggctccctaaaccgattagattg

SEQ ID NO: 96750 - DNA, 25 bp, Homo sapien
ctccgcggagctagtgttcatatga

SEQ ID NO: 96751 - DNA, 25 bp, Homo sapien
aaaccgccagttgggctctgctaga

SEQ ID NO: 96752 - DNA, 25 bp, Homo sapien
tgaaaccagccttgcctccagcgga

SEQ ID NO: 96753 - DNA, 25 bp, Homo sapien
ccagcttggtcgacttgaaggactc

SEQ ID NO: 96754 - DNA, 25 bp, Homo sapien
ccgcatggtcctgtggaagatttcc

SEQ ID NO: 96755 - DNA, 25 bp, Homo sapien
cgtgtcggctgtacagatgcttgta

SEQ ID NO: 96756 - DNA, 25 bp, Homo sapien
cgcggcttgtacaggtactgctgta

SEQ ID NO: 96757 - DNA, 25 bp, Homo sapien
gtcgctgctccagagactgcatgtc

SEQ ID NO: 96758 - DNA, 25 bp, Homo sapien
agccatacaggctccctcagggtgg

SEQ ID NO: 96759 - DNA, 25 bp, Homo sapien
gcacgctcccgcttgtacagcttgg

SEQ ID NO: 96760 - DNA, 25 bp, Homo sapien
attttctctcctgcgtggggaccag

SEQ ID NO: 96761 - DNA, 25 bp, Homo sapien
cctccattttctcggggcgacagca

SEQ ID NO: 96762 - DNA, 25 bp, Homo sapien
agcgactctcttttccctgaacgga

SEQ ID NO: 96763 - DNA, 25 bp, Homo sapien
agccagattttcacaccagcgagtc

SEQ ID NO: 96764 - DNA, 25 bp, Homo sapien
gcctgacagttttccggttgcgaca

SEQ ID NO: 96765 - DNA, 25 bp, Homo sapien
gcacctggcgttcgttagctctttc

SEQ ID NO: 96766 - DNA, 25 bp, Homo sapien
ttagctctttcaccagcggcgcgga

SEQ ID NO: 96767 - DNA, 25 bp, Homo sapien
ggccgcagtcattcgcaagctccag

SEQ ID NO: 96768 - DNA, 25 bp, Homo sapien
gctccaggcaccgacatttcgcaga

SEQ ID NO: 96769 - DNA, 25 bp, Homo sapien
ctctgcttctaatgcggagctggcg

SEQ ID NO: 96770 - DNA, 25 bp, Homo sapien
ttgcagcaacgcttttgccagtagc

SEQ ID NO: 96771 - DNA, 25 bp, Homo sapien
agtagcgcccactgagcggtttttc

SEQ ID NO: 96772 - DNA, 25 bp, Homo sapien
gttgctgcaccgttcttagcgccca

SEQ ID NO: 96773 - DNA, 25 bp, Homo sapien
tcccgtacgcggagtccataagttg

SEQ ID NO: 96774 - DNA, 25 bp, Homo sapien
tgtcgtcactttctcggttctggca

SEQ ID NO: 96775 - DNA, 25 bp, Homo sapien
gagcctctgtgccaactagtacttc

SEQ ID NO: 96776 - DNA, 25 bp, Homo sapien
gtctccgcttcggtggtttcaggtc

SEQ ID NO: 96777 - DNA, 25 bp, Homo sapien
gttatggcgcctaaacggatatttg

SEQ ID NO: 96778 - DNA, 25 bp, Homo sapien
gccagattcttgctagcgaggtcca

SEQ ID NO: 96779 - DNA, 25 bp, Homo sapien
tccctgcgttttgtagcgctcgttc

SEQ ID NO: 96780 - DNA, 25 bp, Homo sapien
gctcgttctctgtaaggtttgctta

SEQ ID NO: 96781 - DNA, 25 bp, Homo sapien
agcaatgctcatttcccggacacag

SEQ ID NO: 96782 - DNA, 25 bp, Homo sapien
tcccggacacagatggtttttggcc

SEQ ID NO: 96783 - DNA, 25 bp, Homo sapien
tgaagaactctttaatccctgcgtt

SEQ ID NO: 96784 - DNA, 25 bp, Homo sapien
tgcagagacctagcggacagttttc

SEQ ID NO: 96785 - DNA, 25 bp, Homo sapien
actcgcctctcgcttagtggacaga

SEQ ID NO: 96786 - DNA, 25 bp, Homo sapien
tcctgggccgacctagatttccact

SEQ ID NO: 96787 - DNA, 25 bp, Homo sapien
gatttccactgccacatactttccg

SEQ ID NO: 96788 - DNA, 25 bp, Homo sapien
tgcgtgcttccttgctgaaactgcc

SEQ ID NO: 96789 - DNA, 25 bp, Homo sapien
cctgctctggatccggcgcaggcaa

SEQ ID NO: 96790 - DNA, 25 bp, Homo sapien
caggaggctgcatagggtctcaaca

SEQ ID NO: 96791 - DNA, 25 bp, Homo sapien
cgactggagccggagacttccatcc

SEQ ID NO: 96792 - DNA, 25 bp, Homo sapien
tgcatagggtctcaacatacgcccg

SEQ ID NO: 96793 - DNA, 25 bp, Homo sapien
cgggtcgcttgtggtctcttatagc

SEQ ID NO: 96794 - DNA, 25 bp, Homo sapien
gtctgcctttggctgaaagcaaata

SEQ ID NO: 96795 - DNA, 25 bp, Homo sapien
cttaggtggtcgagcgcattttctc

SEQ ID NO: 96796 - DNA, 25 bp, Homo sapien
ccttgtgacaccttgctgcagattg

SEQ ID NO: 96797 - DNA, 25 bp, Homo sapien
tcatagctgcggagaagcccttgtg

SEQ ID NO: 96798 - DNA, 25 bp, Homo sapien
ccggggcatggtgttagaaatcata

SEQ ID NO: 96799 - DNA, 25 bp, Homo sapien
tgtgcggtttctgcaacaaaggctg

SEQ ID NO: 96800 - DNA, 25 bp, Homo sapien
ggtgatcctgattcggctcccattt

SEQ ID NO: 96801 - DNA, 25 bp, Homo sapien
cggtttctcacacgcacttcattgg

SEQ ID NO: 96802 - DNA, 25 bp, Homo sapien
cggcgctagttggtctgcacgaaac

SEQ ID NO: 96803 - DNA, 25 bp, Homo sapien
ggtgcctgtattttctcggtgccta

SEQ ID NO: 96804 - DNA, 25 bp, Homo sapien
tgcaccgctgatggcgcccaaaaga

SEQ ID NO: 96805 - DNA, 25 bp, Homo sapien
agattctcacactcgcgggtccagc

SEQ ID NO: 96806 - DNA, 25 bp, Homo sapien
gaacgcgcatttgtctttggcaaca

SEQ ID NO: 96807 - DNA, 25 bp, Homo sapien
tgcgccgtaacgaatgttctccttg

SEQ ID NO: 96808 - DNA, 25 bp, Homo sapien
cttcattggcagcactggcgagtca

SEQ ID NO: 96809 - DNA, 25 bp, Homo sapien
ccgacgtcgccaacaagcggtgcta

SEQ ID NO: 96810 - DNA, 25 bp, Homo sapien
tgctaccaggagaaacgcctgcttt

SEQ ID NO: 96811 - DNA, 25 bp, Homo sapien
cacaaacgcaggtacagggacagcc

SEQ ID NO: 96812 - DNA, 25 bp, Homo sapien
ggacagccgacaccgagaaccaagg

SEQ ID NO: 96813 - DNA, 25 bp, Homo sapien
gagctgcgcctccacggaataactg

SEQ ID NO: 96814 - DNA, 25 bp, Homo sapien
cacagtgcgagtgagaaaccggcca

SEQ ID NO: 96815 - DNA, 25 bp, Homo sapien
cggccactccatgaaacgaccagta

SEQ ID NO: 96816 - DNA, 25 bp, Homo sapien
accagtactgccacggaaaagaatc

SEQ ID NO: 96817 - DNA, 25 bp, Homo sapien
gccctaaccaccttgcaaacgagaa

SEQ ID NO: 96818 - DNA, 25 bp, Homo sapien
caaatcttgaagagaactagcgcta

SEQ ID NO: 96819 - DNA, 25 bp, Homo sapien
tagcgctacagaacgcaggtattca

SEQ ID NO: 96820 - DNA, 25 bp, Homo sapien
caggtattcaagagcgcgcaagggc

SEQ ID NO: 96821 - DNA, 25 bp, Homo sapien
ccgtttccgggaaatgagcgttgct

SEQ ID NO: 96822 - DNA, 25 bp, Homo sapien
aaaactgtctgctagggctctgccc

SEQ ID NO: 96823 - DNA, 25 bp, Homo sapien
cgttgaacttagcaagcgccggcac

SEQ ID NO: 96824 - DNA, 25 bp, Homo sapien
agaaactggcgcgttgaacttagca

SEQ ID NO: 96825 - DNA, 25 bp, Homo sapien
ggaacctgataccagcgaggctaag

SEQ ID NO: 96826 - DNA, 25 bp, Homo sapien
tgataccagcgaggctaagaccgag

SEQ ID NO: 96827 - DNA, 25 bp, Homo sapien
taccagcgaggctaagaccgagctc

SEQ ID NO: 96828 - DNA, 25 bp, Homo sapien
cagcgaggctaagaccgagctcggc

SEQ ID NO: 96829 - DNA, 25 bp, Homo sapien
gcgaggctaagaccgagctcggctc

SEQ ID NO: 96830 - DNA, 25 bp, Homo sapien
gaggctaagaccgagctcggctccc

SEQ ID NO: 96831 - DNA, 25 bp, Homo sapien
aacctgataccagcgaggctaagac

SEQ ID NO: 96832 - DNA, 25 bp, Homo sapien
cctgataccagcgaggctaagaccg

SEQ ID NO: 96833 - DNA, 25 bp, Homo sapien
agctctgcataggaagcggagcctc

SEQ ID NO: 96834 - DNA, 25 bp, Homo sapien
gttctgcacggcaaaacggggttca

SEQ ID NO: 96835 - DNA, 25 bp, Homo sapien
attactagtgcgaacagcggctcgg

SEQ ID NO: 96836 - DNA, 25 bp, Homo sapien
cgccggctaatggtaccacacaatt

SEQ ID NO: 96837 - DNA, 25 bp, Homo sapien
ttgggtgcagcaactgagaaaacgc

SEQ ID NO: 96838 - DNA, 25 bp, Homo sapien
ggcgccactggcaaacgtgctgata

SEQ ID NO: 96839 - DNA, 25 bp, Homo sapien
tgctgatacaaaaccgccagctctg

SEQ ID NO: 96840 - DNA, 25 bp, Homo sapien
tgacagcactgagaacctaaggacc

SEQ ID NO: 96841 - DNA, 25 bp, Homo sapien
gacaacatttgttttggcgcaacca

SEQ ID NO: 96842 - DNA, 25 bp, Homo sapien
aggctcccttcaccgattatgctgc

SEQ ID NO: 96843 - DNA, 25 bp, Homo sapien
aaaccgccagctgggctagactaga

SEQ ID NO: 96844 - DNA, 25 bp, Homo sapien
tccagctccgcgcaatcagtggttc

SEQ ID NO: 96845 - DNA, 25 bp, Homo sapien
tgcgcggccacagaagtacatccag

SEQ ID NO: 96846 - DNA, 25 bp, Homo sapien
ggggccagagaaacaccgcgatttc

SEQ ID NO: 96847 - DNA, 25 bp, Homo sapien
ctgtgcacagcacgactagcagttg

SEQ ID NO: 96848 - DNA, 25 bp, Homo sapien
ggggcagctgcgactttaaatctct

SEQ ID NO: 96849 - DNA, 25 bp, Homo sapien
gccaacaaaacgctgggtgctgcca

SEQ ID NO: 96850 - DNA, 25 bp, Homo sapien
ctcagatcggctaccagagcgctgc

SEQ ID NO: 96851 - DNA, 25 bp, Homo sapien
agatgtgccgcgaccaagagaactc

SEQ ID NO: 96852 - DNA, 25 bp, Homo sapien
tgggaccctaagagtgacgccagcc

SEQ ID NO: 96853 - DNA, 25 bp, Homo sapien
gttcccaaggacaacatccattttg

SEQ ID NO: 96854 - DNA, 25 bp, Homo sapien
ccgagaaattcggtgcaacaagtgc

SEQ ID NO: 96855 - DNA, 25 bp, Homo sapien
gcgcaactggctgcgattccaaatc

SEQ ID NO: 96856 - DNA, 25 bp, Homo sapien
tcacgcagaaaatgtcgaccctcgg

SEQ ID NO: 96857 - DNA, 25 bp, Homo sapien
tccgggctccgagagaacaaaagca

SEQ ID NO: 96858 - DNA, 25 bp, Homo sapien
cgtggcatccacaaaatggcaggtc

SEQ ID NO: 96859 - DNA, 25 bp, Homo sapien
gctccgagagaacaaaagcagaagc

SEQ ID NO: 96860 - DNA, 25 bp, Homo sapien
atgggtttcagcacagcagacggcg

SEQ ID NO: 96861 - DNA, 25 bp, Homo sapien
ccagcatgggtttcagcacagcaga

SEQ ID NO: 96862 - DNA, 25 bp, Homo sapien
agaccagggtccagcatgggtttca

SEQ ID NO: 96863 - DNA, 25 bp, Homo sapien
ctcggcccagtgcacagcgggacca

SEQ ID NO: 96864 - DNA, 25 bp, Homo sapien
tccgggtgcaacgtggcatccacaa

SEQ ID NO: 96865 - DNA, 25 bp, Homo sapien
agaggatgtggtcgaaagcctttca

SEQ ID NO: 96866 - DNA, 25 bp, Homo sapien
agcttctcgttgagccgaggttccc

SEQ ID NO: 96867 - DNA, 25 bp, Homo sapien
tcaagggaagaaagacatgagcgtc

SEQ ID NO: 96868 - DNA, 25 bp, Homo sapien
atctgtccggatatgtcctcgatgg

SEQ ID NO: 96869 - DNA, 25 bp, Homo sapien
tgtgcccgatctgtccggatatgtc

SEQ ID NO: 96870 - DNA, 25 bp, Homo sapien
gtctctgagataattgtgcccgatc

SEQ ID NO: 96871 - DNA, 25 bp, Homo sapien
cccagccacttacttgtctctgaga

SEQ ID NO: 96872 - DNA, 25 bp, Homo sapien
ttacgcgcccgtgcagcttctcgtt

SEQ ID NO: 96873 - DNA, 25 bp, Homo sapien
tccaattaggtcaggctcggagtcc

SEQ ID NO: 96874 - DNA, 25 bp, Homo sapien
cccacgagctaggtaaggcgggcca

SEQ ID NO: 96875 - DNA, 25 bp, Homo sapien
tcgacgtaagtgacgcgcaagcctg

SEQ ID NO: 96876 - DNA, 25 bp, Homo sapien
cccggctctcacgaagaaaatggag

SEQ ID NO: 96877 - DNA, 25 bp, Homo sapien
ggcaatgacttaggttcccagcttc

SEQ ID NO: 96878 - DNA, 25 bp, Homo sapien
tgccaggctctgcagtagcccaagc

SEQ ID NO: 96879 - DNA, 25 bp, Homo sapien
ccgctgcccggtttcttctcagaga

SEQ ID NO: 96880 - DNA, 25 bp, Homo sapien
tcgcgtctcccgactccaattaggt

SEQ ID NO: 96881 - DNA, 25 bp, Homo sapien
ctgctggtggagagaactgacatct

SEQ ID NO: 96882 - DNA, 25 bp, Homo sapien
gccctaaggcaccagaccaaatctg

SEQ ID NO: 96883 - DNA, 25 bp, Homo sapien
cgctccggattggtccttcaggaaa

SEQ ID NO: 96884 - DNA, 25 bp, Homo sapien
cctggctgccatagaaaccagctta

SEQ ID NO: 96885 - DNA, 25 bp, Homo sapien
ggtcctctttgcgtcaggcccaatc

SEQ ID NO: 96886 - DNA, 25 bp, Homo sapien
agcttagcgcctagcgttgcgcaca

SEQ ID NO: 96887 - DNA, 25 bp, Homo sapien
aagagctggcctcgccacgaaggta

SEQ ID NO: 96888 - DNA, 25 bp, Homo sapien
tgtgtgcacccatgtctctgtatgg

SEQ ID NO: 96889 - DNA, 25 bp, Homo sapien
ggcggactctcgcagggcaaaagaa

SEQ ID NO: 96890 - DNA, 25 bp, Homo sapien
gggcaactccggaaacagcagctgc

SEQ ID NO: 96891 - DNA, 25 bp, Homo sapien
ggcggatcttcgctttgcggactcc

SEQ ID NO: 96892 - DNA, 25 bp, Homo sapien
gtcagttcggacatgatgaggaacc

SEQ ID NO: 96893 - DNA, 25 bp, Homo sapien
gctccatcagctctttagtcagttc

SEQ ID NO: 96894 - DNA, 25 bp, Homo sapien
tcgcagggcaaaagaagcagcggct

SEQ ID NO: 96895 - DNA, 25 bp, Homo sapien
cgagaggcgtcacaggcggactctc

SEQ ID NO: 96896 - DNA, 25 bp, Homo sapien
ccagggtaccttgcgtccagcggca

SEQ ID NO: 96897 - DNA, 25 bp, Homo sapien
aggcggggatctacttcctctctcg

SEQ ID NO: 96898 - DNA, 25 bp, Homo sapien
ctagggataccaccggacttggatc

SEQ ID NO: 96899 - DNA, 25 bp, Homo sapien
gcaagcggggccttacctagggata

SEQ ID NO: 96900 - DNA, 25 bp, Homo sapien
aaatcatagttttcgcccgcgctgc

SEQ ID NO: 96901 - DNA, 25 bp, Homo sapien
gagggctgactggtacttcctgtta

SEQ ID NO: 96902 - DNA, 25 bp, Homo sapien
accggacttggatcggagcagcctt

SEQ ID NO: 96903 - DNA, 25 bp, Homo sapien
cccggacaaacttgccgaggattgg

SEQ ID NO: 96904 - DNA, 25 bp, Homo sapien
cccgcagattgctagtggatatggc

SEQ ID NO: 96905 - DNA, 25 bp, Homo sapien
cacgagagcccagttgccaatgacg

SEQ ID NO: 96906 - DNA, 25 bp, Homo sapien
gcgatgactcgctaggattttccct

SEQ ID NO: 96907 - DNA, 25 bp, Homo sapien
ccagtccggcttctaccaatcaaaa

SEQ ID NO: 96908 - DNA, 25 bp, Homo sapien
gggcaaagtccacgcctacgtcctg

SEQ ID NO: 96909 - DNA, 25 bp, Homo sapien
agtgagccacgaaaggacagtccgc

SEQ ID NO: 96910 - DNA, 25 bp, Homo sapien
tgccaatgacggagctgcgagatac

SEQ ID NO: 96911 - DNA, 25 bp, Homo sapien
tcgcctgtgttctcggatcttctca

SEQ ID NO: 96912 - DNA, 25 bp, Homo sapien
ttcgggcctagtcaaggacaccgcc

SEQ ID NO: 96913 - DNA, 25 bp, Homo sapien
actggtatctgtagtcgtggctgcc

SEQ ID NO: 96914 - DNA, 25 bp, Homo sapien
ccaggagagactgaagtggaaaaca

SEQ ID NO: 96915 - DNA, 25 bp, Homo sapien
cgggaagtgcagagcgacagcaaca

SEQ ID NO: 96916 - DNA, 25 bp, Homo sapien
gacgtgaagaagctgccaaagtata

SEQ ID NO: 96917 - DNA, 25 bp, Homo sapien
tacgcaacctgcttggcgccactga

SEQ ID NO: 96918 - DNA, 25 bp, Homo sapien
cgtcgtttacctgggcgacgtccag

SEQ ID NO: 96919 - DNA, 25 bp, Homo sapien
acgttatggcgctttgaggctgtcg

SEQ ID NO: 96920 - DNA, 25 bp, Homo sapien
aggctgtcgcgctactggtatctgt

SEQ ID NO: 96921 - DNA, 25 bp, Homo sapien
tcggccgtcgcatctctaaggtgca

SEQ ID NO: 96922 - DNA, 25 bp, Homo sapien
tctgagttcaatccagcagcagctc

SEQ ID NO: 96923 - DNA, 25 bp, Homo sapien
ggtgcagcgatacggccaacttcct

SEQ ID NO: 96924 - DNA, 25 bp, Homo sapien
aggccttactaccagaagcttgagc

SEQ ID NO: 96925 - DNA, 25 bp, Homo sapien
tgccgcaaacgtagctgccgacatc

SEQ ID NO: 96926 - DNA, 25 bp, Homo sapien
actggccagctccaagtcgaaagga

SEQ ID NO: 96927 - DNA, 25 bp, Homo sapien
ttttcaccagactgagggaccgggc

SEQ ID NO: 96928 - DNA, 25 bp, Homo sapien
gaccctccagacatcagactcagtg

SEQ ID NO: 96929 - DNA, 25 bp, Homo sapien
cagttcaaaaccagcgccctcaggg

SEQ ID NO: 96930 - DNA, 25 bp, Homo sapien
gcgcaaaccgcacaagaccagttca

SEQ ID NO: 96931 - DNA, 25 bp, Homo sapien
tcagagctccgcaacagggaagaca

SEQ ID NO: 96932 - DNA, 25 bp, Homo sapien
ctcagggagccgcttcagagctccg

SEQ ID NO: 96933 - DNA, 25 bp, Homo sapien
gccacgaaacaggaaagcggagaca

SEQ ID NO: 96934 - DNA, 25 bp, Homo sapien
ccaactgtaaccactaagagaaagc

SEQ ID NO: 96935 - DNA, 25 bp, Homo sapien
ccactaagagaaagcgcaaaccgca

SEQ ID NO: 96936 - DNA, 25 bp, Homo sapien
tgccctcgctgcgttccctacgaag

SEQ ID NO: 96937 - DNA, 25 bp, Homo sapien
ggacgcttaccacaggcaggcccga

SEQ ID NO: 96938 - DNA, 25 bp, Homo sapien
acgcggccctctcggggaatgcttt

SEQ ID NO: 96939 - DNA, 25 bp, Homo sapien
ggcccgatcgaaaccgtccgacatg

SEQ ID NO: 96940 - DNA, 25 bp, Homo sapien
cctcactcgggcctcatggaggagg

SEQ ID NO: 96941 - DNA, 25 bp, Homo sapien
gcaggcccgacctactcggtagttc

SEQ ID NO: 96942 - DNA, 25 bp, Homo sapien
tctcaggagagacgtgcgagaccga

SEQ ID NO: 96943 - DNA, 25 bp, Homo sapien
gagaccgacagttgacgcccgggaa

SEQ ID NO: 96944 - DNA, 25 bp, Homo sapien
aggatcctccagttcgcggctggcc

SEQ ID NO: 96945 - DNA, 25 bp, Homo sapien
tggtgtccctttctcgtctcctgct

SEQ ID NO: 96946 - DNA, 25 bp, Homo sapien
ggggtaactagcctttgagctcaaa

SEQ ID NO: 96947 - DNA, 25 bp, Homo sapien
tttgagctcaaaggggcatttcgtg

SEQ ID NO: 96948 - DNA, 25 bp, Homo sapien
gcatttcgtgaggtcgccttttggt

SEQ ID NO: 96949 - DNA, 25 bp, Homo sapien
ctcgggcctttcctgaagaccacgg

SEQ ID NO: 96950 - DNA, 25 bp, Homo sapien
ccgggagagagacctgtcaaagagc

SEQ ID NO: 96951 - DNA, 25 bp, Homo sapien
cgcgtttggcaccaggtttgattga

SEQ ID NO: 96952 - DNA, 25 bp, Homo sapien
gagacaaagaggtttcgcctgtccc

SEQ ID NO: 96953 - DNA, 25 bp, Homo sapien
cgattgtggcctccatgacagccga

SEQ ID NO: 96954 - DNA, 25 bp, Homo sapien
gaagctgcgaatcctcaccaagatg

SEQ ID NO: 96955 - DNA, 25 bp, Homo sapien
tgccgaccgctggtaccagtacttc

SEQ ID NO: 96956 - DNA, 25 bp, Homo sapien
gaacctgaacctgcgctggacctcg

SEQ ID NO: 96957 - DNA, 25 bp, Homo sapien
tgcctgctgcaggagcacttctacc

SEQ ID NO: 96958 - DNA, 25 bp, Homo sapien
aggtcatatctttgcccttcctgga

SEQ ID NO: 96959 - DNA, 25 bp, Homo sapien
ttcctggatcagctggtgtcaaccc

SEQ ID NO: 96960 - DNA, 25 bp, Homo sapien
ggctttcattgcacaccgcggctaa

SEQ ID NO: 96961 - DNA, 25 bp, Homo sapien
gaagacgctgttgccatcgtcccgg

SEQ ID NO: 96962 - DNA, 25 bp, Homo sapien
cttctggctcccaaacatgcggagg

SEQ ID NO: 96963 - DNA, 25 bp, Homo sapien
actgcctctgcatgaagccgtactg

SEQ ID NO: 96964 - DNA, 25 bp, Homo sapien
ccagaagcctgcagttttaaccctt

SEQ ID NO: 96965 - DNA, 25 bp, Homo sapien
ggagccctcacctgaaatcactgta

SEQ ID NO: 96966 - DNA, 25 bp, Homo sapien
tcccggctgttagacgaagagttgg

SEQ ID NO: 96967 - DNA, 25 bp, Homo sapien
ttcccgggcaacaggagcacatcct

SEQ ID NO: 96968 - DNA, 25 bp, Homo sapien
gtccaccttgaagcacacggagttg

SEQ ID NO: 96969 - DNA, 25 bp, Homo sapien
gactgctccgagatgttggccttca

SEQ ID NO: 96970 - DNA, 25 bp, Homo sapien
ttccaggtccagatgaacgggttca

SEQ ID NO: 96971 - DNA, 25 bp, Homo sapien
ctgtcggcccacagacaattcagtg

SEQ ID NO: 96972 - DNA, 25 bp, Homo sapien
cagtggaaacgccaactccttattt

SEQ ID NO: 96973 - DNA, 25 bp, Homo sapien
cggcatcaccgtcatgcagataatg

SEQ ID NO: 96974 - DNA, 25 bp, Homo sapien
acggccgagatacccaggaacatga

SEQ ID NO: 96975 - DNA, 25 bp, Homo sapien
gcccggtacacggagatgaagacca

SEQ ID NO: 96976 - DNA, 25 bp, Homo sapien
tgctggccagcatcttcatggtgta

SEQ ID NO: 96977 - DNA, 25 bp, Homo sapien
gctgttcgttcaagactcgccccaa

SEQ ID NO: 96978 - DNA, 25 bp, Homo sapien
agccgcagcagtttcagggttcagc

SEQ ID NO: 96979 - DNA, 25 bp, Homo sapien
ggtgtccagagtccctgcgcacact

SEQ ID NO: 96980 - DNA, 25 bp, Homo sapien
gcgtacgcgccctggcctccagcag

SEQ ID NO: 96981 - DNA, 25 bp, Homo sapien
tcccacccgcccttaccagcatccc

SEQ ID NO: 96982 - DNA, 25 bp, Homo sapien
cccaaagagcgcaggaacgcgagcc

SEQ ID NO: 96983 - DNA, 25 bp, Homo sapien
gcaggaacgcgagccgcagcagttt

SEQ ID NO: 96984 - DNA, 25 bp, Homo sapien
cgcctgggtcctcgtggagactgct

SEQ ID NO: 96985 - DNA, 25 bp, Homo sapien
cctgggcttttcgtaccaagctcga

SEQ ID NO: 96986 - DNA, 25 bp, Homo sapien
cgttcagaacagagactgggcattg

SEQ ID NO: 96987 - DNA, 25 bp, Homo sapien
tggacgacgctttcgccttcctgct

SEQ ID NO: 96988 - DNA, 25 bp, Homo sapien
gctgcctaggatccgccgacatgaa

SEQ ID NO: 96989 - DNA, 25 bp, Homo sapien
gaatcccatcgtagtggtccacggc

SEQ ID NO: 96990 - DNA, 25 bp, Homo sapien
gccctggaagacgatcccgagttca

SEQ ID NO: 96991 - DNA, 25 bp, Homo sapien
gagccggtcccatctccaaggatcg

SEQ ID NO: 96992 - DNA, 25 bp, Homo sapien
tttcccgaaggcgaaatagacatcc

SEQ ID NO: 96993 - DNA, 25 bp, Homo sapien
cccagccggtgattgctctctggct

SEQ ID NO: 96994 - DNA, 25 bp, Homo sapien
gccggtgattgctctctggctgtcc

SEQ ID NO: 96995 - DNA, 25 bp, Homo sapien
tgagacttggtgtcatcaccatcca

SEQ ID NO: 96996 - DNA, 25 bp, Homo sapien
tcatcaccatccattgtcagaaggg

SEQ ID NO: 96997 - DNA, 25 bp, Homo sapien
ggagggttgcacgtccccattctgg

SEQ ID NO: 96998 - DNA, 25 bp, Homo sapien
caccatccattgtcagaaggggagg

SEQ ID NO: 96999 - DNA, 25 bp, Homo sapien
catccattgtcagaaggggaggaaa

SEQ ID NO: 97000 - DNA, 25 bp, Homo sapien
accgccaagtctgaggcagccacca

SEQ ID NO: 97001 - DNA, 25 bp, Homo sapien
gcgcctacggaagagacgtctggtc

SEQ ID NO: 97002 - DNA, 25 bp, Homo sapien
gtggataactgcctcggacttggcg

SEQ ID NO: 97003 - DNA, 25 bp, Homo sapien
gcacgcgcgtgttttcttgtggata

SEQ ID NO: 97004 - DNA, 25 bp, Homo sapien
ctccggaactggacaacagctgcgt

SEQ ID NO: 97005 - DNA, 25 bp, Homo sapien
atggcgctgcagcactgaccacgtt

SEQ ID NO: 97006 - DNA, 25 bp, Homo sapien
gcggcactccagctccgaagagcga

SEQ ID NO: 97007 - DNA, 25 bp, Homo sapien
gctgagccatttggggccctctaga

SEQ ID NO: 97008 - DNA, 25 bp, Homo sapien
accgatctcaggaccacgcgggcga

SEQ ID NO: 97009 - DNA, 25 bp, Homo sapien
cggcgaggctgaaatatgataatca

SEQ ID NO: 97010 - DNA, 25 bp, Homo sapien
gcgctgcgtcagaccaatggcgatg

SEQ ID NO: 97011 - DNA, 25 bp, Homo sapien
attggactcctagatccgcgagggc

SEQ ID NO: 97012 - DNA, 25 bp, Homo sapien
caactccgccggcttaaattggact

SEQ ID NO: 97013 - DNA, 25 bp, Homo sapien
tgataatcagaacagctgcgccgcg

SEQ ID NO: 97014 - DNA, 25 bp, Homo sapien
agcaagttgcctcgggagccctaat

SEQ ID NO: 97015 - DNA, 25 bp, Homo sapien
gggacctcgtcaacaggtagaccta

SEQ ID NO: 97016 - DNA, 25 bp, Homo sapien
ggaccaaaccaagctgaacggcctg

SEQ ID NO: 97017 - DNA, 25 bp, Homo sapien
catccctggggacgaatttgcgctt

SEQ ID NO: 97018 - DNA, 25 bp, Homo sapien
aggacggtctcttctgccgagcaga

SEQ ID NO: 97019 - DNA, 25 bp, Homo sapien
acatcgagtgtttccgctgtgtggc

SEQ ID NO: 97020 - DNA, 25 bp, Homo sapien
tgcccgctccaaggtgtatcacatc

SEQ ID NO: 97021 - DNA, 25 bp, Homo sapien
cggcttcagcaagaacgacttcgtg

SEQ ID NO: 97022 - DNA, 25 bp, Homo sapien
tgtacgggatcaaatgcgccaagtg

SEQ ID NO: 97023 - DNA, 25 bp, Homo sapien
cggccactgcaaatggcaggtactc

SEQ ID NO: 97024 - DNA, 25 bp, Homo sapien
tgcgccaagtgcagcatcggcttca

SEQ ID NO: 97025 - DNA, 25 bp, Homo sapien
acctcgcctgtacctgtgaaccgga

SEQ ID NO: 97026 - DNA, 25 bp, Homo sapien
caactggtagagatgacgggcctca

SEQ ID NO: 97027 - DNA, 25 bp, Homo sapien
tcccaacctcgtgggtgggctcatg

SEQ ID NO: 97028 - DNA, 25 bp, Homo sapien
tgtgaaccggagaaacgccgtcctc

SEQ ID NO: 97029 - DNA, 25 bp, Homo sapien
acgcaggatcgcacggttttcaatc

SEQ ID NO: 97030 - DNA, 25 bp, Homo sapien
ggcccgggttttgccaacattcaga

SEQ ID NO: 97031 - DNA, 25 bp, Homo sapien
acccgcggccagatgcgctcatgaa

SEQ ID NO: 97032 - DNA, 25 bp, Homo sapien
cgtgtgatccgggtctggtttcaaa

SEQ ID NO: 97033 - DNA, 25 bp, Homo sapien
acctgaggctttatagctcgcttta

SEQ ID NO: 97034 - DNA, 25 bp, Homo sapien
ttgtcttcttggttccgcgacctgg

SEQ ID NO: 97035 - DNA, 25 bp, Homo sapien
gctttgcagccacagacgctgggta

SEQ ID NO: 97036 - DNA, 25 bp, Homo sapien
tgcggcataacattcatttgtcttc

SEQ ID NO: 97037 - DNA, 25 bp, Homo sapien
cgctcgacgcagacggcacaacaaa

SEQ ID NO: 97038 - DNA, 25 bp, Homo sapien
tttccctggaatcagccgaagaggc

SEQ ID NO: 97039 - DNA, 25 bp, Homo sapien
cgcttgacttgtgaggtcgcgagtc

SEQ ID NO: 97040 - DNA, 25 bp, Homo sapien
cgagtctagacagagctggtggctc

SEQ ID NO: 97041 - DNA, 25 bp, Homo sapien
cgatgtggcaatccgtctgggatgt

SEQ ID NO: 97042 - DNA, 25 bp, Homo sapien
atccgtctgggatgtgaaaagcgtg

SEQ ID NO: 97043 - DNA, 25 bp, Homo sapien
gcgtggagcgcatttagaggaattc

SEQ ID NO: 97044 - DNA, 25 bp, Homo sapien
cgcatttagaggaattcgacgaaaa

SEQ ID NO: 97045 - DNA, 25 bp, Homo sapien
ataagtggcccagccagagagcgca

SEQ ID NO: 97046 - DNA, 25 bp, Homo sapien
ctggctcctcactggtgagcgactc

SEQ ID NO: 97047 - DNA, 25 bp, Homo sapien
tgagcgactcgcttttctctgagca

SEQ ID NO: 97048 - DNA, 25 bp, Homo sapien
tcgacgaaaacacaggaaatcactc

SEQ ID NO: 97049 - DNA, 25 bp, Homo sapien
ctgttgcgtgctgccagcgggaact

SEQ ID NO: 97050 - DNA, 25 bp, Homo sapien
cgtccggagcgcctcacagcttagt

SEQ ID NO: 97051 - DNA, 25 bp, Homo sapien
agcgcctcacagcttagtgcgcctg

SEQ ID NO: 97052 - DNA, 25 bp, Homo sapien
ttcgtcagcccgctgttgcgtgctg

SEQ ID NO: 97053 - DNA, 25 bp, Homo sapien
ctgtgtaggggtagattttcgctgc

SEQ ID NO: 97054 - DNA, 25 bp, Homo sapien
ggtagattttcgctgcagtgttccc

SEQ ID NO: 97055 - DNA, 25 bp, Homo sapien
cgagcctgttagacgcagcgcgccg

SEQ ID NO: 97056 - DNA, 25 bp, Homo sapien
gccttcatttcgtcagcccgctgtt

SEQ ID NO: 97057 - DNA, 25 bp, Homo sapien
tgtgttccctcggattccacgtgga

SEQ ID NO: 97058 - DNA, 25 bp, Homo sapien
agaaacttttccctgctctcaccgg

SEQ ID NO: 97059 - DNA, 25 bp, Homo sapien
agccctctggacagcttctagagtg

SEQ ID NO: 97060 - DNA, 25 bp, Homo sapien
agtgtgcaggttctcgtatccctcg

SEQ ID NO: 97061 - DNA, 25 bp, Homo sapien
ctcggccaagggtatcctctgcaaa

SEQ ID NO: 97062 - DNA, 25 bp, Homo sapien
tctgcaaacccagcgcaactacggt

SEQ ID NO: 97063 - DNA, 25 bp, Homo sapien
gggatttcgctctgcatcggctgca

SEQ ID NO: 97064 - DNA, 25 bp, Homo sapien
gctgctggtgttagcgctcagtcaa

SEQ ID NO: 97065 - DNA, 25 bp, Homo sapien
gccctcctttgctgactgaccgatg

SEQ ID NO: 97066 - DNA, 25 bp, Homo sapien
cccaatctgcaggtcgcctggaaga

SEQ ID NO: 97067 - DNA, 25 bp, Homo sapien
tggacctcctcaaacacggccagga

SEQ ID NO: 97068 - DNA, 25 bp, Homo sapien
gacctcgttgacatggacctcctca

SEQ ID NO: 97069 - DNA, 25 bp, Homo sapien
gcgaaagctgccagtcgttctgagc

SEQ ID NO: 97070 - DNA, 25 bp, Homo sapien
tggctccgttgctcaccacggtgac

SEQ ID NO: 97071 - DNA, 25 bp, Homo sapien
gagtttgaggacagggtttcacgcc

SEQ ID NO: 97072 - DNA, 25 bp, Homo sapien
tgactgcgtcgttcagcagcgactc

SEQ ID NO: 97073 - DNA, 25 bp, Homo sapien
ctgtgtttactcaaggtttaatgga

SEQ ID NO: 97074 - DNA, 25 bp, Homo sapien
ccgagcacaccaagaagcacgtcaa

SEQ ID NO: 97075 - DNA, 25 bp, Homo sapien
aacttgagacgtgctgtgtttactc

SEQ ID NO: 97076 - DNA, 25 bp, Homo sapien
aggctgtgctttgttaaaaaagcgc

SEQ ID NO: 97077 - DNA, 25 bp, Homo sapien
tttgttaaaaaagcgcttgaaggca

SEQ ID NO: 97078 - DNA, 25 bp, Homo sapien
taaaagtcatcaccattctctaatc

SEQ ID NO: 97079 - DNA, 25 bp, Homo sapien
ccaagaagcacgtcaaacttgagac

SEQ ID NO: 97080 - DNA, 25 bp, Homo sapien
gtggtggtcgccgaacccgagcaca

SEQ ID NO: 97081 - DNA, 25 bp, Homo sapien
attagttttgcttcgcagatgggcc

SEQ ID NO: 97082 - DNA, 25 bp, Homo sapien
ctgccgtgagctgacaagagttctc

SEQ ID NO: 97083 - DNA, 25 bp, Homo sapien
ttctcggagaggacccgacttctgc

SEQ ID NO: 97084 - DNA, 25 bp, Homo sapien
gtccgactgaccaaggctgggtatg

SEQ ID NO: 97085 - DNA, 25 bp, Homo sapien
ccgcctaggacagcgggaccgaatc

SEQ ID NO: 97086 - DNA, 25 bp, Homo sapien
gccgggctctagctgtttccctcag

SEQ ID NO: 97087 - DNA, 25 bp, Homo sapien
cgccttcagaacgagtccgtccttg

SEQ ID NO: 97088 - DNA, 25 bp, Homo sapien
gcggcctgttccacgccaggattag

SEQ ID NO: 97089 - DNA, 25 bp, Homo sapien
gcccggcttctgacgtccattgaat

SEQ ID NO: 97090 - DNA, 25 bp, Homo sapien
ttccgactagtccagacgaagggcc

SEQ ID NO: 97091 - DNA, 25 bp, Homo sapien
gtggctgcaaagtcaggcactcaca

SEQ ID NO: 97092 - DNA, 25 bp, Homo sapien
ggctcttcggccgtttgcaaaagtc

SEQ ID NO: 97093 - DNA, 25 bp, Homo sapien
gacgattcccttccagccgttttga

SEQ ID NO: 97094 - DNA, 25 bp, Homo sapien
tctagatttaaagcgcggctgcgcc

SEQ ID NO: 97095 - DNA, 25 bp, Homo sapien
cgggcacctccgaaagataattggg

SEQ ID NO: 97096 - DNA, 25 bp, Homo sapien
ggggttcctagcaacacctctgggc

SEQ ID NO: 97097 - DNA, 25 bp, Homo sapien
ctggcggattgcaaaacgggcccgt

SEQ ID NO: 97098 - DNA, 25 bp, Homo sapien
tgggttgcccgcctttagaggagag

SEQ ID NO: 97099 - DNA, 25 bp, Homo sapien
gagaggctctgcctggtgcccggac

SEQ ID NO: 97100 - DNA, 25 bp, Homo sapien
gaaagcagccctcggagatttcgaa

SEQ ID NO: 97101 - DNA, 25 bp, Homo sapien
cagccctcggagatttcgaaagatc

SEQ ID NO: 97102 - DNA, 25 bp, Homo sapien
ccctcggagatttcgaaagatcgcg

SEQ ID NO: 97103 - DNA, 25 bp, Homo sapien
atttcgaaagatcgcggtggccgcg

SEQ ID NO: 97104 - DNA, 25 bp, Homo sapien
gtgctccggtctggcggattgcaaa

SEQ ID NO: 97105 - DNA, 25 bp, Homo sapien
ctgtctgctatcaatgggcgttggc

SEQ ID NO: 97106 - DNA, 25 bp, Homo sapien
tttcgtattcggcttgtcgctgagg

SEQ ID NO: 97107 - DNA, 25 bp, Homo sapien
ctcggggaaggcgtcctctgttgac

SEQ ID NO: 97108 - DNA, 25 bp, Homo sapien
tctgctatcaatgggcgttggccag

SEQ ID NO: 97109 - DNA, 25 bp, Homo sapien
tagggactgtctgctatcaatgggc

SEQ ID NO: 97110 - DNA, 25 bp, Homo sapien
ctgttgacccttttctcgggagaag

SEQ ID NO: 97111 - DNA, 25 bp, Homo sapien
gcggactagggactgtctgctatca

SEQ ID NO: 97112 - DNA, 25 bp, Homo sapien
ttttctggaagctttcgtattcggc

SEQ ID NO: 97113 - DNA, 25 bp, Homo sapien
ggcagcctaaagcatccggaacggc

SEQ ID NO: 97114 - DNA, 25 bp, Homo sapien
cgagatccgagaggcgacatgccac

SEQ ID NO: 97115 - DNA, 25 bp, Homo sapien
tccgagtccagggaaaggcttacca

SEQ ID NO: 97116 - DNA, 25 bp, Homo sapien
ggagatcagacatccggcagcctaa

SEQ ID NO: 97117 - DNA, 25 bp, Homo sapien
acgcctcagttattcggagatcaga

SEQ ID NO: 97118 - DNA, 25 bp, Homo sapien
ttgtgtttccacagctttccagttg

SEQ ID NO: 97119 - DNA, 25 bp, Homo sapien
agcagccgactagccggagattaca

SEQ ID NO: 97120 - DNA, 25 bp, Homo sapien
tccagttgggtacaacggagccgaa

SEQ ID NO: 97121 - DNA, 25 bp, Homo sapien
tggcggagaagttcccggtcatctc

SEQ ID NO: 97122 - DNA, 25 bp, Homo sapien
tgcatcggcgctacaagcacttcga

SEQ ID NO: 97123 - DNA, 25 bp, Homo sapien
tcaagggcatgaagagctacatctc

SEQ ID NO: 97124 - DNA, 25 bp, Homo sapien
gccagccaaggcagcgatgatgact

SEQ ID NO: 97125 - DNA, 25 bp, Homo sapien
ccggcctcctatgtgcaggtgatcc

SEQ ID NO: 97126 - DNA, 25 bp, Homo sapien
cgcttcgaggaggacttcatctcta

SEQ ID NO: 97127 - DNA, 25 bp, Homo sapien
tcagcagctctacggcggctaccag

SEQ ID NO: 97128 - DNA, 25 bp, Homo sapien
agcacttcgactggctgtacgcgcg

SEQ ID NO: 97129 - DNA, 25 bp, Homo sapien
gcgaacctggcccagcattgcctgg

SEQ ID NO: 97130 - DNA, 25 bp, Homo sapien
agtttatggtaacccgagccctgcg

SEQ ID NO: 97131 - DNA, 25 bp, Homo sapien
gtcacgtgcggcagagtaactcgcc

SEQ ID NO: 97132 - DNA, 25 bp, Homo sapien
ctcgtaggaatacagtcaggaggcc

SEQ ID NO: 97133 - DNA, 25 bp, Homo sapien
gccggtggccaaagaagattccagc

SEQ ID NO: 97134 - DNA, 25 bp, Homo sapien
ggaatcattcattctgctcgtagga

SEQ ID NO: 97135 - DNA, 25 bp, Homo sapien
aatgccctgcctgcgagtcaaagtc

SEQ ID NO: 97136 - DNA, 25 bp, Homo sapien
cggggagagccatttgcatcctgaa

SEQ ID NO: 97137 - DNA, 25 bp, Homo sapien
tcccaggtctaagtcagtcttgacg

SEQ ID NO: 97138 - DNA, 25 bp, Homo sapien
ggcgccaagctttgccgcgagccgt

SEQ ID NO: 97139 - DNA, 25 bp, Homo sapien
agtcagtcttgacgcctaatcgtca

SEQ ID NO: 97140 - DNA, 25 bp, Homo sapien
ctctggttttcttcccaggtctaag

SEQ ID NO: 97141 - DNA, 25 bp, Homo sapien
gtttggcctctctgctcgactgcct

SEQ ID NO: 97142 - DNA, 25 bp, Homo sapien
gctgacttcgccctgcctggcgttt

SEQ ID NO: 97143 - DNA, 25 bp, Homo sapien
ggtgcgctccagtttccactccatc

SEQ ID NO: 97144 - DNA, 25 bp, Homo sapien
tcccaccgccgctgcaaggtgttcc

SEQ ID NO: 97145 - DNA, 25 bp, Homo sapien
agggcttcatcgcagcgctcggaaa

SEQ ID NO: 97146 - DNA, 25 bp, Homo sapien
cggaaatctccctcaggatggcgtc

SEQ ID NO: 97147 - DNA, 25 bp, Homo sapien
ctccttttggccttcgccttgagca

SEQ ID NO: 97148 - DNA, 25 bp, Homo sapien
caatcccgggactgtgtgatcatca

SEQ ID NO: 97149 - DNA, 25 bp, Homo sapien
ttcggagcgtgcaaaaggtgaccta

SEQ ID NO: 97150 - DNA, 25 bp, Homo sapien
agctcactgtggctcaggttcaacg

SEQ ID NO: 97151 - DNA, 25 bp, Homo sapien
cagttccgacgtgctgcagttccca

SEQ ID NO: 97152 - DNA, 25 bp, Homo sapien
ttcagctgcacgttccgctccttga

SEQ ID NO: 97153 - DNA, 25 bp, Homo sapien
ggtctgctcgcacttacgtcgccag

SEQ ID NO: 97154 - DNA, 25 bp, Homo sapien
tacgggaaaagcttctgttctgcgc

SEQ ID NO: 97155 - DNA, 25 bp, Homo sapien
agcagtaatttgaggccgcgtttcc

SEQ ID NO: 97156 - DNA, 25 bp, Homo sapien
gcacgtcttgaacaccggatctttc

SEQ ID NO: 97157 - DNA, 25 bp, Homo sapien
cgctgtaggagctgagagcacgtct

SEQ ID NO: 97158 - DNA, 25 bp, Homo sapien
tgcgaaattttgactccgactcacc

SEQ ID NO: 97159 - DNA, 25 bp, Homo sapien
gcccagtctcgtacccgaaaattca

SEQ ID NO: 97160 - DNA, 25 bp, Homo sapien
ttccctgtgcgcctgcgaaattttg

SEQ ID NO: 97161 - DNA, 25 bp, Homo sapien
gtccggttttctttctcctgctaga

SEQ ID NO: 97162 - DNA, 25 bp, Homo sapien
tgagggcagagtcacatctgacgcc

SEQ ID NO: 97163 - DNA, 25 bp, Homo sapien
ctcctgctagatgcggattccttga

SEQ ID NO: 97164 - DNA, 25 bp, Homo sapien
agctgctcgccctccaggatgtccg

SEQ ID NO: 97165 - DNA, 25 bp, Homo sapien
ctatttatctccaaagtgtccggtt

SEQ ID NO: 97166 - DNA, 25 bp, Homo sapien
gctctctatttatctccaaagtgtc

SEQ ID NO: 97167 - DNA, 25 bp, Homo sapien
cgctggccttctagctctctattta

SEQ ID NO: 97168 - DNA, 25 bp, Homo sapien
cggattccttgagggcagagtcaca

SEQ ID NO: 97169 - DNA, 25 bp, Homo sapien
agtggcgcagactcacccatgagcc

SEQ ID NO: 97170 - DNA, 25 bp, Homo sapien
cctttctgagatgaggcagcgccgc

SEQ ID NO: 97171 - DNA, 25 bp, Homo sapien
tcacctgacacttaccgcctggagg

SEQ ID NO: 97172 - DNA, 25 bp, Homo sapien
agctgccgagatgggaactcctccc

SEQ ID NO: 97173 - DNA, 25 bp, Homo sapien
ggtgcccgatacaccaggctctgca

SEQ ID NO: 97174 - DNA, 25 bp, Homo sapien
cagtgcccgagagatgaagcatcca

SEQ ID NO: 97175 - DNA, 25 bp, Homo sapien
caaaaccgcgcagcagttctggctc

SEQ ID NO: 97176 - DNA, 25 bp, Homo sapien
cacgacggcgtacaacaggatggtc

SEQ ID NO: 97177 - DNA, 25 bp, Homo sapien
acccgagtagcgaagagcagtcagc

SEQ ID NO: 97178 - DNA, 25 bp, Homo sapien
ttcagtgcctgcaggctccgaagcc

SEQ ID NO: 97179 - DNA, 25 bp, Homo sapien
gccagcattctgttggggcagatgc

SEQ ID NO: 97180 - DNA, 25 bp, Homo sapien
ctggccgggcacacaaacgttgaac

SEQ ID NO: 97181 - DNA, 25 bp, Homo sapien
agaacttccgcggaggagcgaactg

SEQ ID NO: 97182 - DNA, 25 bp, Homo sapien
ccgcctgtgcatccggggaagaact

SEQ ID NO: 97183 - DNA, 25 bp, Homo sapien
ccaggctcgcagctaggacgtcaga

SEQ ID NO: 97184 - DNA, 25 bp, Homo sapien
agtcagcgaggtcctgcaggtctat

SEQ ID NO: 97185 - DNA, 25 bp, Homo sapien
tccactttctgaaaacgccacagtg

SEQ ID NO: 97186 - DNA, 25 bp, Homo sapien
gtggcgcgtgagcacagcctttaaa

SEQ ID NO: 97187 - DNA, 25 bp, Homo sapien
aagtgacactacgaaccctcctcca

SEQ ID NO: 97188 - DNA, 25 bp, Homo sapien
acgccacagtggaaagtaccgaatc

SEQ ID NO: 97189 - DNA, 25 bp, Homo sapien
gttcctgtctttcctagtggcctca

SEQ ID NO: 97190 - DNA, 25 bp, Homo sapien
acgtttggctggtctcttcgcagtc

SEQ ID NO: 97191 - DNA, 25 bp, Homo sapien
cggcccatcgccacgtttggctggt

SEQ ID NO: 97192 - DNA, 25 bp, Homo sapien
tgtctttcctagtggcctcagcggc

SEQ ID NO: 97193 - DNA, 25 bp, Homo sapien
cgcacccagggtgaagtgcagcttg

SEQ ID NO: 97194 - DNA, 25 bp, Homo sapien
aagaagctaatggtgggcgcaccca

SEQ ID NO: 97195 - DNA, 25 bp, Homo sapien
gcgtgcgtgaaatgctccaggaaga

SEQ ID NO: 97196 - DNA, 25 bp, Homo sapien
tgcgcttccagagcttcggaggcct

SEQ ID NO: 97197 - DNA, 25 bp, Homo sapien
tagtcggccagactcagctctgcca

SEQ ID NO: 97198 - DNA, 25 bp, Homo sapien
tggtctcccagtcgcaagtccacgg

SEQ ID NO: 97199 - DNA, 25 bp, Homo sapien
agcttgtgcagcacgatgcactcga

SEQ ID NO: 97200 - DNA, 25 bp, Homo sapien
tggtgaaggcatagtcggccagact

SEQ ID NO: 97201 - DNA, 25 bp, Homo sapien
tgaggaagcggtccagagtgttcac

SEQ ID NO: 97202 - DNA, 25 bp, Homo sapien
ccagagtgttcaccgtcaggcacag

SEQ ID NO: 97203 - DNA, 25 bp, Homo sapien
gagtgttcaccgtcaggcacagcga

SEQ ID NO: 97204 - DNA, 25 bp, Homo sapien
tgttcaccgtcaggcacagcgactc

SEQ ID NO: 97205 - DNA, 25 bp, Homo sapien
actcgaaggagaggccgaattggcg

SEQ ID NO: 97206 - DNA, 25 bp, Homo sapien
aggagaggccgaattggcggtgcac

SEQ ID NO: 97207 - DNA, 25 bp, Homo sapien
aagcggtccagagtgttcaccgtca

SEQ ID NO: 97208 - DNA, 25 bp, Homo sapien
ggtccagagtgttcaccgtcaggca

SEQ ID NO: 97209 - DNA, 25 bp, Homo sapien
tctgtagatctagctgcgccacggg

SEQ ID NO: 97210 - DNA, 25 bp, Homo sapien
tgctcttcttcaccggggcgcgaag

SEQ ID NO: 97211 - DNA, 25 bp, Homo sapien
gtggccgctttactaccttcaacgc

SEQ ID NO: 97212 - DNA, 25 bp, Homo sapien
ttttccggctggagaaccactcgcc

SEQ ID NO: 97213 - DNA, 25 bp, Homo sapien
ccgctgcgccggttaaaacattctc

SEQ ID NO: 97214 - DNA, 25 bp, Homo sapien
tgatcctgagttccaaacgaaagtc

SEQ ID NO: 97215 - DNA, 25 bp, Homo sapien
tcagtgacccaaacaagcaatagtg

SEQ ID NO: 97216 - DNA, 25 bp, Homo sapien
ggctagaattctgtcgacacgggaa

SEQ ID NO: 97217 - DNA, 25 bp, Homo sapien
cgcattcggagatgagctgttcagc

SEQ ID NO: 97218 - DNA, 25 bp, Homo sapien
cgtaccttgcttgacacggggctcc

SEQ ID NO: 97219 - DNA, 25 bp, Homo sapien
tggacactggcttcttgctttgggc

SEQ ID NO: 97220 - DNA, 25 bp, Homo sapien
gtgtttcttgttcttgccgcccatg

SEQ ID NO: 97221 - DNA, 25 bp, Homo sapien
tgcacagccgagagctcttcacatt

SEQ ID NO: 97222 - DNA, 25 bp, Homo sapien
cactgagcagcttatccactttagg

SEQ ID NO: 97223 - DNA, 25 bp, Homo sapien
gactacttttgtctcctgcgggcca

SEQ ID NO: 97224 - DNA, 25 bp, Homo sapien
tgagccttcacgagacgtcactgtc

SEQ ID NO: 97225 - DNA, 25 bp, Homo sapien
cgatggtgacatggtgacagcggca

SEQ ID NO: 97226 - DNA, 25 bp, Homo sapien
cagacggggcagtaggatgtggccg

SEQ ID NO: 97227 - DNA, 25 bp, Homo sapien
ggcagtaggatgtggccgcggagag

SEQ ID NO: 97228 - DNA, 25 bp, Homo sapien
cggccccgatggtgacatggtgaca

SEQ ID NO: 97229 - DNA, 25 bp, Homo sapien
tgacggcccggggctcgatgcccta

SEQ ID NO: 97230 - DNA, 25 bp, Homo sapien
ggctcgatgccctacaacaacatcg

SEQ ID NO: 97231 - DNA, 25 bp, Homo sapien
ctcgatgccctacaacaacatcgcg

SEQ ID NO: 97232 - DNA, 25 bp, Homo sapien
gggctcgatgccctacaacaacatc

SEQ ID NO: 97233 - DNA, 25 bp, Homo sapien
cacctcctgacagacggggcagtag

SEQ ID NO: 97234 - DNA, 25 bp, Homo sapien
cgcacgggcgttttgagcacctcct

SEQ ID NO: 97235 - DNA, 25 bp, Homo sapien
acgggcgttttgagcacctcctgac

SEQ ID NO: 97236 - DNA, 25 bp, Homo sapien
ggcgttttgagcacctcctgacaga

SEQ ID NO: 97237 - DNA, 25 bp, Homo sapien
cgttttgagcacctcctgacagacg

SEQ ID NO: 97238 - DNA, 25 bp, Homo sapien
tttgagcacctcctgacagacgggg

SEQ ID NO: 97239 - DNA, 25 bp, Homo sapien
gtccgcacgggcgttttgagcacct

SEQ ID NO: 97240 - DNA, 25 bp, Homo sapien
ttttgagcacctcctgacagacggg

SEQ ID NO: 97241 - DNA, 25 bp, Homo sapien
tgtcaaacatggtctctgcccgggc

SEQ ID NO: 97242 - DNA, 25 bp, Homo sapien
ctttgctctggaccgcaattgctca

SEQ ID NO: 97243 - DNA, 25 bp, Homo sapien
tctcgctttaaggatggggaccggc

SEQ ID NO: 97244 - DNA, 25 bp, Homo sapien
cccgcgaacactcggttagtgccga

SEQ ID NO: 97245 - DNA, 25 bp, Homo sapien
cggccgaggcccttgattctcgagc

SEQ ID NO: 97246 - DNA, 25 bp, Homo sapien
tacggcagccgcgtcttgtcaaaca

SEQ ID NO: 97247 - DNA, 25 bp, Homo sapien
gtacgtacccagcaacacgcagagc

SEQ ID NO: 97248 - DNA, 25 bp, Homo sapien
agctgcgcacgcgtcaggcaacaca

SEQ ID NO: 97249 - DNA, 25 bp, Homo sapien
tctacctgagcaggccgagccttca

SEQ ID NO: 97250 - DNA, 25 bp, Homo sapien
cgtgggaacgtgatctacctgagca

SEQ ID NO: 97251 - DNA, 25 bp, Homo sapien
gtccaaacaggaagcggcaatagcc

SEQ ID NO: 97252 - DNA, 25 bp, Homo sapien
agacggttccgatgcgctgcaaaga

SEQ ID NO: 97253 - DNA, 25 bp, Homo sapien
ttctgaatgcgccaagcccgcggtc

SEQ ID NO: 97254 - DNA, 25 bp, Homo sapien
gagccttcaacctcggagaactaga

SEQ ID NO: 97255 - DNA, 25 bp, Homo sapien
cgcggggctcctagtccaaacagga

SEQ ID NO: 97256 - DNA, 25 bp, Homo sapien
actatcccaggtgacagccggcttc

SEQ ID NO: 97257 - DNA, 25 bp, Homo sapien
aggcgcattgcaaacttccaggttc

SEQ ID NO: 97258 - DNA, 25 bp, Homo sapien
agaggcagaactccgctcccagaga

SEQ ID NO: 97259 - DNA, 25 bp, Homo sapien
tggagcaaagcacttcggagcgatt

SEQ ID NO: 97260 - DNA, 25 bp, Homo sapien
ccgccctccggagaaataaagagtg

SEQ ID NO: 97261 - DNA, 25 bp, Homo sapien
tgccttgcagtggagccaacagtcc

SEQ ID NO: 97262 - DNA, 25 bp, Homo sapien
gcggtggcgatctcggaaatttccc

SEQ ID NO: 97263 - DNA, 25 bp, Homo sapien
ccgcttgctccaaactgcttgaatc

SEQ ID NO: 97264 - DNA, 25 bp, Homo sapien
aacatgggatacgaacggagcagcc

SEQ ID NO: 97265 - DNA, 25 bp, Homo sapien
cgccactggtcgtctgagcgctgat

SEQ ID NO: 97266 - DNA, 25 bp, Homo sapien
ttctacgggaactggcctgaactcg

SEQ ID NO: 97267 - DNA, 25 bp, Homo sapien
tggcgctagtcaccagccaatcgtc

SEQ ID NO: 97268 - DNA, 25 bp, Homo sapien
gccaatcgtcaacagacgccatttg

SEQ ID NO: 97269 - DNA, 25 bp, Homo sapien
cgccatttgttgttggagccacgca

SEQ ID NO: 97270 - DNA, 25 bp, Homo sapien
gcgtcttgcacgtgcagccgtttaa

SEQ ID NO: 97271 - DNA, 25 bp, Homo sapien
agccgtttaagtcgcgtgggcgcct

SEQ ID NO: 97272 - DNA, 25 bp, Homo sapien
tgagtgggccgcttttctacgggaa

SEQ ID NO: 97273 - DNA, 25 bp, Homo sapien
gtcctcctcttttcagggtcacaag

SEQ ID NO: 97274 - DNA, 25 bp, Homo sapien
tccaatagcgcttgtggagcagcca

SEQ ID NO: 97275 - DNA, 25 bp, Homo sapien
cgtgggctgctttgaggataaaatc

SEQ ID NO: 97276 - DNA, 25 bp, Homo sapien
ctggcgacgagtgcctagcaaagcc

SEQ ID NO: 97277 - DNA, 25 bp, Homo sapien
gccgctgttttctacacgatgcacg

SEQ ID NO: 97278 - DNA, 25 bp, Homo sapien
aggggtaatcggctcacctgtcctc

SEQ ID NO: 97279 - DNA, 25 bp, Homo sapien
gatgcacgttctttgcctctgccca

SEQ ID NO: 97280 - DNA, 25 bp, Homo sapien
acatctgtccttggcgacgtcgtca

SEQ ID NO: 97281 - DNA, 25 bp, Homo sapien
ggtcctgacgctctcccagccagcg

SEQ ID NO: 97282 - DNA, 25 bp, Homo sapien
ccgggctggccacacccaggtgagt

SEQ ID NO: 97283 - DNA, 25 bp, Homo sapien
ggcgaagctgcttccgcccgcgtgt

SEQ ID NO: 97284 - DNA, 25 bp, Homo sapien
tccagaaaggagtcgtcgatgtccc

SEQ ID NO: 97285 - DNA, 25 bp, Homo sapien
aaacagtccagaaaggagtcgtcga

SEQ ID NO: 97286 - DNA, 25 bp, Homo sapien
tacctccagcgtgaaacagtccaga

SEQ ID NO: 97287 - DNA, 25 bp, Homo sapien
gcgatcctagtacctccagcgtgaa

SEQ ID NO: 97288 - DNA, 25 bp, Homo sapien
gtccacaccgaagcgcgatcctagt

SEQ ID NO: 97289 - DNA, 25 bp, Homo sapien
ctgcgataatcgaggtgacaaagtt

SEQ ID NO: 97290 - DNA, 25 bp, Homo sapien
gagtgccagatagcccgtccgaaac

SEQ ID NO: 97291 - DNA, 25 bp, Homo sapien
gctccggaacactgtcagatccttc

SEQ ID NO: 97292 - DNA, 25 bp, Homo sapien
tgagagaccctttgcgcccaggcat

SEQ ID NO: 97293 - DNA, 25 bp, Homo sapien
agcgattcccgtaacgcggctcttc

SEQ ID NO: 97294 - DNA, 25 bp, Homo sapien
tctcccagactagatcgaagggttc

SEQ ID NO: 97295 - DNA, 25 bp, Homo sapien
tctgtggaataacggggtcatgaac

SEQ ID NO: 97296 - DNA, 25 bp, Homo sapien
tgcgcctgggtgaagtttgtactca

SEQ ID NO: 97297 - DNA, 25 bp, Homo sapien
tccttcctgggaagcggccacaaag

SEQ ID NO: 97298 - DNA, 25 bp, Homo sapien
cggcggcattccgacacaggaaagc

SEQ ID NO: 97299 - DNA, 25 bp, Homo sapien
agacaacgcttcttccttcctggga

SEQ ID NO: 97300 - DNA, 25 bp, Homo sapien
ctttggcaaaagcatcccaggcgtg

SEQ ID NO: 97301 - DNA, 25 bp, Homo sapien
caggcgtggttcaggcagagtccac

SEQ ID NO: 97302 - DNA, 25 bp, Homo sapien
ctctccacgccaggaaggcggggta

SEQ ID NO: 97303 - DNA, 25 bp, Homo sapien
cgctcgcgtttcaggagccgacttc

SEQ ID NO: 97304 - DNA, 25 bp, Homo sapien
ggaaagcccgcggatcaactgatct

SEQ ID NO: 97305 - DNA, 25 bp, Homo sapien
cagccaaggaaaaactaaagatcga

SEQ ID NO: 97306 - DNA, 25 bp, Homo sapien
tacgggactgcctttcccaaagaca

SEQ ID NO: 97307 - DNA, 25 bp, Homo sapien
acgtgcggcgagaagcatcggattc

SEQ ID NO: 97308 - DNA, 25 bp, Homo sapien
ctgcctttcccaaagacagccaagg

SEQ ID NO: 97309 - DNA, 25 bp, Homo sapien
atatgtggttctgtacgggactgcc

SEQ ID NO: 97310 - DNA, 25 bp, Homo sapien
ttaccgagcacttcctggcacagcg

SEQ ID NO: 97311 - DNA, 25 bp, Homo sapien
cccaaacgcgctatatgtggttctg

SEQ ID NO: 97312 - DNA, 25 bp, Homo sapien
ccgagggtgacattaccgagcactt

SEQ ID NO: 97313 - DNA, 25 bp, Homo sapien
ccacggctggctttgtgggactcct

SEQ ID NO: 97314 - DNA, 25 bp, Homo sapien
ccgagcgaatgtagcccgcgagaga

SEQ ID NO: 97315 - DNA, 25 bp, Homo sapien
gaatcgcgcctcgtcgtcgggattc

SEQ ID NO: 97316 - DNA, 25 bp, Homo sapien
tctctgcggggaaccgttgcgaaaa

SEQ ID NO: 97317 - DNA, 25 bp, Homo sapien
gttcagcgcagcgaggctacgcgcc

SEQ ID NO: 97318 - DNA, 25 bp, Homo sapien
tattgtttgcagacatgtgacaggc

SEQ ID NO: 97319 - DNA, 25 bp, Homo sapien
accatgcacggcgtcccggggttca

SEQ ID NO: 97320 - DNA, 25 bp, Homo sapien
tgcggaagagtttgttattgtttgc

SEQ ID NO: 97321 - DNA, 25 bp, Homo sapien
ccatcccggctgtgagaatagcgtg

SEQ ID NO: 97322 - DNA, 25 bp, Homo sapien
ttcacgtggttaaagaagcccatcc

SEQ ID NO: 97323 - DNA, 25 bp, Homo sapien
tccctggatcgcactgaacctaagc

SEQ ID NO: 97324 - DNA, 25 bp, Homo sapien
ctggggagcttgtatctgggcaaaa

SEQ ID NO: 97325 - DNA, 25 bp, Homo sapien
aaaagactgcccttaccgcgtgaga

SEQ ID NO: 97326 - DNA, 25 bp, Homo sapien
ggcctatggcctctttcccagtgtc

SEQ ID NO: 97327 - DNA, 25 bp, Homo sapien
agagtgcgtggctttttctccacca

SEQ ID NO: 97328 - DNA, 25 bp, Homo sapien
caagtaccgcttcgttccctggatc

SEQ ID NO: 97329 - DNA, 25 bp, Homo sapien
ttccagagtgttcagtccctccctg

SEQ ID NO: 97330 - DNA, 25 bp, Homo sapien
cacctccgccatattggtaccttta

SEQ ID NO: 97331 - DNA, 25 bp, Homo sapien
cccagcaaagtgaagcgtgcggctc

SEQ ID NO: 97332 - DNA, 25 bp, Homo sapien
tcgagggtctcggtctgccctttaa

SEQ ID NO: 97333 - DNA, 25 bp, Homo sapien
agatgcagctcctctcagttccagg

SEQ ID NO: 97334 - DNA, 25 bp, Homo sapien
tctctctcgagtccagagatgcagc

SEQ ID NO: 97335 - DNA, 25 bp, Homo sapien
taggccagctcgaatcggacactcg

SEQ ID NO: 97336 - DNA, 25 bp, Homo sapien
gggagtcccgctcttctgagaagcc

SEQ ID NO: 97337 - DNA, 25 bp, Homo sapien
gggcagaaggtaacaccgtcctcta

SEQ ID NO: 97338 - DNA, 25 bp, Homo sapien
tccaccgaacgttcccgattgttca

SEQ ID NO: 97339 - DNA, 25 bp, Homo sapien
tagagggcggagcttctttgaccgc

SEQ ID NO: 97340 - DNA, 25 bp, Homo sapien
cttggcccagaacattgcggatcgg

SEQ ID NO: 97341 - DNA, 25 bp, Homo sapien
cccagtaggttcgttcgcaccgctt

SEQ ID NO: 97342 - DNA, 25 bp, Homo sapien
gattgttcaccgtcctcacgtcagc

SEQ ID NO: 97343 - DNA, 25 bp, Homo sapien
ctctaggtattgactcggcccgggt

SEQ ID NO: 97344 - DNA, 25 bp, Homo sapien
cggcgccattttgggactgagactg

SEQ ID NO: 97345 - DNA, 25 bp, Homo sapien
tccatatccgcacagaactggcttg

SEQ ID NO: 97346 - DNA, 25 bp, Homo sapien
acagaactggcttggatttccaccc

SEQ ID NO: 97347 - DNA, 25 bp, Homo sapien
tccgcacagaactggcttggatttc

SEQ ID NO: 97348 - DNA, 25 bp, Homo sapien
cgttggacagcggacccgacgccca

SEQ ID NO: 97349 - DNA, 25 bp, Homo sapien
tcaccagtgcctcgcgcaccgcggt

SEQ ID NO: 97350 - DNA, 25 bp, Homo sapien
cagcggacccgacgcccaccttcct

SEQ ID NO: 97351 - DNA, 25 bp, Homo sapien
tcccattccttctctgagcgccgcc

SEQ ID NO: 97352 - DNA, 25 bp, Homo sapien
gcacagaactggcttggatttccac

SEQ ID NO: 97353 - DNA, 25 bp, Homo sapien
gtaggtgatagtccgcaaaagctcc

SEQ ID NO: 97354 - DNA, 25 bp, Homo sapien
ctgtcccgttcttcgaaggctccga

SEQ ID NO: 97355 - DNA, 25 bp, Homo sapien
acgcgacatcacgtcacggcctatg

SEQ ID NO: 97356 - DNA, 25 bp, Homo sapien
ggcggagactcgatacgcgacatca

SEQ ID NO: 97357 - DNA, 25 bp, Homo sapien
agcgctcggcgaagtcttatatacg

SEQ ID NO: 97358 - DNA, 25 bp, Homo sapien
tccacttgtgcgagtgagagcgctc

SEQ ID NO: 97359 - DNA, 25 bp, Homo sapien
aaaagctccatggtcgccttgccgc

SEQ ID NO: 97360 - DNA, 25 bp, Homo sapien
aggctccgagcctcagcgtacaaaa

SEQ ID NO: 97361 - DNA, 25 bp, Homo sapien
agttgtagttcaccgctcgcccgtt

SEQ ID NO: 97362 - DNA, 25 bp, Homo sapien
gcttgaccggaagcccagaccagtg

SEQ ID NO: 97363 - DNA, 25 bp, Homo sapien
ctccgcgcacaagcagttcaacgta

SEQ ID NO: 97364 - DNA, 25 bp, Homo sapien
cctgtttaatggtttgcttgcttgc

SEQ ID NO: 97365 - DNA, 25 bp, Homo sapien
agaccagtgcggtcctagccagaga

SEQ ID NO: 97366 - DNA, 25 bp, Homo sapien
ttgccaacaatgagacacgaagcgc

SEQ ID NO: 97367 - DNA, 25 bp, Homo sapien
gcccatgcaggtgggtccataaaga

SEQ ID NO: 97368 - DNA, 25 bp, Homo sapien
cgactggcggatcgagcctgtttaa

SEQ ID NO: 97369 - DNA, 25 bp, Homo sapien
cctctggtcgctctatcttatcttt

SEQ ID NO: 97370 - DNA, 25 bp, Homo sapien
gctgctgcttccgtgactcacattc

SEQ ID NO: 97371 - DNA, 25 bp, Homo sapien
tgctgccaaccgtgtcttctctgtg

SEQ ID NO: 97372 - DNA, 25 bp, Homo sapien
acgtctctcggacctttcgctctga

SEQ ID NO: 97373 - DNA, 25 bp, Homo sapien
aggatgctgttttgcctctggtcgc

SEQ ID NO: 97374 - DNA, 25 bp, Homo sapien
ctgtgaacgtcctcacgatgaacgc

SEQ ID NO: 97375 - DNA, 25 bp, Homo sapien
tcgctctgacagtggcttgagcctc

SEQ ID NO: 97376 - DNA, 25 bp, Homo sapien
cattccggccatttccgtggtgtga

SEQ ID NO: 97377 - DNA, 25 bp, Homo sapien
cttcatattgcccagcccggcagtg

SEQ ID NO: 97378 - DNA, 25 bp, Homo sapien
cgacgcgagcggaaaaaccactatg

SEQ ID NO: 97379 - DNA, 25 bp, Homo sapien
cgacttttcaactgtgcggcgggcc

SEQ ID NO: 97380 - DNA, 25 bp, Homo sapien
ccttctgcacggcacttgaagtgaa

SEQ ID NO: 97381 - DNA, 25 bp, Homo sapien
gccactcgctttgaagtgcagacga

SEQ ID NO: 97382 - DNA, 25 bp, Homo sapien
tccgaattgcaaaagcctgtccctg

SEQ ID NO: 97383 - DNA, 25 bp, Homo sapien
tttctttctcaactcctcgggcggc

SEQ ID NO: 97384 - DNA, 25 bp, Homo sapien
cggcgagccaactttcacacagcga

SEQ ID NO: 97385 - DNA, 25 bp, Homo sapien
acaggtagcgctcggtgtccgagta

SEQ ID NO: 97386 - DNA, 25 bp, Homo sapien
gtccatggcgcgacagtacaggtag

SEQ ID NO: 97387 - DNA, 25 bp, Homo sapien
gctgctcgtgcctccagagatgctt

SEQ ID NO: 97388 - DNA, 25 bp, Homo sapien
tagcttctcacttgaaggcgccaga

SEQ ID NO: 97389 - DNA, 25 bp, Homo sapien
ttccaccgaggctatggcagagaca

SEQ ID NO: 97390 - DNA, 25 bp, Homo sapien
tcaccaagactagggtgcgcggtgc

SEQ ID NO: 97391 - DNA, 25 bp, Homo sapien
ttcgccagaggttggtccttcttcc

SEQ ID NO: 97392 - DNA, 25 bp, Homo sapien
agcagggattgtcagcaactcgggc

SEQ ID NO: 97393 - DNA, 25 bp, Homo sapien
tctgggcaccgtttattcgaatacc

SEQ ID NO: 97394 - DNA, 25 bp, Homo sapien
cgctatctctacaaaagggtcaata

SEQ ID NO: 97395 - DNA, 25 bp, Homo sapien
cccagtagtcccagctgaaatgctc

SEQ ID NO: 97396 - DNA, 25 bp, Homo sapien
tttgaggctcgtccactaaaaggca

SEQ ID NO: 97397 - DNA, 25 bp, Homo sapien
gagaggcgccatctactgccgagaa

SEQ ID NO: 97398 - DNA, 25 bp, Homo sapien
ggcgaaatctgttgcccaccctggt

SEQ ID NO: 97399 - DNA, 25 bp, Homo sapien
gaacagcctggtcttggggtcttta

SEQ ID NO: 97400 - DNA, 25 bp, Homo sapien
cccgtcaggtatcatcaggtgtcac

SEQ ID NO: 97401 - DNA, 25 bp, Homo sapien
gcgttggcatccttatcggccagct

SEQ ID NO: 97402 - DNA, 25 bp, Homo sapien
tgccgcccatgtcctgcttggtcca

SEQ ID NO: 97403 - DNA, 25 bp, Homo sapien
cttggcgttggcatccttatcggcc

SEQ ID NO: 97404 - DNA, 25 bp, Homo sapien
ccgcccatgtcctgcttggtccact

SEQ ID NO: 97405 - DNA, 25 bp, Homo sapien
ggcgttggcatccttatcggccagc

SEQ ID NO: 97406 - DNA, 25 bp, Homo sapien
acgctactcggcatctctgatggcg

SEQ ID NO: 97407 - DNA, 25 bp, Homo sapien
cacgctactcggcatctctgatggc

SEQ ID NO: 97408 - DNA, 25 bp, Homo sapien
ttggcgttggcatccttatcggcca

SEQ ID NO: 97409 - DNA, 25 bp, Homo sapien
gggacagcgccccaagttcatctgg

SEQ ID NO: 97410 - DNA, 25 bp, Homo sapien
gccgggtgtcacctgcccgctatcc

SEQ ID NO: 97411 - DNA, 25 bp, Homo sapien
cgccgcgcccaagttcctccatccg

SEQ ID NO: 97412 - DNA, 25 bp, Homo sapien
aggcagcggggacagaacttcccaa

SEQ ID NO: 97413 - DNA, 25 bp, Homo sapien
ccttcccttcgggatgctgccgggt

SEQ ID NO: 97414 - DNA, 25 bp, Homo sapien
gtccaaggtcgagcaggtccttctc

SEQ ID NO: 97415 - DNA, 25 bp, Homo sapien
tgacctccgcgtccaaggtcgagca

SEQ ID NO: 97416 - DNA, 25 bp, Homo sapien
gctgggaaaatgacctccgcgtcca

SEQ ID NO: 97417 - DNA, 25 bp, Homo sapien
cggccaatggtgagcgccgttacta

SEQ ID NO: 97418 - DNA, 25 bp, Homo sapien
atatcgtgtcctcacaccggctgga

SEQ ID NO: 97419 - DNA, 25 bp, Homo sapien
cccattggtcagtcggtgatatatc

SEQ ID NO: 97420 - DNA, 25 bp, Homo sapien
atggaggccgacctgacttctccgc

SEQ ID NO: 97421 - DNA, 25 bp, Homo sapien
gtctcaggatttgttccgcgccttg

SEQ ID NO: 97422 - DNA, 25 bp, Homo sapien
gcacggaccaattcgggaacaaata

SEQ ID NO: 97423 - DNA, 25 bp, Homo sapien
acgcatcatgcgacacttagggtgt

SEQ ID NO: 97424 - DNA, 25 bp, Homo sapien
gagcactggacgtcgccatgacaga

SEQ ID NO: 97425 - DNA, 25 bp, Homo sapien
cgtgagtaagtctagggcccagttt

SEQ ID NO: 97426 - DNA, 25 bp, Homo sapien
gcccaaaacggatcgaccaggctcg

SEQ ID NO: 97427 - DNA, 25 bp, Homo sapien
tcgcgcctccacactttcaggaata

SEQ ID NO: 97428 - DNA, 25 bp, Homo sapien
actcaccgccagaccggaagcagga

SEQ ID NO: 97429 - DNA, 25 bp, Homo sapien
ccaggagaaaaccacggcagctgca

SEQ ID NO: 97430 - DNA, 25 bp, Homo sapien
tgcagacccacggaggccacgttca

SEQ ID NO: 97431 - DNA, 25 bp, Homo sapien
tccgaagcagctagggacttttgcc

SEQ ID NO: 97432 - DNA, 25 bp, Homo sapien
tgcaacgggtagcacttgacggccg

SEQ ID NO: 97433 - DNA, 25 bp, Homo sapien
cccgctggaaaagccgcgagttctt

SEQ ID NO: 97434 - DNA, 25 bp, Homo sapien
caatcggagtctagacgtggaggta

SEQ ID NO: 97435 - DNA, 25 bp, Homo sapien
ctgcgcattggagctcttgactggc

SEQ ID NO: 97436 - DNA, 25 bp, Homo sapien
ccagtggcgctgaattggaaaaaga

SEQ ID NO: 97437 - DNA, 25 bp, Homo sapien
acgacagttcggtatccagtggcgc

SEQ ID NO: 97438 - DNA, 25 bp, Homo sapien
ctgccgcaaagtaagccgcccggga

SEQ ID NO: 97439 - DNA, 25 bp, Homo sapien
agccgccatggtgattccgcaaaga

SEQ ID NO: 97440 - DNA, 25 bp, Homo sapien
taggatgacccgaaccaccagagcc

SEQ ID NO: 97441 - DNA, 25 bp, Homo sapien
tgtactcgtccttcaacaccggcgg

SEQ ID NO: 97442 - DNA, 25 bp, Homo sapien
ggtgcagcgccgcatagtctattgg

SEQ ID NO: 97443 - DNA, 25 bp, Homo sapien
tcagcccagcgatttgcataggccc

SEQ ID NO: 97444 - DNA, 25 bp, Homo sapien
cggcacttccgctgtcgggttagaa

SEQ ID NO: 97445 - DNA, 25 bp, Homo sapien
ctctatttatgtttcagcccagcga

SEQ ID NO: 97446 - DNA, 25 bp, Homo sapien
ccgtgtccgccaagcgctctattta

SEQ ID NO: 97447 - DNA, 25 bp, Homo sapien
tagtgccgtttatagggtcccggca

SEQ ID NO: 97448 - DNA, 25 bp, Homo sapien
cccagcttctgcgtcacagcggagg

SEQ ID NO: 97449 - DNA, 25 bp, Homo sapien
ttgctggctgcacatctgcttccga

SEQ ID NO: 97450 - DNA, 25 bp, Homo sapien
accagcagcgccacaagccggttgg

SEQ ID NO: 97451 - DNA, 25 bp, Homo sapien
aggccaccggatacagcgacctcag

SEQ ID NO: 97452 - DNA, 25 bp, Homo sapien
gtggtcgctgcactttgtccgagac

SEQ ID NO: 97453 - DNA, 25 bp, Homo sapien
ctagattggccaataggagaccgga

SEQ ID NO: 97454 - DNA, 25 bp, Homo sapien
ggcactcgatgcaaatggcttccca

SEQ ID NO: 97455 - DNA, 25 bp, Homo sapien
cacccaggggcaacttgaggcaatg

SEQ ID NO: 97456 - DNA, 25 bp, Homo sapien
cgagcccagctttcctaagccggga

SEQ ID NO: 97457 - DNA, 25 bp, Homo sapien
gctgaaatcaaacgcgacgccggct

SEQ ID NO: 97458 - DNA, 25 bp, Homo sapien
atcaagcgcagcgatggtgagccgc

SEQ ID NO: 97459 - DNA, 25 bp, Homo sapien
ctgctccagatgaggtgatggcaac

SEQ ID NO: 97460 - DNA, 25 bp, Homo sapien
ggccaacttcggcaagatccagatc

SEQ ID NO: 97461 - DNA, 25 bp, Homo sapien
ccagatcgggatttacgtggagatc

SEQ ID NO: 97462 - DNA, 25 bp, Homo sapien
gtctttgcattttaccggcttggcc

SEQ ID NO: 97463 - DNA, 25 bp, Homo sapien
agcgggcttcgttagggatgaccct

SEQ ID NO: 97464 - DNA, 25 bp, Homo sapien
cctcattgattgcttcgccgggctg

SEQ ID NO: 97465 - DNA, 25 bp, Homo sapien
caggaaacacacaccaagcacggag

SEQ ID NO: 97466 - DNA, 25 bp, Homo sapien
tgcacacacggcatgcgactggcgt

SEQ ID NO: 97467 - DNA, 25 bp, Homo sapien
acaccaagcacggagaggccaggcg

SEQ ID NO: 97468 - DNA, 25 bp, Homo sapien
acggaaccggcttccggcaccactg

SEQ ID NO: 97469 - DNA, 25 bp, Homo sapien
cacggcatgcgactggcgtggatcc

SEQ ID NO: 97470 - DNA, 25 bp, Homo sapien
agctaggtgcacacacggcatgcga

SEQ ID NO: 97471 - DNA, 25 bp, Homo sapien
ggcaccactgggacacgccacgagg

SEQ ID NO: 97472 - DNA, 25 bp, Homo sapien
gcgtggatccctggcgagaatggaa

SEQ ID NO: 97473 - DNA, 25 bp, Homo sapien
cgacttgaccttcggcatctcggca

SEQ ID NO: 97474 - DNA, 25 bp, Homo sapien
catctcggcagaaagcgggcccaca

SEQ ID NO: 97475 - DNA, 25 bp, Homo sapien
ggctagcgtgagaaagccaccacgt

SEQ ID NO: 97476 - DNA, 25 bp, Homo sapien
ggtcctgccggaagacctgacccga

SEQ ID NO: 97477 - DNA, 25 bp, Homo sapien
agcccactgactgccgggaattgga

SEQ ID NO: 97478 - DNA, 25 bp, Homo sapien
accgcgggagcctacagatcccaga

SEQ ID NO: 97479 - DNA, 25 bp, Homo sapien
acagatcccagaagacaccgcgcta

SEQ ID NO: 97480 - DNA, 25 bp, Homo sapien
tctgccgatcaggtcttggtccgca

SEQ ID NO: 97481 - DNA, 25 bp, Homo sapien
tggcgtgttcctagaagccgctttc

SEQ ID NO: 97482 - DNA, 25 bp, Homo sapien
agtgtacccatcgtgaccgcggttg

SEQ ID NO: 97483 - DNA, 25 bp, Homo sapien
gctagtccggactcctggctcttta

SEQ ID NO: 97484 - DNA, 25 bp, Homo sapien
agggaccaaccgacgccacttcgtg

SEQ ID NO: 97485 - DNA, 25 bp, Homo sapien
cgctggtctcctgtgacgtagtttt

SEQ ID NO: 97486 - DNA, 25 bp, Homo sapien
gcgcaagcgcacacaactgatttgg

SEQ ID NO: 97487 - DNA, 25 bp, Homo sapien
tggctctttatactgcgcaagcgca

SEQ ID NO: 97488 - DNA, 25 bp, Homo sapien
agacttggctgtttgcgcaacctta

SEQ ID NO: 97489 - DNA, 25 bp, Homo sapien
tgcgccactggctaaggcaaaaacc

SEQ ID NO: 97490 - DNA, 25 bp, Homo sapien
tcaggtcgtacacactcgccagcta

SEQ ID NO: 97491 - DNA, 25 bp, Homo sapien
gccagctacctgtacaaacagcgtc

SEQ ID NO: 97492 - DNA, 25 bp, Homo sapien
atcctgtaagtcagcagccgggagc

SEQ ID NO: 97493 - DNA, 25 bp, Homo sapien
ggtctctccaatcccaagagttccg

SEQ ID NO: 97494 - DNA, 25 bp, Homo sapien
agagttccgcggcatcttgcgccac

SEQ ID NO: 97495 - DNA, 25 bp, Homo sapien
cggaggaacccagatcctgtaagtc

SEQ ID NO: 97496 - DNA, 25 bp, Homo sapien
tggcgcctcccgcagtaagtaagtg

SEQ ID NO: 97497 - DNA, 25 bp, Homo sapien
accgcgcagaagatgagcgtgccca

SEQ ID NO: 97498 - DNA, 25 bp, Homo sapien
gtcggtgaccgccaaagagccaata

SEQ ID NO: 97499 - DNA, 25 bp, Homo sapien
tcacttggtagctgacggtcacgtc

SEQ ID NO: 97500 - DNA, 25 bp, Homo sapien
gcagctcggaatatgcgcccataga

SEQ ID NO: 97501 - DNA, 25 bp, Homo sapien
atggcccagtacctgtccagcgcga

SEQ ID NO: 97502 - DNA, 25 bp, Homo sapien
ggcgtcctcttgttcacgtagtcga

SEQ ID NO: 97503 - DNA, 25 bp, Homo sapien
cgtcggagataccagtagtgttgcc

SEQ ID NO: 97504 - DNA, 25 bp, Homo sapien
gtgtccacttgttgagcacctgata

SEQ ID NO: 97505 - DNA, 25 bp, Homo sapien
cacagggtcgaaaaagctgagtcct

SEQ ID NO: 97506 - DNA, 25 bp, Homo sapien
tggaattacacagggtcgaaaaagc

SEQ ID NO: 97507 - DNA, 25 bp, Homo sapien
cgcccacctggaggttggaattaca

SEQ ID NO: 97508 - DNA, 25 bp, Homo sapien
tgcaggcacagctcgagcgctttcc

SEQ ID NO: 97509 - DNA, 25 bp, Homo sapien
cgcggcttaactttcgcacctgagg

SEQ ID NO: 97510 - DNA, 25 bp, Homo sapien
ctccgggacgtggatacaggtaaag

SEQ ID NO: 97511 - DNA, 25 bp, Homo sapien
cgcagcgagtcctcagagcctggct

SEQ ID NO: 97512 - DNA, 25 bp, Homo sapien
gcacctgaggctctcggagcggcct

SEQ ID NO: 97513 - DNA, 25 bp, Homo sapien
ggaccgattctctgcgtctgccagt

SEQ ID NO: 97514 - DNA, 25 bp, Homo sapien
agcagaacttgatcgcgctccttcc

SEQ ID NO: 97515 - DNA, 25 bp, Homo sapien
ttcaagctgaaggttaccgacccgc

SEQ ID NO: 97516 - DNA, 25 bp, Homo sapien
tctgcaccgaatgggcgcaaaaagc

SEQ ID NO: 97517 - DNA, 25 bp, Homo sapien
tgctgcacggcacagctagcgcttc

SEQ ID NO: 97518 - DNA, 25 bp, Homo sapien
ggcagccgattagagccaattgctt

SEQ ID NO: 97519 - DNA, 25 bp, Homo sapien
tcctatcaatgtgcgggcccgcgaa

SEQ ID NO: 97520 - DNA, 25 bp, Homo sapien
cctgaatggaaactcggaaccgccg

SEQ ID NO: 97521 - DNA, 25 bp, Homo sapien
gtactgacgggtccttgcgagccgt

SEQ ID NO: 97522 - DNA, 25 bp, Homo sapien
ccgcgccgctttccgattggcagcc

SEQ ID NO: 97523 - DNA, 25 bp, Homo sapien
agcctgtaggatccgcagctgcggt

SEQ ID NO: 97524 - DNA, 25 bp, Homo sapien
ggagacccagcctgtaggatccgca

SEQ ID NO: 97525 - DNA, 25 bp, Homo sapien
tggatcctgcatcgccgggttcggc

SEQ ID NO: 97526 - DNA, 25 bp, Homo sapien
gcgacttccacggtgaggacggcgc

SEQ ID NO: 97527 - DNA, 25 bp, Homo sapien
accatggatcctgcatcgccgggtt

SEQ ID NO: 97528 - DNA, 25 bp, Homo sapien
tcctccagccctcccggtgcgtccc

SEQ ID NO: 97529 - DNA, 25 bp, Homo sapien
agccgactgtgctccggctactaca

SEQ ID NO: 97530 - DNA, 25 bp, Homo sapien
gcttcgccgacctcaagtactgctg

SEQ ID NO: 97531 - DNA, 25 bp, Homo sapien
acagctacatgtggagcctcaggtg

SEQ ID NO: 97532 - DNA, 25 bp, Homo sapien
aaggcgcccagacaccatgtggaca

SEQ ID NO: 97533 - DNA, 25 bp, Homo sapien
tccagtattgctgcggcttcgccga

SEQ ID NO: 97534 - DNA, 25 bp, Homo sapien
acagcctcaaccagagcttcgtgga

SEQ ID NO: 97535 - DNA, 25 bp, Homo sapien
ccagagcccagatcggaagagccga

SEQ ID NO: 97536 - DNA, 25 bp, Homo sapien
aaggagcgaccgctcagcagcgaga

SEQ ID NO: 97537 - DNA, 25 bp, Homo sapien
tggctttcgaaaaggcgcttgcttc

SEQ ID NO: 97538 - DNA, 25 bp, Homo sapien
ctagcgacggcagaaccagtagatg

SEQ ID NO: 97539 - DNA, 25 bp, Homo sapien
gaagggcctgtacgcctctagcgac

SEQ ID NO: 97540 - DNA, 25 bp, Homo sapien
aggcacagtcaaagcggcgttttcc

SEQ ID NO: 97541 - DNA, 25 bp, Homo sapien
aggggtaactcgagcctctggcttt

SEQ ID NO: 97542 - DNA, 25 bp, Homo sapien
tccttacctgggactgccatgacgg

SEQ ID NO: 97543 - DNA, 25 bp, Homo sapien
gcagaggccctgtaattgctcctta

SEQ ID NO: 97544 - DNA, 25 bp, Homo sapien
cagcaccctcgctacggtcgggaag

SEQ ID NO: 97545 - DNA, 25 bp, Homo sapien
aacaggctcctttttgagggttgcg

SEQ ID NO: 97546 - DNA, 25 bp, Homo sapien
tgcgcgaccactgcgcggtacaata

SEQ ID NO: 97547 - DNA, 25 bp, Homo sapien
tcgcggcgtctgaggttgcaatctc

SEQ ID NO: 97548 - DNA, 25 bp, Homo sapien
tgcaatctcgtctggggcactctcg

SEQ ID NO: 97549 - DNA, 25 bp, Homo sapien
gggattagttctgacttcatgatta

SEQ ID NO: 97550 - DNA, 25 bp, Homo sapien
ggtttccttagggtgacgtcatctc

SEQ ID NO: 97551 - DNA, 25 bp, Homo sapien
tctgctcagagataaaacaggctcc

SEQ ID NO: 97552 - DNA, 25 bp, Homo sapien
ctgcgcggtacaataagaacctgtc

SEQ ID NO: 97553 - DNA, 25 bp, Homo sapien
gtgcttcagtgctcccgacctttct

SEQ ID NO: 97554 - DNA, 25 bp, Homo sapien
cgtcgtgccctttctggcttttggc

SEQ ID NO: 97555 - DNA, 25 bp, Homo sapien
ttaaactgcccagagaaagggcttc

SEQ ID NO: 97556 - DNA, 25 bp, Homo sapien
tgctgcggccgctgtttgttattaa

SEQ ID NO: 97557 - DNA, 25 bp, Homo sapien
tctgtgtatttgcagctcagcagtc

SEQ ID NO: 97558 - DNA, 25 bp, Homo sapien
cggtgggcaaagctttctgtgtatt

SEQ ID NO: 97559 - DNA, 25 bp, Homo sapien
gcataaacttgggtgccctcgcctc

SEQ ID NO: 97560 - DNA, 25 bp, Homo sapien
ttgcagctcagcagtcgagcgtcca

SEQ ID NO: 97561 - DNA, 25 bp, Homo sapien
atgtgtcggccgtcaagcccagggc

SEQ ID NO: 97562 - DNA, 25 bp, Homo sapien
gtaaaggtgctcacggaggtccgcc

SEQ ID NO: 97563 - DNA, 25 bp, Homo sapien
cctggcagacgtgcctgcgtgaccc

SEQ ID NO: 97564 - DNA, 25 bp, Homo sapien
cggtaaatgtgtcggccgtcaagcc

SEQ ID NO: 97565 - DNA, 25 bp, Homo sapien
cccgtgagtactcaggttggcgtgg

SEQ ID NO: 97566 - DNA, 25 bp, Homo sapien
ggcaccggcgaggaatcacggtaaa

SEQ ID NO: 97567 - DNA, 25 bp, Homo sapien
gcgtccctgcctgcgggtgcagttc

SEQ ID NO: 97568 - DNA, 25 bp, Homo sapien
atcacggtaaatgtgtcggccgtca

SEQ ID NO: 97569 - DNA, 25 bp, Homo sapien
cgtcacaaactccaggtcgcctagg

SEQ ID NO: 97570 - DNA, 25 bp, Homo sapien
ggagctccacaagattcaaccgtta

SEQ ID NO: 97571 - DNA, 25 bp, Homo sapien
tcaggtatctagttggccggcgata

SEQ ID NO: 97572 - DNA, 25 bp, Homo sapien
tcgctcggacgctgacagaagactg

SEQ ID NO: 97573 - DNA, 25 bp, Homo sapien
agctgagttttgtgtcgcgcctttt

SEQ ID NO: 97574 - DNA, 25 bp, Homo sapien
cgcgccttttctgacgatgcgaaca

SEQ ID NO: 97575 - DNA, 25 bp, Homo sapien
tttcagcagagacgtagaaggcgcc

SEQ ID NO: 97576 - DNA, 25 bp, Homo sapien
gctgcatgcccattggatgtgctca

SEQ ID NO: 97577 - DNA, 25 bp, Homo sapien
caatcgtcgggtggttagttgcaca

SEQ ID NO: 97578 - DNA, 25 bp, Homo sapien
gggcgccgcttagccgactcttact

SEQ ID NO: 97579 - DNA, 25 bp, Homo sapien
ggttgagccacctacccagaggcct

SEQ ID NO: 97580 - DNA, 25 bp, Homo sapien
agaaacagccttcagagtcctcaac

SEQ ID NO: 97581 - DNA, 25 bp, Homo sapien
aaccagggtagccatcctcgcaggg

SEQ ID NO: 97582 - DNA, 25 bp, Homo sapien
cgagcttgtttacaaccagggtagc

SEQ ID NO: 97583 - DNA, 25 bp, Homo sapien
tgtctactcccgctccgagcttgtt

SEQ ID NO: 97584 - DNA, 25 bp, Homo sapien
ccgatggtggagaatagagcacgca

SEQ ID NO: 97585 - DNA, 25 bp, Homo sapien
tccagcgcgcgggttaaccttggcc

SEQ ID NO: 97586 - DNA, 25 bp, Homo sapien
cgcagtcagcgaggctggtcacaga

SEQ ID NO: 97587 - DNA, 25 bp, Homo sapien
ctcgggaggacgtccattcctcttt

SEQ ID NO: 97588 - DNA, 25 bp, Homo sapien
tgtgcgaagcctccgcaggtacctc

SEQ ID NO: 97589 - DNA, 25 bp, Homo sapien
tgccttttggctgtgcgaagcctcc

SEQ ID NO: 97590 - DNA, 25 bp, Homo sapien
ccttaccaagcaggaggacgcgaga

SEQ ID NO: 97591 - DNA, 25 bp, Homo sapien
ggaggcgcacccttgccagacagaa

SEQ ID NO: 97592 - DNA, 25 bp, Homo sapien
ttcctctttgtttgggactgcctca

SEQ ID NO: 97593 - DNA, 25 bp, Homo sapien
cggcaagcgctatcgagacaataac

SEQ ID NO: 97594 - DNA, 25 bp, Homo sapien
cctgtgcaccgattactgtcgtaca

SEQ ID NO: 97595 - DNA, 25 bp, Homo sapien
ctgccttcaaatcagggctggactc

SEQ ID NO: 97596 - DNA, 25 bp, Homo sapien
tgtcgtacaaagaaactccatcggc

SEQ ID NO: 97597 - DNA, 25 bp, Homo sapien
tgggctctctatctctctggctggg

SEQ ID NO: 97598 - DNA, 25 bp, Homo sapien
cgccgtctctcgctcgagtgaatgt

SEQ ID NO: 97599 - DNA, 25 bp, Homo sapien
cgccgctggcgaaggagaacaagca

SEQ ID NO: 97600 - DNA, 25 bp, Homo sapien
gctgcaagagatacctgctgccttc

SEQ ID NO: 97601 - DNA, 25 bp, Homo sapien
gtcctgctctccttagtcggatttg

SEQ ID NO: 97602 - DNA, 25 bp, Homo sapien
gatgcggacgcttttttccttccta

SEQ ID NO: 97603 - DNA, 25 bp, Homo sapien
ggcttaccttggtgcccatatttga

SEQ ID NO: 97604 - DNA, 25 bp, Homo sapien
ccatatttgattagggcacccgggt

SEQ ID NO: 97605 - DNA, 25 bp, Homo sapien
tcgctgctgggtcttcgaattccgt

SEQ ID NO: 97606 - DNA, 25 bp, Homo sapien
cccgaacttaagatggccgcaggtg

SEQ ID NO: 97607 - DNA, 25 bp, Homo sapien
gactctcatcgacttttggggaaaa

SEQ ID NO: 97608 - DNA, 25 bp, Homo sapien
ggttaactactgcacggagccctta

SEQ ID NO: 97609 - DNA, 25 bp, Homo sapien
agctgttcagacgttgattggccca

SEQ ID NO: 97610 - DNA, 25 bp, Homo sapien
caggcccattccttccgcagtagtg

SEQ ID NO: 97611 - DNA, 25 bp, Homo sapien
ttggcccaaagcatcgtgaatattc

SEQ ID NO: 97612 - DNA, 25 bp, Homo sapien
cggcgcgttacgatgcttatctgca

SEQ ID NO: 97613 - DNA, 25 bp, Homo sapien
cgccgatccgataggaagtgacata

SEQ ID NO: 97614 - DNA, 25 bp, Homo sapien
agcgactctcctgtaccgacaaaaa

SEQ ID NO: 97615 - DNA, 25 bp, Homo sapien
ccaccgcttacggttggctgtagta

SEQ ID NO: 97616 - DNA, 25 bp, Homo sapien
aggatcggcggcttccaattctttg

SEQ ID NO: 97617 - DNA, 25 bp, Homo sapien
cccgagcacgggacaacgatagtta

SEQ ID NO: 97618 - DNA, 25 bp, Homo sapien
ctgtgaacttagcagcgggctcctg

SEQ ID NO: 97619 - DNA, 25 bp, Homo sapien
gggcgaccgtagtttcccatcctgc

SEQ ID NO: 97620 - DNA, 25 bp, Homo sapien
attgacttccctgtggctgttaccc

SEQ ID NO: 97621 - DNA, 25 bp, Homo sapien
gctgcctgatggtgtgtttttaaaa

SEQ ID NO: 97622 - DNA, 25 bp, Homo sapien
ctccttcgtgtttgtatctgacttg

SEQ ID NO: 97623 - DNA, 25 bp, Homo sapien
ctctgattctccaaagtgggcgttg

SEQ ID NO: 97624 - DNA, 25 bp, Homo sapien
tcctcctcgggctcagaaactctgt

SEQ ID NO: 97625 - DNA, 25 bp, Homo sapien
tccgggacggatccattccgggctc

SEQ ID NO: 97626 - DNA, 25 bp, Homo sapien
ttttcctatacaaccagcggcgtcc

SEQ ID NO: 97627 - DNA, 25 bp, Homo sapien
gcggaggagtcactgtggacttccc

SEQ ID NO: 97628 - DNA, 25 bp, Homo sapien
ccggagcgttgtcactgccatccct

SEQ ID NO: 97629 - DNA, 25 bp, Homo sapien
atccctcccgcggtgaatcacaggt

SEQ ID NO: 97630 - DNA, 25 bp, Homo sapien
ccgtccgcgtgcttttcctatacaa

SEQ ID NO: 97631 - DNA, 25 bp, Homo sapien
gagcagccgcgggtttatttattta

SEQ ID NO: 97632 - DNA, 25 bp, Homo sapien
aatcacaggtcggcctcaggtgcgc

SEQ ID NO: 97633 - DNA, 25 bp, Homo sapien
tgggcaattccaagatcgcgcaagc

SEQ ID NO: 97634 - DNA, 25 bp, Homo sapien
cgcgcaagcctttcccagcaagatg

SEQ ID NO: 97635 - DNA, 25 bp, Homo sapien
tcgtcagacacatcgtgaggcccaa

SEQ ID NO: 97636 - DNA, 25 bp, Homo sapien
ccgaggagaagctgtcgccctctta

SEQ ID NO: 97637 - DNA, 25 bp, Homo sapien
ttacggcagtgacaagaagcacctg

SEQ ID NO: 97638 - DNA, 25 bp, Homo sapien
aaggctgcctgaaacgcccagtctc

SEQ ID NO: 97639 - DNA, 25 bp, Homo sapien
tctgggacactcactgggcaattcc

SEQ ID NO: 97640 - DNA, 25 bp, Homo sapien
gtcttgcacccaaactcggcgggca

SEQ ID NO: 97641 - DNA, 25 bp, Homo sapien
agttgccgacgagctcgggcttcct

SEQ ID NO: 97642 - DNA, 25 bp, Homo sapien
gacactcggattagagacgcagcca

SEQ ID NO: 97643 - DNA, 25 bp, Homo sapien
ggttggctgaaagacactcggatta

SEQ ID NO: 97644 - DNA, 25 bp, Homo sapien
tccgtcaccgcacacttcggagggt

SEQ ID NO: 97645 - DNA, 25 bp, Homo sapien
acgtgtagagccagagcactccgca

SEQ ID NO: 97646 - DNA, 25 bp, Homo sapien
ctcgaaaaagcctggggttggctga

SEQ ID NO: 97647 - DNA, 25 bp, Homo sapien
gcgactctcttcctgtcactggcag

SEQ ID NO: 97648 - DNA, 25 bp, Homo sapien
ggtctgaacttgtcttcgacctccc

SEQ ID NO: 97649 - DNA, 25 bp, Homo sapien
ccgagccaagcggagctgggccact

SEQ ID NO: 97650 - DNA, 25 bp, Homo sapien
cgccggacacgagcactgcctgccg

SEQ ID NO: 97651 - DNA, 25 bp, Homo sapien
tccagttggcttctcaatgaggagc

SEQ ID NO: 97652 - DNA, 25 bp, Homo sapien
gttggcttctcaatgaggagccggc

SEQ ID NO: 97653 - DNA, 25 bp, Homo sapien
gcgaaatccagttggcttctcaatg

SEQ ID NO: 97654 - DNA, 25 bp, Homo sapien
ccaagcggagctgggccactgtgca

SEQ ID NO: 97655 - DNA, 25 bp, Homo sapien
acagtagcgaaatccagttggcttc

SEQ ID NO: 97656 - DNA, 25 bp, Homo sapien
cccgatacagtagcgaaatccagtt

SEQ ID NO: 97657 - DNA, 25 bp, Homo sapien
cccagagaggacaaaggtggaaaga

SEQ ID NO: 97658 - DNA, 25 bp, Homo sapien
gcgaagccaggactttgtcacgagc

SEQ ID NO: 97659 - DNA, 25 bp, Homo sapien
ggcgcattctcacgcgaggtgtgcc

SEQ ID NO: 97660 - DNA, 25 bp, Homo sapien
tttgtcacgagctttgcccggacgc

SEQ ID NO: 97661 - DNA, 25 bp, Homo sapien
tgatattgatgccacccagagagga

SEQ ID NO: 97662 - DNA, 25 bp, Homo sapien
cgcacagggcgcattctcacgcgag

SEQ ID NO: 97663 - DNA, 25 bp, Homo sapien
agacacacgaaaggggcccgagacg

SEQ ID NO: 97664 - DNA, 25 bp, Homo sapien
gaggattgattcttgatattgatgc

SEQ ID NO: 97665 - DNA, 25 bp, Homo sapien
gcctgatgacgtggcttggcaacgt

SEQ ID NO: 97666 - DNA, 25 bp, Homo sapien
cggagcttcaatgcgacacaacgtg

SEQ ID NO: 97667 - DNA, 25 bp, Homo sapien
ggtcgctcaggatgcactttctccg

SEQ ID NO: 97668 - DNA, 25 bp, Homo sapien
accgatccggaaggcagcgaccggc

SEQ ID NO: 97669 - DNA, 25 bp, Homo sapien
cgccggaactgatcgcggcctagtc

SEQ ID NO: 97670 - DNA, 25 bp, Homo sapien
ttgcgcagacgcaaggctgggcact

SEQ ID NO: 97671 - DNA, 25 bp, Homo sapien
acgaggaaaggcgagtgttctgctt

SEQ ID NO: 97672 - DNA, 25 bp, Homo sapien
cccagcgctcggtaagggaccgatc

SEQ ID NO: 97673 - DNA, 25 bp, Homo sapien
atcgccctggaaacgcattctctgc

SEQ ID NO: 97674 - DNA, 25 bp, Homo sapien
agtgagtgccacgaacaggccaata

SEQ ID NO: 97675 - DNA, 25 bp, Homo sapien
cggggtttaaatctgaggctaggct

SEQ ID NO: 97676 - DNA, 25 bp, Homo sapien
gcagaccacgtgagagcctggccag

SEQ ID NO: 97677 - DNA, 25 bp, Homo sapien
gaagccatggcgctccgagtcacca

SEQ ID NO: 97678 - DNA, 25 bp, Homo sapien
agccgcttcggactgcgaactaacg

SEQ ID NO: 97679 - DNA, 25 bp, Homo sapien
taacgcggccttcttagctgctgcc

SEQ ID NO: 97680 - DNA, 25 bp, Homo sapien
cttgcccggctaacctttccaggtg

SEQ ID NO: 97681 - DNA, 25 bp, Homo sapien
tcaaccagcaatggaggagcagccc

SEQ ID NO: 97682 - DNA, 25 bp, Homo sapien
ttgcctgttgagtggtagcctttcc

SEQ ID NO: 97683 - DNA, 25 bp, Homo sapien
ttttctgagcgcgtttgcctgttga

SEQ ID NO: 97684 - DNA, 25 bp, Homo sapien
gcgtccatttagtggcgggaaaagc

SEQ ID NO: 97685 - DNA, 25 bp, Homo sapien
gaggagcccgtagtaaccacggcaa

SEQ ID NO: 97686 - DNA, 25 bp, Homo sapien
ttcaccagtagagcccggatgaaag

SEQ ID NO: 97687 - DNA, 25 bp, Homo sapien
cagccgtctgcagttattttcacca

SEQ ID NO: 97688 - DNA, 25 bp, Homo sapien
attccaactttttaccagccgtctg

SEQ ID NO: 97689 - DNA, 25 bp, Homo sapien
ctagtagggtcgttcaggtaaagca

SEQ ID NO: 97690 - DNA, 25 bp, Homo sapien
ctccgccaggaccttgttagtctta

SEQ ID NO: 97691 - DNA, 25 bp, Homo sapien
taaagcaatttgtcgcgtttccgca

SEQ ID NO: 97692 - DNA, 25 bp, Homo sapien
gccttgcggcaaccgtgcagcatct

SEQ ID NO: 97693 - DNA, 25 bp, Homo sapien
agcatcttggcaggtaggtcctgta

SEQ ID NO: 97694 - DNA, 25 bp, Homo sapien
aggtcctgtacctactgccgggatc

SEQ ID NO: 97695 - DNA, 25 bp, Homo sapien
atgggactttgagcctgttggaccg

SEQ ID NO: 97696 - DNA, 25 bp, Homo sapien
tcccttcaaggtctcgggaatggtc

SEQ ID NO: 97697 - DNA, 25 bp, Homo sapien
gctcggctatttccgtcgcagctcg

SEQ ID NO: 97698 - DNA, 25 bp, Homo sapien
tcgggcttaactctgtcctcgctgg

SEQ ID NO: 97699 - DNA, 25 bp, Homo sapien
gccctccaggaaaatgcgcgatcgg

SEQ ID NO: 97700 - DNA, 25 bp, Homo sapien
ctcagccagcgggtctaaacagtgt

SEQ ID NO: 97701 - DNA, 25 bp, Homo sapien
tgcataaatggtctacgctccctta

SEQ ID NO: 97702 - DNA, 25 bp, Homo sapien
acaccttcggccgatccggagaaca

SEQ ID NO: 97703 - DNA, 25 bp, Homo sapien
ttccggaagaagttcggctcctgtc

SEQ ID NO: 97704 - DNA, 25 bp, Homo sapien
tagcgcttcgccaggttatttgcaa

SEQ ID NO: 97705 - DNA, 25 bp, Homo sapien
gatactaaagcgacggagcccggtg

SEQ ID NO: 97706 - DNA, 25 bp, Homo sapien
gtagctttaaattcgtgttgtcctg

SEQ ID NO: 97707 - DNA, 25 bp, Homo sapien
aaagcgttatgagaagctggacttc

SEQ ID NO: 97708 - DNA, 25 bp, Homo sapien
tgaagtctcgggcaaagcgttatga

SEQ ID NO: 97709 - DNA, 25 bp, Homo sapien
cggatggctctggacgtgaagtctc

SEQ ID NO: 97710 - DNA, 25 bp, Homo sapien
cgcccttttcggctggagtcgggct

SEQ ID NO: 97711 - DNA, 25 bp, Homo sapien
ttgtcctgggagctcgcccttttcg

SEQ ID NO: 97712 - DNA, 25 bp, Homo sapien
taaattcgtgttgtcctgggagctc

SEQ ID NO: 97713 - DNA, 25 bp, Homo sapien
tccgggccaccacgtgaccgcgtgg

SEQ ID NO: 97714 - DNA, 25 bp, Homo sapien
cccggttcccacctgccaggtctga

SEQ ID NO: 97715 - DNA, 25 bp, Homo sapien
ctccagctcagcgaacagcaccctc

SEQ ID NO: 97716 - DNA, 25 bp, Homo sapien
actcagctcgctcacctggcaagta

SEQ ID NO: 97717 - DNA, 25 bp, Homo sapien
tggcaagtagcctcctctccgtgcg

SEQ ID NO: 97718 - DNA, 25 bp, Homo sapien
aagtagcctcctctccgtgcgcgtg

SEQ ID NO: 97719 - DNA, 25 bp, Homo sapien
ccagacaggaaacgccggtgaggtc

SEQ ID NO: 97720 - DNA, 25 bp, Homo sapien
cgcagtcccagacaggaaacgccgg

SEQ ID NO: 97721 - DNA, 25 bp, Homo sapien
gctcacgtgccctttgctctacagg

SEQ ID NO: 97722 - DNA, 25 bp, Homo sapien
cagtgcgctggatgcctaagtcaca

SEQ ID NO: 97723 - DNA, 25 bp, Homo sapien
ggtggctgccctttcacctagggta

SEQ ID NO: 97724 - DNA, 25 bp, Homo sapien
tccgctcttcgcctaaaaggggatg

SEQ ID NO: 97725 - DNA, 25 bp, Homo sapien
cgtgagtctatctctgccttcaagc

SEQ ID NO: 97726 - DNA, 25 bp, Homo sapien
cgccctgaccggtgagcaggatgtt

SEQ ID NO: 97727 - DNA, 25 bp, Homo sapien
cgcggttgcggctatattatgtata

SEQ ID NO: 97728 - DNA, 25 bp, Homo sapien
tggttacctggctttcgatgacaca

SEQ ID NO: 97729 - DNA, 25 bp, Homo sapien
tctccaaagacagtgggtttcagcc

SEQ ID NO: 97730 - DNA, 25 bp, Homo sapien
gttagaaccgcagagcctttcccga

SEQ ID NO: 97731 - DNA, 25 bp, Homo sapien
gaagcgcagaagtatccgaaatcta

SEQ ID NO: 97732 - DNA, 25 bp, Homo sapien
gcccgataccggtttcagagtcctg

SEQ ID NO: 97733 - DNA, 25 bp, Homo sapien
gcgggcagaaccgaggacacaatga

SEQ ID NO: 97734 - DNA, 25 bp, Homo sapien
ggcgatctcggtgctccttacctgg

SEQ ID NO: 97735 - DNA, 25 bp, Homo sapien
tttcagccagaaacgcgaagacgaa

SEQ ID NO: 97736 - DNA, 25 bp, Homo sapien
ggcctcgttgggtcggaatctccaa

SEQ ID NO: 97737 - DNA, 25 bp, Homo sapien
ccacttgttgcgagttgtgtgaacc

SEQ ID NO: 97738 - DNA, 25 bp, Homo sapien
gcgcgggcaacttttcacttttatg

SEQ ID NO: 97739 - DNA, 25 bp, Homo sapien
tggagccgccgatcaagctttattc

SEQ ID NO: 97740 - DNA, 25 bp, Homo sapien
gggccacactggctacttcgaatcc

SEQ ID NO: 97741 - DNA, 25 bp, Homo sapien
tctcatccgtgaccaaaagggctgc

SEQ ID NO: 97742 - DNA, 25 bp, Homo sapien
tgtgaacccgcgtcgatttaagctg

SEQ ID NO: 97743 - DNA, 25 bp, Homo sapien
gctgctcacgcttcggattctcatc

SEQ ID NO: 97744 - DNA, 25 bp, Homo sapien
atggggcacgacattcctgaacagc

SEQ ID NO: 97745 - DNA, 25 bp, Homo sapien
cttccgagagcgaatggcgatcact

SEQ ID NO: 97746 - DNA, 25 bp, Homo sapien
cactctgcagcatccggaacgtttc

SEQ ID NO: 97747 - DNA, 25 bp, Homo sapien
agagtccttctagcggcgccggtga

SEQ ID NO: 97748 - DNA, 25 bp, Homo sapien
cccaactcagcggaggccatgccct

SEQ ID NO: 97749 - DNA, 25 bp, Homo sapien
gcatccggaacgtttcggcgtggcc

SEQ ID NO: 97750 - DNA, 25 bp, Homo sapien
gagtttccggctgagagtccttcta

SEQ ID NO: 97751 - DNA, 25 bp, Homo sapien
attccagctggaacaccgtcccttt

SEQ ID NO: 97752 - DNA, 25 bp, Homo sapien
ggcgatcactctttccggttctctg

SEQ ID NO: 97753 - DNA, 25 bp, Homo sapien
gacacagcccatagtgtgcccggga

SEQ ID NO: 97754 - DNA, 25 bp, Homo sapien
atgccgcagggaaactcaggcctca

SEQ ID NO: 97755 - DNA, 25 bp, Homo sapien
atggagatgccgcagggaaactcag

SEQ ID NO: 97756 - DNA, 25 bp, Homo sapien
acagcccatagtgtgcccgggatgg

SEQ ID NO: 97757 - DNA, 25 bp, Homo sapien
cagcccatagtgtgcccgggatgga

SEQ ID NO: 97758 - DNA, 25 bp, Homo sapien
cccatagcgcgcctgggatggagat

SEQ ID NO: 97759 - DNA, 25 bp, Homo sapien
gccgcagggaaactcaggcctcagc

SEQ ID NO: 97760 - DNA, 25 bp, Homo sapien
gcagggagacacagcccatagtgtg

SEQ ID NO: 97761 - DNA, 25 bp, Homo sapien
acgcaggcctcaggatggagtagcc

SEQ ID NO: 97762 - DNA, 25 bp, Homo sapien
cagcccacagtctgccggggataga

SEQ ID NO: 97763 - DNA, 25 bp, Homo sapien
tgtggctccagttcccattcggctt

SEQ ID NO: 97764 - DNA, 25 bp, Homo sapien
tgaccagtgctcaggcgcggagccc

SEQ ID NO: 97765 - DNA, 25 bp, Homo sapien
cgcggagcccagctatggaatcaca

SEQ ID NO: 97766 - DNA, 25 bp, Homo sapien
tggaatcacaagcagcccagagcgc

SEQ ID NO: 97767 - DNA, 25 bp, Homo sapien
agacgcagcccatagtgtgcccggg

SEQ ID NO: 97768 - DNA, 25 bp, Homo sapien
acgcagtcctcagcgcgccagggat

SEQ ID NO: 97769 - DNA, 25 bp, Homo sapien
cttttcaggccggacgggtgcctgc

SEQ ID NO: 97770 - DNA, 25 bp, Homo sapien
agccttcccggtcagcggtggtgac

SEQ ID NO: 97771 - DNA, 25 bp, Homo sapien
tggtgacggtatcccagagtgccag

SEQ ID NO: 97772 - DNA, 25 bp, Homo sapien
tgccagagaaccgttgcttttccga

SEQ ID NO: 97773 - DNA, 25 bp, Homo sapien
ttttccgagttgctcttcttccagg

SEQ ID NO: 97774 - DNA, 25 bp, Homo sapien
tccaggctccgttggtggtcggcat

SEQ ID NO: 97775 - DNA, 25 bp, Homo sapien
cttcagtcggcagagagagagctcg

SEQ ID NO: 97776 - DNA, 25 bp, Homo sapien
cctcaggtgcgagtttgtgcggtaa

SEQ ID NO: 97777 - DNA, 25 bp, Homo sapien
cgataaccactcgtagaaagcgtga

SEQ ID NO: 97778 - DNA, 25 bp, Homo sapien
cgtgagaagttactacaagcggtcc

SEQ ID NO: 97779 - DNA, 25 bp, Homo sapien
ctcgagcagtttgggctccttgata

SEQ ID NO: 97780 - DNA, 25 bp, Homo sapien
atccgctcactggagttgtggtccg

SEQ ID NO: 97781 - DNA, 25 bp, Homo sapien
ggacagcatcaagtcgatccgctca

SEQ ID NO: 97782 - DNA, 25 bp, Homo sapien
gcagccagtgcagtctccctattag

SEQ ID NO: 97783 - DNA, 25 bp, Homo sapien
tcccggagcaggaggattccgtgct

SEQ ID NO: 97784 - DNA, 25 bp, Homo sapien
gcggcggaagtcgtcactcttaaga

SEQ ID NO: 97785 - DNA, 25 bp, Homo sapien
agctccctgtggctcgacagcaatg

SEQ ID NO: 97786 - DNA, 25 bp, Homo sapien
agggacgttgcaaagagcgccagtc

SEQ ID NO: 97787 - DNA, 25 bp, Homo sapien
ctgccgcctctccttaagtgcttga

SEQ ID NO: 97788 - DNA, 25 bp, Homo sapien
attttctagccgctgcgcttgggcc

SEQ ID NO: 97789 - DNA, 25 bp, Homo sapien
ctgccggaaggaaggattttctagc

SEQ ID NO: 97790 - DNA, 25 bp, Homo sapien
cttcttggagtcagagcaggagccg

SEQ ID NO: 97791 - DNA, 25 bp, Homo sapien
tgtacccgaggtaaggcttcttgga

SEQ ID NO: 97792 - DNA, 25 bp, Homo sapien
cgtgtcctacgaagaggtagggctt

SEQ ID NO: 97793 - DNA, 25 bp, Homo sapien
tagaatgacgctggggaagcccgaa

SEQ ID NO: 97794 - DNA, 25 bp, Homo sapien
gtgacagcaagacccaagcaactag

SEQ ID NO: 97795 - DNA, 25 bp, Homo sapien
ggcataacccgacgagccgggcgct

SEQ ID NO: 97796 - DNA, 25 bp, Homo sapien
cagacagccgtccagctctggcata

SEQ ID NO: 97797 - DNA, 25 bp, Homo sapien
gccacagcgccgcagcacaaacagg

SEQ ID NO: 97798 - DNA, 25 bp, Homo sapien
cccaagcaactagggagggcgaccg

SEQ ID NO: 97799 - DNA, 25 bp, Homo sapien
agcacgcggggacgcctccagacag

SEQ ID NO: 97800 - DNA, 25 bp, Homo sapien
gtccagctctggcataacccgacga

SEQ ID NO: 97801 - DNA, 25 bp, Homo sapien
cggccacgccgaaacgttccggatg

SEQ ID NO: 97802 - DNA, 25 bp, Homo sapien
tagaaggactctcagccggaaactc

SEQ ID NO: 97803 - DNA, 25 bp, Homo sapien
agggacggtgttccagctggaattc

SEQ ID NO: 97804 - DNA, 25 bp, Homo sapien
tcaccggcgccgctagaaggactct

SEQ ID NO: 97805 - DNA, 25 bp, Homo sapien
aacgttccggatgctgcagagtgca

SEQ ID NO: 97806 - DNA, 25 bp, Homo sapien
cagagaaccggaaagagtgatcgcc

SEQ ID NO: 97807 - DNA, 25 bp, Homo sapien
cggaaagagtgatcgccattcgctc

SEQ ID NO: 97808 - DNA, 25 bp, Homo sapien
atcgccattcgctctcggaaggtcg

SEQ ID NO: 97809 - DNA, 25 bp, Homo sapien
gcgcaatcagttgcggcgtcctgtg

SEQ ID NO: 97810 - DNA, 25 bp, Homo sapien
ccatgttccgcagggcacgccttag

SEQ ID NO: 97811 - DNA, 25 bp, Homo sapien
agggtgaaatttagccatcggtgtg

SEQ ID NO: 97812 - DNA, 25 bp, Homo sapien
tgcccacagtcgatttcggtggagc

SEQ ID NO: 97813 - DNA, 25 bp, Homo sapien
ggagcccacagatgtgcccacagtc

SEQ ID NO: 97814 - DNA, 25 bp, Homo sapien
ggactctgcttccaagcccgcggag

SEQ ID NO: 97815 - DNA, 25 bp, Homo sapien
aatgtcaggcctggtgtaggcgcca

SEQ ID NO: 97816 - DNA, 25 bp, Homo sapien
cgccttagcgtgaagccgaatgtca

SEQ ID NO: 97817 - DNA, 25 bp, Homo sapien
tcctgcgctcgggactagacgcgac

SEQ ID NO: 97818 - DNA, 25 bp, Homo sapien
ctgccctctaccaggtaggctgagc

SEQ ID NO: 97819 - DNA, 25 bp, Homo sapien
gaaagcaccggctccaggccagcgt

SEQ ID NO: 97820 - DNA, 25 bp, Homo sapien
gaaaccttctctggggctgcaagga

SEQ ID NO: 97821 - DNA, 25 bp, Homo sapien
cctatcacggggactcggtggcctc

SEQ ID NO: 97822 - DNA, 25 bp, Homo sapien
ggctgaggctctgtcccttattggc

SEQ ID NO: 97823 - DNA, 25 bp, Homo sapien
ccgcaccgcttcgtgagggtcgatc

SEQ ID NO: 97824 - DNA, 25 bp, Homo sapien
cacgtgtgtggacaggcctgagaat

SEQ ID NO: 97825 - DNA, 25 bp, Homo sapien
ccctggacatctactctgccgtgga

SEQ ID NO: 97826 - DNA, 25 bp, Homo sapien
cctgggacagcgtccgctaagtttc

SEQ ID NO: 97827 - DNA, 25 bp, Homo sapien
tggatgatgcctcccacgagaagga

SEQ ID NO: 97828 - DNA, 25 bp, Homo sapien
ctgctgatgctacctctgttgggta

SEQ ID NO: 97829 - DNA, 25 bp, Homo sapien
gggctcgggctcactataaaaggtg

SEQ ID NO: 97830 - DNA, 25 bp, Homo sapien
gagcgctgcctacagacggttgacc

SEQ ID NO: 97831 - DNA, 25 bp, Homo sapien
ctcctggcagtctgttgagcgaatc

SEQ ID NO: 97832 - DNA, 25 bp, Homo sapien
agctgtcgccttgtctcttctcttg

SEQ ID NO: 97833 - DNA, 25 bp, Homo sapien
gcttttagaagtcccagcctcggga

SEQ ID NO: 97834 - DNA, 25 bp, Homo sapien
gtgggattcatcctcaccacggcta

SEQ ID NO: 97835 - DNA, 25 bp, Homo sapien
gctctcagaaaggacaatgggaccc

SEQ ID NO: 97836 - DNA, 25 bp, Homo sapien
tcccgctaagtgaaatgcaggtgtc

SEQ ID NO: 97837 - DNA, 25 bp, Homo sapien
tgagggatctgtcaccacgctgagt

SEQ ID NO: 97838 - DNA, 25 bp, Homo sapien
cagaccctttctgggctaattaaga

SEQ ID NO: 97839 - DNA, 25 bp, Homo sapien
gtcgcaccgcttccttgacagcaag

SEQ ID NO: 97840 - DNA, 25 bp, Homo sapien
caagttctacttgctggtggtcgtc

SEQ ID NO: 97841 - DNA, 25 bp, Homo sapien
ctcacactaatgctctgacggggca

SEQ ID NO: 97842 - DNA, 25 bp, Homo sapien
cacactaatgctctgacggggcgga

SEQ ID NO: 97843 - DNA, 25 bp, Homo sapien
cacagtaatcctctgacggggcgga

SEQ ID NO: 97844 - DNA, 25 bp, Homo sapien
ggcggggctcacactaatgctctga

SEQ ID NO: 97845 - DNA, 25 bp, Homo sapien
ctcacagtaatcctctgacggggcg

SEQ ID NO: 97846 - DNA, 25 bp, Homo sapien
gacggggctcacactaatgctctga

SEQ ID NO: 97847 - DNA, 25 bp, Homo sapien
tcacactaatgctctgacggggcgg

SEQ ID NO: 97848 - DNA, 25 bp, Homo sapien
cagtaatcctctgacggggcggagc

SEQ ID NO: 97849 - DNA, 25 bp, Homo sapien
tgccggtaccggctacagtccgatc

SEQ ID NO: 97850 - DNA, 25 bp, Homo sapien
acgtgggcccactcgaaggtgacca

SEQ ID NO: 97851 - DNA, 25 bp, Homo sapien
cgatgacgtagggatcctgcacgtg

SEQ ID NO: 97852 - DNA, 25 bp, Homo sapien
ggacgtttctctaaaaagcctgaga

SEQ ID NO: 97853 - DNA, 25 bp, Homo sapien
ttgtaactcacgaaaaaacgccatc

SEQ ID NO: 97854 - DNA, 25 bp, Homo sapien
cgggtagcaccgcttttcttttctg

SEQ ID NO: 97855 - DNA, 25 bp, Homo sapien
gccaagctggccacgaggatccaga

SEQ ID NO: 97856 - DNA, 25 bp, Homo sapien
ccacttaccgatcttggccaagctg

SEQ ID NO: 97857 - DNA, 25 bp, Homo sapien
ttgctgcctcgatctccaatgggga

SEQ ID NO: 97858 - DNA, 25 bp, Homo sapien
agacggcgctctggcacatgaagcc

SEQ ID NO: 97859 - DNA, 25 bp, Homo sapien
atgggagcggcgaaagcctcatatc

SEQ ID NO: 97860 - DNA, 25 bp, Homo sapien
ggcgcaggtcctagacagctgcatt

SEQ ID NO: 97861 - DNA, 25 bp, Homo sapien
cgaggagctctctggcacaatcagc

SEQ ID NO: 97862 - DNA, 25 bp, Homo sapien
gcacaatcagccacgaggacgaaga

SEQ ID NO: 97863 - DNA, 25 bp, Homo sapien
atcacagcgctccacatgctgggcg

SEQ ID NO: 97864 - DNA, 25 bp, Homo sapien
cgctgggaaactgccctcacgctag

SEQ ID NO: 97865 - DNA, 25 bp, Homo sapien
gcagaatctcgagtaggtgcacgtg

SEQ ID NO: 97866 - DNA, 25 bp, Homo sapien
ggtgcacgtggtacctacctcgaga

SEQ ID NO: 97867 - DNA, 25 bp, Homo sapien
ccaaactcgcgtggccggcagtcaa

SEQ ID NO: 97868 - DNA, 25 bp, Homo sapien
gtgacgtcacatccggcgtgccaaa

SEQ ID NO: 97869 - DNA, 25 bp, Homo sapien
tagacttgatttccggtcccaccgc

SEQ ID NO: 97870 - DNA, 25 bp, Homo sapien
ggcacgcttccggtcatctgtgcac

SEQ ID NO: 97871 - DNA, 25 bp, Homo sapien
ttcagcttcagcttcatggccgcgc

SEQ ID NO: 97872 - DNA, 25 bp, Homo sapien
ggcgagaaacacgttcttcagcttc

SEQ ID NO: 97873 - DNA, 25 bp, Homo sapien
caggcgctgcagattttggtgtatc

SEQ ID NO: 97874 - DNA, 25 bp, Homo sapien
gcagccatcttggagcgtaccaaaa

SEQ ID NO: 97875 - DNA, 25 bp, Homo sapien
cagccaacgggttacggacagagga

SEQ ID NO: 97876 - DNA, 25 bp, Homo sapien
tccagtagttggtatggtccgagac

SEQ ID NO: 97877 - DNA, 25 bp, Homo sapien
tccgagacagtatggctgctgcatt

SEQ ID NO: 97878 - DNA, 25 bp, Homo sapien
gctgctgcatttcggccctcgaatc

SEQ ID NO: 97879 - DNA, 25 bp, Homo sapien
cgccgcactatggaggcagccatct

SEQ ID NO: 97880 - DNA, 25 bp, Homo sapien
aatcgagttctcctgcaggcgctgc

SEQ ID NO: 97881 - DNA, 25 bp, Homo sapien
gcggtccagtacgaggcagtacatg

SEQ ID NO: 97882 - DNA, 25 bp, Homo sapien
ctttgagacgccatccgcactgcag

SEQ ID NO: 97883 - DNA, 25 bp, Homo sapien
atgcagcgaccgcaaccctttgaga

SEQ ID NO: 97884 - DNA, 25 bp, Homo sapien
gctcaggaatcaccttcgcagcgtg

SEQ ID NO: 97885 - DNA, 25 bp, Homo sapien
atggggtttcatcagcgggaatgac

SEQ ID NO: 97886 - DNA, 25 bp, Homo sapien
ccatgagcaaagaggcccaggccga

SEQ ID NO: 97887 - DNA, 25 bp, Homo sapien
gcgcctcgtgcacttagcagtagga

SEQ ID NO: 97888 - DNA, 25 bp, Homo sapien
gatgtattttgtacagcagactgcc

SEQ ID NO: 97889 - DNA, 25 bp, Homo sapien
tgcttgaagagcttcccgcagtgcg

SEQ ID NO: 97890 - DNA, 25 bp, Homo sapien
ccacgtccacgtagtagctgtcatc

SEQ ID NO: 97891 - DNA, 25 bp, Homo sapien
gaggccgcactccacacagatgttc

SEQ ID NO: 97892 - DNA, 25 bp, Homo sapien
acttctcgcaggtggggcactgcca

SEQ ID NO: 97893 - DNA, 25 bp, Homo sapien
ctgtgctgcatcatgtggcgcttca

SEQ ID NO: 97894 - DNA, 25 bp, Homo sapien
ggcttcacctcgctgtgctgcatca

SEQ ID NO: 97895 - DNA, 25 bp, Homo sapien
acacgcggcagttgtgcggcttcac

SEQ ID NO: 97896 - DNA, 25 bp, Homo sapien
tgtcatcgatctgcacgttcacgtc

SEQ ID NO: 97897 - DNA, 25 bp, Homo sapien
tgccgagcccgcttagaaagcacgg

SEQ ID NO: 97898 - DNA, 25 bp, Homo sapien
tgcctttcactggttctgggcgctg

SEQ ID NO: 97899 - DNA, 25 bp, Homo sapien
cgtttgcctcgcctgttaagctgtg

SEQ ID NO: 97900 - DNA, 25 bp, Homo sapien
ttacattcaggggagcgtttgcctc

SEQ ID NO: 97901 - DNA, 25 bp, Homo sapien
tcaagcgtccgaggatcccgttagg

SEQ ID NO: 97902 - DNA, 25 bp, Homo sapien
ccagattctctttgttccgcagcca

SEQ ID NO: 97903 - DNA, 25 bp, Homo sapien
gcccatcgtccttacatgcagcttg

SEQ ID NO: 97904 - DNA, 25 bp, Homo sapien
gcgctcggtgaagcccagattctct

SEQ ID NO: 97905 - DNA, 25 bp, Homo sapien
acaagtatcctttccgaggcctggc

SEQ ID NO: 97906 - DNA, 25 bp, Homo sapien
tgtgcaccgggagtaacagttgctc

SEQ ID NO: 97907 - DNA, 25 bp, Homo sapien
ccgtctcttcctgtgtctggcttta

SEQ ID NO: 97908 - DNA, 25 bp, Homo sapien
caagggcttcagcaaatcctgcagc

SEQ ID NO: 97909 - DNA, 25 bp, Homo sapien
gccgggtttcactgtccgtgacttc

SEQ ID NO: 97910 - DNA, 25 bp, Homo sapien
tccagagaaccgtgcaacaagtatc

SEQ ID NO: 97911 - DNA, 25 bp, Homo sapien
tcttggggccagattgcaaattcgc

SEQ ID NO: 97912 - DNA, 25 bp, Homo sapien
tgcagctgttgaaggagtcccagtc

SEQ ID NO: 97913 - DNA, 25 bp, Homo sapien
agtgcccgtcgcaccacaaacagtg

SEQ ID NO: 97914 - DNA, 25 bp, Homo sapien
gtcgccagcctatagggactcccgg

SEQ ID NO: 97915 - DNA, 25 bp, Homo sapien
cgtgtgtttcgaagtccaaggcttt

SEQ ID NO: 97916 - DNA, 25 bp, Homo sapien
agcccagcgagtccagactatagtc

SEQ ID NO: 97917 - DNA, 25 bp, Homo sapien
cggtgactcctcaaggacccagttc

SEQ ID NO: 97918 - DNA, 25 bp, Homo sapien
gactatagtccgttcgagatcctcg

SEQ ID NO: 97919 - DNA, 25 bp, Homo sapien
cgccctgttgaccaaaggcttctca

SEQ ID NO: 97920 - DNA, 25 bp, Homo sapien
cggcacgatggtcatggcgtatttc

SEQ ID NO: 97921 - DNA, 25 bp, Homo sapien
tctccagagcagtaggagggccaca

SEQ ID NO: 97922 - DNA, 25 bp, Homo sapien
gcagcgagtcgcttccctctgtaac

SEQ ID NO: 97923 - DNA, 25 bp, Homo sapien
ctccatattcgatggggagctcgca

SEQ ID NO: 97924 - DNA, 25 bp, Homo sapien
gagggcccttgtctcacattctgta

SEQ ID NO: 97925 - DNA, 25 bp, Homo sapien
ccgtgacctggtggctccatattcg

SEQ ID NO: 97926 - DNA, 25 bp, Homo sapien
acattctgtagagcgcacgtcgtcc

SEQ ID NO: 97927 - DNA, 25 bp, Homo sapien
ccctatagaactgggcctcaggcct

SEQ ID NO: 97928 - DNA, 25 bp, Homo sapien
ttctctaaatactgccgggtccgcc

SEQ ID NO: 97929 - DNA, 25 bp, Homo sapien
ccttctcgaagatcccagggagtct

SEQ ID NO: 97930 - DNA, 25 bp, Homo sapien
gtcactccaactccagggaattccg

SEQ ID NO: 97931 - DNA, 25 bp, Homo sapien
ccagcgagtggagtgcccaagaatt

SEQ ID NO: 97932 - DNA, 25 bp, Homo sapien
gcggagctgccgaaaccttctcgaa

SEQ ID NO: 97933 - DNA, 25 bp, Homo sapien
ccttgtccgcacttctgggtcaaca

SEQ ID NO: 97934 - DNA, 25 bp, Homo sapien
ttctcgttcacgaagcggccagcct

SEQ ID NO: 97935 - DNA, 25 bp, Homo sapien
gtccgtgcataaccacgttctcgtt

SEQ ID NO: 97936 - DNA, 25 bp, Homo sapien
gggagtctctgtcccgcagaatcag

SEQ ID NO: 97937 - DNA, 25 bp, Homo sapien
aacaggcccgcggtcgctttgctgg

SEQ ID NO: 97938 - DNA, 25 bp, Homo sapien
ctaggtgggcccaatgctccgggcc

SEQ ID NO: 97939 - DNA, 25 bp, Homo sapien
agagcaattacagcgctgggccggc

SEQ ID NO: 97940 - DNA, 25 bp, Homo sapien
gcctcgtgaaggaacagagcaatta

SEQ ID NO: 97941 - DNA, 25 bp, Homo sapien
tctctgggcctcgtgaaggaacaga

SEQ ID NO: 97942 - DNA, 25 bp, Homo sapien
agggcgatctgacgatcagggagtt

SEQ ID NO: 97943 - DNA, 25 bp, Homo sapien
cgcgcgccctggtctgggaaagcag

SEQ ID NO: 97944 - DNA, 25 bp, Homo sapien
gatcagggagttgcgcccctctctc

SEQ ID NO: 97945 - DNA, 25 bp, Homo sapien
ctgctgcggtgtcttagcggtccgc

SEQ ID NO: 97946 - DNA, 25 bp, Homo sapien
tccgcatgtgcatccgcaaccgctt

SEQ ID NO: 97947 - DNA, 25 bp, Homo sapien
acctggcggtcacgcgcgaagccag

SEQ ID NO: 97948 - DNA, 25 bp, Homo sapien
ccacgaaaggcgctgcggacctggc

SEQ ID NO: 97949 - DNA, 25 bp, Homo sapien
tctccggccacgaaaggcgctgcgg

SEQ ID NO: 97950 - DNA, 25 bp, Homo sapien
cggacgcctctgctgcggtgtctta

SEQ ID NO: 97951 - DNA, 25 bp, Homo sapien
gcgccgcaggagagtctctgtgccc

SEQ ID NO: 97952 - DNA, 25 bp, Homo sapien
ggtcacgcgcgaagccagtggcctc

SEQ ID NO: 97953 - DNA, 25 bp, Homo sapien
tcgctcggatctaccacggggagac

SEQ ID NO: 97954 - DNA, 25 bp, Homo sapien
agccaggcgctgtcagactttgcac

SEQ ID NO: 97955 - DNA, 25 bp, Homo sapien
tctcattggtagagtgcgcactcca

SEQ ID NO: 97956 - DNA, 25 bp, Homo sapien
cggccttatgattggttcgacctga

SEQ ID NO: 97957 - DNA, 25 bp, Homo sapien
gcacagctgtggctttactaaaccg

SEQ ID NO: 97958 - DNA, 25 bp, Homo sapien
gcgcgctcagccacgtatcctagtt

SEQ ID NO: 97959 - DNA, 25 bp, Homo sapien
cgccatcttgtgcagagtttgctcc

SEQ ID NO: 97960 - DNA, 25 bp, Homo sapien
ttgaccgccgcaagcagccaaagga

SEQ ID NO: 97961 - DNA, 25 bp, Homo sapien
cgccgaacgaggtgggatcagatat

SEQ ID NO: 97962 - DNA, 25 bp, Homo sapien
cagatattcccgcttgtgagtgttg

SEQ ID NO: 97963 - DNA, 25 bp, Homo sapien
aggacgctgccctctgttgcccaaa

SEQ ID NO: 97964 - DNA, 25 bp, Homo sapien
ccgctggtccagctgtcaaaacagg

SEQ ID NO: 97965 - DNA, 25 bp, Homo sapien
ggggtgtctctttcattctggctca

SEQ ID NO: 97966 - DNA, 25 bp, Homo sapien
tctggctcacaaagtcccaaagggg

SEQ ID NO: 97967 - DNA, 25 bp, Homo sapien
cactgcgggtttagagctgattcaa

SEQ ID NO: 97968 - DNA, 25 bp, Homo sapien
actcgggtgtctccaaatgtggctc

SEQ ID NO: 97969 - DNA, 25 bp, Homo sapien
caccgggcacggaggtttaatgtga

SEQ ID NO: 97970 - DNA, 25 bp, Homo sapien
acgcagcgttctctgtgcagcttca

SEQ ID NO: 97971 - DNA, 25 bp, Homo sapien
ctcagtttacaggtacgcgggccga

SEQ ID NO: 97972 - DNA, 25 bp, Homo sapien
tggagtaacaaagacgctgccgcgc

SEQ ID NO: 97973 - DNA, 25 bp, Homo sapien
ccgcgggataggagtttctacaatt

SEQ ID NO: 97974 - DNA, 25 bp, Homo sapien
cccgaaggcaagtctggatatgaaa

SEQ ID NO: 97975 - DNA, 25 bp, Homo sapien
ccagtggatacgaacccggactgtc

SEQ ID NO: 97976 - DNA, 25 bp, Homo sapien
tcgctttcacacagccaagccgttg

SEQ ID NO: 97977 - DNA, 25 bp, Homo sapien
ttcaactcaggtcagaacggagctg

SEQ ID NO: 97978 - DNA, 25 bp, Homo sapien
ccgtcgggcaaagaaccagaggcgt

SEQ ID NO: 97979 - DNA, 25 bp, Homo sapien
cgccgggcattgagctgtttcctcc

SEQ ID NO: 97980 - DNA, 25 bp, Homo sapien
tgcagatacgtcagagggaacattc

SEQ ID NO: 97981 - DNA, 25 bp, Homo sapien
gcctcggagatctggcctgccagat

SEQ ID NO: 97982 - DNA, 25 bp, Homo sapien
gctggcttcagagtgcgcttctcgt

SEQ ID NO: 97983 - DNA, 25 bp, Homo sapien
ccacccgcgcgcaatgtggaagggc

SEQ ID NO: 97984 - DNA, 25 bp, Homo sapien
cccttgcgcggcgagtttcaactca

SEQ ID NO: 97985 - DNA, 25 bp, Homo sapien
cgctgggccacttgcagaaagcaga

SEQ ID NO: 97986 - DNA, 25 bp, Homo sapien
ggccgctctgtttttgcgaaacttg

SEQ ID NO: 97987 - DNA, 25 bp, Homo sapien
cttctgggccaattacacgtggtta

SEQ ID NO: 97988 - DNA, 25 bp, Homo sapien
cagatggggtatcgcaaacagttcc

SEQ ID NO: 97989 - DNA, 25 bp, Homo sapien
ctgtcggacccgtagcattagttca

SEQ ID NO: 97990 - DNA, 25 bp, Homo sapien
ccttggggctgtgtaaaagtctact

SEQ ID NO: 97991 - DNA, 25 bp, Homo sapien
gatgataaacctgggaccgaccttg

SEQ ID NO: 97992 - DNA, 25 bp, Homo sapien
gcggccgaaatcctcagggaaaatc

SEQ ID NO: 97993 - DNA, 25 bp, Homo sapien
agcctcttcgcgttcgcaccgtgaa

SEQ ID NO: 97994 - DNA, 25 bp, Homo sapien
tggagacttcccgagcaacaatatg

SEQ ID NO: 97995 - DNA, 25 bp, Homo sapien
agaactcggtttggctggagacttc

SEQ ID NO: 97996 - DNA, 25 bp, Homo sapien
gtcagccaaggcatgttaatctgtt

SEQ ID NO: 97997 - DNA, 25 bp, Homo sapien
gcttattgaatctgcgggccggaga

SEQ ID NO: 97998 - DNA, 25 bp, Homo sapien
aatctgtttagcatgtgcgccgcgc

SEQ ID NO: 97999 - DNA, 25 bp, Homo sapien
tgggctgccgtattaggtttgtgac

SEQ ID NO: 98000 - DNA, 25 bp, Homo sapien
gggttagccatctcgaacattttta

SEQ ID NO: 98001 - DNA, 25 bp, Homo sapien
cgtctgggctgtgcgttgtaacgca

SEQ ID NO: 98002 - DNA, 25 bp, Homo sapien
tccactccgctgaccccaacgtctg

SEQ ID NO: 98003 - DNA, 25 bp, Homo sapien
ccaacgtctgggctgtgcgttgtaa

SEQ ID NO: 98004 - DNA, 25 bp, Homo sapien
ggctgtgcgttgtaacgcagttggc

SEQ ID NO: 98005 - DNA, 25 bp, Homo sapien
caacgtctgggctgtgcgttgtaac

SEQ ID NO: 98006 - DNA, 25 bp, Homo sapien
tctgggctgtgcgttgtaacgcagt

SEQ ID NO: 98007 - DNA, 25 bp, Homo sapien
aacgtctgggctgtgcgttgtaacg

SEQ ID NO: 98008 - DNA, 25 bp, Homo sapien
ctgggctgtgcgttgtaacgcagtt

SEQ ID NO: 98009 - DNA, 25 bp, Homo sapien
ccttcagcttgggatgagggcgaag

SEQ ID NO: 98010 - DNA, 25 bp, Homo sapien
agcagtagcgcacagaactagtgtc

SEQ ID NO: 98011 - DNA, 25 bp, Homo sapien
gtagcgcacagaactagtgtctgcg

SEQ ID NO: 98012 - DNA, 25 bp, Homo sapien
cagaactagtgtctgcggggtcccg

SEQ ID NO: 98013 - DNA, 25 bp, Homo sapien
atcggctgtgctgaaagggcggaaa

SEQ ID NO: 98014 - DNA, 25 bp, Homo sapien
tgtctcggggaaggaaatcggctgt

SEQ ID NO: 98015 - DNA, 25 bp, Homo sapien
cggaaagcagtagcgcacagaacta

SEQ ID NO: 98016 - DNA, 25 bp, Homo sapien
gtgggaaagcaaggaccgggcaaca

SEQ ID NO: 98017 - DNA, 25 bp, Homo sapien
atgtgcccgaggtttctctgccctt

SEQ ID NO: 98018 - DNA, 25 bp, Homo sapien
ggcttggagaacactgaacctttaa

SEQ ID NO: 98019 - DNA, 25 bp, Homo sapien
aagccgaattatctccctttccgcg

SEQ ID NO: 98020 - DNA, 25 bp, Homo sapien
taacatcttgataagtccgctgaca

SEQ ID NO: 98021 - DNA, 25 bp, Homo sapien
gaacctccagcaaactaacatcttg

SEQ ID NO: 98022 - DNA, 25 bp, Homo sapien
aaagcgcccgggcaggtcagaacct

SEQ ID NO: 98023 - DNA, 25 bp, Homo sapien
ggctataaatcagacaggggagtgc

SEQ ID NO: 98024 - DNA, 25 bp, Homo sapien
tttccgcgtctcattcccgtggatg

SEQ ID NO: 98025 - DNA, 25 bp, Homo sapien
gtctgcaaggccaagaacggaaccc

SEQ ID NO: 98026 - DNA, 25 bp, Homo sapien
gcggcaggacgcaaaactcggaatc

SEQ ID NO: 98027 - DNA, 25 bp, Homo sapien
cagatgcgtgcgttacagaaggcta

SEQ ID NO: 98028 - DNA, 25 bp, Homo sapien
tttcaggacatccacgcatcgcgca

SEQ ID NO: 98029 - DNA, 25 bp, Homo sapien
accggtcctggcacttttgaagacg

SEQ ID NO: 98030 - DNA, 25 bp, Homo sapien
cacgctgctctccacctgtttaaaa

SEQ ID NO: 98031 - DNA, 25 bp, Homo sapien
agcagtgtctgtgccgtttggattc

SEQ ID NO: 98032 - DNA, 25 bp, Homo sapien
acacgttcctttagctctgggctca

SEQ ID NO: 98033 - DNA, 25 bp, Homo sapien
cacgagcggtttgggccctccagga

SEQ ID NO: 98034 - DNA, 25 bp, Homo sapien
ctgtgtttctcgagtgtgggcagcc

SEQ ID NO: 98035 - DNA, 25 bp, Homo sapien
ccagcagcctgtgtttctcgagtgt

SEQ ID NO: 98036 - DNA, 25 bp, Homo sapien
acgtggattacgctaggtgagagcc

SEQ ID NO: 98037 - DNA, 25 bp, Homo sapien
caacccgctcgcgtggacgcggaaa

SEQ ID NO: 98038 - DNA, 25 bp, Homo sapien
aagcgattcacgtcttgcgcgaccc

SEQ ID NO: 98039 - DNA, 25 bp, Homo sapien
cccgagcgcggaaactcaagcgatt

SEQ ID NO: 98040 - DNA, 25 bp, Homo sapien
caaaacctttcccagaggcgagccg

SEQ ID NO: 98041 - DNA, 25 bp, Homo sapien
ttcgcggcgaagtcagtttcctgac

SEQ ID NO: 98042 - DNA, 25 bp, Homo sapien
cctgactcttgaaggaagtggcctt

SEQ ID NO: 98043 - DNA, 25 bp, Homo sapien
aagtggccttgtgtcacttccggcc

SEQ ID NO: 98044 - DNA, 25 bp, Homo sapien
tgtgtgcgcctaatctcaggtggtc

SEQ ID NO: 98045 - DNA, 25 bp, Homo sapien
tccgacaaggtacaaaaaggctctg

SEQ ID NO: 98046 - DNA, 25 bp, Homo sapien
cccgaggacaggagcctcaggtacc

SEQ ID NO: 98047 - DNA, 25 bp, Homo sapien
cagcagtctctcgtagggcctacag

SEQ ID NO: 98048 - DNA, 25 bp, Homo sapien
aatagggactcgctggaccatcaca

SEQ ID NO: 98049 - DNA, 25 bp, Homo sapien
ccagagcataatcccgggacgatga

SEQ ID NO: 98050 - DNA, 25 bp, Homo sapien
caccctgtcggagtcccagagcata

SEQ ID NO: 98051 - DNA, 25 bp, Homo sapien
gtcctcgaccctcttacattagttc

SEQ ID NO: 98052 - DNA, 25 bp, Homo sapien
aattaatccggcgatgtcctcgacc

SEQ ID NO: 98053 - DNA, 25 bp, Homo sapien
gctaccaggcctcgcaggaaaatta

SEQ ID NO: 98054 - DNA, 25 bp, Homo sapien
ggtgccaagggctctaactacctga

SEQ ID NO: 98055 - DNA, 25 bp, Homo sapien
tttctaccgagaaggctagggatcg

SEQ ID NO: 98056 - DNA, 25 bp, Homo sapien
gacgatgatagcaggaagccgattc

SEQ ID NO: 98057 - DNA, 25 bp, Homo sapien
ccctgtgggcaacgtgaccctggca

SEQ ID NO: 98058 - DNA, 25 bp, Homo sapien
accgtcccggatgccatcgctgggg

SEQ ID NO: 98059 - DNA, 25 bp, Homo sapien
tcggtcccgtgggtgtctgtgctcc

SEQ ID NO: 98060 - DNA, 25 bp, Homo sapien
gcccagcagtgctcagtctgccgtg

SEQ ID NO: 98061 - DNA, 25 bp, Homo sapien
agcagtgctcagtctgccgtgtgca

SEQ ID NO: 98062 - DNA, 25 bp, Homo sapien
agtgctcagtctgccgtgtgcacac

SEQ ID NO: 98063 - DNA, 25 bp, Homo sapien
gactgtggggcctgaaatgtgctcc

SEQ ID NO: 98064 - DNA, 25 bp, Homo sapien
cggacatcattgcgggccgctggca

SEQ ID NO: 98065 - DNA, 25 bp, Homo sapien
agcgtgctctggtacgtcatcttcg

SEQ ID NO: 98066 - DNA, 25 bp, Homo sapien
cagttgacggttctgggtcaccaga

SEQ ID NO: 98067 - DNA, 25 bp, Homo sapien
ccggagtactacacagacagggtca

SEQ ID NO: 98068 - DNA, 25 bp, Homo sapien
tgtttttgccgcctttacgctccga

SEQ ID NO: 98069 - DNA, 25 bp, Homo sapien
ggccgcgacgtcacttccgatttct

SEQ ID NO: 98070 - DNA, 25 bp, Homo sapien
gccagcttcagtacaggcctccaag

SEQ ID NO: 98071 - DNA, 25 bp, Homo sapien
cagctgtgcccgaaaagtcccagga

SEQ ID NO: 98072 - DNA, 25 bp, Homo sapien
ctcttgcaggaaagaaagtccgttc

SEQ ID NO: 98073 - DNA, 25 bp, Homo sapien
gggaaataaacagcactcctgcggt

SEQ ID NO: 98074 - DNA, 25 bp, Homo sapien
gggcgcaactggcactcctgtggcc

SEQ ID NO: 98075 - DNA, 25 bp, Homo sapien
ttgtccacctgagttcgcatccgca

SEQ ID NO: 98076 - DNA, 25 bp, Homo sapien
agctctgggcggaaaagtttgtcca

SEQ ID NO: 98077 - DNA, 25 bp, Homo sapien
tttgggactccatcgtctgcgtttc

SEQ ID NO: 98078 - DNA, 25 bp, Homo sapien
tccaggtaaatgctctttgggactc

SEQ ID NO: 98079 - DNA, 25 bp, Homo sapien
ggggccatcgctccaggtaaatgct

SEQ ID NO: 98080 - DNA, 25 bp, Homo sapien
atccgcagggccactttctccaggg

SEQ ID NO: 98081 - DNA, 25 bp, Homo sapien
agacagcgccttgggtaggacaccc

SEQ ID NO: 98082 - DNA, 25 bp, Homo sapien
ccgcgagatgctctaaaaagggctg

SEQ ID NO: 98083 - DNA, 25 bp, Homo sapien
tgggccagcctggttaatggacagc

SEQ ID NO: 98084 - DNA, 25 bp, Homo sapien
gcgcgtatgcaaagagaccgacacc

SEQ ID NO: 98085 - DNA, 25 bp, Homo sapien
caactgagttctagcgacggtcacg

SEQ ID NO: 98086 - DNA, 25 bp, Homo sapien
ctggccgcaacgcacaactgagttc

SEQ ID NO: 98087 - DNA, 25 bp, Homo sapien
tctggacagtttagggacactcggg

SEQ ID NO: 98088 - DNA, 25 bp, Homo sapien
acaggccctgggcacgcatagacag

SEQ ID NO: 98089 - DNA, 25 bp, Homo sapien
gaagcgtttcgacggtgagcgctcc

SEQ ID NO: 98090 - DNA, 25 bp, Homo sapien
ggccgcgcttcctctgatccgggcc

SEQ ID NO: 98091 - DNA, 25 bp, Homo sapien
accctgctggaggaagcgtttcgac

SEQ ID NO: 98092 - DNA, 25 bp, Homo sapien
cgcgcgcagtcatctgactcggtga

SEQ ID NO: 98093 - DNA, 25 bp, Homo sapien
tcctgcaccctgctggaggaagcgt

SEQ ID NO: 98094 - DNA, 25 bp, Homo sapien
ctcttggtgaagatgaccccgaacc

SEQ ID NO: 98095 - DNA, 25 bp, Homo sapien
atctgactcggtgactcacccgcgg

SEQ ID NO: 98096 - DNA, 25 bp, Homo sapien
ggagaacttctacatcagccacagc

SEQ ID NO: 98097 - DNA, 25 bp, Homo sapien
ttgctcttcactcggccgttttaaa

SEQ ID NO: 98098 - DNA, 25 bp, Homo sapien
gtgtccgtcgcagcctgaaaggtca

SEQ ID NO: 98099 - DNA, 25 bp, Homo sapien
cgatgtctcacagctcggagcagta

SEQ ID NO: 98100 - DNA, 25 bp, Homo sapien
agctctcaccgctgggctcttgaag

SEQ ID NO: 98101 - DNA, 25 bp, Homo sapien
ccaaagtctgcaacggcctcaagtc

SEQ ID NO: 98102 - DNA, 25 bp, Homo sapien
aaccgctgcgtggttcttgctcttc

SEQ ID NO: 98103 - DNA, 25 bp, Homo sapien
ttgagagcgttttcgcactccagcg

SEQ ID NO: 98104 - DNA, 25 bp, Homo sapien
gcaacttccgtcctcctagctaaaa

SEQ ID NO: 98105 - DNA, 25 bp, Homo sapien
gacgggcattccctcacacaaaatg

SEQ ID NO: 98106 - DNA, 25 bp, Homo sapien
gcatagcccggtggagttctccagc

SEQ ID NO: 98107 - DNA, 25 bp, Homo sapien
tgccgaccttcgcaggattctgttc

SEQ ID NO: 98108 - DNA, 25 bp, Homo sapien
gcgtattcctttaatgccgaccttc

SEQ ID NO: 98109 - DNA, 25 bp, Homo sapien
ggggctgcaacgctgattttgcgta

SEQ ID NO: 98110 - DNA, 25 bp, Homo sapien
gagtgaccttggcttagatataaaa

SEQ ID NO: 98111 - DNA, 25 bp, Homo sapien
tcacacaaaatggtggcgccgaggc

SEQ ID NO: 98112 - DNA, 25 bp, Homo sapien
agctcagggcaatggcctggtatta

SEQ ID NO: 98113 - DNA, 25 bp, Homo sapien
ctaagcggacacgaccgcattcagg

SEQ ID NO: 98114 - DNA, 25 bp, Homo sapien
ccagctaagcggacacgaccgcatt

SEQ ID NO: 98115 - DNA, 25 bp, Homo sapien
agcggacacgaccgcattcagggac

SEQ ID NO: 98116 - DNA, 25 bp, Homo sapien
gcggacacgaccgcattcagggaca

SEQ ID NO: 98117 - DNA, 25 bp, Homo sapien
aagcggacacgaccgcattcaggga

SEQ ID NO: 98118 - DNA, 25 bp, Homo sapien
taagcggacacgaccgcattcaggg

SEQ ID NO: 98119 - DNA, 25 bp, Homo sapien
cagctaagcggacacgaccgcattc

SEQ ID NO: 98120 - DNA, 25 bp, Homo sapien
agctaagcggacacgaccgcattca

SEQ ID NO: 98121 - DNA, 25 bp, Homo sapien
ttgccctggcgcagaagccgcggta

SEQ ID NO: 98122 - DNA, 25 bp, Homo sapien
agccgcggtagcagtcctttcaggc

SEQ ID NO: 98123 - DNA, 25 bp, Homo sapien
ccctctggtccagggctgcggagaa

SEQ ID NO: 98124 - DNA, 25 bp, Homo sapien
aagcggctccgaaaggcaagcgtca

SEQ ID NO: 98125 - DNA, 25 bp, Homo sapien
aagcgtcacgaagccgggctcagta

SEQ ID NO: 98126 - DNA, 25 bp, Homo sapien
ccgcttcttggcacttggggagagt

SEQ ID NO: 98127 - DNA, 25 bp, Homo sapien
tgagaccgggttaacatctccagcc

SEQ ID NO: 98128 - DNA, 25 bp, Homo sapien
acgaggctgagaccgggttaacatc

SEQ ID NO: 98129 - DNA, 25 bp, Homo sapien
gcttgctattcacgcacttccagga

SEQ ID NO: 98130 - DNA, 25 bp, Homo sapien
gctgtgcttgctattcacgcacttc

SEQ ID NO: 98131 - DNA, 25 bp, Homo sapien
tgcttgctattcacgcacttccagg

SEQ ID NO: 98132 - DNA, 25 bp, Homo sapien
cacgctgtgcttgctattcacgcac

SEQ ID NO: 98133 - DNA, 25 bp, Homo sapien
tgctattcacgcacttccaggagtc

SEQ ID NO: 98134 - DNA, 25 bp, Homo sapien
ctattcacgcacttccaggagtctc

SEQ ID NO: 98135 - DNA, 25 bp, Homo sapien
gcgaggctccacgtcctttcggggc

SEQ ID NO: 98136 - DNA, 25 bp, Homo sapien
tattcacgcacttccaggagtctcc

SEQ ID NO: 98137 - DNA, 25 bp, Homo sapien
ccttccgagcgggttcttgtgaata

SEQ ID NO: 98138 - DNA, 25 bp, Homo sapien
aggcagctcgctctcatgggtgaga

SEQ ID NO: 98139 - DNA, 25 bp, Homo sapien
cacgcagccgcgagaaatattatca

SEQ ID NO: 98140 - DNA, 25 bp, Homo sapien
ggtggagctttttgccgaataacta

SEQ ID NO: 98141 - DNA, 25 bp, Homo sapien
gtgcctacatgccaaatcggcttgc

SEQ ID NO: 98142 - DNA, 25 bp, Homo sapien
tgctttttatcctcaagcgagagtg

SEQ ID NO: 98143 - DNA, 25 bp, Homo sapien
tcgggatcaccgaataagtgcagtg

SEQ ID NO: 98144 - DNA, 25 bp, Homo sapien
ccaattggccgacatcaaggacttg

SEQ ID NO: 98145 - DNA, 25 bp, Homo sapien
tcaggtctgcggacgctgtataccc

SEQ ID NO: 98146 - DNA, 25 bp, Homo sapien
cgctacgcggaatttgcagatcttc

SEQ ID NO: 98147 - DNA, 25 bp, Homo sapien
ccggcgtttgaacagcttcttcttc

SEQ ID NO: 98148 - DNA, 25 bp, Homo sapien
gcgttcttttttccgggactgcaga

SEQ ID NO: 98149 - DNA, 25 bp, Homo sapien
ggcggcttcccatccgctggttcta

SEQ ID NO: 98150 - DNA, 25 bp, Homo sapien
ggggtgctcacactttctcatttga

SEQ ID NO: 98151 - DNA, 25 bp, Homo sapien
cggagctcccatagtcgcgattcca

SEQ ID NO: 98152 - DNA, 25 bp, Homo sapien
aaggccgttcctaccatagtctgtg

SEQ ID NO: 98153 - DNA, 25 bp, Homo sapien
tgccgctgcgtgtttttttcacggt

SEQ ID NO: 98154 - DNA, 25 bp, Homo sapien
cgtggcctgccgctgcgtgtttttt

SEQ ID NO: 98155 - DNA, 25 bp, Homo sapien
tttcacggtttctcattctcggtcg

SEQ ID NO: 98156 - DNA, 25 bp, Homo sapien
cgcaggcctactctgggcgtggcct

SEQ ID NO: 98157 - DNA, 25 bp, Homo sapien
cacgacggagccctgcgcagcgctc

SEQ ID NO: 98158 - DNA, 25 bp, Homo sapien
gcagccgctcgccacacgacggagc

SEQ ID NO: 98159 - DNA, 25 bp, Homo sapien
tcccgccgctcgtcgcagacagggg

SEQ ID NO: 98160 - DNA, 25 bp, Homo sapien
aggagccgggacttgtcgcagggct

SEQ ID NO: 98161 - DNA, 25 bp, Homo sapien
gggctgagacaccttccctagcacg

SEQ ID NO: 98162 - DNA, 25 bp, Homo sapien
ggcctcgcgtctacagaaagccgct

SEQ ID NO: 98163 - DNA, 25 bp, Homo sapien
ctcaacggcatctgcagggcactgc

SEQ ID NO: 98164 - DNA, 25 bp, Homo sapien
atgaaagcccgctcaacggcatctg

SEQ ID NO: 98165 - DNA, 25 bp, Homo sapien
gcgatgctttgctccggccggctca

SEQ ID NO: 98166 - DNA, 25 bp, Homo sapien
acgctgcacaggtgggcgatgcttt

SEQ ID NO: 98167 - DNA, 25 bp, Homo sapien
cgattctgtgagtctgacgctgcac

SEQ ID NO: 98168 - DNA, 25 bp, Homo sapien
tacagaaagccgctgagaaggcagg

SEQ ID NO: 98169 - DNA, 25 bp, Homo sapien
ctggctgcacggtcacgaaaatcgg

SEQ ID NO: 98170 - DNA, 25 bp, Homo sapien
cgtccctgttcagtcagagtaggca

SEQ ID NO: 98171 - DNA, 25 bp, Homo sapien
cgtagctgcgttcatcgtccctgtt

SEQ ID NO: 98172 - DNA, 25 bp, Homo sapien
ggcctcttcgtgactgcggtcatca

SEQ ID NO: 98173 - DNA, 25 bp, Homo sapien
tggcaattctggagcttccctcggc

SEQ ID NO: 98174 - DNA, 25 bp, Homo sapien
ttccgctccgcgactgcgttaactg

SEQ ID NO: 98175 - DNA, 25 bp, Homo sapien
ttaaggcgaccgttcgtgacgtagc

SEQ ID NO: 98176 - DNA, 25 bp, Homo sapien
tctcccgcgctagtaactgagcttt

SEQ ID NO: 98177 - DNA, 25 bp, Homo sapien
tatccgacatggaggctcgacaacc

SEQ ID NO: 98178 - DNA, 25 bp, Homo sapien
atggcgaagcgaagagtgcccgctc

SEQ ID NO: 98179 - DNA, 25 bp, Homo sapien
cgagcggtgaaggaagcctaccctt

SEQ ID NO: 98180 - DNA, 25 bp, Homo sapien
cctcgatgccaatttcaaataggga

SEQ ID NO: 98181 - DNA, 25 bp, Homo sapien
ggaagagaaaatccggccgctgagt

SEQ ID NO: 98182 - DNA, 25 bp, Homo sapien
agttgtagtcgcgatcctgaggtaa

SEQ ID NO: 98183 - DNA, 25 bp, Homo sapien
atcctgaggtaacgggtgagtatcc

SEQ ID NO: 98184 - DNA, 25 bp, Homo sapien
caccaggggttgctcaccttactga

SEQ ID NO: 98185 - DNA, 25 bp, Homo sapien
cgaggtctcagaaaatcaggctgcg

SEQ ID NO: 98186 - DNA, 25 bp, Homo sapien
tcccgggacgaggtctcagaaaatc

SEQ ID NO: 98187 - DNA, 25 bp, Homo sapien
gccacaacagagagcggactcgatc

SEQ ID NO: 98188 - DNA, 25 bp, Homo sapien
agagcggactcgatcctgcgctccg

SEQ ID NO: 98189 - DNA, 25 bp, Homo sapien
ccgccaagggtctcagggaagacct

SEQ ID NO: 98190 - DNA, 25 bp, Homo sapien
aggacacagcagttgccggacacga

SEQ ID NO: 98191 - DNA, 25 bp, Homo sapien
tgccggacacgagctccgtgagtcc

SEQ ID NO: 98192 - DNA, 25 bp, Homo sapien
cttgagaaggtacccagagcagcac

SEQ ID NO: 98193 - DNA, 25 bp, Homo sapien
tattgcgcgtgctcagttctgttca

SEQ ID NO: 98194 - DNA, 25 bp, Homo sapien
tccggcacaacagctgaatcactcg

SEQ ID NO: 98195 - DNA, 25 bp, Homo sapien
ctccactactttcgccagggatgca

SEQ ID NO: 98196 - DNA, 25 bp, Homo sapien
agtgtcagcaagtgcagcctcagca

SEQ ID NO: 98197 - DNA, 25 bp, Homo sapien
cctagacggcaacctgacagtttca

SEQ ID NO: 98198 - DNA, 25 bp, Homo sapien
ctgcagggaggaattaaggaccgcc

SEQ ID NO: 98199 - DNA, 25 bp, Homo sapien
tggtcctttgtttcagcaatctgcc

SEQ ID NO: 98200 - DNA, 25 bp, Homo sapien
tctgccgtttgattggtccgagagc

SEQ ID NO: 98201 - DNA, 25 bp, Homo sapien
cactccacttgggttccgtgagcgc

SEQ ID NO: 98202 - DNA, 25 bp, Homo sapien
agcgagtttctctccagccgcctgg

SEQ ID NO: 98203 - DNA, 25 bp, Homo sapien
attggcgcggcgctttgtctcgctt

SEQ ID NO: 98204 - DNA, 25 bp, Homo sapien
tgaggatgccctacttcccgcagca

SEQ ID NO: 98205 - DNA, 25 bp, Homo sapien
gagcaacgatttcggggacggcaca

SEQ ID NO: 98206 - DNA, 25 bp, Homo sapien
ggtcaccaccacaggagcaacgatt

SEQ ID NO: 98207 - DNA, 25 bp, Homo sapien
tttgtctcgctttgggtcaccacca

SEQ ID NO: 98208 - DNA, 25 bp, Homo sapien
tggcctcacgggagcgagtttctct

SEQ ID NO: 98209 - DNA, 25 bp, Homo sapien
ggagagggaccaatcgcagtaaata

SEQ ID NO: 98210 - DNA, 25 bp, Homo sapien
agcctttcggaagcgcaactttgcc

SEQ ID NO: 98211 - DNA, 25 bp, Homo sapien
cccgctgctttgtaggcgcctttgt

SEQ ID NO: 98212 - DNA, 25 bp, Homo sapien
ctgggtcgcactttatctgggattc

SEQ ID NO: 98213 - DNA, 25 bp, Homo sapien
cgaccgccacgctcttttttgcttg

SEQ ID NO: 98214 - DNA, 25 bp, Homo sapien
accggcagggataggcagattcaaa

SEQ ID NO: 98215 - DNA, 25 bp, Homo sapien
taggctcaacttttcggcggggatc

SEQ ID NO: 98216 - DNA, 25 bp, Homo sapien
agcgcctgcacttcctacgttacaa

SEQ ID NO: 98217 - DNA, 25 bp, Homo sapien
acagatattaaaggcaacgtcttta

SEQ ID NO: 98218 - DNA, 25 bp, Homo sapien
attttaaagacaagatcactgtctc

SEQ ID NO: 98219 - DNA, 25 bp, Homo sapien
ctgaaaggactatcatattttaaag

SEQ ID NO: 98220 - DNA, 25 bp, Homo sapien
agacattatactgaaaggactatca

SEQ ID NO: 98221 - DNA, 25 bp, Homo sapien
ggcaacgtctttaatctaagacatt

SEQ ID NO: 98222 - DNA, 25 bp, Homo sapien
cccaacagatattaaaggcaacgtc

SEQ ID NO: 98223 - DNA, 25 bp, Homo sapien
gagatttgaaaagtctggacatttc

SEQ ID NO: 98224 - DNA, 25 bp, Homo sapien
tctaagacattatactgaaaggact

SEQ ID NO: 98225 - DNA, 25 bp, Homo sapien
caaaacctagtactctgcgaacctc

SEQ ID NO: 98226 - DNA, 25 bp, Homo sapien
cgcctcgtgagccaagaacgactag

SEQ ID NO: 98227 - DNA, 25 bp, Homo sapien
gtgagccaagaacgactagcttata

SEQ ID NO: 98228 - DNA, 25 bp, Homo sapien
gactagcttatactcacgcatgatg

SEQ ID NO: 98229 - DNA, 25 bp, Homo sapien
tactcacgcatgatgcaagcttgtc

SEQ ID NO: 98230 - DNA, 25 bp, Homo sapien
cgcatgatgcaagcttgtcaaaacc

SEQ ID NO: 98231 - DNA, 25 bp, Homo sapien
gcttgtcaaaacctagtactctgcg

SEQ ID NO: 98232 - DNA, 25 bp, Homo sapien
gatgcaagcttgtcaaaacctagta

SEQ ID NO: 98233 - DNA, 25 bp, Homo sapien
cccaaaccctggactgactgcttta

SEQ ID NO: 98234 - DNA, 25 bp, Homo sapien
tagccggccgcttatctatggtttc

SEQ ID NO: 98235 - DNA, 25 bp, Homo sapien
ttccttgcggaaaatgctgatctca

SEQ ID NO: 98236 - DNA, 25 bp, Homo sapien
ggctacgcgctcctcgttatcgtga

SEQ ID NO: 98237 - DNA, 25 bp, Homo sapien
tgccctcaggagatgccactgcagg

SEQ ID NO: 98238 - DNA, 25 bp, Homo sapien
gtcaccgtgagaccggacttgcctc

SEQ ID NO: 98239 - DNA, 25 bp, Homo sapien
gtccggaccgagataccatgccagg

SEQ ID NO: 98240 - DNA, 25 bp, Homo sapien
cgtttcctcgagcaggtcctctcta

SEQ ID NO: 98241 - DNA, 25 bp, Homo sapien
ttgcaaagggcagtgaatcgcgtcc

SEQ ID NO: 98242 - DNA, 25 bp, Homo sapien
cacacgaagagctgccgtcgctgca

SEQ ID NO: 98243 - DNA, 25 bp, Homo sapien
ttttacttcagtgtcagcgcgcggc

SEQ ID NO: 98244 - DNA, 25 bp, Homo sapien
ggaaagtttgtttgctgtggctaca

SEQ ID NO: 98245 - DNA, 25 bp, Homo sapien
agacgcgcaggatgccacacgaaga

SEQ ID NO: 98246 - DNA, 25 bp, Homo sapien
tggcgtaaggcaccggattcttcca

SEQ ID NO: 98247 - DNA, 25 bp, Homo sapien
ctctgctagtgcaaagccggcttga

SEQ ID NO: 98248 - DNA, 25 bp, Homo sapien
tcacctgacccgctagagccattgg

SEQ ID NO: 98249 - DNA, 25 bp, Homo sapien
gcttggaccctgatcttacccgtgg

SEQ ID NO: 98250 - DNA, 25 bp, Homo sapien
ctcatttggacttctaggcccggca

SEQ ID NO: 98251 - DNA, 25 bp, Homo sapien
gcttcgcgaatcaacggtgcccaga

SEQ ID NO: 98252 - DNA, 25 bp, Homo sapien
gtcgacgtctccacatcccaggagg

SEQ ID NO: 98253 - DNA, 25 bp, Homo sapien
tgaactttgccggtgtcccacacgg

SEQ ID NO: 98254 - DNA, 25 bp, Homo sapien
ggggcaaccctgtcactacatcata

SEQ ID NO: 98255 - DNA, 25 bp, Homo sapien
agagactctcactgcacgccggagg

SEQ ID NO: 98256 - DNA, 25 bp, Homo sapien
ttctgtccagactcaagggcccttt

SEQ ID NO: 98257 - DNA, 25 bp, Homo sapien
cagctgacgggacggcgccgacaca

SEQ ID NO: 98258 - DNA, 25 bp, Homo sapien
tcagctgacgggacggcgccgacac

SEQ ID NO: 98259 - DNA, 25 bp, Homo sapien
ttcagctgacgggacggcgccgaca

SEQ ID NO: 98260 - DNA, 25 bp, Homo sapien
cggctgacgggacggcgacgacaca

SEQ ID NO: 98261 - DNA, 25 bp, Homo sapien
tcggctgacgggacggcgacgacac

SEQ ID NO: 98262 - DNA, 25 bp, Homo sapien
ctcggctgacgggacggcgacgaca

SEQ ID NO: 98263 - DNA, 25 bp, Homo sapien
cagctgaggggacggcgccgacaca

SEQ ID NO: 98264 - DNA, 25 bp, Homo sapien
cagctcaggggacggcgccgacaca

SEQ ID NO: 98265 - DNA, 25 bp, Homo sapien
cagctgacgggacggcgccgacaca

SEQ ID NO: 98266 - DNA, 25 bp, Homo sapien
caggggacggcgacaacacaggccc

SEQ ID NO: 98267 - DNA, 25 bp, Homo sapien
cagctcaggggacggcgacaacaca

SEQ ID NO: 98268 - DNA, 25 bp, Homo sapien
aggggagggcgacaacacaggctcc

SEQ ID NO: 98269 - DNA, 25 bp, Homo sapien
ctcagggaacggcgacaacacaggc

SEQ ID NO: 98270 - DNA, 25 bp, Homo sapien
cagctgacgggagggcgacaacaca

SEQ ID NO: 98271 - DNA, 25 bp, Homo sapien
cagctcaggggacggcgccgacaca

SEQ ID NO: 98272 - DNA, 25 bp, Homo sapien
tcagggaacggcgacaacacaggcc

SEQ ID NO: 98273 - DNA, 25 bp, Homo sapien
cagctcaggggacggcgacaacaca

SEQ ID NO: 98274 - DNA, 25 bp, Homo sapien
ttcagctgacgggacggcgccgaca

SEQ ID NO: 98275 - DNA, 25 bp, Homo sapien
tcagctgacgggacggcgccgacac

SEQ ID NO: 98276 - DNA, 25 bp, Homo sapien
tcaggggacagcgccgacacaggcc

SEQ ID NO: 98277 - DNA, 25 bp, Homo sapien
cagctcaggggacggcgccgacaca

SEQ ID NO: 98278 - DNA, 25 bp, Homo sapien
tcagggaacggcgacaacacaggcc

SEQ ID NO: 98279 - DNA, 25 bp, Homo sapien
caggggacggcgacaacacaggccc

SEQ ID NO: 98280 - DNA, 25 bp, Homo sapien
cagctgacgggacggcgccgacaca

SEQ ID NO: 98281 - DNA, 25 bp, Homo sapien
acgctgctccttcggtttccctgaa

SEQ ID NO: 98282 - DNA, 25 bp, Homo sapien
cgacgacccgcttctctaggagtaa

SEQ ID NO: 98283 - DNA, 25 bp, Homo sapien
cgcggtatagcctaggcagggatta

SEQ ID NO: 98284 - DNA, 25 bp, Homo sapien
ggattaacccgtggtcccagcgctc

SEQ ID NO: 98285 - DNA, 25 bp, Homo sapien
cgtccagtggagctctgagtttcga

SEQ ID NO: 98286 - DNA, 25 bp, Homo sapien
tgcattccaaagcagacacctcatg

SEQ ID NO: 98287 - DNA, 25 bp, Homo sapien
ggctgactttctctcggtgcgtcca

SEQ ID NO: 98288 - DNA, 25 bp, Homo sapien
tcccgcaggtgagtacgctgctcct

SEQ ID NO: 98289 - DNA, 25 bp, Homo sapien
ccacgaggatttacgagcggaactt

SEQ ID NO: 98290 - DNA, 25 bp, Homo sapien
ttctggtggtaatgagcgctcaggc

SEQ ID NO: 98291 - DNA, 25 bp, Homo sapien
ctggcctgggaacagagcagcactt

SEQ ID NO: 98292 - DNA, 25 bp, Homo sapien
tttttgcgtccctctccaactgctg

SEQ ID NO: 98293 - DNA, 25 bp, Homo sapien
tccgggactttcctagtgtgccacc

SEQ ID NO: 98294 - DNA, 25 bp, Homo sapien
cgggtgtgctcgaacttgtattgct

SEQ ID NO: 98295 - DNA, 25 bp, Homo sapien
tggaagcctttcttcgggttctggc

SEQ ID NO: 98296 - DNA, 25 bp, Homo sapien
ttggaccctgccttatatttgacca

SEQ ID NO: 98297 - DNA, 25 bp, Homo sapien
taaagacttgaactcgcagcgcgga

SEQ ID NO: 98298 - DNA, 25 bp, Homo sapien
ccgaggagttcattaccatccacta

SEQ ID NO: 98299 - DNA, 25 bp, Homo sapien
accaggtctccatcgactgtcaggg

SEQ ID NO: 98300 - DNA, 25 bp, Homo sapien
cgacttcctgaaggtgaggcgccca

SEQ ID NO: 98301 - DNA, 25 bp, Homo sapien
ggacgctgccatggtttaaattccc

SEQ ID NO: 98302 - DNA, 25 bp, Homo sapien
agccttcttcatcagcgagcccgag

SEQ ID NO: 98303 - DNA, 25 bp, Homo sapien
cagcgcggaactctgacgcaatcca

SEQ ID NO: 98304 - DNA, 25 bp, Homo sapien
tggcacttcttagacacttcgctgg

SEQ ID NO: 98305 - DNA, 25 bp, Homo sapien
ccgagacgtcggcacgtacactgtc

SEQ ID NO: 98306 - DNA, 25 bp, Homo sapien
gtacactgtcaggtcttcccgcttt

SEQ ID NO: 98307 - DNA, 25 bp, Homo sapien
gcgccgttgtttccggctcaactgg

SEQ ID NO: 98308 - DNA, 25 bp, Homo sapien
tggcctctggttttccgactgctta

SEQ ID NO: 98309 - DNA, 25 bp, Homo sapien
cccgttcggctacaagtgagtttca

SEQ ID NO: 98310 - DNA, 25 bp, Homo sapien
ctctgtagctggagaaggtagtttc

SEQ ID NO: 98311 - DNA, 25 bp, Homo sapien
cggctgtaccagaacgcagaaagca

SEQ ID NO: 98312 - DNA, 25 bp, Homo sapien
ctgctgcatcacacagaacggctgt

SEQ ID NO: 98313 - DNA, 25 bp, Homo sapien
ttgtgatgacgcagccgtccctgtc

SEQ ID NO: 98314 - DNA, 25 bp, Homo sapien
tcaggtgcctccacaacgccgaggt

SEQ ID NO: 98315 - DNA, 25 bp, Homo sapien
agcgcgcccatctgttccagcaggc

SEQ ID NO: 98316 - DNA, 25 bp, Homo sapien
gtcaccctcggggtcgtccttgagc

SEQ ID NO: 98317 - DNA, 25 bp, Homo sapien
ccgcacagacggcaggtggcccagt

SEQ ID NO: 98318 - DNA, 25 bp, Homo sapien
ccctacaggaggacctttgtgatga

SEQ ID NO: 98319 - DNA, 25 bp, Homo sapien
cattggacggagaagcgctgtcctg

SEQ ID NO: 98320 - DNA, 25 bp, Homo sapien
tctgaaggcattggcattggacgga

SEQ ID NO: 98321 - DNA, 25 bp, Homo sapien
tctgaaaccgccaaggatcgcgagc

SEQ ID NO: 98322 - DNA, 25 bp, Homo sapien
ggggccttgccacagaatcccgggc

SEQ ID NO: 98323 - DNA, 25 bp, Homo sapien
tgctttctcacagtcgcgacagccg

SEQ ID NO: 98324 - DNA, 25 bp, Homo sapien
tcgggagtccgagatggtagatccc

SEQ ID NO: 98325 - DNA, 25 bp, Homo sapien
cgctgacattttgtcccggacggaa

SEQ ID NO: 98326 - DNA, 25 bp, Homo sapien
agacacagcgctgcattcacacgtc

SEQ ID NO: 98327 - DNA, 25 bp, Homo sapien
aggggagtcgctctgaaaccgccaa

SEQ ID NO: 98328 - DNA, 25 bp, Homo sapien
cattcacacgtctgcggggaaaggg

SEQ ID NO: 98329 - DNA, 25 bp, Homo sapien
atggaccagctgtactgcccaccga

SEQ ID NO: 98330 - DNA, 25 bp, Homo sapien
ttgcgcctggtgttttccacgcttc

SEQ ID NO: 98331 - DNA, 25 bp, Homo sapien
tagtccctgcgtgtcctagtgccaa

SEQ ID NO: 98332 - DNA, 25 bp, Homo sapien
ctttccaggcgggaagcacctcgag

SEQ ID NO: 98333 - DNA, 25 bp, Homo sapien
acctcgagcgtctagtgtaaccgtc

SEQ ID NO: 98334 - DNA, 25 bp, Homo sapien
aattgaccacagacagccgccgttc

SEQ ID NO: 98335 - DNA, 25 bp, Homo sapien
gtccacctggcgcttctcagcagga

SEQ ID NO: 98336 - DNA, 25 bp, Homo sapien
gccagagtcccacggagcaaccaga

SEQ ID NO: 98337 - DNA, 25 bp, Homo sapien
ggggaagcccatctcgatgagactc

SEQ ID NO: 98338 - DNA, 25 bp, Homo sapien
ggggcagaaacaccatgaatagcgc

SEQ ID NO: 98339 - DNA, 25 bp, Homo sapien
cgggacgagcgcttaccagtccatc

SEQ ID NO: 98340 - DNA, 25 bp, Homo sapien
tgaatagcgcccacgagccatggtg

SEQ ID NO: 98341 - DNA, 25 bp, Homo sapien
ggctctatagcagccgggaacaccg

SEQ ID NO: 98342 - DNA, 25 bp, Homo sapien
aagtgccggatctgtttgggtcacg

SEQ ID NO: 98343 - DNA, 25 bp, Homo sapien
gtcgtcttcgtgctccatcagcctg

SEQ ID NO: 98344 - DNA, 25 bp, Homo sapien
tgagactctcaagagccgtcagctc

SEQ ID NO: 98345 - DNA, 25 bp, Homo sapien
cctgctacaccagcgtgaaggtaaa

SEQ ID NO: 98346 - DNA, 25 bp, Homo sapien
atctactgccgggactcggacgagt

SEQ ID NO: 98347 - DNA, 25 bp, Homo sapien
cgggactcggacgagtccagctcgc

SEQ ID NO: 98348 - DNA, 25 bp, Homo sapien
agcgccgaggccgagactcagacct

SEQ ID NO: 98349 - DNA, 25 bp, Homo sapien
gactcagacctgctacaccagcgtg

SEQ ID NO: 98350 - DNA, 25 bp, Homo sapien
tcgcagagcggcgtgatctactgcc

SEQ ID NO: 98351 - DNA, 25 bp, Homo sapien
acgctctgccctgtcgggagagctc

SEQ ID NO: 98352 - DNA, 25 bp, Homo sapien
cagcatccatgtctcgcagagcggc

SEQ ID NO: 98353 - DNA, 25 bp, Homo sapien
acccagccacggaggcttagtttgg

SEQ ID NO: 98354 - DNA, 25 bp, Homo sapien
ccacagttgagggagaatttttgtc

SEQ ID NO: 98355 - DNA, 25 bp, Homo sapien
ccgaaggaatgcagaccacagttga

SEQ ID NO: 98356 - DNA, 25 bp, Homo sapien
ctgcagcgcaactgagacgctaata

SEQ ID NO: 98357 - DNA, 25 bp, Homo sapien
gatcagccatcgcaacatccgggca

SEQ ID NO: 98358 - DNA, 25 bp, Homo sapien
ctccagcaagctcgacggacgcaga

SEQ ID NO: 98359 - DNA, 25 bp, Homo sapien
cccaccgtcgtgagaacagcgcgtg

SEQ ID NO: 98360 - DNA, 25 bp, Homo sapien
agcgcacggagcttaggtagctcga

SEQ ID NO: 98361 - DNA, 25 bp, Homo sapien
cccagggacaccgttcatctgagga

SEQ ID NO: 98362 - DNA, 25 bp, Homo sapien
acgcgttccaactggcgcgaatata

SEQ ID NO: 98363 - DNA, 25 bp, Homo sapien
cccggacacgcctcttctggagaag

SEQ ID NO: 98364 - DNA, 25 bp, Homo sapien
gtcccgggtatctgaagcggatccc

SEQ ID NO: 98365 - DNA, 25 bp, Homo sapien
tcatctgaggaactctcgcgccctg

SEQ ID NO: 98366 - DNA, 25 bp, Homo sapien
gcccggaaacctcgggaggctcaga

SEQ ID NO: 98367 - DNA, 25 bp, Homo sapien
ttgcagcccagaaaccgaacccaag

SEQ ID NO: 98368 - DNA, 25 bp, Homo sapien
gagaagcgcgtttgtcccttacttg

SEQ ID NO: 98369 - DNA, 25 bp, Homo sapien
ctccggtagcgaaggccacacagaa

SEQ ID NO: 98370 - DNA, 25 bp, Homo sapien
gttttgtagggtcagcatttgcgta

SEQ ID NO: 98371 - DNA, 25 bp, Homo sapien
cgagaacccgcggtgcgttttgtag

SEQ ID NO: 98372 - DNA, 25 bp, Homo sapien
gagaatgagtccctccgtggacgtg

SEQ ID NO: 98373 - DNA, 25 bp, Homo sapien
aacccacaaggttctgagttcctgg

SEQ ID NO: 98374 - DNA, 25 bp, Homo sapien
ctggaccagcccgaagggcacatgg

SEQ ID NO: 98375 - DNA, 25 bp, Homo sapien
catttgcgtactgggtctgctgcac

SEQ ID NO: 98376 - DNA, 25 bp, Homo sapien
cagaagtcccgaggaccctggcagc

SEQ ID NO: 98377 - DNA, 25 bp, Homo sapien
gcttcttccacttggcgcgtcggtt

SEQ ID NO: 98378 - DNA, 25 bp, Homo sapien
ggtcgtctttttgcgcttcttccac

SEQ ID NO: 98379 - DNA, 25 bp, Homo sapien
cgcacggaacacgttggtcgtcttt

SEQ ID NO: 98380 - DNA, 25 bp, Homo sapien
tgcactgggacagcgactgcgccat

SEQ ID NO: 98381 - DNA, 25 bp, Homo sapien
ttggaacccgccaggctgttggaca

SEQ ID NO: 98382 - DNA, 25 bp, Homo sapien
tgaagctcatagagactgtgtgctc

SEQ ID NO: 98383 - DNA, 25 bp, Homo sapien
aacgccgcccgtcagaaggccagga

SEQ ID NO: 98384 - DNA, 25 bp, Homo sapien
gcgcggctgcattaagtgaagctca

SEQ ID NO: 98385 - DNA, 25 bp, Homo sapien
gctcggcggcatctttcatacctga

SEQ ID NO: 98386 - DNA, 25 bp, Homo sapien
tcgatacaggaacgcacaggcagcc

SEQ ID NO: 98387 - DNA, 25 bp, Homo sapien
tgccagctcctcacgcataaagatg

SEQ ID NO: 98388 - DNA, 25 bp, Homo sapien
ggcgaagctcctctccaactcgttg

SEQ ID NO: 98389 - DNA, 25 bp, Homo sapien
aaggggatcgcggtcactactttct

SEQ ID NO: 98390 - DNA, 25 bp, Homo sapien
tggacagccgggttggaataatatc

SEQ ID NO: 98391 - DNA, 25 bp, Homo sapien
tcccgtagtaaacagcacaagcttt

SEQ ID NO: 98392 - DNA, 25 bp, Homo sapien
gcacccgcgcttgtcctaaggaaga

SEQ ID NO: 98393 - DNA, 25 bp, Homo sapien
tctgtgcctctgagctaacatcttc

SEQ ID NO: 98394 - DNA, 25 bp, Homo sapien
gttcgagcgctctgcactcttctca

SEQ ID NO: 98395 - DNA, 25 bp, Homo sapien
ccacagtgggcctagagcgcaaaga

SEQ ID NO: 98396 - DNA, 25 bp, Homo sapien
ctaacatcttcctagggcaggggca

SEQ ID NO: 98397 - DNA, 25 bp, Homo sapien
cgcttcgaaggcgtagctctgtgcc

SEQ ID NO: 98398 - DNA, 25 bp, Homo sapien
cagcctgcaaatgtcagcgcccgga

SEQ ID NO: 98399 - DNA, 25 bp, Homo sapien
cccggagcaggagctaaagcagcct

SEQ ID NO: 98400 - DNA, 25 bp, Homo sapien
ggccttcagacaacgcctggacttc

SEQ ID NO: 98401 - DNA, 25 bp, Homo sapien
cggcaaagcgaactctcgggcagtt

SEQ ID NO: 98402 - DNA, 25 bp, Homo sapien
cctgggaggagaattccgagaccta

SEQ ID NO: 98403 - DNA, 25 bp, Homo sapien
gcccttctgagaaacgctttgcctg

SEQ ID NO: 98404 - DNA, 25 bp, Homo sapien
agctgctaccaacgcggcctatgtg

SEQ ID NO: 98405 - DNA, 25 bp, Homo sapien
atgcagggtattggccacaccagtt

SEQ ID NO: 98406 - DNA, 25 bp, Homo sapien
gtgcgtgcacacaagcgctagtgtc

SEQ ID NO: 98407 - DNA, 25 bp, Homo sapien
tccagaaccctgctcccagaaatag

SEQ ID NO: 98408 - DNA, 25 bp, Homo sapien
agcctggctccacacgctgtctgga

SEQ ID NO: 98409 - DNA, 25 bp, Homo sapien
cgcggacaccgcgtctgggagtcct

SEQ ID NO: 98410 - DNA, 25 bp, Homo sapien
gtcacaaaaacaggtgctcagaggc

SEQ ID NO: 98411 - DNA, 25 bp, Homo sapien
gctccatcgggaaaagggtgtcaca

SEQ ID NO: 98412 - DNA, 25 bp, Homo sapien
ctcccgggtagatgtgagctccatc

SEQ ID NO: 98413 - DNA, 25 bp, Homo sapien
ctggaacaggtggaagtcctcccgg

SEQ ID NO: 98414 - DNA, 25 bp, Homo sapien
gtcagtccaggaaacttctggaaca

SEQ ID NO: 98415 - DNA, 25 bp, Homo sapien
gccgggttggcacaagcaactgcca

SEQ ID NO: 98416 - DNA, 25 bp, Homo sapien
agggtgtcacaaaaacaggtgctca

SEQ ID NO: 98417 - DNA, 25 bp, Homo sapien
caccacgccggtcttgatcttgatc

SEQ ID NO: 98418 - DNA, 25 bp, Homo sapien
ctgcggctatttaggcgtggtcgcc

SEQ ID NO: 98419 - DNA, 25 bp, Homo sapien
catggtccctcgagcgccgcgagaa

SEQ ID NO: 98420 - DNA, 25 bp, Homo sapien
ttccggcaaatcagagcggccagtg

SEQ ID NO: 98421 - DNA, 25 bp, Homo sapien
tactagagggcggtaccctgctccc

SEQ ID NO: 98422 - DNA, 25 bp, Homo sapien
cccgggccaagttcagcaaggagag

SEQ ID NO: 98423 - DNA, 25 bp, Homo sapien
tcttgatctgtctcacgcgaggatc

SEQ ID NO: 98424 - DNA, 25 bp, Homo sapien
gcgaggatcggccatggtccctcga

SEQ ID NO: 98425 - DNA, 25 bp, Homo sapien
ccttcagttcggctctgcggaccgt

SEQ ID NO: 98426 - DNA, 25 bp, Homo sapien
gttagcggccactacgcaaacgaca

SEQ ID NO: 98427 - DNA, 25 bp, Homo sapien
ctgagaaccatgactccgccgtggc

SEQ ID NO: 98428 - DNA, 25 bp, Homo sapien
caagcgctcagtcctgagaaccatg

SEQ ID NO: 98429 - DNA, 25 bp, Homo sapien
atcgcgcaggcagaagtgccacacc

SEQ ID NO: 98430 - DNA, 25 bp, Homo sapien
agtaccggacctaaacaagcgctca

SEQ ID NO: 98431 - DNA, 25 bp, Homo sapien
tgccgtcccaaagcagcagccagta

SEQ ID NO: 98432 - DNA, 25 bp, Homo sapien
cgaccctctgtagctccttgcaggg

SEQ ID NO: 98433 - DNA, 25 bp, Homo sapien
tgcagccgcgtggatgtctctcgaa

SEQ ID NO: 98434 - DNA, 25 bp, Homo sapien
cgggtactttctcggcctggctgca

SEQ ID NO: 98435 - DNA, 25 bp, Homo sapien
gggctttccggacatccctccacta

SEQ ID NO: 98436 - DNA, 25 bp, Homo sapien
gatgtctctcgaagcctccacccta

SEQ ID NO: 98437 - DNA, 25 bp, Homo sapien
ctccaccctattctccttattgtta

SEQ ID NO: 98438 - DNA, 25 bp, Homo sapien
tccttattgttatttccactcaccc

SEQ ID NO: 98439 - DNA, 25 bp, Homo sapien
tcctggttccagaccgcctctctca

SEQ ID NO: 98440 - DNA, 25 bp, Homo sapien
cctcctcgtggggagcgtccgagca

SEQ ID NO: 98441 - DNA, 25 bp, Homo sapien
gcgcttctgctctactccagcaagg

SEQ ID NO: 98442 - DNA, 25 bp, Homo sapien
gcgcgcgtgtgtttacacttccaga

SEQ ID NO: 98443 - DNA, 25 bp, Homo sapien
tccagcaaggcttttacaggccggc

SEQ ID NO: 98444 - DNA, 25 bp, Homo sapien
cgaggacacacacaaaggccaggga

SEQ ID NO: 98445 - DNA, 25 bp, Homo sapien
cggagttggacctctcccgaggaca

SEQ ID NO: 98446 - DNA, 25 bp, Homo sapien
agtgccattcaattactcggagttg

SEQ ID NO: 98447 - DNA, 25 bp, Homo sapien
tagactactggttagagtgccattc

SEQ ID NO: 98448 - DNA, 25 bp, Homo sapien
cagcagttaacccttggcaggccgg

SEQ ID NO: 98449 - DNA, 25 bp, Homo sapien
cagagatgatttaggggccgtgata

SEQ ID NO: 98450 - DNA, 25 bp, Homo sapien
tgtcttgatgggattagaggaaacc

SEQ ID NO: 98451 - DNA, 25 bp, Homo sapien
tcattcattatgtcaccaggaggga

SEQ ID NO: 98452 - DNA, 25 bp, Homo sapien
tccagaggggcctctttaacggctc

SEQ ID NO: 98453 - DNA, 25 bp, Homo sapien
agtgctgtgtttcctctggttaagg

SEQ ID NO: 98454 - DNA, 25 bp, Homo sapien
gtaaatcattactcagctcagctca

SEQ ID NO: 98455 - DNA, 25 bp, Homo sapien
ttagcttaatctattccgcaagtgg

SEQ ID NO: 98456 - DNA, 25 bp, Homo sapien
tcagtcaccaggcaaactgtgttta

SEQ ID NO: 98457 - DNA, 25 bp, Homo sapien
agtcaacgcgggacacggctcccgg

SEQ ID NO: 98458 - DNA, 25 bp, Homo sapien
ggaccgcgagcaacaaaagcccggc

SEQ ID NO: 98459 - DNA, 25 bp, Homo sapien
accgacgcccgctcggaaggcgaga

SEQ ID NO: 98460 - DNA, 25 bp, Homo sapien
ctggagagttacaccgagtcaacgc

SEQ ID NO: 98461 - DNA, 25 bp, Homo sapien
gagcttggccggacatcctcctcca

SEQ ID NO: 98462 - DNA, 25 bp, Homo sapien
gaaatgagctggagagttacaccga

SEQ ID NO: 98463 - DNA, 25 bp, Homo sapien
atgcgccgagggacccaagtctcca

SEQ ID NO: 98464 - DNA, 25 bp, Homo sapien
ttacaccgagtcaacgcgggacacg

SEQ ID NO: 98465 - DNA, 25 bp, Homo sapien
agggaagccttgacagggagctatc

SEQ ID NO: 98466 - DNA, 25 bp, Homo sapien
aggctcttggttccgcccacgcagt

SEQ ID NO: 98467 - DNA, 25 bp, Homo sapien
gaagagcggcttagggcctcaccgc

SEQ ID NO: 98468 - DNA, 25 bp, Homo sapien
cccgggaggacaccgcgtgtgtcaa

SEQ ID NO: 98469 - DNA, 25 bp, Homo sapien
ttacatccgctgagaagagggagcc

SEQ ID NO: 98470 - DNA, 25 bp, Homo sapien
tgggagaaccgccattcaggagaac

SEQ ID NO: 98471 - DNA, 25 bp, Homo sapien
cctgtctatcgggtcactggttccg

SEQ ID NO: 98472 - DNA, 25 bp, Homo sapien
tccgagggctccgtttgaaacatgg

SEQ ID NO: 98473 - DNA, 25 bp, Homo sapien
ggactttcctgctccgggctttaga

SEQ ID NO: 98474 - DNA, 25 bp, Homo sapien
aactagttctcgtacggaggagcgc

SEQ ID NO: 98475 - DNA, 25 bp, Homo sapien
ccggactgctcattgtaaggaaaac

SEQ ID NO: 98476 - DNA, 25 bp, Homo sapien
cttcaaatcgctgctaaagaggccg

SEQ ID NO: 98477 - DNA, 25 bp, Homo sapien
tgcaggcctgctagattaccacccg

SEQ ID NO: 98478 - DNA, 25 bp, Homo sapien
aaactattgctggacattgccgcgg

SEQ ID NO: 98479 - DNA, 25 bp, Homo sapien
tccaaaaggttccagtccagagggc

SEQ ID NO: 98480 - DNA, 25 bp, Homo sapien
ccagagggcacggaacaaaactagt

SEQ ID NO: 98481 - DNA, 25 bp, Homo sapien
tgcctactcggtcgcagctaaagcc

SEQ ID NO: 98482 - DNA, 25 bp, Homo sapien
gtggaacgcttttcatcgctttcag

SEQ ID NO: 98483 - DNA, 25 bp, Homo sapien
aagggttccatactctccgaggatc

SEQ ID NO: 98484 - DNA, 25 bp, Homo sapien
acctgacaagtgtgcgtccttacca

SEQ ID NO: 98485 - DNA, 25 bp, Homo sapien
cctggcccgcctctcaggagagaaa

SEQ ID NO: 98486 - DNA, 25 bp, Homo sapien
tgaaaacggacgagttccttcgcgc

SEQ ID NO: 98487 - DNA, 25 bp, Homo sapien
ccgcgacgcgtcgttgtttgtgaaa

SEQ ID NO: 98488 - DNA, 25 bp, Homo sapien
atcccttcaaggtgagcttcggccc

SEQ ID NO: 98489 - DNA, 25 bp, Homo sapien
ccgatcagccagtctgcactcatga

SEQ ID NO: 98490 - DNA, 25 bp, Homo sapien
cggcaaaagccaccacaatactcag

SEQ ID NO: 98491 - DNA, 25 bp, Homo sapien
gcaaggtccagagcatcgagcgaca

SEQ ID NO: 98492 - DNA, 25 bp, Homo sapien
cacatattgatgttccgggcgaaga

SEQ ID NO: 98493 - DNA, 25 bp, Homo sapien
aggaagtcgcagctgcagtcattca

SEQ ID NO: 98494 - DNA, 25 bp, Homo sapien
agtcaggagtccacggagttaatca

SEQ ID NO: 98495 - DNA, 25 bp, Homo sapien
tgaaggcaatgagctcggcaaaagc

SEQ ID NO: 98496 - DNA, 25 bp, Homo sapien
tcgagcgacaggtgacaatgacatg

SEQ ID NO: 98497 - DNA, 25 bp, Homo sapien
cagcttcgagcagccctgccgggag

SEQ ID NO: 98498 - DNA, 25 bp, Homo sapien
agctcccggagcagcttcgagcagc

SEQ ID NO: 98499 - DNA, 25 bp, Homo sapien
gcccagtcaccatcgccgcctccgt

SEQ ID NO: 98500 - DNA, 25 bp, Homo sapien
gggctttcagtgacgcctcctcgca

SEQ ID NO: 98501 - DNA, 25 bp, Homo sapien
ccaagtcagggctttcagtgacgcc

SEQ ID NO: 98502 - DNA, 25 bp, Homo sapien
gaagcagctgttcccttcccattcc

SEQ ID NO: 98503 - DNA, 25 bp, Homo sapien
tcccgcagcacctccgaccgctcgg

SEQ ID NO: 98504 - DNA, 25 bp, Homo sapien
tcccagggcgccgaagcgaagttcc

SEQ ID NO: 98505 - DNA, 25 bp, Homo sapien
ccttgtaccgctgatagaatgagga

SEQ ID NO: 98506 - DNA, 25 bp, Homo sapien
cctaggtcgtctgccagcaagaaga

SEQ ID NO: 98507 - DNA, 25 bp, Homo sapien
cgacgtcgttccagcctaggtcgtc

SEQ ID NO: 98508 - DNA, 25 bp, Homo sapien
cgtgtagtagttgtccaggagcacc

SEQ ID NO: 98509 - DNA, 25 bp, Homo sapien
tgcacagcggctgcgtgtagtagtt

SEQ ID NO: 98510 - DNA, 25 bp, Homo sapien
ccgcgtacctggtagcggccagtga

SEQ ID NO: 98511 - DNA, 25 bp, Homo sapien
cccataactgggtcggcggtccgag

SEQ ID NO: 98512 - DNA, 25 bp, Homo sapien
cttcgcccggagcttcagaaaacga

SEQ ID NO: 98513 - DNA, 25 bp, Homo sapien
tcagaagccggtggctcagaaggtc

SEQ ID NO: 98514 - DNA, 25 bp, Homo sapien
ccacgagcagacaggcgggcctgtt

SEQ ID NO: 98515 - DNA, 25 bp, Homo sapien
tcgcggacgctcttcggacactggc

SEQ ID NO: 98516 - DNA, 25 bp, Homo sapien
cctcgccgggcagacgagactcgga

SEQ ID NO: 98517 - DNA, 25 bp, Homo sapien
agctgggtcaactcccggaatggcc

SEQ ID NO: 98518 - DNA, 25 bp, Homo sapien
gcccgacctcagagctgggtcaact

SEQ ID NO: 98519 - DNA, 25 bp, Homo sapien
ggtctcctcagaagccggtggctca

SEQ ID NO: 98520 - DNA, 25 bp, Homo sapien
gcccgtggtgttccggtggccacac

SEQ ID NO: 98521 - DNA, 25 bp, Homo sapien
cacagagtgctgtgctcaagttatc

SEQ ID NO: 98522 - DNA, 25 bp, Homo sapien
gcaggagagactttacacggggaac

SEQ ID NO: 98523 - DNA, 25 bp, Homo sapien
tcgagaagatatatcaaggcctatt

SEQ ID NO: 98524 - DNA, 25 bp, Homo sapien
ctatttcttggaggccagagcgctc

SEQ ID NO: 98525 - DNA, 25 bp, Homo sapien
tggggcctcggcaaaacacttggac

SEQ ID NO: 98526 - DNA, 25 bp, Homo sapien
caaaacacttggacgggatggccct

SEQ ID NO: 98527 - DNA, 25 bp, Homo sapien
gtttatggagcccttactcggtgcc

SEQ ID NO: 98528 - DNA, 25 bp, Homo sapien
tgtcacgggttggttagcgtttatg

SEQ ID NO: 98529 - DNA, 25 bp, Homo sapien
actgcctctgcaactctggttagga

SEQ ID NO: 98530 - DNA, 25 bp, Homo sapien
gccgcaggtgaccatgtgaactacc

SEQ ID NO: 98531 - DNA, 25 bp, Homo sapien
cccatcccgggtcagaaaacatctg

SEQ ID NO: 98532 - DNA, 25 bp, Homo sapien
tttgccataacctgccacaaccgga

SEQ ID NO: 98533 - DNA, 25 bp, Homo sapien
cccatgtgttcgacgagcgcgagaa

SEQ ID NO: 98534 - DNA, 25 bp, Homo sapien
gagccaccatgtcgttcgcgctgga

SEQ ID NO: 98535 - DNA, 25 bp, Homo sapien
ccggcgcactaagatggctgaaggc

SEQ ID NO: 98536 - DNA, 25 bp, Homo sapien
gctcccgggacgcttattgtccttc

SEQ ID NO: 98537 - DNA, 25 bp, Homo sapien
cgcaggaggacctttaaatagcaac

SEQ ID NO: 98538 - DNA, 25 bp, Homo sapien
ccgagcacaatggagcccggctggt

SEQ ID NO: 98539 - DNA, 25 bp, Homo sapien
ctcctctcttcagagcacagcgggt

SEQ ID NO: 98540 - DNA, 25 bp, Homo sapien
tctgaggctcccgtcggcggagaat

SEQ ID NO: 98541 - DNA, 25 bp, Homo sapien
cccgtcggcggagaatgaatgaatc

SEQ ID NO: 98542 - DNA, 25 bp, Homo sapien
aggtgctcgcgctgtgtctccatcc

SEQ ID NO: 98543 - DNA, 25 bp, Homo sapien
atagcaacgtcagcgcgcttctctc

SEQ ID NO: 98544 - DNA, 25 bp, Homo sapien
cagagaagagggtgctgctttcccg

SEQ ID NO: 98545 - DNA, 25 bp, Homo sapien
cggccaccggaagtgtgacctttcg

SEQ ID NO: 98546 - DNA, 25 bp, Homo sapien
ccttcccggaggacacctgtgagtt

SEQ ID NO: 98547 - DNA, 25 bp, Homo sapien
ccagctcgggccttagaacttctga

SEQ ID NO: 98548 - DNA, 25 bp, Homo sapien
tacgaccaagtacgcccagctcggg

SEQ ID NO: 98549 - DNA, 25 bp, Homo sapien
cggcgactttttgctcttccgcttt

SEQ ID NO: 98550 - DNA, 25 bp, Homo sapien
tctttgacagggttttctacgccgc

SEQ ID NO: 98551 - DNA, 25 bp, Homo sapien
tcggtcttccgggtgtctttgacag

SEQ ID NO: 98552 - DNA, 25 bp, Homo sapien
cgctgcctattctcatccggggtca

SEQ ID NO: 98553 - DNA, 25 bp, Homo sapien
cttgcgcgggccgacctttactatc

SEQ ID NO: 98554 - DNA, 25 bp, Homo sapien
cccgtgatctcaagtagggacgcgg

SEQ ID NO: 98555 - DNA, 25 bp, Homo sapien
accagggactcgctgtgaaccgatg

SEQ ID NO: 98556 - DNA, 25 bp, Homo sapien
tgtgaggcggacaaaactcggagcc

SEQ ID NO: 98557 - DNA, 25 bp, Homo sapien
cgactgatactgaggccgcatccct

SEQ ID NO: 98558 - DNA, 25 bp, Homo sapien
ccacccggctttcgaggactttgct

SEQ ID NO: 98559 - DNA, 25 bp, Homo sapien
ctaatttccggcacgtgaaacgcgg

SEQ ID NO: 98560 - DNA, 25 bp, Homo sapien
ttgcttcggggtttcactccaccgc

SEQ ID NO: 98561 - DNA, 25 bp, Homo sapien
ctccgcgtgggtcatggaaaggccc

SEQ ID NO: 98562 - DNA, 25 bp, Homo sapien
ctgccctgcgtggtgcctcctggag

SEQ ID NO: 98563 - DNA, 25 bp, Homo sapien
tgtgagagatgcttcctgcagtggc

SEQ ID NO: 98564 - DNA, 25 bp, Homo sapien
cccgcatgtgagagatgcttcctgc

SEQ ID NO: 98565 - DNA, 25 bp, Homo sapien
cagagagtttctgcagagaaggagc

SEQ ID NO: 98566 - DNA, 25 bp, Homo sapien
ggccgtctccctcttagtgtttctg

SEQ ID NO: 98567 - DNA, 25 bp, Homo sapien
gcctcctggagtgggctcggtcctt

SEQ ID NO: 98568 - DNA, 25 bp, Homo sapien
cggtccttggctccgcgtgggtcat

SEQ ID NO: 98569 - DNA, 25 bp, Homo sapien
gcgtcggggccgtgtctacacccac

SEQ ID NO: 98570 - DNA, 25 bp, Homo sapien
aggacctggtccgtccaggctcctt

SEQ ID NO: 98571 - DNA, 25 bp, Homo sapien
cccaggacaggggatcccgccaagg

SEQ ID NO: 98572 - DNA, 25 bp, Homo sapien
gcccggccgcaccataaagcgcccg

SEQ ID NO: 98573 - DNA, 25 bp, Homo sapien
cggacgccgagcacgggtcacctgc

SEQ ID NO: 98574 - DNA, 25 bp, Homo sapien
cgggcgccgaccgaggttcaacgca

SEQ ID NO: 98575 - DNA, 25 bp, Homo sapien
gggagcaggaagagccaacatgctg

SEQ ID NO: 98576 - DNA, 25 bp, Homo sapien
gcgccgaccgaggttcaacgcacgg

SEQ ID NO: 98577 - DNA, 25 bp, Homo sapien
ttgctgcctctaaaaggttggagcc

SEQ ID NO: 98578 - DNA, 25 bp, Homo sapien
tggcccggttctccgatctgacaac

SEQ ID NO: 98579 - DNA, 25 bp, Homo sapien
gccgcagctcacacttgaacgaaga

SEQ ID NO: 98580 - DNA, 25 bp, Homo sapien
tcgccaaatgagagcgcagcgcctc

SEQ ID NO: 98581 - DNA, 25 bp, Homo sapien
cggagctcagcgctattcaccagtg

SEQ ID NO: 98582 - DNA, 25 bp, Homo sapien
ccttcggatccagagaaagagcttg

SEQ ID NO: 98583 - DNA, 25 bp, Homo sapien
attcaccagtgctcggcgcaagagg

SEQ ID NO: 98584 - DNA, 25 bp, Homo sapien
tagtaagcggttcctgcctttcctg

SEQ ID NO: 98585 - DNA, 25 bp, Homo sapien
ggaaccctggccctccaatctgatg

SEQ ID NO: 98586 - DNA, 25 bp, Homo sapien
ggtagctcttcactcctcagcgcga

SEQ ID NO: 98587 - DNA, 25 bp, Homo sapien
tccggtaagaaatctagtgcccttg

SEQ ID NO: 98588 - DNA, 25 bp, Homo sapien
ctaaggtcgaatcatcaggcgtccc

SEQ ID NO: 98589 - DNA, 25 bp, Homo sapien
cgatcccgcagtcgagtggagaacc

SEQ ID NO: 98590 - DNA, 25 bp, Homo sapien
tctgtccagtagagaccggaacgcc

SEQ ID NO: 98591 - DNA, 25 bp, Homo sapien
cgtcgtgtcgagttcccaaaaagct

SEQ ID NO: 98592 - DNA, 25 bp, Homo sapien
gctgcctctaggttagcgaagggta

SEQ ID NO: 98593 - DNA, 25 bp, Homo sapien
tcgtcaccatggcagcatccgctgg

SEQ ID NO: 98594 - DNA, 25 bp, Homo sapien
tcttccttgctagggacctgggagc

SEQ ID NO: 98595 - DNA, 25 bp, Homo sapien
agtcgaatttccctgccaccagtgc

SEQ ID NO: 98596 - DNA, 25 bp, Homo sapien
cctgtggtttgtggagtcgaatttc

SEQ ID NO: 98597 - DNA, 25 bp, Homo sapien
gagttccatcctccgccgcagtatg

SEQ ID NO: 98598 - DNA, 25 bp, Homo sapien
aacgaacctcgaacgccagcctttg

SEQ ID NO: 98599 - DNA, 25 bp, Homo sapien
gaaacctttcggaggagcgcttcgc

SEQ ID NO: 98600 - DNA, 25 bp, Homo sapien
cgcagtatgccctaacgcagcgtta

SEQ ID NO: 98601 - DNA, 25 bp, Homo sapien
taatcgtgcaaccatggaaaccagc

SEQ ID NO: 98602 - DNA, 25 bp, Homo sapien
cggagagaatgtgcgacttgcctaa

SEQ ID NO: 98603 - DNA, 25 bp, Homo sapien
acttgcctaaggtcgcacggcctga

SEQ ID NO: 98604 - DNA, 25 bp, Homo sapien
gtagccttagagtagccacaattgc

SEQ ID NO: 98605 - DNA, 25 bp, Homo sapien
actggctctctctgcggcaggtttc

SEQ ID NO: 98606 - DNA, 25 bp, Homo sapien
gagactgcaatcacagccctccgtg

SEQ ID NO: 98607 - DNA, 25 bp, Homo sapien
acaggccatttcacccgcgaagcgg

SEQ ID NO: 98608 - DNA, 25 bp, Homo sapien
gcctgactcgaaaccagtagcctta

SEQ ID NO: 98609 - DNA, 25 bp, Homo sapien
ctcacactgacctgggacgcgctgt

SEQ ID NO: 98610 - DNA, 25 bp, Homo sapien
tcggcgcctcgaatcgcagatctcg

SEQ ID NO: 98611 - DNA, 25 bp, Homo sapien
caaagtttcccaagtgcagccggca

SEQ ID NO: 98612 - DNA, 25 bp, Homo sapien
agatctcggtagatgccgcccagtc

SEQ ID NO: 98613 - DNA, 25 bp, Homo sapien
cagctgccgaggcacctgcggagac

SEQ ID NO: 98614 - DNA, 25 bp, Homo sapien
agccgccactgcaagccaaagtttc

SEQ ID NO: 98615 - DNA, 25 bp, Homo sapien
gcggccgcaaaactggaaccgagaa

SEQ ID NO: 98616 - DNA, 25 bp, Homo sapien
agctgagctgtggtcttcggctcct

SEQ ID NO: 98617 - DNA, 25 bp, Homo sapien
agctgccgccgcacatagtaggttc

SEQ ID NO: 98618 - DNA, 25 bp, Homo sapien
tccgggcagaaatcagcaactgggc

SEQ ID NO: 98619 - DNA, 25 bp, Homo sapien
gttcttgccgatgcccatgttctgg

SEQ ID NO: 98620 - DNA, 25 bp, Homo sapien
cagcgacgatgcagtttagcgaacc

SEQ ID NO: 98621 - DNA, 25 bp, Homo sapien
ttagcgaaccaaccatgacagcagc

SEQ ID NO: 98622 - DNA, 25 bp, Homo sapien
ctcgttacagcagaacgcgcggtca

SEQ ID NO: 98623 - DNA, 25 bp, Homo sapien
gagccgattcttccagtctacggga

SEQ ID NO: 98624 - DNA, 25 bp, Homo sapien
ggcaaagacctcaccgggcagcaga

SEQ ID NO: 98625 - DNA, 25 bp, Homo sapien
ttgccctttaaatcggtctccaagc

SEQ ID NO: 98626 - DNA, 25 bp, Homo sapien
ttacagctgagctcccacgtgacgt

SEQ ID NO: 98627 - DNA, 25 bp, Homo sapien
tgtacctggcctttctggcgcgcaa

SEQ ID NO: 98628 - DNA, 25 bp, Homo sapien
caccaagcgcggcttcctgagtaag

SEQ ID NO: 98629 - DNA, 25 bp, Homo sapien
aagtggttcgccctctaccagaatg

SEQ ID NO: 98630 - DNA, 25 bp, Homo sapien
cttctacttcgagggcgagcagagc

SEQ ID NO: 98631 - DNA, 25 bp, Homo sapien
ccttgccgtcctaatccggggatca

SEQ ID NO: 98632 - DNA, 25 bp, Homo sapien
cacccgcaccatgcagaagagcgtg

SEQ ID NO: 98633 - DNA, 25 bp, Homo sapien
tcagacagcacggattgaactcttc

SEQ ID NO: 98634 - DNA, 25 bp, Homo sapien
gtctatctcgcctgctacactgtga

SEQ ID NO: 98635 - DNA, 25 bp, Homo sapien
tcatcttttcgtgtcggcgtcctgc

SEQ ID NO: 98636 - DNA, 25 bp, Homo sapien
tgcacagggccatcccatcactaag

SEQ ID NO: 98637 - DNA, 25 bp, Homo sapien
gcgccacaaactcagcccagtattg

SEQ ID NO: 98638 - DNA, 25 bp, Homo sapien
gacgcccacgagtcgcttgtaaaga

SEQ ID NO: 98639 - DNA, 25 bp, Homo sapien
ggcactatgtgcttccggtctccaa

SEQ ID NO: 98640 - DNA, 25 bp, Homo sapien
accaaagctgcagggtctcgtcgtt

SEQ ID NO: 98641 - DNA, 25 bp, Homo sapien
gactatcgcgagtgggggaaaacca

SEQ ID NO: 98642 - DNA, 25 bp, Homo sapien
gtcatcccaggactatcgcgagtgg

SEQ ID NO: 98643 - DNA, 25 bp, Homo sapien
gctggatggcttggctcatgaccac

SEQ ID NO: 98644 - DNA, 25 bp, Homo sapien
atggcttggctcatgaccacctcgc

SEQ ID NO: 98645 - DNA, 25 bp, Homo sapien
agctccagagggcactggcgccgcc

SEQ ID NO: 98646 - DNA, 25 bp, Homo sapien
aaaccagcgctctcgggtctcagga

SEQ ID NO: 98647 - DNA, 25 bp, Homo sapien
gcactgtcatcccaggactatcgcg

SEQ ID NO: 98648 - DNA, 25 bp, Homo sapien
ggaaaaccagcgctctcgggtctca

SEQ ID NO: 98649 - DNA, 25 bp, Homo sapien
ggtgagaagcggagacacttacttc

SEQ ID NO: 98650 - DNA, 25 bp, Homo sapien
acggcgctgctgttactcttgcctt

SEQ ID NO: 98651 - DNA, 25 bp, Homo sapien
actcttgcctttgccgtacatgctt

SEQ ID NO: 98652 - DNA, 25 bp, Homo sapien
agtgtctgtgtctcccagagtgtgc

SEQ ID NO: 98653 - DNA, 25 bp, Homo sapien
ggctaagcctcagcggcagtctcct

SEQ ID NO: 98654 - DNA, 25 bp, Homo sapien
ctgctctagaaggattttaaacaac

SEQ ID NO: 98655 - DNA, 25 bp, Homo sapien
ttaaacaactggctgttctctccgc

SEQ ID NO: 98656 - DNA, 25 bp, Homo sapien
tcgcccaggcaacgcgcgagactga

SEQ ID NO: 98657 - DNA, 25 bp, Homo sapien
gcaggtcatgctggttggcgccact

SEQ ID NO: 98658 - DNA, 25 bp, Homo sapien
ccgcgaaatgaagaacgggccaaga

SEQ ID NO: 98659 - DNA, 25 bp, Homo sapien
cactgcagcagacaccttggggaga

SEQ ID NO: 98660 - DNA, 25 bp, Homo sapien
tgaagaacgggccaagataagcctg

SEQ ID NO: 98661 - DNA, 25 bp, Homo sapien
aatggtctcagacccagcgatcagc

SEQ ID NO: 98662 - DNA, 25 bp, Homo sapien
ctcactgagcggagaaggatgaagc

SEQ ID NO: 98663 - DNA, 25 bp, Homo sapien
tggcgccactgcagcagacaccttg

SEQ ID NO: 98664 - DNA, 25 bp, Homo sapien
accttggggagaagtccgcgaaatg

SEQ ID NO: 98665 - DNA, 25 bp, Homo sapien
cccactcctaggacagggaggaagg

SEQ ID NO: 98666 - DNA, 25 bp, Homo sapien
acgagccgcctttgtgctccgcgga

SEQ ID NO: 98667 - DNA, 25 bp, Homo sapien
ccgcggacctgactgaaggaggcca

SEQ ID NO: 98668 - DNA, 25 bp, Homo sapien
gaggccacggccacttctggttggc

SEQ ID NO: 98669 - DNA, 25 bp, Homo sapien
cattcagttccgtagggtcaccggc

SEQ ID NO: 98670 - DNA, 25 bp, Homo sapien
cgggaaacagcccagtcctgaacaa

SEQ ID NO: 98671 - DNA, 25 bp, Homo sapien
ccgccggtaactgcaggcctgtgct

SEQ ID NO: 98672 - DNA, 25 bp, Homo sapien
cgcagtcccatcattcagttccgta

SEQ ID NO: 98673 - DNA, 25 bp, Homo sapien
agcgaaagagagaagcaccgcagga

SEQ ID NO: 98674 - DNA, 25 bp, Homo sapien
agagggctccggagaatgtgttctc

SEQ ID NO: 98675 - DNA, 25 bp, Homo sapien
ggagccacaagccaccgcgagcaag

SEQ ID NO: 98676 - DNA, 25 bp, Homo sapien
agcgcccttaaaccggccacaacag

SEQ ID NO: 98677 - DNA, 25 bp, Homo sapien
ccaagtcccgcttgcagcgccctta

SEQ ID NO: 98678 - DNA, 25 bp, Homo sapien
tactctattcgcatccgcccgcccg

SEQ ID NO: 98679 - DNA, 25 bp, Homo sapien
cccgctcgaatgcccgggaggaagc

SEQ ID NO: 98680 - DNA, 25 bp, Homo sapien
cggagaatgtgttctcccgaaggac

SEQ ID NO: 98681 - DNA, 25 bp, Homo sapien
ttgggcttgtcacggcaccgcctac

SEQ ID NO: 98682 - DNA, 25 bp, Homo sapien
gaggctgcatgtcccgtctgccctt

SEQ ID NO: 98683 - DNA, 25 bp, Homo sapien
tccagccgtccggttgggcttgtca

SEQ ID NO: 98684 - DNA, 25 bp, Homo sapien
gaaaaggcgggatttagatcacgtc

SEQ ID NO: 98685 - DNA, 25 bp, Homo sapien
ataggctcctctccaccggaaaagg

SEQ ID NO: 98686 - DNA, 25 bp, Homo sapien
cggttaagacactaggataggctcc

SEQ ID NO: 98687 - DNA, 25 bp, Homo sapien
ccaagacgggcggttaagacactag

SEQ ID NO: 98688 - DNA, 25 bp, Homo sapien
cttcttaccatagcgaggccggcga

SEQ ID NO: 98689 - DNA, 25 bp, Homo sapien
cctggaatgtgaggcccagagcgtc

SEQ ID NO: 98690 - DNA, 25 bp, Homo sapien
attcttttctgctcggctgtcctcg

SEQ ID NO: 98691 - DNA, 25 bp, Homo sapien
cgcggaaaaacggatgctaccgttg

SEQ ID NO: 98692 - DNA, 25 bp, Homo sapien
cgggattccgtaccggcgtctccat

SEQ ID NO: 98693 - DNA, 25 bp, Homo sapien
gctgcccttctgaggcctggaatgt

SEQ ID NO: 98694 - DNA, 25 bp, Homo sapien
gggatcccttgaaggcagcctcgga

SEQ ID NO: 98695 - DNA, 25 bp, Homo sapien
accgctccaaaggtggtgcctcagc

SEQ ID NO: 98696 - DNA, 25 bp, Homo sapien
tccagccgcgatgctgaccgcaaag

SEQ ID NO: 98697 - DNA, 25 bp, Homo sapien
ggcgatcctcttgtctgcttttgga

SEQ ID NO: 98698 - DNA, 25 bp, Homo sapien
ccgcgctcacctggttgtttttgca

SEQ ID NO: 98699 - DNA, 25 bp, Homo sapien
gtttttgcagagatcagcccacatg

SEQ ID NO: 98700 - DNA, 25 bp, Homo sapien
ccctccgcgcatcaggacgtggtag

SEQ ID NO: 98701 - DNA, 25 bp, Homo sapien
cgatcttgggcaccgtgctgtaggt

SEQ ID NO: 98702 - DNA, 25 bp, Homo sapien
ggggacctcttcagagccgaaaaca

SEQ ID NO: 98703 - DNA, 25 bp, Homo sapien
atcgagggtcccagactccggaact

SEQ ID NO: 98704 - DNA, 25 bp, Homo sapien
tcgtagccttcatgctgccgcttga

SEQ ID NO: 98705 - DNA, 25 bp, Homo sapien
ggagcttggcttcagttaccgcgac

SEQ ID NO: 98706 - DNA, 25 bp, Homo sapien
taccgcgactggagccgattttata

SEQ ID NO: 98707 - DNA, 25 bp, Homo sapien
accgtacagggcttctcttaaaatg

SEQ ID NO: 98708 - DNA, 25 bp, Homo sapien
cagtcgtacagcagaggaactctta

SEQ ID NO: 98709 - DNA, 25 bp, Homo sapien
ccggcgttctcaatatggtcccttc

SEQ ID NO: 98710 - DNA, 25 bp, Homo sapien
tcttctggtctcaaaatggctgccc

SEQ ID NO: 98711 - DNA, 25 bp, Homo sapien
tcctcccgattgagtcgaaggcaca

SEQ ID NO: 98712 - DNA, 25 bp, Homo sapien
ggctccctttggagcggaaatatta

SEQ ID NO: 98713 - DNA, 25 bp, Homo sapien
ttgagcaactttactggcaggtcta

SEQ ID NO: 98714 - DNA, 25 bp, Homo sapien
cgacatccctggtgcgtgcagacct

SEQ ID NO: 98715 - DNA, 25 bp, Homo sapien
caggagtcctccgtttccttacata

SEQ ID NO: 98716 - DNA, 25 bp, Homo sapien
gggtctgtcgctcccatctcaacaa

SEQ ID NO: 98717 - DNA, 25 bp, Homo sapien
cggcagggatgtgcaacaatttttc

SEQ ID NO: 98718 - DNA, 25 bp, Homo sapien
cccgccgtgtctctttgacgacttg

SEQ ID NO: 98719 - DNA, 25 bp, Homo sapien
gggagaaatctacacggcgcctgga

SEQ ID NO: 98720 - DNA, 25 bp, Homo sapien
tccaactgcgtctcggcaagtcctg

SEQ ID NO: 98721 - DNA, 25 bp, Homo sapien
acaaatgtgactgcagaggcgtgcc

SEQ ID NO: 98722 - DNA, 25 bp, Homo sapien
cagggcccagcttaaccgagagagc

SEQ ID NO: 98723 - DNA, 25 bp, Homo sapien
agagactgcagtacagccgcacagg

SEQ ID NO: 98724 - DNA, 25 bp, Homo sapien
ttagccagccgccacgtgggttggc

SEQ ID NO: 98725 - DNA, 25 bp, Homo sapien
tcgcgccaagggaggacccgcaacg

SEQ ID NO: 98726 - DNA, 25 bp, Homo sapien
ttccctttcccagcggcaacaaatg

SEQ ID NO: 98727 - DNA, 25 bp, Homo sapien
cgagactcgttttaggatactcttt

SEQ ID NO: 98728 - DNA, 25 bp, Homo sapien
ttgggtctgaatttcgagactcgtt

SEQ ID NO: 98729 - DNA, 25 bp, Homo sapien
gctctggccgacaatgcaggtggcc

SEQ ID NO: 98730 - DNA, 25 bp, Homo sapien
ggccgtccccgagttgcagcgagca

SEQ ID NO: 98731 - DNA, 25 bp, Homo sapien
cgtgctcccggctccaacctccggc

SEQ ID NO: 98732 - DNA, 25 bp, Homo sapien
ggactgcgggcttcttaaggccgcc

SEQ ID NO: 98733 - DNA, 25 bp, Homo sapien
actgcgggcttcttaaggccgccgc

SEQ ID NO: 98734 - DNA, 25 bp, Homo sapien
gccgtagggactgagggagtcgtaa

SEQ ID NO: 98735 - DNA, 25 bp, Homo sapien
ccgggatgcccgatccgagtcgcgc

SEQ ID NO: 98736 - DNA, 25 bp, Homo sapien
tcgtaagtcgatgagctagtggggc

SEQ ID NO: 98737 - DNA, 25 bp, Homo sapien
gtggcggtgacacaatgcgagtgag

SEQ ID NO: 98738 - DNA, 25 bp, Homo sapien
gctagacgcactatcttctcctcta

SEQ ID NO: 98739 - DNA, 25 bp, Homo sapien
ggccacataggctagacgcactatc

SEQ ID NO: 98740 - DNA, 25 bp, Homo sapien
tatcttcaggagacagagctcctgg

SEQ ID NO: 98741 - DNA, 25 bp, Homo sapien
ccagccaggcaagcgcggccacata

SEQ ID NO: 98742 - DNA, 25 bp, Homo sapien
ccacataggcaagcgcggccacata

SEQ ID NO: 98743 - DNA, 25 bp, Homo sapien
cgcggccacataggctagacgcact

SEQ ID NO: 98744 - DNA, 25 bp, Homo sapien
cgcgggtatcttcaggagacagagc

SEQ ID NO: 98745 - DNA, 25 bp, Homo sapien
tgcccgacgtctgcagtcagcatcg

SEQ ID NO: 98746 - DNA, 25 bp, Homo sapien
cgcgcactctgctcagactttacaa

SEQ ID NO: 98747 - DNA, 25 bp, Homo sapien
cgacgccttacctttgccgaactgg

SEQ ID NO: 98748 - DNA, 25 bp, Homo sapien
gacggctaccgagcgcttcatgatc

SEQ ID NO: 98749 - DNA, 25 bp, Homo sapien
gacgttctctttcctcagcgctttg

SEQ ID NO: 98750 - DNA, 25 bp, Homo sapien
acaccgaggctgagcccgaccaaga

SEQ ID NO: 98751 - DNA, 25 bp, Homo sapien
tggtgactaaagagaggagcctttc

SEQ ID NO: 98752 - DNA, 25 bp, Homo sapien
ttcatgatcccgtctcccggacgtg

SEQ ID NO: 98753 - DNA, 25 bp, Homo sapien
ggcgggctctctccttttgttgttg

SEQ ID NO: 98754 - DNA, 25 bp, Homo sapien
ggctccagtgcctatcccgcagtgt

SEQ ID NO: 98755 - DNA, 25 bp, Homo sapien
tccagtgcctatcccgcagtgtgtc

SEQ ID NO: 98756 - DNA, 25 bp, Homo sapien
cctatcccgcagtgtgtcgggtgaa

SEQ ID NO: 98757 - DNA, 25 bp, Homo sapien
tcccgcagtgtgtcgggtgaagata

SEQ ID NO: 98758 - DNA, 25 bp, Homo sapien
cagtgtgtcgggtgaagatacccgc

SEQ ID NO: 98759 - DNA, 25 bp, Homo sapien
ggcggcccggtaacagccggagctg

SEQ ID NO: 98760 - DNA, 25 bp, Homo sapien
ggcagagtagagcgggcttcaacat

SEQ ID NO: 98761 - DNA, 25 bp, Homo sapien
gctcagaatttagtgaccgggcaac

SEQ ID NO: 98762 - DNA, 25 bp, Homo sapien
gcccgtacgcagttgcatttccgga

SEQ ID NO: 98763 - DNA, 25 bp, Homo sapien
tgtcgtcacgattacgcggccagcc

SEQ ID NO: 98764 - DNA, 25 bp, Homo sapien
cgcatcagcgtcctggcgtaaaaca

SEQ ID NO: 98765 - DNA, 25 bp, Homo sapien
ggccacggctttgcatctgaatttg

SEQ ID NO: 98766 - DNA, 25 bp, Homo sapien
cctggcaaggtgctcgcttattttg

SEQ ID NO: 98767 - DNA, 25 bp, Homo sapien
gatggcgttgttcgtctttgtaccc

SEQ ID NO: 98768 - DNA, 25 bp, Homo sapien
gccgcttctgactactgttgtggta

SEQ ID NO: 98769 - DNA, 25 bp, Homo sapien
tttccagaaccatcagtgcgaagcg

SEQ ID NO: 98770 - DNA, 25 bp, Homo sapien
tgtggacagtgaattcggcttcgtt

SEQ ID NO: 98771 - DNA, 25 bp, Homo sapien
cagtgaattcggcttcgttacactg

SEQ ID NO: 98772 - DNA, 25 bp, Homo sapien
tgaattcggcttctttccacggcgg

SEQ ID NO: 98773 - DNA, 25 bp, Homo sapien
ctttccacggcggtcgctttgcttc

SEQ ID NO: 98774 - DNA, 25 bp, Homo sapien
cggtcgctttgcttcgtggctgttt

SEQ ID NO: 98775 - DNA, 25 bp, Homo sapien
gtggctgtttccagaaccatcagtg

SEQ ID NO: 98776 - DNA, 25 bp, Homo sapien
cttcgtggctgtttccagaaccatc

SEQ ID NO: 98777 - DNA, 25 bp, Homo sapien
caagattcattcgactaaagaaagc

SEQ ID NO: 98778 - DNA, 25 bp, Homo sapien
ggaggatcggtctgaatatgcatga

SEQ ID NO: 98779 - DNA, 25 bp, Homo sapien
gcctggtcggcgcaatatgcagcct

SEQ ID NO: 98780 - DNA, 25 bp, Homo sapien
ctgaatatgcatgaggcacccagca

SEQ ID NO: 98781 - DNA, 25 bp, Homo sapien
ttggagaacggaagagatgatttgc

SEQ ID NO: 98782 - DNA, 25 bp, Homo sapien
agatgatttgcatggcgcctggtga

SEQ ID NO: 98783 - DNA, 25 bp, Homo sapien
acggaggaaattacaagattcattc

SEQ ID NO: 98784 - DNA, 25 bp, Homo sapien
caatatgcagcctgtccgcaagggg

SEQ ID NO: 98785 - DNA, 25 bp, Homo sapien
cccacgccacgcagaggtgaagata

SEQ ID NO: 98786 - DNA, 25 bp, Homo sapien
ggtccttgagccgagagactctcaa

SEQ ID NO: 98787 - DNA, 25 bp, Homo sapien
cgagagactctcaaacagcgaaaga

SEQ ID NO: 98788 - DNA, 25 bp, Homo sapien
tcttccggctctgccggaagttgtg

SEQ ID NO: 98789 - DNA, 25 bp, Homo sapien
gtgaagatacgcaggacgtcctcta

SEQ ID NO: 98790 - DNA, 25 bp, Homo sapien
gcaggacgtcctctaaagcaacttc

SEQ ID NO: 98791 - DNA, 25 bp, Homo sapien
aaagcaacttccgtgggtgccaggt

SEQ ID NO: 98792 - DNA, 25 bp, Homo sapien
acagcgaaagagagggtcttccggc

SEQ ID NO: 98793 - DNA, 25 bp, Homo sapien
cggtgcttttatcgcgcagccgcag

SEQ ID NO: 98794 - DNA, 25 bp, Homo sapien
cttctcggaagcatctggctcggcc

SEQ ID NO: 98795 - DNA, 25 bp, Homo sapien
agctcggtcactttcagccgcttca

SEQ ID NO: 98796 - DNA, 25 bp, Homo sapien
acggagcccaaaacaacgcagcagg

SEQ ID NO: 98797 - DNA, 25 bp, Homo sapien
ccgcagtggagtccaagacgggcaa

SEQ ID NO: 98798 - DNA, 25 bp, Homo sapien
caaggctggctgcagctcaagtgcc

SEQ ID NO: 98799 - DNA, 25 bp, Homo sapien
cagctcaagtgcctcgtagcacgga

SEQ ID NO: 98800 - DNA, 25 bp, Homo sapien
ccgctgcgcagtgtttgcttctcct

SEQ ID NO: 98801 - DNA, 25 bp, Homo sapien
cgggcgaataagcttcattgttaca

SEQ ID NO: 98802 - DNA, 25 bp, Homo sapien
tcgcttggctgagctccagccgaag

SEQ ID NO: 98803 - DNA, 25 bp, Homo sapien
caaggaggtcttcataccgtggtgc

SEQ ID NO: 98804 - DNA, 25 bp, Homo sapien
taccgtggtgcctgcaaagcggact

SEQ ID NO: 98805 - DNA, 25 bp, Homo sapien
actgcacgcaaatccacgggtggta

SEQ ID NO: 98806 - DNA, 25 bp, Homo sapien
aaaagccttttgcaagagtgcgccc

SEQ ID NO: 98807 - DNA, 25 bp, Homo sapien
gccctctactggacgggcgaataag

SEQ ID NO: 98808 - DNA, 25 bp, Homo sapien
caggcctcgtagtgaggcacgattc

SEQ ID NO: 98809 - DNA, 25 bp, Homo sapien
agtccctgggctcgtgcctacgcaa

SEQ ID NO: 98810 - DNA, 25 bp, Homo sapien
ggctcgtgcctacgcaacagcagga

SEQ ID NO: 98811 - DNA, 25 bp, Homo sapien
cgtcacccgcagtaaggatcggggc

SEQ ID NO: 98812 - DNA, 25 bp, Homo sapien
gccagtttcggccctctttccaaga

SEQ ID NO: 98813 - DNA, 25 bp, Homo sapien
tttccaagacctctttccaaggcgc

SEQ ID NO: 98814 - DNA, 25 bp, Homo sapien
tttccaaggcgctctttcctagcct

SEQ ID NO: 98815 - DNA, 25 bp, Homo sapien
ttcctagcctcacccgagggccgca

SEQ ID NO: 98816 - DNA, 25 bp, Homo sapien
ggaccagtgaccgtcacccgcagta

SEQ ID NO: 98817 - DNA, 25 bp, Homo sapien
ttcacaagctcaactcagggattcc

SEQ ID NO: 98818 - DNA, 25 bp, Homo sapien
cgacgtccaggcgtgactaaacctc

SEQ ID NO: 98819 - DNA, 25 bp, Homo sapien
gggattcccaagcaaccgcagaccg

SEQ ID NO: 98820 - DNA, 25 bp, Homo sapien
ccgagaggctggcaaataataattt

SEQ ID NO: 98821 - DNA, 25 bp, Homo sapien
tccatcagctagaggagcccgtctc

SEQ ID NO: 98822 - DNA, 25 bp, Homo sapien
cgtctcccgggaaacaccaatcaga

SEQ ID NO: 98823 - DNA, 25 bp, Homo sapien
agatctccagaatgcgctatgcccg

SEQ ID NO: 98824 - DNA, 25 bp, Homo sapien
cgggaacttgagctagcgcaaactt

SEQ ID NO: 98825 - DNA, 25 bp, Homo sapien
gccgcagcacacaaacaggcttctt

SEQ ID NO: 98826 - DNA, 25 bp, Homo sapien
acgatactcacttgatctccctgcg

SEQ ID NO: 98827 - DNA, 25 bp, Homo sapien
ccaaatccagctgggcaggaaccga

SEQ ID NO: 98828 - DNA, 25 bp, Homo sapien
gggccgccacgatactcacttgatc

SEQ ID NO: 98829 - DNA, 25 bp, Homo sapien
aaagtcacagcacggccgcagcaca

SEQ ID NO: 98830 - DNA, 25 bp, Homo sapien
ctgagggccgccacgatactcactt

SEQ ID NO: 98831 - DNA, 25 bp, Homo sapien
agcacacaaacaggcttctttcggc

SEQ ID NO: 98832 - DNA, 25 bp, Homo sapien
gccggctgaaagacaagatccaaag

SEQ ID NO: 98833 - DNA, 25 bp, Homo sapien
ggcgatttacctctccctacaggga

SEQ ID NO: 98834 - DNA, 25 bp, Homo sapien
aggccgaggaccatttcttagctgc

SEQ ID NO: 98835 - DNA, 25 bp, Homo sapien
ctgaggccgctgagtttcaagtgca

SEQ ID NO: 98836 - DNA, 25 bp, Homo sapien
gcggctacagaatggctcacacttc

SEQ ID NO: 98837 - DNA, 25 bp, Homo sapien
acgtggccatggaaagactgatctc

SEQ ID NO: 98838 - DNA, 25 bp, Homo sapien
gcgcgctcatgatcctgccgttaat

SEQ ID NO: 98839 - DNA, 25 bp, Homo sapien
cccgagcattggtctaaaacatctg

SEQ ID NO: 98840 - DNA, 25 bp, Homo sapien
ttcttgcctgctcgtagatctgccc

SEQ ID NO: 98841 - DNA, 25 bp, Homo sapien
gtaacccaaagcgtgtgaaccgtca

SEQ ID NO: 98842 - DNA, 25 bp, Homo sapien
gatctctctgtaatctccttttctg

SEQ ID NO: 98843 - DNA, 25 bp, Homo sapien
tgcgtgtacggctgagcatgcatgt

SEQ ID NO: 98844 - DNA, 25 bp, Homo sapien
ggaacacagagaggtacacctctta

SEQ ID NO: 98845 - DNA, 25 bp, Homo sapien
cccttattggcgcatggtagtaacc

SEQ ID NO: 98846 - DNA, 25 bp, Homo sapien
gcatgcatgtgtgtacagatgcgtg

SEQ ID NO: 98847 - DNA, 25 bp, Homo sapien
cgcgcgctatgtgacaaggaacaca

SEQ ID NO: 98848 - DNA, 25 bp, Homo sapien
tgaaccgtcaccgtcgctgccgtgt

SEQ ID NO: 98849 - DNA, 25 bp, Homo sapien
ctgcggactgctctaggactcgtcc

SEQ ID NO: 98850 - DNA, 25 bp, Homo sapien
gcgacacctactggccgcatgggta

SEQ ID NO: 98851 - DNA, 25 bp, Homo sapien
gccgcccatggcacgtgaagagaaa

SEQ ID NO: 98852 - DNA, 25 bp, Homo sapien
aaggtacttccttaggccggcagtg

SEQ ID NO: 98853 - DNA, 25 bp, Homo sapien
ccggcaggggaacagcgacacctac

SEQ ID NO: 98854 - DNA, 25 bp, Homo sapien
cgcgggaaacttcaccgaaggctct

SEQ ID NO: 98855 - DNA, 25 bp, Homo sapien
caccgaaggctctgcggactgctct

SEQ ID NO: 98856 - DNA, 25 bp, Homo sapien
agctccggtgggtctgcgaacctgc

SEQ ID NO: 98857 - DNA, 25 bp, Homo sapien
ctcagctcggacaagcgtcgctgtc

SEQ ID NO: 98858 - DNA, 25 bp, Homo sapien
cgagctcgaaccacggagggctctc

SEQ ID NO: 98859 - DNA, 25 bp, Homo sapien
tgggcttctaccctagcagaccgag

SEQ ID NO: 98860 - DNA, 25 bp, Homo sapien
catctcagacaagcgccggaggctc

SEQ ID NO: 98861 - DNA, 25 bp, Homo sapien
cggtcatccacttctgcatctcaga

SEQ ID NO: 98862 - DNA, 25 bp, Homo sapien
ctttgattttatgcccgggagcccg

SEQ ID NO: 98863 - DNA, 25 bp, Homo sapien
cgtcgctgtctaagagctccaagct

SEQ ID NO: 98864 - DNA, 25 bp, Homo sapien
cgtacaaaagctagcgccgcgggac

SEQ ID NO: 98865 - DNA, 25 bp, Homo sapien
gcaccacgttattttcggcaacttg

SEQ ID NO: 98866 - DNA, 25 bp, Homo sapien
cagtttcctgagacacgtaagtgca

SEQ ID NO: 98867 - DNA, 25 bp, Homo sapien
gggccgcagtttcctgagacacgta

SEQ ID NO: 98868 - DNA, 25 bp, Homo sapien
agcagcacttcctccgggagctgga

SEQ ID NO: 98869 - DNA, 25 bp, Homo sapien
ttggagaagctccacgacttccacc

SEQ ID NO: 98870 - DNA, 25 bp, Homo sapien
ttttcggcaacttggagaagctcca

SEQ ID NO: 98871 - DNA, 25 bp, Homo sapien
cgagggaagcaccacgttattttcg

SEQ ID NO: 98872 - DNA, 25 bp, Homo sapien
gacacgtaagtgcaggccatggcgt

SEQ ID NO: 98873 - DNA, 25 bp, Homo sapien
ttccgatgactgctcgtctgtgatc

SEQ ID NO: 98874 - DNA, 25 bp, Homo sapien
cgggtgattccgatgactgctcgtc

SEQ ID NO: 98875 - DNA, 25 bp, Homo sapien
ctcgtctgtgatcgggtgagtccga

SEQ ID NO: 98876 - DNA, 25 bp, Homo sapien
gtgagtccgatgactgctcgtctgt

SEQ ID NO: 98877 - DNA, 25 bp, Homo sapien
ctcgtctgtgatcgggtgattccga

SEQ ID NO: 98878 - DNA, 25 bp, Homo sapien
tgaccgctcgtctgtgatcgggtga

SEQ ID NO: 98879 - DNA, 25 bp, Homo sapien
ggtgagtccgatgactgctcgtctg

SEQ ID NO: 98880 - DNA, 25 bp, Homo sapien
tgagtccgatgactgctcgtctgtg

SEQ ID NO: 98881 - DNA, 25 bp, Homo sapien
atgcgcttggctcttttctcgaggc

SEQ ID NO: 98882 - DNA, 25 bp, Homo sapien
ttatcgggtgattccggtggccact

SEQ ID NO: 98883 - DNA, 25 bp, Homo sapien
ggccgtgcttgtctgaggccaacca

SEQ ID NO: 98884 - DNA, 25 bp, Homo sapien
gccttttcaacacaagggctttgga

SEQ ID NO: 98885 - DNA, 25 bp, Homo sapien
agccaccctgtttggtgaccactcg

SEQ ID NO: 98886 - DNA, 25 bp, Homo sapien
acgcagcctgtgaccaggagacgca

SEQ ID NO: 98887 - DNA, 25 bp, Homo sapien
cctctggagtcatgttcgttctgcg

SEQ ID NO: 98888 - DNA, 25 bp, Homo sapien
tgcttgtctgtgattgggcgattcc

SEQ ID NO: 98889 - DNA, 25 bp, Homo sapien
gcgtccaacggctccacgaagtaga

SEQ ID NO: 98890 - DNA, 25 bp, Homo sapien
cttctacctaatccagcaggcagga

SEQ ID NO: 98891 - DNA, 25 bp, Homo sapien
gattgggtgacgctcctgtcctcaa

SEQ ID NO: 98892 - DNA, 25 bp, Homo sapien
tcgccgccatcgcttttgcagtcag

SEQ ID NO: 98893 - DNA, 25 bp, Homo sapien
gtctacaattgggtgctcgccgcca

SEQ ID NO: 98894 - DNA, 25 bp, Homo sapien
ggattggtccgctctccactaacca

SEQ ID NO: 98895 - DNA, 25 bp, Homo sapien
agatctttttcgctcccaggccttg

SEQ ID NO: 98896 - DNA, 25 bp, Homo sapien
actagcggagaaagctgatacctca

SEQ ID NO: 98897 - DNA, 25 bp, Homo sapien
cctgaaggcggacaatggctttatt

SEQ ID NO: 98898 - DNA, 25 bp, Homo sapien
ggatccctctctagtgaaggcccga

SEQ ID NO: 98899 - DNA, 25 bp, Homo sapien
gtggttaacacgctggatccctctc

SEQ ID NO: 98900 - DNA, 25 bp, Homo sapien
gggcgcggcaggctaattttgccta

SEQ ID NO: 98901 - DNA, 25 bp, Homo sapien
cctaacacgtggacgcggcccataa

SEQ ID NO: 98902 - DNA, 25 bp, Homo sapien
cctgggtgctattgatgcggacctt

SEQ ID NO: 98903 - DNA, 25 bp, Homo sapien
ccgtcaccagcggaggactcatctg

SEQ ID NO: 98904 - DNA, 25 bp, Homo sapien
cctacggctgaacagttggggcaaa

SEQ ID NO: 98905 - DNA, 25 bp, Homo sapien
ccaggatgtctgcagcactcgattc

SEQ ID NO: 98906 - DNA, 25 bp, Homo sapien
tctgaccaataggagcgcgacccta

SEQ ID NO: 98907 - DNA, 25 bp, Homo sapien
ttcaccctgagaggttggagcgcta

SEQ ID NO: 98908 - DNA, 25 bp, Homo sapien
tgcacgcccagaagtcgcggttttc

SEQ ID NO: 98909 - DNA, 25 bp, Homo sapien
gtcgggatctttcctctgaccaata

SEQ ID NO: 98910 - DNA, 25 bp, Homo sapien
gcgaccctaatagttgctcttgtga

SEQ ID NO: 98911 - DNA, 25 bp, Homo sapien
tggacacgcgttagccacttctctc

SEQ ID NO: 98912 - DNA, 25 bp, Homo sapien
cgcgtaaaaaccacggtccaggatg

SEQ ID NO: 98913 - DNA, 25 bp, Homo sapien
gggtgtgccgacttgtatttagttg

SEQ ID NO: 98914 - DNA, 25 bp, Homo sapien
ttccttggagtgtttctagagctcg

SEQ ID NO: 98915 - DNA, 25 bp, Homo sapien
tgtgccgacttgtatttagttgggg

SEQ ID NO: 98916 - DNA, 25 bp, Homo sapien
ttgttggtaaagagggtgcgtgatg

SEQ ID NO: 98917 - DNA, 25 bp, Homo sapien
acgtgcgtgcgccacgggcgagcag

SEQ ID NO: 98918 - DNA, 25 bp, Homo sapien
ccttggagtgtttctagagctcgga

SEQ ID NO: 98919 - DNA, 25 bp, Homo sapien
agtgtttctagagctcggaggctgc

SEQ ID NO: 98920 - DNA, 25 bp, Homo sapien
tgtttctagagctcggaggctgctg

SEQ ID NO: 98921 - DNA, 25 bp, Homo sapien
accgacctcagagctaaactcatta

SEQ ID NO: 98922 - DNA, 25 bp, Homo sapien
tccttattaccgacctcagagctaa

SEQ ID NO: 98923 - DNA, 25 bp, Homo sapien
gctaaactcattatctcttcgcaca

SEQ ID NO: 98924 - DNA, 25 bp, Homo sapien
tcttcgcacagagacgttcctctca

SEQ ID NO: 98925 - DNA, 25 bp, Homo sapien
gacgttcctctcaagaacgatttta

SEQ ID NO: 98926 - DNA, 25 bp, Homo sapien
aaggcagcaagacgcccacagccgt

SEQ ID NO: 98927 - DNA, 25 bp, Homo sapien
cacagccgttcaacagacacgaacg

SEQ ID NO: 98928 - DNA, 25 bp, Homo sapien
tcaacagacacgaacgacctcagcg

SEQ ID NO: 98929 - DNA, 25 bp, Homo sapien
gcctccgatccctgtgtggctgttt

SEQ ID NO: 98930 - DNA, 25 bp, Homo sapien
cggattggctcgatgcgtttttccc

SEQ ID NO: 98931 - DNA, 25 bp, Homo sapien
tgtgttcctctctcgtaaagccgtg

SEQ ID NO: 98932 - DNA, 25 bp, Homo sapien
tctgtgggccgccattcagaaactg

SEQ ID NO: 98933 - DNA, 25 bp, Homo sapien
tgggccgccattcagaaactggatg

SEQ ID NO: 98934 - DNA, 25 bp, Homo sapien
cagaaactggatggacagcttcggc

SEQ ID NO: 98935 - DNA, 25 bp, Homo sapien
gctctcgcccttcggattggctcga

SEQ ID NO: 98936 - DNA, 25 bp, Homo sapien
ctctctcgtaaagccgtgcggtctg

SEQ ID NO: 98937 - DNA, 25 bp, Homo sapien
gcagccgcaccacgagagagcttta

SEQ ID NO: 98938 - DNA, 25 bp, Homo sapien
gccaggtcacggtctcaaagttgtc

SEQ ID NO: 98939 - DNA, 25 bp, Homo sapien
tctttggcctctcggtcctgcaaga

SEQ ID NO: 98940 - DNA, 25 bp, Homo sapien
ggcctgtatcgatcaccacgtcctg

SEQ ID NO: 98941 - DNA, 25 bp, Homo sapien
agccgcgcaccagccagatgttggc

SEQ ID NO: 98942 - DNA, 25 bp, Homo sapien
tgcccgactcgtagaaacgttcttg

SEQ ID NO: 98943 - DNA, 25 bp, Homo sapien
gagctttaacgcaggggccactgca

SEQ ID NO: 98944 - DNA, 25 bp, Homo sapien
agataccatcgcctagagacttgtg

SEQ ID NO: 98945 - DNA, 25 bp, Homo sapien
ccacactgcgctggcagagactgtc

SEQ ID NO: 98946 - DNA, 25 bp, Homo sapien
ctgagatgcgtcatcgcgtcaagtg

SEQ ID NO: 98947 - DNA, 25 bp, Homo sapien
tctgcgagaagatggccaaaaggtc

SEQ ID NO: 98948 - DNA, 25 bp, Homo sapien
gccgagcctctgctttgggctgacc

SEQ ID NO: 98949 - DNA, 25 bp, Homo sapien
gccacgtccgcaaacctgagatgcg

SEQ ID NO: 98950 - DNA, 25 bp, Homo sapien
ggggagtccaaccacaggtccacgc

SEQ ID NO: 98951 - DNA, 25 bp, Homo sapien
gacctactggctgcgtctttgtcca

SEQ ID NO: 98952 - DNA, 25 bp, Homo sapien
tggtggccaagtcagcggatccaac

SEQ ID NO: 98953 - DNA, 25 bp, Homo sapien
agaggcaagactcgcgcgctcctaa

SEQ ID NO: 98954 - DNA, 25 bp, Homo sapien
cgctcctaagccgaggcaggtcagc

SEQ ID NO: 98955 - DNA, 25 bp, Homo sapien
gagccatgggtcctattggagcaga

SEQ ID NO: 98956 - DNA, 25 bp, Homo sapien
cctgatcctgtagtggtagtaagaa

SEQ ID NO: 98957 - DNA, 25 bp, Homo sapien
gcgcacttacattgggacgcccagg

SEQ ID NO: 98958 - DNA, 25 bp, Homo sapien
gtagtaagaatcagcagcgcgggca

SEQ ID NO: 98959 - DNA, 25 bp, Homo sapien
agctgcccgcgtcggttctgtccaa

SEQ ID NO: 98960 - DNA, 25 bp, Homo sapien
ttctgtccaaggctgcggttttgca

SEQ ID NO: 98961 - DNA, 25 bp, Homo sapien
cggtatctgcgaagtcctgcgagct

SEQ ID NO: 98962 - DNA, 25 bp, Homo sapien
gagtcagcagagatccgccgcttcc

SEQ ID NO: 98963 - DNA, 25 bp, Homo sapien
ctgagtcacgctcggcgctacgtgc

SEQ ID NO: 98964 - DNA, 25 bp, Homo sapien
gtcggatgagtcagcgctgagtcac

SEQ ID NO: 98965 - DNA, 25 bp, Homo sapien
atctgcgaagtcctgcgagctcccg

SEQ ID NO: 98966 - DNA, 25 bp, Homo sapien
tgcagtcacacactcgcccgcacgc

SEQ ID NO: 98967 - DNA, 25 bp, Homo sapien
tccactggcagcgagtcggatgagt

SEQ ID NO: 98968 - DNA, 25 bp, Homo sapien
gaagaccctccctgcgcctgaggga

SEQ ID NO: 98969 - DNA, 25 bp, Homo sapien
tgaagtcgtttcctttcgatggccc

SEQ ID NO: 98970 - DNA, 25 bp, Homo sapien
ttgtgccagctcagcagtctcattg

SEQ ID NO: 98971 - DNA, 25 bp, Homo sapien
gtgccgggctgtcaatcaagaacta

SEQ ID NO: 98972 - DNA, 25 bp, Homo sapien
atacatacggcatacgtcgcgcggc

SEQ ID NO: 98973 - DNA, 25 bp, Homo sapien
ttccatctggctcgggccactctga

SEQ ID NO: 98974 - DNA, 25 bp, Homo sapien
ctcccactcggaagatagctaacgg

SEQ ID NO: 98975 - DNA, 25 bp, Homo sapien
tgctaaagttgggtccatggccatc

SEQ ID NO: 98976 - DNA, 25 bp, Homo sapien
ggagcgtctgccctctactcagtta

SEQ ID NO: 98977 - DNA, 25 bp, Homo sapien
gaggcccaatcagacccgcggagct

SEQ ID NO: 98978 - DNA, 25 bp, Homo sapien
ctcaacacggtgaagcagaagctct

SEQ ID NO: 98979 - DNA, 25 bp, Homo sapien
gcagatctccctagagcacgaaatc

SEQ ID NO: 98980 - DNA, 25 bp, Homo sapien
cttgtcgtccaataacctgccagcg

SEQ ID NO: 98981 - DNA, 25 bp, Homo sapien
tgttctaccatgtgagcagggctca

SEQ ID NO: 98982 - DNA, 25 bp, Homo sapien
gcctacctggtctgggaagatgttc

SEQ ID NO: 98983 - DNA, 25 bp, Homo sapien
gcgtctaagtgtttccggtggattc

SEQ ID NO: 98984 - DNA, 25 bp, Homo sapien
accgccagatcgttcgatgcgcaca

SEQ ID NO: 98985 - DNA, 25 bp, Homo sapien
agcgctccttgtgggagcccgtgaa

SEQ ID NO: 98986 - DNA, 25 bp, Homo sapien
accttctggtcgtaggtgcctgcgt

SEQ ID NO: 98987 - DNA, 25 bp, Homo sapien
ttgccagaggggtcgaagcgctcct

SEQ ID NO: 98988 - DNA, 25 bp, Homo sapien
acatagcctgactcgtccaccagat

SEQ ID NO: 98989 - DNA, 25 bp, Homo sapien
tagccggacacatagcctgactcgt

SEQ ID NO: 98990 - DNA, 25 bp, Homo sapien
cctgcgtgcttgtagccggacacat

SEQ ID NO: 98991 - DNA, 25 bp, Homo sapien
agcccgtgaacttggtggtgtccgt

SEQ ID NO: 98992 - DNA, 25 bp, Homo sapien
gtgtccgtgagcctcgacactgtgg

SEQ ID NO: 98993 - DNA, 25 bp, Homo sapien
tggtctaaatacagccacgtgctcg

SEQ ID NO: 98994 - DNA, 25 bp, Homo sapien
ccgccctcctatgcaagagcgtttg

SEQ ID NO: 98995 - DNA, 25 bp, Homo sapien
tagggacaccacagctcacatctgg

SEQ ID NO: 98996 - DNA, 25 bp, Homo sapien
ctaagttcggtacctgcgacgagta

SEQ ID NO: 98997 - DNA, 25 bp, Homo sapien
gccggccacttgatgatgtcgctca

SEQ ID NO: 98998 - DNA, 25 bp, Homo sapien
tcgctcaaactagatacggggtctc

SEQ ID NO: 98999 - DNA, 25 bp, Homo sapien
acatggagactgacacactttgcga

SEQ ID NO: 99000 - DNA, 25 bp, Homo sapien
cctgaggttgtccaagcagcggaac

SEQ ID NO: 99001 - DNA, 25 bp, Homo sapien
cattatgttacttgcctggtgaggc

SEQ ID NO: 99002 - DNA, 25 bp, Homo sapien
ccatcgatcgcgttacattagggga

SEQ ID NO: 99003 - DNA, 25 bp, Homo sapien
ttaactgaccagaagacgggagcgc

SEQ ID NO: 99004 - DNA, 25 bp, Homo sapien
agcggctcgatgtcccttttaatcc

SEQ ID NO: 99005 - DNA, 25 bp, Homo sapien
tcgactccctgcctctgactgtatg

SEQ ID NO: 99006 - DNA, 25 bp, Homo sapien
cgagtctcgtttctggtgcccacga

SEQ ID NO: 99007 - DNA, 25 bp, Homo sapien
ccaagctcgccaggttcaggccgta

SEQ ID NO: 99008 - DNA, 25 bp, Homo sapien
ttttgaatgtggattgctgctcgcc

SEQ ID NO: 99009 - DNA, 25 bp, Homo sapien
atggcaatggtagttagcagctggc

SEQ ID NO: 99010 - DNA, 25 bp, Homo sapien
aaaagcgagagaagggagcttgctc

SEQ ID NO: 99011 - DNA, 25 bp, Homo sapien
tctgattttgcaacttggggaagaa

SEQ ID NO: 99012 - DNA, 25 bp, Homo sapien
catttctgattttgcaacttgggga

SEQ ID NO: 99013 - DNA, 25 bp, Homo sapien
gctgccgcctgtgccatttctgatt

SEQ ID NO: 99014 - DNA, 25 bp, Homo sapien
gccggcttcctctatgtcggctcag

SEQ ID NO: 99015 - DNA, 25 bp, Homo sapien
gtagttagcagctggcgagatccgc

SEQ ID NO: 99016 - DNA, 25 bp, Homo sapien
cagctggcgagatccgcaggacgac

SEQ ID NO: 99017 - DNA, 25 bp, Homo sapien
caacattatgggcatcgagaacatc

SEQ ID NO: 99018 - DNA, 25 bp, Homo sapien
ggatctgcagatcaccgaccaggtg

SEQ ID NO: 99019 - DNA, 25 bp, Homo sapien
tgtccggctacatctcgctgctgct

SEQ ID NO: 99020 - DNA, 25 bp, Homo sapien
gccagtacgcactcaccaacgggga

SEQ ID NO: 99021 - DNA, 25 bp, Homo sapien
ctttctttttgtcagcggttcagcg

SEQ ID NO: 99022 - DNA, 25 bp, Homo sapien
gctccctggatgcacattgcctctt

SEQ ID NO: 99023 - DNA, 25 bp, Homo sapien
cggcaatgttcgcaagctccctgga

SEQ ID NO: 99024 - DNA, 25 bp, Homo sapien
gtacagctgcctcaaagccatcgtg

SEQ ID NO: 99025 - DNA, 25 bp, Homo sapien
agctcttcttcgtccgtttggtagg

SEQ ID NO: 99026 - DNA, 25 bp, Homo sapien
ttttggcaaactgctgctgcgactg

SEQ ID NO: 99027 - DNA, 25 bp, Homo sapien
cggatgcggcccacatcgagagcct

SEQ ID NO: 99028 - DNA, 25 bp, Homo sapien
cctgtggcctgtcggatgcggccca

SEQ ID NO: 99029 - DNA, 25 bp, Homo sapien
tgcaggagaagtcgcagtgcgcact

SEQ ID NO: 99030 - DNA, 25 bp, Homo sapien
gagcagctcttcttcgtccgtttgg

SEQ ID NO: 99031 - DNA, 25 bp, Homo sapien
cagcccagccgttttggcaaactgc

SEQ ID NO: 99032 - DNA, 25 bp, Homo sapien
gtgtcctcctccgtcatcgagcagc

SEQ ID NO: 99033 - DNA, 25 bp, Homo sapien
taccgcatgtgggaacttgctgagc

SEQ ID NO: 99034 - DNA, 25 bp, Homo sapien
gtcgcgcgcccggtaagtctccagg

SEQ ID NO: 99035 - DNA, 25 bp, Homo sapien
cggcaaccggggctttaccgcatgt

SEQ ID NO: 99036 - DNA, 25 bp, Homo sapien
agctggagaagctacagagggacat

SEQ ID NO: 99037 - DNA, 25 bp, Homo sapien
tgggccgttcagacgccactgagcc

SEQ ID NO: 99038 - DNA, 25 bp, Homo sapien
gcttcagtgtctggcggcggcaacc

SEQ ID NO: 99039 - DNA, 25 bp, Homo sapien
cttggtcgctgacttcagccgttga

SEQ ID NO: 99040 - DNA, 25 bp, Homo sapien
cttcagccgttgagacctggtgggc

SEQ ID NO: 99041 - DNA, 25 bp, Homo sapien
cccgatcgtcttccgggcgcatcca

SEQ ID NO: 99042 - DNA, 25 bp, Homo sapien
cacttggaagaaactgtgtgtgcgc

SEQ ID NO: 99043 - DNA, 25 bp, Homo sapien
gctcttacttgaaaaagcacttgga

SEQ ID NO: 99044 - DNA, 25 bp, Homo sapien
catctctccggctcttacttgaaaa

SEQ ID NO: 99045 - DNA, 25 bp, Homo sapien
agaagtacttgtctggctccgcgct

SEQ ID NO: 99046 - DNA, 25 bp, Homo sapien
ctccgccgggatgagaagtacttgt

SEQ ID NO: 99047 - DNA, 25 bp, Homo sapien
gccgtggggcttcttgacatagaac

SEQ ID NO: 99048 - DNA, 25 bp, Homo sapien
ttgacatagaacgtccgggcctcgg

SEQ ID NO: 99049 - DNA, 25 bp, Homo sapien
tccttcagggcaattagagcttcgc

SEQ ID NO: 99050 - DNA, 25 bp, Homo sapien
cagacttcgctatccgcggcgtcta

SEQ ID NO: 99051 - DNA, 25 bp, Homo sapien
gaccagtgaacccatattgctttga

SEQ ID NO: 99052 - DNA, 25 bp, Homo sapien
ggagtccgctcgacacaagcagtga

SEQ ID NO: 99053 - DNA, 25 bp, Homo sapien
tccaggaagttagctcgtgacggtc

SEQ ID NO: 99054 - DNA, 25 bp, Homo sapien
gcctctgaggcttcggtaaagaatt

SEQ ID NO: 99055 - DNA, 25 bp, Homo sapien
cggtcggtgcctgcaaagaacaaca

SEQ ID NO: 99056 - DNA, 25 bp, Homo sapien
atgtatatatcacgaccctgggctc

SEQ ID NO: 99057 - DNA, 25 bp, Homo sapien
tcattacgcacttgacggcagcggc

SEQ ID NO: 99058 - DNA, 25 bp, Homo sapien
tccggggtcttcaggagattgatac

SEQ ID NO: 99059 - DNA, 25 bp, Homo sapien
ccctcgtgcggttgttatgactttc

SEQ ID NO: 99060 - DNA, 25 bp, Homo sapien
gtggccttccagttcgccagtcgaa

SEQ ID NO: 99061 - DNA, 25 bp, Homo sapien
gcaaacggcagtcctacctgagctc

SEQ ID NO: 99062 - DNA, 25 bp, Homo sapien
tggaaatggaacatgggacctgccc

SEQ ID NO: 99063 - DNA, 25 bp, Homo sapien
cgctcccgcctagagagtggaaatg

SEQ ID NO: 99064 - DNA, 25 bp, Homo sapien
cccgaccaagttcgagttgcacttc

SEQ ID NO: 99065 - DNA, 25 bp, Homo sapien
tcctctccagcgtgactagtggctg

SEQ ID NO: 99066 - DNA, 25 bp, Homo sapien
agcgggagactttggtcacagtcta

SEQ ID NO: 99067 - DNA, 25 bp, Homo sapien
tataatagggaaactccctccgtgc

SEQ ID NO: 99068 - DNA, 25 bp, Homo sapien
ttcgtgtacggtcatataataggga

SEQ ID NO: 99069 - DNA, 25 bp, Homo sapien
gccgactgcttactcaccagtcttg

SEQ ID NO: 99070 - DNA, 25 bp, Homo sapien
tggctgaccacgtgacccaagttca

SEQ ID NO: 99071 - DNA, 25 bp, Homo sapien
ttactcaccagtcttggagcccgca

SEQ ID NO: 99072 - DNA, 25 bp, Homo sapien
cacagtctagatttcgtgtacggtc

SEQ ID NO: 99073 - DNA, 25 bp, Homo sapien
tgacccgaggtcgagttccaagtcg

SEQ ID NO: 99074 - DNA, 25 bp, Homo sapien
ccgagtcacggtacacggtgtcttc

SEQ ID NO: 99075 - DNA, 25 bp, Homo sapien
cgggctggccataatgctgcacaga

SEQ ID NO: 99076 - DNA, 25 bp, Homo sapien
gactcaagctctgcaccaggtatta

SEQ ID NO: 99077 - DNA, 25 bp, Homo sapien
cacccggaaatggtactatcgcttc

SEQ ID NO: 99078 - DNA, 25 bp, Homo sapien
ggctcagctaggaagacacagtgta

SEQ ID NO: 99079 - DNA, 25 bp, Homo sapien
cgaagtttctgcctcccggctgtga

SEQ ID NO: 99080 - DNA, 25 bp, Homo sapien
agcgtcactgacaaccacccggaaa

SEQ ID NO: 99081 - DNA, 25 bp, Homo sapien
cagggaagtaccgacaagcacacgg

SEQ ID NO: 99082 - DNA, 25 bp, Homo sapien
ggaagtaccgacaagcacacagaga

SEQ ID NO: 99083 - DNA, 25 bp, Homo sapien
gtaccgacaagcacacagagagggg

SEQ ID NO: 99084 - DNA, 25 bp, Homo sapien
cgccgtcagggaagtaccgacaagc

SEQ ID NO: 99085 - DNA, 25 bp, Homo sapien
aagtaccgacaagcacacagagagg

SEQ ID NO: 99086 - DNA, 25 bp, Homo sapien
ccgacaagcacacggagaggggtcc

SEQ ID NO: 99087 - DNA, 25 bp, Homo sapien
agtaccgacaagcacacagagaggg

SEQ ID NO: 99088 - DNA, 25 bp, Homo sapien
cgtcagggaagtaccgacaagcaca

SEQ ID NO: 99089 - DNA, 25 bp, Homo sapien
ggagaagactcggtccagcacttgc

SEQ ID NO: 99090 - DNA, 25 bp, Homo sapien
tgcctccaaattgggcgcgcacgcg

SEQ ID NO: 99091 - DNA, 25 bp, Homo sapien
ctcttctctctgaccgagctcggga

SEQ ID NO: 99092 - DNA, 25 bp, Homo sapien
tgcaaagtttttccctcgaagctcc

SEQ ID NO: 99093 - DNA, 25 bp, Homo sapien
tgggctggagccgtaaccgaatccc

SEQ ID NO: 99094 - DNA, 25 bp, Homo sapien
cagaaaccgggagtgcccagcgact

SEQ ID NO: 99095 - DNA, 25 bp, Homo sapien
cagctgcaggttcttccagagccgg

SEQ ID NO: 99096 - DNA, 25 bp, Homo sapien
ccagcacttgcttccgcttcttgaa

SEQ ID NO: 99097 - DNA, 25 bp, Homo sapien
cgggaatttctctgttgcgcatgtg

SEQ ID NO: 99098 - DNA, 25 bp, Homo sapien
cgtgagcgactccttcgtaagtacc

SEQ ID NO: 99099 - DNA, 25 bp, Homo sapien
tcaacttaagtgacagccgcgccgc

SEQ ID NO: 99100 - DNA, 25 bp, Homo sapien
ggatcccttgtgcaaaaccgacaga

SEQ ID NO: 99101 - DNA, 25 bp, Homo sapien
ctcttctacaaacgccgaggctgca

SEQ ID NO: 99102 - DNA, 25 bp, Homo sapien
ttcccaggactcattcacgtgactg

SEQ ID NO: 99103 - DNA, 25 bp, Homo sapien
agctcggcgttactatcaagcaacc

SEQ ID NO: 99104 - DNA, 25 bp, Homo sapien
cgctctccgcctgataggagttgta

SEQ ID NO: 99105 - DNA, 25 bp, Homo sapien
ctgaagatgagcctgctgctggcgc

SEQ ID NO: 99106 - DNA, 25 bp, Homo sapien
tctacgcgttctacgaggccgtcgc

SEQ ID NO: 99107 - DNA, 25 bp, Homo sapien
acctactctccgtctggtggcggca

SEQ ID NO: 99108 - DNA, 25 bp, Homo sapien
tggcaggcaacaccacagtgctgtg

SEQ ID NO: 99109 - DNA, 25 bp, Homo sapien
tccgggacaaggatggaggatctct

SEQ ID NO: 99110 - DNA, 25 bp, Homo sapien
caacatttccgtgcccatcttgctg

SEQ ID NO: 99111 - DNA, 25 bp, Homo sapien
gtctcaacctgaccttggggcaagg

SEQ ID NO: 99112 - DNA, 25 bp, Homo sapien
gctggcacctgcaggtctacgcgtt

SEQ ID NO: 99113 - DNA, 25 bp, Homo sapien
aaccagggtcatctgccggcaatgc

SEQ ID NO: 99114 - DNA, 25 bp, Homo sapien
tggactcctcattccggctgtggcc

SEQ ID NO: 99115 - DNA, 25 bp, Homo sapien
ccagagatctctatcaaccagggtc

SEQ ID NO: 99116 - DNA, 25 bp, Homo sapien
tgccggcaatgccatagaggcggtc

SEQ ID NO: 99117 - DNA, 25 bp, Homo sapien
aggcgccgcgcacgtctggagctct

SEQ ID NO: 99118 - DNA, 25 bp, Homo sapien
tctggctcgtgcagtagcgtcacgc

SEQ ID NO: 99119 - DNA, 25 bp, Homo sapien
gactcggggacagtaagttctgttc

SEQ ID NO: 99120 - DNA, 25 bp, Homo sapien
gcgctgttggccagagatctctatc

SEQ ID NO: 99121 - DNA, 25 bp, Homo sapien
tcaccgagtatcaggccagtgcgtt

SEQ ID NO: 99122 - DNA, 25 bp, Homo sapien
gcactccctgagtagcggcagctta

SEQ ID NO: 99123 - DNA, 25 bp, Homo sapien
tgagccgctgcttttctccgagtcg

SEQ ID NO: 99124 - DNA, 25 bp, Homo sapien
cgccctgcccttggatttgagatca

SEQ ID NO: 99125 - DNA, 25 bp, Homo sapien
ttgagatcatgtacgtacgcgccgc

SEQ ID NO: 99126 - DNA, 25 bp, Homo sapien
ccgcacttcctgttccgaggagaga

SEQ ID NO: 99127 - DNA, 25 bp, Homo sapien
tccgtgcaggtccatccacatcgtg

SEQ ID NO: 99128 - DNA, 25 bp, Homo sapien
gggcttatccgcacttacctgggga

SEQ ID NO: 99129 - DNA, 25 bp, Homo sapien
caagttcgccatgtcccactgctgc

SEQ ID NO: 99130 - DNA, 25 bp, Homo sapien
gagcagagctgtgaggagccgccag

SEQ ID NO: 99131 - DNA, 25 bp, Homo sapien
gtttcggaggtggatactctcgtca

SEQ ID NO: 99132 - DNA, 25 bp, Homo sapien
ggatactctcgtcagccggttgcta

SEQ ID NO: 99133 - DNA, 25 bp, Homo sapien
tcagccggttgctaccgtaggcgaa

SEQ ID NO: 99134 - DNA, 25 bp, Homo sapien
cggttgctaccgtaggcgaagtaca

SEQ ID NO: 99135 - DNA, 25 bp, Homo sapien
atccgggcccgggacgtccctgcag

SEQ ID NO: 99136 - DNA, 25 bp, Homo sapien
cctgcagcccaagttcgccatgtcc

SEQ ID NO: 99137 - DNA, 25 bp, Homo sapien
agcgctaagtgtgcgtgagtcctca

SEQ ID NO: 99138 - DNA, 25 bp, Homo sapien
tctctctccagaacccgatgtcttg

SEQ ID NO: 99139 - DNA, 25 bp, Homo sapien
gagggtagcgtggtcatctcacttc

SEQ ID NO: 99140 - DNA, 25 bp, Homo sapien
tgcctatgtaactggaaaacgcggg

SEQ ID NO: 99141 - DNA, 25 bp, Homo sapien
tctgaggatccaccgtgcctatgta

SEQ ID NO: 99142 - DNA, 25 bp, Homo sapien
ccatcccttcgagcacacagtgtgt

SEQ ID NO: 99143 - DNA, 25 bp, Homo sapien
tatctctatgagtacaccgtgtgcc

SEQ ID NO: 99144 - DNA, 25 bp, Homo sapien
tcacttctcttatcggggcctctct

SEQ ID NO: 99145 - DNA, 25 bp, Homo sapien
cggcgagcgctcagtgaagcgcttc

SEQ ID NO: 99146 - DNA, 25 bp, Homo sapien
gacgtcagatctacctggactaaga

SEQ ID NO: 99147 - DNA, 25 bp, Homo sapien
acgaaagccatctcttgacgtcaga

SEQ ID NO: 99148 - DNA, 25 bp, Homo sapien
tgagtgtttacacgtcaaatcgacg

SEQ ID NO: 99149 - DNA, 25 bp, Homo sapien
ctggactaagatccgaatggtattc

SEQ ID NO: 99150 - DNA, 25 bp, Homo sapien
cagccagaatggaaatgagtgttta

SEQ ID NO: 99151 - DNA, 25 bp, Homo sapien
gcccttcccagccagaatggaaatg

SEQ ID NO: 99152 - DNA, 25 bp, Homo sapien
tgaagcgcttcggtctccaggctga

SEQ ID NO: 99153 - DNA, 25 bp, Homo sapien
ggcacccgcgacgttttccagaaga

SEQ ID NO: 99154 - DNA, 25 bp, Homo sapien
ccggcctgtacctgaaatgcagcga

SEQ ID NO: 99155 - DNA, 25 bp, Homo sapien
ctactcgctgtacttgccgctctga

SEQ ID NO: 99156 - DNA, 25 bp, Homo sapien
ttcgtttcatcatagccgggcggca

SEQ ID NO: 99157 - DNA, 25 bp, Homo sapien
cagctgacggcaagcgccatagtca

SEQ ID NO: 99158 - DNA, 25 bp, Homo sapien
ctacgccttcttcggtgacagcttg

SEQ ID NO: 99159 - DNA, 25 bp, Homo sapien
tggccgacatctaccgggagctcta

SEQ ID NO: 99160 - DNA, 25 bp, Homo sapien
gcgctacgtgcagaaactgcccatg

SEQ ID NO: 99161 - DNA, 25 bp, Homo sapien
ttgttgccatggcattcgccagctg

SEQ ID NO: 99162 - DNA, 25 bp, Homo sapien
ggaaaagctgtttcatcgcccgctc

SEQ ID NO: 99163 - DNA, 25 bp, Homo sapien
cgcgtcaagaaaagttggctggtaa

SEQ ID NO: 99164 - DNA, 25 bp, Homo sapien
tttcactggacagcgggatgtagtc

SEQ ID NO: 99165 - DNA, 25 bp, Homo sapien
ggatgtagtcttccgcgctaaggcc

SEQ ID NO: 99166 - DNA, 25 bp, Homo sapien
gctgcctggagacgcagagcctctt

SEQ ID NO: 99167 - DNA, 25 bp, Homo sapien
taaccagcctcgagccaaattgggc

SEQ ID NO: 99168 - DNA, 25 bp, Homo sapien
ccagctggtggtacaagacggtaaa

SEQ ID NO: 99169 - DNA, 25 bp, Homo sapien
tttgcgaagtgcacccaccgtcgtt

SEQ ID NO: 99170 - DNA, 25 bp, Homo sapien
cgggacgtgcgcttttcctactatc

SEQ ID NO: 99171 - DNA, 25 bp, Homo sapien
ccacgcagagtgagtactgtcttcc

SEQ ID NO: 99172 - DNA, 25 bp, Homo sapien
ccgagcccagctaggaatgcagacc

SEQ ID NO: 99173 - DNA, 25 bp, Homo sapien
cgtcgttgccttattctggtagtca

SEQ ID NO: 99174 - DNA, 25 bp, Homo sapien
ccgccgggaaatgtatctggtgacc

SEQ ID NO: 99175 - DNA, 25 bp, Homo sapien
taactgtgtttcttggcgactcctc

SEQ ID NO: 99176 - DNA, 25 bp, Homo sapien
gcgataccgtgcgttctgagtttaa

SEQ ID NO: 99177 - DNA, 25 bp, Homo sapien
cctggcagtccttgcacagcttcga

SEQ ID NO: 99178 - DNA, 25 bp, Homo sapien
taagtcaggtccctcggcccgtgag

SEQ ID NO: 99179 - DNA, 25 bp, Homo sapien
cttgatcttgctgaagacgatgtcc

SEQ ID NO: 99180 - DNA, 25 bp, Homo sapien
acggtcacgttcctgccgtcgatca

SEQ ID NO: 99181 - DNA, 25 bp, Homo sapien
agcttcgaccagttcttgccgtgca

SEQ ID NO: 99182 - DNA, 25 bp, Homo sapien
tccgattccagcgacagcctcttgg

SEQ ID NO: 99183 - DNA, 25 bp, Homo sapien
agcccagcgcactcacttgatcttg

SEQ ID NO: 99184 - DNA, 25 bp, Homo sapien
acgatgtccacgtcagtgacggtca

SEQ ID NO: 99185 - DNA, 25 bp, Homo sapien
cgagcgagggaagccgcaactccca

SEQ ID NO: 99186 - DNA, 25 bp, Homo sapien
ggaagtgcacgcctttctgaacgcg

SEQ ID NO: 99187 - DNA, 25 bp, Homo sapien
agacccgtgaagcaggcgcaccggc

SEQ ID NO: 99188 - DNA, 25 bp, Homo sapien
gcggactcgggcctagccagcgact

SEQ ID NO: 99189 - DNA, 25 bp, Homo sapien
tcgagcgcgctgtacctggggttct

SEQ ID NO: 99190 - DNA, 25 bp, Homo sapien
aattggtaaatgagcgctgcacgcc

SEQ ID NO: 99191 - DNA, 25 bp, Homo sapien
tcaggcgtaggaagtgcacgccttt

SEQ ID NO: 99192 - DNA, 25 bp, Homo sapien
ggaagccgcaactcccaggaaggga

SEQ ID NO: 99193 - DNA, 25 bp, Homo sapien
ggcgatgcgcataccgagaggataa

SEQ ID NO: 99194 - DNA, 25 bp, Homo sapien
ctgttgaaagcctcagagcgtgtga

SEQ ID NO: 99195 - DNA, 25 bp, Homo sapien
gcagcccgagccaagtcaatgcagg

SEQ ID NO: 99196 - DNA, 25 bp, Homo sapien
gataaggaagcggttcccgacgagc

SEQ ID NO: 99197 - DNA, 25 bp, Homo sapien
aaccgcaggtgttgatttaaggctc

SEQ ID NO: 99198 - DNA, 25 bp, Homo sapien
aaggctcggaacaggcgggccttct

SEQ ID NO: 99199 - DNA, 25 bp, Homo sapien
cgcttgccgcggcttgtttgtccct

SEQ ID NO: 99200 - DNA, 25 bp, Homo sapien
gcccgatttggcactggaaacaatg

SEQ ID NO: 99201 - DNA, 25 bp, Homo sapien
ctcgcctgtccacggagcagcaggg

SEQ ID NO: 99202 - DNA, 25 bp, Homo sapien
atgctcagtcagctgggccgcctca

SEQ ID NO: 99203 - DNA, 25 bp, Homo sapien
ttcaccaatggtgagtgggctgccg

SEQ ID NO: 99204 - DNA, 25 bp, Homo sapien
gccgcctcagctctcggagtaggaa

SEQ ID NO: 99205 - DNA, 25 bp, Homo sapien
aaatggagcccttcaccaatggtga

SEQ ID NO: 99206 - DNA, 25 bp, Homo sapien
ggtttgactgtgcttttccctcttg

SEQ ID NO: 99207 - DNA, 25 bp, Homo sapien
ccgcagccgggtccacttcaggtag

SEQ ID NO: 99208 - DNA, 25 bp, Homo sapien
tctttctgcagctgccacgaaaacc

SEQ ID NO: 99209 - DNA, 25 bp, Homo sapien
agggcgtggttaatggaactcatgc

SEQ ID NO: 99210 - DNA, 25 bp, Homo sapien
ggaactcatgcgcttgctcagtact

SEQ ID NO: 99211 - DNA, 25 bp, Homo sapien
gattttgatagttcgggctgaccta

SEQ ID NO: 99212 - DNA, 25 bp, Homo sapien
ggcggacgtccttacctccagagga

SEQ ID NO: 99213 - DNA, 25 bp, Homo sapien
cttgctcagtacttctcttaggttg

SEQ ID NO: 99214 - DNA, 25 bp, Homo sapien
ctcttaggttggtctaggaggcttc

SEQ ID NO: 99215 - DNA, 25 bp, Homo sapien
tgacctacgcgggtaggacttcgag

SEQ ID NO: 99216 - DNA, 25 bp, Homo sapien
ctaggaggcttcgaagtgcgcctgc

SEQ ID NO: 99217 - DNA, 25 bp, Homo sapien
ccggctagatcctagtttacgctca

SEQ ID NO: 99218 - DNA, 25 bp, Homo sapien
ggagggtctctgttcacctctattt

SEQ ID NO: 99219 - DNA, 25 bp, Homo sapien
gcggcttattttcccagctggcaag

SEQ ID NO: 99220 - DNA, 25 bp, Homo sapien
tccacctgtggggtataaatctgcc

SEQ ID NO: 99221 - DNA, 25 bp, Homo sapien
ccggagtgagaaagctctgacgctc

SEQ ID NO: 99222 - DNA, 25 bp, Homo sapien
gaccacatttgattctccacgcctg

SEQ ID NO: 99223 - DNA, 25 bp, Homo sapien
tgaagggcgcccatgaaattcgtgg

SEQ ID NO: 99224 - DNA, 25 bp, Homo sapien
tgcccgggactacaaaatgggatcc

SEQ ID NO: 99225 - DNA, 25 bp, Homo sapien
taagacttgcggtcgcccatttctg

SEQ ID NO: 99226 - DNA, 25 bp, Homo sapien
gcctagggctttgttcccaaatagc

SEQ ID NO: 99227 - DNA, 25 bp, Homo sapien
gcatgggcttgagagcagcaccttc

SEQ ID NO: 99228 - DNA, 25 bp, Homo sapien
cccacgagacctgcatggacgggca

SEQ ID NO: 99229 - DNA, 25 bp, Homo sapien
agtcgctcacggtctttgtgtcttc

SEQ ID NO: 99230 - DNA, 25 bp, Homo sapien
cgggactcgtctcagcagtcgctca

SEQ ID NO: 99231 - DNA, 25 bp, Homo sapien
ggctgacgtgcggtcacaaccaatg

SEQ ID NO: 99232 - DNA, 25 bp, Homo sapien
cgatggacagggaactcgaattaca

SEQ ID NO: 99233 - DNA, 25 bp, Homo sapien
ttcattattgaagcaccaagggcga

SEQ ID NO: 99234 - DNA, 25 bp, Homo sapien
atcgcggcggacactgacaaggaac

SEQ ID NO: 99235 - DNA, 25 bp, Homo sapien
gtatgggcgctaatgtcacttggga

SEQ ID NO: 99236 - DNA, 25 bp, Homo sapien
gcgagggcagcaagagctataagta

SEQ ID NO: 99237 - DNA, 25 bp, Homo sapien
tctcggggtaagcaagagtccgtgc

SEQ ID NO: 99238 - DNA, 25 bp, Homo sapien
gctataagtaaccagtcgtcgccgc

SEQ ID NO: 99239 - DNA, 25 bp, Homo sapien
ggccttagtccgctgatcctcgctt

SEQ ID NO: 99240 - DNA, 25 bp, Homo sapien
cggagtggagctaacaattcattat

SEQ ID NO: 99241 - DNA, 25 bp, Homo sapien
gcatccagaggctgcaccggaaccg

SEQ ID NO: 99242 - DNA, 25 bp, Homo sapien
cacgttgtcacagtgggaagccagc

SEQ ID NO: 99243 - DNA, 25 bp, Homo sapien
acatcccgttgcagcgtcgtgcctt

SEQ ID NO: 99244 - DNA, 25 bp, Homo sapien
gctcaaagagcagcacatcccgttg

SEQ ID NO: 99245 - DNA, 25 bp, Homo sapien
aagccagcccacgtcttaccgatgg

SEQ ID NO: 99246 - DNA, 25 bp, Homo sapien
gccacagccatggaagcccagaaga

SEQ ID NO: 99247 - DNA, 25 bp, Homo sapien
acgatttgggacctccgcatccaga

SEQ ID NO: 99248 - DNA, 25 bp, Homo sapien
aacagcccgaggatggtgaagaagc

SEQ ID NO: 99249 - DNA, 25 bp, Homo sapien
cgcctatggtccctcttggagccag

SEQ ID NO: 99250 - DNA, 25 bp, Homo sapien
gctaggcctctgacgtcaccaagtg

SEQ ID NO: 99251 - DNA, 25 bp, Homo sapien
tcctgaccctagaccacggacatta

SEQ ID NO: 99252 - DNA, 25 bp, Homo sapien
gctgccactgctgtagcttctgcca

SEQ ID NO: 99253 - DNA, 25 bp, Homo sapien
cctgctgttgctgcctgaactaagc

SEQ ID NO: 99254 - DNA, 25 bp, Homo sapien
cggtcacgtcctcgctttttacaca

SEQ ID NO: 99255 - DNA, 25 bp, Homo sapien
tggccgctgagatgtacgaacttcc

SEQ ID NO: 99256 - DNA, 25 bp, Homo sapien
ctacaagttagcaaccgaaggcgtc

SEQ ID NO: 99257 - DNA, 25 bp, Homo sapien
cttcagcttgaaaaggatgcgggca

SEQ ID NO: 99258 - DNA, 25 bp, Homo sapien
caccagccggcaacgtccaggaaag

SEQ ID NO: 99259 - DNA, 25 bp, Homo sapien
ggccacaggagaaatgacacccgtg

SEQ ID NO: 99260 - DNA, 25 bp, Homo sapien
cgcgcctctcttcctgtttggttta

SEQ ID NO: 99261 - DNA, 25 bp, Homo sapien
gagatggacacctcggcagtatctg

SEQ ID NO: 99262 - DNA, 25 bp, Homo sapien
gcagtatctggcgaccctcttctca

SEQ ID NO: 99263 - DNA, 25 bp, Homo sapien
gtttggtttactcaagcgcctgccc

SEQ ID NO: 99264 - DNA, 25 bp, Homo sapien
cgccttctcagtcaagctgggagga

SEQ ID NO: 99265 - DNA, 25 bp, Homo sapien
ccgggatcccgggatcagatcactg

SEQ ID NO: 99266 - DNA, 25 bp, Homo sapien
ctgtaaaatgcgaggagagcttgga

SEQ ID NO: 99267 - DNA, 25 bp, Homo sapien
agctcacagtgctacgcgcctgcga

SEQ ID NO: 99268 - DNA, 25 bp, Homo sapien
tctgtgccgggagaggaagctcaca

SEQ ID NO: 99269 - DNA, 25 bp, Homo sapien
acgctgcgcaaagccaatcaccagg

SEQ ID NO: 99270 - DNA, 25 bp, Homo sapien
ggcccttccctcttgctaggagata

SEQ ID NO: 99271 - DNA, 25 bp, Homo sapien
cttttcagatgagacaccttgtgca

SEQ ID NO: 99272 - DNA, 25 bp, Homo sapien
cccgggatcagatcactggggtctt

SEQ ID NO: 99273 - DNA, 25 bp, Homo sapien
gcagccagtgaccagcggagcttcc

SEQ ID NO: 99274 - DNA, 25 bp, Homo sapien
cccatgacttcatgttttgtgaaga

SEQ ID NO: 99275 - DNA, 25 bp, Homo sapien
tgcaaagcgagttcatgccggcgcc

SEQ ID NO: 99276 - DNA, 25 bp, Homo sapien
tgccggcgcctttctgaatcagaga

SEQ ID NO: 99277 - DNA, 25 bp, Homo sapien
tccgtttagaaaccatgaaagctgc

SEQ ID NO: 99278 - DNA, 25 bp, Homo sapien
gggaaaacgcacacaccctcctgga

SEQ ID NO: 99279 - DNA, 25 bp, Homo sapien
acaggccctccgaggatcacgtggt

SEQ ID NO: 99280 - DNA, 25 bp, Homo sapien
tgaatcagagatccgtttagaaacc

SEQ ID NO: 99281 - DNA, 25 bp, Homo sapien
cctcaaggaccaaccggaaggcgcg

SEQ ID NO: 99282 - DNA, 25 bp, Homo sapien
gctttggcgctcagctgtgcctcac

SEQ ID NO: 99283 - DNA, 25 bp, Homo sapien
tccgccaccgcctgaaccttcctac

SEQ ID NO: 99284 - DNA, 25 bp, Homo sapien
cgttagcgccccagcctgtggcttt

SEQ ID NO: 99285 - DNA, 25 bp, Homo sapien
cgtcgcctcaaggaccaaccggaag

SEQ ID NO: 99286 - DNA, 25 bp, Homo sapien
ccctgcggttctgacctgagccttc

SEQ ID NO: 99287 - DNA, 25 bp, Homo sapien
tactccagctcgcagctgtctggag

SEQ ID NO: 99288 - DNA, 25 bp, Homo sapien
cccacagccttcgaccggagtccgc

SEQ ID NO: 99289 - DNA, 25 bp, Homo sapien
gggcgacgcctacgaacatggctca

SEQ ID NO: 99290 - DNA, 25 bp, Homo sapien
cctagggcaggaggcaaacgtcctc

SEQ ID NO: 99291 - DNA, 25 bp, Homo sapien
agcgaacgtttctcctagggcagga

SEQ ID NO: 99292 - DNA, 25 bp, Homo sapien
ccaagcctccagagcgaacgtttct

SEQ ID NO: 99293 - DNA, 25 bp, Homo sapien
tgggccaacccaaaggccagcctgg

SEQ ID NO: 99294 - DNA, 25 bp, Homo sapien
tagtctcagataccggtgttttttc

SEQ ID NO: 99295 - DNA, 25 bp, Homo sapien
tatcaaggcctctggaagtagtctc

SEQ ID NO: 99296 - DNA, 25 bp, Homo sapien
tggccctcctgtccttagcaggctg

SEQ ID NO: 99297 - DNA, 25 bp, Homo sapien
agtcggacattttcctctgcttctc

SEQ ID NO: 99298 - DNA, 25 bp, Homo sapien
tgagttcagacacccagcacacgcg

SEQ ID NO: 99299 - DNA, 25 bp, Homo sapien
gagttccagctcttggctacctctg

SEQ ID NO: 99300 - DNA, 25 bp, Homo sapien
ggcacttgggcaagagttccagctc

SEQ ID NO: 99301 - DNA, 25 bp, Homo sapien
cagagactttcaggccgggccttca

SEQ ID NO: 99302 - DNA, 25 bp, Homo sapien
tctgcttctctcagggcagctggcg

SEQ ID NO: 99303 - DNA, 25 bp, Homo sapien
gaaacgttcttctggcgcgaagctg

SEQ ID NO: 99304 - DNA, 25 bp, Homo sapien
caaggctgcttctagggacacgaga

SEQ ID NO: 99305 - DNA, 25 bp, Homo sapien
cgcccgcccttcagtctagtttggg

SEQ ID NO: 99306 - DNA, 25 bp, Homo sapien
gttttgccagcctccgaatgtaata

SEQ ID NO: 99307 - DNA, 25 bp, Homo sapien
gacgcctagaaagcctcctcggttc

SEQ ID NO: 99308 - DNA, 25 bp, Homo sapien
gctttgctctcttcctgccgttttg

SEQ ID NO: 99309 - DNA, 25 bp, Homo sapien
tccgaatgtaatacgcgggcgaagg

SEQ ID NO: 99310 - DNA, 25 bp, Homo sapien
tgccagcctccgaatgtaatacgcg

SEQ ID NO: 99311 - DNA, 25 bp, Homo sapien
gccgttttgccagcctccgaatgta

SEQ ID NO: 99312 - DNA, 25 bp, Homo sapien
cgtgacgcctagaaagcctcctcgg

SEQ ID NO: 99313 - DNA, 25 bp, Homo sapien
cgccgtgcccgggccatgaagtagc

SEQ ID NO: 99314 - DNA, 25 bp, Homo sapien
ttttgcccgccgctcgtgaccgaga

SEQ ID NO: 99315 - DNA, 25 bp, Homo sapien
tgaccgagacgcctcgccgcggcca

SEQ ID NO: 99316 - DNA, 25 bp, Homo sapien
gccggacaaaagtcccgcctgccca

SEQ ID NO: 99317 - DNA, 25 bp, Homo sapien
tccgcctgcgggccggacaaaagtc

SEQ ID NO: 99318 - DNA, 25 bp, Homo sapien
ggaggaaagcttccgcctgcgggcc

SEQ ID NO: 99319 - DNA, 25 bp, Homo sapien
agtcataaggcacccgcgcgtctag

SEQ ID NO: 99320 - DNA, 25 bp, Homo sapien
ggagtcataaggcacccgcgcgtct

SEQ ID NO: 99321 - DNA, 25 bp, Homo sapien
taggactgatcatttggctcttgcc

SEQ ID NO: 99322 - DNA, 25 bp, Homo sapien
ctttctgctcagctagcgcgggaca

SEQ ID NO: 99323 - DNA, 25 bp, Homo sapien
ggccctcctatctcaaaggcgcttg

SEQ ID NO: 99324 - DNA, 25 bp, Homo sapien
gtcgaggcgaatggttttgaaatta

SEQ ID NO: 99325 - DNA, 25 bp, Homo sapien
tactgtcgggttacgcctcacttta

SEQ ID NO: 99326 - DNA, 25 bp, Homo sapien
actcaccgaggtggtcctaaattca

SEQ ID NO: 99327 - DNA, 25 bp, Homo sapien
gacagatttaagcttcctctcgtga

SEQ ID NO: 99328 - DNA, 25 bp, Homo sapien
tcgtgatttatctcgcgctgccgga

SEQ ID NO: 99329 - DNA, 25 bp, Homo sapien
gtccgccatgccacagcgaagatca

SEQ ID NO: 99330 - DNA, 25 bp, Homo sapien
ccgaagaccagcacttaccgctgta

SEQ ID NO: 99331 - DNA, 25 bp, Homo sapien
gcaccttttcatctgtccgctgacg

SEQ ID NO: 99332 - DNA, 25 bp, Homo sapien
gtgcgcacacttaaggccgtcgttc

SEQ ID NO: 99333 - DNA, 25 bp, Homo sapien
tcaggaccgaagtgtccctacgccg

SEQ ID NO: 99334 - DNA, 25 bp, Homo sapien
gggcgccaccgcatttatacagcaa

SEQ ID NO: 99335 - DNA, 25 bp, Homo sapien
agcaaagcacgtcgcgcgccgctga

SEQ ID NO: 99336 - DNA, 25 bp, Homo sapien
agatagccagttcccgacccgaaga

SEQ ID NO: 99337 - DNA, 25 bp, Homo sapien
ctgtaaccttttgtgctgcagaaaa

SEQ ID NO: 99338 - DNA, 25 bp, Homo sapien
agatgtcgggcattgccaccctcgc

SEQ ID NO: 99339 - DNA, 25 bp, Homo sapien
gccagaagcttaagcggcagatgtc

SEQ ID NO: 99340 - DNA, 25 bp, Homo sapien
cccggtccgagccagaagcttaagc

SEQ ID NO: 99341 - DNA, 25 bp, Homo sapien
actgcccgggtcagatagcacctca

SEQ ID NO: 99342 - DNA, 25 bp, Homo sapien
cgacggctccgtctgtaaccttttg

SEQ ID NO: 99343 - DNA, 25 bp, Homo sapien
agccctgggccatcggtaggttgca

SEQ ID NO: 99344 - DNA, 25 bp, Homo sapien
cgtcctggttgcaacccgcgtgcga

SEQ ID NO: 99345 - DNA, 25 bp, Homo sapien
gccacgcttcgctccaagttacttt

SEQ ID NO: 99346 - DNA, 25 bp, Homo sapien
tctccgcctgttatcggcttacctg

SEQ ID NO: 99347 - DNA, 25 bp, Homo sapien
ggggttgctgctgttccagtagaca

SEQ ID NO: 99348 - DNA, 25 bp, Homo sapien
gagagcgggcgccaaataaatatga

SEQ ID NO: 99349 - DNA, 25 bp, Homo sapien
aacccagccttgtcggtgtcctgga

SEQ ID NO: 99350 - DNA, 25 bp, Homo sapien
tcctggaactggttaagcggcagct

SEQ ID NO: 99351 - DNA, 25 bp, Homo sapien
ccggctttcgaagcggtcttgcctc

SEQ ID NO: 99352 - DNA, 25 bp, Homo sapien
gggtcctggctgaacacacacatcc

SEQ ID NO: 99353 - DNA, 25 bp, Homo sapien
caggaagagacttcggccctgctgc

SEQ ID NO: 99354 - DNA, 25 bp, Homo sapien
ttttaactgcggatccgccgccggc

SEQ ID NO: 99355 - DNA, 25 bp, Homo sapien
ccttcgagagaaggtggcccatata

SEQ ID NO: 99356 - DNA, 25 bp, Homo sapien
cccaactctttgcagcaggaggcgg

SEQ ID NO: 99357 - DNA, 25 bp, Homo sapien
ccgggactgtgcacgatgaagcaga

SEQ ID NO: 99358 - DNA, 25 bp, Homo sapien
aactgcaacagcgaggcctcttctg

SEQ ID NO: 99359 - DNA, 25 bp, Homo sapien
ggggctacatgctttgcccagggaa

SEQ ID NO: 99360 - DNA, 25 bp, Homo sapien
gtcccgctcggaccattttaactgc

SEQ ID NO: 99361 - DNA, 25 bp, Homo sapien
aagctccatgctctcctggttttcc

SEQ ID NO: 99362 - DNA, 25 bp, Homo sapien
gtgaagctcctttccgccgtcagaa

SEQ ID NO: 99363 - DNA, 25 bp, Homo sapien
ctttccgccgtcagaaggaggctcc

SEQ ID NO: 99364 - DNA, 25 bp, Homo sapien
ggctcccagcgggaagcagcatcga

SEQ ID NO: 99365 - DNA, 25 bp, Homo sapien
aaatgccagggaccgcgtcagccga

SEQ ID NO: 99366 - DNA, 25 bp, Homo sapien
ccgttccgcctgaggacagtactcg

SEQ ID NO: 99367 - DNA, 25 bp, Homo sapien
gccggaccagcgaaaaagctccatg

SEQ ID NO: 99368 - DNA, 25 bp, Homo sapien
gtgcccgccacaggaacgcaagaga

SEQ ID NO: 99369 - DNA, 25 bp, Homo sapien
cttacaaggccgactctgctcaggc

SEQ ID NO: 99370 - DNA, 25 bp, Homo sapien
gcaccgagacctctgccttacaagg

SEQ ID NO: 99371 - DNA, 25 bp, Homo sapien
cgagacctctgccttacaaggccga

SEQ ID NO: 99372 - DNA, 25 bp, Homo sapien
agacctctgccttacaaggccgact

SEQ ID NO: 99373 - DNA, 25 bp, Homo sapien
ccttacaaggccgactctgctcagg

SEQ ID NO: 99374 - DNA, 25 bp, Homo sapien
ttacaaggccgactctgctcaggcc

SEQ ID NO: 99375 - DNA, 25 bp, Homo sapien
gcggaccgccgggtatccgctcagc

SEQ ID NO: 99376 - DNA, 25 bp, Homo sapien
tctgccttacaaggccgactctgct

SEQ ID NO: 99377 - DNA, 25 bp, Homo sapien
caaagtttcctgtgaggccttcgtc

SEQ ID NO: 99378 - DNA, 25 bp, Homo sapien
gcgagcccagaaagcggcgaccgca

SEQ ID NO: 99379 - DNA, 25 bp, Homo sapien
ttccaggcggcctcagcttatcatc

SEQ ID NO: 99380 - DNA, 25 bp, Homo sapien
agcttgggctaagcgtgcgcccacc

SEQ ID NO: 99381 - DNA, 25 bp, Homo sapien
agaggttcgtgacagtggcgcctat

SEQ ID NO: 99382 - DNA, 25 bp, Homo sapien
ttcgggcttgtcaggttctaggtag

SEQ ID NO: 99383 - DNA, 25 bp, Homo sapien
ggcaacaatgcctgcccgcagaggg

SEQ ID NO: 99384 - DNA, 25 bp, Homo sapien
gcacaaacgcgcagacctcgggact

SEQ ID NO: 99385 - DNA, 25 bp, Homo sapien
aaacgacggcaacagaaggctcctc

SEQ ID NO: 99386 - DNA, 25 bp, Homo sapien
tggccaagtcaccaaggacagcaga

SEQ ID NO: 99387 - DNA, 25 bp, Homo sapien
ctccttccgaagctagagacagaga

SEQ ID NO: 99388 - DNA, 25 bp, Homo sapien
tgaggagctgaacgcagcaatttcc

SEQ ID NO: 99389 - DNA, 25 bp, Homo sapien
cctgtggcgtaagatggttccgctc

SEQ ID NO: 99390 - DNA, 25 bp, Homo sapien
atgcagacgcccagcaaaacgacgg

SEQ ID NO: 99391 - DNA, 25 bp, Homo sapien
gcctcactgacaatcggggaaaatg

SEQ ID NO: 99392 - DNA, 25 bp, Homo sapien
ggggcaaactcttgtacagtggcga

SEQ ID NO: 99393 - DNA, 25 bp, Homo sapien
ttaagccgccagttcaccgtgttcg

SEQ ID NO: 99394 - DNA, 25 bp, Homo sapien
cggctgcttcctagagtccacagtg

SEQ ID NO: 99395 - DNA, 25 bp, Homo sapien
tcggcgctgagcttgcgatcaagtt

SEQ ID NO: 99396 - DNA, 25 bp, Homo sapien
cgcctgccctcgtcgagaaaacttt

SEQ ID NO: 99397 - DNA, 25 bp, Homo sapien
ggctcctcgcgatcttgttcctttc

SEQ ID NO: 99398 - DNA, 25 bp, Homo sapien
cggacgctagctctgaggaaactca

SEQ ID NO: 99399 - DNA, 25 bp, Homo sapien
tctgtgtggtgattttctcgctcta

SEQ ID NO: 99400 - DNA, 25 bp, Homo sapien
accgtgttcggcagtgcgatcttct

SEQ ID NO: 99401 - DNA, 25 bp, Homo sapien
tgtgccagcgaagcagaaccccggg

SEQ ID NO: 99402 - DNA, 25 bp, Homo sapien
cccactgtgccagcgaagcagaacc

SEQ ID NO: 99403 - DNA, 25 bp, Homo sapien
agacgctgaggctcggccgcgtgcc

SEQ ID NO: 99404 - DNA, 25 bp, Homo sapien
aggtcccaggcgctcaatgcctggc

SEQ ID NO: 99405 - DNA, 25 bp, Homo sapien
ggtcccaggcgctcaatgcctggca

SEQ ID NO: 99406 - DNA, 25 bp, Homo sapien
tcccaggcgctcaatgcctggcagg

SEQ ID NO: 99407 - DNA, 25 bp, Homo sapien
ccaggcgctcaatgcctggcaggcg

SEQ ID NO: 99408 - DNA, 25 bp, Homo sapien
cagcgaagcagaaccccgggaccaa

SEQ ID NO: 99409 - DNA, 25 bp, Homo sapien
ggcgcagaggatcccgcctcctatt

SEQ ID NO: 99410 - DNA, 25 bp, Homo sapien
ctgcaaggtccttcagcaccgggtc

SEQ ID NO: 99411 - DNA, 25 bp, Homo sapien
gacggatttgatggcttgggctacc

SEQ ID NO: 99412 - DNA, 25 bp, Homo sapien
cgtgacttccggttgtcagaattta

SEQ ID NO: 99413 - DNA, 25 bp, Homo sapien
tataatcacgtgctccgaagacttc

SEQ ID NO: 99414 - DNA, 25 bp, Homo sapien
gttgccggaagaggctataatcacg

SEQ ID NO: 99415 - DNA, 25 bp, Homo sapien
gtgccctttaatggttgccggaaga

SEQ ID NO: 99416 - DNA, 25 bp, Homo sapien
tccctagcaaccgtgccctttaatg

SEQ ID NO: 99417 - DNA, 25 bp, Homo sapien
cagaggctttcctgattggacggca

SEQ ID NO: 99418 - DNA, 25 bp, Homo sapien
taaggccgacgtctctctcaacaga

SEQ ID NO: 99419 - DNA, 25 bp, Homo sapien
ttggacggcaaggaattcgctcacc

SEQ ID NO: 99420 - DNA, 25 bp, Homo sapien
tcccattggctaaggcgccaccgtg

SEQ ID NO: 99421 - DNA, 25 bp, Homo sapien
cccagagtactacagcaggcgctca

SEQ ID NO: 99422 - DNA, 25 bp, Homo sapien
gccttaaagaaccagctgcccggtg

SEQ ID NO: 99423 - DNA, 25 bp, Homo sapien
tgtcccaagtcgaacccgcttcaga

SEQ ID NO: 99424 - DNA, 25 bp, Homo sapien
gaagcggccacgtcacctacacgta

SEQ ID NO: 99425 - DNA, 25 bp, Homo sapien
cagaactccgagaggtgcctgggct

SEQ ID NO: 99426 - DNA, 25 bp, Homo sapien
agtcttttcgcgacgagtgccctcc

SEQ ID NO: 99427 - DNA, 25 bp, Homo sapien
acacttctgttccaatttagggaga

SEQ ID NO: 99428 - DNA, 25 bp, Homo sapien
tagggagaggaagtctctatccgga

SEQ ID NO: 99429 - DNA, 25 bp, Homo sapien
ctctatccggaggaaaggcaaattg

SEQ ID NO: 99430 - DNA, 25 bp, Homo sapien
ggctcggaattttggcagcctccgc

SEQ ID NO: 99431 - DNA, 25 bp, Homo sapien
agcgtgggtgacagtcttttcgcga

SEQ ID NO: 99432 - DNA, 25 bp, Homo sapien
tgcgcctagcttgggacaacacttc

SEQ ID NO: 99433 - DNA, 25 bp, Homo sapien
gggccttgggacttttcagcaacga

SEQ ID NO: 99434 - DNA, 25 bp, Homo sapien
gttctgtcggaacctaacgagcttc

SEQ ID NO: 99435 - DNA, 25 bp, Homo sapien
gtcacgcctcccatgtgagctctgg

SEQ ID NO: 99436 - DNA, 25 bp, Homo sapien
tgcactgagggcagtctccggaaac

SEQ ID NO: 99437 - DNA, 25 bp, Homo sapien
gctctggcagaggactgttccacta

SEQ ID NO: 99438 - DNA, 25 bp, Homo sapien
acgtgttttccttcaggaccagagc

SEQ ID NO: 99439 - DNA, 25 bp, Homo sapien
attccacacgtggtgcggttcagcg

SEQ ID NO: 99440 - DNA, 25 bp, Homo sapien
tgttccactagacacgctgaaggga

SEQ ID NO: 99441 - DNA, 25 bp, Homo sapien
tgagcgatttcttcgaggtggagtc

SEQ ID NO: 99442 - DNA, 25 bp, Homo sapien
tccaacagggatgcgctgagcgatt

SEQ ID NO: 99443 - DNA, 25 bp, Homo sapien
ttactggatcgacggctccaacagg

SEQ ID NO: 99444 - DNA, 25 bp, Homo sapien
agcctcgtcccggattactggatcg

SEQ ID NO: 99445 - DNA, 25 bp, Homo sapien
tgctcttcggtcaccgccagtgcgg

SEQ ID NO: 99446 - DNA, 25 bp, Homo sapien
tcccgctgcgaagatgctcaaagtc

SEQ ID NO: 99447 - DNA, 25 bp, Homo sapien
ctctcctcagcggtgcagctagtct

SEQ ID NO: 99448 - DNA, 25 bp, Homo sapien
ctcaaggagggatgagttgcgccac

SEQ ID NO: 99449 - DNA, 25 bp, Homo sapien
gagttgcaagccctgggatccttcc

SEQ ID NO: 99450 - DNA, 25 bp, Homo sapien
tcaggtttctctttcatctgtgagg

SEQ ID NO: 99451 - DNA, 25 bp, Homo sapien
agatccatggtctggagcaggtcca

SEQ ID NO: 99452 - DNA, 25 bp, Homo sapien
cgtggctctccttacctttacctga

SEQ ID NO: 99453 - DNA, 25 bp, Homo sapien
ggcgacagcagccaacttgtaagtc

SEQ ID NO: 99454 - DNA, 25 bp, Homo sapien
aacttgtaagtcaccgctggtcgca

SEQ ID NO: 99455 - DNA, 25 bp, Homo sapien
tcgcagccaactggaaggcacccag

SEQ ID NO: 99456 - DNA, 25 bp, Homo sapien
acaacgtgcgcttgttcggattggc

SEQ ID NO: 99457 - DNA, 25 bp, Homo sapien
ggcgcggcccgtactgtaataataa

SEQ ID NO: 99458 - DNA, 25 bp, Homo sapien
taaacctgcagcagagggcatctga

SEQ ID NO: 99459 - DNA, 25 bp, Homo sapien
catctgaggaaaagaggacggcgac

SEQ ID NO: 99460 - DNA, 25 bp, Homo sapien
cggcagccgccttccttttatgtgc

SEQ ID NO: 99461 - DNA, 25 bp, Homo sapien
agagtccgcgaaggatgcatttgca

SEQ ID NO: 99462 - DNA, 25 bp, Homo sapien
tcctgagcgaagcagaaaatggtgc

SEQ ID NO: 99463 - DNA, 25 bp, Homo sapien
tttatgtgcctgtcctgagcgaagc

SEQ ID NO: 99464 - DNA, 25 bp, Homo sapien
cgacgtgcggttgcttttcagacaa

SEQ ID NO: 99465 - DNA, 25 bp, Homo sapien
cacgacctggcagcatctacagagc

SEQ ID NO: 99466 - DNA, 25 bp, Homo sapien
gcctgacacgacctggcagcatcta

SEQ ID NO: 99467 - DNA, 25 bp, Homo sapien
ggcggccacgtaccttcatacctgg

SEQ ID NO: 99468 - DNA, 25 bp, Homo sapien
ggctgtatgaacactgggctgctgc

SEQ ID NO: 99469 - DNA, 25 bp, Homo sapien
gtaccttcatacctggggtccgtgc

SEQ ID NO: 99470 - DNA, 25 bp, Homo sapien
gcatctacagagcagcgtggccagc

SEQ ID NO: 99471 - DNA, 25 bp, Homo sapien
ctggcagcatctacagagcagcgtg

SEQ ID NO: 99472 - DNA, 25 bp, Homo sapien
gccacgtaccttcatacctggggtc

SEQ ID NO: 99473 - DNA, 25 bp, Homo sapien
tcgtcgggagtgatcacctacccta

SEQ ID NO: 99474 - DNA, 25 bp, Homo sapien
tttcttccttttggtgcgagcttgc

SEQ ID NO: 99475 - DNA, 25 bp, Homo sapien
aacgcggccaccctgagtctggtga

SEQ ID NO: 99476 - DNA, 25 bp, Homo sapien
caggcctgcgttcccacgtttggaa

SEQ ID NO: 99477 - DNA, 25 bp, Homo sapien
catcgactatgccagggagttctcc

SEQ ID NO: 99478 - DNA, 25 bp, Homo sapien
ttcacgttcgtgcaagaccagtcgc

SEQ ID NO: 99479 - DNA, 25 bp, Homo sapien
tcgtcagtgaaaaggccttaccgta

SEQ ID NO: 99480 - DNA, 25 bp, Homo sapien
gcgtgcctggttacagctgtttcca

SEQ ID NO: 99481 - DNA, 25 bp, Homo sapien
cagtcctggggacgacaaaagtctc

SEQ ID NO: 99482 - DNA, 25 bp, Homo sapien
ggaaagttctcttggccgcgcgagt

SEQ ID NO: 99483 - DNA, 25 bp, Homo sapien
ggcttcttcaggacattcagcaaag

SEQ ID NO: 99484 - DNA, 25 bp, Homo sapien
gccgtgtgtagccaagttcaagctc

SEQ ID NO: 99485 - DNA, 25 bp, Homo sapien
aggctccttacccagaccagcgagg

SEQ ID NO: 99486 - DNA, 25 bp, Homo sapien
ccttggaaaaccctggaagcgctgc

SEQ ID NO: 99487 - DNA, 25 bp, Homo sapien
ccggtccaggcgtctgcaaaaagcc

SEQ ID NO: 99488 - DNA, 25 bp, Homo sapien
cagatccgccgagtatgaagcgctc

SEQ ID NO: 99489 - DNA, 25 bp, Homo sapien
acgcatgcgcattgtagtcttccca

SEQ ID NO: 99490 - DNA, 25 bp, Homo sapien
cgcataacaggctctagtctccggg

SEQ ID NO: 99491 - DNA, 25 bp, Homo sapien
ctgtgggaagccagcaacacctctc

SEQ ID NO: 99492 - DNA, 25 bp, Homo sapien
accgaggttggctcgatgctgttcc

SEQ ID NO: 99493 - DNA, 25 bp, Homo sapien
gaagcactcagttgccttctcgggc

SEQ ID NO: 99494 - DNA, 25 bp, Homo sapien
ggctgcaggcattgacgtctcctcc

SEQ ID NO: 99495 - DNA, 25 bp, Homo sapien
tggctttgcaggtcctccattctca

SEQ ID NO: 99496 - DNA, 25 bp, Homo sapien
tcccaggtactgttgttggctgttg

SEQ ID NO: 99497 - DNA, 25 bp, Homo sapien
gctgatccaactcgctctgtacggg

SEQ ID NO: 99498 - DNA, 25 bp, Homo sapien
cgagcgacaggtgccggaacaaaca

SEQ ID NO: 99499 - DNA, 25 bp, Homo sapien
gccacgtcagagactagagatcctg

SEQ ID NO: 99500 - DNA, 25 bp, Homo sapien
ctccagaatggcctagctgatccaa

SEQ ID NO: 99501 - DNA, 25 bp, Homo sapien
agggaagtcttcatgccacgtcaga

SEQ ID NO: 99502 - DNA, 25 bp, Homo sapien
ctcctgggttgttgagactcttgtg

SEQ ID NO: 99503 - DNA, 25 bp, Homo sapien
aaaagcgggctgtctcggaaactca

SEQ ID NO: 99504 - DNA, 25 bp, Homo sapien
cggacgcggaaccatttcttgggca

SEQ ID NO: 99505 - DNA, 25 bp, Homo sapien
tctcccgggatcaactgagccctgg

SEQ ID NO: 99506 - DNA, 25 bp, Homo sapien
aggagagctcgggagtttcccacaa

SEQ ID NO: 99507 - DNA, 25 bp, Homo sapien
cgcgcaaacccagtgaccttcaagg

SEQ ID NO: 99508 - DNA, 25 bp, Homo sapien
gcgcgcaaacccagtgaccttcaag

SEQ ID NO: 99509 - DNA, 25 bp, Homo sapien
tcaactgagccctggagaactgggg

SEQ ID NO: 99510 - DNA, 25 bp, Homo sapien
gggatcaactgagccctggagaact

SEQ ID NO: 99511 - DNA, 25 bp, Homo sapien
ggagagctcgggagtttcccacaat

SEQ ID NO: 99512 - DNA, 25 bp, Homo sapien
cccgggatcaactgagccctggaga

SEQ ID NO: 99513 - DNA, 25 bp, Homo sapien
aggccagcctgatccctgaatatgc

SEQ ID NO: 99514 - DNA, 25 bp, Homo sapien
gaatatgctgcttgtcccgtctgtc

SEQ ID NO: 99515 - DNA, 25 bp, Homo sapien
cggccacccaccaagagcgatgaag

SEQ ID NO: 99516 - DNA, 25 bp, Homo sapien
gaagctcctgttcacgccggttttg

SEQ ID NO: 99517 - DNA, 25 bp, Homo sapien
tcttctcgtgcaggaaccggtcgaa

SEQ ID NO: 99518 - DNA, 25 bp, Homo sapien
gtccgctgggctatgccttgaagtc

SEQ ID NO: 99519 - DNA, 25 bp, Homo sapien
agacatacgtcagcgctggcccttc

SEQ ID NO: 99520 - DNA, 25 bp, Homo sapien
ggccagaaggtcagtcatgcagttc

SEQ ID NO: 99521 - DNA, 25 bp, Homo sapien
gcctgggtcttagcgttttgccgcc

SEQ ID NO: 99522 - DNA, 25 bp, Homo sapien
agtcctagtgccgtaccgtcagtcc

SEQ ID NO: 99523 - DNA, 25 bp, Homo sapien
gatgcactgttcctgctgtgggtcc

SEQ ID NO: 99524 - DNA, 25 bp, Homo sapien
gtcctcatcatggagaccaaacggg

SEQ ID NO: 99525 - DNA, 25 bp, Homo sapien
caaacgggtggagattcccggcagc

SEQ ID NO: 99526 - DNA, 25 bp, Homo sapien
actattttgctttcccgcaggcgta

SEQ ID NO: 99527 - DNA, 25 bp, Homo sapien
tcgtctccgttggagtcgtctctgc

SEQ ID NO: 99528 - DNA, 25 bp, Homo sapien
gacgatttctgcaggtaccgcgcta

SEQ ID NO: 99529 - DNA, 25 bp, Homo sapien
gacgagccattgctgcaggaggctc

SEQ ID NO: 99530 - DNA, 25 bp, Homo sapien
ctcttaaaaagagcagccgtggctc

SEQ ID NO: 99531 - DNA, 25 bp, Homo sapien
tcgcgtttcacggacgagccattgc

SEQ ID NO: 99532 - DNA, 25 bp, Homo sapien
cgcaaacggaggatgcaggcactct

SEQ ID NO: 99533 - DNA, 25 bp, Homo sapien
ttaccaggatggagggcacttccca

SEQ ID NO: 99534 - DNA, 25 bp, Homo sapien
gcacgagccgacaccctagagggca

SEQ ID NO: 99535 - DNA, 25 bp, Homo sapien
ggagctgcacttcacgccgaagttt

SEQ ID NO: 99536 - DNA, 25 bp, Homo sapien
agatccgcgcctcggattccagaga

SEQ ID NO: 99537 - DNA, 25 bp, Homo sapien
ggactgatctcgctcctgtcggttt

SEQ ID NO: 99538 - DNA, 25 bp, Homo sapien
ccgcgtacctgctgatgtatccgtc

SEQ ID NO: 99539 - DNA, 25 bp, Homo sapien
ttcccgcgagcttctgagcaacttg

SEQ ID NO: 99540 - DNA, 25 bp, Homo sapien
gaagctcacctggtcagcgcacaga

SEQ ID NO: 99541 - DNA, 25 bp, Homo sapien
gccagaactccttttcccacaggga

SEQ ID NO: 99542 - DNA, 25 bp, Homo sapien
ccgaggctgtcgcttagctcatctc

SEQ ID NO: 99543 - DNA, 25 bp, Homo sapien
tggaattcatgggttctgcggcaca

SEQ ID NO: 99544 - DNA, 25 bp, Homo sapien
cctctcaggctactgcgtttaaatc

SEQ ID NO: 99545 - DNA, 25 bp, Homo sapien
ctcttcagggcaatgtccaggccga

SEQ ID NO: 99546 - DNA, 25 bp, Homo sapien
atcgcagtcaatatcgcgctggagc

SEQ ID NO: 99547 - DNA, 25 bp, Homo sapien
gagaaccgcaccatagctccgcaga

SEQ ID NO: 99548 - DNA, 25 bp, Homo sapien
ccgtgatatcaatggcgcaggcttc

SEQ ID NO: 99549 - DNA, 25 bp, Homo sapien
tcacttctgctgtggcggtgactga

SEQ ID NO: 99550 - DNA, 25 bp, Homo sapien
cggattcccacggtctttgtcattg

SEQ ID NO: 99551 - DNA, 25 bp, Homo sapien
ctcccgtgcggagagaccatctctt

SEQ ID NO: 99552 - DNA, 25 bp, Homo sapien
gagcgcttccgatacggggaccaga

SEQ ID NO: 99553 - DNA, 25 bp, Homo sapien
gcgcctgggattcggttcaatattt

SEQ ID NO: 99554 - DNA, 25 bp, Homo sapien
ggcacgtttctaaccttgtactgga

SEQ ID NO: 99555 - DNA, 25 bp, Homo sapien
gccgcatgctgcttaaggactgtta

SEQ ID NO: 99556 - DNA, 25 bp, Homo sapien
tcggcgataccctgagcattcgggc

SEQ ID NO: 99557 - DNA, 25 bp, Homo sapien
tggttttcacccttgagcggcgttc

SEQ ID NO: 99558 - DNA, 25 bp, Homo sapien
ttagcacagtcagtaccgaagcagg

SEQ ID NO: 99559 - DNA, 25 bp, Homo sapien
gccgcaagcaggcacggaatttgac

SEQ ID NO: 99560 - DNA, 25 bp, Homo sapien
ctcggtagcctcaaggtcggcgata

SEQ ID NO: 99561 - DNA, 25 bp, Homo sapien
cccgcaggtgatgtcatgcccattg

SEQ ID NO: 99562 - DNA, 25 bp, Homo sapien
catgcccattgttttggtgcgccca

SEQ ID NO: 99563 - DNA, 25 bp, Homo sapien
tggtgcgcccaaccaatcggactcg

SEQ ID NO: 99564 - DNA, 25 bp, Homo sapien
gactcgccgcctggattctaccgga

SEQ ID NO: 99565 - DNA, 25 bp, Homo sapien
gcagctttaacagccctgacatgga

SEQ ID NO: 99566 - DNA, 25 bp, Homo sapien
cattgcagttccagcgcggcttctt

SEQ ID NO: 99567 - DNA, 25 bp, Homo sapien
ccctagggtttgtcctgcagattcc

SEQ ID NO: 99568 - DNA, 25 bp, Homo sapien
ctccacgcaatcagcaggcggaatc

SEQ ID NO: 99569 - DNA, 25 bp, Homo sapien
gcaacagcgccagtcgcacaaaaga

SEQ ID NO: 99570 - DNA, 25 bp, Homo sapien
tgtcatcagcggcacgttccactca

SEQ ID NO: 99571 - DNA, 25 bp, Homo sapien
gcctcggtccgaagctggaagatga

SEQ ID NO: 99572 - DNA, 25 bp, Homo sapien
gcgctttcttcactcgcggttcgaa

SEQ ID NO: 99573 - DNA, 25 bp, Homo sapien
gaatctgagccatcgccctccatgg

SEQ ID NO: 99574 - DNA, 25 bp, Homo sapien
aagcgagctttgctcccagcgacta

SEQ ID NO: 99575 - DNA, 25 bp, Homo sapien
ttcagtttgctctcactgcgctttc

SEQ ID NO: 99576 - DNA, 25 bp, Homo sapien
tgagctggtcagctgtacgtggcca

SEQ ID NO: 99577 - DNA, 25 bp, Homo sapien
ttcacaaactctggaggaccgacgc

SEQ ID NO: 99578 - DNA, 25 bp, Homo sapien
gctttaaatattcccggcctggagc

SEQ ID NO: 99579 - DNA, 25 bp, Homo sapien
cgaacgtgctgtccctatttaccgg

SEQ ID NO: 99580 - DNA, 25 bp, Homo sapien
atttaccggccacacgctctgactg

SEQ ID NO: 99581 - DNA, 25 bp, Homo sapien
tgatcgcacacttcgagcctgttca

SEQ ID NO: 99582 - DNA, 25 bp, Homo sapien
ttagtctgagttttgccgagctccc

SEQ ID NO: 99583 - DNA, 25 bp, Homo sapien
ccgacgcgggtgtatcgaatttgtc

SEQ ID NO: 99584 - DNA, 25 bp, Homo sapien
agtcaccacgtttgagtagccctgg

SEQ ID NO: 99585 - DNA, 25 bp, Homo sapien
aagaggccttcgctgccactctgag

SEQ ID NO: 99586 - DNA, 25 bp, Homo sapien
ggctccgcccttaaaagtctgtgga

SEQ ID NO: 99587 - DNA, 25 bp, Homo sapien
aacaaagcacgtgggcgatgacagc

SEQ ID NO: 99588 - DNA, 25 bp, Homo sapien
ctgcaacaccggcactgaacagcga

SEQ ID NO: 99589 - DNA, 25 bp, Homo sapien
cccacgctgaggatagtttatcccg

SEQ ID NO: 99590 - DNA, 25 bp, Homo sapien
ttggcgcaagctcagttgatgggtc

SEQ ID NO: 99591 - DNA, 25 bp, Homo sapien
cgcttgtgtaatagccgctccactc

SEQ ID NO: 99592 - DNA, 25 bp, Homo sapien
ggcacgcagtttcccgccctattaa

SEQ ID NO: 99593 - DNA, 25 bp, Homo sapien
agtctcggtgccgacccacacatgg

SEQ ID NO: 99594 - DNA, 25 bp, Homo sapien
agacagttcacacttccggcgcagc

SEQ ID NO: 99595 - DNA, 25 bp, Homo sapien
gacccacacatggttccagcgtgca

SEQ ID NO: 99596 - DNA, 25 bp, Homo sapien
ccctgagagacgaaggcgtcagtca

SEQ ID NO: 99597 - DNA, 25 bp, Homo sapien
gccgcctgttttcgctgaagattta

SEQ ID NO: 99598 - DNA, 25 bp, Homo sapien
ccatcctcggtgctgaagtgcttca

SEQ ID NO: 99599 - DNA, 25 bp, Homo sapien
gtgtctctgaccctggaatatgcca

SEQ ID NO: 99600 - DNA, 25 bp, Homo sapien
agcagccgccatgacaaagcctgga

SEQ ID NO: 99601 - DNA, 25 bp, Homo sapien
gcacgtgccgatcccgtaagaaatc

SEQ ID NO: 99602 - DNA, 25 bp, Homo sapien
cgccatgctgctccggaagcgacgt

SEQ ID NO: 99603 - DNA, 25 bp, Homo sapien
ctgtgccacgagttacctgcttgtc

SEQ ID NO: 99604 - DNA, 25 bp, Homo sapien
acctgcttgtctcgagtgaagaata

SEQ ID NO: 99605 - DNA, 25 bp, Homo sapien
tgaagaatagcgctccggcaaaacc

SEQ ID NO: 99606 - DNA, 25 bp, Homo sapien
gcgctggaaaaatcgcacgtgccga

SEQ ID NO: 99607 - DNA, 25 bp, Homo sapien
tgcccgcggagagaaagaaccctcc

SEQ ID NO: 99608 - DNA, 25 bp, Homo sapien
gcgacccggaatcagtgcccgcgga

SEQ ID NO: 99609 - DNA, 25 bp, Homo sapien
gctaccacaaccgtcgtcagtgcgg

SEQ ID NO: 99610 - DNA, 25 bp, Homo sapien
tgtttacccgccgagctactcgggc

SEQ ID NO: 99611 - DNA, 25 bp, Homo sapien
aaccgtcgtcagtgcggccatgttt

SEQ ID NO: 99612 - DNA, 25 bp, Homo sapien
tgttgaggcgctggcgtcgctccca

SEQ ID NO: 99613 - DNA, 25 bp, Homo sapien
ctcccggatttacctgttgaggcgc

SEQ ID NO: 99614 - DNA, 25 bp, Homo sapien
cagagcagctctcggttctcccgga

SEQ ID NO: 99615 - DNA, 25 bp, Homo sapien
ctgcagagggcacctgttcagccag

SEQ ID NO: 99616 - DNA, 25 bp, Homo sapien
gcggccatgtttacccgccgagcta

SEQ ID NO: 99617 - DNA, 25 bp, Homo sapien
cgactgctgcgacggatggtgtaat

SEQ ID NO: 99618 - DNA, 25 bp, Homo sapien
tggtcactcgggctttgtccgtccc

SEQ ID NO: 99619 - DNA, 25 bp, Homo sapien
gcccttagtcggctcggactgcagc

SEQ ID NO: 99620 - DNA, 25 bp, Homo sapien
cctgagcgtcacatcactgactgtg

SEQ ID NO: 99621 - DNA, 25 bp, Homo sapien
ccgaggcagctcgagttctgagatc

SEQ ID NO: 99622 - DNA, 25 bp, Homo sapien
agttctgagatctcgctggctcttc

SEQ ID NO: 99623 - DNA, 25 bp, Homo sapien
gctggctcttctcctctcggatttt

SEQ ID NO: 99624 - DNA, 25 bp, Homo sapien
caaaggaatgaatccggccgcgctg

SEQ ID NO: 99625 - DNA, 25 bp, Homo sapien
agcccgcggcttttctgtcttcctt

SEQ ID NO: 99626 - DNA, 25 bp, Homo sapien
tcgccgcttgtcaggcctgactgct

SEQ ID NO: 99627 - DNA, 25 bp, Homo sapien
tagcgcccggtacttgcctgcaggc

SEQ ID NO: 99628 - DNA, 25 bp, Homo sapien
ccgcagaggcctcacccttggaggt

SEQ ID NO: 99629 - DNA, 25 bp, Homo sapien
aggcctgactgctgttggcgcccac

SEQ ID NO: 99630 - DNA, 25 bp, Homo sapien
ctcgaggccggactgctgctttgcc

SEQ ID NO: 99631 - DNA, 25 bp, Homo sapien
gactgctgctttgccgtggcaggcc

SEQ ID NO: 99632 - DNA, 25 bp, Homo sapien
ctcacccttggaggtcgccgcttgt

SEQ ID NO: 99633 - DNA, 25 bp, Homo sapien
gagcctgagacaccggctcccgtga

SEQ ID NO: 99634 - DNA, 25 bp, Homo sapien
tgtcaggaagctcgaaggtgatctc

SEQ ID NO: 99635 - DNA, 25 bp, Homo sapien
ggtccaggcaccagtagcagcagtg

SEQ ID NO: 99636 - DNA, 25 bp, Homo sapien
ggcctcaaccgagctgcgagacgca

SEQ ID NO: 99637 - DNA, 25 bp, Homo sapien
gagattcgggatcagagcgaccctc

SEQ ID NO: 99638 - DNA, 25 bp, Homo sapien
tcccgtgacccggatgcgttcttct

SEQ ID NO: 99639 - DNA, 25 bp, Homo sapien
atgtcctcgtagaagcactgcttgg

SEQ ID NO: 99640 - DNA, 25 bp, Homo sapien
gttggctctgcctccgttgcagcct

SEQ ID NO: 99641 - DNA, 25 bp, Homo sapien
acctgtactggtcgaacttggcgta

SEQ ID NO: 99642 - DNA, 25 bp, Homo sapien
caggttcagatctgtggggttcatc

SEQ ID NO: 99643 - DNA, 25 bp, Homo sapien
gtcgctctcgtaggcttccatgatg

SEQ ID NO: 99644 - DNA, 25 bp, Homo sapien
gatggcctgcacctcctctacattg

SEQ ID NO: 99645 - DNA, 25 bp, Homo sapien
gtggcttcagcacttcggtctgttc

SEQ ID NO: 99646 - DNA, 25 bp, Homo sapien
cccagcattagagtgccgaaacgta

SEQ ID NO: 99647 - DNA, 25 bp, Homo sapien
tggagacgcggtgcacacacaaatc

SEQ ID NO: 99648 - DNA, 25 bp, Homo sapien
cgagcttcccgagccagtcactttg

SEQ ID NO: 99649 - DNA, 25 bp, Homo sapien
taccagccctacgtgagtatccagc

SEQ ID NO: 99650 - DNA, 25 bp, Homo sapien
cgcagacctctgaacgttagtaacg

SEQ ID NO: 99651 - DNA, 25 bp, Homo sapien
gcaacatgtgtttctccgcgactac

SEQ ID NO: 99652 - DNA, 25 bp, Homo sapien
gtcgaatgcgcacactccagttagg

SEQ ID NO: 99653 - DNA, 25 bp, Homo sapien
gctggctcggacctagaaatgtttc

SEQ ID NO: 99654 - DNA, 25 bp, Homo sapien
gaagccgcggctctccaagttctac

SEQ ID NO: 99655 - DNA, 25 bp, Homo sapien
tcggcccggcacagccatgatcaag

SEQ ID NO: 99656 - DNA, 25 bp, Homo sapien
gtgttcccggctagtcattcaaatc

SEQ ID NO: 99657 - DNA, 25 bp, Homo sapien
gcgaccaagtgctcagcgcagcgct

SEQ ID NO: 99658 - DNA, 25 bp, Homo sapien
ccgcccctcgtgttcattggcagcc

SEQ ID NO: 99659 - DNA, 25 bp, Homo sapien
gagacctcagccttacaagaccggc

SEQ ID NO: 99660 - DNA, 25 bp, Homo sapien
cttacaagaccggctccgctgaggc

SEQ ID NO: 99661 - DNA, 25 bp, Homo sapien
ccggccgccaggtatccgctcagcg

SEQ ID NO: 99662 - DNA, 25 bp, Homo sapien
gcagtggcagcgaggcccctcacct

SEQ ID NO: 99663 - DNA, 25 bp, Homo sapien
gcgcgcgaccaagtgctcagcgcag

SEQ ID NO: 99664 - DNA, 25 bp, Homo sapien
agccttacaagaccggctccgctga

SEQ ID NO: 99665 - DNA, 25 bp, Homo sapien
cagttctttaaggagccgcagacgg

SEQ ID NO: 99666 - DNA, 25 bp, Homo sapien
cacccaggggactgggcttccaggt

SEQ ID NO: 99667 - DNA, 25 bp, Homo sapien
cccagttctttaaggagccgcagac

SEQ ID NO: 99668 - DNA, 25 bp, Homo sapien
cgggcatcccaatccgggggctcag

SEQ ID NO: 99669 - DNA, 25 bp, Homo sapien
cagcgccgaactccgggcatcccaa

SEQ ID NO: 99670 - DNA, 25 bp, Homo sapien
cccgctcgcggcctttgcaaagcct

SEQ ID NO: 99671 - DNA, 25 bp, Homo sapien
ggccgcgaagaaaggccaaagcgcc

SEQ ID NO: 99672 - DNA, 25 bp, Homo sapien
tccgtggccgcgaagaaaggccaaa

SEQ ID NO: 99673 - DNA, 25 bp, Homo sapien
gttgctggtagctcatcgctggctt

SEQ ID NO: 99674 - DNA, 25 bp, Homo sapien
ggaagcgaagttagcgccacacatt

SEQ ID NO: 99675 - DNA, 25 bp, Homo sapien
gcctccggacgttgtttccatcttc

SEQ ID NO: 99676 - DNA, 25 bp, Homo sapien
gttgtttccatcttcgccttcgctg

SEQ ID NO: 99677 - DNA, 25 bp, Homo sapien
gccgcatgcctcctgggcttattta

SEQ ID NO: 99678 - DNA, 25 bp, Homo sapien
agaaatttgttctgacggcgcggcc

SEQ ID NO: 99679 - DNA, 25 bp, Homo sapien
aaatatcctggtcctcaagccctta

SEQ ID NO: 99680 - DNA, 25 bp, Homo sapien
gcagggtcatttctgaacgcattcc

SEQ ID NO: 99681 - DNA, 25 bp, Homo sapien
tcgcgctggacacggaatacatggt

SEQ ID NO: 99682 - DNA, 25 bp, Homo sapien
tgccgctgcactacgatctggagct

SEQ ID NO: 99683 - DNA, 25 bp, Homo sapien
tgctgcatagcctcttccaggactg

SEQ ID NO: 99684 - DNA, 25 bp, Homo sapien
ccctgaaacctggtagcagctacga

SEQ ID NO: 99685 - DNA, 25 bp, Homo sapien
tgcagcttagcttctcgggcctggt

SEQ ID NO: 99686 - DNA, 25 bp, Homo sapien
gggtccagctgactaccgtgtccag

SEQ ID NO: 99687 - DNA, 25 bp, Homo sapien
gcgtctgctgccctttccaaagaat

SEQ ID NO: 99688 - DNA, 25 bp, Homo sapien
tctttgcccttcactggccgcgtga

SEQ ID NO: 99689 - DNA, 25 bp, Homo sapien
caaacctgtgtgcaggatccgcctc

SEQ ID NO: 99690 - DNA, 25 bp, Homo sapien
cccggggagacgattaaataccatg

SEQ ID NO: 99691 - DNA, 25 bp, Homo sapien
cgcacgcgcatacgttgaccgcatg

SEQ ID NO: 99692 - DNA, 25 bp, Homo sapien
actcaggtactggatcccgggctaa

SEQ ID NO: 99693 - DNA, 25 bp, Homo sapien
gccacctgaacttgcggcgcgaaaa

SEQ ID NO: 99694 - DNA, 25 bp, Homo sapien
accgcattgcggcttggttttctca

SEQ ID NO: 99695 - DNA, 25 bp, Homo sapien
ttggttttctcacccagtgcatgtg

SEQ ID NO: 99696 - DNA, 25 bp, Homo sapien
gctcacattcggaggctggtgtcca

SEQ ID NO: 99697 - DNA, 25 bp, Homo sapien
cccaggtagctgatccgttaagctc

SEQ ID NO: 99698 - DNA, 25 bp, Homo sapien
cgttaagctcttgcggtagccgcgc

SEQ ID NO: 99699 - DNA, 25 bp, Homo sapien
cgggctcgcacaaggctgtccttgc

SEQ ID NO: 99700 - DNA, 25 bp, Homo sapien
gtagcgcctctacagtcacggtggt

SEQ ID NO: 99701 - DNA, 25 bp, Homo sapien
tcactgttcgcggagtttggtatca

SEQ ID NO: 99702 - DNA, 25 bp, Homo sapien
tttggtatcagaagttcccgggtgc

SEQ ID NO: 99703 - DNA, 25 bp, Homo sapien
tgctgccttcagtgctgccgaatca

SEQ ID NO: 99704 - DNA, 25 bp, Homo sapien
tgccgaatcacgtggaacggtattc

SEQ ID NO: 99705 - DNA, 25 bp, Homo sapien
acggtccctgcatctcctgatgaga

SEQ ID NO: 99706 - DNA, 25 bp, Homo sapien
gtggcgctcttgaaatccatcgtca

SEQ ID NO: 99707 - DNA, 25 bp, Homo sapien
ggcggctgctgtctaccctaaacag

SEQ ID NO: 99708 - DNA, 25 bp, Homo sapien
gctccagatttagggctcctccatc

SEQ ID NO: 99709 - DNA, 25 bp, Homo sapien
tggtgctttcaagtgggcccgacac

SEQ ID NO: 99710 - DNA, 25 bp, Homo sapien
gcgctgtcgctgctcccacagaaag

SEQ ID NO: 99711 - DNA, 25 bp, Homo sapien
tgcccgcgctgtcattacggcgctg

SEQ ID NO: 99712 - DNA, 25 bp, Homo sapien
tgagagcccgcgcttctaattcggg

SEQ ID NO: 99713 - DNA, 25 bp, Homo sapien
cgccgatgatcacagacgcagtaga

SEQ ID NO: 99714 - DNA, 25 bp, Homo sapien
ctccggctttgggtctttggattga

SEQ ID NO: 99715 - DNA, 25 bp, Homo sapien
ccgctgagcttggtgacgctgctca

SEQ ID NO: 99716 - DNA, 25 bp, Homo sapien
agtgggtgagctccttctccttgcg

SEQ ID NO: 99717 - DNA, 25 bp, Homo sapien
agccacgtctttgcgccgatgatca

SEQ ID NO: 99718 - DNA, 25 bp, Homo sapien
cagtagacggtgatgcccgagaaga

SEQ ID NO: 99719 - DNA, 25 bp, Homo sapien
taatgagcatcttggccgtgttgcc

SEQ ID NO: 99720 - DNA, 25 bp, Homo sapien
gtgctggtctgctttaatgagcatc

SEQ ID NO: 99721 - DNA, 25 bp, Homo sapien
gcttccgagaatcccaccatttagg

SEQ ID NO: 99722 - DNA, 25 bp, Homo sapien
cggctgctcccggacacttattcga

SEQ ID NO: 99723 - DNA, 25 bp, Homo sapien
cgggtgcctagagccattacaagtt

SEQ ID NO: 99724 - DNA, 25 bp, Homo sapien
gcactggacgaaaacagcgctgtta

SEQ ID NO: 99725 - DNA, 25 bp, Homo sapien
cgcaagcctttgtcattcctacatg

SEQ ID NO: 99726 - DNA, 25 bp, Homo sapien
cgcggcgactactttctgggatgca

SEQ ID NO: 99727 - DNA, 25 bp, Homo sapien
tctgggatgcaaacgcgatgtgttc

SEQ ID NO: 99728 - DNA, 25 bp, Homo sapien
taccttttcggtgcatcgacggaca

SEQ ID NO: 99729 - DNA, 25 bp, Homo sapien
taggattgcgctttcccgcgggttg

SEQ ID NO: 99730 - DNA, 25 bp, Homo sapien
cacccagattttggctgatgactgc

SEQ ID NO: 99731 - DNA, 25 bp, Homo sapien
ccggctgcgctatttaacacccaga

SEQ ID NO: 99732 - DNA, 25 bp, Homo sapien
ggacgtctcctcagaatcccgcggg

SEQ ID NO: 99733 - DNA, 25 bp, Homo sapien
cggggtcgccgaggctccttcttcg

SEQ ID NO: 99734 - DNA, 25 bp, Homo sapien
ggcgcggtactgcagccccttcgaa

SEQ ID NO: 99735 - DNA, 25 bp, Homo sapien
tttggctgatgactgcagggtcagt

SEQ ID NO: 99736 - DNA, 25 bp, Homo sapien
tcgaagctccggacccttcggcctc

SEQ ID NO: 99737 - DNA, 25 bp, Homo sapien
ggactccggcagctttatcgccaga

SEQ ID NO: 99738 - DNA, 25 bp, Homo sapien
gcggactccggcagctttatcgcca

SEQ ID NO: 99739 - DNA, 25 bp, Homo sapien
tcagacgcagccgtagacaccagct

SEQ ID NO: 99740 - DNA, 25 bp, Homo sapien
catgtcagacgcagccgtagacacc

SEQ ID NO: 99741 - DNA, 25 bp, Homo sapien
ccaccatgtcagacgcagccgtaga

SEQ ID NO: 99742 - DNA, 25 bp, Homo sapien
gctttatcgccagagtccctgaact

SEQ ID NO: 99743 - DNA, 25 bp, Homo sapien
cagctttatcgccagagtccctgaa

SEQ ID NO: 99744 - DNA, 25 bp, Homo sapien
tccggcagctttatcgccagagtcc

SEQ ID NO: 99745 - DNA, 25 bp, Homo sapien
ctccttgtcgttcggcgtctgagag

SEQ ID NO: 99746 - DNA, 25 bp, Homo sapien
gagtgttcgtgcctctttctgcgac

SEQ ID NO: 99747 - DNA, 25 bp, Homo sapien
gacactccggtcaggccgtggcatt

SEQ ID NO: 99748 - DNA, 25 bp, Homo sapien
ggcgccacgcgctgtagaaaccggc

SEQ ID NO: 99749 - DNA, 25 bp, Homo sapien
cccattggtccgtgcccagtgggac

SEQ ID NO: 99750 - DNA, 25 bp, Homo sapien
gagatttccaacgtgcacccgccaa

SEQ ID NO: 99751 - DNA, 25 bp, Homo sapien
gccgctgggaaggaacgagcccatt

SEQ ID NO: 99752 - DNA, 25 bp, Homo sapien
cggtcacctgcagcgggtgcactca

SEQ ID NO: 99753 - DNA, 25 bp, Homo sapien
tgcccgtcattctgggccgagcttg

SEQ ID NO: 99754 - DNA, 25 bp, Homo sapien
cactgcttctccgtgggcagcattg

SEQ ID NO: 99755 - DNA, 25 bp, Homo sapien
gggcgccgacatgaacctgcaccag

SEQ ID NO: 99756 - DNA, 25 bp, Homo sapien
aagcagccgctgacccgtggcatga

SEQ ID NO: 99757 - DNA, 25 bp, Homo sapien
ggaccctgagcttcacctgggctag

SEQ ID NO: 99758 - DNA, 25 bp, Homo sapien
agcgcgtactgcttgcgccactcgg

SEQ ID NO: 99759 - DNA, 25 bp, Homo sapien
atatttcggccgcagggatccagag

SEQ ID NO: 99760 - DNA, 25 bp, Homo sapien
gcagcattggcgaccagcgcttcac

SEQ ID NO: 99761 - DNA, 25 bp, Homo sapien
gtcgcgccactcctccgagtaagtg

SEQ ID NO: 99762 - DNA, 25 bp, Homo sapien
caacttgtttaggtgggtgtgcgta

SEQ ID NO: 99763 - DNA, 25 bp, Homo sapien
cgcgaaattttactcggttccagtg

SEQ ID NO: 99764 - DNA, 25 bp, Homo sapien
caggagcgcacagcctcggaaactc

SEQ ID NO: 99765 - DNA, 25 bp, Homo sapien
gaacccgtgagccaccgagagagca

SEQ ID NO: 99766 - DNA, 25 bp, Homo sapien
tcctccgagtaagtggctcctgggc

SEQ ID NO: 99767 - DNA, 25 bp, Homo sapien
cgcctccggctcagagagtttctga

SEQ ID NO: 99768 - DNA, 25 bp, Homo sapien
tgggtgcgtttgaacaacttgttta

SEQ ID NO: 99769 - DNA, 25 bp, Homo sapien
cggaggcgtgttcctgactttacta

SEQ ID NO: 99770 - DNA, 25 bp, Homo sapien
cccagacggatctagatggttcttc

SEQ ID NO: 99771 - DNA, 25 bp, Homo sapien
tccggttgaatctggtggcttgcac

SEQ ID NO: 99772 - DNA, 25 bp, Homo sapien
atcggcgaccttcaggccttccagg

SEQ ID NO: 99773 - DNA, 25 bp, Homo sapien
tgccgtggtcataatcgtgcgagcg

SEQ ID NO: 99774 - DNA, 25 bp, Homo sapien
gcggctaagttcacgggcctgtcca

SEQ ID NO: 99775 - DNA, 25 bp, Homo sapien
tgagccaccatctgaccgcaagctg

SEQ ID NO: 99776 - DNA, 25 bp, Homo sapien
ctgaatgagttagagcccgagaagc

SEQ ID NO: 99777 - DNA, 25 bp, Homo sapien
cgaacttgcggctcgtccgagtaca

SEQ ID NO: 99778 - DNA, 25 bp, Homo sapien
tccgagtacatgtgagcggtaatcg

SEQ ID NO: 99779 - DNA, 25 bp, Homo sapien
cttctcggccctgtgtctcgggaga

SEQ ID NO: 99780 - DNA, 25 bp, Homo sapien
gctgacacgcgattcgtcactcttg

SEQ ID NO: 99781 - DNA, 25 bp, Homo sapien
ttcgtcactcttgcagaactttccc

SEQ ID NO: 99782 - DNA, 25 bp, Homo sapien
cggatttcgctgcagagcgaacttg

SEQ ID NO: 99783 - DNA, 25 bp, Homo sapien
tgcgtttgccgacggttcttctcgg

SEQ ID NO: 99784 - DNA, 25 bp, Homo sapien
attttccgtcgtgtgcggatttcgc

SEQ ID NO: 99785 - DNA, 25 bp, Homo sapien
agcggctctgcttgttcgtgtgtgt

SEQ ID NO: 99786 - DNA, 25 bp, Homo sapien
tgcgctcatcttcctaccagaaatc

SEQ ID NO: 99787 - DNA, 25 bp, Homo sapien
gcgtccagcggctctgcttgttcgt

SEQ ID NO: 99788 - DNA, 25 bp, Homo sapien
tgtgtgtcgttgcaggccttattca

SEQ ID NO: 99789 - DNA, 25 bp, Homo sapien
ggccttattcatgggctcaccgctg

SEQ ID NO: 99790 - DNA, 25 bp, Homo sapien
atgggctcaccgctgaggttcgacg

SEQ ID NO: 99791 - DNA, 25 bp, Homo sapien
ttttcgggccggcatacgcgcgcag

SEQ ID NO: 99792 - DNA, 25 bp, Homo sapien
ccagaaatcggcaagtcactgaccc

SEQ ID NO: 99793 - DNA, 25 bp, Homo sapien
gggactgcaagcgtcaaccctggcg

SEQ ID NO: 99794 - DNA, 25 bp, Homo sapien
tcgaggggactgcaagcgtcaaccc

SEQ ID NO: 99795 - DNA, 25 bp, Homo sapien
tgcaagcgtcaaccctggcgcggca

SEQ ID NO: 99796 - DNA, 25 bp, Homo sapien
gatggcagcaccactgtgcggccgc

SEQ ID NO: 99797 - DNA, 25 bp, Homo sapien
ggagcgcagccactcgccgctgccc

SEQ ID NO: 99798 - DNA, 25 bp, Homo sapien
cagcggccgtagcagcgccagggac

SEQ ID NO: 99799 - DNA, 25 bp, Homo sapien
caacgtcgaggggactgcaagcgtc

SEQ ID NO: 99800 - DNA, 25 bp, Homo sapien
ggagttgatggcagcaccactgtgc

SEQ ID NO: 99801 - DNA, 25 bp, Homo sapien
cgaacgtcgttaccagtaactctgg

SEQ ID NO: 99802 - DNA, 25 bp, Homo sapien
cattggcgtcctggctctctgcagc

SEQ ID NO: 99803 - DNA, 25 bp, Homo sapien
ggtcttgccattggcgtcctggctc

SEQ ID NO: 99804 - DNA, 25 bp, Homo sapien
ttgaacccgagaagcaggacgcgca

SEQ ID NO: 99805 - DNA, 25 bp, Homo sapien
cgccacttggcattgaacccgagaa

SEQ ID NO: 99806 - DNA, 25 bp, Homo sapien
caccctgtcgccacttggcattgaa

SEQ ID NO: 99807 - DNA, 25 bp, Homo sapien
gcagctgggactgcttcggttcttc

SEQ ID NO: 99808 - DNA, 25 bp, Homo sapien
tcgttaccagtaactctgggccttc

SEQ ID NO: 99809 - DNA, 25 bp, Homo sapien
ctcgagctctatgcgtcctacgtgt

SEQ ID NO: 99810 - DNA, 25 bp, Homo sapien
ggatgacgtggccttgaacaacttc

SEQ ID NO: 99811 - DNA, 25 bp, Homo sapien
acgtgtacttgtccatggcctatta

SEQ ID NO: 99812 - DNA, 25 bp, Homo sapien
cctagggccacgttctgatcagatc

SEQ ID NO: 99813 - DNA, 25 bp, Homo sapien
acgcagtcaccgttgcctagggcca

SEQ ID NO: 99814 - DNA, 25 bp, Homo sapien
tcacggaatcgtgactgggcatctg

SEQ ID NO: 99815 - DNA, 25 bp, Homo sapien
gcctgcaggacatcaagaagccgga

SEQ ID NO: 99816 - DNA, 25 bp, Homo sapien
tggcctattacttctcccgggatga

SEQ ID NO: 99817 - DNA, 25 bp, Homo sapien
cgaggaacctatggggctgacttta

SEQ ID NO: 99818 - DNA, 25 bp, Homo sapien
cagccgggaactctgaacctcaata

SEQ ID NO: 99819 - DNA, 25 bp, Homo sapien
agctcttttgagacgcgtggtcgga

SEQ ID NO: 99820 - DNA, 25 bp, Homo sapien
ttcatctaccatggctcagccggga

SEQ ID NO: 99821 - DNA, 25 bp, Homo sapien
aggcagcggcggatcatattccttc

SEQ ID NO: 99822 - DNA, 25 bp, Homo sapien
caatgtttcttgttcccaggcggca

SEQ ID NO: 99823 - DNA, 25 bp, Homo sapien
cggttttcccttccaagcgtcaatg

SEQ ID NO: 99824 - DNA, 25 bp, Homo sapien
aattccgttgcgtagccctctgcgc

SEQ ID NO: 99825 - DNA, 25 bp, Homo sapien
ggcagccacgtcgagaagccacata

SEQ ID NO: 99826 - DNA, 25 bp, Homo sapien
gcgcatcactccttttgccagattg

SEQ ID NO: 99827 - DNA, 25 bp, Homo sapien
cacggtccaggcgaagcgcatcact

SEQ ID NO: 99828 - DNA, 25 bp, Homo sapien
ccagacgcgcggtttgcactggatt

SEQ ID NO: 99829 - DNA, 25 bp, Homo sapien
ctctagatgtcgagtagccagcttg

SEQ ID NO: 99830 - DNA, 25 bp, Homo sapien
tgagcccaggctcagcaagctgaac

SEQ ID NO: 99831 - DNA, 25 bp, Homo sapien
aggaggacgtggctcacagaaaata

SEQ ID NO: 99832 - DNA, 25 bp, Homo sapien
cgcaggttactgagcgcaggaactt

SEQ ID NO: 99833 - DNA, 25 bp, Homo sapien
cggcagtcgaggtaaaaagagcgaa

SEQ ID NO: 99834 - DNA, 25 bp, Homo sapien
gaaagagcaggttcgtggacaggag

SEQ ID NO: 99835 - DNA, 25 bp, Homo sapien
aaagaaagagcaggttcgtggacag

SEQ ID NO: 99836 - DNA, 25 bp, Homo sapien
ggcgcccgcgctgcgttccttgtcc

SEQ ID NO: 99837 - DNA, 25 bp, Homo sapien
taaagaaagagcaggttcgtggaca

SEQ ID NO: 99838 - DNA, 25 bp, Homo sapien
aaggtaaagaaagagcaggttcgtg

SEQ ID NO: 99839 - DNA, 25 bp, Homo sapien
aagagcgaaaggtaaagaaagagca

SEQ ID NO: 99840 - DNA, 25 bp, Homo sapien
cagtcgaggtaaaaagagcgaaagg

SEQ ID NO: 99841 - DNA, 25 bp, Homo sapien
tcggtcagtcagtcccttcgcgctc

SEQ ID NO: 99842 - DNA, 25 bp, Homo sapien
cggccgggccgcattgtgacgtagc

SEQ ID NO: 99843 - DNA, 25 bp, Homo sapien
tgctcctgccgctgcggtccgtcgg

SEQ ID NO: 99844 - DNA, 25 bp, Homo sapien
agtcccttcgcgctcctgagccgcc

SEQ ID NO: 99845 - DNA, 25 bp, Homo sapien
gagtccaggtcccaagcggacgccg

SEQ ID NO: 99846 - DNA, 25 bp, Homo sapien
cagcggctcagcctttccaagtttg

SEQ ID NO: 99847 - DNA, 25 bp, Homo sapien
agcggctcagcctttccaagtttgc

SEQ ID NO: 99848 - DNA, 25 bp, Homo sapien
tccaccgcccgcctacttcggctga

SEQ ID NO: 99849 - DNA, 25 bp, Homo sapien
atcttatcgcaggcagggatgggca

SEQ ID NO: 99850 - DNA, 25 bp, Homo sapien
taatagctgtagaaaagggacgtct

SEQ ID NO: 99851 - DNA, 25 bp, Homo sapien
aaaagggacgtctggtgttgctgcc

SEQ ID NO: 99852 - DNA, 25 bp, Homo sapien
gtactaacaacggtaataatagctg

SEQ ID NO: 99853 - DNA, 25 bp, Homo sapien
gcgacagtactaacaacggtaataa

SEQ ID NO: 99854 - DNA, 25 bp, Homo sapien
gtaatagcgacagtactaacaacgg

SEQ ID NO: 99855 - DNA, 25 bp, Homo sapien
atgggcagttccgcggctcggaaaa

SEQ ID NO: 99856 - DNA, 25 bp, Homo sapien
cctccctctagtgctgttctgcgtc

SEQ ID NO: 99857 - DNA, 25 bp, Homo sapien
gtgcagtgatgagcgaccgagtccc

SEQ ID NO: 99858 - DNA, 25 bp, Homo sapien
catcgtcaagggcacaggtacggtg

SEQ ID NO: 99859 - DNA, 25 bp, Homo sapien
cagagtgcaccaggcctgtcgtcaa

SEQ ID NO: 99860 - DNA, 25 bp, Homo sapien
ctgtcgtcaaggacacgggtacggt

SEQ ID NO: 99861 - DNA, 25 bp, Homo sapien
cacaggtacggtggctcggtcccgc

SEQ ID NO: 99862 - DNA, 25 bp, Homo sapien
cccaaatgtgcagtgatgagcgacc

SEQ ID NO: 99863 - DNA, 25 bp, Homo sapien
cgaccgggctcccaaatgtgcagtg

SEQ ID NO: 99864 - DNA, 25 bp, Homo sapien
ccgacagcatcgtcaagggcacagg

SEQ ID NO: 99865 - DNA, 25 bp, Homo sapien
ttggctagctcacccttatcagatg

SEQ ID NO: 99866 - DNA, 25 bp, Homo sapien
tcgcctggtcgagaattcagtcctc

SEQ ID NO: 99867 - DNA, 25 bp, Homo sapien
tctcggctcctgctggttgttattt

SEQ ID NO: 99868 - DNA, 25 bp, Homo sapien
cagttctccctcatttctggctggg

SEQ ID NO: 99869 - DNA, 25 bp, Homo sapien
ctgctcgcgacaaagggcttcttga

SEQ ID NO: 99870 - DNA, 25 bp, Homo sapien
ttttaagcctccgagtgcggcacga

SEQ ID NO: 99871 - DNA, 25 bp, Homo sapien
cttctgaagtctgtgcagtcgcgga

SEQ ID NO: 99872 - DNA, 25 bp, Homo sapien
cctccaggccaccaagggaacgtgg

SEQ ID NO: 99873 - DNA, 25 bp, Homo sapien
catgagtctgacattggagtcggcc

SEQ ID NO: 99874 - DNA, 25 bp, Homo sapien
cgggcactcacacggtgaccttgca

SEQ ID NO: 99875 - DNA, 25 bp, Homo sapien
ccttgcacaggtggcagaactgatt

SEQ ID NO: 99876 - DNA, 25 bp, Homo sapien
cgacgaggtggaacgagaagatccc

SEQ ID NO: 99877 - DNA, 25 bp, Homo sapien
actgattctggatcacgtgtgcatg

SEQ ID NO: 99878 - DNA, 25 bp, Homo sapien
cgtgtgcatgttttgatctgtcgaa

SEQ ID NO: 99879 - DNA, 25 bp, Homo sapien
ggcatgggctgagaatagttcttca

SEQ ID NO: 99880 - DNA, 25 bp, Homo sapien
tccactagcatcagctgcggccatg

SEQ ID NO: 99881 - DNA, 25 bp, Homo sapien
gaccgtcttggggtgacacctgtga

SEQ ID NO: 99882 - DNA, 25 bp, Homo sapien
cccgtgtttgcaaggaccgtcttgg

SEQ ID NO: 99883 - DNA, 25 bp, Homo sapien
tccaccctagaggtgagaccgcgtc

SEQ ID NO: 99884 - DNA, 25 bp, Homo sapien
ggagaggacctgttcaccagcactg

SEQ ID NO: 99885 - DNA, 25 bp, Homo sapien
agcccaccgactttgaggatctgga

SEQ ID NO: 99886 - DNA, 25 bp, Homo sapien
agggccacgtcccagactttctggg

SEQ ID NO: 99887 - DNA, 25 bp, Homo sapien
cgggtgccgacctaatcctcagagg

SEQ ID NO: 99888 - DNA, 25 bp, Homo sapien
cacctccggtgcctgtcagagggat

SEQ ID NO: 99889 - DNA, 25 bp, Homo sapien
cccgtttctgcagactcaggttttc

SEQ ID NO: 99890 - DNA, 25 bp, Homo sapien
tcccggacgagctgcagtcctcgga

SEQ ID NO: 99891 - DNA, 25 bp, Homo sapien
gcccttggcgcggttgtcaaggaaa

SEQ ID NO: 99892 - DNA, 25 bp, Homo sapien
tgctgcgcccaggaaacacccttgg

SEQ ID NO: 99893 - DNA, 25 bp, Homo sapien
cccgtcctttcgctatgaagagagc

SEQ ID NO: 99894 - DNA, 25 bp, Homo sapien
tggaggtctacatcccgtcctttcg

SEQ ID NO: 99895 - DNA, 25 bp, Homo sapien
aggcccgaaacccaggcgcctggag

SEQ ID NO: 99896 - DNA, 25 bp, Homo sapien
ggtcagcccgcagacctgagtccgg

SEQ ID NO: 99897 - DNA, 25 bp, Homo sapien
tccaggaatttaccgcgtaggcgcg

SEQ ID NO: 99898 - DNA, 25 bp, Homo sapien
ggctgggagcacctccaggaattta

SEQ ID NO: 99899 - DNA, 25 bp, Homo sapien
ttcagactcgcgacccgaacttggg

SEQ ID NO: 99900 - DNA, 25 bp, Homo sapien
gggcgcgttcctcccaagttcagac

SEQ ID NO: 99901 - DNA, 25 bp, Homo sapien
cccacgcaaagcacgagaggtagca

SEQ ID NO: 99902 - DNA, 25 bp, Homo sapien
ttgggcagtctctttcctggagaac

SEQ ID NO: 99903 - DNA, 25 bp, Homo sapien
ccaggccacgctgaaggaagtactt

SEQ ID NO: 99904 - DNA, 25 bp, Homo sapien
aggcgctttaatgcctgcctgaagc

SEQ ID NO: 99905 - DNA, 25 bp, Homo sapien
cccggaggatttatgttagaggttg

SEQ ID NO: 99906 - DNA, 25 bp, Homo sapien
ccggaggatttatgttagaggttgc

SEQ ID NO: 99907 - DNA, 25 bp, Homo sapien
gaggatttatgttagaggttgcgtg

SEQ ID NO: 99908 - DNA, 25 bp, Homo sapien
atgttagaggttgcgtggcgggcga

SEQ ID NO: 99909 - DNA, 25 bp, Homo sapien
ggatttatgttagaggttgcgtggc

SEQ ID NO: 99910 - DNA, 25 bp, Homo sapien
atttatgttagaggttgcgtggcgg

SEQ ID NO: 99911 - DNA, 25 bp, Homo sapien
ttagaggttgcgtggcgggcgagtg

SEQ ID NO: 99912 - DNA, 25 bp, Homo sapien
ttatgttagaggttgcgtggcgggc

SEQ ID NO: 99913 - DNA, 25 bp, Homo sapien
acagcgtgtgcggagatgcattccc

SEQ ID NO: 99914 - DNA, 25 bp, Homo sapien
gcaaaagcgcaaacccggtcctggc

SEQ ID NO: 99915 - DNA, 25 bp, Homo sapien
actgagccgggcaaaagcgcaaacc

SEQ ID NO: 99916 - DNA, 25 bp, Homo sapien
caggaaaaactgagccgggcaaaag

SEQ ID NO: 99917 - DNA, 25 bp, Homo sapien
cccagaagcacttcaggaaaaactg

SEQ ID NO: 99918 - DNA, 25 bp, Homo sapien
ggcgagtggactctggcacccagaa

SEQ ID NO: 99919 - DNA, 25 bp, Homo sapien
tctggcacccagaagcacttcagga

SEQ ID NO: 99920 - DNA, 25 bp, Homo sapien
gtgcggagatgcattcccgttgccg

SEQ ID NO: 99921 - DNA, 25 bp, Homo sapien
tccgggcggcacaatctctaggact

SEQ ID NO: 99922 - DNA, 25 bp, Homo sapien
gtagcgcacgcagggcgcacactct

SEQ ID NO: 99923 - DNA, 25 bp, Homo sapien
ccggcagcaccgagttttcaggtaa

SEQ ID NO: 99924 - DNA, 25 bp, Homo sapien
tcctgcagccgagttctacggggca

SEQ ID NO: 99925 - DNA, 25 bp, Homo sapien
gccgcagcttcggagtaaactttgc

SEQ ID NO: 99926 - DNA, 25 bp, Homo sapien
ggagtaaactttgcgcccaagcgga

SEQ ID NO: 99927 - DNA, 25 bp, Homo sapien
tgaaccaccggctcgggcactttct

SEQ ID NO: 99928 - DNA, 25 bp, Homo sapien
caattttctcgcttgcaggtcggga

SEQ ID NO: 99929 - DNA, 25 bp, Homo sapien
gtggacccggcctaacagacctctg

SEQ ID NO: 99930 - DNA, 25 bp, Homo sapien
cctgcttcacagtcccaagtgtttg

SEQ ID NO: 99931 - DNA, 25 bp, Homo sapien
gacaaaagttttctggcgttggaga

SEQ ID NO: 99932 - DNA, 25 bp, Homo sapien
cccgatctctgtgacaaaagttttc

SEQ ID NO: 99933 - DNA, 25 bp, Homo sapien
cgtctctggggagcacgcagaccag

SEQ ID NO: 99934 - DNA, 25 bp, Homo sapien
gcacgcagaccagggcttgtttttg

SEQ ID NO: 99935 - DNA, 25 bp, Homo sapien
tcacagtcccaagtgtttggggccg

SEQ ID NO: 99936 - DNA, 25 bp, Homo sapien
gggcttgtttttgctactctccacc

SEQ ID NO: 99937 - DNA, 25 bp, Homo sapien
cgcccagagcttttgcgattcgcgg

SEQ ID NO: 99938 - DNA, 25 bp, Homo sapien
aagcaggcttttcacctactccttg

SEQ ID NO: 99939 - DNA, 25 bp, Homo sapien
ttcagccatcccatctagcctatag

SEQ ID NO: 99940 - DNA, 25 bp, Homo sapien
tgggaccttcaaaactcagccttcg

SEQ ID NO: 99941 - DNA, 25 bp, Homo sapien
cggccacgcctcatgtcagaagaga

SEQ ID NO: 99942 - DNA, 25 bp, Homo sapien
gctttcctatatgcagggcgggtga

SEQ ID NO: 99943 - DNA, 25 bp, Homo sapien
cccgcagggtcgagactgaaatcaa

SEQ ID NO: 99944 - DNA, 25 bp, Homo sapien
tctggatctgcttctagacccgctc

SEQ ID NO: 99945 - DNA, 25 bp, Homo sapien
tctgcgcccagatccgaaggctttt

SEQ ID NO: 99946 - DNA, 25 bp, Homo sapien
agagcggacatgctatctgcgccca

SEQ ID NO: 99947 - DNA, 25 bp, Homo sapien
ccagcccagttcgagtggagggata

SEQ ID NO: 99948 - DNA, 25 bp, Homo sapien
gcatttagcctggagaacagccgtc

SEQ ID NO: 99949 - DNA, 25 bp, Homo sapien
aggctgatcgttaaatttgctattc

SEQ ID NO: 99950 - DNA, 25 bp, Homo sapien
tgctattcctttcttccggcgtcta

SEQ ID NO: 99951 - DNA, 25 bp, Homo sapien
ctagggagagcgtgcacaccaaacc

SEQ ID NO: 99952 - DNA, 25 bp, Homo sapien
tctcttcgagacagcagattgggca

SEQ ID NO: 99953 - DNA, 25 bp, Homo sapien
ttaatggccagctctccacactgct

SEQ ID NO: 99954 - DNA, 25 bp, Homo sapien
gtgggtctcctgttcccagtgctac

SEQ ID NO: 99955 - DNA, 25 bp, Homo sapien
gttcccagtgctaccctgcatagtg

SEQ ID NO: 99956 - DNA, 25 bp, Homo sapien
agtgctaccctgcatagtgacctcc

SEQ ID NO: 99957 - DNA, 25 bp, Homo sapien
acttggcgttagcatccttaatggc

SEQ ID NO: 99958 - DNA, 25 bp, Homo sapien
acactgctcggcatctgcaatggcg

SEQ ID NO: 99959 - DNA, 25 bp, Homo sapien
tcggagatcttagtctttgtgcacc

SEQ ID NO: 99960 - DNA, 25 bp, Homo sapien
cctccagctcgacaacttggcgtta

SEQ ID NO: 99961 - DNA, 25 bp, Homo sapien
ccagagtcaggccagtagaattcca

SEQ ID NO: 99962 - DNA, 25 bp, Homo sapien
cccgcctatgaggacacaacctgga

SEQ ID NO: 99963 - DNA, 25 bp, Homo sapien
tcagctttccgccacagggtgtacg

SEQ ID NO: 99964 - DNA, 25 bp, Homo sapien
tgtaggtcccacgtgaaactgctgg

SEQ ID NO: 99965 - DNA, 25 bp, Homo sapien
ccgcaagtacgcaccgagaggttca

SEQ ID NO: 99966 - DNA, 25 bp, Homo sapien
cagtgtcaaatgtactcgcgtcttc

SEQ ID NO: 99967 - DNA, 25 bp, Homo sapien
tgcttttgccgcgatcctaaatgtc

SEQ ID NO: 99968 - DNA, 25 bp, Homo sapien
aactctgtacagtggaatccgctcg

SEQ ID NO: 99969 - DNA, 25 bp, Homo sapien
cgcccttttacgctctgttccagag

SEQ ID NO: 99970 - DNA, 25 bp, Homo sapien
gctagaacgcccgtcagcgagcttc

SEQ ID NO: 99971 - DNA, 25 bp, Homo sapien
gcagccctgccagtctgcaagcaga

SEQ ID NO: 99972 - DNA, 25 bp, Homo sapien
gcactactgctgtaaacgcttcctg

SEQ ID NO: 99973 - DNA, 25 bp, Homo sapien
aacgggtgatagagacagagcagtc

SEQ ID NO: 99974 - DNA, 25 bp, Homo sapien
agccctaaggaggacgccttcatta

SEQ ID NO: 99975 - DNA, 25 bp, Homo sapien
cttcctgaagctgcgtagcctttaa

SEQ ID NO: 99976 - DNA, 25 bp, Homo sapien
agcctttaaggagcgtgagtgtagc

SEQ ID NO: 99977 - DNA, 25 bp, Homo sapien
aggacatctgtggaaaccgacctcc

SEQ ID NO: 99978 - DNA, 25 bp, Homo sapien
ctgtggaaaccgacctccacaacag

SEQ ID NO: 99979 - DNA, 25 bp, Homo sapien
aatgctgcccactacctcgtctaga

SEQ ID NO: 99980 - DNA, 25 bp, Homo sapien
gccgcgacccaaggacatctgtgga

SEQ ID NO: 99981 - DNA, 25 bp, Homo sapien
cctcgtctagacgtcacactgactg

SEQ ID NO: 99982 - DNA, 25 bp, Homo sapien
gtcacactgactgtgctggggtctc

SEQ ID NO: 99983 - DNA, 25 bp, Homo sapien
tggtccctctcggaggcgttggaca

SEQ ID NO: 99984 - DNA, 25 bp, Homo sapien
tgtgcttcgtgcaggtcctgcagga

SEQ ID NO: 99985 - DNA, 25 bp, Homo sapien
tactcggctgttttcgctgatgcgg

SEQ ID NO: 99986 - DNA, 25 bp, Homo sapien
cagaaggatgtttgacctccggata

SEQ ID NO: 99987 - DNA, 25 bp, Homo sapien
gcacggctctagaaagacggggata

SEQ ID NO: 99988 - DNA, 25 bp, Homo sapien
gcgcggcttaggctttatacacctt

SEQ ID NO: 99989 - DNA, 25 bp, Homo sapien
tcggcgatccgaccaatccaagaag

SEQ ID NO: 99990 - DNA, 25 bp, Homo sapien
gttggtgcaatcttcggctctactc

SEQ ID NO: 99991 - DNA, 25 bp, Homo sapien
ctgtgcattcattccgggctgcatc

SEQ ID NO: 99992 - DNA, 25 bp, Homo sapien
tccatgtgttcacttccgggtccgg

SEQ ID NO: 99993 - DNA, 25 bp, Homo sapien
catagcagtggcataaaaatagaca

SEQ ID NO: 99994 - DNA, 25 bp, Homo sapien
gcctgaaagactgcctggcctccta

SEQ ID NO: 99995 - DNA, 25 bp, Homo sapien
tagacacaacaggtcggtaaagccg

SEQ ID NO: 99996 - DNA, 25 bp, Homo sapien
tggtaatcaaaacagcatagcagtg

SEQ ID NO: 99997 - DNA, 25 bp, Homo sapien
cctgacttcgaaatatataaagcta

SEQ ID NO: 99998 - DNA, 25 bp, Homo sapien
gaaagcatcatacaacctgacttcg

SEQ ID NO: 99999 - DNA, 25 bp, Homo sapien
gccaaagaaatctagagcagaaaga

SEQ ID NO: 100000 - DNA, 25 bp, Homo sapien
gagtcgggtcctgtcggcttcctcc

SEQ ID NO: 100001 - DNA, 25 bp, Homo sapien
ggacacaggctcattcgcactaacg

SEQ ID NO: 100002 - DNA, 25 bp, Homo sapien
ccggccgtgcagtgaaagcttcggt

SEQ ID NO: 100003 - DNA, 25 bp, Homo sapien
aaagcttcggtctgcgtgaccgtgc

SEQ ID NO: 100004 - DNA, 25 bp, Homo sapien
cgcagaaccctcagaacgaaattca

SEQ ID NO: 100005 - DNA, 25 bp, Homo sapien
cacgcgggacacaggctcattcgca

SEQ ID NO: 100006 - DNA, 25 bp, Homo sapien
ccgctgcgagcactcgcgtctgatt

SEQ ID NO: 100007 - DNA, 25 bp, Homo sapien
gtttccagagaacgctggccgcgga

SEQ ID NO: 100008 - DNA, 25 bp, Homo sapien
attcgcactaacgagtccggccgtg

SEQ ID NO: 100009 - DNA, 25 bp, Homo sapien
tctgaaggtgccctccagacacggc

SEQ ID NO: 100010 - DNA, 25 bp, Homo sapien
cctctcggcttttccacagtgggtc

SEQ ID NO: 100011 - DNA, 25 bp, Homo sapien
ctcggcttttccacagtgggtcgga

SEQ ID NO: 100012 - DNA, 25 bp, Homo sapien
ttccacagtgggtcggaccaatcgc

SEQ ID NO: 100013 - DNA, 25 bp, Homo sapien
gtgggtcggaccaatcgcgcccgct

SEQ ID NO: 100014 - DNA, 25 bp, Homo sapien
cccgctccgacgtgtccaggtccgc

SEQ ID NO: 100015 - DNA, 25 bp, Homo sapien
gcgccgcttgcttggcctgcgcacc

SEQ ID NO: 100016 - DNA, 25 bp, Homo sapien
cggaagtctgaaggtgccctccaga

SEQ ID NO: 100017 - DNA, 25 bp, Homo sapien
cccaaggccctgagagctgctgaaa

SEQ ID NO: 100018 - DNA, 25 bp, Homo sapien
agctctttcagccacgcatactggg

SEQ ID NO: 100019 - DNA, 25 bp, Homo sapien
cgcccgggagaacccattgggcaga

SEQ ID NO: 100020 - DNA, 25 bp, Homo sapien
tgctggtctttgcagcgtgcacaca

SEQ ID NO: 100021 - DNA, 25 bp, Homo sapien
cctgctccaaggtccagagagcttg

SEQ ID NO: 100022 - DNA, 25 bp, Homo sapien
gcttccattatacacgccctcgttt

SEQ ID NO: 100023 - DNA, 25 bp, Homo sapien
agagatttcttgagcgcccgcgtac

SEQ ID NO: 100024 - DNA, 25 bp, Homo sapien
cgaggaaggcgccacatactgagcc

SEQ ID NO: 100025 - DNA, 25 bp, Homo sapien
ttccgactcggattccgacatgacg

SEQ ID NO: 100026 - DNA, 25 bp, Homo sapien
gatgggcagctttccgactcggatt

SEQ ID NO: 100027 - DNA, 25 bp, Homo sapien
gattccgacatgacggtcgcaccca

SEQ ID NO: 100028 - DNA, 25 bp, Homo sapien
atgacggtcgcacccagcgacaggc

SEQ ID NO: 100029 - DNA, 25 bp, Homo sapien
gcgacaggccgctgcaattgccagt

SEQ ID NO: 100030 - DNA, 25 bp, Homo sapien
cgctgcaattgccagtgagtgtgaa

SEQ ID NO: 100031 - DNA, 25 bp, Homo sapien
tgcggcggcctcttagacgtctcac

SEQ ID NO: 100032 - DNA, 25 bp, Homo sapien
cccgccggaagtgctctcctgaccc

SEQ ID NO: 100033 - DNA, 25 bp, Homo sapien
tacaaagggtatttcgcgatcgatc

SEQ ID NO: 100034 - DNA, 25 bp, Homo sapien
cgtcttgcattttcccgcgtgcgtg

SEQ ID NO: 100035 - DNA, 25 bp, Homo sapien
ctcaatgaccggctggcggtgtaca

SEQ ID NO: 100036 - DNA, 25 bp, Homo sapien
cgcgcctttgccctttgtgctgtaa

SEQ ID NO: 100037 - DNA, 25 bp, Homo sapien
gctccgtgcagcctgagaggaaaca

SEQ ID NO: 100038 - DNA, 25 bp, Homo sapien
gcctcaaggcgctctacgagaccga

SEQ ID NO: 100039 - DNA, 25 bp, Homo sapien
ggatgcacgcgtccttctgaaggaa

SEQ ID NO: 100040 - DNA, 25 bp, Homo sapien
ccaggtgcttctccgttcctctaaa

SEQ ID NO: 100041 - DNA, 25 bp, Homo sapien
gtcctcgccgagtcccgatagcaaa

SEQ ID NO: 100042 - DNA, 25 bp, Homo sapien
ctgcggttctaagtgccaagttgcc

SEQ ID NO: 100043 - DNA, 25 bp, Homo sapien
gggctctctggaaaacgttctgatc

SEQ ID NO: 100044 - DNA, 25 bp, Homo sapien
cacaagtggaaacctgggctctctg

SEQ ID NO: 100045 - DNA, 25 bp, Homo sapien
cgcgcatagcgctgtggagcaagaa

SEQ ID NO: 100046 - DNA, 25 bp, Homo sapien
ctgatctcgatctggctatctctga

SEQ ID NO: 100047 - DNA, 25 bp, Homo sapien
tgcgggactctctgcaatgggaccc

SEQ ID NO: 100048 - DNA, 25 bp, Homo sapien
cgctgacaattcacggacctgctca

SEQ ID NO: 100049 - DNA, 25 bp, Homo sapien
gccgcgggctgcaaacggcagaggc

SEQ ID NO: 100050 - DNA, 25 bp, Homo sapien
cccaggccttgcaggggactacgcc

SEQ ID NO: 100051 - DNA, 25 bp, Homo sapien
gcggagccgcggaagcttgggcact

SEQ ID NO: 100052 - DNA, 25 bp, Homo sapien
cagtgagcgcgtccgagaacagaat

SEQ ID NO: 100053 - DNA, 25 bp, Homo sapien
agcgcgtccgagaacagaatgggac

SEQ ID NO: 100054 - DNA, 25 bp, Homo sapien
tccgagaacagaatgggacgaaacg

SEQ ID NO: 100055 - DNA, 25 bp, Homo sapien
aatctgtgggtcttttaggcggaga

SEQ ID NO: 100056 - DNA, 25 bp, Homo sapien
ccctggcgagttcccagtcggcgcg

SEQ ID NO: 100057 - DNA, 25 bp, Homo sapien
gtggtgtcccgtctacgctctcaag

SEQ ID NO: 100058 - DNA, 25 bp, Homo sapien
tcccgtctacgctctcaagggtggc

SEQ ID NO: 100059 - DNA, 25 bp, Homo sapien
gttctatctcaggtggtgtcccgtc

SEQ ID NO: 100060 - DNA, 25 bp, Homo sapien
taagggaacccacctgagcctcacg

SEQ ID NO: 100061 - DNA, 25 bp, Homo sapien
agcactgccgctgggcgttctatct

SEQ ID NO: 100062 - DNA, 25 bp, Homo sapien
gactatccaaatgggcagcacgcgg

SEQ ID NO: 100063 - DNA, 25 bp, Homo sapien
gtggccgcgcctgaacctttactcg

SEQ ID NO: 100064 - DNA, 25 bp, Homo sapien
tccgtataacgactatccaaatggg

SEQ ID NO: 100065 - DNA, 25 bp, Homo sapien
aggaaacccgggcaagctacctatg

SEQ ID NO: 100066 - DNA, 25 bp, Homo sapien
cacctgtttattttcaagtggcttc

SEQ ID NO: 100067 - DNA, 25 bp, Homo sapien
ggcaagctacctatgccctttacgg

SEQ ID NO: 100068 - DNA, 25 bp, Homo sapien
tatcagccggcatggcgtctctgcc

SEQ ID NO: 100069 - DNA, 25 bp, Homo sapien
tcacgcgccgaggagtgaaagaacg

SEQ ID NO: 100070 - DNA, 25 bp, Homo sapien
ctctgaggaagcagcgcaccgccag

SEQ ID NO: 100071 - DNA, 25 bp, Homo sapien
tggtgcactgggctccgtggttccc

SEQ ID NO: 100072 - DNA, 25 bp, Homo sapien
ctatgccctttacggcacctgttta

SEQ ID NO: 100073 - DNA, 25 bp, Homo sapien
gccgtgttgaccacgctgtagagca

SEQ ID NO: 100074 - DNA, 25 bp, Homo sapien
atcagcgtccggctcggccgtgttg

SEQ ID NO: 100075 - DNA, 25 bp, Homo sapien
ggagagcataaagccagccctgagc

SEQ ID NO: 100076 - DNA, 25 bp, Homo sapien
cccaaaaagcagtgtacggagagca

SEQ ID NO: 100077 - DNA, 25 bp, Homo sapien
tacagaatatcaacggaggcccaaa

SEQ ID NO: 100078 - DNA, 25 bp, Homo sapien
tccactcagcgcacgtgtcacgttg

SEQ ID NO: 100079 - DNA, 25 bp, Homo sapien
ggccatggctcagcttttcattaca

SEQ ID NO: 100080 - DNA, 25 bp, Homo sapien
agccctgaccgaggtctgaccagca

SEQ ID NO: 100081 - DNA, 25 bp, Homo sapien
ttgctttcttctgggacgctgcttg

SEQ ID NO: 100082 - DNA, 25 bp, Homo sapien
tgctaacttcgcgaccaggcctttg

SEQ ID NO: 100083 - DNA, 25 bp, Homo sapien
agcaagtactttcccggtgcgcaaa

SEQ ID NO: 100084 - DNA, 25 bp, Homo sapien
cgctaaccgcgttgattggaacaga

SEQ ID NO: 100085 - DNA, 25 bp, Homo sapien
tgcgctgcgattctcaagatctctg

SEQ ID NO: 100086 - DNA, 25 bp, Homo sapien
ggtcacattttccttagccagggta

SEQ ID NO: 100087 - DNA, 25 bp, Homo sapien
tgggcaaactcaactccggcggctc

SEQ ID NO: 100088 - DNA, 25 bp, Homo sapien
cgggaagatcctgcatgttgcgcta

SEQ ID NO: 100089 - DNA, 25 bp, Homo sapien
gaagccgctgtctcctgaaacagga

SEQ ID NO: 100090 - DNA, 25 bp, Homo sapien
gtgcacatcgcaaggtgagcagttt

SEQ ID NO: 100091 - DNA, 25 bp, Homo sapien
tgcagcaggcaggagtgcacatcgc

SEQ ID NO: 100092 - DNA, 25 bp, Homo sapien
tttgctcctgtccaaggaccaaggc

SEQ ID NO: 100093 - DNA, 25 bp, Homo sapien
cactggacgccgatgtcgtttgcga

SEQ ID NO: 100094 - DNA, 25 bp, Homo sapien
gtcttctccaagctgtagttctacg

SEQ ID NO: 100095 - DNA, 25 bp, Homo sapien
ggtgcgccttcgttgtcttctccaa

SEQ ID NO: 100096 - DNA, 25 bp, Homo sapien
cgaggtaacttccagggtgcgcctt

SEQ ID NO: 100097 - DNA, 25 bp, Homo sapien
agccagagccgtttccaggtggacc

SEQ ID NO: 100098 - DNA, 25 bp, Homo sapien
gactctctcacctggtcttgcggct

SEQ ID NO: 100099 - DNA, 25 bp, Homo sapien
gcctctgtggccgtccaggctagcg

SEQ ID NO: 100100 - DNA, 25 bp, Homo sapien
cgcgctcttcgcacggggcgctttt

SEQ ID NO: 100101 - DNA, 25 bp, Homo sapien
gcccgaggccctttgcggactggct

SEQ ID NO: 100102 - DNA, 25 bp, Homo sapien
cccggcgacatcactgaggcggagc

SEQ ID NO: 100103 - DNA, 25 bp, Homo sapien
gatcctcccggcgacatcactgagg

SEQ ID NO: 100104 - DNA, 25 bp, Homo sapien
cagccagggtggaactgcccggcac

SEQ ID NO: 100105 - DNA, 25 bp, Homo sapien
cgcgtcccgattatcagtgcaatgt

SEQ ID NO: 100106 - DNA, 25 bp, Homo sapien
tcagtgcaatgtgatcacttgattt

SEQ ID NO: 100107 - DNA, 25 bp, Homo sapien
gtgatcacttgattttaaacgcaac

SEQ ID NO: 100108 - DNA, 25 bp, Homo sapien
acttgattttaaacgcaactatgcg

SEQ ID NO: 100109 - DNA, 25 bp, Homo sapien
cccgattatcagtgcaatgtgatca

SEQ ID NO: 100110 - DNA, 25 bp, Homo sapien
tccaaatggctgagtgcaagaggtc

SEQ ID NO: 100111 - DNA, 25 bp, Homo sapien
ctatgcgtccaaatggctgagtgca

SEQ ID NO: 100112 - DNA, 25 bp, Homo sapien
cgcaactatgcgtccaaatggctga

SEQ ID NO: 100113 - DNA, 25 bp, Homo sapien
gcgtcttccatccagggcagcagta

SEQ ID NO: 100114 - DNA, 25 bp, Homo sapien
cactcacggacaatgcactggtttc

SEQ ID NO: 100115 - DNA, 25 bp, Homo sapien
agtggaatctggagccgcacacgtt

SEQ ID NO: 100116 - DNA, 25 bp, Homo sapien
cacacgttgggcctgtgatggacaa

SEQ ID NO: 100117 - DNA, 25 bp, Homo sapien
gacaagcgcggtcacgtaacagata

SEQ ID NO: 100118 - DNA, 25 bp, Homo sapien
taacagataggtagagggatgcagc

SEQ ID NO: 100119 - DNA, 25 bp, Homo sapien
gggatgcagcaacatataaacggtc

SEQ ID NO: 100120 - DNA, 25 bp, Homo sapien
taaacggtcttcgtaagcaatgccc

SEQ ID NO: 100121 - DNA, 25 bp, Homo sapien
agctggagacacagcctccgtcttc

SEQ ID NO: 100122 - DNA, 25 bp, Homo sapien
cggatattggaaagctgcaaaagtc

SEQ ID NO: 100123 - DNA, 25 bp, Homo sapien
cccgagcggtacacgttgcataacc

SEQ ID NO: 100124 - DNA, 25 bp, Homo sapien
tccctgctctagctggagacctcga

SEQ ID NO: 100125 - DNA, 25 bp, Homo sapien
ctaataagcccttcgtcggctccgg

SEQ ID NO: 100126 - DNA, 25 bp, Homo sapien
ctcagaaaagagtcagggtctaata

SEQ ID NO: 100127 - DNA, 25 bp, Homo sapien
cccgtgcgctccgaagacggatatt

SEQ ID NO: 100128 - DNA, 25 bp, Homo sapien
tgatcaaagacaaaatctgcgcgcc

SEQ ID NO: 100129 - DNA, 25 bp, Homo sapien
cagttctccgggacccgttgcgtca

SEQ ID NO: 100130 - DNA, 25 bp, Homo sapien
ggctagcctaacgacactcggagtg

SEQ ID NO: 100131 - DNA, 25 bp, Homo sapien
tgggtcaccaaggagcagttctccg

SEQ ID NO: 100132 - DNA, 25 bp, Homo sapien
tcccaccatgtttcggaggagaata

SEQ ID NO: 100133 - DNA, 25 bp, Homo sapien
tcgctgcgcttctcagtcatcatca

SEQ ID NO: 100134 - DNA, 25 bp, Homo sapien
atcccagcttttcccggctcgaatt

SEQ ID NO: 100135 - DNA, 25 bp, Homo sapien
cacacttctctaggtggccggacgc

SEQ ID NO: 100136 - DNA, 25 bp, Homo sapien
tagagactgtaaatcgctgcgcttc

SEQ ID NO: 100137 - DNA, 25 bp, Homo sapien
acaaacccttgtgtgagctgcagca

SEQ ID NO: 100138 - DNA, 25 bp, Homo sapien
ccagtacgtggacttgcccaagggc

SEQ ID NO: 100139 - DNA, 25 bp, Homo sapien
ccgcaaattcgtggtgcagctgttc

SEQ ID NO: 100140 - DNA, 25 bp, Homo sapien
ttcctcagcctgtacggcgaccaga

SEQ ID NO: 100141 - DNA, 25 bp, Homo sapien
ctacgagctgctcatccagaagttc

SEQ ID NO: 100142 - DNA, 25 bp, Homo sapien
gcacagtcccggtgctcttctgttt

SEQ ID NO: 100143 - DNA, 25 bp, Homo sapien
agggctgcgcgtctttcgcaagttc

SEQ ID NO: 100144 - DNA, 25 bp, Homo sapien
tctgcgagaccactaggcgttctgc

SEQ ID NO: 100145 - DNA, 25 bp, Homo sapien
ggccttatcgcacccttccaggaag

SEQ ID NO: 100146 - DNA, 25 bp, Homo sapien
cgccagatttctgcggacagacctg

SEQ ID NO: 100147 - DNA, 25 bp, Homo sapien
gcgccgagacaactcccaacaggtg

SEQ ID NO: 100148 - DNA, 25 bp, Homo sapien
acaccgatgcctcgcagctgacaga

SEQ ID NO: 100149 - DNA, 25 bp, Homo sapien
gctcctctctcggaagcagtaattc

SEQ ID NO: 100150 - DNA, 25 bp, Homo sapien
cgcacttacaatgggcgcacgcatc

SEQ ID NO: 100151 - DNA, 25 bp, Homo sapien
cacgcatcttccctcgcggtgtgga

SEQ ID NO: 100152 - DNA, 25 bp, Homo sapien
gccaggctcgatttcgctgcgtaga

SEQ ID NO: 100153 - DNA, 25 bp, Homo sapien
tcctttaccagctggggttcctgtc

SEQ ID NO: 100154 - DNA, 25 bp, Homo sapien
gttcctgtcgaatgggatcgtttca

SEQ ID NO: 100155 - DNA, 25 bp, Homo sapien
agaaccgcgagatgcgcctgactca

SEQ ID NO: 100156 - DNA, 25 bp, Homo sapien
ctgccggcctcgttttaaccgtatg

SEQ ID NO: 100157 - DNA, 25 bp, Homo sapien
gctggggtctgtaatctgatcgcaa

SEQ ID NO: 100158 - DNA, 25 bp, Homo sapien
cgcgagcgccctgtatctatggact

SEQ ID NO: 100159 - DNA, 25 bp, Homo sapien
gtggtctccattgcattcaacgcga

SEQ ID NO: 100160 - DNA, 25 bp, Homo sapien
atgtttgtgctactggaaccgcggc

SEQ ID NO: 100161 - DNA, 25 bp, Homo sapien
ggatcaccagttttcgaagcagccc

SEQ ID NO: 100162 - DNA, 25 bp, Homo sapien
agcacccgggatcaccagttttcga

SEQ ID NO: 100163 - DNA, 25 bp, Homo sapien
cagtcccgaccacggcaggagcagt

SEQ ID NO: 100164 - DNA, 25 bp, Homo sapien
tcctactacggtcgctctgctgctg

SEQ ID NO: 100165 - DNA, 25 bp, Homo sapien
agagacgtggctccagcctctgctc

SEQ ID NO: 100166 - DNA, 25 bp, Homo sapien
gagaagtttcactcccgacccttgc

SEQ ID NO: 100167 - DNA, 25 bp, Homo sapien
gcgccactgacagggtggcagccta

SEQ ID NO: 100168 - DNA, 25 bp, Homo sapien
tgatgaccgcgcagaagtacctggg

SEQ ID NO: 100169 - DNA, 25 bp, Homo sapien
gtccaactgctactgacagaagctg

SEQ ID NO: 100170 - DNA, 25 bp, Homo sapien
aaccgcgaaaaccaggcgttcagct

SEQ ID NO: 100171 - DNA, 25 bp, Homo sapien
gctttctgtacgagccagcccaaca

SEQ ID NO: 100172 - DNA, 25 bp, Homo sapien
acagccaagcgtccaactgctactg

SEQ ID NO: 100173 - DNA, 25 bp, Homo sapien
cgcagccaccgtcaagaggaagccg

SEQ ID NO: 100174 - DNA, 25 bp, Homo sapien
cagaagctggaggagttccagaaag

SEQ ID NO: 100175 - DNA, 25 bp, Homo sapien
ggcctgaagcgcaggtctcctcctg

SEQ ID NO: 100176 - DNA, 25 bp, Homo sapien
cggggatcccgagatggaaaccatc

SEQ ID NO: 100177 - DNA, 25 bp, Homo sapien
tcggccttgtgcttcttgtgcttct

SEQ ID NO: 100178 - DNA, 25 bp, Homo sapien
ccgaccggatcctagcgcaatgacg

SEQ ID NO: 100179 - DNA, 25 bp, Homo sapien
gcactgattctgatgcgaccgaacc

SEQ ID NO: 100180 - DNA, 25 bp, Homo sapien
ggacctgtccgacacatcctctggg

SEQ ID NO: 100181 - DNA, 25 bp, Homo sapien
agtcgccaacggtccacgtggaggt

SEQ ID NO: 100182 - DNA, 25 bp, Homo sapien
ttcttgtgcttcttgcccatggcgg

SEQ ID NO: 100183 - DNA, 25 bp, Homo sapien
taggacgagcgccactcggccttgt

SEQ ID NO: 100184 - DNA, 25 bp, Homo sapien
cctcgcgcggcagattcgaagctag

SEQ ID NO: 100185 - DNA, 25 bp, Homo sapien
tggtgcccagtacctacccggtcat

SEQ ID NO: 100186 - DNA, 25 bp, Homo sapien
tcccaaagatcgtgtcgccaccagg

SEQ ID NO: 100187 - DNA, 25 bp, Homo sapien
agcgacctgagccttggcaatctca

SEQ ID NO: 100188 - DNA, 25 bp, Homo sapien
gggccctcgagcacaatgccttgct

SEQ ID NO: 100189 - DNA, 25 bp, Homo sapien
ggctggtatttccttgcggatgatc

SEQ ID NO: 100190 - DNA, 25 bp, Homo sapien
atgccttgctgagcagcgcccagga

SEQ ID NO: 100191 - DNA, 25 bp, Homo sapien
gaaacccgaggatccgcggacgata

SEQ ID NO: 100192 - DNA, 25 bp, Homo sapien
ggacgatacccacctcagcaggcga

SEQ ID NO: 100193 - DNA, 25 bp, Homo sapien
gggtgccgacgccatccactatata

SEQ ID NO: 100194 - DNA, 25 bp, Homo sapien
cctagtgattcgttgtggcgcatta

SEQ ID NO: 100195 - DNA, 25 bp, Homo sapien
taccagttcccatccgtttagcaaa

SEQ ID NO: 100196 - DNA, 25 bp, Homo sapien
gcggctcctcgcgattttaccagtt

SEQ ID NO: 100197 - DNA, 25 bp, Homo sapien
ccagtaattgggctctgcggctcct

SEQ ID NO: 100198 - DNA, 25 bp, Homo sapien
gatttccgttctcttctggccagta

SEQ ID NO: 100199 - DNA, 25 bp, Homo sapien
tagtccgcctagcagacgatccctg

SEQ ID NO: 100200 - DNA, 25 bp, Homo sapien
acatggcgtccaggtgatttccgtt

SEQ ID NO: 100201 - DNA, 25 bp, Homo sapien
tcctctgaggaatggttacacgctc

SEQ ID NO: 100202 - DNA, 25 bp, Homo sapien
tttggtcgccatctttcggagcgtc

SEQ ID NO: 100203 - DNA, 25 bp, Homo sapien
agtcccggatctcaggcgtccgtta

SEQ ID NO: 100204 - DNA, 25 bp, Homo sapien
gcctgcgtcttccatttcaggtttg

SEQ ID NO: 100205 - DNA, 25 bp, Homo sapien
cagttcagaattcacggcaggcgga

SEQ ID NO: 100206 - DNA, 25 bp, Homo sapien
ggcagccaactgaccgcctgatgta

SEQ ID NO: 100207 - DNA, 25 bp, Homo sapien
tttcggggagcaaagacacctggct

SEQ ID NO: 100208 - DNA, 25 bp, Homo sapien
cgtccgttagctacagaggccaatt

SEQ ID NO: 100209 - DNA, 25 bp, Homo sapien
ttcccagtagcaggtgcgagactct

SEQ ID NO: 100210 - DNA, 25 bp, Homo sapien
gctgccgacagagaagtgcttgatc

SEQ ID NO: 100211 - DNA, 25 bp, Homo sapien
gcgccgtaacaaggtccgaactcta

SEQ ID NO: 100212 - DNA, 25 bp, Homo sapien
agatctcttgtgaaagctgccgaca

SEQ ID NO: 100213 - DNA, 25 bp, Homo sapien
gccgccattcggcaaagaaggaatt

SEQ ID NO: 100214 - DNA, 25 bp, Homo sapien
tctgcaacttctactgccgactttg

SEQ ID NO: 100215 - DNA, 25 bp, Homo sapien
aagtcgtttcctgctgtcgtcgtga

SEQ ID NO: 100216 - DNA, 25 bp, Homo sapien
ttgtgcccaaatccggaagcccagg

SEQ ID NO: 100217 - DNA, 25 bp, Homo sapien
agctgtcagcgaccatcagagggta

SEQ ID NO: 100218 - DNA, 25 bp, Homo sapien
ccacagagttgcgtagggaaccacg

SEQ ID NO: 100219 - DNA, 25 bp, Homo sapien
ggagctgcctcccataggctcactg

SEQ ID NO: 100220 - DNA, 25 bp, Homo sapien
ttagtcacttcaaacggccacggcg

SEQ ID NO: 100221 - DNA, 25 bp, Homo sapien
ccatgggcgcctcagtcatatgaca

SEQ ID NO: 100222 - DNA, 25 bp, Homo sapien
tgtggacccaaagtctcaggccgcg

SEQ ID NO: 100223 - DNA, 25 bp, Homo sapien
gcccaactctactcggtgccaggaa

SEQ ID NO: 100224 - DNA, 25 bp, Homo sapien
gggcaaccgactcttccttgtcagc

SEQ ID NO: 100225 - DNA, 25 bp, Homo sapien
ctaagtcacagggagtcagcgtcca

SEQ ID NO: 100226 - DNA, 25 bp, Homo sapien
tcctgaggatcagggctaagtcaca

SEQ ID NO: 100227 - DNA, 25 bp, Homo sapien
tcccgcgcttttatctctgtgaggc

SEQ ID NO: 100228 - DNA, 25 bp, Homo sapien
cgacaagccgtgcactttgcctttt

SEQ ID NO: 100229 - DNA, 25 bp, Homo sapien
ttgccttttctcttcgaacctgaga

SEQ ID NO: 100230 - DNA, 25 bp, Homo sapien
gtatagacccgtagcggccacattg

SEQ ID NO: 100231 - DNA, 25 bp, Homo sapien
cggagcagcctcacagcaactaatc

SEQ ID NO: 100232 - DNA, 25 bp, Homo sapien
gcggcacgtttcagggcaagaaacc

SEQ ID NO: 100233 - DNA, 25 bp, Homo sapien
gcgtggttctccgacgactgaacta

SEQ ID NO: 100234 - DNA, 25 bp, Homo sapien
ggtcctcatactgcgcactcatctg

SEQ ID NO: 100235 - DNA, 25 bp, Homo sapien
attctccgaccagagagggcgctga

SEQ ID NO: 100236 - DNA, 25 bp, Homo sapien
ttttcagaactacagcagggaaggc

SEQ ID NO: 100237 - DNA, 25 bp, Homo sapien
atccagggaaaatcggcgcctcacc

SEQ ID NO: 100238 - DNA, 25 bp, Homo sapien
tgccactcgctgaggggacaacatg

SEQ ID NO: 100239 - DNA, 25 bp, Homo sapien
gtgctaccgtcctttgggaattgta

SEQ ID NO: 100240 - DNA, 25 bp, Homo sapien
tggagcctccgccttcaaagcagaa

SEQ ID NO: 100241 - DNA, 25 bp, Homo sapien
ggtcgcagagagcaagccctatatc

SEQ ID NO: 100242 - DNA, 25 bp, Homo sapien
gcggccgcggagatgtaacacctcc

SEQ ID NO: 100243 - DNA, 25 bp, Homo sapien
cgactcgcagcctgggttttatggc

SEQ ID NO: 100244 - DNA, 25 bp, Homo sapien
caggacgggcacttacctacgaata

SEQ ID NO: 100245 - DNA, 25 bp, Homo sapien
gcgccagagcgtgacattgagccca

SEQ ID NO: 100246 - DNA, 25 bp, Homo sapien
tggcattctgcggaaaccggctgga

SEQ ID NO: 100247 - DNA, 25 bp, Homo sapien
tccaacgtcagtacctggcattctg

SEQ ID NO: 100248 - DNA, 25 bp, Homo sapien
tccacctcgggcgaagacctcatag

SEQ ID NO: 100249 - DNA, 25 bp, Homo sapien
acccagacgggtgcagaaacagggc

SEQ ID NO: 100250 - DNA, 25 bp, Homo sapien
ccagcgctaaggttgatctggcggc

SEQ ID NO: 100251 - DNA, 25 bp, Homo sapien
gcgctcacctggacactcgcagctc

SEQ ID NO: 100252 - DNA, 25 bp, Homo sapien
tggagaggtcgccacgacccgatcc

SEQ ID NO: 100253 - DNA, 25 bp, Homo sapien
aggctgacggatttccctgcctgcg

SEQ ID NO: 100254 - DNA, 25 bp, Homo sapien
cccgacagccgagggaactgcacga

SEQ ID NO: 100255 - DNA, 25 bp, Homo sapien
cggcggcacaagaacccagacgggt

SEQ ID NO: 100256 - DNA, 25 bp, Homo sapien
ggaagagcggccaagttcccagccc

SEQ ID NO: 100257 - DNA, 25 bp, Homo sapien
ccatctcacgggtgagtctggcggc

SEQ ID NO: 100258 - DNA, 25 bp, Homo sapien
tccgaacgcggggatctctgagagc

SEQ ID NO: 100259 - DNA, 25 bp, Homo sapien
ccctgtgtatccgaggcttgaaggc

SEQ ID NO: 100260 - DNA, 25 bp, Homo sapien
ccgcatgctgtagaggcggcttcca

SEQ ID NO: 100261 - DNA, 25 bp, Homo sapien
cgatcccgcgaagaatctcccaaga

SEQ ID NO: 100262 - DNA, 25 bp, Homo sapien
gaagaatctcccaagagttcacgca

SEQ ID NO: 100263 - DNA, 25 bp, Homo sapien
ggcctgcagatccaaggcccgagca

SEQ ID NO: 100264 - DNA, 25 bp, Homo sapien
tcccatgtctgagaccgggttctcg

SEQ ID NO: 100265 - DNA, 25 bp, Homo sapien
gttcatgccacctacgctccgggtt

SEQ ID NO: 100266 - DNA, 25 bp, Homo sapien
ggcgcagtcgtgaacccatcagtca

SEQ ID NO: 100267 - DNA, 25 bp, Homo sapien
atcaggggcaccatcgtcaaggcac

SEQ ID NO: 100268 - DNA, 25 bp, Homo sapien
tcaaggcacgggacaagctctacca

SEQ ID NO: 100269 - DNA, 25 bp, Homo sapien
cttccgctacttgcagggcatgcta

SEQ ID NO: 100270 - DNA, 25 bp, Homo sapien
atcccgagtgcttcatgtgcagtga

SEQ ID NO: 100271 - DNA, 25 bp, Homo sapien
ctcaagcagcgtggttacttctttc

SEQ ID NO: 100272 - DNA, 25 bp, Homo sapien
acttctttctggacgagcggctcta

SEQ ID NO: 100273 - DNA, 25 bp, Homo sapien
cgtgagtctggaacgccgtcgccat

SEQ ID NO: 100274 - DNA, 25 bp, Homo sapien
tcttgagtcgcctgttgtgatgata

SEQ ID NO: 100275 - DNA, 25 bp, Homo sapien
tgatgataggcaggaacactgttgc

SEQ ID NO: 100276 - DNA, 25 bp, Homo sapien
gtcgccacgggcacaatgacatgtg

SEQ ID NO: 100277 - DNA, 25 bp, Homo sapien
acggggtccacatgacgtcacgttc

SEQ ID NO: 100278 - DNA, 25 bp, Homo sapien
gtagtatgggcctggttttggtcac

SEQ ID NO: 100279 - DNA, 25 bp, Homo sapien
tgacgtcacgttcttgagtcgcctg

SEQ ID NO: 100280 - DNA, 25 bp, Homo sapien
acactgttgccgtgggcagagcgac

SEQ ID NO: 100281 - DNA, 25 bp, Homo sapien
cctaagctcagcctccagattggag

SEQ ID NO: 100282 - DNA, 25 bp, Homo sapien
gtcatcacccgtagttgcaagtttc

SEQ ID NO: 100283 - DNA, 25 bp, Homo sapien
cactgtcctgagaacgctgtcatca

SEQ ID NO: 100284 - DNA, 25 bp, Homo sapien
gaacgttctaacatccttggggagc

SEQ ID NO: 100285 - DNA, 25 bp, Homo sapien
aacgccttcagcctgtttcccagga

SEQ ID NO: 100286 - DNA, 25 bp, Homo sapien
tcccaagtgtacagtggcatcaagc

SEQ ID NO: 100287 - DNA, 25 bp, Homo sapien
tggggacaaccgagaacgagcttct

SEQ ID NO: 100288 - DNA, 25 bp, Homo sapien
gagaactcgctctctggcctcggct

SEQ ID NO: 100289 - DNA, 25 bp, Homo sapien
ctggcgcaaccacactgtcccactg

SEQ ID NO: 100290 - DNA, 25 bp, Homo sapien
gtcctccgtgttcctgatagcgacc

SEQ ID NO: 100291 - DNA, 25 bp, Homo sapien
ggcctgtcctccgtgttcctgatag

SEQ ID NO: 100292 - DNA, 25 bp, Homo sapien
cccaatggcttcaccggcctgtcct

SEQ ID NO: 100293 - DNA, 25 bp, Homo sapien
ctccgcggacggtcttgggtcgcct

SEQ ID NO: 100294 - DNA, 25 bp, Homo sapien
cgctgccttcctaagccgagcccgg

SEQ ID NO: 100295 - DNA, 25 bp, Homo sapien
ttccctggtcgtgcgccctatgtaa

SEQ ID NO: 100296 - DNA, 25 bp, Homo sapien
tgcgccctatgtaaggccagccgcg

SEQ ID NO: 100297 - DNA, 25 bp, Homo sapien
ccaagtaaacgctgaatgaagggca

SEQ ID NO: 100298 - DNA, 25 bp, Homo sapien
agccacaggcccaagtaaacgctga

SEQ ID NO: 100299 - DNA, 25 bp, Homo sapien
cgacgccaggcgtttgacccgggca

SEQ ID NO: 100300 - DNA, 25 bp, Homo sapien
tcctgccgatgtcgttgaggaaaat

SEQ ID NO: 100301 - DNA, 25 bp, Homo sapien
tttcgctttcctgccgatgtcgttg

SEQ ID NO: 100302 - DNA, 25 bp, Homo sapien
gagggtttcgctttcgctttcctgc

SEQ ID NO: 100303 - DNA, 25 bp, Homo sapien
cggactagctctcgggcactcggct

SEQ ID NO: 100304 - DNA, 25 bp, Homo sapien
tgagaagcggcacccttgggtttcg

SEQ ID NO: 100305 - DNA, 25 bp, Homo sapien
gcgtgccgtcatttcggggaaatca

SEQ ID NO: 100306 - DNA, 25 bp, Homo sapien
gccaccgagcaatccaaacacttag

SEQ ID NO: 100307 - DNA, 25 bp, Homo sapien
gtatatctcccgaacgcaggtgagg

SEQ ID NO: 100308 - DNA, 25 bp, Homo sapien
cgcacgtcttgcctcgactaaggag

SEQ ID NO: 100309 - DNA, 25 bp, Homo sapien
cgccttttattcgacgccgccggtg

SEQ ID NO: 100310 - DNA, 25 bp, Homo sapien
gggacgaacatagcgggccacctac

SEQ ID NO: 100311 - DNA, 25 bp, Homo sapien
tggggccatcttttcaccctcctgg

SEQ ID NO: 100312 - DNA, 25 bp, Homo sapien
tcaaaggcgtactcacctctgctgc

SEQ ID NO: 100313 - DNA, 25 bp, Homo sapien
atagacctgcggctctcccgttgga

SEQ ID NO: 100314 - DNA, 25 bp, Homo sapien
cggcaacagggaaatcgaggagttt

SEQ ID NO: 100315 - DNA, 25 bp, Homo sapien
gagcctgggtttcggtttcttgcaa

SEQ ID NO: 100316 - DNA, 25 bp, Homo sapien
agcctgagacttgggatagacctgc

SEQ ID NO: 100317 - DNA, 25 bp, Homo sapien
tgccatccgttgcagcctgagactt

SEQ ID NO: 100318 - DNA, 25 bp, Homo sapien
aggcgcccgcttgtaaattgccgca

SEQ ID NO: 100319 - DNA, 25 bp, Homo sapien
ttcgcagggacataggggatgcaca

SEQ ID NO: 100320 - DNA, 25 bp, Homo sapien
gtttcttgcaaacgcggcggcaaca

SEQ ID NO: 100321 - DNA, 25 bp, Homo sapien
ttaccctcgactactgacggcttca

SEQ ID NO: 100322 - DNA, 25 bp, Homo sapien
attggggcttggatacgccttttgc

SEQ ID NO: 100323 - DNA, 25 bp, Homo sapien
tccttccctgcaagagcgcagagga

SEQ ID NO: 100324 - DNA, 25 bp, Homo sapien
tgcgctcggctgagtcagtcagtct

SEQ ID NO: 100325 - DNA, 25 bp, Homo sapien
tcagtcagtctgtcggagtctgtcc

SEQ ID NO: 100326 - DNA, 25 bp, Homo sapien
aaagggacttgagcgagccagttgc

SEQ ID NO: 100327 - DNA, 25 bp, Homo sapien
gccagttgccggattattctatttc

SEQ ID NO: 100328 - DNA, 25 bp, Homo sapien
gcagctccacgattagccgcagtcg

SEQ ID NO: 100329 - DNA, 25 bp, Homo sapien
tagaggcccacgtgatccgcagggc

SEQ ID NO: 100330 - DNA, 25 bp, Homo sapien
gcaccgcgggactctgatttcccgg

SEQ ID NO: 100331 - DNA, 25 bp, Homo sapien
cgcattgtggctacggctttgcgtc

SEQ ID NO: 100332 - DNA, 25 bp, Homo sapien
atcttttggcagtcctgtggcctcg

SEQ ID NO: 100333 - DNA, 25 bp, Homo sapien
taccgcacccggaagtcggagctgc

SEQ ID NO: 100334 - DNA, 25 bp, Homo sapien
cctcctgaccctgagattcgcgggt

SEQ ID NO: 100335 - DNA, 25 bp, Homo sapien
attcgcgggtctcacgtcccgtgca

SEQ ID NO: 100336 - DNA, 25 bp, Homo sapien
tgttggctggcaggatcttttggca

SEQ ID NO: 100337 - DNA, 25 bp, Homo sapien
tcgggcccatctcccgttacataag

SEQ ID NO: 100338 - DNA, 25 bp, Homo sapien
ggccgcgcagatcccgcttatcggg

SEQ ID NO: 100339 - DNA, 25 bp, Homo sapien
cagcttccagactggccggtctgcg

SEQ ID NO: 100340 - DNA, 25 bp, Homo sapien
cccgctgacaatctagaaacaagca

SEQ ID NO: 100341 - DNA, 25 bp, Homo sapien
agccacatgcgccaagtgcccggag

SEQ ID NO: 100342 - DNA, 25 bp, Homo sapien
cccacgcagcgcattgcaggcaggt

SEQ ID NO: 100343 - DNA, 25 bp, Homo sapien
ggccagagcaaagcgaagaggctcc

SEQ ID NO: 100344 - DNA, 25 bp, Homo sapien
agaccctctgatgtagccatctgtg

SEQ ID NO: 100345 - DNA, 25 bp, Homo sapien
cctcaccaggtgtgcagcatccaaa

SEQ ID NO: 100346 - DNA, 25 bp, Homo sapien
tggccagagactaccgaaacacctc

SEQ ID NO: 100347 - DNA, 25 bp, Homo sapien
ttgacgctctcgagactgcggcttc

SEQ ID NO: 100348 - DNA, 25 bp, Homo sapien
ggcccttgaattacgcctgcgcgga

SEQ ID NO: 100349 - DNA, 25 bp, Homo sapien
aggctttccgagtccatctcctagg

SEQ ID NO: 100350 - DNA, 25 bp, Homo sapien
ctgccattctgctgcgctagaaatg

SEQ ID NO: 100351 - DNA, 25 bp, Homo sapien
ccaggccgctaggatgagaagaaac

SEQ ID NO: 100352 - DNA, 25 bp, Homo sapien
ccagcacagcgcctttttgataagc

SEQ ID NO: 100353 - DNA, 25 bp, Homo sapien
ttctctctaggagggcgtcttgcta

SEQ ID NO: 100354 - DNA, 25 bp, Homo sapien
gggcctgtttgaatcaaggaactca

SEQ ID NO: 100355 - DNA, 25 bp, Homo sapien
acccgcgctcgggtgttctgaaact

SEQ ID NO: 100356 - DNA, 25 bp, Homo sapien
cgcaacctggaaggcgacctggacg

SEQ ID NO: 100357 - DNA, 25 bp, Homo sapien
taagcggcaactcagactcaggatc

SEQ ID NO: 100358 - DNA, 25 bp, Homo sapien
tccgggagctgggttataaaatgcc

SEQ ID NO: 100359 - DNA, 25 bp, Homo sapien
cagaggtagctccaccgcgagcgtt

SEQ ID NO: 100360 - DNA, 25 bp, Homo sapien
cgtcttgctagcagggccttcggaa

SEQ ID NO: 100361 - DNA, 25 bp, Homo sapien
gctgcggctgaatggatccaatatg

SEQ ID NO: 100362 - DNA, 25 bp, Homo sapien
tgctgggaccaccaaccagagtgtg

SEQ ID NO: 100363 - DNA, 25 bp, Homo sapien
cggcagcctagtctgcgggtgtctt

SEQ ID NO: 100364 - DNA, 25 bp, Homo sapien
acccgctggagcctgcaaatgtgct

SEQ ID NO: 100365 - DNA, 25 bp, Homo sapien
ggtccgcgcgctggaaagcctttcc

SEQ ID NO: 100366 - DNA, 25 bp, Homo sapien
accaaccagagtgtggacaagctgc

SEQ ID NO: 100367 - DNA, 25 bp, Homo sapien
caatatggccacttcctggaaactc

SEQ ID NO: 100368 - DNA, 25 bp, Homo sapien
cgaaaggggttagccttgcctgcgc

SEQ ID NO: 100369 - DNA, 25 bp, Homo sapien
ttttctacctactcggcagcgtttc

SEQ ID NO: 100370 - DNA, 25 bp, Homo sapien
ccaggaccctggaagccacggaact

SEQ ID NO: 100371 - DNA, 25 bp, Homo sapien
agggttatttcttcctgccatcagc

SEQ ID NO: 100372 - DNA, 25 bp, Homo sapien
agagctcttcacactccacacgtgg

SEQ ID NO: 100373 - DNA, 25 bp, Homo sapien
aactctgctgcgtctgtcatcttgg

SEQ ID NO: 100374 - DNA, 25 bp, Homo sapien
acccgagcttcgtttgtgactgaaa

SEQ ID NO: 100375 - DNA, 25 bp, Homo sapien
cgcgagttacggttttctctctggc

SEQ ID NO: 100376 - DNA, 25 bp, Homo sapien
tgccatcagctggagaagcgctctc

SEQ ID NO: 100377 - DNA, 25 bp, Homo sapien
ttcgtcaacaacgtggcggtggtga

SEQ ID NO: 100378 - DNA, 25 bp, Homo sapien
cttcatgtctggcttcacggccctg

SEQ ID NO: 100379 - DNA, 25 bp, Homo sapien
cggccaagcgcgacttcatgtctgg

SEQ ID NO: 100380 - DNA, 25 bp, Homo sapien
cagaagccctgtatgctgccggtgc

SEQ ID NO: 100381 - DNA, 25 bp, Homo sapien
tgagccgcttcaagccgctgctcga

SEQ ID NO: 100382 - DNA, 25 bp, Homo sapien
ccacttcgacggtcttgccgcggag

SEQ ID NO: 100383 - DNA, 25 bp, Homo sapien
gaccgcttcaagcagttcgtcaaca

SEQ ID NO: 100384 - DNA, 25 bp, Homo sapien
tgggtctgccaacagagccacagga

SEQ ID NO: 100385 - DNA, 25 bp, Homo sapien
catggcttccctgttccgtttctaa

SEQ ID NO: 100386 - DNA, 25 bp, Homo sapien
gccgaacatggcttccctgttccgt

SEQ ID NO: 100387 - DNA, 25 bp, Homo sapien
ttctaatttacagcctgaaggtaaa

SEQ ID NO: 100388 - DNA, 25 bp, Homo sapien
cctgaaggtaaaaagtacactgatt

SEQ ID NO: 100389 - DNA, 25 bp, Homo sapien
cactgattaaatccatgttaggagg

SEQ ID NO: 100390 - DNA, 25 bp, Homo sapien
tgttgcccagcaacgatgccagccg

SEQ ID NO: 100391 - DNA, 25 bp, Homo sapien
agcaacgatgccagccgcggcctgt

SEQ ID NO: 100392 - DNA, 25 bp, Homo sapien
ccggtttcgggcaccgccgaacatg

SEQ ID NO: 100393 - DNA, 25 bp, Homo sapien
cctgaagcatcttttggaggcgggc

SEQ ID NO: 100394 - DNA, 25 bp, Homo sapien
atgatggccaaggtcgtccctgatg

SEQ ID NO: 100395 - DNA, 25 bp, Homo sapien
ctgatggcgtccagttggtcctgaa

SEQ ID NO: 100396 - DNA, 25 bp, Homo sapien
cggaatggttccagccggagacagc

SEQ ID NO: 100397 - DNA, 25 bp, Homo sapien
acctgctcatcagggtcgctgtctg

SEQ ID NO: 100398 - DNA, 25 bp, Homo sapien
agcagaaggccaagcacgcgctcta

SEQ ID NO: 100399 - DNA, 25 bp, Homo sapien
ctaggtcggccatgaaccggctgaa

SEQ ID NO: 100400 - DNA, 25 bp, Homo sapien
tcctgctccgtgtgaaggtcctgaa

SEQ ID NO: 100401 - DNA, 25 bp, Homo sapien
tccagctttcctggctctgagaagc

SEQ ID NO: 100402 - DNA, 25 bp, Homo sapien
aggcatcaccgagcttcaaggaccc

SEQ ID NO: 100403 - DNA, 25 bp, Homo sapien
ccggagtccaggttcatggagcctt

SEQ ID NO: 100404 - DNA, 25 bp, Homo sapien
ggcagccatccgacctcgtgatctt

SEQ ID NO: 100405 - DNA, 25 bp, Homo sapien
ttcaaacttagccagcgccggatgc

SEQ ID NO: 100406 - DNA, 25 bp, Homo sapien
gaagcaccacttccgctgctggttg

SEQ ID NO: 100407 - DNA, 25 bp, Homo sapien
tccgcgcgcatggacagatgccaca

SEQ ID NO: 100408 - DNA, 25 bp, Homo sapien
cacgcacgtagtcccagtctaggta

SEQ ID NO: 100409 - DNA, 25 bp, Homo sapien
tcctcaggcgtgaagtccatggaga

SEQ ID NO: 100410 - DNA, 25 bp, Homo sapien
ccgagaggccgagaatcccaattag

SEQ ID NO: 100411 - DNA, 25 bp, Homo sapien
cttcggccctaatactgactgacgg

SEQ ID NO: 100412 - DNA, 25 bp, Homo sapien
tcggcgctaacacgtggaggccact

SEQ ID NO: 100413 - DNA, 25 bp, Homo sapien
gattctcggaaaacgtgggccctgc

SEQ ID NO: 100414 - DNA, 25 bp, Homo sapien
cctcgtaggcctccaggatagtctg

SEQ ID NO: 100415 - DNA, 25 bp, Homo sapien
tgccgtcgtagtccatcaggtactc

SEQ ID NO: 100416 - DNA, 25 bp, Homo sapien
caccgactggctcagggacccaagt

SEQ ID NO: 100417 - DNA, 25 bp, Homo sapien
agccgcagcctcttggtagcgtccg

SEQ ID NO: 100418 - DNA, 25 bp, Homo sapien
cgcagccgcgcggtgacatcagagc

SEQ ID NO: 100419 - DNA, 25 bp, Homo sapien
gcgactggtttacgggctcatcggt

SEQ ID NO: 100420 - DNA, 25 bp, Homo sapien
cagagtctctggagacccgagctcc

SEQ ID NO: 100421 - DNA, 25 bp, Homo sapien
gttacctggggttcaatctctggga

SEQ ID NO: 100422 - DNA, 25 bp, Homo sapien
cggctcgacagcagatggccgcagc

SEQ ID NO: 100423 - DNA, 25 bp, Homo sapien
cggcttctccagatgcttggcgaca

SEQ ID NO: 100424 - DNA, 25 bp, Homo sapien
tggggtccgactccactggcgcaac

SEQ ID NO: 100425 - DNA, 25 bp, Homo sapien
cagctacagcttgtcaccgttcgag

SEQ ID NO: 100426 - DNA, 25 bp, Homo sapien
tccgcacgtcttcactaaaggaatc

SEQ ID NO: 100427 - DNA, 25 bp, Homo sapien
tcagaggcgctctgtctacagctgg

SEQ ID NO: 100428 - DNA, 25 bp, Homo sapien
gccgcttcctgactgggattccaca

SEQ ID NO: 100429 - DNA, 25 bp, Homo sapien
tctttctgggacaaaggcgtcatcc

SEQ ID NO: 100430 - DNA, 25 bp, Homo sapien
gcgtcatcccttagagacagtagga

SEQ ID NO: 100431 - DNA, 25 bp, Homo sapien
cggatgcggcatgtgatcagctaca

SEQ ID NO: 100432 - DNA, 25 bp, Homo sapien
cgccgcattcgggagtctttctttc

SEQ ID NO: 100433 - DNA, 25 bp, Homo sapien
gcgggttaacgaagacctggcacca

SEQ ID NO: 100434 - DNA, 25 bp, Homo sapien
cgtagcccgctagtgaggttccgaa

SEQ ID NO: 100435 - DNA, 25 bp, Homo sapien
ctgccacggcagtacagggcctgca

SEQ ID NO: 100436 - DNA, 25 bp, Homo sapien
cggccgtgccaccatgtgaccaaga

SEQ ID NO: 100437 - DNA, 25 bp, Homo sapien
atgcgcctcacacggaacaggcgta

SEQ ID NO: 100438 - DNA, 25 bp, Homo sapien
gggtcagtctgtcggcccttcttac

SEQ ID NO: 100439 - DNA, 25 bp, Homo sapien
gctcaggtgacaaacccaggccttc

SEQ ID NO: 100440 - DNA, 25 bp, Homo sapien
ccgagcggtataggcctgagcctct

SEQ ID NO: 100441 - DNA, 25 bp, Homo sapien
acttacgcttgtctccgggctatta

SEQ ID NO: 100442 - DNA, 25 bp, Homo sapien
caactgtgggcgttcctttcagaga

SEQ ID NO: 100443 - DNA, 25 bp, Homo sapien
agtcgccatcttagcgcggtcaaag

SEQ ID NO: 100444 - DNA, 25 bp, Homo sapien
tagccgatgcatgggagtcgccatc

SEQ ID NO: 100445 - DNA, 25 bp, Homo sapien
cgaaccggatccttacttacgcttg

SEQ ID NO: 100446 - DNA, 25 bp, Homo sapien
tgtcccgtgccgcagactttacgcg

SEQ ID NO: 100447 - DNA, 25 bp, Homo sapien
tcggctggaataaaggtgtcggacc

SEQ ID NO: 100448 - DNA, 25 bp, Homo sapien
cattctccgccggtcccaatagggg

SEQ ID NO: 100449 - DNA, 25 bp, Homo sapien
gctcggttggctaaatgcgctttcc

SEQ ID NO: 100450 - DNA, 25 bp, Homo sapien
agaggcctgctttccactcgctagc

SEQ ID NO: 100451 - DNA, 25 bp, Homo sapien
tctcgagccaggacgtgacgtattc

SEQ ID NO: 100452 - DNA, 25 bp, Homo sapien
gggaggtgctccacatctctatgca

SEQ ID NO: 100453 - DNA, 25 bp, Homo sapien
gctggctcgcctactttctacggta

SEQ ID NO: 100454 - DNA, 25 bp, Homo sapien
gcgcttcctcagtatagtgcctcga

SEQ ID NO: 100455 - DNA, 25 bp, Homo sapien
tgcgtctcattctggggcaccgaca

SEQ ID NO: 100456 - DNA, 25 bp, Homo sapien
acatcccgttctttcgtagctctgg

SEQ ID NO: 100457 - DNA, 25 bp, Homo sapien
tcctgaaactcagaactcgtctttg

SEQ ID NO: 100458 - DNA, 25 bp, Homo sapien
ctcgtctttgttttgcgggcgcaaa

SEQ ID NO: 100459 - DNA, 25 bp, Homo sapien
gcaaagagggcggagatcatccaca

SEQ ID NO: 100460 - DNA, 25 bp, Homo sapien
cacagtgcaagctctcttaggacca

SEQ ID NO: 100461 - DNA, 25 bp, Homo sapien
ctccctagacacgttcaagcgggta

SEQ ID NO: 100462 - DNA, 25 bp, Homo sapien
ctgcagcgaggagacgcaagtttcc

SEQ ID NO: 100463 - DNA, 25 bp, Homo sapien
tgaacccaagaacggcgcctgcagg

SEQ ID NO: 100464 - DNA, 25 bp, Homo sapien
agtaaggacaagcaagcgcccgcgc

SEQ ID NO: 100465 - DNA, 25 bp, Homo sapien
tctgtccgatgagtccacacgtggg

SEQ ID NO: 100466 - DNA, 25 bp, Homo sapien
ggaaacggagcagccgcactctgtc

SEQ ID NO: 100467 - DNA, 25 bp, Homo sapien
cgttgctggccaggggcacaaaaaa

SEQ ID NO: 100468 - DNA, 25 bp, Homo sapien
tacccgaaaagcaaagtgcggcctc

SEQ ID NO: 100469 - DNA, 25 bp, Homo sapien
tgcggcctcacacggttctttaatc

SEQ ID NO: 100470 - DNA, 25 bp, Homo sapien
gttctttaatctggagccggactcc

SEQ ID NO: 100471 - DNA, 25 bp, Homo sapien
agacgcaggtacgtgctcagctctg

SEQ ID NO: 100472 - DNA, 25 bp, Homo sapien
agctctgccgttgcggtttggttca

SEQ ID NO: 100473 - DNA, 25 bp, Homo sapien
gcctgcgctgttgctaggctctacg

SEQ ID NO: 100474 - DNA, 25 bp, Homo sapien
agcctggagacgtgctctggaaacc

SEQ ID NO: 100475 - DNA, 25 bp, Homo sapien
cgccgtctgctcctgacacttggaa

SEQ ID NO: 100476 - DNA, 25 bp, Homo sapien
tcctgacacttggaagcgccctttc

SEQ ID NO: 100477 - DNA, 25 bp, Homo sapien
ttaccactggatagagcggcggaca

SEQ ID NO: 100478 - DNA, 25 bp, Homo sapien
cccacaagggcttggatggccgacc

SEQ ID NO: 100479 - DNA, 25 bp, Homo sapien
cggcacatacgtcccagcgtggtga

SEQ ID NO: 100480 - DNA, 25 bp, Homo sapien
tctacgccatgaggtcagacgccgc

SEQ ID NO: 100481 - DNA, 25 bp, Homo sapien
aggccttccgattctctgagctgtg

SEQ ID NO: 100482 - DNA, 25 bp, Homo sapien
atcccgctagcgagccgcgttctta

SEQ ID NO: 100483 - DNA, 25 bp, Homo sapien
cacgcgggttcttgctggaaacctc

SEQ ID NO: 100484 - DNA, 25 bp, Homo sapien
gaggtccctgcgctaatggaagacg

SEQ ID NO: 100485 - DNA, 25 bp, Homo sapien
tccctgcgctaatggaagacgcgcg

SEQ ID NO: 100486 - DNA, 25 bp, Homo sapien
ctcgcctgggtggacaaagtggccc

SEQ ID NO: 100487 - DNA, 25 bp, Homo sapien
tggacccaagcctcgcctgggtgga

SEQ ID NO: 100488 - DNA, 25 bp, Homo sapien
ccggactgacgtgtgcaccgtgtgt

SEQ ID NO: 100489 - DNA, 25 bp, Homo sapien
ttcctgggggatgaatttacaaaga

SEQ ID NO: 100490 - DNA, 25 bp, Homo sapien
agctgtgcaggtggcgacatcctcc

SEQ ID NO: 100491 - DNA, 25 bp, Homo sapien
tggacttggaggcccacaaagggac

SEQ ID NO: 100492 - DNA, 25 bp, Homo sapien
aagggctggacttggaggcccacaa

SEQ ID NO: 100493 - DNA, 25 bp, Homo sapien
cggccacttcaaagcgccgcgtgta

SEQ ID NO: 100494 - DNA, 25 bp, Homo sapien
ggtggcgacatcctcctcgcccagc

SEQ ID NO: 100495 - DNA, 25 bp, Homo sapien
caaagagttcccagcgggtgccacc

SEQ ID NO: 100496 - DNA, 25 bp, Homo sapien
tttacaaagagttcccagcgggtgc

SEQ ID NO: 100497 - DNA, 25 bp, Homo sapien
cagcctctggttccgcggcgtttca

SEQ ID NO: 100498 - DNA, 25 bp, Homo sapien
cgactcccaactgggccctttgagg

SEQ ID NO: 100499 - DNA, 25 bp, Homo sapien
aactgggccctttgaggcgccatgt

SEQ ID NO: 100500 - DNA, 25 bp, Homo sapien
tcgagccagactcggcgccaggaga

SEQ ID NO: 100501 - DNA, 25 bp, Homo sapien
ctgtttccaggacaaccgagggccg

SEQ ID NO: 100502 - DNA, 25 bp, Homo sapien
ggtgctagatggactctcacctctc

SEQ ID NO: 100503 - DNA, 25 bp, Homo sapien
atggactctcacctctcagcgcgtg

SEQ ID NO: 100504 - DNA, 25 bp, Homo sapien
acctctcagcgcgtggtgcatgccg

SEQ ID NO: 100505 - DNA, 25 bp, Homo sapien
tcgttgacgcctcgctgaagtgact

SEQ ID NO: 100506 - DNA, 25 bp, Homo sapien
atgcccaggaagtagaccacctgtg

SEQ ID NO: 100507 - DNA, 25 bp, Homo sapien
agtccaggatcccagagtaggtgtc

SEQ ID NO: 100508 - DNA, 25 bp, Homo sapien
accatcacaggggttgacggccaca

SEQ ID NO: 100509 - DNA, 25 bp, Homo sapien
gccggccaggaaggacacgtagaaa

SEQ ID NO: 100510 - DNA, 25 bp, Homo sapien
gaccacctgtgcgatgccgaaaagg

SEQ ID NO: 100511 - DNA, 25 bp, Homo sapien
cgtagaaaggcgacttctcctcgga

SEQ ID NO: 100512 - DNA, 25 bp, Homo sapien
gtcttcaccactgcaaggggcgctc

SEQ ID NO: 100513 - DNA, 25 bp, Homo sapien
gcttgtccgacgtctctctcagggt

SEQ ID NO: 100514 - DNA, 25 bp, Homo sapien
ggtgatcattcccaggcttgtccga

SEQ ID NO: 100515 - DNA, 25 bp, Homo sapien
ccagttcaaagcacagggcgcattg

SEQ ID NO: 100516 - DNA, 25 bp, Homo sapien
tcgcactgtatgcaggcggcctaga

SEQ ID NO: 100517 - DNA, 25 bp, Homo sapien
gcggcctagaaggaagtccctgatt

SEQ ID NO: 100518 - DNA, 25 bp, Homo sapien
gagcctgggcacgatacagttcaca

SEQ ID NO: 100519 - DNA, 25 bp, Homo sapien
tcaagtcgtcgctcgtgaacgagtc

SEQ ID NO: 100520 - DNA, 25 bp, Homo sapien
caggagttcccgttagagtctctgc

SEQ ID NO: 100521 - DNA, 25 bp, Homo sapien
acgaagccactacagcgtcgcagcg

SEQ ID NO: 100522 - DNA, 25 bp, Homo sapien
cggctactcacggtgttcggtgtta

SEQ ID NO: 100523 - DNA, 25 bp, Homo sapien
ctgtctcgtcaactgggtgccggac

SEQ ID NO: 100524 - DNA, 25 bp, Homo sapien
ctttccagttcagtgggcggctact

SEQ ID NO: 100525 - DNA, 25 bp, Homo sapien
gtagccacgaccctttccagttcag

SEQ ID NO: 100526 - DNA, 25 bp, Homo sapien
tcggctcacttatggagcgccgtga

SEQ ID NO: 100527 - DNA, 25 bp, Homo sapien
gaccggtagctagtgacgccagaca

SEQ ID NO: 100528 - DNA, 25 bp, Homo sapien
aacagggtcgacaacgcgatccacc

SEQ ID NO: 100529 - DNA, 25 bp, Homo sapien
aggctcttgacctgggactcggaca

SEQ ID NO: 100530 - DNA, 25 bp, Homo sapien
ctcggacagctgcttgcactcgttc

SEQ ID NO: 100531 - DNA, 25 bp, Homo sapien
ctctgtaatcgtgtgggtttccgtc

SEQ ID NO: 100532 - DNA, 25 bp, Homo sapien
ccggctggtaactgaagcgccttga

SEQ ID NO: 100533 - DNA, 25 bp, Homo sapien
ggtgaacaccttctcgtccatgatg

SEQ ID NO: 100534 - DNA, 25 bp, Homo sapien
agcgagtggccgcttggattaacca

SEQ ID NO: 100535 - DNA, 25 bp, Homo sapien
aggccgctctggtgatgaactcagc

SEQ ID NO: 100536 - DNA, 25 bp, Homo sapien
agcggcgaaccggactaatccctga

SEQ ID NO: 100537 - DNA, 25 bp, Homo sapien
ccaccatggaaacgccggcggagtt

SEQ ID NO: 100538 - DNA, 25 bp, Homo sapien
agttgctgcgttctagactcgtgcg

SEQ ID NO: 100539 - DNA, 25 bp, Homo sapien
ggaaccggccacttgccaccatgga

SEQ ID NO: 100540 - DNA, 25 bp, Homo sapien
gtggagccaccgaacactgatacta

SEQ ID NO: 100541 - DNA, 25 bp, Homo sapien
tctggctctgcgtagttccagtgga

SEQ ID NO: 100542 - DNA, 25 bp, Homo sapien
cgtcccgctgttgactttatccaaa

SEQ ID NO: 100543 - DNA, 25 bp, Homo sapien
acacgtcttaggatgccggaccggc

SEQ ID NO: 100544 - DNA, 25 bp, Homo sapien
actcgtgcgcaagaccggaacatgg

SEQ ID NO: 100545 - DNA, 25 bp, Homo sapien
ggatttcaagcggtaagggccttca

SEQ ID NO: 100546 - DNA, 25 bp, Homo sapien
tccggcagcaccagtcagctttgtt

SEQ ID NO: 100547 - DNA, 25 bp, Homo sapien
ctcgcccaggcgatcagacattatc

SEQ ID NO: 100548 - DNA, 25 bp, Homo sapien
cgatcgactggtctagggttccctg

SEQ ID NO: 100549 - DNA, 25 bp, Homo sapien
tctggcgcccgaagaaattttgata

SEQ ID NO: 100550 - DNA, 25 bp, Homo sapien
cccataagctttgccgctcgttctg

SEQ ID NO: 100551 - DNA, 25 bp, Homo sapien
agggccttcaccttcgcctagatga

SEQ ID NO: 100552 - DNA, 25 bp, Homo sapien
cattgcagggttgtttgtcagtctc

SEQ ID NO: 100553 - DNA, 25 bp, Homo sapien
ggatgaattccatgcgggccttcca

SEQ ID NO: 100554 - DNA, 25 bp, Homo sapien
ctgggtctacccagggctacaaggg

SEQ ID NO: 100555 - DNA, 25 bp, Homo sapien
gactgctccagaagaccaacctgga

SEQ ID NO: 100556 - DNA, 25 bp, Homo sapien
atcagcgcacgactgctccagaaga

SEQ ID NO: 100557 - DNA, 25 bp, Homo sapien
agcggaactgctccgcgaagtcggc

SEQ ID NO: 100558 - DNA, 25 bp, Homo sapien
gctacaagggtcttttgcggtcgac

SEQ ID NO: 100559 - DNA, 25 bp, Homo sapien
tccattgcttctcgctctctgagta

SEQ ID NO: 100560 - DNA, 25 bp, Homo sapien
ctctctgagtaggagcggaactgct

SEQ ID NO: 100561 - DNA, 25 bp, Homo sapien
ttcgctgctcccgaaagccctcagc

SEQ ID NO: 100562 - DNA, 25 bp, Homo sapien
tgtggtgggtcgtccttcccggagc

SEQ ID NO: 100563 - DNA, 25 bp, Homo sapien
gcggccctgcaagcggttggcctta

SEQ ID NO: 100564 - DNA, 25 bp, Homo sapien
gccctgcaagcggttggccttatct

SEQ ID NO: 100565 - DNA, 25 bp, Homo sapien
ctgcaagcggttggccttatctccg

SEQ ID NO: 100566 - DNA, 25 bp, Homo sapien
caagcggttggccttatctccggac

SEQ ID NO: 100567 - DNA, 25 bp, Homo sapien
cccgtgggaaatccgggcgcctctg

SEQ ID NO: 100568 - DNA, 25 bp, Homo sapien
tatctccggacttcgctgctcccga

SEQ ID NO: 100569 - DNA, 25 bp, Homo sapien
gcgcatgcgcctatttcaactccag

SEQ ID NO: 100570 - DNA, 25 bp, Homo sapien
ttaacctccagggacggcttgagcc

SEQ ID NO: 100571 - DNA, 25 bp, Homo sapien
tgcgaggacgcgcattttaacctcc

SEQ ID NO: 100572 - DNA, 25 bp, Homo sapien
gttcacgagcgtgtcccaagccgag

SEQ ID NO: 100573 - DNA, 25 bp, Homo sapien
ttccaggcacgccacaccgtgaggt

SEQ ID NO: 100574 - DNA, 25 bp, Homo sapien
tcagagttggctacaccatgccttc

SEQ ID NO: 100575 - DNA, 25 bp, Homo sapien
caagacagtgtcttcaaaagaggcc

SEQ ID NO: 100576 - DNA, 25 bp, Homo sapien
ccgccctgcctttcgaaagtgctgg

SEQ ID NO: 100577 - DNA, 25 bp, Homo sapien
ggggcgcatgcaacaacaacttttg

SEQ ID NO: 100578 - DNA, 25 bp, Homo sapien
ttattaatgactgcggcaaagcgcc

SEQ ID NO: 100579 - DNA, 25 bp, Homo sapien
cggccatcgcagttggaggctattt

SEQ ID NO: 100580 - DNA, 25 bp, Homo sapien
cgtccatggagttactttgcgccca

SEQ ID NO: 100581 - DNA, 25 bp, Homo sapien
tccgagaacctggagctatctgccc

SEQ ID NO: 100582 - DNA, 25 bp, Homo sapien
gtgagcttggcgaccttctttatta

SEQ ID NO: 100583 - DNA, 25 bp, Homo sapien
gcgcatgttggtcagtcgtgtttta

SEQ ID NO: 100584 - DNA, 25 bp, Homo sapien
cctgcgcatctccacgacgttattt

SEQ ID NO: 100585 - DNA, 25 bp, Homo sapien
cggagcatggatgagacctgtcctc

SEQ ID NO: 100586 - DNA, 25 bp, Homo sapien
ggtgcctcactagcgacagtccgca

SEQ ID NO: 100587 - DNA, 25 bp, Homo sapien
ccgaactgcaaagcgcgatggctgc

SEQ ID NO: 100588 - DNA, 25 bp, Homo sapien
ccgtacaccaggagaccgaactgca

SEQ ID NO: 100589 - DNA, 25 bp, Homo sapien
cctacttggcgttggccgtacacca

SEQ ID NO: 100590 - DNA, 25 bp, Homo sapien
gctgtcactcacctgcgactggagg

SEQ ID NO: 100591 - DNA, 25 bp, Homo sapien
aagtgcgccttctaggggatccata

SEQ ID NO: 100592 - DNA, 25 bp, Homo sapien
ctcagagtaggtcttggccctaaaa

SEQ ID NO: 100593 - DNA, 25 bp, Homo sapien
actcggcccggaaccagttctgcag

SEQ ID NO: 100594 - DNA, 25 bp, Homo sapien
gtccatgagacactcggcccggaac

SEQ ID NO: 100595 - DNA, 25 bp, Homo sapien
atagtccatgagacactcggcccgg

SEQ ID NO: 100596 - DNA, 25 bp, Homo sapien
cggcccggaaccagttctgcaggga

SEQ ID NO: 100597 - DNA, 25 bp, Homo sapien
gcgggtcatagtccatgagacactc

SEQ ID NO: 100598 - DNA, 25 bp, Homo sapien
cccgcgggtcatagtccatgagaca

SEQ ID NO: 100599 - DNA, 25 bp, Homo sapien
tgcccggccacaggccatgcacacc

SEQ ID NO: 100600 - DNA, 25 bp, Homo sapien
cacggatgtcgtccaggtgcaggct

SEQ ID NO: 100601 - DNA, 25 bp, Homo sapien
ctgactgacctttgcgtgccactgc

SEQ ID NO: 100602 - DNA, 25 bp, Homo sapien
ccactgctgcttgaggcgacataga

SEQ ID NO: 100603 - DNA, 25 bp, Homo sapien
ctctcttcttgtgcgctgttgtcga

SEQ ID NO: 100604 - DNA, 25 bp, Homo sapien
cttctctctaggtttggctgccgcc

SEQ ID NO: 100605 - DNA, 25 bp, Homo sapien
gccggaagtgccacgtgtcctgatt

SEQ ID NO: 100606 - DNA, 25 bp, Homo sapien
cgggaatttccgtagcggtgacaca

SEQ ID NO: 100607 - DNA, 25 bp, Homo sapien
agagtgacctccttaccgggttctg

SEQ ID NO: 100608 - DNA, 25 bp, Homo sapien
tccgctttcagcagtggtctttcag

SEQ ID NO: 100609 - DNA, 25 bp, Homo sapien
gagtcgatggccgtcgctaccgacg

SEQ ID NO: 100610 - DNA, 25 bp, Homo sapien
tgcttagctcacaggctccgggacc

SEQ ID NO: 100611 - DNA, 25 bp, Homo sapien
caaccggatcatgggctttcacagg

SEQ ID NO: 100612 - DNA, 25 bp, Homo sapien
ctgcgtcggagaaagctgctcatga

SEQ ID NO: 100613 - DNA, 25 bp, Homo sapien
gaaagctgctcatgaactcggaaca

SEQ ID NO: 100614 - DNA, 25 bp, Homo sapien
ctcggaacagcgcatcaaccggatc

SEQ ID NO: 100615 - DNA, 25 bp, Homo sapien
gcggtgcgtgagtgcttagctcaca

SEQ ID NO: 100616 - DNA, 25 bp, Homo sapien
ggctcaggtctgtcggcttcccagc

SEQ ID NO: 100617 - DNA, 25 bp, Homo sapien
cgtgtacggagaaagttgccgcatt

SEQ ID NO: 100618 - DNA, 25 bp, Homo sapien
ggggcgaaggcatcacctttcgatg

SEQ ID NO: 100619 - DNA, 25 bp, Homo sapien
gcagcttccggtcggcttttctctt

SEQ ID NO: 100620 - DNA, 25 bp, Homo sapien
gcgccagcacgtcctgttttcgttg

SEQ ID NO: 100621 - DNA, 25 bp, Homo sapien
gccgccacagctgtaggtgctgcta

SEQ ID NO: 100622 - DNA, 25 bp, Homo sapien
gggcagctcagcctccttgtttgtc

SEQ ID NO: 100623 - DNA, 25 bp, Homo sapien
cctgtgcgtggtactcaagggcacc

SEQ ID NO: 100624 - DNA, 25 bp, Homo sapien
aagggcaccagtattcccgcggtcg

SEQ ID NO: 100625 - DNA, 25 bp, Homo sapien
tttgagaggtcagaatccgcagtcc

SEQ ID NO: 100626 - DNA, 25 bp, Homo sapien
ccgtggacttctacgcttgcggaac

SEQ ID NO: 100627 - DNA, 25 bp, Homo sapien
cctcccaaagcttgcgtgcaggttg

SEQ ID NO: 100628 - DNA, 25 bp, Homo sapien
gcagtccgcccttcgcctttaaata

SEQ ID NO: 100629 - DNA, 25 bp, Homo sapien
tagcggcctcttcgtactgcgtccg

SEQ ID NO: 100630 - DNA, 25 bp, Homo sapien
ccgcctctaacactacagggtggta

SEQ ID NO: 100631 - DNA, 25 bp, Homo sapien
caggcttaaggccacgacgcgcaag

SEQ ID NO: 100632 - DNA, 25 bp, Homo sapien
aaagcctgccggctcgagatcggcg

SEQ ID NO: 100633 - DNA, 25 bp, Homo sapien
tagctcctaaagaggtctccagtcc

SEQ ID NO: 100634 - DNA, 25 bp, Homo sapien
ctcggctggtggcaagtattgctgt

SEQ ID NO: 100635 - DNA, 25 bp, Homo sapien
ttgcctctcggcctgggcaatggtc

SEQ ID NO: 100636 - DNA, 25 bp, Homo sapien
tagccgtgcgccgattgcctctcgg

SEQ ID NO: 100637 - DNA, 25 bp, Homo sapien
cacagctgccaggtgttaagatggc

SEQ ID NO: 100638 - DNA, 25 bp, Homo sapien
ctggcgcttagctcctaaagaggtc

SEQ ID NO: 100639 - DNA, 25 bp, Homo sapien
caacgtctggcgcttagctcctaaa

SEQ ID NO: 100640 - DNA, 25 bp, Homo sapien
ctggcagcacgactcgcgtagccgt

SEQ ID NO: 100641 - DNA, 25 bp, Homo sapien
tgggcgaagttcctcctagcgcagc

SEQ ID NO: 100642 - DNA, 25 bp, Homo sapien
gccgctcgttgtgctgaggacgaac

SEQ ID NO: 100643 - DNA, 25 bp, Homo sapien
ttgcagaacaattcggtgcccgctg

SEQ ID NO: 100644 - DNA, 25 bp, Homo sapien
gttcagcaactacaaaaggcagatg

SEQ ID NO: 100645 - DNA, 25 bp, Homo sapien
gaagcctacgaacttgccaaccgga

SEQ ID NO: 100646 - DNA, 25 bp, Homo sapien
ctagcggccatggtgagtgcacagc

SEQ ID NO: 100647 - DNA, 25 bp, Homo sapien
cccgatgggaactgccgtggttcac

SEQ ID NO: 100648 - DNA, 25 bp, Homo sapien
cttgactttacacttccgccgaagc

SEQ ID NO: 100649 - DNA, 25 bp, Homo sapien
cgccgtagccaaacgacgagtgctg

SEQ ID NO: 100650 - DNA, 25 bp, Homo sapien
cgcggcacttttctccgacgtcttt

SEQ ID NO: 100651 - DNA, 25 bp, Homo sapien
gcaactcatccattttttcgcggca

SEQ ID NO: 100652 - DNA, 25 bp, Homo sapien
ccgcgccatcccgagagaaattgca

SEQ ID NO: 100653 - DNA, 25 bp, Homo sapien
ggtcgggaaatcctaggcaagtcca

SEQ ID NO: 100654 - DNA, 25 bp, Homo sapien
acacggatccgactcgagctaaggc

SEQ ID NO: 100655 - DNA, 25 bp, Homo sapien
cagctgttgtactggcacgcgttga

SEQ ID NO: 100656 - DNA, 25 bp, Homo sapien
gctccgtggccttaatatagggctc

SEQ ID NO: 100657 - DNA, 25 bp, Homo sapien
ggaacgtggcctctagctcttgcaa

SEQ ID NO: 100658 - DNA, 25 bp, Homo sapien
gctcttgcaactgctggcttgtgaa

SEQ ID NO: 100659 - DNA, 25 bp, Homo sapien
cttgtgaagtgcgtacgttgccgcc

SEQ ID NO: 100660 - DNA, 25 bp, Homo sapien
ctccttctctgcagtaggcaggacg

SEQ ID NO: 100661 - DNA, 25 bp, Homo sapien
gagcgggtcacctgggcttacgccc

SEQ ID NO: 100662 - DNA, 25 bp, Homo sapien
tggtcgtcagtaggcacctctagtc

SEQ ID NO: 100663 - DNA, 25 bp, Homo sapien
cacctctagtctggtgtgccgcgga

SEQ ID NO: 100664 - DNA, 25 bp, Homo sapien
aagagcccaagaatcggagctggag

SEQ ID NO: 100665 - DNA, 25 bp, Homo sapien
tctccaggcgatggggacacagcga

SEQ ID NO: 100666 - DNA, 25 bp, Homo sapien
ggggccaggagagccagtctctccc

SEQ ID NO: 100667 - DNA, 25 bp, Homo sapien
agcttcgtggcgtccgcgtacgcga

SEQ ID NO: 100668 - DNA, 25 bp, Homo sapien
tccacgacgtctggggctcccgtgg

SEQ ID NO: 100669 - DNA, 25 bp, Homo sapien
gggaccctcagagctaggagcccgc

SEQ ID NO: 100670 - DNA, 25 bp, Homo sapien
aactgcagtcgaagcacggtgagcc

SEQ ID NO: 100671 - DNA, 25 bp, Homo sapien
ggcgtggagccatcttccctcacct

SEQ ID NO: 100672 - DNA, 25 bp, Homo sapien
tccgcgtacgcgagcggccgcaaag

SEQ ID NO: 100673 - DNA, 25 bp, Homo sapien
aaccctccagctgtaggctcgtgca

SEQ ID NO: 100674 - DNA, 25 bp, Homo sapien
gcgccggcagagtctgtcttaaagc

SEQ ID NO: 100675 - DNA, 25 bp, Homo sapien
agctccgtgtcagacgactcgctgg

SEQ ID NO: 100676 - DNA, 25 bp, Homo sapien
tgccttcgcgtgtgcgtaagtttcc

SEQ ID NO: 100677 - DNA, 25 bp, Homo sapien
aggggctgtcagtccaaccctccag

SEQ ID NO: 100678 - DNA, 25 bp, Homo sapien
ttactcctgatcaagaggggctgtc

SEQ ID NO: 100679 - DNA, 25 bp, Homo sapien
cgcccagttgcgcaaatcaaattct

SEQ ID NO: 100680 - DNA, 25 bp, Homo sapien
tccgcgttcaccgtcaggtcgagaa

SEQ ID NO: 100681 - DNA, 25 bp, Homo sapien
gccgctactggcaggggccccagat

SEQ ID NO: 100682 - DNA, 25 bp, Homo sapien
cccaaagggtcactgaggtggcgag

SEQ ID NO: 100683 - DNA, 25 bp, Homo sapien
gcgcgctatttcctcctgccagctc

SEQ ID NO: 100684 - DNA, 25 bp, Homo sapien
ctgagagctcgggcttctcatggga

SEQ ID NO: 100685 - DNA, 25 bp, Homo sapien
cgtccgctgcgacgcgcttccaccc

SEQ ID NO: 100686 - DNA, 25 bp, Homo sapien
ctccggacgctaggggcacggacct

SEQ ID NO: 100687 - DNA, 25 bp, Homo sapien
aggcaacgagcccagccgaggctca

SEQ ID NO: 100688 - DNA, 25 bp, Homo sapien
acagcagacccgcagagagccggct

SEQ ID NO: 100689 - DNA, 25 bp, Homo sapien
gactctggctcaggtttcggctccg

SEQ ID NO: 100690 - DNA, 25 bp, Homo sapien
aagctaggtgttcgccgggacctgc

SEQ ID NO: 100691 - DNA, 25 bp, Homo sapien
ccagtttcccacctgactcgtgagg

SEQ ID NO: 100692 - DNA, 25 bp, Homo sapien
gacgaagccagagcgggtcccagcc

SEQ ID NO: 100693 - DNA, 25 bp, Homo sapien
gtgacggcggctatgactgtgccct

SEQ ID NO: 100694 - DNA, 25 bp, Homo sapien
gcgcaggaacgagctcctcgcgctg

SEQ ID NO: 100695 - DNA, 25 bp, Homo sapien
gccaggagcaaactgcgcaggactc

SEQ ID NO: 100696 - DNA, 25 bp, Homo sapien
tctggcactgcacggttcttcggcc

SEQ ID NO: 100697 - DNA, 25 bp, Homo sapien
gttttgcctgcaagggttctgacca

SEQ ID NO: 100698 - DNA, 25 bp, Homo sapien
gcccatcccggcatggctgctggga

SEQ ID NO: 100699 - DNA, 25 bp, Homo sapien
cacagagggcccgaactgtgcccag

SEQ ID NO: 100700 - DNA, 25 bp, Homo sapien
agggttctgaccacttggggacagc

SEQ ID NO: 100701 - DNA, 25 bp, Homo sapien
cagagcccgctgtgccaccggagaa

SEQ ID NO: 100702 - DNA, 25 bp, Homo sapien
caccggagaaccgtggagcagccag

SEQ ID NO: 100703 - DNA, 25 bp, Homo sapien
cccagcctcatggttgccagcagag

SEQ ID NO: 100704 - DNA, 25 bp, Homo sapien
gcgagcacatctcacagagcctggg

SEQ ID NO: 100705 - DNA, 25 bp, Homo sapien
cgctacggggagaagccacgcttca

SEQ ID NO: 100706 - DNA, 25 bp, Homo sapien
cgaagctctcctgccacctgttggc

SEQ ID NO: 100707 - DNA, 25 bp, Homo sapien
cgcttcagtggcttgcctggaattc

SEQ ID NO: 100708 - DNA, 25 bp, Homo sapien
ttcatgacttgtgcgctccacgtcc

SEQ ID NO: 100709 - DNA, 25 bp, Homo sapien
gccgacctgctgagggtatctctga

SEQ ID NO: 100710 - DNA, 25 bp, Homo sapien
cctgctgagggtatctctgagagca

SEQ ID NO: 100711 - DNA, 25 bp, Homo sapien
gcttcgcggcttgcggcgcaaagta

SEQ ID NO: 100712 - DNA, 25 bp, Homo sapien
cctggaattcatgacttgtgcgctc

SEQ ID NO: 100713 - DNA, 25 bp, Homo sapien
ggaaccttgtaatgagcgacgccgg

SEQ ID NO: 100714 - DNA, 25 bp, Homo sapien
gcactaattactggaaggcccgggc

SEQ ID NO: 100715 - DNA, 25 bp, Homo sapien
gagtcttaacaagggcgcactaatt

SEQ ID NO: 100716 - DNA, 25 bp, Homo sapien
gagggcctccgcatgggaacaaaaa

SEQ ID NO: 100717 - DNA, 25 bp, Homo sapien
agccgtgaggcggaaccttgtaatg

SEQ ID NO: 100718 - DNA, 25 bp, Homo sapien
tcgtgctggatgagctcatgtctga

SEQ ID NO: 100719 - DNA, 25 bp, Homo sapien
tcctcacacgcgtcgtgctggatga

SEQ ID NO: 100720 - DNA, 25 bp, Homo sapien
ggaatggcgcgactgagtcttaaca

SEQ ID NO: 100721 - DNA, 25 bp, Homo sapien
tgcgtttcgaagagaagttggtttc

SEQ ID NO: 100722 - DNA, 25 bp, Homo sapien
agcccggcttcaatcccgcgagtag

SEQ ID NO: 100723 - DNA, 25 bp, Homo sapien
ctcgggcccgacttattgtgccggg

SEQ ID NO: 100724 - DNA, 25 bp, Homo sapien
ctgcagatagcgagccagacgccta

SEQ ID NO: 100725 - DNA, 25 bp, Homo sapien
gtaggcgccagcaccgcttttttcc

SEQ ID NO: 100726 - DNA, 25 bp, Homo sapien
cgctgccgagtgaactggaaccagt

SEQ ID NO: 100727 - DNA, 25 bp, Homo sapien
ccggacgcgaggtctgacccatgac

SEQ ID NO: 100728 - DNA, 25 bp, Homo sapien
ggggcctcaccaagtacaactctgc

SEQ ID NO: 100729 - DNA, 25 bp, Homo sapien
tttacagtgattaacccgtccgagc

SEQ ID NO: 100730 - DNA, 25 bp, Homo sapien
tccaattggagagcctttcatctct

SEQ ID NO: 100731 - DNA, 25 bp, Homo sapien
ggccgccgagggctctccaattgga

SEQ ID NO: 100732 - DNA, 25 bp, Homo sapien
agaagcgtcttcttggctggctaga

SEQ ID NO: 100733 - DNA, 25 bp, Homo sapien
ctggctagagaagctccgccggagt

SEQ ID NO: 100734 - DNA, 25 bp, Homo sapien
agtgattaacccgtccgagcgcgct

SEQ ID NO: 100735 - DNA, 25 bp, Homo sapien
ttcttggctggctagagaagctccg

SEQ ID NO: 100736 - DNA, 25 bp, Homo sapien
agcctttcatctctttgtttttaca

SEQ ID NO: 100737 - DNA, 25 bp, Homo sapien
gcatttccttctaacctcgccagta

SEQ ID NO: 100738 - DNA, 25 bp, Homo sapien
cagtctttcagcgtcactcggaggc

SEQ ID NO: 100739 - DNA, 25 bp, Homo sapien
ctcgcagtacgcagactcagtcttt

SEQ ID NO: 100740 - DNA, 25 bp, Homo sapien
gctcggcatttcctggcccttcaga

SEQ ID NO: 100741 - DNA, 25 bp, Homo sapien
ggctcactcggaccttactgcaaca

SEQ ID NO: 100742 - DNA, 25 bp, Homo sapien
cttcagaagacgatgtcgggacctc

SEQ ID NO: 100743 - DNA, 25 bp, Homo sapien
cgcggtcttagccagctgtggccaa

SEQ ID NO: 100744 - DNA, 25 bp, Homo sapien
gcctgccggtgcagtccttaatgca

SEQ ID NO: 100745 - DNA, 25 bp, Homo sapien
aggggcgttatctcctgaccgaaga

SEQ ID NO: 100746 - DNA, 25 bp, Homo sapien
agagggccgcacatctgtttatctc

SEQ ID NO: 100747 - DNA, 25 bp, Homo sapien
catctgtttatctctgaagcggcgc

SEQ ID NO: 100748 - DNA, 25 bp, Homo sapien
gcgctggattggatttctcgatgtt

SEQ ID NO: 100749 - DNA, 25 bp, Homo sapien
ctcgatgtttatctccctcagagga

SEQ ID NO: 100750 - DNA, 25 bp, Homo sapien
tgacaggtcgggaacagggcctccc

SEQ ID NO: 100751 - DNA, 25 bp, Homo sapien
agaggcgcgtccctgtcgcctcagg

SEQ ID NO: 100752 - DNA, 25 bp, Homo sapien
tatctcctgaccgaagagggccgca

SEQ ID NO: 100753 - DNA, 25 bp, Homo sapien
cttcccacccgctgtgggcgtctca

SEQ ID NO: 100754 - DNA, 25 bp, Homo sapien
cccacccgctgtgggcgtctcagcc

SEQ ID NO: 100755 - DNA, 25 bp, Homo sapien
ttcccacccgctgtgggcgtctcag

SEQ ID NO: 100756 - DNA, 25 bp, Homo sapien
tgggcgtctcagcccgttgtccctg

SEQ ID NO: 100757 - DNA, 25 bp, Homo sapien
cgctgtgggcgtctcagcccgttgt

SEQ ID NO: 100758 - DNA, 25 bp, Homo sapien
gctgtgggcgtctcagcccgttgtc

SEQ ID NO: 100759 - DNA, 25 bp, Homo sapien
gtgggcgtctcagcccgttgtccct

SEQ ID NO: 100760 - DNA, 25 bp, Homo sapien
tcccacccgctgtgggcgtctcagc

SEQ ID NO: 100761 - DNA, 25 bp, Homo sapien
gggcgccgacaatgagcctccataa

SEQ ID NO: 100762 - DNA, 25 bp, Homo sapien
cccaccatggtttagaagctcaggc

SEQ ID NO: 100763 - DNA, 25 bp, Homo sapien
agaagctcaggcctcctcgatttcc

SEQ ID NO: 100764 - DNA, 25 bp, Homo sapien
agggtctggagacttcgatccacgc

SEQ ID NO: 100765 - DNA, 25 bp, Homo sapien
gggattccacttccgcgtcacggtg

SEQ ID NO: 100766 - DNA, 25 bp, Homo sapien
tggtggccgtaattccgcggcccga

SEQ ID NO: 100767 - DNA, 25 bp, Homo sapien
caggtttccctctcggatctgggtc

SEQ ID NO: 100768 - DNA, 25 bp, Homo sapien
cccaactgacttcttaatggaggga

SEQ ID NO: 100769 - DNA, 25 bp, Homo sapien
agcctggggttgttactctgtgcca

SEQ ID NO: 100770 - DNA, 25 bp, Homo sapien
cggagtgtgcccgtaattaccgccg

SEQ ID NO: 100771 - DNA, 25 bp, Homo sapien
aggctgcctgttggagtctggcaca

SEQ ID NO: 100772 - DNA, 25 bp, Homo sapien
gcataatttatgctcgcgggaggcc

SEQ ID NO: 100773 - DNA, 25 bp, Homo sapien
cagcgcccgggtatttgcataattt

SEQ ID NO: 100774 - DNA, 25 bp, Homo sapien
agggcgcacttacgttcccaacagc

SEQ ID NO: 100775 - DNA, 25 bp, Homo sapien
ctggcacagtcttcctcgtcggtga

SEQ ID NO: 100776 - DNA, 25 bp, Homo sapien
ccgacggacagatagaaaggcgctc

SEQ ID NO: 100777 - DNA, 25 bp, Homo sapien
ctctgggccagcaagttccagttcc

SEQ ID NO: 100778 - DNA, 25 bp, Homo sapien
tagcgccgtggctcttcctacggcg

SEQ ID NO: 100779 - DNA, 25 bp, Homo sapien
gattagggccgcacgagaggcgacc

SEQ ID NO: 100780 - DNA, 25 bp, Homo sapien
tatccggcaggataaccgcggccgc

SEQ ID NO: 100781 - DNA, 25 bp, Homo sapien
ctaatccttgttatccggcaggata

SEQ ID NO: 100782 - DNA, 25 bp, Homo sapien
acgcactaatccttgttatccggca

SEQ ID NO: 100783 - DNA, 25 bp, Homo sapien
gccacgtgagcacagacacggcttc

SEQ ID NO: 100784 - DNA, 25 bp, Homo sapien
tccagccacgtgagcacagacacgg

SEQ ID NO: 100785 - DNA, 25 bp, Homo sapien
cgcgggatcccaggatgcctagaaa

SEQ ID NO: 100786 - DNA, 25 bp, Homo sapien
tcccttccgggagcacttgcatttg

SEQ ID NO: 100787 - DNA, 25 bp, Homo sapien
aacggcttagttgctaggcggtctc

SEQ ID NO: 100788 - DNA, 25 bp, Homo sapien
tgcctagaaattggcgcttgggttc

SEQ ID NO: 100789 - DNA, 25 bp, Homo sapien
cgcagcgagcgagctcattaatatg

SEQ ID NO: 100790 - DNA, 25 bp, Homo sapien
cattaatatgcagaaccactcggtg

SEQ ID NO: 100791 - DNA, 25 bp, Homo sapien
ccactcggtgactcactgagatttc

SEQ ID NO: 100792 - DNA, 25 bp, Homo sapien
acttgcatttggaccctgcgagcga

SEQ ID NO: 100793 - DNA, 25 bp, Homo sapien
gaaactttgcctctgtgcgctgcca

SEQ ID NO: 100794 - DNA, 25 bp, Homo sapien
ccagggctaaattctgagagcttca

SEQ ID NO: 100795 - DNA, 25 bp, Homo sapien
cccagagtgctgtgcctttaaggtc

SEQ ID NO: 100796 - DNA, 25 bp, Homo sapien
gctgcgaggagcacttattgccttc

SEQ ID NO: 100797 - DNA, 25 bp, Homo sapien
ccttcagtgacctggtgcacacctg

SEQ ID NO: 100798 - DNA, 25 bp, Homo sapien
cacacctgaattgcggacgtggctc

SEQ ID NO: 100799 - DNA, 25 bp, Homo sapien
caggcttcgagattaggccggccca

SEQ ID NO: 100800 - DNA, 25 bp, Homo sapien
ggcggagtttgcctctatgctctga

SEQ ID NO: 100801 - DNA, 25 bp, Homo sapien
tttggggtcttcagtaacacgcagc

SEQ ID NO: 100802 - DNA, 25 bp, Homo sapien
gttttcactgcagatgttcggcttc

SEQ ID NO: 100803 - DNA, 25 bp, Homo sapien
tgccgtctacaactccgtggtgttt

SEQ ID NO: 100804 - DNA, 25 bp, Homo sapien
gggcccgtggacctcatcaagatcc

SEQ ID NO: 100805 - DNA, 25 bp, Homo sapien
atcaagatccggttgcagatgcaga

SEQ ID NO: 100806 - DNA, 25 bp, Homo sapien
cagatgcagacacaaccgtttcggg

SEQ ID NO: 100807 - DNA, 25 bp, Homo sapien
tcacgcctcttccttctggttttca

SEQ ID NO: 100808 - DNA, 25 bp, Homo sapien
gttcggcttcttcaagggcatgtcc

SEQ ID NO: 100809 - DNA, 25 bp, Homo sapien
ctcttcggtggagtgagcctagaaa

SEQ ID NO: 100810 - DNA, 25 bp, Homo sapien
tctcagatcgccgtgcgtgacttgg

SEQ ID NO: 100811 - DNA, 25 bp, Homo sapien
ggacggccggactccagcaccttgg

SEQ ID NO: 100812 - DNA, 25 bp, Homo sapien
cgcgaacgctgagcacgcgcggaaa

SEQ ID NO: 100813 - DNA, 25 bp, Homo sapien
tccgctttctcgctgggctgggttt

SEQ ID NO: 100814 - DNA, 25 bp, Homo sapien
tagcacatttttcgggtgtcgcggg

SEQ ID NO: 100815 - DNA, 25 bp, Homo sapien
catgagccgcgcgtctggctcttcg

SEQ ID NO: 100816 - DNA, 25 bp, Homo sapien
tgagcacgcgcggaaaccctttaaa

SEQ ID NO: 100817 - DNA, 25 bp, Homo sapien
aaaccttgcagcatggagcgctcgg

SEQ ID NO: 100818 - DNA, 25 bp, Homo sapien
cagcttacttaacctggcccgggcg

SEQ ID NO: 100819 - DNA, 25 bp, Homo sapien
ggaggcgctctcacttccctggagc

SEQ ID NO: 100820 - DNA, 25 bp, Homo sapien
gtcgctagctcgctcggtgcgcgtc

SEQ ID NO: 100821 - DNA, 25 bp, Homo sapien
ctccatggcgctcttcgtgcggctg

SEQ ID NO: 100822 - DNA, 25 bp, Homo sapien
taccagctggtgctgcagcacagca

SEQ ID NO: 100823 - DNA, 25 bp, Homo sapien
cagcacgggtaagccgagccgcctg

SEQ ID NO: 100824 - DNA, 25 bp, Homo sapien
agcccgaactaaaaaccttgcagca

SEQ ID NO: 100825 - DNA, 25 bp, Homo sapien
tgcggcgcaacatgcaccacaggta

SEQ ID NO: 100826 - DNA, 25 bp, Homo sapien
gacgattctggattgtaggccgccc

SEQ ID NO: 100827 - DNA, 25 bp, Homo sapien
gggtcaagggacaagaagacgattc

SEQ ID NO: 100828 - DNA, 25 bp, Homo sapien
aacagctgctcagtggtccgcaacc

SEQ ID NO: 100829 - DNA, 25 bp, Homo sapien
tggtaccagagcaaggcggaacagc

SEQ ID NO: 100830 - DNA, 25 bp, Homo sapien
taggggcactaccagggcaaaaaga

SEQ ID NO: 100831 - DNA, 25 bp, Homo sapien
accaaaatttaagtgcggcgcaaca

SEQ ID NO: 100832 - DNA, 25 bp, Homo sapien
ccgggcctgatcaaaggtgcgtatg

SEQ ID NO: 100833 - DNA, 25 bp, Homo sapien
acagatagaaagtccggcatgagga

SEQ ID NO: 100834 - DNA, 25 bp, Homo sapien
catgaggaggtaaccgcttgagcta

SEQ ID NO: 100835 - DNA, 25 bp, Homo sapien
agaggcctgcgtcatgcggtctcgc

SEQ ID NO: 100836 - DNA, 25 bp, Homo sapien
gcttgagctaactccgacccgggta

SEQ ID NO: 100837 - DNA, 25 bp, Homo sapien
tctaaaccatagaagagtgacgatg

SEQ ID NO: 100838 - DNA, 25 bp, Homo sapien
ggagtgtgcgactgaaacttctaaa

SEQ ID NO: 100839 - DNA, 25 bp, Homo sapien
tggagggactctcagttcctcccgc

SEQ ID NO: 100840 - DNA, 25 bp, Homo sapien
aggcgtcctgctaacgtgtcctgga

SEQ ID NO: 100841 - DNA, 25 bp, Homo sapien
gggagcggtttgctttcctaactca

SEQ ID NO: 100842 - DNA, 25 bp, Homo sapien
tgccgccgtcgctttgtgtttcaaa

SEQ ID NO: 100843 - DNA, 25 bp, Homo sapien
tccaatggcttgatgaatccgtgcc

SEQ ID NO: 100844 - DNA, 25 bp, Homo sapien
tgctgcactgcgaagctgtccaatg

SEQ ID NO: 100845 - DNA, 25 bp, Homo sapien
ctcatcggatgtaccaccctggata

SEQ ID NO: 100846 - DNA, 25 bp, Homo sapien
gctgttaccgcccagactttggagg

SEQ ID NO: 100847 - DNA, 25 bp, Homo sapien
aaggcctccagctgatcggaagtcg

SEQ ID NO: 100848 - DNA, 25 bp, Homo sapien
tggatacacacccttgataggactg

SEQ ID NO: 100849 - DNA, 25 bp, Homo sapien
gtcgcttcgtggatttccgtaaaca

SEQ ID NO: 100850 - DNA, 25 bp, Homo sapien
gtcctgactccaagctgcacacttg

SEQ ID NO: 100851 - DNA, 25 bp, Homo sapien
ctacccacgctgaacgagagggaca

SEQ ID NO: 100852 - DNA, 25 bp, Homo sapien
gcttcggatgtttccggctgctgcc

SEQ ID NO: 100853 - DNA, 25 bp, Homo sapien
ctcccgtttctagccgcttcggatg

SEQ ID NO: 100854 - DNA, 25 bp, Homo sapien
ttccggaattcacccgtagtctgtg

SEQ ID NO: 100855 - DNA, 25 bp, Homo sapien
gaagcttcgtcttcggaatcgagga

SEQ ID NO: 100856 - DNA, 25 bp, Homo sapien
tttccgtaaacagagccgaagcttc

SEQ ID NO: 100857 - DNA, 25 bp, Homo sapien
ttctccacgctgaccgggaagatcc

SEQ ID NO: 100858 - DNA, 25 bp, Homo sapien
gctcagcaagatggcgcagctcact

SEQ ID NO: 100859 - DNA, 25 bp, Homo sapien
tgacctcacgggcatccgagatgtg

SEQ ID NO: 100860 - DNA, 25 bp, Homo sapien
tcactgagggcaacttcgaggcggt

SEQ ID NO: 100861 - DNA, 25 bp, Homo sapien
tcgccgacctcttcgtcactgaggg

SEQ ID NO: 100862 - DNA, 25 bp, Homo sapien
tggtgcacaacgtgcggctgcatgc

SEQ ID NO: 100863 - DNA, 25 bp, Homo sapien
caggacctgcgcgacagaacctgca

SEQ ID NO: 100864 - DNA, 25 bp, Homo sapien
tggccaggacctgctgtgagctgca

SEQ ID NO: 100865 - DNA, 25 bp, Homo sapien
tggaacacgtcgtgccagcctcgga

SEQ ID NO: 100866 - DNA, 25 bp, Homo sapien
acgcggtgccagtgatccagcggca

SEQ ID NO: 100867 - DNA, 25 bp, Homo sapien
cggccacaagcggtaccgccaaaag

SEQ ID NO: 100868 - DNA, 25 bp, Homo sapien
gggaaagccttcagctactacctgc

SEQ ID NO: 100869 - DNA, 25 bp, Homo sapien
ggccggagaagcagttcctcaagtc

SEQ ID NO: 100870 - DNA, 25 bp, Homo sapien
ccaccgcaggtcacaggtgctggtg

SEQ ID NO: 100871 - DNA, 25 bp, Homo sapien
ccaggagccagatacacatgccgta

SEQ ID NO: 100872 - DNA, 25 bp, Homo sapien
gccagccagcagcaagtccgggaaa

SEQ ID NO: 100873 - DNA, 25 bp, Homo sapien
ctcgggttgccactctagttcagga

SEQ ID NO: 100874 - DNA, 25 bp, Homo sapien
gtggctcagtcccaagctacaccgg

SEQ ID NO: 100875 - DNA, 25 bp, Homo sapien
aaagcgccttctgccttgaccgtgg

SEQ ID NO: 100876 - DNA, 25 bp, Homo sapien
ccgcccgtggcgttgaatatgtcgc

SEQ ID NO: 100877 - DNA, 25 bp, Homo sapien
aatatgtcgccgtacatggcccgcg

SEQ ID NO: 100878 - DNA, 25 bp, Homo sapien
accgcttcacttggcctggagcata

SEQ ID NO: 100879 - DNA, 25 bp, Homo sapien
ttctcggagctggacagttctgtgc

SEQ ID NO: 100880 - DNA, 25 bp, Homo sapien
ggggatcagaatcacggtacctaca

SEQ ID NO: 100881 - DNA, 25 bp, Homo sapien
gccagtcctttgtaggcgttcatgc

SEQ ID NO: 100882 - DNA, 25 bp, Homo sapien
gctgaaggagtctttccgctgtttc

SEQ ID NO: 100883 - DNA, 25 bp, Homo sapien
gcacgatctcatactcctggcagtg

SEQ ID NO: 100884 - DNA, 25 bp, Homo sapien
gaccaccgggatgttgccatactca

SEQ ID NO: 100885 - DNA, 25 bp, Homo sapien
actcagccgagtccaggaagcgctc

SEQ ID NO: 100886 - DNA, 25 bp, Homo sapien
tggtgcccttctcgttgaacatgta

SEQ ID NO: 100887 - DNA, 25 bp, Homo sapien
tcgtaggcatagaagtcgtcgtcgc

SEQ ID NO: 100888 - DNA, 25 bp, Homo sapien
cgctgtttctcggtgcactcattgc

SEQ ID NO: 100889 - DNA, 25 bp, Homo sapien
ctcagccactggtcattgtctagga

SEQ ID NO: 100890 - DNA, 25 bp, Homo sapien
tagtccgagttgctcgagctcccgc

SEQ ID NO: 100891 - DNA, 25 bp, Homo sapien
atgccgccctcctatcaggggcttg

SEQ ID NO: 100892 - DNA, 25 bp, Homo sapien
gggacccgtctcgtctattctccga

SEQ ID NO: 100893 - DNA, 25 bp, Homo sapien
cgaatccgaggctgccgtccaacta

SEQ ID NO: 100894 - DNA, 25 bp, Homo sapien
actcatctacgaacgaggaggctgc

SEQ ID NO: 100895 - DNA, 25 bp, Homo sapien
cggctctcgacttggaggaagcacc

SEQ ID NO: 100896 - DNA, 25 bp, Homo sapien
tgagcccgcagcgatgtgctctgct

SEQ ID NO: 100897 - DNA, 25 bp, Homo sapien
ggcagcctagggctaccagccaatc

SEQ ID NO: 100898 - DNA, 25 bp, Homo sapien
aggccgccgatgaacagcttacaca

SEQ ID NO: 100899 - DNA, 25 bp, Homo sapien
tccacattggagtaggtcacgaagc

SEQ ID NO: 100900 - DNA, 25 bp, Homo sapien
agcgcttggtctggggattcaccac

SEQ ID NO: 100901 - DNA, 25 bp, Homo sapien
ctcgtctgcacattgaggccgccga

SEQ ID NO: 100902 - DNA, 25 bp, Homo sapien
ttggttaaggcctctacacagcttg

SEQ ID NO: 100903 - DNA, 25 bp, Homo sapien
gattcatttcctcctagcaccgcgg

SEQ ID NO: 100904 - DNA, 25 bp, Homo sapien
acgcagtccgtcagagtcccaaagg

SEQ ID NO: 100905 - DNA, 25 bp, Homo sapien
aattcgtttgagagatgtgactgcc

SEQ ID NO: 100906 - DNA, 25 bp, Homo sapien
agccgcgctgacgacttgtcgagta

SEQ ID NO: 100907 - DNA, 25 bp, Homo sapien
acttgtcgagtagctcgccgccctg

SEQ ID NO: 100908 - DNA, 25 bp, Homo sapien
ggcagttccagacaccctgaaagga

SEQ ID NO: 100909 - DNA, 25 bp, Homo sapien
gatgtgactgccgacacctttagcc

SEQ ID NO: 100910 - DNA, 25 bp, Homo sapien
cagatggtcccattgcacagacggg

SEQ ID NO: 100911 - DNA, 25 bp, Homo sapien
tcacctgtcgagtgaccgtcgctag

SEQ ID NO: 100912 - DNA, 25 bp, Homo sapien
acaggggcgatttggcagttccaga

SEQ ID NO: 100913 - DNA, 25 bp, Homo sapien
ttacctaccgttggaaccgcgatgc

SEQ ID NO: 100914 - DNA, 25 bp, Homo sapien
gggtgtcgcgccatctactctggag

SEQ ID NO: 100915 - DNA, 25 bp, Homo sapien
aagaaacgtggggtgtcgcgccatc

SEQ ID NO: 100916 - DNA, 25 bp, Homo sapien
gccgctgacgggaggttaaagctac

SEQ ID NO: 100917 - DNA, 25 bp, Homo sapien
agccgctgcaaatccaaggctgcca

SEQ ID NO: 100918 - DNA, 25 bp, Homo sapien
cagccagggacacggcttcatcttc

SEQ ID NO: 100919 - DNA, 25 bp, Homo sapien
tgctagagtcctccacatcccgaaa

SEQ ID NO: 100920 - DNA, 25 bp, Homo sapien
aggtgaggggcacgcccgctcaact

SEQ ID NO: 100921 - DNA, 25 bp, Homo sapien
tctgtaacaaagctgcacctcgtgg

SEQ ID NO: 100922 - DNA, 25 bp, Homo sapien
ggtagctgcaggcttccctatctga

SEQ ID NO: 100923 - DNA, 25 bp, Homo sapien
ccgaacgaacgcagcgcgtaattta

SEQ ID NO: 100924 - DNA, 25 bp, Homo sapien
ttccttacgcggattggtagctgca

SEQ ID NO: 100925 - DNA, 25 bp, Homo sapien
ctaggtgtgagtaagccagtatccc

SEQ ID NO: 100926 - DNA, 25 bp, Homo sapien
tatcccaggaggagcaagtggcacg

SEQ ID NO: 100927 - DNA, 25 bp, Homo sapien
gctggagcccgggttaccagctctt

SEQ ID NO: 100928 - DNA, 25 bp, Homo sapien
tccctatctgattggccgaacgaac

SEQ ID NO: 100929 - DNA, 25 bp, Homo sapien
tggactcaactcagggtccggctgc

SEQ ID NO: 100930 - DNA, 25 bp, Homo sapien
tcggctaatgcgtatcgaatttttg

SEQ ID NO: 100931 - DNA, 25 bp, Homo sapien
atttttgtggagttcggcccgcgca

SEQ ID NO: 100932 - DNA, 25 bp, Homo sapien
tgcccgagcctcttaattccctttg

SEQ ID NO: 100933 - DNA, 25 bp, Homo sapien
tcctgccgttaatgacataaccttc

SEQ ID NO: 100934 - DNA, 25 bp, Homo sapien
gcggccgctgatagtcggctaatgc

SEQ ID NO: 100935 - DNA, 25 bp, Homo sapien
ttaactgacaactgcattaggcggc

SEQ ID NO: 100936 - DNA, 25 bp, Homo sapien
agggcctcccgcagtcaagccggga

SEQ ID NO: 100937 - DNA, 25 bp, Homo sapien
gcagtggcggcaacgacaaagaaaa

SEQ ID NO: 100938 - DNA, 25 bp, Homo sapien
ggctctctctcaacggggttcgatt

SEQ ID NO: 100939 - DNA, 25 bp, Homo sapien
cagagcgagctgcatgagaagtaca

SEQ ID NO: 100940 - DNA, 25 bp, Homo sapien
tggacgcgaacagctgccagagcga

SEQ ID NO: 100941 - DNA, 25 bp, Homo sapien
tccatggagcccaacgagatgatgc

SEQ ID NO: 100942 - DNA, 25 bp, Homo sapien
ccctccgcttcacgtggagtatgaa

SEQ ID NO: 100943 - DNA, 25 bp, Homo sapien
ctccacagacctcacgtggtgggca

SEQ ID NO: 100944 - DNA, 25 bp, Homo sapien
gagtatgaagaccacgagctccatg

SEQ ID NO: 100945 - DNA, 25 bp, Homo sapien
agaaagtgagcagctgcctgaggca

SEQ ID NO: 100946 - DNA, 25 bp, Homo sapien
atgggcacagtagcaggccctgcgc

SEQ ID NO: 100947 - DNA, 25 bp, Homo sapien
ctcgaagaaagtgagcagctgcctg

SEQ ID NO: 100948 - DNA, 25 bp, Homo sapien
cttctcgaagaaagtgagcagctgc

SEQ ID NO: 100949 - DNA, 25 bp, Homo sapien
gcggccttctcgaagaaagtgagca

SEQ ID NO: 100950 - DNA, 25 bp, Homo sapien
ctcggcggccttctcgaagaaagtg

SEQ ID NO: 100951 - DNA, 25 bp, Homo sapien
cacatgggcacagtagcaggccctg

SEQ ID NO: 100952 - DNA, 25 bp, Homo sapien
agctgcctgaggcagacgtggcgct

SEQ ID NO: 100953 - DNA, 25 bp, Homo sapien
tccaactccgaagcgcgcgtccaca

SEQ ID NO: 100954 - DNA, 25 bp, Homo sapien
cgggcctcgcctacacctcacctcc

SEQ ID NO: 100955 - DNA, 25 bp, Homo sapien
cgcaccatggcgagctgtaggcgcc

SEQ ID NO: 100956 - DNA, 25 bp, Homo sapien
caacatcaggactacgggcggcagc

SEQ ID NO: 100957 - DNA, 25 bp, Homo sapien
agcagcaacatcaggactacgggcg

SEQ ID NO: 100958 - DNA, 25 bp, Homo sapien
ccggtgcgcgctctgacactcaccg

SEQ ID NO: 100959 - DNA, 25 bp, Homo sapien
tgctgcgccctctccggacaggtgc

SEQ ID NO: 100960 - DNA, 25 bp, Homo sapien
gcgtccacaccacgcgcctccagcg

SEQ ID NO: 100961 - DNA, 25 bp, Homo sapien
cattcacacgtgttggaaagggctg

SEQ ID NO: 100962 - DNA, 25 bp, Homo sapien
ctccgagcgaaaggcgctgactgca

SEQ ID NO: 100963 - DNA, 25 bp, Homo sapien
gattctctgaccctgaaggatgcag

SEQ ID NO: 100964 - DNA, 25 bp, Homo sapien
gtgagtcaggatcaggcggattctc

SEQ ID NO: 100965 - DNA, 25 bp, Homo sapien
cacgctccggacacgaggctgagct

SEQ ID NO: 100966 - DNA, 25 bp, Homo sapien
cgccattgagcttcacagccgtgtg

SEQ ID NO: 100967 - DNA, 25 bp, Homo sapien
tgcatccgcctgacgttggactggt

SEQ ID NO: 100968 - DNA, 25 bp, Homo sapien
agccctgatgagctgcattcacacg

SEQ ID NO: 100969 - DNA, 25 bp, Homo sapien
cttccacgggagatggagcgtttgc

SEQ ID NO: 100970 - DNA, 25 bp, Homo sapien
gcttctttctcgtgccgttttcgcg

SEQ ID NO: 100971 - DNA, 25 bp, Homo sapien
cgcaggcgttgaccattcaaacctt

SEQ ID NO: 100972 - DNA, 25 bp, Homo sapien
gtgtttggcccaccagcgttaggca

SEQ ID NO: 100973 - DNA, 25 bp, Homo sapien
catggcctatcgttgggctcgcaga

SEQ ID NO: 100974 - DNA, 25 bp, Homo sapien
gcgtgtgcttgctctggaaatggta

SEQ ID NO: 100975 - DNA, 25 bp, Homo sapien
cgcgccttactagtgatgtccattc

SEQ ID NO: 100976 - DNA, 25 bp, Homo sapien
cccatagccagagcaggatagtgtt

SEQ ID NO: 100977 - DNA, 25 bp, Homo sapien
ctctcctcagggactcgttggttcg

SEQ ID NO: 100978 - DNA, 25 bp, Homo sapien
cagcgctgtccgagagacactttga

SEQ ID NO: 100979 - DNA, 25 bp, Homo sapien
tgactcgttagtgaggaaaccaccc

SEQ ID NO: 100980 - DNA, 25 bp, Homo sapien
gggccgtccactttctgcgatattt

SEQ ID NO: 100981 - DNA, 25 bp, Homo sapien
cgcgggtttcaagatgtgcctccaa

SEQ ID NO: 100982 - DNA, 25 bp, Homo sapien
agcaggccctaatccgcgcttggac

SEQ ID NO: 100983 - DNA, 25 bp, Homo sapien
ccgcggccagatgatggaacctagt

SEQ ID NO: 100984 - DNA, 25 bp, Homo sapien
ggcgatgcctttgtttaccttcttc

SEQ ID NO: 100985 - DNA, 25 bp, Homo sapien
tctggatgcccgcaaaactggggtc

SEQ ID NO: 100986 - DNA, 25 bp, Homo sapien
caaaactggggtcaagcggcgccac

SEQ ID NO: 100987 - DNA, 25 bp, Homo sapien
ccagagctgccctggcgacctcgag

SEQ ID NO: 100988 - DNA, 25 bp, Homo sapien
gcgacctcgaggtctccgcaacctt

SEQ ID NO: 100989 - DNA, 25 bp, Homo sapien
gccttgtgatctggatgcccgcaaa

SEQ ID NO: 100990 - DNA, 25 bp, Homo sapien
tgcccggagctctcccgcatcctcc

SEQ ID NO: 100991 - DNA, 25 bp, Homo sapien
tgggcccgcaggcaagccgcttctt

SEQ ID NO: 100992 - DNA, 25 bp, Homo sapien
cgctcacagccttgtgatctggatg

SEQ ID NO: 100993 - DNA, 25 bp, Homo sapien
agcctcagagttcggccagtgttgc

SEQ ID NO: 100994 - DNA, 25 bp, Homo sapien
tcccgggagcctcagagttcggcca

SEQ ID NO: 100995 - DNA, 25 bp, Homo sapien
tctcgaatcttgagctcccgggagc

SEQ ID NO: 100996 - DNA, 25 bp, Homo sapien
gttcggccagtgttgccgctgccct

SEQ ID NO: 100997 - DNA, 25 bp, Homo sapien
cggagcaggctctcgaatcttgagc

SEQ ID NO: 100998 - DNA, 25 bp, Homo sapien
acacgccttcggagcaggctctcga

SEQ ID NO: 100999 - DNA, 25 bp, Homo sapien
agcgcttgccggcatggcttccgcg

SEQ ID NO: 101000 - DNA, 25 bp, Homo sapien
ctgttcgcggacactgcggcctcag

SEQ ID NO: 101001 - DNA, 25 bp, Homo sapien
caacccttatttgggcagcacctta

SEQ ID NO: 101002 - DNA, 25 bp, Homo sapien
cgtgccgttccagacccttcaaata

SEQ ID NO: 101003 - DNA, 25 bp, Homo sapien
gccggtcctgccatattagggcttc

SEQ ID NO: 101004 - DNA, 25 bp, Homo sapien
ctagttcacgcctaggagccgcctg

SEQ ID NO: 101005 - DNA, 25 bp, Homo sapien
cgagagatcccagcgcgcagaactt

SEQ ID NO: 101006 - DNA, 25 bp, Homo sapien
agctgcgacccggaaatgccatata

SEQ ID NO: 101007 - DNA, 25 bp, Homo sapien
gcaccttatttggagtggcccgata

SEQ ID NO: 101008 - DNA, 25 bp, Homo sapien
atatatggccatgtacgtcacgacg

SEQ ID NO: 101009 - DNA, 25 bp, Homo sapien
cgcccttacgcttgcccagtggagt

SEQ ID NO: 101010 - DNA, 25 bp, Homo sapien
ggagtcctgtgatcgccgcttctcc

SEQ ID NO: 101011 - DNA, 25 bp, Homo sapien
ttgcccagtggagtcctgtgatcgc

SEQ ID NO: 101012 - DNA, 25 bp, Homo sapien
cttacgcttgcccagtggagtcctg

SEQ ID NO: 101013 - DNA, 25 bp, Homo sapien
aacgcccttacgcttgcccagtgga

SEQ ID NO: 101014 - DNA, 25 bp, Homo sapien
cagtggagtcctgtgatcgccgctt

SEQ ID NO: 101015 - DNA, 25 bp, Homo sapien
cgcttgcccagtggagtcctgtgat

SEQ ID NO: 101016 - DNA, 25 bp, Homo sapien
tccgacgagctcacccgccacatcc

SEQ ID NO: 101017 - DNA, 25 bp, Homo sapien
cccgctggtttcgtattttgcctcg

SEQ ID NO: 101018 - DNA, 25 bp, Homo sapien
ctaaaggggcacgaccagccggcgt

SEQ ID NO: 101019 - DNA, 25 bp, Homo sapien
gcgtctgggaaaccgctcctgcagc

SEQ ID NO: 101020 - DNA, 25 bp, Homo sapien
ctcagagacgaaggcactgcaccca

SEQ ID NO: 101021 - DNA, 25 bp, Homo sapien
ccacagatcgtgcatggctttgctg

SEQ ID NO: 101022 - DNA, 25 bp, Homo sapien
aggctccggcggaaacggctccatc

SEQ ID NO: 101023 - DNA, 25 bp, Homo sapien
tcattctgcccttcgtacaggcttc

SEQ ID NO: 101024 - DNA, 25 bp, Homo sapien
gctttgctggaattcccaccgggcc

SEQ ID NO: 101025 - DNA, 25 bp, Homo sapien
gctccagaggggttccaatcagggt

SEQ ID NO: 101026 - DNA, 25 bp, Homo sapien
gcccagtctaaggaccaaggcggcg

SEQ ID NO: 101027 - DNA, 25 bp, Homo sapien
cctcagcccagtctaaggaccaagg

SEQ ID NO: 101028 - DNA, 25 bp, Homo sapien
ccgatgtaatctggacctgagggga

SEQ ID NO: 101029 - DNA, 25 bp, Homo sapien
cacggacgtggagaccgatgtaatc

SEQ ID NO: 101030 - DNA, 25 bp, Homo sapien
tcagtgacaccagagatgcctgggg

SEQ ID NO: 101031 - DNA, 25 bp, Homo sapien
tgtcctcagtgacaccagagatgcc

SEQ ID NO: 101032 - DNA, 25 bp, Homo sapien
cgtggagaccgatgtaatctggacc

SEQ ID NO: 101033 - DNA, 25 bp, Homo sapien
cggagacaccaagaccacagagtta

SEQ ID NO: 101034 - DNA, 25 bp, Homo sapien
gggtcgtcgtcttttcagtccattc

SEQ ID NO: 101035 - DNA, 25 bp, Homo sapien
gcagcctacaatgagcccgccgatt

SEQ ID NO: 101036 - DNA, 25 bp, Homo sapien
tgcagctcgccacaaaggtcaccgg

SEQ ID NO: 101037 - DNA, 25 bp, Homo sapien
tttgcgactcgaagctaggcacttg

SEQ ID NO: 101038 - DNA, 25 bp, Homo sapien
gatctccacgttcctgtcggcagca

SEQ ID NO: 101039 - DNA, 25 bp, Homo sapien
tcaggggctactacccagagatcca

SEQ ID NO: 101040 - DNA, 25 bp, Homo sapien
ttgcaatccgctcacatggggcctg

SEQ ID NO: 101041 - DNA, 25 bp, Homo sapien
tgttggcgcaacagacatccagcta

SEQ ID NO: 101042 - DNA, 25 bp, Homo sapien
tgcagctcggctggcacttatcatg

SEQ ID NO: 101043 - DNA, 25 bp, Homo sapien
cgccgcctgaccagaggatactcga

SEQ ID NO: 101044 - DNA, 25 bp, Homo sapien
ccagggcgtacaggtaatatgctcc

SEQ ID NO: 101045 - DNA, 25 bp, Homo sapien
tatgaaggccgtatctcggacagcc

SEQ ID NO: 101046 - DNA, 25 bp, Homo sapien
gactcaaggtcacacgggataaatt

SEQ ID NO: 101047 - DNA, 25 bp, Homo sapien
attacagtcttcttgcgtcagttgc

SEQ ID NO: 101048 - DNA, 25 bp, Homo sapien
tggagactaactgcggcgctcactg

SEQ ID NO: 101049 - DNA, 25 bp, Homo sapien
gaagtgattgtcgtccggctccgag

SEQ ID NO: 101050 - DNA, 25 bp, Homo sapien
gaggagaaactataggcccagcgcc

SEQ ID NO: 101051 - DNA, 25 bp, Homo sapien
ccagctagccgcaggtaacttcgta

SEQ ID NO: 101052 - DNA, 25 bp, Homo sapien
tggaatttagcgctcgcccagctag

SEQ ID NO: 101053 - DNA, 25 bp, Homo sapien
tctgcttcgggcctctggaatttag

SEQ ID NO: 101054 - DNA, 25 bp, Homo sapien
gggagacaaagcagcgcccgtctgc

SEQ ID NO: 101055 - DNA, 25 bp, Homo sapien
atttcctcctcctagccggactgga

SEQ ID NO: 101056 - DNA, 25 bp, Homo sapien
gcgttgccagactctcttcgcggtg

SEQ ID NO: 101057 - DNA, 25 bp, Homo sapien
acagaggccgcccatgcagggtcat

SEQ ID NO: 101058 - DNA, 25 bp, Homo sapien
aggggagcacttgcgtttctgtgtt

SEQ ID NO: 101059 - DNA, 25 bp, Homo sapien
ggtctcaggccagctgcagccgtgc

SEQ ID NO: 101060 - DNA, 25 bp, Homo sapien
cccatgcagggtcatggagaggccc

SEQ ID NO: 101061 - DNA, 25 bp, Homo sapien
ggctcacgccctttgatccgcttga

SEQ ID NO: 101062 - DNA, 25 bp, Homo sapien
ccctttgatccgcttgacgcttaag

SEQ ID NO: 101063 - DNA, 25 bp, Homo sapien
gcttgacgcttaagccacataaacg

SEQ ID NO: 101064 - DNA, 25 bp, Homo sapien
cccgtgtgtggacttgaaagtcgga

SEQ ID NO: 101065 - DNA, 25 bp, Homo sapien
gcagccgagtggcagacacaactcc

SEQ ID NO: 101066 - DNA, 25 bp, Homo sapien
cggcagccgagtggcagacacaact

SEQ ID NO: 101067 - DNA, 25 bp, Homo sapien
aacgcggcggcgaccgtctgagccg

SEQ ID NO: 101068 - DNA, 25 bp, Homo sapien
agccgagtggcagacacaactccca

SEQ ID NO: 101069 - DNA, 25 bp, Homo sapien
cacaactcccacaattccaggcggc

SEQ ID NO: 101070 - DNA, 25 bp, Homo sapien
ccggtgagctggcagctgtcacgcc

SEQ ID NO: 101071 - DNA, 25 bp, Homo sapien
cggcgaccgtctgagccggtgagct

SEQ ID NO: 101072 - DNA, 25 bp, Homo sapien
gagctggcagctgtcacgccgctcg

SEQ ID NO: 101073 - DNA, 25 bp, Homo sapien
gggtgagcgatccattagccgaatg

SEQ ID NO: 101074 - DNA, 25 bp, Homo sapien
ctcctctaagaagcaggttcacctc

SEQ ID NO: 101075 - DNA, 25 bp, Homo sapien
gggagtccaacaaacccagccattg

SEQ ID NO: 101076 - DNA, 25 bp, Homo sapien
tggctccactaggacacacagattc

SEQ ID NO: 101077 - DNA, 25 bp, Homo sapien
tgcagcaacggaaaggcgccacgct

SEQ ID NO: 101078 - DNA, 25 bp, Homo sapien
attagccgaatgacagcgctgccgc

SEQ ID NO: 101079 - DNA, 25 bp, Homo sapien
aagaccgtggaccaaggtgacctgc

SEQ ID NO: 101080 - DNA, 25 bp, Homo sapien
gcgctgccgcagaaagccagaaaaa

SEQ ID NO: 101081 - DNA, 25 bp, Homo sapien
agcctgcttgtttgagcagcgtttc

SEQ ID NO: 101082 - DNA, 25 bp, Homo sapien
ctaagtccttgggtagcgccagtgc

SEQ ID NO: 101083 - DNA, 25 bp, Homo sapien
gcgccagtgccaaataacccgttcg

SEQ ID NO: 101084 - DNA, 25 bp, Homo sapien
ccaaaatggaggatttcgcagactc

SEQ ID NO: 101085 - DNA, 25 bp, Homo sapien
cgcggcgttagctggacatcagaaa

SEQ ID NO: 101086 - DNA, 25 bp, Homo sapien
cttgccgtttgaggaggatggttaa

SEQ ID NO: 101087 - DNA, 25 bp, Homo sapien
gcaaccagccttctagggcggcgga

SEQ ID NO: 101088 - DNA, 25 bp, Homo sapien
gaggcctgagggacagactgtacac

SEQ ID NO: 101089 - DNA, 25 bp, Homo sapien
gcagctctctatccgggtcctcagt

SEQ ID NO: 101090 - DNA, 25 bp, Homo sapien
gttgccgggatagcactttctcctg

SEQ ID NO: 101091 - DNA, 25 bp, Homo sapien
cgggcctgatcagaagatcgtcttt

SEQ ID NO: 101092 - DNA, 25 bp, Homo sapien
ttctccgagacatggccgtcgcttt

SEQ ID NO: 101093 - DNA, 25 bp, Homo sapien
gacttcgtctctgtcttctccgaga

SEQ ID NO: 101094 - DNA, 25 bp, Homo sapien
tgcggcctccgttgttcattgcctc

SEQ ID NO: 101095 - DNA, 25 bp, Homo sapien
tccaccaagtctgagggatgagctt

SEQ ID NO: 101096 - DNA, 25 bp, Homo sapien
atgatttggatctcgcagctctcta

SEQ ID NO: 101097 - DNA, 25 bp, Homo sapien
ggaccagcatgatagccgcaccata

SEQ ID NO: 101098 - DNA, 25 bp, Homo sapien
cgccgcacacgcgtaatccaggtga

SEQ ID NO: 101099 - DNA, 25 bp, Homo sapien
atccaggtgagtcccactcggcgac

SEQ ID NO: 101100 - DNA, 25 bp, Homo sapien
tgaacttgccgatggtgcccaggac

SEQ ID NO: 101101 - DNA, 25 bp, Homo sapien
cggcccacggaattagggcaggatt

SEQ ID NO: 101102 - DNA, 25 bp, Homo sapien
ggctcgtcgcgacaccttggtaatt

SEQ ID NO: 101103 - DNA, 25 bp, Homo sapien
ggtaattcccaggacgccaatgttg

SEQ ID NO: 101104 - DNA, 25 bp, Homo sapien
cgcgccagacactcaccaaagagag

SEQ ID NO: 101105 - DNA, 25 bp, Homo sapien
gcttcagggaacaatgggctactca

SEQ ID NO: 101106 - DNA, 25 bp, Homo sapien
ggcgcgtacgtggtcttcaccaact

SEQ ID NO: 101107 - DNA, 25 bp, Homo sapien
ggcggtgccaactcctcctgagtta

SEQ ID NO: 101108 - DNA, 25 bp, Homo sapien
ccgcgactgccgaatgtggaatctc

SEQ ID NO: 101109 - DNA, 25 bp, Homo sapien
tccgtgccctctgaacagttcgatc

SEQ ID NO: 101110 - DNA, 25 bp, Homo sapien
tcctgctgacagtttcctcgacggc

SEQ ID NO: 101111 - DNA, 25 bp, Homo sapien
actctgcatctctgttggttctgga

SEQ ID NO: 101112 - DNA, 25 bp, Homo sapien
cctcgacggcaggattttgattttc

SEQ ID NO: 101113 - DNA, 25 bp, Homo sapien
ccttcggagagcgacagtggttgcc

SEQ ID NO: 101114 - DNA, 25 bp, Homo sapien
ggctacgggacaggatcccagagcc

SEQ ID NO: 101115 - DNA, 25 bp, Homo sapien
gcccgcgctcggcttctccatcact

SEQ ID NO: 101116 - DNA, 25 bp, Homo sapien
gctgtccgccgttgggcaccgtctt

SEQ ID NO: 101117 - DNA, 25 bp, Homo sapien
ccagggcgtcagaaaagtttgtgca

SEQ ID NO: 101118 - DNA, 25 bp, Homo sapien
cgtcagaaaagtttgtgcagaagtg

SEQ ID NO: 101119 - DNA, 25 bp, Homo sapien
gctggggcgtgattactatgtacgc

SEQ ID NO: 101120 - DNA, 25 bp, Homo sapien
acgagccagggcgtcagaaaagttt

SEQ ID NO: 101121 - DNA, 25 bp, Homo sapien
tcgccgtcgcccaccaatgagaatg

SEQ ID NO: 101122 - DNA, 25 bp, Homo sapien
gaatgcgacgccacagagcaccctg

SEQ ID NO: 101123 - DNA, 25 bp, Homo sapien
tcacgtcccgcagttgatctaaagc

SEQ ID NO: 101124 - DNA, 25 bp, Homo sapien
ggtggattagttcctcctgagactc

SEQ ID NO: 101125 - DNA, 25 bp, Homo sapien
tgcataccacgttcctcagctggtg

SEQ ID NO: 101126 - DNA, 25 bp, Homo sapien
atgggccatgcgttctagccacggc

SEQ ID NO: 101127 - DNA, 25 bp, Homo sapien
ctaaagcgagacacacagatcctga

SEQ ID NO: 101128 - DNA, 25 bp, Homo sapien
tcctcctgatgacgccatgggccat

SEQ ID NO: 101129 - DNA, 25 bp, Homo sapien
caatcagcaggtccgccgagcctcc

SEQ ID NO: 101130 - DNA, 25 bp, Homo sapien
acctagtaccttccgtccagcgctc

SEQ ID NO: 101131 - DNA, 25 bp, Homo sapien
catatcggttcccaatcagcaggtc

SEQ ID NO: 101132 - DNA, 25 bp, Homo sapien
actcccggcaggctctgcgccagag

SEQ ID NO: 101133 - DNA, 25 bp, Homo sapien
gtccagtccatatgagctcccgggg

SEQ ID NO: 101134 - DNA, 25 bp, Homo sapien
gctcccggggcactggactacaact

SEQ ID NO: 101135 - DNA, 25 bp, Homo sapien
agacgcagagaagtgctcgaccttc

SEQ ID NO: 101136 - DNA, 25 bp, Homo sapien
agagtcgccgccatatcggttccca

SEQ ID NO: 101137 - DNA, 25 bp, Homo sapien
tgatgtgtcaggaggccctacactc

SEQ ID NO: 101138 - DNA, 25 bp, Homo sapien
ggttgtccgtcctgtcttctcatcg

SEQ ID NO: 101139 - DNA, 25 bp, Homo sapien
gcccgagtcagaaacctgtgcttca

SEQ ID NO: 101140 - DNA, 25 bp, Homo sapien
tgtggctcacatctccacgcctttg

SEQ ID NO: 101141 - DNA, 25 bp, Homo sapien
ggactcgcgccagagtaggacaaga

SEQ ID NO: 101142 - DNA, 25 bp, Homo sapien
cgtgcactggctcgcagtttggaca

SEQ ID NO: 101143 - DNA, 25 bp, Homo sapien
gcaggagaaggtaccgcagagctcc

SEQ ID NO: 101144 - DNA, 25 bp, Homo sapien
tggacagagaccctacaggccaggc

SEQ ID NO: 101145 - DNA, 25 bp, Homo sapien
acggcggtgcgtagcttactcacag

SEQ ID NO: 101146 - DNA, 25 bp, Homo sapien
ctccggctgtccgaccaagagaggc

SEQ ID NO: 101147 - DNA, 25 bp, Homo sapien
cttttgctttctggcggagggatct

SEQ ID NO: 101148 - DNA, 25 bp, Homo sapien
ggctctgaagagaatccacaaggta

SEQ ID NO: 101149 - DNA, 25 bp, Homo sapien
ggcctccttggatcttgctgccggt

SEQ ID NO: 101150 - DNA, 25 bp, Homo sapien
cttccaggcccgcatggtgtggact

SEQ ID NO: 101151 - DNA, 25 bp, Homo sapien
tgtggactcttagggcttctctcca

SEQ ID NO: 101152 - DNA, 25 bp, Homo sapien
gcctgcagaactcgcgctctagatc

SEQ ID NO: 101153 - DNA, 25 bp, Homo sapien
acacacaggcatgcagggcaaccgg

SEQ ID NO: 101154 - DNA, 25 bp, Homo sapien
cgcctgacccagaaggacgtggatg

SEQ ID NO: 101155 - DNA, 25 bp, Homo sapien
atggactcactgacgggccctgcga

SEQ ID NO: 101156 - DNA, 25 bp, Homo sapien
ggcacaggcctagaacacgcgcaca

SEQ ID NO: 101157 - DNA, 25 bp, Homo sapien
gctgtacgcggacgcacacaagcca

SEQ ID NO: 101158 - DNA, 25 bp, Homo sapien
tgtgctggagccaccgtgaacagag

SEQ ID NO: 101159 - DNA, 25 bp, Homo sapien
cctcacttaggaagaggcttcaggc

SEQ ID NO: 101160 - DNA, 25 bp, Homo sapien
cagctctgggtgagctctggctgta

SEQ ID NO: 101161 - DNA, 25 bp, Homo sapien
ggctcccggcacagacaccacctcg

SEQ ID NO: 101162 - DNA, 25 bp, Homo sapien
tggcggtgtcatttccacacactcc

SEQ ID NO: 101163 - DNA, 25 bp, Homo sapien
agcgctggtggatgttgtcaccaca

SEQ ID NO: 101164 - DNA, 25 bp, Homo sapien
gttgtcaccacaggagtttaagctg

SEQ ID NO: 101165 - DNA, 25 bp, Homo sapien
gaggcgccagcaggccaactttgcc

SEQ ID NO: 101166 - DNA, 25 bp, Homo sapien
gccgcggcccaaacagatgctaatg

SEQ ID NO: 101167 - DNA, 25 bp, Homo sapien
tgctaatgattttccgggaggcgcc

SEQ ID NO: 101168 - DNA, 25 bp, Homo sapien
gccctggcggtgtcatttccacaca

SEQ ID NO: 101169 - DNA, 25 bp, Homo sapien
ttcgctgcaagtcggcggaaagttt

SEQ ID NO: 101170 - DNA, 25 bp, Homo sapien
cgacgttaactgctctgggcgccct

SEQ ID NO: 101171 - DNA, 25 bp, Homo sapien
ggtggccgctgctatacccaagcct

SEQ ID NO: 101172 - DNA, 25 bp, Homo sapien
tccctaagccgcagtatgctcggtc

SEQ ID NO: 101173 - DNA, 25 bp, Homo sapien
gctcggtcgcagatcactgagttca

SEQ ID NO: 101174 - DNA, 25 bp, Homo sapien
ccttggggagtcttttgagctgtct

SEQ ID NO: 101175 - DNA, 25 bp, Homo sapien
cgggctgatgaagtttgaccttttt

SEQ ID NO: 101176 - DNA, 25 bp, Homo sapien
tgcttgtagatctctggcgcgcact

SEQ ID NO: 101177 - DNA, 25 bp, Homo sapien
cccaggcacacacttaggacagaca

SEQ ID NO: 101178 - DNA, 25 bp, Homo sapien
ttagctcaggagacgtgagtcaccc

SEQ ID NO: 101179 - DNA, 25 bp, Homo sapien
ctgcggcctggcagttagagtgcac

SEQ ID NO: 101180 - DNA, 25 bp, Homo sapien
acgtagttccacacgactcagcaca

SEQ ID NO: 101181 - DNA, 25 bp, Homo sapien
cccacacgcggcacacccaggcaca

SEQ ID NO: 101182 - DNA, 25 bp, Homo sapien
gacacagtcacttgcagcacacgta

SEQ ID NO: 101183 - DNA, 25 bp, Homo sapien
ttgcagcacacgtagttccacacga

SEQ ID NO: 101184 - DNA, 25 bp, Homo sapien
gcctggcagttagagtgcacactca

SEQ ID NO: 101185 - DNA, 25 bp, Homo sapien
agccggacgcggacgtgcctgcgcg

SEQ ID NO: 101186 - DNA, 25 bp, Homo sapien
cgctccaggcccgaggtgatggcgg

SEQ ID NO: 101187 - DNA, 25 bp, Homo sapien
gcccgaggtgatggcggctgttcct

SEQ ID NO: 101188 - DNA, 25 bp, Homo sapien
tgctcgcctggcttaacccagacga

SEQ ID NO: 101189 - DNA, 25 bp, Homo sapien
caggccgactaattaggcccggcta

SEQ ID NO: 101190 - DNA, 25 bp, Homo sapien
ttaacccagacgagcccaggacgcc

SEQ ID NO: 101191 - DNA, 25 bp, Homo sapien
gcttaacccagacgagcccaggacg

SEQ ID NO: 101192 - DNA, 25 bp, Homo sapien
tggcttaacccagacgagcccagga

SEQ ID NO: 101193 - DNA, 25 bp, Homo sapien
tgtccctcctcaggcgcagtatttc

SEQ ID NO: 101194 - DNA, 25 bp, Homo sapien
ctcaggcgcagtatttctttttggg

SEQ ID NO: 101195 - DNA, 25 bp, Homo sapien
cgctcattcccgctccgcttcaacg

SEQ ID NO: 101196 - DNA, 25 bp, Homo sapien
gcattgctgatgaaacggagccctt

SEQ ID NO: 101197 - DNA, 25 bp, Homo sapien
tttgttgtccctcctcaggcgcagt

SEQ ID NO: 101198 - DNA, 25 bp, Homo sapien
ctggccggctcctgcatggacaaag

SEQ ID NO: 101199 - DNA, 25 bp, Homo sapien
tcctgcatggacaaaggggtccttt

SEQ ID NO: 101200 - DNA, 25 bp, Homo sapien
cgctggctccgcattgctgatgaaa

SEQ ID NO: 101201 - DNA, 25 bp, Homo sapien
ggactcctgcggacagccagggaaa

SEQ ID NO: 101202 - DNA, 25 bp, Homo sapien
gttcccggggactcctgcggacagc

SEQ ID NO: 101203 - DNA, 25 bp, Homo sapien
taaatttagaagcagcctagggccc

SEQ ID NO: 101204 - DNA, 25 bp, Homo sapien
ctgtaatcagattcctaaatttaga

SEQ ID NO: 101205 - DNA, 25 bp, Homo sapien
cggacagccagggaaagccaggctc

SEQ ID NO: 101206 - DNA, 25 bp, Homo sapien
tgctgcagcgcacacaagctgaagc

SEQ ID NO: 101207 - DNA, 25 bp, Homo sapien
cctggtccactctgtaatcagattc

SEQ ID NO: 101208 - DNA, 25 bp, Homo sapien
ctgctgcgccgtcgagccacatggg

SEQ ID NO: 101209 - DNA, 25 bp, Homo sapien
aagaagcggaaacgctgcggcatgt

SEQ ID NO: 101210 - DNA, 25 bp, Homo sapien
tctgccatcagctccggcaagaaga

SEQ ID NO: 101211 - DNA, 25 bp, Homo sapien
gcaggtgccgaagccctcaatggcc

SEQ ID NO: 101212 - DNA, 25 bp, Homo sapien
gtgcaggagcatctcccgctgatga

SEQ ID NO: 101213 - DNA, 25 bp, Homo sapien
gtccacagagatgctgaagcgcgtg

SEQ ID NO: 101214 - DNA, 25 bp, Homo sapien
tgctggcctgcctgacatggaggct

SEQ ID NO: 101215 - DNA, 25 bp, Homo sapien
ctgcagcagtttgcgcagtccacag

SEQ ID NO: 101216 - DNA, 25 bp, Homo sapien
agggacagctgacgctgcagcagtt

SEQ ID NO: 101217 - DNA, 25 bp, Homo sapien
cgctcggcacgatcacacgggcaag

SEQ ID NO: 101218 - DNA, 25 bp, Homo sapien
ggcactaatgtctttcccacatggc

SEQ ID NO: 101219 - DNA, 25 bp, Homo sapien
gcggccggcactaatgtctttccca

SEQ ID NO: 101220 - DNA, 25 bp, Homo sapien
gtcggcacgcgatgagcgactcaca

SEQ ID NO: 101221 - DNA, 25 bp, Homo sapien
gagcgactcacagggcagctgcagt

SEQ ID NO: 101222 - DNA, 25 bp, Homo sapien
ctgggtcaggctttccctcgcgctg

SEQ ID NO: 101223 - DNA, 25 bp, Homo sapien
ggccgcctccgatcctacgccttct

SEQ ID NO: 101224 - DNA, 25 bp, Homo sapien
tgcgcccacggtgtcggcacgcgat

SEQ ID NO: 101225 - DNA, 25 bp, Homo sapien
ggccgtcagccttgccggctaattg

SEQ ID NO: 101226 - DNA, 25 bp, Homo sapien
attcgaagctgaggccgtcagcctt

SEQ ID NO: 101227 - DNA, 25 bp, Homo sapien
tctgtcattcgaagctgaggccgtc

SEQ ID NO: 101228 - DNA, 25 bp, Homo sapien
acaggaggtgtctgtcattcgaagc

SEQ ID NO: 101229 - DNA, 25 bp, Homo sapien
gagttaatctccttgcccgtcaggg

SEQ ID NO: 101230 - DNA, 25 bp, Homo sapien
gcgctgctctgagttaatctccttg

SEQ ID NO: 101231 - DNA, 25 bp, Homo sapien
gctggcgctgctctgagttaatctc

SEQ ID NO: 101232 - DNA, 25 bp, Homo sapien
ttcctgtcgtcccttcgagctggcg

SEQ ID NO: 101233 - DNA, 25 bp, Homo sapien
aggtatagcctagcgcactggtgcc

SEQ ID NO: 101234 - DNA, 25 bp, Homo sapien
tcttgccgcacgtgttcttgtcttg

SEQ ID NO: 101235 - DNA, 25 bp, Homo sapien
tacccagggcatccacgaatgcaga

SEQ ID NO: 101236 - DNA, 25 bp, Homo sapien
tgtgcgccaatataggtcgattacc

SEQ ID NO: 101237 - DNA, 25 bp, Homo sapien
tggtcgcgtcttagcaagagctctg

SEQ ID NO: 101238 - DNA, 25 bp, Homo sapien
tccaaagccagcgttgttagcctcg

SEQ ID NO: 101239 - DNA, 25 bp, Homo sapien
aacaccatgataggcgttgaacgta

SEQ ID NO: 101240 - DNA, 25 bp, Homo sapien
gcggaactcctagcctccgggctaa

SEQ ID NO: 101241 - DNA, 25 bp, Homo sapien
tgtctcacacgagcagccgcattta

SEQ ID NO: 101242 - DNA, 25 bp, Homo sapien
cgcagatgtgcgcttgtctcacacg

SEQ ID NO: 101243 - DNA, 25 bp, Homo sapien
agcagccgcatttagccaccgagtc

SEQ ID NO: 101244 - DNA, 25 bp, Homo sapien
ccaccgagtcgggactgaaatattc

SEQ ID NO: 101245 - DNA, 25 bp, Homo sapien
atgttgtcaccatctgcctcgtgtc

SEQ ID NO: 101246 - DNA, 25 bp, Homo sapien
ataatactggggtgagactcgccgc

SEQ ID NO: 101247 - DNA, 25 bp, Homo sapien
tgagggagaagaaccctgaggcttc

SEQ ID NO: 101248 - DNA, 25 bp, Homo sapien
gcctcgtgtctgtctgcgactaaaa

SEQ ID NO: 101249 - DNA, 25 bp, Homo sapien
tgagcgcacgatgggcagtcacgcc

SEQ ID NO: 101250 - DNA, 25 bp, Homo sapien
gatgggcagtcacgccgcacacacg

SEQ ID NO: 101251 - DNA, 25 bp, Homo sapien
tacccagagaccgagccgccctgag

SEQ ID NO: 101252 - DNA, 25 bp, Homo sapien
ggatggctccaacaccagcccggta

SEQ ID NO: 101253 - DNA, 25 bp, Homo sapien
cacagaaccacggatggctccaaca

SEQ ID NO: 101254 - DNA, 25 bp, Homo sapien
cggtgtgcacagaaccacggatggc

SEQ ID NO: 101255 - DNA, 25 bp, Homo sapien
tagtaagcccggtgtgcacagaacc

SEQ ID NO: 101256 - DNA, 25 bp, Homo sapien
gccgcacacacgctctgctcatgtc

SEQ ID NO: 101257 - DNA, 25 bp, Homo sapien
gcctcctgaaggcttgtgctggcga

SEQ ID NO: 101258 - DNA, 25 bp, Homo sapien
cgcagctcgaggcagcctgcatttc

SEQ ID NO: 101259 - DNA, 25 bp, Homo sapien
tcattgtgtgtctcctctctggctc

SEQ ID NO: 101260 - DNA, 25 bp, Homo sapien
gggtgtctccgtgtctatctccaca

SEQ ID NO: 101261 - DNA, 25 bp, Homo sapien
gctcgcctcttgctcattttcgttc

SEQ ID NO: 101262 - DNA, 25 bp, Homo sapien
cagctgttaaccttcacgcttcagg

SEQ ID NO: 101263 - DNA, 25 bp, Homo sapien
gcttcaggcctctgcggatggcaga

SEQ ID NO: 101264 - DNA, 25 bp, Homo sapien
cttcatctagcgctcccggggaagc

SEQ ID NO: 101265 - DNA, 25 bp, Homo sapien
tcgatgccaatcaggttggggcgca

SEQ ID NO: 101266 - DNA, 25 bp, Homo sapien
ttaacaacggctcggactgccgctg

SEQ ID NO: 101267 - DNA, 25 bp, Homo sapien
tttattgggtcattaacaacggctc

SEQ ID NO: 101268 - DNA, 25 bp, Homo sapien
gctttgtgtgcaccggccgcggtct

SEQ ID NO: 101269 - DNA, 25 bp, Homo sapien
cgcgcggcgtaattcgatgccaatc

SEQ ID NO: 101270 - DNA, 25 bp, Homo sapien
tctgggctgagcctcggtaatttcc

SEQ ID NO: 101271 - DNA, 25 bp, Homo sapien
ccagtcacgctgctctgggctgagc

SEQ ID NO: 101272 - DNA, 25 bp, Homo sapien
agcctcggtaatttccgagtcggcg

SEQ ID NO: 101273 - DNA, 25 bp, Homo sapien
tcgtccttttctgcggcggatgaca

SEQ ID NO: 101274 - DNA, 25 bp, Homo sapien
ctgggctccctgacgaaatcgtcct

SEQ ID NO: 101275 - DNA, 25 bp, Homo sapien
cggatgacaggttgtgggaacaaca

SEQ ID NO: 101276 - DNA, 25 bp, Homo sapien
tgggaacaacagcttgaattacgga

SEQ ID NO: 101277 - DNA, 25 bp, Homo sapien
actgagttaatctgcagtggctgga

SEQ ID NO: 101278 - DNA, 25 bp, Homo sapien
accttctggagacggcgattaatca

SEQ ID NO: 101279 - DNA, 25 bp, Homo sapien
cgtatatcatgtctgcagccgggag

SEQ ID NO: 101280 - DNA, 25 bp, Homo sapien
acccgtgtcgggacgcaccgtatat

SEQ ID NO: 101281 - DNA, 25 bp, Homo sapien
tcaggatgcggcagcgtctccatgg

SEQ ID NO: 101282 - DNA, 25 bp, Homo sapien
cccgttgccaggagcagtcaggatg

SEQ ID NO: 101283 - DNA, 25 bp, Homo sapien
tgggggagccatatccgtgtcccgg

SEQ ID NO: 101284 - DNA, 25 bp, Homo sapien
tccgtgtgcccctgggagtgtgagt

SEQ ID NO: 101285 - DNA, 25 bp, Homo sapien
ccgttgccaggagcagtcaggatgc

SEQ ID NO: 101286 - DNA, 25 bp, Homo sapien
ttgccaggagcagtcaggatgcggc

SEQ ID NO: 101287 - DNA, 25 bp, Homo sapien
gcgtacgtacatccgtgtgcccctg

SEQ ID NO: 101288 - DNA, 25 bp, Homo sapien
gtacgtacatccgtgtgcccctggg

SEQ ID NO: 101289 - DNA, 25 bp, Homo sapien
tggtcggagaccctcggccagccta

SEQ ID NO: 101290 - DNA, 25 bp, Homo sapien
agaagaagctgagcgttgtcgccgc

SEQ ID NO: 101291 - DNA, 25 bp, Homo sapien
tcctgcttcgcggacccgttactgg

SEQ ID NO: 101292 - DNA, 25 bp, Homo sapien
gcaggtactttagaggtcgagacgc

SEQ ID NO: 101293 - DNA, 25 bp, Homo sapien
tgccatagttacagacgcagccctg

SEQ ID NO: 101294 - DNA, 25 bp, Homo sapien
tctaagggtccctacgctaggccta

SEQ ID NO: 101295 - DNA, 25 bp, Homo sapien
tggcgccgccgttgccatagttaca

SEQ ID NO: 101296 - DNA, 25 bp, Homo sapien
ctccctgccggcaagtgtgtgaaga

SEQ ID NO: 101297 - DNA, 25 bp, Homo sapien
ggcagcatccaaggccgtcttctta

SEQ ID NO: 101298 - DNA, 25 bp, Homo sapien
taggccgatgagaggacgccgctct

SEQ ID NO: 101299 - DNA, 25 bp, Homo sapien
cgagtagtcagcaggagaccgaagc

SEQ ID NO: 101300 - DNA, 25 bp, Homo sapien
agtacagcttcctaggccgatgaga

SEQ ID NO: 101301 - DNA, 25 bp, Homo sapien
ggctgctgagcagtacagcttccta

SEQ ID NO: 101302 - DNA, 25 bp, Homo sapien
gccgtcgtggctttggctctgagaa

SEQ ID NO: 101303 - DNA, 25 bp, Homo sapien
gccgtcttcttacaagggctgaatc

SEQ ID NO: 101304 - DNA, 25 bp, Homo sapien
caagggctgaatccgagcccagggt

SEQ ID NO: 101305 - DNA, 25 bp, Homo sapien
atcccgacgcgcaggctgatttttg

SEQ ID NO: 101306 - DNA, 25 bp, Homo sapien
tccctgggcaggactcgacatgtcc

SEQ ID NO: 101307 - DNA, 25 bp, Homo sapien
ctgatttttgagtgcctgcggctga

SEQ ID NO: 101308 - DNA, 25 bp, Homo sapien
gcctgttttccatccgtgttgtgta

SEQ ID NO: 101309 - DNA, 25 bp, Homo sapien
cctctcaattctctgtggtctctgg

SEQ ID NO: 101310 - DNA, 25 bp, Homo sapien
gacccgtgcgtgaactcctctcaat

SEQ ID NO: 101311 - DNA, 25 bp, Homo sapien
tcggccagttagacccgcgatcttt

SEQ ID NO: 101312 - DNA, 25 bp, Homo sapien
ggatgacccatatgacctgtattcg

SEQ ID NO: 101313 - DNA, 25 bp, Homo sapien
tttccagatcaattccgcggcgtct

SEQ ID NO: 101314 - DNA, 25 bp, Homo sapien
gcgggaaagcccgagcccagcctga

SEQ ID NO: 101315 - DNA, 25 bp, Homo sapien
cgaaggatacggttgtcatggagat

SEQ ID NO: 101316 - DNA, 25 bp, Homo sapien
ccaccttcacgaggctgcagctttg

SEQ ID NO: 101317 - DNA, 25 bp, Homo sapien
ggcgtctggagcatccgaaggatac

SEQ ID NO: 101318 - DNA, 25 bp, Homo sapien
gctaacaaagctacatttccagatc

SEQ ID NO: 101319 - DNA, 25 bp, Homo sapien
ccgggtccgctaacaaagctacatt

SEQ ID NO: 101320 - DNA, 25 bp, Homo sapien
aggctgcagctttgaggatttattt

SEQ ID NO: 101321 - DNA, 25 bp, Homo sapien
gcccaggaaaggtgtgctctcggcc

SEQ ID NO: 101322 - DNA, 25 bp, Homo sapien
agctgtcatagctgcgctgcatgtc

SEQ ID NO: 101323 - DNA, 25 bp, Homo sapien
ccgcggggtaatagtagctgtcata

SEQ ID NO: 101324 - DNA, 25 bp, Homo sapien
gctgctcggccaggcggtaactgat

SEQ ID NO: 101325 - DNA, 25 bp, Homo sapien
gatctcgaaagttggcacctgcgtg

SEQ ID NO: 101326 - DNA, 25 bp, Homo sapien
tggccagcgagtagtggaagtccac

SEQ ID NO: 101327 - DNA, 25 bp, Homo sapien
ggtgccgcagtaacggctgctgctc

SEQ ID NO: 101328 - DNA, 25 bp, Homo sapien
cactcctgcgtggtctcgtactcgt

SEQ ID NO: 101329 - DNA, 25 bp, Homo sapien
tttctgtcggtatccgcggctccat

SEQ ID NO: 101330 - DNA, 25 bp, Homo sapien
gctccgatctctccgaggaagggaa

SEQ ID NO: 101331 - DNA, 25 bp, Homo sapien
aggggagcagcgagccttaactctt

SEQ ID NO: 101332 - DNA, 25 bp, Homo sapien
atcagccgccgcctttctgtcggta

SEQ ID NO: 101333 - DNA, 25 bp, Homo sapien
cttataggcggtcacaccctccggg

SEQ ID NO: 101334 - DNA, 25 bp, Homo sapien
gcccaccgaggtaggcaagaccggc

SEQ ID NO: 101335 - DNA, 25 bp, Homo sapien
tccgacattctgcacggggtcccag

SEQ ID NO: 101336 - DNA, 25 bp, Homo sapien
cgagcgcggcgcctttcttataggc

SEQ ID NO: 101337 - DNA, 25 bp, Homo sapien
cccgggatttatcggcatgacagtg

SEQ ID NO: 101338 - DNA, 25 bp, Homo sapien
gcgacacaccgaagagcagcatgga

SEQ ID NO: 101339 - DNA, 25 bp, Homo sapien
cggcagcgctgagcagcaaacctgc

SEQ ID NO: 101340 - DNA, 25 bp, Homo sapien
ggaagcttgggactgcactgcttta

SEQ ID NO: 101341 - DNA, 25 bp, Homo sapien
tgcactgctttagtgcccgccttca

SEQ ID NO: 101342 - DNA, 25 bp, Homo sapien
tgccaccctttgctcccgggattta

SEQ ID NO: 101343 - DNA, 25 bp, Homo sapien
gcctggtcctgcactgacttgaggc

SEQ ID NO: 101344 - DNA, 25 bp, Homo sapien
cagcgtaacgttagcgcctcttagc

SEQ ID NO: 101345 - DNA, 25 bp, Homo sapien
tgcgtctcacccaccgcacccgccg

SEQ ID NO: 101346 - DNA, 25 bp, Homo sapien
cgcacccgccgtgcgggatccctga

SEQ ID NO: 101347 - DNA, 25 bp, Homo sapien
acctgccgtgcaggatccctgagtc

SEQ ID NO: 101348 - DNA, 25 bp, Homo sapien
gtgcaggatccctgagtctcacccg

SEQ ID NO: 101349 - DNA, 25 bp, Homo sapien
gccgcacccgccgtgcgggatccct

SEQ ID NO: 101350 - DNA, 25 bp, Homo sapien
ctgcgtctcacccaccgcacccgcc

SEQ ID NO: 101351 - DNA, 25 bp, Homo sapien
gcacctgccgtgcaggatccctgag

SEQ ID NO: 101352 - DNA, 25 bp, Homo sapien
tgccgtgcaggatccctgagtctca

SEQ ID NO: 101353 - DNA, 25 bp, Homo sapien
gctgacgtcgcctggagtcacgcac

SEQ ID NO: 101354 - DNA, 25 bp, Homo sapien
gcaacgacgcacagggccctaagtt

SEQ ID NO: 101355 - DNA, 25 bp, Homo sapien
tcggccttcagaagccaaacgagta

SEQ ID NO: 101356 - DNA, 25 bp, Homo sapien
cccgcggaatgttgacgcgccagga

SEQ ID NO: 101357 - DNA, 25 bp, Homo sapien
tggcgcaggcccttcagggttctat

SEQ ID NO: 101358 - DNA, 25 bp, Homo sapien
atagggtggtagcagaagtcgcaac

SEQ ID NO: 101359 - DNA, 25 bp, Homo sapien
gtctggctgccacgacttgccgtct

SEQ ID NO: 101360 - DNA, 25 bp, Homo sapien
gccaaacgagtaataggtccttctg

SEQ ID NO: 101361 - DNA, 25 bp, Homo sapien
cgacgggaacagtcactgcgggcac

SEQ ID NO: 101362 - DNA, 25 bp, Homo sapien
aggccagagccactgccgtgtgtgc

SEQ ID NO: 101363 - DNA, 25 bp, Homo sapien
atctgaggccagagccactgccgtg

SEQ ID NO: 101364 - DNA, 25 bp, Homo sapien
ggtgcgtctactgtcctctgctcgg

SEQ ID NO: 101365 - DNA, 25 bp, Homo sapien
agccctggtgcgtctactgtcctct

SEQ ID NO: 101366 - DNA, 25 bp, Homo sapien
accctagccctggtgcgtctactgt

SEQ ID NO: 101367 - DNA, 25 bp, Homo sapien
ggaacagtcactgcgggcaccctag

SEQ ID NO: 101368 - DNA, 25 bp, Homo sapien
acaggctaggtgtctgctgctccac

SEQ ID NO: 101369 - DNA, 25 bp, Homo sapien
tctggccaagctcatcgacgactac

SEQ ID NO: 101370 - DNA, 25 bp, Homo sapien
gactgtggacaacaagcgcttcttc

SEQ ID NO: 101371 - DNA, 25 bp, Homo sapien
cgccgggcgctcaaaagcgagttcc

SEQ ID NO: 101372 - DNA, 25 bp, Homo sapien
ttcatcgagcactacgcgcagctgg

SEQ ID NO: 101373 - DNA, 25 bp, Homo sapien
ttccgcgactacctgggcgacttca

SEQ ID NO: 101374 - DNA, 25 bp, Homo sapien
ggtggacatccagaacaagcgcttc

SEQ ID NO: 101375 - DNA, 25 bp, Homo sapien
cgcttcttcttcgatgtgggctcca

SEQ ID NO: 101376 - DNA, 25 bp, Homo sapien
tgggctccaacaagtacggcgtgtt

SEQ ID NO: 101377 - DNA, 25 bp, Homo sapien
tccagccggagctacgtgactacgt

SEQ ID NO: 101378 - DNA, 25 bp, Homo sapien
cagcgctgaagtaacgggaccatgc

SEQ ID NO: 101379 - DNA, 25 bp, Homo sapien
agcccagctcagactatcatccgga

SEQ ID NO: 101380 - DNA, 25 bp, Homo sapien
cagaataagatcctgctggccgagc

SEQ ID NO: 101381 - DNA, 25 bp, Homo sapien
tggccgacgccatcaacaccgagtt

SEQ ID NO: 101382 - DNA, 25 bp, Homo sapien
ccggcaggtggaccagctaaccaac

SEQ ID NO: 101383 - DNA, 25 bp, Homo sapien
taaggctgcgcccatgcaagtagct

SEQ ID NO: 101384 - DNA, 25 bp, Homo sapien
ccgcttctcgctaggtccctattgg

SEQ ID NO: 101385 - DNA, 25 bp, Homo sapien
aggtgtgttcttgcgtcatttccga

SEQ ID NO: 101386 - DNA, 25 bp, Homo sapien
ctgccgacttctttagccgctctga

SEQ ID NO: 101387 - DNA, 25 bp, Homo sapien
ccaagatccattcgttgccgccgga

SEQ ID NO: 101388 - DNA, 25 bp, Homo sapien
ccgctctgagcccattttctcgttg

SEQ ID NO: 101389 - DNA, 25 bp, Homo sapien
agccattttggcttcctgaccttgg

SEQ ID NO: 101390 - DNA, 25 bp, Homo sapien
gctgtttcgaggaacgcgccaaaaa

SEQ ID NO: 101391 - DNA, 25 bp, Homo sapien
ccgcccatagcgtaggaaggtgtca

SEQ ID NO: 101392 - DNA, 25 bp, Homo sapien
gtggtgtactccgtgccatcatgtc

SEQ ID NO: 101393 - DNA, 25 bp, Homo sapien
aggccgtcagcatgcctggctcgtc

SEQ ID NO: 101394 - DNA, 25 bp, Homo sapien
tggctcgtcgcgcacagaacactgc

SEQ ID NO: 101395 - DNA, 25 bp, Homo sapien
agaacactgcccaggggttcaccca

SEQ ID NO: 101396 - DNA, 25 bp, Homo sapien
gtgactggaggacgccggaatttaa

SEQ ID NO: 101397 - DNA, 25 bp, Homo sapien
acgcagctctgtttctcgctgtacc

SEQ ID NO: 101398 - DNA, 25 bp, Homo sapien
cacacgctgcgcacctgttggagcg

SEQ ID NO: 101399 - DNA, 25 bp, Homo sapien
gcccgcacaggtggtcaggccgtca

SEQ ID NO: 101400 - DNA, 25 bp, Homo sapien
agaccagccgggcagagacttccag

SEQ ID NO: 101401 - DNA, 25 bp, Homo sapien
ctcaggttcagacccgaccgttatc

SEQ ID NO: 101402 - DNA, 25 bp, Homo sapien
tcggagaaccaatccaatctgaggg

SEQ ID NO: 101403 - DNA, 25 bp, Homo sapien
cttcgccttgggctgcgatttctga

SEQ ID NO: 101404 - DNA, 25 bp, Homo sapien
cgcctgtgggagtcctaagtatcca

SEQ ID NO: 101405 - DNA, 25 bp, Homo sapien
tgcgccgactgcaagagagcgcttc

SEQ ID NO: 101406 - DNA, 25 bp, Homo sapien
cggctgctcctcacttgctctgaga

SEQ ID NO: 101407 - DNA, 25 bp, Homo sapien
cgctgcggttctcgtctcacgagga

SEQ ID NO: 101408 - DNA, 25 bp, Homo sapien
ttgccagggtgatcaggtgactccc

SEQ ID NO: 101409 - DNA, 25 bp, Homo sapien
tgctggttccagcagctagccctct

SEQ ID NO: 101410 - DNA, 25 bp, Homo sapien
gcgcagctcgctcttcttgagtgtc

SEQ ID NO: 101411 - DNA, 25 bp, Homo sapien
agtcactttcgaagcggcggccact

SEQ ID NO: 101412 - DNA, 25 bp, Homo sapien
cggcgaggcaccagtcactttcgaa

SEQ ID NO: 101413 - DNA, 25 bp, Homo sapien
acggcagcagcttcatggtcccgca

SEQ ID NO: 101414 - DNA, 25 bp, Homo sapien
aagagcttcagcaccaccgacggca

SEQ ID NO: 101415 - DNA, 25 bp, Homo sapien
tcgccagtcaccagtgccgagagaa

SEQ ID NO: 101416 - DNA, 25 bp, Homo sapien
cgcgtagctccttcggccgaatgag

SEQ ID NO: 101417 - DNA, 25 bp, Homo sapien
ttccctcgccggcagagacaagagc

SEQ ID NO: 101418 - DNA, 25 bp, Homo sapien
cgggagatcagaggtcccgccgtcc

SEQ ID NO: 101419 - DNA, 25 bp, Homo sapien
cttccctcgcaacagcgggagatca

SEQ ID NO: 101420 - DNA, 25 bp, Homo sapien
tcaggcttccctcgcaacagcggga

SEQ ID NO: 101421 - DNA, 25 bp, Homo sapien
gagatcctcagccaacctggggttc

SEQ ID NO: 101422 - DNA, 25 bp, Homo sapien
gtcgcagactggttggagatcctca

SEQ ID NO: 101423 - DNA, 25 bp, Homo sapien
cagggcgccacgagctctggaccga

SEQ ID NO: 101424 - DNA, 25 bp, Homo sapien
ctctggaccgagtcgcagactggtt

SEQ ID NO: 101425 - DNA, 25 bp, Homo sapien
gcgggtcatcacttcagcagtcatt

SEQ ID NO: 101426 - DNA, 25 bp, Homo sapien
atggtactcccacaggccaattgta

SEQ ID NO: 101427 - DNA, 25 bp, Homo sapien
gaccgacactttatggcgccaatga

SEQ ID NO: 101428 - DNA, 25 bp, Homo sapien
tctcccattgttcggggtcactatg

SEQ ID NO: 101429 - DNA, 25 bp, Homo sapien
cgacgggtcactttggccaatgatc

SEQ ID NO: 101430 - DNA, 25 bp, Homo sapien
tccgggtgcgaacaatgctgactga

SEQ ID NO: 101431 - DNA, 25 bp, Homo sapien
gcgcctcttgcatccttgacgtaga

SEQ ID NO: 101432 - DNA, 25 bp, Homo sapien
cgcagggtgaagtctactccaaatt

SEQ ID NO: 101433 - DNA, 25 bp, Homo sapien
acgttgttctagtgttgttgccagc

SEQ ID NO: 101434 - DNA, 25 bp, Homo sapien
tgagtccgcctcagactcagagctg

SEQ ID NO: 101435 - DNA, 25 bp, Homo sapien
caacgccaggcggttactttgctgc

SEQ ID NO: 101436 - DNA, 25 bp, Homo sapien
cgctcgctatgtcaacgtccactag

SEQ ID NO: 101437 - DNA, 25 bp, Homo sapien
gtcaacgtccactagctgcccgatt

SEQ ID NO: 101438 - DNA, 25 bp, Homo sapien
ccgcaggctgcggacatattagcgc

SEQ ID NO: 101439 - DNA, 25 bp, Homo sapien
catattagcgcgtgcgtgttgttgc

SEQ ID NO: 101440 - DNA, 25 bp, Homo sapien
ttgttgccagcagctgcacgtggtc

SEQ ID NO: 101441 - DNA, 25 bp, Homo sapien
ctgcagcccgtatgagaactgcggc

SEQ ID NO: 101442 - DNA, 25 bp, Homo sapien
agccgcgttccttgttgcctgcgga

SEQ ID NO: 101443 - DNA, 25 bp, Homo sapien
agcgagcccggaactccactgttag

SEQ ID NO: 101444 - DNA, 25 bp, Homo sapien
ccactgttagcttatactggggctg

SEQ ID NO: 101445 - DNA, 25 bp, Homo sapien
cagagggtccatactaagcgccgca

SEQ ID NO: 101446 - DNA, 25 bp, Homo sapien
ctcacgcgggccagttgagacacgt

SEQ ID NO: 101447 - DNA, 25 bp, Homo sapien
tgctggttcacaaccgtcgggagcc

SEQ ID NO: 101448 - DNA, 25 bp, Homo sapien
cggcgaccctcttggtaagcagcga

SEQ ID NO: 101449 - DNA, 25 bp, Homo sapien
cgttcttggccaccagcagagcctg

SEQ ID NO: 101450 - DNA, 25 bp, Homo sapien
gtcgacgttcttggccaccagcaga

SEQ ID NO: 101451 - DNA, 25 bp, Homo sapien
ttgcggaaacgagtcgacgttcttg

SEQ ID NO: 101452 - DNA, 25 bp, Homo sapien
cgaagcgctcctggttttgcggaaa

SEQ ID NO: 101453 - DNA, 25 bp, Homo sapien
gtgcacgatccaccacacgtcgatg

SEQ ID NO: 101454 - DNA, 25 bp, Homo sapien
gagcatgccgccgtcgtgcacgatc

SEQ ID NO: 101455 - DNA, 25 bp, Homo sapien
aagggcagcagcatgagcatgccgc

SEQ ID NO: 101456 - DNA, 25 bp, Homo sapien
ccgtccgcaggtcatctgaggccag

SEQ ID NO: 101457 - DNA, 25 bp, Homo sapien
actatgaactcatcaggcgcctgaa

SEQ ID NO: 101458 - DNA, 25 bp, Homo sapien
aaaaatgctccggaagtgccttcgc

SEQ ID NO: 101459 - DNA, 25 bp, Homo sapien
gtgccttcgccctccgtaaagatgg

SEQ ID NO: 101460 - DNA, 25 bp, Homo sapien
tacttggccactaggaaagcacctc

SEQ ID NO: 101461 - DNA, 25 bp, Homo sapien
ctgagagaggcgtacttggccacta

SEQ ID NO: 101462 - DNA, 25 bp, Homo sapien
cctgaagaccgacacgccgaacatg

SEQ ID NO: 101463 - DNA, 25 bp, Homo sapien
ggaggcccacgaacgccagcgaaac

SEQ ID NO: 101464 - DNA, 25 bp, Homo sapien
actcgcgcacgagtgagatcatcgc

SEQ ID NO: 101465 - DNA, 25 bp, Homo sapien
ggaccacatgcatctcggagcgcta

SEQ ID NO: 101466 - DNA, 25 bp, Homo sapien
cgcatcgacgcgctttagaaacggc

SEQ ID NO: 101467 - DNA, 25 bp, Homo sapien
ggagagccttgaccgtgtcagcata

SEQ ID NO: 101468 - DNA, 25 bp, Homo sapien
tctttaggtcctcgagcgtcagttc

SEQ ID NO: 101469 - DNA, 25 bp, Homo sapien
gcttgggcaatgctcagtaccttga

SEQ ID NO: 101470 - DNA, 25 bp, Homo sapien
tccattcctgtgttgcgcagcgcta

SEQ ID NO: 101471 - DNA, 25 bp, Homo sapien
ttccagcccagcgaacgacagattg

SEQ ID NO: 101472 - DNA, 25 bp, Homo sapien
gcgttcgcccagtccaggattgtca

SEQ ID NO: 101473 - DNA, 25 bp, Homo sapien
gcctcggccagaggacaaaggagaa

SEQ ID NO: 101474 - DNA, 25 bp, Homo sapien
ggtgaactcccacgtgtgcgtccca

SEQ ID NO: 101475 - DNA, 25 bp, Homo sapien
ccaccctcggggacacgtatgtgcg

SEQ ID NO: 101476 - DNA, 25 bp, Homo sapien
gcggatcggagcatccgctggtcca

SEQ ID NO: 101477 - DNA, 25 bp, Homo sapien
cgcacgtgtccacagatgtccggtg

SEQ ID NO: 101478 - DNA, 25 bp, Homo sapien
tgccctactgctggggctcagccga

SEQ ID NO: 101479 - DNA, 25 bp, Homo sapien
aggggactccaactgcgcgatgcct

SEQ ID NO: 101480 - DNA, 25 bp, Homo sapien
ggcggtgctttctatcctgctggct

SEQ ID NO: 101481 - DNA, 25 bp, Homo sapien
ctccaccatgtggagccgacggcag

SEQ ID NO: 101482 - DNA, 25 bp, Homo sapien
ctggcgccagactcccgggagtact

SEQ ID NO: 101483 - DNA, 25 bp, Homo sapien
agcagcagctggtcagcaagaggct

SEQ ID NO: 101484 - DNA, 25 bp, Homo sapien
ggtgccatcttctacgcccctggga

SEQ ID NO: 101485 - DNA, 25 bp, Homo sapien
gagcgttgtggctgctgtttccttc

SEQ ID NO: 101486 - DNA, 25 bp, Homo sapien
gtggctgctgtttccttcggctttc

SEQ ID NO: 101487 - DNA, 25 bp, Homo sapien
ggttgtggtcgtccttcccacgctc

SEQ ID NO: 101488 - DNA, 25 bp, Homo sapien
ggctgctgagaaacgacgccccaga

SEQ ID NO: 101489 - DNA, 25 bp, Homo sapien
taggtcgggattcgccttcttcagc

SEQ ID NO: 101490 - DNA, 25 bp, Homo sapien
cagctccacgtagcgtttctcaatg

SEQ ID NO: 101491 - DNA, 25 bp, Homo sapien
gtcttcaggccaagtgctccggtct

SEQ ID NO: 101492 - DNA, 25 bp, Homo sapien
aagtcgccaattccaggtcttcagg

SEQ ID NO: 101493 - DNA, 25 bp, Homo sapien
accgctgcgaggtcaatttctttgc

SEQ ID NO: 101494 - DNA, 25 bp, Homo sapien
gcggggtaaagcttggccaatgata

SEQ ID NO: 101495 - DNA, 25 bp, Homo sapien
tgcacatcggagcattcgcggatta

SEQ ID NO: 101496 - DNA, 25 bp, Homo sapien
tttctcaatgaagtccctgcggggc

SEQ ID NO: 101497 - DNA, 25 bp, Homo sapien
gccgatctcccagatgcggtctctt

SEQ ID NO: 101498 - DNA, 25 bp, Homo sapien
tactcctcccgcagtgtgggtggtt

SEQ ID NO: 101499 - DNA, 25 bp, Homo sapien
ccggaagacatcgtgctggaagctc

SEQ ID NO: 101500 - DNA, 25 bp, Homo sapien
cagcaggacaaggaagtagccgatc

SEQ ID NO: 101501 - DNA, 25 bp, Homo sapien
tacctagcccaaacggggtcacagc

SEQ ID NO: 101502 - DNA, 25 bp, Homo sapien
gcagttctcaactttacgtgacgtg

SEQ ID NO: 101503 - DNA, 25 bp, Homo sapien
tggttccgaggctgactaccctgcg

SEQ ID NO: 101504 - DNA, 25 bp, Homo sapien
cttctcagcatggaccgcacttgtg

SEQ ID NO: 101505 - DNA, 25 bp, Homo sapien
aagagggtatgcaaggccaccgtca

SEQ ID NO: 101506 - DNA, 25 bp, Homo sapien
tttctgacagtgaaggctcggagca

SEQ ID NO: 101507 - DNA, 25 bp, Homo sapien
atccgggtagttcgcagtttctgac

SEQ ID NO: 101508 - DNA, 25 bp, Homo sapien
agtaggtacaccttgagattggccc

SEQ ID NO: 101509 - DNA, 25 bp, Homo sapien
gtaccctgggtggttggcataatta

SEQ ID NO: 101510 - DNA, 25 bp, Homo sapien
accgtcaggcgacgctttcgaattc

SEQ ID NO: 101511 - DNA, 25 bp, Homo sapien
aagctggtgctcgtacacgtcctga

SEQ ID NO: 101512 - DNA, 25 bp, Homo sapien
tttcgaattctgagcccacggaccc

SEQ ID NO: 101513 - DNA, 25 bp, Homo sapien
ggctcctcccggaagtgccgaagct

SEQ ID NO: 101514 - DNA, 25 bp, Homo sapien
tgaggtgcgcaaacgcccgagtttt

SEQ ID NO: 101515 - DNA, 25 bp, Homo sapien
tgctcggacttcttcccaggagggc

SEQ ID NO: 101516 - DNA, 25 bp, Homo sapien
ccgaagctggctactaagggaactt

SEQ ID NO: 101517 - DNA, 25 bp, Homo sapien
agagcctccgccgagcacaaaaatt

SEQ ID NO: 101518 - DNA, 25 bp, Homo sapien
agcaaggatgacttccggctatcga

SEQ ID NO: 101519 - DNA, 25 bp, Homo sapien
gccttctgctgcttgaggcctcgca

SEQ ID NO: 101520 - DNA, 25 bp, Homo sapien
ccacctcagccttcgtgactagtga

SEQ ID NO: 101521 - DNA, 25 bp, Homo sapien
acacggcaccttcgttggccgcgtt

SEQ ID NO: 101522 - DNA, 25 bp, Homo sapien
atcgatcgcgaggagctgtgccagt

SEQ ID NO: 101523 - DNA, 25 bp, Homo sapien
cacctggagttgatcgccgacaggc

SEQ ID NO: 101524 - DNA, 25 bp, Homo sapien
tccacctggagttgatcgccgacag

SEQ ID NO: 101525 - DNA, 25 bp, Homo sapien
gcatccacctggagttgatcgccga

SEQ ID NO: 101526 - DNA, 25 bp, Homo sapien
cggcaccttcgttggccgcgttgct

SEQ ID NO: 101527 - DNA, 25 bp, Homo sapien
cctggagttgatcgccgacaggccg

SEQ ID NO: 101528 - DNA, 25 bp, Homo sapien
ccgcgttgctcaggacctgggactg

SEQ ID NO: 101529 - DNA, 25 bp, Homo sapien
acttgtcgcgctaccgccttctggt

SEQ ID NO: 101530 - DNA, 25 bp, Homo sapien
cgcccactgagggtgcgtatgtgcc

SEQ ID NO: 101531 - DNA, 25 bp, Homo sapien
gcggtgctcagtgccgcccactgag

SEQ ID NO: 101532 - DNA, 25 bp, Homo sapien
cgccaaaggcgtcttcgcgggcgtc

SEQ ID NO: 101533 - DNA, 25 bp, Homo sapien
gacgaggctgacttgtcgcgctacc

SEQ ID NO: 101534 - DNA, 25 bp, Homo sapien
gtcctatgaactgcagccggcagca

SEQ ID NO: 101535 - DNA, 25 bp, Homo sapien
gtggcactattggtgcagtcagtga

SEQ ID NO: 101536 - DNA, 25 bp, Homo sapien
gcgtggctgtcctatgaactgcagc

SEQ ID NO: 101537 - DNA, 25 bp, Homo sapien
gaatgtagcatccacgtggaggtga

SEQ ID NO: 101538 - DNA, 25 bp, Homo sapien
cgcggaatgtagcatccacgtggag

SEQ ID NO: 101539 - DNA, 25 bp, Homo sapien
gcgcggaatgtagcatccacgtgga

SEQ ID NO: 101540 - DNA, 25 bp, Homo sapien
gagcgcggaatgtagcatccacgtg

SEQ ID NO: 101541 - DNA, 25 bp, Homo sapien
ggagcgcggaatgtagcatccacgt

SEQ ID NO: 101542 - DNA, 25 bp, Homo sapien
cggagcgcggaatgtagcatccacg

SEQ ID NO: 101543 - DNA, 25 bp, Homo sapien
atgtagcatccacgtggaggtgatc

SEQ ID NO: 101544 - DNA, 25 bp, Homo sapien
cggaatgtagcatccacgtggaggt

SEQ ID NO: 101545 - DNA, 25 bp, Homo sapien
tcgtcctcccgtccgcaagagcggg

SEQ ID NO: 101546 - DNA, 25 bp, Homo sapien
tgccctgtccctcgtgcgcacagac

SEQ ID NO: 101547 - DNA, 25 bp, Homo sapien
cagtcactgcaatccctgccctgtc

SEQ ID NO: 101548 - DNA, 25 bp, Homo sapien
gcagctcttcccatggccgtgaaga

SEQ ID NO: 101549 - DNA, 25 bp, Homo sapien
agagtataagtgagcgcagctcttc

SEQ ID NO: 101550 - DNA, 25 bp, Homo sapien
gctccgttaacgtgagagtataagt

SEQ ID NO: 101551 - DNA, 25 bp, Homo sapien
acggagaggatctgcctgtgagctc

SEQ ID NO: 101552 - DNA, 25 bp, Homo sapien
gatctgcctgtgagctccgttaacg

SEQ ID NO: 101553 - DNA, 25 bp, Homo sapien
cgagcttcagctgggtactggcagc

SEQ ID NO: 101554 - DNA, 25 bp, Homo sapien
accagcgtgtccatcgaggtggccg

SEQ ID NO: 101555 - DNA, 25 bp, Homo sapien
ctttcgtacgagcttcagctgggta

SEQ ID NO: 101556 - DNA, 25 bp, Homo sapien
acgacacgtgccctagacgaggctg

SEQ ID NO: 101557 - DNA, 25 bp, Homo sapien
aaggaccacggcgaaccagcgttga

SEQ ID NO: 101558 - DNA, 25 bp, Homo sapien
gaaccagcgttgacagccacggcca

SEQ ID NO: 101559 - DNA, 25 bp, Homo sapien
gtactggcagcgctcgcatcccgtt

SEQ ID NO: 101560 - DNA, 25 bp, Homo sapien
cactgttggcgcctagggctggcac

SEQ ID NO: 101561 - DNA, 25 bp, Homo sapien
tccgcactgcagctatggtcgcatg

SEQ ID NO: 101562 - DNA, 25 bp, Homo sapien
ctcctacaggtctcaggtccgcagg

SEQ ID NO: 101563 - DNA, 25 bp, Homo sapien
tctgcaatcaccaccgggaactttg

SEQ ID NO: 101564 - DNA, 25 bp, Homo sapien
ggcagcgactccgaaggtacagatc

SEQ ID NO: 101565 - DNA, 25 bp, Homo sapien
gaagcccattccttgacaacgccta

SEQ ID NO: 101566 - DNA, 25 bp, Homo sapien
cggaggaacctcagcagcagaagca

SEQ ID NO: 101567 - DNA, 25 bp, Homo sapien
atcccgttgctagggctgttgccaa

SEQ ID NO: 101568 - DNA, 25 bp, Homo sapien
tgctgccttcggtgattttaatttc

SEQ ID NO: 101569 - DNA, 25 bp, Homo sapien
cgagaagatcctggagcccagtgcc

SEQ ID NO: 101570 - DNA, 25 bp, Homo sapien
tccgtctctgaggaggccaagcatg

SEQ ID NO: 101571 - DNA, 25 bp, Homo sapien
ttaagaaatgaagataaggaactcg

SEQ ID NO: 101572 - DNA, 25 bp, Homo sapien
ggatcaatgtaaaggcaatctaata

SEQ ID NO: 101573 - DNA, 25 bp, Homo sapien
atgttgttctcctggcgagaagatc

SEQ ID NO: 101574 - DNA, 25 bp, Homo sapien
tgacaacgcgccagtttttccaatg

SEQ ID NO: 101575 - DNA, 25 bp, Homo sapien
agaatctgtttatttccgaatcccg

SEQ ID NO: 101576 - DNA, 25 bp, Homo sapien
ttatttccgaatcccgacagcctgg

SEQ ID NO: 101577 - DNA, 25 bp, Homo sapien
ctgctgctatatactgctctgcggt

SEQ ID NO: 101578 - DNA, 25 bp, Homo sapien
gctcacactgctgctatatactgct

SEQ ID NO: 101579 - DNA, 25 bp, Homo sapien
cccaaggcctcgtcccaggcgtccg

SEQ ID NO: 101580 - DNA, 25 bp, Homo sapien
ccacgggcccggaagctgcactggt

SEQ ID NO: 101581 - DNA, 25 bp, Homo sapien
gaaggaccacggtgaaccctcattg

SEQ ID NO: 101582 - DNA, 25 bp, Homo sapien
acaatgcgccggcattctcgcagtc

SEQ ID NO: 101583 - DNA, 25 bp, Homo sapien
ccggcattctcgcagtccgagtaca

SEQ ID NO: 101584 - DNA, 25 bp, Homo sapien
gaccacggtgaaccctcattgaccg

SEQ ID NO: 101585 - DNA, 25 bp, Homo sapien
gataacccgccggtgttcccagcaa

SEQ ID NO: 101586 - DNA, 25 bp, Homo sapien
tcccagcaacacaaaagaacctgtc

SEQ ID NO: 101587 - DNA, 25 bp, Homo sapien
aacacaaaagaacctgtccatcgcg

SEQ ID NO: 101588 - DNA, 25 bp, Homo sapien
cgccggtgttcccagcaacacaaaa

SEQ ID NO: 101589 - DNA, 25 bp, Homo sapien
cggcgtctgctgctcttacttcttc

SEQ ID NO: 101590 - DNA, 25 bp, Homo sapien
ccggcgtctgctgctcttacttctt

SEQ ID NO: 101591 - DNA, 25 bp, Homo sapien
ggtgttcccagcaacacaaaagaac

SEQ ID NO: 101592 - DNA, 25 bp, Homo sapien
ggaggcagggaacggtcagctccac

SEQ ID NO: 101593 - DNA, 25 bp, Homo sapien
ttcaggtgaccgctcgcgatgccgg

SEQ ID NO: 101594 - DNA, 25 bp, Homo sapien
agtttcaggtgaccgctcgcgatgc

SEQ ID NO: 101595 - DNA, 25 bp, Homo sapien
gcagtttcaggtgaccgctcgcgat

SEQ ID NO: 101596 - DNA, 25 bp, Homo sapien
accgctcgcgatgccggcgtgccac

SEQ ID NO: 101597 - DNA, 25 bp, Homo sapien
gccatggtcggtgggtgtgggccac

SEQ ID NO: 101598 - DNA, 25 bp, Homo sapien
tcacttgtggagagtggacaggcgc

SEQ ID NO: 101599 - DNA, 25 bp, Homo sapien
ctcctcacgggcgttggtgggcgct

SEQ ID NO: 101600 - DNA, 25 bp, Homo sapien
tcaggtgaccgctcgcgatgccggc

SEQ ID NO: 101601 - DNA, 25 bp, Homo sapien
tctggcttctccttgcctactggaa

SEQ ID NO: 101602 - DNA, 25 bp, Homo sapien
ttttagagtcaagaatgccagattc

SEQ ID NO: 101603 - DNA, 25 bp, Homo sapien
tgtgtggtgatgcaatagaaagctc

SEQ ID NO: 101604 - DNA, 25 bp, Homo sapien
ggacatcaatgacaatccgcccagg

SEQ ID NO: 101605 - DNA, 25 bp, Homo sapien
attcccggagaggaagtctgggatc

SEQ ID NO: 101606 - DNA, 25 bp, Homo sapien
aacgagattgagatggtatattccc

SEQ ID NO: 101607 - DNA, 25 bp, Homo sapien
aagctcataattggaacgagattga

SEQ ID NO: 101608 - DNA, 25 bp, Homo sapien
atccgcccaggttctccagacaaga

SEQ ID NO: 101609 - DNA, 25 bp, Homo sapien
cgagcgcccgctgtcgagttacgtt

SEQ ID NO: 101610 - DNA, 25 bp, Homo sapien
tggccaggcgccgaaggcctcatcg

SEQ ID NO: 101611 - DNA, 25 bp, Homo sapien
tggatgagaccgaagcaccgcgcca

SEQ ID NO: 101612 - DNA, 25 bp, Homo sapien
agcacaacacgctctctggatgaga

SEQ ID NO: 101613 - DNA, 25 bp, Homo sapien
cgagatcagcacaacacgctctctg

SEQ ID NO: 101614 - DNA, 25 bp, Homo sapien
ccctgattcgggctacaacgcttgg

SEQ ID NO: 101615 - DNA, 25 bp, Homo sapien
cgcagtggaccctgattcgggctac

SEQ ID NO: 101616 - DNA, 25 bp, Homo sapien
gccgtgtgcacacggggcaagccca

SEQ ID NO: 101617 - DNA, 25 bp, Homo sapien
tgccgcgcctgttcaggatggcctc

SEQ ID NO: 101618 - DNA, 25 bp, Homo sapien
gtgccgcgcctgttcaggatggcct

SEQ ID NO: 101619 - DNA, 25 bp, Homo sapien
cgcgcctgttcaggatggcctccaa

SEQ ID NO: 101620 - DNA, 25 bp, Homo sapien
gcgcctgttcaggatggcctccaaa

SEQ ID NO: 101621 - DNA, 25 bp, Homo sapien
cgcctgttcaggatggcctccaaag

SEQ ID NO: 101622 - DNA, 25 bp, Homo sapien
gcctgttcaggatggcctccaaaga

SEQ ID NO: 101623 - DNA, 25 bp, Homo sapien
cctgttcaggatggcctccaaagac

SEQ ID NO: 101624 - DNA, 25 bp, Homo sapien
tgttcaggatggcctccaaagaccg

SEQ ID NO: 101625 - DNA, 25 bp, Homo sapien
agcagcgctcgcttcccgtttcgcg

SEQ ID NO: 101626 - DNA, 25 bp, Homo sapien
ggcaagcagcgctcgcttcccgttt

SEQ ID NO: 101627 - DNA, 25 bp, Homo sapien
ggctccaaaggcgtcatcacgggcg

SEQ ID NO: 101628 - DNA, 25 bp, Homo sapien
gctccaaaggcgtcatcacgggcgt

SEQ ID NO: 101629 - DNA, 25 bp, Homo sapien
ctccaaaggcgtcatcacgggcgtc

SEQ ID NO: 101630 - DNA, 25 bp, Homo sapien
tccaaaggcgtcatcacgggcgtcg

SEQ ID NO: 101631 - DNA, 25 bp, Homo sapien
ggtcctcacgctactgctgtacaca

SEQ ID NO: 101632 - DNA, 25 bp, Homo sapien
gtcctcacgctactgctgtacacag

SEQ ID NO: 101633 - DNA, 25 bp, Homo sapien
tccgtggggatcttctggaggtaaa

SEQ ID NO: 101634 - DNA, 25 bp, Homo sapien
cccgaggaggctaaacatggcaact

SEQ ID NO: 101635 - DNA, 25 bp, Homo sapien
ttccgggcggtgtgcaaattccgtg

SEQ ID NO: 101636 - DNA, 25 bp, Homo sapien
ctgttccgggcggtgtgcaaattcc

SEQ ID NO: 101637 - DNA, 25 bp, Homo sapien
taaacatggcaacttcgtgggccgc

SEQ ID NO: 101638 - DNA, 25 bp, Homo sapien
ggctaaacatggcaacttcgtgggc

SEQ ID NO: 101639 - DNA, 25 bp, Homo sapien
ggaggctaaacatggcaacttcgtg

SEQ ID NO: 101640 - DNA, 25 bp, Homo sapien
aaattccgtggggatcttctggagg

SEQ ID NO: 101641 - DNA, 25 bp, Homo sapien
tgctccgcgtccaggttcagcatca

SEQ ID NO: 101642 - DNA, 25 bp, Homo sapien
cacggcaacgcttaccagggcacgg

SEQ ID NO: 101643 - DNA, 25 bp, Homo sapien
cagcaccgagcccacgatggtcagg

SEQ ID NO: 101644 - DNA, 25 bp, Homo sapien
gacatgccagggcacgtttcctgtg

SEQ ID NO: 101645 - DNA, 25 bp, Homo sapien
tgacacgctgcgatgaggacatgcc

SEQ ID NO: 101646 - DNA, 25 bp, Homo sapien
agcgccacgcacagcaccgtgttga

SEQ ID NO: 101647 - DNA, 25 bp, Homo sapien
cttagcgcgctgctctgagctcaaa

SEQ ID NO: 101648 - DNA, 25 bp, Homo sapien
ggcccatcaacaggcagggcagatg

SEQ ID NO: 101649 - DNA, 25 bp, Homo sapien
tgatgtcccagtgacacacgggcgc

SEQ ID NO: 101650 - DNA, 25 bp, Homo sapien
gcccgatgaatgcagccgtccactg

SEQ ID NO: 101651 - DNA, 25 bp, Homo sapien
ggtccttgcctttcttccagactca

SEQ ID NO: 101652 - DNA, 25 bp, Homo sapien
ccaaacacgccggtggagatgcagg

SEQ ID NO: 101653 - DNA, 25 bp, Homo sapien
gcaggtccagactgctcaggtagca

SEQ ID NO: 101654 - DNA, 25 bp, Homo sapien
cccacatctgtatgggcccggctga

SEQ ID NO: 101655 - DNA, 25 bp, Homo sapien
tggccttgccagtcttacagctctg

SEQ ID NO: 101656 - DNA, 25 bp, Homo sapien
cccactgtgtggatgacgtctacgg

SEQ ID NO: 101657 - DNA, 25 bp, Homo sapien
catcgttgggcattgcaggcccaga

SEQ ID NO: 101658 - DNA, 25 bp, Homo sapien
agccctagatgagacggacgcaccg

SEQ ID NO: 101659 - DNA, 25 bp, Homo sapien
tttcgtatgagttgcaaccggtggc

SEQ ID NO: 101660 - DNA, 25 bp, Homo sapien
cttgtgaaggaccacggggagccct

SEQ ID NO: 101661 - DNA, 25 bp, Homo sapien
aagcggccaggcaccaaaggcgtcg

SEQ ID NO: 101662 - DNA, 25 bp, Homo sapien
caccaaaggcgtcgtcgcgggcatc

SEQ ID NO: 101663 - DNA, 25 bp, Homo sapien
acgtgcagttgacgctgactcaggc

SEQ ID NO: 101664 - DNA, 25 bp, Homo sapien
cccagagaccgagctggtggatgtc

SEQ ID NO: 101665 - DNA, 25 bp, Homo sapien
tccagaatgccagactctcggtttc

SEQ ID NO: 101666 - DNA, 25 bp, Homo sapien
tgacaacccgccagtgttccgggta

SEQ ID NO: 101667 - DNA, 25 bp, Homo sapien
tggaggtgaaggatgttaatgacaa

SEQ ID NO: 101668 - DNA, 25 bp, Homo sapien
cagaatgccagactctcggtttccg

SEQ ID NO: 101669 - DNA, 25 bp, Homo sapien
tgaaggatgttaatgacaacccgcc

SEQ ID NO: 101670 - DNA, 25 bp, Homo sapien
tttcagaatccagaatgccagactc

SEQ ID NO: 101671 - DNA, 25 bp, Homo sapien
gctgtttgtttcagaatccagaatg

SEQ ID NO: 101672 - DNA, 25 bp, Homo sapien
ccaaaagctgtttgtttcagaatcc

SEQ ID NO: 101673 - DNA, 25 bp, Homo sapien
catcgaggcagtcggctggcgtttt

SEQ ID NO: 101674 - DNA, 25 bp, Homo sapien
tccaaaagcgtcatcgaggcagtcg

SEQ ID NO: 101675 - DNA, 25 bp, Homo sapien
caggctccaaaagcgtcatcgaggc

SEQ ID NO: 101676 - DNA, 25 bp, Homo sapien
atcatggtgaacctgcgctgaccgc

SEQ ID NO: 101677 - DNA, 25 bp, Homo sapien
tcctggtgaaggatcatggtgaacc

SEQ ID NO: 101678 - DNA, 25 bp, Homo sapien
ccgtctgctggtcctggtgaaggat

SEQ ID NO: 101679 - DNA, 25 bp, Homo sapien
ctgcaagcagccctcgcatcccgtt

SEQ ID NO: 101680 - DNA, 25 bp, Homo sapien
tcagcactgcccactgagggcgggt

SEQ ID NO: 101681 - DNA, 25 bp, Homo sapien
gcgcctgttccagttggattccaaa

SEQ ID NO: 101682 - DNA, 25 bp, Homo sapien
ttctgatcctcgcaatgtgggtggt

SEQ ID NO: 101683 - DNA, 25 bp, Homo sapien
tctgatcctcgcaatgtgggtggtg

SEQ ID NO: 101684 - DNA, 25 bp, Homo sapien
ctgatcctcgcaatgtgggtggtgg

SEQ ID NO: 101685 - DNA, 25 bp, Homo sapien
tgatcctcgcaatgtgggtggtggg

SEQ ID NO: 101686 - DNA, 25 bp, Homo sapien
gatcctcgcaatgtgggtggtgggg

SEQ ID NO: 101687 - DNA, 25 bp, Homo sapien
cgcgcctgttccagttggattccaa

SEQ ID NO: 101688 - DNA, 25 bp, Homo sapien
atcctcgcaatgtgggtggtgggga

SEQ ID NO: 101689 - DNA, 25 bp, Homo sapien
tgacacctcggatgaggggcactga

SEQ ID NO: 101690 - DNA, 25 bp, Homo sapien
tagcctgttggttctcacgctgctg

SEQ ID NO: 101691 - DNA, 25 bp, Homo sapien
ggccaggcgccaaagtcatcgtcgc

SEQ ID NO: 101692 - DNA, 25 bp, Homo sapien
gccagaaacggccagcgcgagcatc

SEQ ID NO: 101693 - DNA, 25 bp, Homo sapien
caagccgacgctggtgtgttctagc

SEQ ID NO: 101694 - DNA, 25 bp, Homo sapien
ggctttcatacgagctgcagccaga

SEQ ID NO: 101695 - DNA, 25 bp, Homo sapien
caaagtcatcgtcgcgggcgtcagt

SEQ ID NO: 101696 - DNA, 25 bp, Homo sapien
atacgagctgcagccagaaacggcc

SEQ ID NO: 101697 - DNA, 25 bp, Homo sapien
gatgttggagagaacgcattgctta

SEQ ID NO: 101698 - DNA, 25 bp, Homo sapien
gcattgcttacttacaaactcagtc

SEQ ID NO: 101699 - DNA, 25 bp, Homo sapien
gaccgctgattcgtcgatttgtaaa

SEQ ID NO: 101700 - DNA, 25 bp, Homo sapien
aagatggtttccagatgtagctgcc

SEQ ID NO: 101701 - DNA, 25 bp, Homo sapien
cgcccaggttctccgtaacagaaca

SEQ ID NO: 101702 - DNA, 25 bp, Homo sapien
gctctcaatacctgaatccagactg

SEQ ID NO: 101703 - DNA, 25 bp, Homo sapien
cagactgcttgactctcgatttcca

SEQ ID NO: 101704 - DNA, 25 bp, Homo sapien
cactagaaggcgcatctgatgcgga

SEQ ID NO: 101705 - DNA, 25 bp, Homo sapien
atgagactgactcgccacgccagcg

SEQ ID NO: 101706 - DNA, 25 bp, Homo sapien
tgactctggatacaacgcgtggctg

SEQ ID NO: 101707 - DNA, 25 bp, Homo sapien
cgtggctgtcgtatgaattgcagtc

SEQ ID NO: 101708 - DNA, 25 bp, Homo sapien
catgtgggccggtgaagcccacgct

SEQ ID NO: 101709 - DNA, 25 bp, Homo sapien
acgcgcgctctggatgagactgact

SEQ ID NO: 101710 - DNA, 25 bp, Homo sapien
aaggaccatggcgagccgtcgctga

SEQ ID NO: 101711 - DNA, 25 bp, Homo sapien
tgtacactgcactgaggtgctcggc

SEQ ID NO: 101712 - DNA, 25 bp, Homo sapien
ggttggtgcacgcatcccgtttcgc

SEQ ID NO: 101713 - DNA, 25 bp, Homo sapien
ccagcagcccgagtacatggtgttc

SEQ ID NO: 101714 - DNA, 25 bp, Homo sapien
acgttgctgctgtacacgacgctgc

SEQ ID NO: 101715 - DNA, 25 bp, Homo sapien
taccctggacgaggcgaaagctacg

SEQ ID NO: 101716 - DNA, 25 bp, Homo sapien
gcctggttgtcgcaacagctgcatc

SEQ ID NO: 101717 - DNA, 25 bp, Homo sapien
ttagtgctggaacgacaactttgtc

SEQ ID NO: 101718 - DNA, 25 bp, Homo sapien
tcctactcgttgatggaacagcggg

SEQ ID NO: 101719 - DNA, 25 bp, Homo sapien
ggactcgctttcattgttggccaca

SEQ ID NO: 101720 - DNA, 25 bp, Homo sapien
cgctgtctagctatgtgtgggtgca

SEQ ID NO: 101721 - DNA, 25 bp, Homo sapien
caaaagctgctgattgcggaatcta

SEQ ID NO: 101722 - DNA, 25 bp, Homo sapien
cccgccggtgttctcgctcagagaa

SEQ ID NO: 101723 - DNA, 25 bp, Homo sapien
ccggtgttctcgctcagagaacaaa

SEQ ID NO: 101724 - DNA, 25 bp, Homo sapien
tcagagaacaaaagctgctgattgc

SEQ ID NO: 101725 - DNA, 25 bp, Homo sapien
aagctgctgattgcggaatctaagc

SEQ ID NO: 101726 - DNA, 25 bp, Homo sapien
ttgcggaatctaagcaatcggactc

SEQ ID NO: 101727 - DNA, 25 bp, Homo sapien
cggaatctaagcaatcggactcgcg

SEQ ID NO: 101728 - DNA, 25 bp, Homo sapien
ctcgctcagagaacaaaagctgctg

SEQ ID NO: 101729 - DNA, 25 bp, Homo sapien
cgggaggcgcagttaacaagctagt

SEQ ID NO: 101730 - DNA, 25 bp, Homo sapien
gtggtgtccagcctcctggtactca

SEQ ID NO: 101731 - DNA, 25 bp, Homo sapien
tctagtactggtgaaggatcacggt

SEQ ID NO: 101732 - DNA, 25 bp, Homo sapien
cgcgccaccgacttctagtactggt

SEQ ID NO: 101733 - DNA, 25 bp, Homo sapien
tggacgaggcagactcgccgcgcca

SEQ ID NO: 101734 - DNA, 25 bp, Homo sapien
gtgccctggacgaggcagactcgcc

SEQ ID NO: 101735 - DNA, 25 bp, Homo sapien
taacaagctagtaccgcggtcggtg

SEQ ID NO: 101736 - DNA, 25 bp, Homo sapien
gcgagaacgtgtgggcctatgaact

SEQ ID NO: 101737 - DNA, 25 bp, Homo sapien
acaggccacggaggtcacgtttatc

SEQ ID NO: 101738 - DNA, 25 bp, Homo sapien
aggtcacgtttatctgctcgcagag

SEQ ID NO: 101739 - DNA, 25 bp, Homo sapien
aatcacggattagcagcggccgggc

SEQ ID NO: 101740 - DNA, 25 bp, Homo sapien
ccgcgggaagcaatcacggattagc

SEQ ID NO: 101741 - DNA, 25 bp, Homo sapien
acttagaggcctgggcgaatcctcc

SEQ ID NO: 101742 - DNA, 25 bp, Homo sapien
gagctgagccttttcctagcggccg

SEQ ID NO: 101743 - DNA, 25 bp, Homo sapien
ctcgcagagcaaggccacggctaat

SEQ ID NO: 101744 - DNA, 25 bp, Homo sapien
gtcgagcgctgaatacttagaggcc

SEQ ID NO: 101745 - DNA, 25 bp, Homo sapien
cacggcactgtgaggatcccgcagg

SEQ ID NO: 101746 - DNA, 25 bp, Homo sapien
ctcacctgcaggaaggggacgatgc

SEQ ID NO: 101747 - DNA, 25 bp, Homo sapien
tgaggatcccgcaggggaggagagc

SEQ ID NO: 101748 - DNA, 25 bp, Homo sapien
acgatgccgtcacgggcaatggcct

SEQ ID NO: 101749 - DNA, 25 bp, Homo sapien
cacacggcactgtgaggatcccgca

SEQ ID NO: 101750 - DNA, 25 bp, Homo sapien
gggcatgcgtcccacacacggcact

SEQ ID NO: 101751 - DNA, 25 bp, Homo sapien
caatggcctgcagtaggcgcggtgc

SEQ ID NO: 101752 - DNA, 25 bp, Homo sapien
actcacctgcaggaaggggacgatg

SEQ ID NO: 101753 - DNA, 25 bp, Homo sapien
aaggtacctgtttctgaatctgcgc

SEQ ID NO: 101754 - DNA, 25 bp, Homo sapien
ggcgtaaactctcttttgacctatg

SEQ ID NO: 101755 - DNA, 25 bp, Homo sapien
cgatcccttaaaactgattgtccca

SEQ ID NO: 101756 - DNA, 25 bp, Homo sapien
tttctgcaatggtgattatcggacc

SEQ ID NO: 101757 - DNA, 25 bp, Homo sapien
ctgatgcggatatcggcgtaaactc

SEQ ID NO: 101758 - DNA, 25 bp, Homo sapien
ttatcggaccaagaggcccgggatc

SEQ ID NO: 101759 - DNA, 25 bp, Homo sapien
ctcattttcctctagagggcgcttc

SEQ ID NO: 101760 - DNA, 25 bp, Homo sapien
tctgcgcctctggactctcattttc

SEQ ID NO: 101761 - DNA, 25 bp, Homo sapien
cagttagcgagttggtaccgcggtc

SEQ ID NO: 101762 - DNA, 25 bp, Homo sapien
ctccggctataacgcttggctgtcc

SEQ ID NO: 101763 - DNA, 25 bp, Homo sapien
ggtggacgctgactccggctataac

SEQ ID NO: 101764 - DNA, 25 bp, Homo sapien
gtcctacgagttgcaaccggcggcg

SEQ ID NO: 101765 - DNA, 25 bp, Homo sapien
cgaagcggctctggtggatattaac

SEQ ID NO: 101766 - DNA, 25 bp, Homo sapien
ccaaagacgtcgtcgcgggcctcag

SEQ ID NO: 101767 - DNA, 25 bp, Homo sapien
tattaacgtgtacctcatcatcgcc

SEQ ID NO: 101768 - DNA, 25 bp, Homo sapien
atcagcacgacacgcatcctggatg

SEQ ID NO: 101769 - DNA, 25 bp, Homo sapien
ggagtgtaccatgctgtcttcctgg

SEQ ID NO: 101770 - DNA, 25 bp, Homo sapien
tccgcactaggaagccataaaaatt

SEQ ID NO: 101771 - DNA, 25 bp, Homo sapien
agctctgaggtttttggagtgtacc

SEQ ID NO: 101772 - DNA, 25 bp, Homo sapien
tgcagaatctagacctccggaaact

SEQ ID NO: 101773 - DNA, 25 bp, Homo sapien
gtcttcctggcaaggaggcccaaga

SEQ ID NO: 101774 - DNA, 25 bp, Homo sapien
cgcccatattccctgaaagcaagaa

SEQ ID NO: 101775 - DNA, 25 bp, Homo sapien
aattgggccttgagagacagtttga

SEQ ID NO: 101776 - DNA, 25 bp, Homo sapien
gcggcaactactgctctggcttctg

SEQ ID NO: 101777 - DNA, 25 bp, Homo sapien
gctggtggatgtcaatgtttacttg

SEQ ID NO: 101778 - DNA, 25 bp, Homo sapien
cgccacaggcttcgtcgagggcgtc

SEQ ID NO: 101779 - DNA, 25 bp, Homo sapien
ccaagcgccacaggcttcgtcgagg

SEQ ID NO: 101780 - DNA, 25 bp, Homo sapien
ggtggacgccgattcgggctacaat

SEQ ID NO: 101781 - DNA, 25 bp, Homo sapien
gccacggcaacggtgctgttgtcgc

SEQ ID NO: 101782 - DNA, 25 bp, Homo sapien
gtggatgtcaatgtttacttgatca

SEQ ID NO: 101783 - DNA, 25 bp, Homo sapien
aacgctccggcgctgctgacgcccg

SEQ ID NO: 101784 - DNA, 25 bp, Homo sapien
gcacgacgcgccctctggacgaggt

SEQ ID NO: 101785 - DNA, 25 bp, Homo sapien
tcccgaatgcccaagatgacgacga

SEQ ID NO: 101786 - DNA, 25 bp, Homo sapien
ggagcccgctttactctcccgaatg

SEQ ID NO: 101787 - DNA, 25 bp, Homo sapien
ggtggatctacccagcggcaatttg

SEQ ID NO: 101788 - DNA, 25 bp, Homo sapien
cgagctctacttcggggtggatcta

SEQ ID NO: 101789 - DNA, 25 bp, Homo sapien
gtaggcaatctctccgcggacttga

SEQ ID NO: 101790 - DNA, 25 bp, Homo sapien
ctgcgtcttgacctacgacctggtg

SEQ ID NO: 101791 - DNA, 25 bp, Homo sapien
ctgggctcagccacagttatcagca

SEQ ID NO: 101792 - DNA, 25 bp, Homo sapien
tcagggcgttgtcctagaaaacacc

SEQ ID NO: 101793 - DNA, 25 bp, Homo sapien
ctggagcgcgctttcacatagagag

SEQ ID NO: 101794 - DNA, 25 bp, Homo sapien
cccagctgcgatactctgtgccaga

SEQ ID NO: 101795 - DNA, 25 bp, Homo sapien
tgcttgcgcatcaaccatctgggtg

SEQ ID NO: 101796 - DNA, 25 bp, Homo sapien
ctcttcgtcaacgagcgcattgatc

SEQ ID NO: 101797 - DNA, 25 bp, Homo sapien
ctcagcttggaagtgctggcgcaca

SEQ ID NO: 101798 - DNA, 25 bp, Homo sapien
gcggcccaactaccagcttcaggta

SEQ ID NO: 101799 - DNA, 25 bp, Homo sapien
tgggcgccaactcagtacagaccta

SEQ ID NO: 101800 - DNA, 25 bp, Homo sapien
tgagcgccgttgaggtggaaatatt

SEQ ID NO: 101801 - DNA, 25 bp, Homo sapien
ctctggtgataagcacggccctgga

SEQ ID NO: 101802 - DNA, 25 bp, Homo sapien
cgggagaccagatccgaatacaaca

SEQ ID NO: 101803 - DNA, 25 bp, Homo sapien
tggtgtgctccatccaagatgatct

SEQ ID NO: 101804 - DNA, 25 bp, Homo sapien
caacggaaggatggtgtgctccatc

SEQ ID NO: 101805 - DNA, 25 bp, Homo sapien
actccggagacaacggaaggatggt

SEQ ID NO: 101806 - DNA, 25 bp, Homo sapien
ccctcattgctgtattcagcgtttc

SEQ ID NO: 101807 - DNA, 25 bp, Homo sapien
tggaccgggagaccagatccgaata

SEQ ID NO: 101808 - DNA, 25 bp, Homo sapien
gttgagaacttttacactctggtga

SEQ ID NO: 101809 - DNA, 25 bp, Homo sapien
cctgaaaccatctgtagagaatttt

SEQ ID NO: 101810 - DNA, 25 bp, Homo sapien
ttcttcctgaaaccatctgtagaga

SEQ ID NO: 101811 - DNA, 25 bp, Homo sapien
catcactatcactgacctggggaca

SEQ ID NO: 101812 - DNA, 25 bp, Homo sapien
ccatctgtagagaatttttacaccc

SEQ ID NO: 101813 - DNA, 25 bp, Homo sapien
accctagtgtcagaaggcgcgctgg

SEQ ID NO: 101814 - DNA, 25 bp, Homo sapien
ttaccatcactatcactgacctggg

SEQ ID NO: 101815 - DNA, 25 bp, Homo sapien
ccttcttcctgaaaccatctgtaga

SEQ ID NO: 101816 - DNA, 25 bp, Homo sapien
atcactatcactgacctggggacac

SEQ ID NO: 101817 - DNA, 25 bp, Homo sapien
cctgaagccaatatttcctaatctc

SEQ ID NO: 101818 - DNA, 25 bp, Homo sapien
atttcctaatctcttggttcaggac

SEQ ID NO: 101819 - DNA, 25 bp, Homo sapien
gaagccaatatttcctaatctcttg

SEQ ID NO: 101820 - DNA, 25 bp, Homo sapien
gttcctgaagccaatatttcctaat

SEQ ID NO: 101821 - DNA, 25 bp, Homo sapien
caatatttcctaatctcttggttca

SEQ ID NO: 101822 - DNA, 25 bp, Homo sapien
actctgggactggtgagttcaagtt

SEQ ID NO: 101823 - DNA, 25 bp, Homo sapien
gagactctgggactggtgagttcaa

SEQ ID NO: 101824 - DNA, 25 bp, Homo sapien
accgagagaccagcgctgagtacaa

SEQ ID NO: 101825 - DNA, 25 bp, Homo sapien
ggctccagccgtcaccgcaaagttt

SEQ ID NO: 101826 - DNA, 25 bp, Homo sapien
gctctcaagacaaggaggcggcccg

SEQ ID NO: 101827 - DNA, 25 bp, Homo sapien
ctggaacggtgagaccatggtgcct

SEQ ID NO: 101828 - DNA, 25 bp, Homo sapien
agtcacggttggagcgaggttttat

SEQ ID NO: 101829 - DNA, 25 bp, Homo sapien
ggagctctagtccaagccctcgctg

SEQ ID NO: 101830 - DNA, 25 bp, Homo sapien
ccaagcaccagtagcggtggcgctg

SEQ ID NO: 101831 - DNA, 25 bp, Homo sapien
tccctgagtcaagagccaagcacca

SEQ ID NO: 101832 - DNA, 25 bp, Homo sapien
gtcaccgcaaagtttcccgaggaga

SEQ ID NO: 101833 - DNA, 25 bp, Homo sapien
ctacgaggtgtgtttgaccggagac

SEQ ID NO: 101834 - DNA, 25 bp, Homo sapien
gtgtttgaccggagactcaggggcc

SEQ ID NO: 101835 - DNA, 25 bp, Homo sapien
ctaccactacgaggtgtgtttgacc

SEQ ID NO: 101836 - DNA, 25 bp, Homo sapien
accactacgaggtgtgtttgaccgg

SEQ ID NO: 101837 - DNA, 25 bp, Homo sapien
taccactacgaggtgtgtttgaccg

SEQ ID NO: 101838 - DNA, 25 bp, Homo sapien
actacgaggtgtgtttgaccggaga

SEQ ID NO: 101839 - DNA, 25 bp, Homo sapien
cgaggtgtgtttgaccggagactca

SEQ ID NO: 101840 - DNA, 25 bp, Homo sapien
ccactacgaggtgtgtttgaccgga

SEQ ID NO: 101841 - DNA, 25 bp, Homo sapien
agctggccatgtccaagttcaacca

SEQ ID NO: 101842 - DNA, 25 bp, Homo sapien
acccacaggacgagctggccatgtc

SEQ ID NO: 101843 - DNA, 25 bp, Homo sapien
gttcaaccagcagaaatacgacgag

SEQ ID NO: 101844 - DNA, 25 bp, Homo sapien
agggtgccgcctacccacaggacga

SEQ ID NO: 101845 - DNA, 25 bp, Homo sapien
gttcccggtgcccaaggactgctac

SEQ ID NO: 101846 - DNA, 25 bp, Homo sapien
agctgcgctgcattgagttcccggt

SEQ ID NO: 101847 - DNA, 25 bp, Homo sapien
gctcaagttcctcgggaacccgctg

SEQ ID NO: 101848 - DNA, 25 bp, Homo sapien
atacgacgagatcgccgaggagctg

SEQ ID NO: 101849 - DNA, 25 bp, Homo sapien
ggccggggatgtttccacacaatcg

SEQ ID NO: 101850 - DNA, 25 bp, Homo sapien
accaccttgctctagggagccacgg

SEQ ID NO: 101851 - DNA, 25 bp, Homo sapien
ctgtggcaccaccttgctctaggga

SEQ ID NO: 101852 - DNA, 25 bp, Homo sapien
tggctcggtcccatccaaggcgcag

SEQ ID NO: 101853 - DNA, 25 bp, Homo sapien
cagcctgaagcacccattgctcggg

SEQ ID NO: 101854 - DNA, 25 bp, Homo sapien
cacaatcggctcctacaaagctctg

SEQ ID NO: 101855 - DNA, 25 bp, Homo sapien
agcccacaatccagtgccgcggaga

SEQ ID NO: 101856 - DNA, 25 bp, Homo sapien
acggcgcggagacaccaggagccac

SEQ ID NO: 101857 - DNA, 25 bp, Homo sapien
acggtcactgatttggggacaccaa

SEQ ID NO: 101858 - DNA, 25 bp, Homo sapien
ggtcactgatttggggacaccaagg

SEQ ID NO: 101859 - DNA, 25 bp, Homo sapien
gtggagaatttctacaccctggtaa

SEQ ID NO: 101860 - DNA, 25 bp, Homo sapien
ttccgtggagaatttctacaccctg

SEQ ID NO: 101861 - DNA, 25 bp, Homo sapien
gaccttccgtggagaatttctacac

SEQ ID NO: 101862 - DNA, 25 bp, Homo sapien
agaccttccgtggagaatttctaca

SEQ ID NO: 101863 - DNA, 25 bp, Homo sapien
cacggtcactgatttggggacacca

SEQ ID NO: 101864 - DNA, 25 bp, Homo sapien
ctaagaccttccgtggagaatttct

SEQ ID NO: 101865 - DNA, 25 bp, Homo sapien
ctgagagccagttaaagtttcttaa

SEQ ID NO: 101866 - DNA, 25 bp, Homo sapien
gagtacaacataaccctgcgggtct

SEQ ID NO: 101867 - DNA, 25 bp, Homo sapien
accctgtcccagaattatcagtatg

SEQ ID NO: 101868 - DNA, 25 bp, Homo sapien
gttaacagaaggagcgctagacaga

SEQ ID NO: 101869 - DNA, 25 bp, Homo sapien
tctacactttgttaacagaaggagc

SEQ ID NO: 101870 - DNA, 25 bp, Homo sapien
caccattactgtcacagacttgggg

SEQ ID NO: 101871 - DNA, 25 bp, Homo sapien
attatcagtatgaagtttacctggc

SEQ ID NO: 101872 - DNA, 25 bp, Homo sapien
tggcagaaagctctgagagccagtt

SEQ ID NO: 101873 - DNA, 25 bp, Homo sapien
ccacgacatctggtggacttgagcg

SEQ ID NO: 101874 - DNA, 25 bp, Homo sapien
cagggaagtggaagaaaatcgccca

SEQ ID NO: 101875 - DNA, 25 bp, Homo sapien
cgggaacaatggaaagacagtgtgc

SEQ ID NO: 101876 - DNA, 25 bp, Homo sapien
tcatcctgaagccatctgtcgaaaa

SEQ ID NO: 101877 - DNA, 25 bp, Homo sapien
tgtcgaaaacttctatactctggta

SEQ ID NO: 101878 - DNA, 25 bp, Homo sapien
ctggtaacagagaaacctttggatc

SEQ ID NO: 101879 - DNA, 25 bp, Homo sapien
agtgtgctccatccaggacgatgtc

SEQ ID NO: 101880 - DNA, 25 bp, Homo sapien
ctttggatcgagagaggaacactga

SEQ ID NO: 101881 - DNA, 25 bp, Homo sapien
ggacacccaggctgacaacacatct

SEQ ID NO: 101882 - DNA, 25 bp, Homo sapien
tgaaatcttctgtggggaactttta

SEQ ID NO: 101883 - DNA, 25 bp, Homo sapien
ggctgacaacacatctcaatatgac

SEQ ID NO: 101884 - DNA, 25 bp, Homo sapien
ccgggagcctgtctcagaactatca

SEQ ID NO: 101885 - DNA, 25 bp, Homo sapien
ctcagaactatcagtacgaggtgtg

SEQ ID NO: 101886 - DNA, 25 bp, Homo sapien
ctatcagtacgaggtgtgcctggca

SEQ ID NO: 101887 - DNA, 25 bp, Homo sapien
tccagttcctgaaaccagtattacc

SEQ ID NO: 101888 - DNA, 25 bp, Homo sapien
cttcctcctgaaatcttctgtgggg

SEQ ID NO: 101889 - DNA, 25 bp, Homo sapien
tgaatataatatcaccctcaccgtc

SEQ ID NO: 101890 - DNA, 25 bp, Homo sapien
cctcaccgtcacagatatggggact

SEQ ID NO: 101891 - DNA, 25 bp, Homo sapien
tccaaggctgaaaacggagcacaac

SEQ ID NO: 101892 - DNA, 25 bp, Homo sapien
ggagcacaacataacagtgcagata

SEQ ID NO: 101893 - DNA, 25 bp, Homo sapien
cagtgcagatatcagatgtcaatga

SEQ ID NO: 101894 - DNA, 25 bp, Homo sapien
caacttctctccttagggcactagg

SEQ ID NO: 101895 - DNA, 25 bp, Homo sapien
cttagggcactaggaaagaaataga

SEQ ID NO: 101896 - DNA, 25 bp, Homo sapien
cgacagagaagcaagagctgaatat

SEQ ID NO: 101897 - DNA, 25 bp, Homo sapien
cgagcacagcataaccctgcaggtc

SEQ ID NO: 101898 - DNA, 25 bp, Homo sapien
tttacatcctaatgactgaaggtgc

SEQ ID NO: 101899 - DNA, 25 bp, Homo sapien
ccgtctgttgacaatttttacatcc

SEQ ID NO: 101900 - DNA, 25 bp, Homo sapien
tctgaaaccgtctgttgacaatttt

SEQ ID NO: 101901 - DNA, 25 bp, Homo sapien
ctaatgactgaaggtgcactggaca

SEQ ID NO: 101902 - DNA, 25 bp, Homo sapien
tctgactggaggttcagagaccggc

SEQ ID NO: 101903 - DNA, 25 bp, Homo sapien
gaggttcagagaccggcgagttcaa

SEQ ID NO: 101904 - DNA, 25 bp, Homo sapien
gaaatagaggaaaattctactctcc

SEQ ID NO: 101905 - DNA, 25 bp, Homo sapien
catcctaattacagaaggcgcgctg

SEQ ID NO: 101906 - DNA, 25 bp, Homo sapien
tcaagttcttgaaaccagttatttc

SEQ ID NO: 101907 - DNA, 25 bp, Homo sapien
ccttctgtggagaatttttacatcc

SEQ ID NO: 101908 - DNA, 25 bp, Homo sapien
tatttcggatattcaggcacagggc

SEQ ID NO: 101909 - DNA, 25 bp, Homo sapien
gccattcctactaaaaccttctgtg

SEQ ID NO: 101910 - DNA, 25 bp, Homo sapien
ctacattcaagagaatctgccattc

SEQ ID NO: 101911 - DNA, 25 bp, Homo sapien
cccgggaccagtgagttcaagttct

SEQ ID NO: 101912 - DNA, 25 bp, Homo sapien
aaccagttatttcggatattcaggc

SEQ ID NO: 101913 - DNA, 25 bp, Homo sapien
aattcgtgctaatatttctctgggg

SEQ ID NO: 101914 - DNA, 25 bp, Homo sapien
cccaaatcgaattcgtgctaatatt

SEQ ID NO: 101915 - DNA, 25 bp, Homo sapien
ccaggcccaaccacggggctgccgg

SEQ ID NO: 101916 - DNA, 25 bp, Homo sapien
ctgccgggaccaggccatgtgtctg

SEQ ID NO: 101917 - DNA, 25 bp, Homo sapien
ggcttagctggctgggattgtccac

SEQ ID NO: 101918 - DNA, 25 bp, Homo sapien
ggctgggattgtccacccaaattaa

SEQ ID NO: 101919 - DNA, 25 bp, Homo sapien
ttttaacccagctcataaatcttcc

SEQ ID NO: 101920 - DNA, 25 bp, Homo sapien
gctcataaatcttccactaagtacg

SEQ ID NO: 101921 - DNA, 25 bp, Homo sapien
aaaccgagcacaacacaactgtgtt

SEQ ID NO: 101922 - DNA, 25 bp, Homo sapien
cacaactgtgttggtctctgacgtc

SEQ ID NO: 101923 - DNA, 25 bp, Homo sapien
cgggaggttccgagacaaatgaatt

SEQ ID NO: 101924 - DNA, 25 bp, Homo sapien
cgagacaaatgaattcaagttccta

SEQ ID NO: 101925 - DNA, 25 bp, Homo sapien
accggttatccctaatatccaggca

SEQ ID NO: 101926 - DNA, 25 bp, Homo sapien
ttgggaagaatagtgaagaaaactc

SEQ ID NO: 101927 - DNA, 25 bp, Homo sapien
ccctaatatccaggcaaaaggtctt

SEQ ID NO: 101928 - DNA, 25 bp, Homo sapien
tagtgaagaaaactccacctttcga

SEQ ID NO: 101929 - DNA, 25 bp, Homo sapien
gctccaggtcaaataagttcaaatt

SEQ ID NO: 101930 - DNA, 25 bp, Homo sapien
tggaggctccaggtcaaataagttc

SEQ ID NO: 101931 - DNA, 25 bp, Homo sapien
cccggaggacatcccattcgtgcta

SEQ ID NO: 101932 - DNA, 25 bp, Homo sapien
gaaagatggtttgttctatcccgga

SEQ ID NO: 101933 - DNA, 25 bp, Homo sapien
cgtgctaaaatcttcggtaaataat

SEQ ID NO: 101934 - DNA, 25 bp, Homo sapien
tgtgtgactggaggctccaggtcaa

SEQ ID NO: 101935 - DNA, 25 bp, Homo sapien
atggtttgttctatcccggaggaca

SEQ ID NO: 101936 - DNA, 25 bp, Homo sapien
ttctatcccggaggacatcccattc

SEQ ID NO: 101937 - DNA, 25 bp, Homo sapien
tgaccgtgctgatcgccgatgtcaa

SEQ ID NO: 101938 - DNA, 25 bp, Homo sapien
gaaagcagagcggaatacaacatca

SEQ ID NO: 101939 - DNA, 25 bp, Homo sapien
cctatgctgataacacagctcaata

SEQ ID NO: 101940 - DNA, 25 bp, Homo sapien
gatcgccgatgtcaatgacaacgct

SEQ ID NO: 101941 - DNA, 25 bp, Homo sapien
aatatgaccgtgctgatcgccgatg

SEQ ID NO: 101942 - DNA, 25 bp, Homo sapien
gctgatcgccgatgtcaatgacaac

SEQ ID NO: 101943 - DNA, 25 bp, Homo sapien
tgctgataacacagctcaatatgac

SEQ ID NO: 101944 - DNA, 25 bp, Homo sapien
cttggggacccctatgctgataaca

SEQ ID NO: 101945 - DNA, 25 bp, Homo sapien
ccctggatttcggtgacgttgttct

SEQ ID NO: 101946 - DNA, 25 bp, Homo sapien
ccgttgcagaagaggccccagagcg

SEQ ID NO: 101947 - DNA, 25 bp, Homo sapien
aagtactcgtcacaggcggcgctgg

SEQ ID NO: 101948 - DNA, 25 bp, Homo sapien
atgaagtactcgtcacaggcggcgc

SEQ ID NO: 101949 - DNA, 25 bp, Homo sapien
tctggatgaagtactcgtcacaggc

SEQ ID NO: 101950 - DNA, 25 bp, Homo sapien
cgttgttctggatgaagtactcgtc

SEQ ID NO: 101951 - DNA, 25 bp, Homo sapien
cggtgacgttgttctggatgaagta

SEQ ID NO: 101952 - DNA, 25 bp, Homo sapien
cccgggatgccctggatttcggtga

SEQ ID NO: 101953 - DNA, 25 bp, Homo sapien
ccgtaggccttgacgcaggcatcga

SEQ ID NO: 101954 - DNA, 25 bp, Homo sapien
agttgttgtggatgccgtaggcctt

SEQ ID NO: 101955 - DNA, 25 bp, Homo sapien
caggcatcgaagctgcgccgtgaca

SEQ ID NO: 101956 - DNA, 25 bp, Homo sapien
tgcgccgtgacagcgtgcggttccc

SEQ ID NO: 101957 - DNA, 25 bp, Homo sapien
gcacggcacgtgtgctgccaccgaa

SEQ ID NO: 101958 - DNA, 25 bp, Homo sapien
tgtgctgccaccgaagtggctttta

SEQ ID NO: 101959 - DNA, 25 bp, Homo sapien
tgccaccgaagtggcttttactgcc

SEQ ID NO: 101960 - DNA, 25 bp, Homo sapien
ccaacgggcacccatggtgtcgccc

SEQ ID NO: 101961 - DNA, 25 bp, Homo sapien
cccaattttcaagttcatgacactg

SEQ ID NO: 101962 - DNA, 25 bp, Homo sapien
ttttcaagttcatgacactggtagg

SEQ ID NO: 101963 - DNA, 25 bp, Homo sapien
tttcaagttcatgacactggtagga

SEQ ID NO: 101964 - DNA, 25 bp, Homo sapien
caagttcatgacactggtaggaata

SEQ ID NO: 101965 - DNA, 25 bp, Homo sapien
gttcatgacactggtaggaatatgg

SEQ ID NO: 101966 - DNA, 25 bp, Homo sapien
tcatgacactggtaggaatatgggg

SEQ ID NO: 101967 - DNA, 25 bp, Homo sapien
cactggtaggaatatgggggaaatc

SEQ ID NO: 101968 - DNA, 25 bp, Homo sapien
aggaatatgggggaaatcgagaact

SEQ ID NO: 101969 - DNA, 25 bp, Homo sapien
cctttgtcttgaagcctaccttcaa

SEQ ID NO: 101970 - DNA, 25 bp, Homo sapien
cttcaagaatttttacgctctggta

SEQ ID NO: 101971 - DNA, 25 bp, Homo sapien
gctctggtaacagagcacccactgg

SEQ ID NO: 101972 - DNA, 25 bp, Homo sapien
cccactggacagagaggtcagaaat

SEQ ID NO: 101973 - DNA, 25 bp, Homo sapien
ttcctgaagccggtgattcccaatc

SEQ ID NO: 101974 - DNA, 25 bp, Homo sapien
gaagccggtgattcccaatctcctg

SEQ ID NO: 101975 - DNA, 25 bp, Homo sapien
ccacctttctgaatggcgtggaatg

SEQ ID NO: 101976 - DNA, 25 bp, Homo sapien
atgggagaacagtttgctcaattca

SEQ ID NO: 101977 - DNA, 25 bp, Homo sapien
aatgcactgacaggctgctgagcga

SEQ ID NO: 101978 - DNA, 25 bp, Homo sapien
gccctacttgccgttccctgaagcg

SEQ ID NO: 101979 - DNA, 25 bp, Homo sapien
tgtgggcgcacaatgcactgacagg

SEQ ID NO: 101980 - DNA, 25 bp, Homo sapien
tcactcttcgtgctgttcccgctgc

SEQ ID NO: 101981 - DNA, 25 bp, Homo sapien
cctgcatattggcagcgtcagcacc

SEQ ID NO: 101982 - DNA, 25 bp, Homo sapien
cgcacaatgcactgacaggctgctg

SEQ ID NO: 101983 - DNA, 25 bp, Homo sapien
cgacagctcactcttcgtgctgttc

SEQ ID NO: 101984 - DNA, 25 bp, Homo sapien
tggacgccaacgacagctcactctt

SEQ ID NO: 101985 - DNA, 25 bp, Homo sapien
tctacaggctggtaacagaaggggc

SEQ ID NO: 101986 - DNA, 25 bp, Homo sapien
gccaggactctaggaggaaatcaga

SEQ ID NO: 101987 - DNA, 25 bp, Homo sapien
tcccaaatattgtaagccaggactc

SEQ ID NO: 101988 - DNA, 25 bp, Homo sapien
caagttcttgaagcctatattccca

SEQ ID NO: 101989 - DNA, 25 bp, Homo sapien
agcagagcataaccgtgctggtgtc

SEQ ID NO: 101990 - DNA, 25 bp, Homo sapien
ccttctgttgagaatttctacaggc

SEQ ID NO: 101991 - DNA, 25 bp, Homo sapien
caggatgatgttccttttaagctaa

SEQ ID NO: 101992 - DNA, 25 bp, Homo sapien
cgggaggctctgaaagtaatgattt

SEQ ID NO: 101993 - DNA, 25 bp, Homo sapien
caggaccggacttcatgttcgctca

SEQ ID NO: 101994 - DNA, 25 bp, Homo sapien
ggtcccagtggaaggcgactaactc

SEQ ID NO: 101995 - DNA, 25 bp, Homo sapien
gctcactcgtctgagggtcccagtg

SEQ ID NO: 101996 - DNA, 25 bp, Homo sapien
acccacttgggcgtatgtcttcagg

SEQ ID NO: 101997 - DNA, 25 bp, Homo sapien
gtgtcgaagggctgcccagtcagta

SEQ ID NO: 101998 - DNA, 25 bp, Homo sapien
caggtcagggaacgtctgcatcttc

SEQ ID NO: 101999 - DNA, 25 bp, Homo sapien
cgagttttcggcgacgtaggccata

SEQ ID NO: 102000 - DNA, 25 bp, Homo sapien
ccagagcgtgagaccggcttttcac

SEQ ID NO: 102001 - DNA, 25 bp, Homo sapien
gcccagaaagcccagcagagatact

SEQ ID NO: 102002 - DNA, 25 bp, Homo sapien
cgcctcgggtacttacaatccagtg

SEQ ID NO: 102003 - DNA, 25 bp, Homo sapien
cgagcgtctccttgtcgtttcctta

SEQ ID NO: 102004 - DNA, 25 bp, Homo sapien
tgccgcttggcagagtgatccacta

SEQ ID NO: 102005 - DNA, 25 bp, Homo sapien
taccgattactgatgaaagggcccg

SEQ ID NO: 102006 - DNA, 25 bp, Homo sapien
cgaaatcttgccgagaggcgcagct

SEQ ID NO: 102007 - DNA, 25 bp, Homo sapien
gctgcccagcgtgaaactcatcttt

SEQ ID NO: 102008 - DNA, 25 bp, Homo sapien
cgcctacccagcaaaaacggaagtg

SEQ ID NO: 102009 - DNA, 25 bp, Homo sapien
cagagctctcgctggtgcgcaattc

SEQ ID NO: 102010 - DNA, 25 bp, Homo sapien
ccaaggtcaacgtgcaggtcatcta

SEQ ID NO: 102011 - DNA, 25 bp, Homo sapien
atgtgcgcaccattgccagggactc

SEQ ID NO: 102012 - DNA, 25 bp, Homo sapien
tccgtgtccaccgtcagcattgagg

SEQ ID NO: 102013 - DNA, 25 bp, Homo sapien
ttcctgagccggaaccacctgagca

SEQ ID NO: 102014 - DNA, 25 bp, Homo sapien
tgctgctcaggaacaacccttggtt

SEQ ID NO: 102015 - DNA, 25 bp, Homo sapien
tggacggtaacctgctggccaacca

SEQ ID NO: 102016 - DNA, 25 bp, Homo sapien
ccagcgagatggacgagtgttttga

SEQ ID NO: 102017 - DNA, 25 bp, Homo sapien
ggacatgcaactgaaagtgatggcg

SEQ ID NO: 102018 - DNA, 25 bp, Homo sapien
gtgtctctcagcctattcctgctgg

SEQ ID NO: 102019 - DNA, 25 bp, Homo sapien
cagcagcaacgtgtctctcagccta

SEQ ID NO: 102020 - DNA, 25 bp, Homo sapien
ccgggacatgcaactgaaagtgatg

SEQ ID NO: 102021 - DNA, 25 bp, Homo sapien
gttccgggacatgcaactgaaagtg

SEQ ID NO: 102022 - DNA, 25 bp, Homo sapien
cgactatgagcagttccgggacatg

SEQ ID NO: 102023 - DNA, 25 bp, Homo sapien
tcagcctattcctgctggaccagaa

SEQ ID NO: 102024 - DNA, 25 bp, Homo sapien
agcaacgtgtctctcagcctattcc

SEQ ID NO: 102025 - DNA, 25 bp, Homo sapien
ggatactcacggtgaccgccactga

SEQ ID NO: 102026 - DNA, 25 bp, Homo sapien
acctcgttctcgtggcttctgatgg

SEQ ID NO: 102027 - DNA, 25 bp, Homo sapien
gggtgacccagtgctatctggcacc

SEQ ID NO: 102028 - DNA, 25 bp, Homo sapien
tcccgcatctgcgtgaaggtcctgg

SEQ ID NO: 102029 - DNA, 25 bp, Homo sapien
cgcctgtttttacacagcccgagta

SEQ ID NO: 102030 - DNA, 25 bp, Homo sapien
gcccgagtaccgcataagcattccg

SEQ ID NO: 102031 - DNA, 25 bp, Homo sapien
acgctcgtgggcacccggatactca

SEQ ID NO: 102032 - DNA, 25 bp, Homo sapien
agcattccggagaatacgctcgtgg

SEQ ID NO: 102033 - DNA, 25 bp, Homo sapien
ggcatgcagagctcgcactttgtgg

SEQ ID NO: 102034 - DNA, 25 bp, Homo sapien
acaggcatgcagagctcgcactttg

SEQ ID NO: 102035 - DNA, 25 bp, Homo sapien
cctccactcagtagcaatgtatcat

SEQ ID NO: 102036 - DNA, 25 bp, Homo sapien
caggaggcagcttgacaggcatgca

SEQ ID NO: 102037 - DNA, 25 bp, Homo sapien
atgtatcattaagcctgttcgtgct

SEQ ID NO: 102038 - DNA, 25 bp, Homo sapien
caatgtatcattaagcctgttcgtg

SEQ ID NO: 102039 - DNA, 25 bp, Homo sapien
ctcagtagcaatgtatcattaagcc

SEQ ID NO: 102040 - DNA, 25 bp, Homo sapien
tccactcagtagcaatgtatcatta

SEQ ID NO: 102041 - DNA, 25 bp, Homo sapien
tgaccaattgcctgagtttccgaaa

SEQ ID NO: 102042 - DNA, 25 bp, Homo sapien
tcaccgaaaaggaaatgaccaattg

SEQ ID NO: 102043 - DNA, 25 bp, Homo sapien
taaaggttccttcgtgggcaacatc

SEQ ID NO: 102044 - DNA, 25 bp, Homo sapien
ctcggtgtctgaggagctagataaa

SEQ ID NO: 102045 - DNA, 25 bp, Homo sapien
cggtcagatccgctactcggtgtct

SEQ ID NO: 102046 - DNA, 25 bp, Homo sapien
cgctgtgcgaaacaggatccggtca

SEQ ID NO: 102047 - DNA, 25 bp, Homo sapien
acatcgctaacgacctggggctaga

SEQ ID NO: 102048 - DNA, 25 bp, Homo sapien
ccgaattcagagaaagcgattcacc

SEQ ID NO: 102049 - DNA, 25 bp, Homo sapien
gttcaagccaccctcgtgccacgtg

SEQ ID NO: 102050 - DNA, 25 bp, Homo sapien
ggtcagctgtcacaatctcagtgtc

SEQ ID NO: 102051 - DNA, 25 bp, Homo sapien
atctcagtgtctgagttcaagccac

SEQ ID NO: 102052 - DNA, 25 bp, Homo sapien
taagccaggcctgtacgtggaaaac

SEQ ID NO: 102053 - DNA, 25 bp, Homo sapien
cccgacgtataagccaggcctgtac

SEQ ID NO: 102054 - DNA, 25 bp, Homo sapien
ccaacggccaagagcacaggagtgc

SEQ ID NO: 102055 - DNA, 25 bp, Homo sapien
tgccacgtgccaacggccaagagca

SEQ ID NO: 102056 - DNA, 25 bp, Homo sapien
tcctggccgggtcagctgtcacaat

SEQ ID NO: 102057 - DNA, 25 bp, Homo sapien
cattgaccgaggacactctccaggg

SEQ ID NO: 102058 - DNA, 25 bp, Homo sapien
ctggcgtcctatacgcgctgagatc

SEQ ID NO: 102059 - DNA, 25 bp, Homo sapien
gcttggcgagtacgcccggctcgca

SEQ ID NO: 102060 - DNA, 25 bp, Homo sapien
gacttaaagctactggtgacagcca

SEQ ID NO: 102061 - DNA, 25 bp, Homo sapien
cgactacgagcaatttagagactta

SEQ ID NO: 102062 - DNA, 25 bp, Homo sapien
cctatacgcgctgagatccttcgac

SEQ ID NO: 102063 - DNA, 25 bp, Homo sapien
gcatcacttatgcattgaccgagga

SEQ ID NO: 102064 - DNA, 25 bp, Homo sapien
tcaactccaacactggcgtcctata

SEQ ID NO: 102065 - DNA, 25 bp, Homo sapien
cgccctgcgcctgcgacgttcctcc

SEQ ID NO: 102066 - DNA, 25 bp, Homo sapien
gattctagcgatcgccctgcgcctg

SEQ ID NO: 102067 - DNA, 25 bp, Homo sapien
ggtgattctagcgatcgccctgcgc

SEQ ID NO: 102068 - DNA, 25 bp, Homo sapien
gcggtgattctagcgatcgccctgc

SEQ ID NO: 102069 - DNA, 25 bp, Homo sapien
ctactctattctggccagtgacctg

SEQ ID NO: 102070 - DNA, 25 bp, Homo sapien
ggacccaacggcagagtctcctact

SEQ ID NO: 102071 - DNA, 25 bp, Homo sapien
ggcagagtctcctactctattctgg

SEQ ID NO: 102072 - DNA, 25 bp, Homo sapien
gtctcctactctattctggccagtg

SEQ ID NO: 102073 - DNA, 25 bp, Homo sapien
tggtggaaatcagggccgaacagat

SEQ ID NO: 102074 - DNA, 25 bp, Homo sapien
ggccgaacagattctctactcggtg

SEQ ID NO: 102075 - DNA, 25 bp, Homo sapien
ccagatctgccttctcctgggggtt

SEQ ID NO: 102076 - DNA, 25 bp, Homo sapien
tcagggccgaacagattctctactc

SEQ ID NO: 102077 - DNA, 25 bp, Homo sapien
acagagggaaaaccgaagcacaggc

SEQ ID NO: 102078 - DNA, 25 bp, Homo sapien
ctcagtggtgggcaacatcgccaag

SEQ ID NO: 102079 - DNA, 25 bp, Homo sapien
cagattctctactcggtgtttgagg

SEQ ID NO: 102080 - DNA, 25 bp, Homo sapien
ctcgcccagaccacacccggctgct

SEQ ID NO: 102081 - DNA, 25 bp, Homo sapien
tgctagcactcaagctgagacgctg

SEQ ID NO: 102082 - DNA, 25 bp, Homo sapien
actcaagctgagacgctggcacaag

SEQ ID NO: 102083 - DNA, 25 bp, Homo sapien
gactcgggcctcacactctatctcg

SEQ ID NO: 102084 - DNA, 25 bp, Homo sapien
ctgcgtcttcctggcttttgtcacg

SEQ ID NO: 102085 - DNA, 25 bp, Homo sapien
gcgtcttcctggcttttgtcacggt

SEQ ID NO: 102086 - DNA, 25 bp, Homo sapien
gcttttgtcacggtgctgctagcac

SEQ ID NO: 102087 - DNA, 25 bp, Homo sapien
gtcacggtgctgctagcactcaagc

SEQ ID NO: 102088 - DNA, 25 bp, Homo sapien
ggtgctgctagcactcaagctgaga

SEQ ID NO: 102089 - DNA, 25 bp, Homo sapien
gccgcgggagattttatcctacgtg

SEQ ID NO: 102090 - DNA, 25 bp, Homo sapien
ctgaagccgcgggagattttatcct

SEQ ID NO: 102091 - DNA, 25 bp, Homo sapien
tgaagccgcgggagattttatccta

SEQ ID NO: 102092 - DNA, 25 bp, Homo sapien
aagccgcgggagattttatcctacg

SEQ ID NO: 102093 - DNA, 25 bp, Homo sapien
cgcgggagattttatcctacgtgtc

SEQ ID NO: 102094 - DNA, 25 bp, Homo sapien
cgtagcgagcgacctgaagccgcgg

SEQ ID NO: 102095 - DNA, 25 bp, Homo sapien
cgggagattttatcctacgtgtccg

SEQ ID NO: 102096 - DNA, 25 bp, Homo sapien
ggagattttatcctacgtgtccgtg

SEQ ID NO: 102097 - DNA, 25 bp, Homo sapien
cgacatagactactcctacacatga

SEQ ID NO: 102098 - DNA, 25 bp, Homo sapien
tcctacacatgatgcccgcccaccc

SEQ ID NO: 102099 - DNA, 25 bp, Homo sapien
attggctacggcaccacgcggggct

SEQ ID NO: 102100 - DNA, 25 bp, Homo sapien
tggctacggcaccacgcggggctac

SEQ ID NO: 102101 - DNA, 25 bp, Homo sapien
ccgacatagactactcctacacatg

SEQ ID NO: 102102 - DNA, 25 bp, Homo sapien
catagactactcctacacatgatgc

SEQ ID NO: 102103 - DNA, 25 bp, Homo sapien
agactactcctacacatgatgcccg

SEQ ID NO: 102104 - DNA, 25 bp, Homo sapien
gggacggcggcatccccgacataga

SEQ ID NO: 102105 - DNA, 25 bp, Homo sapien
gtcggcaacatagccaaggaccttg

SEQ ID NO: 102106 - DNA, 25 bp, Homo sapien
ccactgtgtgtggtgaactttaaca

SEQ ID NO: 102107 - DNA, 25 bp, Homo sapien
cctagaccgcgagaaagagactgtt

SEQ ID NO: 102108 - DNA, 25 bp, Homo sapien
acacggttagtgcttcccttcgcgc

SEQ ID NO: 102109 - DNA, 25 bp, Homo sapien
cacagctttagatggcggagacccg

SEQ ID NO: 102110 - DNA, 25 bp, Homo sapien
tccgtgttacggtcctcgacgcaaa

SEQ ID NO: 102111 - DNA, 25 bp, Homo sapien
tgggtgtgaactctctccggagtta

SEQ ID NO: 102112 - DNA, 25 bp, Homo sapien
ctctctggatgtggtaagcggaact

SEQ ID NO: 102113 - DNA, 25 bp, Homo sapien
gggcgcccttgtcctcctatgtatc

SEQ ID NO: 102114 - DNA, 25 bp, Homo sapien
atgtatccattaactctgacaccgg

SEQ ID NO: 102115 - DNA, 25 bp, Homo sapien
cggtgtcctgtatgctctgagatcc

SEQ ID NO: 102116 - DNA, 25 bp, Homo sapien
accttcacggtcaccgttgccgtgg

SEQ ID NO: 102117 - DNA, 25 bp, Homo sapien
gatccctgacatcctggctgaccta

SEQ ID NO: 102118 - DNA, 25 bp, Homo sapien
ctggctgacctaggcagtatcaaga

SEQ ID NO: 102119 - DNA, 25 bp, Homo sapien
cattgaccctgaggatctggacctc

SEQ ID NO: 102120 - DNA, 25 bp, Homo sapien
ctggacctcacactctatcttgtgg

SEQ ID NO: 102121 - DNA, 25 bp, Homo sapien
cctgcgggttattgcagagaagaaa

SEQ ID NO: 102122 - DNA, 25 bp, Homo sapien
accgagaggagatttgtggcaagaa

SEQ ID NO: 102123 - DNA, 25 bp, Homo sapien
cgaccgtatagaccgagaggagatt

SEQ ID NO: 102124 - DNA, 25 bp, Homo sapien
acttgtgagcgaccgtatagaccga

SEQ ID NO: 102125 - DNA, 25 bp, Homo sapien
gagaagaaattctttaccgtgagcc

SEQ ID NO: 102126 - DNA, 25 bp, Homo sapien
cctactaggaacctgcgggttattg

SEQ ID NO: 102127 - DNA, 25 bp, Homo sapien
ctcgctggtagggaacctcgccaag

SEQ ID NO: 102128 - DNA, 25 bp, Homo sapien
aatgggaacttacttgtgagcgacc

SEQ ID NO: 102129 - DNA, 25 bp, Homo sapien
gtctcctactacatcgtggccagtg

SEQ ID NO: 102130 - DNA, 25 bp, Homo sapien
tacaccgtgcatgtagctgagaaca

SEQ ID NO: 102131 - DNA, 25 bp, Homo sapien
tagctgagaacaatccgcctggagc

SEQ ID NO: 102132 - DNA, 25 bp, Homo sapien
ccattgcgcatgtcagagcctcgga

SEQ ID NO: 102133 - DNA, 25 bp, Homo sapien
gacctaatggccttgtctcctacta

SEQ ID NO: 102134 - DNA, 25 bp, Homo sapien
ccgcaacgacaatgcaccgctggtg

SEQ ID NO: 102135 - DNA, 25 bp, Homo sapien
ctaccacattgtgcaggccagcgag

SEQ ID NO: 102136 - DNA, 25 bp, Homo sapien
tcggatcccgacttgggacctaatg

SEQ ID NO: 102137 - DNA, 25 bp, Homo sapien
ctgctcctcacgctcctggggacgc

SEQ ID NO: 102138 - DNA, 25 bp, Homo sapien
cgtcaaggatctgggactggagccc

SEQ ID NO: 102139 - DNA, 25 bp, Homo sapien
acatcgtcaaggatctgggactgga

SEQ ID NO: 102140 - DNA, 25 bp, Homo sapien
aggcaacatcgtcaaggatctggga

SEQ ID NO: 102141 - DNA, 25 bp, Homo sapien
tcgtaggcaacatcgtcaaggatct

SEQ ID NO: 102142 - DNA, 25 bp, Homo sapien
ggcagcgcagatccgctactctatt

SEQ ID NO: 102143 - DNA, 25 bp, Homo sapien
gcggcagcgcagatccgctactcta

SEQ ID NO: 102144 - DNA, 25 bp, Homo sapien
agaggcatccgcagcgcagcgagca

SEQ ID NO: 102145 - DNA, 25 bp, Homo sapien
gtgccgtacacacgcatgttgtgca

SEQ ID NO: 102146 - DNA, 25 bp, Homo sapien
ttgacgcccacgaagaccaccaggg

SEQ ID NO: 102147 - DNA, 25 bp, Homo sapien
agcttgttgacatacttgacgccca

SEQ ID NO: 102148 - DNA, 25 bp, Homo sapien
ccaggaagaccagcgccagcttgtt

SEQ ID NO: 102149 - DNA, 25 bp, Homo sapien
gcagacttgatgacgccggcataga

SEQ ID NO: 102150 - DNA, 25 bp, Homo sapien
atgtacgtctgtgggaacaaggccg

SEQ ID NO: 102151 - DNA, 25 bp, Homo sapien
tggacagcacgacgcaggccaggaa

SEQ ID NO: 102152 - DNA, 25 bp, Homo sapien
cacgagcgtgcacgtgccgtacaca

SEQ ID NO: 102153 - DNA, 25 bp, Homo sapien
ctccgacactgggattctgtacgcc

SEQ ID NO: 102154 - DNA, 25 bp, Homo sapien
cagcgagccaggacttttctcagtg

SEQ ID NO: 102155 - DNA, 25 bp, Homo sapien
ctcgcgtaagagtcatctgattttc

SEQ ID NO: 102156 - DNA, 25 bp, Homo sapien
tatgccgacacgcttatcaaccagg

SEQ ID NO: 102157 - DNA, 25 bp, Homo sapien
cgcttatcaaccaggagagctatga

SEQ ID NO: 102158 - DNA, 25 bp, Homo sapien
ttgaaacgaaaggagaacccaggca

SEQ ID NO: 102159 - DNA, 25 bp, Homo sapien
acccaggcaacttcaggtgagtttc

SEQ ID NO: 102160 - DNA, 25 bp, Homo sapien
aagtctcctactcactggcagaaga

SEQ ID NO: 102161 - DNA, 25 bp, Homo sapien
tctgaagcacttcccgagatcggcg

SEQ ID NO: 102162 - DNA, 25 bp, Homo sapien
cgagatcggcgcctaagcaagagaa

SEQ ID NO: 102163 - DNA, 25 bp, Homo sapien
caggacgactatggcggctcagccg

SEQ ID NO: 102164 - DNA, 25 bp, Homo sapien
aagcctgggcaggacgtattctcta

SEQ ID NO: 102165 - DNA, 25 bp, Homo sapien
gacgtattctctactccgtgtcgga

SEQ ID NO: 102166 - DNA, 25 bp, Homo sapien
ctccgtgtcggaggagacggacaaa

SEQ ID NO: 102167 - DNA, 25 bp, Homo sapien
ccgggaagagatctgcgctcagagt

SEQ ID NO: 102168 - DNA, 25 bp, Homo sapien
cggatacacccgcattctgaagcac

SEQ ID NO: 102169 - DNA, 25 bp, Homo sapien
cccgaagtcttggccgacctgggca

SEQ ID NO: 102170 - DNA, 25 bp, Homo sapien
cctccgacggtccttacaactatga

SEQ ID NO: 102171 - DNA, 25 bp, Homo sapien
gtccttacaactatgacctcacgtt

SEQ ID NO: 102172 - DNA, 25 bp, Homo sapien
ctatgacctcacgttgtacctggtg

SEQ ID NO: 102173 - DNA, 25 bp, Homo sapien
ctagccttcgtcctcgtactgctgg

SEQ ID NO: 102174 - DNA, 25 bp, Homo sapien
gtggcttggcgaacgtgcccacctc

SEQ ID NO: 102175 - DNA, 25 bp, Homo sapien
tcctctgtcagccaccgtcacactc

SEQ ID NO: 102176 - DNA, 25 bp, Homo sapien
agccttcgtcctcgtactgctggcg

SEQ ID NO: 102177 - DNA, 25 bp, Homo sapien
gaactggaactgcaactaaagtccg

SEQ ID NO: 102178 - DNA, 25 bp, Homo sapien
aattttttcttgaactggaactgca

SEQ ID NO: 102179 - DNA, 25 bp, Homo sapien
ttttttcttgaactggaactgcaac

SEQ ID NO: 102180 - DNA, 25 bp, Homo sapien
ttttcttgaactggaactgcaacta

SEQ ID NO: 102181 - DNA, 25 bp, Homo sapien
tttcttgaactggaactgcaactaa

SEQ ID NO: 102182 - DNA, 25 bp, Homo sapien
tcttgaactggaactgcaactaaag

SEQ ID NO: 102183 - DNA, 25 bp, Homo sapien
ttgaactggaactgcaactaaagtc

SEQ ID NO: 102184 - DNA, 25 bp, Homo sapien
agaattttttcttgaactggaactg

SEQ ID NO: 102185 - DNA, 25 bp, Homo sapien
agatccgctacaggattcccgagga

SEQ ID NO: 102186 - DNA, 25 bp, Homo sapien
ttcccgaggaaatgcccaagggctc

SEQ ID NO: 102187 - DNA, 25 bp, Homo sapien
ttcagcgtccaggagttaccgactc

SEQ ID NO: 102188 - DNA, 25 bp, Homo sapien
gttaccgactcgaaaactgcgcgtc

SEQ ID NO: 102189 - DNA, 25 bp, Homo sapien
tctccaggctggtgagcaagctgag

SEQ ID NO: 102190 - DNA, 25 bp, Homo sapien
gaagccttacttcaccgtgagcgca

SEQ ID NO: 102191 - DNA, 25 bp, Homo sapien
cggcgctctgtgagcagatccgcta

SEQ ID NO: 102192 - DNA, 25 bp, Homo sapien
actgcgcgtcagttcggagaagcct

SEQ ID NO: 102193 - DNA, 25 bp, Homo sapien
gcgcctggtggtgctattttcaaac

SEQ ID NO: 102194 - DNA, 25 bp, Homo sapien
gtcactgtgccgcttgttctgcgcc

SEQ ID NO: 102195 - DNA, 25 bp, Homo sapien
tgctattttcaaacggcctccacca

SEQ ID NO: 102196 - DNA, 25 bp, Homo sapien
ctccaccaccgtgcgaaaagcaaag

SEQ ID NO: 102197 - DNA, 25 bp, Homo sapien
gcccgggtcaccatctgtcactgtg

SEQ ID NO: 102198 - DNA, 25 bp, Homo sapien
cgtgcgaaaagcaaaggcagaagca

SEQ ID NO: 102199 - DNA, 25 bp, Homo sapien
acgtgcctgcgtcccagtactcagg

SEQ ID NO: 102200 - DNA, 25 bp, Homo sapien
gaacgtcaaagaggagatgctggtc

SEQ ID NO: 102201 - DNA, 25 bp, Homo sapien
tacgtgtccataagcgcggagagcg

SEQ ID NO: 102202 - DNA, 25 bp, Homo sapien
ctggtcttcgccgacagcttgcagg

SEQ ID NO: 102203 - DNA, 25 bp, Homo sapien
gcacctggtcttcgccgacagcttg

SEQ ID NO: 102204 - DNA, 25 bp, Homo sapien
acgttgcacctggtcttcgccgaca

SEQ ID NO: 102205 - DNA, 25 bp, Homo sapien
catcctacgtgtccataagcgcgga

SEQ ID NO: 102206 - DNA, 25 bp, Homo sapien
tgtcatcctacgtgtccataagcgc

SEQ ID NO: 102207 - DNA, 25 bp, Homo sapien
agctgtcatcctacgtgtccataag

SEQ ID NO: 102208 - DNA, 25 bp, Homo sapien
ttgcacctggtcttcgccgacagct

SEQ ID NO: 102209 - DNA, 25 bp, Homo sapien
tgccagaagagacggacaaaggctc

SEQ ID NO: 102210 - DNA, 25 bp, Homo sapien
cagaagagacggacaaaggctcctt

SEQ ID NO: 102211 - DNA, 25 bp, Homo sapien
tactctgtgccagaagagacggaca

SEQ ID NO: 102212 - DNA, 25 bp, Homo sapien
agattcgctactctgtgccagaaga

SEQ ID NO: 102213 - DNA, 25 bp, Homo sapien
aggggacagattcgctactctgtgc

SEQ ID NO: 102214 - DNA, 25 bp, Homo sapien
aaatcgggaggggacagattcgcta

SEQ ID NO: 102215 - DNA, 25 bp, Homo sapien
agacgcggcgagctgatcctgctgt

SEQ ID NO: 102216 - DNA, 25 bp, Homo sapien
caaaggctccttcgtgggtaatatc

SEQ ID NO: 102217 - DNA, 25 bp, Homo sapien
ttgggcagtctgaagccttcggtcg

SEQ ID NO: 102218 - DNA, 25 bp, Homo sapien
tcctcgtatatctccatcaactctg

SEQ ID NO: 102219 - DNA, 25 bp, Homo sapien
gcaatctttcgactatgagcagatc

SEQ ID NO: 102220 - DNA, 25 bp, Homo sapien
tgagcagatccgagacctgcagcta

SEQ ID NO: 102221 - DNA, 25 bp, Homo sapien
gacctgcagctactggtaacagcca

SEQ ID NO: 102222 - DNA, 25 bp, Homo sapien
cccgaagtcctgaccgagttgggca

SEQ ID NO: 102223 - DNA, 25 bp, Homo sapien
tcctgaccgagttgggcagtctgaa

SEQ ID NO: 102224 - DNA, 25 bp, Homo sapien
tgaagccttcggtcgacccgaacga

SEQ ID NO: 102225 - DNA, 25 bp, Homo sapien
tttccaccaggcgtcctacttagtc

SEQ ID NO: 102226 - DNA, 25 bp, Homo sapien
tacgtgtccatgagcgcgcaaagtg

SEQ ID NO: 102227 - DNA, 25 bp, Homo sapien
tacttagtcagtgtacccgaaaaca

SEQ ID NO: 102228 - DNA, 25 bp, Homo sapien
caagtctgcgcctcggacctggact

SEQ ID NO: 102229 - DNA, 25 bp, Homo sapien
aagtctcctactctatcatggccag

SEQ ID NO: 102230 - DNA, 25 bp, Homo sapien
tcatggccagcgacctagagcctct

SEQ ID NO: 102231 - DNA, 25 bp, Homo sapien
tggggcctccatcgcgcaagtctgc

SEQ ID NO: 102232 - DNA, 25 bp, Homo sapien
ggcactggcctcttacgtgtccatg

SEQ ID NO: 102233 - DNA, 25 bp, Homo sapien
ctgtcccgcacggagcctctgggcg

SEQ ID NO: 102234 - DNA, 25 bp, Homo sapien
atgaaaaaccgggctgctgtcccgc

SEQ ID NO: 102235 - DNA, 25 bp, Homo sapien
tttcccagcacagcggattgccagc

SEQ ID NO: 102236 - DNA, 25 bp, Homo sapien
aatgaaaaaccgggctgctgtcccg

SEQ ID NO: 102237 - DNA, 25 bp, Homo sapien
tgctgtcccgcacggagcctctggg

SEQ ID NO: 102238 - DNA, 25 bp, Homo sapien
gctgctgtcccgcacggagcctctg

SEQ ID NO: 102239 - DNA, 25 bp, Homo sapien
ctgctgtcccgcacggagcctctgg

SEQ ID NO: 102240 - DNA, 25 bp, Homo sapien
gctgtcccgcacggagcctctgggc

SEQ ID NO: 102241 - DNA, 25 bp, Homo sapien
attgccagctccgagacccgggact

SEQ ID NO: 102242 - DNA, 25 bp, Homo sapien
ggattccctgcgcagccaacaacag

SEQ ID NO: 102243 - DNA, 25 bp, Homo sapien
gtagagtgcactttctccaactgga

SEQ ID NO: 102244 - DNA, 25 bp, Homo sapien
cagcgagaacccgagcgaacgatgg

SEQ ID NO: 102245 - DNA, 25 bp, Homo sapien
tgagccgatccgctactcgattccg

SEQ ID NO: 102246 - DNA, 25 bp, Homo sapien
tggggaacctcgctaaggatctagg

SEQ ID NO: 102247 - DNA, 25 bp, Homo sapien
cgcggagaagctgcacttcagcgta

SEQ ID NO: 102248 - DNA, 25 bp, Homo sapien
ccgaatgctcttttagcgcggtaga

SEQ ID NO: 102249 - DNA, 25 bp, Homo sapien
atggagacgcttccacggtgaactc

SEQ ID NO: 102250 - DNA, 25 bp, Homo sapien
agcagaggccgacagcgcctccaaa

SEQ ID NO: 102251 - DNA, 25 bp, Homo sapien
ccagcgagcgcgatatcatgtagta

SEQ ID NO: 102252 - DNA, 25 bp, Homo sapien
atcatgtagtaggacccgccagctg

SEQ ID NO: 102253 - DNA, 25 bp, Homo sapien
gtctgcgctgccattcacgggcaaa

SEQ ID NO: 102254 - DNA, 25 bp, Homo sapien
ccattcacgggcaaaggagggcctg

SEQ ID NO: 102255 - DNA, 25 bp, Homo sapien
aaggcagcgtgtagaccctcgtcca

SEQ ID NO: 102256 - DNA, 25 bp, Homo sapien
ccacccgcaaagcagcacatggaga

SEQ ID NO: 102257 - DNA, 25 bp, Homo sapien
tttggggctcaatggccacatctcc

SEQ ID NO: 102258 - DNA, 25 bp, Homo sapien
ccattgcgcaagtgagcgcctctga

SEQ ID NO: 102259 - DNA, 25 bp, Homo sapien
agttttcgaccagacgtcctacgtg

SEQ ID NO: 102260 - DNA, 25 bp, Homo sapien
ctactctatagtggcgagtgaccta

SEQ ID NO: 102261 - DNA, 25 bp, Homo sapien
gcggtgtcgtcatacgtgtcagtga

SEQ ID NO: 102262 - DNA, 25 bp, Homo sapien
tgggagaccgcaatgacaacgcacc

SEQ ID NO: 102263 - DNA, 25 bp, Homo sapien
tccgcgttcttcgatatggtacctc

SEQ ID NO: 102264 - DNA, 25 bp, Homo sapien
cgcacggctcgagccttaggcgaca

SEQ ID NO: 102265 - DNA, 25 bp, Homo sapien
cccattggttccagtgagttttatt

SEQ ID NO: 102266 - DNA, 25 bp, Homo sapien
ggggtacctctgtcctcatacatat

SEQ ID NO: 102267 - DNA, 25 bp, Homo sapien
atccatcaactcagacactggcgtc

SEQ ID NO: 102268 - DNA, 25 bp, Homo sapien
ctggcgtcctgtatgcactcagatc

SEQ ID NO: 102269 - DNA, 25 bp, Homo sapien
cagtttcatgagctacagatgcagg

SEQ ID NO: 102270 - DNA, 25 bp, Homo sapien
cttgacaggtgtgtccggctcgcac

SEQ ID NO: 102271 - DNA, 25 bp, Homo sapien
tcgaagtttcctatagaggataccc

SEQ ID NO: 102272 - DNA, 25 bp, Homo sapien
gctgtgagaaaaacgatcctttgtc

SEQ ID NO: 102273 - DNA, 25 bp, Homo sapien
tcgcccacagcgatgcgcgctagag

SEQ ID NO: 102274 - DNA, 25 bp, Homo sapien
ccagaatcctgcacagccggggaga

SEQ ID NO: 102275 - DNA, 25 bp, Homo sapien
cccagagttggaagagccttagggc

SEQ ID NO: 102276 - DNA, 25 bp, Homo sapien
tgagatcctgatgcggaacccgacg

SEQ ID NO: 102277 - DNA, 25 bp, Homo sapien
agaagaagccgcgttcgggctcgcc

SEQ ID NO: 102278 - DNA, 25 bp, Homo sapien
gcgatcggctggcagatgacgattc

SEQ ID NO: 102279 - DNA, 25 bp, Homo sapien
cagatgacgattcgccgagctcgcc

SEQ ID NO: 102280 - DNA, 25 bp, Homo sapien
ccagaatggggagcatgagatcctg

SEQ ID NO: 102281 - DNA, 25 bp, Homo sapien
atgggcccacgcactcgtatacaca

SEQ ID NO: 102282 - DNA, 25 bp, Homo sapien
ctcggccgcctctaactttctggtt

SEQ ID NO: 102283 - DNA, 25 bp, Homo sapien
agtgtctctcccttatttactctgg

SEQ ID NO: 102284 - DNA, 25 bp, Homo sapien
tccgcccacttggactctatttacg

SEQ ID NO: 102285 - DNA, 25 bp, Homo sapien
acatttcgcctccttccagtcggtg

SEQ ID NO: 102286 - DNA, 25 bp, Homo sapien
ctatttacggcgctcgggagtgtct

SEQ ID NO: 102287 - DNA, 25 bp, Homo sapien
ccggacagtcggctctgtagagaca

SEQ ID NO: 102288 - DNA, 25 bp, Homo sapien
ctaactttctggttggctgagcgtc

SEQ ID NO: 102289 - DNA, 25 bp, Homo sapien
tgctttgggtgacaaggactcggtc

SEQ ID NO: 102290 - DNA, 25 bp, Homo sapien
gcgacctggagtcacgaacgctgtc

SEQ ID NO: 102291 - DNA, 25 bp, Homo sapien
tactctctcattgccagcgacctgg

SEQ ID NO: 102292 - DNA, 25 bp, Homo sapien
cagacttcgggctcaacggccgtgt

SEQ ID NO: 102293 - DNA, 25 bp, Homo sapien
ggtgcctccatagcgcaagtcagtg

SEQ ID NO: 102294 - DNA, 25 bp, Homo sapien
ggtccacgtgccagaaaacaaccag

SEQ ID NO: 102295 - DNA, 25 bp, Homo sapien
caacgcgccggttttcggacagtca

SEQ ID NO: 102296 - DNA, 25 bp, Homo sapien
acagtcagcctacctggtccacgtg

SEQ ID NO: 102297 - DNA, 25 bp, Homo sapien
cgagaaaccgcggaatatcggctta

SEQ ID NO: 102298 - DNA, 25 bp, Homo sapien
agagaccgaaaagggctccttcgtg

SEQ ID NO: 102299 - DNA, 25 bp, Homo sapien
cctgccatggcgaatcggctacagc

SEQ ID NO: 102300 - DNA, 25 bp, Homo sapien
ttccgggccaggcagatccgatatt

SEQ ID NO: 102301 - DNA, 25 bp, Homo sapien
ccgatattcggtgccagaagagacc

SEQ ID NO: 102302 - DNA, 25 bp, Homo sapien
acagcttttcgctgtgaatccgcga

SEQ ID NO: 102303 - DNA, 25 bp, Homo sapien
ctccagagggaagacacagcttttc

SEQ ID NO: 102304 - DNA, 25 bp, Homo sapien
atatcggcttagagcctgccatggc

SEQ ID NO: 102305 - DNA, 25 bp, Homo sapien
tcagacctctcgctgtacttggtgg

SEQ ID NO: 102306 - DNA, 25 bp, Homo sapien
actgagagtgatagcacgtgacagc

SEQ ID NO: 102307 - DNA, 25 bp, Homo sapien
actatgagcagtttcgagacttaga

SEQ ID NO: 102308 - DNA, 25 bp, Homo sapien
gccctggtcacttactctctgacgg

SEQ ID NO: 102309 - DNA, 25 bp, Homo sapien
tctctgacggatgacactgtccagg

SEQ ID NO: 102310 - DNA, 25 bp, Homo sapien
ctctattaactccaacactggtgtt

SEQ ID NO: 102311 - DNA, 25 bp, Homo sapien
atgccctacaatccttcgactatga

SEQ ID NO: 102312 - DNA, 25 bp, Homo sapien
acactggtgttctctatgccctaca

SEQ ID NO: 102313 - DNA, 25 bp, Homo sapien
cacacgggaacctgctggttgctgt

SEQ ID NO: 102314 - DNA, 25 bp, Homo sapien
gccgctacgcttcacctagtcttcg

SEQ ID NO: 102315 - DNA, 25 bp, Homo sapien
ctgcacacgggaacctgctggttgc

SEQ ID NO: 102316 - DNA, 25 bp, Homo sapien
ggctgcacacgggaacctgctggtt

SEQ ID NO: 102317 - DNA, 25 bp, Homo sapien
cgatggctccgcactcttcgatata

SEQ ID NO: 102318 - DNA, 25 bp, Homo sapien
tctgcgccgctacgcttcacctagt

SEQ ID NO: 102319 - DNA, 25 bp, Homo sapien
gcgccaacatgagccggcgcatgtt

SEQ ID NO: 102320 - DNA, 25 bp, Homo sapien
tcagcgccaacatgagccggcgcat

SEQ ID NO: 102321 - DNA, 25 bp, Homo sapien
accacgaggagtcaggattctacca

SEQ ID NO: 102322 - DNA, 25 bp, Homo sapien
tcaacgctaccgaccctgacgaagg

SEQ ID NO: 102323 - DNA, 25 bp, Homo sapien
cagatcacttattccctggctgaga

SEQ ID NO: 102324 - DNA, 25 bp, Homo sapien
gcgagccaaagtcctgatcactgtt

SEQ ID NO: 102325 - DNA, 25 bp, Homo sapien
ggttcctagctacaacatcacagtg

SEQ ID NO: 102326 - DNA, 25 bp, Homo sapien
acgcagctgcttgtagtcaacgcta

SEQ ID NO: 102327 - DNA, 25 bp, Homo sapien
cccgactgtgaagagaacgcccaga

SEQ ID NO: 102328 - DNA, 25 bp, Homo sapien
ggggcaagcctatcgtcctacgtgt

SEQ ID NO: 102329 - DNA, 25 bp, Homo sapien
tggacgacctgaatgacaacgcacc

SEQ ID NO: 102330 - DNA, 25 bp, Homo sapien
ctcttcagcctggaatgcgcaccga

SEQ ID NO: 102331 - DNA, 25 bp, Homo sapien
tgacagctcgcacgatgggccacag

SEQ ID NO: 102332 - DNA, 25 bp, Homo sapien
tgggccacaggaaagcgactcgcca

SEQ ID NO: 102333 - DNA, 25 bp, Homo sapien
gcacagtgcgccttcgaccaagagc

SEQ ID NO: 102334 - DNA, 25 bp, Homo sapien
tgtgagacacaatgcgtggctgtcc

SEQ ID NO: 102335 - DNA, 25 bp, Homo sapien
gctgtagacgcagatgtgagacaca

SEQ ID NO: 102336 - DNA, 25 bp, Homo sapien
agcgcaatggcttcgcgctcttgga

SEQ ID NO: 102337 - DNA, 25 bp, Homo sapien
tgcgcctgtcttcaaccagtccttg

SEQ ID NO: 102338 - DNA, 25 bp, Homo sapien
tgggacactgccctcttgcactgta

SEQ ID NO: 102339 - DNA, 25 bp, Homo sapien
acgcgcgtggtacaagtccttgcaa

SEQ ID NO: 102340 - DNA, 25 bp, Homo sapien
ctggagctagccgaagattctttga

SEQ ID NO: 102341 - DNA, 25 bp, Homo sapien
aggcttccacggtcattcactatga

SEQ ID NO: 102342 - DNA, 25 bp, Homo sapien
tgcttctgcttggtgccttgaacaa

SEQ ID NO: 102343 - DNA, 25 bp, Homo sapien
gcgctaacccgctgaaagtttctca

SEQ ID NO: 102344 - DNA, 25 bp, Homo sapien
cccgctgagaggaactgcttttgag

SEQ ID NO: 102345 - DNA, 25 bp, Homo sapien
aggggtcctaatggacgcggccatc

SEQ ID NO: 102346 - DNA, 25 bp, Homo sapien
tcgtgaagcagagactggtcccttg

SEQ ID NO: 102347 - DNA, 25 bp, Homo sapien
cgtctcgtgtactgtgaaccacgca

SEQ ID NO: 102348 - DNA, 25 bp, Homo sapien
acgcggccatcgtgaagcagagact

SEQ ID NO: 102349 - DNA, 25 bp, Homo sapien
ctgctctgagcagtgcgtgtggcat

SEQ ID NO: 102350 - DNA, 25 bp, Homo sapien
cgcacgctatcactggcgggaaagc

SEQ ID NO: 102351 - DNA, 25 bp, Homo sapien
gtactgtgaaccacgcacgctatca

SEQ ID NO: 102352 - DNA, 25 bp, Homo sapien
agcagagactggtcccttggctgcg

SEQ ID NO: 102353 - DNA, 25 bp, Homo sapien
gaaacctggtgcagccagtccactg

SEQ ID NO: 102354 - DNA, 25 bp, Homo sapien
cccggtgagctcactgtaccgaaca

SEQ ID NO: 102355 - DNA, 25 bp, Homo sapien
gagctcactgtaccgaacaccaggg

SEQ ID NO: 102356 - DNA, 25 bp, Homo sapien
gaggcctgatgtcgccgcaccttta

SEQ ID NO: 102357 - DNA, 25 bp, Homo sapien
cgccgcacctttaccatcaggtgta

SEQ ID NO: 102358 - DNA, 25 bp, Homo sapien
gccagaacacgctgcggagctgtga

SEQ ID NO: 102359 - DNA, 25 bp, Homo sapien
tcaggtgtatctcaccacggactcc

SEQ ID NO: 102360 - DNA, 25 bp, Homo sapien
gctgctgaagaaacctggtgcagcc

SEQ ID NO: 102361 - DNA, 25 bp, Homo sapien
catccgcgtctcaggagcaagtaga

SEQ ID NO: 102362 - DNA, 25 bp, Homo sapien
tggtgaaaggcagacaaatctaccc

SEQ ID NO: 102363 - DNA, 25 bp, Homo sapien
ctcaggagcaagtagagaattagcg

SEQ ID NO: 102364 - DNA, 25 bp, Homo sapien
aagggagataggtgtctccagctgc

SEQ ID NO: 102365 - DNA, 25 bp, Homo sapien
gccaccagcaaaaacggcgcgtaac

SEQ ID NO: 102366 - DNA, 25 bp, Homo sapien
cgggtggtgaaaggcagacaaatct

SEQ ID NO: 102367 - DNA, 25 bp, Homo sapien
cgctgtctgccaatcgggtggtgaa

SEQ ID NO: 102368 - DNA, 25 bp, Homo sapien
ggcgggtcggcttcatccgcgtctc

SEQ ID NO: 102369 - DNA, 25 bp, Homo sapien
cgcggctacgattggcagtgcaaaa

SEQ ID NO: 102370 - DNA, 25 bp, Homo sapien
aatccgtgtcgcagaagttcgctcc

SEQ ID NO: 102371 - DNA, 25 bp, Homo sapien
gcagccggtactcccatatatcagg

SEQ ID NO: 102372 - DNA, 25 bp, Homo sapien
cccggccttttgaagggcagcgatt

SEQ ID NO: 102373 - DNA, 25 bp, Homo sapien
tcagcgcaaagagttggcaaccctc

SEQ ID NO: 102374 - DNA, 25 bp, Homo sapien
ccgcccaattggaatcgctctcatt

SEQ ID NO: 102375 - DNA, 25 bp, Homo sapien
gctctcattctgaaggcggttccga

SEQ ID NO: 102376 - DNA, 25 bp, Homo sapien
tcccggtagcttctagtaggttcca

SEQ ID NO: 102377 - DNA, 25 bp, Homo sapien
tcattggaccgtttgcgcgaaacca

SEQ ID NO: 102378 - DNA, 25 bp, Homo sapien
gccgcccgtcctcataagggattga

SEQ ID NO: 102379 - DNA, 25 bp, Homo sapien
gcctccttcgagcttccggtgaatt

SEQ ID NO: 102380 - DNA, 25 bp, Homo sapien
acgcttcgccggtctgtagatttcc

SEQ ID NO: 102381 - DNA, 25 bp, Homo sapien
tgtgacttcactgttaccctcccta

SEQ ID NO: 102382 - DNA, 25 bp, Homo sapien
tgggcttacgcgaataccagctttc

SEQ ID NO: 102383 - DNA, 25 bp, Homo sapien
tcgcggccagattcacaggcctgtt

SEQ ID NO: 102384 - DNA, 25 bp, Homo sapien
agtactcgtagctgattgtgcgcgc

SEQ ID NO: 102385 - DNA, 25 bp, Homo sapien
gactaaaattgcctacccgaagcgc

SEQ ID NO: 102386 - DNA, 25 bp, Homo sapien
cttcacgggaggagggtagactctc

SEQ ID NO: 102387 - DNA, 25 bp, Homo sapien
gaggagggtagactctcctttgccc

SEQ ID NO: 102388 - DNA, 25 bp, Homo sapien
tgcgggaggtgattcttccaaagcc

SEQ ID NO: 102389 - DNA, 25 bp, Homo sapien
tcttccaaagccaagtctgcagctc

SEQ ID NO: 102390 - DNA, 25 bp, Homo sapien
tggaattcgccttcccgctgacatc

SEQ ID NO: 102391 - DNA, 25 bp, Homo sapien
caagtctgcagctcgagcctcagtt

SEQ ID NO: 102392 - DNA, 25 bp, Homo sapien
cttcctgactaaaattgcctacccg

SEQ ID NO: 102393 - DNA, 25 bp, Homo sapien
aatttcttagatttgccgccgtcgc

SEQ ID NO: 102394 - DNA, 25 bp, Homo sapien
tgcccagcggacctaaccattcgga

SEQ ID NO: 102395 - DNA, 25 bp, Homo sapien
ggaagcgcgctacctgcccagcgga

SEQ ID NO: 102396 - DNA, 25 bp, Homo sapien
gaagccgcggaagcgcgctacctgc

SEQ ID NO: 102397 - DNA, 25 bp, Homo sapien
tgaatatacaacgacgacgcctcgc

SEQ ID NO: 102398 - DNA, 25 bp, Homo sapien
ccgccgagggcagctcatctgggct

SEQ ID NO: 102399 - DNA, 25 bp, Homo sapien
agggacactcacaaatttcttagat

SEQ ID NO: 102400 - DNA, 25 bp, Homo sapien
ctgcgcgcgcctcatgaatatacaa

SEQ ID NO: 102401 - DNA, 25 bp, Homo sapien
cccagccctcggagaagattcctga

SEQ ID NO: 102402 - DNA, 25 bp, Homo sapien
cagggaactggcagcatagctccta

SEQ ID NO: 102403 - DNA, 25 bp, Homo sapien
ggcgtaccggatagaccagtggaca

SEQ ID NO: 102404 - DNA, 25 bp, Homo sapien
tctcccggtatctggggctttgagc

SEQ ID NO: 102405 - DNA, 25 bp, Homo sapien
caggccgtggtcacttctctaggaa

SEQ ID NO: 102406 - DNA, 25 bp, Homo sapien
agaatgccgtcccatctcgtgctgc

SEQ ID NO: 102407 - DNA, 25 bp, Homo sapien
ctcctaggatgcgagggccatttgt

SEQ ID NO: 102408 - DNA, 25 bp, Homo sapien
tctctaggaagctccgaagatcccg

SEQ ID NO: 102409 - DNA, 25 bp, Homo sapien
tggactccggaactggaggaagccc

SEQ ID NO: 102410 - DNA, 25 bp, Homo sapien
acctgttactgctgcgaatacgccg

SEQ ID NO: 102411 - DNA, 25 bp, Homo sapien
gcccacgacttgtccggcgacgtcg

SEQ ID NO: 102412 - DNA, 25 bp, Homo sapien
ctgctgcgaatacgccggcagggtc

SEQ ID NO: 102413 - DNA, 25 bp, Homo sapien
ggtcagccactggactccggaactg

SEQ ID NO: 102414 - DNA, 25 bp, Homo sapien
cagcaaggcggtcagccactggact

SEQ ID NO: 102415 - DNA, 25 bp, Homo sapien
atctccgctccagcaaggcggtcag

SEQ ID NO: 102416 - DNA, 25 bp, Homo sapien
caccgagaaactaaacctgttactg

SEQ ID NO: 102417 - DNA, 25 bp, Homo sapien
cgtgactttggtgcaagcagccgca

SEQ ID NO: 102418 - DNA, 25 bp, Homo sapien
gacgctctccctgatttctgcatca

SEQ ID NO: 102419 - DNA, 25 bp, Homo sapien
ctctgtccgtggacacaggtctcca

SEQ ID NO: 102420 - DNA, 25 bp, Homo sapien
aggaaagggcgcgttcccacatatg

SEQ ID NO: 102421 - DNA, 25 bp, Homo sapien
gagtctgcaagctggcgtgactttg

SEQ ID NO: 102422 - DNA, 25 bp, Homo sapien
tgcccactcagacagccgactgttg

SEQ ID NO: 102423 - DNA, 25 bp, Homo sapien
tccggaagaccgcaggtccctatgc

SEQ ID NO: 102424 - DNA, 25 bp, Homo sapien
cacatatgtccactagatggcgccc

SEQ ID NO: 102425 - DNA, 25 bp, Homo sapien
gcgagaactctctgtgcgcttcaga

SEQ ID NO: 102426 - DNA, 25 bp, Homo sapien
ccaaccacagggctttagggaaatg

SEQ ID NO: 102427 - DNA, 25 bp, Homo sapien
gtgcgcttcagacccgtggggaaac

SEQ ID NO: 102428 - DNA, 25 bp, Homo sapien
ggagcgcggtacagacaaacacagg

SEQ ID NO: 102429 - DNA, 25 bp, Homo sapien
ctttagggaaatgcccgctgccctg

SEQ ID NO: 102430 - DNA, 25 bp, Homo sapien
tttgcgaacagatgcgagaactctc

SEQ ID NO: 102431 - DNA, 25 bp, Homo sapien
caggctgcttttctcgcccgaaaga

SEQ ID NO: 102432 - DNA, 25 bp, Homo sapien
agcctcgagtcagggtttgcgaaca

SEQ ID NO: 102433 - DNA, 25 bp, Homo sapien
ggccctgcctgtgtggatagcgccc

SEQ ID NO: 102434 - DNA, 25 bp, Homo sapien
tgccgcaggcatcccgcgactggaa

SEQ ID NO: 102435 - DNA, 25 bp, Homo sapien
gccctaggcactgcagacgcgcggt

SEQ ID NO: 102436 - DNA, 25 bp, Homo sapien
taataacagccacaaccgagcggga

SEQ ID NO: 102437 - DNA, 25 bp, Homo sapien
caaccgagcgggaaaccgcttgcca

SEQ ID NO: 102438 - DNA, 25 bp, Homo sapien
gggaaaccgcttgccactcttctgt

SEQ ID NO: 102439 - DNA, 25 bp, Homo sapien
tggctcggccagtaaaggccctcct

SEQ ID NO: 102440 - DNA, 25 bp, Homo sapien
ggccgacatctcctccttaataaaa

SEQ ID NO: 102441 - DNA, 25 bp, Homo sapien
tacctgggaccacaccgttggtagc

SEQ ID NO: 102442 - DNA, 25 bp, Homo sapien
ggtagcgatcgcactcatggaaatg

SEQ ID NO: 102443 - DNA, 25 bp, Homo sapien
cgttggtagcgatcgcactcatgga

SEQ ID NO: 102444 - DNA, 25 bp, Homo sapien
gaccacaccgttggtagcgatcgca

SEQ ID NO: 102445 - DNA, 25 bp, Homo sapien
cacaccgttggtagcgatcgcactc

SEQ ID NO: 102446 - DNA, 25 bp, Homo sapien
tgggaccacaccgttggtagcgatc

SEQ ID NO: 102447 - DNA, 25 bp, Homo sapien
agcgatcgcactcatggaaatggcg

SEQ ID NO: 102448 - DNA, 25 bp, Homo sapien
accgttggtagcgatcgcactcatg

SEQ ID NO: 102449 - DNA, 25 bp, Homo sapien
cgggtctctccgaaagcagcaagga

SEQ ID NO: 102450 - DNA, 25 bp, Homo sapien
ccgattaataccagtgcgggtctca

SEQ ID NO: 102451 - DNA, 25 bp, Homo sapien
ctatcctcagaacgcgtcagctcga

SEQ ID NO: 102452 - DNA, 25 bp, Homo sapien
tcctgcacctgagttcttgcgggga

SEQ ID NO: 102453 - DNA, 25 bp, Homo sapien
atacacccgggaacgactgcacgtc

SEQ ID NO: 102454 - DNA, 25 bp, Homo sapien
aaccctcgttcctgagcgtgggaga

SEQ ID NO: 102455 - DNA, 25 bp, Homo sapien
atccgggtttacacgaggctcatcc

SEQ ID NO: 102456 - DNA, 25 bp, Homo sapien
agatttagctcccactctccacggg

SEQ ID NO: 102457 - DNA, 25 bp, Homo sapien
atgaggttcacacggtgcagccgca

SEQ ID NO: 102458 - DNA, 25 bp, Homo sapien
cgccgctgcagagcgatgaggttca

SEQ ID NO: 102459 - DNA, 25 bp, Homo sapien
atctccaccgtgtcagagggctcgg

SEQ ID NO: 102460 - DNA, 25 bp, Homo sapien
agcccgtgcagctcaggacccaaag

SEQ ID NO: 102461 - DNA, 25 bp, Homo sapien
cccaccttgtttcggggcaggcact

SEQ ID NO: 102462 - DNA, 25 bp, Homo sapien
caggcactgcagcaggacctgctca

SEQ ID NO: 102463 - DNA, 25 bp, Homo sapien
gctcgaaggccgcaaagaactcttc

SEQ ID NO: 102464 - DNA, 25 bp, Homo sapien
gcaaagaactcttcgccctcgaaca

SEQ ID NO: 102465 - DNA, 25 bp, Homo sapien
ctcctcggtcctggtaaggcacgaa

SEQ ID NO: 102466 - DNA, 25 bp, Homo sapien
ggatttcctccaaggtggccgagtc

SEQ ID NO: 102467 - DNA, 25 bp, Homo sapien
gggctcacaggtagatctcgcgctt

SEQ ID NO: 102468 - DNA, 25 bp, Homo sapien
gtccttgcaggaatcatggctactg

SEQ ID NO: 102469 - DNA, 25 bp, Homo sapien
gtagatctcgcgcttggccgtctgg

SEQ ID NO: 102470 - DNA, 25 bp, Homo sapien
ttcctccaaggtggccgagtccttg

SEQ ID NO: 102471 - DNA, 25 bp, Homo sapien
agtttgagggcgctgctcttggtcc

SEQ ID NO: 102472 - DNA, 25 bp, Homo sapien
catggctactgtgggagaaggcact

SEQ ID NO: 102473 - DNA, 25 bp, Homo sapien
agacccaggtggctcagaaaactca

SEQ ID NO: 102474 - DNA, 25 bp, Homo sapien
gggtcgcaatcaccgtcccaggcta

SEQ ID NO: 102475 - DNA, 25 bp, Homo sapien
agccttcccgctgtgccgatattta

SEQ ID NO: 102476 - DNA, 25 bp, Homo sapien
tcctgcctgaatctggactccgaga

SEQ ID NO: 102477 - DNA, 25 bp, Homo sapien
aggcgctgctgtaggtgccaattcc

SEQ ID NO: 102478 - DNA, 25 bp, Homo sapien
gtgctgtgtacctatgttctggcca

SEQ ID NO: 102479 - DNA, 25 bp, Homo sapien
cacccggttgtgttattgctctgta

SEQ ID NO: 102480 - DNA, 25 bp, Homo sapien
ttcctgtgttagagtgtgtgccatc

SEQ ID NO: 102481 - DNA, 25 bp, Homo sapien
agtgtcacggcctgtgtcacacgcc

SEQ ID NO: 102482 - DNA, 25 bp, Homo sapien
acgtatttgccagtgacttacatta

SEQ ID NO: 102483 - DNA, 25 bp, Homo sapien
gatggggaagatacacaagcgtgaa

SEQ ID NO: 102484 - DNA, 25 bp, Homo sapien
caagcgtgaagacgaagtgctgctc

SEQ ID NO: 102485 - DNA, 25 bp, Homo sapien
ctgctcctgagcttaggctattcga

SEQ ID NO: 102486 - DNA, 25 bp, Homo sapien
ctgccctctgcacggcgtagtgctg

SEQ ID NO: 102487 - DNA, 25 bp, Homo sapien
gtgctgcggccacacgtatttgcca

SEQ ID NO: 102488 - DNA, 25 bp, Homo sapien
ttacattatacagtcaccgggtccc

SEQ ID NO: 102489 - DNA, 25 bp, Homo sapien
ggaccgctgattcgcctaggtgcca

SEQ ID NO: 102490 - DNA, 25 bp, Homo sapien
cgctgattcgcctaggtgccatcgg

SEQ ID NO: 102491 - DNA, 25 bp, Homo sapien
ctcgggtcctgacggaccgctgatt

SEQ ID NO: 102492 - DNA, 25 bp, Homo sapien
ctccggagaaccatttctgggaccg

SEQ ID NO: 102493 - DNA, 25 bp, Homo sapien
gctggactccggagaaccatttctg

SEQ ID NO: 102494 - DNA, 25 bp, Homo sapien
tgacggaccgctgattcgcctaggt

SEQ ID NO: 102495 - DNA, 25 bp, Homo sapien
ggagctcccagcaaccttcgcgctt

SEQ ID NO: 102496 - DNA, 25 bp, Homo sapien
cacctcactgctggactccggagaa

SEQ ID NO: 102497 - DNA, 25 bp, Homo sapien
ctaggccttgaggaacgtgtactgc

SEQ ID NO: 102498 - DNA, 25 bp, Homo sapien
cgcacttagctcttaagctgggcca

SEQ ID NO: 102499 - DNA, 25 bp, Homo sapien
ggaacgtgtactgcggatccaagtc

SEQ ID NO: 102500 - DNA, 25 bp, Homo sapien
cggcgaaagaggaacctaggccttg

SEQ ID NO: 102501 - DNA, 25 bp, Homo sapien
cgtctccgcaggcagttgagcctgc

SEQ ID NO: 102502 - DNA, 25 bp, Homo sapien
ggtcggttccctccagatttcacag

SEQ ID NO: 102503 - DNA, 25 bp, Homo sapien
gatccaagtccgcacttagctctta

SEQ ID NO: 102504 - DNA, 25 bp, Homo sapien
gccatcacgtgggtgcggcctgacc

SEQ ID NO: 102505 - DNA, 25 bp, Homo sapien
gcccgaggaaacagccgaagcgatc

SEQ ID NO: 102506 - DNA, 25 bp, Homo sapien
taagggacgtccaagcaaccagcgt

SEQ ID NO: 102507 - DNA, 25 bp, Homo sapien
tctagccgctgtcccaagggttggt

SEQ ID NO: 102508 - DNA, 25 bp, Homo sapien
ctcccttctaattggccagctcaga

SEQ ID NO: 102509 - DNA, 25 bp, Homo sapien
cctcacggtctgcaaggtcctctta

SEQ ID NO: 102510 - DNA, 25 bp, Homo sapien
tgggccgcaaagaccgaactggagt

SEQ ID NO: 102511 - DNA, 25 bp, Homo sapien
aaccagcgtcactctgggccgcaaa

SEQ ID NO: 102512 - DNA, 25 bp, Homo sapien
tcggcttgggaacgccaaggacatc

SEQ ID NO: 102513 - DNA, 25 bp, Homo sapien
aaacgacgccgcacgcctagtggcg

SEQ ID NO: 102514 - DNA, 25 bp, Homo sapien
gcagagtcctccctatgccggcggt

SEQ ID NO: 102515 - DNA, 25 bp, Homo sapien
cggatagctagcgttgggcctgccc

SEQ ID NO: 102516 - DNA, 25 bp, Homo sapien
tgttttggggcagtcgcccaaacga

SEQ ID NO: 102517 - DNA, 25 bp, Homo sapien
attgcgccctctgatcccagcgttg

SEQ ID NO: 102518 - DNA, 25 bp, Homo sapien
actcccttcgggacgctgaggagga

SEQ ID NO: 102519 - DNA, 25 bp, Homo sapien
gggcctcagtccctcaaatccggga

SEQ ID NO: 102520 - DNA, 25 bp, Homo sapien
tgacagctcccgagaacggaagagg

SEQ ID NO: 102521 - DNA, 25 bp, Homo sapien
gggtcttcctactggcccaccttgc

SEQ ID NO: 102522 - DNA, 25 bp, Homo sapien
ctccagaaggaggacattttgttcc

SEQ ID NO: 102523 - DNA, 25 bp, Homo sapien
cccagcactgcggttagtgggagtg

SEQ ID NO: 102524 - DNA, 25 bp, Homo sapien
tgctacccacttacacggacgcctc

SEQ ID NO: 102525 - DNA, 25 bp, Homo sapien
ggctgactcagcttggccgcagcta

SEQ ID NO: 102526 - DNA, 25 bp, Homo sapien
ctacccggaccgactctcccaggtg

SEQ ID NO: 102527 - DNA, 25 bp, Homo sapien
accttgctttgcgaacccctctggg

SEQ ID NO: 102528 - DNA, 25 bp, Homo sapien
ggaaaaggtaatcgctccagaagga

SEQ ID NO: 102529 - DNA, 25 bp, Homo sapien
cggcggtgcttacagcctgagaaga

SEQ ID NO: 102530 - DNA, 25 bp, Homo sapien
aggcggcatcgatctgaggcattcg

SEQ ID NO: 102531 - DNA, 25 bp, Homo sapien
ccgggctcggattcgaggctgccac

SEQ ID NO: 102532 - DNA, 25 bp, Homo sapien
accagcaggtaagcggcgcccgact

SEQ ID NO: 102533 - DNA, 25 bp, Homo sapien
tgcggcagccggtaccagcaggtaa

SEQ ID NO: 102534 - DNA, 25 bp, Homo sapien
catcgagacccacccaaggcgcgtc

SEQ ID NO: 102535 - DNA, 25 bp, Homo sapien
agcctgagaagagcgtctcgcccgg

SEQ ID NO: 102536 - DNA, 25 bp, Homo sapien
acccacaggcggcatcgatctgagg

SEQ ID NO: 102537 - DNA, 25 bp, Homo sapien
tgtgcagcacatggccacgatgagg

SEQ ID NO: 102538 - DNA, 25 bp, Homo sapien
gggagactcacacatgtgcagcaca

SEQ ID NO: 102539 - DNA, 25 bp, Homo sapien
cctgcgacagagcatagcgtgtccc

SEQ ID NO: 102540 - DNA, 25 bp, Homo sapien
acgatccacgtcaggcgcaggaaga

SEQ ID NO: 102541 - DNA, 25 bp, Homo sapien
ggtagacgccgatgaaggtgcccat

SEQ ID NO: 102542 - DNA, 25 bp, Homo sapien
atgttctgcaggcacggcaggtaga

SEQ ID NO: 102543 - DNA, 25 bp, Homo sapien
catctggggagagccctactgtcca

SEQ ID NO: 102544 - DNA, 25 bp, Homo sapien
cgaaggcacaaccacagcggccagg

SEQ ID NO: 102545 - DNA, 25 bp, Homo sapien
atgaagacagcctccggggactaca

SEQ ID NO: 102546 - DNA, 25 bp, Homo sapien
ccatggcggggatgaagacagcctc

SEQ ID NO: 102547 - DNA, 25 bp, Homo sapien
tgctgaactcggcaccatgggcggc

SEQ ID NO: 102548 - DNA, 25 bp, Homo sapien
ccgcttgctgaactcggcaccatgg

SEQ ID NO: 102549 - DNA, 25 bp, Homo sapien
agcagatcagtgagtgtccgctgcc

SEQ ID NO: 102550 - DNA, 25 bp, Homo sapien
tcctgaagattgtggagcagatcag

SEQ ID NO: 102551 - DNA, 25 bp, Homo sapien
acatcgactcgtcatgggagctgcg

SEQ ID NO: 102552 - DNA, 25 bp, Homo sapien
ccggggactacatcgactcgtcatg

SEQ ID NO: 102553 - DNA, 25 bp, Homo sapien
cgtgccgttcgcgattctatgaatg

SEQ ID NO: 102554 - DNA, 25 bp, Homo sapien
aacccgtgattgctgggactggctc

SEQ ID NO: 102555 - DNA, 25 bp, Homo sapien
aatctacgtcgagcataggccgcta

SEQ ID NO: 102556 - DNA, 25 bp, Homo sapien
ctcagagaggggcagtttcagatct

SEQ ID NO: 102557 - DNA, 25 bp, Homo sapien
tttcagatctccaaaccagccatgg

SEQ ID NO: 102558 - DNA, 25 bp, Homo sapien
cccacgtctgtgtaaatcctgaagc

SEQ ID NO: 102559 - DNA, 25 bp, Homo sapien
tacctccgcggcgatgttgcaacca

SEQ ID NO: 102560 - DNA, 25 bp, Homo sapien
tgcaaccactgcctgggaaaatggc

SEQ ID NO: 102561 - DNA, 25 bp, Homo sapien
gcccttcgctgttgtaggcgccttt

SEQ ID NO: 102562 - DNA, 25 bp, Homo sapien
aggcccacggcccttcgctgttgta

SEQ ID NO: 102563 - DNA, 25 bp, Homo sapien
gggagcggccgagaactggccaggt

SEQ ID NO: 102564 - DNA, 25 bp, Homo sapien
acgctggcctgaggagcctcggtcc

SEQ ID NO: 102565 - DNA, 25 bp, Homo sapien
cttcgctgttgtaggcgcctttccc

SEQ ID NO: 102566 - DNA, 25 bp, Homo sapien
ctcacaggacgctggcctgaggagc

SEQ ID NO: 102567 - DNA, 25 bp, Homo sapien
gttgtaggcgcctttccccaatatc

SEQ ID NO: 102568 - DNA, 25 bp, Homo sapien
agcctcggtccaccgaaggcccacg

SEQ ID NO: 102569 - DNA, 25 bp, Homo sapien
cttctctccgggagcgaatgggaac

SEQ ID NO: 102570 - DNA, 25 bp, Homo sapien
caggatgttgttgatttgtcaccaa

SEQ ID NO: 102571 - DNA, 25 bp, Homo sapien
accacagagaggaaatgattgtaaa

SEQ ID NO: 102572 - DNA, 25 bp, Homo sapien
ctcacaaaagaacaggatgttgttg

SEQ ID NO: 102573 - DNA, 25 bp, Homo sapien
gacgccttgaggaagctgtattttt

SEQ ID NO: 102574 - DNA, 25 bp, Homo sapien
gggacgtccttcagattggtgcgcc

SEQ ID NO: 102575 - DNA, 25 bp, Homo sapien
ctttttctacagttgcagcggagga

SEQ ID NO: 102576 - DNA, 25 bp, Homo sapien
cccagctcgcgttccagttgctttt

SEQ ID NO: 102577 - DNA, 25 bp, Homo sapien
cgggcgaaccagcaaccatcagatg

SEQ ID NO: 102578 - DNA, 25 bp, Homo sapien
ccgccttttgcgttcagggatggtc

SEQ ID NO: 102579 - DNA, 25 bp, Homo sapien
gcgcgctcaagagtgagtgtcccga

SEQ ID NO: 102580 - DNA, 25 bp, Homo sapien
gggaagtcactcataagcgcgctca

SEQ ID NO: 102581 - DNA, 25 bp, Homo sapien
gctcatcaaggacgggaagtcactc

SEQ ID NO: 102582 - DNA, 25 bp, Homo sapien
agacgctcaagtcgcacgaagcaga

SEQ ID NO: 102583 - DNA, 25 bp, Homo sapien
gtccgcacttccgagagacgctcaa

SEQ ID NO: 102584 - DNA, 25 bp, Homo sapien
taagtcatcgctagcaggttcgagc

SEQ ID NO: 102585 - DNA, 25 bp, Homo sapien
tgtgtcacttcgaaaggggctacgg

SEQ ID NO: 102586 - DNA, 25 bp, Homo sapien
ccgagttgcgtgaagtgtgtcactt

SEQ ID NO: 102587 - DNA, 25 bp, Homo sapien
caacctgttggtgacgcttggcaac

SEQ ID NO: 102588 - DNA, 25 bp, Homo sapien
gtcacagacacgagctcgcaaaatg

SEQ ID NO: 102589 - DNA, 25 bp, Homo sapien
cctgacacgccctctggggaggctt

SEQ ID NO: 102590 - DNA, 25 bp, Homo sapien
gtgactcgggctcccgtcacagaca

SEQ ID NO: 102591 - DNA, 25 bp, Homo sapien
tcggcgcatacgtactttgggcccg

SEQ ID NO: 102592 - DNA, 25 bp, Homo sapien
gccgcgctctcgcactgggagagaa

SEQ ID NO: 102593 - DNA, 25 bp, Homo sapien
agtatctacccaacctgcggctggc

SEQ ID NO: 102594 - DNA, 25 bp, Homo sapien
accaaactctgaggctgcgctggcg

SEQ ID NO: 102595 - DNA, 25 bp, Homo sapien
ggcggcaaaggcagtagcttcacta

SEQ ID NO: 102596 - DNA, 25 bp, Homo sapien
ggcctgggtcactcaccaaactctg

SEQ ID NO: 102597 - DNA, 25 bp, Homo sapien
tgtcacagggccaaagaacggcttc

SEQ ID NO: 102598 - DNA, 25 bp, Homo sapien
gagtatggagcttgcgcagtatcta

SEQ ID NO: 102599 - DNA, 25 bp, Homo sapien
agctgaacactgtgccacgggcctg

SEQ ID NO: 102600 - DNA, 25 bp, Homo sapien
gccgaaagacggcaacaagcccatt

SEQ ID NO: 102601 - DNA, 25 bp, Homo sapien
ttccctggatggtttcttgcctgca

SEQ ID NO: 102602 - DNA, 25 bp, Homo sapien
caacagcatccgaactgcactggga

SEQ ID NO: 102603 - DNA, 25 bp, Homo sapien
gaggacgtgactcggagctgcctcc

SEQ ID NO: 102604 - DNA, 25 bp, Homo sapien
cgctttctccaagccatattccttt

SEQ ID NO: 102605 - DNA, 25 bp, Homo sapien
ttgcctgcactgctgaaacaacagc

SEQ ID NO: 102606 - DNA, 25 bp, Homo sapien
gatgtaatagtcatttccctggatg

SEQ ID NO: 102607 - DNA, 25 bp, Homo sapien
tgggaactgtggaaccacccagctc

SEQ ID NO: 102608 - DNA, 25 bp, Homo sapien
tgcagtcctggcaacctgtcaccga

SEQ ID NO: 102609 - DNA, 25 bp, Homo sapien
ttcccgcactatacccagaggcttt

SEQ ID NO: 102610 - DNA, 25 bp, Homo sapien
gtttacctcagcgattcttcccgca

SEQ ID NO: 102611 - DNA, 25 bp, Homo sapien
ctgacactcttgcaggtttacctca

SEQ ID NO: 102612 - DNA, 25 bp, Homo sapien
tgcgcggcaagactgtagaaatagc

SEQ ID NO: 102613 - DNA, 25 bp, Homo sapien
gctgcgcaggtgttccttccactgc

SEQ ID NO: 102614 - DNA, 25 bp, Homo sapien
aggctttcttaattggccctccgag

SEQ ID NO: 102615 - DNA, 25 bp, Homo sapien
tgtgcacgcgtgtcacctgcagcac

SEQ ID NO: 102616 - DNA, 25 bp, Homo sapien
agatggccaaccgatttcccgttcg

SEQ ID NO: 102617 - DNA, 25 bp, Homo sapien
ccacatgggcgtggcctttttcctc

SEQ ID NO: 102618 - DNA, 25 bp, Homo sapien
ccagcttccgcgtggatgaaggaga

SEQ ID NO: 102619 - DNA, 25 bp, Homo sapien
ctttcggagaaagctggcgaccacc

SEQ ID NO: 102620 - DNA, 25 bp, Homo sapien
ccacctgctcgaaggggtacttgta

SEQ ID NO: 102621 - DNA, 25 bp, Homo sapien
cgaaactttattggccactcggaga

SEQ ID NO: 102622 - DNA, 25 bp, Homo sapien
cacactcggacagccacatgggcgt

SEQ ID NO: 102623 - DNA, 25 bp, Homo sapien
ggggtacttgtacacctggtgcaca

SEQ ID NO: 102624 - DNA, 25 bp, Homo sapien
cactcggagaaacgcgcagtcggcc

SEQ ID NO: 102625 - DNA, 25 bp, Homo sapien
gctgagctgaactcagcagaagtta

SEQ ID NO: 102626 - DNA, 25 bp, Homo sapien
aggcgccatcgctcattctcggtcg

SEQ ID NO: 102627 - DNA, 25 bp, Homo sapien
aaggcgaggcgccatcgctcattct

SEQ ID NO: 102628 - DNA, 25 bp, Homo sapien
gccgcgctgacatctttggagagga

SEQ ID NO: 102629 - DNA, 25 bp, Homo sapien
ccgctgccgcgctgacatctttgga

SEQ ID NO: 102630 - DNA, 25 bp, Homo sapien
cagcagaagttacatgcacaaggtt

SEQ ID NO: 102631 - DNA, 25 bp, Homo sapien
cgcttggaggaaaggaagccggttg

SEQ ID NO: 102632 - DNA, 25 bp, Homo sapien
gttacatgcacaaggttagtggccc

SEQ ID NO: 102633 - DNA, 25 bp, Homo sapien
ccgccaatgaaaagccgcgtggaaa

SEQ ID NO: 102634 - DNA, 25 bp, Homo sapien
acccgccaatgaaaagccgcgtgga

SEQ ID NO: 102635 - DNA, 25 bp, Homo sapien
aggcagggccgacgtgccgacggac

SEQ ID NO: 102636 - DNA, 25 bp, Homo sapien
cggggacaaacctccaggatcctcg

SEQ ID NO: 102637 - DNA, 25 bp, Homo sapien
cgccaatgaaaagccgcgtggaaag

SEQ ID NO: 102638 - DNA, 25 bp, Homo sapien
cggcggacccgccaatgaaaagccg

SEQ ID NO: 102639 - DNA, 25 bp, Homo sapien
ggacccgccaatgaaaagccgcgtg

SEQ ID NO: 102640 - DNA, 25 bp, Homo sapien
tccaggatcctcgaccgcggcggac

SEQ ID NO: 102641 - DNA, 25 bp, Homo sapien
ctcaggttggtgtagttggccagct

SEQ ID NO: 102642 - DNA, 25 bp, Homo sapien
cagggtggcagtaccttggcctccc

SEQ ID NO: 102643 - DNA, 25 bp, Homo sapien
cctgcgcggcgtggacatggtcaca

SEQ ID NO: 102644 - DNA, 25 bp, Homo sapien
agttggccagcttgttgagcagcga

SEQ ID NO: 102645 - DNA, 25 bp, Homo sapien
gcagcgaggacaccatggggttact

SEQ ID NO: 102646 - DNA, 25 bp, Homo sapien
ggacaccatggggttactgtccatc

SEQ ID NO: 102647 - DNA, 25 bp, Homo sapien
gggttactgtccatctcctcctgcg

SEQ ID NO: 102648 - DNA, 25 bp, Homo sapien
tgatctaaccctgccgggacacacg

SEQ ID NO: 102649 - DNA, 25 bp, Homo sapien
tcctggctggccaagttactggagc

SEQ ID NO: 102650 - DNA, 25 bp, Homo sapien
tgtggatgccctcaagtcctggctg

SEQ ID NO: 102651 - DNA, 25 bp, Homo sapien
ccctgcaccatgctcatagaggatg

SEQ ID NO: 102652 - DNA, 25 bp, Homo sapien
tactggttctcaggcctgccactcg

SEQ ID NO: 102653 - DNA, 25 bp, Homo sapien
tttcattggtcttgccctcagggcc

SEQ ID NO: 102654 - DNA, 25 bp, Homo sapien
ttgcaccaggagttcacttaagctc

SEQ ID NO: 102655 - DNA, 25 bp, Homo sapien
cacgagtgtgtgtttccaagaaaaa

SEQ ID NO: 102656 - DNA, 25 bp, Homo sapien
actacagctgagtcatttcgggaca

SEQ ID NO: 102657 - DNA, 25 bp, Homo sapien
cctgaatccctctgggcgtctcgga

SEQ ID NO: 102658 - DNA, 25 bp, Homo sapien
gaagtttgtgaaaggcgaccagaga

SEQ ID NO: 102659 - DNA, 25 bp, Homo sapien
cggcgagtacatgtgagaagtttgt

SEQ ID NO: 102660 - DNA, 25 bp, Homo sapien
tcgctgcgcgatggcatcttgagtt

SEQ ID NO: 102661 - DNA, 25 bp, Homo sapien
cactttgcagacaatgcaaggcagc

SEQ ID NO: 102662 - DNA, 25 bp, Homo sapien
caacagacgagtcccgcagcagctg

SEQ ID NO: 102663 - DNA, 25 bp, Homo sapien
gtctcggatcctctgagccactttg

SEQ ID NO: 102664 - DNA, 25 bp, Homo sapien
caaggcagcggccaacagacgagtc

SEQ ID NO: 102665 - DNA, 25 bp, Homo sapien
gccgctgcctccgtattaattttta

SEQ ID NO: 102666 - DNA, 25 bp, Homo sapien
ggcacattttttgacaggcactagc

SEQ ID NO: 102667 - DNA, 25 bp, Homo sapien
tggagcacatctcgcccacgctgag

SEQ ID NO: 102668 - DNA, 25 bp, Homo sapien
cttgcagctgcagggtaatatattt

SEQ ID NO: 102669 - DNA, 25 bp, Homo sapien
tgtcgcccagaacaatcgccgctgt

SEQ ID NO: 102670 - DNA, 25 bp, Homo sapien
agtattccctactgaccgtgctgtg

SEQ ID NO: 102671 - DNA, 25 bp, Homo sapien
cgcggctctggctaatctcaagatc

SEQ ID NO: 102672 - DNA, 25 bp, Homo sapien
cccggtgctgcaagaacccaaattc

SEQ ID NO: 102673 - DNA, 25 bp, Homo sapien
tgcgcaggagtattttcaccagttc

SEQ ID NO: 102674 - DNA, 25 bp, Homo sapien
ttcctgcaggtaagaagagccttcg

SEQ ID NO: 102675 - DNA, 25 bp, Homo sapien
gtccagtagcactaggtccagtctc

SEQ ID NO: 102676 - DNA, 25 bp, Homo sapien
cctagtcttcttcaggcgcctgaga

SEQ ID NO: 102677 - DNA, 25 bp, Homo sapien
caccagttcctacgtgcaggccgga

SEQ ID NO: 102678 - DNA, 25 bp, Homo sapien
agccttcgcatgttcgggctctgga

SEQ ID NO: 102679 - DNA, 25 bp, Homo sapien
gcaaggtctgctccaagacggtcca

SEQ ID NO: 102680 - DNA, 25 bp, Homo sapien
gagccatgcctctgagcctagtctt

SEQ ID NO: 102681 - DNA, 25 bp, Homo sapien
ttgtcacgggcaagacggaagctta

SEQ ID NO: 102682 - DNA, 25 bp, Homo sapien
gaaaccgctttgcacactgtgcgtc

SEQ ID NO: 102683 - DNA, 25 bp, Homo sapien
ggaacgaagtattctctccctggga

SEQ ID NO: 102684 - DNA, 25 bp, Homo sapien
gtgcctggtgcgaatacatagctcc

SEQ ID NO: 102685 - DNA, 25 bp, Homo sapien
tagctcccactgagaagcttggccc

SEQ ID NO: 102686 - DNA, 25 bp, Homo sapien
cgggcaccattcagccttttcgaag

SEQ ID NO: 102687 - DNA, 25 bp, Homo sapien
gaaggctccagacttcgcgctgctc

SEQ ID NO: 102688 - DNA, 25 bp, Homo sapien
gtcccagctacgcaaggaacgaagt

SEQ ID NO: 102689 - DNA, 25 bp, Homo sapien
gctgggtcagggttcgcccgctcct

SEQ ID NO: 102690 - DNA, 25 bp, Homo sapien
gggagccgagaacgcccgctgtcct

SEQ ID NO: 102691 - DNA, 25 bp, Homo sapien
ataggggcttcccttcggctgcgtc

SEQ ID NO: 102692 - DNA, 25 bp, Homo sapien
tcttttccgatcaagtcaggtttcc

SEQ ID NO: 102693 - DNA, 25 bp, Homo sapien
tcgatcgctcttttccgatcaagtc

SEQ ID NO: 102694 - DNA, 25 bp, Homo sapien
tcctctcttccgcagagcggcggga

SEQ ID NO: 102695 - DNA, 25 bp, Homo sapien
cgtctgttcgcgtgtctctcactca

SEQ ID NO: 102696 - DNA, 25 bp, Homo sapien
cgtctcccgtcctgtctgtgtgcgt

SEQ ID NO: 102697 - DNA, 25 bp, Homo sapien
accgcctggccgactttctcgtgaa

SEQ ID NO: 102698 - DNA, 25 bp, Homo sapien
agcgagcggcactacagaggaaacg

SEQ ID NO: 102699 - DNA, 25 bp, Homo sapien
gccgcgcagtcctttgctcagagga

SEQ ID NO: 102700 - DNA, 25 bp, Homo sapien
ctaattacactgatgtggggtctgg

SEQ ID NO: 102701 - DNA, 25 bp, Homo sapien
ggcgcgctaattacactgatgtggg

SEQ ID NO: 102702 - DNA, 25 bp, Homo sapien
acccgagctgtgtgcggcgcgctaa

SEQ ID NO: 102703 - DNA, 25 bp, Homo sapien
tttctcgtgaatgacagggcctggc

SEQ ID NO: 102704 - DNA, 25 bp, Homo sapien
gcagtcctgacacccgagctgtgtg

SEQ ID NO: 102705 - DNA, 25 bp, Homo sapien
tggaaagtttgaccaaccgcatctc

SEQ ID NO: 102706 - DNA, 25 bp, Homo sapien
ggacttagttctgcttaccgcgaga

SEQ ID NO: 102707 - DNA, 25 bp, Homo sapien
tcgacgtctctgcactccgcagtta

SEQ ID NO: 102708 - DNA, 25 bp, Homo sapien
cgcctctctcgttggggattgacga

SEQ ID NO: 102709 - DNA, 25 bp, Homo sapien
cttcctagtgctttcttggggcctc

SEQ ID NO: 102710 - DNA, 25 bp, Homo sapien
actggctgtcttcataccgctttca

SEQ ID NO: 102711 - DNA, 25 bp, Homo sapien
ctgcgggcctgattttcctcatcga

SEQ ID NO: 102712 - DNA, 25 bp, Homo sapien
ccggcggttcctcactgctaaaatc

SEQ ID NO: 102713 - DNA, 25 bp, Homo sapien
agcaggcttacttgcgtgggaacca

SEQ ID NO: 102714 - DNA, 25 bp, Homo sapien
cagccgcgacaaaatggtgcctttc

SEQ ID NO: 102715 - DNA, 25 bp, Homo sapien
agccggcagacaagtatccatgatc

SEQ ID NO: 102716 - DNA, 25 bp, Homo sapien
ttgcgggtatcaatgtcctcctcca

SEQ ID NO: 102717 - DNA, 25 bp, Homo sapien
accttcggtcgcatagctgtggtcg

SEQ ID NO: 102718 - DNA, 25 bp, Homo sapien
agctgcccaggaagcacagtgatcc

SEQ ID NO: 102719 - DNA, 25 bp, Homo sapien
tggtgcattaaaggcgaggctcctc

SEQ ID NO: 102720 - DNA, 25 bp, Homo sapien
aacccggcaatggagctgtcacctc

SEQ ID NO: 102721 - DNA, 25 bp, Homo sapien
aatgcgctcttggtagcctcctttc

SEQ ID NO: 102722 - DNA, 25 bp, Homo sapien
ggcggaagcagctccgtaagatata

SEQ ID NO: 102723 - DNA, 25 bp, Homo sapien
tccgtaagatatacctcgctgcaga

SEQ ID NO: 102724 - DNA, 25 bp, Homo sapien
cgaaaacgtcacaaagccgcagaga

SEQ ID NO: 102725 - DNA, 25 bp, Homo sapien
ggcaccaaaggccaatagacatgta

SEQ ID NO: 102726 - DNA, 25 bp, Homo sapien
tttcctgacaggtggacgtggtctt

SEQ ID NO: 102727 - DNA, 25 bp, Homo sapien
ggcatccacgccaatgagaatgtga

SEQ ID NO: 102728 - DNA, 25 bp, Homo sapien
tcctttgcagaacaacgggccaggc

SEQ ID NO: 102729 - DNA, 25 bp, Homo sapien
gcgggacctccatccgtagccctct

SEQ ID NO: 102730 - DNA, 25 bp, Homo sapien
ctcccggggtccttgtctagtctca

SEQ ID NO: 102731 - DNA, 25 bp, Homo sapien
tctagtctcagcaggcggcaaacgg

SEQ ID NO: 102732 - DNA, 25 bp, Homo sapien
tcacccaggagactgcccagcggtt

SEQ ID NO: 102733 - DNA, 25 bp, Homo sapien
gagacgcccgctggcaagcagatcc

SEQ ID NO: 102734 - DNA, 25 bp, Homo sapien
aggagactgcccagcggtttctgga

SEQ ID NO: 102735 - DNA, 25 bp, Homo sapien
ccagcggtttctggagagagcgcta

SEQ ID NO: 102736 - DNA, 25 bp, Homo sapien
cgctaagcggagacgcccgctggca

SEQ ID NO: 102737 - DNA, 25 bp, Homo sapien
cacagaatgagccatggtaccgacc

SEQ ID NO: 102738 - DNA, 25 bp, Homo sapien
tcagaggattgatcccagttccggc

SEQ ID NO: 102739 - DNA, 25 bp, Homo sapien
gacggcaggcatcctcagcgggtca

SEQ ID NO: 102740 - DNA, 25 bp, Homo sapien
ccagttccggccaggacacagaatg

SEQ ID NO: 102741 - DNA, 25 bp, Homo sapien
cctcagcgggtcagaggattgatcc

SEQ ID NO: 102742 - DNA, 25 bp, Homo sapien
cggccaggacacagaatgagccatg

SEQ ID NO: 102743 - DNA, 25 bp, Homo sapien
atggtaccgacctccacaaaactcg

SEQ ID NO: 102744 - DNA, 25 bp, Homo sapien
tgagccatggtaccgacctccacaa

SEQ ID NO: 102745 - DNA, 25 bp, Homo sapien
agaatggctgatctgcgactcctcc

SEQ ID NO: 102746 - DNA, 25 bp, Homo sapien
ttttttctgattcgcgagtgctgcg

SEQ ID NO: 102747 - DNA, 25 bp, Homo sapien
tggggcggcaaaaaccgacactcca

SEQ ID NO: 102748 - DNA, 25 bp, Homo sapien
cgtgccactgtttgggtttcctctt

SEQ ID NO: 102749 - DNA, 25 bp, Homo sapien
atccgcgggatgttcttcttgcctt

SEQ ID NO: 102750 - DNA, 25 bp, Homo sapien
tcttgccttggtaggacatggtggc

SEQ ID NO: 102751 - DNA, 25 bp, Homo sapien
taatccaaagttctccgtgccactg

SEQ ID NO: 102752 - DNA, 25 bp, Homo sapien
cggctgccagagacaatagtaaatc

SEQ ID NO: 102753 - DNA, 25 bp, Homo sapien
aggcgccctccacgttgcagaacat

SEQ ID NO: 102754 - DNA, 25 bp, Homo sapien
ttccgcgcttgcacgaagatgctgc

SEQ ID NO: 102755 - DNA, 25 bp, Homo sapien
tgagggcatcgaaatccagcgtctt

SEQ ID NO: 102756 - DNA, 25 bp, Homo sapien
gttgcagaacatgccgccgtatttc

SEQ ID NO: 102757 - DNA, 25 bp, Homo sapien
cccgaggccatggttcaagcacgaa

SEQ ID NO: 102758 - DNA, 25 bp, Homo sapien
tgctccgattcctgcttgtccctag

SEQ ID NO: 102759 - DNA, 25 bp, Homo sapien
acgcagcgtcggtgcccatcacaat

SEQ ID NO: 102760 - DNA, 25 bp, Homo sapien
cagatcgtcttcgtgggagctgtcc

SEQ ID NO: 102761 - DNA, 25 bp, Homo sapien
ttccgaaatgccacgctgaacatgg

SEQ ID NO: 102762 - DNA, 25 bp, Homo sapien
tggttccgacgtatcagactcagtg

SEQ ID NO: 102763 - DNA, 25 bp, Homo sapien
tcagactcagtgcttccggcatggc

SEQ ID NO: 102764 - DNA, 25 bp, Homo sapien
ggaagtgtctgtagcgtccctccct

SEQ ID NO: 102765 - DNA, 25 bp, Homo sapien
tcaggtgaaagaacagcaacccgcc

SEQ ID NO: 102766 - DNA, 25 bp, Homo sapien
tgccgcgcttcgatgcttcttcaca

SEQ ID NO: 102767 - DNA, 25 bp, Homo sapien
acacacaatatggacacgggtttga

SEQ ID NO: 102768 - DNA, 25 bp, Homo sapien
catggcgctttagtgtcaggtgaaa

SEQ ID NO: 102769 - DNA, 25 bp, Homo sapien
gccgggtgtcctgagtccagaaccc

SEQ ID NO: 102770 - DNA, 25 bp, Homo sapien
gcacatacccgctgccagaggcgag

SEQ ID NO: 102771 - DNA, 25 bp, Homo sapien
gtgccctggcagattcgagcggcca

SEQ ID NO: 102772 - DNA, 25 bp, Homo sapien
gccgctgagccgagcttctgctgcc

SEQ ID NO: 102773 - DNA, 25 bp, Homo sapien
cgggctggagcgatctcacccgttc

SEQ ID NO: 102774 - DNA, 25 bp, Homo sapien
ggagcgatctcacccgttccgggct

SEQ ID NO: 102775 - DNA, 25 bp, Homo sapien
gaagcccaccctgccgcaaagccgg

SEQ ID NO: 102776 - DNA, 25 bp, Homo sapien
cgcaaagccgggtgtcctgagtcca

SEQ ID NO: 102777 - DNA, 25 bp, Homo sapien
ccacagccgctgaatgaggcttcca

SEQ ID NO: 102778 - DNA, 25 bp, Homo sapien
agcgccttcttgctggcacccaatg

SEQ ID NO: 102779 - DNA, 25 bp, Homo sapien
cctagcacccgacaagctgagtgtg

SEQ ID NO: 102780 - DNA, 25 bp, Homo sapien
ttcttcagagcacgggctggaactg

SEQ ID NO: 102781 - DNA, 25 bp, Homo sapien
gaacgcactgcgaagcggcttcttc

SEQ ID NO: 102782 - DNA, 25 bp, Homo sapien
tcctgtgcacataacgggcagaacg

SEQ ID NO: 102783 - DNA, 25 bp, Homo sapien
gtgccattggccgaaagttcccgta

SEQ ID NO: 102784 - DNA, 25 bp, Homo sapien
ccggaccacgacgtcacgcaggaaa

SEQ ID NO: 102785 - DNA, 25 bp, Homo sapien
acacgcgccggtgcgtccagcaggt

SEQ ID NO: 102786 - DNA, 25 bp, Homo sapien
ttcatgaaatcagtcgcaggggccg

SEQ ID NO: 102787 - DNA, 25 bp, Homo sapien
cccagacgaggaccaggattcatga

SEQ ID NO: 102788 - DNA, 25 bp, Homo sapien
attgctagccctggaattcgagacc

SEQ ID NO: 102789 - DNA, 25 bp, Homo sapien
cctatttcgcattgctagccctgga

SEQ ID NO: 102790 - DNA, 25 bp, Homo sapien
cgcgagcccgcatcatggatgtcga

SEQ ID NO: 102791 - DNA, 25 bp, Homo sapien
acttctgcccgggattccaatctga

SEQ ID NO: 102792 - DNA, 25 bp, Homo sapien
gcccgcatcatggatgtcgagctcc

SEQ ID NO: 102793 - DNA, 25 bp, Homo sapien
gcgggcccactgtctggcttagaag

SEQ ID NO: 102794 - DNA, 25 bp, Homo sapien
gattccctaggataaaaacgcgctc

SEQ ID NO: 102795 - DNA, 25 bp, Homo sapien
aacagtctccgcattccggcatgga

SEQ ID NO: 102796 - DNA, 25 bp, Homo sapien
ccatcgctagcggagtgcaagcaaa

SEQ ID NO: 102797 - DNA, 25 bp, Homo sapien
agactggacgatctgaagccggaga

SEQ ID NO: 102798 - DNA, 25 bp, Homo sapien
cggcgaatggagaagacaagcccaa

SEQ ID NO: 102799 - DNA, 25 bp, Homo sapien
gcggcgcttatgcaaaggtgccttc

SEQ ID NO: 102800 - DNA, 25 bp, Homo sapien
gctcaagaaagacccgcggcgaatg

SEQ ID NO: 102801 - DNA, 25 bp, Homo sapien
cgctgcctctcagcccaaattggaa

SEQ ID NO: 102802 - DNA, 25 bp, Homo sapien
gcgcccagcacggagactgtagtta

SEQ ID NO: 102803 - DNA, 25 bp, Homo sapien
gaagtgttgccttagctccggacga

SEQ ID NO: 102804 - DNA, 25 bp, Homo sapien
atcgggcaaccggaagcatagcgtt

SEQ ID NO: 102805 - DNA, 25 bp, Homo sapien
gggagcatctcttcactcgcagcaa

SEQ ID NO: 102806 - DNA, 25 bp, Homo sapien
aattggaaacatggccgtacggtcg

SEQ ID NO: 102807 - DNA, 25 bp, Homo sapien
gggaccaagcttctcggcctctacg

SEQ ID NO: 102808 - DNA, 25 bp, Homo sapien
gctggtttttaagcgggagcatctc

SEQ ID NO: 102809 - DNA, 25 bp, Homo sapien
taaagtgattcgcagagctcgtgtc

SEQ ID NO: 102810 - DNA, 25 bp, Homo sapien
ccgaaacgcgcgcaataaagtgatt

SEQ ID NO: 102811 - DNA, 25 bp, Homo sapien
attcgcagagctcgtgtccggctcc

SEQ ID NO: 102812 - DNA, 25 bp, Homo sapien
cgtgtctgggtcacatgagccgcct

SEQ ID NO: 102813 - DNA, 25 bp, Homo sapien
ggcgggcaccatgagccctctgctc

SEQ ID NO: 102814 - DNA, 25 bp, Homo sapien
gccgtgccctctctcaaggttggcg

SEQ ID NO: 102815 - DNA, 25 bp, Homo sapien
cctctctcaaggttggcggaagtga

SEQ ID NO: 102816 - DNA, 25 bp, Homo sapien
cagtgcgttcccgctttgcttcctt

SEQ ID NO: 102817 - DNA, 25 bp, Homo sapien
ccagccaatgaggagcccgcatgcg

SEQ ID NO: 102818 - DNA, 25 bp, Homo sapien
acctgcgccgggcaagaatgaaccc

SEQ ID NO: 102819 - DNA, 25 bp, Homo sapien
gggaagctgccaatgagagagccta

SEQ ID NO: 102820 - DNA, 25 bp, Homo sapien
aagctgccaatgagagagcctaccc

SEQ ID NO: 102821 - DNA, 25 bp, Homo sapien
atggagctaatgagggcctcgtgct

SEQ ID NO: 102822 - DNA, 25 bp, Homo sapien
agagccgagcgccaacccgctagcg

SEQ ID NO: 102823 - DNA, 25 bp, Homo sapien
tagcgcctgaatccggcgtgctgcc

SEQ ID NO: 102824 - DNA, 25 bp, Homo sapien
cgggcaagaatgaacccagccaatg

SEQ ID NO: 102825 - DNA, 25 bp, Homo sapien
ggggctcctacactaggcaaggcta

SEQ ID NO: 102826 - DNA, 25 bp, Homo sapien
cagatgattacctcgccgttggtga

SEQ ID NO: 102827 - DNA, 25 bp, Homo sapien
cagacccgatcttccgtaccagttt

SEQ ID NO: 102828 - DNA, 25 bp, Homo sapien
tgctactcgccatcctgagagacga

SEQ ID NO: 102829 - DNA, 25 bp, Homo sapien
ccgccgctcagtcaggtttcttttt

SEQ ID NO: 102830 - DNA, 25 bp, Homo sapien
accaggctgggccacttgtttctcg

SEQ ID NO: 102831 - DNA, 25 bp, Homo sapien
ggtgttacctgttactcgcctcgga

SEQ ID NO: 102832 - DNA, 25 bp, Homo sapien
cctccgacaatgaattcagccttgg

SEQ ID NO: 102833 - DNA, 25 bp, Homo sapien
actcaggcgggtgtctgcaaatagc

SEQ ID NO: 102834 - DNA, 25 bp, Homo sapien
tccattctgcagacacgccgtcgga

SEQ ID NO: 102835 - DNA, 25 bp, Homo sapien
aggcttgtacggtgctccattctgc

SEQ ID NO: 102836 - DNA, 25 bp, Homo sapien
atctgcggatccgacagtgggaacc

SEQ ID NO: 102837 - DNA, 25 bp, Homo sapien
tgggttactccacagcacagcaggc

SEQ ID NO: 102838 - DNA, 25 bp, Homo sapien
ctgcaaatagctcacgaagcccgtg

SEQ ID NO: 102839 - DNA, 25 bp, Homo sapien
cgaggcagccgctcaggaatttccc

SEQ ID NO: 102840 - DNA, 25 bp, Homo sapien
cctttcaaaggctcgatggtctcgc

SEQ ID NO: 102841 - DNA, 25 bp, Homo sapien
agacaattaacaaaggctggagacc

SEQ ID NO: 102842 - DNA, 25 bp, Homo sapien
ggagcagcgaacagaaaacaacctg

SEQ ID NO: 102843 - DNA, 25 bp, Homo sapien
aacaaaggctggagaccagccaccc

SEQ ID NO: 102844 - DNA, 25 bp, Homo sapien
cagaaaacaacctggctccagaaag

SEQ ID NO: 102845 - DNA, 25 bp, Homo sapien
tgccagccagggcacggttccgagc

SEQ ID NO: 102846 - DNA, 25 bp, Homo sapien
atccttcgggttggctgccagccag

SEQ ID NO: 102847 - DNA, 25 bp, Homo sapien
taaactccgcctgcaatccttcggg

SEQ ID NO: 102848 - DNA, 25 bp, Homo sapien
ggtgccggcacgtcgctaaactccg

SEQ ID NO: 102849 - DNA, 25 bp, Homo sapien
gcggagacagcgtcttcctggtttc

SEQ ID NO: 102850 - DNA, 25 bp, Homo sapien
ccaaaaatgtcagcacgaggcgtgc

SEQ ID NO: 102851 - DNA, 25 bp, Homo sapien
ccacccaatgcctgttgcaagcata

SEQ ID NO: 102852 - DNA, 25 bp, Homo sapien
gctgccgtactttcacgtggacttg

SEQ ID NO: 102853 - DNA, 25 bp, Homo sapien
ttcctggtttcgctatcgggcggag

SEQ ID NO: 102854 - DNA, 25 bp, Homo sapien
tgcaagcataaagtttggctccaga

SEQ ID NO: 102855 - DNA, 25 bp, Homo sapien
ttcctgccagttgccggctaaaggc

SEQ ID NO: 102856 - DNA, 25 bp, Homo sapien
ctgggacaagcagccaccaaaaatg

SEQ ID NO: 102857 - DNA, 25 bp, Homo sapien
cccgcgcggtagaatcccagatcag

SEQ ID NO: 102858 - DNA, 25 bp, Homo sapien
ccgctgcttttccagtcctcgttga

SEQ ID NO: 102859 - DNA, 25 bp, Homo sapien
gatcgaggagataggagccaccacc

SEQ ID NO: 102860 - DNA, 25 bp, Homo sapien
cgggcgtttacactggctctgcctc

SEQ ID NO: 102861 - DNA, 25 bp, Homo sapien
cgttgatccgtctcgaacctagata

SEQ ID NO: 102862 - DNA, 25 bp, Homo sapien
gctgagcacttcaaaactctgggca

SEQ ID NO: 102863 - DNA, 25 bp, Homo sapien
agcttgtgctcttctgtccagggca

SEQ ID NO: 102864 - DNA, 25 bp, Homo sapien
cagcggcggaacctctctaagaatc

SEQ ID NO: 102865 - DNA, 25 bp, Homo sapien
gcagcttgcacgctcctccgggtaa

SEQ ID NO: 102866 - DNA, 25 bp, Homo sapien
cctgcggagcgaacctgtgctccta

SEQ ID NO: 102867 - DNA, 25 bp, Homo sapien
cggaagcagtccgttcgccttacta

SEQ ID NO: 102868 - DNA, 25 bp, Homo sapien
gtcgcatgcagtcacgcgctgccga

SEQ ID NO: 102869 - DNA, 25 bp, Homo sapien
ttactagacccgctccaagcctttg

SEQ ID NO: 102870 - DNA, 25 bp, Homo sapien
tccaagcctttgagcagttcgtgtg

SEQ ID NO: 102871 - DNA, 25 bp, Homo sapien
tgtgctcctattcttgcccttcagg

SEQ ID NO: 102872 - DNA, 25 bp, Homo sapien
tccgctcccaagctagggctgggct

SEQ ID NO: 102873 - DNA, 25 bp, Homo sapien
gttgtctttgaaccacaggacagtg

SEQ ID NO: 102874 - DNA, 25 bp, Homo sapien
cagcaaattgtagtgtgcccacctc

SEQ ID NO: 102875 - DNA, 25 bp, Homo sapien
taggcctcgaacactacctgcagtg

SEQ ID NO: 102876 - DNA, 25 bp, Homo sapien
ctccgatgcagctcagcaaattgta

SEQ ID NO: 102877 - DNA, 25 bp, Homo sapien
acagggcgatttcgccagcgctgga

SEQ ID NO: 102878 - DNA, 25 bp, Homo sapien
gtctccgacacgttgcgcgtggaca

SEQ ID NO: 102879 - DNA, 25 bp, Homo sapien
cgcacgtagccgctctctgcaaggg

SEQ ID NO: 102880 - DNA, 25 bp, Homo sapien
actacctgcagtgtccggctccgat

SEQ ID NO: 102881 - DNA, 25 bp, Homo sapien
ctatgtgctggacaaggattcgccc

SEQ ID NO: 102882 - DNA, 25 bp, Homo sapien
tggcaagcgattcccactcgcagcg

SEQ ID NO: 102883 - DNA, 25 bp, Homo sapien
ttccctgcgcccaaggacgactggg

SEQ ID NO: 102884 - DNA, 25 bp, Homo sapien
ccgcggccaccatgtatgtgggcta

SEQ ID NO: 102885 - DNA, 25 bp, Homo sapien
gcggcccggagctataaaaggcctg

SEQ ID NO: 102886 - DNA, 25 bp, Homo sapien
ggcggcaatttgtctccttttgaac

SEQ ID NO: 102887 - DNA, 25 bp, Homo sapien
tccagctactctcacgtggagccgg

SEQ ID NO: 102888 - DNA, 25 bp, Homo sapien
ttgaaatgcaaacccgcctcggctg

SEQ ID NO: 102889 - DNA, 25 bp, Homo sapien
gcggcagcaccaccggggttgactc

SEQ ID NO: 102890 - DNA, 25 bp, Homo sapien
aaggggtctagttctgtcgaaggcg

SEQ ID NO: 102891 - DNA, 25 bp, Homo sapien
tccgagtgtcaacgagagctaggtg

SEQ ID NO: 102892 - DNA, 25 bp, Homo sapien
aagcggaccgggctccgagtgtcaa

SEQ ID NO: 102893 - DNA, 25 bp, Homo sapien
cgcgggtttcgcacggtccaataag

SEQ ID NO: 102894 - DNA, 25 bp, Homo sapien
tacagactaccgctccgccggaagt

SEQ ID NO: 102895 - DNA, 25 bp, Homo sapien
acgagagctaggtgacgaggaaatt

SEQ ID NO: 102896 - DNA, 25 bp, Homo sapien
ttcgcacggtccaataagggagggc

SEQ ID NO: 102897 - DNA, 25 bp, Homo sapien
gtccgtccgtcagctgtctgtctgg

SEQ ID NO: 102898 - DNA, 25 bp, Homo sapien
tctatgcgggcgcagcagtgcaccc

SEQ ID NO: 102899 - DNA, 25 bp, Homo sapien
agggctctccaatccgcagctctgc

SEQ ID NO: 102900 - DNA, 25 bp, Homo sapien
ggacagacaaggcattcgcagcgcc

SEQ ID NO: 102901 - DNA, 25 bp, Homo sapien
tcacctccgcaaggtagggcacgag

SEQ ID NO: 102902 - DNA, 25 bp, Homo sapien
ggaccatctctcgtgccctcgctct

SEQ ID NO: 102903 - DNA, 25 bp, Homo sapien
agtggccagcggaccatctctcgtg

SEQ ID NO: 102904 - DNA, 25 bp, Homo sapien
agacaaggcattcgcagcgccctgc

SEQ ID NO: 102905 - DNA, 25 bp, Homo sapien
tgcggttatattcggccaggcgagc

SEQ ID NO: 102906 - DNA, 25 bp, Homo sapien
tcccgttcataagggtcagcactga

SEQ ID NO: 102907 - DNA, 25 bp, Homo sapien
tcagcactgatgttgaagagccaca

SEQ ID NO: 102908 - DNA, 25 bp, Homo sapien
ggccattcgttccaggttccaccag

SEQ ID NO: 102909 - DNA, 25 bp, Homo sapien
atccaatcgccatagccggggtctc

SEQ ID NO: 102910 - DNA, 25 bp, Homo sapien
cgggtaccagtcagtgatgtgcatc

SEQ ID NO: 102911 - DNA, 25 bp, Homo sapien
cacggcggtgttccagatgccaaag

SEQ ID NO: 102912 - DNA, 25 bp, Homo sapien
cccgagaaagtctggccaccattgt

SEQ ID NO: 102913 - DNA, 25 bp, Homo sapien
aaagttgtaacatctgccgggccgg

SEQ ID NO: 102914 - DNA, 25 bp, Homo sapien
tatctgaaccatggtagcccacgtc

SEQ ID NO: 102915 - DNA, 25 bp, Homo sapien
agcccacgtcgtggtagccttggtc

SEQ ID NO: 102916 - DNA, 25 bp, Homo sapien
tcccaggacaggtagccgaagctga

SEQ ID NO: 102917 - DNA, 25 bp, Homo sapien
cgcggcgtggcagcttccaaaaagt

SEQ ID NO: 102918 - DNA, 25 bp, Homo sapien
gacacggcgggagagaattcgaaaa

SEQ ID NO: 102919 - DNA, 25 bp, Homo sapien
agcgtaggggtctcgatatctgaac

SEQ ID NO: 102920 - DNA, 25 bp, Homo sapien
ccggagtccttaaaacagcccagct

SEQ ID NO: 102921 - DNA, 25 bp, Homo sapien
agtttcctaagtctcccgccacgtg

SEQ ID NO: 102922 - DNA, 25 bp, Homo sapien
atgctccgcgccaatgggcggtatt

SEQ ID NO: 102923 - DNA, 25 bp, Homo sapien
ggcggtattgttgatcacgagtctc

SEQ ID NO: 102924 - DNA, 25 bp, Homo sapien
ccgcgtgcaagatgtggagatcagc

SEQ ID NO: 102925 - DNA, 25 bp, Homo sapien
ggtaccggaggagccgcaatctctg

SEQ ID NO: 102926 - DNA, 25 bp, Homo sapien
cacgcccttcctggtagcgggtatt

SEQ ID NO: 102927 - DNA, 25 bp, Homo sapien
taagtctcccgccacgtggctaggc

SEQ ID NO: 102928 - DNA, 25 bp, Homo sapien
tcgcaggggccgaactttgtaattc

SEQ ID NO: 102929 - DNA, 25 bp, Homo sapien
cggcagctctagctgtcctcagatt

SEQ ID NO: 102930 - DNA, 25 bp, Homo sapien
aggacaaagcggcagctctagctgt

SEQ ID NO: 102931 - DNA, 25 bp, Homo sapien
acaggcgaggacggcccaggacaaa

SEQ ID NO: 102932 - DNA, 25 bp, Homo sapien
ccaacacggacacggtaggtagttg

SEQ ID NO: 102933 - DNA, 25 bp, Homo sapien
gcagtgcagagcatggcacccagca

SEQ ID NO: 102934 - DNA, 25 bp, Homo sapien
cgtctcgccattcccaagggcagtg

SEQ ID NO: 102935 - DNA, 25 bp, Homo sapien
actgaccacgcaaccgggcctctgt

SEQ ID NO: 102936 - DNA, 25 bp, Homo sapien
gacgggcaggccactgaccacgcaa

SEQ ID NO: 102937 - DNA, 25 bp, Homo sapien
gcacctagctcggttcccacggaaa

SEQ ID NO: 102938 - DNA, 25 bp, Homo sapien
gccttaaaaggctggacccgcactc

SEQ ID NO: 102939 - DNA, 25 bp, Homo sapien
gctagacagacttccgccatcctga

SEQ ID NO: 102940 - DNA, 25 bp, Homo sapien
ctcaatcccgagttggccaggatcc

SEQ ID NO: 102941 - DNA, 25 bp, Homo sapien
ccgtgtcccggaagtatacctctga

SEQ ID NO: 102942 - DNA, 25 bp, Homo sapien
gccggcattattcctcccaaagagt

SEQ ID NO: 102943 - DNA, 25 bp, Homo sapien
acgggccttctgagaccaggaacga

SEQ ID NO: 102944 - DNA, 25 bp, Homo sapien
cgtgggcctgcgatcaccaagaaaa

SEQ ID NO: 102945 - DNA, 25 bp, Homo sapien
gccctcgtgggtcctgcatctgaca

SEQ ID NO: 102946 - DNA, 25 bp, Homo sapien
acccacgcggcatcacgggatcgaa

SEQ ID NO: 102947 - DNA, 25 bp, Homo sapien
cgggtggaagtcgagaaatccagcc

SEQ ID NO: 102948 - DNA, 25 bp, Homo sapien
aggggtcaaaggcagcccgcgtcac

SEQ ID NO: 102949 - DNA, 25 bp, Homo sapien
gtctctgaccccgaataacttgttg

SEQ ID NO: 102950 - DNA, 25 bp, Homo sapien
cccagcgctgtttcgtctctgaccc

SEQ ID NO: 102951 - DNA, 25 bp, Homo sapien
gggtctttgtctcccacattctctc

SEQ ID NO: 102952 - DNA, 25 bp, Homo sapien
aaggcagcccgcgtcacgtggtcgc

SEQ ID NO: 102953 - DNA, 25 bp, Homo sapien
ggacggttttccagtcaaatcactc

SEQ ID NO: 102954 - DNA, 25 bp, Homo sapien
tctacgtgacgcgacctagcgaggt

SEQ ID NO: 102955 - DNA, 25 bp, Homo sapien
cgctgctctacgtgacgcgacctag

SEQ ID NO: 102956 - DNA, 25 bp, Homo sapien
caagacgcgctcgtctgagtccatc

SEQ ID NO: 102957 - DNA, 25 bp, Homo sapien
gcatgctgcactgcacgccactgtg

SEQ ID NO: 102958 - DNA, 25 bp, Homo sapien
gcactgcacgccactgtggtccagg

SEQ ID NO: 102959 - DNA, 25 bp, Homo sapien
tgggcctgcacgacggcatccagcg

SEQ ID NO: 102960 - DNA, 25 bp, Homo sapien
tcactccacctatgagccagtgctg

SEQ ID NO: 102961 - DNA, 25 bp, Homo sapien
gaattgaccaacatgggcgccgtgg

SEQ ID NO: 102962 - DNA, 25 bp, Homo sapien
gggctctgcccagaattgaccaaca

SEQ ID NO: 102963 - DNA, 25 bp, Homo sapien
taacccaggcgggttgggctctgcc

SEQ ID NO: 102964 - DNA, 25 bp, Homo sapien
acttgacccaggataacccaggcgg

SEQ ID NO: 102965 - DNA, 25 bp, Homo sapien
agtcggaccgacttgacccaggata

SEQ ID NO: 102966 - DNA, 25 bp, Homo sapien
aggtgggcaacagcccagagtctgt

SEQ ID NO: 102967 - DNA, 25 bp, Homo sapien
cccaggcttacaggtgggcaacagc

SEQ ID NO: 102968 - DNA, 25 bp, Homo sapien
tgacgccgggaagctaccctcctgg

SEQ ID NO: 102969 - DNA, 25 bp, Homo sapien
tggagaaatatgtcatcgagtcttc

SEQ ID NO: 102970 - DNA, 25 bp, Homo sapien
ggggcagccgcaaatccatgtttac

SEQ ID NO: 102971 - DNA, 25 bp, Homo sapien
tttcgtggagaagcccaaggtgacc

SEQ ID NO: 102972 - DNA, 25 bp, Homo sapien
agacttgctggatctggtacagaca

SEQ ID NO: 102973 - DNA, 25 bp, Homo sapien
ccgccgccagtcacggatggagaaa

SEQ ID NO: 102974 - DNA, 25 bp, Homo sapien
gtcttcaagccacacgccagagctg

SEQ ID NO: 102975 - DNA, 25 bp, Homo sapien
ggccttccgagtggcatcccgaagc

SEQ ID NO: 102976 - DNA, 25 bp, Homo sapien
aggagccagcacctcgtgacagggc

SEQ ID NO: 102977 - DNA, 25 bp, Homo sapien
gatacagtggcggtggaaccctcct

SEQ ID NO: 102978 - DNA, 25 bp, Homo sapien
agtactgtccatctgcctgagcgcc

SEQ ID NO: 102979 - DNA, 25 bp, Homo sapien
gttccgggtcctgacagtactgtcc

SEQ ID NO: 102980 - DNA, 25 bp, Homo sapien
tgcccacagagacatgaggctgagc

SEQ ID NO: 102981 - DNA, 25 bp, Homo sapien
gtcggggtctgtgcccacagagaca

SEQ ID NO: 102982 - DNA, 25 bp, Homo sapien
tgtccatctgcctgagcgccgtggc

SEQ ID NO: 102983 - DNA, 25 bp, Homo sapien
tcctgttacctacccgtgttccata

SEQ ID NO: 102984 - DNA, 25 bp, Homo sapien
tcaagaagcgggtggaccactgtcc

SEQ ID NO: 102985 - DNA, 25 bp, Homo sapien
ggcatcctgggctacaatatctgtc

SEQ ID NO: 102986 - DNA, 25 bp, Homo sapien
ccggggctaagtctccaggcatcct

SEQ ID NO: 102987 - DNA, 25 bp, Homo sapien
tcgactccgaggactccggggctaa

SEQ ID NO: 102988 - DNA, 25 bp, Homo sapien
aaacatcatcaatgcggcccggcgc

SEQ ID NO: 102989 - DNA, 25 bp, Homo sapien
cgcttctggcgcgaaacatcatcaa

SEQ ID NO: 102990 - DNA, 25 bp, Homo sapien
cccagcagcctagacggctgggtga

SEQ ID NO: 102991 - DNA, 25 bp, Homo sapien
aatggcagccttcggctcaagcgtg

SEQ ID NO: 102992 - DNA, 25 bp, Homo sapien
ccatgtctccctcgtggagcgagcg

SEQ ID NO: 102993 - DNA, 25 bp, Homo sapien
ctgcagtcctccgtgtttcctggga

SEQ ID NO: 102994 - DNA, 25 bp, Homo sapien
gcgaactcgtggcttcctcactgca

SEQ ID NO: 102995 - DNA, 25 bp, Homo sapien
tgtgcccaggttgccaatgccaatg

SEQ ID NO: 102996 - DNA, 25 bp, Homo sapien
cgctgagcttctctgcggtttattc

SEQ ID NO: 102997 - DNA, 25 bp, Homo sapien
cctcgttcccagatgctggccggaa

SEQ ID NO: 102998 - DNA, 25 bp, Homo sapien
gtcccgccagagaagttcaaccaca

SEQ ID NO: 102999 - DNA, 25 bp, Homo sapien
taccagagcgatggccgaagtcaca

SEQ ID NO: 103000 - DNA, 25 bp, Homo sapien
aggagttcgtcagctaccgggacta

SEQ ID NO: 103001 - DNA, 25 bp, Homo sapien
gaagtccatcacgacccgatcgcgg

SEQ ID NO: 103002 - DNA, 25 bp, Homo sapien
tgtcctgccagcttgcaaggtgcgc

SEQ ID NO: 103003 - DNA, 25 bp, Homo sapien
cccagttctgcctgttgtaggtgtt

SEQ ID NO: 103004 - DNA, 25 bp, Homo sapien
gaacccagagaggtcgccatcttga

SEQ ID NO: 103005 - DNA, 25 bp, Homo sapien
tatttacgcgtctagggcttcttcc

SEQ ID NO: 103006 - DNA, 25 bp, Homo sapien
ggtagctgtagcttccgaattggga

SEQ ID NO: 103007 - DNA, 25 bp, Homo sapien
gcgccggtcggcgtcttatttacgc

SEQ ID NO: 103008 - DNA, 25 bp, Homo sapien
agaggaccgccacaatcccgtcaag

SEQ ID NO: 103009 - DNA, 25 bp, Homo sapien
ccacatactcgctatagggcgactc

SEQ ID NO: 103010 - DNA, 25 bp, Homo sapien
cgtgagacacacattccagcgaccg

SEQ ID NO: 103011 - DNA, 25 bp, Homo sapien
tccctggactagatagagaacccgg

SEQ ID NO: 103012 - DNA, 25 bp, Homo sapien
gcgcatcacgtgacccgagagccag

SEQ ID NO: 103013 - DNA, 25 bp, Homo sapien
ggctctgcgcccgtcgaaaaccaga

SEQ ID NO: 103014 - DNA, 25 bp, Homo sapien
ggcgactctgttacctcgtgagaca

SEQ ID NO: 103015 - DNA, 25 bp, Homo sapien
acgacttcctacgtagactttgacg

SEQ ID NO: 103016 - DNA, 25 bp, Homo sapien
ccagcgaccgcagttcgctacaata

SEQ ID NO: 103017 - DNA, 25 bp, Homo sapien
cggattcgcgacctacctctagtgc

SEQ ID NO: 103018 - DNA, 25 bp, Homo sapien
cacgttccaggagctgcctagggct

SEQ ID NO: 103019 - DNA, 25 bp, Homo sapien
cgggctcccaacgttcttctttatg

SEQ ID NO: 103020 - DNA, 25 bp, Homo sapien
agcggagctcttcggattcgcgacc

SEQ ID NO: 103021 - DNA, 25 bp, Homo sapien
ggaccctgagaagcaccgagccatc

SEQ ID NO: 103022 - DNA, 25 bp, Homo sapien
gccagatcccgtgcagtcctgggga

SEQ ID NO: 103023 - DNA, 25 bp, Homo sapien
tgcctagggctgaggttccaggcct

SEQ ID NO: 103024 - DNA, 25 bp, Homo sapien
tgacccaggaactttccgcagactc

SEQ ID NO: 103025 - DNA, 25 bp, Homo sapien
cgtttccatggctaccagcagcggc

SEQ ID NO: 103026 - DNA, 25 bp, Homo sapien
acgcggggctttcgctgcctgcgct

SEQ ID NO: 103027 - DNA, 25 bp, Homo sapien
atggctaccagcagcggcgtccaca

SEQ ID NO: 103028 - DNA, 25 bp, Homo sapien
ccctagcgctgccactaacgtgggg

SEQ ID NO: 103029 - DNA, 25 bp, Homo sapien
gcgctcggcctttgtccggccaggt

SEQ ID NO: 103030 - DNA, 25 bp, Homo sapien
ggcatggccgcctgcagccgacagt

SEQ ID NO: 103031 - DNA, 25 bp, Homo sapien
cgggccacgtgacttcacctgcttg

SEQ ID NO: 103032 - DNA, 25 bp, Homo sapien
aacccaggctgcgtctgtctgaccg

SEQ ID NO: 103033 - DNA, 25 bp, Homo sapien
cggttttgcccgttccgcatcttca

SEQ ID NO: 103034 - DNA, 25 bp, Homo sapien
cccgagaatgggctgtaccacagcg

SEQ ID NO: 103035 - DNA, 25 bp, Homo sapien
tactagcggaggattcgcccagtgc

SEQ ID NO: 103036 - DNA, 25 bp, Homo sapien
gcccggtcgtcttcgtactagcgga

SEQ ID NO: 103037 - DNA, 25 bp, Homo sapien
cgccatcttgagagcccggtcgtct

SEQ ID NO: 103038 - DNA, 25 bp, Homo sapien
tccgcatcttcagaggctttgttca

SEQ ID NO: 103039 - DNA, 25 bp, Homo sapien
ctgcgccgttccgtactgggcggtt

SEQ ID NO: 103040 - DNA, 25 bp, Homo sapien
ctccctggagctgtttccgcatggg

SEQ ID NO: 103041 - DNA, 25 bp, Homo sapien
gaggcaacatgactgctcccagacg

SEQ ID NO: 103042 - DNA, 25 bp, Homo sapien
tcccagacgctgtttccgcacgggg

SEQ ID NO: 103043 - DNA, 25 bp, Homo sapien
tcttcatcttcagcggctttgttca

SEQ ID NO: 103044 - DNA, 25 bp, Homo sapien
gccattttgagatcccaggcgtctc

SEQ ID NO: 103045 - DNA, 25 bp, Homo sapien
gcgtctcagtacaagcggaggactc

SEQ ID NO: 103046 - DNA, 25 bp, Homo sapien
ctgagccggaatgtggactgtacca

SEQ ID NO: 103047 - DNA, 25 bp, Homo sapien
ctgtaccacagtgactgcgaaggga

SEQ ID NO: 103048 - DNA, 25 bp, Homo sapien
gcgctgttccgtatggggcgatttt

SEQ ID NO: 103049 - DNA, 25 bp, Homo sapien
ccgcctagcgattggctgcaagggt

SEQ ID NO: 103050 - DNA, 25 bp, Homo sapien
cccaggtgcgagagacctcctgaac

SEQ ID NO: 103051 - DNA, 25 bp, Homo sapien
tgtccagcgctcagtgcaatgcacc

SEQ ID NO: 103052 - DNA, 25 bp, Homo sapien
agaagtcgaaggtgagtgagcctcc

SEQ ID NO: 103053 - DNA, 25 bp, Homo sapien
tggccggcttcgtctcgcagagccg

SEQ ID NO: 103054 - DNA, 25 bp, Homo sapien
cggctcaggcgaccctgagtgtgcc

SEQ ID NO: 103055 - DNA, 25 bp, Homo sapien
cgccggacacctcagacggacggtg

SEQ ID NO: 103056 - DNA, 25 bp, Homo sapien
ggattggtcacacccgagggcttga

SEQ ID NO: 103057 - DNA, 25 bp, Homo sapien
cgaaaactcctgacgccgcgtaggc

SEQ ID NO: 103058 - DNA, 25 bp, Homo sapien
gtaggcaactcgtctccacaggata

SEQ ID NO: 103059 - DNA, 25 bp, Homo sapien
agcgaggtaaacaccggctgcctgc

SEQ ID NO: 103060 - DNA, 25 bp, Homo sapien
cgccaccgaggctctggacgatctg

SEQ ID NO: 103061 - DNA, 25 bp, Homo sapien
gggcctgggtgcacaagccaccttc

SEQ ID NO: 103062 - DNA, 25 bp, Homo sapien
acccggagggtctgcgctctctaca

SEQ ID NO: 103063 - DNA, 25 bp, Homo sapien
tccacaggatagacacccaaagggc

SEQ ID NO: 103064 - DNA, 25 bp, Homo sapien
ccaagcagggagtagcggctcagcc

SEQ ID NO: 103065 - DNA, 25 bp, Homo sapien
gacgatttgcgctcacgccaggacc

SEQ ID NO: 103066 - DNA, 25 bp, Homo sapien
ctaagcgctcaggacgacgatttgc

SEQ ID NO: 103067 - DNA, 25 bp, Homo sapien
cgccaggaccctagtcttcattgga

SEQ ID NO: 103068 - DNA, 25 bp, Homo sapien
tgtcctcattgaggccatctgagaa

SEQ ID NO: 103069 - DNA, 25 bp, Homo sapien
gccatctgagaataggggctatctg

SEQ ID NO: 103070 - DNA, 25 bp, Homo sapien
tccgcacggaccgacacgtggactg

SEQ ID NO: 103071 - DNA, 25 bp, Homo sapien
gactctccgagtagcaggtcccacg

SEQ ID NO: 103072 - DNA, 25 bp, Homo sapien
caaacccaggcgttctaagcgctca

SEQ ID NO: 103073 - DNA, 25 bp, Homo sapien
acacgtggcgcgcagaggccaatcc

SEQ ID NO: 103074 - DNA, 25 bp, Homo sapien
tcggagcccgttagcccagcagcaa

SEQ ID NO: 103075 - DNA, 25 bp, Homo sapien
acgcagcgctcgctggatcggagcc

SEQ ID NO: 103076 - DNA, 25 bp, Homo sapien
tgggcgcttatttcttgtgtccctg

SEQ ID NO: 103077 - DNA, 25 bp, Homo sapien
cagccgatgactgggcgcttatttc

SEQ ID NO: 103078 - DNA, 25 bp, Homo sapien
ggggtacccatcagccgatgactgg

SEQ ID NO: 103079 - DNA, 25 bp, Homo sapien
cccagtctgcgacactctcgggtta

SEQ ID NO: 103080 - DNA, 25 bp, Homo sapien
tctgcgacactctcgggttaccgcg

SEQ ID NO: 103081 - DNA, 25 bp, Homo sapien
agcgggaatcagctgcctttccctg

SEQ ID NO: 103082 - DNA, 25 bp, Homo sapien
cgtgtttgtaaactcggctgcttgg

SEQ ID NO: 103083 - DNA, 25 bp, Homo sapien
tatcccgggccgaccagagagagcc

SEQ ID NO: 103084 - DNA, 25 bp, Homo sapien
tgaaagcaaacttctccgccggcgc

SEQ ID NO: 103085 - DNA, 25 bp, Homo sapien
tcagcctgctgtgtctgcagcccat

SEQ ID NO: 103086 - DNA, 25 bp, Homo sapien
cggcgagaccctgaaactgaacctg

SEQ ID NO: 103087 - DNA, 25 bp, Homo sapien
actgaacctggaagcgctgtcttga

SEQ ID NO: 103088 - DNA, 25 bp, Homo sapien
agagcctccctcgtctctgagctgg

SEQ ID NO: 103089 - DNA, 25 bp, Homo sapien
gccgctcaagggagcacgtgacctc

SEQ ID NO: 103090 - DNA, 25 bp, Homo sapien
atggcgaggggctgatactgaaccc

SEQ ID NO: 103091 - DNA, 25 bp, Homo sapien
ggccagaacccgagcagtgagttcc

SEQ ID NO: 103092 - DNA, 25 bp, Homo sapien
agtgagttcctccactggctgccgg

SEQ ID NO: 103093 - DNA, 25 bp, Homo sapien
tggcagatgctccaggtcaggcact

SEQ ID NO: 103094 - DNA, 25 bp, Homo sapien
ccctctgtgaattgggcgaagcgtg

SEQ ID NO: 103095 - DNA, 25 bp, Homo sapien
gtcaggcactggatccgcccgggct

SEQ ID NO: 103096 - DNA, 25 bp, Homo sapien
gcagctgcggtacgacgctgacacc

SEQ ID NO: 103097 - DNA, 25 bp, Homo sapien
ctgaccacgcggtagccggtcttct

SEQ ID NO: 103098 - DNA, 25 bp, Homo sapien
tggaaaagtggccttcggctgaatc

SEQ ID NO: 103099 - DNA, 25 bp, Homo sapien
gcctgacctgcagcggcttttccag

SEQ ID NO: 103100 - DNA, 25 bp, Homo sapien
cacggaccgtgagctccagtggtgc

SEQ ID NO: 103101 - DNA, 25 bp, Homo sapien
tgcccaggtcagaggcacggaccgt

SEQ ID NO: 103102 - DNA, 25 bp, Homo sapien
ttctaggcccaccaccgagactgtg

SEQ ID NO: 103103 - DNA, 25 bp, Homo sapien
cgctgtgctcggtgttcaggaacac

SEQ ID NO: 103104 - DNA, 25 bp, Homo sapien
aacacgggcaggtagtcttctaggc

SEQ ID NO: 103105 - DNA, 25 bp, Homo sapien
tgcgcttccgagagtgcgcactaga

SEQ ID NO: 103106 - DNA, 25 bp, Homo sapien
tgagcccttcaagatcagcatccgg

SEQ ID NO: 103107 - DNA, 25 bp, Homo sapien
cagcatccggtcaagcggctgtgca

SEQ ID NO: 103108 - DNA, 25 bp, Homo sapien
tgtgcagccgagaagcaacccggga

SEQ ID NO: 103109 - DNA, 25 bp, Homo sapien
caacccgggactgcaagtctgcgtg

SEQ ID NO: 103110 - DNA, 25 bp, Homo sapien
cactcaccggcatgactgaggcagc

SEQ ID NO: 103111 - DNA, 25 bp, Homo sapien
ttggcctccatcgactgtcggcctt

SEQ ID NO: 103112 - DNA, 25 bp, Homo sapien
ctgtcggcctttttcagaacgccta

SEQ ID NO: 103113 - DNA, 25 bp, Homo sapien
tgtctatcagctccttccggcgttg

SEQ ID NO: 103114 - DNA, 25 bp, Homo sapien
gttgcgattggccacaggctgtctt

SEQ ID NO: 103115 - DNA, 25 bp, Homo sapien
cgctcctgcatggaaaacggatctc

SEQ ID NO: 103116 - DNA, 25 bp, Homo sapien
gaactgctcactcgcctttctattg

SEQ ID NO: 103117 - DNA, 25 bp, Homo sapien
acctggccgcaacaagttagggtga

SEQ ID NO: 103118 - DNA, 25 bp, Homo sapien
ccaattactgttcgaagagccctga

SEQ ID NO: 103119 - DNA, 25 bp, Homo sapien
ctgttactagggaaacgagatcctc

SEQ ID NO: 103120 - DNA, 25 bp, Homo sapien
ggtctctcttagtgccgatctgtta

SEQ ID NO: 103121 - DNA, 25 bp, Homo sapien
gaggaacagacctcgctctgcgccg

SEQ ID NO: 103122 - DNA, 25 bp, Homo sapien
acccgccgtggtcccgagagaggca

SEQ ID NO: 103123 - DNA, 25 bp, Homo sapien
agagaggcagccctggacgagaaca

SEQ ID NO: 103124 - DNA, 25 bp, Homo sapien
ggcgctggctgtcgccttccttggc

SEQ ID NO: 103125 - DNA, 25 bp, Homo sapien
ggtcaccacgaagcgctgggacatg

SEQ ID NO: 103126 - DNA, 25 bp, Homo sapien
cctgaggggaggaacagacctcgct

SEQ ID NO: 103127 - DNA, 25 bp, Homo sapien
cccgaagaacgaagagcggcctcgg

SEQ ID NO: 103128 - DNA, 25 bp, Homo sapien
ctcccgcgctataaatcatcagatc

SEQ ID NO: 103129 - DNA, 25 bp, Homo sapien
tgacggcgctgccttcagttaaatc

SEQ ID NO: 103130 - DNA, 25 bp, Homo sapien
ctgcttttcaggagcgcgaagagta

SEQ ID NO: 103131 - DNA, 25 bp, Homo sapien
cccgccgaataagttgtgatcactg

SEQ ID NO: 103132 - DNA, 25 bp, Homo sapien
gtctgctgtcgccttgctattcctg

SEQ ID NO: 103133 - DNA, 25 bp, Homo sapien
ggagagcgtccagacctgcttttca

SEQ ID NO: 103134 - DNA, 25 bp, Homo sapien
tggcgcatcgcaatccagtctcgga

SEQ ID NO: 103135 - DNA, 25 bp, Homo sapien
ttaaacggccagctccctgcaagga

SEQ ID NO: 103136 - DNA, 25 bp, Homo sapien
tcggaatctcgttctcctgcctctg

SEQ ID NO: 103137 - DNA, 25 bp, Homo sapien
cggaagtgctccttcagcgcagagg

SEQ ID NO: 103138 - DNA, 25 bp, Homo sapien
gtgccggtgtgtccgagaaaacttc

SEQ ID NO: 103139 - DNA, 25 bp, Homo sapien
tcccaactaagttctcaggcgctga

SEQ ID NO: 103140 - DNA, 25 bp, Homo sapien
caggcgctgacaacgacaagaattc

SEQ ID NO: 103141 - DNA, 25 bp, Homo sapien
ctcacacaaacgtagcgcttcaatc

SEQ ID NO: 103142 - DNA, 25 bp, Homo sapien
cgcttcaatcactaaaccgctttca

SEQ ID NO: 103143 - DNA, 25 bp, Homo sapien
tcgttcaggaagctccgcacctatc

SEQ ID NO: 103144 - DNA, 25 bp, Homo sapien
aacttccgagttaagccgccgctga

SEQ ID NO: 103145 - DNA, 25 bp, Homo sapien
acccgccggtttgcaggatctacag

SEQ ID NO: 103146 - DNA, 25 bp, Homo sapien
gcagcaaaggttcggctgcagtccc

SEQ ID NO: 103147 - DNA, 25 bp, Homo sapien
ggtcaaagtaggtccgcaggtcctg

SEQ ID NO: 103148 - DNA, 25 bp, Homo sapien
tttcatggccgggaacaccgagtcg

SEQ ID NO: 103149 - DNA, 25 bp, Homo sapien
ccgcggaacagtgagcgtgcagcac

SEQ ID NO: 103150 - DNA, 25 bp, Homo sapien
acagctccctacagtttgcagaggg

SEQ ID NO: 103151 - DNA, 25 bp, Homo sapien
caactccgggactttcgcaaagctc

SEQ ID NO: 103152 - DNA, 25 bp, Homo sapien
ttgcagagggcgttcacacctaacg

SEQ ID NO: 103153 - DNA, 25 bp, Homo sapien
ctgcgggcgcctcttcatagagaga

SEQ ID NO: 103154 - DNA, 25 bp, Homo sapien
ggggcgaaaactctgcccagcgatc

SEQ ID NO: 103155 - DNA, 25 bp, Homo sapien
cccagcgatcgcagcatgaagctct

SEQ ID NO: 103156 - DNA, 25 bp, Homo sapien
agcatgaagctctgcgctcccgaga

SEQ ID NO: 103157 - DNA, 25 bp, Homo sapien
ctcccgagaccatcgagtggccagg

SEQ ID NO: 103158 - DNA, 25 bp, Homo sapien
ttctatacttaacctccggccagcg

SEQ ID NO: 103159 - DNA, 25 bp, Homo sapien
ccgccgtgcaccgtattaggcaatg

SEQ ID NO: 103160 - DNA, 25 bp, Homo sapien
tttccgctcccgaggaaagtgcacc

SEQ ID NO: 103161 - DNA, 25 bp, Homo sapien
gtactgcagccctagtcgctcggaa

SEQ ID NO: 103162 - DNA, 25 bp, Homo sapien
ggcgcgggagtaagttcatcaaatg

SEQ ID NO: 103163 - DNA, 25 bp, Homo sapien
tcatcaaatgggacgaggtaagcgc

SEQ ID NO: 103164 - DNA, 25 bp, Homo sapien
tcagtcaagctcgaccagacgctgg

SEQ ID NO: 103165 - DNA, 25 bp, Homo sapien
tcgctcggaaacctcagtgggctga

SEQ ID NO: 103166 - DNA, 25 bp, Homo sapien
attagccggctaagtgctcccaggg

SEQ ID NO: 103167 - DNA, 25 bp, Homo sapien
aatcccgggactctttcagtcaagc

SEQ ID NO: 103168 - DNA, 25 bp, Homo sapien
ggctgatcccggaccgccttaagca

SEQ ID NO: 103169 - DNA, 25 bp, Homo sapien
gtcccttgaagcaggaatcgcgttc

SEQ ID NO: 103170 - DNA, 25 bp, Homo sapien
tcgcgttcttctgaaaggccatttg

SEQ ID NO: 103171 - DNA, 25 bp, Homo sapien
accttgacgtgtagaattgcagccc

SEQ ID NO: 103172 - DNA, 25 bp, Homo sapien
gtaggttctaggttcagtcccttga

SEQ ID NO: 103173 - DNA, 25 bp, Homo sapien
gccctccagtggtagcagagcctaa

SEQ ID NO: 103174 - DNA, 25 bp, Homo sapien
cctagaagagcgttgtcctgtgact

SEQ ID NO: 103175 - DNA, 25 bp, Homo sapien
aggccatttggcgatccctgaggag

SEQ ID NO: 103176 - DNA, 25 bp, Homo sapien
ccaggcaggaaaagcgcacgctctc

SEQ ID NO: 103177 - DNA, 25 bp, Homo sapien
acgcctccttcagcaagagggtcca

SEQ ID NO: 103178 - DNA, 25 bp, Homo sapien
atctcgcagaagaaactcaagctgg

SEQ ID NO: 103179 - DNA, 25 bp, Homo sapien
cagagctgctgcctcatcgaggacg

SEQ ID NO: 103180 - DNA, 25 bp, Homo sapien
agatgaacggcttcagcacggagga

SEQ ID NO: 103181 - DNA, 25 bp, Homo sapien
ccggcagaaggctcctccgggtgac

SEQ ID NO: 103182 - DNA, 25 bp, Homo sapien
agcggctgtttcctgggacgccctc

SEQ ID NO: 103183 - DNA, 25 bp, Homo sapien
cagagagcaaatgagaccaatggtc

SEQ ID NO: 103184 - DNA, 25 bp, Homo sapien
ctggacatcgacaagagcgtgagtc

SEQ ID NO: 103185 - DNA, 25 bp, Homo sapien
aagttccaagacagcctcacgggtc

SEQ ID NO: 103186 - DNA, 25 bp, Homo sapien
tccaggtgcgcagagcgaaagttcc

SEQ ID NO: 103187 - DNA, 25 bp, Homo sapien
cctgctacggtgtttacagccaaga

SEQ ID NO: 103188 - DNA, 25 bp, Homo sapien
cagccaagactaatggggtcccata

SEQ ID NO: 103189 - DNA, 25 bp, Homo sapien
ccactgtttcctagcgcccataaaa

SEQ ID NO: 103190 - DNA, 25 bp, Homo sapien
ttaccgccaagtgttgccctagtta

SEQ ID NO: 103191 - DNA, 25 bp, Homo sapien
gtgcgtcggacaggctcattaccgc

SEQ ID NO: 103192 - DNA, 25 bp, Homo sapien
gaggtctcctttcttgttcccaagc

SEQ ID NO: 103193 - DNA, 25 bp, Homo sapien
actgacgcgcgttgatttggcttta

SEQ ID NO: 103194 - DNA, 25 bp, Homo sapien
ataacaacttctttcgaggcgccgc

SEQ ID NO: 103195 - DNA, 25 bp, Homo sapien
ggcctcggctcactggtttaactcc

SEQ ID NO: 103196 - DNA, 25 bp, Homo sapien
gccggtgcgtcctttaatcctcttc

SEQ ID NO: 103197 - DNA, 25 bp, Homo sapien
aatttgcctttatgcgcggagttcc

SEQ ID NO: 103198 - DNA, 25 bp, Homo sapien
tcccgctctttcagcaggaaccaag

SEQ ID NO: 103199 - DNA, 25 bp, Homo sapien
atccaagtgtgtggttgcagccgac

SEQ ID NO: 103200 - DNA, 25 bp, Homo sapien
atcctcttctcgactgggcccaggg

SEQ ID NO: 103201 - DNA, 25 bp, Homo sapien
agagcccgccttttgattttacaga

SEQ ID NO: 103202 - DNA, 25 bp, Homo sapien
tagtcatcggccctttctggagaga

SEQ ID NO: 103203 - DNA, 25 bp, Homo sapien
ctactgaccagcgaagaagcctttc

SEQ ID NO: 103204 - DNA, 25 bp, Homo sapien
tatcccaggttttacgctcagcccg

SEQ ID NO: 103205 - DNA, 25 bp, Homo sapien
tggcttatataagaccgcggctttg

SEQ ID NO: 103206 - DNA, 25 bp, Homo sapien
tcgccgaagcccaaagacctgttta

SEQ ID NO: 103207 - DNA, 25 bp, Homo sapien
gcagcccactgtcttcttaccggtt

SEQ ID NO: 103208 - DNA, 25 bp, Homo sapien
gctttgatgtcaacctctcccggga

SEQ ID NO: 103209 - DNA, 25 bp, Homo sapien
aacgcgccataaatcagcccgcgga

SEQ ID NO: 103210 - DNA, 25 bp, Homo sapien
tcgcgtcgcgcagtaacgcgccata

SEQ ID NO: 103211 - DNA, 25 bp, Homo sapien
ttctcgctgtcttggggaatcgcgt

SEQ ID NO: 103212 - DNA, 25 bp, Homo sapien
cgcggtgtaaaatattctcgctgtc

SEQ ID NO: 103213 - DNA, 25 bp, Homo sapien
gcctgtttatattagcgcggtgtaa

SEQ ID NO: 103214 - DNA, 25 bp, Homo sapien
ccggccggccgcctgtttatattag

SEQ ID NO: 103215 - DNA, 25 bp, Homo sapien
ccgtgaccttgacgccacgggcaat

SEQ ID NO: 103216 - DNA, 25 bp, Homo sapien
tagggcagtaaatcaaggacctgtc

SEQ ID NO: 103217 - DNA, 25 bp, Homo sapien
aggacctgacaaagagcgcctcctc

SEQ ID NO: 103218 - DNA, 25 bp, Homo sapien
gccattcataacatgtccgccagaa

SEQ ID NO: 103219 - DNA, 25 bp, Homo sapien
cgctgggcgatcaggctgcctaact

SEQ ID NO: 103220 - DNA, 25 bp, Homo sapien
atcaggctgcctaactggccggctt

SEQ ID NO: 103221 - DNA, 25 bp, Homo sapien
agctgcccgccattcataacatgtc

SEQ ID NO: 103222 - DNA, 25 bp, Homo sapien
agcccggtcctctgtcgcaggagaa

SEQ ID NO: 103223 - DNA, 25 bp, Homo sapien
gtcctctgtcgcaggagaaccgctg

SEQ ID NO: 103224 - DNA, 25 bp, Homo sapien
catgtccgccagaacccgggaagca

SEQ ID NO: 103225 - DNA, 25 bp, Homo sapien
gctgcagtgggttacagagaacgtc

SEQ ID NO: 103226 - DNA, 25 bp, Homo sapien
agcagagtcacacggagctgcagtg

SEQ ID NO: 103227 - DNA, 25 bp, Homo sapien
tgggttacagagaacgtctggatta

SEQ ID NO: 103228 - DNA, 25 bp, Homo sapien
cgtctggattatagacgcagaagtc

SEQ ID NO: 103229 - DNA, 25 bp, Homo sapien
gtgggttacagagaacgtctggatt

SEQ ID NO: 103230 - DNA, 25 bp, Homo sapien
ctggattatagacgcagaagtcacg

SEQ ID NO: 103231 - DNA, 25 bp, Homo sapien
agtcacggaagagcagagtcacacg

SEQ ID NO: 103232 - DNA, 25 bp, Homo sapien
gcagaagtcacggaagagcagagtc

SEQ ID NO: 103233 - DNA, 25 bp, Homo sapien
tccgtaacttcgacacggcagtctc

SEQ ID NO: 103234 - DNA, 25 bp, Homo sapien
cctcggggttcaagacgagttccag

SEQ ID NO: 103235 - DNA, 25 bp, Homo sapien
tccagtgggagaatgtcgcaccctg

SEQ ID NO: 103236 - DNA, 25 bp, Homo sapien
cgcctaagtgcaactgcgatgtttg

SEQ ID NO: 103237 - DNA, 25 bp, Homo sapien
tgaaaggcccgagcacatggtcctg

SEQ ID NO: 103238 - DNA, 25 bp, Homo sapien
ccgtcctggggtgaaggactccaga

SEQ ID NO: 103239 - DNA, 25 bp, Homo sapien
cggccttgttcctcaccaaagcaaa

SEQ ID NO: 103240 - DNA, 25 bp, Homo sapien
ccattagcatggtttggaggcttcc

SEQ ID NO: 103241 - DNA, 25 bp, Homo sapien
gtaggagccctagcaccaccacgag

SEQ ID NO: 103242 - DNA, 25 bp, Homo sapien
gcgctgacagctcccatcaggttgg

SEQ ID NO: 103243 - DNA, 25 bp, Homo sapien
acaccgaggcaggaaccaagtgccg

SEQ ID NO: 103244 - DNA, 25 bp, Homo sapien
caggaaccaagtgccgcggagacag

SEQ ID NO: 103245 - DNA, 25 bp, Homo sapien
ccgcggagacagaggtcgcgctcct

SEQ ID NO: 103246 - DNA, 25 bp, Homo sapien
cgctcctggaggttgggcacctgta

SEQ ID NO: 103247 - DNA, 25 bp, Homo sapien
cccttgcgaaacagacgcgcgtgtt

SEQ ID NO: 103248 - DNA, 25 bp, Homo sapien
aaacagacgcgcgtgttaaaagctg

SEQ ID NO: 103249 - DNA, 25 bp, Homo sapien
cagagcaattctgccctgagcgaga

SEQ ID NO: 103250 - DNA, 25 bp, Homo sapien
tctccttcgagaaccatgtggactc

SEQ ID NO: 103251 - DNA, 25 bp, Homo sapien
atgggccgtatcctggtgaagaaca

SEQ ID NO: 103252 - DNA, 25 bp, Homo sapien
cgagcctctggacaagtacccggta

SEQ ID NO: 103253 - DNA, 25 bp, Homo sapien
tccatctttggagacgcgctactca

SEQ ID NO: 103254 - DNA, 25 bp, Homo sapien
tggctgagtactgccgctccatctt

SEQ ID NO: 103255 - DNA, 25 bp, Homo sapien
gttccgcagggcaaagcaacaggca

SEQ ID NO: 103256 - DNA, 25 bp, Homo sapien
gccattgccgagactgccttcaaga

SEQ ID NO: 103257 - DNA, 25 bp, Homo sapien
accactaaggagcatgagcgtcgta

SEQ ID NO: 103258 - DNA, 25 bp, Homo sapien
ggctcggtcacttaaggctgctttc

SEQ ID NO: 103259 - DNA, 25 bp, Homo sapien
tgaatggcactcttcccacactgtg

SEQ ID NO: 103260 - DNA, 25 bp, Homo sapien
gccaggtgatctcgcaagctcccga

SEQ ID NO: 103261 - DNA, 25 bp, Homo sapien
tagatgacctcatcccagccaggtg

SEQ ID NO: 103262 - DNA, 25 bp, Homo sapien
tggactttagactcagacgaccgcg

SEQ ID NO: 103263 - DNA, 25 bp, Homo sapien
gtgatcagccacgtgaccctagcca

SEQ ID NO: 103264 - DNA, 25 bp, Homo sapien
ttgacttctcttggggtgatcagcc

SEQ ID NO: 103265 - DNA, 25 bp, Homo sapien
cccgcccgcactggtggtgtgcgga

SEQ ID NO: 103266 - DNA, 25 bp, Homo sapien
acgcgcaggtctcgctgggatgacc

SEQ ID NO: 103267 - DNA, 25 bp, Homo sapien
gctgtgcgacaacggcctggcggga

SEQ ID NO: 103268 - DNA, 25 bp, Homo sapien
gcacagtcctcaggattcccgaaga

SEQ ID NO: 103269 - DNA, 25 bp, Homo sapien
agtcctcaggattcccgaagaggta

SEQ ID NO: 103270 - DNA, 25 bp, Homo sapien
tcaggattcccgaagaggtaaaata

SEQ ID NO: 103271 - DNA, 25 bp, Homo sapien
ttcccgaagaggtaaaatagatata

SEQ ID NO: 103272 - DNA, 25 bp, Homo sapien
ggagtattcggcatcccagccgccg

SEQ ID NO: 103273 - DNA, 25 bp, Homo sapien
ggtgaacccgtggactaagaacgca

SEQ ID NO: 103274 - DNA, 25 bp, Homo sapien
taaaattgcctcctggttgatcctg

SEQ ID NO: 103275 - DNA, 25 bp, Homo sapien
gatttacggcggctgcatctaactg

SEQ ID NO: 103276 - DNA, 25 bp, Homo sapien
cgggcgctctgctagccaagttcga

SEQ ID NO: 103277 - DNA, 25 bp, Homo sapien
gcgccacgctcttgcaggccgaaga

SEQ ID NO: 103278 - DNA, 25 bp, Homo sapien
ggtcatggtgactcgggacttttta

SEQ ID NO: 103279 - DNA, 25 bp, Homo sapien
tcctgaccaccgtgaacggacagtc

SEQ ID NO: 103280 - DNA, 25 bp, Homo sapien
taagaacgcattgccgccggtcctg

SEQ ID NO: 103281 - DNA, 25 bp, Homo sapien
cctgcgcgtccgcaaagattttgga

SEQ ID NO: 103282 - DNA, 25 bp, Homo sapien
ttcgctcggaaagaggaccaaaatg

SEQ ID NO: 103283 - DNA, 25 bp, Homo sapien
tattcggcggcaccctgttacttct

SEQ ID NO: 103284 - DNA, 25 bp, Homo sapien
cggacgtcacccacattcggctttg

SEQ ID NO: 103285 - DNA, 25 bp, Homo sapien
aggcgccgtcctctttgtaactcga

SEQ ID NO: 103286 - DNA, 25 bp, Homo sapien
gcccgtgggtctcgacactaaaatc

SEQ ID NO: 103287 - DNA, 25 bp, Homo sapien
tttgtgagacatctacggggccatg

SEQ ID NO: 103288 - DNA, 25 bp, Homo sapien
tgctatggcaatgttcctcgctctg

SEQ ID NO: 103289 - DNA, 25 bp, Homo sapien
tccgcgcggcgaagccaaagaggcc

SEQ ID NO: 103290 - DNA, 25 bp, Homo sapien
cctcagtacctagcccgcggtagga

SEQ ID NO: 103291 - DNA, 25 bp, Homo sapien
cgccttctcgggcagtcgctacggt

SEQ ID NO: 103292 - DNA, 25 bp, Homo sapien
cgctcgtagcctcacgccttaggta

SEQ ID NO: 103293 - DNA, 25 bp, Homo sapien
agagaagctgccacagccgaccgct

SEQ ID NO: 103294 - DNA, 25 bp, Homo sapien
gccgtcagagacaagagaagctgcc

SEQ ID NO: 103295 - DNA, 25 bp, Homo sapien
tacaaagggcagtaagtctcgggcc

SEQ ID NO: 103296 - DNA, 25 bp, Homo sapien
gcccaagggtggtgagttacctcga

SEQ ID NO: 103297 - DNA, 25 bp, Homo sapien
gctagcggcttgcatggacggcaaa

SEQ ID NO: 103298 - DNA, 25 bp, Homo sapien
ccctattccgttggcaagtcccttg

SEQ ID NO: 103299 - DNA, 25 bp, Homo sapien
tggcagaggaatgcaacactgtttc

SEQ ID NO: 103300 - DNA, 25 bp, Homo sapien
gccctgcgggatagcgtttataccc

SEQ ID NO: 103301 - DNA, 25 bp, Homo sapien
aagttgggtctccttgcgcttaatc

SEQ ID NO: 103302 - DNA, 25 bp, Homo sapien
ttcctccaactcgattgccgcgggg

SEQ ID NO: 103303 - DNA, 25 bp, Homo sapien
gcgcgatgctgcttcgcttcttcta

SEQ ID NO: 103304 - DNA, 25 bp, Homo sapien
gcaagtcccttgtctatcccggagg

SEQ ID NO: 103305 - DNA, 25 bp, Homo sapien
taacatcttggcgacctatcatcca

SEQ ID NO: 103306 - DNA, 25 bp, Homo sapien
agaactatgaaaaagggcgtcggat

SEQ ID NO: 103307 - DNA, 25 bp, Homo sapien
gtgtccacagtacaaaagaactatg

SEQ ID NO: 103308 - DNA, 25 bp, Homo sapien
catggtgtccacagtacaaaagaac

SEQ ID NO: 103309 - DNA, 25 bp, Homo sapien
ttacaacttgttacatctataaaga

SEQ ID NO: 103310 - DNA, 25 bp, Homo sapien
tcgttgtgacaaccgctccagtagc

SEQ ID NO: 103311 - DNA, 25 bp, Homo sapien
gaaattaacatcttggcgacctatc

SEQ ID NO: 103312 - DNA, 25 bp, Homo sapien
gaaaaagggcgtcggatttgctcca

SEQ ID NO: 103313 - DNA, 25 bp, Homo sapien
ctccgggaagaagccaccgactctg

SEQ ID NO: 103314 - DNA, 25 bp, Homo sapien
tgcgcctacgtatgtttgactcctc

SEQ ID NO: 103315 - DNA, 25 bp, Homo sapien
tctgcagccgaaaccaacttccggt

SEQ ID NO: 103316 - DNA, 25 bp, Homo sapien
ccgactctgtccttgattggctgta

SEQ ID NO: 103317 - DNA, 25 bp, Homo sapien
gattggctgtaagagctgtccttta

SEQ ID NO: 103318 - DNA, 25 bp, Homo sapien
aacgaaattctagctccgcctcaga

SEQ ID NO: 103319 - DNA, 25 bp, Homo sapien
gatccctcgctgttgcgcctacgta

SEQ ID NO: 103320 - DNA, 25 bp, Homo sapien
cctcagctctggctttacactggta

SEQ ID NO: 103321 - DNA, 25 bp, Homo sapien
ctctgagcggaacagcgagccacct

SEQ ID NO: 103322 - DNA, 25 bp, Homo sapien
cctaccgtcagcaatggagccgtga

SEQ ID NO: 103323 - DNA, 25 bp, Homo sapien
tttcatcctcatggcgcaaacggga

SEQ ID NO: 103324 - DNA, 25 bp, Homo sapien
tccacggcggctttcatcctcatgg

SEQ ID NO: 103325 - DNA, 25 bp, Homo sapien
caggaacagacgtccacggcggctt

SEQ ID NO: 103326 - DNA, 25 bp, Homo sapien
tgtgcgaaaggcaggaacagacgtc

SEQ ID NO: 103327 - DNA, 25 bp, Homo sapien
ctccgggcatgaatgtgcgaaaggc

SEQ ID NO: 103328 - DNA, 25 bp, Homo sapien
cgcttacctcggagaactccgggca

SEQ ID NO: 103329 - DNA, 25 bp, Homo sapien
tcagggaccggagacacctgcagcg

SEQ ID NO: 103330 - DNA, 25 bp, Homo sapien
tcgagtccaggtactgcagagcgct

SEQ ID NO: 103331 - DNA, 25 bp, Homo sapien
cgcctcgggcacacagaacgtgtga

SEQ ID NO: 103332 - DNA, 25 bp, Homo sapien
agcggcgacatcctcgagtccaggt

SEQ ID NO: 103333 - DNA, 25 bp, Homo sapien
cgcagccatttcctgccctttgtgt

SEQ ID NO: 103334 - DNA, 25 bp, Homo sapien
gctgagcggtcctccgaaaccgaga

SEQ ID NO: 103335 - DNA, 25 bp, Homo sapien
aagctctcgtcctcgggttgctgca

SEQ ID NO: 103336 - DNA, 25 bp, Homo sapien
gaggccgtggaagaagccttccctc

SEQ ID NO: 103337 - DNA, 25 bp, Homo sapien
cagctctgaactggctgagcgaggt

SEQ ID NO: 103338 - DNA, 25 bp, Homo sapien
acgcagctctgaactggctgagcga

SEQ ID NO: 103339 - DNA, 25 bp, Homo sapien
aacggtcacgcacccgggagcagcg

SEQ ID NO: 103340 - DNA, 25 bp, Homo sapien
aggaggagaacacgcagctctgaac

SEQ ID NO: 103341 - DNA, 25 bp, Homo sapien
actcggagagccaggaggagaacac

SEQ ID NO: 103342 - DNA, 25 bp, Homo sapien
gcctctggtggcctgtgccagcaac

SEQ ID NO: 103343 - DNA, 25 bp, Homo sapien
ggcctgtgccagcaacggtcacgca

SEQ ID NO: 103344 - DNA, 25 bp, Homo sapien
cacctgtcgggcgctgactcggaga

SEQ ID NO: 103345 - DNA, 25 bp, Homo sapien
ggggacaagtcgcggccacctgctc

SEQ ID NO: 103346 - DNA, 25 bp, Homo sapien
cctagcacggggcggtgactccaga

SEQ ID NO: 103347 - DNA, 25 bp, Homo sapien
tgggagcctggcagcgtcctcaccc

SEQ ID NO: 103348 - DNA, 25 bp, Homo sapien
attgcccaagatgccgggtgactcc

SEQ ID NO: 103349 - DNA, 25 bp, Homo sapien
acaccagctgcgagaacggtgcgta

SEQ ID NO: 103350 - DNA, 25 bp, Homo sapien
atggagctgcgggtcagcaacacca

SEQ ID NO: 103351 - DNA, 25 bp, Homo sapien
agctgcgggtcagcaacaccagctg

SEQ ID NO: 103352 - DNA, 25 bp, Homo sapien
cggaattgcccaagatgccgggtga

SEQ ID NO: 103353 - DNA, 25 bp, Homo sapien
cagcccgtctgcagcggtggagcca

SEQ ID NO: 103354 - DNA, 25 bp, Homo sapien
agccttctccggtcataatgagaga

SEQ ID NO: 103355 - DNA, 25 bp, Homo sapien
cagggctaagccttctccggtcata

SEQ ID NO: 103356 - DNA, 25 bp, Homo sapien
ccgaactgtcggaagagctctcagc

SEQ ID NO: 103357 - DNA, 25 bp, Homo sapien
agtctggagtcagcccagcccgtct

SEQ ID NO: 103358 - DNA, 25 bp, Homo sapien
tttgaaaacgctgactgttggtccc

SEQ ID NO: 103359 - DNA, 25 bp, Homo sapien
cgccggtgctcgctctatttgaaaa

SEQ ID NO: 103360 - DNA, 25 bp, Homo sapien
ctcagcctctgggtttgaggcggcc

SEQ ID NO: 103361 - DNA, 25 bp, Homo sapien
ccagggcgcagaacgtgggaacaaa

SEQ ID NO: 103362 - DNA, 25 bp, Homo sapien
cttgggtgacactcagaggtgattc

SEQ ID NO: 103363 - DNA, 25 bp, Homo sapien
gcaaacgccagcaagcagagccggg

SEQ ID NO: 103364 - DNA, 25 bp, Homo sapien
actcgggcttctaggagttaaactg

SEQ ID NO: 103365 - DNA, 25 bp, Homo sapien
ggcccgtttactgtcccgcactgtg

SEQ ID NO: 103366 - DNA, 25 bp, Homo sapien
tgccagacgccttgggtgacactca

SEQ ID NO: 103367 - DNA, 25 bp, Homo sapien
agaggtgattcacccagcgccgtcc

SEQ ID NO: 103368 - DNA, 25 bp, Homo sapien
ccagtgagcggaccggctgttttct

SEQ ID NO: 103369 - DNA, 25 bp, Homo sapien
ggctccatggctgctgcccaaaagg

SEQ ID NO: 103370 - DNA, 25 bp, Homo sapien
cgatacccgtggacggccaatcaca

SEQ ID NO: 103371 - DNA, 25 bp, Homo sapien
cgtgctgagtcctcgaatcacctgc

SEQ ID NO: 103372 - DNA, 25 bp, Homo sapien
atcacctgccatggtaggagccgcc

SEQ ID NO: 103373 - DNA, 25 bp, Homo sapien
ggagccgccgcacttgttgcacatt

SEQ ID NO: 103374 - DNA, 25 bp, Homo sapien
gttgcacattttcgttctgactctc

SEQ ID NO: 103375 - DNA, 25 bp, Homo sapien
gtggagttctcttacagccgttgtc

SEQ ID NO: 103376 - DNA, 25 bp, Homo sapien
ccgccttgcatcgagtctctcatga

SEQ ID NO: 103377 - DNA, 25 bp, Homo sapien
tgccgagggacaatattaccgcgtc

SEQ ID NO: 103378 - DNA, 25 bp, Homo sapien
agccgcaatgacacagccgactagg

SEQ ID NO: 103379 - DNA, 25 bp, Homo sapien
cccaggatagtcgatttctcgtagc

SEQ ID NO: 103380 - DNA, 25 bp, Homo sapien
tctttctccaacagggaagccgcaa

SEQ ID NO: 103381 - DNA, 25 bp, Homo sapien
gtcttcacagcaacgcgccgggtct

SEQ ID NO: 103382 - DNA, 25 bp, Homo sapien
acgtcgaagcggaaaaggtctgctc

SEQ ID NO: 103383 - DNA, 25 bp, Homo sapien
tcgggttcgaactaccagcgcgata

SEQ ID NO: 103384 - DNA, 25 bp, Homo sapien
atgcccagagcgttcgtcagaccct

SEQ ID NO: 103385 - DNA, 25 bp, Homo sapien
tgactttccctctcttgtggcgttc

SEQ ID NO: 103386 - DNA, 25 bp, Homo sapien
cgttctctccctgccgttgtcttta

SEQ ID NO: 103387 - DNA, 25 bp, Homo sapien
acgggttgccagttttcgctctgac

SEQ ID NO: 103388 - DNA, 25 bp, Homo sapien
tgctgagtcctcaaatcacccgtga

SEQ ID NO: 103389 - DNA, 25 bp, Homo sapien
agctctatgtctcggcgtcacccaa

SEQ ID NO: 103390 - DNA, 25 bp, Homo sapien
agcctagctctctccatggaggttg

SEQ ID NO: 103391 - DNA, 25 bp, Homo sapien
tcttcacggccgctgcccaaaagga

SEQ ID NO: 103392 - DNA, 25 bp, Homo sapien
gctcctacttcttggccttgacgtg

SEQ ID NO: 103393 - DNA, 25 bp, Homo sapien
atctggccctttcctttccgcgtgt

SEQ ID NO: 103394 - DNA, 25 bp, Homo sapien
gacagtgcctgaacgctggctgtta

SEQ ID NO: 103395 - DNA, 25 bp, Homo sapien
gctccagtcacggttaccagggtaa

SEQ ID NO: 103396 - DNA, 25 bp, Homo sapien
gcgcttccggggaatccagcttctt

SEQ ID NO: 103397 - DNA, 25 bp, Homo sapien
ttccatcggtgagcgagctcgactc

SEQ ID NO: 103398 - DNA, 25 bp, Homo sapien
ggacttcgaggctgacgacacctgc

SEQ ID NO: 103399 - DNA, 25 bp, Homo sapien
catcactctgagacggtacctgaga

SEQ ID NO: 103400 - DNA, 25 bp, Homo sapien
ggcgaccatggcaaaaagcaagttc

SEQ ID NO: 103401 - DNA, 25 bp, Homo sapien
cgagagcttcctcaggaccggagtc

SEQ ID NO: 103402 - DNA, 25 bp, Homo sapien
ggcttgcgggcctttcaaacatgga

SEQ ID NO: 103403 - DNA, 25 bp, Homo sapien
aaactgcgctggagcaggtcaagca

SEQ ID NO: 103404 - DNA, 25 bp, Homo sapien
acgtgctcacgcgaatgccctgtga

SEQ ID NO: 103405 - DNA, 25 bp, Homo sapien
tggcggcttcgttccttcttcccat

SEQ ID NO: 103406 - DNA, 25 bp, Homo sapien
cctgcttcaacaacgtggcggagta

SEQ ID NO: 103407 - DNA, 25 bp, Homo sapien
tccgccgtctcatggtggccaaaga

SEQ ID NO: 103408 - DNA, 25 bp, Homo sapien
cagcgttaacctgtcagctatggga

SEQ ID NO: 103409 - DNA, 25 bp, Homo sapien
acttgtagttttccctgagtgccga

SEQ ID NO: 103410 - DNA, 25 bp, Homo sapien
ccgatactcacgctttgtccaccag

SEQ ID NO: 103411 - DNA, 25 bp, Homo sapien
tgtccaccagctcgcgcaccttcca

SEQ ID NO: 103412 - DNA, 25 bp, Homo sapien
gcaccttccacatgttcaacatcgt

SEQ ID NO: 103413 - DNA, 25 bp, Homo sapien
cacttccgtaccggggcagttccag

SEQ ID NO: 103414 - DNA, 25 bp, Homo sapien
tgacacgtcgagacgcggcagcaca

SEQ ID NO: 103415 - DNA, 25 bp, Homo sapien
ggaagtgtccgactttccgccgctg

SEQ ID NO: 103416 - DNA, 25 bp, Homo sapien
cgtggagcggaagtgtccgactttc

SEQ ID NO: 103417 - DNA, 25 bp, Homo sapien
gacggccatcacagatggccacttc

SEQ ID NO: 103418 - DNA, 25 bp, Homo sapien
tcgccgacggtcacctcccacctcc

SEQ ID NO: 103419 - DNA, 25 bp, Homo sapien
cagccatcacagacagtcacctccc

SEQ ID NO: 103420 - DNA, 25 bp, Homo sapien
cgacggccatcacagatggccactt

SEQ ID NO: 103421 - DNA, 25 bp, Homo sapien
ggccatcgccgacggtcacctccca

SEQ ID NO: 103422 - DNA, 25 bp, Homo sapien
acggccatcgccgacggtcacctcc

SEQ ID NO: 103423 - DNA, 25 bp, Homo sapien
agtcgacggccatcgccgacggtca

SEQ ID NO: 103424 - DNA, 25 bp, Homo sapien
atcacagatggccacttcccacctc

SEQ ID NO: 103425 - DNA, 25 bp, Homo sapien
tcgtgagccccggaggaaacctctc

SEQ ID NO: 103426 - DNA, 25 bp, Homo sapien
agccattgggcagcttcggggtcct

SEQ ID NO: 103427 - DNA, 25 bp, Homo sapien
tggtgcaccgcgcaccgctcagacg

SEQ ID NO: 103428 - DNA, 25 bp, Homo sapien
ccagcctcccaaaagcaaacgtgtc

SEQ ID NO: 103429 - DNA, 25 bp, Homo sapien
cgaaagtcagggaaggccgtgtaag

SEQ ID NO: 103430 - DNA, 25 bp, Homo sapien
gacgcgacccgtccatctgccgagc

SEQ ID NO: 103431 - DNA, 25 bp, Homo sapien
gcgctcggcttcctgttagtccgcg

SEQ ID NO: 103432 - DNA, 25 bp, Homo sapien
cggcctttccagttcggtccactgg

SEQ ID NO: 103433 - DNA, 25 bp, Homo sapien
acatgtgcgactcgtgtttcggctt

SEQ ID NO: 103434 - DNA, 25 bp, Homo sapien
tgtttcggctttcgctggcgacaaa

SEQ ID NO: 103435 - DNA, 25 bp, Homo sapien
ttcgctggcgacaaactggagccgg

SEQ ID NO: 103436 - DNA, 25 bp, Homo sapien
gcctttccgcttaggaggaactcgc

SEQ ID NO: 103437 - DNA, 25 bp, Homo sapien
aggaggaactcgctacgtgtcgcta

SEQ ID NO: 103438 - DNA, 25 bp, Homo sapien
acgtgtcgctaacaacaacacaaac

SEQ ID NO: 103439 - DNA, 25 bp, Homo sapien
cgctccacatgtgcgactcgtgttt

SEQ ID NO: 103440 - DNA, 25 bp, Homo sapien
ctcgctacgtgtcgctaacaacaac

SEQ ID NO: 103441 - DNA, 25 bp, Homo sapien
gggtgcgtcctcagaactcgctgaa

SEQ ID NO: 103442 - DNA, 25 bp, Homo sapien
gaatctcacgtctcagctagcaggg

SEQ ID NO: 103443 - DNA, 25 bp, Homo sapien
tggaaaacatgctcggcgtctcgcc

SEQ ID NO: 103444 - DNA, 25 bp, Homo sapien
agtgaacccaccttcgcggagtaga

SEQ ID NO: 103445 - DNA, 25 bp, Homo sapien
tttgcgcgcgagatgaaactctata

SEQ ID NO: 103446 - DNA, 25 bp, Homo sapien
ccttcaggcgacatagacccagctg

SEQ ID NO: 103447 - DNA, 25 bp, Homo sapien
ccaaaacatccagtgggcgctcttc

SEQ ID NO: 103448 - DNA, 25 bp, Homo sapien
tcgcggagtagaacccacagttata

SEQ ID NO: 103449 - DNA, 25 bp, Homo sapien
gacgaaggcagagcggctggagagc

SEQ ID NO: 103450 - DNA, 25 bp, Homo sapien
atccacgtccgcaccgcgttcatgc

SEQ ID NO: 103451 - DNA, 25 bp, Homo sapien
cctgcatccacgtccgcaccgcgtt

SEQ ID NO: 103452 - DNA, 25 bp, Homo sapien
ccggcgccctgcatccacgtccgca

SEQ ID NO: 103453 - DNA, 25 bp, Homo sapien
tgggctcctcgcagacagctccagg

SEQ ID NO: 103454 - DNA, 25 bp, Homo sapien
agcggctgcggactcaccccgccgc

SEQ ID NO: 103455 - DNA, 25 bp, Homo sapien
cggccgcaggcgacgaaggcagagc

SEQ ID NO: 103456 - DNA, 25 bp, Homo sapien
cacctctgcgccgccgtgttggcgt

SEQ ID NO: 103457 - DNA, 25 bp, Homo sapien
agcgctgagcactgacgtctgggct

SEQ ID NO: 103458 - DNA, 25 bp, Homo sapien
gccggccaaagttcctcgcaaagtg

SEQ ID NO: 103459 - DNA, 25 bp, Homo sapien
aggtgcccacctcttcgctttgagg

SEQ ID NO: 103460 - DNA, 25 bp, Homo sapien
tcaggaatttgagctggggatctgc

SEQ ID NO: 103461 - DNA, 25 bp, Homo sapien
ggggatctgcatcctggccattgca

SEQ ID NO: 103462 - DNA, 25 bp, Homo sapien
ttgcagtcctttagcatcctcgccg

SEQ ID NO: 103463 - DNA, 25 bp, Homo sapien
cccttcatttgcataacgtcatctt

SEQ ID NO: 103464 - DNA, 25 bp, Homo sapien
cagaaaaagcaggacgcgcgtccca

SEQ ID NO: 103465 - DNA, 25 bp, Homo sapien
ctccagaggagtcgaccagcagcct

SEQ ID NO: 103466 - DNA, 25 bp, Homo sapien
ccctgaactgcacccggaagatggc

SEQ ID NO: 103467 - DNA, 25 bp, Homo sapien
aagatggcgcgagtggccgaacacc

SEQ ID NO: 103468 - DNA, 25 bp, Homo sapien
cagccctcaaaaccgtggctctttt

SEQ ID NO: 103469 - DNA, 25 bp, Homo sapien
cgtggctcttttcctcggtgatctc

SEQ ID NO: 103470 - DNA, 25 bp, Homo sapien
ctcggtgatctccatgcgcagtcct

SEQ ID NO: 103471 - DNA, 25 bp, Homo sapien
tctccatgcgcagtcctcggggaac

SEQ ID NO: 103472 - DNA, 25 bp, Homo sapien
agtggccgaacaccgtgacacaccg

SEQ ID NO: 103473 - DNA, 25 bp, Homo sapien
tgcgcgtactgaatgcgcattcacg

SEQ ID NO: 103474 - DNA, 25 bp, Homo sapien
agttaccgatgtgcttctctctctc

SEQ ID NO: 103475 - DNA, 25 bp, Homo sapien
ggtcagttaccgatgtgcttctctc

SEQ ID NO: 103476 - DNA, 25 bp, Homo sapien
cgtcctaactaatgcgcgtactgaa

SEQ ID NO: 103477 - DNA, 25 bp, Homo sapien
ggaagactatgaaacgtcctaacta

SEQ ID NO: 103478 - DNA, 25 bp, Homo sapien
atgcgcattcacgtggtcagttacc

SEQ ID NO: 103479 - DNA, 25 bp, Homo sapien
acgtggtcagttaccgatgtgcttc

SEQ ID NO: 103480 - DNA, 25 bp, Homo sapien
tctctcctggcccgcagggacagag

SEQ ID NO: 103481 - DNA, 25 bp, Homo sapien
agctgccgtgaagatgccaaaccca

SEQ ID NO: 103482 - DNA, 25 bp, Homo sapien
ttgatgcttgccgtgtgtcctaaaa

SEQ ID NO: 103483 - DNA, 25 bp, Homo sapien
cctcgcctacggtctctgattattg

SEQ ID NO: 103484 - DNA, 25 bp, Homo sapien
tgacccgcgagctccagaatctttc

SEQ ID NO: 103485 - DNA, 25 bp, Homo sapien
cctgctggacagttccgtgctctta

SEQ ID NO: 103486 - DNA, 25 bp, Homo sapien
cgggcctacagattacgcggactga

SEQ ID NO: 103487 - DNA, 25 bp, Homo sapien
cgcgggttagcatacagctcagctc

SEQ ID NO: 103488 - DNA, 25 bp, Homo sapien
gcagaccgctacgactttggcttta

SEQ ID NO: 103489 - DNA, 25 bp, Homo sapien
tactgcagagacacctggacgcgca

SEQ ID NO: 103490 - DNA, 25 bp, Homo sapien
gtacggtcaccatcgtccgcggcag

SEQ ID NO: 103491 - DNA, 25 bp, Homo sapien
tgcgccgagcctcggatgttgcttc

SEQ ID NO: 103492 - DNA, 25 bp, Homo sapien
acgcgcactgtgacaggcgccattc

SEQ ID NO: 103493 - DNA, 25 bp, Homo sapien
ggcgccattctgacacacgtgctct

SEQ ID NO: 103494 - DNA, 25 bp, Homo sapien
aagggctgatcctgtcccggtgcat

SEQ ID NO: 103495 - DNA, 25 bp, Homo sapien
tcccggtgcattcgcagtagcaatg

SEQ ID NO: 103496 - DNA, 25 bp, Homo sapien
gcgggagacataagcctagccaagc

SEQ ID NO: 103497 - DNA, 25 bp, Homo sapien
cggccatttgattagcacccgaaga

SEQ ID NO: 103498 - DNA, 25 bp, Homo sapien
cgcagaacgagagagcggccaccca

SEQ ID NO: 103499 - DNA, 25 bp, Homo sapien
tgtctgtcctagtctgacgcccagg

SEQ ID NO: 103500 - DNA, 25 bp, Homo sapien
agggatcggcgctatctgcacagcg

SEQ ID NO: 103501 - DNA, 25 bp, Homo sapien
cttcttcgtggctttgtggagatcc

SEQ ID NO: 103502 - DNA, 25 bp, Homo sapien
tgcacagcggttacagtctcggaaa

SEQ ID NO: 103503 - DNA, 25 bp, Homo sapien
ggagatcccttacagcggccatttg

SEQ ID NO: 103504 - DNA, 25 bp, Homo sapien
acttccggtcgctttcggtctctca

SEQ ID NO: 103505 - DNA, 25 bp, Homo sapien
tacacgcagacagatgcgggccatc

SEQ ID NO: 103506 - DNA, 25 bp, Homo sapien
ccagagccgccgacagaggtcgctg

SEQ ID NO: 103507 - DNA, 25 bp, Homo sapien
gcgcaggtccacttctccatccctg

SEQ ID NO: 103508 - DNA, 25 bp, Homo sapien
accaggtacacgcagacagatgcgg

SEQ ID NO: 103509 - DNA, 25 bp, Homo sapien
cgggcgcagatttccgggctaactt

SEQ ID NO: 103510 - DNA, 25 bp, Homo sapien
gggctaactttcctcgccgtctcag

SEQ ID NO: 103511 - DNA, 25 bp, Homo sapien
acagaggtcgctgcgagacggtacc

SEQ ID NO: 103512 - DNA, 25 bp, Homo sapien
agagcagcggagcttcccagccgca

SEQ ID NO: 103513 - DNA, 25 bp, Homo sapien
ggagacagcacggatcctctttttg

SEQ ID NO: 103514 - DNA, 25 bp, Homo sapien
tcacacgcaccggaagggaatctgg

SEQ ID NO: 103515 - DNA, 25 bp, Homo sapien
ggttaaacctggctcgcgacttagc

SEQ ID NO: 103516 - DNA, 25 bp, Homo sapien
cctcgtaagacagcggcctcttttg

SEQ ID NO: 103517 - DNA, 25 bp, Homo sapien
ggcagagcctaagtttccctcgtaa

SEQ ID NO: 103518 - DNA, 25 bp, Homo sapien
cttccgtctctgtcgctggatgtca

SEQ ID NO: 103519 - DNA, 25 bp, Homo sapien
acccaaataggagcgagtgaccctc

SEQ ID NO: 103520 - DNA, 25 bp, Homo sapien
cagacgcgggctttattaacatttg

SEQ ID NO: 103521 - DNA, 25 bp, Homo sapien
gtgcaccggcgtttgtacgcatttg

SEQ ID NO: 103522 - DNA, 25 bp, Homo sapien
gggcgtctctgcagataaggcatta

SEQ ID NO: 103523 - DNA, 25 bp, Homo sapien
aaggcattaacagtccctccgcaga

SEQ ID NO: 103524 - DNA, 25 bp, Homo sapien
ctgcagatctgctgacgactggctc

SEQ ID NO: 103525 - DNA, 25 bp, Homo sapien
agctcccggccgaagtgggacaaca

SEQ ID NO: 103526 - DNA, 25 bp, Homo sapien
ttctctataaagtgcccggctcccg

SEQ ID NO: 103527 - DNA, 25 bp, Homo sapien
agccgtccagcgaccaccatggtga

SEQ ID NO: 103528 - DNA, 25 bp, Homo sapien
gtgggacaacaaggcgcagtacatg

SEQ ID NO: 103529 - DNA, 25 bp, Homo sapien
ccgggctcgtctgcattgacgtctg

SEQ ID NO: 103530 - DNA, 25 bp, Homo sapien
tctcgaaagcaaaacggcgaggacc

SEQ ID NO: 103531 - DNA, 25 bp, Homo sapien
cagccaggtgtgtctcgaaagcaaa

SEQ ID NO: 103532 - DNA, 25 bp, Homo sapien
agtgactcaccaccggccgcggaaa

SEQ ID NO: 103533 - DNA, 25 bp, Homo sapien
aaaagggcagtgactcaccaccggc

SEQ ID NO: 103534 - DNA, 25 bp, Homo sapien
gcctgggtgaattatgatgcacatc

SEQ ID NO: 103535 - DNA, 25 bp, Homo sapien
ctagcggcgcggacctgggtctcct

SEQ ID NO: 103536 - DNA, 25 bp, Homo sapien
gatgcacatccaccgcggctgctaa

SEQ ID NO: 103537 - DNA, 25 bp, Homo sapien
caccgccgtgcagtcagcccagaag

SEQ ID NO: 103538 - DNA, 25 bp, Homo sapien
ccagaagcggctcattgaaagcaga

SEQ ID NO: 103539 - DNA, 25 bp, Homo sapien
ggtgacccgcgatctccacgcccag

SEQ ID NO: 103540 - DNA, 25 bp, Homo sapien
gcctgatgtcaccgccgtgcagtca

SEQ ID NO: 103541 - DNA, 25 bp, Homo sapien
attgccccctagtgccgcgcggagt

SEQ ID NO: 103542 - DNA, 25 bp, Homo sapien
ggctcattgaaagcagaccctcttc

SEQ ID NO: 103543 - DNA, 25 bp, Homo sapien
ggcgccttggctggacccgcattgc

SEQ ID NO: 103544 - DNA, 25 bp, Homo sapien
gaagagtgactagcggggaaaataa

SEQ ID NO: 103545 - DNA, 25 bp, Homo sapien
gtgccaggtaccacgcggaaagccg

SEQ ID NO: 103546 - DNA, 25 bp, Homo sapien
ctgtgtatatataaacgagtccctc

SEQ ID NO: 103547 - DNA, 25 bp, Homo sapien
acgagtccctctctacttgtattta

SEQ ID NO: 103548 - DNA, 25 bp, Homo sapien
ctacttgtatttaaccgtgggtgca

SEQ ID NO: 103549 - DNA, 25 bp, Homo sapien
agcgctcgcagtcgcgcaaggactc

SEQ ID NO: 103550 - DNA, 25 bp, Homo sapien
ctttcgtgcgcatcctcgggtgcca

SEQ ID NO: 103551 - DNA, 25 bp, Homo sapien
gcagctttctttccctggggaggaa

SEQ ID NO: 103552 - DNA, 25 bp, Homo sapien
gcagccgggcttcaaaagcaacatg

SEQ ID NO: 103553 - DNA, 25 bp, Homo sapien
ggggcatccttcctccttacgtgca

SEQ ID NO: 103554 - DNA, 25 bp, Homo sapien
tgttttctgccgttgccaggagctc

SEQ ID NO: 103555 - DNA, 25 bp, Homo sapien
atgccttttaaatcacgcgtagagg

SEQ ID NO: 103556 - DNA, 25 bp, Homo sapien
ttcttcctctgcaggcccgtaaata

SEQ ID NO: 103557 - DNA, 25 bp, Homo sapien
tcacttcccaggtggttaacgtcca

SEQ ID NO: 103558 - DNA, 25 bp, Homo sapien
ctgggaagcagctctttagacactg

SEQ ID NO: 103559 - DNA, 25 bp, Homo sapien
ttagacactgcagtgaccgagcccg

SEQ ID NO: 103560 - DNA, 25 bp, Homo sapien
ggttccagaaaccaaacagcagttg

SEQ ID NO: 103561 - DNA, 25 bp, Homo sapien
acccgaacggacagtttctcctcag

SEQ ID NO: 103562 - DNA, 25 bp, Homo sapien
cccgaagcggaacgacacgacaagc

SEQ ID NO: 103563 - DNA, 25 bp, Homo sapien
atcagttgcgacaccgtggagtccc

SEQ ID NO: 103564 - DNA, 25 bp, Homo sapien
cctcaatgatgtggtccagcgtgac

SEQ ID NO: 103565 - DNA, 25 bp, Homo sapien
cacgacaagcgcgtcctcaatgatg

SEQ ID NO: 103566 - DNA, 25 bp, Homo sapien
cggcgacagcgctgcttggttccct

SEQ ID NO: 103567 - DNA, 25 bp, Homo sapien
gccctttccctgatgctcgtttctg

SEQ ID NO: 103568 - DNA, 25 bp, Homo sapien
gcgcggtaccttttggacagatcca

SEQ ID NO: 103569 - DNA, 25 bp, Homo sapien
ttgtcaactccgctagctcgctcga

SEQ ID NO: 103570 - DNA, 25 bp, Homo sapien
caccctgcgtggacacgggcaactt

SEQ ID NO: 103571 - DNA, 25 bp, Homo sapien
ggctcatccatcatcgcgtacgcag

SEQ ID NO: 103572 - DNA, 25 bp, Homo sapien
gggcgaaactcacgcatcctctctg

SEQ ID NO: 103573 - DNA, 25 bp, Homo sapien
tggagcctttctttgccagctctgg

SEQ ID NO: 103574 - DNA, 25 bp, Homo sapien
ctcgcttcggcggaaagcttctctc

SEQ ID NO: 103575 - DNA, 25 bp, Homo sapien
ctcaccttcgctgaggctagtggta

SEQ ID NO: 103576 - DNA, 25 bp, Homo sapien
gctagtggtagccttctgggcaccc

SEQ ID NO: 103577 - DNA, 25 bp, Homo sapien
caggcatagttttcccatcccgtca

SEQ ID NO: 103578 - DNA, 25 bp, Homo sapien
gagcgtcggccccaggcatagtttt

SEQ ID NO: 103579 - DNA, 25 bp, Homo sapien
aggcatagttttcccatcccgtcat

SEQ ID NO: 103580 - DNA, 25 bp, Homo sapien
cccgaccgcggtgcgggacactcac

SEQ ID NO: 103581 - DNA, 25 bp, Homo sapien
gagccttcctcccggtcacgtgggc

SEQ ID NO: 103582 - DNA, 25 bp, Homo sapien
tccggagcaaagaagctctcggcgg

SEQ ID NO: 103583 - DNA, 25 bp, Homo sapien
ccacgtccaggggcgtccggagcaa

SEQ ID NO: 103584 - DNA, 25 bp, Homo sapien
ccgcagcagtgcgagtcctcctcct

SEQ ID NO: 103585 - DNA, 25 bp, Homo sapien
ttcccgcccgcaaactgggagaggc

SEQ ID NO: 103586 - DNA, 25 bp, Homo sapien
ggagagagaagcatccgcaacaacc

SEQ ID NO: 103587 - DNA, 25 bp, Homo sapien
aaccagtagagacggcggttcctcg

SEQ ID NO: 103588 - DNA, 25 bp, Homo sapien
ctgggagaggcgtctcccacacgca

SEQ ID NO: 103589 - DNA, 25 bp, Homo sapien
ttttaggcgcccgtttcaggctcca

SEQ ID NO: 103590 - DNA, 25 bp, Homo sapien
ctatgggatgcacgggcttctttta

SEQ ID NO: 103591 - DNA, 25 bp, Homo sapien
tctccaagcctgaggcgcaggccta

SEQ ID NO: 103592 - DNA, 25 bp, Homo sapien
gcctctggccgtcggaaccagtaga

SEQ ID NO: 103593 - DNA, 25 bp, Homo sapien
agctgctgcgtatcgcgctatttac

SEQ ID NO: 103594 - DNA, 25 bp, Homo sapien
tgcgcactaatttcctggcggggcc

SEQ ID NO: 103595 - DNA, 25 bp, Homo sapien
gtcgcccgcaagttctaacaatatt

SEQ ID NO: 103596 - DNA, 25 bp, Homo sapien
atccaagccaatctcgtaatgttta

SEQ ID NO: 103597 - DNA, 25 bp, Homo sapien
tttcgcctaattccggcggccactg

SEQ ID NO: 103598 - DNA, 25 bp, Homo sapien
cggatgaccggcacatgcgcactaa

SEQ ID NO: 103599 - DNA, 25 bp, Homo sapien
cgccgtgggaaacgcgagaactcta

SEQ ID NO: 103600 - DNA, 25 bp, Homo sapien
ggccactgcggtaacttccggatga

SEQ ID NO: 103601 - DNA, 25 bp, Homo sapien
ggcgctcaccttaaaggagtccaca

SEQ ID NO: 103602 - DNA, 25 bp, Homo sapien
cggcctggtacttcaggtcctggca

SEQ ID NO: 103603 - DNA, 25 bp, Homo sapien
tggtacttcaggtcctggcacgctg

SEQ ID NO: 103604 - DNA, 25 bp, Homo sapien
gggactggcgctcaccttaaaggag

SEQ ID NO: 103605 - DNA, 25 bp, Homo sapien
gagctcgcggccatagcgctgtgct

SEQ ID NO: 103606 - DNA, 25 bp, Homo sapien
catagcgctgtgctgcccagaggtt

SEQ ID NO: 103607 - DNA, 25 bp, Homo sapien
cagatccgggcgtgccttgggacaa

SEQ ID NO: 103608 - DNA, 25 bp, Homo sapien
ggagtccacaaactcgtcactcatc

SEQ ID NO: 103609 - DNA, 25 bp, Homo sapien
cgtggtctcggactgctaactggac

SEQ ID NO: 103610 - DNA, 25 bp, Homo sapien
tttaaaccaggagtgcgccgcgtcc

SEQ ID NO: 103611 - DNA, 25 bp, Homo sapien
cggcctcagatgaatgcggctgtta

SEQ ID NO: 103612 - DNA, 25 bp, Homo sapien
ggctgttaagacctgcgtgagtgaa

SEQ ID NO: 103613 - DNA, 25 bp, Homo sapien
gcaactgtctgatgagtgccagccc

SEQ ID NO: 103614 - DNA, 25 bp, Homo sapien
ggcttagatggctccgagcccgttt

SEQ ID NO: 103615 - DNA, 25 bp, Homo sapien
gctaactggaccaacggcaactgtc

SEQ ID NO: 103616 - DNA, 25 bp, Homo sapien
cctcctgggcggaagagccaattgg

SEQ ID NO: 103617 - DNA, 25 bp, Homo sapien
acctcatcctgtgtgtagcctgggg

SEQ ID NO: 103618 - DNA, 25 bp, Homo sapien
gccgtacgtccacccgcagagggag

SEQ ID NO: 103619 - DNA, 25 bp, Homo sapien
tcccaaaggctgtcggcttcgctgt

SEQ ID NO: 103620 - DNA, 25 bp, Homo sapien
agcaccttgggcaccgtcatgatgc

SEQ ID NO: 103621 - DNA, 25 bp, Homo sapien
tcgagtgaaggacccaccggtgtcc

SEQ ID NO: 103622 - DNA, 25 bp, Homo sapien
gtccttctccaccttcgagtgaagg

SEQ ID NO: 103623 - DNA, 25 bp, Homo sapien
ctcgggttcaggtaggagacgcact

SEQ ID NO: 103624 - DNA, 25 bp, Homo sapien
agctgctgacctcggtcccaaaggc

SEQ ID NO: 103625 - DNA, 25 bp, Homo sapien
gaaggaaccggagtccacaccagcg

SEQ ID NO: 103626 - DNA, 25 bp, Homo sapien
ctggatacaagaagccggagcggtc

SEQ ID NO: 103627 - DNA, 25 bp, Homo sapien
tcaggggctgtacctctggatacaa

SEQ ID NO: 103628 - DNA, 25 bp, Homo sapien
ggggagggagatactcaattcacaa

SEQ ID NO: 103629 - DNA, 25 bp, Homo sapien
tgctacgagtctggggacacaaggc

SEQ ID NO: 103630 - DNA, 25 bp, Homo sapien
ctcacctccggaggcactgtgttct

SEQ ID NO: 103631 - DNA, 25 bp, Homo sapien
cggtccctagaaggcaggcaaaatg

SEQ ID NO: 103632 - DNA, 25 bp, Homo sapien
agaagtcttccctccgctccaggga

SEQ ID NO: 103633 - DNA, 25 bp, Homo sapien
gattggccggacttctcactccacg

SEQ ID NO: 103634 - DNA, 25 bp, Homo sapien
tctctgtcaaggtgagtgggactgc

SEQ ID NO: 103635 - DNA, 25 bp, Homo sapien
ggttaccgctgaggagctgcagtct

SEQ ID NO: 103636 - DNA, 25 bp, Homo sapien
tcgtaggcctctcggatctgatatc

SEQ ID NO: 103637 - DNA, 25 bp, Homo sapien
tcggctccgagctgaccctgatcag

SEQ ID NO: 103638 - DNA, 25 bp, Homo sapien
tatattcctcgttagggcaggcgcg

SEQ ID NO: 103639 - DNA, 25 bp, Homo sapien
ttacaccaatcagcggcgaaaatgc

SEQ ID NO: 103640 - DNA, 25 bp, Homo sapien
ctctaccgctgttgtgagcacaagc

SEQ ID NO: 103641 - DNA, 25 bp, Homo sapien
tgcgcatgcgcaggaacgcaagcta

SEQ ID NO: 103642 - DNA, 25 bp, Homo sapien
agctagcgctttggtgtgcgtgttc

SEQ ID NO: 103643 - DNA, 25 bp, Homo sapien
cgtcgggacacccaacagtcgttca

SEQ ID NO: 103644 - DNA, 25 bp, Homo sapien
cctggcggcacctgaacttcaatga

SEQ ID NO: 103645 - DNA, 25 bp, Homo sapien
tcctccaaggtctggtaccactggc

SEQ ID NO: 103646 - DNA, 25 bp, Homo sapien
caaacggggccgacataatccagtc

SEQ ID NO: 103647 - DNA, 25 bp, Homo sapien
cgagctgccgctaccttgaggatct

SEQ ID NO: 103648 - DNA, 25 bp, Homo sapien
cgcgcggaatcccacgcttaggcta

SEQ ID NO: 103649 - DNA, 25 bp, Homo sapien
gggcgccaccgagtttgtttatctc

SEQ ID NO: 103650 - DNA, 25 bp, Homo sapien
ctctctatacactttgttcccggga

SEQ ID NO: 103651 - DNA, 25 bp, Homo sapien
ggcgggagaaagagctctctataca

SEQ ID NO: 103652 - DNA, 25 bp, Homo sapien
ctgaggcccgcgtcgatcctgggtt

SEQ ID NO: 103653 - DNA, 25 bp, Homo sapien
gtggccaatcaacgggcgcggctat

SEQ ID NO: 103654 - DNA, 25 bp, Homo sapien
cgtcggcggagcgtggccaatcaac

SEQ ID NO: 103655 - DNA, 25 bp, Homo sapien
cgctttaagcatcggcgcgtgggct

SEQ ID NO: 103656 - DNA, 25 bp, Homo sapien
gagtttgtttatctcagcgcacacg

SEQ ID NO: 103657 - DNA, 25 bp, Homo sapien
aaacgcccagctggggttctctctg

SEQ ID NO: 103658 - DNA, 25 bp, Homo sapien
acaaaggggtgcacgtgtccctagc

SEQ ID NO: 103659 - DNA, 25 bp, Homo sapien
cgcgctcagttcctggtcttggaaa

SEQ ID NO: 103660 - DNA, 25 bp, Homo sapien
cgaactgaactctgagccgcccggg

SEQ ID NO: 103661 - DNA, 25 bp, Homo sapien
tcaggctaaccctagagccgaactg

SEQ ID NO: 103662 - DNA, 25 bp, Homo sapien
tgcagctagggatccaagcctcctc

SEQ ID NO: 103663 - DNA, 25 bp, Homo sapien
tgctgtgctctcctgtttgcagaga

SEQ ID NO: 103664 - DNA, 25 bp, Homo sapien
tccgcaggactcgaaggcttgctgt

SEQ ID NO: 103665 - DNA, 25 bp, Homo sapien
ttgcccacatgaacatgtttgttca

SEQ ID NO: 103666 - DNA, 25 bp, Homo sapien
tcatgtctgaaatggcacatcattg

SEQ ID NO: 103667 - DNA, 25 bp, Homo sapien
gcacatcattgtatcacctcacatg

SEQ ID NO: 103668 - DNA, 25 bp, Homo sapien
tgcaaactcctcactcactttaagt

SEQ ID NO: 103669 - DNA, 25 bp, Homo sapien
tctttcagcatttctaccctggttg

SEQ ID NO: 103670 - DNA, 25 bp, Homo sapien
ctaccctggttggtagtggcttctt

SEQ ID NO: 103671 - DNA, 25 bp, Homo sapien
gtggcttctttcctggcaactatga

SEQ ID NO: 103672 - DNA, 25 bp, Homo sapien
tgaaaacaacgtcaagagaaggctc

SEQ ID NO: 103673 - DNA, 25 bp, Homo sapien
tgctgctcagcatccgctatggcct

SEQ ID NO: 103674 - DNA, 25 bp, Homo sapien
tgagttccagtactccacgctgctg

SEQ ID NO: 103675 - DNA, 25 bp, Homo sapien
taggcaccaccatcggccgcaaggt

SEQ ID NO: 103676 - DNA, 25 bp, Homo sapien
agccgatggcgacctggtcacacta

SEQ ID NO: 103677 - DNA, 25 bp, Homo sapien
ggcaaggacacccactactttgtga

SEQ ID NO: 103678 - DNA, 25 bp, Homo sapien
tgtgctgaacaacgcctactacctg

SEQ ID NO: 103679 - DNA, 25 bp, Homo sapien
tcgccagcgaagatagccgcaaggt

SEQ ID NO: 103680 - DNA, 25 bp, Homo sapien
gtcaacggcaggactcgaaggttca

SEQ ID NO: 103681 - DNA, 25 bp, Homo sapien
ctcttgagctctcttcagttcgcca

SEQ ID NO: 103682 - DNA, 25 bp, Homo sapien
tggcggaggcagaagtcacaaaccc

SEQ ID NO: 103683 - DNA, 25 bp, Homo sapien
ctgcccggagttttgaccttaagct

SEQ ID NO: 103684 - DNA, 25 bp, Homo sapien
gggagctctgcgtgcctcttgagct

SEQ ID NO: 103685 - DNA, 25 bp, Homo sapien
tactacatagaccacacgaaccgca

SEQ ID NO: 103686 - DNA, 25 bp, Homo sapien
tcgacggcaaggtctactacataga

SEQ ID NO: 103687 - DNA, 25 bp, Homo sapien
gcgcgacttcgacggcaaggtctac

SEQ ID NO: 103688 - DNA, 25 bp, Homo sapien
gcagaagtcacaaacccggcgagct

SEQ ID NO: 103689 - DNA, 25 bp, Homo sapien
tcgcgccaattctcgtacggtttca

SEQ ID NO: 103690 - DNA, 25 bp, Homo sapien
gcaatttgcgtagcgaacggcgccc

SEQ ID NO: 103691 - DNA, 25 bp, Homo sapien
ggctctcccatcagcggcctgagga

SEQ ID NO: 103692 - DNA, 25 bp, Homo sapien
tcgagaattacgaggacaggaggca

SEQ ID NO: 103693 - DNA, 25 bp, Homo sapien
cccatccgcattattggaggagaga

SEQ ID NO: 103694 - DNA, 25 bp, Homo sapien
catcttggctatgggcggaagtttt

SEQ ID NO: 103695 - DNA, 25 bp, Homo sapien
ccatacaagtaaaggcgggcggcac

SEQ ID NO: 103696 - DNA, 25 bp, Homo sapien
agttttcttcagagaccgagggacg

SEQ ID NO: 103697 - DNA, 25 bp, Homo sapien
tggacgtactggtgtctgagtgctc

SEQ ID NO: 103698 - DNA, 25 bp, Homo sapien
ccgcttccgtccacttggcgagtga

SEQ ID NO: 103699 - DNA, 25 bp, Homo sapien
agaggctgaccgtttccgcttccgt

SEQ ID NO: 103700 - DNA, 25 bp, Homo sapien
gcacccagtccgacgggacagcgga

SEQ ID NO: 103701 - DNA, 25 bp, Homo sapien
gcgggttctcctcgcagtgtctact

SEQ ID NO: 103702 - DNA, 25 bp, Homo sapien
ttgcggcctcgctcctgaccgaaat

SEQ ID NO: 103703 - DNA, 25 bp, Homo sapien
caaacgtccctgagttgcggcctcg

SEQ ID NO: 103704 - DNA, 25 bp, Homo sapien
cagtgtctactggatcccgccagga

SEQ ID NO: 103705 - DNA, 25 bp, Homo sapien
acgagggcgtcttcatctaccgcgg

SEQ ID NO: 103706 - DNA, 25 bp, Homo sapien
ggccaagaagcgcaccaacatcatt

SEQ ID NO: 103707 - DNA, 25 bp, Homo sapien
acggcctggtctacgccgtcgagtt

SEQ ID NO: 103708 - DNA, 25 bp, Homo sapien
atgtctccgacatcattggcccaga

SEQ ID NO: 103709 - DNA, 25 bp, Homo sapien
tcaagcccaagtccaaggtgctgta

SEQ ID NO: 103710 - DNA, 25 bp, Homo sapien
gtggaacccgttccgctctaagctg

SEQ ID NO: 103711 - DNA, 25 bp, Homo sapien
tcacgctgaacatggtgccgggcca

SEQ ID NO: 103712 - DNA, 25 bp, Homo sapien
gtaccgcatgctcatcgggatggtg

SEQ ID NO: 103713 - DNA, 25 bp, Homo sapien
gagagacgctcaacatctccacgtc

SEQ ID NO: 103714 - DNA, 25 bp, Homo sapien
accaccgggaaggtactgcatgggc

SEQ ID NO: 103715 - DNA, 25 bp, Homo sapien
tccgcggcatcgagaccaccgggaa

SEQ ID NO: 103716 - DNA, 25 bp, Homo sapien
gtacatgtgcaccatccgcggcatc

SEQ ID NO: 103717 - DNA, 25 bp, Homo sapien
atggagcgtcctgtacatgtgcacc

SEQ ID NO: 103718 - DNA, 25 bp, Homo sapien
ccatccagtggtggatgctgctgtg

SEQ ID NO: 103719 - DNA, 25 bp, Homo sapien
agcgactcgggctccatccagtggt

SEQ ID NO: 103720 - DNA, 25 bp, Homo sapien
cctgcgcatggagcgtcctgtacat

SEQ ID NO: 103721 - DNA, 25 bp, Homo sapien
cctcgaactcgtggctcaaatggtc

SEQ ID NO: 103722 - DNA, 25 bp, Homo sapien
accgcccagccaaggggctttcaga

SEQ ID NO: 103723 - DNA, 25 bp, Homo sapien
agcttccgcagatcgcctcagagtg

SEQ ID NO: 103724 - DNA, 25 bp, Homo sapien
tgtagttctccggttcgtgaggccc

SEQ ID NO: 103725 - DNA, 25 bp, Homo sapien
ccgctctctggctgtagttgtgcag

SEQ ID NO: 103726 - DNA, 25 bp, Homo sapien
aggtggactacaaagcccgagatgc

SEQ ID NO: 103727 - DNA, 25 bp, Homo sapien
cgcactgagaaatagcccgcccagg

SEQ ID NO: 103728 - DNA, 25 bp, Homo sapien
ccgtcttacagggtttcttggcatc

SEQ ID NO: 103729 - DNA, 25 bp, Homo sapien
tccacgctggcagcggagcaggtac

SEQ ID NO: 103730 - DNA, 25 bp, Homo sapien
gctggaggcccactcaggacgctcg

SEQ ID NO: 103731 - DNA, 25 bp, Homo sapien
gcaacagcagctccatcggcggggc

SEQ ID NO: 103732 - DNA, 25 bp, Homo sapien
cgctgcgcatcgctgggagtgccca

SEQ ID NO: 103733 - DNA, 25 bp, Homo sapien
tactcacaggcgctcagcgttgcgg

SEQ ID NO: 103734 - DNA, 25 bp, Homo sapien
cgccgcgcgtcatgtcgactaagtt

SEQ ID NO: 103735 - DNA, 25 bp, Homo sapien
agttgggaactttgctggagcgacc

SEQ ID NO: 103736 - DNA, 25 bp, Homo sapien
ccattcagtgagcacggcagacacc

SEQ ID NO: 103737 - DNA, 25 bp, Homo sapien
aaccgccactggatctgcgctgtgc

SEQ ID NO: 103738 - DNA, 25 bp, Homo sapien
cgagccggtcttatcttccgctgga

SEQ ID NO: 103739 - DNA, 25 bp, Homo sapien
ttatacactgggttccgagccggtc

SEQ ID NO: 103740 - DNA, 25 bp, Homo sapien
ggccgaggcctttagctgaaacatc

SEQ ID NO: 103741 - DNA, 25 bp, Homo sapien
tggacgccctgagctcccattagga

SEQ ID NO: 103742 - DNA, 25 bp, Homo sapien
atcccaggcgcttactcgagagcta

SEQ ID NO: 103743 - DNA, 25 bp, Homo sapien
ttctcgcgggaactgcattcaaata

SEQ ID NO: 103744 - DNA, 25 bp, Homo sapien
cgtctcgtgagacgtgggacttctc

SEQ ID NO: 103745 - DNA, 25 bp, Homo sapien
tgacaactcagttcttcgcgccaaa

SEQ ID NO: 103746 - DNA, 25 bp, Homo sapien
ccctggcgcaaagctgacaaggagc

SEQ ID NO: 103747 - DNA, 25 bp, Homo sapien
caaagctgacaaggagcggcacggc

SEQ ID NO: 103748 - DNA, 25 bp, Homo sapien
tctcgcctgctgagggaaccttaga

SEQ ID NO: 103749 - DNA, 25 bp, Homo sapien
ccttagacatttccgagatagggtc

SEQ ID NO: 103750 - DNA, 25 bp, Homo sapien
agacctgcgcttgacaactcagttc

SEQ ID NO: 103751 - DNA, 25 bp, Homo sapien
agttcttcgcgccaaactcggcgtc

SEQ ID NO: 103752 - DNA, 25 bp, Homo sapien
tccgagatagggtcaagacctgcgc

SEQ ID NO: 103753 - DNA, 25 bp, Homo sapien
cttctacaacaagagcaaggccggc

SEQ ID NO: 103754 - DNA, 25 bp, Homo sapien
taccagtacgtggccgacaacttcc

SEQ ID NO: 103755 - DNA, 25 bp, Homo sapien
agcgcctcactctcagccagatcta

SEQ ID NO: 103756 - DNA, 25 bp, Homo sapien
acggggcacccgacaagcgcctcac

SEQ ID NO: 103757 - DNA, 25 bp, Homo sapien
gcggccaccctattcctactcggct

SEQ ID NO: 103758 - DNA, 25 bp, Homo sapien
tgccccaggcctatggagtgcagag

SEQ ID NO: 103759 - DNA, 25 bp, Homo sapien
cctctggttcaacgggcccaccatg

SEQ ID NO: 103760 - DNA, 25 bp, Homo sapien
ctacaacaagagcaaggccggctgg

SEQ ID NO: 103761 - DNA, 25 bp, Homo sapien
ggagggtgaagaccgctgaaatttc

SEQ ID NO: 103762 - DNA, 25 bp, Homo sapien
gccgcgcgagtcagttgtaacccgg

SEQ ID NO: 103763 - DNA, 25 bp, Homo sapien
ttgtaacccggcatccagaaccttc

SEQ ID NO: 103764 - DNA, 25 bp, Homo sapien
aggggccttgcctgggactacaact

SEQ ID NO: 103765 - DNA, 25 bp, Homo sapien
aatttccaggctgcccgaggctcca

SEQ ID NO: 103766 - DNA, 25 bp, Homo sapien
cctgctcctgtcagaacctcggtga

SEQ ID NO: 103767 - DNA, 25 bp, Homo sapien
tcctaatctggtttgggagggtgaa

SEQ ID NO: 103768 - DNA, 25 bp, Homo sapien
tgctcggtcttgaaggatcctaatc

SEQ ID NO: 103769 - DNA, 25 bp, Homo sapien
ttgctgaataccaagctgcaggcga

SEQ ID NO: 103770 - DNA, 25 bp, Homo sapien
gcgcggtccgggctctgttcattca

SEQ ID NO: 103771 - DNA, 25 bp, Homo sapien
cattcatgattggtactcggccctc

SEQ ID NO: 103772 - DNA, 25 bp, Homo sapien
agcggctagccctgagtccctgcat

SEQ ID NO: 103773 - DNA, 25 bp, Homo sapien
cctgagtccctgcatgtgcggggct

SEQ ID NO: 103774 - DNA, 25 bp, Homo sapien
gcctccacgcttgctgaataccaag

SEQ ID NO: 103775 - DNA, 25 bp, Homo sapien
ataccaagctgcaggcgagctgccg

SEQ ID NO: 103776 - DNA, 25 bp, Homo sapien
gctgaagaaggaagccagaagcctc

SEQ ID NO: 103777 - DNA, 25 bp, Homo sapien
tcctggtgagcgactccctgttcgt

SEQ ID NO: 103778 - DNA, 25 bp, Homo sapien
caggctcgctgtccgaggggccttt

SEQ ID NO: 103779 - DNA, 25 bp, Homo sapien
ctctttctgctggtgaacgtgctgt

SEQ ID NO: 103780 - DNA, 25 bp, Homo sapien
tccctgttcgtcatctgcgcgctgt

SEQ ID NO: 103781 - DNA, 25 bp, Homo sapien
ctgtgctctcccatcggcgccgggc

SEQ ID NO: 103782 - DNA, 25 bp, Homo sapien
tgagcgactccctgttcgtcatctg

SEQ ID NO: 103783 - DNA, 25 bp, Homo sapien
gcctgcctctgcctcgtcgccaggc

SEQ ID NO: 103784 - DNA, 25 bp, Homo sapien
tctgctggtgaacgtgctgtgtgct

SEQ ID NO: 103785 - DNA, 25 bp, Homo sapien
tccagagaccgcaagagaacagctt

SEQ ID NO: 103786 - DNA, 25 bp, Homo sapien
aagagaacagcttgcgagggaccgt

SEQ ID NO: 103787 - DNA, 25 bp, Homo sapien
ctgttcgccatcagccgctagatgg

SEQ ID NO: 103788 - DNA, 25 bp, Homo sapien
tggcagagagccacagaagagctcc

SEQ ID NO: 103789 - DNA, 25 bp, Homo sapien
ccctggaggaccatggagagaacgt

SEQ ID NO: 103790 - DNA, 25 bp, Homo sapien
ccaaagtactcatgacagggcagga

SEQ ID NO: 103791 - DNA, 25 bp, Homo sapien
tgggcgaatgagtagaccaaagtac

SEQ ID NO: 103792 - DNA, 25 bp, Homo sapien
tgggaacttcaaggaaccgcaccgc

SEQ ID NO: 103793 - DNA, 25 bp, Homo sapien
cggcagcggttggactttaattggc

SEQ ID NO: 103794 - DNA, 25 bp, Homo sapien
ctttaattggccagaggagacaggg

SEQ ID NO: 103795 - DNA, 25 bp, Homo sapien
acgcgaggatcgcagaggctacgaa

SEQ ID NO: 103796 - DNA, 25 bp, Homo sapien
cgcctcctgggaagatggcgctgca

SEQ ID NO: 103797 - DNA, 25 bp, Homo sapien
tggcgctgcacttccaggtcagtgt

SEQ ID NO: 103798 - DNA, 25 bp, Homo sapien
gctgaccgcggctttagtgttgcca

SEQ ID NO: 103799 - DNA, 25 bp, Homo sapien
cttcgaatgcggacgcgaagcctgg

SEQ ID NO: 103800 - DNA, 25 bp, Homo sapien
agatgggacgcgtgcttgtatatcc

SEQ ID NO: 103801 - DNA, 25 bp, Homo sapien
gtttaggctgggtccactcttcttc

SEQ ID NO: 103802 - DNA, 25 bp, Homo sapien
cgttttcgttccaataatgctcggc

SEQ ID NO: 103803 - DNA, 25 bp, Homo sapien
caacgttcgtctgcattcgcctcgg

SEQ ID NO: 103804 - DNA, 25 bp, Homo sapien
agggtggcctcgaacttcttagagc

SEQ ID NO: 103805 - DNA, 25 bp, Homo sapien
tcctcggtctccaaacgcctgggga

SEQ ID NO: 103806 - DNA, 25 bp, Homo sapien
aatgcagcgcacaaccctaggggcc

SEQ ID NO: 103807 - DNA, 25 bp, Homo sapien
ggcgcccggaactcagaactctaag

SEQ ID NO: 103808 - DNA, 25 bp, Homo sapien
cttagagctcaagtcggaactcgga

SEQ ID NO: 103809 - DNA, 25 bp, Homo sapien
agacaatttcacaagcggagcgctc

SEQ ID NO: 103810 - DNA, 25 bp, Homo sapien
gcctttattgaaagccgggagccaa

SEQ ID NO: 103811 - DNA, 25 bp, Homo sapien
tgatgtcaccttggaacagtcccta

SEQ ID NO: 103812 - DNA, 25 bp, Homo sapien
ggggttgcaactccattgtacctga

SEQ ID NO: 103813 - DNA, 25 bp, Homo sapien
gggctctaatatccgccgcccatta

SEQ ID NO: 103814 - DNA, 25 bp, Homo sapien
tgactacttcgtgtgcggtcctgtc

SEQ ID NO: 103815 - DNA, 25 bp, Homo sapien
tgcccgcgcctttgacattcaggaa

SEQ ID NO: 103816 - DNA, 25 bp, Homo sapien
caacgaattacgagagtcaggtccc

SEQ ID NO: 103817 - DNA, 25 bp, Homo sapien
tcgtggtctcccacgccttggtttc

SEQ ID NO: 103818 - DNA, 25 bp, Homo sapien
gcagcctcgcactagccctatttta

SEQ ID NO: 103819 - DNA, 25 bp, Homo sapien
cggacgccgcccaagcgtaagaagc

SEQ ID NO: 103820 - DNA, 25 bp, Homo sapien
cgaccagcgaaatagcggagctctc

SEQ ID NO: 103821 - DNA, 25 bp, Homo sapien
cggtctcctgcgttcacttgatttc

SEQ ID NO: 103822 - DNA, 25 bp, Homo sapien
tttcaacaatcctcgtggacgccgg

SEQ ID NO: 103823 - DNA, 25 bp, Homo sapien
cgtctccattccagccgcgttttta

SEQ ID NO: 103824 - DNA, 25 bp, Homo sapien
gcgctcgccaagtccctcaaaatga

SEQ ID NO: 103825 - DNA, 25 bp, Homo sapien
tccgtgcccattagcttctggggta

SEQ ID NO: 103826 - DNA, 25 bp, Homo sapien
ggcccttctcggaacgttgagcaga

SEQ ID NO: 103827 - DNA, 25 bp, Homo sapien
tgtggcccacacagagcccagtctg

SEQ ID NO: 103828 - DNA, 25 bp, Homo sapien
tccgttcaaacgtcgcagttgtggc

SEQ ID NO: 103829 - DNA, 25 bp, Homo sapien
tacctgcctacctggttcctgaaca

SEQ ID NO: 103830 - DNA, 25 bp, Homo sapien
ttgagcagacctaacatgacgctgg

SEQ ID NO: 103831 - DNA, 25 bp, Homo sapien
agaaacgcacccactgagacatgtg

SEQ ID NO: 103832 - DNA, 25 bp, Homo sapien
gcgcctcctcggctatttattgagg

SEQ ID NO: 103833 - DNA, 25 bp, Homo sapien
ggcagccaggaacccgactacgaat

SEQ ID NO: 103834 - DNA, 25 bp, Homo sapien
taacgtcttccctcgttcgcgctgg

SEQ ID NO: 103835 - DNA, 25 bp, Homo sapien
ccggtgcgttttcgtggctgaaaca

SEQ ID NO: 103836 - DNA, 25 bp, Homo sapien
tggctgaaacaagccgcgccctttg

SEQ ID NO: 103837 - DNA, 25 bp, Homo sapien
tcgccttcagccaccatggggaatg

SEQ ID NO: 103838 - DNA, 25 bp, Homo sapien
gacttgttgacactgcgagcactca

SEQ ID NO: 103839 - DNA, 25 bp, Homo sapien
ggtccctgccgctgacttgttgaca

SEQ ID NO: 103840 - DNA, 25 bp, Homo sapien
aacatgccatagtgcgcctgcgacc

SEQ ID NO: 103841 - DNA, 25 bp, Homo sapien
cgccacttgtcgtttgcagagccca

SEQ ID NO: 103842 - DNA, 25 bp, Homo sapien
aaggcacccacacaagacggcacaa

SEQ ID NO: 103843 - DNA, 25 bp, Homo sapien
acgggatgagctaaccggactgtcg

SEQ ID NO: 103844 - DNA, 25 bp, Homo sapien
agcccacttagtgcgcgctagctgg

SEQ ID NO: 103845 - DNA, 25 bp, Homo sapien
tcgccacaagctggacgggatgagc

SEQ ID NO: 103846 - DNA, 25 bp, Homo sapien
cggcacaactgcctgcgagaaacag

SEQ ID NO: 103847 - DNA, 25 bp, Homo sapien
tgctcttcgttcctaaggggcccaa

SEQ ID NO: 103848 - DNA, 25 bp, Homo sapien
tccacatttgggtcgctccgagcct

SEQ ID NO: 103849 - DNA, 25 bp, Homo sapien
tttcggtttctcagtgctgggtcgg

SEQ ID NO: 103850 - DNA, 25 bp, Homo sapien
gaggaaaggcgacggcacagctccc

SEQ ID NO: 103851 - DNA, 25 bp, Homo sapien
ctcccgttttctcaatgaaggcaga

SEQ ID NO: 103852 - DNA, 25 bp, Homo sapien
agcatctgcccagaaaactgccttc

SEQ ID NO: 103853 - DNA, 25 bp, Homo sapien
tttctcaatgaaggcagaaagctgc

SEQ ID NO: 103854 - DNA, 25 bp, Homo sapien
ctgcacagctgcttttagttcaggc

SEQ ID NO: 103855 - DNA, 25 bp, Homo sapien
tgcttttagttcaggcgaagctgga

SEQ ID NO: 103856 - DNA, 25 bp, Homo sapien
ggcacagctcccgttttctcaatga

SEQ ID NO: 103857 - DNA, 25 bp, Homo sapien
gccgccgaagaggttgtccttgtta

SEQ ID NO: 103858 - DNA, 25 bp, Homo sapien
cgccaccgtgaccttgtacttcgag

SEQ ID NO: 103859 - DNA, 25 bp, Homo sapien
gctctgaaattctgtggctctgcta

SEQ ID NO: 103860 - DNA, 25 bp, Homo sapien
cagaagacttcgttggggttcacca

SEQ ID NO: 103861 - DNA, 25 bp, Homo sapien
aggcgacccggaactgaacagaaga

SEQ ID NO: 103862 - DNA, 25 bp, Homo sapien
accagaactcgctcgcgggaaagca

SEQ ID NO: 103863 - DNA, 25 bp, Homo sapien
cagcagcgacgcgttgagacactcg

SEQ ID NO: 103864 - DNA, 25 bp, Homo sapien
gatcccaggctttgggccacagtcc

SEQ ID NO: 103865 - DNA, 25 bp, Homo sapien
gtcttgggcggcaaacatcccactc

SEQ ID NO: 103866 - DNA, 25 bp, Homo sapien
ggcaacgcaccggactgcaaatgtc

SEQ ID NO: 103867 - DNA, 25 bp, Homo sapien
tcagagacggcttccagcgtcctcg

SEQ ID NO: 103868 - DNA, 25 bp, Homo sapien
tatccagagaatgatgagcccggcg

SEQ ID NO: 103869 - DNA, 25 bp, Homo sapien
cacaaggggacgctcagttgatatc

SEQ ID NO: 103870 - DNA, 25 bp, Homo sapien
cagctgtggtcgcttcctaagcggc

SEQ ID NO: 103871 - DNA, 25 bp, Homo sapien
acaggtttccttctccatcgctgcg

SEQ ID NO: 103872 - DNA, 25 bp, Homo sapien
tgcaaatgtcaccagcgcagcgggg

SEQ ID NO: 103873 - DNA, 25 bp, Homo sapien
cccgctgtctcggactgacagctgt

SEQ ID NO: 103874 - DNA, 25 bp, Homo sapien
ccaggcggccgcaggtaaacggctt

SEQ ID NO: 103875 - DNA, 25 bp, Homo sapien
ccacacacgtgtgcgtgggctctgg

SEQ ID NO: 103876 - DNA, 25 bp, Homo sapien
ctagtgtccacacacgtgtgcgtgg

SEQ ID NO: 103877 - DNA, 25 bp, Homo sapien
tgtgcacgctagtgtccacacacgt

SEQ ID NO: 103878 - DNA, 25 bp, Homo sapien
tctggcgtgtgcacgctagtgtcca

SEQ ID NO: 103879 - DNA, 25 bp, Homo sapien
gtctcggactgacagctgtctcggg

SEQ ID NO: 103880 - DNA, 25 bp, Homo sapien
ctgctgtctggcgtgtgcacgctag

SEQ ID NO: 103881 - DNA, 25 bp, Homo sapien
cctggagtccctgtaccgagacatc

SEQ ID NO: 103882 - DNA, 25 bp, Homo sapien
cgaggtcatccactgcaagctgcgc

SEQ ID NO: 103883 - DNA, 25 bp, Homo sapien
gccgagatgaagcagcgcgacaact

SEQ ID NO: 103884 - DNA, 25 bp, Homo sapien
tttccgagaacttgctggccgacgt

SEQ ID NO: 103885 - DNA, 25 bp, Homo sapien
ccgcgacgtacacgagctcttcttg

SEQ ID NO: 103886 - DNA, 25 bp, Homo sapien
ccgtgcagtacgaggagaagaaccc

SEQ ID NO: 103887 - DNA, 25 bp, Homo sapien
tcgagacggaccacatcctggagtc

SEQ ID NO: 103888 - DNA, 25 bp, Homo sapien
aggccgacaccctgaacgtcatcga

SEQ ID NO: 103889 - DNA, 25 bp, Homo sapien
gacagtggcggcgaaaactctctgc

SEQ ID NO: 103890 - DNA, 25 bp, Homo sapien
agccgacacgcgcatttctacaaag

SEQ ID NO: 103891 - DNA, 25 bp, Homo sapien
tccctcccgtgtgacttgtggcacg

SEQ ID NO: 103892 - DNA, 25 bp, Homo sapien
tgtggcacgtgcgaagaagaaaagc

SEQ ID NO: 103893 - DNA, 25 bp, Homo sapien
tgcccgtgcacctcattccttgaaa

SEQ ID NO: 103894 - DNA, 25 bp, Homo sapien
cttgaaacctactctgcttagaaca

SEQ ID NO: 103895 - DNA, 25 bp, Homo sapien
actgaaagcgcaactggagggcctg

SEQ ID NO: 103896 - DNA, 25 bp, Homo sapien
cgctccgctgcagttgtcttcactg

SEQ ID NO: 103897 - DNA, 25 bp, Homo sapien
tggcctcttaggagagtctgtcaca

SEQ ID NO: 103898 - DNA, 25 bp, Homo sapien
aggtccttgggatccgtactagttg

SEQ ID NO: 103899 - DNA, 25 bp, Homo sapien
agcaggtaagcccatgcattattga

SEQ ID NO: 103900 - DNA, 25 bp, Homo sapien
ggttactccgtgtcaaactcctaga

SEQ ID NO: 103901 - DNA, 25 bp, Homo sapien
ttcggttcgtgtctgcttctccaag

SEQ ID NO: 103902 - DNA, 25 bp, Homo sapien
cccttccaggtttgcgctttgactg

SEQ ID NO: 103903 - DNA, 25 bp, Homo sapien
attgcacaagtaaggggcgttttca

SEQ ID NO: 103904 - DNA, 25 bp, Homo sapien
tcagtcgggtgtcaatttctctttc

SEQ ID NO: 103905 - DNA, 25 bp, Homo sapien
ctggggacacgcgaccggaagaaat

SEQ ID NO: 103906 - DNA, 25 bp, Homo sapien
gagccgctagctgcctctttgtgcc

SEQ ID NO: 103907 - DNA, 25 bp, Homo sapien
tgcgccttctttgggatgcatcacg

SEQ ID NO: 103908 - DNA, 25 bp, Homo sapien
gcaccggggagaacacgtgctgttc

SEQ ID NO: 103909 - DNA, 25 bp, Homo sapien
tcaggaacttgtaccagaacgtgtc

SEQ ID NO: 103910 - DNA, 25 bp, Homo sapien
ggcgtctgctggcaataccttccca

SEQ ID NO: 103911 - DNA, 25 bp, Homo sapien
agcgctatacgggtctagggaatca

SEQ ID NO: 103912 - DNA, 25 bp, Homo sapien
ctgaggactggatgtgcggaaacca

SEQ ID NO: 103913 - DNA, 25 bp, Homo sapien
caggccctagctgccctggacgccg

SEQ ID NO: 103914 - DNA, 25 bp, Homo sapien
tctgtcccggcgacgctccgtaccc

SEQ ID NO: 103915 - DNA, 25 bp, Homo sapien
tcagccgcctttcctctgctccagg

SEQ ID NO: 103916 - DNA, 25 bp, Homo sapien
catggaccggggtcagccgcctttc

SEQ ID NO: 103917 - DNA, 25 bp, Homo sapien
ccatttgctgacctcaacggctggc

SEQ ID NO: 103918 - DNA, 25 bp, Homo sapien
agtcgccatttgctgacctcaacgg

SEQ ID NO: 103919 - DNA, 25 bp, Homo sapien
tgccctcgaggcttaagtcgccatt

SEQ ID NO: 103920 - DNA, 25 bp, Homo sapien
cgaggcttaagtcgccatttgctga

SEQ ID NO: 103921 - DNA, 25 bp, Homo sapien
gccggctaactcagcgtgcccaagt

SEQ ID NO: 103922 - DNA, 25 bp, Homo sapien
tctggagcccggacgggacagccca

SEQ ID NO: 103923 - DNA, 25 bp, Homo sapien
aggacggtgctgtgacccgttatcc

SEQ ID NO: 103924 - DNA, 25 bp, Homo sapien
cagcgtgcccaagtcccgtgactta

SEQ ID NO: 103925 - DNA, 25 bp, Homo sapien
cccaccagggtctgcttctgtgagg

SEQ ID NO: 103926 - DNA, 25 bp, Homo sapien
acctttggtgattgccgccacaggc

SEQ ID NO: 103927 - DNA, 25 bp, Homo sapien
cgcccttgctcgacctttggtgatt

SEQ ID NO: 103928 - DNA, 25 bp, Homo sapien
tcccgtgacttagtgccaggacggt

SEQ ID NO: 103929 - DNA, 25 bp, Homo sapien
ccggatcctagtgtgttggacgctc

SEQ ID NO: 103930 - DNA, 25 bp, Homo sapien
cggcgcacggtacccactcagttat

SEQ ID NO: 103931 - DNA, 25 bp, Homo sapien
tcttctgcgcaagttcacactgtta

SEQ ID NO: 103932 - DNA, 25 bp, Homo sapien
gttggacgctcgagacaaacaccgc

SEQ ID NO: 103933 - DNA, 25 bp, Homo sapien
tccgaagttcgctagtccgggatcg

SEQ ID NO: 103934 - DNA, 25 bp, Homo sapien
ttgagtctgtttgcaccaggcctgc

SEQ ID NO: 103935 - DNA, 25 bp, Homo sapien
gcacgagcgctttttgccggaacgt

SEQ ID NO: 103936 - DNA, 25 bp, Homo sapien
gcgctggcttcatgagtctcttctg

SEQ ID NO: 103937 - DNA, 25 bp, Homo sapien
caggagcgtcgtctcagcgctcggt

SEQ ID NO: 103938 - DNA, 25 bp, Homo sapien
gatctttttggaggtgtcccttctc

SEQ ID NO: 103939 - DNA, 25 bp, Homo sapien
tcccagcgatctttttggaggtgtc

SEQ ID NO: 103940 - DNA, 25 bp, Homo sapien
cctcgtcctcaccaccatggtcggg

SEQ ID NO: 103941 - DNA, 25 bp, Homo sapien
ggcaggctgtggacctcgtcctcac

SEQ ID NO: 103942 - DNA, 25 bp, Homo sapien
accattgttggcgaggggcaccact

SEQ ID NO: 103943 - DNA, 25 bp, Homo sapien
tcagcgctcggtggccagaatggac

SEQ ID NO: 103944 - DNA, 25 bp, Homo sapien
tgttgctggcaggagcgtcgtctca

SEQ ID NO: 103945 - DNA, 25 bp, Homo sapien
caggagtacgtgtatgagcacgagc

SEQ ID NO: 103946 - DNA, 25 bp, Homo sapien
ctgccgctgcagctgagcacctttg

SEQ ID NO: 103947 - DNA, 25 bp, Homo sapien
ccgtgtccgagtcggtgctctgcac

SEQ ID NO: 103948 - DNA, 25 bp, Homo sapien
ggatgattcgcctgcgctgacgcct

SEQ ID NO: 103949 - DNA, 25 bp, Homo sapien
cgacgacagcgagaggtttaagctc

SEQ ID NO: 103950 - DNA, 25 bp, Homo sapien
agctcctccaggagtacgtgtatga

SEQ ID NO: 103951 - DNA, 25 bp, Homo sapien
atcccggattttcacgcggtgctgg

SEQ ID NO: 103952 - DNA, 25 bp, Homo sapien
cgtatcctacgcctctgtcattctg

SEQ ID NO: 103953 - DNA, 25 bp, Homo sapien
gcctgtagtccctgcgaggatccag

SEQ ID NO: 103954 - DNA, 25 bp, Homo sapien
atcgagaggtctccgagtcctgagc

SEQ ID NO: 103955 - DNA, 25 bp, Homo sapien
cgctcgtgtagggagattgacctac

SEQ ID NO: 103956 - DNA, 25 bp, Homo sapien
attgacctacagtgcccagctgggg

SEQ ID NO: 103957 - DNA, 25 bp, Homo sapien
cgtcgtgacggtcctagaagagagc

SEQ ID NO: 103958 - DNA, 25 bp, Homo sapien
tcaggcgtcgagctacaactatcca

SEQ ID NO: 103959 - DNA, 25 bp, Homo sapien
acttgacaagtctgcgtgggaaatc

SEQ ID NO: 103960 - DNA, 25 bp, Homo sapien
tcttaccgggacctcctcgatggcg

SEQ ID NO: 103961 - DNA, 25 bp, Homo sapien
cacaggtgtcgctcaagtcttccga

SEQ ID NO: 103962 - DNA, 25 bp, Homo sapien
catgcctggcttgtttgaccaaaga

SEQ ID NO: 103963 - DNA, 25 bp, Homo sapien
gagggctgtcgtttgaactctccca

SEQ ID NO: 103964 - DNA, 25 bp, Homo sapien
gttgactcccttctcgtctcgaggc

SEQ ID NO: 103965 - DNA, 25 bp, Homo sapien
tcgaaagtaagacgtctccctaggc

SEQ ID NO: 103966 - DNA, 25 bp, Homo sapien
ggcgctatttcttactcagccttgg

SEQ ID NO: 103967 - DNA, 25 bp, Homo sapien
tgcatagcgacactcgggacctgtg

SEQ ID NO: 103968 - DNA, 25 bp, Homo sapien
tccctccttgtatgtggcccacagg

SEQ ID NO: 103969 - DNA, 25 bp, Homo sapien
cgtctgcctgggtacctttaggaga

SEQ ID NO: 103970 - DNA, 25 bp, Homo sapien
cctcaactgggacagcaggactctg

SEQ ID NO: 103971 - DNA, 25 bp, Homo sapien
tttaggagaagagagaggcccaatc

SEQ ID NO: 103972 - DNA, 25 bp, Homo sapien
ttcgccctcaaggtcctcaactggg

SEQ ID NO: 103973 - DNA, 25 bp, Homo sapien
accatcggggtggacttcgccctca

SEQ ID NO: 103974 - DNA, 25 bp, Homo sapien
tttctgcctgaactcgtctgcctgg

SEQ ID NO: 103975 - DNA, 25 bp, Homo sapien
tccggggcccataaaggctccaggc

SEQ ID NO: 103976 - DNA, 25 bp, Homo sapien
cctcttcaaggtgctggtgatcggc

SEQ ID NO: 103977 - DNA, 25 bp, Homo sapien
tgccatggcctccaaacaaaccaaa

SEQ ID NO: 103978 - DNA, 25 bp, Homo sapien
aggtgcatcgtatcaactcggcgca

SEQ ID NO: 103979 - DNA, 25 bp, Homo sapien
tacatagatcggcttctgccatggc

SEQ ID NO: 103980 - DNA, 25 bp, Homo sapien
cagagctcagccctacatagatcgg

SEQ ID NO: 103981 - DNA, 25 bp, Homo sapien
gcaggctctttgctcagagctcagc

SEQ ID NO: 103982 - DNA, 25 bp, Homo sapien
cgtctcctggcaacgcagacgcgga

SEQ ID NO: 103983 - DNA, 25 bp, Homo sapien
ggacgccgtctcctggcaacgcaga

SEQ ID NO: 103984 - DNA, 25 bp, Homo sapien
actcggcgcacggatcggataaatc

SEQ ID NO: 103985 - DNA, 25 bp, Homo sapien
cggcggctgaatcggcaccacagca

SEQ ID NO: 103986 - DNA, 25 bp, Homo sapien
tttccgcggtcgaagctgccttcgg

SEQ ID NO: 103987 - DNA, 25 bp, Homo sapien
agatccaggaaacgctccagtccga

SEQ ID NO: 103988 - DNA, 25 bp, Homo sapien
tccgagaccatgaggaaattcaaca

SEQ ID NO: 103989 - DNA, 25 bp, Homo sapien
cactttcagctctgcaaggtgaacg

SEQ ID NO: 103990 - DNA, 25 bp, Homo sapien
cgcagtatttcctgttcggattatc

SEQ ID NO: 103991 - DNA, 25 bp, Homo sapien
gccgctcttgtcgtcgcagtatttc

SEQ ID NO: 103992 - DNA, 25 bp, Homo sapien
agcagcatccgcctgggaaccggga

SEQ ID NO: 103993 - DNA, 25 bp, Homo sapien
gatggccaacgtgcaccagaccatg

SEQ ID NO: 103994 - DNA, 25 bp, Homo sapien
aagatggccaacgtgcaccagacca

SEQ ID NO: 103995 - DNA, 25 bp, Homo sapien
ggcgtcagatcctgcacgcccgcgg

SEQ ID NO: 103996 - DNA, 25 bp, Homo sapien
cccaccgggcgtcagatcctgcacg

SEQ ID NO: 103997 - DNA, 25 bp, Homo sapien
agggcccgcggtccagaccagggca

SEQ ID NO: 103998 - DNA, 25 bp, Homo sapien
atggccaacgtgcaccagaccatgc

SEQ ID NO: 103999 - DNA, 25 bp, Homo sapien
ctgcccgactctttcaagccgcccg

SEQ ID NO: 104000 - DNA, 25 bp, Homo sapien
aggcggcgccacaggcaacccccac

SEQ ID NO: 104001 - DNA, 25 bp, Homo sapien
gtgacccaagtttggggccacaagc

SEQ ID NO: 104002 - DNA, 25 bp, Homo sapien
actgtgagtccgctttggcgaggga

SEQ ID NO: 104003 - DNA, 25 bp, Homo sapien
atcccagcgcccaggagcttcgcca

SEQ ID NO: 104004 - DNA, 25 bp, Homo sapien
ttcgccacctaccagggtccgagac

SEQ ID NO: 104005 - DNA, 25 bp, Homo sapien
caagtttggggccacaagcagctcc

SEQ ID NO: 104006 - DNA, 25 bp, Homo sapien
gtttggggccacaagcagctccacc

SEQ ID NO: 104007 - DNA, 25 bp, Homo sapien
tggggccacaagcagctccaccggc

SEQ ID NO: 104008 - DNA, 25 bp, Homo sapien
aggagcttcgccacctaccagggtc

SEQ ID NO: 104009 - DNA, 25 bp, Homo sapien
ctgctgcttggggaattcactttgc

SEQ ID NO: 104010 - DNA, 25 bp, Homo sapien
aactttcgcagacccgggagcttag

SEQ ID NO: 104011 - DNA, 25 bp, Homo sapien
ggccgcccacggaagaagtcagatc

SEQ ID NO: 104012 - DNA, 25 bp, Homo sapien
ttccacgggtagaagagtcagatta

SEQ ID NO: 104013 - DNA, 25 bp, Homo sapien
gtgactgacactcgcgaagactagg

SEQ ID NO: 104014 - DNA, 25 bp, Homo sapien
aggcttcttctgatggttttccgtc

SEQ ID NO: 104015 - DNA, 25 bp, Homo sapien
aagttccaagaactggtgccgcccg

SEQ ID NO: 104016 - DNA, 25 bp, Homo sapien
ccagcagcgtagaagccaccggctt

SEQ ID NO: 104017 - DNA, 25 bp, Homo sapien
gtccgaggctcatttccatgcaaag

SEQ ID NO: 104018 - DNA, 25 bp, Homo sapien
ttctcccgactctggaccgacgtga

SEQ ID NO: 104019 - DNA, 25 bp, Homo sapien
gactttgcctcctgctaccctgttg

SEQ ID NO: 104020 - DNA, 25 bp, Homo sapien
cccgtcacaggaagaaacgcctttg

SEQ ID NO: 104021 - DNA, 25 bp, Homo sapien
tcgcgtgccttagttagttggttcc

SEQ ID NO: 104022 - DNA, 25 bp, Homo sapien
acgctttctttagcctcgagggaga

SEQ ID NO: 104023 - DNA, 25 bp, Homo sapien
gcggctgctctttcaacaggcgatt

SEQ ID NO: 104024 - DNA, 25 bp, Homo sapien
gcctgacatcagagcaccttttgtt

SEQ ID NO: 104025 - DNA, 25 bp, Homo sapien
caggtttcggcctccgtcttgccga

SEQ ID NO: 104026 - DNA, 25 bp, Homo sapien
agcgagacctggagtcctgtaacca

SEQ ID NO: 104027 - DNA, 25 bp, Homo sapien
aaactcccaggagagcgatgatggg

SEQ ID NO: 104028 - DNA, 25 bp, Homo sapien
cgatgatgggtgaccgatggaactc

SEQ ID NO: 104029 - DNA, 25 bp, Homo sapien
accgatggaactcctggctgctttc

SEQ ID NO: 104030 - DNA, 25 bp, Homo sapien
tggctgctttcatgaccggagctgg

SEQ ID NO: 104031 - DNA, 25 bp, Homo sapien
cccgaaaccgagtgcggcggcagca

SEQ ID NO: 104032 - DNA, 25 bp, Homo sapien
cgactcaccaagtgagcagcgagac

SEQ ID NO: 104033 - DNA, 25 bp, Homo sapien
ctcgacctgcggcagtacttgggta

SEQ ID NO: 104034 - DNA, 25 bp, Homo sapien
ggactacggcttctgcatggccacc

SEQ ID NO: 104035 - DNA, 25 bp, Homo sapien
gtctctccaggtgctaagcccgtga

SEQ ID NO: 104036 - DNA, 25 bp, Homo sapien
ccggagtgtgtgtatcttcaggcct

SEQ ID NO: 104037 - DNA, 25 bp, Homo sapien
gaaggtcctcttcgttgcattgtta

SEQ ID NO: 104038 - DNA, 25 bp, Homo sapien
ttagtgaccgcagttcagtcccgtc

SEQ ID NO: 104039 - DNA, 25 bp, Homo sapien
gccaccgtccgctctgagaattctg

SEQ ID NO: 104040 - DNA, 25 bp, Homo sapien
gatgggtgaccttttcctggcacgg

SEQ ID NO: 104041 - DNA, 25 bp, Homo sapien
gtatgagtgcggagatcgtgtatga

SEQ ID NO: 104042 - DNA, 25 bp, Homo sapien
acgagtgaggagatcatgtacgagt

SEQ ID NO: 104043 - DNA, 25 bp, Homo sapien
tgagtgtgaggggtcgtgtatgagt

SEQ ID NO: 104044 - DNA, 25 bp, Homo sapien
tgtatgagtgtgaggggtcgtgtat

SEQ ID NO: 104045 - DNA, 25 bp, Homo sapien
tgtacgagtgcggagattgtgtatg

SEQ ID NO: 104046 - DNA, 25 bp, Homo sapien
tcatgtacgagtgcggagattgtgt

SEQ ID NO: 104047 - DNA, 25 bp, Homo sapien
gagtgaggagatcatgtacgagtgt

SEQ ID NO: 104048 - DNA, 25 bp, Homo sapien
tcgtgtatgagtgcggagatcgtgt

SEQ ID NO: 104049 - DNA, 25 bp, Homo sapien
gcgaggggtcatgtatgagtgcagg

SEQ ID NO: 104050 - DNA, 25 bp, Homo sapien
tgagggatcatgtaagagtgcgggg

SEQ ID NO: 104051 - DNA, 25 bp, Homo sapien
agtcatgtacgagtgtaggggtcat

SEQ ID NO: 104052 - DNA, 25 bp, Homo sapien
gtcatgtacgagtgctggggtcgtg

SEQ ID NO: 104053 - DNA, 25 bp, Homo sapien
tgtgggtatcgtgtacaagtgtggg

SEQ ID NO: 104054 - DNA, 25 bp, Homo sapien
atcgtgtttgagtgcaggggatcgt

SEQ ID NO: 104055 - DNA, 25 bp, Homo sapien
atgtacgagtgtaggggtcatgtac

SEQ ID NO: 104056 - DNA, 25 bp, Homo sapien
cgagtgtggggatcgtgtatgagtt

SEQ ID NO: 104057 - DNA, 25 bp, Homo sapien
cctgtagagtcggtctctgttgctc

SEQ ID NO: 104058 - DNA, 25 bp, Homo sapien
tcgcggaccctgtagagtcggtctc

SEQ ID NO: 104059 - DNA, 25 bp, Homo sapien
aaggtcgcccagattcccgacaagc

SEQ ID NO: 104060 - DNA, 25 bp, Homo sapien
tgaggagtcttccatcctacgtcga

SEQ ID NO: 104061 - DNA, 25 bp, Homo sapien
ttccatcctacgtcgagctctgact

SEQ ID NO: 104062 - DNA, 25 bp, Homo sapien
gctctgactcccgtgctgtcgagag

SEQ ID NO: 104063 - DNA, 25 bp, Homo sapien
ctcccgtgctgtcgagagggagtcc

SEQ ID NO: 104064 - DNA, 25 bp, Homo sapien
tgttgctctttttgcctgaggagtc

SEQ ID NO: 104065 - DNA, 25 bp, Homo sapien
tctgtaagtggtctcttggctccgc

SEQ ID NO: 104066 - DNA, 25 bp, Homo sapien
aagcggccgcgatgtccttttgtgt

SEQ ID NO: 104067 - DNA, 25 bp, Homo sapien
ttttgtgtcctacaagcagccggcg

SEQ ID NO: 104068 - DNA, 25 bp, Homo sapien
cccgctggtctgattagcataggac

SEQ ID NO: 104069 - DNA, 25 bp, Homo sapien
cctccgttacgaaagagcgcttctg

SEQ ID NO: 104070 - DNA, 25 bp, Homo sapien
cccgcccttgcgttttcatctgtaa

SEQ ID NO: 104071 - DNA, 25 bp, Homo sapien
ctcaagcataggtagcaggtccagc

SEQ ID NO: 104072 - DNA, 25 bp, Homo sapien
gccgcgtacgcatgtgcgccgcagt

SEQ ID NO: 104073 - DNA, 25 bp, Homo sapien
gcgtgcgtgttccttaatccgtgtc

SEQ ID NO: 104074 - DNA, 25 bp, Homo sapien
gagccggctctcaatgcagtccatt

SEQ ID NO: 104075 - DNA, 25 bp, Homo sapien
gacgggagtctcagtgtagcaaatc

SEQ ID NO: 104076 - DNA, 25 bp, Homo sapien
gcagcgttcctggagcctcctaata

SEQ ID NO: 104077 - DNA, 25 bp, Homo sapien
gagcttctaataaccgcgctgggca

SEQ ID NO: 104078 - DNA, 25 bp, Homo sapien
ggcggcttcgcttgagcttctaata

SEQ ID NO: 104079 - DNA, 25 bp, Homo sapien
aatgcctggaaatcgagcgtgaagc

SEQ ID NO: 104080 - DNA, 25 bp, Homo sapien
ccctcttttcttagcggcggcttcg

SEQ ID NO: 104081 - DNA, 25 bp, Homo sapien
gacgcgagctcagttcctttcttcc

SEQ ID NO: 104082 - DNA, 25 bp, Homo sapien
gccgcccagccgtcgtttttgatct

SEQ ID NO: 104083 - DNA, 25 bp, Homo sapien
cgccgccatattgtgtgacagtatt

SEQ ID NO: 104084 - DNA, 25 bp, Homo sapien
gcagatctcgcggtgtttgccggcc

SEQ ID NO: 104085 - DNA, 25 bp, Homo sapien
gtacaggtcggaggaagagcatccc

SEQ ID NO: 104086 - DNA, 25 bp, Homo sapien
caagacaggcgtagagactgcgagt

SEQ ID NO: 104087 - DNA, 25 bp, Homo sapien
ctccagccctagcaagacaggcgta

SEQ ID NO: 104088 - DNA, 25 bp, Homo sapien
ccgtcgtttttgatctgctgcagcc

SEQ ID NO: 104089 - DNA, 25 bp, Homo sapien
tctccgggtggtagaacttgcactt

SEQ ID NO: 104090 - DNA, 25 bp, Homo sapien
ctctggcatctctgtaccaggagga

SEQ ID NO: 104091 - DNA, 25 bp, Homo sapien
gccataggtgcatttcttgcctgaa

SEQ ID NO: 104092 - DNA, 25 bp, Homo sapien
cgtggagattcctccaagcaggccc

SEQ ID NO: 104093 - DNA, 25 bp, Homo sapien
aagcaagtcgccgtgcaggtcccta

SEQ ID NO: 104094 - DNA, 25 bp, Homo sapien
gtcctcggtcgcgtacactgaaagt

SEQ ID NO: 104095 - DNA, 25 bp, Homo sapien
agcgccctggaaacgcctcaagatc

SEQ ID NO: 104096 - DNA, 25 bp, Homo sapien
tccacctggtcacgcgggaagacgc

SEQ ID NO: 104097 - DNA, 25 bp, Homo sapien
ttgacgaaggagaacatgagcagcc

SEQ ID NO: 104098 - DNA, 25 bp, Homo sapien
gcagcctctgctcgatgaaccactt

SEQ ID NO: 104099 - DNA, 25 bp, Homo sapien
tcccggtagttgtcgttggagacga

SEQ ID NO: 104100 - DNA, 25 bp, Homo sapien
atgacgccgtcctgctcgtaggcca

SEQ ID NO: 104101 - DNA, 25 bp, Homo sapien
aggccaccttcacgatgtagcggtc

SEQ ID NO: 104102 - DNA, 25 bp, Homo sapien
tagcggtcgtcgtagcagaccaggc

SEQ ID NO: 104103 - DNA, 25 bp, Homo sapien
agaccaggcgcttgccgtgcacctt

SEQ ID NO: 104104 - DNA, 25 bp, Homo sapien
aacaccagtttttgccgccatagcg

SEQ ID NO: 104105 - DNA, 25 bp, Homo sapien
acgtcgcctaaagtggtctccagta

SEQ ID NO: 104106 - DNA, 25 bp, Homo sapien
gcggcgggatcttctctccacctat

SEQ ID NO: 104107 - DNA, 25 bp, Homo sapien
gcggccgttcttcggtgtacaagtc

SEQ ID NO: 104108 - DNA, 25 bp, Homo sapien
cgtttgtgtccgtctcaagagcaga

SEQ ID NO: 104109 - DNA, 25 bp, Homo sapien
cctgtccctcagaacggtctcagta

SEQ ID NO: 104110 - DNA, 25 bp, Homo sapien
tgaaaatcctggtccgcccttggcg

SEQ ID NO: 104111 - DNA, 25 bp, Homo sapien
tggtctccagtagaaccgccatggc

SEQ ID NO: 104112 - DNA, 25 bp, Homo sapien
gcccagctgacttacggatcgggtt

SEQ ID NO: 104113 - DNA, 25 bp, Homo sapien
tagagccagcgcttgggcaaggaat

SEQ ID NO: 104114 - DNA, 25 bp, Homo sapien
cggatgttggaggagaagttctcac

SEQ ID NO: 104115 - DNA, 25 bp, Homo sapien
acttcgcgcatttccaggccacttg

SEQ ID NO: 104116 - DNA, 25 bp, Homo sapien
tgccggtgatcaggccttcgtaatg

SEQ ID NO: 104117 - DNA, 25 bp, Homo sapien
gggctgtccacagtgacgcttccca

SEQ ID NO: 104118 - DNA, 25 bp, Homo sapien
ggctggccgctttacgactccgact

SEQ ID NO: 104119 - DNA, 25 bp, Homo sapien
gttgtccaagatggagggcgctcca

SEQ ID NO: 104120 - DNA, 25 bp, Homo sapien
gccctcgcgcgacgtaatgtttttg

SEQ ID NO: 104121 - DNA, 25 bp, Homo sapien
cctgctcgccgagaatttgaagaca

SEQ ID NO: 104122 - DNA, 25 bp, Homo sapien
tgccggggacgacctcggcgactct

SEQ ID NO: 104123 - DNA, 25 bp, Homo sapien
gtactgcccagttcaatcgtcaaca

SEQ ID NO: 104124 - DNA, 25 bp, Homo sapien
agcccactttgctctccgctcacgg

SEQ ID NO: 104125 - DNA, 25 bp, Homo sapien
agtgaaaactcacctgcggcggccc

SEQ ID NO: 104126 - DNA, 25 bp, Homo sapien
ccagagcaccgccagagtgaaaact

SEQ ID NO: 104127 - DNA, 25 bp, Homo sapien
tttgaagacaaacccgccagggtca

SEQ ID NO: 104128 - DNA, 25 bp, Homo sapien
gtgcgcattcttgcaccgcctcctc

SEQ ID NO: 104129 - DNA, 25 bp, Homo sapien
gcccgcagctctgatcgttcgtgag

SEQ ID NO: 104130 - DNA, 25 bp, Homo sapien
cgaggccgaaaagcctggggctctt

SEQ ID NO: 104131 - DNA, 25 bp, Homo sapien
ggctcagctcgggtcaatgcaacca

SEQ ID NO: 104132 - DNA, 25 bp, Homo sapien
tgcaaccagccaagtcaggcccgga

SEQ ID NO: 104133 - DNA, 25 bp, Homo sapien
ccaactcgagcactggaggagcgca

SEQ ID NO: 104134 - DNA, 25 bp, Homo sapien
aggcggccagagtccgtcccagcaa

SEQ ID NO: 104135 - DNA, 25 bp, Homo sapien
caggtttcccggatgtgggcatttc

SEQ ID NO: 104136 - DNA, 25 bp, Homo sapien
cacgccgccagaaagacaggctcta

SEQ ID NO: 104137 - DNA, 25 bp, Homo sapien
aagcgtctcagcaggaggttcctac

SEQ ID NO: 104138 - DNA, 25 bp, Homo sapien
gtaagcagtttcatgtcgccgcaca

SEQ ID NO: 104139 - DNA, 25 bp, Homo sapien
gggatgctcctctcgatgctattgg

SEQ ID NO: 104140 - DNA, 25 bp, Homo sapien
gtcgtcctctgtatcccactttcgg

SEQ ID NO: 104141 - DNA, 25 bp, Homo sapien
cccatttgtagttgcgtcggctgtc

SEQ ID NO: 104142 - DNA, 25 bp, Homo sapien
cctgagacgctcagcgggctatata

SEQ ID NO: 104143 - DNA, 25 bp, Homo sapien
cccgcacatgcgagctcagcagatt

SEQ ID NO: 104144 - DNA, 25 bp, Homo sapien
aaaaaggtcgtcctccgctgcctca

SEQ ID NO: 104145 - DNA, 25 bp, Homo sapien
tctgagctacggagcaaccgcgcct

SEQ ID NO: 104146 - DNA, 25 bp, Homo sapien
ggctcgtccctatcagcggcgatac

SEQ ID NO: 104147 - DNA, 25 bp, Homo sapien
gcggcgatacctcattgtcccaaga

SEQ ID NO: 104148 - DNA, 25 bp, Homo sapien
aggcatgccatcaccggctctgagc

SEQ ID NO: 104149 - DNA, 25 bp, Homo sapien
ccaagatcctgtagcgaacgtctcc

SEQ ID NO: 104150 - DNA, 25 bp, Homo sapien
gcggtctgtaaacttcccggaggca

SEQ ID NO: 104151 - DNA, 25 bp, Homo sapien
ctgggacacaaacttcgcataaatt

SEQ ID NO: 104152 - DNA, 25 bp, Homo sapien
cttcccgcggaaccctgattggatg

SEQ ID NO: 104153 - DNA, 25 bp, Homo sapien
caaggattcccacggtcgttctggg

SEQ ID NO: 104154 - DNA, 25 bp, Homo sapien
ccgcgcaaggattcccacggtcgtt

SEQ ID NO: 104155 - DNA, 25 bp, Homo sapien
gcagccgcgcaaggattcccacggt

SEQ ID NO: 104156 - DNA, 25 bp, Homo sapien
cttgcggcaccagaggtggtctgca

SEQ ID NO: 104157 - DNA, 25 bp, Homo sapien
aggattcccacggtcgttctgggct

SEQ ID NO: 104158 - DNA, 25 bp, Homo sapien
ccagcaggctcggcgcagcacatct

SEQ ID NO: 104159 - DNA, 25 bp, Homo sapien
cgcaaggattcccacggtcgttctg

SEQ ID NO: 104160 - DNA, 25 bp, Homo sapien
gcagaagctggtgctcccgcaccca

SEQ ID NO: 104161 - DNA, 25 bp, Homo sapien
taaaatgggttccaaagcggcgcgc

SEQ ID NO: 104162 - DNA, 25 bp, Homo sapien
aaagcggcgcgctctgtcggcccag

SEQ ID NO: 104163 - DNA, 25 bp, Homo sapien
ctgcctcaagaaggcgagctcaggg

SEQ ID NO: 104164 - DNA, 25 bp, Homo sapien
tcaggggactctgcgttttaaaatg

SEQ ID NO: 104165 - DNA, 25 bp, Homo sapien
gagctcaggggactctgcgttttaa

SEQ ID NO: 104166 - DNA, 25 bp, Homo sapien
ggacaggtcgcgctagggtctccct

SEQ ID NO: 104167 - DNA, 25 bp, Homo sapien
tagggtctcccttgctgcctcaaga

SEQ ID NO: 104168 - DNA, 25 bp, Homo sapien
cttgctgcctcaagaaggcgagctc

SEQ ID NO: 104169 - DNA, 25 bp, Homo sapien
gccgtccggaacgttctgtctgtcc

SEQ ID NO: 104170 - DNA, 25 bp, Homo sapien
tcgcgctgaaggtggttctgtacct

SEQ ID NO: 104171 - DNA, 25 bp, Homo sapien
tctgtacctgctccgagtgtgctta

SEQ ID NO: 104172 - DNA, 25 bp, Homo sapien
ttagcgatggcctggaaatccggcg

SEQ ID NO: 104173 - DNA, 25 bp, Homo sapien
agccactcggagctaatccacaatc

SEQ ID NO: 104174 - DNA, 25 bp, Homo sapien
taatccacaatctccgcagtaagtg

SEQ ID NO: 104175 - DNA, 25 bp, Homo sapien
taagtgccacctccgcccgttgtag

SEQ ID NO: 104176 - DNA, 25 bp, Homo sapien
gtggtctcactcttgggaaaactgc

SEQ ID NO: 104177 - DNA, 25 bp, Homo sapien
ccgcggctaaaataacttggcacga

SEQ ID NO: 104178 - DNA, 25 bp, Homo sapien
gcacgagtgtgtttcgcttccaact

SEQ ID NO: 104179 - DNA, 25 bp, Homo sapien
tagccgctgtgcagcgcgaacttgc

SEQ ID NO: 104180 - DNA, 25 bp, Homo sapien
atggcgtcaggcattgcgctgtagc

SEQ ID NO: 104181 - DNA, 25 bp, Homo sapien
gcgaacttgcagacgttgcggccgc

SEQ ID NO: 104182 - DNA, 25 bp, Homo sapien
agttgccggcggaactcctccagca

SEQ ID NO: 104183 - DNA, 25 bp, Homo sapien
ccgtgcagttgaagaggtagcagcc

SEQ ID NO: 104184 - DNA, 25 bp, Homo sapien
cagccacaggcagagcagtagcagc

SEQ ID NO: 104185 - DNA, 25 bp, Homo sapien
gaagcccagcccgtggatcacctgg

SEQ ID NO: 104186 - DNA, 25 bp, Homo sapien
cggggtgatcgcacgggtccttcca

SEQ ID NO: 104187 - DNA, 25 bp, Homo sapien
gtgatcgcacgggtccttccagaag

SEQ ID NO: 104188 - DNA, 25 bp, Homo sapien
cacggttggcctccgccccgcttag

SEQ ID NO: 104189 - DNA, 25 bp, Homo sapien
ctgccattggggagttggatcgcag

SEQ ID NO: 104190 - DNA, 25 bp, Homo sapien
agaagcgaagcccagcccgtggatc

SEQ ID NO: 104191 - DNA, 25 bp, Homo sapien
gcccagcccgtggatcacctggcgg

SEQ ID NO: 104192 - DNA, 25 bp, Homo sapien
aagcgaagcccagcccgtggatcac

SEQ ID NO: 104193 - DNA, 25 bp, Homo sapien
caagggacaggcggttcctgagaca

SEQ ID NO: 104194 - DNA, 25 bp, Homo sapien
tctgggaggccctagcatggacgtc

SEQ ID NO: 104195 - DNA, 25 bp, Homo sapien
tggtttctccgctggtctgggaggc

SEQ ID NO: 104196 - DNA, 25 bp, Homo sapien
ctgctggtttctccgctggtctggg

SEQ ID NO: 104197 - DNA, 25 bp, Homo sapien
cagggctgctggtttctccgctggt

SEQ ID NO: 104198 - DNA, 25 bp, Homo sapien
caggaagacccggaaggactcgccg

SEQ ID NO: 104199 - DNA, 25 bp, Homo sapien
ccagagcctcgggacgaaactgttt

SEQ ID NO: 104200 - DNA, 25 bp, Homo sapien
ggctgctggtttctccgctggtctg

SEQ ID NO: 104201 - DNA, 25 bp, Homo sapien
tcaggacctagtgcgccatgggcgc

SEQ ID NO: 104202 - DNA, 25 bp, Homo sapien
tgtctccgaaagtcatctgcggttg

SEQ ID NO: 104203 - DNA, 25 bp, Homo sapien
gagcgggactgtgacgtctccacac

SEQ ID NO: 104204 - DNA, 25 bp, Homo sapien
tgtctcctgccacggttccttgtcg

SEQ ID NO: 104205 - DNA, 25 bp, Homo sapien
ccctgttggatcctgggcactcagg

SEQ ID NO: 104206 - DNA, 25 bp, Homo sapien
gcagggtgaaaactgaaaccgcata

SEQ ID NO: 104207 - DNA, 25 bp, Homo sapien
accgcatatgcgaactgtctccgaa

SEQ ID NO: 104208 - DNA, 25 bp, Homo sapien
accgtgtgaccgtccctgggactct

SEQ ID NO: 104209 - DNA, 25 bp, Homo sapien
aggtgattcatcttccaggctctcc

SEQ ID NO: 104210 - DNA, 25 bp, Homo sapien
cgcgcccgtacatagggaggcttta

SEQ ID NO: 104211 - DNA, 25 bp, Homo sapien
cgtgacgctatgacccgcttgacgc

SEQ ID NO: 104212 - DNA, 25 bp, Homo sapien
gtcagggcagccaatcatatttcta

SEQ ID NO: 104213 - DNA, 25 bp, Homo sapien
gccgctgaatattcctctgcaagtt

SEQ ID NO: 104214 - DNA, 25 bp, Homo sapien
tgtaatcacgtccactgggaactgg

SEQ ID NO: 104215 - DNA, 25 bp, Homo sapien
ctagcgctctgggtccttaatggca

SEQ ID NO: 104216 - DNA, 25 bp, Homo sapien
tggctgcgcccagagcatgataagc

SEQ ID NO: 104217 - DNA, 25 bp, Homo sapien
tcaggacctagtgcgtcccggcgcc

SEQ ID NO: 104218 - DNA, 25 bp, Homo sapien
cccacagattcgagtgggacggtga

SEQ ID NO: 104219 - DNA, 25 bp, Homo sapien
tgatccttctgacacgggaaccaag

SEQ ID NO: 104220 - DNA, 25 bp, Homo sapien
ttgccgcgaccagcgagtcatccca

SEQ ID NO: 104221 - DNA, 25 bp, Homo sapien
ccgcagaagccagaatggacgcgga

SEQ ID NO: 104222 - DNA, 25 bp, Homo sapien
ttgaaatcagcaatcgcctataaca

SEQ ID NO: 104223 - DNA, 25 bp, Homo sapien
cctgcttgggttccgcgtcccagga

SEQ ID NO: 104224 - DNA, 25 bp, Homo sapien
cccacgacatgcatgctccgggtcc

SEQ ID NO: 104225 - DNA, 25 bp, Homo sapien
ggcgcgatctccctgaacgaacatc

SEQ ID NO: 104226 - DNA, 25 bp, Homo sapien
gaacattgccatctcaccgaacatc

SEQ ID NO: 104227 - DNA, 25 bp, Homo sapien
tctccctgaacgaacatcgcggtct

SEQ ID NO: 104228 - DNA, 25 bp, Homo sapien
caggccaggaggcttctggtagcac

SEQ ID NO: 104229 - DNA, 25 bp, Homo sapien
aagggaaccatcagcgcctcctgtc

SEQ ID NO: 104230 - DNA, 25 bp, Homo sapien
gtgtgagcctcgaagggaaccatca

SEQ ID NO: 104231 - DNA, 25 bp, Homo sapien
gctgggcagctttataaacagccgt

SEQ ID NO: 104232 - DNA, 25 bp, Homo sapien
gtttctggaaggaccggtgctgtct

SEQ ID NO: 104233 - DNA, 25 bp, Homo sapien
cctacaagagtcagctggaggtgag

SEQ ID NO: 104234 - DNA, 25 bp, Homo sapien
ccgccaggaggtgcgctcacatgct

SEQ ID NO: 104235 - DNA, 25 bp, Homo sapien
cgccaccgcggcattccctaacctc

SEQ ID NO: 104236 - DNA, 25 bp, Homo sapien
cgtccctaatccctctggcccgcgg

SEQ ID NO: 104237 - DNA, 25 bp, Homo sapien
cccaggcgctgtcgggacaggccaa

SEQ ID NO: 104238 - DNA, 25 bp, Homo sapien
gcggctgaggcctacaagagtcagc

SEQ ID NO: 104239 - DNA, 25 bp, Homo sapien
ctgaggcctacaagagtcagctgga

SEQ ID NO: 104240 - DNA, 25 bp, Homo sapien
acaggccaagcgggccgagctgtac

SEQ ID NO: 104241 - DNA, 25 bp, Homo sapien
tgcaatgaatcaacgtggggccctc

SEQ ID NO: 104242 - DNA, 25 bp, Homo sapien
tcctgccgagacgtgaccttacagc

SEQ ID NO: 104243 - DNA, 25 bp, Homo sapien
gcctttggaagacgcgtgagaactc

SEQ ID NO: 104244 - DNA, 25 bp, Homo sapien
ctcaaagttcattgcgaggggtttc

SEQ ID NO: 104245 - DNA, 25 bp, Homo sapien
gagcgctgcttctttattgtcttaa

SEQ ID NO: 104246 - DNA, 25 bp, Homo sapien
atttttgtctcttgcgcgcctcagg

SEQ ID NO: 104247 - DNA, 25 bp, Homo sapien
ggtcagaaagatccgtcctccgcga

SEQ ID NO: 104248 - DNA, 25 bp, Homo sapien
gggtcggagtcgctctaaagtcatt

SEQ ID NO: 104249 - DNA, 25 bp, Homo sapien
gtccttctagaagctttccttcctc

SEQ ID NO: 104250 - DNA, 25 bp, Homo sapien
aggaatcgcctggtgcctcacattc

SEQ ID NO: 104251 - DNA, 25 bp, Homo sapien
tcaggctagtgaattggaccgctcc

SEQ ID NO: 104252 - DNA, 25 bp, Homo sapien
ggctgccttgtttgggcatgctcca

SEQ ID NO: 104253 - DNA, 25 bp, Homo sapien
aggacacggtgccttccatgactgc

SEQ ID NO: 104254 - DNA, 25 bp, Homo sapien
ccatgactgcctcgtttaatttttc

SEQ ID NO: 104255 - DNA, 25 bp, Homo sapien
cttaacaggaatatacagtggcggc

SEQ ID NO: 104256 - DNA, 25 bp, Homo sapien
cggacccagcgtaaaggagccgcag

SEQ ID NO: 104257 - DNA, 25 bp, Homo sapien
gctgcgctggggaaagtttgtccca

SEQ ID NO: 104258 - DNA, 25 bp, Homo sapien
acccgcgtttcgcagctggttgcaa

SEQ ID NO: 104259 - DNA, 25 bp, Homo sapien
agcctgtgaccgcacggatgatcga

SEQ ID NO: 104260 - DNA, 25 bp, Homo sapien
cgcagtcctcgtacttgatattatc

SEQ ID NO: 104261 - DNA, 25 bp, Homo sapien
tactctctgggtgagcgcaaagtgc

SEQ ID NO: 104262 - DNA, 25 bp, Homo sapien
cgcacccaagtggagctactctctg

SEQ ID NO: 104263 - DNA, 25 bp, Homo sapien
tggatcggcgtgaacggatatgccc

SEQ ID NO: 104264 - DNA, 25 bp, Homo sapien
ccaaagcattttcatggatcggcgt

SEQ ID NO: 104265 - DNA, 25 bp, Homo sapien
tcctgggacgcggaacccaagcagg

SEQ ID NO: 104266 - DNA, 25 bp, Homo sapien
tccgcgtccattctggcttctgcgg

SEQ ID NO: 104267 - DNA, 25 bp, Homo sapien
ccttggttcccgtgtcagaaggatc

SEQ ID NO: 104268 - DNA, 25 bp, Homo sapien
tcaccgtcccactcgaatctgtggg

SEQ ID NO: 104269 - DNA, 25 bp, Homo sapien
cactcgaatctgtggggctccgaca

SEQ ID NO: 104270 - DNA, 25 bp, Homo sapien
tgttataggcgattgctgatttcaa

SEQ ID NO: 104271 - DNA, 25 bp, Homo sapien
cggtgttgacacaccggggatgtta

SEQ ID NO: 104272 - DNA, 25 bp, Homo sapien
caccggggatgttataggcgattgc

SEQ ID NO: 104273 - DNA, 25 bp, Homo sapien
agacctcaccgtcccgcttggatcc

SEQ ID NO: 104274 - DNA, 25 bp, Homo sapien
tggtgccccgcttgcggccgatgct

SEQ ID NO: 104275 - DNA, 25 bp, Homo sapien
tggggctccggcagtgtggcctccg

SEQ ID NO: 104276 - DNA, 25 bp, Homo sapien
ggagacctcaccgtcccgcttggat

SEQ ID NO: 104277 - DNA, 25 bp, Homo sapien
tgtggagacctcaccgtcccgcttg

SEQ ID NO: 104278 - DNA, 25 bp, Homo sapien
ctacttcatcctcgcggaaactttg

SEQ ID NO: 104279 - DNA, 25 bp, Homo sapien
cctacttcatcctcgcggaaacttt

SEQ ID NO: 104280 - DNA, 25 bp, Homo sapien
gactcgccggtagcggcaagggaag

SEQ ID NO: 104281 - DNA, 25 bp, Homo sapien
ggctgggacgactttacacctggct

SEQ ID NO: 104282 - DNA, 25 bp, Homo sapien
tgggacgactttacacctggctcct

SEQ ID NO: 104283 - DNA, 25 bp, Homo sapien
acacctggctcctgcggagacgtca

SEQ ID NO: 104284 - DNA, 25 bp, Homo sapien
ggagacgtcaccttccagctggggt

SEQ ID NO: 104285 - DNA, 25 bp, Homo sapien
gggctccaacagagcggctcccacg

SEQ ID NO: 104286 - DNA, 25 bp, Homo sapien
gcgcccgtgatccacttggtcctta

SEQ ID NO: 104287 - DNA, 25 bp, Homo sapien
cgtgatccacttggtccttagggtc

SEQ ID NO: 104288 - DNA, 25 bp, Homo sapien
atccacttggtccttagggtccacg

SEQ ID NO: 104289 - DNA, 25 bp, Homo sapien
ctgcccacgtttggagggatgctcc

SEQ ID NO: 104290 - DNA, 25 bp, Homo sapien
cctggcgaaaaagagcagcgaatcg

SEQ ID NO: 104291 - DNA, 25 bp, Homo sapien
tcccggaccagtcgaatagcaggta

SEQ ID NO: 104292 - DNA, 25 bp, Homo sapien
ctgccattgtagaccaggagcgccc

SEQ ID NO: 104293 - DNA, 25 bp, Homo sapien
tggagaccagcgtatgaatcacttc

SEQ ID NO: 104294 - DNA, 25 bp, Homo sapien
tatgaatcacttcggccctcgcatg

SEQ ID NO: 104295 - DNA, 25 bp, Homo sapien
gccctcgcatgccagctagtgattg

SEQ ID NO: 104296 - DNA, 25 bp, Homo sapien
gctagtgattgagtgtgctcggccc

SEQ ID NO: 104297 - DNA, 25 bp, Homo sapien
cgcgcagtaattttcccgggctcca

SEQ ID NO: 104298 - DNA, 25 bp, Homo sapien
cctgtctccgagactagaggccacg

SEQ ID NO: 104299 - DNA, 25 bp, Homo sapien
ccttccggagtctacacatcggcga

SEQ ID NO: 104300 - DNA, 25 bp, Homo sapien
acatcggcgacctcccgtgtctagg

SEQ ID NO: 104301 - DNA, 25 bp, Homo sapien
cgtgtctaggcgcacacatttcccg

SEQ ID NO: 104302 - DNA, 25 bp, Homo sapien
gcggcttctttaaggctgcggtccc

SEQ ID NO: 104303 - DNA, 25 bp, Homo sapien
tcagctctacggctgcgaggtacct

SEQ ID NO: 104304 - DNA, 25 bp, Homo sapien
tacgatcgtaaggagcttcggaagc

SEQ ID NO: 104305 - DNA, 25 bp, Homo sapien
gaaccgcagtgatgcccgagctcgc

SEQ ID NO: 104306 - DNA, 25 bp, Homo sapien
ctcggaaacaatgagctggatcctt

SEQ ID NO: 104307 - DNA, 25 bp, Homo sapien
cttgggaacgctctaactgggagaa

SEQ ID NO: 104308 - DNA, 25 bp, Homo sapien
tgtggctcttccgtcacggggtaaa

SEQ ID NO: 104309 - DNA, 25 bp, Homo sapien
cacccgggagttgtagccaccgctt

SEQ ID NO: 104310 - DNA, 25 bp, Homo sapien
acatcagcgcgcagaggagtttctg

SEQ ID NO: 104311 - DNA, 25 bp, Homo sapien
cttgacttgaatgtgctggcggagc

SEQ ID NO: 104312 - DNA, 25 bp, Homo sapien
gcgctcggctggtcaattcattccg

SEQ ID NO: 104313 - DNA, 25 bp, Homo sapien
tgggcatctccaatgggcgcctagc

SEQ ID NO: 104314 - DNA, 25 bp, Homo sapien
cgcgggactccatcgtcaggtgagt

SEQ ID NO: 104315 - DNA, 25 bp, Homo sapien
gcgagtgtttggtgccaactcatta

SEQ ID NO: 104316 - DNA, 25 bp, Homo sapien
aagctccctggtgttgtgcgccctt

SEQ ID NO: 104317 - DNA, 25 bp, Homo sapien
gtctgtggctgacgtccgcttttcc

SEQ ID NO: 104318 - DNA, 25 bp, Homo sapien
atccgagaggtctcagcgctggttt

SEQ ID NO: 104319 - DNA, 25 bp, Homo sapien
gtttgcagggttttctgcgggccca

SEQ ID NO: 104320 - DNA, 25 bp, Homo sapien
tccgtgtgccctgtcgcgctagcag

SEQ ID NO: 104321 - DNA, 25 bp, Homo sapien
ctccaaggagctggcccaagcgcga

SEQ ID NO: 104322 - DNA, 25 bp, Homo sapien
tggaggcccaaaacacggaggctgc

SEQ ID NO: 104323 - DNA, 25 bp, Homo sapien
cagagttccaggctgttgggagtta

SEQ ID NO: 104324 - DNA, 25 bp, Homo sapien
ccaggctgttgggagttactgattc

SEQ ID NO: 104325 - DNA, 25 bp, Homo sapien
gggagttactgattccatcagcagc

SEQ ID NO: 104326 - DNA, 25 bp, Homo sapien
tgattccatcagcagctgttcagtg

SEQ ID NO: 104327 - DNA, 25 bp, Homo sapien
agcagctgttcagtgggtgcccagc

SEQ ID NO: 104328 - DNA, 25 bp, Homo sapien
acagttgaggagaaaggctgaggcc

SEQ ID NO: 104329 - DNA, 25 bp, Homo sapien
ctgggtgcagcatcgttccatgcga

SEQ ID NO: 104330 - DNA, 25 bp, Homo sapien
ccatgtgactgggtgcagcatcgtt

SEQ ID NO: 104331 - DNA, 25 bp, Homo sapien
ttccatgcgactgggtgcagcatcg

SEQ ID NO: 104332 - DNA, 25 bp, Homo sapien
tgcagcatcgttccatgcgactggg

SEQ ID NO: 104333 - DNA, 25 bp, Homo sapien
gcagcatcgttccatgcgactgggt

SEQ ID NO: 104334 - DNA, 25 bp, Homo sapien
atcgttccatgcgactgggtgcagc

SEQ ID NO: 104335 - DNA, 25 bp, Homo sapien
ccatgcgactgggtgcagcattgcc

SEQ ID NO: 104336 - DNA, 25 bp, Homo sapien
gcgactgggtgcagcatcgttccat

SEQ ID NO: 104337 - DNA, 25 bp, Homo sapien
cacttgttccggaggataggagagc

SEQ ID NO: 104338 - DNA, 25 bp, Homo sapien
tggcctggatgggtaacttccagca

SEQ ID NO: 104339 - DNA, 25 bp, Homo sapien
ggtaacttccagcacaggccctcaa

SEQ ID NO: 104340 - DNA, 25 bp, Homo sapien
acaggccctcaaagaaggacgggca

SEQ ID NO: 104341 - DNA, 25 bp, Homo sapien
gacgggcacatttccggtaacagcc

SEQ ID NO: 104342 - DNA, 25 bp, Homo sapien
tggcatcgcctgacatcacttgttc

SEQ ID NO: 104343 - DNA, 25 bp, Homo sapien
tcatccgtggcctgactgcgttaac

SEQ ID NO: 104344 - DNA, 25 bp, Homo sapien
ggcggctagcactgctgatggcatc

SEQ ID NO: 104345 - DNA, 25 bp, Homo sapien
ggtccctccgatttccgccgagaga

SEQ ID NO: 104346 - DNA, 25 bp, Homo sapien
cgagcgcgtctccttcattcgcagg

SEQ ID NO: 104347 - DNA, 25 bp, Homo sapien
ttggaggcttttcagggtctttcgc

SEQ ID NO: 104348 - DNA, 25 bp, Homo sapien
ggcgactgcgccatgcgcaataata

SEQ ID NO: 104349 - DNA, 25 bp, Homo sapien
ctttctgcgcactcttccggtggga

SEQ ID NO: 104350 - DNA, 25 bp, Homo sapien
tttggtacccagtcctcctgcggca

SEQ ID NO: 104351 - DNA, 25 bp, Homo sapien
cttttaaggagtttgccgcgagcgc

SEQ ID NO: 104352 - DNA, 25 bp, Homo sapien
cttgcatctttgtcgcgggtctcca

SEQ ID NO: 104353 - DNA, 25 bp, Homo sapien
cgctaagtcgcttcattgcatgtca

SEQ ID NO: 104354 - DNA, 25 bp, Homo sapien
agtttcgctttcttgccctctgcgg

SEQ ID NO: 104355 - DNA, 25 bp, Homo sapien
tgtgcttaagggaactccaagtttc

SEQ ID NO: 104356 - DNA, 25 bp, Homo sapien
actgttgttgtattcccgccgaggg

SEQ ID NO: 104357 - DNA, 25 bp, Homo sapien
tgccagcgtcattaccacgctaagt

SEQ ID NO: 104358 - DNA, 25 bp, Homo sapien
cgctggggctgctaaactgttgttg

SEQ ID NO: 104359 - DNA, 25 bp, Homo sapien
ttgcatgtcaatgctccggcggggc

SEQ ID NO: 104360 - DNA, 25 bp, Homo sapien
gccagccgagctgcatttatgccag

SEQ ID NO: 104361 - DNA, 25 bp, Homo sapien
ccgcctataattatctggggaaatg

SEQ ID NO: 104362 - DNA, 25 bp, Homo sapien
cccatcctccgggagtgtctgggcg

SEQ ID NO: 104363 - DNA, 25 bp, Homo sapien
tctgggcgctcagtccgctctgatc

SEQ ID NO: 104364 - DNA, 25 bp, Homo sapien
gcgctctgcttttcgctgcggcagc

SEQ ID NO: 104365 - DNA, 25 bp, Homo sapien
ggggaaatgcatccgcgctctgctt

SEQ ID NO: 104366 - DNA, 25 bp, Homo sapien
ggaagtttgcgctcccgaagtcctg

SEQ ID NO: 104367 - DNA, 25 bp, Homo sapien
aaccacctgcggttggcaggcagga

SEQ ID NO: 104368 - DNA, 25 bp, Homo sapien
cgaagtcctggagctcagcaaggga

SEQ ID NO: 104369 - DNA, 25 bp, Homo sapien
ctgcgtcttttgtgatgttcgcggc

SEQ ID NO: 104370 - DNA, 25 bp, Homo sapien
gggaaagcctctctactggccaagg

SEQ ID NO: 104371 - DNA, 25 bp, Homo sapien
ctgtcccttaggaccggcccgagat

SEQ ID NO: 104372 - DNA, 25 bp, Homo sapien
gagggccaccaactgtcccttagga

SEQ ID NO: 104373 - DNA, 25 bp, Homo sapien
gtagcacgtgcacccaagcggcagt

SEQ ID NO: 104374 - DNA, 25 bp, Homo sapien
agcgatggcggacacggaatcccga

SEQ ID NO: 104375 - DNA, 25 bp, Homo sapien
ccaggctttcgcgagctatggcagc

SEQ ID NO: 104376 - DNA, 25 bp, Homo sapien
taaactctgcagtgagtagcacgtg

SEQ ID NO: 104377 - DNA, 25 bp, Homo sapien
ggaaggattacgcacctgacgggcc

SEQ ID NO: 104378 - DNA, 25 bp, Homo sapien
attcgtcgtctttgttgccaccgcc

SEQ ID NO: 104379 - DNA, 25 bp, Homo sapien
cctggtacgagggtcattcgtcgtc

SEQ ID NO: 104380 - DNA, 25 bp, Homo sapien
ccgtagccctggtacgagggtcatt

SEQ ID NO: 104381 - DNA, 25 bp, Homo sapien
cgcctctgccggaaccgtttgcgag

SEQ ID NO: 104382 - DNA, 25 bp, Homo sapien
gtttaacacaatgccgacgcctacg

SEQ ID NO: 104383 - DNA, 25 bp, Homo sapien
agtcccgcggagtttaacacaatgc

SEQ ID NO: 104384 - DNA, 25 bp, Homo sapien
tggttttgtcaagcggccagagccc

SEQ ID NO: 104385 - DNA, 25 bp, Homo sapien
tggtcccacttagcgggagaaactc

SEQ ID NO: 104386 - DNA, 25 bp, Homo sapien
tgcagccaacccatctcctggaagg

SEQ ID NO: 104387 - DNA, 25 bp, Homo sapien
gccggaccactcgagctgctaaaga

SEQ ID NO: 104388 - DNA, 25 bp, Homo sapien
gcctctgtttctgcggcgattgaac

SEQ ID NO: 104389 - DNA, 25 bp, Homo sapien
ttgatcgggcaccaaataaagtttc

SEQ ID NO: 104390 - DNA, 25 bp, Homo sapien
gcgagccactgtttgccgtttgatc

SEQ ID NO: 104391 - DNA, 25 bp, Homo sapien
ttctgcgtaagagttggggatctca

SEQ ID NO: 104392 - DNA, 25 bp, Homo sapien
ctgcgcagccgcactgaactctggt

SEQ ID NO: 104393 - DNA, 25 bp, Homo sapien
agtttcggccgctcagttgcaggcc

SEQ ID NO: 104394 - DNA, 25 bp, Homo sapien
gtcgtcatgagcctggactgcacca

SEQ ID NO: 104395 - DNA, 25 bp, Homo sapien
tggactgcaccagccatatcgcgct

SEQ ID NO: 104396 - DNA, 25 bp, Homo sapien
tgcaccagccatatcgcgctgggtg

SEQ ID NO: 104397 - DNA, 25 bp, Homo sapien
tgatttgcacccttttcctcccgga

SEQ ID NO: 104398 - DNA, 25 bp, Homo sapien
actgccagggcgctgatttcaggag

SEQ ID NO: 104399 - DNA, 25 bp, Homo sapien
cccgggctcgggtcgtcatgagcct

SEQ ID NO: 104400 - DNA, 25 bp, Homo sapien
tgtttacccgttgcccgaggagaca

SEQ ID NO: 104401 - DNA, 25 bp, Homo sapien
gagtcaagttctctcgccgggcagc

SEQ ID NO: 104402 - DNA, 25 bp, Homo sapien
acccacttaccgtccgtgcgagagg

SEQ ID NO: 104403 - DNA, 25 bp, Homo sapien
caccaaagcatctgggatggcccta

SEQ ID NO: 104404 - DNA, 25 bp, Homo sapien
cccgcgctgcgttcagagtcaagtt

SEQ ID NO: 104405 - DNA, 25 bp, Homo sapien
tgtgctctttttccaggtggcccgc

SEQ ID NO: 104406 - DNA, 25 bp, Homo sapien
gttcgtcctgggactgcacttgctc

SEQ ID NO: 104407 - DNA, 25 bp, Homo sapien
gtgccctactacctggagaacgagc

SEQ ID NO: 104408 - DNA, 25 bp, Homo sapien
tggccctactgcatcagatccaagg

SEQ ID NO: 104409 - DNA, 25 bp, Homo sapien
cagcgccaaggacatcaagaagatc

SEQ ID NO: 104410 - DNA, 25 bp, Homo sapien
ccagagccttctgggtagcggttta

SEQ ID NO: 104411 - DNA, 25 bp, Homo sapien
cctttgccgcgaaaagtgcctgacg

SEQ ID NO: 104412 - DNA, 25 bp, Homo sapien
cgctataagagcagtcacttccgga

SEQ ID NO: 104413 - DNA, 25 bp, Homo sapien
ctaggtaccgaaggcagatgccgtc

SEQ ID NO: 104414 - DNA, 25 bp, Homo sapien
cagttcgctggcaaaggttgagtcc

SEQ ID NO: 104415 - DNA, 25 bp, Homo sapien
gcaccatgggacttgcagttcgctg

SEQ ID NO: 104416 - DNA, 25 bp, Homo sapien
ccaccaaggagtcaaggcgagccta

SEQ ID NO: 104417 - DNA, 25 bp, Homo sapien
gccgaatgagtggtttctaatcgcg

SEQ ID NO: 104418 - DNA, 25 bp, Homo sapien
gagtcctcctgcatctcgctaccga

SEQ ID NO: 104419 - DNA, 25 bp, Homo sapien
tcgctaccgagccagaccgcaggct

SEQ ID NO: 104420 - DNA, 25 bp, Homo sapien
gcggcgcaggcacagccaaagtgcc

SEQ ID NO: 104421 - DNA, 25 bp, Homo sapien
ccgcgtcggtacaaaaggagaaatg

SEQ ID NO: 104422 - DNA, 25 bp, Homo sapien
gatgaggccgaatgagtggtttcta

SEQ ID NO: 104423 - DNA, 25 bp, Homo sapien
tacaaaaggagaaatgaggggatga

SEQ ID NO: 104424 - DNA, 25 bp, Homo sapien
gcaggcacagccaaagtgcccgagc

SEQ ID NO: 104425 - DNA, 25 bp, Homo sapien
acgcatctactgctcctgtcgggaa

SEQ ID NO: 104426 - DNA, 25 bp, Homo sapien
gaaggtcgcccaggccggttcagcc

SEQ ID NO: 104427 - DNA, 25 bp, Homo sapien
cttgggcgtttctccgcagctgcaa

SEQ ID NO: 104428 - DNA, 25 bp, Homo sapien
tgcaaagctgtgctgtgacccaccc

SEQ ID NO: 104429 - DNA, 25 bp, Homo sapien
tcagcgagcctttataccgggacca

SEQ ID NO: 104430 - DNA, 25 bp, Homo sapien
gccctggtgacagaggacaacaatc

SEQ ID NO: 104431 - DNA, 25 bp, Homo sapien
gaagcgagcgaacgcttcctcccgg

SEQ ID NO: 104432 - DNA, 25 bp, Homo sapien
aggacaacaatctcagcccgctgcg

SEQ ID NO: 104433 - DNA, 25 bp, Homo sapien
cttgcatgcgcgcaccaataggagg

SEQ ID NO: 104434 - DNA, 25 bp, Homo sapien
ggtccaatgagacgcgtcgcttgca

SEQ ID NO: 104435 - DNA, 25 bp, Homo sapien
tggtagccgactttcttcgatcatc

SEQ ID NO: 104436 - DNA, 25 bp, Homo sapien
gccacacgtgtggagggtctatcac

SEQ ID NO: 104437 - DNA, 25 bp, Homo sapien
cagcgctggcttccatctggagatc

SEQ ID NO: 104438 - DNA, 25 bp, Homo sapien
atttggtgcctaaatccgcgcggtc

SEQ ID NO: 104439 - DNA, 25 bp, Homo sapien
tgtatctcttaaaaggcgccagctg

SEQ ID NO: 104440 - DNA, 25 bp, Homo sapien
ggctcgtccgggaatccagactttc

SEQ ID NO: 104441 - DNA, 25 bp, Homo sapien
tcacagccgcgcaagtcgtcagtct

SEQ ID NO: 104442 - DNA, 25 bp, Homo sapien
ggatttctttcccatgcactgagtc

SEQ ID NO: 104443 - DNA, 25 bp, Homo sapien
ttcagcagtttgatcaccgccagca

SEQ ID NO: 104444 - DNA, 25 bp, Homo sapien
ccgggaccgcatccttagtccgaga

SEQ ID NO: 104445 - DNA, 25 bp, Homo sapien
cgggaacttcctgccaagcgtgaga

SEQ ID NO: 104446 - DNA, 25 bp, Homo sapien
ctctgaaagcctcttggtaggtatc

SEQ ID NO: 104447 - DNA, 25 bp, Homo sapien
cgcccagcgcaagcgttgcttttta

SEQ ID NO: 104448 - DNA, 25 bp, Homo sapien
cgggcctcctgaccttcaaatgggc

SEQ ID NO: 104449 - DNA, 25 bp, Homo sapien
agctccctggaatcgcttaggcaaa

SEQ ID NO: 104450 - DNA, 25 bp, Homo sapien
ttggcaagtatggacatcgcggctc

SEQ ID NO: 104451 - DNA, 25 bp, Homo sapien
tcgacaagctcgacccatggctagc

SEQ ID NO: 104452 - DNA, 25 bp, Homo sapien
cctggtcataaagagctgggttgct

SEQ ID NO: 104453 - DNA, 25 bp, Homo sapien
tgatggatttatagccgcggcaatc

SEQ ID NO: 104454 - DNA, 25 bp, Homo sapien
cgggaaccgaagctgactgactgct

SEQ ID NO: 104455 - DNA, 25 bp, Homo sapien
ttcctgtcttcgctgtctcctggga

SEQ ID NO: 104456 - DNA, 25 bp, Homo sapien
cttagcggatctgactctgccaacc

SEQ ID NO: 104457 - DNA, 25 bp, Homo sapien
tggacactgttgatggcacattctc

SEQ ID NO: 104458 - DNA, 25 bp, Homo sapien
ttgttttggaggcagcgtcttaccc

SEQ ID NO: 104459 - DNA, 25 bp, Homo sapien
gatgtcatttacttagcaccgcttg

SEQ ID NO: 104460 - DNA, 25 bp, Homo sapien
gcagcgacgcgggattcaacttccc

SEQ ID NO: 104461 - DNA, 25 bp, Homo sapien
agcacccaaggtgatcagtcgattg

SEQ ID NO: 104462 - DNA, 25 bp, Homo sapien
tgagcagtgcattttcccaaaggta

SEQ ID NO: 104463 - DNA, 25 bp, Homo sapien
tttactgctggtcaaaggattcatt

SEQ ID NO: 104464 - DNA, 25 bp, Homo sapien
tccatccattggtgcaaagcagaca

SEQ ID NO: 104465 - DNA, 25 bp, Homo sapien
tagatggcaacctgtccgacccatg

SEQ ID NO: 104466 - DNA, 25 bp, Homo sapien
aaaagtctcggtgctcctggctacc

SEQ ID NO: 104467 - DNA, 25 bp, Homo sapien
gggctcttcggaaacttcctggtca

SEQ ID NO: 104468 - DNA, 25 bp, Homo sapien
ggccctctactccatcgtgtgcgtg

SEQ ID NO: 104469 - DNA, 25 bp, Homo sapien
gggtcaacttgtcccacttagatgg

SEQ ID NO: 104470 - DNA, 25 bp, Homo sapien
cgccagcaattgcactgatgccttg

SEQ ID NO: 104471 - DNA, 25 bp, Homo sapien
ccggccgtcagtaccatggacagca

SEQ ID NO: 104472 - DNA, 25 bp, Homo sapien
ctgaggcgcttggaacccgaaaagt

SEQ ID NO: 104473 - DNA, 25 bp, Homo sapien
caccacttgtttggggctccacttg

SEQ ID NO: 104474 - DNA, 25 bp, Homo sapien
gctccacttggtcacgggttccatg

SEQ ID NO: 104475 - DNA, 25 bp, Homo sapien
gttccatggtaaaccgcttcgcctc

SEQ ID NO: 104476 - DNA, 25 bp, Homo sapien
cgcacaggccactcggcagaagttt

SEQ ID NO: 104477 - DNA, 25 bp, Homo sapien
caggtacgagagataggagcgcaca

SEQ ID NO: 104478 - DNA, 25 bp, Homo sapien
tgccacaatccgcaccctggaaagg

SEQ ID NO: 104479 - DNA, 25 bp, Homo sapien
aagtttgcattgtcaccgggctgtg

SEQ ID NO: 104480 - DNA, 25 bp, Homo sapien
tctagtccagtccaccacttgtttg

SEQ ID NO: 104481 - DNA, 25 bp, Homo sapien
ccttcaatagcgaggttggtatggc

SEQ ID NO: 104482 - DNA, 25 bp, Homo sapien
ggaggccgtgaagaccttcaatagc

SEQ ID NO: 104483 - DNA, 25 bp, Homo sapien
tccgcagcgacaacatggaggccgt

SEQ ID NO: 104484 - DNA, 25 bp, Homo sapien
agcgcctctgttccctagaacggcg

SEQ ID NO: 104485 - DNA, 25 bp, Homo sapien
cagcgcgctcgatggtttccgcgcg

SEQ ID NO: 104486 - DNA, 25 bp, Homo sapien
cgccatattggatgccgcagccgct

SEQ ID NO: 104487 - DNA, 25 bp, Homo sapien
ggcccgactcgagtccgccatattg

SEQ ID NO: 104488 - DNA, 25 bp, Homo sapien
caatagcgaggttggtatggcagcc

SEQ ID NO: 104489 - DNA, 25 bp, Homo sapien
ttgtgttgttccaaagaaagcgcga

SEQ ID NO: 104490 - DNA, 25 bp, Homo sapien
ttctcgcccaaagccgagccgtggg

SEQ ID NO: 104491 - DNA, 25 bp, Homo sapien
ggcctcctgataccgaggttctcgc

SEQ ID NO: 104492 - DNA, 25 bp, Homo sapien
ctttccagaaggctctgaaactagg

SEQ ID NO: 104493 - DNA, 25 bp, Homo sapien
ctggggcagcggtaaccgtaactgt

SEQ ID NO: 104494 - DNA, 25 bp, Homo sapien
gcgcgtgctcgatgtttcttgaatt

SEQ ID NO: 104495 - DNA, 25 bp, Homo sapien
cctcagttttgcgtgcctttcctcg

SEQ ID NO: 104496 - DNA, 25 bp, Homo sapien
acagcgcgcgtccaagtggagaaca

SEQ ID NO: 104497 - DNA, 25 bp, Homo sapien
gctgtcacgttccagccgcctgact

SEQ ID NO: 104498 - DNA, 25 bp, Homo sapien
gagaacttcgagctgctcaaggtgc

SEQ ID NO: 104499 - DNA, 25 bp, Homo sapien
agcgtggagaacttcgagctgctca

SEQ ID NO: 104500 - DNA, 25 bp, Homo sapien
cagccaacctgaccgggcacgagga

SEQ ID NO: 104501 - DNA, 25 bp, Homo sapien
gccgccatgtaaccggcgccgcccg

SEQ ID NO: 104502 - DNA, 25 bp, Homo sapien
taaggtcccggagcgcacggccctg

SEQ ID NO: 104503 - DNA, 25 bp, Homo sapien
agtcgagtaaggtcccggagcgcac

SEQ ID NO: 104504 - DNA, 25 bp, Homo sapien
gctgcggatcacagaaggtgggtgt

SEQ ID NO: 104505 - DNA, 25 bp, Homo sapien
cgtgttcttgaccatctcagccgtg

SEQ ID NO: 104506 - DNA, 25 bp, Homo sapien
tgttcttgaccatctcagccgccca

SEQ ID NO: 104507 - DNA, 25 bp, Homo sapien
gccgtgttcttgaccatctcagccg

SEQ ID NO: 104508 - DNA, 25 bp, Homo sapien
cgcccacccgtgttcttgaccatct

SEQ ID NO: 104509 - DNA, 25 bp, Homo sapien
agccgcccacccgtgttcttgacca

SEQ ID NO: 104510 - DNA, 25 bp, Homo sapien
gttcttgaccatctcagccgtgttc

SEQ ID NO: 104511 - DNA, 25 bp, Homo sapien
cagccgtgttcttgaccatctcagc

SEQ ID NO: 104512 - DNA, 25 bp, Homo sapien
ttgaccatctcagccgtgttcttga

SEQ ID NO: 104513 - DNA, 25 bp, Homo sapien
aacgcacttcacgtgtctcctgggc

SEQ ID NO: 104514 - DNA, 25 bp, Homo sapien
tgggaccggagttctgatacaaaga

SEQ ID NO: 104515 - DNA, 25 bp, Homo sapien
atccggggagcactgctaagccatc

SEQ ID NO: 104516 - DNA, 25 bp, Homo sapien
cgctgcttgcagtcttaacaactta

SEQ ID NO: 104517 - DNA, 25 bp, Homo sapien
ctgagttttccggaggcagccatga

SEQ ID NO: 104518 - DNA, 25 bp, Homo sapien
cgatgaccgcggacaggaaattccc

SEQ ID NO: 104519 - DNA, 25 bp, Homo sapien
aaattcccggcgtgctgagagcgca

SEQ ID NO: 104520 - DNA, 25 bp, Homo sapien
cgaacgcggagttttgtgagcaatc

SEQ ID NO: 104521 - DNA, 25 bp, Homo sapien
acacagcccagctggtagcgaggcc

SEQ ID NO: 104522 - DNA, 25 bp, Homo sapien
ttcgctgttttctcggcgcaccacg

SEQ ID NO: 104523 - DNA, 25 bp, Homo sapien
cggcgcctgcagttagtaggcaatc

SEQ ID NO: 104524 - DNA, 25 bp, Homo sapien
ccgagctgcagcgagttaagctgca

SEQ ID NO: 104525 - DNA, 25 bp, Homo sapien
tgtaacggcctcaggtgtgagctgc

SEQ ID NO: 104526 - DNA, 25 bp, Homo sapien
cacctttaaaagaacgcgtccagag

SEQ ID NO: 104527 - DNA, 25 bp, Homo sapien
gaatcagggccctccgtcggagctc

SEQ ID NO: 104528 - DNA, 25 bp, Homo sapien
tggcccagttttcgctgttttctcg

SEQ ID NO: 104529 - DNA, 25 bp, Homo sapien
tcacctggcccagcctaaggaactg

SEQ ID NO: 104530 - DNA, 25 bp, Homo sapien
actgcagcctcgcagatccacggga

SEQ ID NO: 104531 - DNA, 25 bp, Homo sapien
gatgaccacagtgacgctcgcggga

SEQ ID NO: 104532 - DNA, 25 bp, Homo sapien
ttagcgcaacgcctgcagctgactc

SEQ ID NO: 104533 - DNA, 25 bp, Homo sapien
agctgactcgtgttttgcattagga

SEQ ID NO: 104534 - DNA, 25 bp, Homo sapien
ccagagagcaaggtccaggcacagg

SEQ ID NO: 104535 - DNA, 25 bp, Homo sapien
tcactgcctaacgacggatcacctg

SEQ ID NO: 104536 - DNA, 25 bp, Homo sapien
gcattaggaagcgtttcactgccta

SEQ ID NO: 104537 - DNA, 25 bp, Homo sapien
ttgtgtggcacgatctttactgggg

SEQ ID NO: 104538 - DNA, 25 bp, Homo sapien
acaagacttttagcggctccggaga

SEQ ID NO: 104539 - DNA, 25 bp, Homo sapien
cggagacgcgccctgaaaatggccc

SEQ ID NO: 104540 - DNA, 25 bp, Homo sapien
gaaaatggcccgctcgggctctgcg

SEQ ID NO: 104541 - DNA, 25 bp, Homo sapien
cgaggcttatttgtgtggcacgatc

SEQ ID NO: 104542 - DNA, 25 bp, Homo sapien
cggggagagccaggaatgttcctcc

SEQ ID NO: 104543 - DNA, 25 bp, Homo sapien
gagagccaggaatgttcctcccggc

SEQ ID NO: 104544 - DNA, 25 bp, Homo sapien
cggcaaagggcattcgaggcttatt

SEQ ID NO: 104545 - DNA, 25 bp, Homo sapien
tcgccagctcggaggaaactctggc

SEQ ID NO: 104546 - DNA, 25 bp, Homo sapien
gcacgaagggcgcacctgcagctct

SEQ ID NO: 104547 - DNA, 25 bp, Homo sapien
aaactctggctggaggcgacctcgg

SEQ ID NO: 104548 - DNA, 25 bp, Homo sapien
gagcggcggtttcagcctgccaccg

SEQ ID NO: 104549 - DNA, 25 bp, Homo sapien
tctcttaaaagtgagcggcggtttc

SEQ ID NO: 104550 - DNA, 25 bp, Homo sapien
ctgtgctctcttaaaagtgagcggc

SEQ ID NO: 104551 - DNA, 25 bp, Homo sapien
aagggcgcacctgcagctctccggg

SEQ ID NO: 104552 - DNA, 25 bp, Homo sapien
cgtctccaccctcagtacttttggg

SEQ ID NO: 104553 - DNA, 25 bp, Homo sapien
aagcctctgcgtccacacagggatc

SEQ ID NO: 104554 - DNA, 25 bp, Homo sapien
tctggaactcacaggctccctcgga

SEQ ID NO: 104555 - DNA, 25 bp, Homo sapien
agccttcaaagacgcgacctgattg

SEQ ID NO: 104556 - DNA, 25 bp, Homo sapien
tttgtttacacaccacacgccctgg

SEQ ID NO: 104557 - DNA, 25 bp, Homo sapien
tgggaaagccacacaccagtgccgg

SEQ ID NO: 104558 - DNA, 25 bp, Homo sapien
aactggtgcatgtgtcagccgccca

SEQ ID NO: 104559 - DNA, 25 bp, Homo sapien
gttccagacgcttcctctgcgcaga

SEQ ID NO: 104560 - DNA, 25 bp, Homo sapien
gtgtgcgcccagcaaaaagcctctg

SEQ ID NO: 104561 - DNA, 25 bp, Homo sapien
cctccgaagggagaaccagtgattc

SEQ ID NO: 104562 - DNA, 25 bp, Homo sapien
gctgacacagcttcgcgtacacatg

SEQ ID NO: 104563 - DNA, 25 bp, Homo sapien
ggccgctcgcacagcgtgttttcta

SEQ ID NO: 104564 - DNA, 25 bp, Homo sapien
agccacattcctttccgggcaagcg

SEQ ID NO: 104565 - DNA, 25 bp, Homo sapien
tgactgaacaggctcggactcctcc

SEQ ID NO: 104566 - DNA, 25 bp, Homo sapien
tcggctgcgcttttactcttggtca

SEQ ID NO: 104567 - DNA, 25 bp, Homo sapien
gccgcgcacagatgagcctttgtgg

SEQ ID NO: 104568 - DNA, 25 bp, Homo sapien
cggaaacttttagcgcttgccctga

SEQ ID NO: 104569 - DNA, 25 bp, Homo sapien
cccaacgtggtgaatctgcacgagg

SEQ ID NO: 104570 - DNA, 25 bp, Homo sapien
tgcacgaggtgcatcacgaccaggt

SEQ ID NO: 104571 - DNA, 25 bp, Homo sapien
aggtcctaagcctctccgacatggg

SEQ ID NO: 104572 - DNA, 25 bp, Homo sapien
agcgcggcgaccgtaactccttctg

SEQ ID NO: 104573 - DNA, 25 bp, Homo sapien
agttcgcagtcaagatcctcagtcg

SEQ ID NO: 104574 - DNA, 25 bp, Homo sapien
gcccttcttccagcagtacgagctg

SEQ ID NO: 104575 - DNA, 25 bp, Homo sapien
cagcgtgagctcagcaaggtcctaa

SEQ ID NO: 104576 - DNA, 25 bp, Homo sapien
tcacgaccaggtgatggcttccggc

SEQ ID NO: 104577 - DNA, 25 bp, Homo sapien
tccatgcccaacctcgccgaggcca

SEQ ID NO: 104578 - DNA, 25 bp, Homo sapien
accagttcctgacgcccgatgaggc

SEQ ID NO: 104579 - DNA, 25 bp, Homo sapien
tgcgccagcctcacactgggcccgc

SEQ ID NO: 104580 - DNA, 25 bp, Homo sapien
aggccacgctcgcggacgtgatgcc

SEQ ID NO: 104581 - DNA, 25 bp, Homo sapien
cccggaaagatgagcacatgggcca

SEQ ID NO: 104582 - DNA, 25 bp, Homo sapien
agatgagcacatgggccaccagttc

SEQ ID NO: 104583 - DNA, 25 bp, Homo sapien
gcacatgggccaccagttcctgacg

SEQ ID NO: 104584 - DNA, 25 bp, Homo sapien
cctcaccagcgacgagctgcacctg

SEQ ID NO: 104585 - DNA, 25 bp, Homo sapien
ctcatgcacggaaagcgccgagcca

SEQ ID NO: 104586 - DNA, 25 bp, Homo sapien
cagccggggactttcaggaactgca

SEQ ID NO: 104587 - DNA, 25 bp, Homo sapien
cagaatcaccatccgcggcgcggga

SEQ ID NO: 104588 - DNA, 25 bp, Homo sapien
gcgggcagtgcagacagaccaccag

SEQ ID NO: 104589 - DNA, 25 bp, Homo sapien
acagaccaccaggatcgcaccgggg

SEQ ID NO: 104590 - DNA, 25 bp, Homo sapien
agcgaggtttgggaagtttgcacct

SEQ ID NO: 104591 - DNA, 25 bp, Homo sapien
aagtttgcacctgagcgtgggctgc

SEQ ID NO: 104592 - DNA, 25 bp, Homo sapien
tctgcccggggcgtcgagagttcct

SEQ ID NO: 104593 - DNA, 25 bp, Homo sapien
aatgcgtggcatccgggaggctctt

SEQ ID NO: 104594 - DNA, 25 bp, Homo sapien
ggcggcgcaaagtgaaactctggca

SEQ ID NO: 104595 - DNA, 25 bp, Homo sapien
gcctccgcgccgaagtaggcgcagt

SEQ ID NO: 104596 - DNA, 25 bp, Homo sapien
acgcagggtcgaaaggactcgtcca

SEQ ID NO: 104597 - DNA, 25 bp, Homo sapien
tcctccgcagcgaggaatgcgtggc

SEQ ID NO: 104598 - DNA, 25 bp, Homo sapien
cctccgggatagaacgctagtgaaa

SEQ ID NO: 104599 - DNA, 25 bp, Homo sapien
ggtgaccgcaacagcctccgggata

SEQ ID NO: 104600 - DNA, 25 bp, Homo sapien
aagcgcctccgcgaattaactcagg

SEQ ID NO: 104601 - DNA, 25 bp, Homo sapien
cgccatgtcctccagatgacgcgga

SEQ ID NO: 104602 - DNA, 25 bp, Homo sapien
cgcgcgttccctgctactgaaaaca

SEQ ID NO: 104603 - DNA, 25 bp, Homo sapien
tgcctgccaggaataaccgcgcgtt

SEQ ID NO: 104604 - DNA, 25 bp, Homo sapien
ttgctttcagctccctggatgcctg

SEQ ID NO: 104605 - DNA, 25 bp, Homo sapien
accgttctccgagcaggtctctgtc

SEQ ID NO: 104606 - DNA, 25 bp, Homo sapien
acagaggtgcccgtttctggacaga

SEQ ID NO: 104607 - DNA, 25 bp, Homo sapien
agtcggcctcctgtgctcagatccg

SEQ ID NO: 104608 - DNA, 25 bp, Homo sapien
cgctcacgtgtggaacagaccattg

SEQ ID NO: 104609 - DNA, 25 bp, Homo sapien
ggctccacccacaatagcgtcccta

SEQ ID NO: 104610 - DNA, 25 bp, Homo sapien
cgtccctagcgcgatggcgtatcgg

SEQ ID NO: 104611 - DNA, 25 bp, Homo sapien
gttgtctggggagccctactctttc

SEQ ID NO: 104612 - DNA, 25 bp, Homo sapien
gcgaccaccagagagagaggccctc

SEQ ID NO: 104613 - DNA, 25 bp, Homo sapien
cgcttctgcatctgtgggccgaggt

SEQ ID NO: 104614 - DNA, 25 bp, Homo sapien
cgtgactaccgagcccgggaagacg

SEQ ID NO: 104615 - DNA, 25 bp, Homo sapien
cggcaacgccgaggcgcttctgcat

SEQ ID NO: 104616 - DNA, 25 bp, Homo sapien
gtcaggctcgcgaccaccagagaga

SEQ ID NO: 104617 - DNA, 25 bp, Homo sapien
gctctccgggttccagacaaccatt

SEQ ID NO: 104618 - DNA, 25 bp, Homo sapien
cttttgaaacagagacccgcggcac

SEQ ID NO: 104619 - DNA, 25 bp, Homo sapien
gggagttccgcagccactcctggcg

SEQ ID NO: 104620 - DNA, 25 bp, Homo sapien
cggcctcgggtctcttttgaaacag

SEQ ID NO: 104621 - DNA, 25 bp, Homo sapien
ttcccaagaggcctcggaaagtgcg

SEQ ID NO: 104622 - DNA, 25 bp, Homo sapien
ggcccaaggccactaactgcacttg

SEQ ID NO: 104623 - DNA, 25 bp, Homo sapien
agccagctgctctcagtgcgggcag

SEQ ID NO: 104624 - DNA, 25 bp, Homo sapien
acaaccattccggagagccagctgc

SEQ ID NO: 104625 - DNA, 25 bp, Homo sapien
gacagcgcttctgtgctcccggcgg

SEQ ID NO: 104626 - DNA, 25 bp, Homo sapien
tgacagcgcttctgtgctcccggcg

SEQ ID NO: 104627 - DNA, 25 bp, Homo sapien
gtgacagcgcttctgtgctcccggc

SEQ ID NO: 104628 - DNA, 25 bp, Homo sapien
ggtgacagcgcttctgtgctcccgg

SEQ ID NO: 104629 - DNA, 25 bp, Homo sapien
tggtgacagcgcttctgtgctcccg

SEQ ID NO: 104630 - DNA, 25 bp, Homo sapien
gtggtgacagcgcttctgtgctccc

SEQ ID NO: 104631 - DNA, 25 bp, Homo sapien
tcggtggtgacagcgcttctgtgct

SEQ ID NO: 104632 - DNA, 25 bp, Homo sapien
agcgcttctgtgctcccggcggctt

SEQ ID NO: 104633 - DNA, 25 bp, Homo sapien
gcggctttccctgtaagacataatg

SEQ ID NO: 104634 - DNA, 25 bp, Homo sapien
agacataatgggactgggacgtcca

SEQ ID NO: 104635 - DNA, 25 bp, Homo sapien
ctgggacgtccacttccggctcaaa

SEQ ID NO: 104636 - DNA, 25 bp, Homo sapien
ggacgtccacttccggctcaaacga

SEQ ID NO: 104637 - DNA, 25 bp, Homo sapien
ttccggctcaaacgaagttcagacg

SEQ ID NO: 104638 - DNA, 25 bp, Homo sapien
aacgaagttcagacggcgcgcaagc

SEQ ID NO: 104639 - DNA, 25 bp, Homo sapien
ctaggcccggcactgtgggcatctt

SEQ ID NO: 104640 - DNA, 25 bp, Homo sapien
cccggcggctttccctgtaagacat

SEQ ID NO: 104641 - DNA, 25 bp, Homo sapien
acctgtcgtggcagctgcatggaaa

SEQ ID NO: 104642 - DNA, 25 bp, Homo sapien
aggcgtttggcttggagccattttt

SEQ ID NO: 104643 - DNA, 25 bp, Homo sapien
ggagattctgttccgagcaccaacc

SEQ ID NO: 104644 - DNA, 25 bp, Homo sapien
gagccttttgtctccgcgtgtgaga

SEQ ID NO: 104645 - DNA, 25 bp, Homo sapien
cctctggcaaatcacggagattctg

SEQ ID NO: 104646 - DNA, 25 bp, Homo sapien
gctgtctggagtctgtgctgtttcc

SEQ ID NO: 104647 - DNA, 25 bp, Homo sapien
ctgcatggaaatcccggcgcttctg

SEQ ID NO: 104648 - DNA, 25 bp, Homo sapien
gcaggacgccgattccgaagtttga

SEQ ID NO: 104649 - DNA, 25 bp, Homo sapien
gaagccagcgcgctcgacctgagcg

SEQ ID NO: 104650 - DNA, 25 bp, Homo sapien
ctgcgggctaagtgcaagggtcctc

SEQ ID NO: 104651 - DNA, 25 bp, Homo sapien
ctaagtgcaagggtcctcagcctgc

SEQ ID NO: 104652 - DNA, 25 bp, Homo sapien
tgcaagggtcctcagcctgcgcgcg

SEQ ID NO: 104653 - DNA, 25 bp, Homo sapien
cgcgcacctgtcctgagcgtgcacc

SEQ ID NO: 104654 - DNA, 25 bp, Homo sapien
tgcgcgcacccgctgtaagcgcgat

SEQ ID NO: 104655 - DNA, 25 bp, Homo sapien
cgccgccacgcagcacgagcgctcc

SEQ ID NO: 104656 - DNA, 25 bp, Homo sapien
gaacacgaaaggaaactctccagga

SEQ ID NO: 104657 - DNA, 25 bp, Homo sapien
tagaagtcagggttcaccacgcgtg

SEQ ID NO: 104658 - DNA, 25 bp, Homo sapien
aaatcatcgacttcgggttcgcgcg

SEQ ID NO: 104659 - DNA, 25 bp, Homo sapien
tacgacgagtcctgcgacctctgga

SEQ ID NO: 104660 - DNA, 25 bp, Homo sapien
cctgggcgtcattctggtatgggac

SEQ ID NO: 104661 - DNA, 25 bp, Homo sapien
accctcctagtacatgatgctgtcg

SEQ ID NO: 104662 - DNA, 25 bp, Homo sapien
ggcggccgagatcatgtgcaaaatc

SEQ ID NO: 104663 - DNA, 25 bp, Homo sapien
tgcaaaatccgcgaggggcgcttct

SEQ ID NO: 104664 - DNA, 25 bp, Homo sapien
ggctgttacgatctctttggggctc

SEQ ID NO: 104665 - DNA, 25 bp, Homo sapien
aggaggacctcacgcccttcaagga

SEQ ID NO: 104666 - DNA, 25 bp, Homo sapien
ggacgccgagtaccctgcctttgag

SEQ ID NO: 104667 - DNA, 25 bp, Homo sapien
tctgagcgccctaggctttgcagga

SEQ ID NO: 104668 - DNA, 25 bp, Homo sapien
gaagggccgatttccgttcagctga

SEQ ID NO: 104669 - DNA, 25 bp, Homo sapien
atgaccgctactacaggtgggcgcg

SEQ ID NO: 104670 - DNA, 25 bp, Homo sapien
cgcccttcaaggatgaccgctacta

SEQ ID NO: 104671 - DNA, 25 bp, Homo sapien
tgcgggaagcgtaccgcgagctcaa

SEQ ID NO: 104672 - DNA, 25 bp, Homo sapien
tgcagcgagctcaagcacctgtgcc

SEQ ID NO: 104673 - DNA, 25 bp, Homo sapien
ctccggacactccggccgaaagttg

SEQ ID NO: 104674 - DNA, 25 bp, Homo sapien
tcggggtgtcgagttatatgagttt

SEQ ID NO: 104675 - DNA, 25 bp, Homo sapien
gcgtcgcgctctgatgagttttccg

SEQ ID NO: 104676 - DNA, 25 bp, Homo sapien
ttatatgagttttatgcgttttacg

SEQ ID NO: 104677 - DNA, 25 bp, Homo sapien
gcgctctgatgagttttccgcggcc

SEQ ID NO: 104678 - DNA, 25 bp, Homo sapien
gcgcacgtgatctcggcgtcgcgct

SEQ ID NO: 104679 - DNA, 25 bp, Homo sapien
tgagagtcgcttccgcgcacgtgat

SEQ ID NO: 104680 - DNA, 25 bp, Homo sapien
tcttccgccgtgagagtcgcttccg

SEQ ID NO: 104681 - DNA, 25 bp, Homo sapien
tggtagtcttccatctttcctccgg

SEQ ID NO: 104682 - DNA, 25 bp, Homo sapien
agcaaggggcggtgatgtcatcctc

SEQ ID NO: 104683 - DNA, 25 bp, Homo sapien
gccctgcgggaaggtttctcggcac

SEQ ID NO: 104684 - DNA, 25 bp, Homo sapien
gggagacgtccaagcctcggcgctc

SEQ ID NO: 104685 - DNA, 25 bp, Homo sapien
tgccgagactggcctagctgaagga

SEQ ID NO: 104686 - DNA, 25 bp, Homo sapien
tgatgtcatcctctcggcgagcttg

SEQ ID NO: 104687 - DNA, 25 bp, Homo sapien
tccgcagcctggtagtcttccatct

SEQ ID NO: 104688 - DNA, 25 bp, Homo sapien
aaggtttctcggcaccgctcaccgg

SEQ ID NO: 104689 - DNA, 25 bp, Homo sapien
ccgcgtttccttcgggagagacctg

SEQ ID NO: 104690 - DNA, 25 bp, Homo sapien
ccgtcaagcctttgagaaactcttt

SEQ ID NO: 104691 - DNA, 25 bp, Homo sapien
gcggctgcagtcacaaccgtcaagc

SEQ ID NO: 104692 - DNA, 25 bp, Homo sapien
ttcactttgtgtagcaaccgttgcc

SEQ ID NO: 104693 - DNA, 25 bp, Homo sapien
cgagcactcggcaagtttcactttg

SEQ ID NO: 104694 - DNA, 25 bp, Homo sapien
aagcccgtgagaagccgagcactcg

SEQ ID NO: 104695 - DNA, 25 bp, Homo sapien
acactcgaggtgcacccagcggaga

SEQ ID NO: 104696 - DNA, 25 bp, Homo sapien
tttcaaaaactgcaaccgctcggga

SEQ ID NO: 104697 - DNA, 25 bp, Homo sapien
cacacggacgcggttggtttccagt

SEQ ID NO: 104698 - DNA, 25 bp, Homo sapien
tccctcttcggaaggaagcgcagtc

SEQ ID NO: 104699 - DNA, 25 bp, Homo sapien
ttgtcctacaggaacgcgcatctgc

SEQ ID NO: 104700 - DNA, 25 bp, Homo sapien
ccagtgaggcataactcatcgcttc

SEQ ID NO: 104701 - DNA, 25 bp, Homo sapien
gtcgtcagctcaggctccaaatatg

SEQ ID NO: 104702 - DNA, 25 bp, Homo sapien
atcagggcgcgcgaccaaaatagcg

SEQ ID NO: 104703 - DNA, 25 bp, Homo sapien
atcgcttcactcttctcaacggttc

SEQ ID NO: 104704 - DNA, 25 bp, Homo sapien
gcttctgcctgacgtgtacccggaa

SEQ ID NO: 104705 - DNA, 25 bp, Homo sapien
ggggcgggcacaccctcattaaatg

SEQ ID NO: 104706 - DNA, 25 bp, Homo sapien
tcgcacccagtacgcagtgaacacg

SEQ ID NO: 104707 - DNA, 25 bp, Homo sapien
cgtcggtccctcataaaatgtgttg

SEQ ID NO: 104708 - DNA, 25 bp, Homo sapien
ttgggtcacagatcgctacaccgtt

SEQ ID NO: 104709 - DNA, 25 bp, Homo sapien
taaaatgtgttgctgacctcgcacc

SEQ ID NO: 104710 - DNA, 25 bp, Homo sapien
gccttcctctttcagttgggtcaca

SEQ ID NO: 104711 - DNA, 25 bp, Homo sapien
gtgagacctcaaacgctccggcgtg

SEQ ID NO: 104712 - DNA, 25 bp, Homo sapien
gggactaaggcctccgccatcattt

SEQ ID NO: 104713 - DNA, 25 bp, Homo sapien
ggttgcccagcaacccagggttctg

SEQ ID NO: 104714 - DNA, 25 bp, Homo sapien
aaggactgcggcacaagggacttcc

SEQ ID NO: 104715 - DNA, 25 bp, Homo sapien
ccggctttggaatgtggctttgcag

SEQ ID NO: 104716 - DNA, 25 bp, Homo sapien
gatcagtcagcgctgaggccatgtc

SEQ ID NO: 104717 - DNA, 25 bp, Homo sapien
gactgcctcgctttcggtggagctt

SEQ ID NO: 104718 - DNA, 25 bp, Homo sapien
cccggagagatgtaagtagtgccaa

SEQ ID NO: 104719 - DNA, 25 bp, Homo sapien
tgccaagggcaaggattccgcgacg

SEQ ID NO: 104720 - DNA, 25 bp, Homo sapien
gcttgaccgtcatccttgaggcctg

SEQ ID NO: 104721 - DNA, 25 bp, Homo sapien
gcctggaaatggcaatatctgagca

SEQ ID NO: 104722 - DNA, 25 bp, Homo sapien
gctcgctgctctgcacgcagctgga

SEQ ID NO: 104723 - DNA, 25 bp, Homo sapien
ggccacgtagtcaacccgaggatgt

SEQ ID NO: 104724 - DNA, 25 bp, Homo sapien
cttgcctcgggtgagaaggctagtc

SEQ ID NO: 104725 - DNA, 25 bp, Homo sapien
attcagggtgcaggtgtcatggcct

SEQ ID NO: 104726 - DNA, 25 bp, Homo sapien
ctgagcaaacaggtgggcgtcgctt

SEQ ID NO: 104727 - DNA, 25 bp, Homo sapien
tttgctctgcggactcagccagttc

SEQ ID NO: 104728 - DNA, 25 bp, Homo sapien
aaggctagtcaccattcagggtgca

SEQ ID NO: 104729 - DNA, 25 bp, Homo sapien
ccgtgctgtacgaaacagtcgtaga

SEQ ID NO: 104730 - DNA, 25 bp, Homo sapien
aaactacaaacaggctacacgaggg

SEQ ID NO: 104731 - DNA, 25 bp, Homo sapien
cctcgagctgcaaagtggtggctgt

SEQ ID NO: 104732 - DNA, 25 bp, Homo sapien
tggtggctgtggaccacgttaaacc

SEQ ID NO: 104733 - DNA, 25 bp, Homo sapien
tgtggaccacgttaaaccgtctcta

SEQ ID NO: 104734 - DNA, 25 bp, Homo sapien
tggcagcctgagctcacaatcgtcc

SEQ ID NO: 104735 - DNA, 25 bp, Homo sapien
tgagctcacaatcgtccgaccacgt

SEQ ID NO: 104736 - DNA, 25 bp, Homo sapien
catggagcccgtgctgtacgaaaca

SEQ ID NO: 104737 - DNA, 25 bp, Homo sapien
cagcgcgctggcgtttaactttgcc

SEQ ID NO: 104738 - DNA, 25 bp, Homo sapien
gtcactagcctgtgcgtcctcgtca

SEQ ID NO: 104739 - DNA, 25 bp, Homo sapien
gcgcccgagcgcagctaaaaggctc

SEQ ID NO: 104740 - DNA, 25 bp, Homo sapien
agttcagaaccgctaagtcagtccg

SEQ ID NO: 104741 - DNA, 25 bp, Homo sapien
ggaggaacttcctcagccacttggc

SEQ ID NO: 104742 - DNA, 25 bp, Homo sapien
tgggctagccacaggaactacagcg

SEQ ID NO: 104743 - DNA, 25 bp, Homo sapien
ttctgtaaggggacaaagggcactc

SEQ ID NO: 104744 - DNA, 25 bp, Homo sapien
ccagccagaaaatgagagggttaga

SEQ ID NO: 104745 - DNA, 25 bp, Homo sapien
ctgctctgctgatttgcaggtggga

SEQ ID NO: 104746 - DNA, 25 bp, Homo sapien
tcacgctgggatgacggagtgttaa

SEQ ID NO: 104747 - DNA, 25 bp, Homo sapien
ctgggatgacggagtgttaacctca

SEQ ID NO: 104748 - DNA, 25 bp, Homo sapien
tctccagtctctttcggggactcgc

SEQ ID NO: 104749 - DNA, 25 bp, Homo sapien
ccctggcacccactagatggcgctc

SEQ ID NO: 104750 - DNA, 25 bp, Homo sapien
gacggagtgttaacctcagactctg

SEQ ID NO: 104751 - DNA, 25 bp, Homo sapien
acgtcgggagcgctggcctctgctc

SEQ ID NO: 104752 - DNA, 25 bp, Homo sapien
gagtgttaacctcagactctgggtc

SEQ ID NO: 104753 - DNA, 25 bp, Homo sapien
tcccagtgttcccagaaggatgaca

SEQ ID NO: 104754 - DNA, 25 bp, Homo sapien
acggtcacagcagcatcccagtgtt

SEQ ID NO: 104755 - DNA, 25 bp, Homo sapien
cctccaaggctcaggatgttcaaca

SEQ ID NO: 104756 - DNA, 25 bp, Homo sapien
tccacaggggcagatacacatcctc

SEQ ID NO: 104757 - DNA, 25 bp, Homo sapien
cagcctgcatcggaaggaacccatc

SEQ ID NO: 104758 - DNA, 25 bp, Homo sapien
ctaagcttagctcaggtatccatgg

SEQ ID NO: 104759 - DNA, 25 bp, Homo sapien
aggtctccaagcaggttcagcattg

SEQ ID NO: 104760 - DNA, 25 bp, Homo sapien
ggacacttccatttgctcagacaca

SEQ ID NO: 104761 - DNA, 25 bp, Homo sapien
tggtgaccacaggtgggccgcccct

SEQ ID NO: 104762 - DNA, 25 bp, Homo sapien
ccggggctgcgcgtggtgaccacag

SEQ ID NO: 104763 - DNA, 25 bp, Homo sapien
ctgtcctaggcagggccttccctct

SEQ ID NO: 104764 - DNA, 25 bp, Homo sapien
ctcgcactcgccctggactcgcccg

SEQ ID NO: 104765 - DNA, 25 bp, Homo sapien
tggactcgcccgatcctgatcctga

SEQ ID NO: 104766 - DNA, 25 bp, Homo sapien
ggactcgcccgatcctgatcctgat

SEQ ID NO: 104767 - DNA, 25 bp, Homo sapien
tgatcctgatcctctcccacgggga

SEQ ID NO: 104768 - DNA, 25 bp, Homo sapien
atcctgatcctctcccacggggagg

SEQ ID NO: 104769 - DNA, 25 bp, Homo sapien
ctcctcggtgacgttcaggttgttc

SEQ ID NO: 104770 - DNA, 25 bp, Homo sapien
ttcaggttgttcacgtaggccgcgt

SEQ ID NO: 104771 - DNA, 25 bp, Homo sapien
atctgcgcgttgatgtgaggttcca

SEQ ID NO: 104772 - DNA, 25 bp, Homo sapien
cctgctggtgctgaagacgagaaag

SEQ ID NO: 104773 - DNA, 25 bp, Homo sapien
cgagaaagcacagcccggtcagtca

SEQ ID NO: 104774 - DNA, 25 bp, Homo sapien
actgcccggctcaacatgctgctag

SEQ ID NO: 104775 - DNA, 25 bp, Homo sapien
acatgctgctagtgctggtgctacc

SEQ ID NO: 104776 - DNA, 25 bp, Homo sapien
tgcctgtctgccgtacttgagtggc

SEQ ID NO: 104777 - DNA, 25 bp, Homo sapien
cgacacgcggaagcatcacggatga

SEQ ID NO: 104778 - DNA, 25 bp, Homo sapien
cagctgctccattgtgcctcgaggc

SEQ ID NO: 104779 - DNA, 25 bp, Homo sapien
cgcctgaaaggcgactctcctgtga

SEQ ID NO: 104780 - DNA, 25 bp, Homo sapien
ccgcttcccttactgagcttgctga

SEQ ID NO: 104781 - DNA, 25 bp, Homo sapien
ccacggcctctctcttgaggtggca

SEQ ID NO: 104782 - DNA, 25 bp, Homo sapien
ggtttcctccctcagcgccattttg

SEQ ID NO: 104783 - DNA, 25 bp, Homo sapien
atgagcgtcacgaacacagagcggc

SEQ ID NO: 104784 - DNA, 25 bp, Homo sapien
gccattttgtggcagcgagacccac

SEQ ID NO: 104785 - DNA, 25 bp, Homo sapien
aggctcagatcctgtggtcatcgtc

SEQ ID NO: 104786 - DNA, 25 bp, Homo sapien
cgctctgtaaatgcgtccgaggtcc

SEQ ID NO: 104787 - DNA, 25 bp, Homo sapien
tccaacattggggtgtccagaaaca

SEQ ID NO: 104788 - DNA, 25 bp, Homo sapien
actccgtccctcgtgcttggattgg

SEQ ID NO: 104789 - DNA, 25 bp, Homo sapien
cgtcaagtcggggaactccaacatt

SEQ ID NO: 104790 - DNA, 25 bp, Homo sapien
tcctgagctgaacgagagataagtc

SEQ ID NO: 104791 - DNA, 25 bp, Homo sapien
gtcgggctgtcacacaatggctaga

SEQ ID NO: 104792 - DNA, 25 bp, Homo sapien
cctgcctctcccattggttggcgta

SEQ ID NO: 104793 - DNA, 25 bp, Homo sapien
cggcagcgatacacgtcgaattctg

SEQ ID NO: 104794 - DNA, 25 bp, Homo sapien
gatgaccgcccaagctctccgagta

SEQ ID NO: 104795 - DNA, 25 bp, Homo sapien
tgccttattcctacgcggtgcccag

SEQ ID NO: 104796 - DNA, 25 bp, Homo sapien
cagtgggccattctagtgccttcta

SEQ ID NO: 104797 - DNA, 25 bp, Homo sapien
cgggcccttctccaagttagagttg

SEQ ID NO: 104798 - DNA, 25 bp, Homo sapien
gcagtttttccagcgggccatacgg

SEQ ID NO: 104799 - DNA, 25 bp, Homo sapien
agatcgccttctcggccactcagtg

SEQ ID NO: 104800 - DNA, 25 bp, Homo sapien
tccaggcctcaggagtgtaagttta

SEQ ID NO: 104801 - DNA, 25 bp, Homo sapien
attcgcggctgtgccggacagagcc

SEQ ID NO: 104802 - DNA, 25 bp, Homo sapien
tacaattaaaacacccgcaggcagg

SEQ ID NO: 104803 - DNA, 25 bp, Homo sapien
gcagctgcctggtttccatgtgtgc

SEQ ID NO: 104804 - DNA, 25 bp, Homo sapien
catgtgtgcgccctttaagacccgg

SEQ ID NO: 104805 - DNA, 25 bp, Homo sapien
agctcgtccaggaggccgacttcgt

SEQ ID NO: 104806 - DNA, 25 bp, Homo sapien
cagcacgtgatagcgctgggcgact

SEQ ID NO: 104807 - DNA, 25 bp, Homo sapien
gactccgcggagctgcacggccatg

SEQ ID NO: 104808 - DNA, 25 bp, Homo sapien
gacgagttcgaggagagcctccctc

SEQ ID NO: 104809 - DNA, 25 bp, Homo sapien
cgttcccgagggaaagttgcctgcg

SEQ ID NO: 104810 - DNA, 25 bp, Homo sapien
cgcgtccggccacttgtggctgtcg

SEQ ID NO: 104811 - DNA, 25 bp, Homo sapien
ccacttgtggctgtcgctgagtcgg

SEQ ID NO: 104812 - DNA, 25 bp, Homo sapien
ggcaggaactccagtttgctttgtt

SEQ ID NO: 104813 - DNA, 25 bp, Homo sapien
agtttgctttgttcccgctgcgcgt

SEQ ID NO: 104814 - DNA, 25 bp, Homo sapien
cgctgcgcgtttgcatcagagtttc

SEQ ID NO: 104815 - DNA, 25 bp, Homo sapien
gcatcagagtttcgccagcggggca

SEQ ID NO: 104816 - DNA, 25 bp, Homo sapien
gagcccagtcgagccgcgctcacct

SEQ ID NO: 104817 - DNA, 25 bp, Homo sapien
ggactcgccctttgacacctgtcag

SEQ ID NO: 104818 - DNA, 25 bp, Homo sapien
ggctcggtggatcccttttcaaaga

SEQ ID NO: 104819 - DNA, 25 bp, Homo sapien
agcgcctgaggcctttctggaccgc

SEQ ID NO: 104820 - DNA, 25 bp, Homo sapien
ttttcaaagaaacccatgctggccc

SEQ ID NO: 104821 - DNA, 25 bp, Homo sapien
ttgacacctgtcagtcctgcctgga

SEQ ID NO: 104822 - DNA, 25 bp, Homo sapien
cgcgcgagcgcctgaggcctttctg

SEQ ID NO: 104823 - DNA, 25 bp, Homo sapien
gacacctgtcagtcctgcctggagc

SEQ ID NO: 104824 - DNA, 25 bp, Homo sapien
tcggcgcctttaaactgccacagtc

SEQ ID NO: 104825 - DNA, 25 bp, Homo sapien
accttcctgagatatgcctgcttgc

SEQ ID NO: 104826 - DNA, 25 bp, Homo sapien
ggtcctctttgggttcgctgtacac

SEQ ID NO: 104827 - DNA, 25 bp, Homo sapien
ctggagcctgacgtataattcgagc

SEQ ID NO: 104828 - DNA, 25 bp, Homo sapien
cgaccacgaggtgagataccgcgta

SEQ ID NO: 104829 - DNA, 25 bp, Homo sapien
gtgtttccacgttacaggcgactta

SEQ ID NO: 104830 - DNA, 25 bp, Homo sapien
tccgctggtccctgaacaaaaactc

SEQ ID NO: 104831 - DNA, 25 bp, Homo sapien
ctggaacaagtcaccgcgaacccta

SEQ ID NO: 104832 - DNA, 25 bp, Homo sapien
cgggaacgcggacacatctagcact

SEQ ID NO: 104833 - DNA, 25 bp, Homo sapien
accacgaccagcaggagggcggtca

SEQ ID NO: 104834 - DNA, 25 bp, Homo sapien
tcagtggtggagtggaccacgacca

SEQ ID NO: 104835 - DNA, 25 bp, Homo sapien
cacgtgtctgcatccttcagtggtg

SEQ ID NO: 104836 - DNA, 25 bp, Homo sapien
atgaggcctcacctgcacgtgtctg

SEQ ID NO: 104837 - DNA, 25 bp, Homo sapien
agttcactgacactgagtgagtccc

SEQ ID NO: 104838 - DNA, 25 bp, Homo sapien
cattcgtcatctactgcggcctgcg

SEQ ID NO: 104839 - DNA, 25 bp, Homo sapien
gccgcttttgggatggccggcatct

SEQ ID NO: 104840 - DNA, 25 bp, Homo sapien
gccggcatctttctgagttcactga

SEQ ID NO: 104841 - DNA, 25 bp, Homo sapien
ttcaggacgtgacccgcacattatg

SEQ ID NO: 104842 - DNA, 25 bp, Homo sapien
tgcgcatctccctaggcgggtacct

SEQ ID NO: 104843 - DNA, 25 bp, Homo sapien
ttgccaggaaacaccgcatcccttt

SEQ ID NO: 104844 - DNA, 25 bp, Homo sapien
ggcttggcttctgaacttgccagga

SEQ ID NO: 104845 - DNA, 25 bp, Homo sapien
agaggggtcaccctatgtgtgaaca

SEQ ID NO: 104846 - DNA, 25 bp, Homo sapien
acccgtaggggctcttgacacagag

SEQ ID NO: 104847 - DNA, 25 bp, Homo sapien
ccgcacattatgagggacccgtagg

SEQ ID NO: 104848 - DNA, 25 bp, Homo sapien
ttctgcctccttttcaggacgtgac

SEQ ID NO: 104849 - DNA, 25 bp, Homo sapien
tgccctggtgctgagcacatcgccg

SEQ ID NO: 104850 - DNA, 25 bp, Homo sapien
agcaggtgctccgtgccctggtgct

SEQ ID NO: 104851 - DNA, 25 bp, Homo sapien
atcgccgagaaggagcaggtgctcc

SEQ ID NO: 104852 - DNA, 25 bp, Homo sapien
acatcgccgagaaggagcaggtgct

SEQ ID NO: 104853 - DNA, 25 bp, Homo sapien
cgtgccctggtgctgagcacatcgc

SEQ ID NO: 104854 - DNA, 25 bp, Homo sapien
ccctggtgctgagcgcatcgctgag

SEQ ID NO: 104855 - DNA, 25 bp, Homo sapien
cacatcgccgagaaggagcaggtgc

SEQ ID NO: 104856 - DNA, 25 bp, Homo sapien
catcgccgagaaggagcaggtgctc

SEQ ID NO: 104857 - DNA, 25 bp, Homo sapien
cggggtttcccacacgcatgacgca

SEQ ID NO: 104858 - DNA, 25 bp, Homo sapien
tgagctggtcccggggtttcccaca

SEQ ID NO: 104859 - DNA, 25 bp, Homo sapien
ttcccacacgcatgacgcataggga

SEQ ID NO: 104860 - DNA, 25 bp, Homo sapien
cacgcatgacgcatagggatgagct

SEQ ID NO: 104861 - DNA, 25 bp, Homo sapien
gtcccggggtttcccacacgcatga

SEQ ID NO: 104862 - DNA, 25 bp, Homo sapien
gggtttcccacacgcatgacgcata

SEQ ID NO: 104863 - DNA, 25 bp, Homo sapien
catagggatgagctggtcccggggt

SEQ ID NO: 104864 - DNA, 25 bp, Homo sapien
ccacacgcatgacgcatagggatga

SEQ ID NO: 104865 - DNA, 25 bp, Homo sapien
tcctgcaaggaacccgcataacgtc

SEQ ID NO: 104866 - DNA, 25 bp, Homo sapien
tctactactggtgaggcccttcctc

SEQ ID NO: 104867 - DNA, 25 bp, Homo sapien
tcacagaatttgttggctcgggctc

SEQ ID NO: 104868 - DNA, 25 bp, Homo sapien
ctgcgctttctgtcctctcgaggga

SEQ ID NO: 104869 - DNA, 25 bp, Homo sapien
cctctcgagggaccagtctcttgga

SEQ ID NO: 104870 - DNA, 25 bp, Homo sapien
ggccatggtgtccacatgcataacg

SEQ ID NO: 104871 - DNA, 25 bp, Homo sapien
gcgatcatgtaccagatggccttca

SEQ ID NO: 104872 - DNA, 25 bp, Homo sapien
ggctccagaagaacggtggcgatca

SEQ ID NO: 104873 - DNA, 25 bp, Homo sapien
atggacgagccaggcgtctcgtaca

SEQ ID NO: 104874 - DNA, 25 bp, Homo sapien
acctcgtagcgcctacactgtcttg

SEQ ID NO: 104875 - DNA, 25 bp, Homo sapien
ggcaccgtgtagttcagttcctctg

SEQ ID NO: 104876 - DNA, 25 bp, Homo sapien
cctacactgtcttggggaggcttcg

SEQ ID NO: 104877 - DNA, 25 bp, Homo sapien
gctctggttccagtccacctcgtag

SEQ ID NO: 104878 - DNA, 25 bp, Homo sapien
cacgcagtcgaaggtgctctggttc

SEQ ID NO: 104879 - DNA, 25 bp, Homo sapien
ctcctgttggtgtccaggctggcca

SEQ ID NO: 104880 - DNA, 25 bp, Homo sapien
ggtgaagcccaggaagacgatgccc

SEQ ID NO: 104881 - DNA, 25 bp, Homo sapien
gccttcctcttcgtcggcgtggtct

SEQ ID NO: 104882 - DNA, 25 bp, Homo sapien
tgctgtgcctgacgggcgtcacctt

SEQ ID NO: 104883 - DNA, 25 bp, Homo sapien
tccgcacgcgcaagggccaagggct

SEQ ID NO: 104884 - DNA, 25 bp, Homo sapien
tccagaggcgcgtgtttttgctgct

SEQ ID NO: 104885 - DNA, 25 bp, Homo sapien
gctggcagggaccaaaaggagctcc

SEQ ID NO: 104886 - DNA, 25 bp, Homo sapien
gaccctggaactttcttcttctgga

SEQ ID NO: 104887 - DNA, 25 bp, Homo sapien
gccgctgagagatcgggtcccagaa

SEQ ID NO: 104888 - DNA, 25 bp, Homo sapien
gaccactactggtgccgcgggccaa

SEQ ID NO: 104889 - DNA, 25 bp, Homo sapien
tcctttgggccgacagagttgtctc

SEQ ID NO: 104890 - DNA, 25 bp, Homo sapien
gtgtccagggcatgagccttctggc

SEQ ID NO: 104891 - DNA, 25 bp, Homo sapien
gagccttctggcattgtgggttccc

SEQ ID NO: 104892 - DNA, 25 bp, Homo sapien
gtgcacgagaacgtcccatccaggg

SEQ ID NO: 104893 - DNA, 25 bp, Homo sapien
cggatacttcgttcctgccagggtc

SEQ ID NO: 104894 - DNA, 25 bp, Homo sapien
tgtctctaattgagtgcaggcagcc

SEQ ID NO: 104895 - DNA, 25 bp, Homo sapien
tcgggcagctatttcaggcagacgc

SEQ ID NO: 104896 - DNA, 25 bp, Homo sapien
catccagggacccacggatacttcg

SEQ ID NO: 104897 - DNA, 25 bp, Homo sapien
ccgccttggaccctcgccttcgctc

SEQ ID NO: 104898 - DNA, 25 bp, Homo sapien
ctcgccttcgctccagaagaatcag

SEQ ID NO: 104899 - DNA, 25 bp, Homo sapien
ttggaccctcgccttcgctccagaa

SEQ ID NO: 104900 - DNA, 25 bp, Homo sapien
tgccttggtccggtcccgccttgga

SEQ ID NO: 104901 - DNA, 25 bp, Homo sapien
ctgtccatgtctccgccccgttcca

SEQ ID NO: 104902 - DNA, 25 bp, Homo sapien
agccagcgtctggacagagcggggt

SEQ ID NO: 104903 - DNA, 25 bp, Homo sapien
gcggccttggcctgaccatcctggc

SEQ ID NO: 104904 - DNA, 25 bp, Homo sapien
gccttggcctgaccatcctggccct

SEQ ID NO: 104905 - DNA, 25 bp, Homo sapien
ccagcgacaggttttggcagctgca

SEQ ID NO: 104906 - DNA, 25 bp, Homo sapien
atattttgccgcctcgaaggacatg

SEQ ID NO: 104907 - DNA, 25 bp, Homo sapien
tttgccgcctcgaaggacatgaacc

SEQ ID NO: 104908 - DNA, 25 bp, Homo sapien
gcttggacctgaaaccagcgacagg

SEQ ID NO: 104909 - DNA, 25 bp, Homo sapien
gccgcctcgaaggacatgaaccatc

SEQ ID NO: 104910 - DNA, 25 bp, Homo sapien
gctgaaggcgcttggacctgaaacc

SEQ ID NO: 104911 - DNA, 25 bp, Homo sapien
gaaggcgcttggacctgaaaccagc

SEQ ID NO: 104912 - DNA, 25 bp, Homo sapien
gcgacaggttttggcagctgcacgc

SEQ ID NO: 104913 - DNA, 25 bp, Homo sapien
gggttttgtcccaagtgacttcagc

SEQ ID NO: 104914 - DNA, 25 bp, Homo sapien
aaggagtggggcgtaaggctgagag

SEQ ID NO: 104915 - DNA, 25 bp, Homo sapien
cctgtcgtgggttttgtcccaagtg

SEQ ID NO: 104916 - DNA, 25 bp, Homo sapien
agaactggggcttgagggcgtttct

SEQ ID NO: 104917 - DNA, 25 bp, Homo sapien
ctccttcgcccgccctgtgttccag

SEQ ID NO: 104918 - DNA, 25 bp, Homo sapien
ctgatgcttctggagctcgcgaagg

SEQ ID NO: 104919 - DNA, 25 bp, Homo sapien
tgtcgtgggttttgtcccaagtgac

SEQ ID NO: 104920 - DNA, 25 bp, Homo sapien
atgcttctggagctcgcgaagggtc

SEQ ID NO: 104921 - DNA, 25 bp, Homo sapien
agtcgagtcactcccgcacttcggg

SEQ ID NO: 104922 - DNA, 25 bp, Homo sapien
aagagtggcctcactgaagtgcctc

SEQ ID NO: 104923 - DNA, 25 bp, Homo sapien
ccctgccgctagcttcggaagagtg

SEQ ID NO: 104924 - DNA, 25 bp, Homo sapien
gtctgagtctgtccggcgactcctc

SEQ ID NO: 104925 - DNA, 25 bp, Homo sapien
agtcagaacccgagtgctgcttggc

SEQ ID NO: 104926 - DNA, 25 bp, Homo sapien
tccgtgcacggatgagagaagccgc

SEQ ID NO: 104927 - DNA, 25 bp, Homo sapien
cggtcgccgtttccaagatggccgc

SEQ ID NO: 104928 - DNA, 25 bp, Homo sapien
caccggaacccgagaccgagtcaga

SEQ ID NO: 104929 - DNA, 25 bp, Homo sapien
ctggacctgctgaagatcgtgagtc

SEQ ID NO: 104930 - DNA, 25 bp, Homo sapien
tccactgcagggatctctagcctcg

SEQ ID NO: 104931 - DNA, 25 bp, Homo sapien
aactgctagagaacgtggctcccgc

SEQ ID NO: 104932 - DNA, 25 bp, Homo sapien
tggtccaaagggacatgtccaagtc

SEQ ID NO: 104933 - DNA, 25 bp, Homo sapien
ccgagccgacttttcgccaatggtc

SEQ ID NO: 104934 - DNA, 25 bp, Homo sapien
gctgcttgtcactctcgctttccga

SEQ ID NO: 104935 - DNA, 25 bp, Homo sapien
cttttcggcttgtaggctgcttgtc

SEQ ID NO: 104936 - DNA, 25 bp, Homo sapien
ctcccgcgaggaacttttcggcttg

SEQ ID NO: 104937 - DNA, 25 bp, Homo sapien
tagcaagaggcatctcgggacccta

SEQ ID NO: 104938 - DNA, 25 bp, Homo sapien
aggctgcagcgagagcccaagctct

SEQ ID NO: 104939 - DNA, 25 bp, Homo sapien
tcagctaccctagacctggctgggt

SEQ ID NO: 104940 - DNA, 25 bp, Homo sapien
ggcgctctctccgtcatagcaagag

SEQ ID NO: 104941 - DNA, 25 bp, Homo sapien
cagcagttcaggcacctccacggag

SEQ ID NO: 104942 - DNA, 25 bp, Homo sapien
ggaaactgacaacggcgagcacctc

SEQ ID NO: 104943 - DNA, 25 bp, Homo sapien
cgagcagctgcgaggaaactgacaa

SEQ ID NO: 104944 - DNA, 25 bp, Homo sapien
cccaagctctgagcgcgagcagctg

SEQ ID NO: 104945 - DNA, 25 bp, Homo sapien
tttccggcgacacctcgcagtcatt

SEQ ID NO: 104946 - DNA, 25 bp, Homo sapien
gcccttgtagacagccggggccttc

SEQ ID NO: 104947 - DNA, 25 bp, Homo sapien
cggcttgtgcaagtcccaggtccaa

SEQ ID NO: 104948 - DNA, 25 bp, Homo sapien
acctgggactgatactggtcggccc

SEQ ID NO: 104949 - DNA, 25 bp, Homo sapien
acccgctgaatgcagggcgcatgct

SEQ ID NO: 104950 - DNA, 25 bp, Homo sapien
cgcatgctgctacttggcggctcaa

SEQ ID NO: 104951 - DNA, 25 bp, Homo sapien
cggtgcgagtatttggggattattc

SEQ ID NO: 104952 - DNA, 25 bp, Homo sapien
cggtacactgcgcaggcacaacaga

SEQ ID NO: 104953 - DNA, 25 bp, Homo sapien
tggcgtatcagtgacagtggtgact

SEQ ID NO: 104954 - DNA, 25 bp, Homo sapien
tggcgtatcagtgacagtggtcact

SEQ ID NO: 104955 - DNA, 25 bp, Homo sapien
gcgtatcagtgacagtggtgactgc

SEQ ID NO: 104956 - DNA, 25 bp, Homo sapien
tatcagtgacagtggtgactgcgtg

SEQ ID NO: 104957 - DNA, 25 bp, Homo sapien
cgtatcagtgacagtggtgactgcg

SEQ ID NO: 104958 - DNA, 25 bp, Homo sapien
gtggcgtatcagtgacagtggtcac

SEQ ID NO: 104959 - DNA, 25 bp, Homo sapien
cggcgtatcagtgacagtggtgact

SEQ ID NO: 104960 - DNA, 25 bp, Homo sapien
tatcagtgacagtggtcactgcgtg

SEQ ID NO: 104961 - DNA, 25 bp, Homo sapien
cccgtcgaggcggtcttcatgagaa

SEQ ID NO: 104962 - DNA, 25 bp, Homo sapien
ggcgagggcttcgaacgcacacact

SEQ ID NO: 104963 - DNA, 25 bp, Homo sapien
tacctggcaggtacccacgtaccta

SEQ ID NO: 104964 - DNA, 25 bp, Homo sapien
acgtacctatcatggtcactgggta

SEQ ID NO: 104965 - DNA, 25 bp, Homo sapien
agcggctctcctgggttaaatcctc

SEQ ID NO: 104966 - DNA, 25 bp, Homo sapien
agttctaacgcgtagtttctcctca

SEQ ID NO: 104967 - DNA, 25 bp, Homo sapien
cgccgtgttgaccagtcgcttagca

SEQ ID NO: 104968 - DNA, 25 bp, Homo sapien
cttcaggcccagcaatcttacgtca

SEQ ID NO: 104969 - DNA, 25 bp, Homo sapien
gtgagaaacccactcccatgccgtg

SEQ ID NO: 104970 - DNA, 25 bp, Homo sapien
acccgtgcacgctcaccgtgagaaa

SEQ ID NO: 104971 - DNA, 25 bp, Homo sapien
accttcaggctgctcgagagggttc

SEQ ID NO: 104972 - DNA, 25 bp, Homo sapien
cagctgccaggtcaggagcagagca

SEQ ID NO: 104973 - DNA, 25 bp, Homo sapien
ggcctttccattctgcaccgcaggg

SEQ ID NO: 104974 - DNA, 25 bp, Homo sapien
tcccatcacgcagggtcaaaaatgc

SEQ ID NO: 104975 - DNA, 25 bp, Homo sapien
tgggcccttctagattcccatcacg

SEQ ID NO: 104976 - DNA, 25 bp, Homo sapien
tccctgcctctgtgtaggaattccc

SEQ ID NO: 104977 - DNA, 25 bp, Homo sapien
cgcgagctgaaacttctccctaaag

SEQ ID NO: 104978 - DNA, 25 bp, Homo sapien
ggcttttctatccaccgcgagctga

SEQ ID NO: 104979 - DNA, 25 bp, Homo sapien
tcctcgctttgcatgggcttttcta

SEQ ID NO: 104980 - DNA, 25 bp, Homo sapien
gcgtctccagactcctgggcgcttt

SEQ ID NO: 104981 - DNA, 25 bp, Homo sapien
cgctcaagtctccacccggtagatt

SEQ ID NO: 104982 - DNA, 25 bp, Homo sapien
cacggccttgtgatgaagcaaaccc

SEQ ID NO: 104983 - DNA, 25 bp, Homo sapien
gtgaaaagccaaggccacgtctatg

SEQ ID NO: 104984 - DNA, 25 bp, Homo sapien
tgcgaaccctggagaacacggcctt

SEQ ID NO: 104985 - DNA, 25 bp, Homo sapien
ggcagcaagtcatcaccacctcgtg

SEQ ID NO: 104986 - DNA, 25 bp, Homo sapien
ggtgcattttcctcagtcgcgcatt

SEQ ID NO: 104987 - DNA, 25 bp, Homo sapien
gaggcttcccgttatcctgcaggca

SEQ ID NO: 104988 - DNA, 25 bp, Homo sapien
gacggcctaagccacgacatctgtg

SEQ ID NO: 104989 - DNA, 25 bp, Homo sapien
cctccagagcggtaagacggcctaa

SEQ ID NO: 104990 - DNA, 25 bp, Homo sapien
acacagatgagtgcgcctttcctcc

SEQ ID NO: 104991 - DNA, 25 bp, Homo sapien
ggctcctcgtgcttttccactgctg

SEQ ID NO: 104992 - DNA, 25 bp, Homo sapien
cggtccaggccaagcacacagatga

SEQ ID NO: 104993 - DNA, 25 bp, Homo sapien
caggccctctgactctcgctggatt

SEQ ID NO: 104994 - DNA, 25 bp, Homo sapien
gttccgggcagtgctgcagcgcaaa

SEQ ID NO: 104995 - DNA, 25 bp, Homo sapien
tgctgcagcgcaaaggcgccaggcc

SEQ ID NO: 104996 - DNA, 25 bp, Homo sapien
gactctcgctggattcgctgttccg

SEQ ID NO: 104997 - DNA, 25 bp, Homo sapien
gccgcgtctgcgttcacagggaacg

SEQ ID NO: 104998 - DNA, 25 bp, Homo sapien
cttgaactctgcagatgccagggtg

SEQ ID NO: 104999 - DNA, 25 bp, Homo sapien
gacggagcattacgcagcgcactgc

SEQ ID NO: 105000 - DNA, 25 bp, Homo sapien
atgaggacggagcattacgcagcgc

SEQ ID NO: 105001 - DNA, 25 bp, Homo sapien
ctaggccgtggcttggatttttctt

SEQ ID NO: 105002 - DNA, 25 bp, Homo sapien
ggcctcatgggcatctgaacccagt

SEQ ID NO: 105003 - DNA, 25 bp, Homo sapien
cggctgcatggagcaagtcgctctc

SEQ ID NO: 105004 - DNA, 25 bp, Homo sapien
tggaacagcacagaagcgcaacctt

SEQ ID NO: 105005 - DNA, 25 bp, Homo sapien
cctcctcgtcctggtaatactcgga

SEQ ID NO: 105006 - DNA, 25 bp, Homo sapien
atactcggagtctggcggataagcc

SEQ ID NO: 105007 - DNA, 25 bp, Homo sapien
taagccgtcacagggctggaccaca

SEQ ID NO: 105008 - DNA, 25 bp, Homo sapien
cggctcagacgctccagacggaaaa

SEQ ID NO: 105009 - DNA, 25 bp, Homo sapien
gaagcgttgcgttcacgagtccata

SEQ ID NO: 105010 - DNA, 25 bp, Homo sapien
cccgggccgttcaacaaagcaagcg

SEQ ID NO: 105011 - DNA, 25 bp, Homo sapien
ccagctcctgggttcggaaggtatt

SEQ ID NO: 105012 - DNA, 25 bp, Homo sapien
cgctcacagcgatgccattaggttc

SEQ ID NO: 105013 - DNA, 25 bp, Homo sapien
aacgaatttctagcgctccctggag

SEQ ID NO: 105014 - DNA, 25 bp, Homo sapien
ctccctggagtttgtttagacagca

SEQ ID NO: 105015 - DNA, 25 bp, Homo sapien
tgaagccgcttgtcttcccagcaca

SEQ ID NO: 105016 - DNA, 25 bp, Homo sapien
gaactgcttcttaccagctgggaga

SEQ ID NO: 105017 - DNA, 25 bp, Homo sapien
cctcttccgggctgaagatctcagc

SEQ ID NO: 105018 - DNA, 25 bp, Homo sapien
tggggacgtgaacaagccgcttccc

SEQ ID NO: 105019 - DNA, 25 bp, Homo sapien
cgcagattctggacggagactcagg

SEQ ID NO: 105020 - DNA, 25 bp, Homo sapien
acgccacagtgcagaacggagcctc

SEQ ID NO: 105021 - DNA, 25 bp, Homo sapien
agccattccggctgcatccaggagc

SEQ ID NO: 105022 - DNA, 25 bp, Homo sapien
aacagtgaacacagacccagggctc

SEQ ID NO: 105023 - DNA, 25 bp, Homo sapien
ggctcctacccaaatggggacgtga

SEQ ID NO: 105024 - DNA, 25 bp, Homo sapien
aagccgagacaacgacgccacagtg

SEQ ID NO: 105025 - DNA, 25 bp, Homo sapien
accatgcccgtggtgctgctggact

SEQ ID NO: 105026 - DNA, 25 bp, Homo sapien
gattgcggtacttatacatggcgta

SEQ ID NO: 105027 - DNA, 25 bp, Homo sapien
gtctcggtggttcattttgcccgcc

SEQ ID NO: 105028 - DNA, 25 bp, Homo sapien
ggggtctaaggagtcctccgtgata

SEQ ID NO: 105029 - DNA, 25 bp, Homo sapien
tcctccgtgataatgggcaatatta

SEQ ID NO: 105030 - DNA, 25 bp, Homo sapien
cccaaatcggttccaattggctttg

SEQ ID NO: 105031 - DNA, 25 bp, Homo sapien
ccaattggctttggcggagactaga

SEQ ID NO: 105032 - DNA, 25 bp, Homo sapien
cggccgagcactgcgctttaagcgg

SEQ ID NO: 105033 - DNA, 25 bp, Homo sapien
ctccatagcgccctacagcgccggg

SEQ ID NO: 105034 - DNA, 25 bp, Homo sapien
tacagcgccgggcacgcgcctccat

SEQ ID NO: 105035 - DNA, 25 bp, Homo sapien
gggcacgcgcctccatagcgcccta

SEQ ID NO: 105036 - DNA, 25 bp, Homo sapien
acagcgccgggcacgcgcctccata

SEQ ID NO: 105037 - DNA, 25 bp, Homo sapien
gcacgcgcctccatagcgccctaca

SEQ ID NO: 105038 - DNA, 25 bp, Homo sapien
acgcgcctccatagcgccctacagc

SEQ ID NO: 105039 - DNA, 25 bp, Homo sapien
tccatagcgccctacagcgccgggc

SEQ ID NO: 105040 - DNA, 25 bp, Homo sapien
agcgccgggcacgcgcctccatagc

SEQ ID NO: 105041 - DNA, 25 bp, Homo sapien
tctctccaaggacactgcgcacgcg

SEQ ID NO: 105042 - DNA, 25 bp, Homo sapien
acgcgccacgacgtcccgcctttct

SEQ ID NO: 105043 - DNA, 25 bp, Homo sapien
gcgcagcgcgcacgcaatcgcgttt

SEQ ID NO: 105044 - DNA, 25 bp, Homo sapien
gcgcgcacgcaatcgcgtttccgga

SEQ ID NO: 105045 - DNA, 25 bp, Homo sapien
tcgcgtttccggagagacctggctg

SEQ ID NO: 105046 - DNA, 25 bp, Homo sapien
gctccgtagtggactccgcgggcct

SEQ ID NO: 105047 - DNA, 25 bp, Homo sapien
tgtcccgcggcttgcgctccgtagt

SEQ ID NO: 105048 - DNA, 25 bp, Homo sapien
cgcgtgctggtaatccgcggctcaa

SEQ ID NO: 105049 - DNA, 25 bp, Homo sapien
agcactcggtcagccttcggaagca

SEQ ID NO: 105050 - DNA, 25 bp, Homo sapien
acgctcaagggagctgcctcttgtc

SEQ ID NO: 105051 - DNA, 25 bp, Homo sapien
aagcagcaagccctggagcgcaggc

SEQ ID NO: 105052 - DNA, 25 bp, Homo sapien
gtccatcttccatgtcggagccgaa

SEQ ID NO: 105053 - DNA, 25 bp, Homo sapien
caagaggctcctcgaggctggccat

SEQ ID NO: 105054 - DNA, 25 bp, Homo sapien
ccttcggaagcagctcgcattatta

SEQ ID NO: 105055 - DNA, 25 bp, Homo sapien
acttactggggctcaggaagcactc

SEQ ID NO: 105056 - DNA, 25 bp, Homo sapien
agctcgcattattagaaggtccatc

SEQ ID NO: 105057 - DNA, 25 bp, Homo sapien
ctttgttgagcagggagagtgtccc

SEQ ID NO: 105058 - DNA, 25 bp, Homo sapien
ctcgcgggatcgaacccgcagttca

SEQ ID NO: 105059 - DNA, 25 bp, Homo sapien
tgcggttctccctcgcgggatcgaa

SEQ ID NO: 105060 - DNA, 25 bp, Homo sapien
agacaggccatcctctgcggttctc

SEQ ID NO: 105061 - DNA, 25 bp, Homo sapien
gggagagtgtcccatggttagaccc

SEQ ID NO: 105062 - DNA, 25 bp, Homo sapien
tccttgtctgttcctttgttgagca

SEQ ID NO: 105063 - DNA, 25 bp, Homo sapien
gcccgcatccttgtctgttcctttg

SEQ ID NO: 105064 - DNA, 25 bp, Homo sapien
cagcactgagaaccagcttcctggg

SEQ ID NO: 105065 - DNA, 25 bp, Homo sapien
ctggacgaagcctaccctggaggca

SEQ ID NO: 105066 - DNA, 25 bp, Homo sapien
cgcggttcttcctcgcgaagttgga

SEQ ID NO: 105067 - DNA, 25 bp, Homo sapien
actgtgcgccctggacgaagcctac

SEQ ID NO: 105068 - DNA, 25 bp, Homo sapien
acgaagcctaccctggaggcagcgg

SEQ ID NO: 105069 - DNA, 25 bp, Homo sapien
cggaaggaacggccgctttcctcag

SEQ ID NO: 105070 - DNA, 25 bp, Homo sapien
agatccggggcgtcacttctctccc

SEQ ID NO: 105071 - DNA, 25 bp, Homo sapien
gacgcgcggttcttcctcgcgaagt

SEQ ID NO: 105072 - DNA, 25 bp, Homo sapien
cctcgggtcgcagggcacccactgt

SEQ ID NO: 105073 - DNA, 25 bp, Homo sapien
aggtgcccggtgacagcgccaagct

SEQ ID NO: 105074 - DNA, 25 bp, Homo sapien
cggtgtccagctcgagacctgtgcg

SEQ ID NO: 105075 - DNA, 25 bp, Homo sapien
cagggaagggtctaagccctgacgt

SEQ ID NO: 105076 - DNA, 25 bp, Homo sapien
gcaaaacacagggaagggtctaagc

SEQ ID NO: 105077 - DNA, 25 bp, Homo sapien
tcagtctgacccaggaaccaccagg

SEQ ID NO: 105078 - DNA, 25 bp, Homo sapien
cggaggccaagctcagtctgaccca

SEQ ID NO: 105079 - DNA, 25 bp, Homo sapien
gagagcctgacttcctgcgggccct

SEQ ID NO: 105080 - DNA, 25 bp, Homo sapien
gtggtctagacgcttcccctcttgt

SEQ ID NO: 105081 - DNA, 25 bp, Homo sapien
acccagggactcgagcaggtggtcc

SEQ ID NO: 105082 - DNA, 25 bp, Homo sapien
agagaaagccaagaccaggtgcgtt

SEQ ID NO: 105083 - DNA, 25 bp, Homo sapien
gctgggtcaggcacaaaatcgcaga

SEQ ID NO: 105084 - DNA, 25 bp, Homo sapien
aattgctgctgtgagccgcaagacg

SEQ ID NO: 105085 - DNA, 25 bp, Homo sapien
ccgcaagacgttcgcaggctctgct

SEQ ID NO: 105086 - DNA, 25 bp, Homo sapien
ctcgcggccagacaaggagccctga

SEQ ID NO: 105087 - DNA, 25 bp, Homo sapien
ctcgccgtcttgtcttgctggaggt

SEQ ID NO: 105088 - DNA, 25 bp, Homo sapien
caggtgcgttttggaaattgctgct

SEQ ID NO: 105089 - DNA, 25 bp, Homo sapien
ttcatcgtgatgcatctcccggcgc

SEQ ID NO: 105090 - DNA, 25 bp, Homo sapien
gaattctctccagggcgcctgcctg

SEQ ID NO: 105091 - DNA, 25 bp, Homo sapien
tgtgcctccctgtgaattctctcca

SEQ ID NO: 105092 - DNA, 25 bp, Homo sapien
tgctcacactggcagcgttggtgca

SEQ ID NO: 105093 - DNA, 25 bp, Homo sapien
gctctggcgcagtttttcatcgtga

SEQ ID NO: 105094 - DNA, 25 bp, Homo sapien
tctcggaaagttcccgccatgctct

SEQ ID NO: 105095 - DNA, 25 bp, Homo sapien
ctggaaacaacacgccctctcggaa

SEQ ID NO: 105096 - DNA, 25 bp, Homo sapien
ctggagcccatagagcgctcctttc

SEQ ID NO: 105097 - DNA, 25 bp, Homo sapien
tcagtctccgcaccacgaagagtcg

SEQ ID NO: 105098 - DNA, 25 bp, Homo sapien
acatttctgttggagtcctagggcc

SEQ ID NO: 105099 - DNA, 25 bp, Homo sapien
ccttgtcactacgtgtcgggctcgc

SEQ ID NO: 105100 - DNA, 25 bp, Homo sapien
ggatgactcggatctgccctctttg

SEQ ID NO: 105101 - DNA, 25 bp, Homo sapien
gatgacgtctgtagcctcgttgcca

SEQ ID NO: 105102 - DNA, 25 bp, Homo sapien
tcagcagccggacctttggcaaggc

SEQ ID NO: 105103 - DNA, 25 bp, Homo sapien
ccaggctaccgctgccgttcattga

SEQ ID NO: 105104 - DNA, 25 bp, Homo sapien
cctggagcaccggagtatataaata

SEQ ID NO: 105105 - DNA, 25 bp, Homo sapien
acgtccacctggtggagagacgcga

SEQ ID NO: 105106 - DNA, 25 bp, Homo sapien
agtcatcagcgcagcggcggatcct

SEQ ID NO: 105107 - DNA, 25 bp, Homo sapien
cgcctctcaggggtgcgagtcatca

SEQ ID NO: 105108 - DNA, 25 bp, Homo sapien
gctgacattcgccaaggacaggatg

SEQ ID NO: 105109 - DNA, 25 bp, Homo sapien
gtcccgggacagaccagtgaccatc

SEQ ID NO: 105110 - DNA, 25 bp, Homo sapien
tcgcgccgctgacattcgccaagga

SEQ ID NO: 105111 - DNA, 25 bp, Homo sapien
agccatgcagacaggggctgctccg

SEQ ID NO: 105112 - DNA, 25 bp, Homo sapien
gggacagaccagtgaccatccgcct

SEQ ID NO: 105113 - DNA, 25 bp, Homo sapien
gcttcgagtgaagcgcaccacgtgg

SEQ ID NO: 105114 - DNA, 25 bp, Homo sapien
tcgatggtaatgtcgtccgtgccca

SEQ ID NO: 105115 - DNA, 25 bp, Homo sapien
accacgtggtatttgccgtcgctta

SEQ ID NO: 105116 - DNA, 25 bp, Homo sapien
taccgctcgttgaccggccagctgt

SEQ ID NO: 105117 - DNA, 25 bp, Homo sapien
ctacctgccgggtaccgctcgttga

SEQ ID NO: 105118 - DNA, 25 bp, Homo sapien
gtgcggccgcactcctatcagaggc

SEQ ID NO: 105119 - DNA, 25 bp, Homo sapien
tcgcaagcttcgtctctccagtagc

SEQ ID NO: 105120 - DNA, 25 bp, Homo sapien
cgtcgcttactatggcgttgggctc

SEQ ID NO: 105121 - DNA, 25 bp, Homo sapien
cggcgtcgtactggctgtccacgat

SEQ ID NO: 105122 - DNA, 25 bp, Homo sapien
gctgtccacgatgtctgtggccgcg

SEQ ID NO: 105123 - DNA, 25 bp, Homo sapien
tccacgatgtctgtggccgcggccg

SEQ ID NO: 105124 - DNA, 25 bp, Homo sapien
gccgccccttcgtacagtggggatc

SEQ ID NO: 105125 - DNA, 25 bp, Homo sapien
agcccgttggacacggctgctgcct

SEQ ID NO: 105126 - DNA, 25 bp, Homo sapien
cgtcgtactggctgtccacgatgtc

SEQ ID NO: 105127 - DNA, 25 bp, Homo sapien
actggctgtccacgatgtctgtggc

SEQ ID NO: 105128 - DNA, 25 bp, Homo sapien
gtactggctgtccacgatgtctgtg

SEQ ID NO: 105129 - DNA, 25 bp, Homo sapien
gctcccgcacgcctgtttcatgtaa

SEQ ID NO: 105130 - DNA, 25 bp, Homo sapien
aacaggacttgttgccgaggtcagc

SEQ ID NO: 105131 - DNA, 25 bp, Homo sapien
ccgcggctctcaccatctggaaaag

SEQ ID NO: 105132 - DNA, 25 bp, Homo sapien
ctccagtctggcagtttccggtgca

SEQ ID NO: 105133 - DNA, 25 bp, Homo sapien
tctctggggaccgaaattcagtgcc

SEQ ID NO: 105134 - DNA, 25 bp, Homo sapien
tgtttgcacctccatcaaagcggcg

SEQ ID NO: 105135 - DNA, 25 bp, Homo sapien
cgagagcggccatatcagacccagc

SEQ ID NO: 105136 - DNA, 25 bp, Homo sapien
tctcgccgcagtagtagtgctgttc

SEQ ID NO: 105137 - DNA, 25 bp, Homo sapien
tgtgcggaattccactttcacctga

SEQ ID NO: 105138 - DNA, 25 bp, Homo sapien
gcttacctcgttcgctcccttgtga

SEQ ID NO: 105139 - DNA, 25 bp, Homo sapien
aggtctgggagacaccgaccgcctt

SEQ ID NO: 105140 - DNA, 25 bp, Homo sapien
atcctgcctctctgtcctaaaaaca

SEQ ID NO: 105141 - DNA, 25 bp, Homo sapien
tccctccttttagattttgcaacag

SEQ ID NO: 105142 - DNA, 25 bp, Homo sapien
gctggagtcggacctaattcctgtt

SEQ ID NO: 105143 - DNA, 25 bp, Homo sapien
aagctccggcgtcttgtgtgtttca

SEQ ID NO: 105144 - DNA, 25 bp, Homo sapien
tttcacctgagcgtcctttgggatg

SEQ ID NO: 105145 - DNA, 25 bp, Homo sapien
aaacgacagttcatcctccggggtg

SEQ ID NO: 105146 - DNA, 25 bp, Homo sapien
gggtagctcccaggcaaaggccctc

SEQ ID NO: 105147 - DNA, 25 bp, Homo sapien
gacacctgacagctcgttttaactc

SEQ ID NO: 105148 - DNA, 25 bp, Homo sapien
gcagtggtttgtccagcaaggatta

SEQ ID NO: 105149 - DNA, 25 bp, Homo sapien
caaatgttcctttggcgccctccaa

SEQ ID NO: 105150 - DNA, 25 bp, Homo sapien
gcgcctttgaagtcgtttctcatta

SEQ ID NO: 105151 - DNA, 25 bp, Homo sapien
tgtttttctgaatccgcttcctagg

SEQ ID NO: 105152 - DNA, 25 bp, Homo sapien
tgccttttcccgtctaaacttctga

SEQ ID NO: 105153 - DNA, 25 bp, Homo sapien
gggcgctcgttgtcctttaagtgga

SEQ ID NO: 105154 - DNA, 25 bp, Homo sapien
ctcggcacctgctgtgctctgtctg

SEQ ID NO: 105155 - DNA, 25 bp, Homo sapien
tggccaaggccatcttaccgagtgc

SEQ ID NO: 105156 - DNA, 25 bp, Homo sapien
tgcagtcaagccaggctcacccttg

SEQ ID NO: 105157 - DNA, 25 bp, Homo sapien
cgagtgtctcggaactctgtggttc

SEQ ID NO: 105158 - DNA, 25 bp, Homo sapien
caccgcagatgaggagagccacaaa

SEQ ID NO: 105159 - DNA, 25 bp, Homo sapien
cgtgtgctctttttctgcggcatga

SEQ ID NO: 105160 - DNA, 25 bp, Homo sapien
gaacgaggccctttgtctgaagtcc

SEQ ID NO: 105161 - DNA, 25 bp, Homo sapien
gttgagcagcgacaccttgagcatc

SEQ ID NO: 105162 - DNA, 25 bp, Homo sapien
cgaggtcgccgcataggtggtcctc

SEQ ID NO: 105163 - DNA, 25 bp, Homo sapien
tgagattcaggcagaagcgcgcagc

SEQ ID NO: 105164 - DNA, 25 bp, Homo sapien
cgacaccttgagcatcggccgcagg

SEQ ID NO: 105165 - DNA, 25 bp, Homo sapien
gtacctgtgccgctcgttgagcagc

SEQ ID NO: 105166 - DNA, 25 bp, Homo sapien
cgtactccacgtcgtcgtacctgtg

SEQ ID NO: 105167 - DNA, 25 bp, Homo sapien
gtgcacttgcgtaccaggccctcgt

SEQ ID NO: 105168 - DNA, 25 bp, Homo sapien
gctgcttctccagatgacgcttctg

SEQ ID NO: 105169 - DNA, 25 bp, Homo sapien
agctggcgcacagccattgagtgta

SEQ ID NO: 105170 - DNA, 25 bp, Homo sapien
attgagtgtagacccgactggggca

SEQ ID NO: 105171 - DNA, 25 bp, Homo sapien
ccctcgcctggaatcggagagcgga

SEQ ID NO: 105172 - DNA, 25 bp, Homo sapien
tggtggggctatcccttcccactgt

SEQ ID NO: 105173 - DNA, 25 bp, Homo sapien
cagcctttctctcggacccggtagt

SEQ ID NO: 105174 - DNA, 25 bp, Homo sapien
cgccgtagcaatgcgcgcatgctca

SEQ ID NO: 105175 - DNA, 25 bp, Homo sapien
cgcaagttcgctacctgcgcagtca

SEQ ID NO: 105176 - DNA, 25 bp, Homo sapien
actggggcacgaccactgaaccctg

SEQ ID NO: 105177 - DNA, 25 bp, Homo sapien
cagtgtcaccttggccaggagggac

SEQ ID NO: 105178 - DNA, 25 bp, Homo sapien
cccactccctgaaggggactcaatg

SEQ ID NO: 105179 - DNA, 25 bp, Homo sapien
tgaaaggcgcccactgtcaccggct

SEQ ID NO: 105180 - DNA, 25 bp, Homo sapien
gcttcggacatagtccgccgctttc

SEQ ID NO: 105181 - DNA, 25 bp, Homo sapien
cccggaaatccttgcttcggacata

SEQ ID NO: 105182 - DNA, 25 bp, Homo sapien
ccgctgccgtaaaacggctggggct

SEQ ID NO: 105183 - DNA, 25 bp, Homo sapien
cctcatgaggtagtcccggaaatcc

SEQ ID NO: 105184 - DNA, 25 bp, Homo sapien
cggcgctcgtcacctcatgaggtag

SEQ ID NO: 105185 - DNA, 25 bp, Homo sapien
cctgaggtgttctgtttagagcaaa

SEQ ID NO: 105186 - DNA, 25 bp, Homo sapien
cgaccggcttcataattggaaaaca

SEQ ID NO: 105187 - DNA, 25 bp, Homo sapien
aagccatgtatgagaggacccgcgg

SEQ ID NO: 105188 - DNA, 25 bp, Homo sapien
ctccctgctggacttgtggtcactc

SEQ ID NO: 105189 - DNA, 25 bp, Homo sapien
ggccatcgcgccctgcaaaacagaa

SEQ ID NO: 105190 - DNA, 25 bp, Homo sapien
gagtctcttcatgcctctgcgctga

SEQ ID NO: 105191 - DNA, 25 bp, Homo sapien
ctgagccaggttggatgacagcacg

SEQ ID NO: 105192 - DNA, 25 bp, Homo sapien
tctctcggcagaaacagaagccatg

SEQ ID NO: 105193 - DNA, 25 bp, Homo sapien
ccagagtcggctgtgtttggaaata

SEQ ID NO: 105194 - DNA, 25 bp, Homo sapien
aggaggaggcgctcctgctacaccc

SEQ ID NO: 105195 - DNA, 25 bp, Homo sapien
ctccagactagcgaagcgtcgttaa

SEQ ID NO: 105196 - DNA, 25 bp, Homo sapien
ccctggactaatgtgaccagagtcg

SEQ ID NO: 105197 - DNA, 25 bp, Homo sapien
ctagagccaggtgtcggccctcaaa

SEQ ID NO: 105198 - DNA, 25 bp, Homo sapien
cccgggctcatcttcagtgtcctga

SEQ ID NO: 105199 - DNA, 25 bp, Homo sapien
gacgcagcgtcccactggtgctctt

SEQ ID NO: 105200 - DNA, 25 bp, Homo sapien
tgaaattctgcagcgcgacccggca

SEQ ID NO: 105201 - DNA, 25 bp, Homo sapien
gctgggcgggtctgttaaagcctaa

SEQ ID NO: 105202 - DNA, 25 bp, Homo sapien
agacccagcgtagagaggcagaccc

SEQ ID NO: 105203 - DNA, 25 bp, Homo sapien
tgaaggcacaaagacagaccaggga

SEQ ID NO: 105204 - DNA, 25 bp, Homo sapien
agccgttctcacactgctgccagtt

SEQ ID NO: 105205 - DNA, 25 bp, Homo sapien
gcggagagacacttcttgggcagaa

SEQ ID NO: 105206 - DNA, 25 bp, Homo sapien
cggcagtaattaccctggggagaca

SEQ ID NO: 105207 - DNA, 25 bp, Homo sapien
tgggatttatcacccagccgttctc

SEQ ID NO: 105208 - DNA, 25 bp, Homo sapien
gcctaagggcgtttattacactgtg

SEQ ID NO: 105209 - DNA, 25 bp, Homo sapien
ctgcgcgcaagagccctgtgcatat

SEQ ID NO: 105210 - DNA, 25 bp, Homo sapien
caggaagacatcaggacagaggtct

SEQ ID NO: 105211 - DNA, 25 bp, Homo sapien
gaggtctagacgcttacaaccctga

SEQ ID NO: 105212 - DNA, 25 bp, Homo sapien
gccctgtgcatatggactccgattg

SEQ ID NO: 105213 - DNA, 25 bp, Homo sapien
gggctccaatcgatgccatcagatt

SEQ ID NO: 105214 - DNA, 25 bp, Homo sapien
ccctgagagacacactggacgctgc

SEQ ID NO: 105215 - DNA, 25 bp, Homo sapien
catcgatgccatcagattcgcgcac

SEQ ID NO: 105216 - DNA, 25 bp, Homo sapien
ggactccgattgacgccatcagatt

SEQ ID NO: 105217 - DNA, 25 bp, Homo sapien
agcttggggccgtcattatgttttc

SEQ ID NO: 105218 - DNA, 25 bp, Homo sapien
cctgcgcacggcgaacttcttcatg

SEQ ID NO: 105219 - DNA, 25 bp, Homo sapien
cgcgggcgttcctgtcacgcaactt

SEQ ID NO: 105220 - DNA, 25 bp, Homo sapien
acttcttcatgctcaggtccatcgc

SEQ ID NO: 105221 - DNA, 25 bp, Homo sapien
acctaatgagcctcggcccgggaca

SEQ ID NO: 105222 - DNA, 25 bp, Homo sapien
ttcctacaagaaccagctccgtgca

SEQ ID NO: 105223 - DNA, 25 bp, Homo sapien
ttcctgcgcaggtacacagagaaga

SEQ ID NO: 105224 - DNA, 25 bp, Homo sapien
tggagctcttggagcgcgacttcct

SEQ ID NO: 105225 - DNA, 25 bp, Homo sapien
tgcacacctacgcatcaccacatat

SEQ ID NO: 105226 - DNA, 25 bp, Homo sapien
gcacacctacgcatcaccacatatg

SEQ ID NO: 105227 - DNA, 25 bp, Homo sapien
gcacacgtgcacacctacgcatcac

SEQ ID NO: 105228 - DNA, 25 bp, Homo sapien
tgcacacgtgcacacctacgcatca

SEQ ID NO: 105229 - DNA, 25 bp, Homo sapien
tgcacacgtgcacacctacgcataa

SEQ ID NO: 105230 - DNA, 25 bp, Homo sapien
gcacacctacgcataaccacatatg

SEQ ID NO: 105231 - DNA, 25 bp, Homo sapien
tacgcataaccacatatgcacacgt

SEQ ID NO: 105232 - DNA, 25 bp, Homo sapien
tacgcatcaccacatatgcacacgt

SEQ ID NO: 105233 - DNA, 25 bp, Homo sapien
cccagctgagctgcatcccgtagga

SEQ ID NO: 105234 - DNA, 25 bp, Homo sapien
tgcatcccgtaggagcacacgccga

SEQ ID NO: 105235 - DNA, 25 bp, Homo sapien
cggatcgttgatgtcccagctgagc

SEQ ID NO: 105236 - DNA, 25 bp, Homo sapien
acctgaggcatctgcggatcgttga

SEQ ID NO: 105237 - DNA, 25 bp, Homo sapien
acacccggttcacttacctgaggca

SEQ ID NO: 105238 - DNA, 25 bp, Homo sapien
ttctccctccttcggatggacagcg

SEQ ID NO: 105239 - DNA, 25 bp, Homo sapien
ttcaagaactcgaatgccattctcc

SEQ ID NO: 105240 - DNA, 25 bp, Homo sapien
cgtccgcagactcttcaagaactcg

SEQ ID NO: 105241 - DNA, 25 bp, Homo sapien
cggaatctgtactgcgactttggca

SEQ ID NO: 105242 - DNA, 25 bp, Homo sapien
ttggcagagtaaacgctgcacttgc

SEQ ID NO: 105243 - DNA, 25 bp, Homo sapien
tgcacttgcagcttcgaattgaatt

SEQ ID NO: 105244 - DNA, 25 bp, Homo sapien
ccttaattggctctaaacgagggtg

SEQ ID NO: 105245 - DNA, 25 bp, Homo sapien
tgaggatgccgctgccatagaaact

SEQ ID NO: 105246 - DNA, 25 bp, Homo sapien
gaaactgcatagcaaccaagggctg

SEQ ID NO: 105247 - DNA, 25 bp, Homo sapien
ttcctgcggagcgttcaggagactc

SEQ ID NO: 105248 - DNA, 25 bp, Homo sapien
gccgggacagcacctcaggagaaga

SEQ ID NO: 105249 - DNA, 25 bp, Homo sapien
cataaagcggagcattgataaaccc

SEQ ID NO: 105250 - DNA, 25 bp, Homo sapien
gtgctgagaactgtgcttacgtttc

SEQ ID NO: 105251 - DNA, 25 bp, Homo sapien
cttacgtttctcaacataaagcgga

SEQ ID NO: 105252 - DNA, 25 bp, Homo sapien
tggccagagtcgcactagctgtgaa

SEQ ID NO: 105253 - DNA, 25 bp, Homo sapien
tagctgtgaaccaaacgacaggctg

SEQ ID NO: 105254 - DNA, 25 bp, Homo sapien
tgaccacgctgtgcagggctgaacg

SEQ ID NO: 105255 - DNA, 25 bp, Homo sapien
aaacgacaggctgcgcccagtcaga

SEQ ID NO: 105256 - DNA, 25 bp, Homo sapien
aagggccgtctcaaagaccagcctg

SEQ ID NO: 105257 - DNA, 25 bp, Homo sapien
cacacggggaagaacactgcgcgaa

SEQ ID NO: 105258 - DNA, 25 bp, Homo sapien
taacgccgagcaaacacacaggtgg

SEQ ID NO: 105259 - DNA, 25 bp, Homo sapien
cgcgctaaagcacacgggaaataac

SEQ ID NO: 105260 - DNA, 25 bp, Homo sapien
cgcgaacgcacagggtagagaattc

SEQ ID NO: 105261 - DNA, 25 bp, Homo sapien
ggagacgccgcacgaacacacagaa

SEQ ID NO: 105262 - DNA, 25 bp, Homo sapien
tcaacgcacggagaggagaacgcct

SEQ ID NO: 105263 - DNA, 25 bp, Homo sapien
cgtgaacacaatgcgggagaactcc

SEQ ID NO: 105264 - DNA, 25 bp, Homo sapien
accgcacaggtaggagaaagccatg

SEQ ID NO: 105265 - DNA, 25 bp, Homo sapien
ttcacccagtggaaagctctagggc

SEQ ID NO: 105266 - DNA, 25 bp, Homo sapien
gacttccgggagaaacgctgtctcc

SEQ ID NO: 105267 - DNA, 25 bp, Homo sapien
ggacggcctaaaccagtatctcgcg

SEQ ID NO: 105268 - DNA, 25 bp, Homo sapien
gcaaggtaactcaccgcaggcgctt

SEQ ID NO: 105269 - DNA, 25 bp, Homo sapien
acctgctgcccgaggaagacttccg

SEQ ID NO: 105270 - DNA, 25 bp, Homo sapien
agggccactctactctccagggaca

SEQ ID NO: 105271 - DNA, 25 bp, Homo sapien
ttcaggatcgtgcaccaagcgcgca

SEQ ID NO: 105272 - DNA, 25 bp, Homo sapien
acgcagcacccgctttcaaaaactg

SEQ ID NO: 105273 - DNA, 25 bp, Homo sapien
cgtcgataatatgactccggcgatc

SEQ ID NO: 105274 - DNA, 25 bp, Homo sapien
tcggcctggcacctttccggttagc

SEQ ID NO: 105275 - DNA, 25 bp, Homo sapien
gtgggctttaactacgtcgataata

SEQ ID NO: 105276 - DNA, 25 bp, Homo sapien
atttccgggtgacaacctgcagggc

SEQ ID NO: 105277 - DNA, 25 bp, Homo sapien
cgaccctaagtttcggcgctcagtg

SEQ ID NO: 105278 - DNA, 25 bp, Homo sapien
tcctgaaccgcatcaaggtgaggcc

SEQ ID NO: 105279 - DNA, 25 bp, Homo sapien
gcctcagaacgttatttccgggtga

SEQ ID NO: 105280 - DNA, 25 bp, Homo sapien
ggcttcaaagctcgcgcctcaggcg

SEQ ID NO: 105281 - DNA, 25 bp, Homo sapien
gttcagagccttgtgcacacagacc

SEQ ID NO: 105282 - DNA, 25 bp, Homo sapien
gaggcccatccctggcttgactgcg

SEQ ID NO: 105283 - DNA, 25 bp, Homo sapien
gacccactagggttagttcagagcc

SEQ ID NO: 105284 - DNA, 25 bp, Homo sapien
cctgcttccagaggcatcgtggaca

SEQ ID NO: 105285 - DNA, 25 bp, Homo sapien
cggctgttctcacgcatgctcagtg

SEQ ID NO: 105286 - DNA, 25 bp, Homo sapien
agggccgtatcctgcttccagaggc

SEQ ID NO: 105287 - DNA, 25 bp, Homo sapien
ctccctgagtgctgagagccacggt

SEQ ID NO: 105288 - DNA, 25 bp, Homo sapien
cttccctcacgtggagcggagagca

SEQ ID NO: 105289 - DNA, 25 bp, Homo sapien
caaaatcaactggatcccgccggga

SEQ ID NO: 105290 - DNA, 25 bp, Homo sapien
tcctgcggaaaaaccgagctgggga

SEQ ID NO: 105291 - DNA, 25 bp, Homo sapien
agagcgagggaaatcctgcggaaaa

SEQ ID NO: 105292 - DNA, 25 bp, Homo sapien
ccatcgcgaggagctaggggtctct

SEQ ID NO: 105293 - DNA, 25 bp, Homo sapien
cgcggagcggcaacgccaaggtcca

SEQ ID NO: 105294 - DNA, 25 bp, Homo sapien
ggtccggagccaacaaaatcaactg

SEQ ID NO: 105295 - DNA, 25 bp, Homo sapien
gcctcggtccggagccaacaaaatc

SEQ ID NO: 105296 - DNA, 25 bp, Homo sapien
tccaggatgcctgggtccatcgcga

SEQ ID NO: 105297 - DNA, 25 bp, Homo sapien
gtttttgtatcatttgcgtcgtgta

SEQ ID NO: 105298 - DNA, 25 bp, Homo sapien
ctccgagaagagctgagaggcctgc

SEQ ID NO: 105299 - DNA, 25 bp, Homo sapien
ggggcgagaatcacacactctggta

SEQ ID NO: 105300 - DNA, 25 bp, Homo sapien
taccaaaggcgcatttgtgtttttg

SEQ ID NO: 105301 - DNA, 25 bp, Homo sapien
ttgcgtcgtgtaaaaatagcgtccc

SEQ ID NO: 105302 - DNA, 25 bp, Homo sapien
cccgtaaagatgtgggctttgtcgc

SEQ ID NO: 105303 - DNA, 25 bp, Homo sapien
cactctggtaccaaaggcgcatttg

SEQ ID NO: 105304 - DNA, 25 bp, Homo sapien
cgctgggtgacgtggtatctctcac

SEQ ID NO: 105305 - DNA, 25 bp, Homo sapien
aatctcagcgagtgtcagcaggtga

SEQ ID NO: 105306 - DNA, 25 bp, Homo sapien
tggtcccttgagaagccactgtgcc

SEQ ID NO: 105307 - DNA, 25 bp, Homo sapien
ccgcctcttttcagtggtcccttga

SEQ ID NO: 105308 - DNA, 25 bp, Homo sapien
gtttgtttccagctacggtgcaatg

SEQ ID NO: 105309 - DNA, 25 bp, Homo sapien
gccatcctgggtgacgtgacctatt

SEQ ID NO: 105310 - DNA, 25 bp, Homo sapien
gtgacctatttgcagtcccttcgct

SEQ ID NO: 105311 - DNA, 25 bp, Homo sapien
gctccagccgctattgcagcgcgtg

SEQ ID NO: 105312 - DNA, 25 bp, Homo sapien
gcagcgcgtggcttctaaaatctca

SEQ ID NO: 105313 - DNA, 25 bp, Homo sapien
aaaggtgaatctgaccgcgttgacc

SEQ ID NO: 105314 - DNA, 25 bp, Homo sapien
ttttctgttcggagactcacggggc

SEQ ID NO: 105315 - DNA, 25 bp, Homo sapien
tttacagcctccctgcgaggggttc

SEQ ID NO: 105316 - DNA, 25 bp, Homo sapien
cgccggaacgggctttttcatgatg

SEQ ID NO: 105317 - DNA, 25 bp, Homo sapien
cgcgttgaccgcgttacttcagaga

SEQ ID NO: 105318 - DNA, 25 bp, Homo sapien
ttgcatggcacatgttggaaaggtg

SEQ ID NO: 105319 - DNA, 25 bp, Homo sapien
ctggaccacgtgtgcacatttctga

SEQ ID NO: 105320 - DNA, 25 bp, Homo sapien
ttcagagatgcgctgtgagctgctt

SEQ ID NO: 105321 - DNA, 25 bp, Homo sapien
acacacggcggctcatccacatatg

SEQ ID NO: 105322 - DNA, 25 bp, Homo sapien
caaccctccagacggcggctactcc

SEQ ID NO: 105323 - DNA, 25 bp, Homo sapien
cgcaaggcgtctccaaccctccaga

SEQ ID NO: 105324 - DNA, 25 bp, Homo sapien
gcggctcatccacatatgctggctc

SEQ ID NO: 105325 - DNA, 25 bp, Homo sapien
tctccaaccctccagacggcggcta

SEQ ID NO: 105326 - DNA, 25 bp, Homo sapien
agacggcggctactccacacacggc

SEQ ID NO: 105327 - DNA, 25 bp, Homo sapien
acacggcggctcatccacatatgct

SEQ ID NO: 105328 - DNA, 25 bp, Homo sapien
cacggcggctcatccacatatgctg

SEQ ID NO: 105329 - DNA, 25 bp, Homo sapien
tggctctgctgtttgggacgtgcca

SEQ ID NO: 105330 - DNA, 25 bp, Homo sapien
ggtgcgccaagcctccgcgtatgct

SEQ ID NO: 105331 - DNA, 25 bp, Homo sapien
gtgagtgtctcgcagtcttggctct

SEQ ID NO: 105332 - DNA, 25 bp, Homo sapien
ccctaactattgtgagtgtctcgca

SEQ ID NO: 105333 - DNA, 25 bp, Homo sapien
gtgcgccctagcctgaataaccgcg

SEQ ID NO: 105334 - DNA, 25 bp, Homo sapien
taggggtcagcccattttgggcctc

SEQ ID NO: 105335 - DNA, 25 bp, Homo sapien
gcccacgcctcctagttaggggtca

SEQ ID NO: 105336 - DNA, 25 bp, Homo sapien
gtatgctcgcgagcccaggcgcctt

SEQ ID NO: 105337 - DNA, 25 bp, Homo sapien
gtgactcctgcacccactgtcagga

SEQ ID NO: 105338 - DNA, 25 bp, Homo sapien
accctggagctcttcaacgtgcttc

SEQ ID NO: 105339 - DNA, 25 bp, Homo sapien
cttcatctctaggacgcatcgttca

SEQ ID NO: 105340 - DNA, 25 bp, Homo sapien
ttcaggccacagagctaacatacgg

SEQ ID NO: 105341 - DNA, 25 bp, Homo sapien
agtcacgatcactggagcacgttca

SEQ ID NO: 105342 - DNA, 25 bp, Homo sapien
tctcgacctgagattcaaggctcca

SEQ ID NO: 105343 - DNA, 25 bp, Homo sapien
agctggagaaccactgggcgactct

SEQ ID NO: 105344 - DNA, 25 bp, Homo sapien
ctaacatacggcaaacctggacctt

SEQ ID NO: 105345 - DNA, 25 bp, Homo sapien
tccagttccaaaggggtcatcacag

SEQ ID NO: 105346 - DNA, 25 bp, Homo sapien
tgccactgaactccactgctgacct

SEQ ID NO: 105347 - DNA, 25 bp, Homo sapien
ctccgccattgaccttccctgctga

SEQ ID NO: 105348 - DNA, 25 bp, Homo sapien
cccgctgaccttccgccgacctctg

SEQ ID NO: 105349 - DNA, 25 bp, Homo sapien
aggggtcatcacagagcactttgaa

SEQ ID NO: 105350 - DNA, 25 bp, Homo sapien
ctctgtctccagttccaaaggggtc

SEQ ID NO: 105351 - DNA, 25 bp, Homo sapien
cttcctctgtctccagttccaaagg

SEQ ID NO: 105352 - DNA, 25 bp, Homo sapien
gtcatcacagagcactttgaaaccc

SEQ ID NO: 105353 - DNA, 25 bp, Homo sapien
ggtggctgccctgaaaccagagctc

SEQ ID NO: 105354 - DNA, 25 bp, Homo sapien
cccgattggtcttcgtgtgccggcc

SEQ ID NO: 105355 - DNA, 25 bp, Homo sapien
cggcgaggatccaatccgggtcgct

SEQ ID NO: 105356 - DNA, 25 bp, Homo sapien
ggcttcctcggcgtctactacgtcg

SEQ ID NO: 105357 - DNA, 25 bp, Homo sapien
gtggaacatctcgttcgcgggctgc

SEQ ID NO: 105358 - DNA, 25 bp, Homo sapien
cccgcgagaagacgtggaacatctc

SEQ ID NO: 105359 - DNA, 25 bp, Homo sapien
gccgtgagtcccacacttaaaagcg

SEQ ID NO: 105360 - DNA, 25 bp, Homo sapien
cctggtttgttttgctccgagggtg

SEQ ID NO: 105361 - DNA, 25 bp, Homo sapien
cagtacattacagtcagcaaagagg

SEQ ID NO: 105362 - DNA, 25 bp, Homo sapien
agagcaaaccggaccgcagcgccga

SEQ ID NO: 105363 - DNA, 25 bp, Homo sapien
caggagctccagagcaaaccggacc

SEQ ID NO: 105364 - DNA, 25 bp, Homo sapien
atgctgagcaaggagatccaggagc

SEQ ID NO: 105365 - DNA, 25 bp, Homo sapien
cagcagcagatgcacatcgtggaca

SEQ ID NO: 105366 - DNA, 25 bp, Homo sapien
gagcgcagagacttgcagtacatta

SEQ ID NO: 105367 - DNA, 25 bp, Homo sapien
cacgatcgagcgcagagacttgcag

SEQ ID NO: 105368 - DNA, 25 bp, Homo sapien
atcgtggacatgctgagcaaggaga

SEQ ID NO: 105369 - DNA, 25 bp, Homo sapien
ggatgaaacgttcctcgacgcttga

SEQ ID NO: 105370 - DNA, 25 bp, Homo sapien
aacgttcctcgacgcttgaacaccg

SEQ ID NO: 105371 - DNA, 25 bp, Homo sapien
gacgcttgaacaccggcctcctgcc

SEQ ID NO: 105372 - DNA, 25 bp, Homo sapien
ccctgggtcttcctgctatttcttc

SEQ ID NO: 105373 - DNA, 25 bp, Homo sapien
ggtcttcctgctatttcttcctgcc

SEQ ID NO: 105374 - DNA, 25 bp, Homo sapien
gctccgcaagttgcgggagaacctg

SEQ ID NO: 105375 - DNA, 25 bp, Homo sapien
ccggtccaggagctccgcaagttgc

SEQ ID NO: 105376 - DNA, 25 bp, Homo sapien
cagaagggatgaaacgttcctcgac

SEQ ID NO: 105377 - DNA, 25 bp, Homo sapien
cgcctaacctgagaaatcaaggatt

SEQ ID NO: 105378 - DNA, 25 bp, Homo sapien
gtgtttataattcagccgtcgccta

SEQ ID NO: 105379 - DNA, 25 bp, Homo sapien
agccgtcgcctaacctgagaaatca

SEQ ID NO: 105380 - DNA, 25 bp, Homo sapien
atcaaggatttctgcgtcgtgcgcg

SEQ ID NO: 105381 - DNA, 25 bp, Homo sapien
cgtgcccgctgagctgagctctgct

SEQ ID NO: 105382 - DNA, 25 bp, Homo sapien
ggaccaggaagggatcatccttctt

SEQ ID NO: 105383 - DNA, 25 bp, Homo sapien
gatcatccttcttttgagggcacgg

SEQ ID NO: 105384 - DNA, 25 bp, Homo sapien
tggtcttacccgtgtttataattca

SEQ ID NO: 105385 - DNA, 25 bp, Homo sapien
cgccacctccttgggtttgctcgga

SEQ ID NO: 105386 - DNA, 25 bp, Homo sapien
cggattcgtcaattacagttgcgga

SEQ ID NO: 105387 - DNA, 25 bp, Homo sapien
acagttgcggaagaagactcgactc

SEQ ID NO: 105388 - DNA, 25 bp, Homo sapien
actcgactcgaagagcggtccgcca

SEQ ID NO: 105389 - DNA, 25 bp, Homo sapien
aagaagcctcgttatgcaagcggtg

SEQ ID NO: 105390 - DNA, 25 bp, Homo sapien
cggaccttctgtccacagtgctagg

SEQ ID NO: 105391 - DNA, 25 bp, Homo sapien
ccgccttgaggtgttcgctcagaga

SEQ ID NO: 105392 - DNA, 25 bp, Homo sapien
gaaacctcggatccctagctaaata

SEQ ID NO: 105393 - DNA, 25 bp, Homo sapien
gtctgcactgtgagctcctcgtggt

SEQ ID NO: 105394 - DNA, 25 bp, Homo sapien
gggccctgcaatgaaacggcttttc

SEQ ID NO: 105395 - DNA, 25 bp, Homo sapien
tgcttggcgtcaagggccctgcaat

SEQ ID NO: 105396 - DNA, 25 bp, Homo sapien
cggaggccagcatgttccactgcca

SEQ ID NO: 105397 - DNA, 25 bp, Homo sapien
actggaaggccgatctccacgtggt

SEQ ID NO: 105398 - DNA, 25 bp, Homo sapien
agctcctcgtggtggttccggtcac

SEQ ID NO: 105399 - DNA, 25 bp, Homo sapien
agccctggcgtctgcactgtgagct

SEQ ID NO: 105400 - DNA, 25 bp, Homo sapien
ttccggtcactggaaggccgatctc

SEQ ID NO: 105401 - DNA, 25 bp, Homo sapien
cggccgtctttgctccacagttagt

SEQ ID NO: 105402 - DNA, 25 bp, Homo sapien
catcgccgagtcacacgtgggcatc

SEQ ID NO: 105403 - DNA, 25 bp, Homo sapien
ttccgcttctgaggagcttcacacg

SEQ ID NO: 105404 - DNA, 25 bp, Homo sapien
tgcagcctcttcttcagtcccatga

SEQ ID NO: 105405 - DNA, 25 bp, Homo sapien
tcacgtgcgtggtatttctttcttc

SEQ ID NO: 105406 - DNA, 25 bp, Homo sapien
acgcgcaggctgatgatttctaaca

SEQ ID NO: 105407 - DNA, 25 bp, Homo sapien
cggaacacggtttctaacgcgcagg

SEQ ID NO: 105408 - DNA, 25 bp, Homo sapien
tcacacggagaatacggcgattttc

SEQ ID NO: 105409 - DNA, 25 bp, Homo sapien
agaagacaccttcaggcgtagcctc

SEQ ID NO: 105410 - DNA, 25 bp, Homo sapien
gccgcgggcaggtgagaagacacct

SEQ ID NO: 105411 - DNA, 25 bp, Homo sapien
gaagacaccttcaggcgtagcctcg

SEQ ID NO: 105412 - DNA, 25 bp, Homo sapien
gggcaggtgagaagacacctgaggc

SEQ ID NO: 105413 - DNA, 25 bp, Homo sapien
gcaggtgagaagacacctgaggcgt

SEQ ID NO: 105414 - DNA, 25 bp, Homo sapien
ctcgggcaggtgagaagacacctga

SEQ ID NO: 105415 - DNA, 25 bp, Homo sapien
gagaagacaccttcaggcgtagcct

SEQ ID NO: 105416 - DNA, 25 bp, Homo sapien
tgagaagacaccttcaggcgtagcc

SEQ ID NO: 105417 - DNA, 25 bp, Homo sapien
cttcgcagtgttcccagtgtgagct

SEQ ID NO: 105418 - DNA, 25 bp, Homo sapien
atttgccgacggaagcatatccagg

SEQ ID NO: 105419 - DNA, 25 bp, Homo sapien
acgtcccggacgtcggcttcgcagt

SEQ ID NO: 105420 - DNA, 25 bp, Homo sapien
ctgggcttagagatgcacgatgcac

SEQ ID NO: 105421 - DNA, 25 bp, Homo sapien
gtgagagcaggcgtcgtacattcca

SEQ ID NO: 105422 - DNA, 25 bp, Homo sapien
gtcgtacattccacggctgcgtttc

SEQ ID NO: 105423 - DNA, 25 bp, Homo sapien
gccgcgtctcttctcgtctgtgaga

SEQ ID NO: 105424 - DNA, 25 bp, Homo sapien
gctgcgtttccgtttggctctggaa

SEQ ID NO: 105425 - DNA, 25 bp, Homo sapien
agcggttccagccttctcgacagac

SEQ ID NO: 105426 - DNA, 25 bp, Homo sapien
ccaagaaagccggtcccgatgcagt

SEQ ID NO: 105427 - DNA, 25 bp, Homo sapien
tctatgaagaggtcccgcacacagc

SEQ ID NO: 105428 - DNA, 25 bp, Homo sapien
aggtctcggctacgcccatctatga

SEQ ID NO: 105429 - DNA, 25 bp, Homo sapien
cagtcacagatgaagcggttccagc

SEQ ID NO: 105430 - DNA, 25 bp, Homo sapien
gcttcagcgtctcccgggagcaaaa

SEQ ID NO: 105431 - DNA, 25 bp, Homo sapien
ggcagatgcacactgcttcagcgtc

SEQ ID NO: 105432 - DNA, 25 bp, Homo sapien
cggtcccgatgcagtcacagatgaa

SEQ ID NO: 105433 - DNA, 25 bp, Homo sapien
cccgagacgggcaccgtgtgaaaat

SEQ ID NO: 105434 - DNA, 25 bp, Homo sapien
accaagctgcctttgtagaggatgc

SEQ ID NO: 105435 - DNA, 25 bp, Homo sapien
gcaaggccggcgttgtgataaccaa

SEQ ID NO: 105436 - DNA, 25 bp, Homo sapien
gatgaagttcctctctgagcaaggc

SEQ ID NO: 105437 - DNA, 25 bp, Homo sapien
caagccttctttgtgtgtttgatga

SEQ ID NO: 105438 - DNA, 25 bp, Homo sapien
cgcgtgacactcgacaagccttctt

SEQ ID NO: 105439 - DNA, 25 bp, Homo sapien
tgtgaaaatggcagagcttccctct

SEQ ID NO: 105440 - DNA, 25 bp, Homo sapien
agctgctgccatagcgtgaccgaag

SEQ ID NO: 105441 - DNA, 25 bp, Homo sapien
gggaagcctcagtgccgagaacttg

SEQ ID NO: 105442 - DNA, 25 bp, Homo sapien
aaccaaagcgatgggtcctggcccg

SEQ ID NO: 105443 - DNA, 25 bp, Homo sapien
tgatgcacaaccaaagcgatgggtc

SEQ ID NO: 105444 - DNA, 25 bp, Homo sapien
ccggcggtgatgaacatgatgcaca

SEQ ID NO: 105445 - DNA, 25 bp, Homo sapien
gaacgtccggcggtgatgaacatga

SEQ ID NO: 105446 - DNA, 25 bp, Homo sapien
aaacacggcggctccaacatgtcgg

SEQ ID NO: 105447 - DNA, 25 bp, Homo sapien
cgtggtcgccttgcgaaccacgtct

SEQ ID NO: 105448 - DNA, 25 bp, Homo sapien
tccaacatgtcggtgaacgtccggc

SEQ ID NO: 105449 - DNA, 25 bp, Homo sapien
gtgcccggtgtccacatttccggtg

SEQ ID NO: 105450 - DNA, 25 bp, Homo sapien
tccacatttccggtgcccggtgtcc

SEQ ID NO: 105451 - DNA, 25 bp, Homo sapien
ttccggcgtcccgtgtccacatttc

SEQ ID NO: 105452 - DNA, 25 bp, Homo sapien
gtgtccacatttccggtgcccggtg

SEQ ID NO: 105453 - DNA, 25 bp, Homo sapien
gcgtcccgtgtccacatttccggtg

SEQ ID NO: 105454 - DNA, 25 bp, Homo sapien
ttccggtgcccggtgtccacatttc

SEQ ID NO: 105455 - DNA, 25 bp, Homo sapien
ccggtgcccggtgtccacatttccg

SEQ ID NO: 105456 - DNA, 25 bp, Homo sapien
cgtgtccacatttccggtgcccggt

SEQ ID NO: 105457 - DNA, 25 bp, Homo sapien
agtgttcctacagctgagcctctca

SEQ ID NO: 105458 - DNA, 25 bp, Homo sapien
gatgcagcgtcaactccagggccgc

SEQ ID NO: 105459 - DNA, 25 bp, Homo sapien
gctctgtcctcgcacggcacaaatg

SEQ ID NO: 105460 - DNA, 25 bp, Homo sapien
gcgcgagcatcggtgtctcacatca

SEQ ID NO: 105461 - DNA, 25 bp, Homo sapien
gcgagtgatcccaacagtgttccta

SEQ ID NO: 105462 - DNA, 25 bp, Homo sapien
tccggcgtctcgcatgtgacactac

SEQ ID NO: 105463 - DNA, 25 bp, Homo sapien
ttctcaggcagaatcgcagggcgcc

SEQ ID NO: 105464 - DNA, 25 bp, Homo sapien
cgcccaactgatgcgagtgatccca

SEQ ID NO: 105465 - DNA, 25 bp, Homo sapien
tgggcagcagcacgaggacatccct

SEQ ID NO: 105466 - DNA, 25 bp, Homo sapien
agccgcagttgctcccggctgggca

SEQ ID NO: 105467 - DNA, 25 bp, Homo sapien
aggccatcgcgtccattcccagggt

SEQ ID NO: 105468 - DNA, 25 bp, Homo sapien
gtcggctcctgctgactgcatgcag

SEQ ID NO: 105469 - DNA, 25 bp, Homo sapien
tgactgcatgcaggcctctcaggac

SEQ ID NO: 105470 - DNA, 25 bp, Homo sapien
tctcaggactgggttccatacatcg

SEQ ID NO: 105471 - DNA, 25 bp, Homo sapien
cgaggacatccctgtgttccgaggc

SEQ ID NO: 105472 - DNA, 25 bp, Homo sapien
ggcaccgccatgctgtcgttactcg

SEQ ID NO: 105473 - DNA, 25 bp, Homo sapien
gtcgaaccgtcctggaggtcacacg

SEQ ID NO: 105474 - DNA, 25 bp, Homo sapien
atcgctgcctgcgttgtcggtggat

SEQ ID NO: 105475 - DNA, 25 bp, Homo sapien
acggcggcatgcatttgaagccatc

SEQ ID NO: 105476 - DNA, 25 bp, Homo sapien
acggcctggacagcacactcggaac

SEQ ID NO: 105477 - DNA, 25 bp, Homo sapien
cccagagttgcctgtcccaggggtc

SEQ ID NO: 105478 - DNA, 25 bp, Homo sapien
tgaaactcgacagttagcgccactc

SEQ ID NO: 105479 - DNA, 25 bp, Homo sapien
atgggtgatgggacagttccagccc

SEQ ID NO: 105480 - DNA, 25 bp, Homo sapien
cagccttgcagaggcgatcgcgcca

SEQ ID NO: 105481 - DNA, 25 bp, Homo sapien
cccgaagacagcgttccagaggccg

SEQ ID NO: 105482 - DNA, 25 bp, Homo sapien
gccacggcttcaacacggttcatta

SEQ ID NO: 105483 - DNA, 25 bp, Homo sapien
ctcacgcctggtggtttccgcacat

SEQ ID NO: 105484 - DNA, 25 bp, Homo sapien
agcactttctcctcctttgcctgga

SEQ ID NO: 105485 - DNA, 25 bp, Homo sapien
ggtcgctggacacttgacccagctg

SEQ ID NO: 105486 - DNA, 25 bp, Homo sapien
tccttcatgtggttgccgtcagatg

SEQ ID NO: 105487 - DNA, 25 bp, Homo sapien
cggttcattaattgccagcgtgtgt

SEQ ID NO: 105488 - DNA, 25 bp, Homo sapien
cggttttcgctcgaggtccttcatg

SEQ ID NO: 105489 - DNA, 25 bp, Homo sapien
cattagggggaaatggctctgttcc

SEQ ID NO: 105490 - DNA, 25 bp, Homo sapien
ttcggtgggtttgaagcacacatta

SEQ ID NO: 105491 - DNA, 25 bp, Homo sapien
tcttgcttacagttgggcttcggtg

SEQ ID NO: 105492 - DNA, 25 bp, Homo sapien
gggcacgctggtcttgcttacagtt

SEQ ID NO: 105493 - DNA, 25 bp, Homo sapien
atttgcaggtccagccggcgccggt

SEQ ID NO: 105494 - DNA, 25 bp, Homo sapien
ctgtccagggtagccgggtccctct

SEQ ID NO: 105495 - DNA, 25 bp, Homo sapien
tagcgggttccagcggcgaacccgc

SEQ ID NO: 105496 - DNA, 25 bp, Homo sapien
tctgttcctgcaggtttgcgcagtc

SEQ ID NO: 105497 - DNA, 25 bp, Homo sapien
agggtcggccgcctcacgtgtcctg

SEQ ID NO: 105498 - DNA, 25 bp, Homo sapien
gcaaaggtcggccacctcacgtgtc

SEQ ID NO: 105499 - DNA, 25 bp, Homo sapien
acctgacgtccctgcctgcaagggt

SEQ ID NO: 105500 - DNA, 25 bp, Homo sapien
ctgtgcacctgacgtccctgcctgc

SEQ ID NO: 105501 - DNA, 25 bp, Homo sapien
agggtcggccacctcacgtgtcctg

SEQ ID NO: 105502 - DNA, 25 bp, Homo sapien
tgtgcacctgacgtcccgcctgcga

SEQ ID NO: 105503 - DNA, 25 bp, Homo sapien
cacctcacgtgtcctgcgctgtgca

SEQ ID NO: 105504 - DNA, 25 bp, Homo sapien
aaaggtcggccacctcacgtgtcct

SEQ ID NO: 105505 - DNA, 25 bp, Homo sapien
gtagtttggaacgtctggagatccc

SEQ ID NO: 105506 - DNA, 25 bp, Homo sapien
cccagtttggaacgtagcacagcgt

SEQ ID NO: 105507 - DNA, 25 bp, Homo sapien
ccagtctggagacgtagtttggaac

SEQ ID NO: 105508 - DNA, 25 bp, Homo sapien
tttggaacgtagcacagcgtgcgtg

SEQ ID NO: 105509 - DNA, 25 bp, Homo sapien
agcaggagggtccacacttgcgtgg

SEQ ID NO: 105510 - DNA, 25 bp, Homo sapien
cggggtctacgcttgcgtggggcag

SEQ ID NO: 105511 - DNA, 25 bp, Homo sapien
agaggcgctgcaggatccccagtct

SEQ ID NO: 105512 - DNA, 25 bp, Homo sapien
cgtagtttggaacgtctggagatcc

SEQ ID NO: 105513 - DNA, 25 bp, Homo sapien
aaccgcctgcacttgagactcaggg

SEQ ID NO: 105514 - DNA, 25 bp, Homo sapien
cacttgagactcaggggttcccaaa

SEQ ID NO: 105515 - DNA, 25 bp, Homo sapien
cgcctgcatttgagactcaccggtt

SEQ ID NO: 105516 - DNA, 25 bp, Homo sapien
ctgaaactcaccagttgccaaacca

SEQ ID NO: 105517 - DNA, 25 bp, Homo sapien
gaacttactggctcccagaccgctg

SEQ ID NO: 105518 - DNA, 25 bp, Homo sapien
agaccgctgcgcatgagactcgctg

SEQ ID NO: 105519 - DNA, 25 bp, Homo sapien
ggccctccagagactccggtgtcag

SEQ ID NO: 105520 - DNA, 25 bp, Homo sapien
ggggcgttactcacaacgcaggctc

SEQ ID NO: 105521 - DNA, 25 bp, Homo sapien
cgcccagccagaccctaatggaaga

SEQ ID NO: 105522 - DNA, 25 bp, Homo sapien
acttcacggtcttggccagactctc

SEQ ID NO: 105523 - DNA, 25 bp, Homo sapien
ccctttactcttcggaggcgctctg

SEQ ID NO: 105524 - DNA, 25 bp, Homo sapien
cgctctgaggattttgtggtgaaaa

SEQ ID NO: 105525 - DNA, 25 bp, Homo sapien
tcgcctgcgctggaatcgccatcgt

SEQ ID NO: 105526 - DNA, 25 bp, Homo sapien
aggccctcatcccttagtgcttgtc

SEQ ID NO: 105527 - DNA, 25 bp, Homo sapien
tggctcgcggaccttcaaagactgc

SEQ ID NO: 105528 - DNA, 25 bp, Homo sapien
tgtccactcctcgtcaagagcctga

SEQ ID NO: 105529 - DNA, 25 bp, Homo sapien
tcgttttgactttcaggtggcaacc

SEQ ID NO: 105530 - DNA, 25 bp, Homo sapien
gcagtgacaatcctcgctacgaatt

SEQ ID NO: 105531 - DNA, 25 bp, Homo sapien
cccaagcacaagtgcagtgacaatc

SEQ ID NO: 105532 - DNA, 25 bp, Homo sapien
gcaaccgcacggtgccacaggctgt

SEQ ID NO: 105533 - DNA, 25 bp, Homo sapien
ctgcggcacggtcatcttcgttttg

SEQ ID NO: 105534 - DNA, 25 bp, Homo sapien
cctgacaccggctgcgtctgtcatg

SEQ ID NO: 105535 - DNA, 25 bp, Homo sapien
agcgcgtgacacacatcagaaagtg

SEQ ID NO: 105536 - DNA, 25 bp, Homo sapien
aggctgtcgctgtcacccaagcaca

SEQ ID NO: 105537 - DNA, 25 bp, Homo sapien
catcatcttaccacatcacatcgtc

SEQ ID NO: 105538 - DNA, 25 bp, Homo sapien
tgggacacccatcatcttaccacat

SEQ ID NO: 105539 - DNA, 25 bp, Homo sapien
tcacatcgtcactgccgcgaacgtg

SEQ ID NO: 105540 - DNA, 25 bp, Homo sapien
atcatcttaccacatcacatcgtca

SEQ ID NO: 105541 - DNA, 25 bp, Homo sapien
acatcacatcgtcactgccgcgaac

SEQ ID NO: 105542 - DNA, 25 bp, Homo sapien
gtcactgccgcgaacgtgtgggaca

SEQ ID NO: 105543 - DNA, 25 bp, Homo sapien
cacatcgtcactgccgcgaacgtgt

SEQ ID NO: 105544 - DNA, 25 bp, Homo sapien
atcttaccacatcacatcgtcactg

SEQ ID NO: 105545 - DNA, 25 bp, Homo sapien
atgctcacccgaggggcacggctct

SEQ ID NO: 105546 - DNA, 25 bp, Homo sapien
cacggctctgagcatggaaggtagg

SEQ ID NO: 105547 - DNA, 25 bp, Homo sapien
tgctgcatgctcacccgaggggcac

SEQ ID NO: 105548 - DNA, 25 bp, Homo sapien
tgcagggtgctgcatgctcacccga

SEQ ID NO: 105549 - DNA, 25 bp, Homo sapien
cagggtgctgcatgctcacccgagg

SEQ ID NO: 105550 - DNA, 25 bp, Homo sapien
ggcacggctctgagcatggaaggta

SEQ ID NO: 105551 - DNA, 25 bp, Homo sapien
gcagggtgctgcatgctcacccgag

SEQ ID NO: 105552 - DNA, 25 bp, Homo sapien
agggtgctgcatgctcacccgaggg

SEQ ID NO: 105553 - DNA, 25 bp, Homo sapien
agcgcgtcagcctaaaaccgggatc

SEQ ID NO: 105554 - DNA, 25 bp, Homo sapien
cccagcacctgatcgtgttcataac

SEQ ID NO: 105555 - DNA, 25 bp, Homo sapien
tgttcataacgacagtgaccattta

SEQ ID NO: 105556 - DNA, 25 bp, Homo sapien
gaccatttatggagcacgtcctcta

SEQ ID NO: 105557 - DNA, 25 bp, Homo sapien
cacgtcctctaactctgctagtgca

SEQ ID NO: 105558 - DNA, 25 bp, Homo sapien
tgctagtgcagacacctcggcatta

SEQ ID NO: 105559 - DNA, 25 bp, Homo sapien
aggtcgtctggattcatgcagcgcg

SEQ ID NO: 105560 - DNA, 25 bp, Homo sapien
cccgctcaggattaaccacgcaaga

SEQ ID NO: 105561 - DNA, 25 bp, Homo sapien
ggactcacggtctccgaatcggttg

SEQ ID NO: 105562 - DNA, 25 bp, Homo sapien
ggatcttcttcttcagggccttgga

SEQ ID NO: 105563 - DNA, 25 bp, Homo sapien
gccttggaggccttaatacggcaca

SEQ ID NO: 105564 - DNA, 25 bp, Homo sapien
tcggctggaacctgcggatcttctt

SEQ ID NO: 105565 - DNA, 25 bp, Homo sapien
atagcccagtgccaggtcacagtcc

SEQ ID NO: 105566 - DNA, 25 bp, Homo sapien
gtctccgggatgactgacgggaacc

SEQ ID NO: 105567 - DNA, 25 bp, Homo sapien
aaccgcgggtcacactcggccgagt

SEQ ID NO: 105568 - DNA, 25 bp, Homo sapien
taatacggcacagcttgggcacggg

SEQ ID NO: 105569 - DNA, 25 bp, Homo sapien
tcacagtcactgaggtccgcgtgta

SEQ ID NO: 105570 - DNA, 25 bp, Homo sapien
cagcctgttctgatcctgcccgttg

SEQ ID NO: 105571 - DNA, 25 bp, Homo sapien
cgctgctcattcactgcttcgagga

SEQ ID NO: 105572 - DNA, 25 bp, Homo sapien
acggagacgatttagtgcactgttg

SEQ ID NO: 105573 - DNA, 25 bp, Homo sapien
cacctgggagcgagaaaaatgaaca

SEQ ID NO: 105574 - DNA, 25 bp, Homo sapien
cggcagggctctgtcaagatcacct

SEQ ID NO: 105575 - DNA, 25 bp, Homo sapien
cctgggacaccaggtcctgccgata

SEQ ID NO: 105576 - DNA, 25 bp, Homo sapien
agggcctcatttgcatttagacaca

SEQ ID NO: 105577 - DNA, 25 bp, Homo sapien
gaacagggtgtctctcccaaatctg

SEQ ID NO: 105578 - DNA, 25 bp, Homo sapien
tcagtgctgtaaccctgtaacgaac

SEQ ID NO: 105579 - DNA, 25 bp, Homo sapien
tcagtgcctgcaggtcagatcagtg

SEQ ID NO: 105580 - DNA, 25 bp, Homo sapien
tgtgcgcttcacctctaggcacctg

SEQ ID NO: 105581 - DNA, 25 bp, Homo sapien
cctccttggagaccgaactgcattc

SEQ ID NO: 105582 - DNA, 25 bp, Homo sapien
ctgcattccattcaaatcccaaagg

SEQ ID NO: 105583 - DNA, 25 bp, Homo sapien
acacacagtcgctgccgaaggagca

SEQ ID NO: 105584 - DNA, 25 bp, Homo sapien
cgggcagttttcagggtcctcacct

SEQ ID NO: 105585 - DNA, 25 bp, Homo sapien
tgctgatcgtcctgctgctgatggt

SEQ ID NO: 105586 - DNA, 25 bp, Homo sapien
gtgtgtacccgtgcttaccctctgt

SEQ ID NO: 105587 - DNA, 25 bp, Homo sapien
ctgacatctggcatccctggggtct

SEQ ID NO: 105588 - DNA, 25 bp, Homo sapien
gtagtccctgcgagacaacgccgtc

SEQ ID NO: 105589 - DNA, 25 bp, Homo sapien
gcagagccgcccgagaatgaaagca

SEQ ID NO: 105590 - DNA, 25 bp, Homo sapien
tggttgaaatctcactggcgcctca

SEQ ID NO: 105591 - DNA, 25 bp, Homo sapien
ctctctcgccgtacttcatcgatta

SEQ ID NO: 105592 - DNA, 25 bp, Homo sapien
taggtgcacgagcaaccagtttttc

SEQ ID NO: 105593 - DNA, 25 bp, Homo sapien
ccgggcacacggacgcctgaggtaa

SEQ ID NO: 105594 - DNA, 25 bp, Homo sapien
acgctgggaacgttggtcacgacac

SEQ ID NO: 105595 - DNA, 25 bp, Homo sapien
cacgacacggagtctctgggaggtt

SEQ ID NO: 105596 - DNA, 25 bp, Homo sapien
ccacacagggcacgggagcctgttc

SEQ ID NO: 105597 - DNA, 25 bp, Homo sapien
cgggagcctgttcagtctcctcttc

SEQ ID NO: 105598 - DNA, 25 bp, Homo sapien
cctcttctgaatacgagggcttgca

SEQ ID NO: 105599 - DNA, 25 bp, Homo sapien
cacaaaattcgtttccgggcacacg

SEQ ID NO: 105600 - DNA, 25 bp, Homo sapien
tgcaggagggaccaacacaaaattc

SEQ ID NO: 105601 - DNA, 25 bp, Homo sapien
acccggatgtgatgtcagcggcgca

SEQ ID NO: 105602 - DNA, 25 bp, Homo sapien
agcaggtgcctcctctctgagtggc

SEQ ID NO: 105603 - DNA, 25 bp, Homo sapien
gagtggacgtgcacagaggtctcca

SEQ ID NO: 105604 - DNA, 25 bp, Homo sapien
tttccaaggcgtcttggcgagtcca

SEQ ID NO: 105605 - DNA, 25 bp, Homo sapien
ccactgggatgcagaaagagtcctg

SEQ ID NO: 105606 - DNA, 25 bp, Homo sapien
cgggctggaaccctcctctgggtct

SEQ ID NO: 105607 - DNA, 25 bp, Homo sapien
tgggacccttctccttgtctgtgcc

SEQ ID NO: 105608 - DNA, 25 bp, Homo sapien
agaggtctccacaactccctgcaag

SEQ ID NO: 105609 - DNA, 25 bp, Homo sapien
tcgctgcagaacttgccgccgaagc

SEQ ID NO: 105610 - DNA, 25 bp, Homo sapien
gctgaagctgagctcgccgctgctc

SEQ ID NO: 105611 - DNA, 25 bp, Homo sapien
tcaggcttcagagccgcgggcgcat

SEQ ID NO: 105612 - DNA, 25 bp, Homo sapien
cggctcgtacttgacggtgctcagc

SEQ ID NO: 105613 - DNA, 25 bp, Homo sapien
gctcgcccagcttcaggttggccaa

SEQ ID NO: 105614 - DNA, 25 bp, Homo sapien
cgggtcagcagcaccatgtgccagc

SEQ ID NO: 105615 - DNA, 25 bp, Homo sapien
ctcggcgcacgaaagcgtgaagcgc

SEQ ID NO: 105616 - DNA, 25 bp, Homo sapien
gatgccgcccacgaacaggtcgctg

SEQ ID NO: 105617 - DNA, 25 bp, Homo sapien
ggtgccatcataatctctgtgtaga

SEQ ID NO: 105618 - DNA, 25 bp, Homo sapien
ttctcacatgggaaaggtgccatca

SEQ ID NO: 105619 - DNA, 25 bp, Homo sapien
agggacattcttggcacccagctga

SEQ ID NO: 105620 - DNA, 25 bp, Homo sapien
taccgtgcaggtggattaggacagc

SEQ ID NO: 105621 - DNA, 25 bp, Homo sapien
tgcacgtgacctgggacacatgctc

SEQ ID NO: 105622 - DNA, 25 bp, Homo sapien
cacatgctcacaggaaaagggtttg

SEQ ID NO: 105623 - DNA, 25 bp, Homo sapien
aaagggtttgttctgggcatgccta

SEQ ID NO: 105624 - DNA, 25 bp, Homo sapien
tttcctagcgttttctgggtctcta

SEQ ID NO: 105625 - DNA, 25 bp, Homo sapien
attccacaggagtgtgtacgcgggc

SEQ ID NO: 105626 - DNA, 25 bp, Homo sapien
gtgatggattccacaggagtgtgta

SEQ ID NO: 105627 - DNA, 25 bp, Homo sapien
caccaatgtgatggattccacagga

SEQ ID NO: 105628 - DNA, 25 bp, Homo sapien
gcgtgtacaccaatgtgatggattc

SEQ ID NO: 105629 - DNA, 25 bp, Homo sapien
ctaatgtctataagggcgcggtgga

SEQ ID NO: 105630 - DNA, 25 bp, Homo sapien
ccggagcgtgtacaccaatgtgatg

SEQ ID NO: 105631 - DNA, 25 bp, Homo sapien
ggctctgccggagcgtgtacaccaa

SEQ ID NO: 105632 - DNA, 25 bp, Homo sapien
tctgccggagcgtgtacaccaatgt

SEQ ID NO: 105633 - DNA, 25 bp, Homo sapien
gatccttcagcacctctgagaggca

SEQ ID NO: 105634 - DNA, 25 bp, Homo sapien
atccttcagcacctctgagaggcaa

SEQ ID NO: 105635 - DNA, 25 bp, Homo sapien
ctggagcgccgctgatccttcagca

SEQ ID NO: 105636 - DNA, 25 bp, Homo sapien
tggagcgccgctgatccttcagcac

SEQ ID NO: 105637 - DNA, 25 bp, Homo sapien
cgctgatccttcagcacctctgaga

SEQ ID NO: 105638 - DNA, 25 bp, Homo sapien
gctgatccttcagcacctctgagag

SEQ ID NO: 105639 - DNA, 25 bp, Homo sapien
ctgatccttcagcacctctgagagg

SEQ ID NO: 105640 - DNA, 25 bp, Homo sapien
tgatccttcagcacctctgagaggc

SEQ ID NO: 105641 - DNA, 25 bp, Homo sapien
cccgctccacctctcgctccgcaga

SEQ ID NO: 105642 - DNA, 25 bp, Homo sapien
ggacaggccactgcgcagccctggt

SEQ ID NO: 105643 - DNA, 25 bp, Homo sapien
aagctccggggtatttgacaggagc

SEQ ID NO: 105644 - DNA, 25 bp, Homo sapien
tgtggatgaaaagtcccgctgggct

SEQ ID NO: 105645 - DNA, 25 bp, Homo sapien
acctctgagaggcaatgttctgggc

SEQ ID NO: 105646 - DNA, 25 bp, Homo sapien
cttggcgttaacctttgtggatgaa

SEQ ID NO: 105647 - DNA, 25 bp, Homo sapien
ccaaggcttggcgttaacctttgtg

SEQ ID NO: 105648 - DNA, 25 bp, Homo sapien
gaaaagtcccgctgggctgatcctg

SEQ ID NO: 105649 - DNA, 25 bp, Homo sapien
tggagcgtgttctcccgaccgcttt

SEQ ID NO: 105650 - DNA, 25 bp, Homo sapien
ctctgacccggctgtgagaggatcc

SEQ ID NO: 105651 - DNA, 25 bp, Homo sapien
cactcgtgggtctgactctcccaga

SEQ ID NO: 105652 - DNA, 25 bp, Homo sapien
ccgaggaagaagcagatgaggttac

SEQ ID NO: 105653 - DNA, 25 bp, Homo sapien
ttacagatgattcttcacgggcctg

SEQ ID NO: 105654 - DNA, 25 bp, Homo sapien
ggttcttcctcgtggcagggatgct

SEQ ID NO: 105655 - DNA, 25 bp, Homo sapien
tcccttctcaggacagaactggagg

SEQ ID NO: 105656 - DNA, 25 bp, Homo sapien
cacgggcctgagtgttattagagaa

SEQ ID NO: 105657 - DNA, 25 bp, Homo sapien
tctctggaggttttcccatcgcatg

SEQ ID NO: 105658 - DNA, 25 bp, Homo sapien
cgaggagccggttcagagaaaccca

SEQ ID NO: 105659 - DNA, 25 bp, Homo sapien
tgtttccgtcgagctcgtcctcgta

SEQ ID NO: 105660 - DNA, 25 bp, Homo sapien
cgtcctcgtactcagcggcctagaa

SEQ ID NO: 105661 - DNA, 25 bp, Homo sapien
tagaaacaggccagagagctccaca

SEQ ID NO: 105662 - DNA, 25 bp, Homo sapien
tcggaattccacagcctcgccttgg

SEQ ID NO: 105663 - DNA, 25 bp, Homo sapien
ctctgtcctcgcgtctctagaacga

SEQ ID NO: 105664 - DNA, 25 bp, Homo sapien
ttcccatcgcatgagtgtttccgtc

SEQ ID NO: 105665 - DNA, 25 bp, Homo sapien
gaccaatgcgcagtgacagtgatcc

SEQ ID NO: 105666 - DNA, 25 bp, Homo sapien
tgacagtgatcctggggacacgtga

SEQ ID NO: 105667 - DNA, 25 bp, Homo sapien
agggagaccaatgcgcagtgacagt

SEQ ID NO: 105668 - DNA, 25 bp, Homo sapien
tgatcctggggacacgtgaggaata

SEQ ID NO: 105669 - DNA, 25 bp, Homo sapien
agacgcatgagcagtgacagggatc

SEQ ID NO: 105670 - DNA, 25 bp, Homo sapien
cgcatgagcagtgacagggatcctg

SEQ ID NO: 105671 - DNA, 25 bp, Homo sapien
ggatcctggggacacgtgaggaata

SEQ ID NO: 105672 - DNA, 25 bp, Homo sapien
caatgcgcagtgacagtgatcctgg

SEQ ID NO: 105673 - DNA, 25 bp, Homo sapien
tcctttatttcacatcccacgcggg

SEQ ID NO: 105674 - DNA, 25 bp, Homo sapien
gcccggacacaccttcgctttagag

SEQ ID NO: 105675 - DNA, 25 bp, Homo sapien
ggaccgtcgagcttgatcctctacg

SEQ ID NO: 105676 - DNA, 25 bp, Homo sapien
cggtcctcctaaggccgaggcagca

SEQ ID NO: 105677 - DNA, 25 bp, Homo sapien
cgggcagtcccttaccagcagggtg

SEQ ID NO: 105678 - DNA, 25 bp, Homo sapien
ccatactcgggaaccaggggaagct

SEQ ID NO: 105679 - DNA, 25 bp, Homo sapien
ctcctttcctccagtgtccttgttg

SEQ ID NO: 105680 - DNA, 25 bp, Homo sapien
gcagccttgggatgattagctttta

SEQ ID NO: 105681 - DNA, 25 bp, Homo sapien
gtggtccctgaacgcgatgttcatt

SEQ ID NO: 105682 - DNA, 25 bp, Homo sapien
gcgtggtccctgaacgcgatgttca

SEQ ID NO: 105683 - DNA, 25 bp, Homo sapien
gcgatgttcatttcctgcccgcatc

SEQ ID NO: 105684 - DNA, 25 bp, Homo sapien
gaacgcgatgttcatttcctgcccg

SEQ ID NO: 105685 - DNA, 25 bp, Homo sapien
cgtggtccctgaacgcgatgttcac

SEQ ID NO: 105686 - DNA, 25 bp, Homo sapien
cttggacgcgatgctcatttccttc

SEQ ID NO: 105687 - DNA, 25 bp, Homo sapien
acgcgatgttcatttcctgcccgca

SEQ ID NO: 105688 - DNA, 25 bp, Homo sapien
ctccttggacgcgatgctcatttcc

SEQ ID NO: 105689 - DNA, 25 bp, Homo sapien
tgctgaggaacctcacgggtaattg

SEQ ID NO: 105690 - DNA, 25 bp, Homo sapien
acctcacgggtaattgacgcgcctg

SEQ ID NO: 105691 - DNA, 25 bp, Homo sapien
aggtcctgagcctctgggcccacgg

SEQ ID NO: 105692 - DNA, 25 bp, Homo sapien
ccatgatcaacctgtcggtgcagca

SEQ ID NO: 105693 - DNA, 25 bp, Homo sapien
gaccactccatgatcaacctgtcgg

SEQ ID NO: 105694 - DNA, 25 bp, Homo sapien
ctccgtccgccgtcctcaatgtctc

SEQ ID NO: 105695 - DNA, 25 bp, Homo sapien
tgcacctgccggctgcccatcagca

SEQ ID NO: 105696 - DNA, 25 bp, Homo sapien
gttcctcgagtgtcggcgacccgag

SEQ ID NO: 105697 - DNA, 25 bp, Homo sapien
cttccgggcatcactgaattccacg

SEQ ID NO: 105698 - DNA, 25 bp, Homo sapien
ggctcttccgggcatcactgaattc

SEQ ID NO: 105699 - DNA, 25 bp, Homo sapien
ctcttccgggcatcactgaattcca

SEQ ID NO: 105700 - DNA, 25 bp, Homo sapien
gaaacgcctgcagctggctcttccg

SEQ ID NO: 105701 - DNA, 25 bp, Homo sapien
gggcatcactgaattccacgctggg

SEQ ID NO: 105702 - DNA, 25 bp, Homo sapien
ggcatcactgaattccacgctgggg

SEQ ID NO: 105703 - DNA, 25 bp, Homo sapien
ggaaacgcctgcagctggctcttcc

SEQ ID NO: 105704 - DNA, 25 bp, Homo sapien
gggaaacgcctgcagctggctcttc

SEQ ID NO: 105705 - DNA, 25 bp, Homo sapien
acggccagcaggtcttcgcgcagcg

SEQ ID NO: 105706 - DNA, 25 bp, Homo sapien
tgcaacaccgactgacggcagcatc

SEQ ID NO: 105707 - DNA, 25 bp, Homo sapien
cgagacgcgcgcattggaccacgct

SEQ ID NO: 105708 - DNA, 25 bp, Homo sapien
cgcattggaccacgctgcgctgacg

SEQ ID NO: 105709 - DNA, 25 bp, Homo sapien
gcagcgcagccaatgcaagggctca

SEQ ID NO: 105710 - DNA, 25 bp, Homo sapien
caagggctcagaagccgccagtcca

SEQ ID NO: 105711 - DNA, 25 bp, Homo sapien
tgcctctccgaggaggatgctccgc

SEQ ID NO: 105712 - DNA, 25 bp, Homo sapien
ccagggctagcggtgtctgccgcct

SEQ ID NO: 105713 - DNA, 25 bp, Homo sapien
gtggggaaagcacagaatcttcttg

SEQ ID NO: 105714 - DNA, 25 bp, Homo sapien
accgcgagcacgagggcgtcggctg

SEQ ID NO: 105715 - DNA, 25 bp, Homo sapien
gggatttgaaggaagctctataaag

SEQ ID NO: 105716 - DNA, 25 bp, Homo sapien
gggtggggaaagcacagaatcttct

SEQ ID NO: 105717 - DNA, 25 bp, Homo sapien
gaatcttcttgaggccctgggctga

SEQ ID NO: 105718 - DNA, 25 bp, Homo sapien
acagaatcttcttgaggccctgggc

SEQ ID NO: 105719 - DNA, 25 bp, Homo sapien
gcacagaatcttcttgaggccctgg

SEQ ID NO: 105720 - DNA, 25 bp, Homo sapien
ggaaagcacagaatcttcttgaggc

SEQ ID NO: 105721 - DNA, 25 bp, Homo sapien
tgtgtgtatccctgccgtgatgtgt

SEQ ID NO: 105722 - DNA, 25 bp, Homo sapien
tgtgacatgtgtgacaccacgtggg

SEQ ID NO: 105723 - DNA, 25 bp, Homo sapien
tgtccctgctgtgacatgtgtgaca

SEQ ID NO: 105724 - DNA, 25 bp, Homo sapien
ccggcgtgtccctgctgtgatgtgt

SEQ ID NO: 105725 - DNA, 25 bp, Homo sapien
gtgacatgtgtgacaccacgtgggg

SEQ ID NO: 105726 - DNA, 25 bp, Homo sapien
ggcacgtccctgctgtgacatgtgt

SEQ ID NO: 105727 - DNA, 25 bp, Homo sapien
tccctgctgtgacatgtgtgacacc

SEQ ID NO: 105728 - DNA, 25 bp, Homo sapien
acatgtgtgacaccacgtggggccg

SEQ ID NO: 105729 - DNA, 25 bp, Homo sapien
tgtgacaagtgtgacaccacgtggg

SEQ ID NO: 105730 - DNA, 25 bp, Homo sapien
ggctggtgtgtcactgctatgacgt

SEQ ID NO: 105731 - DNA, 25 bp, Homo sapien
cactgctatgacgtgtgtgacacca

SEQ ID NO: 105732 - DNA, 25 bp, Homo sapien
gtatctcagccatggtgtgcgaccc

SEQ ID NO: 105733 - DNA, 25 bp, Homo sapien
cgtgtgtatctcagccatggtgtgc

SEQ ID NO: 105734 - DNA, 25 bp, Homo sapien
cctgctgtgacgtgtgtatctcagc

SEQ ID NO: 105735 - DNA, 25 bp, Homo sapien
tgatgtgtgacaccatgtgaggccg

SEQ ID NO: 105736 - DNA, 25 bp, Homo sapien
ctgccgtgatgtgtgacaccatgtg

SEQ ID NO: 105737 - DNA, 25 bp, Homo sapien
cccggttgattggaaccgcgttcat

SEQ ID NO: 105738 - DNA, 25 bp, Homo sapien
cggtcatttccggagcgtcttccag

SEQ ID NO: 105739 - DNA, 25 bp, Homo sapien
ggcagcccggatgctgaatcccatt

SEQ ID NO: 105740 - DNA, 25 bp, Homo sapien
accgcgttcatttgaggaatgctcc

SEQ ID NO: 105741 - DNA, 25 bp, Homo sapien
ctgagctggaatctgccttttggcc

SEQ ID NO: 105742 - DNA, 25 bp, Homo sapien
caggcctctgagctactgagctgga

SEQ ID NO: 105743 - DNA, 25 bp, Homo sapien
tgacgccggctgagatgcagaatca

SEQ ID NO: 105744 - DNA, 25 bp, Homo sapien
ttgaggaatgctccctgcgaccaga

SEQ ID NO: 105745 - DNA, 25 bp, Homo sapien
cgttaaagggctcaccgtgcgtccg

SEQ ID NO: 105746 - DNA, 25 bp, Homo sapien
tttaaagcgcgccagcgccctctgg

SEQ ID NO: 105747 - DNA, 25 bp, Homo sapien
cgtccgcgtttaaagcgcgccagcg

SEQ ID NO: 105748 - DNA, 25 bp, Homo sapien
gcggcagaaccagggcttccaattc

SEQ ID NO: 105749 - DNA, 25 bp, Homo sapien
aaataattgcatggccggcgtcgcg

SEQ ID NO: 105750 - DNA, 25 bp, Homo sapien
cacaaataattgcatggccggcgtc

SEQ ID NO: 105751 - DNA, 25 bp, Homo sapien
gtgcgtccgttttatgccgtaatta

SEQ ID NO: 105752 - DNA, 25 bp, Homo sapien
tatgccgtaattatgtgcacaaata

SEQ ID NO: 105753 - DNA, 25 bp, Homo sapien
cgctgctagatttatcacttgagga

SEQ ID NO: 105754 - DNA, 25 bp, Homo sapien
ccgagcgacactgcggcattgattc

SEQ ID NO: 105755 - DNA, 25 bp, Homo sapien
aacgacgccgttgagttcgctgcta

SEQ ID NO: 105756 - DNA, 25 bp, Homo sapien
acgcacctctggaagcccttattta

SEQ ID NO: 105757 - DNA, 25 bp, Homo sapien
gcccttatttatgagctgctcagga

SEQ ID NO: 105758 - DNA, 25 bp, Homo sapien
gacatagccacgcagtttccagtaa

SEQ ID NO: 105759 - DNA, 25 bp, Homo sapien
ccgggcgcgcacaagatttacacac

SEQ ID NO: 105760 - DNA, 25 bp, Homo sapien
gaccctagtattgcgggaacaacga

SEQ ID NO: 105761 - DNA, 25 bp, Homo sapien
tgttcagcgtcgtggaggccacatt

SEQ ID NO: 105762 - DNA, 25 bp, Homo sapien
tcagctcagggcgtccttgatccgc

SEQ ID NO: 105763 - DNA, 25 bp, Homo sapien
tggtaatcagcgttgtggaggccac

SEQ ID NO: 105764 - DNA, 25 bp, Homo sapien
ccacgttggtagagtcatggaggca

SEQ ID NO: 105765 - DNA, 25 bp, Homo sapien
tcgtggaggccacgttgatagcatc

SEQ ID NO: 105766 - DNA, 25 bp, Homo sapien
ttgatagcatcatggaggcagcgtc

SEQ ID NO: 105767 - DNA, 25 bp, Homo sapien
cagcgtcatggaggcagtgttgata

SEQ ID NO: 105768 - DNA, 25 bp, Homo sapien
ataatcaacatcagctcagggcgtc

SEQ ID NO: 105769 - DNA, 25 bp, Homo sapien
cggagccacgggaacgcactggaaa

SEQ ID NO: 105770 - DNA, 25 bp, Homo sapien
aatctaggagtggaatagccgggcc

SEQ ID NO: 105771 - DNA, 25 bp, Homo sapien
gagccacgggaacgcactggaaatc

SEQ ID NO: 105772 - DNA, 25 bp, Homo sapien
gccacgggaacgcactggaaatcta

SEQ ID NO: 105773 - DNA, 25 bp, Homo sapien
cacgggaacgcactggaaatctagg

SEQ ID NO: 105774 - DNA, 25 bp, Homo sapien
acgggaacgcactggaaatctagga

SEQ ID NO: 105775 - DNA, 25 bp, Homo sapien
atctaggagtggaatagctgggccc

SEQ ID NO: 105776 - DNA, 25 bp, Homo sapien
atctaggagtggaatatttgggccc

SEQ ID NO: 105777 - DNA, 25 bp, Homo sapien
tgccggttttccgtgctgacggttc

SEQ ID NO: 105778 - DNA, 25 bp, Homo sapien
ccggttctcggtgctggttctcggt

SEQ ID NO: 105779 - DNA, 25 bp, Homo sapien
ctggttctcggtgctgccggttctc

SEQ ID NO: 105780 - DNA, 25 bp, Homo sapien
gccggttctcggtgctgccgattct

SEQ ID NO: 105781 - DNA, 25 bp, Homo sapien
ccggttctcggtgctgccggttctt

SEQ ID NO: 105782 - DNA, 25 bp, Homo sapien
gttctcggtgctgccgattctcggt

SEQ ID NO: 105783 - DNA, 25 bp, Homo sapien
ccggttctcggtgctgccggttctc

SEQ ID NO: 105784 - DNA, 25 bp, Homo sapien
ttctcggtgccgacggttctcggtg

SEQ ID NO: 105785 - DNA, 25 bp, Homo sapien
ctcgagttgttcacggtccggcgtg

SEQ ID NO: 105786 - DNA, 25 bp, Homo sapien
gggcacctggcaagcgtttttcgag

SEQ ID NO: 105787 - DNA, 25 bp, Homo sapien
gtttttcgaggcctccgtccatctg

SEQ ID NO: 105788 - DNA, 25 bp, Homo sapien
atgagccgcccgtgcctggtgcgct

SEQ ID NO: 105789 - DNA, 25 bp, Homo sapien
gatgcccggaggtttctaggacacc

SEQ ID NO: 105790 - DNA, 25 bp, Homo sapien
ttctaggacaccgaggctaccggtg

SEQ ID NO: 105791 - DNA, 25 bp, Homo sapien
ctaccggtgggtatcgaatgccctc

SEQ ID NO: 105792 - DNA, 25 bp, Homo sapien
aatgccctcgagttgttcacggtcc

SEQ ID NO: 105793 - DNA, 25 bp, Homo sapien
ggccgtcagtggacttgagttttaa

SEQ ID NO: 105794 - DNA, 25 bp, Homo sapien
tgagttttaaaaaggctcctgcggc

SEQ ID NO: 105795 - DNA, 25 bp, Homo sapien
aaaaaggctcctgcggcgtggtcct

SEQ ID NO: 105796 - DNA, 25 bp, Homo sapien
gctgcactccaacgtcctcccgaat

SEQ ID NO: 105797 - DNA, 25 bp, Homo sapien
ggaaggaaccactatggaggctgca

SEQ ID NO: 105798 - DNA, 25 bp, Homo sapien
tggaactcagccaccgagtcacctc

SEQ ID NO: 105799 - DNA, 25 bp, Homo sapien
ttctctgctgctccgtggaaaggcc

SEQ ID NO: 105800 - DNA, 25 bp, Homo sapien
tggtcctggccagcttctctgctgc

SEQ ID NO: 105801 - DNA, 25 bp, Homo sapien
tgctccgtgcctaactcaattctta

SEQ ID NO: 105802 - DNA, 25 bp, Homo sapien
cgctaaaacagaaattgcctccctg

SEQ ID NO: 105803 - DNA, 25 bp, Homo sapien
tttctgaaggccgtccaagcccgcg

SEQ ID NO: 105804 - DNA, 25 bp, Homo sapien
acctggctaagggtcggacatggaa

SEQ ID NO: 105805 - DNA, 25 bp, Homo sapien
ctcttggagaactagacaggcgaca

SEQ ID NO: 105806 - DNA, 25 bp, Homo sapien
tttcgtactttctccctgctccgtg

SEQ ID NO: 105807 - DNA, 25 bp, Homo sapien
cctcgaagcaaaagacgaccgccga

SEQ ID NO: 105808 - DNA, 25 bp, Homo sapien
gtttaccgcctgctttttccaagca

SEQ ID NO: 105809 - DNA, 25 bp, Homo sapien
ttcccgttggtgtccatggtggtca

SEQ ID NO: 105810 - DNA, 25 bp, Homo sapien
tcggatccggttgttgaactaaatc

SEQ ID NO: 105811 - DNA, 25 bp, Homo sapien
attaccgtaagtgaggatgtagagg

SEQ ID NO: 105812 - DNA, 25 bp, Homo sapien
agtgagcctggggattaccgtaagt

SEQ ID NO: 105813 - DNA, 25 bp, Homo sapien
ggacactgagtttcctgcgttcggg

SEQ ID NO: 105814 - DNA, 25 bp, Homo sapien
tgaggatgtaaacggacactgagtt

SEQ ID NO: 105815 - DNA, 25 bp, Homo sapien
ttagcctcgggattaccttaagtga

SEQ ID NO: 105816 - DNA, 25 bp, Homo sapien
cagagggttagcctcgggattacct

SEQ ID NO: 105817 - DNA, 25 bp, Homo sapien
tgtagccacctgctaagagaccctt

SEQ ID NO: 105818 - DNA, 25 bp, Homo sapien
cggtttccgaccatttggcttcaga

SEQ ID NO: 105819 - DNA, 25 bp, Homo sapien
aatcgtggctatctggagacgcggc

SEQ ID NO: 105820 - DNA, 25 bp, Homo sapien
cccgcacctcagtcttggtaatgta

SEQ ID NO: 105821 - DNA, 25 bp, Homo sapien
cgactttggatccagtgtagccacc

SEQ ID NO: 105822 - DNA, 25 bp, Homo sapien
ctggccgctgacctagtatggacac

SEQ ID NO: 105823 - DNA, 25 bp, Homo sapien
agagacccttaaacgccgcagtagg

SEQ ID NO: 105824 - DNA, 25 bp, Homo sapien
tctgcgagtgttccctgccgtaaca

SEQ ID NO: 105825 - DNA, 25 bp, Homo sapien
tgggtccgcagctaccatgcctcat

SEQ ID NO: 105826 - DNA, 25 bp, Homo sapien
cggggtcaagaatccagaggtcatt

SEQ ID NO: 105827 - DNA, 25 bp, Homo sapien
taccaggggtgcatcatgaggaaca

SEQ ID NO: 105828 - DNA, 25 bp, Homo sapien
agatagcgagttcctccggattccc

SEQ ID NO: 105829 - DNA, 25 bp, Homo sapien
catgaggaacatgcgcaccagctgc

SEQ ID NO: 105830 - DNA, 25 bp, Homo sapien
ctcatctgtctgaagggcgtgcatc

SEQ ID NO: 105831 - DNA, 25 bp, Homo sapien
tttcgttaaagagactgcacgctgc

SEQ ID NO: 105832 - DNA, 25 bp, Homo sapien
gagccactcaccgaaggcttcgatg

SEQ ID NO: 105833 - DNA, 25 bp, Homo sapien
ccttgagaatcacttggcctctggg

SEQ ID NO: 105834 - DNA, 25 bp, Homo sapien
cgtgctgttcacttgagccaggcca

SEQ ID NO: 105835 - DNA, 25 bp, Homo sapien
aggcgctgacatcctcacacgtgtg

SEQ ID NO: 105836 - DNA, 25 bp, Homo sapien
tacggagttctcaggcggacttttc

SEQ ID NO: 105837 - DNA, 25 bp, Homo sapien
gcggacttttcctaagagccaccca

SEQ ID NO: 105838 - DNA, 25 bp, Homo sapien
ccgcttcctcgtgtgaccttgagaa

SEQ ID NO: 105839 - DNA, 25 bp, Homo sapien
cacccaagttattcgtcggaggccg

SEQ ID NO: 105840 - DNA, 25 bp, Homo sapien
ccggtgggtgcatgacaccattagc

SEQ ID NO: 105841 - DNA, 25 bp, Homo sapien
gagacccttggcacttctgggcgcc

SEQ ID NO: 105842 - DNA, 25 bp, Homo sapien
gcaggagcacatcccttcggcgggc

SEQ ID NO: 105843 - DNA, 25 bp, Homo sapien
gttgtcaagtgaaggagggatccca

SEQ ID NO: 105844 - DNA, 25 bp, Homo sapien
gctctaagtgcctgtttactcccgg

SEQ ID NO: 105845 - DNA, 25 bp, Homo sapien
tgtgcaaccgccgaccttgcagagg

SEQ ID NO: 105846 - DNA, 25 bp, Homo sapien
tccctttcgttctttgctctaagtg

SEQ ID NO: 105847 - DNA, 25 bp, Homo sapien
cttccagccgcagacgcattttgca

SEQ ID NO: 105848 - DNA, 25 bp, Homo sapien
agccgagcaggtacagagggaccca

SEQ ID NO: 105849 - DNA, 25 bp, Homo sapien
cacagccctaagcagatgcggagca

SEQ ID NO: 105850 - DNA, 25 bp, Homo sapien
aaggatcatgtcagcgtgcatgcca

SEQ ID NO: 105851 - DNA, 25 bp, Homo sapien
cccatcttagcaggagggccgggtt

SEQ ID NO: 105852 - DNA, 25 bp, Homo sapien
aagcgacatcggtgtgtggcgtctc

SEQ ID NO: 105853 - DNA, 25 bp, Homo sapien
aatgcctgggcacagcgtacggcca

SEQ ID NO: 105854 - DNA, 25 bp, Homo sapien
gctccctgacgcgaggcaatgcctg

SEQ ID NO: 105855 - DNA, 25 bp, Homo sapien
cttcctaagagcagcgtggaatccc

SEQ ID NO: 105856 - DNA, 25 bp, Homo sapien
gcagctcgggccttcagaaaaagga

SEQ ID NO: 105857 - DNA, 25 bp, Homo sapien
tgccacagcgcgttcctcaggtgct

SEQ ID NO: 105858 - DNA, 25 bp, Homo sapien
ccaccttgagggacacgccggagta

SEQ ID NO: 105859 - DNA, 25 bp, Homo sapien
tggtcctcccagtaggtctgcgtca

SEQ ID NO: 105860 - DNA, 25 bp, Homo sapien
taggtctgcgtcacctgcttccaca

SEQ ID NO: 105861 - DNA, 25 bp, Homo sapien
cggctgcttgactggtaaccaaaga

SEQ ID NO: 105862 - DNA, 25 bp, Homo sapien
gccggcatagtcgtcgtcccggtca

SEQ ID NO: 105863 - DNA, 25 bp, Homo sapien
ggtaaccaaagacgaagccggcata

SEQ ID NO: 105864 - DNA, 25 bp, Homo sapien
ccacatcaccacatagaagcggctg

SEQ ID NO: 105865 - DNA, 25 bp, Homo sapien
agccgctcgcaacacacaaggaagg

SEQ ID NO: 105866 - DNA, 25 bp, Homo sapien
tcaggcgttaacgatgcgcgcaatt

SEQ ID NO: 105867 - DNA, 25 bp, Homo sapien
ggggatgcattcaacctggtgatca

SEQ ID NO: 105868 - DNA, 25 bp, Homo sapien
gtctggcactcgcacttgtacatgg

SEQ ID NO: 105869 - DNA, 25 bp, Homo sapien
agggctttctggacacgcacttgag

SEQ ID NO: 105870 - DNA, 25 bp, Homo sapien
ccgtttgtgactcagccatcgtttc

SEQ ID NO: 105871 - DNA, 25 bp, Homo sapien
ggccttgcgtacttgcttttccgtc

SEQ ID NO: 105872 - DNA, 25 bp, Homo sapien
cacttgaggtgctgttcgttcctga

SEQ ID NO: 105873 - DNA, 25 bp, Homo sapien
tactcggtggtgacatgcggaccca

SEQ ID NO: 105874 - DNA, 25 bp, Homo sapien
tgcgtgagtacccaccactctcttg

SEQ ID NO: 105875 - DNA, 25 bp, Homo sapien
agtacccaccactctcttgaggttc

SEQ ID NO: 105876 - DNA, 25 bp, Homo sapien
tctcttgaggttctcgctgagctgg

SEQ ID NO: 105877 - DNA, 25 bp, Homo sapien
ctcgctgagctggttcacgaggacg

SEQ ID NO: 105878 - DNA, 25 bp, Homo sapien
cccgagagctcctggaccatgtttc

SEQ ID NO: 105879 - DNA, 25 bp, Homo sapien
gagctcctggaccatgtttcccagc

SEQ ID NO: 105880 - DNA, 25 bp, Homo sapien
ggcccacgtactcggtggtgacatg

SEQ ID NO: 105881 - DNA, 25 bp, Homo sapien
tttccgcctgcaggtgctcgtagaa

SEQ ID NO: 105882 - DNA, 25 bp, Homo sapien
atcttgctgaggtcatctgcgttca

SEQ ID NO: 105883 - DNA, 25 bp, Homo sapien
ttcaccggtgggatgtagtcaaagc

SEQ ID NO: 105884 - DNA, 25 bp, Homo sapien
tggagacgatctcgaactgcctctg

SEQ ID NO: 105885 - DNA, 25 bp, Homo sapien
cacgtgcaagctgtaggtctcgcca

SEQ ID NO: 105886 - DNA, 25 bp, Homo sapien
tccagtaggtgagatccagcgtgtc

SEQ ID NO: 105887 - DNA, 25 bp, Homo sapien
cttctgccgcatgatcttggtgatc

SEQ ID NO: 105888 - DNA, 25 bp, Homo sapien
cggtgacgttcttccactgcgagtc

SEQ ID NO: 105889 - DNA, 25 bp, Homo sapien
actcactgcggctggaacgaaccca

SEQ ID NO: 105890 - DNA, 25 bp, Homo sapien
cgtaacagaaggctttgagtgtttc

SEQ ID NO: 105891 - DNA, 25 bp, Homo sapien
gatcaccctgtgaagaaacggctgc

SEQ ID NO: 105892 - DNA, 25 bp, Homo sapien
cagggcgctccttgcttgaaagaaa

SEQ ID NO: 105893 - DNA, 25 bp, Homo sapien
tcttggtaactggtaaatggctgta

SEQ ID NO: 105894 - DNA, 25 bp, Homo sapien
cacgcggtcctttgtacgtaacaga

SEQ ID NO: 105895 - DNA, 25 bp, Homo sapien
ttgagtgtttctgtgaggatcaccc

SEQ ID NO: 105896 - DNA, 25 bp, Homo sapien
gctgtagattactgacacgcggtcc

SEQ ID NO: 105897 - DNA, 25 bp, Homo sapien
ccggctcagtccacaggtgattttc

SEQ ID NO: 105898 - DNA, 25 bp, Homo sapien
gcggccacagattcgcccacaggga

SEQ ID NO: 105899 - DNA, 25 bp, Homo sapien
tggatgtcccaggtgtaaccacagc

SEQ ID NO: 105900 - DNA, 25 bp, Homo sapien
ggaaagacgcaccaactcgccggct

SEQ ID NO: 105901 - DNA, 25 bp, Homo sapien
ggaagcgtccaagcgtccctccaag

SEQ ID NO: 105902 - DNA, 25 bp, Homo sapien
gcccatgggagtggttcgttacagc

SEQ ID NO: 105903 - DNA, 25 bp, Homo sapien
ccgcagcagcttttaaaccatttgc

SEQ ID NO: 105904 - DNA, 25 bp, Homo sapien
ccaccacggaactgcagtcgggaaa

SEQ ID NO: 105905 - DNA, 25 bp, Homo sapien
atcccgtttactcagccagtcgtta

SEQ ID NO: 105906 - DNA, 25 bp, Homo sapien
cgggttgatctccaacacggcaatc

SEQ ID NO: 105907 - DNA, 25 bp, Homo sapien
ttcattctcatagcagcgacatcgc

SEQ ID NO: 105908 - DNA, 25 bp, Homo sapien
atccgcacacgtatcctaacagctg

SEQ ID NO: 105909 - DNA, 25 bp, Homo sapien
cagggacgcggtttcaacatcgtta

SEQ ID NO: 105910 - DNA, 25 bp, Homo sapien
gccagtcgttacaggatcactctga

SEQ ID NO: 105911 - DNA, 25 bp, Homo sapien
cacggcaatcttcccgccaaagagg

SEQ ID NO: 105912 - DNA, 25 bp, Homo sapien
atcgccctgtcactcctaaaacgtt

SEQ ID NO: 105913 - DNA, 25 bp, Homo sapien
tgtgcaccgcggagtactcagatca

SEQ ID NO: 105914 - DNA, 25 bp, Homo sapien
tgtgcaccacggagtcactcggatc

SEQ ID NO: 105915 - DNA, 25 bp, Homo sapien
tgcaccgcggagcattcggatcacg

SEQ ID NO: 105916 - DNA, 25 bp, Homo sapien
caccgcggagcattcggatcacgtg

SEQ ID NO: 105917 - DNA, 25 bp, Homo sapien
tcgaggaaagcactagggtaacacc

SEQ ID NO: 105918 - DNA, 25 bp, Homo sapien
cgcggagtactcagatcacgtgtca

SEQ ID NO: 105919 - DNA, 25 bp, Homo sapien
tcacgcgtcgaggaaagcactaagg

SEQ ID NO: 105920 - DNA, 25 bp, Homo sapien
ggatcacgcgtcgaggaaagcacta

SEQ ID NO: 105921 - DNA, 25 bp, Homo sapien
caccatagtggggttgccttgcatc

SEQ ID NO: 105922 - DNA, 25 bp, Homo sapien
tgcccatcatggtgacaaagttaga

SEQ ID NO: 105923 - DNA, 25 bp, Homo sapien
tagtcgtcgtatctggggtggtaaa

SEQ ID NO: 105924 - DNA, 25 bp, Homo sapien
gcgtcccaatgtctggctccatatg

SEQ ID NO: 105925 - DNA, 25 bp, Homo sapien
aagacactcgatgctacggggcgcc

SEQ ID NO: 105926 - DNA, 25 bp, Homo sapien
tgctccttgcttggcatgcggtacg

SEQ ID NO: 105927 - DNA, 25 bp, Homo sapien
cgcggaaagtcctcactctcatggc

SEQ ID NO: 105928 - DNA, 25 bp, Homo sapien
gcgtgtttaaacgagaccaattctc

SEQ ID NO: 105929 - DNA, 25 bp, Homo sapien
ccacacaggagccgtccagggcgcc

SEQ ID NO: 105930 - DNA, 25 bp, Homo sapien
gggatgccacacaggagccgtccag

SEQ ID NO: 105931 - DNA, 25 bp, Homo sapien
caggagccgtccagggcgcctctcc

SEQ ID NO: 105932 - DNA, 25 bp, Homo sapien
ggatgccacacaggagccgtccagg

SEQ ID NO: 105933 - DNA, 25 bp, Homo sapien
tgccacacaggagccgtccagggcg

SEQ ID NO: 105934 - DNA, 25 bp, Homo sapien
atgccacacaggagccgtccagggc

SEQ ID NO: 105935 - DNA, 25 bp, Homo sapien
gatgccacacaggagccgtccaggg

SEQ ID NO: 105936 - DNA, 25 bp, Homo sapien
cacacaggagccgtccagggcgcct

SEQ ID NO: 105937 - DNA, 25 bp, Homo sapien
aggatgatatagaccggcggcccat

SEQ ID NO: 105938 - DNA, 25 bp, Homo sapien
agtgaccacagtgatcccgggaata

SEQ ID NO: 105939 - DNA, 25 bp, Homo sapien
tgttggtgacattcagactctgttg

SEQ ID NO: 105940 - DNA, 25 bp, Homo sapien
actctgttggctttgacgggttgac

SEQ ID NO: 105941 - DNA, 25 bp, Homo sapien
agaggccaggatctcctttaacctg

SEQ ID NO: 105942 - DNA, 25 bp, Homo sapien
tcagcactcgcgctctttgtgtctc

SEQ ID NO: 105943 - DNA, 25 bp, Homo sapien
cccatccggagagtgcgctccaaga

SEQ ID NO: 105944 - DNA, 25 bp, Homo sapien
cattaatggcggcatcctcggagga

SEQ ID NO: 105945 - DNA, 25 bp, Homo sapien
ggtagaaacaacatcactcaggcgg

SEQ ID NO: 105946 - DNA, 25 bp, Homo sapien
cagggacagaactccaccgcagtca

SEQ ID NO: 105947 - DNA, 25 bp, Homo sapien
tggccgtgaagcaaccgcacagctc

SEQ ID NO: 105948 - DNA, 25 bp, Homo sapien
tttccacagcacgtgccacgcggga

SEQ ID NO: 105949 - DNA, 25 bp, Homo sapien
tcaccttaaagcctctgtcctcaga

SEQ ID NO: 105950 - DNA, 25 bp, Homo sapien
tgcctgctcgccagggacagaactc

SEQ ID NO: 105951 - DNA, 25 bp, Homo sapien
ccgcagaaccgtcctgtcaggaatc

SEQ ID NO: 105952 - DNA, 25 bp, Homo sapien
tggaaatcaggatagcgggcgcctt

SEQ ID NO: 105953 - DNA, 25 bp, Homo sapien
acgcgagccgctatggttactagcc

SEQ ID NO: 105954 - DNA, 25 bp, Homo sapien
ttcctagagacctcagcggagccgc

SEQ ID NO: 105955 - DNA, 25 bp, Homo sapien
acgctcgccgctatggttacttgcc

SEQ ID NO: 105956 - DNA, 25 bp, Homo sapien
cctcgggtccggatgtataaagcgc

SEQ ID NO: 105957 - DNA, 25 bp, Homo sapien
gcctcaagggagatgcggatctgta

SEQ ID NO: 105958 - DNA, 25 bp, Homo sapien
ggatctgtacgtctccgccagcagc

SEQ ID NO: 105959 - DNA, 25 bp, Homo sapien
tcgacgactacgagctgcaatcggc

SEQ ID NO: 105960 - DNA, 25 bp, Homo sapien
agtcctcaggatgcgcagcctcaag

SEQ ID NO: 105961 - DNA, 25 bp, Homo sapien
ccactggggagcgatttcacttaaa

SEQ ID NO: 105962 - DNA, 25 bp, Homo sapien
acctgaccgtggctcgttcctagaa

SEQ ID NO: 105963 - DNA, 25 bp, Homo sapien
tcgatcccgagctaggcagggagtc

SEQ ID NO: 105964 - DNA, 25 bp, Homo sapien
cacctgcgcctcgtacggtaggaag

SEQ ID NO: 105965 - DNA, 25 bp, Homo sapien
ttcctaggcgtcaccggagcctgct

SEQ ID NO: 105966 - DNA, 25 bp, Homo sapien
ctgcctccttctcgaacatgctagg

SEQ ID NO: 105967 - DNA, 25 bp, Homo sapien
ttcacttaaacggtcggacatagcc

SEQ ID NO: 105968 - DNA, 25 bp, Homo sapien
tcgttcctagaagcgcagtttccta

SEQ ID NO: 105969 - DNA, 25 bp, Homo sapien
ctttgcgaatcgatggggatcaggc

SEQ ID NO: 105970 - DNA, 25 bp, Homo sapien
ctttggatttcttggagctgcgctg

SEQ ID NO: 105971 - DNA, 25 bp, Homo sapien
gctcctcttgtgaatggactttgga

SEQ ID NO: 105972 - DNA, 25 bp, Homo sapien
tttcaacgatttggcggagaagctc

SEQ ID NO: 105973 - DNA, 25 bp, Homo sapien
cggtggcgactcatttctcgtttta

SEQ ID NO: 105974 - DNA, 25 bp, Homo sapien
ctaaagcggataccggtggcgactc

SEQ ID NO: 105975 - DNA, 25 bp, Homo sapien
ttgcgttttcgtacggctgactaaa

SEQ ID NO: 105976 - DNA, 25 bp, Homo sapien
ggaccatccatccaggtaaaacgtg

SEQ ID NO: 105977 - DNA, 25 bp, Homo sapien
ggcgagaagcttcccagatgttaaa

SEQ ID NO: 105978 - DNA, 25 bp, Homo sapien
cgcaggctgtttgatgcatgtaata

SEQ ID NO: 105979 - DNA, 25 bp, Homo sapien
tgtaataacgatgcgtccagagctc

SEQ ID NO: 105980 - DNA, 25 bp, Homo sapien
tccagagctccggacaatgcgtgag

SEQ ID NO: 105981 - DNA, 25 bp, Homo sapien
agcgcccagactccgttttcaaagt

SEQ ID NO: 105982 - DNA, 25 bp, Homo sapien
gcccaatgacatgagccgaaaccca

SEQ ID NO: 105983 - DNA, 25 bp, Homo sapien
ctgaacacgcgctaggcccaatgac

SEQ ID NO: 105984 - DNA, 25 bp, Homo sapien
caatgcgtgagttgatgctgaacac

SEQ ID NO: 105985 - DNA, 25 bp, Homo sapien
tcttgcagatgggatcagatggccc

SEQ ID NO: 105986 - DNA, 25 bp, Homo sapien
cggccaccctggtctcaagacggag

SEQ ID NO: 105987 - DNA, 25 bp, Homo sapien
acgtctcctgcttgggctggatgag

SEQ ID NO: 105988 - DNA, 25 bp, Homo sapien
agtgacccttccctgcggccatgaa

SEQ ID NO: 105989 - DNA, 25 bp, Homo sapien
cggccatgaacagggagctttaaac

SEQ ID NO: 105990 - DNA, 25 bp, Homo sapien
cgtcatggtggaggagactacccgt

SEQ ID NO: 105991 - DNA, 25 bp, Homo sapien
gccacagctgaggaaagggtcaagc

SEQ ID NO: 105992 - DNA, 25 bp, Homo sapien
taaacgtgttgaggttggaccctgc

SEQ ID NO: 105993 - DNA, 25 bp, Homo sapien
tgtgtgcccggttccgattccaaga

SEQ ID NO: 105994 - DNA, 25 bp, Homo sapien
ttgcctgtcagaccggcagtgtgtg

SEQ ID NO: 105995 - DNA, 25 bp, Homo sapien
gtggactgtcccatggaaacgcggc

SEQ ID NO: 105996 - DNA, 25 bp, Homo sapien
tccaagagcatcttctccagaactc

SEQ ID NO: 105997 - DNA, 25 bp, Homo sapien
cgctacctcggaacacgtgtgttca

SEQ ID NO: 105998 - DNA, 25 bp, Homo sapien
acacgtgtgttcaggcatggatgca

SEQ ID NO: 105999 - DNA, 25 bp, Homo sapien
gtgttcgtgcactgcagccgcacca

SEQ ID NO: 106000 - DNA, 25 bp, Homo sapien
cagctcccgaatgttgcctgtcaga

SEQ ID NO: 106001 - DNA, 25 bp, Homo sapien
aagggagctttatgatccacgccca

SEQ ID NO: 106002 - DNA, 25 bp, Homo sapien
ctggagtgtccaccgcagaacgagt

SEQ ID NO: 106003 - DNA, 25 bp, Homo sapien
acgggacaacacgtccaactgtgta

SEQ ID NO: 106004 - DNA, 25 bp, Homo sapien
gcttcgagaaagagccaggaccgtg

SEQ ID NO: 106005 - DNA, 25 bp, Homo sapien
cgcccgtctagagttgaagcttctg

SEQ ID NO: 106006 - DNA, 25 bp, Homo sapien
caggaccgtgtagttggacccttgg

SEQ ID NO: 106007 - DNA, 25 bp, Homo sapien
gggagcatcgcactgttaaaaggtc

SEQ ID NO: 106008 - DNA, 25 bp, Homo sapien
acgccacgtcgctggtacaaatgga

SEQ ID NO: 106009 - DNA, 25 bp, Homo sapien
gcggagcctcagtccttcttgatgc

SEQ ID NO: 106010 - DNA, 25 bp, Homo sapien
gtgacgtcaacctttgttcccatgg

SEQ ID NO: 106011 - DNA, 25 bp, Homo sapien
ttcccatggtaacgcagaaccttgg

SEQ ID NO: 106012 - DNA, 25 bp, Homo sapien
tggtggactcaatcaatctcgcctg

SEQ ID NO: 106013 - DNA, 25 bp, Homo sapien
tgcgtagatggagcaaaaccgcctc

SEQ ID NO: 106014 - DNA, 25 bp, Homo sapien
tgttactgcgtgaactgagctccga

SEQ ID NO: 106015 - DNA, 25 bp, Homo sapien
aggcccagccggaacgagatttacg

SEQ ID NO: 106016 - DNA, 25 bp, Homo sapien
gtcgcagcgcgcacttcatttgtta

SEQ ID NO: 106017 - DNA, 25 bp, Homo sapien
gtgtgtgttcgttctcacctgcaga

SEQ ID NO: 106018 - DNA, 25 bp, Homo sapien
gagagcaccgatcccagccttgtcg

SEQ ID NO: 106019 - DNA, 25 bp, Homo sapien
ccttcaccacgtggatggagctgga

SEQ ID NO: 106020 - DNA, 25 bp, Homo sapien
ctggcctcagtccagaggacgctca

SEQ ID NO: 106021 - DNA, 25 bp, Homo sapien
tttccctcacattgacggcgcgttc

SEQ ID NO: 106022 - DNA, 25 bp, Homo sapien
tcatctgcaaaagggaagcgactct

SEQ ID NO: 106023 - DNA, 25 bp, Homo sapien
cgcccagcaagtgaacgcacggatg

SEQ ID NO: 106024 - DNA, 25 bp, Homo sapien
tctctcagagccgaggtctcatctg

SEQ ID NO: 106025 - DNA, 25 bp, Homo sapien
gcggacttttctcccacttgacttg

SEQ ID NO: 106026 - DNA, 25 bp, Homo sapien
tcccacgcggaacgatgctgagttt

SEQ ID NO: 106027 - DNA, 25 bp, Homo sapien
gcctcgccacctacggggtcagaaa

SEQ ID NO: 106028 - DNA, 25 bp, Homo sapien
ctcgcccgcgatggaagaaacggtg

SEQ ID NO: 106029 - DNA, 25 bp, Homo sapien
aagcgcaagtccttcccgtggtcca

SEQ ID NO: 106030 - DNA, 25 bp, Homo sapien
tttagaacacgctccttcatgtcgg

SEQ ID NO: 106031 - DNA, 25 bp, Homo sapien
tcggatggcaaacgcccaggactgt

SEQ ID NO: 106032 - DNA, 25 bp, Homo sapien
ggagagatcacagcccttgccgagg

SEQ ID NO: 106033 - DNA, 25 bp, Homo sapien
ccagagctcccgcagtctaatctga

SEQ ID NO: 106034 - DNA, 25 bp, Homo sapien
gtgcatttgcgcgaccctccaggcg

SEQ ID NO: 106035 - DNA, 25 bp, Homo sapien
cgcggaccaggcagaagcctctgca

SEQ ID NO: 106036 - DNA, 25 bp, Homo sapien
tgaagtagagcagtgaaggcgtgcc

SEQ ID NO: 106037 - DNA, 25 bp, Homo sapien
cgcgcagccgcatcttccaggtgag

SEQ ID NO: 106038 - DNA, 25 bp, Homo sapien
ccgcagtctaatctgaagtagagca

SEQ ID NO: 106039 - DNA, 25 bp, Homo sapien
agctcccgcagtctaatctgaagta

SEQ ID NO: 106040 - DNA, 25 bp, Homo sapien
tgtggctgtgcatttgcgcgaccct

SEQ ID NO: 106041 - DNA, 25 bp, Homo sapien
cagtgccctttagtacgtggagaac

SEQ ID NO: 106042 - DNA, 25 bp, Homo sapien
gcgaactgcagtgccctttagtaca

SEQ ID NO: 106043 - DNA, 25 bp, Homo sapien
tgcccttgagcatgcagcgaactgc

SEQ ID NO: 106044 - DNA, 25 bp, Homo sapien
acggcagtgccctttagtacatgga

SEQ ID NO: 106045 - DNA, 25 bp, Homo sapien
gtgcccttgagcatgcagcgaactg

SEQ ID NO: 106046 - DNA, 25 bp, Homo sapien
actgcagtgccctttagtacatgga

SEQ ID NO: 106047 - DNA, 25 bp, Homo sapien
aacggcagtgccctttagtacatgg

SEQ ID NO: 106048 - DNA, 25 bp, Homo sapien
cagcgaactgcagtgccctttagta

SEQ ID NO: 106049 - DNA, 25 bp, Homo sapien
ggctgcttcccgctactgtaacaga

SEQ ID NO: 106050 - DNA, 25 bp, Homo sapien
accacaggtcgcataggccagagcc

SEQ ID NO: 106051 - DNA, 25 bp, Homo sapien
gcacggcttcttgggtgacaatcga

SEQ ID NO: 106052 - DNA, 25 bp, Homo sapien
tgggcacacccttatttggaaattg

SEQ ID NO: 106053 - DNA, 25 bp, Homo sapien
cgtgccagtctcaccaacgtgtgtt

SEQ ID NO: 106054 - DNA, 25 bp, Homo sapien
ggcagcggtgaacatatccctctta

SEQ ID NO: 106055 - DNA, 25 bp, Homo sapien
gtccatctcctaggccagcgtgatt

SEQ ID NO: 106056 - DNA, 25 bp, Homo sapien
tgccactgattaggggaccagcatc

SEQ ID NO: 106057 - DNA, 25 bp, Homo sapien
cgatcgtcgattagcaagtactttc

SEQ ID NO: 106058 - DNA, 25 bp, Homo sapien
gggcccacatttcactgcttccgaa

SEQ ID NO: 106059 - DNA, 25 bp, Homo sapien
cctgactctgccgtagctgatttgg

SEQ ID NO: 106060 - DNA, 25 bp, Homo sapien
gccgggcgaagacgatcgtcgatta

SEQ ID NO: 106061 - DNA, 25 bp, Homo sapien
tttcataaatccagagtgaggcggc

SEQ ID NO: 106062 - DNA, 25 bp, Homo sapien
tgaaatggcctcactgactcactgc

SEQ ID NO: 106063 - DNA, 25 bp, Homo sapien
ttcaacaacatctgtggggcctccc

SEQ ID NO: 106064 - DNA, 25 bp, Homo sapien
cgtgaatttgcagcatgccgggcga

SEQ ID NO: 106065 - DNA, 25 bp, Homo sapien
tgcgggtttcacctctcaaggcgaa

SEQ ID NO: 106066 - DNA, 25 bp, Homo sapien
agctgctgctcgcttctcaaggtcg

SEQ ID NO: 106067 - DNA, 25 bp, Homo sapien
ctcagcaggacaacggggcaacctt

SEQ ID NO: 106068 - DNA, 25 bp, Homo sapien
tttcaaagaaaaccgctgccctgcc

SEQ ID NO: 106069 - DNA, 25 bp, Homo sapien
cctggccggctgtaaacagctatta

SEQ ID NO: 106070 - DNA, 25 bp, Homo sapien
ctgctgatcaaaggcgctacaagga

SEQ ID NO: 106071 - DNA, 25 bp, Homo sapien
ccgacagccacgtattcacatgaga

SEQ ID NO: 106072 - DNA, 25 bp, Homo sapien
ctcactcgtaagtgtcggcagctgc

SEQ ID NO: 106073 - DNA, 25 bp, Homo sapien
gagcactgaagactccatacgggga

SEQ ID NO: 106074 - DNA, 25 bp, Homo sapien
gagcactgaagactccacacgggga

SEQ ID NO: 106075 - DNA, 25 bp, Homo sapien
tccacaccgggagtcagtactgaga

SEQ ID NO: 106076 - DNA, 25 bp, Homo sapien
ctccacacgggagtcagtactgaga

SEQ ID NO: 106077 - DNA, 25 bp, Homo sapien
tccacagcgggagtcagtactgaga

SEQ ID NO: 106078 - DNA, 25 bp, Homo sapien
gagcactgaagactccacaccggga

SEQ ID NO: 106079 - DNA, 25 bp, Homo sapien
ccacaccgggagtcagtactgagag

SEQ ID NO: 106080 - DNA, 25 bp, Homo sapien
tccacaccgggagtcagtaccgaga

SEQ ID NO: 106081 - DNA, 25 bp, Homo sapien
caatgtcgctggatcccacgtgtta

SEQ ID NO: 106082 - DNA, 25 bp, Homo sapien
gactgcgtctccctcactgcaaagg

SEQ ID NO: 106083 - DNA, 25 bp, Homo sapien
cagtgtcgccagatcccacgtgtta

SEQ ID NO: 106084 - DNA, 25 bp, Homo sapien
gtgtcgctggatcccacgtgttaaa

SEQ ID NO: 106085 - DNA, 25 bp, Homo sapien
cagtgtcgcttgatcccacgtgtta

SEQ ID NO: 106086 - DNA, 25 bp, Homo sapien
gtcgcttgatcccacgtgttaaacg

SEQ ID NO: 106087 - DNA, 25 bp, Homo sapien
gtcgccagatcccacgtgttaaacg

SEQ ID NO: 106088 - DNA, 25 bp, Homo sapien
agtgtcgcttgatcccacgtgttaa

SEQ ID NO: 106089 - DNA, 25 bp, Homo sapien
tgacccactccctcgtccgcgacca

SEQ ID NO: 106090 - DNA, 25 bp, Homo sapien
tcgtccgcgaccatggaaccgagcc

SEQ ID NO: 106091 - DNA, 25 bp, Homo sapien
gtctcctgcacaccacaccagccag

SEQ ID NO: 106092 - DNA, 25 bp, Homo sapien
gcacaccacaccagccagccgtgac

SEQ ID NO: 106093 - DNA, 25 bp, Homo sapien
cgtccgcgaccatggaaccgagccc

SEQ ID NO: 106094 - DNA, 25 bp, Homo sapien
ccactccctcgtccgcgaccatgga

SEQ ID NO: 106095 - DNA, 25 bp, Homo sapien
cagccgtgacccactccctcgtccg

SEQ ID NO: 106096 - DNA, 25 bp, Homo sapien
cctcgtccgcgaccatggaaccgag

SEQ ID NO: 106097 - DNA, 25 bp, Homo sapien
acctgggtctagcttgactatcttc

SEQ ID NO: 106098 - DNA, 25 bp, Homo sapien
gccagttcggacgtgaccgtgtcgc

SEQ ID NO: 106099 - DNA, 25 bp, Homo sapien
gtcccgtcgcaccttgtagacgtcg

SEQ ID NO: 106100 - DNA, 25 bp, Homo sapien
tgtagacgtcgccataggtcccggc

SEQ ID NO: 106101 - DNA, 25 bp, Homo sapien
agctcgaagcggtcccgcgggtcct

SEQ ID NO: 106102 - DNA, 25 bp, Homo sapien
tgcagcgacacatcccgcagcagcg

SEQ ID NO: 106103 - DNA, 25 bp, Homo sapien
tcgctcgcgctccacaggtagggag

SEQ ID NO: 106104 - DNA, 25 bp, Homo sapien
tgactatcttcacggcggccagttc

SEQ ID NO: 106105 - DNA, 25 bp, Homo sapien
gtgttgtccgcttcctgggacggtc

SEQ ID NO: 106106 - DNA, 25 bp, Homo sapien
cgcagggctgtgttgtccgcttcct

SEQ ID NO: 106107 - DNA, 25 bp, Homo sapien
tgttgtccgcttcctgggacggtcc

SEQ ID NO: 106108 - DNA, 25 bp, Homo sapien
gcaggcctgtgttgtccgcttcctg

SEQ ID NO: 106109 - DNA, 25 bp, Homo sapien
acacaggcctgtgttgtccgcttcc

SEQ ID NO: 106110 - DNA, 25 bp, Homo sapien
ctgtgttgtccgcttcctgggacgg

SEQ ID NO: 106111 - DNA, 25 bp, Homo sapien
acgcagggctgtgttgtccgcttcc

SEQ ID NO: 106112 - DNA, 25 bp, Homo sapien
acaggcctgtgttgtccgcttcctg

SEQ ID NO: 106113 - DNA, 25 bp, Homo sapien
tgcagacactgaaagggcggctgca

SEQ ID NO: 106114 - DNA, 25 bp, Homo sapien
ttttgtccagaagtaacccagagcg

SEQ ID NO: 106115 - DNA, 25 bp, Homo sapien
agcaagtccctgtgggtgaggacca

SEQ ID NO: 106116 - DNA, 25 bp, Homo sapien
tgaggaccacgcatgcccggttggc

SEQ ID NO: 106117 - DNA, 25 bp, Homo sapien
gcgctgatgtgtgggaaaacgacaa

SEQ ID NO: 106118 - DNA, 25 bp, Homo sapien
gtgcaagccacacgggtcacgtgcg

SEQ ID NO: 106119 - DNA, 25 bp, Homo sapien
gcggctgcagagacttttttgtcca

SEQ ID NO: 106120 - DNA, 25 bp, Homo sapien
gtcacgtgcgtctcctgtgctaatc

SEQ ID NO: 106121 - DNA, 25 bp, Homo sapien
tgttagcatccgtcagggtgaccct

SEQ ID NO: 106122 - DNA, 25 bp, Homo sapien
tcagcctgaggacgcagggacaggc

SEQ ID NO: 106123 - DNA, 25 bp, Homo sapien
acagaaactgcgtcagcctgaggac

SEQ ID NO: 106124 - DNA, 25 bp, Homo sapien
ggtgaccctttacagaaactgcgtc

SEQ ID NO: 106125 - DNA, 25 bp, Homo sapien
agggtgaccctttacagaaactgcg

SEQ ID NO: 106126 - DNA, 25 bp, Homo sapien
aactgcgtcagcctgaggacgcagg

SEQ ID NO: 106127 - DNA, 25 bp, Homo sapien
tacagaaactgcgtcagcctgagga

SEQ ID NO: 106128 - DNA, 25 bp, Homo sapien
cctttacagaaactgcgtcagcctg

SEQ ID NO: 106129 - DNA, 25 bp, Homo sapien
gacggcccgggagacaaaactcagc

SEQ ID NO: 106130 - DNA, 25 bp, Homo sapien
ctctggcttcgtttgtgaaacccga

SEQ ID NO: 106131 - DNA, 25 bp, Homo sapien
ctaggctcgcctccagagtagtgta

SEQ ID NO: 106132 - DNA, 25 bp, Homo sapien
cctcgaggttcttgcctagggaaga

SEQ ID NO: 106133 - DNA, 25 bp, Homo sapien
gccgtacttaagctgcctgcgtgca

SEQ ID NO: 106134 - DNA, 25 bp, Homo sapien
cggacgtgacatcaactccaggtcg

SEQ ID NO: 106135 - DNA, 25 bp, Homo sapien
gagtagtgtagtttctcccgccgtg

SEQ ID NO: 106136 - DNA, 25 bp, Homo sapien
atttactctggccatccgaaggcgc

SEQ ID NO: 106137 - DNA, 25 bp, Homo sapien
agacgctgccgtttccctttcaagg

SEQ ID NO: 106138 - DNA, 25 bp, Homo sapien
actcagcagagtgggcaatcaccta

SEQ ID NO: 106139 - DNA, 25 bp, Homo sapien
tgagactctgctaccagcgtccttg

SEQ ID NO: 106140 - DNA, 25 bp, Homo sapien
catctgcgatgtgcgtatgcaacca

SEQ ID NO: 106141 - DNA, 25 bp, Homo sapien
gcattctgctgtgggtcacgtcaca

SEQ ID NO: 106142 - DNA, 25 bp, Homo sapien
cacgtcacagacacggcggtccata

SEQ ID NO: 106143 - DNA, 25 bp, Homo sapien
gtatggtccggcttaatgcttttgc

SEQ ID NO: 106144 - DNA, 25 bp, Homo sapien
atgcgcagaaccgtgccctgaaagg

SEQ ID NO: 106145 - DNA, 25 bp, Homo sapien
tcctgggaaccgctcagcgctttga

SEQ ID NO: 106146 - DNA, 25 bp, Homo sapien
ggaggagcagcttccgtgactccca

SEQ ID NO: 106147 - DNA, 25 bp, Homo sapien
acgcgcttagagacggggctgccca

SEQ ID NO: 106148 - DNA, 25 bp, Homo sapien
tcagcccacagggagcccgtgcggt

SEQ ID NO: 106149 - DNA, 25 bp, Homo sapien
caaagcggcaaatgaggggtcagcc

SEQ ID NO: 106150 - DNA, 25 bp, Homo sapien
gcaatcactaccataaggaacccgg

SEQ ID NO: 106151 - DNA, 25 bp, Homo sapien
gcgcaagttaaaaatgcaatcacta

SEQ ID NO: 106152 - DNA, 25 bp, Homo sapien
cgctttgaggtacgcgcaagttaaa

SEQ ID NO: 106153 - DNA, 25 bp, Homo sapien
cagtcgtccacgttgtcgtcacagt

SEQ ID NO: 106154 - DNA, 25 bp, Homo sapien
cgaggttatagtccaccgctgggta

SEQ ID NO: 106155 - DNA, 25 bp, Homo sapien
cctggccctctagcttctcagtgag

SEQ ID NO: 106156 - DNA, 25 bp, Homo sapien
gatgtccttctcacgctggcagttg

SEQ ID NO: 106157 - DNA, 25 bp, Homo sapien
gtagcgggccttgaagccattcttg

SEQ ID NO: 106158 - DNA, 25 bp, Homo sapien
ccttgaggtcctgcacgaggttata

SEQ ID NO: 106159 - DNA, 25 bp, Homo sapien
agaagtcgttcacgccatcccggca

SEQ ID NO: 106160 - DNA, 25 bp, Homo sapien
ccaggttgttcatggtctccgtctc

SEQ ID NO: 106161 - DNA, 25 bp, Homo sapien
agccagcggtgccttcccagagact

SEQ ID NO: 106162 - DNA, 25 bp, Homo sapien
cgtcacacacgaagcggtaggagta

SEQ ID NO: 106163 - DNA, 25 bp, Homo sapien
cctctccgtagtagtgttcgtcaca

SEQ ID NO: 106164 - DNA, 25 bp, Homo sapien
cccacaggtgaagtggccgaaggca

SEQ ID NO: 106165 - DNA, 25 bp, Homo sapien
ttccagccagggttgcacactttct

SEQ ID NO: 106166 - DNA, 25 bp, Homo sapien
ctcacgctctgtgcagtagggccct

SEQ ID NO: 106167 - DNA, 25 bp, Homo sapien
tccgtgttcgtggacgagtgagcca

SEQ ID NO: 106168 - DNA, 25 bp, Homo sapien
agggccctttccagccagggttgca

SEQ ID NO: 106169 - DNA, 25 bp, Homo sapien
cccaatctggcgagagctgtcacaa

SEQ ID NO: 106170 - DNA, 25 bp, Homo sapien
gcaggacccaggacttctttcttta

SEQ ID NO: 106171 - DNA, 25 bp, Homo sapien
tcctcccgagccgattagaaagccg

SEQ ID NO: 106172 - DNA, 25 bp, Homo sapien
cggccgcccgcatggctaatgagat

SEQ ID NO: 106173 - DNA, 25 bp, Homo sapien
gatccgcgtctttccgatgaatcca

SEQ ID NO: 106174 - DNA, 25 bp, Homo sapien
tccgatctccggtgtcacagcaaag

SEQ ID NO: 106175 - DNA, 25 bp, Homo sapien
tctctccttagaacagcggcggacg

SEQ ID NO: 106176 - DNA, 25 bp, Homo sapien
tagaaagccgcggtctggaaatccc

SEQ ID NO: 106177 - DNA, 25 bp, Homo sapien
tggaacccgcggatcatctgctggg

SEQ ID NO: 106178 - DNA, 25 bp, Homo sapien
ccctccgaactttgtgccgactgaa

SEQ ID NO: 106179 - DNA, 25 bp, Homo sapien
gcaccagtgcaaggcccaaagcgcg

SEQ ID NO: 106180 - DNA, 25 bp, Homo sapien
atctccatgacaaagcgcgtgttta

SEQ ID NO: 106181 - DNA, 25 bp, Homo sapien
aggcagcattacgaggggcaccagt

SEQ ID NO: 106182 - DNA, 25 bp, Homo sapien
cgggatcagattaccgcagcagctg

SEQ ID NO: 106183 - DNA, 25 bp, Homo sapien
cgatgattgccggacgctgagatcc

SEQ ID NO: 106184 - DNA, 25 bp, Homo sapien
gccctttgtgcgctcttagcggaaa

SEQ ID NO: 106185 - DNA, 25 bp, Homo sapien
ggattggcccttcccttcaggccga

SEQ ID NO: 106186 - DNA, 25 bp, Homo sapien
agcaaacaggcgcaccacgtcgtcg

SEQ ID NO: 106187 - DNA, 25 bp, Homo sapien
aacagcgtcttctgggcggccttca

SEQ ID NO: 106188 - DNA, 25 bp, Homo sapien
ctcagccgagactgcagagcctttt

SEQ ID NO: 106189 - DNA, 25 bp, Homo sapien
ttcccgagatactcagggattggcc

SEQ ID NO: 106190 - DNA, 25 bp, Homo sapien
tgcccgcagtgccttctggaaaatg

SEQ ID NO: 106191 - DNA, 25 bp, Homo sapien
gatgacgcggttgacagccagaaaa

SEQ ID NO: 106192 - DNA, 25 bp, Homo sapien
cccggggctgtaaagtctgtccaga

SEQ ID NO: 106193 - DNA, 25 bp, Homo sapien
gcgctcgcacaacttcggcctgagg

SEQ ID NO: 106194 - DNA, 25 bp, Homo sapien
tcctcagtgcctccggcaggacaaa

SEQ ID NO: 106195 - DNA, 25 bp, Homo sapien
atgcagcgtcaagacaccgtccggg

SEQ ID NO: 106196 - DNA, 25 bp, Homo sapien
aacacccggccgagaagtgctcagc

SEQ ID NO: 106197 - DNA, 25 bp, Homo sapien
tgttggcgcatctctaggtagggcc

SEQ ID NO: 106198 - DNA, 25 bp, Homo sapien
ggccgcaggacagtgtatgaacaaa

SEQ ID NO: 106199 - DNA, 25 bp, Homo sapien
caccagagcagttgctgtggcaaca

SEQ ID NO: 106200 - DNA, 25 bp, Homo sapien
cggctgcgacatcatgggatcctcg

SEQ ID NO: 106201 - DNA, 25 bp, Homo sapien
cggtgctgtgcacacgcgtccctaa

SEQ ID NO: 106202 - DNA, 25 bp, Homo sapien
gagaacacaggctcacgctgctcgg

SEQ ID NO: 106203 - DNA, 25 bp, Homo sapien
acaggctcacgctgctcggtgctgt

SEQ ID NO: 106204 - DNA, 25 bp, Homo sapien
gaacacaggctcacgctgctcggtg

SEQ ID NO: 106205 - DNA, 25 bp, Homo sapien
ggtgctgtgcacacgcgtccctaat

SEQ ID NO: 106206 - DNA, 25 bp, Homo sapien
tgggagaacacaggctcacgctgct

SEQ ID NO: 106207 - DNA, 25 bp, Homo sapien
gtgctgtgcacacgcgtccctaatc

SEQ ID NO: 106208 - DNA, 25 bp, Homo sapien
ggagaacacaggctcacgctgctcg

SEQ ID NO: 106209 - DNA, 25 bp, Homo sapien
gtggacaccgcagcatgccagcaca

SEQ ID NO: 106210 - DNA, 25 bp, Homo sapien
gacaccgcagcatgccagcacaagg

SEQ ID NO: 106211 - DNA, 25 bp, Homo sapien
ccacgcctccgtggacaccgcagca

SEQ ID NO: 106212 - DNA, 25 bp, Homo sapien
acgcctccgtggacaccgcagcatg

SEQ ID NO: 106213 - DNA, 25 bp, Homo sapien
gcagcatgccagcacaaggccacgc

SEQ ID NO: 106214 - DNA, 25 bp, Homo sapien
tggacaccgcagcatgccagcacga

SEQ ID NO: 106215 - DNA, 25 bp, Homo sapien
accgcagcatgccagcacaaggcca

SEQ ID NO: 106216 - DNA, 25 bp, Homo sapien
gtggacaccgcagcatgccagcacg

SEQ ID NO: 106217 - DNA, 25 bp, Homo sapien
acccatgtgggcgaggtgacagcac

SEQ ID NO: 106218 - DNA, 25 bp, Homo sapien
gaggtgacagcacggactcaggtaa

SEQ ID NO: 106219 - DNA, 25 bp, Homo sapien
cagcacggactcaggtaaccggaaa

SEQ ID NO: 106220 - DNA, 25 bp, Homo sapien
aaaaagaagacggtggcgtgcgctg

SEQ ID NO: 106221 - DNA, 25 bp, Homo sapien
caggatccgcacgtgcgtgtgctat

SEQ ID NO: 106222 - DNA, 25 bp, Homo sapien
cacgtgcgtgtgctattgaggacct

SEQ ID NO: 106223 - DNA, 25 bp, Homo sapien
cgtgtgctattgaggacctgcgtcc

SEQ ID NO: 106224 - DNA, 25 bp, Homo sapien
gtgctattgaggacctgcgtccagt

SEQ ID NO: 106225 - DNA, 25 bp, Homo sapien
gcgcaccgcctgcatcatcttgatg

SEQ ID NO: 106226 - DNA, 25 bp, Homo sapien
tccagttgtacttcttgcccagcag

SEQ ID NO: 106227 - DNA, 25 bp, Homo sapien
tcaagtcgtcgcagctccagttgta

SEQ ID NO: 106228 - DNA, 25 bp, Homo sapien
tgacatcctgcttgaactcgccggg

SEQ ID NO: 106229 - DNA, 25 bp, Homo sapien
agcacgttgcccatgatgctcatga

SEQ ID NO: 106230 - DNA, 25 bp, Homo sapien
cgcacaaggcatacaggcagtcgtc

SEQ ID NO: 106231 - DNA, 25 bp, Homo sapien
ccggctcctcggtcatgatggcaat

SEQ ID NO: 106232 - DNA, 25 bp, Homo sapien
cccttgatgtggtcagtctgcttca

SEQ ID NO: 106233 - DNA, 25 bp, Homo sapien
ctaccaagggaacctgcctaagcgg

SEQ ID NO: 106234 - DNA, 25 bp, Homo sapien
gctgcagcctcggaatagccggtca

SEQ ID NO: 106235 - DNA, 25 bp, Homo sapien
tttcggaaggtgagattgtttttca

SEQ ID NO: 106236 - DNA, 25 bp, Homo sapien
cggggacgctctggttttcagatcc

SEQ ID NO: 106237 - DNA, 25 bp, Homo sapien
agctcaggccgcagctaccaaggga

SEQ ID NO: 106238 - DNA, 25 bp, Homo sapien
agccactgcgctgctgtcggtgaaa

SEQ ID NO: 106239 - DNA, 25 bp, Homo sapien
gaatagccggtcacagccactgcgc

SEQ ID NO: 106240 - DNA, 25 bp, Homo sapien
gggacctgaggccaaacgcaagctc

SEQ ID NO: 106241 - DNA, 25 bp, Homo sapien
ttctcctgatcggattctcctgacc

SEQ ID NO: 106242 - DNA, 25 bp, Homo sapien
atcggattctcctgaccgagtgaac

SEQ ID NO: 106243 - DNA, 25 bp, Homo sapien
ccggatcacgcgagttctcctgatc

SEQ ID NO: 106244 - DNA, 25 bp, Homo sapien
acgcgagttctcctgatcggattct

SEQ ID NO: 106245 - DNA, 25 bp, Homo sapien
cccggatcacgcgagttctcctgat

SEQ ID NO: 106246 - DNA, 25 bp, Homo sapien
tcggattctcctgaccgagtgaacg

SEQ ID NO: 106247 - DNA, 25 bp, Homo sapien
agttctcctgatcggattctcctga

SEQ ID NO: 106248 - DNA, 25 bp, Homo sapien
cacgcgagttctcctgatcggattc

SEQ ID NO: 106249 - DNA, 25 bp, Homo sapien
agtctcaggccgcattccggggcca

SEQ ID NO: 106250 - DNA, 25 bp, Homo sapien
gcattccggggccaagcagggtcct

SEQ ID NO: 106251 - DNA, 25 bp, Homo sapien
cacgagaggaagtgcgagtccaaac

SEQ ID NO: 106252 - DNA, 25 bp, Homo sapien
gtgcgagtccaaacagagcccaggg

SEQ ID NO: 106253 - DNA, 25 bp, Homo sapien
acactgcacctgtcggtgcccggtg

SEQ ID NO: 106254 - DNA, 25 bp, Homo sapien
ctgagtgccgcacggtgcattccac

SEQ ID NO: 106255 - DNA, 25 bp, Homo sapien
gtgcattccacccaccactgacgca

SEQ ID NO: 106256 - DNA, 25 bp, Homo sapien
tgacgcaactgtcagtcacgcagcc

SEQ ID NO: 106257 - DNA, 25 bp, Homo sapien
acggaatctcccgtgtgctctgaga

SEQ ID NO: 106258 - DNA, 25 bp, Homo sapien
gaatctcccgtgtgctctgagacca

SEQ ID NO: 106259 - DNA, 25 bp, Homo sapien
tgctctgagaccactgacgtgctct

SEQ ID NO: 106260 - DNA, 25 bp, Homo sapien
gctctgagaccactgacgtgctatg

SEQ ID NO: 106261 - DNA, 25 bp, Homo sapien
atggcctcagggtgccacggaatct

SEQ ID NO: 106262 - DNA, 25 bp, Homo sapien
ctcccgtgtgctctgagaccactga

SEQ ID NO: 106263 - DNA, 25 bp, Homo sapien
agaccactgacgtgctacggcctca

SEQ ID NO: 106264 - DNA, 25 bp, Homo sapien
tctgagaccactgacgtgctctggc

SEQ ID NO: 106265 - DNA, 25 bp, Homo sapien
ggcccttcacagcgtcgggaggaac

SEQ ID NO: 106266 - DNA, 25 bp, Homo sapien
gaggcccttcacagcgtcgggagga

SEQ ID NO: 106267 - DNA, 25 bp, Homo sapien
atgaacaggggtgaggcccttcaca

SEQ ID NO: 106268 - DNA, 25 bp, Homo sapien
aggaacaggggtgaggcccttcaca

SEQ ID NO: 106269 - DNA, 25 bp, Homo sapien
cccttcacagcgtcgggaggaacag

SEQ ID NO: 106270 - DNA, 25 bp, Homo sapien
aggcccttcacagcgtcgggaggaa

SEQ ID NO: 106271 - DNA, 25 bp, Homo sapien
gcccttcacagcgtcgggaggaaca

SEQ ID NO: 106272 - DNA, 25 bp, Homo sapien
gaggaacaggggtgaggcccttcac

SEQ ID NO: 106273 - DNA, 25 bp, Homo sapien
gtcagctggcattcagggccacaca

SEQ ID NO: 106274 - DNA, 25 bp, Homo sapien
ccgggatgtcgaactcgtccttctc

SEQ ID NO: 106275 - DNA, 25 bp, Homo sapien
tcgatggagttctcgctgaacactg

SEQ ID NO: 106276 - DNA, 25 bp, Homo sapien
tcaccttcttgagcggcacggtctg

SEQ ID NO: 106277 - DNA, 25 bp, Homo sapien
cttggagcgcacaaaagggtccttc

SEQ ID NO: 106278 - DNA, 25 bp, Homo sapien
tgccgtagaggaacagggagccctc

SEQ ID NO: 106279 - DNA, 25 bp, Homo sapien
agctgggctgtgctcacacattccc

SEQ ID NO: 106280 - DNA, 25 bp, Homo sapien
gggtccttcagcatctccctgtggg

SEQ ID NO: 106281 - DNA, 25 bp, Homo sapien
aagccgcagctctctggggttttta

SEQ ID NO: 106282 - DNA, 25 bp, Homo sapien
ccaagtctctgccaggagccgaata

SEQ ID NO: 106283 - DNA, 25 bp, Homo sapien
tcacgctagtcgttgctcctggagg

SEQ ID NO: 106284 - DNA, 25 bp, Homo sapien
tgtagaggacaacatcgcacggctg

SEQ ID NO: 106285 - DNA, 25 bp, Homo sapien
ttccggcttctcctgaagttcgctc

SEQ ID NO: 106286 - DNA, 25 bp, Homo sapien
tgccttgaccggacgttacgccact

SEQ ID NO: 106287 - DNA, 25 bp, Homo sapien
cgacacttgctgtctcacggcgaga

SEQ ID NO: 106288 - DNA, 25 bp, Homo sapien
cacggcggtgactcctaaataggct

SEQ ID NO: 106289 - DNA, 25 bp, Homo sapien
ttcgcttccgctggcccatagtgat

SEQ ID NO: 106290 - DNA, 25 bp, Homo sapien
gtgacattatcaacgcgcgccaggg

SEQ ID NO: 106291 - DNA, 25 bp, Homo sapien
gccgccggctgtttaacttcgcttc

SEQ ID NO: 106292 - DNA, 25 bp, Homo sapien
caggcagcttcccatcgtacgattg

SEQ ID NO: 106293 - DNA, 25 bp, Homo sapien
tggtgccctactctgctgtgtttcg

SEQ ID NO: 106294 - DNA, 25 bp, Homo sapien
tgtactcttttctgacggttcgggc

SEQ ID NO: 106295 - DNA, 25 bp, Homo sapien
gtgacccaggtaacagattgtactc

SEQ ID NO: 106296 - DNA, 25 bp, Homo sapien
ccatagtgatctttgcagtgaccca

SEQ ID NO: 106297 - DNA, 25 bp, Homo sapien
aggcagcggcgcatacacctgcagc

SEQ ID NO: 106298 - DNA, 25 bp, Homo sapien
tggtcgctcccggaattaacgccgc

SEQ ID NO: 106299 - DNA, 25 bp, Homo sapien
attaacgccgcgcacgcgtcggagg

SEQ ID NO: 106300 - DNA, 25 bp, Homo sapien
gctcacctcgcaggccggcacagca

SEQ ID NO: 106301 - DNA, 25 bp, Homo sapien
gcggcgcatacacctgcagcaggaa

SEQ ID NO: 106302 - DNA, 25 bp, Homo sapien
acggggcagaggaaacctctcggca

SEQ ID NO: 106303 - DNA, 25 bp, Homo sapien
agaggaaacctctcggcatcagccc

SEQ ID NO: 106304 - DNA, 25 bp, Homo sapien
ttgcaggaccaatgcgagggaacgg

SEQ ID NO: 106305 - DNA, 25 bp, Homo sapien
cgctctgagagatacatgcgtgttc

SEQ ID NO: 106306 - DNA, 25 bp, Homo sapien
gacgggtgtgctctctgcatacgac

SEQ ID NO: 106307 - DNA, 25 bp, Homo sapien
cacatccacgttcccggggttggat

SEQ ID NO: 106308 - DNA, 25 bp, Homo sapien
tgcgcactgagggacacatccacgt

SEQ ID NO: 106309 - DNA, 25 bp, Homo sapien
gttccaagcgttatgtgcgcactga

SEQ ID NO: 106310 - DNA, 25 bp, Homo sapien
tgctctgagggacacatgcgtgttc

SEQ ID NO: 106311 - DNA, 25 bp, Homo sapien
tccaggggttacgtgtgtgctctga

SEQ ID NO: 106312 - DNA, 25 bp, Homo sapien
agtctgactgtgtcacgggcgttcc

SEQ ID NO: 106313 - DNA, 25 bp, Homo sapien
agaacccgacgcagacacgcgcttt

SEQ ID NO: 106314 - DNA, 25 bp, Homo sapien
gccgaagaggctgctacccagaggc

SEQ ID NO: 106315 - DNA, 25 bp, Homo sapien
tcccgccagcacctacggactcgcg

SEQ ID NO: 106316 - DNA, 25 bp, Homo sapien
cgccgactcgggagcagcaccgccc

SEQ ID NO: 106317 - DNA, 25 bp, Homo sapien
ctcttacctaacaggaagttgggtg

SEQ ID NO: 106318 - DNA, 25 bp, Homo sapien
cctaacaggaagttgggtggaagca

SEQ ID NO: 106319 - DNA, 25 bp, Homo sapien
gaacgcactccaacagaacccgacg

SEQ ID NO: 106320 - DNA, 25 bp, Homo sapien
tacgcctctgcctcgacgcgaacgc

SEQ ID NO: 106321 - DNA, 25 bp, Homo sapien
ggttctgcttctgctcggatctcca

SEQ ID NO: 106322 - DNA, 25 bp, Homo sapien
agcctcctcattctgctgccatgtt

SEQ ID NO: 106323 - DNA, 25 bp, Homo sapien
gaatgaaataatcccgcggccgcca

SEQ ID NO: 106324 - DNA, 25 bp, Homo sapien
tcctagctctccgttgggaatgaaa

SEQ ID NO: 106325 - DNA, 25 bp, Homo sapien
gacaaacgtctacaccctgccagag

SEQ ID NO: 106326 - DNA, 25 bp, Homo sapien
ccggcgaatcgcacagacaaacgtc

SEQ ID NO: 106327 - DNA, 25 bp, Homo sapien
ctcagaacggtgactgcggcagtgt

SEQ ID NO: 106328 - DNA, 25 bp, Homo sapien
tcctgtagccaatctagccgcggtg

SEQ ID NO: 106329 - DNA, 25 bp, Homo sapien
ctcctccctggacgccctcccgtgg

SEQ ID NO: 106330 - DNA, 25 bp, Homo sapien
cacccatgaagcaggcatgaaaggc

SEQ ID NO: 106331 - DNA, 25 bp, Homo sapien
tgaagcaggcatgaaaggctggcca

SEQ ID NO: 106332 - DNA, 25 bp, Homo sapien
aaaggctggccaggttggctaaatg

SEQ ID NO: 106333 - DNA, 25 bp, Homo sapien
gccaggttggctaaatgggaccaca

SEQ ID NO: 106334 - DNA, 25 bp, Homo sapien
aggttggctaaatgggaccacagca

SEQ ID NO: 106335 - DNA, 25 bp, Homo sapien
gggaccacagcagaagcatgagccc

SEQ ID NO: 106336 - DNA, 25 bp, Homo sapien
cccagaatgtgcacgaaggaagaga

SEQ ID NO: 106337 - DNA, 25 bp, Homo sapien
agtttccacaccgtgagctgctgag

SEQ ID NO: 106338 - DNA, 25 bp, Homo sapien
ccgcgtgagtgtcgcagtttccaca

SEQ ID NO: 106339 - DNA, 25 bp, Homo sapien
gtttccacaccgtgagctgctgaga

SEQ ID NO: 106340 - DNA, 25 bp, Homo sapien
gcagtttccacaccgtgagctgctg

SEQ ID NO: 106341 - DNA, 25 bp, Homo sapien
cacccgcgtgagtgtcgcagtttcc

SEQ ID NO: 106342 - DNA, 25 bp, Homo sapien
acccgcgtgagtgtcgcagtttcca

SEQ ID NO: 106343 - DNA, 25 bp, Homo sapien
tcgcagtttccacaccgtgagctgc

SEQ ID NO: 106344 - DNA, 25 bp, Homo sapien
cccgcgtgagtgtcgcagtttccac

SEQ ID NO: 106345 - DNA, 25 bp, Homo sapien
agcgcggtcgggacacagcgcctct

SEQ ID NO: 106346 - DNA, 25 bp, Homo sapien
cagcgcctctaggagaaagcctgga

SEQ ID NO: 106347 - DNA, 25 bp, Homo sapien
gggtacccagagctcttagcgggcc

SEQ ID NO: 106348 - DNA, 25 bp, Homo sapien
gttggaaagtaatcccacccgagca

SEQ ID NO: 106349 - DNA, 25 bp, Homo sapien
tcgggctccggcttcgaggtcccga

SEQ ID NO: 106350 - DNA, 25 bp, Homo sapien
ccgctgcagccgagcagaacgctga

SEQ ID NO: 106351 - DNA, 25 bp, Homo sapien
accaagcactgctctcgcgggactg

SEQ ID NO: 106352 - DNA, 25 bp, Homo sapien
gcccaaggtcttccgggctctgcgt

SEQ ID NO: 106353 - DNA, 25 bp, Homo sapien
cggagcgaacgcagccaaatctaca

SEQ ID NO: 106354 - DNA, 25 bp, Homo sapien
agagcattttccgtggggtccatcc

SEQ ID NO: 106355 - DNA, 25 bp, Homo sapien
tttagagtccaggtctgtcgcccgc

SEQ ID NO: 106356 - DNA, 25 bp, Homo sapien
atgaaagtaggcttgcgctccgctt

SEQ ID NO: 106357 - DNA, 25 bp, Homo sapien
cgcgattaccggttttctgagcacc

SEQ ID NO: 106358 - DNA, 25 bp, Homo sapien
gcggccatctgctagagcgcatttc

SEQ ID NO: 106359 - DNA, 25 bp, Homo sapien
caagctggatccactcgacggaacc

SEQ ID NO: 106360 - DNA, 25 bp, Homo sapien
atgaaacgccacctcctccgaagtg

SEQ ID NO: 106361 - DNA, 25 bp, Homo sapien
acgccgtgtccatgggttccagcgc

SEQ ID NO: 106362 - DNA, 25 bp, Homo sapien
cgtctcttccacactcagactggtg

SEQ ID NO: 106363 - DNA, 25 bp, Homo sapien
ccacactcagactggtgctgggagg

SEQ ID NO: 106364 - DNA, 25 bp, Homo sapien
ggtgggcacccgctcacttatagcc

SEQ ID NO: 106365 - DNA, 25 bp, Homo sapien
ccctcaacgctatatataacacaaa

SEQ ID NO: 106366 - DNA, 25 bp, Homo sapien
taacacaaattacagcctgcgggcc

SEQ ID NO: 106367 - DNA, 25 bp, Homo sapien
caaattacagcctgcgggccgaggg

SEQ ID NO: 106368 - DNA, 25 bp, Homo sapien
ggatacgccgtgtccatgggttcca

SEQ ID NO: 106369 - DNA, 25 bp, Homo sapien
gggtagagacgcttcagccgccgct

SEQ ID NO: 106370 - DNA, 25 bp, Homo sapien
ccagtcgctcgtgggcaggatcgct

SEQ ID NO: 106371 - DNA, 25 bp, Homo sapien
cccgccagtcgctcgtgggcaggat

SEQ ID NO: 106372 - DNA, 25 bp, Homo sapien
gacgactccggagactggggccaag

SEQ ID NO: 106373 - DNA, 25 bp, Homo sapien
tctcctgctcgttcagggccgagtc

SEQ ID NO: 106374 - DNA, 25 bp, Homo sapien
ttcagccgccgctgcaactccttct

SEQ ID NO: 106375 - DNA, 25 bp, Homo sapien
gccgggtagagacgcttcagccgcc

SEQ ID NO: 106376 - DNA, 25 bp, Homo sapien
aactccttctcctgctcgttcaggg

SEQ ID NO: 106377 - DNA, 25 bp, Homo sapien
gttctgagcacacccgtcttgcctg

SEQ ID NO: 106378 - DNA, 25 bp, Homo sapien
gttccctggaagaagcctccctgtg

SEQ ID NO: 106379 - DNA, 25 bp, Homo sapien
ttagcgctcctggatgctagtcccg

SEQ ID NO: 106380 - DNA, 25 bp, Homo sapien
gtacctgagcttcgcggagattttg

SEQ ID NO: 106381 - DNA, 25 bp, Homo sapien
cgtctttgtgcgcttcagtgttagc

SEQ ID NO: 106382 - DNA, 25 bp, Homo sapien
ttcaccgatgaggtacctgagcttc

SEQ ID NO: 106383 - DNA, 25 bp, Homo sapien
gctcgccgtccttagttcaccgatg

SEQ ID NO: 106384 - DNA, 25 bp, Homo sapien
atgcgaatttgctcacggagggccc

SEQ ID NO: 106385 - DNA, 25 bp, Homo sapien
gctgcgcagtcgagttttctttcca

SEQ ID NO: 106386 - DNA, 25 bp, Homo sapien
gcctgcatcttttgcaaagggaaca

SEQ ID NO: 106387 - DNA, 25 bp, Homo sapien
gagagaaagaaagtcccgcctgaaa

SEQ ID NO: 106388 - DNA, 25 bp, Homo sapien
gcggtcggccacgtccgctaggaac

SEQ ID NO: 106389 - DNA, 25 bp, Homo sapien
ctttccactgcactttcacgttctg

SEQ ID NO: 106390 - DNA, 25 bp, Homo sapien
ctttcacgttctgccggatgggatt

SEQ ID NO: 106391 - DNA, 25 bp, Homo sapien
gcagaagactcctcgaatgcagacc

SEQ ID NO: 106392 - DNA, 25 bp, Homo sapien
cctgaaataagcaaacgcggtggcg

SEQ ID NO: 106393 - DNA, 25 bp, Homo sapien
gtccaggcccagagtccgacagcgg

SEQ ID NO: 106394 - DNA, 25 bp, Homo sapien
gcgcgctcatgcctctcgcttttgg

SEQ ID NO: 106395 - DNA, 25 bp, Homo sapien
gcgtgctgaggtttcgctgccgccc

SEQ ID NO: 106396 - DNA, 25 bp, Homo sapien
cccagaccgtcggagagcgcagaga

SEQ ID NO: 106397 - DNA, 25 bp, Homo sapien
tctcctgcaggaaacgagtgcaggc

SEQ ID NO: 106398 - DNA, 25 bp, Homo sapien
ctttcctcggggaggctgtagctga

SEQ ID NO: 106399 - DNA, 25 bp, Homo sapien
caggaattcgtctcttctgggctaa

SEQ ID NO: 106400 - DNA, 25 bp, Homo sapien
cgcccaaaagcagaccctaggagtg

SEQ ID NO: 106401 - DNA, 25 bp, Homo sapien
gcagagcctggcctgcggtcctgct

SEQ ID NO: 106402 - DNA, 25 bp, Homo sapien
cgcatgtcacacgacaaggccagca

SEQ ID NO: 106403 - DNA, 25 bp, Homo sapien
cgcgacgcaaaagccagtagactca

SEQ ID NO: 106404 - DNA, 25 bp, Homo sapien
tggtttctgtggagaactcctgcac

SEQ ID NO: 106405 - DNA, 25 bp, Homo sapien
gagtgagatcgcctctggtttctgt

SEQ ID NO: 106406 - DNA, 25 bp, Homo sapien
cacgaagtcccagtaggatccctcg

SEQ ID NO: 106407 - DNA, 25 bp, Homo sapien
gtcctgctggctcttcgccaagctg

SEQ ID NO: 106408 - DNA, 25 bp, Homo sapien
agctgcccggtactcgcagggtgat

SEQ ID NO: 106409 - DNA, 25 bp, Homo sapien
gccgccggccaggtaaggcgatcgc

SEQ ID NO: 106410 - DNA, 25 bp, Homo sapien
gcccgctagctcctcgcgcgagctc

SEQ ID NO: 106411 - DNA, 25 bp, Homo sapien
tcagcgccgtagagacaaagccgcc

SEQ ID NO: 106412 - DNA, 25 bp, Homo sapien
cggctcagcgccgtagagacaaagc

SEQ ID NO: 106413 - DNA, 25 bp, Homo sapien
aggtaaggcgatcgcgcccgcggcc

SEQ ID NO: 106414 - DNA, 25 bp, Homo sapien
cgccgtcctggcaccaacttgaggg

SEQ ID NO: 106415 - DNA, 25 bp, Homo sapien
tcctggcaccaacttgaggggctgt

SEQ ID NO: 106416 - DNA, 25 bp, Homo sapien
ctggcaccaacttgaggggctgtgc

SEQ ID NO: 106417 - DNA, 25 bp, Homo sapien
tcacgcgcgcgagcgcggtctgcaa

SEQ ID NO: 106418 - DNA, 25 bp, Homo sapien
gtcggtcgcttgctcacgacgcgct

SEQ ID NO: 106419 - DNA, 25 bp, Homo sapien
cacagctctgcagctcgtggcagcg

SEQ ID NO: 106420 - DNA, 25 bp, Homo sapien
aacgcgcgggcataaaagggcagcc

SEQ ID NO: 106421 - DNA, 25 bp, Homo sapien
cgctctctctttcttgtagcctaca

SEQ ID NO: 106422 - DNA, 25 bp, Homo sapien
tcacgcggggattgctgtcgccgct

SEQ ID NO: 106423 - DNA, 25 bp, Homo sapien
ttccttttgcgggtcaacggcagcg

SEQ ID NO: 106424 - DNA, 25 bp, Homo sapien
ggaagttcccgaacgcgcgggcata

SEQ ID NO: 106425 - DNA, 25 bp, Homo sapien
ttggctgctgcctgttgctaaccca

SEQ ID NO: 106426 - DNA, 25 bp, Homo sapien
ccgccgatgcccacaaggtggcagt

SEQ ID NO: 106427 - DNA, 25 bp, Homo sapien
tcccattttacagctctcgttcatc

SEQ ID NO: 106428 - DNA, 25 bp, Homo sapien
cacctgactcgcgttctcattggct

SEQ ID NO: 106429 - DNA, 25 bp, Homo sapien
ttgctaacccacgtgaccggagccg

SEQ ID NO: 106430 - DNA, 25 bp, Homo sapien
cctgctccggaacggaccggggcat

SEQ ID NO: 106431 - DNA, 25 bp, Homo sapien
ggaccggggcatcgcactctcctgg

SEQ ID NO: 106432 - DNA, 25 bp, Homo sapien
gacagtcctcccgttctcgggttgc

SEQ ID NO: 106433 - DNA, 25 bp, Homo sapien
gtagttcccagcttccgtggccata

SEQ ID NO: 106434 - DNA, 25 bp, Homo sapien
ctctgtacacagacgcgaggcgctg

SEQ ID NO: 106435 - DNA, 25 bp, Homo sapien
ggcgccgccgatcaactagttcgca

SEQ ID NO: 106436 - DNA, 25 bp, Homo sapien
ctagttcgcaccgaggattcctctt

SEQ ID NO: 106437 - DNA, 25 bp, Homo sapien
attcctcgattccacaggcggttcg

SEQ ID NO: 106438 - DNA, 25 bp, Homo sapien
tccaagcgtttgttggcacggccag

SEQ ID NO: 106439 - DNA, 25 bp, Homo sapien
catgcattgagctagggagcctctc

SEQ ID NO: 106440 - DNA, 25 bp, Homo sapien
agccagcctctagcagtgtcgcacg

SEQ ID NO: 106441 - DNA, 25 bp, Homo sapien
atcgttctacctcgcaaccggagtc

SEQ ID NO: 106442 - DNA, 25 bp, Homo sapien
acaagcacatggcaaggcggacagc

SEQ ID NO: 106443 - DNA, 25 bp, Homo sapien
agcgcctcctgtgaaaatcgttcta

SEQ ID NO: 106444 - DNA, 25 bp, Homo sapien
tctacatcgagtcggtccgcgctca

SEQ ID NO: 106445 - DNA, 25 bp, Homo sapien
aggagttccacgatccgctcatcta

SEQ ID NO: 106446 - DNA, 25 bp, Homo sapien
ctcaacgatgagatgcggtttgtca

SEQ ID NO: 106447 - DNA, 25 bp, Homo sapien
cggtttgtcacgcagattcagcaca

SEQ ID NO: 106448 - DNA, 25 bp, Homo sapien
aaccggagtccgtgcacaagccgca

SEQ ID NO: 106449 - DNA, 25 bp, Homo sapien
aacatgctgcctgtgcgtctggcca

SEQ ID NO: 106450 - DNA, 25 bp, Homo sapien
gccacggccatgatggtgccctaca

SEQ ID NO: 106451 - DNA, 25 bp, Homo sapien
ggagagcgctctgtccttcaccatc

SEQ ID NO: 106452 - DNA, 25 bp, Homo sapien
tcatccgcgagtgatggttaccagg

SEQ ID NO: 106453 - DNA, 25 bp, Homo sapien
gctgcccggagaagatcacatcctg

SEQ ID NO: 106454 - DNA, 25 bp, Homo sapien
gccagtacctggtgatgcgcgccaa

SEQ ID NO: 106455 - DNA, 25 bp, Homo sapien
gcgcccaagcggaggattactcgca

SEQ ID NO: 106456 - DNA, 25 bp, Homo sapien
tggatgcgcaacaacctctcgctgg

SEQ ID NO: 106457 - DNA, 25 bp, Homo sapien
tgcttgcaggtggtacaagagaacg

SEQ ID NO: 106458 - DNA, 25 bp, Homo sapien
tcgggtgtcctgctcttgcttgcag

SEQ ID NO: 106459 - DNA, 25 bp, Homo sapien
aaaacgtcgtgttctgtctggagtg

SEQ ID NO: 106460 - DNA, 25 bp, Homo sapien
tgctctgcgccacgtggagaaacag

SEQ ID NO: 106461 - DNA, 25 bp, Homo sapien
aaacagaagtcctgccgagggctga

SEQ ID NO: 106462 - DNA, 25 bp, Homo sapien
ggctgaagttgatgtaccgctacga

SEQ ID NO: 106463 - DNA, 25 bp, Homo sapien
accgctacgatgaggtcagtccctg

SEQ ID NO: 106464 - DNA, 25 bp, Homo sapien
agctgcctcctgaccttcgggtgtc

SEQ ID NO: 106465 - DNA, 25 bp, Homo sapien
cacggcaaaggtagagaaaggacgc

SEQ ID NO: 106466 - DNA, 25 bp, Homo sapien
agggccagtagctcctcggctcatt

SEQ ID NO: 106467 - DNA, 25 bp, Homo sapien
tcgcgaagggtctccagcattgccg

SEQ ID NO: 106468 - DNA, 25 bp, Homo sapien
atacccacccggaggtgaaatcctg

SEQ ID NO: 106469 - DNA, 25 bp, Homo sapien
ctaagttactttgcgccgcccgacg

SEQ ID NO: 106470 - DNA, 25 bp, Homo sapien
cccagctgatgctgccgggaaagga

SEQ ID NO: 106471 - DNA, 25 bp, Homo sapien
aggcgcgctggcttctcacatgact

SEQ ID NO: 106472 - DNA, 25 bp, Homo sapien
cagccttgccaagggttaggccggc

SEQ ID NO: 106473 - DNA, 25 bp, Homo sapien
cgggcgatcgctcactctgagcagc

SEQ ID NO: 106474 - DNA, 25 bp, Homo sapien
cagggaaactcagccggctctggga

SEQ ID NO: 106475 - DNA, 25 bp, Homo sapien
agtccctgtcgcagcgcaggcagtt

SEQ ID NO: 106476 - DNA, 25 bp, Homo sapien
ccatgctgtgttatgtgacgaggcc

SEQ ID NO: 106477 - DNA, 25 bp, Homo sapien
ggcgaggactgcctcaaccaggtga

SEQ ID NO: 106478 - DNA, 25 bp, Homo sapien
caacccagcactttcccggaagaag

SEQ ID NO: 106479 - DNA, 25 bp, Homo sapien
cctgccgcaggtatgtgcgtgatgc

SEQ ID NO: 106480 - DNA, 25 bp, Homo sapien
gccgctatatcagcagagtccctgt

SEQ ID NO: 106481 - DNA, 25 bp, Homo sapien
gggccctccgtgctccaaacttgaa

SEQ ID NO: 106482 - DNA, 25 bp, Homo sapien
tctcttggcccatcgcgaacgagct

SEQ ID NO: 106483 - DNA, 25 bp, Homo sapien
ctgccctggggtcagaaactccgac

SEQ ID NO: 106484 - DNA, 25 bp, Homo sapien
gaaagggtcacctggctcaagccga

SEQ ID NO: 106485 - DNA, 25 bp, Homo sapien
tgccatggggcgatttcttgggaaa

SEQ ID NO: 106486 - DNA, 25 bp, Homo sapien
tggcatagatttccaagccgctaca

SEQ ID NO: 106487 - DNA, 25 bp, Homo sapien
accctcgtgcatgtggtttaccttg

SEQ ID NO: 106488 - DNA, 25 bp, Homo sapien
ccctgagcagatggagatttctcct

SEQ ID NO: 106489 - DNA, 25 bp, Homo sapien
ccctgcctgctttggtgtttgagac

SEQ ID NO: 106490 - DNA, 25 bp, Homo sapien
tgaaattctctacacgtcggtcccg

SEQ ID NO: 106491 - DNA, 25 bp, Homo sapien
actgccacgggctgtacacctgagg

SEQ ID NO: 106492 - DNA, 25 bp, Homo sapien
ggaggaagggcttcgccgccaatct

SEQ ID NO: 106493 - DNA, 25 bp, Homo sapien
agatgcggacctcaagctcgacttc

SEQ ID NO: 106494 - DNA, 25 bp, Homo sapien
gctcgacttcaaggatgtcctgctc

SEQ ID NO: 106495 - DNA, 25 bp, Homo sapien
cgacctaagcggagcagcctcaaga

SEQ ID NO: 106496 - DNA, 25 bp, Homo sapien
ctgccaggacgtgaggtgtctttaa

SEQ ID NO: 106497 - DNA, 25 bp, Homo sapien
cggcgtattgcatgacgacctggga

SEQ ID NO: 106498 - DNA, 25 bp, Homo sapien
atctcaccgttcaggacctccttgg

SEQ ID NO: 106499 - DNA, 25 bp, Homo sapien
cccgaaggatcacgactgctgtagt

SEQ ID NO: 106500 - DNA, 25 bp, Homo sapien
tgttgcacctccaggtcagctgcgg

SEQ ID NO: 106501 - DNA, 25 bp, Homo sapien
ttcacgatgagtggcctgttgcacc

SEQ ID NO: 106502 - DNA, 25 bp, Homo sapien
caggccacttttgtcgttgagggta

SEQ ID NO: 106503 - DNA, 25 bp, Homo sapien
cccaccgggagtggctctgaagcac

SEQ ID NO: 106504 - DNA, 25 bp, Homo sapien
gtggccaggcttccctaaatgcagg

SEQ ID NO: 106505 - DNA, 25 bp, Homo sapien
caggcattcgttgctccgctcttgg

SEQ ID NO: 106506 - DNA, 25 bp, Homo sapien
ccgctcttggttggatttcattttt

SEQ ID NO: 106507 - DNA, 25 bp, Homo sapien
ccagccctgtggacaatgctttgtg

SEQ ID NO: 106508 - DNA, 25 bp, Homo sapien
atctcgcgcttcttgggaggcaggc

SEQ ID NO: 106509 - DNA, 25 bp, Homo sapien
ccttctcctcggaggaccggctggt

SEQ ID NO: 106510 - DNA, 25 bp, Homo sapien
ttgcccgggagccatgctgtgccct

SEQ ID NO: 106511 - DNA, 25 bp, Homo sapien
ttgtaaaccaagctccaccgaggtc

SEQ ID NO: 106512 - DNA, 25 bp, Homo sapien
atgctttgtgtaaacctattccctg

SEQ ID NO: 106513 - DNA, 25 bp, Homo sapien
tgtctgcggtatactctgctctctc

SEQ ID NO: 106514 - DNA, 25 bp, Homo sapien
cgctccagtatgtaaatgtgtaata

SEQ ID NO: 106515 - DNA, 25 bp, Homo sapien
gccgcagctcaaggatccgacttca

SEQ ID NO: 106516 - DNA, 25 bp, Homo sapien
gggcacctttcccaaagagtggctc

SEQ ID NO: 106517 - DNA, 25 bp, Homo sapien
cggctccgccactgtagtagaaatg

SEQ ID NO: 106518 - DNA, 25 bp, Homo sapien
aggacatggctctccgcacttgcga

SEQ ID NO: 106519 - DNA, 25 bp, Homo sapien
cagctgttttccgtgcagccgattg

SEQ ID NO: 106520 - DNA, 25 bp, Homo sapien
tgctccacggggcttgttttggatc

SEQ ID NO: 106521 - DNA, 25 bp, Homo sapien
ctgaagaccggagacgtgtacgcgc

SEQ ID NO: 106522 - DNA, 25 bp, Homo sapien
acctgctgaagaccggagacgtgta

SEQ ID NO: 106523 - DNA, 25 bp, Homo sapien
ttcccaacctgctgaagaccggaga

SEQ ID NO: 106524 - DNA, 25 bp, Homo sapien
gtggaccttcccaacctgctgaaga

SEQ ID NO: 106525 - DNA, 25 bp, Homo sapien
gctgtggaccttcccaacctgctga

SEQ ID NO: 106526 - DNA, 25 bp, Homo sapien
atgggctgtggaccttcccaacctg

SEQ ID NO: 106527 - DNA, 25 bp, Homo sapien
cagcatgggctgtggaccttcccaa

SEQ ID NO: 106528 - DNA, 25 bp, Homo sapien
gcccgagcgcagtagcaggggcgta

SEQ ID NO: 106529 - DNA, 25 bp, Homo sapien
ccagacgatccggagaatttgtacg

SEQ ID NO: 106530 - DNA, 25 bp, Homo sapien
caaggcacctgattcctaaggaaga

SEQ ID NO: 106531 - DNA, 25 bp, Homo sapien
cacccgcttcttcgcttgagaacta

SEQ ID NO: 106532 - DNA, 25 bp, Homo sapien
gtggaaaccgcttgcacattctata

SEQ ID NO: 106533 - DNA, 25 bp, Homo sapien
tcgtcttccagatcccacggcggga

SEQ ID NO: 106534 - DNA, 25 bp, Homo sapien
cccggggctatggatttgtaagttg

SEQ ID NO: 106535 - DNA, 25 bp, Homo sapien
cctgcgcaagtacttcgaggtcttc

SEQ ID NO: 106536 - DNA, 25 bp, Homo sapien
gcgaagatgcacacgacccagaagg

SEQ ID NO: 106537 - DNA, 25 bp, Homo sapien
gggatcttggcacctgctacctcta

SEQ ID NO: 106538 - DNA, 25 bp, Homo sapien
ctccgccagggcaaagagacgcacg

SEQ ID NO: 106539 - DNA, 25 bp, Homo sapien
tgcaggatgcttccagctgccagca

SEQ ID NO: 106540 - DNA, 25 bp, Homo sapien
gcgcttgacggctacacagagcacc

SEQ ID NO: 106541 - DNA, 25 bp, Homo sapien
cccagctggtagcagagcacctggc

SEQ ID NO: 106542 - DNA, 25 bp, Homo sapien
agcagcgggtagagtgcaaagccac

SEQ ID NO: 106543 - DNA, 25 bp, Homo sapien
caggaactcgctgaggctaagctcc

SEQ ID NO: 106544 - DNA, 25 bp, Homo sapien
tgcggcctgcgccatccacgtagat

SEQ ID NO: 106545 - DNA, 25 bp, Homo sapien
ccgacaaattggagccgccgcgcga

SEQ ID NO: 106546 - DNA, 25 bp, Homo sapien
gattgttgacgcctgcggttgctgc

SEQ ID NO: 106547 - DNA, 25 bp, Homo sapien
gccgccgcagccgacaaattggagc

SEQ ID NO: 106548 - DNA, 25 bp, Homo sapien
agagagaccagctcggctgagcgcc

SEQ ID NO: 106549 - DNA, 25 bp, Homo sapien
agtactcccggcaagtgcacgagtg

SEQ ID NO: 106550 - DNA, 25 bp, Homo sapien
gcagagcttcccttcgggcggcgct

SEQ ID NO: 106551 - DNA, 25 bp, Homo sapien
ctccagtgacgagggtaggatccgc

SEQ ID NO: 106552 - DNA, 25 bp, Homo sapien
acggagcagtgacaggtatcccaga

SEQ ID NO: 106553 - DNA, 25 bp, Homo sapien
ggtcccatacctgatgctgttgtcg

SEQ ID NO: 106554 - DNA, 25 bp, Homo sapien
ggcgcccgacgcatttgcatcatca

SEQ ID NO: 106555 - DNA, 25 bp, Homo sapien
tcgcgagccagaatgtcgtcactca

SEQ ID NO: 106556 - DNA, 25 bp, Homo sapien
ccgcagaggacagcacgaacagttc

SEQ ID NO: 106557 - DNA, 25 bp, Homo sapien
gcatcatcatgctgcgacgagctga

SEQ ID NO: 106558 - DNA, 25 bp, Homo sapien
ttcaacaacggaacgcggcttctcg

SEQ ID NO: 106559 - DNA, 25 bp, Homo sapien
tgaggcctaactcgaccgccgactg

SEQ ID NO: 106560 - DNA, 25 bp, Homo sapien
ccctgctggtaaggcttaattggcc

SEQ ID NO: 106561 - DNA, 25 bp, Homo sapien
atccgacatgttggctgcgctcgcc

SEQ ID NO: 106562 - DNA, 25 bp, Homo sapien
cgccgccatgttccgcgcccgtcac

SEQ ID NO: 106563 - DNA, 25 bp, Homo sapien
gccgtgagctcgagccgccttctgg

SEQ ID NO: 106564 - DNA, 25 bp, Homo sapien
ccttggtatccgacatgttggctgc

SEQ ID NO: 106565 - DNA, 25 bp, Homo sapien
cacctcgtcggttcatgggccggac

SEQ ID NO: 106566 - DNA, 25 bp, Homo sapien
aagctcctcacctcgtcggttcatg

SEQ ID NO: 106567 - DNA, 25 bp, Homo sapien
cctcagcccgagcagaaataaaaaa

SEQ ID NO: 106568 - DNA, 25 bp, Homo sapien
gcaacttttaccttggtatccgaca

SEQ ID NO: 106569 - DNA, 25 bp, Homo sapien
tacctaatgtcttgggcagcgtccc

SEQ ID NO: 106570 - DNA, 25 bp, Homo sapien
ctgccggtggccaaacttctcaaag

SEQ ID NO: 106571 - DNA, 25 bp, Homo sapien
ccttgcactcgagcaggctgatctc

SEQ ID NO: 106572 - DNA, 25 bp, Homo sapien
tctcggtcacggtcacagtcatggt

SEQ ID NO: 106573 - DNA, 25 bp, Homo sapien
ggtgacatccacagggtacctaatg

SEQ ID NO: 106574 - DNA, 25 bp, Homo sapien
cggcgtcagtgacaaccacatggca

SEQ ID NO: 106575 - DNA, 25 bp, Homo sapien
cccgtcttgggacaaagcgccagtc

SEQ ID NO: 106576 - DNA, 25 bp, Homo sapien
gctcgcctgcagaatgggcactcga

SEQ ID NO: 106577 - DNA, 25 bp, Homo sapien
ggccatccagagctcgcccagcaag

SEQ ID NO: 106578 - DNA, 25 bp, Homo sapien
ccgcggtcccactcgcgggcgcagt

SEQ ID NO: 106579 - DNA, 25 bp, Homo sapien
tcaagctgcctaagggcctcgggcg

SEQ ID NO: 106580 - DNA, 25 bp, Homo sapien
tcgtcctcctccaattcggccagcg

SEQ ID NO: 106581 - DNA, 25 bp, Homo sapien
ctccaggccgccctgatgagcccgc

SEQ ID NO: 106582 - DNA, 25 bp, Homo sapien
tcccagatgaccaccgagggcgggc

SEQ ID NO: 106583 - DNA, 25 bp, Homo sapien
ccgggtcccagatgaccaccgaggg

SEQ ID NO: 106584 - DNA, 25 bp, Homo sapien
ggaagtccgagagacagagcgagga

SEQ ID NO: 106585 - DNA, 25 bp, Homo sapien
cacaaagcagcttggttggggtgca

SEQ ID NO: 106586 - DNA, 25 bp, Homo sapien
cctttctgtacagcggtgccttttc

SEQ ID NO: 106587 - DNA, 25 bp, Homo sapien
acctcttcagcgcaaaggtgagccc

SEQ ID NO: 106588 - DNA, 25 bp, Homo sapien
gggcagttgcttctccgacttcgaa

SEQ ID NO: 106589 - DNA, 25 bp, Homo sapien
cgacttcgaaaagcttccgaaagct

SEQ ID NO: 106590 - DNA, 25 bp, Homo sapien
ggagtaggaactccctcgcttgttc

SEQ ID NO: 106591 - DNA, 25 bp, Homo sapien
cttcccggccgatagggtgcggcca

SEQ ID NO: 106592 - DNA, 25 bp, Homo sapien
tcgggtgacagcgttgcacaaagca

SEQ ID NO: 106593 - DNA, 25 bp, Homo sapien
ggacacctgccctgaaagttgcctc

SEQ ID NO: 106594 - DNA, 25 bp, Homo sapien
gaggcggacatgctgtgaacctgca

SEQ ID NO: 106595 - DNA, 25 bp, Homo sapien
gtgaacctgcatgcgggaagaaagc

SEQ ID NO: 106596 - DNA, 25 bp, Homo sapien
atgatgctacccttcccgcgggaca

SEQ ID NO: 106597 - DNA, 25 bp, Homo sapien
cgaagcagcccttaccgcggatttc

SEQ ID NO: 106598 - DNA, 25 bp, Homo sapien
ggggcctgcgtgtttattgtttcca

SEQ ID NO: 106599 - DNA, 25 bp, Homo sapien
catttcgggttctttctcggacgcg

SEQ ID NO: 106600 - DNA, 25 bp, Homo sapien
ggcggccaccctgaatgatgctacc

SEQ ID NO: 106601 - DNA, 25 bp, Homo sapien
gtagctaggcgacctgaatgtcttc

SEQ ID NO: 106602 - DNA, 25 bp, Homo sapien
ggggccaaaactcttcggaatcagc

SEQ ID NO: 106603 - DNA, 25 bp, Homo sapien
cctgaacccgcagcctgaagaagct

SEQ ID NO: 106604 - DNA, 25 bp, Homo sapien
gcctgaagaagctgatagcggaccc

SEQ ID NO: 106605 - DNA, 25 bp, Homo sapien
ctccttacttggacctcgggcgcaa

SEQ ID NO: 106606 - DNA, 25 bp, Homo sapien
agcgttcgccctcgagctgcctgga

SEQ ID NO: 106607 - DNA, 25 bp, Homo sapien
ctccttcctaaagagggtgcgtttg

SEQ ID NO: 106608 - DNA, 25 bp, Homo sapien
tgaatgtcttccatacctgaacccg

SEQ ID NO: 106609 - DNA, 25 bp, Homo sapien
atggaagagctcctgtccggtgtgc

SEQ ID NO: 106610 - DNA, 25 bp, Homo sapien
tagggttaaggccaacacctgcagc

SEQ ID NO: 106611 - DNA, 25 bp, Homo sapien
ccgacccgtaggtctgggagcgcaa

SEQ ID NO: 106612 - DNA, 25 bp, Homo sapien
gcttcctgtataaataaacgcgctg

SEQ ID NO: 106613 - DNA, 25 bp, Homo sapien
acccacatgggaagtaggaagtgcg

SEQ ID NO: 106614 - DNA, 25 bp, Homo sapien
gagcgcaagtcctgttgcagtcttg

SEQ ID NO: 106615 - DNA, 25 bp, Homo sapien
ctgcagctgaagtacgacccacatg

SEQ ID NO: 106616 - DNA, 25 bp, Homo sapien
tgcaaagtgtaaagctgtcagccgc

SEQ ID NO: 106617 - DNA, 25 bp, Homo sapien
cgaagggccgtcatcttgttggaaa

SEQ ID NO: 106618 - DNA, 25 bp, Homo sapien
gcgcataccaaaggcagactccttt

SEQ ID NO: 106619 - DNA, 25 bp, Homo sapien
tttcccagagcgcataccaaaggca

SEQ ID NO: 106620 - DNA, 25 bp, Homo sapien
atgagcaccacttccacactcaggg

SEQ ID NO: 106621 - DNA, 25 bp, Homo sapien
cctaaggctgaatgagcaccacttc

SEQ ID NO: 106622 - DNA, 25 bp, Homo sapien
ttgttggaaaagaatgcagaaatgc

SEQ ID NO: 106623 - DNA, 25 bp, Homo sapien
gccgtcatcttgttggaaaagaatg

SEQ ID NO: 106624 - DNA, 25 bp, Homo sapien
gcagactcctttgcaggctccacga

SEQ ID NO: 106625 - DNA, 25 bp, Homo sapien
aggcgcggagcactgcaacttctct

SEQ ID NO: 106626 - DNA, 25 bp, Homo sapien
gaacaactgacttctgcgcggggcg

SEQ ID NO: 106627 - DNA, 25 bp, Homo sapien
agcagcagatctaggaggccgtcga

SEQ ID NO: 106628 - DNA, 25 bp, Homo sapien
ggtctcggcgcgatatccctaggcc

SEQ ID NO: 106629 - DNA, 25 bp, Homo sapien
agcctcgctgctcggctacagtctg

SEQ ID NO: 106630 - DNA, 25 bp, Homo sapien
tgtagttcgctctctccatggtttg

SEQ ID NO: 106631 - DNA, 25 bp, Homo sapien
ccttgcccttggctaagagagaggg

SEQ ID NO: 106632 - DNA, 25 bp, Homo sapien
agctcaggaactgcgccacgctgcg

SEQ ID NO: 106633 - DNA, 25 bp, Homo sapien
tctgggcggccgagccaatgaatca

SEQ ID NO: 106634 - DNA, 25 bp, Homo sapien
cacccgggcgccctgaagcccagcg

SEQ ID NO: 106635 - DNA, 25 bp, Homo sapien
gcgggctccgtgaatgggtgacgtc

SEQ ID NO: 106636 - DNA, 25 bp, Homo sapien
cgtctgcgttgtcagggcgaccgcc

SEQ ID NO: 106637 - DNA, 25 bp, Homo sapien
ccagctggaagtcattgtgcgggct

SEQ ID NO: 106638 - DNA, 25 bp, Homo sapien
cccagcgcaagcaagcgagtgagcg

SEQ ID NO: 106639 - DNA, 25 bp, Homo sapien
tgaagcccagcgcaagcaagcgagt

SEQ ID NO: 106640 - DNA, 25 bp, Homo sapien
ccaatgaatcagctgtccgggggag

SEQ ID NO: 106641 - DNA, 25 bp, Homo sapien
ttaaggcactggaatcccacggatg

SEQ ID NO: 106642 - DNA, 25 bp, Homo sapien
gcgcgtctttcttaaggcactggaa

SEQ ID NO: 106643 - DNA, 25 bp, Homo sapien
ccctgggcgccgtgctattaggagt

SEQ ID NO: 106644 - DNA, 25 bp, Homo sapien
cctcagcagcctagtcgggataagg

SEQ ID NO: 106645 - DNA, 25 bp, Homo sapien
ggagagtgaattccggccgcacatt

SEQ ID NO: 106646 - DNA, 25 bp, Homo sapien
gcacattcccgcagttcttcgcagg

SEQ ID NO: 106647 - DNA, 25 bp, Homo sapien
cccgcagttcttcgcaggaacttcg

SEQ ID NO: 106648 - DNA, 25 bp, Homo sapien
tgccttcttgaacagcgcgtctttc

SEQ ID NO: 106649 - DNA, 25 bp, Homo sapien
cctttcccttggtgttcggttgctg

SEQ ID NO: 106650 - DNA, 25 bp, Homo sapien
cgagcgcgttgtttgcgcctgctaa

SEQ ID NO: 106651 - DNA, 25 bp, Homo sapien
tttccgaggacaatccaggaccgtg

SEQ ID NO: 106652 - DNA, 25 bp, Homo sapien
gcgcgccagcctgatttccgaggac

SEQ ID NO: 106653 - DNA, 25 bp, Homo sapien
agtggagatcctgcagcacgttatc

SEQ ID NO: 106654 - DNA, 25 bp, Homo sapien
aacgactgctatagccgcctgcgga

SEQ ID NO: 106655 - DNA, 25 bp, Homo sapien
cgctgtgcctgcagtgcgatatgaa

SEQ ID NO: 106656 - DNA, 25 bp, Homo sapien
cgacagcattctgtgccgctgagcc

SEQ ID NO: 106657 - DNA, 25 bp, Homo sapien
gcgaaccggcgcaaactctcgaggc

SEQ ID NO: 106658 - DNA, 25 bp, Homo sapien
ctgcgtttccctttcaagccgtaga

SEQ ID NO: 106659 - DNA, 25 bp, Homo sapien
tcaagccgtagagggttcctctgcc

SEQ ID NO: 106660 - DNA, 25 bp, Homo sapien
tgccatcctgcatcttcgggaggtg

SEQ ID NO: 106661 - DNA, 25 bp, Homo sapien
cctgcagttacctggtccagcggga

SEQ ID NO: 106662 - DNA, 25 bp, Homo sapien
gacggtggctaacactttcgcccgc

SEQ ID NO: 106663 - DNA, 25 bp, Homo sapien
ctcgaggcgcaaacttggctttggc

SEQ ID NO: 106664 - DNA, 25 bp, Homo sapien
gcgggcgccttccactagagagcac

SEQ ID NO: 106665 - DNA, 25 bp, Homo sapien
ctccatggacaaaagggcactgcta

SEQ ID NO: 106666 - DNA, 25 bp, Homo sapien
cctccaacgagggttcattgttaga

SEQ ID NO: 106667 - DNA, 25 bp, Homo sapien
gttagacctgagtgctcttcccggc

SEQ ID NO: 106668 - DNA, 25 bp, Homo sapien
ttgccttggcgcgaaccacatcaaa

SEQ ID NO: 106669 - DNA, 25 bp, Homo sapien
ttaggatctgtaactcccggcaaca

SEQ ID NO: 106670 - DNA, 25 bp, Homo sapien
gggctgcgcttgacacattttagga

SEQ ID NO: 106671 - DNA, 25 bp, Homo sapien
gcttcctctttctcgggcgtaggaa

SEQ ID NO: 106672 - DNA, 25 bp, Homo sapien
ccgctgcagcctccatggacaaaag

SEQ ID NO: 106673 - DNA, 25 bp, Homo sapien
ttgctttaacgcgacgagggaactc

SEQ ID NO: 106674 - DNA, 25 bp, Homo sapien
gtcttgctcccgtccctataggata

SEQ ID NO: 106675 - DNA, 25 bp, Homo sapien
cggcacacagatcagcacatgtcta

SEQ ID NO: 106676 - DNA, 25 bp, Homo sapien
tggagttctccattaagccctgcga

SEQ ID NO: 106677 - DNA, 25 bp, Homo sapien
cacttcaggaaggagctcgggcttc

SEQ ID NO: 106678 - DNA, 25 bp, Homo sapien
cccgagcctgctattttgtggtcca

SEQ ID NO: 106679 - DNA, 25 bp, Homo sapien
ggacttgccatcagaacttgcttta

SEQ ID NO: 106680 - DNA, 25 bp, Homo sapien
cccgaagcgacgtgcactttatggt

SEQ ID NO: 106681 - DNA, 25 bp, Homo sapien
caagaaaaatctaactaagtaaatg

SEQ ID NO: 106682 - DNA, 25 bp, Homo sapien
gcaccggattctgttgggggctgaa

SEQ ID NO: 106683 - DNA, 25 bp, Homo sapien
ctcgagggaaatgagtaagcaagaa

SEQ ID NO: 106684 - DNA, 25 bp, Homo sapien
tgagtaagcaagaaaaatctaacta

SEQ ID NO: 106685 - DNA, 25 bp, Homo sapien
tggatgggcgatagaaaaccggagg

SEQ ID NO: 106686 - DNA, 25 bp, Homo sapien
aaccggagggggcttctcgccaatg

SEQ ID NO: 106687 - DNA, 25 bp, Homo sapien
gggaaatgagtaagcaagaaaaatc

SEQ ID NO: 106688 - DNA, 25 bp, Homo sapien
gtgctcgagggaaatgagtaagcaa

SEQ ID NO: 106689 - DNA, 25 bp, Homo sapien
agagagcatttagtcgtccagagca

SEQ ID NO: 106690 - DNA, 25 bp, Homo sapien
gcctgctctgcccttctgaaagaga

SEQ ID NO: 106691 - DNA, 25 bp, Homo sapien
tcaactggcttgtaacgctggctta

SEQ ID NO: 106692 - DNA, 25 bp, Homo sapien
cgagaccttccgcagagcttggctt

SEQ ID NO: 106693 - DNA, 25 bp, Homo sapien
tggcttcctcgtaactgcgcccagg

SEQ ID NO: 106694 - DNA, 25 bp, Homo sapien
cgtggccctcgcaaactcagagagc

SEQ ID NO: 106695 - DNA, 25 bp, Homo sapien
tccagtctttcctgcacgagcgagg

SEQ ID NO: 106696 - DNA, 25 bp, Homo sapien
aaccgcctcctacaggtgctgggga

SEQ ID NO: 106697 - DNA, 25 bp, Homo sapien
gaagacgacctgctcgacctgaacc

SEQ ID NO: 106698 - DNA, 25 bp, Homo sapien
tccgacgacgagttcgaagacgacc

SEQ ID NO: 106699 - DNA, 25 bp, Homo sapien
agaaggtgaagtccggcaacgccaa

SEQ ID NO: 106700 - DNA, 25 bp, Homo sapien
cactcgctgtacaaggcgcggactc

SEQ ID NO: 106701 - DNA, 25 bp, Homo sapien
gttagcaaaccgcacgccaagctca

SEQ ID NO: 106702 - DNA, 25 bp, Homo sapien
gcaaacgctggaagctgctcaaaga

SEQ ID NO: 106703 - DNA, 25 bp, Homo sapien
aggtgaagcgcgtctacctgttcgg

SEQ ID NO: 106704 - DNA, 25 bp, Homo sapien
gcgacaagatccctttcattcgaga

SEQ ID NO: 106705 - DNA, 25 bp, Homo sapien
gaaccccgttggaagcgcagcagcg

SEQ ID NO: 106706 - DNA, 25 bp, Homo sapien
cggcgctaggaaatgacccgagaac

SEQ ID NO: 106707 - DNA, 25 bp, Homo sapien
ggcgctaggaaatgacccgagaacc

SEQ ID NO: 106708 - DNA, 25 bp, Homo sapien
ccgagaaccccgttggaagcgcagc

SEQ ID NO: 106709 - DNA, 25 bp, Homo sapien
cggaggaggacacgaactggaaggg

SEQ ID NO: 106710 - DNA, 25 bp, Homo sapien
ctgaaatggatttgcacgttgggga

SEQ ID NO: 106711 - DNA, 25 bp, Homo sapien
aaatggatttgcacgttggggagct

SEQ ID NO: 106712 - DNA, 25 bp, Homo sapien
gcgctaggaaatgacccgagaaccc

SEQ ID NO: 106713 - DNA, 25 bp, Homo sapien
ctccacgcaggcgaattcccgtttg

SEQ ID NO: 106714 - DNA, 25 bp, Homo sapien
cagccagtgtgaccggcgctaggaa

SEQ ID NO: 106715 - DNA, 25 bp, Homo sapien
cgcaggcgaattcccgtttggggct

SEQ ID NO: 106716 - DNA, 25 bp, Homo sapien
ctgagagactccacgcaggcgaatt

SEQ ID NO: 106717 - DNA, 25 bp, Homo sapien
ggaacgccgggactgagagactcca

SEQ ID NO: 106718 - DNA, 25 bp, Homo sapien
cgaatttggccgatggcagatgttt

SEQ ID NO: 106719 - DNA, 25 bp, Homo sapien
ctccggggtgacgaatttggccgat

SEQ ID NO: 106720 - DNA, 25 bp, Homo sapien
cgcgtgatgaagacagaaggctccg

SEQ ID NO: 106721 - DNA, 25 bp, Homo sapien
aggttcctaaccctgcgtgaggctc

SEQ ID NO: 106722 - DNA, 25 bp, Homo sapien
tgcctcaggttaagtaggcagaccc

SEQ ID NO: 106723 - DNA, 25 bp, Homo sapien
aggctctttcacctgcctcaggtta

SEQ ID NO: 106724 - DNA, 25 bp, Homo sapien
cctaaccctgcgtgaggctctttca

SEQ ID NO: 106725 - DNA, 25 bp, Homo sapien
agtcgcttccggcttacgtcacgtc

SEQ ID NO: 106726 - DNA, 25 bp, Homo sapien
tatttctcggcggaaagtcgcttcc

SEQ ID NO: 106727 - DNA, 25 bp, Homo sapien
ggaaagtcgcttccggcttacgtca

SEQ ID NO: 106728 - DNA, 25 bp, Homo sapien
atggtcaaagatatttagttcccgg

SEQ ID NO: 106729 - DNA, 25 bp, Homo sapien
ggcccgttcatggtgccgtcaaagg

SEQ ID NO: 106730 - DNA, 25 bp, Homo sapien
tggtgttcctgtccatgcagcctca

SEQ ID NO: 106731 - DNA, 25 bp, Homo sapien
gcgaggaaacatccgctcagtcttt

SEQ ID NO: 106732 - DNA, 25 bp, Homo sapien
accttgagaaatggtgaggcttccc

SEQ ID NO: 106733 - DNA, 25 bp, Homo sapien
gccatcactcatgtctgcgcttgga

SEQ ID NO: 106734 - DNA, 25 bp, Homo sapien
ccagatcttccctagcacggtgttg

SEQ ID NO: 106735 - DNA, 25 bp, Homo sapien
tggggagcttggacttcaccatctc

SEQ ID NO: 106736 - DNA, 25 bp, Homo sapien
ggtcccgtgaagcaacctcagctca

SEQ ID NO: 106737 - DNA, 25 bp, Homo sapien
tctcggcctcactttgcggccagag

SEQ ID NO: 106738 - DNA, 25 bp, Homo sapien
ctgcccagtactgtacgcgtccaga

SEQ ID NO: 106739 - DNA, 25 bp, Homo sapien
gcgtccagactaaagaaacatcatt

SEQ ID NO: 106740 - DNA, 25 bp, Homo sapien
acatcattcgcttaaggggctggga

SEQ ID NO: 106741 - DNA, 25 bp, Homo sapien
gattgtcccggtttctccttctggc

SEQ ID NO: 106742 - DNA, 25 bp, Homo sapien
cgtctttgttctgctctggaggaga

SEQ ID NO: 106743 - DNA, 25 bp, Homo sapien
cgcgcacgaactctaggggaagttg

SEQ ID NO: 106744 - DNA, 25 bp, Homo sapien
tggttgtaaagtttccgagagcggc

SEQ ID NO: 106745 - DNA, 25 bp, Homo sapien
ggtcatcctgagagccttgccttcg

SEQ ID NO: 106746 - DNA, 25 bp, Homo sapien
cccgagtcagatctttggggtgagc

SEQ ID NO: 106747 - DNA, 25 bp, Homo sapien
gtcagagggcgcctggtcatcctga

SEQ ID NO: 106748 - DNA, 25 bp, Homo sapien
gccttgccttcgcagtttgagatta

SEQ ID NO: 106749 - DNA, 25 bp, Homo sapien
ccttcgcagtttgagattaggggaa

SEQ ID NO: 106750 - DNA, 25 bp, Homo sapien
agctgggaattcttcctcggagccc

SEQ ID NO: 106751 - DNA, 25 bp, Homo sapien
cgctgcgcctgcagcaacaggtagc

SEQ ID NO: 106752 - DNA, 25 bp, Homo sapien
agtcagatctttggggtgagcacga

SEQ ID NO: 106753 - DNA, 25 bp, Homo sapien
aaagtgtccgaacgcctcgtggact

SEQ ID NO: 106754 - DNA, 25 bp, Homo sapien
gtccgaacgcctcgtggactgcagc

SEQ ID NO: 106755 - DNA, 25 bp, Homo sapien
gggtatctccctctcgcaactttgc

SEQ ID NO: 106756 - DNA, 25 bp, Homo sapien
cggggtatctccctctcgcaacttt

SEQ ID NO: 106757 - DNA, 25 bp, Homo sapien
aactctgatgaactctctttcctcc

SEQ ID NO: 106758 - DNA, 25 bp, Homo sapien
ctgtcaggccgggaaaaagtgtccg

SEQ ID NO: 106759 - DNA, 25 bp, Homo sapien
ggggaactctgatgaactctctttc

SEQ ID NO: 106760 - DNA, 25 bp, Homo sapien
tctttgtctgctccgggacttggaa

SEQ ID NO: 106761 - DNA, 25 bp, Homo sapien
cggagatcgcgacagcctgtagtta

SEQ ID NO: 106762 - DNA, 25 bp, Homo sapien
gcagaaccagctatgtcggcctacg

SEQ ID NO: 106763 - DNA, 25 bp, Homo sapien
tcggcctacggcatgcccatgtaca

SEQ ID NO: 106764 - DNA, 25 bp, Homo sapien
ccggcgaggatagagcacatgaccc

SEQ ID NO: 106765 - DNA, 25 bp, Homo sapien
tccgactgcccattagcctcagaga

SEQ ID NO: 106766 - DNA, 25 bp, Homo sapien
tagttaccagcgtttccagaagagc

SEQ ID NO: 106767 - DNA, 25 bp, Homo sapien
gccgttcttggggaatctgaccacg

SEQ ID NO: 106768 - DNA, 25 bp, Homo sapien
cgcctgttcccgtacaaggagtgca

SEQ ID NO: 106769 - DNA, 25 bp, Homo sapien
cgggactcccagctgtcaatcaggc

SEQ ID NO: 106770 - DNA, 25 bp, Homo sapien
acgcgggactcccagctgtcaatca

SEQ ID NO: 106771 - DNA, 25 bp, Homo sapien
cgggctgagctctacgaggcggagc

SEQ ID NO: 106772 - DNA, 25 bp, Homo sapien
cccagctgtcaatcaggcgcgggct

SEQ ID NO: 106773 - DNA, 25 bp, Homo sapien
gctctcggaaagctggaaccctgcc

SEQ ID NO: 106774 - DNA, 25 bp, Homo sapien
ccgctctcggaaagctggaaccctg

SEQ ID NO: 106775 - DNA, 25 bp, Homo sapien
gactcccagctgtcaatcaggcgcg

SEQ ID NO: 106776 - DNA, 25 bp, Homo sapien
cactcgccgctctcggaaagctgga

SEQ ID NO: 106777 - DNA, 25 bp, Homo sapien
accaggttcacctgctacgggcaga

SEQ ID NO: 106778 - DNA, 25 bp, Homo sapien
ttcaccgtggcgtgcacagccaatc

SEQ ID NO: 106779 - DNA, 25 bp, Homo sapien
gtagacgctcaagtttttcaccgtg

SEQ ID NO: 106780 - DNA, 25 bp, Homo sapien
aggcgtccacccagaggagacacta

SEQ ID NO: 106781 - DNA, 25 bp, Homo sapien
ggatcgcctcctgaaacgaacgaga

SEQ ID NO: 106782 - DNA, 25 bp, Homo sapien
acgctcttcacgacgggctgagaca

SEQ ID NO: 106783 - DNA, 25 bp, Homo sapien
tggatctggtctagcttccggattc

SEQ ID NO: 106784 - DNA, 25 bp, Homo sapien
gttgcggtacacaagcacgctcttc

SEQ ID NO: 106785 - DNA, 25 bp, Homo sapien
acacgccgtggggtcggtcaacaca

SEQ ID NO: 106786 - DNA, 25 bp, Homo sapien
cgttgccacgttcatcccggggctg

SEQ ID NO: 106787 - DNA, 25 bp, Homo sapien
cacacgctccaaggcccggaaggaa

SEQ ID NO: 106788 - DNA, 25 bp, Homo sapien
agacacacgccgtggggtcggtcaa

SEQ ID NO: 106789 - DNA, 25 bp, Homo sapien
cgtggggtcggtcaacacacactca

SEQ ID NO: 106790 - DNA, 25 bp, Homo sapien
gggtcggtcaacacacactcacgca

SEQ ID NO: 106791 - DNA, 25 bp, Homo sapien
ttgcacacgctccaaggcccggaag

SEQ ID NO: 106792 - DNA, 25 bp, Homo sapien
tgccacgttcatcccggggctggag

SEQ ID NO: 106793 - DNA, 25 bp, Homo sapien
cacagtggtgaactctgcggcggct

SEQ ID NO: 106794 - DNA, 25 bp, Homo sapien
tccagctgctgttacctctgcgggc

SEQ ID NO: 106795 - DNA, 25 bp, Homo sapien
cgaagctcgggtgcgcatcacgtga

SEQ ID NO: 106796 - DNA, 25 bp, Homo sapien
catcacgtgaagacagcaggcagcg

SEQ ID NO: 106797 - DNA, 25 bp, Homo sapien
cctaccgacactcgcgtgctggaga

SEQ ID NO: 106798 - DNA, 25 bp, Homo sapien
gagttgttatttcccgctgtttcca

SEQ ID NO: 106799 - DNA, 25 bp, Homo sapien
atttcccgctgtttccatagcaacc

SEQ ID NO: 106800 - DNA, 25 bp, Homo sapien
gcctctctcacccaaggggaacgga

SEQ ID NO: 106801 - DNA, 25 bp, Homo sapien
ggacgctggtcttgcagtgacctta

SEQ ID NO: 106802 - DNA, 25 bp, Homo sapien
gcatgcctggtgcacagagtctgca

SEQ ID NO: 106803 - DNA, 25 bp, Homo sapien
ttgctccagcaccatggaatgcctg

SEQ ID NO: 106804 - DNA, 25 bp, Homo sapien
ggaatgcctgcgcagtttaccctgc

SEQ ID NO: 106805 - DNA, 25 bp, Homo sapien
ccttggacgtgacctctgtgggtcc

SEQ ID NO: 106806 - DNA, 25 bp, Homo sapien
ggccgccgagccaacctgattggaa

SEQ ID NO: 106807 - DNA, 25 bp, Homo sapien
agctgcgtcccactcgctcagaatg

SEQ ID NO: 106808 - DNA, 25 bp, Homo sapien
gctcagaatgcgaccttgctatgtg

SEQ ID NO: 106809 - DNA, 25 bp, Homo sapien
ccttggcatttagggcaggcaccag

SEQ ID NO: 106810 - DNA, 25 bp, Homo sapien
atcaatactacgtgctcaggagcta

SEQ ID NO: 106811 - DNA, 25 bp, Homo sapien
ctatggaccgcgcacaaattccggg

SEQ ID NO: 106812 - DNA, 25 bp, Homo sapien
cctacgaggctttctgccgctggag

SEQ ID NO: 106813 - DNA, 25 bp, Homo sapien
caggcaccagcgcatctatggaccg

SEQ ID NO: 106814 - DNA, 25 bp, Homo sapien
gtgacaaatgagcacccgaaaagtg

SEQ ID NO: 106815 - DNA, 25 bp, Homo sapien
agtccgcaggtgcatctactggcga

SEQ ID NO: 106816 - DNA, 25 bp, Homo sapien
gctcaggagcagttagtgacaaatg

SEQ ID NO: 106817 - DNA, 25 bp, Homo sapien
ttgctgacccagctgaacatactgc

SEQ ID NO: 106818 - DNA, 25 bp, Homo sapien
cccgggaagtcctgctcgatcaggt

SEQ ID NO: 106819 - DNA, 25 bp, Homo sapien
ccacgaggagcaccataggcttgtt

SEQ ID NO: 106820 - DNA, 25 bp, Homo sapien
agccaccgtctggaagagctccggc

SEQ ID NO: 106821 - DNA, 25 bp, Homo sapien
tggctgattccaaatctcgcgaggc

SEQ ID NO: 106822 - DNA, 25 bp, Homo sapien
tggctccacgagacacccagtcagg

SEQ ID NO: 106823 - DNA, 25 bp, Homo sapien
ttgccaaacgcgttgagcttgcgga

SEQ ID NO: 106824 - DNA, 25 bp, Homo sapien
aggggtagcagcttctgcgcgtaca

SEQ ID NO: 106825 - DNA, 25 bp, Homo sapien
gtcgtcatcgcaggtcttacacaca

SEQ ID NO: 106826 - DNA, 25 bp, Homo sapien
gcgcgccagtgattcagcgcctttc

SEQ ID NO: 106827 - DNA, 25 bp, Homo sapien
tgcgctctaagtacccgcaccgggg

SEQ ID NO: 106828 - DNA, 25 bp, Homo sapien
cgcgcgcacctgctgttaagaggta

SEQ ID NO: 106829 - DNA, 25 bp, Homo sapien
tcactgctggcgacactgaagctcg

SEQ ID NO: 106830 - DNA, 25 bp, Homo sapien
ataccgtacctgtggtcactgctgg

SEQ ID NO: 106831 - DNA, 25 bp, Homo sapien
cgctctgggaagtagataccgtacc

SEQ ID NO: 106832 - DNA, 25 bp, Homo sapien
ggctgaagctactgctgcgctctca

SEQ ID NO: 106833 - DNA, 25 bp, Homo sapien
gaaatgcgctgctctcggaaaactg

SEQ ID NO: 106834 - DNA, 25 bp, Homo sapien
tcgcagcttgcgaccgaggcaaact

SEQ ID NO: 106835 - DNA, 25 bp, Homo sapien
tctcccagtcgttctcggccaggaa

SEQ ID NO: 106836 - DNA, 25 bp, Homo sapien
cgacagtctggtgcagtgttagatc

SEQ ID NO: 106837 - DNA, 25 bp, Homo sapien
acgcgcagggctacctggtatcaaa

SEQ ID NO: 106838 - DNA, 25 bp, Homo sapien
tggtatcaaactgcctccgtgcgga

SEQ ID NO: 106839 - DNA, 25 bp, Homo sapien
catcacttactaggtcttgggctca

SEQ ID NO: 106840 - DNA, 25 bp, Homo sapien
gtgcgctccaccgacctaggtaatg

SEQ ID NO: 106841 - DNA, 25 bp, Homo sapien
aacttaaaatggcagcgacggccgc

SEQ ID NO: 106842 - DNA, 25 bp, Homo sapien
cgtgacagagccgaactagcgacct

SEQ ID NO: 106843 - DNA, 25 bp, Homo sapien
cacctgggacccatagtctggctcg

SEQ ID NO: 106844 - DNA, 25 bp, Homo sapien
tccggctctcaggaaaggtcgagga

SEQ ID NO: 106845 - DNA, 25 bp, Homo sapien
ggaagtcccagtctcctgagttggc

SEQ ID NO: 106846 - DNA, 25 bp, Homo sapien
aaacacccggatggagtcgcacttc

SEQ ID NO: 106847 - DNA, 25 bp, Homo sapien
cgagtctcgtcagcctctcagagtc

SEQ ID NO: 106848 - DNA, 25 bp, Homo sapien
cctgcgctaagggtcagcaaagtaa

SEQ ID NO: 106849 - DNA, 25 bp, Homo sapien
tacgtgcgttcgctacgaggattga

SEQ ID NO: 106850 - DNA, 25 bp, Homo sapien
cctcgtctgcgtcagttggtcacgt

SEQ ID NO: 106851 - DNA, 25 bp, Homo sapien
tgctgcagccatagctacgtgcgtt

SEQ ID NO: 106852 - DNA, 25 bp, Homo sapien
gaggattgagcgtctccacccagta

SEQ ID NO: 106853 - DNA, 25 bp, Homo sapien
gcacagcctctagacgactcgcttt

SEQ ID NO: 106854 - DNA, 25 bp, Homo sapien
tgaagccgcgtcctactttgacagc

SEQ ID NO: 106855 - DNA, 25 bp, Homo sapien
tcacttccgcgcttcctattggctg

SEQ ID NO: 106856 - DNA, 25 bp, Homo sapien
cgagcggagttagcagggctttact

SEQ ID NO: 106857 - DNA, 25 bp, Homo sapien
ggcacactcagggttctctggcata

SEQ ID NO: 106858 - DNA, 25 bp, Homo sapien
tccttgtcatgtcaggggcacactc

SEQ ID NO: 106859 - DNA, 25 bp, Homo sapien
tctgcttgcaaaaagtgcgcgtgcc

SEQ ID NO: 106860 - DNA, 25 bp, Homo sapien
taaaagcctccgcaccaatgcaatg

SEQ ID NO: 106861 - DNA, 25 bp, Homo sapien
tacctaacgacgacggctccttgtc

SEQ ID NO: 106862 - DNA, 25 bp, Homo sapien
ccgcgttgtacgcaaaatcagaagc

SEQ ID NO: 106863 - DNA, 25 bp, Homo sapien
tgaggacgctccagtttcaacggct

SEQ ID NO: 106864 - DNA, 25 bp, Homo sapien
acggctgcttagcattcaacgctca

SEQ ID NO: 106865 - DNA, 25 bp, Homo sapien
caaagtatttttaaagatatcaatg

SEQ ID NO: 106866 - DNA, 25 bp, Homo sapien
tgaatttgcttctatcaaaatcaga

SEQ ID NO: 106867 - DNA, 25 bp, Homo sapien
aaaataaaactgtagcaaattcttg

SEQ ID NO: 106868 - DNA, 25 bp, Homo sapien
aaactgtagcaaattcttgttttgc

SEQ ID NO: 106869 - DNA, 25 bp, Homo sapien
agcaaattcttgttttgctataaaa

SEQ ID NO: 106870 - DNA, 25 bp, Homo sapien
atgaattgccttttttcgaattggt

SEQ ID NO: 106871 - DNA, 25 bp, Homo sapien
ccccctccatggacatggtgtttga

SEQ ID NO: 106872 - DNA, 25 bp, Homo sapien
agatatcaatgaatttgcttctatc

SEQ ID NO: 106873 - DNA, 25 bp, Homo sapien
ataaagaaagcaaagcgcagaaatg

SEQ ID NO: 106874 - DNA, 25 bp, Homo sapien
tagagccataaagaaagcaaagcgc

SEQ ID NO: 106875 - DNA, 25 bp, Homo sapien
agtcttgaagaatagagccataaag

SEQ ID NO: 106876 - DNA, 25 bp, Homo sapien
tgaggaagtcttgaagaatagagcc

SEQ ID NO: 106877 - DNA, 25 bp, Homo sapien
gccgagaaggaactgacagatagga

SEQ ID NO: 106878 - DNA, 25 bp, Homo sapien
gaactgacagataggaattgggatc

SEQ ID NO: 106879 - DNA, 25 bp, Homo sapien
cagataggaattgggatcaagaaga

SEQ ID NO: 106880 - DNA, 25 bp, Homo sapien
gaattgggatcaagaagatgaagct

SEQ ID NO: 106881 - DNA, 25 bp, Homo sapien
tttcacctagggctgtaggtgcggc

SEQ ID NO: 106882 - DNA, 25 bp, Homo sapien
tgtagacgggtctgcagaatctgcc

SEQ ID NO: 106883 - DNA, 25 bp, Homo sapien
acaaggaaatggaaagcccggctca

SEQ ID NO: 106884 - DNA, 25 bp, Homo sapien
ccttccgctttcacctagggctgta

SEQ ID NO: 106885 - DNA, 25 bp, Homo sapien
gcttgtaatccggtccgctccttat

SEQ ID NO: 106886 - DNA, 25 bp, Homo sapien
gctccttattcagccgccgggaact

SEQ ID NO: 106887 - DNA, 25 bp, Homo sapien
tccgcctcgcatttgcaactctttt

SEQ ID NO: 106888 - DNA, 25 bp, Homo sapien
cctctccagacgcagggcttttgcg

SEQ ID NO: 106889 - DNA, 25 bp, Homo sapien
ggatgaacctgcagggccgaacgct

SEQ ID NO: 106890 - DNA, 25 bp, Homo sapien
tctcgcagaagcgtgtgaaaatccc

SEQ ID NO: 106891 - DNA, 25 bp, Homo sapien
gcgtctccctcctgtgtgaatgcag

SEQ ID NO: 106892 - DNA, 25 bp, Homo sapien
ccaattccagcaacgctagagggcg

SEQ ID NO: 106893 - DNA, 25 bp, Homo sapien
gcggagtcatggaaacacgtgccac

SEQ ID NO: 106894 - DNA, 25 bp, Homo sapien
acgtgccacggcctggatgaacctg

SEQ ID NO: 106895 - DNA, 25 bp, Homo sapien
gggccgaacgctcagtgaaaccagc

SEQ ID NO: 106896 - DNA, 25 bp, Homo sapien
aatcaccagagcacaactgccgcgg

SEQ ID NO: 106897 - DNA, 25 bp, Homo sapien
agcgaaagaagcaggagagcaagtc

SEQ ID NO: 106898 - DNA, 25 bp, Homo sapien
tcaagaaatacggtgaaggagtcct

SEQ ID NO: 106899 - DNA, 25 bp, Homo sapien
cttctggcaggtctggcagcgcttt

SEQ ID NO: 106900 - DNA, 25 bp, Homo sapien
ggtgcctggtcttcgtcgtcaacac

SEQ ID NO: 106901 - DNA, 25 bp, Homo sapien
tccagccgctggttttgctgagggc

SEQ ID NO: 106902 - DNA, 25 bp, Homo sapien
cccagcaacagttactcaaagctaa

SEQ ID NO: 106903 - DNA, 25 bp, Homo sapien
ctgagggacggctcagcgacgccac

SEQ ID NO: 106904 - DNA, 25 bp, Homo sapien
aggagtccttcccaaagttgtctag

SEQ ID NO: 106905 - DNA, 25 bp, Homo sapien
tgttatcgcgagacgcattgcctgc

SEQ ID NO: 106906 - DNA, 25 bp, Homo sapien
gcctgccagctcaaggatttctgct

SEQ ID NO: 106907 - DNA, 25 bp, Homo sapien
tgtgagatactctaacactgccgcc

SEQ ID NO: 106908 - DNA, 25 bp, Homo sapien
gccgccaaatacactggtgcgcctg

SEQ ID NO: 106909 - DNA, 25 bp, Homo sapien
ccgctctgcatagtttcccttacga

SEQ ID NO: 106910 - DNA, 25 bp, Homo sapien
cgggaaactgcaaacccgctctaga

SEQ ID NO: 106911 - DNA, 25 bp, Homo sapien
cccttacgaagcagacgatggatcc

SEQ ID NO: 106912 - DNA, 25 bp, Homo sapien
cgccgcccaaaagcttattgagttc

SEQ ID NO: 106913 - DNA, 25 bp, Homo sapien
gcgcagagcgcttatcctgcaggga

SEQ ID NO: 106914 - DNA, 25 bp, Homo sapien
ctggtcacctctcgcactgtgtcgt

SEQ ID NO: 106915 - DNA, 25 bp, Homo sapien
agatgccctgtggaagccagaggtc

SEQ ID NO: 106916 - DNA, 25 bp, Homo sapien
tctgagctgtatccaagatgccctg

SEQ ID NO: 106917 - DNA, 25 bp, Homo sapien
cactgtgtcgtaggccttggccaca

SEQ ID NO: 106918 - DNA, 25 bp, Homo sapien
ccgcgatgccacgtcacagatggtc

SEQ ID NO: 106919 - DNA, 25 bp, Homo sapien
caggatgagcggcttcaccacagtc

SEQ ID NO: 106920 - DNA, 25 bp, Homo sapien
cgtcggggacaatctggttgcgcat

SEQ ID NO: 106921 - DNA, 25 bp, Homo sapien
gaagggtacgcgctattcattcaga

SEQ ID NO: 106922 - DNA, 25 bp, Homo sapien
cgctagcgtacctgccggcggttct

SEQ ID NO: 106923 - DNA, 25 bp, Homo sapien
cggttctggagtacctggcctccga

SEQ ID NO: 106924 - DNA, 25 bp, Homo sapien
tggcctccgacaccctggagttggc

SEQ ID NO: 106925 - DNA, 25 bp, Homo sapien
caacgccgtcggaacaagaagaaga

SEQ ID NO: 106926 - DNA, 25 bp, Homo sapien
gctgctcagcaagggcaacgatgcc

SEQ ID NO: 106927 - DNA, 25 bp, Homo sapien
ggggctgcacgctagcgtacctgcc

SEQ ID NO: 106928 - DNA, 25 bp, Homo sapien
cgcgctattcattcagagaggttct

SEQ ID NO: 106929 - DNA, 25 bp, Homo sapien
cttgttaagctcctcgccgttgcga

SEQ ID NO: 106930 - DNA, 25 bp, Homo sapien
cgaatggccagctacaggtggcgca

SEQ ID NO: 106931 - DNA, 25 bp, Homo sapien
tgttaagctcctcgccgttgcgaat

SEQ ID NO: 106932 - DNA, 25 bp, Homo sapien
aagctcctcgccgttgcgaatggcc

SEQ ID NO: 106933 - DNA, 25 bp, Homo sapien
cctcgccgttgcgaatggccagcta

SEQ ID NO: 106934 - DNA, 25 bp, Homo sapien
tcgccgttgcgaatggccagctaca

SEQ ID NO: 106935 - DNA, 25 bp, Homo sapien
gccgttgcgaatggccagctacagg

SEQ ID NO: 106936 - DNA, 25 bp, Homo sapien
ggccgccaggtacacctgcgctctg

SEQ ID NO: 106937 - DNA, 25 bp, Homo sapien
tttcatagccgcaggactcgtggtc

SEQ ID NO: 106938 - DNA, 25 bp, Homo sapien
gaaccgcggcttcctctttcatagc

SEQ ID NO: 106939 - DNA, 25 bp, Homo sapien
gggtctccgctgatgcttctctcaa

SEQ ID NO: 106940 - DNA, 25 bp, Homo sapien
gcggatccacgaaatggcctctttg

SEQ ID NO: 106941 - DNA, 25 bp, Homo sapien
ggacgtggtcacgactttatatttc

SEQ ID NO: 106942 - DNA, 25 bp, Homo sapien
cccgcgaggcttgttttctagcgcc

SEQ ID NO: 106943 - DNA, 25 bp, Homo sapien
gggtccgttctcacagctggatctg

SEQ ID NO: 106944 - DNA, 25 bp, Homo sapien
ttcaaggcccgtcagtcactcgagc

SEQ ID NO: 106945 - DNA, 25 bp, Homo sapien
tggcaaggcgccacgcaaacagttg

SEQ ID NO: 106946 - DNA, 25 bp, Homo sapien
tccgctgtgctgtttttccgtcatg

SEQ ID NO: 106947 - DNA, 25 bp, Homo sapien
ctcggaagtctactggtggcaaggc

SEQ ID NO: 106948 - DNA, 25 bp, Homo sapien
aagtccactgaactgcttattcgta

SEQ ID NO: 106949 - DNA, 25 bp, Homo sapien
cgtaaactacctttccagcgcctgg

SEQ ID NO: 106950 - DNA, 25 bp, Homo sapien
cgagattgcgcaggactttaaaaca

SEQ ID NO: 106951 - DNA, 25 bp, Homo sapien
agggctatttgaggacactaacctg

SEQ ID NO: 106952 - DNA, 25 bp, Homo sapien
tccgtcatggctcgcactaagcaaa

SEQ ID NO: 106953 - DNA, 25 bp, Homo sapien
ggtgtgaagcggatctctggtctga

SEQ ID NO: 106954 - DNA, 25 bp, Homo sapien
ccgtgacgctgtcacctatacggag

SEQ ID NO: 106955 - DNA, 25 bp, Homo sapien
tccgtgacgctgtcacctatacgga

SEQ ID NO: 106956 - DNA, 25 bp, Homo sapien
gggtgctcaaggtgtttttggagaa

SEQ ID NO: 106957 - DNA, 25 bp, Homo sapien
ggtgttgcgtgacaacatccagggc

SEQ ID NO: 106958 - DNA, 25 bp, Homo sapien
cgtgatccgtgacgctgtcacctat

SEQ ID NO: 106959 - DNA, 25 bp, Homo sapien
tgatccgtgacgctgtcacctatac

SEQ ID NO: 106960 - DNA, 25 bp, Homo sapien
gatccgtgacgctgtcacctatacg

SEQ ID NO: 106961 - DNA, 25 bp, Homo sapien
gcgtccttgacgcttgagcgcgtaa

SEQ ID NO: 106962 - DNA, 25 bp, Homo sapien
ccgaatggccggtttggtgatgcct

SEQ ID NO: 106963 - DNA, 25 bp, Homo sapien
cttggatgttatcccgcagcacttt

SEQ ID NO: 106964 - DNA, 25 bp, Homo sapien
cagcacttttcggtgacgcttggca

SEQ ID NO: 106965 - DNA, 25 bp, Homo sapien
gcaagccacgagcatttatacacga

SEQ ID NO: 106966 - DNA, 25 bp, Homo sapien
catcggaccttattgagaactgaaa

SEQ ID NO: 106967 - DNA, 25 bp, Homo sapien
agattaaccgccgaagccgtacaga

SEQ ID NO: 106968 - DNA, 25 bp, Homo sapien
ggcgttgctgcctcactttttgctc

SEQ ID NO: 106969 - DNA, 25 bp, Homo sapien
cttagcatggatggcgcaaaggttt

SEQ ID NO: 106970 - DNA, 25 bp, Homo sapien
cgaagatcggtcttgaagtcttggg

SEQ ID NO: 106971 - DNA, 25 bp, Homo sapien
cgtggcgctttaccgccggtggatt

SEQ ID NO: 106972 - DNA, 25 bp, Homo sapien
cagcttccgaatcagcaactcggtc

SEQ ID NO: 106973 - DNA, 25 bp, Homo sapien
agcgaagatcggtcttgaagtcttg

SEQ ID NO: 106974 - DNA, 25 bp, Homo sapien
atggatggcgcaaaggtttgtgtcc

SEQ ID NO: 106975 - DNA, 25 bp, Homo sapien
cttccgaatcagcaactcggtcgac

SEQ ID NO: 106976 - DNA, 25 bp, Homo sapien
gcttccgaatcagcaactcggtcga

SEQ ID NO: 106977 - DNA, 25 bp, Homo sapien
tttattaagctcctcgtcattgcgg

SEQ ID NO: 106978 - DNA, 25 bp, Homo sapien
ccaagagtttattaagctcctcgtc

SEQ ID NO: 106979 - DNA, 25 bp, Homo sapien
agaagaccgagtcttagccttggcg

SEQ ID NO: 106980 - DNA, 25 bp, Homo sapien
acctgcacgagaagaccgagtctta

SEQ ID NO: 106981 - DNA, 25 bp, Homo sapien
ggaaactgcaaacctgcacgagaag

SEQ ID NO: 106982 - DNA, 25 bp, Homo sapien
cactcggcccacaggaaactgcaaa

SEQ ID NO: 106983 - DNA, 25 bp, Homo sapien
ggtactcaagcaccgccgcgagata

SEQ ID NO: 106984 - DNA, 25 bp, Homo sapien
ctcgtcattgcggatggccaattgc

SEQ ID NO: 106985 - DNA, 25 bp, Homo sapien
gaggacgcccgaatctgtcagcaaa

SEQ ID NO: 106986 - DNA, 25 bp, Homo sapien
agatcgggacgcaaacacacacgca

SEQ ID NO: 106987 - DNA, 25 bp, Homo sapien
gccctggcagatcgggacgcaaaca

SEQ ID NO: 106988 - DNA, 25 bp, Homo sapien
ccaggacattcgttcaggggaggac

SEQ ID NO: 106989 - DNA, 25 bp, Homo sapien
ttcgcggctgcgcactttgcacttg

SEQ ID NO: 106990 - DNA, 25 bp, Homo sapien
gcaaagcatccctacctgcaggagg

SEQ ID NO: 106991 - DNA, 25 bp, Homo sapien
cgaatctgtcagcaaagcatcccta

SEQ ID NO: 106992 - DNA, 25 bp, Homo sapien
tgcgcactttgcacttggcgcccag

SEQ ID NO: 106993 - DNA, 25 bp, Homo sapien
ccggtgcgccagtgtacttacaata

SEQ ID NO: 106994 - DNA, 25 bp, Homo sapien
taccgggcttgcagttcccaatagg

SEQ ID NO: 106995 - DNA, 25 bp, Homo sapien
gtccgtcatctttttcgaaagggca

SEQ ID NO: 106996 - DNA, 25 bp, Homo sapien
tgggcagcgccatacgtgacaagac

SEQ ID NO: 106997 - DNA, 25 bp, Homo sapien
ctggccgccgagatcttagaactgg

SEQ ID NO: 106998 - DNA, 25 bp, Homo sapien
tcccaatagggcagagtccgtcatc

SEQ ID NO: 106999 - DNA, 25 bp, Homo sapien
cgctgctttcataggtcgctatttg

SEQ ID NO: 107000 - DNA, 25 bp, Homo sapien
caattattttgagccggtcggagcc

SEQ ID NO: 107001 - DNA, 25 bp, Homo sapien
gctcactgtcattggctattgcaaa

SEQ ID NO: 107002 - DNA, 25 bp, Homo sapien
cattggctattgcaaagggcgaggc

SEQ ID NO: 107003 - DNA, 25 bp, Homo sapien
ctacgctcactgtcattggctattg

SEQ ID NO: 107004 - DNA, 25 bp, Homo sapien
aaagggcgaggcctactgattggct

SEQ ID NO: 107005 - DNA, 25 bp, Homo sapien
tgacatctcggagaccgccgggcct

SEQ ID NO: 107006 - DNA, 25 bp, Homo sapien
gtccggctccgctgttcactagagc

SEQ ID NO: 107007 - DNA, 25 bp, Homo sapien
cccgccgcttctctaggcgccaggc

SEQ ID NO: 107008 - DNA, 25 bp, Homo sapien
ttgcaaagggcgaggcctactgatt

SEQ ID NO: 107009 - DNA, 25 bp, Homo sapien
tctgtgcgctattcacgctaaacgc

SEQ ID NO: 107010 - DNA, 25 bp, Homo sapien
cttcgaagacaccaatctgtgcgct

SEQ ID NO: 107011 - DNA, 25 bp, Homo sapien
cctggtgggactcttcgaagacacc

SEQ ID NO: 107012 - DNA, 25 bp, Homo sapien
catgcccaaagatatccagctggca

SEQ ID NO: 107013 - DNA, 25 bp, Homo sapien
tggccttgcgcgaaatccgtcgcta

SEQ ID NO: 107014 - DNA, 25 bp, Homo sapien
ctaaagcagcccgtaagagcgctcc

SEQ ID NO: 107015 - DNA, 25 bp, Homo sapien
atatccagctggcacgtcgcatccg

SEQ ID NO: 107016 - DNA, 25 bp, Homo sapien
gcaagcagcttgctactaaagcagc

SEQ ID NO: 107017 - DNA, 25 bp, Homo sapien
gatacggctgttgtttttctccaca

SEQ ID NO: 107018 - DNA, 25 bp, Homo sapien
tgcctttcgtttgcaccagagtgcc

SEQ ID NO: 107019 - DNA, 25 bp, Homo sapien
tttctccacatcatagccggcggca

SEQ ID NO: 107020 - DNA, 25 bp, Homo sapien
tacgctctttagaggcggccacagc

SEQ ID NO: 107021 - DNA, 25 bp, Homo sapien
actcgggtacaagtggcaaagcgcc

SEQ ID NO: 107022 - DNA, 25 bp, Homo sapien
ctgtatatatagagcgcaggcgcgc

SEQ ID NO: 107023 - DNA, 25 bp, Homo sapien
cttcggtgttttcttagcgctcttc

SEQ ID NO: 107024 - DNA, 25 bp, Homo sapien
ggcggcagccaacgcttttttcaga

SEQ ID NO: 107025 - DNA, 25 bp, Homo sapien
ggtgctaagcgccatcgtaaggtgc

SEQ ID NO: 107026 - DNA, 25 bp, Homo sapien
agcgcatttccggtcttatctatga

SEQ ID NO: 107027 - DNA, 25 bp, Homo sapien
cagggcattacaaaaccggctattc

SEQ ID NO: 107028 - DNA, 25 bp, Homo sapien
gaacgttattcgagacgccgtcacc

SEQ ID NO: 107029 - DNA, 25 bp, Homo sapien
cctaaaacgtcaggggcgcactctg

SEQ ID NO: 107030 - DNA, 25 bp, Homo sapien
gcttcggcggctgaatctaagaata

SEQ ID NO: 107031 - DNA, 25 bp, Homo sapien
tcgtaaggtgctccgggataacatc

SEQ ID NO: 107032 - DNA, 25 bp, Homo sapien
gactcgaggtgtgcttaaggttttc

SEQ ID NO: 107033 - DNA, 25 bp, Homo sapien
ccaaagcgaaatcccgctcttctcg

SEQ ID NO: 107034 - DNA, 25 bp, Homo sapien
ctaggccgggtgaccattgctcagg

SEQ ID NO: 107035 - DNA, 25 bp, Homo sapien
ctcaacaaactgctaggccgggtga

SEQ ID NO: 107036 - DNA, 25 bp, Homo sapien
gctccgtaaaggcaactacgcagag

SEQ ID NO: 107037 - DNA, 25 bp, Homo sapien
ccgtaaaggcaactacgcagagcgg

SEQ ID NO: 107038 - DNA, 25 bp, Homo sapien
ggagctcaacaaactgctaggccgg

SEQ ID NO: 107039 - DNA, 25 bp, Homo sapien
gctcaacaaactgctaggccgggtg

SEQ ID NO: 107040 - DNA, 25 bp, Homo sapien
cgcgccaaagcgaaatcccgctctt

SEQ ID NO: 107041 - DNA, 25 bp, Homo sapien
tttggccgctctcaagaaagcgctg

SEQ ID NO: 107042 - DNA, 25 bp, Homo sapien
actaaagctgttgccgcctccaagg

SEQ ID NO: 107043 - DNA, 25 bp, Homo sapien
cccggtgtccgagctcattactaaa

SEQ ID NO: 107044 - DNA, 25 bp, Homo sapien
actcccgtgaagaagaaggcccgca

SEQ ID NO: 107045 - DNA, 25 bp, Homo sapien
acgcttgccttcaacatgtccgaga

SEQ ID NO: 107046 - DNA, 25 bp, Homo sapien
ttccggctcgaattgctctcgctca

SEQ ID NO: 107047 - DNA, 25 bp, Homo sapien
cgcagctccgccctatataaacggg

SEQ ID NO: 107048 - DNA, 25 bp, Homo sapien
tctggggaagccaagcctaaggcta

SEQ ID NO: 107049 - DNA, 25 bp, Homo sapien
gggatatcggagacttcgaacaatc

SEQ ID NO: 107050 - DNA, 25 bp, Homo sapien
ccagatcgcgggatatcggagactt

SEQ ID NO: 107051 - DNA, 25 bp, Homo sapien
atcctactcccggtgcggctatgcg

SEQ ID NO: 107052 - DNA, 25 bp, Homo sapien
ctatgcggccatgaaaaggagtctt

SEQ ID NO: 107053 - DNA, 25 bp, Homo sapien
acgcaggctccctcatagggtcatc

SEQ ID NO: 107054 - DNA, 25 bp, Homo sapien
cccgcatagggcgtcacgtacgttt

SEQ ID NO: 107055 - DNA, 25 bp, Homo sapien
gaggttgcccgtaggccgctaactg

SEQ ID NO: 107056 - DNA, 25 bp, Homo sapien
ggccgctaactggtggttcccagtc

SEQ ID NO: 107057 - DNA, 25 bp, Homo sapien
agagccactcaccttttcacaattg

SEQ ID NO: 107058 - DNA, 25 bp, Homo sapien
tgcaactgccttagtaaacccaaag

SEQ ID NO: 107059 - DNA, 25 bp, Homo sapien
aagtaaacttgtccctgcaactgcc

SEQ ID NO: 107060 - DNA, 25 bp, Homo sapien
tagcatgcctgagccagcgaaatcc

SEQ ID NO: 107061 - DNA, 25 bp, Homo sapien
ccgaggatcaggagatgtagatttc

SEQ ID NO: 107062 - DNA, 25 bp, Homo sapien
acattgtctacaaattccgaggatc

SEQ ID NO: 107063 - DNA, 25 bp, Homo sapien
tcagagttggagaaactaaatcttc

SEQ ID NO: 107064 - DNA, 25 bp, Homo sapien
atgcagacttcacgacaaaataacg

SEQ ID NO: 107065 - DNA, 25 bp, Homo sapien
tattgtcacgcaataccttacggtg

SEQ ID NO: 107066 - DNA, 25 bp, Homo sapien
tcgcggattacattttccaggaaaa

SEQ ID NO: 107067 - DNA, 25 bp, Homo sapien
aggaaaactttcagcactccgcgag

SEQ ID NO: 107068 - DNA, 25 bp, Homo sapien
actccgcgagtttcctcataaatga

SEQ ID NO: 107069 - DNA, 25 bp, Homo sapien
ttacggtgacgcttggcgccaccct

SEQ ID NO: 107070 - DNA, 25 bp, Homo sapien
cgggcttggtgattccttggatatt

SEQ ID NO: 107071 - DNA, 25 bp, Homo sapien
cgtgttccgtgtaggtgacagcatc

SEQ ID NO: 107072 - DNA, 25 bp, Homo sapien
aatgaggccagaaatacgcttgacg

SEQ ID NO: 107073 - DNA, 25 bp, Homo sapien
cgagctctgaaaacgcagatcagtc

SEQ ID NO: 107074 - DNA, 25 bp, Homo sapien
cagtctgcttggtacgagccattgc

SEQ ID NO: 107075 - DNA, 25 bp, Homo sapien
ctggagcgctctttcgagcagcctt

SEQ ID NO: 107076 - DNA, 25 bp, Homo sapien
tttgcgaatcagcagctcggtcgac

SEQ ID NO: 107077 - DNA, 25 bp, Homo sapien
ctggaatggcagtttgcgaatcagc

SEQ ID NO: 107078 - DNA, 25 bp, Homo sapien
gcgaacttctaaaccctgctaaatg

SEQ ID NO: 107079 - DNA, 25 bp, Homo sapien
tggtacgagccattgcgaacttcta

SEQ ID NO: 107080 - DNA, 25 bp, Homo sapien
ctcacggactagacgctggaatggc

SEQ ID NO: 107081 - DNA, 25 bp, Homo sapien
gcagaggctcccagtgccgtgagac

SEQ ID NO: 107082 - DNA, 25 bp, Homo sapien
tccagtccgcaaggtcctttccagg

SEQ ID NO: 107083 - DNA, 25 bp, Homo sapien
ggggaaaagcacacctccaaccatg

SEQ ID NO: 107084 - DNA, 25 bp, Homo sapien
acaccagcagcgaaagcacaacttc

SEQ ID NO: 107085 - DNA, 25 bp, Homo sapien
actgcttcgcgatgggaagccgaca

SEQ ID NO: 107086 - DNA, 25 bp, Homo sapien
gtccgaaccaatggagaactgcttc

SEQ ID NO: 107087 - DNA, 25 bp, Homo sapien
tcggtaaggacttgcaggtgacttt

SEQ ID NO: 107088 - DNA, 25 bp, Homo sapien
ggtgactttgctcgcctgtcctgaa

SEQ ID NO: 107089 - DNA, 25 bp, Homo sapien
aggacttcagcggagatccgcgcgc

SEQ ID NO: 107090 - DNA, 25 bp, Homo sapien
tcccaggacttcagcggagatccgc

SEQ ID NO: 107091 - DNA, 25 bp, Homo sapien
ctgcaccgcgttgggtcggagtccc

SEQ ID NO: 107092 - DNA, 25 bp, Homo sapien
tcccgttgcgctgcaccgcgttggg

SEQ ID NO: 107093 - DNA, 25 bp, Homo sapien
cttgatgtcatcctgagcagctggg

SEQ ID NO: 107094 - DNA, 25 bp, Homo sapien
aggtgacttgatgtcatcctgagca

SEQ ID NO: 107095 - DNA, 25 bp, Homo sapien
agttgggggcatgctctagccgccc

SEQ ID NO: 107096 - DNA, 25 bp, Homo sapien
gaaccgctgcgaaggggccctgaac

SEQ ID NO: 107097 - DNA, 25 bp, Homo sapien
tccagaagtttcctgcccgtgtgca

SEQ ID NO: 107098 - DNA, 25 bp, Homo sapien
cgtttacggaatgtgggcagaaatt

SEQ ID NO: 107099 - DNA, 25 bp, Homo sapien
gggcagacatagagctccgcacaga

SEQ ID NO: 107100 - DNA, 25 bp, Homo sapien
tattcagggtgaacacgcacactcg

SEQ ID NO: 107101 - DNA, 25 bp, Homo sapien
gcacctgctttatccgcccttgggt

SEQ ID NO: 107102 - DNA, 25 bp, Homo sapien
tgcgataggaaggtccagaagtttc

SEQ ID NO: 107103 - DNA, 25 bp, Homo sapien
tgcactaaagtgctccgtgtgcctg

SEQ ID NO: 107104 - DNA, 25 bp, Homo sapien
gcagaaattggaccgggcagacata

SEQ ID NO: 107105 - DNA, 25 bp, Homo sapien
aagagcgggtcttagccttagctcg

SEQ ID NO: 107106 - DNA, 25 bp, Homo sapien
tcttagccttagctcgggcctttcc

SEQ ID NO: 107107 - DNA, 25 bp, Homo sapien
cgggtcttagccttagctcgggcct

SEQ ID NO: 107108 - DNA, 25 bp, Homo sapien
cgaagagcgggtcttagccttagct

SEQ ID NO: 107109 - DNA, 25 bp, Homo sapien
cgcgaagagcgggtcttagccttag

SEQ ID NO: 107110 - DNA, 25 bp, Homo sapien
aactggagtccggcccgcgaagagc

SEQ ID NO: 107111 - DNA, 25 bp, Homo sapien
agcaagcggtgtacgcggcccacag

SEQ ID NO: 107112 - DNA, 25 bp, Homo sapien
gtcttagccttagctcgggcctttc

SEQ ID NO: 107113 - DNA, 25 bp, Homo sapien
tgcatattttccgtgtttaccacca

SEQ ID NO: 107114 - DNA, 25 bp, Homo sapien
gccacccactttttcagctatagag

SEQ ID NO: 107115 - DNA, 25 bp, Homo sapien
taagagccacccactttttcagcta

SEQ ID NO: 107116 - DNA, 25 bp, Homo sapien
catacccaatcccaaaggctctttt

SEQ ID NO: 107117 - DNA, 25 bp, Homo sapien
agtaattctaacgtcttcataccca

SEQ ID NO: 107118 - DNA, 25 bp, Homo sapien
agtacaccagctctaagtaattcta

SEQ ID NO: 107119 - DNA, 25 bp, Homo sapien
tttcagctatagagttgtaattacc

SEQ ID NO: 107120 - DNA, 25 bp, Homo sapien
tgtaattacctgcatattttccgtg

SEQ ID NO: 107121 - DNA, 25 bp, Homo sapien
ttctggaaaacgtgattcgtgatgc

SEQ ID NO: 107122 - DNA, 25 bp, Homo sapien
cccggcatataagaatactaccgtc

SEQ ID NO: 107123 - DNA, 25 bp, Homo sapien
taccgcttaaacgactcagcatctc

SEQ ID NO: 107124 - DNA, 25 bp, Homo sapien
ttcgtgatgctgtgacttacacgga

SEQ ID NO: 107125 - DNA, 25 bp, Homo sapien
ccgtaaggtcctgcgagataacatc

SEQ ID NO: 107126 - DNA, 25 bp, Homo sapien
ttttgcggctattttcgttggtgtg

SEQ ID NO: 107127 - DNA, 25 bp, Homo sapien
ccgtcgcttgtttttcagatttttg

SEQ ID NO: 107128 - DNA, 25 bp, Homo sapien
cttcggcggctaatgctaccgctta

SEQ ID NO: 107129 - DNA, 25 bp, Homo sapien
ggcggcaaagctcgggcaaaagcta

SEQ ID NO: 107130 - DNA, 25 bp, Homo sapien
cagtttccagttggccgtgtgcacc

SEQ ID NO: 107131 - DNA, 25 bp, Homo sapien
ttccagggccggtcttcagtttcca

SEQ ID NO: 107132 - DNA, 25 bp, Homo sapien
agcggtgctggaatatctgacggcc

SEQ ID NO: 107133 - DNA, 25 bp, Homo sapien
taagcttctaggtcgcgtgaccatc

SEQ ID NO: 107134 - DNA, 25 bp, Homo sapien
cgacgaggagctaaataagcttcta

SEQ ID NO: 107135 - DNA, 25 bp, Homo sapien
tcttagagctagctggcaacgcggc

SEQ ID NO: 107136 - DNA, 25 bp, Homo sapien
tctgacggccgagatcttagagcta

SEQ ID NO: 107137 - DNA, 25 bp, Homo sapien
cgcgtactaagcagacggctcgtaa

SEQ ID NO: 107138 - DNA, 25 bp, Homo sapien
gcagacggctcgtaaatccacaggc

SEQ ID NO: 107139 - DNA, 25 bp, Homo sapien
ggctcgtaaatccacaggcggtaaa

SEQ ID NO: 107140 - DNA, 25 bp, Homo sapien
tccacaggcggtaaagcaccgcgca

SEQ ID NO: 107141 - DNA, 25 bp, Homo sapien
taaagcaccgcgcaaacagctggcc

SEQ ID NO: 107142 - DNA, 25 bp, Homo sapien
ttggtggggcttttcgaggacacca

SEQ ID NO: 107143 - DNA, 25 bp, Homo sapien
tgcgctattcatgccaaacgcgtga

SEQ ID NO: 107144 - DNA, 25 bp, Homo sapien
gctattcatgccaaacgcgtgacca

SEQ ID NO: 107145 - DNA, 25 bp, Homo sapien
tcactgcaatggatgttgtctacgc

SEQ ID NO: 107146 - DNA, 25 bp, Homo sapien
cgtaagacagtcactgcaatggatg

SEQ ID NO: 107147 - DNA, 25 bp, Homo sapien
atgtgatacgggacgccgtaaccta

SEQ ID NO: 107148 - DNA, 25 bp, Homo sapien
tgaaacgcatttcgggcctcattta

SEQ ID NO: 107149 - DNA, 25 bp, Homo sapien
cgccatccgtcgcttggcccgacgc

SEQ ID NO: 107150 - DNA, 25 bp, Homo sapien
agtgctgcgtgacaacatacagggc

SEQ ID NO: 107151 - DNA, 25 bp, Homo sapien
cgccaagcgccatcgcaaagtgctg

SEQ ID NO: 107152 - DNA, 25 bp, Homo sapien
agcgccatcgcaaagtgctgcgtga

SEQ ID NO: 107153 - DNA, 25 bp, Homo sapien
caaagccttacagggttcttccctg

SEQ ID NO: 107154 - DNA, 25 bp, Homo sapien
ataaatgaggcccaagatgcgcttg

SEQ ID NO: 107155 - DNA, 25 bp, Homo sapien
ggcgtaccagatcacattttccagg

SEQ ID NO: 107156 - DNA, 25 bp, Homo sapien
gctccgtgttggtcacggcgtacca

SEQ ID NO: 107157 - DNA, 25 bp, Homo sapien
agatgcgcttgacaccgccatgccg

SEQ ID NO: 107158 - DNA, 25 bp, Homo sapien
agggccattaacgatattgcaagga

SEQ ID NO: 107159 - DNA, 25 bp, Homo sapien
ttcttccctggcgtttgagcacgta

SEQ ID NO: 107160 - DNA, 25 bp, Homo sapien
tttgagcacgtagaccacggccatg

SEQ ID NO: 107161 - DNA, 25 bp, Homo sapien
ggctttgccgccagtggacttacga

SEQ ID NO: 107162 - DNA, 25 bp, Homo sapien
ccaccggtggctggcgcgcttttgc

SEQ ID NO: 107163 - DNA, 25 bp, Homo sapien
cactcgcttggcgtggatagcacac

SEQ ID NO: 107164 - DNA, 25 bp, Homo sapien
tcgcttggcgtggatagcacacagg

SEQ ID NO: 107165 - DNA, 25 bp, Homo sapien
tggaatggtagcttgcgaatcagta

SEQ ID NO: 107166 - DNA, 25 bp, Homo sapien
cgatttctgatagcggcggatttca

SEQ ID NO: 107167 - DNA, 25 bp, Homo sapien
aatcagtagctcagtcgatttctga

SEQ ID NO: 107168 - DNA, 25 bp, Homo sapien
gcttgcgaatcagtagctcagtcga

SEQ ID NO: 107169 - DNA, 25 bp, Homo sapien
ttactcctttatcttgttgcaatgc

SEQ ID NO: 107170 - DNA, 25 bp, Homo sapien
ttgcaatgcctgatccagctaagtc

SEQ ID NO: 107171 - DNA, 25 bp, Homo sapien
ttctatgggagaagtgtcgccaata

SEQ ID NO: 107172 - DNA, 25 bp, Homo sapien
tggacgcatgttcaaacccaaaggc

SEQ ID NO: 107173 - DNA, 25 bp, Homo sapien
agacctacaaaaacggccagctgtg

SEQ ID NO: 107174 - DNA, 25 bp, Homo sapien
agttttaatgctgggtgctgctgta

SEQ ID NO: 107175 - DNA, 25 bp, Homo sapien
gccagctgtgctgttgagccttcac

SEQ ID NO: 107176 - DNA, 25 bp, Homo sapien
tcactttggggtgtattcttactcc

SEQ ID NO: 107177 - DNA, 25 bp, Homo sapien
ctcctaagcaacttcggggctcgtg

SEQ ID NO: 107178 - DNA, 25 bp, Homo sapien
agcccattgtttatttcgcgcctgc

SEQ ID NO: 107179 - DNA, 25 bp, Homo sapien
gcgccttcaggtccctcctggattt

SEQ ID NO: 107180 - DNA, 25 bp, Homo sapien
gcgcgtgcgcatttcattgtcgaca

SEQ ID NO: 107181 - DNA, 25 bp, Homo sapien
ggccaggctatgtctcacacactga

SEQ ID NO: 107182 - DNA, 25 bp, Homo sapien
cgggcgccaacctcgaacgaagtcg

SEQ ID NO: 107183 - DNA, 25 bp, Homo sapien
tgctctctgaaaaaggcgggcgcca

SEQ ID NO: 107184 - DNA, 25 bp, Homo sapien
attgtcgacaccgagaggacgcctt

SEQ ID NO: 107185 - DNA, 25 bp, Homo sapien
ttggaaaggcaacttgcggatcagc

SEQ ID NO: 107186 - DNA, 25 bp, Homo sapien
ctcgcaccaggcgttggaaaggcaa

SEQ ID NO: 107187 - DNA, 25 bp, Homo sapien
cgcaccaggcgttggaaaggcaact

SEQ ID NO: 107188 - DNA, 25 bp, Homo sapien
gcaccaggcgttggaaaggcaactt

SEQ ID NO: 107189 - DNA, 25 bp, Homo sapien
ccaggcgttggaaaggcaacttgcg

SEQ ID NO: 107190 - DNA, 25 bp, Homo sapien
cgttggaaaggcaacttgcggatca

SEQ ID NO: 107191 - DNA, 25 bp, Homo sapien
accaggcgttggaaaggcaacttgc

SEQ ID NO: 107192 - DNA, 25 bp, Homo sapien
gcgttggaaaggcaacttgcggatc

SEQ ID NO: 107193 - DNA, 25 bp, Homo sapien
gaagaccgcacagagaagaccctgg

SEQ ID NO: 107194 - DNA, 25 bp, Homo sapien
ccatctgctcaggaaggacctcagc

SEQ ID NO: 107195 - DNA, 25 bp, Homo sapien
ggacctcagcgccagactaaacaca

SEQ ID NO: 107196 - DNA, 25 bp, Homo sapien
cggcctttaaaagcaccttcctgcg

SEQ ID NO: 107197 - DNA, 25 bp, Homo sapien
cttcctgcgcacgacggggagacac

SEQ ID NO: 107198 - DNA, 25 bp, Homo sapien
cccggctcttcgagggaagaccgca

SEQ ID NO: 107199 - DNA, 25 bp, Homo sapien
tctcagtgaggacttcgcggtcctg

SEQ ID NO: 107200 - DNA, 25 bp, Homo sapien
acccatcggctggtcttgaggagaa

SEQ ID NO: 107201 - DNA, 25 bp, Homo sapien
cgccctgcgcgatagtaactttgcc

SEQ ID NO: 107202 - DNA, 25 bp, Homo sapien
gcccggacccgcttggcgtagttgc

SEQ ID NO: 107203 - DNA, 25 bp, Homo sapien
gtgacgcgggtcttcttgtctcggg

SEQ ID NO: 107204 - DNA, 25 bp, Homo sapien
ttgagcttctcgtcgtggatggcga

SEQ ID NO: 107205 - DNA, 25 bp, Homo sapien
cttgttgagcttctcgtcgtggatg

SEQ ID NO: 107206 - DNA, 25 bp, Homo sapien
agtaactttgcccaacagcttgttg

SEQ ID NO: 107207 - DNA, 25 bp, Homo sapien
cgcgatagtaactttgcccaacagc

SEQ ID NO: 107208 - DNA, 25 bp, Homo sapien
cctgcgcgatagtaactttgcccaa

SEQ ID NO: 107209 - DNA, 25 bp, Homo sapien
gagccacccatgttgtcatttaaag

SEQ ID NO: 107210 - DNA, 25 bp, Homo sapien
gtatcacttcggctgcgaacatgcc

SEQ ID NO: 107211 - DNA, 25 bp, Homo sapien
tcggctgcgaacatgcctgaaccag

SEQ ID NO: 107212 - DNA, 25 bp, Homo sapien
caaggctatggggattatgaactcc

SEQ ID NO: 107213 - DNA, 25 bp, Homo sapien
cgctaacgacccaaaggctcttcta

SEQ ID NO: 107214 - DNA, 25 bp, Homo sapien
ttttccagacttggcattggcaagg

SEQ ID NO: 107215 - DNA, 25 bp, Homo sapien
tggcaaggtaaaatggctaagcaac

SEQ ID NO: 107216 - DNA, 25 bp, Homo sapien
agctccaagtaaactagttacctgg

SEQ ID NO: 107217 - DNA, 25 bp, Homo sapien
taccacggccagacatgactaagca

SEQ ID NO: 107218 - DNA, 25 bp, Homo sapien
aaggccagaaattcgcttgacaccg

SEQ ID NO: 107219 - DNA, 25 bp, Homo sapien
cgccggatagctggcttagtgatgc

SEQ ID NO: 107220 - DNA, 25 bp, Homo sapien
gcgcaaaaccttgcgatgacgctta

SEQ ID NO: 107221 - DNA, 25 bp, Homo sapien
aagcaacgcccttatatgccgggaa

SEQ ID NO: 107222 - DNA, 25 bp, Homo sapien
accggaactttggtcctgcttcttg

SEQ ID NO: 107223 - DNA, 25 bp, Homo sapien
tccagcctttggcatctgagcgccg

SEQ ID NO: 107224 - DNA, 25 bp, Homo sapien
gccctggatgttatcgcgcaaaacc

SEQ ID NO: 107225 - DNA, 25 bp, Homo sapien
aaacggaggggaggcgctacagctc

SEQ ID NO: 107226 - DNA, 25 bp, Homo sapien
cctgtctttgcctcaggctgcccgg

SEQ ID NO: 107227 - DNA, 25 bp, Homo sapien
gcggcctcgcctgtctttgcctcag

SEQ ID NO: 107228 - DNA, 25 bp, Homo sapien
tgctgtggacacgagacggggtcct

SEQ ID NO: 107229 - DNA, 25 bp, Homo sapien
agcaacgtttaattctagaaggtag

SEQ ID NO: 107230 - DNA, 25 bp, Homo sapien
gaatcgtcgagaaccagcggagaaa

SEQ ID NO: 107231 - DNA, 25 bp, Homo sapien
cgactggagaatcgtcgagaaccag

SEQ ID NO: 107232 - DNA, 25 bp, Homo sapien
ctgggacagggaaagcccaccggtg

SEQ ID NO: 107233 - DNA, 25 bp, Homo sapien
tgtctgtccgtagttcccatctcca

SEQ ID NO: 107234 - DNA, 25 bp, Homo sapien
ttcggcagctccctttgacgtgatt

SEQ ID NO: 107235 - DNA, 25 bp, Homo sapien
cgagcacttggagctacgctggttc

SEQ ID NO: 107236 - DNA, 25 bp, Homo sapien
agccgagcagatgcccgagtaccgc

SEQ ID NO: 107237 - DNA, 25 bp, Homo sapien
gatccgtggcgtcagagtctctgac

SEQ ID NO: 107238 - DNA, 25 bp, Homo sapien
agtctctgacgacggggagtacacg

SEQ ID NO: 107239 - DNA, 25 bp, Homo sapien
cgctggtccaggacggcatcgccaa

SEQ ID NO: 107240 - DNA, 25 bp, Homo sapien
gtctgatcccgctcgtttttcggca

SEQ ID NO: 107241 - DNA, 25 bp, Homo sapien
ttcaggccacggagccgccagatct

SEQ ID NO: 107242 - DNA, 25 bp, Homo sapien
acggagccgccagatctgggtcccg

SEQ ID NO: 107243 - DNA, 25 bp, Homo sapien
ccagatctgggtcccgggtgaccac

SEQ ID NO: 107244 - DNA, 25 bp, Homo sapien
agggcgttagggcatggagggcccg

SEQ ID NO: 107245 - DNA, 25 bp, Homo sapien
gcggtggcgaacgtctcttccctac

SEQ ID NO: 107246 - DNA, 25 bp, Homo sapien
aagcggtggcgaacgtctcttccct

SEQ ID NO: 107247 - DNA, 25 bp, Homo sapien
tgaagcggtggcgaacgtctcttcc

SEQ ID NO: 107248 - DNA, 25 bp, Homo sapien
gccttgaagcggtggcgaacgtctc

SEQ ID NO: 107249 - DNA, 25 bp, Homo sapien
tcgggtaagtgcctcacagactttg

SEQ ID NO: 107250 - DNA, 25 bp, Homo sapien
ccgtctccagagtaatcgcagcatc

SEQ ID NO: 107251 - DNA, 25 bp, Homo sapien
ccgaccgggatgagaagtcctaatc

SEQ ID NO: 107252 - DNA, 25 bp, Homo sapien
agctgaatccagaggtggggtcaca

SEQ ID NO: 107253 - DNA, 25 bp, Homo sapien
ctccgagtgtgaatccctgggaaaa

SEQ ID NO: 107254 - DNA, 25 bp, Homo sapien
cagcatctctcctgagctccgagtg

SEQ ID NO: 107255 - DNA, 25 bp, Homo sapien
gctccgctcgtcttctctgtcttag

SEQ ID NO: 107256 - DNA, 25 bp, Homo sapien
gagaaccagctctctccggcttgga

SEQ ID NO: 107257 - DNA, 25 bp, Homo sapien
tgggatgcacttccgacgccctcta

SEQ ID NO: 107258 - DNA, 25 bp, Homo sapien
acgccctctaggcttgggagttccg

SEQ ID NO: 107259 - DNA, 25 bp, Homo sapien
cggttggcgcactgattcccagttg

SEQ ID NO: 107260 - DNA, 25 bp, Homo sapien
ggaggcttgactgagctcccacccg

SEQ ID NO: 107261 - DNA, 25 bp, Homo sapien
cgtactctggatacccgagggcgcg

SEQ ID NO: 107262 - DNA, 25 bp, Homo sapien
tcctctttagtggagttccggcgga

SEQ ID NO: 107263 - DNA, 25 bp, Homo sapien
ggtctcctcccagatggcgaatttc

SEQ ID NO: 107264 - DNA, 25 bp, Homo sapien
cagcgctaacacctagtcctcttta

SEQ ID NO: 107265 - DNA, 25 bp, Homo sapien
cttctgagtccagttaggcgcccgc

SEQ ID NO: 107266 - DNA, 25 bp, Homo sapien
tgctgtatcctaccggacgccggaa

SEQ ID NO: 107267 - DNA, 25 bp, Homo sapien
gggctcctgaccattctgaagaaga

SEQ ID NO: 107268 - DNA, 25 bp, Homo sapien
cctttcgagcgtggatccaacagtc

SEQ ID NO: 107269 - DNA, 25 bp, Homo sapien
gcgagcgtgatagccaacaggaacc

SEQ ID NO: 107270 - DNA, 25 bp, Homo sapien
accaaacgagcgtccggccaatcga

SEQ ID NO: 107271 - DNA, 25 bp, Homo sapien
acagtccgtctctttggtgttacgc

SEQ ID NO: 107272 - DNA, 25 bp, Homo sapien
agctgcgactgctcatgctgtatcc

SEQ ID NO: 107273 - DNA, 25 bp, Homo sapien
gtcctttgcagtcagcttgtcgctg

SEQ ID NO: 107274 - DNA, 25 bp, Homo sapien
gcggttcccagcactgtcctttgca

SEQ ID NO: 107275 - DNA, 25 bp, Homo sapien
ggattacttgtacgcggttcccagc

SEQ ID NO: 107276 - DNA, 25 bp, Homo sapien
ataagagactgaggacccgagcccg

SEQ ID NO: 107277 - DNA, 25 bp, Homo sapien
ccctcgggcgacgataagagactga

SEQ ID NO: 107278 - DNA, 25 bp, Homo sapien
cccgggctgcttccagaaagctaac

SEQ ID NO: 107279 - DNA, 25 bp, Homo sapien
ccgatgggaagaactgaaacgcctc

SEQ ID NO: 107280 - DNA, 25 bp, Homo sapien
tccagaaagctaaccggattacttg

SEQ ID NO: 107281 - DNA, 25 bp, Homo sapien
tgccgctcgtgtcagtcaacatgga

SEQ ID NO: 107282 - DNA, 25 bp, Homo sapien
cctgtggcagcaagaaacgggtagt

SEQ ID NO: 107283 - DNA, 25 bp, Homo sapien
acgggtagtgccaggtattgtgtac

SEQ ID NO: 107284 - DNA, 25 bp, Homo sapien
tcggacgcgtcttctttcaggctga

SEQ ID NO: 107285 - DNA, 25 bp, Homo sapien
gcaaccttctcagcgcctatggcga

SEQ ID NO: 107286 - DNA, 25 bp, Homo sapien
tgcgtcagttggcaaggcactttac

SEQ ID NO: 107287 - DNA, 25 bp, Homo sapien
ccgtcgcacgcgttttgcgtcagtt

SEQ ID NO: 107288 - DNA, 25 bp, Homo sapien
ggggtgcaagcatgcatgtcctgtt

SEQ ID NO: 107289 - DNA, 25 bp, Homo sapien
cctcgctggcctcctttgttgtgaa

SEQ ID NO: 107290 - DNA, 25 bp, Homo sapien
agtcgctcggcctcaaggatgccag

SEQ ID NO: 107291 - DNA, 25 bp, Homo sapien
ggcacttcattgctcacgggtgaca

SEQ ID NO: 107292 - DNA, 25 bp, Homo sapien
acgcacgtgtgtttaggagcgcagc

SEQ ID NO: 107293 - DNA, 25 bp, Homo sapien
agctgggaaagagtcgacccgctcc

SEQ ID NO: 107294 - DNA, 25 bp, Homo sapien
ggcccacaggtcgagagtgtttata

SEQ ID NO: 107295 - DNA, 25 bp, Homo sapien
ctgttagtttcgctgggttcctcgc

SEQ ID NO: 107296 - DNA, 25 bp, Homo sapien
gcgggcttttctgcaccgttcccag

SEQ ID NO: 107297 - DNA, 25 bp, Homo sapien
tttttctgctgacgctcgcggggaa

SEQ ID NO: 107298 - DNA, 25 bp, Homo sapien
cacatcgtccctttttctgctgacg

SEQ ID NO: 107299 - DNA, 25 bp, Homo sapien
ggaaggcgctttcgccctgcagtcc

SEQ ID NO: 107300 - DNA, 25 bp, Homo sapien
gtctcacggggcaaagcctttcttc

SEQ ID NO: 107301 - DNA, 25 bp, Homo sapien
ctcctgcccagaaggctcagagctg

SEQ ID NO: 107302 - DNA, 25 bp, Homo sapien
ggagcagacggaccaccaggtcacc

SEQ ID NO: 107303 - DNA, 25 bp, Homo sapien
cggagacaacgcctccgacggcagg

SEQ ID NO: 107304 - DNA, 25 bp, Homo sapien
cgagccgggtgtcggccttgtccct

SEQ ID NO: 107305 - DNA, 25 bp, Homo sapien
cgctgcccggaaaaaagtgtaactg

SEQ ID NO: 107306 - DNA, 25 bp, Homo sapien
caatgcttccttaagcggctggcgc

SEQ ID NO: 107307 - DNA, 25 bp, Homo sapien
ctgggtgacggatgctcaaaagttc

SEQ ID NO: 107308 - DNA, 25 bp, Homo sapien
ctgcgtaaaaaagtcctcgcctggg

SEQ ID NO: 107309 - DNA, 25 bp, Homo sapien
aggacccaggaagtctgcgcgaacg

SEQ ID NO: 107310 - DNA, 25 bp, Homo sapien
ctccggctcattcggaggcggttct

SEQ ID NO: 107311 - DNA, 25 bp, Homo sapien
aggcggttctcacctcccattggct

SEQ ID NO: 107312 - DNA, 25 bp, Homo sapien
aagctgcgccgcgagttcctgcaag

SEQ ID NO: 107313 - DNA, 25 bp, Homo sapien
tacacaacacgcctatgggtgcccg

SEQ ID NO: 107314 - DNA, 25 bp, Homo sapien
gcagaccggttcgtgagacgcaaga

SEQ ID NO: 107315 - DNA, 25 bp, Homo sapien
aagcggtcctacaccaaggactaca

SEQ ID NO: 107316 - DNA, 25 bp, Homo sapien
ccaaggactacaccgagggatgggt

SEQ ID NO: 107317 - DNA, 25 bp, Homo sapien
tggagttccgtgacaagcgcatagc

SEQ ID NO: 107318 - DNA, 25 bp, Homo sapien
gcgtggcggccagtctacacaacac

SEQ ID NO: 107319 - DNA, 25 bp, Homo sapien
tcgtgagacgcaagaagaaggcagc

SEQ ID NO: 107320 - DNA, 25 bp, Homo sapien
tcctggacgggtctttgtctttggc

SEQ ID NO: 107321 - DNA, 25 bp, Homo sapien
aactgagggcccgtaaagcagcacg

SEQ ID NO: 107322 - DNA, 25 bp, Homo sapien
agcgtgagaccgacttctatcttca

SEQ ID NO: 107323 - DNA, 25 bp, Homo sapien
tttgcccagcgtcctactgagcagg

SEQ ID NO: 107324 - DNA, 25 bp, Homo sapien
cgcccagatggctcctggacatttg

SEQ ID NO: 107325 - DNA, 25 bp, Homo sapien
ggacaacgctttcttgcggccgatg

SEQ ID NO: 107326 - DNA, 25 bp, Homo sapien
tcaaagtgtggaacggggacaacgc

SEQ ID NO: 107327 - DNA, 25 bp, Homo sapien
gagcacctcgcctttgagcgccagg

SEQ ID NO: 107328 - DNA, 25 bp, Homo sapien
cggaggttgctcaagccaagcgtga

SEQ ID NO: 107329 - DNA, 25 bp, Homo sapien
gctctttgggaattgcagcgcgcta

SEQ ID NO: 107330 - DNA, 25 bp, Homo sapien
tcagcttgaagagagtcggtttacc

SEQ ID NO: 107331 - DNA, 25 bp, Homo sapien
tgtccggaccctaaaggcaagttgc

SEQ ID NO: 107332 - DNA, 25 bp, Homo sapien
tcacccttccggtgtggtgccaaga

SEQ ID NO: 107333 - DNA, 25 bp, Homo sapien
ccgccggacggtgtgtttaatcgat

SEQ ID NO: 107334 - DNA, 25 bp, Homo sapien
tactctctagtttgaggacccagcg

SEQ ID NO: 107335 - DNA, 25 bp, Homo sapien
ctgcagctgcggataacagacattg

SEQ ID NO: 107336 - DNA, 25 bp, Homo sapien
gcggcctttccgagactacccgaga

SEQ ID NO: 107337 - DNA, 25 bp, Homo sapien
tctccggccactagggcgttccaac

SEQ ID NO: 107338 - DNA, 25 bp, Homo sapien
cgccgtcagcggagaccagaccatg

SEQ ID NO: 107339 - DNA, 25 bp, Homo sapien
cggagaccagaccatgctcagtgtc

SEQ ID NO: 107340 - DNA, 25 bp, Homo sapien
gaccagaccatgctcagtgtccagg

SEQ ID NO: 107341 - DNA, 25 bp, Homo sapien
ccactcgactgtggccgtgggtctt

SEQ ID NO: 107342 - DNA, 25 bp, Homo sapien
ctgggccaataggagccgagtcttc

SEQ ID NO: 107343 - DNA, 25 bp, Homo sapien
aataggagccgagtcttcggaaagg

SEQ ID NO: 107344 - DNA, 25 bp, Homo sapien
tgctcccactcgactgtggccgtgg

SEQ ID NO: 107345 - DNA, 25 bp, Homo sapien
cgcagactctgcgatagtagatcta

SEQ ID NO: 107346 - DNA, 25 bp, Homo sapien
cgatagtagatctaagggccaggct

SEQ ID NO: 107347 - DNA, 25 bp, Homo sapien
gcgaacccggcacggacaagaccta

SEQ ID NO: 107348 - DNA, 25 bp, Homo sapien
gagcaactcccttcgtgcgcctaga

SEQ ID NO: 107349 - DNA, 25 bp, Homo sapien
gccgcccacagagcgctttaacaga

SEQ ID NO: 107350 - DNA, 25 bp, Homo sapien
acgcaaaccctttcaagctggctgg

SEQ ID NO: 107351 - DNA, 25 bp, Homo sapien
ggggacagcacttccggttactctc

SEQ ID NO: 107352 - DNA, 25 bp, Homo sapien
ctccggacactcgaatctgggcttc

SEQ ID NO: 107353 - DNA, 25 bp, Homo sapien
atcgtgtttctatcgagtggctggg

SEQ ID NO: 107354 - DNA, 25 bp, Homo sapien
tcgtgggagacgagaccttcactca

SEQ ID NO: 107355 - DNA, 25 bp, Homo sapien
acggggacgatgtgaatcgtgtttc

SEQ ID NO: 107356 - DNA, 25 bp, Homo sapien
tcagccaggaggaggtagccgcaca

SEQ ID NO: 107357 - DNA, 25 bp, Homo sapien
aggaggtagccgcacaaggcttagc

SEQ ID NO: 107358 - DNA, 25 bp, Homo sapien
cacaaggcttagctgggtctcccgc

SEQ ID NO: 107359 - DNA, 25 bp, Homo sapien
cgcgcagacatctcctggacagcga

SEQ ID NO: 107360 - DNA, 25 bp, Homo sapien
ccttcactcaggaacggggacgatg

SEQ ID NO: 107361 - DNA, 25 bp, Homo sapien
tggtgccattatgtgctcacgcgcc

SEQ ID NO: 107362 - DNA, 25 bp, Homo sapien
tgcgcttattaatccattatggtcg

SEQ ID NO: 107363 - DNA, 25 bp, Homo sapien
gcttattaatccattatggtcgctc

SEQ ID NO: 107364 - DNA, 25 bp, Homo sapien
atccattatggtcgctctgtcactg

SEQ ID NO: 107365 - DNA, 25 bp, Homo sapien
cattatggtcgctctgtcactggtg

SEQ ID NO: 107366 - DNA, 25 bp, Homo sapien
ctctgtcactggtgccattatgtgc

SEQ ID NO: 107367 - DNA, 25 bp, Homo sapien
cactggtgccattatgtgctcacgc

SEQ ID NO: 107368 - DNA, 25 bp, Homo sapien
tgtcactggtgccattatgtgctca

SEQ ID NO: 107369 - DNA, 25 bp, Homo sapien
tcctaagtctccttggaaagaagta

SEQ ID NO: 107370 - DNA, 25 bp, Homo sapien
ccggtgctgtgacgaccagagcaaa

SEQ ID NO: 107371 - DNA, 25 bp, Homo sapien
agaagtattcgctttcgtttccgca

SEQ ID NO: 107372 - DNA, 25 bp, Homo sapien
ggagcgtctgccctttcctaagtct

SEQ ID NO: 107373 - DNA, 25 bp, Homo sapien
ttgaaggtcctccagggaacacctg

SEQ ID NO: 107374 - DNA, 25 bp, Homo sapien
ttcctccgacgctgggagaaggacc

SEQ ID NO: 107375 - DNA, 25 bp, Homo sapien
gatttcgtaatcctcccagggattc

SEQ ID NO: 107376 - DNA, 25 bp, Homo sapien
gtttccgcaaacaaagcatgctccg

SEQ ID NO: 107377 - DNA, 25 bp, Homo sapien
ccaagggctacaccgagtacaaagt

SEQ ID NO: 107378 - DNA, 25 bp, Homo sapien
accttaaggaaaggcggtgcagcca

SEQ ID NO: 107379 - DNA, 25 bp, Homo sapien
aggttgcagtacgaggcttagttta

SEQ ID NO: 107380 - DNA, 25 bp, Homo sapien
cttgcgacaaaatccctaggccaga

SEQ ID NO: 107381 - DNA, 25 bp, Homo sapien
cgggatcggaacagcgctgtcactt

SEQ ID NO: 107382 - DNA, 25 bp, Homo sapien
gccactgctccctttttagacgaca

SEQ ID NO: 107383 - DNA, 25 bp, Homo sapien
ttcctgcggcactacacagtgtcgg

SEQ ID NO: 107384 - DNA, 25 bp, Homo sapien
tcccgccaggcgaaggatgacttcc

SEQ ID NO: 107385 - DNA, 25 bp, Homo sapien
cctacagaagggctgaccaggctca

SEQ ID NO: 107386 - DNA, 25 bp, Homo sapien
ttcatgtgaaaacgagccatctcca

SEQ ID NO: 107387 - DNA, 25 bp, Homo sapien
ttttgggaacctcggtctcctgctg

SEQ ID NO: 107388 - DNA, 25 bp, Homo sapien
cgaagcgtttccactcagttcttga

SEQ ID NO: 107389 - DNA, 25 bp, Homo sapien
tgtgagtcccacgaaagctaagccc

SEQ ID NO: 107390 - DNA, 25 bp, Homo sapien
cctgcctcgggaccaggaagcggaa

SEQ ID NO: 107391 - DNA, 25 bp, Homo sapien
tgcgctatccgacgcagcgagacgc

SEQ ID NO: 107392 - DNA, 25 bp, Homo sapien
cggcccggcaattacgtttctatca

SEQ ID NO: 107393 - DNA, 25 bp, Homo sapien
gacgcactactattggttgaaatta

SEQ ID NO: 107394 - DNA, 25 bp, Homo sapien
aagactcgctcttctagggccggtc

SEQ ID NO: 107395 - DNA, 25 bp, Homo sapien
cccgttcactttgtggttgctcgta

SEQ ID NO: 107396 - DNA, 25 bp, Homo sapien
cgtcagaggtcaggtctgcccaatc

SEQ ID NO: 107397 - DNA, 25 bp, Homo sapien
tgacaaggcgcttttatatagaatc

SEQ ID NO: 107398 - DNA, 25 bp, Homo sapien
gcactgtgtagctataaagcgccaa

SEQ ID NO: 107399 - DNA, 25 bp, Homo sapien
gctggctctggcatagcactgtgta

SEQ ID NO: 107400 - DNA, 25 bp, Homo sapien
tgctcgtagtgagttgcgctcgcta

SEQ ID NO: 107401 - DNA, 25 bp, Homo sapien
tgagtctcttaatagggccattgtc

SEQ ID NO: 107402 - DNA, 25 bp, Homo sapien
tcacaggcagcagacctttgttctc

SEQ ID NO: 107403 - DNA, 25 bp, Homo sapien
ctggtccgcagaggttacccataaa

SEQ ID NO: 107404 - DNA, 25 bp, Homo sapien
gctgcgcgacaacatccagggtatc

SEQ ID NO: 107405 - DNA, 25 bp, Homo sapien
ccagggtatcaccaagccagccatt

SEQ ID NO: 107406 - DNA, 25 bp, Homo sapien
gcttcggcggctaaatggcattttg

SEQ ID NO: 107407 - DNA, 25 bp, Homo sapien
gaagcccagtcattctctaaaaagg

SEQ ID NO: 107408 - DNA, 25 bp, Homo sapien
agctcttccggttttcagtctggtc

SEQ ID NO: 107409 - DNA, 25 bp, Homo sapien
gtcggtgcagcctcaacttctactg

SEQ ID NO: 107410 - DNA, 25 bp, Homo sapien
ccggaggcttaggacagtgatttac

SEQ ID NO: 107411 - DNA, 25 bp, Homo sapien
ctctcaggttcgacggattctcccg

SEQ ID NO: 107412 - DNA, 25 bp, Homo sapien
caaatatacgttcccttgcccgcgg

SEQ ID NO: 107413 - DNA, 25 bp, Homo sapien
gtcgccaaccagctttgctcgcgtg

SEQ ID NO: 107414 - DNA, 25 bp, Homo sapien
cggcgagaggatactttgaggaaca

SEQ ID NO: 107415 - DNA, 25 bp, Homo sapien
ccagtcggcttcctcgccataaaaa

SEQ ID NO: 107416 - DNA, 25 bp, Homo sapien
ttcccagagagaactcgaggggctg

SEQ ID NO: 107417 - DNA, 25 bp, Homo sapien
cctgctccgcaagggtaattatgcc

SEQ ID NO: 107418 - DNA, 25 bp, Homo sapien
cctcgttggctactttcagtaagtt

SEQ ID NO: 107419 - DNA, 25 bp, Homo sapien
aaggcgctgcctttcctcgttggct

SEQ ID NO: 107420 - DNA, 25 bp, Homo sapien
tgacgtcagaggttagttataccca

SEQ ID NO: 107421 - DNA, 25 bp, Homo sapien
tcctgtatctgattggtggttatta

SEQ ID NO: 107422 - DNA, 25 bp, Homo sapien
tataggacctctcatgcaaataagg

SEQ ID NO: 107423 - DNA, 25 bp, Homo sapien
taccaggagtcgtttttatatagga

SEQ ID NO: 107424 - DNA, 25 bp, Homo sapien
taatgggagcaaggtaccaggagtc

SEQ ID NO: 107425 - DNA, 25 bp, Homo sapien
cgcagtcaccaggacccgaaattca

SEQ ID NO: 107426 - DNA, 25 bp, Homo sapien
ctgtgcgtcctaagcttgcagctcc

SEQ ID NO: 107427 - DNA, 25 bp, Homo sapien
taaaatcagacttggccctgcagtg

SEQ ID NO: 107428 - DNA, 25 bp, Homo sapien
cgggacggctcctttcaagagtctc

SEQ ID NO: 107429 - DNA, 25 bp, Homo sapien
tggcatcggcgtaaatgaaaggacc

SEQ ID NO: 107430 - DNA, 25 bp, Homo sapien
gctccttgagaccattccagccagg

SEQ ID NO: 107431 - DNA, 25 bp, Homo sapien
gctcttaggcctgggaacctgggaa

SEQ ID NO: 107432 - DNA, 25 bp, Homo sapien
ctgggaaagtgcactgtctcgcctc

SEQ ID NO: 107433 - DNA, 25 bp, Homo sapien
tgcgacagctctgcggacttctcct

SEQ ID NO: 107434 - DNA, 25 bp, Homo sapien
cggagtcccttgacacttccggata

SEQ ID NO: 107435 - DNA, 25 bp, Homo sapien
cccacaggtggtatcccgaagccta

SEQ ID NO: 107436 - DNA, 25 bp, Homo sapien
ccgaagcctaatgagcaccgcgatc

SEQ ID NO: 107437 - DNA, 25 bp, Homo sapien
ggtttgggcagggacaatcctatcc

SEQ ID NO: 107438 - DNA, 25 bp, Homo sapien
caatcctatccggaggtgaggctca

SEQ ID NO: 107439 - DNA, 25 bp, Homo sapien
cccagcctaagtcttggcggacatc

SEQ ID NO: 107440 - DNA, 25 bp, Homo sapien
ggccaagagctaggtctgcaccctc

SEQ ID NO: 107441 - DNA, 25 bp, Homo sapien
agccgggtcctgtgaactctgcggt

SEQ ID NO: 107442 - DNA, 25 bp, Homo sapien
gaggctgcaaattccctggttccga

SEQ ID NO: 107443 - DNA, 25 bp, Homo sapien
ttccgaggcctcagggaagagccca

SEQ ID NO: 107444 - DNA, 25 bp, Homo sapien
tctccaagagtgaaaaggaatccgc

SEQ ID NO: 107445 - DNA, 25 bp, Homo sapien
tgatccattcgctgcagtctcagag

SEQ ID NO: 107446 - DNA, 25 bp, Homo sapien
agtctcagagttggagcagcttggc

SEQ ID NO: 107447 - DNA, 25 bp, Homo sapien
cagcttggcgtttactcccgggcct

SEQ ID NO: 107448 - DNA, 25 bp, Homo sapien
gcttcgtggttgcttccctgatcca

SEQ ID NO: 107449 - DNA, 25 bp, Homo sapien
cacttttgcgggaagctagcgttgc

SEQ ID NO: 107450 - DNA, 25 bp, Homo sapien
ccaatgcgggtcaatgcgtagtagc

SEQ ID NO: 107451 - DNA, 25 bp, Homo sapien
ggccttttggcttggagcatttcca

SEQ ID NO: 107452 - DNA, 25 bp, Homo sapien
cgcaggcgccttgtttaatggcctt

SEQ ID NO: 107453 - DNA, 25 bp, Homo sapien
cgccacaaagacgtcagggattagg

SEQ ID NO: 107454 - DNA, 25 bp, Homo sapien
atttcccttgatggtcccgatcgcc

SEQ ID NO: 107455 - DNA, 25 bp, Homo sapien
tgcgtcgcctgtttctccacgatca

SEQ ID NO: 107456 - DNA, 25 bp, Homo sapien
ctagcgttgcatggaacattaggcc

SEQ ID NO: 107457 - DNA, 25 bp, Homo sapien
ccgactattactggcctcgaaggta

SEQ ID NO: 107458 - DNA, 25 bp, Homo sapien
gtccggattcaccaagtggcgcaga

SEQ ID NO: 107459 - DNA, 25 bp, Homo sapien
tctccgcagcgagttgcagtacttg

SEQ ID NO: 107460 - DNA, 25 bp, Homo sapien
acttgctttgctgttctgagacctc

SEQ ID NO: 107461 - DNA, 25 bp, Homo sapien
tttcggacgtctgcagaatcggaca

SEQ ID NO: 107462 - DNA, 25 bp, Homo sapien
tggacgaactgaacccgatgaactt

SEQ ID NO: 107463 - DNA, 25 bp, Homo sapien
gtgcacagtttccaggctccgacta

SEQ ID NO: 107464 - DNA, 25 bp, Homo sapien
ccggatggcatttgtggcactagca

SEQ ID NO: 107465 - DNA, 25 bp, Homo sapien
acctgagcgtctcggtcgggaactc

SEQ ID NO: 107466 - DNA, 25 bp, Homo sapien
gcgccaaacctgagcgtctcggtcg

SEQ ID NO: 107467 - DNA, 25 bp, Homo sapien
cgcaactcgcgggtaggcgaccgct

SEQ ID NO: 107468 - DNA, 25 bp, Homo sapien
cagtgccctctacgtcccgtccggg

SEQ ID NO: 107469 - DNA, 25 bp, Homo sapien
tcgttgcttcactgctcgctcgagc

SEQ ID NO: 107470 - DNA, 25 bp, Homo sapien
ggtctctggggcatatcgttgcttc

SEQ ID NO: 107471 - DNA, 25 bp, Homo sapien
tggacctcaggtctagccggcaagc

SEQ ID NO: 107472 - DNA, 25 bp, Homo sapien
ggggcatatcgttgcttcactgctc

SEQ ID NO: 107473 - DNA, 25 bp, Homo sapien
tggccgtcgtcaccctctaatttct

SEQ ID NO: 107474 - DNA, 25 bp, Homo sapien
ggaattttatgaccagcgcccgctg

SEQ ID NO: 107475 - DNA, 25 bp, Homo sapien
gggctgagcccggaattttatgacc

SEQ ID NO: 107476 - DNA, 25 bp, Homo sapien
ccagtttgtggctctcggagagttc

SEQ ID NO: 107477 - DNA, 25 bp, Homo sapien
atgtcagtagccacagtcgccgccg

SEQ ID NO: 107478 - DNA, 25 bp, Homo sapien
ctcgggttcccgcaggatacactgc

SEQ ID NO: 107479 - DNA, 25 bp, Homo sapien
cctacgccttttggaatcagcgaca

SEQ ID NO: 107480 - DNA, 25 bp, Homo sapien
cggggacccttcttaatgtcagtag

SEQ ID NO: 107481 - DNA, 25 bp, Homo sapien
gcgcactcaggttccgctccaagtg

SEQ ID NO: 107482 - DNA, 25 bp, Homo sapien
tcgacgcatgggtttctctttaatc

SEQ ID NO: 107483 - DNA, 25 bp, Homo sapien
gtgcctgtgatcttagggaacctga

SEQ ID NO: 107484 - DNA, 25 bp, Homo sapien
tgactggtcccgcataccgagcaga

SEQ ID NO: 107485 - DNA, 25 bp, Homo sapien
gtccgcgtcaggagacttaggtcca

SEQ ID NO: 107486 - DNA, 25 bp, Homo sapien
gttttgcaactggtcgtccgcgtca

SEQ ID NO: 107487 - DNA, 25 bp, Homo sapien
cgttgctcagtctcagtgtggtctc

SEQ ID NO: 107488 - DNA, 25 bp, Homo sapien
gcgaccgctgctgatacgttgctca

SEQ ID NO: 107489 - DNA, 25 bp, Homo sapien
ttgccatggtgatacctgagctccc

SEQ ID NO: 107490 - DNA, 25 bp, Homo sapien
cggaagcgcattgaccgccaccaga

SEQ ID NO: 107491 - DNA, 25 bp, Homo sapien
ggtcacttccggtcgttacgagcga

SEQ ID NO: 107492 - DNA, 25 bp, Homo sapien
gcgttcccagaacactccgcgaagg

SEQ ID NO: 107493 - DNA, 25 bp, Homo sapien
ctccgcgaaggtgttcctgaacttc

SEQ ID NO: 107494 - DNA, 25 bp, Homo sapien
tcccagaggctttagctaacgtgta

SEQ ID NO: 107495 - DNA, 25 bp, Homo sapien
gcagaggcctctaagcgcgaaatca

SEQ ID NO: 107496 - DNA, 25 bp, Homo sapien
cctaacgcagggagccgaagcaact

SEQ ID NO: 107497 - DNA, 25 bp, Homo sapien
ccagctatggcgagtacagaagcct

SEQ ID NO: 107498 - DNA, 25 bp, Homo sapien
gcaggcgctcgctggatgttattcg

SEQ ID NO: 107499 - DNA, 25 bp, Homo sapien
agtacagaagcctggccggtcccgg

SEQ ID NO: 107500 - DNA, 25 bp, Homo sapien
tcagaggagagttggccatgactcc

SEQ ID NO: 107501 - DNA, 25 bp, Homo sapien
tcgttcaccgaggagctttgggctc

SEQ ID NO: 107502 - DNA, 25 bp, Homo sapien
tacgaacaccgtcgttcaccgagga

SEQ ID NO: 107503 - DNA, 25 bp, Homo sapien
ggaagcgattccgtgcctggaatcc

SEQ ID NO: 107504 - DNA, 25 bp, Homo sapien
tttggtgccagctatggcgagtaca

SEQ ID NO: 107505 - DNA, 25 bp, Homo sapien
tctcggcgccgtaaatcactaggtc

SEQ ID NO: 107506 - DNA, 25 bp, Homo sapien
ggtttgtcctcatgagctccacgtc

SEQ ID NO: 107507 - DNA, 25 bp, Homo sapien
gacgctcctatgagaactgtttgga

SEQ ID NO: 107508 - DNA, 25 bp, Homo sapien
catgaagttgtcagggacgctccta

SEQ ID NO: 107509 - DNA, 25 bp, Homo sapien
gcgtcccttgggctcttaatgcttt

SEQ ID NO: 107510 - DNA, 25 bp, Homo sapien
cagtcgccctgcagaaagtcctagg

SEQ ID NO: 107511 - DNA, 25 bp, Homo sapien
cggggcttccagttcagcttctgtt

SEQ ID NO: 107512 - DNA, 25 bp, Homo sapien
gcgtgcgccctaagagatactcaca

SEQ ID NO: 107513 - DNA, 25 bp, Homo sapien
cgacagatctttcggtgaccttcga

SEQ ID NO: 107514 - DNA, 25 bp, Homo sapien
gttgcctgggagtcacgaaactcta

SEQ ID NO: 107515 - DNA, 25 bp, Homo sapien
agtcacagacatcgcagttgcctgg

SEQ ID NO: 107516 - DNA, 25 bp, Homo sapien
agaatctgccgccagaaagcactgc

SEQ ID NO: 107517 - DNA, 25 bp, Homo sapien
tgacgatgtataagaatctgccgcc

SEQ ID NO: 107518 - DNA, 25 bp, Homo sapien
gcgacatcgagattgacgatgtata

SEQ ID NO: 107519 - DNA, 25 bp, Homo sapien
tcggtgaccttcgaaagcgacatcg

SEQ ID NO: 107520 - DNA, 25 bp, Homo sapien
aaactctaccactacgttctcgctg

SEQ ID NO: 107521 - DNA, 25 bp, Homo sapien
agaacgccggacaaacgctcgggag

SEQ ID NO: 107522 - DNA, 25 bp, Homo sapien
gagcctcgcggttcttccaacaacg

SEQ ID NO: 107523 - DNA, 25 bp, Homo sapien
ctttcaaaagtgttcctagcgttag

SEQ ID NO: 107524 - DNA, 25 bp, Homo sapien
gcagcccggcttagggccgcagaac

SEQ ID NO: 107525 - DNA, 25 bp, Homo sapien
cgcaatctgtcagcgcggctaggtt

SEQ ID NO: 107526 - DNA, 25 bp, Homo sapien
cctagcgttaggagcaaagaacgcc

SEQ ID NO: 107527 - DNA, 25 bp, Homo sapien
gccgcctcaatttaagtcatccata

SEQ ID NO: 107528 - DNA, 25 bp, Homo sapien
caggactagttgacacgccgcctca

SEQ ID NO: 107529 - DNA, 25 bp, Homo sapien
gctcgcgtcttctacaaaaaccgtg

SEQ ID NO: 107530 - DNA, 25 bp, Homo sapien
tgaaagcaaccacaggccagcgggg

SEQ ID NO: 107531 - DNA, 25 bp, Homo sapien
ccgtgttcttgctagaacgttggca

SEQ ID NO: 107532 - DNA, 25 bp, Homo sapien
ctcggcttttctcgggctttctgaa

SEQ ID NO: 107533 - DNA, 25 bp, Homo sapien
gctttctgaaaagagcacctgcata

SEQ ID NO: 107534 - DNA, 25 bp, Homo sapien
ggaaattttggctcctgatggcatg

SEQ ID NO: 107535 - DNA, 25 bp, Homo sapien
ggaggatcacattcatcttccagga

SEQ ID NO: 107536 - DNA, 25 bp, Homo sapien
ttcgcgtcctggctctgaaagcaac

SEQ ID NO: 107537 - DNA, 25 bp, Homo sapien
tcatttcgaaccgagctgaacgctc

SEQ ID NO: 107538 - DNA, 25 bp, Homo sapien
cggcgtgaacactacgctgattcca

SEQ ID NO: 107539 - DNA, 25 bp, Homo sapien
aggtcgcgtttgtacagaaggctcc

SEQ ID NO: 107540 - DNA, 25 bp, Homo sapien
cgagaaatctcgcaaacggcgtgaa

SEQ ID NO: 107541 - DNA, 25 bp, Homo sapien
ctgattccagaaatggtcgggttcc

SEQ ID NO: 107542 - DNA, 25 bp, Homo sapien
ttcactcaggatggtcgcctgctgg

SEQ ID NO: 107543 - DNA, 25 bp, Homo sapien
acgctcattgctgagtcctgggaga

SEQ ID NO: 107544 - DNA, 25 bp, Homo sapien
tcgggttcccttccttcactcagga

SEQ ID NO: 107545 - DNA, 25 bp, Homo sapien
gagccgcgtcctttcatccttgaga

SEQ ID NO: 107546 - DNA, 25 bp, Homo sapien
ctgcagcggcaagtgtgtgactttc

SEQ ID NO: 107547 - DNA, 25 bp, Homo sapien
atccttgagacagctccgtggtcca

SEQ ID NO: 107548 - DNA, 25 bp, Homo sapien
gtgacagaggaaccacccgaggcta

SEQ ID NO: 107549 - DNA, 25 bp, Homo sapien
cgtccttttgtctcagcgaaccgca

SEQ ID NO: 107550 - DNA, 25 bp, Homo sapien
aggactctgcaaccatcactcggga

SEQ ID NO: 107551 - DNA, 25 bp, Homo sapien
caagcttggatgcaacttcggattc

SEQ ID NO: 107552 - DNA, 25 bp, Homo sapien
tgcagtttccggatcccgaaggctt

SEQ ID NO: 107553 - DNA, 25 bp, Homo sapien
ccgcagaggcgtagctggactacaa

SEQ ID NO: 107554 - DNA, 25 bp, Homo sapien
gccaactcgactggactgggtgaga

SEQ ID NO: 107555 - DNA, 25 bp, Homo sapien
cgcctcaccacaaagcggttggttg

SEQ ID NO: 107556 - DNA, 25 bp, Homo sapien
cggcagggactacaccggtgtatca

SEQ ID NO: 107557 - DNA, 25 bp, Homo sapien
tgcatctcgggaggccaactcgact

SEQ ID NO: 107558 - DNA, 25 bp, Homo sapien
gctggactacaacgcagtgcatctc

SEQ ID NO: 107559 - DNA, 25 bp, Homo sapien
agaccgcttgcgagctgtgctcctg

SEQ ID NO: 107560 - DNA, 25 bp, Homo sapien
taaaaacactaaggggagcgcgcga

SEQ ID NO: 107561 - DNA, 25 bp, Homo sapien
tgggaaggtctctgctgattggtaa

SEQ ID NO: 107562 - DNA, 25 bp, Homo sapien
tagataataggccttttgccatgtc

SEQ ID NO: 107563 - DNA, 25 bp, Homo sapien
ctctgctgattggtaattatccgtg

SEQ ID NO: 107564 - DNA, 25 bp, Homo sapien
tataatagtttatgcggccgaggta

SEQ ID NO: 107565 - DNA, 25 bp, Homo sapien
gaagtcggtctcctctttttatata

SEQ ID NO: 107566 - DNA, 25 bp, Homo sapien
tcgggcataatgaaacaatagtggc

SEQ ID NO: 107567 - DNA, 25 bp, Homo sapien
gcagacttggccagctcgggcataa

SEQ ID NO: 107568 - DNA, 25 bp, Homo sapien
ttcttgaccgtatagataataggcc

SEQ ID NO: 107569 - DNA, 25 bp, Homo sapien
tgctgatcagaaagctgccttttca

SEQ ID NO: 107570 - DNA, 25 bp, Homo sapien
ctatcggcctggtacagtggctctc

SEQ ID NO: 107571 - DNA, 25 bp, Homo sapien
ccggcggtgtcaagaagccccatcg

SEQ ID NO: 107572 - DNA, 25 bp, Homo sapien
gtacagtggctctccgcgagattcg

SEQ ID NO: 107573 - DNA, 25 bp, Homo sapien
ccagctcgcacgtcgtatccgcggc

SEQ ID NO: 107574 - DNA, 25 bp, Homo sapien
ctggtacagtggctctccgcgagat

SEQ ID NO: 107575 - DNA, 25 bp, Homo sapien
gaaagctgccttttcagcgtctggt

SEQ ID NO: 107576 - DNA, 25 bp, Homo sapien
atcgctatcggcctggtacagtggc

SEQ ID NO: 107577 - DNA, 25 bp, Homo sapien
agcctttgtttttatgcgcttttca

SEQ ID NO: 107578 - DNA, 25 bp, Homo sapien
tcaagaaagactgaaatgaaattgg

SEQ ID NO: 107579 - DNA, 25 bp, Homo sapien
ctttacttagtcttgtggtggctct

SEQ ID NO: 107580 - DNA, 25 bp, Homo sapien
actcggtctttacttagtcttgtgg

SEQ ID NO: 107581 - DNA, 25 bp, Homo sapien
tcaactcggtctttacttagtcttg

SEQ ID NO: 107582 - DNA, 25 bp, Homo sapien
tgcgcttttcaactcggtctttact

SEQ ID NO: 107583 - DNA, 25 bp, Homo sapien
tatgcgcttttcaactcggtcttta

SEQ ID NO: 107584 - DNA, 25 bp, Homo sapien
tgtttttatgcgcttttcaactcgg

SEQ ID NO: 107585 - DNA, 25 bp, Homo sapien
agcaccgacccgctccgcatagttg

SEQ ID NO: 107586 - DNA, 25 bp, Homo sapien
acgtacattttatagcctctactgg

SEQ ID NO: 107587 - DNA, 25 bp, Homo sapien
agctgtgcgattggcttacgtttta

SEQ ID NO: 107588 - DNA, 25 bp, Homo sapien
cattttatagcctctactgggcgcg

SEQ ID NO: 107589 - DNA, 25 bp, Homo sapien
ttttatagcctctactgggcgcgaa

SEQ ID NO: 107590 - DNA, 25 bp, Homo sapien
aggcgatgcactcggcctacgggaa

SEQ ID NO: 107591 - DNA, 25 bp, Homo sapien
cgaaaaggaagctgtgcgattggct

SEQ ID NO: 107592 - DNA, 25 bp, Homo sapien
ctactgggcgcgaaaaggaagctgt

SEQ ID NO: 107593 - DNA, 25 bp, Homo sapien
ccgccgacttctttcaggttctcag

SEQ ID NO: 107594 - DNA, 25 bp, Homo sapien
cctctacggtttcggtggttgagcg

SEQ ID NO: 107595 - DNA, 25 bp, Homo sapien
actgcgcgacaatatccagggcatc

SEQ ID NO: 107596 - DNA, 25 bp, Homo sapien
caccgtaaagtactgcgcgacaata

SEQ ID NO: 107597 - DNA, 25 bp, Homo sapien
acaaagcgttgggtgagactcctct

SEQ ID NO: 107598 - DNA, 25 bp, Homo sapien
cgtataaaggcgctgcctcaggcca

SEQ ID NO: 107599 - DNA, 25 bp, Homo sapien
cggtccgccaactgtcgtataaagg

SEQ ID NO: 107600 - DNA, 25 bp, Homo sapien
tcaggttctcagttcggtccgccaa

SEQ ID NO: 107601 - DNA, 25 bp, Homo sapien
agaggagtctcacccaacgctttgt

SEQ ID NO: 107602 - DNA, 25 bp, Homo sapien
tggcggaccgaactgagaacctgaa

SEQ ID NO: 107603 - DNA, 25 bp, Homo sapien
atgccctggatattgtcgcgcagta

SEQ ID NO: 107604 - DNA, 25 bp, Homo sapien
tggcctgaggcagcgcctttatacg

SEQ ID NO: 107605 - DNA, 25 bp, Homo sapien
tgccgcggccagacatgacgagcaa

SEQ ID NO: 107606 - DNA, 25 bp, Homo sapien
attgtcgcgcagtactttacggtgg

SEQ ID NO: 107607 - DNA, 25 bp, Homo sapien
cgctcaaccaccgaaaccgtagagg

SEQ ID NO: 107608 - DNA, 25 bp, Homo sapien
cctttatacgacagttggcggaccg

SEQ ID NO: 107609 - DNA, 25 bp, Homo sapien
tgtgcagcacgaagcgcctctccag

SEQ ID NO: 107610 - DNA, 25 bp, Homo sapien
aggaccctaatatcgcccgaggatg

SEQ ID NO: 107611 - DNA, 25 bp, Homo sapien
acctggcctgtgataccggtgatga

SEQ ID NO: 107612 - DNA, 25 bp, Homo sapien
agaggcgctcgatgtatcccgcaca

SEQ ID NO: 107613 - DNA, 25 bp, Homo sapien
agctgcgaagcacgacatgggcttg

SEQ ID NO: 107614 - DNA, 25 bp, Homo sapien
ccctttccggcactaggagctgcga

SEQ ID NO: 107615 - DNA, 25 bp, Homo sapien
agttcattgatcaccggttcttttc

SEQ ID NO: 107616 - DNA, 25 bp, Homo sapien
tcaagaagacctcacccgcaagttc

SEQ ID NO: 107617 - DNA, 25 bp, Homo sapien
agctccgctacttatagtcaacaga

SEQ ID NO: 107618 - DNA, 25 bp, Homo sapien
gtacaccagttccaagtgagcccgc

SEQ ID NO: 107619 - DNA, 25 bp, Homo sapien
tttccggcagttactcccagtcatg

SEQ ID NO: 107620 - DNA, 25 bp, Homo sapien
cgtttccaggactcaccactggtta

SEQ ID NO: 107621 - DNA, 25 bp, Homo sapien
agctgtgctattggctaacattaca

SEQ ID NO: 107622 - DNA, 25 bp, Homo sapien
gttcctgagactgacgtaacgctaa

SEQ ID NO: 107623 - DNA, 25 bp, Homo sapien
ctgggaactgaagacccgcccttga

SEQ ID NO: 107624 - DNA, 25 bp, Homo sapien
gtttcgctttaaccaatgggattgc

SEQ ID NO: 107625 - DNA, 25 bp, Homo sapien
gtagtggagctctggtgaacttctc

SEQ ID NO: 107626 - DNA, 25 bp, Homo sapien
gccaaaggcaaataatgtctccata

SEQ ID NO: 107627 - DNA, 25 bp, Homo sapien
cggctgttctcagttcctccattta

SEQ ID NO: 107628 - DNA, 25 bp, Homo sapien
tcgcgcccagtattgactataagta

SEQ ID NO: 107629 - DNA, 25 bp, Homo sapien
cagctttattttcgcgcccagtatt

SEQ ID NO: 107630 - DNA, 25 bp, Homo sapien
tgagccaatggcacagctttatttt

SEQ ID NO: 107631 - DNA, 25 bp, Homo sapien
tgtttcataacagcgattccattgg

SEQ ID NO: 107632 - DNA, 25 bp, Homo sapien
ttatcgtttcttcgtcatgtcggga

SEQ ID NO: 107633 - DNA, 25 bp, Homo sapien
ttccgacatggtggcaagaaactgc

SEQ ID NO: 107634 - DNA, 25 bp, Homo sapien
tgccttcttcttagccggggatttc

SEQ ID NO: 107635 - DNA, 25 bp, Homo sapien
cgccggcagccttcttagttgcctt

SEQ ID NO: 107636 - DNA, 25 bp, Homo sapien
ctcgaaatctaaagagcaggttttg

SEQ ID NO: 107637 - DNA, 25 bp, Homo sapien
caggttttgcgttgctgctatgctc

SEQ ID NO: 107638 - DNA, 25 bp, Homo sapien
cccgggcttatataagccggcgctg

SEQ ID NO: 107639 - DNA, 25 bp, Homo sapien
gccctgtgattggtggagcgtccaa

SEQ ID NO: 107640 - DNA, 25 bp, Homo sapien
tcgctttgcgcttagcagcgccggc

SEQ ID NO: 107641 - DNA, 25 bp, Homo sapien
aggtagcttccggattagcagctcg

SEQ ID NO: 107642 - DNA, 25 bp, Homo sapien
gtgcgatctcccgtaccaagcgctg

SEQ ID NO: 107643 - DNA, 25 bp, Homo sapien
cgatctcccgtaccaagcgctgaaa

SEQ ID NO: 107644 - DNA, 25 bp, Homo sapien
tctcccgtaccaagcgctgaaaagg

SEQ ID NO: 107645 - DNA, 25 bp, Homo sapien
taccaagcgctgaaaaggtagcttc

SEQ ID NO: 107646 - DNA, 25 bp, Homo sapien
ctgaaaaggtagcttccggattagc

SEQ ID NO: 107647 - DNA, 25 bp, Homo sapien
agtcctgtgcgatctcccgtaccaa

SEQ ID NO: 107648 - DNA, 25 bp, Homo sapien
aatagtgacgcgtttggcgtgaatg

SEQ ID NO: 107649 - DNA, 25 bp, Homo sapien
ccagtgcacccggaactgggactgg

SEQ ID NO: 107650 - DNA, 25 bp, Homo sapien
cccttgtggtctgtagcgccacgca

SEQ ID NO: 107651 - DNA, 25 bp, Homo sapien
cgggctcgcttgtttgcagccctga

SEQ ID NO: 107652 - DNA, 25 bp, Homo sapien
aggatccgtctcttcctcacctgga

SEQ ID NO: 107653 - DNA, 25 bp, Homo sapien
cctcactgatgctgatccaggatcc

SEQ ID NO: 107654 - DNA, 25 bp, Homo sapien
gctgtgattttatggcaggcctcgt

SEQ ID NO: 107655 - DNA, 25 bp, Homo sapien
gcagcagagacggtgagtccacaca

SEQ ID NO: 107656 - DNA, 25 bp, Homo sapien
caggcctcgtggaagtgtttagtta

SEQ ID NO: 107657 - DNA, 25 bp, Homo sapien
aaactgtggagcctcttctgtaacc

SEQ ID NO: 107658 - DNA, 25 bp, Homo sapien
gctcgaatccgaggcagagggtccc

SEQ ID NO: 107659 - DNA, 25 bp, Homo sapien
gtcacgcgcctagcttccggcgatg

SEQ ID NO: 107660 - DNA, 25 bp, Homo sapien
ctcagtgggctcgaaacaaagggct

SEQ ID NO: 107661 - DNA, 25 bp, Homo sapien
aggcttctcggcctagcagtgccct

SEQ ID NO: 107662 - DNA, 25 bp, Homo sapien
tggggctgatcttcgccaaactgtg

SEQ ID NO: 107663 - DNA, 25 bp, Homo sapien
tttgggactctcctaccggaagtga

SEQ ID NO: 107664 - DNA, 25 bp, Homo sapien
gttgccgtaagtgcgccgtcgtcac

SEQ ID NO: 107665 - DNA, 25 bp, Homo sapien
cttgttgaagaactcctgcgggtgc

SEQ ID NO: 107666 - DNA, 25 bp, Homo sapien
gtgcgctcctgcagcttgttgaaga

SEQ ID NO: 107667 - DNA, 25 bp, Homo sapien
ccgagatgtccacgttgatgtaggc

SEQ ID NO: 107668 - DNA, 25 bp, Homo sapien
gtggtccagtccttacgaggcttgc

SEQ ID NO: 107669 - DNA, 25 bp, Homo sapien
agaatttagtctcggtgcgcggccc

SEQ ID NO: 107670 - DNA, 25 bp, Homo sapien
atctggccggaaggagaatttagtc

SEQ ID NO: 107671 - DNA, 25 bp, Homo sapien
ctgctgcggttgaagtaccggatcc

SEQ ID NO: 107672 - DNA, 25 bp, Homo sapien
tccagttgtcgtagatgctcaggtc

SEQ ID NO: 107673 - DNA, 25 bp, Homo sapien
acactttaagaactccgcgtgtctc

SEQ ID NO: 107674 - DNA, 25 bp, Homo sapien
ccctgaatgttgtcgcgcagaactt

SEQ ID NO: 107675 - DNA, 25 bp, Homo sapien
tccacgccgtgccaggcgtcggatg

SEQ ID NO: 107676 - DNA, 25 bp, Homo sapien
ataaggcctgagatgcgcttaacgc

SEQ ID NO: 107677 - DNA, 25 bp, Homo sapien
tccgcgtgtctcctcgtatataagg

SEQ ID NO: 107678 - DNA, 25 bp, Homo sapien
tcgcggattacattctccaaaaaca

SEQ ID NO: 107679 - DNA, 25 bp, Homo sapien
gctccgtgtaggtaactgcatcgcg

SEQ ID NO: 107680 - DNA, 25 bp, Homo sapien
tcctcgtatataaggcctgagatgc

SEQ ID NO: 107681 - DNA, 25 bp, Homo sapien
tggggcttcttcacaccgccagtcg

SEQ ID NO: 107682 - DNA, 25 bp, Homo sapien
gccagtcgctggagcgcttttgcgc

SEQ ID NO: 107683 - DNA, 25 bp, Homo sapien
taacggcggatctcacgcaaggcca

SEQ ID NO: 107684 - DNA, 25 bp, Homo sapien
gcagtttgcggatgagcagctcagt

SEQ ID NO: 107685 - DNA, 25 bp, Homo sapien
accaggcgctgaaatggcagtttgc

SEQ ID NO: 107686 - DNA, 25 bp, Homo sapien
tttgcgcgctgccttggtggccagc

SEQ ID NO: 107687 - DNA, 25 bp, Homo sapien
acacgcttggcgtgaatagcacaga

SEQ ID NO: 107688 - DNA, 25 bp, Homo sapien
tcgccacggatacgacgcgcaagct

SEQ ID NO: 107689 - DNA, 25 bp, Homo sapien
cctacaggaaattggagcccagctc

SEQ ID NO: 107690 - DNA, 25 bp, Homo sapien
cggtgcactcgtcctacaggaaatt

SEQ ID NO: 107691 - DNA, 25 bp, Homo sapien
gtgcactcgtcctacaggaaattgg

SEQ ID NO: 107692 - DNA, 25 bp, Homo sapien
ctctagaggagcgggttttggcctt

SEQ ID NO: 107693 - DNA, 25 bp, Homo sapien
tcgtcctacaggaaattggagccca

SEQ ID NO: 107694 - DNA, 25 bp, Homo sapien
tacaggaaattggagcccagctcta

SEQ ID NO: 107695 - DNA, 25 bp, Homo sapien
acaggaaattggagcccagctctag

SEQ ID NO: 107696 - DNA, 25 bp, Homo sapien
cactcgtcctacaggaaattggagc

SEQ ID NO: 107697 - DNA, 25 bp, Homo sapien
agagcctgtgcattttgcttgtagt

SEQ ID NO: 107698 - DNA, 25 bp, Homo sapien
gcttgtagtcttttgggtggactcc

SEQ ID NO: 107699 - DNA, 25 bp, Homo sapien
cgcttccagagaaagagcctgtgca

SEQ ID NO: 107700 - DNA, 25 bp, Homo sapien
tcagagccactcacgcttccagaga

SEQ ID NO: 107701 - DNA, 25 bp, Homo sapien
ctgccagcaatccaaaggctctttt

SEQ ID NO: 107702 - DNA, 25 bp, Homo sapien
tgagctctcgcagctgccagcaatc

SEQ ID NO: 107703 - DNA, 25 bp, Homo sapien
gctccaagtgagctctcgcagctgc

SEQ ID NO: 107704 - DNA, 25 bp, Homo sapien
actccggccggcctccattaggagg

SEQ ID NO: 107705 - DNA, 25 bp, Homo sapien
tcggtctatgcggaccacccttttc

SEQ ID NO: 107706 - DNA, 25 bp, Homo sapien
ctggttcacagatgccgacctggtc

SEQ ID NO: 107707 - DNA, 25 bp, Homo sapien
ccagcccaggtagtaagactggcag

SEQ ID NO: 107708 - DNA, 25 bp, Homo sapien
tccgagacactgcacggggcagact

SEQ ID NO: 107709 - DNA, 25 bp, Homo sapien
ggcaccgcggggttgccctagccaa

SEQ ID NO: 107710 - DNA, 25 bp, Homo sapien
cccagacgttgcgaagtccgactct

SEQ ID NO: 107711 - DNA, 25 bp, Homo sapien
aaggggttcgcagacgcacttccgc

SEQ ID NO: 107712 - DNA, 25 bp, Homo sapien
gcgaagtccgactctggttcacaga

SEQ ID NO: 107713 - DNA, 25 bp, Homo sapien
tagcaaccggaagtggctagaggtc

SEQ ID NO: 107714 - DNA, 25 bp, Homo sapien
ggacggtcgagcctatccaccggca

SEQ ID NO: 107715 - DNA, 25 bp, Homo sapien
tcgcgagagaactgaaaaaggggac

SEQ ID NO: 107716 - DNA, 25 bp, Homo sapien
gctagaggtcgcgagagaactgaaa

SEQ ID NO: 107717 - DNA, 25 bp, Homo sapien
cgagcctatccaccggcagagaaca

SEQ ID NO: 107718 - DNA, 25 bp, Homo sapien
cactcaccggccagaccttttcttc

SEQ ID NO: 107719 - DNA, 25 bp, Homo sapien
tcttccgtccgttttctgcctctgg

SEQ ID NO: 107720 - DNA, 25 bp, Homo sapien
ggcccagctcacgtagcgttttcgg

SEQ ID NO: 107721 - DNA, 25 bp, Homo sapien
tgcgcacgaacgcttctgcgagctt

SEQ ID NO: 107722 - DNA, 25 bp, Homo sapien
taacagagcttacggtgagcaccgg

SEQ ID NO: 107723 - DNA, 25 bp, Homo sapien
tccctgtgtcttttatgggaacacg

SEQ ID NO: 107724 - DNA, 25 bp, Homo sapien
gaggaacggcgctttataaatcaaa

SEQ ID NO: 107725 - DNA, 25 bp, Homo sapien
ggaaggtttggatggctaacgccca

SEQ ID NO: 107726 - DNA, 25 bp, Homo sapien
acgcccagggttggtcttccctgtg

SEQ ID NO: 107727 - DNA, 25 bp, Homo sapien
gcgtcgccagcgaatgacaacactg

SEQ ID NO: 107728 - DNA, 25 bp, Homo sapien
ctgcgagctttctcggaagcagctg

SEQ ID NO: 107729 - DNA, 25 bp, Homo sapien
actgtatttgctggtgccctgctca

SEQ ID NO: 107730 - DNA, 25 bp, Homo sapien
tctcgcggtcgcagactgtatttgc

SEQ ID NO: 107731 - DNA, 25 bp, Homo sapien
tcgcagactgtatttgctggtgccc

SEQ ID NO: 107732 - DNA, 25 bp, Homo sapien
ttccctttacgtctcgcggtcgcag

SEQ ID NO: 107733 - DNA, 25 bp, Homo sapien
gtatttgctggtgccctgctcactg

SEQ ID NO: 107734 - DNA, 25 bp, Homo sapien
tggtgccctgctcactgtgatctcg

SEQ ID NO: 107735 - DNA, 25 bp, Homo sapien
tcactgtgatctcgcaggaccttgc

SEQ ID NO: 107736 - DNA, 25 bp, Homo sapien
caggaccttgcggacttacggagac

SEQ ID NO: 107737 - DNA, 25 bp, Homo sapien
ctcctagagagcttccggaagtgcc

SEQ ID NO: 107738 - DNA, 25 bp, Homo sapien
tgtgcctccgcagatttagaagtta

SEQ ID NO: 107739 - DNA, 25 bp, Homo sapien
ccaggggaccgttactattgacagc

SEQ ID NO: 107740 - DNA, 25 bp, Homo sapien
gcctggtccgagtacagctttcatc

SEQ ID NO: 107741 - DNA, 25 bp, Homo sapien
agcttgtagacctccaggactccta

SEQ ID NO: 107742 - DNA, 25 bp, Homo sapien
ccttcgagtctgtttatccgttgca

SEQ ID NO: 107743 - DNA, 25 bp, Homo sapien
ctcacagtgagtacggtcgggctct

SEQ ID NO: 107744 - DNA, 25 bp, Homo sapien
cagtcggccgaccatagagcttgta

SEQ ID NO: 107745 - DNA, 25 bp, Homo sapien
tcattcgaaagccaccggagatatc

SEQ ID NO: 107746 - DNA, 25 bp, Homo sapien
cggctcggagtagcgtcattcgaaa

SEQ ID NO: 107747 - DNA, 25 bp, Homo sapien
ggcagcgcgtagaactgattgtaaa

SEQ ID NO: 107748 - DNA, 25 bp, Homo sapien
cgactccctcgtggctgcaaacagg

SEQ ID NO: 107749 - DNA, 25 bp, Homo sapien
taattctctaggagacggtggtccg

SEQ ID NO: 107750 - DNA, 25 bp, Homo sapien
cgagaatggcgttaactatgtcacc

SEQ ID NO: 107751 - DNA, 25 bp, Homo sapien
gcgtgcagggacatgtaattctcta

SEQ ID NO: 107752 - DNA, 25 bp, Homo sapien
cctggctttattctccgtgcgtgca

SEQ ID NO: 107753 - DNA, 25 bp, Homo sapien
cgtcttcacctctagcggcagcgga

SEQ ID NO: 107754 - DNA, 25 bp, Homo sapien
gcgttcgcctcccagacataactta

SEQ ID NO: 107755 - DNA, 25 bp, Homo sapien
gaagaggccatctttcaccggactg

SEQ ID NO: 107756 - DNA, 25 bp, Homo sapien
aggccatctttcaccggactgcgtc

SEQ ID NO: 107757 - DNA, 25 bp, Homo sapien
tcccagacataacttaggctccgtc

SEQ ID NO: 107758 - DNA, 25 bp, Homo sapien
aacttaggctccgtctcgagctcct

SEQ ID NO: 107759 - DNA, 25 bp, Homo sapien
cgggaaggccactcgctgcaaaaaa

SEQ ID NO: 107760 - DNA, 25 bp, Homo sapien
ctcgctgcaaaaaacgttcgaatta

SEQ ID NO: 107761 - DNA, 25 bp, Homo sapien
cctgcgtctctcgagctgctggctt

SEQ ID NO: 107762 - DNA, 25 bp, Homo sapien
tgtgaccgcgggacggtcctgtcct

SEQ ID NO: 107763 - DNA, 25 bp, Homo sapien
aagcaggcagctatggtcatgactc

SEQ ID NO: 107764 - DNA, 25 bp, Homo sapien
tctctccgccgacgacccgcacctt

SEQ ID NO: 107765 - DNA, 25 bp, Homo sapien
gcagctatggtcatgactcccaaaa

SEQ ID NO: 107766 - DNA, 25 bp, Homo sapien
ggtcatgactcccaaaaataattcc

SEQ ID NO: 107767 - DNA, 25 bp, Homo sapien
aataattccttcagcgcttaggagg

SEQ ID NO: 107768 - DNA, 25 bp, Homo sapien
tccttcagcgcttaggaggttgggc

SEQ ID NO: 107769 - DNA, 25 bp, Homo sapien
aggagaggtcggcatctttgttccc

SEQ ID NO: 107770 - DNA, 25 bp, Homo sapien
ccggacatcgagacatggaatccta

SEQ ID NO: 107771 - DNA, 25 bp, Homo sapien
ctccgtccgccttcgaggagaggtc

SEQ ID NO: 107772 - DNA, 25 bp, Homo sapien
cggccattgttcgtgccgcgcttct

SEQ ID NO: 107773 - DNA, 25 bp, Homo sapien
cgcttctagcaacgccgggccggta

SEQ ID NO: 107774 - DNA, 25 bp, Homo sapien
tgtggaaagtgaacctcagccgctg

SEQ ID NO: 107775 - DNA, 25 bp, Homo sapien
cgaagcaaggtgaacgccggacatc

SEQ ID NO: 107776 - DNA, 25 bp, Homo sapien
tctttgttccctgcccggccattgt

SEQ ID NO: 107777 - DNA, 25 bp, Homo sapien
tcttctgcagactgggcgtccaggg

SEQ ID NO: 107778 - DNA, 25 bp, Homo sapien
ggcgtccagggctgcgttttttctc

SEQ ID NO: 107779 - DNA, 25 bp, Homo sapien
ggagccggctcaacgcctcgcgggg

SEQ ID NO: 107780 - DNA, 25 bp, Homo sapien
cgcagcctccgggtagcggaagcct

SEQ ID NO: 107781 - DNA, 25 bp, Homo sapien
cagcctccgggtagcggaagcctcg

SEQ ID NO: 107782 - DNA, 25 bp, Homo sapien
agggtgctctcacctccgccgtcaa

SEQ ID NO: 107783 - DNA, 25 bp, Homo sapien
ccttctccaccttcacggtcaggag

SEQ ID NO: 107784 - DNA, 25 bp, Homo sapien
aggagccccgtctggtcttctgcag

SEQ ID NO: 107785 - DNA, 25 bp, Homo sapien
agtatcccggtccagctattccgag

SEQ ID NO: 107786 - DNA, 25 bp, Homo sapien
gtggatatcgctaccatcgtcactg

SEQ ID NO: 107787 - DNA, 25 bp, Homo sapien
tattccgaggacatcgtgggctctc

SEQ ID NO: 107788 - DNA, 25 bp, Homo sapien
ggcggctcccaagattccgcaacta

SEQ ID NO: 107789 - DNA, 25 bp, Homo sapien
taactgacaggaagcggaagccgtg

SEQ ID NO: 107790 - DNA, 25 bp, Homo sapien
cctggtcgacctcgtatagtggata

SEQ ID NO: 107791 - DNA, 25 bp, Homo sapien
agcacacgcgcggattcgttttccg

SEQ ID NO: 107792 - DNA, 25 bp, Homo sapien
tgggtctgtagcaaccgcccagcgt

SEQ ID NO: 107793 - DNA, 25 bp, Homo sapien
cccttgaccaggtgagcggaccctg

SEQ ID NO: 107794 - DNA, 25 bp, Homo sapien
ctgtttcagagcgtttgggtcctct

SEQ ID NO: 107795 - DNA, 25 bp, Homo sapien
cggcgatgagctaagacgctgtttc

SEQ ID NO: 107796 - DNA, 25 bp, Homo sapien
ctagagctgacactcggcgatgagc

SEQ ID NO: 107797 - DNA, 25 bp, Homo sapien
aagcgctccgaagagctagagctga

SEQ ID NO: 107798 - DNA, 25 bp, Homo sapien
tccagcgttcctagagcggagaaga

SEQ ID NO: 107799 - DNA, 25 bp, Homo sapien
atgcctaagcggcagcaccatcgag

SEQ ID NO: 107800 - DNA, 25 bp, Homo sapien
gcagagaatcttccctcgaccgagg

SEQ ID NO: 107801 - DNA, 25 bp, Homo sapien
gcgttcctgaacttttggtccatta

SEQ ID NO: 107802 - DNA, 25 bp, Homo sapien
cgtgctcctagagaggcagggaacc

SEQ ID NO: 107803 - DNA, 25 bp, Homo sapien
tagacacgccggtattcagtgcctg

SEQ ID NO: 107804 - DNA, 25 bp, Homo sapien
acgtctttgttgtgcgcgttcctga

SEQ ID NO: 107805 - DNA, 25 bp, Homo sapien
ggagaagcttttgtacccgcccagc

SEQ ID NO: 107806 - DNA, 25 bp, Homo sapien
tcccggctcaccagagagacgagcg

SEQ ID NO: 107807 - DNA, 25 bp, Homo sapien
gtgcttgcaccgtccgaatgggcct

SEQ ID NO: 107808 - DNA, 25 bp, Homo sapien
agcctttcacgaggtcagctacgtc

SEQ ID NO: 107809 - DNA, 25 bp, Homo sapien
cggagcgcacgaatctgaaaccacc

SEQ ID NO: 107810 - DNA, 25 bp, Homo sapien
ggccttccagctgcagaacgtcgga

SEQ ID NO: 107811 - DNA, 25 bp, Homo sapien
agcgcaagttccagctgagcagtca

SEQ ID NO: 107812 - DNA, 25 bp, Homo sapien
gctttctcctctctgtggttgcccg

SEQ ID NO: 107813 - DNA, 25 bp, Homo sapien
ctctaggattctggaggctttctcc

SEQ ID NO: 107814 - DNA, 25 bp, Homo sapien
gccgtcaacggctgtctcagcattc

SEQ ID NO: 107815 - DNA, 25 bp, Homo sapien
cgcctccaaaggtccgtcacaaagg

SEQ ID NO: 107816 - DNA, 25 bp, Homo sapien
gtactttcacgtgccgctgccgtca

SEQ ID NO: 107817 - DNA, 25 bp, Homo sapien
ttcttagactcgaaggcatcgtaca

SEQ ID NO: 107818 - DNA, 25 bp, Homo sapien
tcccgctacagcaggacggagctac

SEQ ID NO: 107819 - DNA, 25 bp, Homo sapien
acggtcacggtcatgagtgcccttg

SEQ ID NO: 107820 - DNA, 25 bp, Homo sapien
ggggatacgtactactccatgacca

SEQ ID NO: 107821 - DNA, 25 bp, Homo sapien
ccagctggttcatgacgctgatctc

SEQ ID NO: 107822 - DNA, 25 bp, Homo sapien
ccaggacaatgtcgttcttagactc

SEQ ID NO: 107823 - DNA, 25 bp, Homo sapien
gacggagctactgaggcacggtcac

SEQ ID NO: 107824 - DNA, 25 bp, Homo sapien
atcgtacagctggatgaggttcgcg

SEQ ID NO: 107825 - DNA, 25 bp, Homo sapien
ggccagaagagaactccctcctacg

SEQ ID NO: 107826 - DNA, 25 bp, Homo sapien
tcgcagcgtacagagcacaacatcg

SEQ ID NO: 107827 - DNA, 25 bp, Homo sapien
ccactgtccagaaatgtcggtaagc

SEQ ID NO: 107828 - DNA, 25 bp, Homo sapien
tcggtaagcgctgaacccaaggata

SEQ ID NO: 107829 - DNA, 25 bp, Homo sapien
caactcggtagtgtttccgcgcgtc

SEQ ID NO: 107830 - DNA, 25 bp, Homo sapien
cgcggaaggtatgggccttacagcc

SEQ ID NO: 107831 - DNA, 25 bp, Homo sapien
gactgggagccaaaccctcatccta

SEQ ID NO: 107832 - DNA, 25 bp, Homo sapien
gcccagcagctggaatacagcaatc

SEQ ID NO: 107833 - DNA, 25 bp, Homo sapien
ggcccggtagtatgcgaagacacgc

SEQ ID NO: 107834 - DNA, 25 bp, Homo sapien
cgcccagaacgctttcgtggggttg

SEQ ID NO: 107835 - DNA, 25 bp, Homo sapien
aattcaggtgcgtctgcggggccca

SEQ ID NO: 107836 - DNA, 25 bp, Homo sapien
gcgtccaggagcaggccctacgtag

SEQ ID NO: 107837 - DNA, 25 bp, Homo sapien
aaccgatttcggctccgcgtccagg

SEQ ID NO: 107838 - DNA, 25 bp, Homo sapien
gcccgcaggctttgaaccgatttcg

SEQ ID NO: 107839 - DNA, 25 bp, Homo sapien
gttctcattctttcggggacctgca

SEQ ID NO: 107840 - DNA, 25 bp, Homo sapien
acacgcataacgcaaaaggattccc

SEQ ID NO: 107841 - DNA, 25 bp, Homo sapien
ttacctagacaaggtgtgtgcgcac

SEQ ID NO: 107842 - DNA, 25 bp, Homo sapien
acctagacaaggtgtgtgcgcacgg

SEQ ID NO: 107843 - DNA, 25 bp, Homo sapien
gcgcacgggatgctgaagctttact

SEQ ID NO: 107844 - DNA, 25 bp, Homo sapien
cgcacgggatgctgaagctttacta

SEQ ID NO: 107845 - DNA, 25 bp, Homo sapien
cacgggatgctgaagctttactacg

SEQ ID NO: 107846 - DNA, 25 bp, Homo sapien
cgggatgctgaagctttactacggc

SEQ ID NO: 107847 - DNA, 25 bp, Homo sapien
gtttacctagacaaggtgtgtgcgc

SEQ ID NO: 107848 - DNA, 25 bp, Homo sapien
gggatgctgaagctttactacggcc

SEQ ID NO: 107849 - DNA, 25 bp, Homo sapien
acacccgcagctgtgcccgtaggtt

SEQ ID NO: 107850 - DNA, 25 bp, Homo sapien
ctgtggaacccagactagtgggtcg

SEQ ID NO: 107851 - DNA, 25 bp, Homo sapien
cagctgtgcccgtaggttccggccg

SEQ ID NO: 107852 - DNA, 25 bp, Homo sapien
gttccgcagacacacccgcagctgt

SEQ ID NO: 107853 - DNA, 25 bp, Homo sapien
ctacagctcaggtggaggttccgca

SEQ ID NO: 107854 - DNA, 25 bp, Homo sapien
gtcgagggaaacactctacagctca

SEQ ID NO: 107855 - DNA, 25 bp, Homo sapien
ccagactagtgggtcgagggaaaca

SEQ ID NO: 107856 - DNA, 25 bp, Homo sapien
gaggcccgattgtcgccgcgcacat

SEQ ID NO: 107857 - DNA, 25 bp, Homo sapien
ctggccgttaaagccgttatccact

SEQ ID NO: 107858 - DNA, 25 bp, Homo sapien
ccctagtggcctctgcgcggttctt

SEQ ID NO: 107859 - DNA, 25 bp, Homo sapien
ccactgttatcaggaccaggtagtc

SEQ ID NO: 107860 - DNA, 25 bp, Homo sapien
cgctgcttcaagtcggggcccgacg

SEQ ID NO: 107861 - DNA, 25 bp, Homo sapien
ctgcgctgaccttctggccgttaaa

SEQ ID NO: 107862 - DNA, 25 bp, Homo sapien
ttctactcgtcctcatccgggactg

SEQ ID NO: 107863 - DNA, 25 bp, Homo sapien
ccatggccgttaccgttctactcgt

SEQ ID NO: 107864 - DNA, 25 bp, Homo sapien
accaggtagtctcgcccaactggga

SEQ ID NO: 107865 - DNA, 25 bp, Homo sapien
tcagctcggccttggacatatgtcc

SEQ ID NO: 107866 - DNA, 25 bp, Homo sapien
agatcgcagtttcagcggactaaca

SEQ ID NO: 107867 - DNA, 25 bp, Homo sapien
aagcctcgtctctgccttcttagga

SEQ ID NO: 107868 - DNA, 25 bp, Homo sapien
tcttaggattcagcttggggtggtc

SEQ ID NO: 107869 - DNA, 25 bp, Homo sapien
tggtccattgacttctccagggagc

SEQ ID NO: 107870 - DNA, 25 bp, Homo sapien
cctgcctgtcatcccggttttcttt

SEQ ID NO: 107871 - DNA, 25 bp, Homo sapien
accaccaccgttaagcaatgacatg

SEQ ID NO: 107872 - DNA, 25 bp, Homo sapien
ttccggaaccgtttatcagctcggc

SEQ ID NO: 107873 - DNA, 25 bp, Homo sapien
tccacgataggtgagagggctcatt

SEQ ID NO: 107874 - DNA, 25 bp, Homo sapien
cgaccacaagagctcgaggagggaa

SEQ ID NO: 107875 - DNA, 25 bp, Homo sapien
ccacaagagctcgaggagggaagca

SEQ ID NO: 107876 - DNA, 25 bp, Homo sapien
aggagcgaagtggacgagcacccga

SEQ ID NO: 107877 - DNA, 25 bp, Homo sapien
tgtccacgataggtgagagggctca

SEQ ID NO: 107878 - DNA, 25 bp, Homo sapien
ccacgataggtgagagggctcattc

SEQ ID NO: 107879 - DNA, 25 bp, Homo sapien
cacgataggtgagagggctcattcc

SEQ ID NO: 107880 - DNA, 25 bp, Homo sapien
gcccatctctgctgcgtttcctcgg

SEQ ID NO: 107881 - DNA, 25 bp, Homo sapien
catggatttcgtcttggggacgcta

SEQ ID NO: 107882 - DNA, 25 bp, Homo sapien
ccatggtcgcgaaacccagcatgga

SEQ ID NO: 107883 - DNA, 25 bp, Homo sapien
ctgggccagcaccatggtcgcgaaa

SEQ ID NO: 107884 - DNA, 25 bp, Homo sapien
ctgtccgcgataagcgagagggctc

SEQ ID NO: 107885 - DNA, 25 bp, Homo sapien
tttcgtcttggggacgctatggctc

SEQ ID NO: 107886 - DNA, 25 bp, Homo sapien
gctgcttttcctcgctgtccgcgat

SEQ ID NO: 107887 - DNA, 25 bp, Homo sapien
cggaagcccatctccgctgcttttc

SEQ ID NO: 107888 - DNA, 25 bp, Homo sapien
ggacgctatggctccagttctgaca

SEQ ID NO: 107889 - DNA, 25 bp, Homo sapien
acgggttcgtgtcggtgcagccact

SEQ ID NO: 107890 - DNA, 25 bp, Homo sapien
aacgattcatcaagccctccgtgtg

SEQ ID NO: 107891 - DNA, 25 bp, Homo sapien
cgagggcggtatacactcaacacgc

SEQ ID NO: 107892 - DNA, 25 bp, Homo sapien
cagaaaacgatacgagggcggtata

SEQ ID NO: 107893 - DNA, 25 bp, Homo sapien
tccggtcccgattggcagaaaacga

SEQ ID NO: 107894 - DNA, 25 bp, Homo sapien
cgaggaagaggagcacccgccagat

SEQ ID NO: 107895 - DNA, 25 bp, Homo sapien
agccactgctttggacccgagcctc

SEQ ID NO: 107896 - DNA, 25 bp, Homo sapien
tcaacacgcgcatgaacgattcatc

SEQ ID NO: 107897 - DNA, 25 bp, Homo sapien
cacgctacgtttcgcgggctctgag

SEQ ID NO: 107898 - DNA, 25 bp, Homo sapien
cgctcgacaaccacctatcggggtt

SEQ ID NO: 107899 - DNA, 25 bp, Homo sapien
caggacgcacctgcatttatggcgc

SEQ ID NO: 107900 - DNA, 25 bp, Homo sapien
tggagaacctggcacgctacgtttc

SEQ ID NO: 107901 - DNA, 25 bp, Homo sapien
attgcagatcggcttgtcccggtcg

SEQ ID NO: 107902 - DNA, 25 bp, Homo sapien
caggaaaccgcgagcataacgcaga

SEQ ID NO: 107903 - DNA, 25 bp, Homo sapien
gtttataagggagccgtcctgcctg

SEQ ID NO: 107904 - DNA, 25 bp, Homo sapien
ccgagatgcgcactgggaagagaaa

SEQ ID NO: 107905 - DNA, 25 bp, Homo sapien
ttggcccaaatctcgcggcttcgta

SEQ ID NO: 107906 - DNA, 25 bp, Homo sapien
tatctgcgttccgaatcccgcgaca

SEQ ID NO: 107907 - DNA, 25 bp, Homo sapien
atcccgcgacatcaggattatctcg

SEQ ID NO: 107908 - DNA, 25 bp, Homo sapien
ggattatctcgcactgcagcacaga

SEQ ID NO: 107909 - DNA, 25 bp, Homo sapien
cgctagtaacctctgcctttaatta

SEQ ID NO: 107910 - DNA, 25 bp, Homo sapien
cgaggcaggaagctatctgcgttcc

SEQ ID NO: 107911 - DNA, 25 bp, Homo sapien
gcggcttcgtaaaaatatcgcgatg

SEQ ID NO: 107912 - DNA, 25 bp, Homo sapien
gcagcacagagaccaatcgctagta

SEQ ID NO: 107913 - DNA, 25 bp, Homo sapien
cggccacggactacacttacttaca

SEQ ID NO: 107914 - DNA, 25 bp, Homo sapien
aagtgccgcgcgaggtattctcggc

SEQ ID NO: 107915 - DNA, 25 bp, Homo sapien
tgattggggcaaacggccacggact

SEQ ID NO: 107916 - DNA, 25 bp, Homo sapien
acacttacttacatgccgcgcgagg

SEQ ID NO: 107917 - DNA, 25 bp, Homo sapien
acgtgaggcatgagcggcgccctcc

SEQ ID NO: 107918 - DNA, 25 bp, Homo sapien
ctagcggagggcatcgaaggcctcc

SEQ ID NO: 107919 - DNA, 25 bp, Homo sapien
agagccgcgagagctacgacgcgcc

SEQ ID NO: 107920 - DNA, 25 bp, Homo sapien
ccgtgtgccagcagatgatgcccgc

SEQ ID NO: 107921 - DNA, 25 bp, Homo sapien
ggtcgcgctgaagctctatcctagg

SEQ ID NO: 107922 - DNA, 25 bp, Homo sapien
ctatcctagggcactggtcgcaaga

SEQ ID NO: 107923 - DNA, 25 bp, Homo sapien
cgcttccagcgagtgacaaggtttc

SEQ ID NO: 107924 - DNA, 25 bp, Homo sapien
catcatgggctctgcgaagtactgc

SEQ ID NO: 107925 - DNA, 25 bp, Homo sapien
cgcaacagatgttatggccgcagtc

SEQ ID NO: 107926 - DNA, 25 bp, Homo sapien
cctcgcagtacagcttcaggggctc

SEQ ID NO: 107927 - DNA, 25 bp, Homo sapien
tcgcaagagcagatggtgccacacg

SEQ ID NO: 107928 - DNA, 25 bp, Homo sapien
actctcctttggactggtcgcgctg

SEQ ID NO: 107929 - DNA, 25 bp, Homo sapien
agccgctattttgcgctggtggagc

SEQ ID NO: 107930 - DNA, 25 bp, Homo sapien
agttcctctttgagctgccctcgcg

SEQ ID NO: 107931 - DNA, 25 bp, Homo sapien
ctcgcgcctcaccaagtgcgtggaa

SEQ ID NO: 107932 - DNA, 25 bp, Homo sapien
cgtgctgcagcagtaccaacacctg

SEQ ID NO: 107933 - DNA, 25 bp, Homo sapien
atccaggacgactgccaggtcatca

SEQ ID NO: 107934 - DNA, 25 bp, Homo sapien
ccggctcccgacgtgttagagttca

SEQ ID NO: 107935 - DNA, 25 bp, Homo sapien
ttagagttcaccgaccatggaggca

SEQ ID NO: 107936 - DNA, 25 bp, Homo sapien
tgctgcggaagctgcagttcctctt

SEQ ID NO: 107937 - DNA, 25 bp, Homo sapien
ttgaaactcgctcagcggcgtcggg

SEQ ID NO: 107938 - DNA, 25 bp, Homo sapien
tggccgcttcctcttacatcggtga

SEQ ID NO: 107939 - DNA, 25 bp, Homo sapien
cccatcagtgcgaaagcaacgtgtt

SEQ ID NO: 107940 - DNA, 25 bp, Homo sapien
gcgctgtcgcctgcactaagagaaa

SEQ ID NO: 107941 - DNA, 25 bp, Homo sapien
tcggccaaaaccacttgaaactcgc

SEQ ID NO: 107942 - DNA, 25 bp, Homo sapien
caaggactgcgctctttcgcacggc

SEQ ID NO: 107943 - DNA, 25 bp, Homo sapien
tcaaactgaaccgtcttgtgccttt

SEQ ID NO: 107944 - DNA, 25 bp, Homo sapien
taggatccgccggtttccttcctca

SEQ ID NO: 107945 - DNA, 25 bp, Homo sapien
ttccttcgacctcgcctggggagaa

SEQ ID NO: 107946 - DNA, 25 bp, Homo sapien
tttcctagccgcgaatggggtcgtg

SEQ ID NO: 107947 - DNA, 25 bp, Homo sapien
gtttcttgtttcctagccgcgaatg

SEQ ID NO: 107948 - DNA, 25 bp, Homo sapien
ctgcggaatggaaaagcgttcggtt

SEQ ID NO: 107949 - DNA, 25 bp, Homo sapien
gttaccatggagactgcggaatgga

SEQ ID NO: 107950 - DNA, 25 bp, Homo sapien
agcgaagcacgcgttaccatggaga

SEQ ID NO: 107951 - DNA, 25 bp, Homo sapien
cgcgggtgctagaaaagcgaagcac

SEQ ID NO: 107952 - DNA, 25 bp, Homo sapien
tcgggctatacttgggccacacagc

SEQ ID NO: 107953 - DNA, 25 bp, Homo sapien
tcctggccaaacgtgggttattctc

SEQ ID NO: 107954 - DNA, 25 bp, Homo sapien
gtgcaggcccggagcgccgtcttct

SEQ ID NO: 107955 - DNA, 25 bp, Homo sapien
aacgccaaggctctaagtggccctg

SEQ ID NO: 107956 - DNA, 25 bp, Homo sapien
agctaaaacgaacgccaaggctcta

SEQ ID NO: 107957 - DNA, 25 bp, Homo sapien
gaggaagacgtcttggtcgccgtta

SEQ ID NO: 107958 - DNA, 25 bp, Homo sapien
gctgggaggttccttacaagttaca

SEQ ID NO: 107959 - DNA, 25 bp, Homo sapien
ggcacacgccacttgcttgctggga

SEQ ID NO: 107960 - DNA, 25 bp, Homo sapien
tggtcgccgttaagagctaaaacga

SEQ ID NO: 107961 - DNA, 25 bp, Homo sapien
tgctaggatgcagcgcatttgagtg

SEQ ID NO: 107962 - DNA, 25 bp, Homo sapien
gtgtcccagacaacgacggatagcg

SEQ ID NO: 107963 - DNA, 25 bp, Homo sapien
ccctgccgagctgctaggatgcagc

SEQ ID NO: 107964 - DNA, 25 bp, Homo sapien
ctagtcctgacgacaggaacaacgg

SEQ ID NO: 107965 - DNA, 25 bp, Homo sapien
gggcagatcggaccgctctgtccca

SEQ ID NO: 107966 - DNA, 25 bp, Homo sapien
ccaggcctgaagaagccgcgaacct

SEQ ID NO: 107967 - DNA, 25 bp, Homo sapien
accgctctgtcccaactggtcgaga

SEQ ID NO: 107968 - DNA, 25 bp, Homo sapien
gtcccaactggtcgagaccgaccta

SEQ ID NO: 107969 - DNA, 25 bp, Homo sapien
gtcggtctcgaccagttgggacaga

SEQ ID NO: 107970 - DNA, 25 bp, Homo sapien
ctgcatcctagcagctcggcagggg

SEQ ID NO: 107971 - DNA, 25 bp, Homo sapien
agccactcaaatgcgctgcatccta

SEQ ID NO: 107972 - DNA, 25 bp, Homo sapien
ggacagagcggtccgatctgcccgc

SEQ ID NO: 107973 - DNA, 25 bp, Homo sapien
ccgttgttcctgtcgtcaggactag

SEQ ID NO: 107974 - DNA, 25 bp, Homo sapien
cgctatccgtcgttgtctgggacac

SEQ ID NO: 107975 - DNA, 25 bp, Homo sapien
aggttcgcggcttcttcaggcctgg

SEQ ID NO: 107976 - DNA, 25 bp, Homo sapien
agttggggcggtcaccatgcttccc

SEQ ID NO: 107977 - DNA, 25 bp, Homo sapien
gctggaccacttcatctgtgagctg

SEQ ID NO: 107978 - DNA, 25 bp, Homo sapien
ccgagctgtctgttgcatgcggttc

SEQ ID NO: 107979 - DNA, 25 bp, Homo sapien
gctaagcggcctcaccaactcggtt

SEQ ID NO: 107980 - DNA, 25 bp, Homo sapien
ctgttctacggctcggccatctaca

SEQ ID NO: 107981 - DNA, 25 bp, Homo sapien
ctacaaccaggcacggggcaagttc

SEQ ID NO: 107982 - DNA, 25 bp, Homo sapien
ggggcaagttcgtatcgctcttcta

SEQ ID NO: 107983 - DNA, 25 bp, Homo sapien
tcctctgccacctggccttggtaga

SEQ ID NO: 107984 - DNA, 25 bp, Homo sapien
ttcactactagcgtggtgccgccgc

SEQ ID NO: 107985 - DNA, 25 bp, Homo sapien
ggcaggatgtccctgcggctattca

SEQ ID NO: 107986 - DNA, 25 bp, Homo sapien
cgcctccatccctgattttgtgggg

SEQ ID NO: 107987 - DNA, 25 bp, Homo sapien
agctcaggggggacacttttcctgg

SEQ ID NO: 107988 - DNA, 25 bp, Homo sapien
tcacaaccagaagcggcagtggcca

SEQ ID NO: 107989 - DNA, 25 bp, Homo sapien
agtgggaggcccacaccggagccac

SEQ ID NO: 107990 - DNA, 25 bp, Homo sapien
atgtccctgcggctattcacgtcct

SEQ ID NO: 107991 - DNA, 25 bp, Homo sapien
ccgatgtacactgcgcgccgttctg

SEQ ID NO: 107992 - DNA, 25 bp, Homo sapien
cgccatcacaaccagaagcggcagt

SEQ ID NO: 107993 - DNA, 25 bp, Homo sapien
gactactcgacctcttgccggttgc

SEQ ID NO: 107994 - DNA, 25 bp, Homo sapien
gacctcttgccggttgcctcgcagg

SEQ ID NO: 107995 - DNA, 25 bp, Homo sapien
cctctccgagccctgctaacccggg

SEQ ID NO: 107996 - DNA, 25 bp, Homo sapien
cggagactactcgacctcttgccgg

SEQ ID NO: 107997 - DNA, 25 bp, Homo sapien
cctcccgggactccacctctcacca

SEQ ID NO: 107998 - DNA, 25 bp, Homo sapien
ttgccggttgcctcgcaggctccga

SEQ ID NO: 107999 - DNA, 25 bp, Homo sapien
gcggctcgcagaagcctggcttacc

SEQ ID NO: 108000 - DNA, 25 bp, Homo sapien
cctggcttacccacgctcccggcat

SEQ ID NO: 108001 - DNA, 25 bp, Homo sapien
tggcgaagtcgtgacgtcagctgtt

SEQ ID NO: 108002 - DNA, 25 bp, Homo sapien
gcaaccaattctcggtggcgaagtc

SEQ ID NO: 108003 - DNA, 25 bp, Homo sapien
cccaaaggctgctggcaaccaattc

SEQ ID NO: 108004 - DNA, 25 bp, Homo sapien
tgacctatttataatctgcgcctta

SEQ ID NO: 108005 - DNA, 25 bp, Homo sapien
gcaggcacctctctttgacctattt

SEQ ID NO: 108006 - DNA, 25 bp, Homo sapien
tgcccttaggaacggggtgtcactg

SEQ ID NO: 108007 - DNA, 25 bp, Homo sapien
ggcaagaaaagctctgcccttagga

SEQ ID NO: 108008 - DNA, 25 bp, Homo sapien
accaagtgcagtgggtctgaagcga

SEQ ID NO: 108009 - DNA, 25 bp, Homo sapien
agctcccgaggtcgcctaagtgcaa

SEQ ID NO: 108010 - DNA, 25 bp, Homo sapien
ggtcgcctaagtgcaagcagaagtg

SEQ ID NO: 108011 - DNA, 25 bp, Homo sapien
tgcaagcagaagtgagcgtggcttc

SEQ ID NO: 108012 - DNA, 25 bp, Homo sapien
cccttcccggtgactgcgtaggagt

SEQ ID NO: 108013 - DNA, 25 bp, Homo sapien
gagggccgctgctcttatagcaggc

SEQ ID NO: 108014 - DNA, 25 bp, Homo sapien
actgcgtaggagtccgagctcccga

SEQ ID NO: 108015 - DNA, 25 bp, Homo sapien
atcagaggtcgtctgtctccgtcgg

SEQ ID NO: 108016 - DNA, 25 bp, Homo sapien
ttatagcaggcggaagcgtcacccg

SEQ ID NO: 108017 - DNA, 25 bp, Homo sapien
agagcggtccttgtctgcgttccgt

SEQ ID NO: 108018 - DNA, 25 bp, Homo sapien
cggacagtgtttccttgactgacta

SEQ ID NO: 108019 - DNA, 25 bp, Homo sapien
gactgactattgtgagcgccctctc

SEQ ID NO: 108020 - DNA, 25 bp, Homo sapien
ctgcagaacggggatttatggtgtc

SEQ ID NO: 108021 - DNA, 25 bp, Homo sapien
cactctgggaatgccgagagggtcc

SEQ ID NO: 108022 - DNA, 25 bp, Homo sapien
aatgccgagagggtcccgcagagac

SEQ ID NO: 108023 - DNA, 25 bp, Homo sapien
tgcgttccgtgtccaggcaggtgca

SEQ ID NO: 108024 - DNA, 25 bp, Homo sapien
catctcctgggaaatggggcggaca

SEQ ID NO: 108025 - DNA, 25 bp, Homo sapien
cgggtatcaccagcacgcgtacgac

SEQ ID NO: 108026 - DNA, 25 bp, Homo sapien
gaccacagggtacgccaaggccaac

SEQ ID NO: 108027 - DNA, 25 bp, Homo sapien
tgaggaacctgctccgccgctacaa

SEQ ID NO: 108028 - DNA, 25 bp, Homo sapien
caccctccagggaatgaatggctgc

SEQ ID NO: 108029 - DNA, 25 bp, Homo sapien
tacatcgccgtggagtacgtagacg

SEQ ID NO: 108030 - DNA, 25 bp, Homo sapien
ccgcagtattgggagtggaccacag

SEQ ID NO: 108031 - DNA, 25 bp, Homo sapien
cccattgggcgtcgcgtttctagag

SEQ ID NO: 108032 - DNA, 25 bp, Homo sapien
gtacgtagacgacacgcaattcctg

SEQ ID NO: 108033 - DNA, 25 bp, Homo sapien
ctggctccgagcagctgagagtaca

SEQ ID NO: 108034 - DNA, 25 bp, Homo sapien
gtgcggatcaggaacagcaggacta

SEQ ID NO: 108035 - DNA, 25 bp, Homo sapien
tagcgtgcctcaccaagaccgtttc

SEQ ID NO: 108036 - DNA, 25 bp, Homo sapien
ggcgcccgcagcttagggccaatca

SEQ ID NO: 108037 - DNA, 25 bp, Homo sapien
cgaccgctcacccaatgaaaactgg

SEQ ID NO: 108038 - DNA, 25 bp, Homo sapien
gccgcgaaggcccaccagaaatttc

SEQ ID NO: 108039 - DNA, 25 bp, Homo sapien
tttcctcgcagtggctcaagcggct

SEQ ID NO: 108040 - DNA, 25 bp, Homo sapien
agcaggactaggctcatctccatgg

SEQ ID NO: 108041 - DNA, 25 bp, Homo sapien
cggttctgacggaaactggctcctc

SEQ ID NO: 108042 - DNA, 25 bp, Homo sapien
cggtcgcttacagaacccagggcgg

SEQ ID NO: 108043 - DNA, 25 bp, Homo sapien
ttctgacggaaactggctcctccgc

SEQ ID NO: 108044 - DNA, 25 bp, Homo sapien
gggcactcacagctgccgctatgaa

SEQ ID NO: 108045 - DNA, 25 bp, Homo sapien
gaggacggagttgccttcaggcttc

SEQ ID NO: 108046 - DNA, 25 bp, Homo sapien
gcgttttcaagcctgcggcccggag

SEQ ID NO: 108047 - DNA, 25 bp, Homo sapien
tcctaaatttacatcccgagtgtgg

SEQ ID NO: 108048 - DNA, 25 bp, Homo sapien
ggatcctaaatttacatcccgagtg

SEQ ID NO: 108049 - DNA, 25 bp, Homo sapien
ccgccaaggccaaagcacagtttta

SEQ ID NO: 108050 - DNA, 25 bp, Homo sapien
tgctccttgacagccgcagacacgg

SEQ ID NO: 108051 - DNA, 25 bp, Homo sapien
tccgattcttcccagtcgccgagga

SEQ ID NO: 108052 - DNA, 25 bp, Homo sapien
gcgggtatcaccagcttgcttacga

SEQ ID NO: 108053 - DNA, 25 bp, Homo sapien
acagcgacgccacgagtcccaggat

SEQ ID NO: 108054 - DNA, 25 bp, Homo sapien
ctagaggatgtctgtctgcgacgtg

SEQ ID NO: 108055 - DNA, 25 bp, Homo sapien
cagggtctcacacccatctagagga

SEQ ID NO: 108056 - DNA, 25 bp, Homo sapien
ccagagtgaggcctgtgagtgacac

SEQ ID NO: 108057 - DNA, 25 bp, Homo sapien
tgctctcttggaccgcagcggaaaa

SEQ ID NO: 108058 - DNA, 25 bp, Homo sapien
ggactcgtggagaccctcgacacaa

SEQ ID NO: 108059 - DNA, 25 bp, Homo sapien
cacctccagtggatacacagctgcg

SEQ ID NO: 108060 - DNA, 25 bp, Homo sapien
tggatacacagctgcgacctggacc

SEQ ID NO: 108061 - DNA, 25 bp, Homo sapien
tcttcgcgcggggatgaacataccc

SEQ ID NO: 108062 - DNA, 25 bp, Homo sapien
tcgcgcggggatgaacataccctac

SEQ ID NO: 108063 - DNA, 25 bp, Homo sapien
acataccctacgatggcgccagtta

SEQ ID NO: 108064 - DNA, 25 bp, Homo sapien
gatgaacataccctacgatggcgcc

SEQ ID NO: 108065 - DNA, 25 bp, Homo sapien
cggacactgcggctcagatctccaa

SEQ ID NO: 108066 - DNA, 25 bp, Homo sapien
ctccagtggatgattggctgcgacc

SEQ ID NO: 108067 - DNA, 25 bp, Homo sapien
ggttctcacaccctccagtggatga

SEQ ID NO: 108068 - DNA, 25 bp, Homo sapien
ccagagcgaggccagtgagtaactc

SEQ ID NO: 108069 - DNA, 25 bp, Homo sapien
ggcccacgcacagactgacagaatg

SEQ ID NO: 108070 - DNA, 25 bp, Homo sapien
ttcgacagcgactcggcgtgtccga

SEQ ID NO: 108071 - DNA, 25 bp, Homo sapien
tgacagaatgaacctgcagaccctg

SEQ ID NO: 108072 - DNA, 25 bp, Homo sapien
agaggagacacggaacaccaaggcc

SEQ ID NO: 108073 - DNA, 25 bp, Homo sapien
gattggctccgcttggacctttgcg

SEQ ID NO: 108074 - DNA, 25 bp, Homo sapien
cgccctctaccttgtggcgtcggtg

SEQ ID NO: 108075 - DNA, 25 bp, Homo sapien
gtcacgttgcccttccctgggcttg

SEQ ID NO: 108076 - DNA, 25 bp, Homo sapien
tccgcttggacctttgcggtgctcc

SEQ ID NO: 108077 - DNA, 25 bp, Homo sapien
ccctgctcatctcctatggctgttg

SEQ ID NO: 108078 - DNA, 25 bp, Homo sapien
atggctgttgccttttgggcagccc

SEQ ID NO: 108079 - DNA, 25 bp, Homo sapien
tccaggttgtccctccggtgccgga

SEQ ID NO: 108080 - DNA, 25 bp, Homo sapien
atgagttctccgacgcagcaggcac

SEQ ID NO: 108081 - DNA, 25 bp, Homo sapien
cgcactcccgggtacttggaggcca

SEQ ID NO: 108082 - DNA, 25 bp, Homo sapien
gcggcctggagagctcagcagctcc

SEQ ID NO: 108083 - DNA, 25 bp, Homo sapien
agactcctcaggtcatatctccaag

SEQ ID NO: 108084 - DNA, 25 bp, Homo sapien
agaagctcccaggtaagcggctcca

SEQ ID NO: 108085 - DNA, 25 bp, Homo sapien
ctagtgaggagaggatcaagatgaa

SEQ ID NO: 108086 - DNA, 25 bp, Homo sapien
caaggagctgtctgagccgctcagc

SEQ ID NO: 108087 - DNA, 25 bp, Homo sapien
ctccaggcctgtcttcactccagtg

SEQ ID NO: 108088 - DNA, 25 bp, Homo sapien
aggtcatatctccaagtacgccgcc

SEQ ID NO: 108089 - DNA, 25 bp, Homo sapien
agagaagccaatcggtgccgccgcg

SEQ ID NO: 108090 - DNA, 25 bp, Homo sapien
accatgcaggtgatgtatggctgcg

SEQ ID NO: 108091 - DNA, 25 bp, Homo sapien
acctgggcgcgtgagtgcagggtct

SEQ ID NO: 108092 - DNA, 25 bp, Homo sapien
gaagccaatcggtgccgccgcggtc

SEQ ID NO: 108093 - DNA, 25 bp, Homo sapien
ctccgtcggctacgtggacgatacg

SEQ ID NO: 108094 - DNA, 25 bp, Homo sapien
tgcggatcgcgctccgctactacaa

SEQ ID NO: 108095 - DNA, 25 bp, Homo sapien
catgcaggtgatgtatggctgcgac

SEQ ID NO: 108096 - DNA, 25 bp, Homo sapien
agaacctgcggatcgcgctccgcta

SEQ ID NO: 108097 - DNA, 25 bp, Homo sapien
tgggaccggagcacacggaacatca

SEQ ID NO: 108098 - DNA, 25 bp, Homo sapien
catagcccggaactaggacctgcgc

SEQ ID NO: 108099 - DNA, 25 bp, Homo sapien
gggtctaacaccctccagataatgt

SEQ ID NO: 108100 - DNA, 25 bp, Homo sapien
ggcccgcgcacagactgacaagagt

SEQ ID NO: 108101 - DNA, 25 bp, Homo sapien
cgactccgaggatgtagccgcagtc

SEQ ID NO: 108102 - DNA, 25 bp, Homo sapien
cgcgaacccattgggactcagattc

SEQ ID NO: 108103 - DNA, 25 bp, Homo sapien
gctggggtccctgttccagaagtcc

SEQ ID NO: 108104 - DNA, 25 bp, Homo sapien
tgacaagagtgaacctgcccatgcc

SEQ ID NO: 108105 - DNA, 25 bp, Homo sapien
catggcaactggcaccgcgatctac

SEQ ID NO: 108106 - DNA, 25 bp, Homo sapien
cacagaagtcagagagcagcgcgtc

SEQ ID NO: 108107 - DNA, 25 bp, Homo sapien
cccagcacctggtcacggtagaagt

SEQ ID NO: 108108 - DNA, 25 bp, Homo sapien
gtagaagttttctgcgcaggtgcca

SEQ ID NO: 108109 - DNA, 25 bp, Homo sapien
cagccgctcgaaggcagctttttcg

SEQ ID NO: 108110 - DNA, 25 bp, Homo sapien
cggggcattatccagctcctccaga

SEQ ID NO: 108111 - DNA, 25 bp, Homo sapien
gcgcgctgtgttttcgcaaagcttc

SEQ ID NO: 108112 - DNA, 25 bp, Homo sapien
cggcggaggcatctttcacagaatc

SEQ ID NO: 108113 - DNA, 25 bp, Homo sapien
gagacgagaaccaccacgcaccgag

SEQ ID NO: 108114 - DNA, 25 bp, Homo sapien
gtccacactcggagacgagaaccac

SEQ ID NO: 108115 - DNA, 25 bp, Homo sapien
cgtccacactcggagacgagaacca

SEQ ID NO: 108116 - DNA, 25 bp, Homo sapien
accgtccacactcggagacgagaac

SEQ ID NO: 108117 - DNA, 25 bp, Homo sapien
tcgccgtccacactcggagacgaaa

SEQ ID NO: 108118 - DNA, 25 bp, Homo sapien
caccgtccacactcggagacgagaa

SEQ ID NO: 108119 - DNA, 25 bp, Homo sapien
tcaccgtccacactcggagacgaga

SEQ ID NO: 108120 - DNA, 25 bp, Homo sapien
actcggagacgagaaccaccacgca

SEQ ID NO: 108121 - DNA, 25 bp, Homo sapien
cgctaatccggctaggaggcttcgg

SEQ ID NO: 108122 - DNA, 25 bp, Homo sapien
gcgctaatccggctaggaggcttcg

SEQ ID NO: 108123 - DNA, 25 bp, Homo sapien
ctaatccggctaggaggcttcgggc

SEQ ID NO: 108124 - DNA, 25 bp, Homo sapien
aggcttcgggcgaggcaggctggag

SEQ ID NO: 108125 - DNA, 25 bp, Homo sapien
ctccagcctcccttcggcgcaggac

SEQ ID NO: 108126 - DNA, 25 bp, Homo sapien
ccagcctcccttcggcgcaggaccc

SEQ ID NO: 108127 - DNA, 25 bp, Homo sapien
cgggccggtgcgctaatccggctag

SEQ ID NO: 108128 - DNA, 25 bp, Homo sapien
cccaccgccaagccgctcgcccttc

SEQ ID NO: 108129 - DNA, 25 bp, Homo sapien
gcccatgaggcggagcagttgagag

SEQ ID NO: 108130 - DNA, 25 bp, Homo sapien
ggcaggtctcagccactgctcgccc

SEQ ID NO: 108131 - DNA, 25 bp, Homo sapien
agacacggaatgtgaaggcccagtc

SEQ ID NO: 108132 - DNA, 25 bp, Homo sapien
cacggaatgtgaaggcccagtcaca

SEQ ID NO: 108133 - DNA, 25 bp, Homo sapien
tgtgaaggcccagtcacagactgac

SEQ ID NO: 108134 - DNA, 25 bp, Homo sapien
acggacgggccaggtcgcccacagt

SEQ ID NO: 108135 - DNA, 25 bp, Homo sapien
gtaccggcaggacgcctacgacggc

SEQ ID NO: 108136 - DNA, 25 bp, Homo sapien
ccaggagacacggaatgtgaaggcc

SEQ ID NO: 108137 - DNA, 25 bp, Homo sapien
ggtctcacacccttcaatgggtaca

SEQ ID NO: 108138 - DNA, 25 bp, Homo sapien
cggagatcctccacccaataaaagc

SEQ ID NO: 108139 - DNA, 25 bp, Homo sapien
accgcagtcgctgggaatgggtctc

SEQ ID NO: 108140 - DNA, 25 bp, Homo sapien
ttcaatgggtacacagctgcgacgt

SEQ ID NO: 108141 - DNA, 25 bp, Homo sapien
ctgcgacgtggactcggactgcagt

SEQ ID NO: 108142 - DNA, 25 bp, Homo sapien
cggactgcagtctcctcagtgggta

SEQ ID NO: 108143 - DNA, 25 bp, Homo sapien
ctcctcagtgggtatgaacataccc

SEQ ID NO: 108144 - DNA, 25 bp, Homo sapien
acataccctatcacggcgccagtta

SEQ ID NO: 108145 - DNA, 25 bp, Homo sapien
cagaatgcggagacacggctgcctc

SEQ ID NO: 108146 - DNA, 25 bp, Homo sapien
ggcgctgccgctcacagaatgcgga

SEQ ID NO: 108147 - DNA, 25 bp, Homo sapien
tgaaatgacacaagatcagcgaggc

SEQ ID NO: 108148 - DNA, 25 bp, Homo sapien
actagagcgaaggtcactgaaatga

SEQ ID NO: 108149 - DNA, 25 bp, Homo sapien
cccgtcaaagactagagcgaaggtc

SEQ ID NO: 108150 - DNA, 25 bp, Homo sapien
gcccgagcgcgttctcaggactgcg

SEQ ID NO: 108151 - DNA, 25 bp, Homo sapien
agaaagagaaaaggcccagcgtggt

SEQ ID NO: 108152 - DNA, 25 bp, Homo sapien
cagcgtggtcgcgtgtgtaactcag

SEQ ID NO: 108153 - DNA, 25 bp, Homo sapien
cctctgccgtgaggagcgaaaggtc

SEQ ID NO: 108154 - DNA, 25 bp, Homo sapien
ctcagattacccagcgcaagtatga

SEQ ID NO: 108155 - DNA, 25 bp, Homo sapien
catcctccagggaatgtttggctgc

SEQ ID NO: 108156 - DNA, 25 bp, Homo sapien
aactgggccagggtatcacatcctc

SEQ ID NO: 108157 - DNA, 25 bp, Homo sapien
tgaggccaaaatctccgcaggttgc

SEQ ID NO: 108158 - DNA, 25 bp, Homo sapien
ggacctgcagagatcctcgacccgg

SEQ ID NO: 108159 - DNA, 25 bp, Homo sapien
ctgagtctccgggtccaagatcgac

SEQ ID NO: 108160 - DNA, 25 bp, Homo sapien
gtattgggacctacagacactgggc

SEQ ID NO: 108161 - DNA, 25 bp, Homo sapien
aagcctgacgctctagccggctcta

SEQ ID NO: 108162 - DNA, 25 bp, Homo sapien
gctcccgagacacggttcgcaatta

SEQ ID NO: 108163 - DNA, 25 bp, Homo sapien
gagttggttaactcctctcaccggc

SEQ ID NO: 108164 - DNA, 25 bp, Homo sapien
acccgacgctgtctgggaattccgg

SEQ ID NO: 108165 - DNA, 25 bp, Homo sapien
ccaagtcctttagtacccgacgctg

SEQ ID NO: 108166 - DNA, 25 bp, Homo sapien
cgctctagcccacggagttggttaa

SEQ ID NO: 108167 - DNA, 25 bp, Homo sapien
tcgcaattaattatgacgtcacagc

SEQ ID NO: 108168 - DNA, 25 bp, Homo sapien
gccaatcgtcaacgcgaaagcctga

SEQ ID NO: 108169 - DNA, 25 bp, Homo sapien
ccaggcgcctggaaggcgtaaagca

SEQ ID NO: 108170 - DNA, 25 bp, Homo sapien
cccagcacagctgggagctgatcga

SEQ ID NO: 108171 - DNA, 25 bp, Homo sapien
actgcatagtggctctcctcgtcgt

SEQ ID NO: 108172 - DNA, 25 bp, Homo sapien
cgcagcccttgcgttgcactgattc

SEQ ID NO: 108173 - DNA, 25 bp, Homo sapien
agtccaggtccacgcgaatgcgccg

SEQ ID NO: 108174 - DNA, 25 bp, Homo sapien
cagaacagcgggaagatgcgctccc

SEQ ID NO: 108175 - DNA, 25 bp, Homo sapien
cgagactcagctttccgctggtaca

SEQ ID NO: 108176 - DNA, 25 bp, Homo sapien
tcaacaccgcccagcagggtgggtt

SEQ ID NO: 108177 - DNA, 25 bp, Homo sapien
aggacacgtcgccagctgctccaga

SEQ ID NO: 108178 - DNA, 25 bp, Homo sapien
cttgctgtgtagatgcccttctctc

SEQ ID NO: 108179 - DNA, 25 bp, Homo sapien
gctcgggcgcatccatggaaagcca

SEQ ID NO: 108180 - DNA, 25 bp, Homo sapien
cgcacagaggacacgtcgccagctg

SEQ ID NO: 108181 - DNA, 25 bp, Homo sapien
gcagaagctgtgctcgcacgccaga

SEQ ID NO: 108182 - DNA, 25 bp, Homo sapien
gcacattagacctcaggctgcggcg

SEQ ID NO: 108183 - DNA, 25 bp, Homo sapien
tggaaagccaggatctggacgccgc

SEQ ID NO: 108184 - DNA, 25 bp, Homo sapien
tcccgcattaacttttgccgctttc

SEQ ID NO: 108185 - DNA, 25 bp, Homo sapien
ctgtttatgtaatcggcggcgcctc

SEQ ID NO: 108186 - DNA, 25 bp, Homo sapien
ttgttgtcccctccgcaggaaggtg

SEQ ID NO: 108187 - DNA, 25 bp, Homo sapien
agggctgactgagcgcccctggaat

SEQ ID NO: 108188 - DNA, 25 bp, Homo sapien
cgttactttcgggtctcggcctgtg

SEQ ID NO: 108189 - DNA, 25 bp, Homo sapien
gaaggtgaaggctgtttatgtaatc

SEQ ID NO: 108190 - DNA, 25 bp, Homo sapien
ccctggaatccgtgctccgggcgtt

SEQ ID NO: 108191 - DNA, 25 bp, Homo sapien
cacgcctcctgcaacaccgccctct

SEQ ID NO: 108192 - DNA, 25 bp, Homo sapien
actttcgggtctcggcctgtgtgtc

SEQ ID NO: 108193 - DNA, 25 bp, Homo sapien
gggcgcaccaagcagccttaccttg

SEQ ID NO: 108194 - DNA, 25 bp, Homo sapien
cgcgcggttccctgctatttgtacc

SEQ ID NO: 108195 - DNA, 25 bp, Homo sapien
ccaggcctcccaaggagttcggata

SEQ ID NO: 108196 - DNA, 25 bp, Homo sapien
gggcgcggacaaagagctgcatatt

SEQ ID NO: 108197 - DNA, 25 bp, Homo sapien
cacctcgaaggtgtgtagctcctgg

SEQ ID NO: 108198 - DNA, 25 bp, Homo sapien
ttaccttgatctgggcgaccgtttc

SEQ ID NO: 108199 - DNA, 25 bp, Homo sapien
tggcagctaccatgttccgggctac

SEQ ID NO: 108200 - DNA, 25 bp, Homo sapien
ctgcatattggcgactgagtaaaga

SEQ ID NO: 108201 - DNA, 25 bp, Homo sapien
tgcagctccacgaagccggtcaagg

SEQ ID NO: 108202 - DNA, 25 bp, Homo sapien
cggacgcccactttgttcggacaga

SEQ ID NO: 108203 - DNA, 25 bp, Homo sapien
atgcgaggttcagcgtcactatctc

SEQ ID NO: 108204 - DNA, 25 bp, Homo sapien
gttcggacagatcgggagatcctcc

SEQ ID NO: 108205 - DNA, 25 bp, Homo sapien
cgtcactatctcatcctgggaaagg

SEQ ID NO: 108206 - DNA, 25 bp, Homo sapien
aggtggcgtcgtagaagactacctc

SEQ ID NO: 108207 - DNA, 25 bp, Homo sapien
gaagactacctctccgccctagtaa

SEQ ID NO: 108208 - DNA, 25 bp, Homo sapien
agcccagcactcagcggaacctgta

SEQ ID NO: 108209 - DNA, 25 bp, Homo sapien
tgttctctgagctggcttagcttga

SEQ ID NO: 108210 - DNA, 25 bp, Homo sapien
actcagtgccgcatggagctcctcg

SEQ ID NO: 108211 - DNA, 25 bp, Homo sapien
atgctccgaagtccgtgtagcacca

SEQ ID NO: 108212 - DNA, 25 bp, Homo sapien
ggatcgctgtcagccactcactcag

SEQ ID NO: 108213 - DNA, 25 bp, Homo sapien
tggcttagcttgaaggaacctcaca

SEQ ID NO: 108214 - DNA, 25 bp, Homo sapien
cctcggacagcgcaacgtcaaatgt

SEQ ID NO: 108215 - DNA, 25 bp, Homo sapien
tcaaatgtcttcgtatcctgagagc

SEQ ID NO: 108216 - DNA, 25 bp, Homo sapien
gccactctatgctccgaagtccgtg

SEQ ID NO: 108217 - DNA, 25 bp, Homo sapien
agttctgcccgcaaaggtgtccctg

SEQ ID NO: 108218 - DNA, 25 bp, Homo sapien
tcgccaactcagaaggtgaatatga

SEQ ID NO: 108219 - DNA, 25 bp, Homo sapien
tcagctccttcctggcgtagggcag

SEQ ID NO: 108220 - DNA, 25 bp, Homo sapien
tgccgcatcgccaactcagaaggtg

SEQ ID NO: 108221 - DNA, 25 bp, Homo sapien
cgggtcttaccgtgctgagctccac

SEQ ID NO: 108222 - DNA, 25 bp, Homo sapien
agtgcctgcacagtgtgcgtctgcc

SEQ ID NO: 108223 - DNA, 25 bp, Homo sapien
ccaacgccaagtgcctgcacagtgt

SEQ ID NO: 108224 - DNA, 25 bp, Homo sapien
aatatgagaggtggaagtggcactc

SEQ ID NO: 108225 - DNA, 25 bp, Homo sapien
tgcctggcggcgttttagaaaagct

SEQ ID NO: 108226 - DNA, 25 bp, Homo sapien
tgcaaacgacagagcgcaagccttg

SEQ ID NO: 108227 - DNA, 25 bp, Homo sapien
tggaaacaccagagggcccagatgt

SEQ ID NO: 108228 - DNA, 25 bp, Homo sapien
cacacattcgatcaggttagttaca

SEQ ID NO: 108229 - DNA, 25 bp, Homo sapien
ggggagcggaatcctgattacactg

SEQ ID NO: 108230 - DNA, 25 bp, Homo sapien
ttggcgacggtcttctgcaaacgac

SEQ ID NO: 108231 - DNA, 25 bp, Homo sapien
tggaattctagagccgccgcaaaga

SEQ ID NO: 108232 - DNA, 25 bp, Homo sapien
caatttcagttgaggtgggctttta

SEQ ID NO: 108233 - DNA, 25 bp, Homo sapien
aaggttcctgccttacgctgaaagg

SEQ ID NO: 108234 - DNA, 25 bp, Homo sapien
caccgctggcaggttgacctgcagc

SEQ ID NO: 108235 - DNA, 25 bp, Homo sapien
ccgtgatcatctcgcaccagcagtg

SEQ ID NO: 108236 - DNA, 25 bp, Homo sapien
cggcgtgagagtcgccctggactac

SEQ ID NO: 108237 - DNA, 25 bp, Homo sapien
ccttacgctgaaaggctgaagtggg

SEQ ID NO: 108238 - DNA, 25 bp, Homo sapien
actgcctctttctccggcaaagtct

SEQ ID NO: 108239 - DNA, 25 bp, Homo sapien
acaggggacttgagtctcgaacagc

SEQ ID NO: 108240 - DNA, 25 bp, Homo sapien
gacggcggctctccgggatccagct

SEQ ID NO: 108241 - DNA, 25 bp, Homo sapien
cgctcctcgacgctgaatttagaaa

SEQ ID NO: 108242 - DNA, 25 bp, Homo sapien
acgtggcctaaatttgcttccagga

SEQ ID NO: 108243 - DNA, 25 bp, Homo sapien
gcctgttacacggtctaagggagta

SEQ ID NO: 108244 - DNA, 25 bp, Homo sapien
ctcgccaggtgctcaacatcaaata

SEQ ID NO: 108245 - DNA, 25 bp, Homo sapien
cgcagcctgagtttggcgcgtaatt

SEQ ID NO: 108246 - DNA, 25 bp, Homo sapien
tacgtcactgatcaccgggcaaatc

SEQ ID NO: 108247 - DNA, 25 bp, Homo sapien
gccatccaatgggaaccttagtctc

SEQ ID NO: 108248 - DNA, 25 bp, Homo sapien
ccaactctggccttatgctggatca

SEQ ID NO: 108249 - DNA, 25 bp, Homo sapien
ggcactacgatcccggcactacagt

SEQ ID NO: 108250 - DNA, 25 bp, Homo sapien
cagcgactccgtgagtccgaggatg

SEQ ID NO: 108251 - DNA, 25 bp, Homo sapien
ccaggagacacggaacgccaagggc

SEQ ID NO: 108252 - DNA, 25 bp, Homo sapien
aagggccacgcgcagatttaccgag

SEQ ID NO: 108253 - DNA, 25 bp, Homo sapien
cacgcgcagatttaccgagtgaacc

SEQ ID NO: 108254 - DNA, 25 bp, Homo sapien
ctcgaccagggaagaaactcgggcg

SEQ ID NO: 108255 - DNA, 25 bp, Homo sapien
ctcacaccatccagaggaagcatgg

SEQ ID NO: 108256 - DNA, 25 bp, Homo sapien
tccagaggaagcatggctgcgacgt

SEQ ID NO: 108257 - DNA, 25 bp, Homo sapien
ccagactggcccgaagagaggaaaa

SEQ ID NO: 108258 - DNA, 25 bp, Homo sapien
cagaggattcctcgggtcacctgga

SEQ ID NO: 108259 - DNA, 25 bp, Homo sapien
gcgggcctgtatctccagaggattc

SEQ ID NO: 108260 - DNA, 25 bp, Homo sapien
gcaatgggcttcagcgctcgagcac

SEQ ID NO: 108261 - DNA, 25 bp, Homo sapien
cccgggtgaaactctgacgcagtca

SEQ ID NO: 108262 - DNA, 25 bp, Homo sapien
ggagcctggactagacagcctcgcc

SEQ ID NO: 108263 - DNA, 25 bp, Homo sapien
tcgtcgactttcagctgcaccggga

SEQ ID NO: 108264 - DNA, 25 bp, Homo sapien
cgcttccggcgagtattgtgtgtcg

SEQ ID NO: 108265 - DNA, 25 bp, Homo sapien
cgtcttgcggcggtgagacagccac

SEQ ID NO: 108266 - DNA, 25 bp, Homo sapien
gaggctcaacttcctgtaccaggtg

SEQ ID NO: 108267 - DNA, 25 bp, Homo sapien
taccaggtgagtctgcgacaagggc

SEQ ID NO: 108268 - DNA, 25 bp, Homo sapien
cgctggcgaggttttactgctacac

SEQ ID NO: 108269 - DNA, 25 bp, Homo sapien
gaccattgcgaagcggctcgtcttg

SEQ ID NO: 108270 - DNA, 25 bp, Homo sapien
cccagggatccctcggtgaagagga

SEQ ID NO: 108271 - DNA, 25 bp, Homo sapien
agtgctccaacggaggtggaagact

SEQ ID NO: 108272 - DNA, 25 bp, Homo sapien
actgctacactgagaggaccattgc

SEQ ID NO: 108273 - DNA, 25 bp, Homo sapien
ccacgaggctttagctgctgcaaga

SEQ ID NO: 108274 - DNA, 25 bp, Homo sapien
gctcagggaaccagcgctgcttctc

SEQ ID NO: 108275 - DNA, 25 bp, Homo sapien
gctgctgcaagatccaagcgcgctc

SEQ ID NO: 108276 - DNA, 25 bp, Homo sapien
cctgagaaaccttccgctccgaatg

SEQ ID NO: 108277 - DNA, 25 bp, Homo sapien
acatattcaccagctgccggcggcg

SEQ ID NO: 108278 - DNA, 25 bp, Homo sapien
tggggcacttggtgactagagaccc

SEQ ID NO: 108279 - DNA, 25 bp, Homo sapien
ggagaagactgccaagccaccaccg

SEQ ID NO: 108280 - DNA, 25 bp, Homo sapien
accggtcctgcgacatattcaccag

SEQ ID NO: 108281 - DNA, 25 bp, Homo sapien
cgactccggagacctcaaggggaag

SEQ ID NO: 108282 - DNA, 25 bp, Homo sapien
tccggccagctgacaggccgaaagc

SEQ ID NO: 108283 - DNA, 25 bp, Homo sapien
ggccgcgcacctgtgagcaccagga

SEQ ID NO: 108284 - DNA, 25 bp, Homo sapien
caggcttgagcaaagcggccgcacc

SEQ ID NO: 108285 - DNA, 25 bp, Homo sapien
cccggagtagtgtcaactcagagca

SEQ ID NO: 108286 - DNA, 25 bp, Homo sapien
gacagcgccggtgacagctgtgtta

SEQ ID NO: 108287 - DNA, 25 bp, Homo sapien
gcggggaacgtcagcctggaatcct

SEQ ID NO: 108288 - DNA, 25 bp, Homo sapien
tcagagcaccacaaaaacagcggga

SEQ ID NO: 108289 - DNA, 25 bp, Homo sapien
gcgccggccggagccttcttcaaag

SEQ ID NO: 108290 - DNA, 25 bp, Homo sapien
gcacagggaaccacggctgcttctc

SEQ ID NO: 108291 - DNA, 25 bp, Homo sapien
tgtggcctgagaaactctccgctgc

SEQ ID NO: 108292 - DNA, 25 bp, Homo sapien
tcttcaaagccgagctgttcgccgc

SEQ ID NO: 108293 - DNA, 25 bp, Homo sapien
accagagaggagtctccaagccacc

SEQ ID NO: 108294 - DNA, 25 bp, Homo sapien
cgtcaccggctaccggctaggtcag

SEQ ID NO: 108295 - DNA, 25 bp, Homo sapien
cttctctccgaggtttgtggcctga

SEQ ID NO: 108296 - DNA, 25 bp, Homo sapien
ccctacgtggccaagaggacgcagc

SEQ ID NO: 108297 - DNA, 25 bp, Homo sapien
gctcctggatatgccagcgttcctg

SEQ ID NO: 108298 - DNA, 25 bp, Homo sapien
agcgttcctggaagactcctgggtc

SEQ ID NO: 108299 - DNA, 25 bp, Homo sapien
gtccgcaagtttttgccctgctccg

SEQ ID NO: 108300 - DNA, 25 bp, Homo sapien
gcctggctttctgtccgcaagtttt

SEQ ID NO: 108301 - DNA, 25 bp, Homo sapien
cttttgtgtcgggtctggcctggct

SEQ ID NO: 108302 - DNA, 25 bp, Homo sapien
cgcgggtgtctgcatcgttcagccc

SEQ ID NO: 108303 - DNA, 25 bp, Homo sapien
tcgccattaaagtgaggctcccggc

SEQ ID NO: 108304 - DNA, 25 bp, Homo sapien
tcctgggtcctgacgaaagacaagt

SEQ ID NO: 108305 - DNA, 25 bp, Homo sapien
gacggcaaggattatctcaccctga

SEQ ID NO: 108306 - DNA, 25 bp, Homo sapien
acacccagttcgtgcgcttcgacaa

SEQ ID NO: 108307 - DNA, 25 bp, Homo sapien
tctcaccctgaatgaggacctgcgc

SEQ ID NO: 108308 - DNA, 25 bp, Homo sapien
cagggacaccgcacagattttccga

SEQ ID NO: 108309 - DNA, 25 bp, Homo sapien
ttccgagtgaatctgcggacgctgc

SEQ ID NO: 108310 - DNA, 25 bp, Homo sapien
ccctcgaatcttcgggtcccagatt

SEQ ID NO: 108311 - DNA, 25 bp, Homo sapien
ggtctcacaccctgcagtggatgca

SEQ ID NO: 108312 - DNA, 25 bp, Homo sapien
ccagaccctagaccggggagagtct

SEQ ID NO: 108313 - DNA, 25 bp, Homo sapien
gcctcccacgctttctgcgtttagg

SEQ ID NO: 108314 - DNA, 25 bp, Homo sapien
ggactcccgctagggcctctgcagg

SEQ ID NO: 108315 - DNA, 25 bp, Homo sapien
ttataccgcagggtcgggcgcctcc

SEQ ID NO: 108316 - DNA, 25 bp, Homo sapien
gcctctgcaggcaccgcttttatac

SEQ ID NO: 108317 - DNA, 25 bp, Homo sapien
ggcaccgcttttataccgcagggtc

SEQ ID NO: 108318 - DNA, 25 bp, Homo sapien
tccggtcccatcactcggtggcagc

SEQ ID NO: 108319 - DNA, 25 bp, Homo sapien
cctgccacctagtccagcgctgccg

SEQ ID NO: 108320 - DNA, 25 bp, Homo sapien
acgctttctgcgtttaggcggagcc

SEQ ID NO: 108321 - DNA, 25 bp, Homo sapien
gctggttaagcctgcggatatgatg

SEQ ID NO: 108322 - DNA, 25 bp, Homo sapien
ccctgagaaggctgctggttaagcc

SEQ ID NO: 108323 - DNA, 25 bp, Homo sapien
tgcggatatgatgggtcacagactc

SEQ ID NO: 108324 - DNA, 25 bp, Homo sapien
tccgaggtgtcggtctgttcctctc

SEQ ID NO: 108325 - DNA, 25 bp, Homo sapien
tcccgctgcggctgttggaactgga

SEQ ID NO: 108326 - DNA, 25 bp, Homo sapien
gaactggagcgcagcccatcttgaa

SEQ ID NO: 108327 - DNA, 25 bp, Homo sapien
agcccatcttgaagccctgcgggga

SEQ ID NO: 108328 - DNA, 25 bp, Homo sapien
cctcaccgatttgggtcgtagcctc

SEQ ID NO: 108329 - DNA, 25 bp, Homo sapien
ctctgtgacacactctgaggagctg

SEQ ID NO: 108330 - DNA, 25 bp, Homo sapien
tctggcccgagagcctgttgactct

SEQ ID NO: 108331 - DNA, 25 bp, Homo sapien
gcgatcttacggtgcgacagtcctc

SEQ ID NO: 108332 - DNA, 25 bp, Homo sapien
tgaccttagtggaaagccgagactg

SEQ ID NO: 108333 - DNA, 25 bp, Homo sapien
gacacgctgaggctatactacaaag

SEQ ID NO: 108334 - DNA, 25 bp, Homo sapien
cgggagaacctaccactcacctgga

SEQ ID NO: 108335 - DNA, 25 bp, Homo sapien
aggaccaggctaactccgtcacgga

SEQ ID NO: 108336 - DNA, 25 bp, Homo sapien
atatagtcacttccctccaggagcg

SEQ ID NO: 108337 - DNA, 25 bp, Homo sapien
cctgcgggagttactgcgcatgcgt

SEQ ID NO: 108338 - DNA, 25 bp, Homo sapien
ggtcacggcgtcaggcttcccagac

SEQ ID NO: 108339 - DNA, 25 bp, Homo sapien
ttcccagacagtcgtaaacgccatg

SEQ ID NO: 108340 - DNA, 25 bp, Homo sapien
aacgccatgtgtttacgcgactgga

SEQ ID NO: 108341 - DNA, 25 bp, Homo sapien
tttacgcgactggagcaagcggacg

SEQ ID NO: 108342 - DNA, 25 bp, Homo sapien
agatgacggcgaagctcgcacgtgc

SEQ ID NO: 108343 - DNA, 25 bp, Homo sapien
gggcgccgccacagtagctgtaact

SEQ ID NO: 108344 - DNA, 25 bp, Homo sapien
gtagctgtaactgccaccgcgatgc

SEQ ID NO: 108345 - DNA, 25 bp, Homo sapien
taagccgtggctctcaaatgaaccc

SEQ ID NO: 108346 - DNA, 25 bp, Homo sapien
acgcgcccaaacgtgctagtgaaac

SEQ ID NO: 108347 - DNA, 25 bp, Homo sapien
gatggcggcgtctgtattaaacacc

SEQ ID NO: 108348 - DNA, 25 bp, Homo sapien
caattcctgtcctgggcgtacgtca

SEQ ID NO: 108349 - DNA, 25 bp, Homo sapien
tgcgcagttgcctttccgtcaattc

SEQ ID NO: 108350 - DNA, 25 bp, Homo sapien
ggagaacatttctcacccaggattg

SEQ ID NO: 108351 - DNA, 25 bp, Homo sapien
cgcgaggcgtgaactcattggtcaa

SEQ ID NO: 108352 - DNA, 25 bp, Homo sapien
gaaacgcccttgtcgcgagacatta

SEQ ID NO: 108353 - DNA, 25 bp, Homo sapien
ttccctcgagcctgcagtgcgcaag

SEQ ID NO: 108354 - DNA, 25 bp, Homo sapien
ttacagccgacagagcgcttcagcc

SEQ ID NO: 108355 - DNA, 25 bp, Homo sapien
gcaagcgcgggacatctccgtttcc

SEQ ID NO: 108356 - DNA, 25 bp, Homo sapien
aagatcatgtaccagcccagccggg

SEQ ID NO: 108357 - DNA, 25 bp, Homo sapien
gccgagagattcgtagccctgctgc

SEQ ID NO: 108358 - DNA, 25 bp, Homo sapien
cctctaggacaccatcggggaccga

SEQ ID NO: 108359 - DNA, 25 bp, Homo sapien
tctccgcggttacctgtgcctagag

SEQ ID NO: 108360 - DNA, 25 bp, Homo sapien
ggaggctgtaacttgcgcaagcgca

SEQ ID NO: 108361 - DNA, 25 bp, Homo sapien
ggctgtactttttcggcctctaagc

SEQ ID NO: 108362 - DNA, 25 bp, Homo sapien
caaagctgtcttcccgtaccgcgga

SEQ ID NO: 108363 - DNA, 25 bp, Homo sapien
gggacctctaggatcttccgacatc

SEQ ID NO: 108364 - DNA, 25 bp, Homo sapien
tggagcctcagcttcgcaagtcagc

SEQ ID NO: 108365 - DNA, 25 bp, Homo sapien
cggcccactgagatccaaggtatca

SEQ ID NO: 108366 - DNA, 25 bp, Homo sapien
caaggtatcagtgtctcgtaggcgc

SEQ ID NO: 108367 - DNA, 25 bp, Homo sapien
cagcgctgtgcggtaccgatcagaa

SEQ ID NO: 108368 - DNA, 25 bp, Homo sapien
ccgatcagaaactgggcgacgtgcc

SEQ ID NO: 108369 - DNA, 25 bp, Homo sapien
ctgccgtttgctgagtgtccggcag

SEQ ID NO: 108370 - DNA, 25 bp, Homo sapien
tgcggccgtccggccctgcaactcg

SEQ ID NO: 108371 - DNA, 25 bp, Homo sapien
gccgccgcacaatcgccccggaatg

SEQ ID NO: 108372 - DNA, 25 bp, Homo sapien
tgccgcagcccgaggtaatctcggc

SEQ ID NO: 108373 - DNA, 25 bp, Homo sapien
tccggcaggggtctgctcgctgcca

SEQ ID NO: 108374 - DNA, 25 bp, Homo sapien
gctgccgtttgctgagtgtccggca

SEQ ID NO: 108375 - DNA, 25 bp, Homo sapien
tgaggctgccgtttgctgagtgtcc

SEQ ID NO: 108376 - DNA, 25 bp, Homo sapien
ctgccgcagcccgaggtaatctcgg

SEQ ID NO: 108377 - DNA, 25 bp, Homo sapien
cctgtcctgtcaccaccgcctgcct

SEQ ID NO: 108378 - DNA, 25 bp, Homo sapien
gcgttcccagaaccctggcgtccac

SEQ ID NO: 108379 - DNA, 25 bp, Homo sapien
cgcgttcccagaaccctggcgtcca

SEQ ID NO: 108380 - DNA, 25 bp, Homo sapien
agcgcgttcccagaaccctggcgtc

SEQ ID NO: 108381 - DNA, 25 bp, Homo sapien
tgccagcgcgttcccagaaccctgg

SEQ ID NO: 108382 - DNA, 25 bp, Homo sapien
ctgccagcgcgttcccagaaccctg

SEQ ID NO: 108383 - DNA, 25 bp, Homo sapien
ttcggaacccgggcgtcagggctgc

SEQ ID NO: 108384 - DNA, 25 bp, Homo sapien
ccggctccgcttccagcaccgctcg

SEQ ID NO: 108385 - DNA, 25 bp, Homo sapien
aagggccggctccatgtctcttctc

SEQ ID NO: 108386 - DNA, 25 bp, Homo sapien
cccgctctcatgaagccgtgacaga

SEQ ID NO: 108387 - DNA, 25 bp, Homo sapien
aagccgtgacagagccggccgtctc

SEQ ID NO: 108388 - DNA, 25 bp, Homo sapien
ccgctgtagccgcacagactgacaa

SEQ ID NO: 108389 - DNA, 25 bp, Homo sapien
aatctcggcacaaagaggagacagc

SEQ ID NO: 108390 - DNA, 25 bp, Homo sapien
acaggggcgaggagacacccactcc

SEQ ID NO: 108391 - DNA, 25 bp, Homo sapien
ctcagtcaactcacaggccgcggga

SEQ ID NO: 108392 - DNA, 25 bp, Homo sapien
cagactgacaatctcggcacaaaga

SEQ ID NO: 108393 - DNA, 25 bp, Homo sapien
ctgtgtcatagacgtccgacgtgtc

SEQ ID NO: 108394 - DNA, 25 bp, Homo sapien
ttccaaaccgcgaccagagagtctg

SEQ ID NO: 108395 - DNA, 25 bp, Homo sapien
aatgcacgtcgattgggcagctcca

SEQ ID NO: 108396 - DNA, 25 bp, Homo sapien
ccgccgtgcgccaacagaataatgc

SEQ ID NO: 108397 - DNA, 25 bp, Homo sapien
tggcttctgccgctgtctttcacaa

SEQ ID NO: 108398 - DNA, 25 bp, Homo sapien
actgcgtgtgccgaaaaagagctta

SEQ ID NO: 108399 - DNA, 25 bp, Homo sapien
tcttcatacctaaactcggagcggg

SEQ ID NO: 108400 - DNA, 25 bp, Homo sapien
cctcggtcctcctagacatggtgtc

SEQ ID NO: 108401 - DNA, 25 bp, Homo sapien
gccaatggacgcctggtacatgacc

SEQ ID NO: 108402 - DNA, 25 bp, Homo sapien
atgaggctttgtctccctaccgcgc

SEQ ID NO: 108403 - DNA, 25 bp, Homo sapien
acatgaccggcatcgactaatcagg

SEQ ID NO: 108404 - DNA, 25 bp, Homo sapien
gcatcgactaatcagggccaggctc

SEQ ID NO: 108405 - DNA, 25 bp, Homo sapien
taatcagggccaggctcgatgaggc

SEQ ID NO: 108406 - DNA, 25 bp, Homo sapien
ccaggctcgatgaggctttgtctcc

SEQ ID NO: 108407 - DNA, 25 bp, Homo sapien
cctggtacatgaccggcatcgacta

SEQ ID NO: 108408 - DNA, 25 bp, Homo sapien
tggctcagaggccaatggacgcctg

SEQ ID NO: 108409 - DNA, 25 bp, Homo sapien
tggagcgacaaacccaagccagcgt

SEQ ID NO: 108410 - DNA, 25 bp, Homo sapien
cggctttcccgactttggagcgaca

SEQ ID NO: 108411 - DNA, 25 bp, Homo sapien
acctgaaagtgctgcggattggcca

SEQ ID NO: 108412 - DNA, 25 bp, Homo sapien
acacgatcgtctccacaggtctggg

SEQ ID NO: 108413 - DNA, 25 bp, Homo sapien
ccggacctcaaatactcgcggggag

SEQ ID NO: 108414 - DNA, 25 bp, Homo sapien
ccagacacgtactccagagcgggga

SEQ ID NO: 108415 - DNA, 25 bp, Homo sapien
gagcggctcccaagccagacacgta

SEQ ID NO: 108416 - DNA, 25 bp, Homo sapien
ggccagtccagtgaacacacgcagg

SEQ ID NO: 108417 - DNA, 25 bp, Homo sapien
cgcttatcgaagtgtggtcgacctc

SEQ ID NO: 108418 - DNA, 25 bp, Homo sapien
ttttgcgcgcggttacagtgtagcg

SEQ ID NO: 108419 - DNA, 25 bp, Homo sapien
ccctcaggacttaatgggagagaaa

SEQ ID NO: 108420 - DNA, 25 bp, Homo sapien
gtggttttctttaatgagtccctca

SEQ ID NO: 108421 - DNA, 25 bp, Homo sapien
cgcccacgcgcgaagtcttttgtcg

SEQ ID NO: 108422 - DNA, 25 bp, Homo sapien
gagagacttttttagggcgtgaaca

SEQ ID NO: 108423 - DNA, 25 bp, Homo sapien
agggccggtcctgtatttgttcctg

SEQ ID NO: 108424 - DNA, 25 bp, Homo sapien
gcgctgggcgctacctttcacaaaa

SEQ ID NO: 108425 - DNA, 25 bp, Homo sapien
tccgctgtagtgttctgagttcaag

SEQ ID NO: 108426 - DNA, 25 bp, Homo sapien
ccgagggctccgaagtcagattaaa

SEQ ID NO: 108427 - DNA, 25 bp, Homo sapien
gtcggcgcttgcaaagatacactca

SEQ ID NO: 108428 - DNA, 25 bp, Homo sapien
ggtccgccgaagtctcacacagtag

SEQ ID NO: 108429 - DNA, 25 bp, Homo sapien
tactttgccgcagttccaggtgtcc

SEQ ID NO: 108430 - DNA, 25 bp, Homo sapien
tccatcacctaggaggacgtacata

SEQ ID NO: 108431 - DNA, 25 bp, Homo sapien
gtcccagttggggatacgctctcgc

SEQ ID NO: 108432 - DNA, 25 bp, Homo sapien
agttcaagttgcctcggaagtccca

SEQ ID NO: 108433 - DNA, 25 bp, Homo sapien
cgggagccgcctcccgacacccgag

SEQ ID NO: 108434 - DNA, 25 bp, Homo sapien
ctggcataccgtctgaaaaccgggg

SEQ ID NO: 108435 - DNA, 25 bp, Homo sapien
tgctctggcataccgtctgaaaacc

SEQ ID NO: 108436 - DNA, 25 bp, Homo sapien
ccgatgctctggcataccgtctgaa

SEQ ID NO: 108437 - DNA, 25 bp, Homo sapien
catgcttggtcgtccagctcttcta

SEQ ID NO: 108438 - DNA, 25 bp, Homo sapien
gaggcaggacgtcccgagccatgct

SEQ ID NO: 108439 - DNA, 25 bp, Homo sapien
gagccactgggactactgggtccgg

SEQ ID NO: 108440 - DNA, 25 bp, Homo sapien
tcccgagccatgcttggtcgtccag

SEQ ID NO: 108441 - DNA, 25 bp, Homo sapien
gctcaattaaaagccagctcctctc

SEQ ID NO: 108442 - DNA, 25 bp, Homo sapien
tccagccggttacacgcgccgttag

SEQ ID NO: 108443 - DNA, 25 bp, Homo sapien
ccacggtgcctttcgggatttgtag

SEQ ID NO: 108444 - DNA, 25 bp, Homo sapien
tgccttcgcggaaccaactggtcca

SEQ ID NO: 108445 - DNA, 25 bp, Homo sapien
atttgtagtcagacgcgcttcagcc

SEQ ID NO: 108446 - DNA, 25 bp, Homo sapien
cgcttcagccggctctaaggagagc

SEQ ID NO: 108447 - DNA, 25 bp, Homo sapien
aggcaagactccaattcccagcatc

SEQ ID NO: 108448 - DNA, 25 bp, Homo sapien
ggagttggttctgccttcgcggaac

SEQ ID NO: 108449 - DNA, 25 bp, Homo sapien
ttatgatagctagcagtgcggtccc

SEQ ID NO: 108450 - DNA, 25 bp, Homo sapien
cccaggtgtcctgtataaccagttc

SEQ ID NO: 108451 - DNA, 25 bp, Homo sapien
cgagaactcggccaagcggctcatg

SEQ ID NO: 108452 - DNA, 25 bp, Homo sapien
cgggcacagcgacgtcaagcgcttt

SEQ ID NO: 108453 - DNA, 25 bp, Homo sapien
tttggaagcggcagaaacatagctc

SEQ ID NO: 108454 - DNA, 25 bp, Homo sapien
tacgcgtcagggcttttcttgttta

SEQ ID NO: 108455 - DNA, 25 bp, Homo sapien
gcggggcatcagaactcaggtgttt

SEQ ID NO: 108456 - DNA, 25 bp, Homo sapien
agttcctgtcgcaagtggactttga

SEQ ID NO: 108457 - DNA, 25 bp, Homo sapien
tccttggacgggatgggcccttgct

SEQ ID NO: 108458 - DNA, 25 bp, Homo sapien
cccgcgtgcaagtgggcgcgccatt

SEQ ID NO: 108459 - DNA, 25 bp, Homo sapien
gcagcctggacaccctgctcattgt

SEQ ID NO: 108460 - DNA, 25 bp, Homo sapien
cacgcgggttcagacctgccgagcg

SEQ ID NO: 108461 - DNA, 25 bp, Homo sapien
agctcctccgtccttggacgggatg

SEQ ID NO: 108462 - DNA, 25 bp, Homo sapien
aggctggtcgccgtcttacctccgg

SEQ ID NO: 108463 - DNA, 25 bp, Homo sapien
tctggctaggctggtcgccgtctta

SEQ ID NO: 108464 - DNA, 25 bp, Homo sapien
gccgcgcattctcagcgctgggagc

SEQ ID NO: 108465 - DNA, 25 bp, Homo sapien
agccctggtaatcgctcgctccatg

SEQ ID NO: 108466 - DNA, 25 bp, Homo sapien
gcctgcatgctgtctgcccttgtca

SEQ ID NO: 108467 - DNA, 25 bp, Homo sapien
ctggttctgcacagggtctctaggc

SEQ ID NO: 108468 - DNA, 25 bp, Homo sapien
gcccagcctagcgtcagctgcgatt

SEQ ID NO: 108469 - DNA, 25 bp, Homo sapien
ccggcatgatttcccgcagaatttg

SEQ ID NO: 108470 - DNA, 25 bp, Homo sapien
gcccaggggcgaagaagtctcctaa

SEQ ID NO: 108471 - DNA, 25 bp, Homo sapien
ctttcgaggatgttctgatacgcgc

SEQ ID NO: 108472 - DNA, 25 bp, Homo sapien
ctgtagcgctggcaagttctcatcc

SEQ ID NO: 108473 - DNA, 25 bp, Homo sapien
agtgtcggactcctccttccctagg

SEQ ID NO: 108474 - DNA, 25 bp, Homo sapien
ctgctacggcaactggagctgctca

SEQ ID NO: 108475 - DNA, 25 bp, Homo sapien
ggaagtccttccttatgcctgcctt

SEQ ID NO: 108476 - DNA, 25 bp, Homo sapien
ccgtctccaggaacatgcagaaaga

SEQ ID NO: 108477 - DNA, 25 bp, Homo sapien
cctagggagctgaatacacggctgc

SEQ ID NO: 108478 - DNA, 25 bp, Homo sapien
tcacggaccatgagctagaagctgc

SEQ ID NO: 108479 - DNA, 25 bp, Homo sapien
aggctcgcctgactgaagacatgaa

SEQ ID NO: 108480 - DNA, 25 bp, Homo sapien
ggctgccgctctactccattggaag

SEQ ID NO: 108481 - DNA, 25 bp, Homo sapien
gatcctccgatcaccctgcgagtta

SEQ ID NO: 108482 - DNA, 25 bp, Homo sapien
tgctttcacgtacatcgcacctgtg

SEQ ID NO: 108483 - DNA, 25 bp, Homo sapien
actgacacccgtttgtgctgtgctt

SEQ ID NO: 108484 - DNA, 25 bp, Homo sapien
tctaggcggaaatcctttaacaagc

SEQ ID NO: 108485 - DNA, 25 bp, Homo sapien
cagctcagattagtggctcgaggcc

SEQ ID NO: 108486 - DNA, 25 bp, Homo sapien
gctgggccctcattagggataatta

SEQ ID NO: 108487 - DNA, 25 bp, Homo sapien
cggcttctgatctcttgcggacagc

SEQ ID NO: 108488 - DNA, 25 bp, Homo sapien
cgtgacattggccataaaactgaca

SEQ ID NO: 108489 - DNA, 25 bp, Homo sapien
tcctcactgcggcaacccgggaaaa

SEQ ID NO: 108490 - DNA, 25 bp, Homo sapien
gcgggcgccctaaagtcctatttca

SEQ ID NO: 108491 - DNA, 25 bp, Homo sapien
ccggcttcttggctgtcaaacagat

SEQ ID NO: 108492 - DNA, 25 bp, Homo sapien
tccaatggcgcggaagagaacacat

SEQ ID NO: 108493 - DNA, 25 bp, Homo sapien
ttgggcccactaaatgcgtcggagc

SEQ ID NO: 108494 - DNA, 25 bp, Homo sapien
gcagtggcgtctaaatttgggccca

SEQ ID NO: 108495 - DNA, 25 bp, Homo sapien
aaggccgggtatgccttgcatgatc

SEQ ID NO: 108496 - DNA, 25 bp, Homo sapien
catgagctggccaatcgggaacggc

SEQ ID NO: 108497 - DNA, 25 bp, Homo sapien
cggaacgaaccgtcgccagcaagca

SEQ ID NO: 108498 - DNA, 25 bp, Homo sapien
agcaagcacagcagtaggaccaggg

SEQ ID NO: 108499 - DNA, 25 bp, Homo sapien
aatcacgtgccatgctccaggccag

SEQ ID NO: 108500 - DNA, 25 bp, Homo sapien
gggatcgtgcttctcgctcaggtcc

SEQ ID NO: 108501 - DNA, 25 bp, Homo sapien
gattcccggcaaccaggccggcgga

SEQ ID NO: 108502 - DNA, 25 bp, Homo sapien
cggcggaatcacgtgccatgctcca

SEQ ID NO: 108503 - DNA, 25 bp, Homo sapien
gcagtcactggcctgacttccggaa

SEQ ID NO: 108504 - DNA, 25 bp, Homo sapien
cactggcctgacttccggaacgaac

SEQ ID NO: 108505 - DNA, 25 bp, Homo sapien
tcacctgtctccgaatccgtcgtgg

SEQ ID NO: 108506 - DNA, 25 bp, Homo sapien
ggcgaagccagtttccatcagaact

SEQ ID NO: 108507 - DNA, 25 bp, Homo sapien
cagcagcaggaagagtttccggatc

SEQ ID NO: 108508 - DNA, 25 bp, Homo sapien
tgaggctcatttctctactcacctg

SEQ ID NO: 108509 - DNA, 25 bp, Homo sapien
tccgtcgtggtgtttcaagcgagtc

SEQ ID NO: 108510 - DNA, 25 bp, Homo sapien
aaaacgcttgcggtcgccgagcgca

SEQ ID NO: 108511 - DNA, 25 bp, Homo sapien
cccgccctgggttatgtaagtgaca

SEQ ID NO: 108512 - DNA, 25 bp, Homo sapien
ctggggcgcagaattcaaaacgctt

SEQ ID NO: 108513 - DNA, 25 bp, Homo sapien
caggtcgcagccagacatcctctgg

SEQ ID NO: 108514 - DNA, 25 bp, Homo sapien
gcgcttgtacttctgtgtctcccgg

SEQ ID NO: 108515 - DNA, 25 bp, Homo sapien
gcctggcgcttgtacttctgtgtct

SEQ ID NO: 108516 - DNA, 25 bp, Homo sapien
actcggtcagcctgtgcctggcgct

SEQ ID NO: 108517 - DNA, 25 bp, Homo sapien
cagatccaccttggggtggatctca

SEQ ID NO: 108518 - DNA, 25 bp, Homo sapien
gttccgcagatccaccttggggtgg

SEQ ID NO: 108519 - DNA, 25 bp, Homo sapien
attggggacgcgtcatgagtattca

SEQ ID NO: 108520 - DNA, 25 bp, Homo sapien
cagccagacatcctctggagggtgt

SEQ ID NO: 108521 - DNA, 25 bp, Homo sapien
tgcgacctcagcacggagcactgta

SEQ ID NO: 108522 - DNA, 25 bp, Homo sapien
aaggggctacttcctgcgcggagta

SEQ ID NO: 108523 - DNA, 25 bp, Homo sapien
acaaaagcggctcggggctcctgaa

SEQ ID NO: 108524 - DNA, 25 bp, Homo sapien
gtgagctgagctgcacccagacaaa

SEQ ID NO: 108525 - DNA, 25 bp, Homo sapien
acgagccgggaaagacttgcatcgg

SEQ ID NO: 108526 - DNA, 25 bp, Homo sapien
tcaccgacagcaaggcatggactcc

SEQ ID NO: 108527 - DNA, 25 bp, Homo sapien
cacagtgtgggatgagtcaccgaca

SEQ ID NO: 108528 - DNA, 25 bp, Homo sapien
gccgcgctcccggatgaacagagaa

SEQ ID NO: 108529 - DNA, 25 bp, Homo sapien
aagctcaggaatcgcgtgtcgccca

SEQ ID NO: 108530 - DNA, 25 bp, Homo sapien
tcgcctctctcctggacgccgtcgc

SEQ ID NO: 108531 - DNA, 25 bp, Homo sapien
tccgggaacccgcacattgcgggcg

SEQ ID NO: 108532 - DNA, 25 bp, Homo sapien
ggaatcgcgtgtcgcccacgaaggc

SEQ ID NO: 108533 - DNA, 25 bp, Homo sapien
ctgtggaagctcaggaatcgcgtgt

SEQ ID NO: 108534 - DNA, 25 bp, Homo sapien
ttctcgccgcggctgtggaagctca

SEQ ID NO: 108535 - DNA, 25 bp, Homo sapien
acgctctgattctcgccgcggctgt

SEQ ID NO: 108536 - DNA, 25 bp, Homo sapien
aactcagggcccacgtggtgaaggc

SEQ ID NO: 108537 - DNA, 25 bp, Homo sapien
gcgtctgaggagactctgagtccgg

SEQ ID NO: 108538 - DNA, 25 bp, Homo sapien
acgcgtcacgagtatcctggaagaa

SEQ ID NO: 108539 - DNA, 25 bp, Homo sapien
aagtggggacgcgtcacgagtatcc

SEQ ID NO: 108540 - DNA, 25 bp, Homo sapien
cacgtcgcagccgtacatgctctgg

SEQ ID NO: 108541 - DNA, 25 bp, Homo sapien
ggcttctctagatatccaataccca

SEQ ID NO: 108542 - DNA, 25 bp, Homo sapien
ccatgaccagcatctcggcgtctga

SEQ ID NO: 108543 - DNA, 25 bp, Homo sapien
cgtcgcagccgtacatgctctggag

SEQ ID NO: 108544 - DNA, 25 bp, Homo sapien
agatatccaatacccaatgggagtg

SEQ ID NO: 108545 - DNA, 25 bp, Homo sapien
tttcatggaggccaaactaagggtg

SEQ ID NO: 108546 - DNA, 25 bp, Homo sapien
catggaggccaaactaagggtgtaa

SEQ ID NO: 108547 - DNA, 25 bp, Homo sapien
aggtcactccagtctttcatggagg

SEQ ID NO: 108548 - DNA, 25 bp, Homo sapien
tcagtgaaggtcactccagtctttc

SEQ ID NO: 108549 - DNA, 25 bp, Homo sapien
ggcgcagccggtttccatcagaacc

SEQ ID NO: 108550 - DNA, 25 bp, Homo sapien
tccctgggccccttgtatcatttca

SEQ ID NO: 108551 - DNA, 25 bp, Homo sapien
tgctgtttcaagagagccggattcc

SEQ ID NO: 108552 - DNA, 25 bp, Homo sapien
agccggattccagatcacgctccag

SEQ ID NO: 108553 - DNA, 25 bp, Homo sapien
tgttgggagaatagccacgcgttgt

SEQ ID NO: 108554 - DNA, 25 bp, Homo sapien
caggtgactaagtttccgcggcgcc

SEQ ID NO: 108555 - DNA, 25 bp, Homo sapien
cccagtttcattggatgagcggtcg

SEQ ID NO: 108556 - DNA, 25 bp, Homo sapien
tccagcccactggaattttctcttc

SEQ ID NO: 108557 - DNA, 25 bp, Homo sapien
ctactcgaagctggtccctgcttta

SEQ ID NO: 108558 - DNA, 25 bp, Homo sapien
ccctggccgtgcttatgaagttgga

SEQ ID NO: 108559 - DNA, 25 bp, Homo sapien
ccggccactgcttgagccgctgaga

SEQ ID NO: 108560 - DNA, 25 bp, Homo sapien
gctctcaggtccctgaagtcctgtc

SEQ ID NO: 108561 - DNA, 25 bp, Homo sapien
tagcctcaggagtcaggtcccctac

SEQ ID NO: 108562 - DNA, 25 bp, Homo sapien
cccggggtctagagaagcactgaga

SEQ ID NO: 108563 - DNA, 25 bp, Homo sapien
ggactcctcagcctggtgagtggcc

SEQ ID NO: 108564 - DNA, 25 bp, Homo sapien
tgagtggcccgcaaaggacagcgct

SEQ ID NO: 108565 - DNA, 25 bp, Homo sapien
ccaggtgccttagcctcaggagtca

SEQ ID NO: 108566 - DNA, 25 bp, Homo sapien
aggtgccttagcctcaggagtcagg

SEQ ID NO: 108567 - DNA, 25 bp, Homo sapien
gccttagcctcaggagtcaggtccc

SEQ ID NO: 108568 - DNA, 25 bp, Homo sapien
gtgccttagcctcaggagtcaggtc

SEQ ID NO: 108569 - DNA, 25 bp, Homo sapien
acccagggtgcggaacccacagtgc

SEQ ID NO: 108570 - DNA, 25 bp, Homo sapien
tcgagtccttggtcgcttctgaccc

SEQ ID NO: 108571 - DNA, 25 bp, Homo sapien
cctcagatggtacctcgagtccttg

SEQ ID NO: 108572 - DNA, 25 bp, Homo sapien
tccgattggccagttcagtacccgc

SEQ ID NO: 108573 - DNA, 25 bp, Homo sapien
acctgctccagtctgcaggggcgca

SEQ ID NO: 108574 - DNA, 25 bp, Homo sapien
cacagtgcggatccactttggccca

SEQ ID NO: 108575 - DNA, 25 bp, Homo sapien
ggtacctcgagtccttggtcgcttc

SEQ ID NO: 108576 - DNA, 25 bp, Homo sapien
ggaacccacagtgcggatccacttt

SEQ ID NO: 108577 - DNA, 25 bp, Homo sapien
gcggcgctgtcacagcattctatgc

SEQ ID NO: 108578 - DNA, 25 bp, Homo sapien
gcgctgtcacagcattctatgcgcc

SEQ ID NO: 108579 - DNA, 25 bp, Homo sapien
cctgggccgcgctggtcttgtatca

SEQ ID NO: 108580 - DNA, 25 bp, Homo sapien
tgtatcatttcagtggtccctcccg

SEQ ID NO: 108581 - DNA, 25 bp, Homo sapien
aggcgcagttccctactcacccagg

SEQ ID NO: 108582 - DNA, 25 bp, Homo sapien
tcagtggtccctcccgtctttgacg

SEQ ID NO: 108583 - DNA, 25 bp, Homo sapien
cgctgccttccaggggtgaagtgtt

SEQ ID NO: 108584 - DNA, 25 bp, Homo sapien
catttcagtggtccctcccgtcttt

SEQ ID NO: 108585 - DNA, 25 bp, Homo sapien
attcagttggccactgctgagcagc

SEQ ID NO: 108586 - DNA, 25 bp, Homo sapien
ggggtcttctcacgggtttcattca

SEQ ID NO: 108587 - DNA, 25 bp, Homo sapien
ggggcgcaggtgactaaatttcgac

SEQ ID NO: 108588 - DNA, 25 bp, Homo sapien
tcctgctgtttctggccgtcgcctt

SEQ ID NO: 108589 - DNA, 25 bp, Homo sapien
gttttcactggataagcggtcgctg

SEQ ID NO: 108590 - DNA, 25 bp, Homo sapien
agaattttctcttctgaacgtggcc

SEQ ID NO: 108591 - DNA, 25 bp, Homo sapien
ctggtccttgattttggctgcgctc

SEQ ID NO: 108592 - DNA, 25 bp, Homo sapien
gggtccaggtcgtgctcataagttt

SEQ ID NO: 108593 - DNA, 25 bp, Homo sapien
tacctaaacagggagagcgcgtatg

SEQ ID NO: 108594 - DNA, 25 bp, Homo sapien
gaagcgcagatggaaacggattgta

SEQ ID NO: 108595 - DNA, 25 bp, Homo sapien
cggattgtagcgaaggccaaagctt

SEQ ID NO: 108596 - DNA, 25 bp, Homo sapien
gggccttccgcggttatacagatcc

SEQ ID NO: 108597 - DNA, 25 bp, Homo sapien
caacagcgacgaaggagggaaatct

SEQ ID NO: 108598 - DNA, 25 bp, Homo sapien
tcccgccttcttggctgcaagagcg

SEQ ID NO: 108599 - DNA, 25 bp, Homo sapien
gaaatctgccttcacttccggttgc

SEQ ID NO: 108600 - DNA, 25 bp, Homo sapien
gcgaaggccaaagcttacctaaaca

SEQ ID NO: 108601 - DNA, 25 bp, Homo sapien
gtcccgctcgtcagaaacgcctgtt

SEQ ID NO: 108602 - DNA, 25 bp, Homo sapien
cggcttttgcttgcaccggagggaa

SEQ ID NO: 108603 - DNA, 25 bp, Homo sapien
acgcgctcttgggaatgcgatccta

SEQ ID NO: 108604 - DNA, 25 bp, Homo sapien
tgggaaaccgagcactggaatcatg

SEQ ID NO: 108605 - DNA, 25 bp, Homo sapien
ctcgtgtaccagagaggcccgtacc

SEQ ID NO: 108606 - DNA, 25 bp, Homo sapien
tgatgttgacgtacaccctctcgcc

SEQ ID NO: 108607 - DNA, 25 bp, Homo sapien
agaaggtcttccctctcgcgaagtc

SEQ ID NO: 108608 - DNA, 25 bp, Homo sapien
tgcgatcctaaaggcttgggacttc

SEQ ID NO: 108609 - DNA, 25 bp, Homo sapien
gtcgtgtaaattctgcgtcccaacc

SEQ ID NO: 108610 - DNA, 25 bp, Homo sapien
gagaagctgccattagccgccgcca

SEQ ID NO: 108611 - DNA, 25 bp, Homo sapien
gcctccttagccaatcggggtccta

SEQ ID NO: 108612 - DNA, 25 bp, Homo sapien
cgcacctccggcagttcattcagga

SEQ ID NO: 108613 - DNA, 25 bp, Homo sapien
ccgtgtgtcgttgccttccactttt

SEQ ID NO: 108614 - DNA, 25 bp, Homo sapien
ttctccctagctgaaggcgccacgg

SEQ ID NO: 108615 - DNA, 25 bp, Homo sapien
ctggaactcttaccaggcctgcgga

SEQ ID NO: 108616 - DNA, 25 bp, Homo sapien
tcctcaaactcacggcaaagggatg

SEQ ID NO: 108617 - DNA, 25 bp, Homo sapien
ccgggaattccgcagttaccgagag

SEQ ID NO: 108618 - DNA, 25 bp, Homo sapien
attccgcagttaccgagagtttcga

SEQ ID NO: 108619 - DNA, 25 bp, Homo sapien
ccgcagttaccgagagtttcgagga

SEQ ID NO: 108620 - DNA, 25 bp, Homo sapien
taccgagagtttcgaggagatgatg

SEQ ID NO: 108621 - DNA, 25 bp, Homo sapien
cagcgagacacggagcgagggttca

SEQ ID NO: 108622 - DNA, 25 bp, Homo sapien
cgagggttcagagtatgaggaaatc

SEQ ID NO: 108623 - DNA, 25 bp, Homo sapien
tgaggaaatccccaagcggcgccgg

SEQ ID NO: 108624 - DNA, 25 bp, Homo sapien
gggccgaggcgagtattttgccaga

SEQ ID NO: 108625 - DNA, 25 bp, Homo sapien
atcgtgcttggctctcacggaacgc

SEQ ID NO: 108626 - DNA, 25 bp, Homo sapien
ttctgtacataggatcgtgcttggc

SEQ ID NO: 108627 - DNA, 25 bp, Homo sapien
agggatttcagctggccggccatat

SEQ ID NO: 108628 - DNA, 25 bp, Homo sapien
acggccagaacgctctcagggattt

SEQ ID NO: 108629 - DNA, 25 bp, Homo sapien
ccagtcctgcggctcctactgggga

SEQ ID NO: 108630 - DNA, 25 bp, Homo sapien
cggaacctggcgcaactcctagagc

SEQ ID NO: 108631 - DNA, 25 bp, Homo sapien
cgctgcgtaaagaggcctgcagtcc

SEQ ID NO: 108632 - DNA, 25 bp, Homo sapien
cgggccagggaccattctgtacata

SEQ ID NO: 108633 - DNA, 25 bp, Homo sapien
taactcactatagacccgaaacggc

SEQ ID NO: 108634 - DNA, 25 bp, Homo sapien
ccgaaacggcactcacggggcgaca

SEQ ID NO: 108635 - DNA, 25 bp, Homo sapien
gggcgacagacctgctagctgactg

SEQ ID NO: 108636 - DNA, 25 bp, Homo sapien
tgctagctgactgcccgcgtctact

SEQ ID NO: 108637 - DNA, 25 bp, Homo sapien
cacggtgttccagcagaacggcaca

SEQ ID NO: 108638 - DNA, 25 bp, Homo sapien
cccgatagtatttggggatctcgaa

SEQ ID NO: 108639 - DNA, 25 bp, Homo sapien
cacactctgcggagaaagtggtttc

SEQ ID NO: 108640 - DNA, 25 bp, Homo sapien
cagaggtcggaaaatcctgggacaa

SEQ ID NO: 108641 - DNA, 25 bp, Homo sapien
gtggaggcattaccgcctctccgtg

SEQ ID NO: 108642 - DNA, 25 bp, Homo sapien
tcttaacctgccctgggccaagggc

SEQ ID NO: 108643 - DNA, 25 bp, Homo sapien
aggccggccagcgtgcttccgaagg

SEQ ID NO: 108644 - DNA, 25 bp, Homo sapien
aaaggccggccagcgtgcttccgaa

SEQ ID NO: 108645 - DNA, 25 bp, Homo sapien
taaaggccggccagcgtgcttccga

SEQ ID NO: 108646 - DNA, 25 bp, Homo sapien
ttaaaggccggccagcgtgcttccg

SEQ ID NO: 108647 - DNA, 25 bp, Homo sapien
ggaatttaaaggccggccagcgtgc

SEQ ID NO: 108648 - DNA, 25 bp, Homo sapien
agacaagaccctgaccgtggggaat

SEQ ID NO: 108649 - DNA, 25 bp, Homo sapien
acttgtcaagaaaagaggcgcttcc

SEQ ID NO: 108650 - DNA, 25 bp, Homo sapien
ctgtgcctccggaagttactctttc

SEQ ID NO: 108651 - DNA, 25 bp, Homo sapien
ggccaaggggacatgacacgtttta

SEQ ID NO: 108652 - DNA, 25 bp, Homo sapien
gaggcgcttccgagtttgagaattg

SEQ ID NO: 108653 - DNA, 25 bp, Homo sapien
gggcggcactggtcaattttgttct

SEQ ID NO: 108654 - DNA, 25 bp, Homo sapien
tggttgggctagatttcggttctgc

SEQ ID NO: 108655 - DNA, 25 bp, Homo sapien
gtgctactaagttgcacgacttgtc

SEQ ID NO: 108656 - DNA, 25 bp, Homo sapien
cgtcacattcgtcggtgtgtggcca

SEQ ID NO: 108657 - DNA, 25 bp, Homo sapien
tgccgcagctcatggggcggaccct

SEQ ID NO: 108658 - DNA, 25 bp, Homo sapien
cgaagcccggaagcagctgcaccag

SEQ ID NO: 108659 - DNA, 25 bp, Homo sapien
ttacgaagcaaagcgcgggcctact

SEQ ID NO: 108660 - DNA, 25 bp, Homo sapien
gaactaagatgtcctcagagatccc

SEQ ID NO: 108661 - DNA, 25 bp, Homo sapien
ggcctccacaaggtcagaactaaga

SEQ ID NO: 108662 - DNA, 25 bp, Homo sapien
agacgcggcctccacaaggtcagaa

SEQ ID NO: 108663 - DNA, 25 bp, Homo sapien
cgaacacgcagcagagacgcggcct

SEQ ID NO: 108664 - DNA, 25 bp, Homo sapien
atggggcggaccctgcgaatagacc

SEQ ID NO: 108665 - DNA, 25 bp, Homo sapien
gactattggcttcgcggtctacgag

SEQ ID NO: 108666 - DNA, 25 bp, Homo sapien
ttatgcagaagcaccgtcgccgcga

SEQ ID NO: 108667 - DNA, 25 bp, Homo sapien
ttcgtgctcgcccttatgcagaagc

SEQ ID NO: 108668 - DNA, 25 bp, Homo sapien
gctgcagcttcgtgctcgcccttat

SEQ ID NO: 108669 - DNA, 25 bp, Homo sapien
ggaccgcgagtcaggctgcagcttc

SEQ ID NO: 108670 - DNA, 25 bp, Homo sapien
tggatctcactgagcaggcagagga

SEQ ID NO: 108671 - DNA, 25 bp, Homo sapien
gtggatcaccggtggatctcactga

SEQ ID NO: 108672 - DNA, 25 bp, Homo sapien
ccgcgacatggagactattggcttc

SEQ ID NO: 108673 - DNA, 25 bp, Homo sapien
ccagggttcgaaggtcacacttaga

SEQ ID NO: 108674 - DNA, 25 bp, Homo sapien
tgccgagaagccgtgtaatgaaata

SEQ ID NO: 108675 - DNA, 25 bp, Homo sapien
atcctgggattggtagttcgctttc

SEQ ID NO: 108676 - DNA, 25 bp, Homo sapien
tccactctgtgggttaggaaaggcc

SEQ ID NO: 108677 - DNA, 25 bp, Homo sapien
accacctcaggttagcgcactggga

SEQ ID NO: 108678 - DNA, 25 bp, Homo sapien
tgggacgttccagttctcacaccgc

SEQ ID NO: 108679 - DNA, 25 bp, Homo sapien
gactgattcgcactaggggcccaac

SEQ ID NO: 108680 - DNA, 25 bp, Homo sapien
gccgttccctggaagtagcaacttc

SEQ ID NO: 108681 - DNA, 25 bp, Homo sapien
cattttctccgctggggacccgctg

SEQ ID NO: 108682 - DNA, 25 bp, Homo sapien
agaaacctggaaagtgcgaaccgcg

SEQ ID NO: 108683 - DNA, 25 bp, Homo sapien
cggacatccggagcccgaagcggct

SEQ ID NO: 108684 - DNA, 25 bp, Homo sapien
gaaggcggcgccgtagcgccactct

SEQ ID NO: 108685 - DNA, 25 bp, Homo sapien
gcacctcagaactccggtaggacgg

SEQ ID NO: 108686 - DNA, 25 bp, Homo sapien
caggcgaattctggagaccgcggcc

SEQ ID NO: 108687 - DNA, 25 bp, Homo sapien
ccgctcaagctctgttccctgggga

SEQ ID NO: 108688 - DNA, 25 bp, Homo sapien
tccctcccaggcgaattctggagac

SEQ ID NO: 108689 - DNA, 25 bp, Homo sapien
ccacccagcattcgcggaatatttc

SEQ ID NO: 108690 - DNA, 25 bp, Homo sapien
aggccaacgactagaggctttgcga

SEQ ID NO: 108691 - DNA, 25 bp, Homo sapien
tggaattcaagcgaccgtgggcctt

SEQ ID NO: 108692 - DNA, 25 bp, Homo sapien
ggcgcggcctccgagtaattaatcc

SEQ ID NO: 108693 - DNA, 25 bp, Homo sapien
agagtccagagagttcgtttccatg

SEQ ID NO: 108694 - DNA, 25 bp, Homo sapien
cagcagcagatgacggtgtcccttc

SEQ ID NO: 108695 - DNA, 25 bp, Homo sapien
gtcccttctgagtgctcctacctag

SEQ ID NO: 108696 - DNA, 25 bp, Homo sapien
tcccgtctttgttgcgttttgctcc

SEQ ID NO: 108697 - DNA, 25 bp, Homo sapien
tcagagtccctctcccggtagattt

SEQ ID NO: 108698 - DNA, 25 bp, Homo sapien
cgggactcaagactcaactgggacc

SEQ ID NO: 108699 - DNA, 25 bp, Homo sapien
ggccagtccgtaggcgtgactttaa

SEQ ID NO: 108700 - DNA, 25 bp, Homo sapien
tttgcggataactggcttgacaagc

SEQ ID NO: 108701 - DNA, 25 bp, Homo sapien
ttggactgtaccacgttcttcggtg

SEQ ID NO: 108702 - DNA, 25 bp, Homo sapien
gttgcgacattttcagtgcttcctg

SEQ ID NO: 108703 - DNA, 25 bp, Homo sapien
cgggtacagcagtggtccgaaacta

SEQ ID NO: 108704 - DNA, 25 bp, Homo sapien
ccattatgggcacttctggggagca

SEQ ID NO: 108705 - DNA, 25 bp, Homo sapien
ccaaaggacgccgaccgatcctgtg

SEQ ID NO: 108706 - DNA, 25 bp, Homo sapien
cctggggaccgggtgaatctctcct

SEQ ID NO: 108707 - DNA, 25 bp, Homo sapien
ggagtctctcatcccatccgctggg

SEQ ID NO: 108708 - DNA, 25 bp, Homo sapien
tacgctccctggactctggtatccg

SEQ ID NO: 108709 - DNA, 25 bp, Homo sapien
ggggactcgggcacttttttctgca

SEQ ID NO: 108710 - DNA, 25 bp, Homo sapien
gcacttttttctgcaagggccgcca

SEQ ID NO: 108711 - DNA, 25 bp, Homo sapien
aggacgagagccgtacagtgcttca

SEQ ID NO: 108712 - DNA, 25 bp, Homo sapien
atctctcctgcggaggagtctctca

SEQ ID NO: 108713 - DNA, 25 bp, Homo sapien
gactcctcaggtggcagttctagca

SEQ ID NO: 108714 - DNA, 25 bp, Homo sapien
tggaagtcctgaatacccgaacgag

SEQ ID NO: 108715 - DNA, 25 bp, Homo sapien
tcttggcagccactaggatgcgctc

SEQ ID NO: 108716 - DNA, 25 bp, Homo sapien
acaaggctagggtctctaatctcca

SEQ ID NO: 108717 - DNA, 25 bp, Homo sapien
ccgctcggatttcttagttttcttg

SEQ ID NO: 108718 - DNA, 25 bp, Homo sapien
ggtcccagcggcaatgactcctcag

SEQ ID NO: 108719 - DNA, 25 bp, Homo sapien
ttcgagcctaaggagttaagcatcc

SEQ ID NO: 108720 - DNA, 25 bp, Homo sapien
ccctcaggggtcagattctttaaga

SEQ ID NO: 108721 - DNA, 25 bp, Homo sapien
gggcctctccaatcaacagcggtta

SEQ ID NO: 108722 - DNA, 25 bp, Homo sapien
ttttgcatccgcagagcctccaagc

SEQ ID NO: 108723 - DNA, 25 bp, Homo sapien
gttctcccacctgtagcgactcagg

SEQ ID NO: 108724 - DNA, 25 bp, Homo sapien
ggtaacctccgcgtgacaggaatga

SEQ ID NO: 108725 - DNA, 25 bp, Homo sapien
agtgctttgcattctgcgcgccacc

SEQ ID NO: 108726 - DNA, 25 bp, Homo sapien
cggcctcctctgtgaatcgttgctt

SEQ ID NO: 108727 - DNA, 25 bp, Homo sapien
aataggccaatcagcgtccagactc

SEQ ID NO: 108728 - DNA, 25 bp, Homo sapien
gtccagactcttcagctacggcagt

SEQ ID NO: 108729 - DNA, 25 bp, Homo sapien
ccgtggcgtcacaagctactatata

SEQ ID NO: 108730 - DNA, 25 bp, Homo sapien
gctgccaccgaaagatgggacctga

SEQ ID NO: 108731 - DNA, 25 bp, Homo sapien
tactatataaaaggcggtgcccgcc

SEQ ID NO: 108732 - DNA, 25 bp, Homo sapien
accgaaagatgggacctgaagacag

SEQ ID NO: 108733 - DNA, 25 bp, Homo sapien
tgtgggaaaagctccgtggcgtcac

SEQ ID NO: 108734 - DNA, 25 bp, Homo sapien
ctcgtcaagtgtgggaaaagctccg

SEQ ID NO: 108735 - DNA, 25 bp, Homo sapien
cccagttagactgctcgtcaagtgt

SEQ ID NO: 108736 - DNA, 25 bp, Homo sapien
agcgcgacacggagactaggtggca

SEQ ID NO: 108737 - DNA, 25 bp, Homo sapien
ggacgcaggacgagaggacacccct

SEQ ID NO: 108738 - DNA, 25 bp, Homo sapien
ttcgagccgcgtgtacgtactggag

SEQ ID NO: 108739 - DNA, 25 bp, Homo sapien
cagactgggccgggaatccacctca

SEQ ID NO: 108740 - DNA, 25 bp, Homo sapien
tccaggtgaccctagttccctaaga

SEQ ID NO: 108741 - DNA, 25 bp, Homo sapien
cgccggtctcacgaggaacagcgcg

SEQ ID NO: 108742 - DNA, 25 bp, Homo sapien
gccacgggcaccttgtgcgggtcct

SEQ ID NO: 108743 - DNA, 25 bp, Homo sapien
gggcagctagggaactggcccaaga

SEQ ID NO: 108744 - DNA, 25 bp, Homo sapien
gtgaccctagttccctaagatcgcc

SEQ ID NO: 108745 - DNA, 25 bp, Homo sapien
tttgacgtcacggtacccaccatgg

SEQ ID NO: 108746 - DNA, 25 bp, Homo sapien
gacgtcacggtacccaccatggtgc

SEQ ID NO: 108747 - DNA, 25 bp, Homo sapien
aaaccgaagcgcgagcccgcgcgtg

SEQ ID NO: 108748 - DNA, 25 bp, Homo sapien
cagcgggaagcgacgcagaaagctc

SEQ ID NO: 108749 - DNA, 25 bp, Homo sapien
cgacgcagaaagctccaagcgctga

SEQ ID NO: 108750 - DNA, 25 bp, Homo sapien
agctccaagcgctgacgggcaaagc

SEQ ID NO: 108751 - DNA, 25 bp, Homo sapien
gcggaccctagcctgggctgccaga

SEQ ID NO: 108752 - DNA, 25 bp, Homo sapien
ctgacgggcaaagcgcggccgactt

SEQ ID NO: 108753 - DNA, 25 bp, Homo sapien
gccgggacttgccaaccgcacccga

SEQ ID NO: 108754 - DNA, 25 bp, Homo sapien
aaccgcaggtttggttcgcgcacgc

SEQ ID NO: 108755 - DNA, 25 bp, Homo sapien
ttggttcgcgcacgccgggacttgc

SEQ ID NO: 108756 - DNA, 25 bp, Homo sapien
caaatgtttcgcttcgctgccggca

SEQ ID NO: 108757 - DNA, 25 bp, Homo sapien
aatcggggccatgtccaaatgtttc

SEQ ID NO: 108758 - DNA, 25 bp, Homo sapien
tcctgggatcaactgcacagtcctg

SEQ ID NO: 108759 - DNA, 25 bp, Homo sapien
gggccatgtccaaatgtttcgcttc

SEQ ID NO: 108760 - DNA, 25 bp, Homo sapien
ccgcacccgaaaaatcggggccatg

SEQ ID NO: 108761 - DNA, 25 bp, Homo sapien
ctgaacccgcagaacaccgtgtttg

SEQ ID NO: 108762 - DNA, 25 bp, Homo sapien
aaagccgcggcgatcggcatcgacc

SEQ ID NO: 108763 - DNA, 25 bp, Homo sapien
cgtgtttgacgcgaagcggctgatt

SEQ ID NO: 108764 - DNA, 25 bp, Homo sapien
ggcctttccaggtgatcaacgacgg

SEQ ID NO: 108765 - DNA, 25 bp, Homo sapien
tcctgacgatcgacgacggcatctt

SEQ ID NO: 108766 - DNA, 25 bp, Homo sapien
gcctggagatcgactccctgtttga

SEQ ID NO: 108767 - DNA, 25 bp, Homo sapien
cctgtttgagggcatcgacttctac

SEQ ID NO: 108768 - DNA, 25 bp, Homo sapien
caagaaccaggtggcgctgaacccg

SEQ ID NO: 108769 - DNA, 25 bp, Homo sapien
ttctttttgcgaagtgggctcgtgg

SEQ ID NO: 108770 - DNA, 25 bp, Homo sapien
cgcgcgtctagccaggcagataaga

SEQ ID NO: 108771 - DNA, 25 bp, Homo sapien
ctagccaggcagataagaaaacaac

SEQ ID NO: 108772 - DNA, 25 bp, Homo sapien
cgccattttagttctttttgcgaag

SEQ ID NO: 108773 - DNA, 25 bp, Homo sapien
cagtatgagagttgtaatggcccga

SEQ ID NO: 108774 - DNA, 25 bp, Homo sapien
agcaggggatcccaacggcttgcgc

SEQ ID NO: 108775 - DNA, 25 bp, Homo sapien
caacggcttgcgctgcctttgcgca

SEQ ID NO: 108776 - DNA, 25 bp, Homo sapien
ttgtaatggcccgactgttgagtga

SEQ ID NO: 108777 - DNA, 25 bp, Homo sapien
ggcaccatccttattgggctttttg

SEQ ID NO: 108778 - DNA, 25 bp, Homo sapien
tggggctatgcaaagggtgactcac

SEQ ID NO: 108779 - DNA, 25 bp, Homo sapien
agaccgaagtcgttctcagccttgg

SEQ ID NO: 108780 - DNA, 25 bp, Homo sapien
gaccctggcagctagactccacaga

SEQ ID NO: 108781 - DNA, 25 bp, Homo sapien
tgacccggaccctttaaagcgcaga

SEQ ID NO: 108782 - DNA, 25 bp, Homo sapien
agcgcagatgtcacccttaagcccg

SEQ ID NO: 108783 - DNA, 25 bp, Homo sapien
tgatcacgcagcatctcgaagcttg

SEQ ID NO: 108784 - DNA, 25 bp, Homo sapien
tggtcttcaagtagctcatctcctc

SEQ ID NO: 108785 - DNA, 25 bp, Homo sapien
gggcacccaaaagcagcagagcctc

SEQ ID NO: 108786 - DNA, 25 bp, Homo sapien
cgtgggtacatgcaggtggacatgc

SEQ ID NO: 108787 - DNA, 25 bp, Homo sapien
ctggagggcacccaaaagcagcaga

SEQ ID NO: 108788 - DNA, 25 bp, Homo sapien
ctgtcttttcgccatttcttcttgg

SEQ ID NO: 108789 - DNA, 25 bp, Homo sapien
ccatgggctgtcttttcgccatttc

SEQ ID NO: 108790 - DNA, 25 bp, Homo sapien
cgagacggcttcacccatgggctgt

SEQ ID NO: 108791 - DNA, 25 bp, Homo sapien
cttgcgccgtttccgagacggcttc

SEQ ID NO: 108792 - DNA, 25 bp, Homo sapien
agcctcctcacctcgtggctccttg

SEQ ID NO: 108793 - DNA, 25 bp, Homo sapien
ttgcacccccggagcattgcacggg

SEQ ID NO: 108794 - DNA, 25 bp, Homo sapien
tggattgctgcaagtcccgcccggg

SEQ ID NO: 108795 - DNA, 25 bp, Homo sapien
ctgcacgcgcgcctccgtgcccact

SEQ ID NO: 108796 - DNA, 25 bp, Homo sapien
tctcggtagaccccgcatctctggg

SEQ ID NO: 108797 - DNA, 25 bp, Homo sapien
cccggcgcccgtcgcccactcaggg

SEQ ID NO: 108798 - DNA, 25 bp, Homo sapien
cctcgtgcccctcacgcgtgctcct

SEQ ID NO: 108799 - DNA, 25 bp, Homo sapien
gtgctggccccctggattgctgcaa

SEQ ID NO: 108800 - DNA, 25 bp, Homo sapien
ctggattgctgcaagtcccgcccgg

SEQ ID NO: 108801 - DNA, 25 bp, Homo sapien
ttgggaaggaaaccggtcagagaca

SEQ ID NO: 108802 - DNA, 25 bp, Homo sapien
cgccagagcggaaatacgttccaca

SEQ ID NO: 108803 - DNA, 25 bp, Homo sapien
ccgggattatttgtccgccagagcg

SEQ ID NO: 108804 - DNA, 25 bp, Homo sapien
ctctttggccgggattatttgtccg

SEQ ID NO: 108805 - DNA, 25 bp, Homo sapien
tttaccggctgcctcattcctccgc

SEQ ID NO: 108806 - DNA, 25 bp, Homo sapien
ggtcttcagatttcttcctcagttt

SEQ ID NO: 108807 - DNA, 25 bp, Homo sapien
ggcatccgatctcccggtcttcaga

SEQ ID NO: 108808 - DNA, 25 bp, Homo sapien
ggtcagagacaaaggtctctggctc

SEQ ID NO: 108809 - DNA, 25 bp, Homo sapien
tgccgcggaaacgaaagtaacgctc

SEQ ID NO: 108810 - DNA, 25 bp, Homo sapien
acgaaagtaacgctcgggtgcttgc

SEQ ID NO: 108811 - DNA, 25 bp, Homo sapien
gtctctgcttatccggagtccgctg

SEQ ID NO: 108812 - DNA, 25 bp, Homo sapien
gcttgaaaacaaagtccgcgatcct

SEQ ID NO: 108813 - DNA, 25 bp, Homo sapien
cgcgatcctctagcccgcaagagag

SEQ ID NO: 108814 - DNA, 25 bp, Homo sapien
gcgactccaggggacccacagctgg

SEQ ID NO: 108815 - DNA, 25 bp, Homo sapien
ggcctccagacgtttgccgcggaaa

SEQ ID NO: 108816 - DNA, 25 bp, Homo sapien
tgctccgctaggtgtctctgcttat

SEQ ID NO: 108817 - DNA, 25 bp, Homo sapien
gctgatagcgggctcacaacgatga

SEQ ID NO: 108818 - DNA, 25 bp, Homo sapien
gggctgtaccggaagttgcctctac

SEQ ID NO: 108819 - DNA, 25 bp, Homo sapien
gagtgagaagcagagggccttaccc

SEQ ID NO: 108820 - DNA, 25 bp, Homo sapien
cgcccgcagagcaacgcaaagagga

SEQ ID NO: 108821 - DNA, 25 bp, Homo sapien
cctcgctagggtaaggacaaccgcg

SEQ ID NO: 108822 - DNA, 25 bp, Homo sapien
tccgcagcgatagttcacgctctcg

SEQ ID NO: 108823 - DNA, 25 bp, Homo sapien
gggcttacttcgcagcgactacttg

SEQ ID NO: 108824 - DNA, 25 bp, Homo sapien
tcggaaagacgatggcacccgaccc

SEQ ID NO: 108825 - DNA, 25 bp, Homo sapien
cctagactgcgaggaggctctaatt

SEQ ID NO: 108826 - DNA, 25 bp, Homo sapien
ggcatccgcacacagactcagtttc

SEQ ID NO: 108827 - DNA, 25 bp, Homo sapien
catgcgccactgagttttatcgagc

SEQ ID NO: 108828 - DNA, 25 bp, Homo sapien
ctcggcgcctagaaccgaaagtgga

SEQ ID NO: 108829 - DNA, 25 bp, Homo sapien
aggagctgcagatcttcggcctaga

SEQ ID NO: 108830 - DNA, 25 bp, Homo sapien
agtatttctctgtgaccgacggccg

SEQ ID NO: 108831 - DNA, 25 bp, Homo sapien
tctgccaccgtcactgagaagctca

SEQ ID NO: 108832 - DNA, 25 bp, Homo sapien
gttgcgagtcacaaccggcattctc

SEQ ID NO: 108833 - DNA, 25 bp, Homo sapien
ctgatcccggagacctttggagtta

SEQ ID NO: 108834 - DNA, 25 bp, Homo sapien
tccggtagccgagagttttgttaga

SEQ ID NO: 108835 - DNA, 25 bp, Homo sapien
tctgcgccggaagaccctattttca

SEQ ID NO: 108836 - DNA, 25 bp, Homo sapien
gctcctttcgtcatcacctggtcta

SEQ ID NO: 108837 - DNA, 25 bp, Homo sapien
ggacgacaagttgacgctcctttcg

SEQ ID NO: 108838 - DNA, 25 bp, Homo sapien
gatgcaatcattcagcgacagtggc

SEQ ID NO: 108839 - DNA, 25 bp, Homo sapien
actcatgcagctgttcccgcgaggc

SEQ ID NO: 108840 - DNA, 25 bp, Homo sapien
ttccctgtccgtgagccgatttatc

SEQ ID NO: 108841 - DNA, 25 bp, Homo sapien
atccctgtccttgtactgcacggtg

SEQ ID NO: 108842 - DNA, 25 bp, Homo sapien
gggaggatcctgtcactgtcagctc

SEQ ID NO: 108843 - DNA, 25 bp, Homo sapien
gctcagcgaatcaggggaggatcct

SEQ ID NO: 108844 - DNA, 25 bp, Homo sapien
cggtccagaagaggctcagcgaatc

SEQ ID NO: 108845 - DNA, 25 bp, Homo sapien
ccttgtactgcacggtgaaagagtc

SEQ ID NO: 108846 - DNA, 25 bp, Homo sapien
atcttgtacttgtgcccgggctcta

SEQ ID NO: 108847 - DNA, 25 bp, Homo sapien
tggaggccgtacaggtgcatcttgt

SEQ ID NO: 108848 - DNA, 25 bp, Homo sapien
acggtgaaagagtcgaagctgccct

SEQ ID NO: 108849 - DNA, 25 bp, Homo sapien
aggtcctgcaccgtgccgcggaaac

SEQ ID NO: 108850 - DNA, 25 bp, Homo sapien
cgccaccgacgtgtaagtctggttg

SEQ ID NO: 108851 - DNA, 25 bp, Homo sapien
gccttcaggcgagaggccgtagatt

SEQ ID NO: 108852 - DNA, 25 bp, Homo sapien
agaggccgtagattccctggttgga

SEQ ID NO: 108853 - DNA, 25 bp, Homo sapien
gtcccgtttcctggtgccgggatca

SEQ ID NO: 108854 - DNA, 25 bp, Homo sapien
cagacgccgctgcaagtattcatgg

SEQ ID NO: 108855 - DNA, 25 bp, Homo sapien
gtattcatggatgtggcgcgccacc

SEQ ID NO: 108856 - DNA, 25 bp, Homo sapien
cgagagacacgagaagcgcgccatc

SEQ ID NO: 108857 - DNA, 25 bp, Homo sapien
actcacgtagccttcccaacagatg

SEQ ID NO: 108858 - DNA, 25 bp, Homo sapien
cggggttacacacgcagcgcccatt

SEQ ID NO: 108859 - DNA, 25 bp, Homo sapien
gcgtaccacagtcctcgccagtgta

SEQ ID NO: 108860 - DNA, 25 bp, Homo sapien
tgtagcccgtgtcgcaaatgcattc

SEQ ID NO: 108861 - DNA, 25 bp, Homo sapien
ccctttggttgcagtcgccagggca

SEQ ID NO: 108862 - DNA, 25 bp, Homo sapien
gcgagccgcaatcggttccagtgta

SEQ ID NO: 108863 - DNA, 25 bp, Homo sapien
cacacgccgtgctggctgcagtcat

SEQ ID NO: 108864 - DNA, 25 bp, Homo sapien
cgctgtagcccgcattgcaaacaca

SEQ ID NO: 108865 - DNA, 25 bp, Homo sapien
ggcggaacaactgggaaagatactg

SEQ ID NO: 108866 - DNA, 25 bp, Homo sapien
gtcaataagtacctgcgcggccaaa

SEQ ID NO: 108867 - DNA, 25 bp, Homo sapien
tccttccaaagctaaatggctactg

SEQ ID NO: 108868 - DNA, 25 bp, Homo sapien
ggagccgggccattcgaatcacctc

SEQ ID NO: 108869 - DNA, 25 bp, Homo sapien
cgcggccaaagtgcctagcatggtg

SEQ ID NO: 108870 - DNA, 25 bp, Homo sapien
gatactgacaactaaccctggagcc

SEQ ID NO: 108871 - DNA, 25 bp, Homo sapien
aggtagccgcgccaactacggacac

SEQ ID NO: 108872 - DNA, 25 bp, Homo sapien
atggctactgaatgctgccctcgga

SEQ ID NO: 108873 - DNA, 25 bp, Homo sapien
gaactggattccgagcttgctcgca

SEQ ID NO: 108874 - DNA, 25 bp, Homo sapien
tccgcggtatgactgcagaaagagc

SEQ ID NO: 108875 - DNA, 25 bp, Homo sapien
tttagggatcccagtagttctcgtg

SEQ ID NO: 108876 - DNA, 25 bp, Homo sapien
actacggtgaggatggtacagagca

SEQ ID NO: 108877 - DNA, 25 bp, Homo sapien
gtgaagcgatctcggccgacaccat

SEQ ID NO: 108878 - DNA, 25 bp, Homo sapien
aggtcaaagagctgcggcctcgttc

SEQ ID NO: 108879 - DNA, 25 bp, Homo sapien
tgctcgcaaggcgagacgttccgtg

SEQ ID NO: 108880 - DNA, 25 bp, Homo sapien
tacgatgtatccaagtctgacggcc

SEQ ID NO: 108881 - DNA, 25 bp, Homo sapien
taagcagtgcaaggctgcagctgca

SEQ ID NO: 108882 - DNA, 25 bp, Homo sapien
agcgagtctcctgcaggtaagggtc

SEQ ID NO: 108883 - DNA, 25 bp, Homo sapien
cctcgaagcgagtctcctgcaggta

SEQ ID NO: 108884 - DNA, 25 bp, Homo sapien
ccctctttcccatgtccctgtctgc

SEQ ID NO: 108885 - DNA, 25 bp, Homo sapien
cccagcggcagcgtgcccacagtcc

SEQ ID NO: 108886 - DNA, 25 bp, Homo sapien
ccggcacgtaagcagtgcaaggctg

SEQ ID NO: 108887 - DNA, 25 bp, Homo sapien
tgcccaccgggtagaccggcacgta

SEQ ID NO: 108888 - DNA, 25 bp, Homo sapien
aagtgggccctcgaagcgagtctcc

SEQ ID NO: 108889 - DNA, 25 bp, Homo sapien
ggtcctgcttctgttgcctttcctg

SEQ ID NO: 108890 - DNA, 25 bp, Homo sapien
cctacaagccggtcatcgtggtgca

SEQ ID NO: 108891 - DNA, 25 bp, Homo sapien
ggctgctgctcacgggtattaaaga

SEQ ID NO: 108892 - DNA, 25 bp, Homo sapien
gggtgttgccatctccctcacatgc

SEQ ID NO: 108893 - DNA, 25 bp, Homo sapien
catgggctcttcgacagctcgtaca

SEQ ID NO: 108894 - DNA, 25 bp, Homo sapien
agtaggctattttgtgacacggacc

SEQ ID NO: 108895 - DNA, 25 bp, Homo sapien
agaactccgcgttgttcatggctga

SEQ ID NO: 108896 - DNA, 25 bp, Homo sapien
ccaggtgggagtctgcactcttcaa

SEQ ID NO: 108897 - DNA, 25 bp, Homo sapien
gcgcgctctgaagcaggagattcac

SEQ ID NO: 108898 - DNA, 25 bp, Homo sapien
tgttccaggaccatgtaccgcgtta

SEQ ID NO: 108899 - DNA, 25 bp, Homo sapien
ggaggttcagcagacccatgcagtg

SEQ ID NO: 108900 - DNA, 25 bp, Homo sapien
ctgcgccaagccttgcctgaacgga

SEQ ID NO: 108901 - DNA, 25 bp, Homo sapien
ctctgctcgcaccattgttttaata

SEQ ID NO: 108902 - DNA, 25 bp, Homo sapien
ttttaatacggcaggcagcttcacc

SEQ ID NO: 108903 - DNA, 25 bp, Homo sapien
ccagcatactcagcgtggccggtga

SEQ ID NO: 108904 - DNA, 25 bp, Homo sapien
gtggtcacactcttggtctcctttg

SEQ ID NO: 108905 - DNA, 25 bp, Homo sapien
tgccgcacctagtaaccgcagcgcg

SEQ ID NO: 108906 - DNA, 25 bp, Homo sapien
tagtaaccgcagagcgcctacctgc

SEQ ID NO: 108907 - DNA, 25 bp, Homo sapien
ctgccgcacctagtaaccgcagagc

SEQ ID NO: 108908 - DNA, 25 bp, Homo sapien
ctagtaaccgcagagcgcctacctg

SEQ ID NO: 108909 - DNA, 25 bp, Homo sapien
ctacctgccgcacctcggaaccgca

SEQ ID NO: 108910 - DNA, 25 bp, Homo sapien
acctgccgcacctagtaaccgcaga

SEQ ID NO: 108911 - DNA, 25 bp, Homo sapien
tgccgcacctagtaaccgcagagcg

SEQ ID NO: 108912 - DNA, 25 bp, Homo sapien
acctgccgcacctcggaaccgcaga

SEQ ID NO: 108913 - DNA, 25 bp, Homo sapien
gttctgccctccattttgtgtccgg

SEQ ID NO: 108914 - DNA, 25 bp, Homo sapien
actctgtaagttcaccgccggtcgg

SEQ ID NO: 108915 - DNA, 25 bp, Homo sapien
actcagttcctttcgagggctccta

SEQ ID NO: 108916 - DNA, 25 bp, Homo sapien
ggctcctcccagagcttggagacta

SEQ ID NO: 108917 - DNA, 25 bp, Homo sapien
gggccgtatttttagccgatagtga

SEQ ID NO: 108918 - DNA, 25 bp, Homo sapien
tcctatctttagctgcggccgcgaa

SEQ ID NO: 108919 - DNA, 25 bp, Homo sapien
ggccgcgaatgtcctgaaacggatc

SEQ ID NO: 108920 - DNA, 25 bp, Homo sapien
tgccgagcggacactaggacatcgc

SEQ ID NO: 108921 - DNA, 25 bp, Homo sapien
cgcagccaagtctacggaccaagtc

SEQ ID NO: 108922 - DNA, 25 bp, Homo sapien
gcgcatgcctgcagaaaacctacgg

SEQ ID NO: 108923 - DNA, 25 bp, Homo sapien
ccttcaggctttgcgggttaccgca

SEQ ID NO: 108924 - DNA, 25 bp, Homo sapien
tcacagggccagtcatccgttgaga

SEQ ID NO: 108925 - DNA, 25 bp, Homo sapien
agcgtcagcagatcccagtggttac

SEQ ID NO: 108926 - DNA, 25 bp, Homo sapien
tttccatctctcgtgcgcctgactg

SEQ ID NO: 108927 - DNA, 25 bp, Homo sapien
tgtcctgggcatctttatcggctcc

SEQ ID NO: 108928 - DNA, 25 bp, Homo sapien
cccagtgcagcgcagttttccctag

SEQ ID NO: 108929 - DNA, 25 bp, Homo sapien
tgtctctgtgcaggaaccgcacccg

SEQ ID NO: 108930 - DNA, 25 bp, Homo sapien
cttggttatagatgtctctgtgcag

SEQ ID NO: 108931 - DNA, 25 bp, Homo sapien
gcgggcactggaaccttaactgatc

SEQ ID NO: 108932 - DNA, 25 bp, Homo sapien
ggaagatactgacagagacgccgcc

SEQ ID NO: 108933 - DNA, 25 bp, Homo sapien
cctccggggaagatactgacagaga

SEQ ID NO: 108934 - DNA, 25 bp, Homo sapien
tacttatcctgctgcaagaaacgtg

SEQ ID NO: 108935 - DNA, 25 bp, Homo sapien
atgacactcatacttatcctgctgc

SEQ ID NO: 108936 - DNA, 25 bp, Homo sapien
ggaaccttaactgatcccaaccata

SEQ ID NO: 108937 - DNA, 25 bp, Homo sapien
ctccctcttaggctgccacaggaaa

SEQ ID NO: 108938 - DNA, 25 bp, Homo sapien
cttaggctgccacaggaaacgtgct

SEQ ID NO: 108939 - DNA, 25 bp, Homo sapien
ccctcttaggctgccacaggaaacg

SEQ ID NO: 108940 - DNA, 25 bp, Homo sapien
tcttaggctgccacaggaaacgtgc

SEQ ID NO: 108941 - DNA, 25 bp, Homo sapien
ttaggctgccacaggaaacgtgctg

SEQ ID NO: 108942 - DNA, 25 bp, Homo sapien
acgaaccatccggtcacagggcggc

SEQ ID NO: 108943 - DNA, 25 bp, Homo sapien
gaagaaatgacactccctcttaggc

SEQ ID NO: 108944 - DNA, 25 bp, Homo sapien
taggctgccacaggaaacgtgctgt

SEQ ID NO: 108945 - DNA, 25 bp, Homo sapien
gcaagctgcgcacgtgggccttgct

SEQ ID NO: 108946 - DNA, 25 bp, Homo sapien
cggaacgccacctcgtagttgtgtc

SEQ ID NO: 108947 - DNA, 25 bp, Homo sapien
acacataaggcacgaggcgagaaac

SEQ ID NO: 108948 - DNA, 25 bp, Homo sapien
gggctcagatttcagagacctcgcc

SEQ ID NO: 108949 - DNA, 25 bp, Homo sapien
tcccggcacagaaactcggggtctc

SEQ ID NO: 108950 - DNA, 25 bp, Homo sapien
tgtatctggtcacaagacgcacgcg

SEQ ID NO: 108951 - DNA, 25 bp, Homo sapien
tggaacacgaaatcctctgcgggga

SEQ ID NO: 108952 - DNA, 25 bp, Homo sapien
tctgcggggaatcaccggccggtca

SEQ ID NO: 108953 - DNA, 25 bp, Homo sapien
tgcgaaacccgtccacgcgaaattg

SEQ ID NO: 108954 - DNA, 25 bp, Homo sapien
ccttgccgctgcaaggtcgtgcgca

SEQ ID NO: 108955 - DNA, 25 bp, Homo sapien
gctcctgctccaagaagtccttata

SEQ ID NO: 108956 - DNA, 25 bp, Homo sapien
gtccttatagttgttccagtcctcg

SEQ ID NO: 108957 - DNA, 25 bp, Homo sapien
tatagatgtatctggccacaccgcg

SEQ ID NO: 108958 - DNA, 25 bp, Homo sapien
aaatcctctgcggagaatcacggcg

SEQ ID NO: 108959 - DNA, 25 bp, Homo sapien
cgaaattgagttcttggctgggccc

SEQ ID NO: 108960 - DNA, 25 bp, Homo sapien
cctctgtgcgcaagagactcgggcc

SEQ ID NO: 108961 - DNA, 25 bp, Homo sapien
ttcagcgctgaggtccgctccgtct

SEQ ID NO: 108962 - DNA, 25 bp, Homo sapien
tcgggcagctttcgctttcgcttcc

SEQ ID NO: 108963 - DNA, 25 bp, Homo sapien
tgcgtccctgttggcgctccaggtt

SEQ ID NO: 108964 - DNA, 25 bp, Homo sapien
ccaaggccttcattctgggctgggc

SEQ ID NO: 108965 - DNA, 25 bp, Homo sapien
tcctatcgccgggtgcagagggact

SEQ ID NO: 108966 - DNA, 25 bp, Homo sapien
cgcgagacccgcagacagcggaact

SEQ ID NO: 108967 - DNA, 25 bp, Homo sapien
cagcggaactggagcccgaactctg

SEQ ID NO: 108968 - DNA, 25 bp, Homo sapien
gggacttctgcttcagcgctgaggt

SEQ ID NO: 108969 - DNA, 25 bp, Homo sapien
tccgctctcggaggaggaagtgaaa

SEQ ID NO: 108970 - DNA, 25 bp, Homo sapien
acccagagatctgtccgctctcgga

SEQ ID NO: 108971 - DNA, 25 bp, Homo sapien
ggtaaagcgagctctggagatcgca

SEQ ID NO: 108972 - DNA, 25 bp, Homo sapien
ctggagatcgcatagagaaactgta

SEQ ID NO: 108973 - DNA, 25 bp, Homo sapien
aaactgtagtgtcctgggtccgagc

SEQ ID NO: 108974 - DNA, 25 bp, Homo sapien
cgcaaccgggagagccgattccggc

SEQ ID NO: 108975 - DNA, 25 bp, Homo sapien
ggggctccgcatacatctagtagcg

SEQ ID NO: 108976 - DNA, 25 bp, Homo sapien
atctagtagcgccatgaccgcccag

SEQ ID NO: 108977 - DNA, 25 bp, Homo sapien
cccagtcggcgagaagtagcagtac

SEQ ID NO: 108978 - DNA, 25 bp, Homo sapien
cgctggcgagaagctcagccattta

SEQ ID NO: 108979 - DNA, 25 bp, Homo sapien
gtgcgctgtcccaggttggaaacca

SEQ ID NO: 108980 - DNA, 25 bp, Homo sapien
agcagccctggtgcccaattttctc

SEQ ID NO: 108981 - DNA, 25 bp, Homo sapien
tggtagcaagcgtggaaatcagatc

SEQ ID NO: 108982 - DNA, 25 bp, Homo sapien
ggcagatctgccctacacacgttag

SEQ ID NO: 108983 - DNA, 25 bp, Homo sapien
cctcgtcacttgtctcggggcagat

SEQ ID NO: 108984 - DNA, 25 bp, Homo sapien
gggcacctgcgttttcgctcttgga

SEQ ID NO: 108985 - DNA, 25 bp, Homo sapien
ccgacgccagactcaagcggggaaa

SEQ ID NO: 108986 - DNA, 25 bp, Homo sapien
cgccagactcaagcggggaaaagcg

SEQ ID NO: 108987 - DNA, 25 bp, Homo sapien
ggagcggttgtcaagacacaatgac

SEQ ID NO: 108988 - DNA, 25 bp, Homo sapien
gtaccggagcggttgtcaagacaca

SEQ ID NO: 108989 - DNA, 25 bp, Homo sapien
ggtcggcactagcagagaccagcag

SEQ ID NO: 108990 - DNA, 25 bp, Homo sapien
ccgcgaacagaagggtcggcactag

SEQ ID NO: 108991 - DNA, 25 bp, Homo sapien
aagtcgtagaggtgttgtccttcag

SEQ ID NO: 108992 - DNA, 25 bp, Homo sapien
ggaaaagcgggcctagagctccagg

SEQ ID NO: 108993 - DNA, 25 bp, Homo sapien
cgccgcctgcactgaaaggtctgta

SEQ ID NO: 108994 - DNA, 25 bp, Homo sapien
gtacctgagcctggatacttgaaca

SEQ ID NO: 108995 - DNA, 25 bp, Homo sapien
taggtacctattgtgcggagtctcg

SEQ ID NO: 108996 - DNA, 25 bp, Homo sapien
ccgccgatcccaaggaggcaatctg

SEQ ID NO: 108997 - DNA, 25 bp, Homo sapien
ccgagccctgattgacgttcagcca

SEQ ID NO: 108998 - DNA, 25 bp, Homo sapien
gggaacacctgcctaccctagaaga

SEQ ID NO: 108999 - DNA, 25 bp, Homo sapien
tgggaccaggaaaaacgcagactct

SEQ ID NO: 109000 - DNA, 25 bp, Homo sapien
tctcggaacgcctgcctggaagaag

SEQ ID NO: 109001 - DNA, 25 bp, Homo sapien
gactccggagaagacgttgcgcttc

SEQ ID NO: 109002 - DNA, 25 bp, Homo sapien
tctttggaaacttgtggaggccctg

SEQ ID NO: 109003 - DNA, 25 bp, Homo sapien
ccgcgaacaggcgtaaagctctttc

SEQ ID NO: 109004 - DNA, 25 bp, Homo sapien
gctctttcttcagtgctcgctctag

SEQ ID NO: 109005 - DNA, 25 bp, Homo sapien
agctgtgagtggtcgtttctttctc

SEQ ID NO: 109006 - DNA, 25 bp, Homo sapien
ctttctctcctagggcggcaggttt

SEQ ID NO: 109007 - DNA, 25 bp, Homo sapien
agctccgggatgcatgccaatctcc

SEQ ID NO: 109008 - DNA, 25 bp, Homo sapien
cccgggaaagccatgttgcgactcc

SEQ ID NO: 109009 - DNA, 25 bp, Homo sapien
cgcgttcgggtaatggcggccacct

SEQ ID NO: 109010 - DNA, 25 bp, Homo sapien
ttccaggactgcgaaaccacgagcc

SEQ ID NO: 109011 - DNA, 25 bp, Homo sapien
cgcgtgccgacagcaggagttcccg

SEQ ID NO: 109012 - DNA, 25 bp, Homo sapien
acgagccgagtttcggtcgcccatg

SEQ ID NO: 109013 - DNA, 25 bp, Homo sapien
gtcgcccatgggaaagcacccggca

SEQ ID NO: 109014 - DNA, 25 bp, Homo sapien
acggggacactcatcccgggagcca

SEQ ID NO: 109015 - DNA, 25 bp, Homo sapien
agctacgcgacctgtgaccatggtg

SEQ ID NO: 109016 - DNA, 25 bp, Homo sapien
gtaccgcgcttggtcttagcgcatg

SEQ ID NO: 109017 - DNA, 25 bp, Homo sapien
ttatagcgctctgggtttcgggaca

SEQ ID NO: 109018 - DNA, 25 bp, Homo sapien
gcagcgtgcgcttccgctggattca

SEQ ID NO: 109019 - DNA, 25 bp, Homo sapien
ctgcggcagccatgctgaactcgta

SEQ ID NO: 109020 - DNA, 25 bp, Homo sapien
gggatatggacaagcagcagcgtta

SEQ ID NO: 109021 - DNA, 25 bp, Homo sapien
tcgcaccacacgacaccagggaagg

SEQ ID NO: 109022 - DNA, 25 bp, Homo sapien
aacgttcggaaagctggtcctcgtg

SEQ ID NO: 109023 - DNA, 25 bp, Homo sapien
cccggtcagccaatctgggtgctgc

SEQ ID NO: 109024 - DNA, 25 bp, Homo sapien
agaccctcatatctccaggtccagg

SEQ ID NO: 109025 - DNA, 25 bp, Homo sapien
ctggaggattctgcctaccgataca

SEQ ID NO: 109026 - DNA, 25 bp, Homo sapien
aaagagactgctttcgtgccggcca

SEQ ID NO: 109027 - DNA, 25 bp, Homo sapien
agcgggctatattgacgacggtgtc

SEQ ID NO: 109028 - DNA, 25 bp, Homo sapien
ccctgcagaccaacagcgggctata

SEQ ID NO: 109029 - DNA, 25 bp, Homo sapien
tatgacgtcatcgttgcggctggcc

SEQ ID NO: 109030 - DNA, 25 bp, Homo sapien
catccgcttggaaatggccttcgtc

SEQ ID NO: 109031 - DNA, 25 bp, Homo sapien
ggccaatagaaaaagctcccgcgga

SEQ ID NO: 109032 - DNA, 25 bp, Homo sapien
cgccctcaagaggatttcaaagatg

SEQ ID NO: 109033 - DNA, 25 bp, Homo sapien
ccgccctgcgggtcaaagcgggcaa

SEQ ID NO: 109034 - DNA, 25 bp, Homo sapien
agcgggcaaagtcaccaaactcagg

SEQ ID NO: 109035 - DNA, 25 bp, Homo sapien
ggatgtccagatgggctttgattgc

SEQ ID NO: 109036 - DNA, 25 bp, Homo sapien
ccaccaggatgtccagatgggcttt

SEQ ID NO: 109037 - DNA, 25 bp, Homo sapien
ggccggtaccgttgatggctctgct

SEQ ID NO: 109038 - DNA, 25 bp, Homo sapien
agtttctctggaccttcccgcctga

SEQ ID NO: 109039 - DNA, 25 bp, Homo sapien
ccagagtgatgggagcctaggaact

SEQ ID NO: 109040 - DNA, 25 bp, Homo sapien
ctaggaactgggaggaagtttctct

SEQ ID NO: 109041 - DNA, 25 bp, Homo sapien
tgccggacaggatgtgcagacacaa

SEQ ID NO: 109042 - DNA, 25 bp, Homo sapien
gacggcaggaatgctacgcgtttaa

SEQ ID NO: 109043 - DNA, 25 bp, Homo sapien
cccgcagagaattaccttttccagg

SEQ ID NO: 109044 - DNA, 25 bp, Homo sapien
ccttttccagggacggcaggaatgc

SEQ ID NO: 109045 - DNA, 25 bp, Homo sapien
cgcgtttaatgggacacagcgcttc

SEQ ID NO: 109046 - DNA, 25 bp, Homo sapien
acagcgcttcctggagagatacatc

SEQ ID NO: 109047 - DNA, 25 bp, Homo sapien
tacaaccgggaggagttcgcgcgct

SEQ ID NO: 109048 - DNA, 25 bp, Homo sapien
ctggagagatacatctacaaccggg

SEQ ID NO: 109049 - DNA, 25 bp, Homo sapien
tgatggagccactcatccggcagcg

SEQ ID NO: 109050 - DNA, 25 bp, Homo sapien
aatgctatgcgttcaatgggactca

SEQ ID NO: 109051 - DNA, 25 bp, Homo sapien
tggacgggctcatctacaaccggga

SEQ ID NO: 109052 - DNA, 25 bp, Homo sapien
caaccgggaggaatacgtgcatttt

SEQ ID NO: 109053 - DNA, 25 bp, Homo sapien
tacgtgcattttgacagcgcagtgg

SEQ ID NO: 109054 - DNA, 25 bp, Homo sapien
cggcccataggcgagtacttcaata

SEQ ID NO: 109055 - DNA, 25 bp, Homo sapien
gacacaagtacgagctgatggagcc

SEQ ID NO: 109056 - DNA, 25 bp, Homo sapien
gtctaccaggaacggcaggaatgct

SEQ ID NO: 109057 - DNA, 25 bp, Homo sapien
ggcacgcactcttgattctggcgcc

SEQ ID NO: 109058 - DNA, 25 bp, Homo sapien
agggaccgggattattcagctgacc

SEQ ID NO: 109059 - DNA, 25 bp, Homo sapien
ggagaggcttccaccctcgagaagt

SEQ ID NO: 109060 - DNA, 25 bp, Homo sapien
tcgagaagtttttccgcgcacccgc

SEQ ID NO: 109061 - DNA, 25 bp, Homo sapien
gtctagacgcccacgtggggcttcc

SEQ ID NO: 109062 - DNA, 25 bp, Homo sapien
gcttcctgcgatcgagaatgggttg

SEQ ID NO: 109063 - DNA, 25 bp, Homo sapien
ccgcggatgcgaaaccgggacacaa

SEQ ID NO: 109064 - DNA, 25 bp, Homo sapien
ccgggacacaaaggcacgcactctt

SEQ ID NO: 109065 - DNA, 25 bp, Homo sapien
ctgcaccgctccatggctgagaagc

SEQ ID NO: 109066 - DNA, 25 bp, Homo sapien
gcagcgacagctgtcagcggcccag

SEQ ID NO: 109067 - DNA, 25 bp, Homo sapien
atgagcctcagacgccggggtccca

SEQ ID NO: 109068 - DNA, 25 bp, Homo sapien
gacagggagcagactatgagcctca

SEQ ID NO: 109069 - DNA, 25 bp, Homo sapien
agctccatgcagcaaggcgccgtcg

SEQ ID NO: 109070 - DNA, 25 bp, Homo sapien
tggatgccctgaggctgacagaaga

SEQ ID NO: 109071 - DNA, 25 bp, Homo sapien
acccaggtcggcctgagacgctgga

SEQ ID NO: 109072 - DNA, 25 bp, Homo sapien
tccatggctgagaagccgaaacgcc

SEQ ID NO: 109073 - DNA, 25 bp, Homo sapien
cagggatcgcgtccggagctcccaa

SEQ ID NO: 109074 - DNA, 25 bp, Homo sapien
cctccgggcgggcaacgcctgagaa

SEQ ID NO: 109075 - DNA, 25 bp, Homo sapien
gggcaacgcctgagaagcacgcagc

SEQ ID NO: 109076 - DNA, 25 bp, Homo sapien
gcctgagaagcacgcagcgctcggc

SEQ ID NO: 109077 - DNA, 25 bp, Homo sapien
gggcacgagcgaacaaggcgccttt

SEQ ID NO: 109078 - DNA, 25 bp, Homo sapien
acaaggcgcctttgagaatccaccg

SEQ ID NO: 109079 - DNA, 25 bp, Homo sapien
ccaccctgcgtgcacctcttgggcc

SEQ ID NO: 109080 - DNA, 25 bp, Homo sapien
cccgacaaagcttgccttgtgtccc

SEQ ID NO: 109081 - DNA, 25 bp, Homo sapien
gtcgctaccggagtgccgccatatt

SEQ ID NO: 109082 - DNA, 25 bp, Homo sapien
gaacttcctgttctcgcgggatcta

SEQ ID NO: 109083 - DNA, 25 bp, Homo sapien
cagtgcaggatggattcgtcgctac

SEQ ID NO: 109084 - DNA, 25 bp, Homo sapien
ggcccaagacatgatccctggctga

SEQ ID NO: 109085 - DNA, 25 bp, Homo sapien
cccaaggattgatcggaggattagc

SEQ ID NO: 109086 - DNA, 25 bp, Homo sapien
ttgggtcgaattaagcccgtcgctc

SEQ ID NO: 109087 - DNA, 25 bp, Homo sapien
cgtcgctctgctcagtaccaaaatg

SEQ ID NO: 109088 - DNA, 25 bp, Homo sapien
tgtggcagccatctttgtacagacg

SEQ ID NO: 109089 - DNA, 25 bp, Homo sapien
gccacttccgcaacgtccaatgaaa

SEQ ID NO: 109090 - DNA, 25 bp, Homo sapien
cgccaagtcagctcggcggtcacca

SEQ ID NO: 109091 - DNA, 25 bp, Homo sapien
agaggggctcgacgaaccgccactt

SEQ ID NO: 109092 - DNA, 25 bp, Homo sapien
caacgtccaatgaaacttagccggg

SEQ ID NO: 109093 - DNA, 25 bp, Homo sapien
ggcgccactgaggaccaatctgctt

SEQ ID NO: 109094 - DNA, 25 bp, Homo sapien
ctgaggaccaatctgcttgggccgg

SEQ ID NO: 109095 - DNA, 25 bp, Homo sapien
cccgccgacatactccgggtcgagg

SEQ ID NO: 109096 - DNA, 25 bp, Homo sapien
ggcggtcaccacaccacctacaggg

SEQ ID NO: 109097 - DNA, 25 bp, Homo sapien
ccgccatggcgtctcagctccagaa

SEQ ID NO: 109098 - DNA, 25 bp, Homo sapien
tacccacattttactttctgccctg

SEQ ID NO: 109099 - DNA, 25 bp, Homo sapien
tccggcgtgttctgtcctacctcag

SEQ ID NO: 109100 - DNA, 25 bp, Homo sapien
ttctgtcctacctcaggtgcgggga

SEQ ID NO: 109101 - DNA, 25 bp, Homo sapien
attggcttagtgctgggattcccac

SEQ ID NO: 109102 - DNA, 25 bp, Homo sapien
gctccagaaccgactccgctccgca

SEQ ID NO: 109103 - DNA, 25 bp, Homo sapien
cctctgcgctgggattggcttagtg

SEQ ID NO: 109104 - DNA, 25 bp, Homo sapien
atcggccgagcggtcagtgtacgcc

SEQ ID NO: 109105 - DNA, 25 bp, Homo sapien
cgcacacacgagatgacggccgacg

SEQ ID NO: 109106 - DNA, 25 bp, Homo sapien
cgacggagcgtacactcgagttgat

SEQ ID NO: 109107 - DNA, 25 bp, Homo sapien
gacggagcgtacactcgagttgatg

SEQ ID NO: 109108 - DNA, 25 bp, Homo sapien
ccgacggagcgtacactcgagttga

SEQ ID NO: 109109 - DNA, 25 bp, Homo sapien
cgacggagcgtacactcgagttgac

SEQ ID NO: 109110 - DNA, 25 bp, Homo sapien
agcgcacacacgagatgacggccga

SEQ ID NO: 109111 - DNA, 25 bp, Homo sapien
cacacacgagatgacggccgacgga

SEQ ID NO: 109112 - DNA, 25 bp, Homo sapien
acactcgagttgatggccgacggag

SEQ ID NO: 109113 - DNA, 25 bp, Homo sapien
gccgacttcattcataagcacgtga

SEQ ID NO: 109114 - DNA, 25 bp, Homo sapien
ggtaagtcctgtcaccgccttcaca

SEQ ID NO: 109115 - DNA, 25 bp, Homo sapien
gtcccacggtttcatgccgacttca

SEQ ID NO: 109116 - DNA, 25 bp, Homo sapien
cacggtgagaaggatcctctggtcc

SEQ ID NO: 109117 - DNA, 25 bp, Homo sapien
cctctgaccgcgtagaatggttgca

SEQ ID NO: 109118 - DNA, 25 bp, Homo sapien
tggttgcactaaagcagattcctcg

SEQ ID NO: 109119 - DNA, 25 bp, Homo sapien
cctcgtgctgtgtatccgtcaggta

SEQ ID NO: 109120 - DNA, 25 bp, Homo sapien
cccgccttgattgtgcacggtgaga

SEQ ID NO: 109121 - DNA, 25 bp, Homo sapien
ccgtggttccctaagtggcgcagaa

SEQ ID NO: 109122 - DNA, 25 bp, Homo sapien
gtagcccttttcacgagccctctgt

SEQ ID NO: 109123 - DNA, 25 bp, Homo sapien
accgagcgaacttggcccaggagcc

SEQ ID NO: 109124 - DNA, 25 bp, Homo sapien
attctcgagtctatggctccggccg

SEQ ID NO: 109125 - DNA, 25 bp, Homo sapien
ggacctaggtgtgttctcaggacta

SEQ ID NO: 109126 - DNA, 25 bp, Homo sapien
ctcaggactagaaggctaaagcggc

SEQ ID NO: 109127 - DNA, 25 bp, Homo sapien
ctaaagcggcagatcttttgcagcc

SEQ ID NO: 109128 - DNA, 25 bp, Homo sapien
gccgcggctcctgattgtccaaacg

SEQ ID NO: 109129 - DNA, 25 bp, Homo sapien
aagaggaatcgcctctccagaaccg

SEQ ID NO: 109130 - DNA, 25 bp, Homo sapien
gtattcggggaagaggaatcgcctc

SEQ ID NO: 109131 - DNA, 25 bp, Homo sapien
aggggcgcacgactgcactcccggt

SEQ ID NO: 109132 - DNA, 25 bp, Homo sapien
ttactggcctcgagttccgcgagcg

SEQ ID NO: 109133 - DNA, 25 bp, Homo sapien
cggctgccttactggcctcgagttc

SEQ ID NO: 109134 - DNA, 25 bp, Homo sapien
ggcatcaaggaaagccgcggctgcc

SEQ ID NO: 109135 - DNA, 25 bp, Homo sapien
cactagttctgtgctcgtccaggca

SEQ ID NO: 109136 - DNA, 25 bp, Homo sapien
agggtcgcctgggaacactagttct

SEQ ID NO: 109137 - DNA, 25 bp, Homo sapien
tcctgtccagagagaccgttgggtc

SEQ ID NO: 109138 - DNA, 25 bp, Homo sapien
gtatcacttgaatgcccaccgggtt

SEQ ID NO: 109139 - DNA, 25 bp, Homo sapien
cgggttccggaatcacgagtctcca

SEQ ID NO: 109140 - DNA, 25 bp, Homo sapien
cgcgcttctcgatcagctctgagga

SEQ ID NO: 109141 - DNA, 25 bp, Homo sapien
ctcgcgtgcgagcattagttggcta

SEQ ID NO: 109142 - DNA, 25 bp, Homo sapien
ggtctcaggcgcaaacacgttcaaa

SEQ ID NO: 109143 - DNA, 25 bp, Homo sapien
tcaccgtctgttctggatcatcctg

SEQ ID NO: 109144 - DNA, 25 bp, Homo sapien
gtagccaatgcctctcctgtccaaa

SEQ ID NO: 109145 - DNA, 25 bp, Homo sapien
cctgcgactttctgtatggagcctt

SEQ ID NO: 109146 - DNA, 25 bp, Homo sapien
accttcgctgttctcttacctatga

SEQ ID NO: 109147 - DNA, 25 bp, Homo sapien
cggaagttgtggtacccaagccata

SEQ ID NO: 109148 - DNA, 25 bp, Homo sapien
agccaggtcgcgctgaaacagtttc

SEQ ID NO: 109149 - DNA, 25 bp, Homo sapien
tcctcctggaagctatataatgata

SEQ ID NO: 109150 - DNA, 25 bp, Homo sapien
tgcagccatggtaagactggaatcc

SEQ ID NO: 109151 - DNA, 25 bp, Homo sapien
gggtcttcctcagcgcgaaatcgtt

SEQ ID NO: 109152 - DNA, 25 bp, Homo sapien
ttctggaaacgtcctgccctgaggg

SEQ ID NO: 109153 - DNA, 25 bp, Homo sapien
gggctcagggtacagacgctattct

SEQ ID NO: 109154 - DNA, 25 bp, Homo sapien
ctgaaccagagaaacgccattcggg

SEQ ID NO: 109155 - DNA, 25 bp, Homo sapien
cccaaccaggaagcttgcagtggtc

SEQ ID NO: 109156 - DNA, 25 bp, Homo sapien
atcgtctggaccctcttcgggcctt

SEQ ID NO: 109157 - DNA, 25 bp, Homo sapien
agtacgccgcaccatgcagctcagg

SEQ ID NO: 109158 - DNA, 25 bp, Homo sapien
cgggctgtgaccgaagcaacaaagg

SEQ ID NO: 109159 - DNA, 25 bp, Homo sapien
tattcttgctgggagagccgaacgc

SEQ ID NO: 109160 - DNA, 25 bp, Homo sapien
ggacagaccggtctcactccgtttg

SEQ ID NO: 109161 - DNA, 25 bp, Homo sapien
tttgtctttcttgggcgggacatcc

SEQ ID NO: 109162 - DNA, 25 bp, Homo sapien
ggaggcctctacctttctcttggtc

SEQ ID NO: 109163 - DNA, 25 bp, Homo sapien
aggcacatcaggaactccgcactca

SEQ ID NO: 109164 - DNA, 25 bp, Homo sapien
cgccgcggtttctacaggcacatca

SEQ ID NO: 109165 - DNA, 25 bp, Homo sapien
ttcttcttgttacgaggaggccctg

SEQ ID NO: 109166 - DNA, 25 bp, Homo sapien
acggagctcccgattcttcttgtta

SEQ ID NO: 109167 - DNA, 25 bp, Homo sapien
tgggactccgggttcttccattctc

SEQ ID NO: 109168 - DNA, 25 bp, Homo sapien
aggcttcttagagatccgagacttc

SEQ ID NO: 109169 - DNA, 25 bp, Homo sapien
ggattctggagaccacgtcgacccg

SEQ ID NO: 109170 - DNA, 25 bp, Homo sapien
ttctctgagcggttcagggtcactg

SEQ ID NO: 109171 - DNA, 25 bp, Homo sapien
cccacgaatgtagctgaccgaaatc

SEQ ID NO: 109172 - DNA, 25 bp, Homo sapien
gtggagtaccctctgcttgagcgca

SEQ ID NO: 109173 - DNA, 25 bp, Homo sapien
tgctcaggctctgacctgctcggga

SEQ ID NO: 109174 - DNA, 25 bp, Homo sapien
ttccagattcggctctcagaggctt

SEQ ID NO: 109175 - DNA, 25 bp, Homo sapien
cgcctctacactcggggattctgga

SEQ ID NO: 109176 - DNA, 25 bp, Homo sapien
cgtcgacccgcaatgaactggaata

SEQ ID NO: 109177 - DNA, 25 bp, Homo sapien
gggccaggacttcgtgcccagcatc

SEQ ID NO: 109178 - DNA, 25 bp, Homo sapien
aagcgcaagcgggagtccaagtaca

SEQ ID NO: 109179 - DNA, 25 bp, Homo sapien
acagccaaccgagagcgcaagcgca

SEQ ID NO: 109180 - DNA, 25 bp, Homo sapien
tctcgcgcatctgcaagaataagga

SEQ ID NO: 109181 - DNA, 25 bp, Homo sapien
ggctctgctctgctggtaccacatt

SEQ ID NO: 109182 - DNA, 25 bp, Homo sapien
tggtaccacattgcccgggccaagg

SEQ ID NO: 109183 - DNA, 25 bp, Homo sapien
aagtacagcgggatcgacgaggctc

SEQ ID NO: 109184 - DNA, 25 bp, Homo sapien
agccaaggagctggccgatatcatg

SEQ ID NO: 109185 - DNA, 25 bp, Homo sapien
cgagtccctagagactcaccgtgta

SEQ ID NO: 109186 - DNA, 25 bp, Homo sapien
ccctctagttcttgggcgatgagtc

SEQ ID NO: 109187 - DNA, 25 bp, Homo sapien
acgaagcggctcatctcgcagtgtg

SEQ ID NO: 109188 - DNA, 25 bp, Homo sapien
aagttgcagctgtagagtcaccgcc

SEQ ID NO: 109189 - DNA, 25 bp, Homo sapien
cggggaacttcaaatgcacagacta

SEQ ID NO: 109190 - DNA, 25 bp, Homo sapien
cctgaggtcactgccggatctaaag

SEQ ID NO: 109191 - DNA, 25 bp, Homo sapien
cggtttgtatgtctggtgacctgcc

SEQ ID NO: 109192 - DNA, 25 bp, Homo sapien
gcaacagcagtgcaccgggtctctt

SEQ ID NO: 109193 - DNA, 25 bp, Homo sapien
tcatgtgctcagtcagatggtgctt

SEQ ID NO: 109194 - DNA, 25 bp, Homo sapien
cgggagactctctcttggacggcaa

SEQ ID NO: 109195 - DNA, 25 bp, Homo sapien
actttttgttgcacacggggcagtc

SEQ ID NO: 109196 - DNA, 25 bp, Homo sapien
tcacagtgtcctcggtggcgcatga

SEQ ID NO: 109197 - DNA, 25 bp, Homo sapien
cgcatgaagctgtctcgccacatga

SEQ ID NO: 109198 - DNA, 25 bp, Homo sapien
cttggcgcagactccgcactcgtag

SEQ ID NO: 109199 - DNA, 25 bp, Homo sapien
ggcttgagacctgtgtgcgtcttca

SEQ ID NO: 109200 - DNA, 25 bp, Homo sapien
ggccgcagattgaggtgcatgttca

SEQ ID NO: 109201 - DNA, 25 bp, Homo sapien
tccgcctttaaaggcacagccgggc

SEQ ID NO: 109202 - DNA, 25 bp, Homo sapien
gccagagcagcaacctgggcccctc

SEQ ID NO: 109203 - DNA, 25 bp, Homo sapien
agagcagcaacctgggcccctcccg

SEQ ID NO: 109204 - DNA, 25 bp, Homo sapien
atcttgcgccgactccctccgccct

SEQ ID NO: 109205 - DNA, 25 bp, Homo sapien
cgcctttaaaggcacagccgggcac

SEQ ID NO: 109206 - DNA, 25 bp, Homo sapien
gcctttaaaggcacagccgggcacc

SEQ ID NO: 109207 - DNA, 25 bp, Homo sapien
cgctgggcaatactcggccgactcg

SEQ ID NO: 109208 - DNA, 25 bp, Homo sapien
ccatcttgcgccgactccctccgcc

SEQ ID NO: 109209 - DNA, 25 bp, Homo sapien
atgaaggtggccgacatcttcaggc

SEQ ID NO: 109210 - DNA, 25 bp, Homo sapien
catgcggccccggaagatggcagcc

SEQ ID NO: 109211 - DNA, 25 bp, Homo sapien
tgttctgcacgttgagcatctgctc

SEQ ID NO: 109212 - DNA, 25 bp, Homo sapien
cttgttctgcacgttgagcatctgc

SEQ ID NO: 109213 - DNA, 25 bp, Homo sapien
gttcttgttctgcacgttgagcatc

SEQ ID NO: 109214 - DNA, 25 bp, Homo sapien
ctgttcttgttctgcacgttgagca

SEQ ID NO: 109215 - DNA, 25 bp, Homo sapien
tgctgttcttgttctgcacgttgag

SEQ ID NO: 109216 - DNA, 25 bp, Homo sapien
aggtggccgacatcttcaggccgcg

SEQ ID NO: 109217 - DNA, 25 bp, Homo sapien
tatgcggagtctgggtcatccaatt

SEQ ID NO: 109218 - DNA, 25 bp, Homo sapien
caatgcgcctgttaacctctgggta

SEQ ID NO: 109219 - DNA, 25 bp, Homo sapien
gccggtcagtgaagagcagtctttc

SEQ ID NO: 109220 - DNA, 25 bp, Homo sapien
ttcagctcacatagtcgcccaaaga

SEQ ID NO: 109221 - DNA, 25 bp, Homo sapien
ttcaaccgtgcctcctgcaggtatg

SEQ ID NO: 109222 - DNA, 25 bp, Homo sapien
gccgccggatctctgccacatagag

SEQ ID NO: 109223 - DNA, 25 bp, Homo sapien
gcagctgctccaaacgctggatctg

SEQ ID NO: 109224 - DNA, 25 bp, Homo sapien
gaggcggatcagcttacgcttcaac

SEQ ID NO: 109225 - DNA, 25 bp, Homo sapien
gtcacagagtttccgccttcatgca

SEQ ID NO: 109226 - DNA, 25 bp, Homo sapien
attcctcttagatcccaaccgtggg

SEQ ID NO: 109227 - DNA, 25 bp, Homo sapien
tggagctcttttcacccggtgcttc

SEQ ID NO: 109228 - DNA, 25 bp, Homo sapien
gaacccaggcgtcccaaagcagctg

SEQ ID NO: 109229 - DNA, 25 bp, Homo sapien
ggtgacccgtaactgatcaaaagtc

SEQ ID NO: 109230 - DNA, 25 bp, Homo sapien
tctcttccaggtcggagtttgtctc

SEQ ID NO: 109231 - DNA, 25 bp, Homo sapien
ggcccacatagtcagcggtctcttc

SEQ ID NO: 109232 - DNA, 25 bp, Homo sapien
cgccgccatattgtcgtacggaaca

SEQ ID NO: 109233 - DNA, 25 bp, Homo sapien
ggcctttgtcatgtctaccgggaga

SEQ ID NO: 109234 - DNA, 25 bp, Homo sapien
cgacggaaaacaagtgcgctcccta

SEQ ID NO: 109235 - DNA, 25 bp, Homo sapien
tcctcgtttgcgcacgcgtcatttc

SEQ ID NO: 109236 - DNA, 25 bp, Homo sapien
ccaccagtttcgcttggccagttgc

SEQ ID NO: 109237 - DNA, 25 bp, Homo sapien
gcggcgacgtccacgcattttctga

SEQ ID NO: 109238 - DNA, 25 bp, Homo sapien
ccgagcggaagtccagcactattgc

SEQ ID NO: 109239 - DNA, 25 bp, Homo sapien
gagttctctaccctgcttcgcgagc

SEQ ID NO: 109240 - DNA, 25 bp, Homo sapien
ctggagcctcaatcacgtcgacgga

SEQ ID NO: 109241 - DNA, 25 bp, Homo sapien
tgctttggctgctgcgtcatacgcc

SEQ ID NO: 109242 - DNA, 25 bp, Homo sapien
ctgcctttccgttcgaacggctggg

SEQ ID NO: 109243 - DNA, 25 bp, Homo sapien
gggactcgcctaggtctcctacgtc

SEQ ID NO: 109244 - DNA, 25 bp, Homo sapien
agggccagcctcttcttcggcgccc

SEQ ID NO: 109245 - DNA, 25 bp, Homo sapien
ctctcccaccgggtccgactcttcg

SEQ ID NO: 109246 - DNA, 25 bp, Homo sapien
cccaagggcgaatctcaggtcggag

SEQ ID NO: 109247 - DNA, 25 bp, Homo sapien
gtgaaggaggggctcagtcctccca

SEQ ID NO: 109248 - DNA, 25 bp, Homo sapien
cccagctgtcaccggtaaggaggcg

SEQ ID NO: 109249 - DNA, 25 bp, Homo sapien
atcgactaccgcatctgcagacgtg

SEQ ID NO: 109250 - DNA, 25 bp, Homo sapien
atggcacgcccgtttccgtgtgaac

SEQ ID NO: 109251 - DNA, 25 bp, Homo sapien
ggagccatgggagacttgaccaatc

SEQ ID NO: 109252 - DNA, 25 bp, Homo sapien
tcccgaccctatcatggcgcggttt

SEQ ID NO: 109253 - DNA, 25 bp, Homo sapien
acagcgcgcaccatgtgacagtaga

SEQ ID NO: 109254 - DNA, 25 bp, Homo sapien
gtggcagccacgtgattagaaaaca

SEQ ID NO: 109255 - DNA, 25 bp, Homo sapien
ctacgctggtacaggagagttgatc

SEQ ID NO: 109256 - DNA, 25 bp, Homo sapien
gcggcctcttcttacctgggtggca

SEQ ID NO: 109257 - DNA, 25 bp, Homo sapien
gacgcacagtctccgtgccggtgga

SEQ ID NO: 109258 - DNA, 25 bp, Homo sapien
cgagcaggctctcatgacccggaca

SEQ ID NO: 109259 - DNA, 25 bp, Homo sapien
ctgctgagacgcacagtctccgtgc

SEQ ID NO: 109260 - DNA, 25 bp, Homo sapien
agtcgcaacaaactgctgagacgca

SEQ ID NO: 109261 - DNA, 25 bp, Homo sapien
gagcgagtccagtcgcaacaaactg

SEQ ID NO: 109262 - DNA, 25 bp, Homo sapien
aggctctcatgacccggacaggcgc

SEQ ID NO: 109263 - DNA, 25 bp, Homo sapien
gacaaagtcttgcttcccgagggga

SEQ ID NO: 109264 - DNA, 25 bp, Homo sapien
tcccgaggggagatggcgccctcct

SEQ ID NO: 109265 - DNA, 25 bp, Homo sapien
tggcacgtgccaggaagtgtccatt

SEQ ID NO: 109266 - DNA, 25 bp, Homo sapien
gcctttgcagatggacgggacagaa

SEQ ID NO: 109267 - DNA, 25 bp, Homo sapien
cctcttacaggccaacagtcggggc

SEQ ID NO: 109268 - DNA, 25 bp, Homo sapien
ggcctttgtgaagggaaactcgctc

SEQ ID NO: 109269 - DNA, 25 bp, Homo sapien
ggatcccttaccgtactcaccgaga

SEQ ID NO: 109270 - DNA, 25 bp, Homo sapien
tcaccgagagcttgaggagacctcc

SEQ ID NO: 109271 - DNA, 25 bp, Homo sapien
tggctcccggtaactgctgtttctc

SEQ ID NO: 109272 - DNA, 25 bp, Homo sapien
ggaactagcccgaagacccagcgtg

SEQ ID NO: 109273 - DNA, 25 bp, Homo sapien
tgtccgcgtgtgtgttcgtgcccat

SEQ ID NO: 109274 - DNA, 25 bp, Homo sapien
ctcgtgcggacagggtcttgagcac

SEQ ID NO: 109275 - DNA, 25 bp, Homo sapien
ttctcgctgcatcttccgagtgggg

SEQ ID NO: 109276 - DNA, 25 bp, Homo sapien
cgcatgttctcgctgcatcttccga

SEQ ID NO: 109277 - DNA, 25 bp, Homo sapien
gtgcccatgctcgtgtctcctgtgt

SEQ ID NO: 109278 - DNA, 25 bp, Homo sapien
atgctcgtgtctcctgtgtgtcggt

SEQ ID NO: 109279 - DNA, 25 bp, Homo sapien
tgtctcctgtgtgtcggtgccatgt

SEQ ID NO: 109280 - DNA, 25 bp, Homo sapien
tgtgttcgtgcccatgctcgtgtct

SEQ ID NO: 109281 - DNA, 25 bp, Homo sapien
agcagacctctgtgggcactgtgag

SEQ ID NO: 109282 - DNA, 25 bp, Homo sapien
gacggagctgtagcggcactgtaac

SEQ ID NO: 109283 - DNA, 25 bp, Homo sapien
gattggctacggctctagctccgcc

SEQ ID NO: 109284 - DNA, 25 bp, Homo sapien
taggctgccgttcctcgattggcta

SEQ ID NO: 109285 - DNA, 25 bp, Homo sapien
tcaacacgaggcttgtaggctgccg

SEQ ID NO: 109286 - DNA, 25 bp, Homo sapien
gtctgcagtagccaatcaacacgag

SEQ ID NO: 109287 - DNA, 25 bp, Homo sapien
cttaatcaccgggaaacgcagcttt

SEQ ID NO: 109288 - DNA, 25 bp, Homo sapien
ggggcgggtgctacacttaatcacc

SEQ ID NO: 109289 - DNA, 25 bp, Homo sapien
tttcttccagcgatgcaacgatctg

SEQ ID NO: 109290 - DNA, 25 bp, Homo sapien
gctccttagacgagtaggctaacca

SEQ ID NO: 109291 - DNA, 25 bp, Homo sapien
cccaaggaagggcacgcttgcgtgc

SEQ ID NO: 109292 - DNA, 25 bp, Homo sapien
tcaatgccgcatgctgttcaaagcc

SEQ ID NO: 109293 - DNA, 25 bp, Homo sapien
cggttagcgttgcagctccttagac

SEQ ID NO: 109294 - DNA, 25 bp, Homo sapien
gcaacgatctgttcgccgctcaatg

SEQ ID NO: 109295 - DNA, 25 bp, Homo sapien
taacctctatggcatcgctccggga

SEQ ID NO: 109296 - DNA, 25 bp, Homo sapien
gggcctcttaaacctgtgctcgcga

SEQ ID NO: 109297 - DNA, 25 bp, Homo sapien
cgcaggcgctcgcatctgagaactg

SEQ ID NO: 109298 - DNA, 25 bp, Homo sapien
cgcatctgagaactgccgaaccgtg

SEQ ID NO: 109299 - DNA, 25 bp, Homo sapien
agaactgccgaaccgtgccacattt

SEQ ID NO: 109300 - DNA, 25 bp, Homo sapien
caggctccagcggagcgtgcgtacc

SEQ ID NO: 109301 - DNA, 25 bp, Homo sapien
agcaaacacgtctcggccacgactg

SEQ ID NO: 109302 - DNA, 25 bp, Homo sapien
aaccaagaggttggcaccgcagtgc

SEQ ID NO: 109303 - DNA, 25 bp, Homo sapien
agcgtgcgtacctgcgcaggcgctc

SEQ ID NO: 109304 - DNA, 25 bp, Homo sapien
tgcctgtgcgcaccgaagtgcagca

SEQ ID NO: 109305 - DNA, 25 bp, Homo sapien
acacagcggtcggtaattgcagccc

SEQ ID NO: 109306 - DNA, 25 bp, Homo sapien
ggcgctggctgcattgtgaatttgc

SEQ ID NO: 109307 - DNA, 25 bp, Homo sapien
ctggctgcattgtgaatttgcggcg

SEQ ID NO: 109308 - DNA, 25 bp, Homo sapien
ggtgggcaacatggcggttctcaaa

SEQ ID NO: 109309 - DNA, 25 bp, Homo sapien
ggttctcaaagagaccacgtccttg

SEQ ID NO: 109310 - DNA, 25 bp, Homo sapien
gagaccacgtccttgtactggcgcc

SEQ ID NO: 109311 - DNA, 25 bp, Homo sapien
tcccacacagcggtcggtaattgca

SEQ ID NO: 109312 - DNA, 25 bp, Homo sapien
cccatgcaccagacccgctgctgcc

SEQ ID NO: 109313 - DNA, 25 bp, Homo sapien
ccgagggctccgtcaatggcttcat

SEQ ID NO: 109314 - DNA, 25 bp, Homo sapien
gggccgcagccatgagtgaaatgtc

SEQ ID NO: 109315 - DNA, 25 bp, Homo sapien
tggcttcatcagcactttggggtga

SEQ ID NO: 109316 - DNA, 25 bp, Homo sapien
cctagtctcaaggagcgggaacggc

SEQ ID NO: 109317 - DNA, 25 bp, Homo sapien
acggctcgcctccttcttttacaga

SEQ ID NO: 109318 - DNA, 25 bp, Homo sapien
tgaagtgtttgctcaggtaggactc

SEQ ID NO: 109319 - DNA, 25 bp, Homo sapien
ctcgggctccctactggagttggca

SEQ ID NO: 109320 - DNA, 25 bp, Homo sapien
cagctttcttcacatcggggacatc

SEQ ID NO: 109321 - DNA, 25 bp, Homo sapien
ctaaggccagggacgtcggtgccat

SEQ ID NO: 109322 - DNA, 25 bp, Homo sapien
tagtttgataaacacaggtgcccgc

SEQ ID NO: 109323 - DNA, 25 bp, Homo sapien
cctgtggtccggctagtttgataaa

SEQ ID NO: 109324 - DNA, 25 bp, Homo sapien
ggtttcagcgcccggtgcgcactca

SEQ ID NO: 109325 - DNA, 25 bp, Homo sapien
ctcccaccacgcagcgatggggagg

SEQ ID NO: 109326 - DNA, 25 bp, Homo sapien
acttacccctgtagagcgcggctct

SEQ ID NO: 109327 - DNA, 25 bp, Homo sapien
gaggccagacctacgctctccggag

SEQ ID NO: 109328 - DNA, 25 bp, Homo sapien
gggtgaagcgaagcggccacttacc

SEQ ID NO: 109329 - DNA, 25 bp, Homo sapien
gtcctccttcctgcacaacgagatg

SEQ ID NO: 109330 - DNA, 25 bp, Homo sapien
caagctccgcagtgaggacccacgg

SEQ ID NO: 109331 - DNA, 25 bp, Homo sapien
ttcaccactactgagcaggacgagc

SEQ ID NO: 109332 - DNA, 25 bp, Homo sapien
gcagggcagcaaagtgagcgacttc

SEQ ID NO: 109333 - DNA, 25 bp, Homo sapien
tgtgctcagattgtgcggcaggacc

SEQ ID NO: 109334 - DNA, 25 bp, Homo sapien
cggaggaaaccaagcaccggctctt

SEQ ID NO: 109335 - DNA, 25 bp, Homo sapien
agatcgtgttcccagtgcccggcat

SEQ ID NO: 109336 - DNA, 25 bp, Homo sapien
accgcagcatggagcagatcgtgtt

SEQ ID NO: 109337 - DNA, 25 bp, Homo sapien
tggccattcctcacagagcttaaga

SEQ ID NO: 109338 - DNA, 25 bp, Homo sapien
ctgtgctacccgctgtcgcaggtaa

SEQ ID NO: 109339 - DNA, 25 bp, Homo sapien
cgtttggtctcgtccactggccatt

SEQ ID NO: 109340 - DNA, 25 bp, Homo sapien
acgaatggcgcttgcgcactaagcc

SEQ ID NO: 109341 - DNA, 25 bp, Homo sapien
cgcgactttgtaggcgcaccgctac

SEQ ID NO: 109342 - DNA, 25 bp, Homo sapien
ctctgcaagccgagctaattcagtc

SEQ ID NO: 109343 - DNA, 25 bp, Homo sapien
tgtcgcaggtaagcgcccaagtccc

SEQ ID NO: 109344 - DNA, 25 bp, Homo sapien
gggcgtcgctatcagtagctccctg

SEQ ID NO: 109345 - DNA, 25 bp, Homo sapien
gacgctgctcccttgtggccggcag

SEQ ID NO: 109346 - DNA, 25 bp, Homo sapien
gcctggtctagagtcgcagcttctg

SEQ ID NO: 109347 - DNA, 25 bp, Homo sapien
gaatcggcgttctggctgcaggcct

SEQ ID NO: 109348 - DNA, 25 bp, Homo sapien
cacacagcaagtgcgaggctctggg

SEQ ID NO: 109349 - DNA, 25 bp, Homo sapien
aggcgatcttcgcacacagcaagtg

SEQ ID NO: 109350 - DNA, 25 bp, Homo sapien
gtggtcacagtaaagcaaggcgatc

SEQ ID NO: 109351 - DNA, 25 bp, Homo sapien
ccggctgcgctgaagttcttgttaa

SEQ ID NO: 109352 - DNA, 25 bp, Homo sapien
cgcagcttctgtgagaagcaacact

SEQ ID NO: 109353 - DNA, 25 bp, Homo sapien
agcagcccttctgtgcatgtgcaca

SEQ ID NO: 109354 - DNA, 25 bp, Homo sapien
gctcctcactggctcctgttcagcg

SEQ ID NO: 109355 - DNA, 25 bp, Homo sapien
atctctccaccatcgactacgtgga

SEQ ID NO: 109356 - DNA, 25 bp, Homo sapien
ccatcgactacgtggaggacggtga

SEQ ID NO: 109357 - DNA, 25 bp, Homo sapien
cggtgagcagcccttctgtgcatgt

SEQ ID NO: 109358 - DNA, 25 bp, Homo sapien
tgagcagcccttctgtgcatgtgca

SEQ ID NO: 109359 - DNA, 25 bp, Homo sapien
gcagcccttctgtgcatgtgcacac

SEQ ID NO: 109360 - DNA, 25 bp, Homo sapien
gtgcgactggctcgccctcggaccc

SEQ ID NO: 109361 - DNA, 25 bp, Homo sapien
agcagtagccctaggctggcccaga

SEQ ID NO: 109362 - DNA, 25 bp, Homo sapien
agcttgttgcggtagacatcccggg

SEQ ID NO: 109363 - DNA, 25 bp, Homo sapien
gccggcccaggacgtactgttgtcc

SEQ ID NO: 109364 - DNA, 25 bp, Homo sapien
tgagggcttgcccatcttcacccaa

SEQ ID NO: 109365 - DNA, 25 bp, Homo sapien
tcttcacccaaaggatgcccaggaa

SEQ ID NO: 109366 - DNA, 25 bp, Homo sapien
tgcccaggaagacgagcagtagccc

SEQ ID NO: 109367 - DNA, 25 bp, Homo sapien
agcggcgcatcctcgcgtaaccggg

SEQ ID NO: 109368 - DNA, 25 bp, Homo sapien
gagggccggatatcaccgtaggccc

SEQ ID NO: 109369 - DNA, 25 bp, Homo sapien
ggacgccttggaacagcacccgcgt

SEQ ID NO: 109370 - DNA, 25 bp, Homo sapien
aggccgagccctctatttagaagca

SEQ ID NO: 109371 - DNA, 25 bp, Homo sapien
aggcttgagcacaccaggcaatttg

SEQ ID NO: 109372 - DNA, 25 bp, Homo sapien
cgcacaggaaatggcaggcttgagc

SEQ ID NO: 109373 - DNA, 25 bp, Homo sapien
gattgtttgcggagctcaaccctga

SEQ ID NO: 109374 - DNA, 25 bp, Homo sapien
ggagaggtgtctctggtctcccagc

SEQ ID NO: 109375 - DNA, 25 bp, Homo sapien
ccaggcaatttgctgaatttcaggg

SEQ ID NO: 109376 - DNA, 25 bp, Homo sapien
tcttcagataattcgccggggctca

SEQ ID NO: 109377 - DNA, 25 bp, Homo sapien
agactttgggcatgtagagcattcc

SEQ ID NO: 109378 - DNA, 25 bp, Homo sapien
gtggccgccgtaacgacggctttga

SEQ ID NO: 109379 - DNA, 25 bp, Homo sapien
cagcgtcgtcgtctggatgtacagc

SEQ ID NO: 109380 - DNA, 25 bp, Homo sapien
tgggccggaagttgcccttctgcgt

SEQ ID NO: 109381 - DNA, 25 bp, Homo sapien
gactcaccgagaccgtcagcgtcgt

SEQ ID NO: 109382 - DNA, 25 bp, Homo sapien
cccttctgcgtgaacttgttggaca

SEQ ID NO: 109383 - DNA, 25 bp, Homo sapien
gcattcccagggacaccgaggcgct

SEQ ID NO: 109384 - DNA, 25 bp, Homo sapien
accgaggcgctcagactcaccgaga

SEQ ID NO: 109385 - DNA, 25 bp, Homo sapien
acgccgcgtgtcttgatggcataca

SEQ ID NO: 109386 - DNA, 25 bp, Homo sapien
acggtgcacgtgaccatgagcagca

SEQ ID NO: 109387 - DNA, 25 bp, Homo sapien
cagggctgcatagctgatgctcatc

SEQ ID NO: 109388 - DNA, 25 bp, Homo sapien
cctagtcccaggaagattcggcgca

SEQ ID NO: 109389 - DNA, 25 bp, Homo sapien
acgtagctcagttcacggcccgagg

SEQ ID NO: 109390 - DNA, 25 bp, Homo sapien
tcgttgtagcgcacaaaggtgatca

SEQ ID NO: 109391 - DNA, 25 bp, Homo sapien
ccgcatgtcatagggacacgtctta

SEQ ID NO: 109392 - DNA, 25 bp, Homo sapien
gcgacaggtccgagatgtcacactt

SEQ ID NO: 109393 - DNA, 25 bp, Homo sapien
cacggccggccgacgacagacaaag

SEQ ID NO: 109394 - DNA, 25 bp, Homo sapien
aaagggagactctcggcctcaggcc

SEQ ID NO: 109395 - DNA, 25 bp, Homo sapien
gcgtgctcactggtgcacttcttga

SEQ ID NO: 109396 - DNA, 25 bp, Homo sapien
gcacttcttgacgtggctgcccttc

SEQ ID NO: 109397 - DNA, 25 bp, Homo sapien
acgtggctgcccttcttgagggcgt

SEQ ID NO: 109398 - DNA, 25 bp, Homo sapien
agcttgcagtggaagttgtcctccc

SEQ ID NO: 109399 - DNA, 25 bp, Homo sapien
caaaccagatgttgcgccggttgtt

SEQ ID NO: 109400 - DNA, 25 bp, Homo sapien
gttgtcctcccagaactcggcaaac

SEQ ID NO: 109401 - DNA, 25 bp, Homo sapien
aggcgtcgagtaccctttggagtag

SEQ ID NO: 109402 - DNA, 25 bp, Homo sapien
tggcaaaggtttcccgcatcctggg

SEQ ID NO: 109403 - DNA, 25 bp, Homo sapien
ctctccagcgggtggcaaaggtttc

SEQ ID NO: 109404 - DNA, 25 bp, Homo sapien
ggccggaaattgaagacccatttgc

SEQ ID NO: 109405 - DNA, 25 bp, Homo sapien
tcctcgcctcctaaggacgggaaga

SEQ ID NO: 109406 - DNA, 25 bp, Homo sapien
tcggaacagggtcctcgcctcctaa

SEQ ID NO: 109407 - DNA, 25 bp, Homo sapien
ggggcgctcgccctattgctgctgc

SEQ ID NO: 109408 - DNA, 25 bp, Homo sapien
aagacccatttgcagtgggctctcc

SEQ ID NO: 109409 - DNA, 25 bp, Homo sapien
tccgcagaccgggatgcgctaatgc

SEQ ID NO: 109410 - DNA, 25 bp, Homo sapien
tggcacgaccctccatccggtggaa

SEQ ID NO: 109411 - DNA, 25 bp, Homo sapien
gggcacccggaaagcctgccttagc

SEQ ID NO: 109412 - DNA, 25 bp, Homo sapien
aggggagaccctctagttcagatcc

SEQ ID NO: 109413 - DNA, 25 bp, Homo sapien
tcggagcactccaagcgcgggagct

SEQ ID NO: 109414 - DNA, 25 bp, Homo sapien
accgcgcgccagcaaggtttaagcc

SEQ ID NO: 109415 - DNA, 25 bp, Homo sapien
ctgccgggaagaggtgcaaataatg

SEQ ID NO: 109416 - DNA, 25 bp, Homo sapien
cagagacagtactttccaccgggcc

SEQ ID NO: 109417 - DNA, 25 bp, Homo sapien
gggtctatttcagggctgcttccca

SEQ ID NO: 109418 - DNA, 25 bp, Homo sapien
cagaaacgcggcaagatcgctgaga

SEQ ID NO: 109419 - DNA, 25 bp, Homo sapien
cggcaagatcgctgagaagaacgtg

SEQ ID NO: 109420 - DNA, 25 bp, Homo sapien
aacgtgaggagcctcgattcccgcg

SEQ ID NO: 109421 - DNA, 25 bp, Homo sapien
cccggattgagaggcttgtttttca

SEQ ID NO: 109422 - DNA, 25 bp, Homo sapien
gaggcttgtttttcacctgagcaga

SEQ ID NO: 109423 - DNA, 25 bp, Homo sapien
cctgagcagattccggaaggaggca

SEQ ID NO: 109424 - DNA, 25 bp, Homo sapien
tgtgcccgcagaagggagtgccact

SEQ ID NO: 109425 - DNA, 25 bp, Homo sapien
ccagcagctccgctgaataggcgcg

SEQ ID NO: 109426 - DNA, 25 bp, Homo sapien
tgcgcctcctgcattgtgaaaggga

SEQ ID NO: 109427 - DNA, 25 bp, Homo sapien
ggagtgcaccttgcgcctcctgcat

SEQ ID NO: 109428 - DNA, 25 bp, Homo sapien
tgcggcccatcaagtgtgctgcacg

SEQ ID NO: 109429 - DNA, 25 bp, Homo sapien
ccacagaggcgtccttgtggaagga

SEQ ID NO: 109430 - DNA, 25 bp, Homo sapien
ctggcatcccggtgcggccacagag

SEQ ID NO: 109431 - DNA, 25 bp, Homo sapien
tgctgcaagtcgaatccctctcaac

SEQ ID NO: 109432 - DNA, 25 bp, Homo sapien
tccacgctgctgactgctgcaagtc

SEQ ID NO: 109433 - DNA, 25 bp, Homo sapien
gggctttcggagctgcagtcgaatc

SEQ ID NO: 109434 - DNA, 25 bp, Homo sapien
cagtgaccttgtgtgagccctagct

SEQ ID NO: 109435 - DNA, 25 bp, Homo sapien
cagtcgaatcgcagggaaagagaaa

SEQ ID NO: 109436 - DNA, 25 bp, Homo sapien
acgctgctttgacacagtgaccttg

SEQ ID NO: 109437 - DNA, 25 bp, Homo sapien
ttcgaaacgctgctttgacacagtg

SEQ ID NO: 109438 - DNA, 25 bp, Homo sapien
cccgcagacagcagcacgcacaccc

SEQ ID NO: 109439 - DNA, 25 bp, Homo sapien
aaagagaaagtgttcgaaacgctgc

SEQ ID NO: 109440 - DNA, 25 bp, Homo sapien
tgtgtgagccctagctgcacacacc

SEQ ID NO: 109441 - DNA, 25 bp, Homo sapien
gcttaatctgttggccgcgactcct

SEQ ID NO: 109442 - DNA, 25 bp, Homo sapien
tgtcgggagggtttcgtcatcaacc

SEQ ID NO: 109443 - DNA, 25 bp, Homo sapien
cagagccgaccagccctagtggatc

SEQ ID NO: 109444 - DNA, 25 bp, Homo sapien
cgctggctgtggaattagatctgtt

SEQ ID NO: 109445 - DNA, 25 bp, Homo sapien
ttttgaacccagtggagcgcatcgc

SEQ ID NO: 109446 - DNA, 25 bp, Homo sapien
tggaaccgacagtttgcgagcctcg

SEQ ID NO: 109447 - DNA, 25 bp, Homo sapien
tcccgataggttccagcgtgactcc

SEQ ID NO: 109448 - DNA, 25 bp, Homo sapien
atctggcaaattgcgagctgccttc

SEQ ID NO: 109449 - DNA, 25 bp, Homo sapien
gccgacacgcagcaacaagtggggt

SEQ ID NO: 109450 - DNA, 25 bp, Homo sapien
ctcccacttgttgccgacgatcttg

SEQ ID NO: 109451 - DNA, 25 bp, Homo sapien
cgacgatcttgccacaagtgaagca

SEQ ID NO: 109452 - DNA, 25 bp, Homo sapien
agtgaagcagcgtacagggatgatc

SEQ ID NO: 109453 - DNA, 25 bp, Homo sapien
gcgcgtccactgttgcgggagaatc

SEQ ID NO: 109454 - DNA, 25 bp, Homo sapien
accgtcttggtgcatcccggcgcta

SEQ ID NO: 109455 - DNA, 25 bp, Homo sapien
gttcgcgtttctcgtgtccgcttga

SEQ ID NO: 109456 - DNA, 25 bp, Homo sapien
agttcgagcccagagccgacacgca

SEQ ID NO: 109457 - DNA, 25 bp, Homo sapien
ccaatcgttggtttcgctggaaggc

SEQ ID NO: 109458 - DNA, 25 bp, Homo sapien
tgctgcgctcctctaattgggactc

SEQ ID NO: 109459 - DNA, 25 bp, Homo sapien
taggccgcggaattctctaacgagc

SEQ ID NO: 109460 - DNA, 25 bp, Homo sapien
gtccgcccaggggaaatctaccatc

SEQ ID NO: 109461 - DNA, 25 bp, Homo sapien
agtgggcctgcgtatctccagaaca

SEQ ID NO: 109462 - DNA, 25 bp, Homo sapien
ctcgctggtggccattaataaaaca

SEQ ID NO: 109463 - DNA, 25 bp, Homo sapien
agcctcccttgggtgtacctgccaa

SEQ ID NO: 109464 - DNA, 25 bp, Homo sapien
cacacgcgggttgacactgaaaggc

SEQ ID NO: 109465 - DNA, 25 bp, Homo sapien
ctcgttgcagccagaatagggtcgc

SEQ ID NO: 109466 - DNA, 25 bp, Homo sapien
cgtcaggcgcgtgatcaaaggaccc

SEQ ID NO: 109467 - DNA, 25 bp, Homo sapien
gcctccgtctgtgtttgttccctgg

SEQ ID NO: 109468 - DNA, 25 bp, Homo sapien
gtcgtatgctcatcgtcccaggtca

SEQ ID NO: 109469 - DNA, 25 bp, Homo sapien
gagcttgcccttacccagtcgtatg

SEQ ID NO: 109470 - DNA, 25 bp, Homo sapien
ggtcgcgccacgctctaacgttgag

SEQ ID NO: 109471 - DNA, 25 bp, Homo sapien
tgagtctctatcagagggcaaggta

SEQ ID NO: 109472 - DNA, 25 bp, Homo sapien
cgcgacccaggttcgcttgagtctc

SEQ ID NO: 109473 - DNA, 25 bp, Homo sapien
ttgatcttggccattgctgcacagg

SEQ ID NO: 109474 - DNA, 25 bp, Homo sapien
tcctgaggttttctttctgagtcta

SEQ ID NO: 109475 - DNA, 25 bp, Homo sapien
cggacgactcggatcttagagagct

SEQ ID NO: 109476 - DNA, 25 bp, Homo sapien
ctgcttcttggtcttcgggttctcc

SEQ ID NO: 109477 - DNA, 25 bp, Homo sapien
ttcgggttctcctcatgcttgttga

SEQ ID NO: 109478 - DNA, 25 bp, Homo sapien
gcgtgtcttcttaggccgcaggtcc

SEQ ID NO: 109479 - DNA, 25 bp, Homo sapien
ggcttgtagttcctgcccttgtaga

SEQ ID NO: 109480 - DNA, 25 bp, Homo sapien
caggcaatggatttgcggacgactc

SEQ ID NO: 109481 - DNA, 25 bp, Homo sapien
tgcgtcagcggcgtaaggctgcacc

SEQ ID NO: 109482 - DNA, 25 bp, Homo sapien
gtccagccgcgcaagtctgcggatg

SEQ ID NO: 109483 - DNA, 25 bp, Homo sapien
tttcgcctcaggaaattccatcgga

SEQ ID NO: 109484 - DNA, 25 bp, Homo sapien
cggaacttcattccgcccgagcggg

SEQ ID NO: 109485 - DNA, 25 bp, Homo sapien
atgcggcccgcttcttgtagccgtc

SEQ ID NO: 109486 - DNA, 25 bp, Homo sapien
acttgagcttcatcatcctccgggc

SEQ ID NO: 109487 - DNA, 25 bp, Homo sapien
acgccggcagcgtaggcgtagaact

SEQ ID NO: 109488 - DNA, 25 bp, Homo sapien
gtctggttcgacttgagcttcatca

SEQ ID NO: 109489 - DNA, 25 bp, Homo sapien
aatctcgcggctgtaccataaggta

SEQ ID NO: 109490 - DNA, 25 bp, Homo sapien
ccaaactagagctccagtgccaggc

SEQ ID NO: 109491 - DNA, 25 bp, Homo sapien
tctcgctagtctcacctggcaagtc

SEQ ID NO: 109492 - DNA, 25 bp, Homo sapien
tcggacaatcttcgcctaccagcgg

SEQ ID NO: 109493 - DNA, 25 bp, Homo sapien
acagaaactcacctctgcggctgca

SEQ ID NO: 109494 - DNA, 25 bp, Homo sapien
gcctgaagaactggcggatctgacc

SEQ ID NO: 109495 - DNA, 25 bp, Homo sapien
gactcacgcacgcactaggaaaccg

SEQ ID NO: 109496 - DNA, 25 bp, Homo sapien
tcgctactcagaaatcggtgtgtgg

SEQ ID NO: 109497 - DNA, 25 bp, Homo sapien
gctcgctaaaaatgcctctctaatc

SEQ ID NO: 109498 - DNA, 25 bp, Homo sapien
gagctggcatcggaggcccttaccc

SEQ ID NO: 109499 - DNA, 25 bp, Homo sapien
caggatgccactgcgctgggtccct

SEQ ID NO: 109500 - DNA, 25 bp, Homo sapien
tctaatctgctctgctcggtgcacg

SEQ ID NO: 109501 - DNA, 25 bp, Homo sapien
ccgcgctaccattggctcgctaaaa

SEQ ID NO: 109502 - DNA, 25 bp, Homo sapien
ggcgcctgccaaactggttgctgcc

SEQ ID NO: 109503 - DNA, 25 bp, Homo sapien
aggcagggagcaacatcccgggctc

SEQ ID NO: 109504 - DNA, 25 bp, Homo sapien
cgggcatcacccaggcagtgccagg

SEQ ID NO: 109505 - DNA, 25 bp, Homo sapien
ttcacccttcgccaggtctgggctg

SEQ ID NO: 109506 - DNA, 25 bp, Homo sapien
ctgtctcaagatcggacggcctttg

SEQ ID NO: 109507 - DNA, 25 bp, Homo sapien
cacgctctaggcaaacggtagttcg

SEQ ID NO: 109508 - DNA, 25 bp, Homo sapien
cgctccgtttcacgctctaggcaaa

SEQ ID NO: 109509 - DNA, 25 bp, Homo sapien
ctgaccacctagttctggagccagg

SEQ ID NO: 109510 - DNA, 25 bp, Homo sapien
gccgaggcgccatcggaacactctt

SEQ ID NO: 109511 - DNA, 25 bp, Homo sapien
cgcaggatcgctaagcgcgagccga

SEQ ID NO: 109512 - DNA, 25 bp, Homo sapien
tggagccaggcttcttcacccttcg

SEQ ID NO: 109513 - DNA, 25 bp, Homo sapien
ggccaccgtctatgcaacgacctga

SEQ ID NO: 109514 - DNA, 25 bp, Homo sapien
acgacctgatgaactgcgtgcagga

SEQ ID NO: 109515 - DNA, 25 bp, Homo sapien
ccaagatcgagaaggcgtacgggca

SEQ ID NO: 109516 - DNA, 25 bp, Homo sapien
cagctcaccgactgggccaagcgtt

SEQ ID NO: 109517 - DNA, 25 bp, Homo sapien
gggccaagcgttggcgccagctcat

SEQ ID NO: 109518 - DNA, 25 bp, Homo sapien
gccagctcatcgagaaaggtgctcc

SEQ ID NO: 109519 - DNA, 25 bp, Homo sapien
tggggaactacaagcggaccgtgaa

SEQ ID NO: 109520 - DNA, 25 bp, Homo sapien
aagcgcatcgatgacggccaccgtc

SEQ ID NO: 109521 - DNA, 25 bp, Homo sapien
tccttcctccgcgtctcagtgttag

SEQ ID NO: 109522 - DNA, 25 bp, Homo sapien
cctttgaggacgactccaagggagt

SEQ ID NO: 109523 - DNA, 25 bp, Homo sapien
cgtgcgggcactctacgactatgac

SEQ ID NO: 109524 - DNA, 25 bp, Homo sapien
caggagcaggacgagctcagcttta

SEQ ID NO: 109525 - DNA, 25 bp, Homo sapien
agccctacgccaccgagtggtcaga

SEQ ID NO: 109526 - DNA, 25 bp, Homo sapien
gcagctacgacagaggccagcccta

SEQ ID NO: 109527 - DNA, 25 bp, Homo sapien
cgcgtctcagtgttagcagctacga

SEQ ID NO: 109528 - DNA, 25 bp, Homo sapien
caccgagtggtcagacgacgagagt

SEQ ID NO: 109529 - DNA, 25 bp, Homo sapien
gtcccgtctctcgagacccactgcc

SEQ ID NO: 109530 - DNA, 25 bp, Homo sapien
gcgtggcgggtggactgggactcca

SEQ ID NO: 109531 - DNA, 25 bp, Homo sapien
tgggactccagtcccgtctctcgag

SEQ ID NO: 109532 - DNA, 25 bp, Homo sapien
ctccaagcctgtccgcgacaccgtg

SEQ ID NO: 109533 - DNA, 25 bp, Homo sapien
gggatacgctgctcagacccgggct

SEQ ID NO: 109534 - DNA, 25 bp, Homo sapien
atacgctgctcagacccgggctggc

SEQ ID NO: 109535 - DNA, 25 bp, Homo sapien
cggacaggccctgctcgggcgtggc

SEQ ID NO: 109536 - DNA, 25 bp, Homo sapien
ccttctccaagcctgtccgcgacac

SEQ ID NO: 109537 - DNA, 25 bp, Homo sapien
ggaagagtcaaaaccacgatgcctg

SEQ ID NO: 109538 - DNA, 25 bp, Homo sapien
tccgcgatcccaaaaagcactgtta

SEQ ID NO: 109539 - DNA, 25 bp, Homo sapien
atgttgtcacccactagctcctgga

SEQ ID NO: 109540 - DNA, 25 bp, Homo sapien
cagggatgcgcattctcaggaaaca

SEQ ID NO: 109541 - DNA, 25 bp, Homo sapien
ggaattttccagatgtcctgccggc

SEQ ID NO: 109542 - DNA, 25 bp, Homo sapien
catggcattcgcctcccaaatgtca

SEQ ID NO: 109543 - DNA, 25 bp, Homo sapien
ccaaatgtcaccttgagcgctgtcc

SEQ ID NO: 109544 - DNA, 25 bp, Homo sapien
gaatcgtcccgttgagcaatgaccc

SEQ ID NO: 109545 - DNA, 25 bp, Homo sapien
gctgaacttctgcatcagctccggg

SEQ ID NO: 109546 - DNA, 25 bp, Homo sapien
ggccggctcaccagttggtcatgtc

SEQ ID NO: 109547 - DNA, 25 bp, Homo sapien
caaccggcaggattgagctggaagc

SEQ ID NO: 109548 - DNA, 25 bp, Homo sapien
gagcagcctctggaactcggagatg

SEQ ID NO: 109549 - DNA, 25 bp, Homo sapien
agcacgtccttgtcggtggtgccca

SEQ ID NO: 109550 - DNA, 25 bp, Homo sapien
acgtccatgccctccatggcgggga

SEQ ID NO: 109551 - DNA, 25 bp, Homo sapien
gtgcccaggcagctgaacttctgca

SEQ ID NO: 109552 - DNA, 25 bp, Homo sapien
gctccgggtccaggtctacgtccat

SEQ ID NO: 109553 - DNA, 25 bp, Homo sapien
attgaacctcgtagcggcccgtagt

SEQ ID NO: 109554 - DNA, 25 bp, Homo sapien
tcatttccgggcgtcacgtaacgga

SEQ ID NO: 109555 - DNA, 25 bp, Homo sapien
gtcgctggctgtgcgcgtcatttcc

SEQ ID NO: 109556 - DNA, 25 bp, Homo sapien
cttcatgctagtctcgtggggttcc

SEQ ID NO: 109557 - DNA, 25 bp, Homo sapien
ccggaagcaccgacaaacaagatta

SEQ ID NO: 109558 - DNA, 25 bp, Homo sapien
ttcccgccatcctatagatgaaagg

SEQ ID NO: 109559 - DNA, 25 bp, Homo sapien
ttaaatgagcttggattgaacctcg

SEQ ID NO: 109560 - DNA, 25 bp, Homo sapien
gagggcttcggaagtcttcatgcta

SEQ ID NO: 109561 - DNA, 25 bp, Homo sapien
agaagcgtttcagacccgagaggcg

SEQ ID NO: 109562 - DNA, 25 bp, Homo sapien
cgggagctgcgcaatgatctaacga

SEQ ID NO: 109563 - DNA, 25 bp, Homo sapien
tgcctaactcgagcccggacagctt

SEQ ID NO: 109564 - DNA, 25 bp, Homo sapien
tgaaacacctgtcccggtgagagcg

SEQ ID NO: 109565 - DNA, 25 bp, Homo sapien
cgcctcttctccacaactgaggagg

SEQ ID NO: 109566 - DNA, 25 bp, Homo sapien
cctcagaggcgaaagaagcgtttca

SEQ ID NO: 109567 - DNA, 25 bp, Homo sapien
tctcctaggtttcaaggcgactgcc

SEQ ID NO: 109568 - DNA, 25 bp, Homo sapien
gcatggccgggatcattaagaagca

SEQ ID NO: 109569 - DNA, 25 bp, Homo sapien
ggatcttacttcctgtcgtcgcgca

SEQ ID NO: 109570 - DNA, 25 bp, Homo sapien
gctgcacaggccaggatcttacttc

SEQ ID NO: 109571 - DNA, 25 bp, Homo sapien
atgcctgaggcagaagctcggaaac

SEQ ID NO: 109572 - DNA, 25 bp, Homo sapien
tgggcatcgtccatcacggatagga

SEQ ID NO: 109573 - DNA, 25 bp, Homo sapien
ctccacctttgtcggagggcgactc

SEQ ID NO: 109574 - DNA, 25 bp, Homo sapien
gggattccatcggtgtcggtagccc

SEQ ID NO: 109575 - DNA, 25 bp, Homo sapien
tccgtcagtttcctctgggattcca

SEQ ID NO: 109576 - DNA, 25 bp, Homo sapien
ctgtcgtcgcgcagcgatgacatca

SEQ ID NO: 109577 - DNA, 25 bp, Homo sapien
cgtgacgccggatcccggaagtgac

SEQ ID NO: 109578 - DNA, 25 bp, Homo sapien
atggcacagccagggttcactctcg

SEQ ID NO: 109579 - DNA, 25 bp, Homo sapien
ttctgacccggctgcgaagaatggt

SEQ ID NO: 109580 - DNA, 25 bp, Homo sapien
gagaggcgtgtctcggcacagcaaa

SEQ ID NO: 109581 - DNA, 25 bp, Homo sapien
agtccacctgcgctggtccgcggag

SEQ ID NO: 109582 - DNA, 25 bp, Homo sapien
aggtccgagtccacgctgctccggg

SEQ ID NO: 109583 - DNA, 25 bp, Homo sapien
gggctcgcctggtctcccgttctga

SEQ ID NO: 109584 - DNA, 25 bp, Homo sapien
gtctcggcacagcaaagtccacctg

SEQ ID NO: 109585 - DNA, 25 bp, Homo sapien
tgagctcgaagccaaccaggcctcg

SEQ ID NO: 109586 - DNA, 25 bp, Homo sapien
cggggcctgagaacaaaccgccgcg

SEQ ID NO: 109587 - DNA, 25 bp, Homo sapien
actgctgagacgaggccagagcatg

SEQ ID NO: 109588 - DNA, 25 bp, Homo sapien
ccagagcatgcatggggcttttctt

SEQ ID NO: 109589 - DNA, 25 bp, Homo sapien
ggcttttcttcaggctgtttggaca

SEQ ID NO: 109590 - DNA, 25 bp, Homo sapien
tgggcggcaacgaggaaactaaagc

SEQ ID NO: 109591 - DNA, 25 bp, Homo sapien
ttgtttcacagcgtgtgccgcaggg

SEQ ID NO: 109592 - DNA, 25 bp, Homo sapien
gcgctctttcctcacatgtgggaga

SEQ ID NO: 109593 - DNA, 25 bp, Homo sapien
tcccacccagcatcaggagaatcag

SEQ ID NO: 109594 - DNA, 25 bp, Homo sapien
tgtctgtgactcaccgcccggagcg

SEQ ID NO: 109595 - DNA, 25 bp, Homo sapien
cgacgaggtgcagctgcaaagcgcc

SEQ ID NO: 109596 - DNA, 25 bp, Homo sapien
ctgctttcctcgaggtgagggattc

SEQ ID NO: 109597 - DNA, 25 bp, Homo sapien
acaatgcgcctttcaggggcctccg

SEQ ID NO: 109598 - DNA, 25 bp, Homo sapien
cccaggctgacaatgcgcctttcag

SEQ ID NO: 109599 - DNA, 25 bp, Homo sapien
catcaggagaatcagggcccacgtg

SEQ ID NO: 109600 - DNA, 25 bp, Homo sapien
cgagggatctgcgacgcagccaccg

SEQ ID NO: 109601 - DNA, 25 bp, Homo sapien
cgggggcatctacgcctcgtcctcg

SEQ ID NO: 109602 - DNA, 25 bp, Homo sapien
cctaacccgtctcgcgggggcatct

SEQ ID NO: 109603 - DNA, 25 bp, Homo sapien
cgcgggggcatctacgcctcgtcct

SEQ ID NO: 109604 - DNA, 25 bp, Homo sapien
tctcgcgggggcatctacgcctcgt

SEQ ID NO: 109605 - DNA, 25 bp, Homo sapien
gtctcgcgggggcatctacgcctcg

SEQ ID NO: 109606 - DNA, 25 bp, Homo sapien
taacccgtctcgcgggggcatctac

SEQ ID NO: 109607 - DNA, 25 bp, Homo sapien
ctaacccgtctcgcgggggcatcta

SEQ ID NO: 109608 - DNA, 25 bp, Homo sapien
ggggcatctacgcctcgtcctcgcc

SEQ ID NO: 109609 - DNA, 25 bp, Homo sapien
caaagccgcgcaaggtaaggaagga

SEQ ID NO: 109610 - DNA, 25 bp, Homo sapien
ctctctcccggcgaagctgggaatt

SEQ ID NO: 109611 - DNA, 25 bp, Homo sapien
tctcaggtccttcgctcgggctctg

SEQ ID NO: 109612 - DNA, 25 bp, Homo sapien
gcgaagaaaaagagcctgagagacg

SEQ ID NO: 109613 - DNA, 25 bp, Homo sapien
cccatcgccggattgtaaattcctg

SEQ ID NO: 109614 - DNA, 25 bp, Homo sapien
tgatccattgattgcgcgcggtctg

SEQ ID NO: 109615 - DNA, 25 bp, Homo sapien
gcccagtacagcaaagccgcgcaag

SEQ ID NO: 109616 - DNA, 25 bp, Homo sapien
gccgagcggagcttgcattgatcca

SEQ ID NO: 109617 - DNA, 25 bp, Homo sapien
tcgggaccgtaagacagtgagtgct

SEQ ID NO: 109618 - DNA, 25 bp, Homo sapien
gccctggaacctggatatcgcgcga

SEQ ID NO: 109619 - DNA, 25 bp, Homo sapien
gcggttcccgattgctatagcgacg

SEQ ID NO: 109620 - DNA, 25 bp, Homo sapien
ccttggaatggacaggtagcggttc

SEQ ID NO: 109621 - DNA, 25 bp, Homo sapien
acgcttctgctggaccgaatccttg

SEQ ID NO: 109622 - DNA, 25 bp, Homo sapien
ccgcagaagtgatgacgcaaagccc

SEQ ID NO: 109623 - DNA, 25 bp, Homo sapien
ctgcaactgcttccttcaaggggtg

SEQ ID NO: 109624 - DNA, 25 bp, Homo sapien
aggcctgcggactgcgcaccttaaa

SEQ ID NO: 109625 - DNA, 25 bp, Homo sapien
ccggtgactggtgcggcacctagca

SEQ ID NO: 109626 - DNA, 25 bp, Homo sapien
ccagggtggtatgtaattttcgctc

SEQ ID NO: 109627 - DNA, 25 bp, Homo sapien
tctggcccagggtggtatgtaattt

SEQ ID NO: 109628 - DNA, 25 bp, Homo sapien
atgtaattttcgctcggcctgggac

SEQ ID NO: 109629 - DNA, 25 bp, Homo sapien
ccagcctggtggagcgtccaggtct

SEQ ID NO: 109630 - DNA, 25 bp, Homo sapien
atgtggagttaaggcgccatcctca

SEQ ID NO: 109631 - DNA, 25 bp, Homo sapien
ggcgccatcctcaccggtgactggt

SEQ ID NO: 109632 - DNA, 25 bp, Homo sapien
ctagcatgtttgacaggcggggact

SEQ ID NO: 109633 - DNA, 25 bp, Homo sapien
tgataatactttgtccagcgggagg

SEQ ID NO: 109634 - DNA, 25 bp, Homo sapien
gtgcgaggatcctactgacccgctc

SEQ ID NO: 109635 - DNA, 25 bp, Homo sapien
catccagatggcgatccggctgcag

SEQ ID NO: 109636 - DNA, 25 bp, Homo sapien
ggagagtggactcgggaaactccta

SEQ ID NO: 109637 - DNA, 25 bp, Homo sapien
tgggtggtccttaggcgcctcatct

SEQ ID NO: 109638 - DNA, 25 bp, Homo sapien
ccgcacgtatgagatgagcgcctca

SEQ ID NO: 109639 - DNA, 25 bp, Homo sapien
gcgctgcatgttctgtgtgaagaca

SEQ ID NO: 109640 - DNA, 25 bp, Homo sapien
gtgaagacagccaaccgcacgtatg

SEQ ID NO: 109641 - DNA, 25 bp, Homo sapien
tcacggcggcttcctgatgctccgg

SEQ ID NO: 109642 - DNA, 25 bp, Homo sapien
gaggcagaattaggggagtctccag

SEQ ID NO: 109643 - DNA, 25 bp, Homo sapien
gtcgtgcgttgccatgtaggcgccc

SEQ ID NO: 109644 - DNA, 25 bp, Homo sapien
ccggtcagccgtcgtgcgttgccat

SEQ ID NO: 109645 - DNA, 25 bp, Homo sapien
tccgcggacagcgtcacggcggctt

SEQ ID NO: 109646 - DNA, 25 bp, Homo sapien
cagccgggacaggtcagtccgagac

SEQ ID NO: 109647 - DNA, 25 bp, Homo sapien
gtccgcatcccgcaccagagggcgc

SEQ ID NO: 109648 - DNA, 25 bp, Homo sapien
tcagtccgagacgagagaagcggtc

SEQ ID NO: 109649 - DNA, 25 bp, Homo sapien
ggacggcgctggagtcctccgttcc

SEQ ID NO: 109650 - DNA, 25 bp, Homo sapien
tccggtctcccaacgccgaggagag

SEQ ID NO: 109651 - DNA, 25 bp, Homo sapien
cgaggatccgggaactcgaggcaca

SEQ ID NO: 109652 - DNA, 25 bp, Homo sapien
aggggcacccttcactgagcacttg

SEQ ID NO: 109653 - DNA, 25 bp, Homo sapien
ccgaggagagcttgtaacaggcgct

SEQ ID NO: 109654 - DNA, 25 bp, Homo sapien
gccgcgcaccctatgagcaggggca

SEQ ID NO: 109655 - DNA, 25 bp, Homo sapien
ccttcgactggggtcgcttgctcga

SEQ ID NO: 109656 - DNA, 25 bp, Homo sapien
actcgaggcacacgccttctgttcg

SEQ ID NO: 109657 - DNA, 25 bp, Homo sapien
cgctctacttggtgtccggaatcta

SEQ ID NO: 109658 - DNA, 25 bp, Homo sapien
agttggtcctgaaagccctatccgc

SEQ ID NO: 109659 - DNA, 25 bp, Homo sapien
gacatgctagtctcttttccggtta

SEQ ID NO: 109660 - DNA, 25 bp, Homo sapien
gggccactatttgagcgcatgcgca

SEQ ID NO: 109661 - DNA, 25 bp, Homo sapien
ttatcgcgagatcagggccactatt

SEQ ID NO: 109662 - DNA, 25 bp, Homo sapien
taggaccgaggagcaaagcattatc

SEQ ID NO: 109663 - DNA, 25 bp, Homo sapien
gcgctcaggactgcgacaactctgt

SEQ ID NO: 109664 - DNA, 25 bp, Homo sapien
aagtctctcgcgacaccctgtacga

SEQ ID NO: 109665 - DNA, 25 bp, Homo sapien
tgggcccactgagtcacctcgaaac

SEQ ID NO: 109666 - DNA, 25 bp, Homo sapien
tgacccactttcttgggcccactga

SEQ ID NO: 109667 - DNA, 25 bp, Homo sapien
gtacatcttgccctcgtctgacagg

SEQ ID NO: 109668 - DNA, 25 bp, Homo sapien
aactatacgggctgtgggagtcacc

SEQ ID NO: 109669 - DNA, 25 bp, Homo sapien
agacacacaggcttgcgcgcccaga

SEQ ID NO: 109670 - DNA, 25 bp, Homo sapien
agcccgcactggagagaactatacg

SEQ ID NO: 109671 - DNA, 25 bp, Homo sapien
ctcgaaacctccaggccggtagcgg

SEQ ID NO: 109672 - DNA, 25 bp, Homo sapien
tgacaggatgatcttccgccggccg

SEQ ID NO: 109673 - DNA, 25 bp, Homo sapien
ctcgttctccgcacgcgctgaggaa

SEQ ID NO: 109674 - DNA, 25 bp, Homo sapien
gctgaggaaccaccgctccgcttgg

SEQ ID NO: 109675 - DNA, 25 bp, Homo sapien
ggggttgagacttccagctcgcgcc

SEQ ID NO: 109676 - DNA, 25 bp, Homo sapien
tctcgacgctgtgcggccgccgagt

SEQ ID NO: 109677 - DNA, 25 bp, Homo sapien
aaggcggagcgtaccctccagctcg

SEQ ID NO: 109678 - DNA, 25 bp, Homo sapien
cgtggctagtttctcgaatttcttc

SEQ ID NO: 109679 - DNA, 25 bp, Homo sapien
cccgcgtggctagtttctcgaattt

SEQ ID NO: 109680 - DNA, 25 bp, Homo sapien
cggcttacctggtccgagctcgcgg

SEQ ID NO: 109681 - DNA, 25 bp, Homo sapien
ccttgagccgccagaaataaccgca

SEQ ID NO: 109682 - DNA, 25 bp, Homo sapien
aacctggcgtagaccgtctgcggcg

SEQ ID NO: 109683 - DNA, 25 bp, Homo sapien
atgcggggttcagacagggtcccat

SEQ ID NO: 109684 - DNA, 25 bp, Homo sapien
agacagggtcccatccgcgggtccg

SEQ ID NO: 109685 - DNA, 25 bp, Homo sapien
ttcttccttagcctctgtgccgggg

SEQ ID NO: 109686 - DNA, 25 bp, Homo sapien
tccctgaggaacctggcgtagaccg

SEQ ID NO: 109687 - DNA, 25 bp, Homo sapien
ccgccagaaataaccgcagattatc

SEQ ID NO: 109688 - DNA, 25 bp, Homo sapien
gtcctcttcttccttagcctctgtg

SEQ ID NO: 109689 - DNA, 25 bp, Homo sapien
tcacgtcccagaacagaagagcata

SEQ ID NO: 109690 - DNA, 25 bp, Homo sapien
ggcacagcgttcagccgcttcggta

SEQ ID NO: 109691 - DNA, 25 bp, Homo sapien
gaagagcataaggagccctggcaca

SEQ ID NO: 109692 - DNA, 25 bp, Homo sapien
caataaggcggaagacgttttcacg

SEQ ID NO: 109693 - DNA, 25 bp, Homo sapien
ggtgcacctttttggacgaccaata

SEQ ID NO: 109694 - DNA, 25 bp, Homo sapien
ctcttatactgtgaccggtgcacct

SEQ ID NO: 109695 - DNA, 25 bp, Homo sapien
agcgaagtttggctcccgcccgcag

SEQ ID NO: 109696 - DNA, 25 bp, Homo sapien
tgacgcggatcacctgttagacggc

SEQ ID NO: 109697 - DNA, 25 bp, Homo sapien
acttttgttgctcgctagtgatgga

SEQ ID NO: 109698 - DNA, 25 bp, Homo sapien
ggctgacgtaatgctccgagcccta

SEQ ID NO: 109699 - DNA, 25 bp, Homo sapien
ggtgagaccaccgtctttttcctca

SEQ ID NO: 109700 - DNA, 25 bp, Homo sapien
gtgcttgatggcaaccgggacacct

SEQ ID NO: 109701 - DNA, 25 bp, Homo sapien
tcttgggctggtagctcctctcact

SEQ ID NO: 109702 - DNA, 25 bp, Homo sapien
cagcatctaggggtgaagcgacctc

SEQ ID NO: 109703 - DNA, 25 bp, Homo sapien
agaagccgtcaggtgctccagtgcc

SEQ ID NO: 109704 - DNA, 25 bp, Homo sapien
gaccctctccgggagtgcataacgc

SEQ ID NO: 109705 - DNA, 25 bp, Homo sapien
cccagcgtgcaatcgcatggttgcg

SEQ ID NO: 109706 - DNA, 25 bp, Homo sapien
gcgcgagcgagaacagcctgactca

SEQ ID NO: 109707 - DNA, 25 bp, Homo sapien
gcctgactcagcagctgggtaagtg

SEQ ID NO: 109708 - DNA, 25 bp, Homo sapien
gtgtgctcgctcaccagatcaaccg

SEQ ID NO: 109709 - DNA, 25 bp, Homo sapien
aggggcaagcatacggcccgctcct

SEQ ID NO: 109710 - DNA, 25 bp, Homo sapien
acgtggccggtttgcgcatccctct

SEQ ID NO: 109711 - DNA, 25 bp, Homo sapien
agcgcaagccgcgagcacaaacagg

SEQ ID NO: 109712 - DNA, 25 bp, Homo sapien
tggaacacaatgtcccgagcgggcg

SEQ ID NO: 109713 - DNA, 25 bp, Homo sapien
tagagtacgacgaggaccgactaga

SEQ ID NO: 109714 - DNA, 25 bp, Homo sapien
tccgcgggaccgactagagtacgac

SEQ ID NO: 109715 - DNA, 25 bp, Homo sapien
gtctagcaggaagcccgctctctgt

SEQ ID NO: 109716 - DNA, 25 bp, Homo sapien
taccgtatcccaccgtctagcagga

SEQ ID NO: 109717 - DNA, 25 bp, Homo sapien
tctgtcctcaagtcgcctacgtgcg

SEQ ID NO: 109718 - DNA, 25 bp, Homo sapien
aggtggggctgctgacctcagtctc

SEQ ID NO: 109719 - DNA, 25 bp, Homo sapien
aggaccgactagagcacagtgagga

SEQ ID NO: 109720 - DNA, 25 bp, Homo sapien
cgctctctgtccaactccgcgggac

SEQ ID NO: 109721 - DNA, 25 bp, Homo sapien
cccagttgccttgacatcagtgacg

SEQ ID NO: 109722 - DNA, 25 bp, Homo sapien
aagaacatcctgtgcccgtcgccgg

SEQ ID NO: 109723 - DNA, 25 bp, Homo sapien
ggacgggagcgaaagaacatcctgt

SEQ ID NO: 109724 - DNA, 25 bp, Homo sapien
agagttaaactaggtgccggcgccg

SEQ ID NO: 109725 - DNA, 25 bp, Homo sapien
ggccacgagatcctgagaacctggg

SEQ ID NO: 109726 - DNA, 25 bp, Homo sapien
gggttctagagagtgccggctccca

SEQ ID NO: 109727 - DNA, 25 bp, Homo sapien
ttgtctcgagtgtgggtacccacct

SEQ ID NO: 109728 - DNA, 25 bp, Homo sapien
tggtggcctttgaccgtactcgcct

SEQ ID NO: 109729 - DNA, 25 bp, Homo sapien
tgccctcccggtctcatgaagccgc

SEQ ID NO: 109730 - DNA, 25 bp, Homo sapien
gccgattcttcgctgccctcccggt

SEQ ID NO: 109731 - DNA, 25 bp, Homo sapien
ctggtcgtgtttgtccacggcggtc

SEQ ID NO: 109732 - DNA, 25 bp, Homo sapien
cacgccgcacctgtcagccctctga

SEQ ID NO: 109733 - DNA, 25 bp, Homo sapien
tgtcagccctctgagctccgaggtg

SEQ ID NO: 109734 - DNA, 25 bp, Homo sapien
tcagccctctgagctccgaggtgcg

SEQ ID NO: 109735 - DNA, 25 bp, Homo sapien
aggtgcggtgcaggctgagccactg

SEQ ID NO: 109736 - DNA, 25 bp, Homo sapien
agacctgccggccgattcttcgctg

SEQ ID NO: 109737 - DNA, 25 bp, Homo sapien
gcaatataaaaaggtgagccgggga

SEQ ID NO: 109738 - DNA, 25 bp, Homo sapien
ttccgcaatataaaaaggtgagccg

SEQ ID NO: 109739 - DNA, 25 bp, Homo sapien
cccgtgcgagcctgagcgcctttcc

SEQ ID NO: 109740 - DNA, 25 bp, Homo sapien
cgcgcttccgcaatataaaaaggtg

SEQ ID NO: 109741 - DNA, 25 bp, Homo sapien
agcgcgcttccgcaatataaaaagg

SEQ ID NO: 109742 - DNA, 25 bp, Homo sapien
tctggagcgcgcttccgcaatataa

SEQ ID NO: 109743 - DNA, 25 bp, Homo sapien
ccgcaggcgtcctcgccctccacgt

SEQ ID NO: 109744 - DNA, 25 bp, Homo sapien
ccttcccttccgcaggcgtcctcgc

SEQ ID NO: 109745 - DNA, 25 bp, Homo sapien
cttgcatccggaaccaggactgcga

SEQ ID NO: 109746 - DNA, 25 bp, Homo sapien
ccgagggcagtctgtgtcaaacgca

SEQ ID NO: 109747 - DNA, 25 bp, Homo sapien
gagctcaaggagtcttgcatccgga

SEQ ID NO: 109748 - DNA, 25 bp, Homo sapien
gctgccaacgtgctccagacaattg

SEQ ID NO: 109749 - DNA, 25 bp, Homo sapien
gtgctccagacaattgcgagtcgca

SEQ ID NO: 109750 - DNA, 25 bp, Homo sapien
gactgcgagactggctgctgccaac

SEQ ID NO: 109751 - DNA, 25 bp, Homo sapien
acaattgcgagtcgcactgcgcgga

SEQ ID NO: 109752 - DNA, 25 bp, Homo sapien
tgtcaaacgcaggtgggtatcgccg

SEQ ID NO: 109753 - DNA, 25 bp, Homo sapien
gagcagtaggaatgtgtcagtcaca

SEQ ID NO: 109754 - DNA, 25 bp, Homo sapien
caggaaggtgaacggtgttccgatt

SEQ ID NO: 109755 - DNA, 25 bp, Homo sapien
caattcttgtcatctcggttcagga

SEQ ID NO: 109756 - DNA, 25 bp, Homo sapien
gagactggagacagcctcggctaga

SEQ ID NO: 109757 - DNA, 25 bp, Homo sapien
tcggctagagcggacacaggcacct

SEQ ID NO: 109758 - DNA, 25 bp, Homo sapien
acaggcacctggcaagctttccttg

SEQ ID NO: 109759 - DNA, 25 bp, Homo sapien
cttgaccaaatcaaggttgtccttg

SEQ ID NO: 109760 - DNA, 25 bp, Homo sapien
ggttgtccttgtcctattaagcctc

SEQ ID NO: 109761 - DNA, 25 bp, Homo sapien
cctgcgcactcgagtggcggcgact

SEQ ID NO: 109762 - DNA, 25 bp, Homo sapien
cgaaccgcggcagttaagcgaagct

SEQ ID NO: 109763 - DNA, 25 bp, Homo sapien
cggcagttaagcgaagctcccggcg

SEQ ID NO: 109764 - DNA, 25 bp, Homo sapien
acctttccgctccatggtgagaccg

SEQ ID NO: 109765 - DNA, 25 bp, Homo sapien
gagaccggtaatcgccaggcgcctg

SEQ ID NO: 109766 - DNA, 25 bp, Homo sapien
cgcggcccaaaaccgagcccgctca

SEQ ID NO: 109767 - DNA, 25 bp, Homo sapien
gcgttgggcgcggagcctaccacct

SEQ ID NO: 109768 - DNA, 25 bp, Homo sapien
tccatggtgagaccggtaatcgcca

SEQ ID NO: 109769 - DNA, 25 bp, Homo sapien
cctgggagtttctgcctttggtctc

SEQ ID NO: 109770 - DNA, 25 bp, Homo sapien
ccgcggagaggttccatattgggta

SEQ ID NO: 109771 - DNA, 25 bp, Homo sapien
attgggtaaaatctcggctctcgga

SEQ ID NO: 109772 - DNA, 25 bp, Homo sapien
cggctgccgctggaaaatgtctcag

SEQ ID NO: 109773 - DNA, 25 bp, Homo sapien
atgtctcaggagaggcccacgttct

SEQ ID NO: 109774 - DNA, 25 bp, Homo sapien
tgcccgagcgttaccagaacctgtc

SEQ ID NO: 109775 - DNA, 25 bp, Homo sapien
gcgtcaagtggcaggaattttcctc

SEQ ID NO: 109776 - DNA, 25 bp, Homo sapien
ttcgcgcccttaaggagacagtccc

SEQ ID NO: 109777 - DNA, 25 bp, Homo sapien
aagggcttctacaagcaggacgtca

SEQ ID NO: 109778 - DNA, 25 bp, Homo sapien
ttgaccgcggacctcaaggcccagc

SEQ ID NO: 109779 - DNA, 25 bp, Homo sapien
cctatggctccgtgtggtgagaccc

SEQ ID NO: 109780 - DNA, 25 bp, Homo sapien
ctacaagcaggacgtcaacaagaca

SEQ ID NO: 109781 - DNA, 25 bp, Homo sapien
cgggtgcccgggatgagcctcatcc

SEQ ID NO: 109782 - DNA, 25 bp, Homo sapien
ctcatccggaaaaagggcttctaca

SEQ ID NO: 109783 - DNA, 25 bp, Homo sapien
gatgagcctcatccggaaaaagggc

SEQ ID NO: 109784 - DNA, 25 bp, Homo sapien
aggacgtcaacaagacagcctggga

SEQ ID NO: 109785 - DNA, 25 bp, Homo sapien
gcagacccggtctcttgctcggtgt

SEQ ID NO: 109786 - DNA, 25 bp, Homo sapien
ttccaattggcctggccagacgaga

SEQ ID NO: 109787 - DNA, 25 bp, Homo sapien
aggtgacgcagccaatgggttctcg

SEQ ID NO: 109788 - DNA, 25 bp, Homo sapien
gcgctctcgctcctgttcagcggga

SEQ ID NO: 109789 - DNA, 25 bp, Homo sapien
cctgttcagcgggagagcccgcaga

SEQ ID NO: 109790 - DNA, 25 bp, Homo sapien
gtgcgaaagctctctcctggagcga

SEQ ID NO: 109791 - DNA, 25 bp, Homo sapien
acgccttccaattggcctggccaga

SEQ ID NO: 109792 - DNA, 25 bp, Homo sapien
attcgctggcgctcgctttctctgt

SEQ ID NO: 109793 - DNA, 25 bp, Homo sapien
cgcagtgcgggaacacttgcccttt

SEQ ID NO: 109794 - DNA, 25 bp, Homo sapien
cctggcttttctagggcgccatttc

SEQ ID NO: 109795 - DNA, 25 bp, Homo sapien
agagctttgcctgctttgtcctaca

SEQ ID NO: 109796 - DNA, 25 bp, Homo sapien
gccgagcttccacgagagagctttg

SEQ ID NO: 109797 - DNA, 25 bp, Homo sapien
cccagggaatgcacgctgagtccta

SEQ ID NO: 109798 - DNA, 25 bp, Homo sapien
ccggaggttgtgaatttgagttata

SEQ ID NO: 109799 - DNA, 25 bp, Homo sapien
gcggcctgcgaaatcaacagactta

SEQ ID NO: 109800 - DNA, 25 bp, Homo sapien
ttataatggcctcggtcgggactga

SEQ ID NO: 109801 - DNA, 25 bp, Homo sapien
cccggaactactgaaggctcaagtt

SEQ ID NO: 109802 - DNA, 25 bp, Homo sapien
ttggaacggagaccacaacacccgc

SEQ ID NO: 109803 - DNA, 25 bp, Homo sapien
tggaacagcgcgcagtggccaccgc

SEQ ID NO: 109804 - DNA, 25 bp, Homo sapien
ctcaagttaggtcaacccggcagga

SEQ ID NO: 109805 - DNA, 25 bp, Homo sapien
ctccgatgcggtcctgccctgggga

SEQ ID NO: 109806 - DNA, 25 bp, Homo sapien
attggccaatctgcgggaccgtctg

SEQ ID NO: 109807 - DNA, 25 bp, Homo sapien
tcccgactttggaacggagaccaca

SEQ ID NO: 109808 - DNA, 25 bp, Homo sapien
ctgagtcaccgggaagcatctggct

SEQ ID NO: 109809 - DNA, 25 bp, Homo sapien
agccaccggctttctgtcttgagcg

SEQ ID NO: 109810 - DNA, 25 bp, Homo sapien
ggcgctccggtaatcgctatccttc

SEQ ID NO: 109811 - DNA, 25 bp, Homo sapien
tcgcgtgggaggaaatctctttcga

SEQ ID NO: 109812 - DNA, 25 bp, Homo sapien
cgcacataggataggaaggggcctc

SEQ ID NO: 109813 - DNA, 25 bp, Homo sapien
tctctttcgagaagcgccaaggcgt

SEQ ID NO: 109814 - DNA, 25 bp, Homo sapien
tcctgaactcggaaccaactgcgtc

SEQ ID NO: 109815 - DNA, 25 bp, Homo sapien
aggaccctgtgagtctccgcacata

SEQ ID NO: 109816 - DNA, 25 bp, Homo sapien
cgggattctgcaggatctgaggatc

SEQ ID NO: 109817 - DNA, 25 bp, Homo sapien
gttactctatctggcgttctcgacg

SEQ ID NO: 109818 - DNA, 25 bp, Homo sapien
tctatcagtctttggttactctatc

SEQ ID NO: 109819 - DNA, 25 bp, Homo sapien
ccgccctaggctttctgtggtggaa

SEQ ID NO: 109820 - DNA, 25 bp, Homo sapien
gcgcgacccgcgcaaccagtgagaa

SEQ ID NO: 109821 - DNA, 25 bp, Homo sapien
aaccacctcgcgcactttagctggg

SEQ ID NO: 109822 - DNA, 25 bp, Homo sapien
accagcgttatttattctatcagtc

SEQ ID NO: 109823 - DNA, 25 bp, Homo sapien
ttctcgacgccgtaataacaagttc

SEQ ID NO: 109824 - DNA, 25 bp, Homo sapien
tcccgaattacacacaccagcgtta

SEQ ID NO: 109825 - DNA, 25 bp, Homo sapien
ccacattttcgggtaagcattagcc

SEQ ID NO: 109826 - DNA, 25 bp, Homo sapien
gcaactcagaaaagtgcgcccgctg

SEQ ID NO: 109827 - DNA, 25 bp, Homo sapien
taagcattagccgtcctggcgctgc

SEQ ID NO: 109828 - DNA, 25 bp, Homo sapien
gctgcacgagcgtattctacaattc

SEQ ID NO: 109829 - DNA, 25 bp, Homo sapien
tggaggaaaggcgacacccatttac

SEQ ID NO: 109830 - DNA, 25 bp, Homo sapien
cccgagtcttccctttgtggccgag

SEQ ID NO: 109831 - DNA, 25 bp, Homo sapien
cctcgctccacgcatggggagatca

SEQ ID NO: 109832 - DNA, 25 bp, Homo sapien
ctcttaacgtgaagcgctgggtgac

SEQ ID NO: 109833 - DNA, 25 bp, Homo sapien
ctgccggaaaagacgcgagcgctga

SEQ ID NO: 109834 - DNA, 25 bp, Homo sapien
tctcgacttgaaggctggcgaagcc

SEQ ID NO: 109835 - DNA, 25 bp, Homo sapien
gcggcggcagccaacgagccaaaga

SEQ ID NO: 109836 - DNA, 25 bp, Homo sapien
cagccaacgagccaaagacgggagg

SEQ ID NO: 109837 - DNA, 25 bp, Homo sapien
gccgagactacgcatgcgcgacttc

SEQ ID NO: 109838 - DNA, 25 bp, Homo sapien
ggtgaggacaacaggaagcgttcca

SEQ ID NO: 109839 - DNA, 25 bp, Homo sapien
gaagcgttccaactgccggaaaaga

SEQ ID NO: 109840 - DNA, 25 bp, Homo sapien
ccttcggccagtagtctcgacttga

SEQ ID NO: 109841 - DNA, 25 bp, Homo sapien
tcatgtgattccagtatggcgtata

SEQ ID NO: 109842 - DNA, 25 bp, Homo sapien
agactcatcggagcgtgtggatttg

SEQ ID NO: 109843 - DNA, 25 bp, Homo sapien
tgagccgccgcattttttaacccta

SEQ ID NO: 109844 - DNA, 25 bp, Homo sapien
ccctagatctcggtaagagaccagc

SEQ ID NO: 109845 - DNA, 25 bp, Homo sapien
aatggcggcgccagattgagacaaa

SEQ ID NO: 109846 - DNA, 25 bp, Homo sapien
ctcgctgcgtttgtagccatacgtc

SEQ ID NO: 109847 - DNA, 25 bp, Homo sapien
ggggagcccgtccaatcatgtgatt

SEQ ID NO: 109848 - DNA, 25 bp, Homo sapien
accaggcctgttacaacgagcgcgc

SEQ ID NO: 109849 - DNA, 25 bp, Homo sapien
agcgtcgcacaaacgcatctgcacg

SEQ ID NO: 109850 - DNA, 25 bp, Homo sapien
gcaacccacacacgtgcgtagcgtg

SEQ ID NO: 109851 - DNA, 25 bp, Homo sapien
acgtgcgtagcgtgcagactcggac

SEQ ID NO: 109852 - DNA, 25 bp, Homo sapien
ggcacagatacactagcactcacct

SEQ ID NO: 109853 - DNA, 25 bp, Homo sapien
cacgcaaatgacacaagtctctctg

SEQ ID NO: 109854 - DNA, 25 bp, Homo sapien
cacagcatgcgcaaagcgtcgcaca

SEQ ID NO: 109855 - DNA, 25 bp, Homo sapien
caagtctctctgagcccaacaaagg

SEQ ID NO: 109856 - DNA, 25 bp, Homo sapien
aggcagcgaccttagcgtcgccgcg

SEQ ID NO: 109857 - DNA, 25 bp, Homo sapien
ttgttcccaaggaagccgggcactg

SEQ ID NO: 109858 - DNA, 25 bp, Homo sapien
ggttcaggtcctttacgccactgtg

SEQ ID NO: 109859 - DNA, 25 bp, Homo sapien
ggcgggctctaaccagcctgtcagt

SEQ ID NO: 109860 - DNA, 25 bp, Homo sapien
tggctctgggatccaatctgcgccg

SEQ ID NO: 109861 - DNA, 25 bp, Homo sapien
cccagggaacggactgtatgaggtc

SEQ ID NO: 109862 - DNA, 25 bp, Homo sapien
cctatttggctggaacagtttgttc

SEQ ID NO: 109863 - DNA, 25 bp, Homo sapien
tttcctggcccttgggaatgtgcca

SEQ ID NO: 109864 - DNA, 25 bp, Homo sapien
tcccatcggcacagtgacctatttg

SEQ ID NO: 109865 - DNA, 25 bp, Homo sapien
gcccgtgagcgatggaacttcgact

SEQ ID NO: 109866 - DNA, 25 bp, Homo sapien
cgccatgtcagaaccggctggggat

SEQ ID NO: 109867 - DNA, 25 bp, Homo sapien
tcttcggcccagtggacagcgagca

SEQ ID NO: 109868 - DNA, 25 bp, Homo sapien
ctgagccgcgactgtgatgcgctaa

SEQ ID NO: 109869 - DNA, 25 bp, Homo sapien
tgatgcgctaatggcgggctgcatc

SEQ ID NO: 109870 - DNA, 25 bp, Homo sapien
caccactggagggtgacttcgcctg

SEQ ID NO: 109871 - DNA, 25 bp, Homo sapien
tggggatgtccgtcagaacccatgc

SEQ ID NO: 109872 - DNA, 25 bp, Homo sapien
tttgtcaccgagacaccactggagg

SEQ ID NO: 109873 - DNA, 25 bp, Homo sapien
gtcgccacccgcagctggacaggac

SEQ ID NO: 109874 - DNA, 25 bp, Homo sapien
gcaggacacggtgatctccaccttg

SEQ ID NO: 109875 - DNA, 25 bp, Homo sapien
tcctggagaccaggacactctggga

SEQ ID NO: 109876 - DNA, 25 bp, Homo sapien
ctccaccttggtggccgggatgctg

SEQ ID NO: 109877 - DNA, 25 bp, Homo sapien
acacggtgatctccaccttggtggc

SEQ ID NO: 109878 - DNA, 25 bp, Homo sapien
tcagcgacgccatgtcctcaggctg

SEQ ID NO: 109879 - DNA, 25 bp, Homo sapien
ccaaggagtcgaactcgctcagcga

SEQ ID NO: 109880 - DNA, 25 bp, Homo sapien
gctgcccgccaaggagtcgaactcg

SEQ ID NO: 109881 - DNA, 25 bp, Homo sapien
cagaccctacatctccttctgggga

SEQ ID NO: 109882 - DNA, 25 bp, Homo sapien
ggctgcacacgtagacttgactcta

SEQ ID NO: 109883 - DNA, 25 bp, Homo sapien
gcgtctccctgagtaaggctgcaca

SEQ ID NO: 109884 - DNA, 25 bp, Homo sapien
gagttgggacacctctcctgcagtc

SEQ ID NO: 109885 - DNA, 25 bp, Homo sapien
ttctatgcagccagcaccgagtagg

SEQ ID NO: 109886 - DNA, 25 bp, Homo sapien
tgccaggagggactacctcggtttc

SEQ ID NO: 109887 - DNA, 25 bp, Homo sapien
gggcgggtctcagttcagaaacaga

SEQ ID NO: 109888 - DNA, 25 bp, Homo sapien
tcagcctcagcctaagctttgccga

SEQ ID NO: 109889 - DNA, 25 bp, Homo sapien
agctgcgtcagctcccgctgcccgc

SEQ ID NO: 109890 - DNA, 25 bp, Homo sapien
cgtccagagctaggagggagttacg

SEQ ID NO: 109891 - DNA, 25 bp, Homo sapien
ggtgactcccagcttgcactgcgtc

SEQ ID NO: 109892 - DNA, 25 bp, Homo sapien
gcttgcactgcgtcccacagtcgcg

SEQ ID NO: 109893 - DNA, 25 bp, Homo sapien
ccggagcccgagtcttccaagggcg

SEQ ID NO: 109894 - DNA, 25 bp, Homo sapien
agcccgagtcttccaagggcgctgg

SEQ ID NO: 109895 - DNA, 25 bp, Homo sapien
cgagtcttccaagggcgctggcagc

SEQ ID NO: 109896 - DNA, 25 bp, Homo sapien
cccaagcgtccagagctaggaggga

SEQ ID NO: 109897 - DNA, 25 bp, Homo sapien
atgtgcagccgctacgtgagtgcct

SEQ ID NO: 109898 - DNA, 25 bp, Homo sapien
tctgtaggtcagaatgtcttgggtc

SEQ ID NO: 109899 - DNA, 25 bp, Homo sapien
ccacccgtgggatgtcttaggaagc

SEQ ID NO: 109900 - DNA, 25 bp, Homo sapien
gcaacctcgccgtggccatgtgcag

SEQ ID NO: 109901 - DNA, 25 bp, Homo sapien
ggtccacttccacgtcatgcggctg

SEQ ID NO: 109902 - DNA, 25 bp, Homo sapien
tgcacaacttcagcgcgaggctgtg

SEQ ID NO: 109903 - DNA, 25 bp, Homo sapien
gggacgtctccctgcacaacttcag

SEQ ID NO: 109904 - DNA, 25 bp, Homo sapien
cccgcactggtctctgtaggtcaga

SEQ ID NO: 109905 - DNA, 25 bp, Homo sapien
agaggacggtcccttcttccaatgc

SEQ ID NO: 109906 - DNA, 25 bp, Homo sapien
ggcggcggaatgcttgtctagtaat

SEQ ID NO: 109907 - DNA, 25 bp, Homo sapien
tctagtaattgctacttccggcgtc

SEQ ID NO: 109908 - DNA, 25 bp, Homo sapien
accaggatttgggtggccaagacaa

SEQ ID NO: 109909 - DNA, 25 bp, Homo sapien
tgcaaacttcattcgcggtggtctc

SEQ ID NO: 109910 - DNA, 25 bp, Homo sapien
ccactctgggcgatctgattggttc

SEQ ID NO: 109911 - DNA, 25 bp, Homo sapien
tcaaccctttcgataccaggatttg

SEQ ID NO: 109912 - DNA, 25 bp, Homo sapien
tcacctggtctccaagtaaacgttg

SEQ ID NO: 109913 - DNA, 25 bp, Homo sapien
gcccgtctctgacatcctcgcgcag

SEQ ID NO: 109914 - DNA, 25 bp, Homo sapien
aacaggaagttgcccatcctcctcg

SEQ ID NO: 109915 - DNA, 25 bp, Homo sapien
agaggaggaattactctagggtaca

SEQ ID NO: 109916 - DNA, 25 bp, Homo sapien
tctagggtacaaggcctcgcccagg

SEQ ID NO: 109917 - DNA, 25 bp, Homo sapien
ttactctagggtacaaggcctcgcc

SEQ ID NO: 109918 - DNA, 25 bp, Homo sapien
cgctcgccacgacactgagtgttct

SEQ ID NO: 109919 - DNA, 25 bp, Homo sapien
cactgagtgttctgttttgggcgga

SEQ ID NO: 109920 - DNA, 25 bp, Homo sapien
gccgctgctaccaccctctatccca

SEQ ID NO: 109921 - DNA, 25 bp, Homo sapien
ttcgccaaggcctacgcacggcagt

SEQ ID NO: 109922 - DNA, 25 bp, Homo sapien
ctcctaagcgtcctcgctgcaagta

SEQ ID NO: 109923 - DNA, 25 bp, Homo sapien
agatgtgcggccactacacgcaggt

SEQ ID NO: 109924 - DNA, 25 bp, Homo sapien
catcacagacgagggcatggacgtg

SEQ ID NO: 109925 - DNA, 25 bp, Homo sapien
agtggcaccacgagcgtgagcacta

SEQ ID NO: 109926 - DNA, 25 bp, Homo sapien
ccgcggcgagaatctgttcgccatc

SEQ ID NO: 109927 - DNA, 25 bp, Homo sapien
gttcgccatcacagacgagggcatg

SEQ ID NO: 109928 - DNA, 25 bp, Homo sapien
agcgtgagcactacaacctcagcgc

SEQ ID NO: 109929 - DNA, 25 bp, Homo sapien
tgggcgtggtcagaaggcttcaaac

SEQ ID NO: 109930 - DNA, 25 bp, Homo sapien
ccacactttagggtctcgaggagcg

SEQ ID NO: 109931 - DNA, 25 bp, Homo sapien
cgaggtgggtgtcgccacactttag

SEQ ID NO: 109932 - DNA, 25 bp, Homo sapien
ggatgttagaaagtctggcggcttc

SEQ ID NO: 109933 - DNA, 25 bp, Homo sapien
tcaacccttcaaagggaggatgtta

SEQ ID NO: 109934 - DNA, 25 bp, Homo sapien
caagtggccggatttcaacccttca

SEQ ID NO: 109935 - DNA, 25 bp, Homo sapien
ccctgtcgttccaagtggccggatt

SEQ ID NO: 109936 - DNA, 25 bp, Homo sapien
tcaaacgggcgaggccagtcttgct

SEQ ID NO: 109937 - DNA, 25 bp, Homo sapien
ccggttggaggcctagcaggacact

SEQ ID NO: 109938 - DNA, 25 bp, Homo sapien
gcccagtgccacgaaaagagcctca

SEQ ID NO: 109939 - DNA, 25 bp, Homo sapien
tggatcgcgagctcgagcctcgacc

SEQ ID NO: 109940 - DNA, 25 bp, Homo sapien
acttccgggtccgaagctcccatgg

SEQ ID NO: 109941 - DNA, 25 bp, Homo sapien
cccaatatggtctgaggcgcttcca

SEQ ID NO: 109942 - DNA, 25 bp, Homo sapien
gcgtggaactctgcgcgagctgaat

SEQ ID NO: 109943 - DNA, 25 bp, Homo sapien
gcgagctgaatctcctgctgcagga

SEQ ID NO: 109944 - DNA, 25 bp, Homo sapien
ccctggcttcgggagttttctctgc

SEQ ID NO: 109945 - DNA, 25 bp, Homo sapien
cggcagtccagatcaaaaatggcgg

SEQ ID NO: 109946 - DNA, 25 bp, Homo sapien
gagagacccgagttcatcgcctacc

SEQ ID NO: 109947 - DNA, 25 bp, Homo sapien
tttctcggctgctgggtcggtcccg

SEQ ID NO: 109948 - DNA, 25 bp, Homo sapien
gcggcctatgtcgagtggcgcccat

SEQ ID NO: 109949 - DNA, 25 bp, Homo sapien
gcatgctgaatgtgtacctgaagtc

SEQ ID NO: 109950 - DNA, 25 bp, Homo sapien
acctgaagtcgcaccacggagagca

SEQ ID NO: 109951 - DNA, 25 bp, Homo sapien
gcaccacggagagcacgagagaccc

SEQ ID NO: 109952 - DNA, 25 bp, Homo sapien
gcgctgcggcagtccagatcaaaaa

SEQ ID NO: 109953 - DNA, 25 bp, Homo sapien
ctccgacaacttgccggtgagtggg

SEQ ID NO: 109954 - DNA, 25 bp, Homo sapien
ccgacatcctggaggttgggatgct

SEQ ID NO: 109955 - DNA, 25 bp, Homo sapien
acgagggaacctgacggagaccctg

SEQ ID NO: 109956 - DNA, 25 bp, Homo sapien
cacgggcgtgctttagcccggacga

SEQ ID NO: 109957 - DNA, 25 bp, Homo sapien
aggcatccgcgtctccgacaacttg

SEQ ID NO: 109958 - DNA, 25 bp, Homo sapien
tcggctcggtctactcaggcatccg

SEQ ID NO: 109959 - DNA, 25 bp, Homo sapien
ggttgggatgctcttgtccaaaatc

SEQ ID NO: 109960 - DNA, 25 bp, Homo sapien
tgtccaaaatcaactcgcttgccca

SEQ ID NO: 109961 - DNA, 25 bp, Homo sapien
cttcagcggcctgcaggattccggc

SEQ ID NO: 109962 - DNA, 25 bp, Homo sapien
ctgacgttaccggtcggcttcagcg

SEQ ID NO: 109963 - DNA, 25 bp, Homo sapien
aggattccggctcccaattggtcgg

SEQ ID NO: 109964 - DNA, 25 bp, Homo sapien
attggtcggcccgtccacggcttgc

SEQ ID NO: 109965 - DNA, 25 bp, Homo sapien
cacggcttgcgcagctcaccaatgg

SEQ ID NO: 109966 - DNA, 25 bp, Homo sapien
ttgcgcagctcaccaatggcagcgg

SEQ ID NO: 109967 - DNA, 25 bp, Homo sapien
gggtgcccacatccaagatggcgtc

SEQ ID NO: 109968 - DNA, 25 bp, Homo sapien
aagcggcctgggttggccctcagat

SEQ ID NO: 109969 - DNA, 25 bp, Homo sapien
gcccggcttcttcgtcacaggagac

SEQ ID NO: 109970 - DNA, 25 bp, Homo sapien
ggcgattgcttctgtctgttattta

SEQ ID NO: 109971 - DNA, 25 bp, Homo sapien
cggagcctgctttcgcagcgatcgc

SEQ ID NO: 109972 - DNA, 25 bp, Homo sapien
tgcgcaggcgtagtgctcctgcttc

SEQ ID NO: 109973 - DNA, 25 bp, Homo sapien
gaggagacctctcgaatcgcgcccg

SEQ ID NO: 109974 - DNA, 25 bp, Homo sapien
ccagatcccgtttagggcgcacaga

SEQ ID NO: 109975 - DNA, 25 bp, Homo sapien
cggcgcctgaactttctcgagtttg

SEQ ID NO: 109976 - DNA, 25 bp, Homo sapien
cagaacctaggtcagggtctcgctc

SEQ ID NO: 109977 - DNA, 25 bp, Homo sapien
taagcgcagcgccattttagcaacg

SEQ ID NO: 109978 - DNA, 25 bp, Homo sapien
gcctcagctcgcctgaaggcaggtc

SEQ ID NO: 109979 - DNA, 25 bp, Homo sapien
agccggttagaaccagtggcgcccg

SEQ ID NO: 109980 - DNA, 25 bp, Homo sapien
attttagcaacgcagaagcccggcg

SEQ ID NO: 109981 - DNA, 25 bp, Homo sapien
ccgagacttctgtaaaggactgggg

SEQ ID NO: 109982 - DNA, 25 bp, Homo sapien
ggtttcccagagtccttgggacgca

SEQ ID NO: 109983 - DNA, 25 bp, Homo sapien
gcctgcagcccgagacttctgtaaa

SEQ ID NO: 109984 - DNA, 25 bp, Homo sapien
acgagccagcgcctcacaaagggag

SEQ ID NO: 109985 - DNA, 25 bp, Homo sapien
gcgctgtccgtgacgtcatcaggct

SEQ ID NO: 109986 - DNA, 25 bp, Homo sapien
cgcagtactggacccgagcgcgacg

SEQ ID NO: 109987 - DNA, 25 bp, Homo sapien
tgacacacgtctctgcgcacacatt

SEQ ID NO: 109988 - DNA, 25 bp, Homo sapien
agcgggccaaacctcagctgccttt

SEQ ID NO: 109989 - DNA, 25 bp, Homo sapien
gagctgccgctgacacacgtctctg

SEQ ID NO: 109990 - DNA, 25 bp, Homo sapien
gtgacgtcatcaggctgcgctgccc

SEQ ID NO: 109991 - DNA, 25 bp, Homo sapien
ctggcttgtggggaaacgaaactga

SEQ ID NO: 109992 - DNA, 25 bp, Homo sapien
ccgcggttatgggtctcctcgcctt

SEQ ID NO: 109993 - DNA, 25 bp, Homo sapien
tggccgcgctgtatttctccgactt

SEQ ID NO: 109994 - DNA, 25 bp, Homo sapien
cgcgctgtatttctccgacttcggg

SEQ ID NO: 109995 - DNA, 25 bp, Homo sapien
tcgcgccgccggtctatggccatgg

SEQ ID NO: 109996 - DNA, 25 bp, Homo sapien
gtatttctccgacttcgggcgcctc

SEQ ID NO: 109997 - DNA, 25 bp, Homo sapien
agccgccgcggctcatcagttccgc

SEQ ID NO: 109998 - DNA, 25 bp, Homo sapien
tccagcaacaagaggctcggggccg

SEQ ID NO: 109999 - DNA, 25 bp, Homo sapien
gacccgtcatagtccagcaacaaga

SEQ ID NO: 110000 - DNA, 25 bp, Homo sapien
agggcagcaccgacccgtcatagtc

SEQ ID NO: 110001 - DNA, 25 bp, Homo sapien
cctcattggccaccgagtcagcggg

SEQ ID NO: 110002 - DNA, 25 bp, Homo sapien
acctctagagcgacgcccagattct

SEQ ID NO: 110003 - DNA, 25 bp, Homo sapien
gctatgtgcgcatgctcaagtcttc

SEQ ID NO: 110004 - DNA, 25 bp, Homo sapien
gacgcgcccaccaagtcgctatgtg

SEQ ID NO: 110005 - DNA, 25 bp, Homo sapien
ctcccgcttctttttagtcatgtta

SEQ ID NO: 110006 - DNA, 25 bp, Homo sapien
tgccgtcgccatcttgttgaggggc

SEQ ID NO: 110007 - DNA, 25 bp, Homo sapien
aagtcttcgtgcttctccctcattg

SEQ ID NO: 110008 - DNA, 25 bp, Homo sapien
tagtcatgttacttgccgggatccc

SEQ ID NO: 110009 - DNA, 25 bp, Homo sapien
gtttcctgaacgcaatatagcccgg

SEQ ID NO: 110010 - DNA, 25 bp, Homo sapien
ttttctcccggcaagtgcatccatc

SEQ ID NO: 110011 - DNA, 25 bp, Homo sapien
tctcgctgggtctggatagataaca

SEQ ID NO: 110012 - DNA, 25 bp, Homo sapien
cgcagcgcgatattactttgataca

SEQ ID NO: 110013 - DNA, 25 bp, Homo sapien
ttgatacactacctgctgcagcttg

SEQ ID NO: 110014 - DNA, 25 bp, Homo sapien
ccgggaggcgtgcattatttaccag

SEQ ID NO: 110015 - DNA, 25 bp, Homo sapien
gctctctcggagtgaccgtttcctg

SEQ ID NO: 110016 - DNA, 25 bp, Homo sapien
tgctcgcagtgacatcgcttttctc

SEQ ID NO: 110017 - DNA, 25 bp, Homo sapien
cttggaaggcgaaggcctcaacctc

SEQ ID NO: 110018 - DNA, 25 bp, Homo sapien
cgcggttgtcacacgcccaggaagc

SEQ ID NO: 110019 - DNA, 25 bp, Homo sapien
tgtcacacgcccaggaagcgggctg

SEQ ID NO: 110020 - DNA, 25 bp, Homo sapien
aggcgaaggcctcaacctcaaggga

SEQ ID NO: 110021 - DNA, 25 bp, Homo sapien
cttaggactggtataggcataggcg

SEQ ID NO: 110022 - DNA, 25 bp, Homo sapien
tcaacctcaagggaaggtgtgagtg

SEQ ID NO: 110023 - DNA, 25 bp, Homo sapien
cccaggttgggatccgagtggcacg

SEQ ID NO: 110024 - DNA, 25 bp, Homo sapien
ggcctcaacctcaagggaaggtgtg

SEQ ID NO: 110025 - DNA, 25 bp, Homo sapien
ggaggcaacgcgctcgcctctaatg

SEQ ID NO: 110026 - DNA, 25 bp, Homo sapien
gccaggaaaaatcccagggcggatg

SEQ ID NO: 110027 - DNA, 25 bp, Homo sapien
caggaaaaatcccagggcggatgca

SEQ ID NO: 110028 - DNA, 25 bp, Homo sapien
ggaaaaatcccagggcggatgcaca

SEQ ID NO: 110029 - DNA, 25 bp, Homo sapien
acgcgctcgcctctaatgccgtgag

SEQ ID NO: 110030 - DNA, 25 bp, Homo sapien
aaatcccagggcggatgcacactcg

SEQ ID NO: 110031 - DNA, 25 bp, Homo sapien
cgctcgcctctaatgccgtgagccc

SEQ ID NO: 110032 - DNA, 25 bp, Homo sapien
aacgcgctcgcctctaatgccgtga

SEQ ID NO: 110033 - DNA, 25 bp, Homo sapien
ctgcactcgtagctgccgctgctgt

SEQ ID NO: 110034 - DNA, 25 bp, Homo sapien
ggacgctcaccggagacctggaaga

SEQ ID NO: 110035 - DNA, 25 bp, Homo sapien
ccacatcgttggagacgctgcactc

SEQ ID NO: 110036 - DNA, 25 bp, Homo sapien
ctgctgtcgcgagttacggcgtcga

SEQ ID NO: 110037 - DNA, 25 bp, Homo sapien
gcagcagctgccctttgaaacgcca

SEQ ID NO: 110038 - DNA, 25 bp, Homo sapien
cctttgaaacgccacacagccgagg

SEQ ID NO: 110039 - DNA, 25 bp, Homo sapien
gcagccgagcccacatcgttggaga

SEQ ID NO: 110040 - DNA, 25 bp, Homo sapien
tgggaactgggctccacctccggcg

SEQ ID NO: 110041 - DNA, 25 bp, Homo sapien
gaagccattatagcgggccgtctgg

SEQ ID NO: 110042 - DNA, 25 bp, Homo sapien
tctggcagcggtaggtcccgctcat

SEQ ID NO: 110043 - DNA, 25 bp, Homo sapien
taggtcccgctcatgtctcggctca

SEQ ID NO: 110044 - DNA, 25 bp, Homo sapien
ggcagcagtgcagcctccttgtcca

SEQ ID NO: 110045 - DNA, 25 bp, Homo sapien
gtggtggactcacactgcacgttca

SEQ ID NO: 110046 - DNA, 25 bp, Homo sapien
ttgtccacgcgggaccagagcactg

SEQ ID NO: 110047 - DNA, 25 bp, Homo sapien
tcgcattgcagctcggcaggcgatc

SEQ ID NO: 110048 - DNA, 25 bp, Homo sapien
ggggcgcacgttgaagccattatag

SEQ ID NO: 110049 - DNA, 25 bp, Homo sapien
cgcaggcctaggaaacgaacccaga

SEQ ID NO: 110050 - DNA, 25 bp, Homo sapien
tccacgcggatggacttgatggccg

SEQ ID NO: 110051 - DNA, 25 bp, Homo sapien
ccgttctcagccttgcagtagtagc

SEQ ID NO: 110052 - DNA, 25 bp, Homo sapien
gatgcgcagcgtctcgttgaacacc

SEQ ID NO: 110053 - DNA, 25 bp, Homo sapien
gaacaccgatgtctcctggaacttg

SEQ ID NO: 110054 - DNA, 25 bp, Homo sapien
tcagactgtcagactcacacggggt

SEQ ID NO: 110055 - DNA, 25 bp, Homo sapien
ccagacagactcgtgggaatgcaca

SEQ ID NO: 110056 - DNA, 25 bp, Homo sapien
ttttcacaagcgcacgtggggcaca

SEQ ID NO: 110057 - DNA, 25 bp, Homo sapien
gtcgctcgctctcctgtttgattcc

SEQ ID NO: 110058 - DNA, 25 bp, Homo sapien
gcgcttcgatccaacaggccacgga

SEQ ID NO: 110059 - DNA, 25 bp, Homo sapien
ttgggctttgctgtgctgctttttc

SEQ ID NO: 110060 - DNA, 25 bp, Homo sapien
cgctcgctcagcaacttgggctttg

SEQ ID NO: 110061 - DNA, 25 bp, Homo sapien
ttgaaaaatattcgcgctctcgccc

SEQ ID NO: 110062 - DNA, 25 bp, Homo sapien
tgaagttagccgagccgccgataaa

SEQ ID NO: 110063 - DNA, 25 bp, Homo sapien
ggggctccgctcgagttaatcaatc

SEQ ID NO: 110064 - DNA, 25 bp, Homo sapien
ggccacggacgactgacaaacttgt

SEQ ID NO: 110065 - DNA, 25 bp, Homo sapien
ctcgtcttattacgtggctctcccg

SEQ ID NO: 110066 - DNA, 25 bp, Homo sapien
ggaaggagccatcgggccttctcct

SEQ ID NO: 110067 - DNA, 25 bp, Homo sapien
ccacgctgcggatggttcagagaga

SEQ ID NO: 110068 - DNA, 25 bp, Homo sapien
tggcgggtcatcctaccctgtacct

SEQ ID NO: 110069 - DNA, 25 bp, Homo sapien
ggatacgacagacatggcgcccgcc

SEQ ID NO: 110070 - DNA, 25 bp, Homo sapien
cgccattcacataggatacgacaga

SEQ ID NO: 110071 - DNA, 25 bp, Homo sapien
cgcgaccgctgcgtggcataaacta

SEQ ID NO: 110072 - DNA, 25 bp, Homo sapien
ggacttggaggcgttcagcacaccc

SEQ ID NO: 110073 - DNA, 25 bp, Homo sapien
caagaaggtgagtgcggccgagctc

SEQ ID NO: 110074 - DNA, 25 bp, Homo sapien
gaccgagggaccgacaggcggacag

SEQ ID NO: 110075 - DNA, 25 bp, Homo sapien
gagctccgtaggccgcggtcgacct

SEQ ID NO: 110076 - DNA, 25 bp, Homo sapien
actttccgttcgagctcatcccgga

SEQ ID NO: 110077 - DNA, 25 bp, Homo sapien
cgggactttccgttcgagctcatcc

SEQ ID NO: 110078 - DNA, 25 bp, Homo sapien
gtccgggactttccgttcgagctca

SEQ ID NO: 110079 - DNA, 25 bp, Homo sapien
gacgatgtggttctttgcccgggac

SEQ ID NO: 110080 - DNA, 25 bp, Homo sapien
ggccttgcctattccgcgccgccga

SEQ ID NO: 110081 - DNA, 25 bp, Homo sapien
aacgaagtggcacgcccggatccca

SEQ ID NO: 110082 - DNA, 25 bp, Homo sapien
gttctaagaatacgaaggcctcagc

SEQ ID NO: 110083 - DNA, 25 bp, Homo sapien
gccgccgagcaccatgggagacgct

SEQ ID NO: 110084 - DNA, 25 bp, Homo sapien
agcggccattgtccggtcagcgcag

SEQ ID NO: 110085 - DNA, 25 bp, Homo sapien
ccggatcccagctgatcagcggctg

SEQ ID NO: 110086 - DNA, 25 bp, Homo sapien
gacagcccgaggctctcgttttctc

SEQ ID NO: 110087 - DNA, 25 bp, Homo sapien
ttggagcgcaccattcgcgtttagg

SEQ ID NO: 110088 - DNA, 25 bp, Homo sapien
ccgggcgagaccattgtgactcctc

SEQ ID NO: 110089 - DNA, 25 bp, Homo sapien
ggatacgagactgctagggaacctg

SEQ ID NO: 110090 - DNA, 25 bp, Homo sapien
acgagactgctagggaacctgggct

SEQ ID NO: 110091 - DNA, 25 bp, Homo sapien
aggcaacgtcgtctcagacaggata

SEQ ID NO: 110092 - DNA, 25 bp, Homo sapien
tctcagacaggatacgagactgcta

SEQ ID NO: 110093 - DNA, 25 bp, Homo sapien
tcagacaggatacgagactgctagg

SEQ ID NO: 110094 - DNA, 25 bp, Homo sapien
caggatacgagactgctagggaacc

SEQ ID NO: 110095 - DNA, 25 bp, Homo sapien
tacgagactgctagggaacctgggc

SEQ ID NO: 110096 - DNA, 25 bp, Homo sapien
gatacgagactgctagggaacctgg

SEQ ID NO: 110097 - DNA, 25 bp, Homo sapien
ggacggctaccgctctcccagagca

SEQ ID NO: 110098 - DNA, 25 bp, Homo sapien
ccctgattcgaactcctctctttgg

SEQ ID NO: 110099 - DNA, 25 bp, Homo sapien
aactcctctctttgggaggctggta

SEQ ID NO: 110100 - DNA, 25 bp, Homo sapien
ctctttgggaggctggtagagccac

SEQ ID NO: 110101 - DNA, 25 bp, Homo sapien
actacaccttcgtggactgcgaacg

SEQ ID NO: 110102 - DNA, 25 bp, Homo sapien
accttcgtggactgcgaacgggacg

SEQ ID NO: 110103 - DNA, 25 bp, Homo sapien
ctgcgaacgggacggctaccgctct

SEQ ID NO: 110104 - DNA, 25 bp, Homo sapien
cgggcccaagaaatgaccctcgtca

SEQ ID NO: 110105 - DNA, 25 bp, Homo sapien
gacaccttccatgcgaaactgctgg

SEQ ID NO: 110106 - DNA, 25 bp, Homo sapien
gcgcgaaacttcatgatgccacagg

SEQ ID NO: 110107 - DNA, 25 bp, Homo sapien
tgccggtgatcttggcgcgaaactt

SEQ ID NO: 110108 - DNA, 25 bp, Homo sapien
acggtgccgctgacgtgaatgaaca

SEQ ID NO: 110109 - DNA, 25 bp, Homo sapien
catcgagatcttccgagacaccttc

SEQ ID NO: 110110 - DNA, 25 bp, Homo sapien
gctccaggtggatctcatcgagatc

SEQ ID NO: 110111 - DNA, 25 bp, Homo sapien
gggattccgcgtgccacaagccctt

SEQ ID NO: 110112 - DNA, 25 bp, Homo sapien
ctctagacagcctttgccggtgatc

SEQ ID NO: 110113 - DNA, 25 bp, Homo sapien
cgggcagaaaggagaagtcgcaatc

SEQ ID NO: 110114 - DNA, 25 bp, Homo sapien
tcactccaaggaggctgcgtatggc

SEQ ID NO: 110115 - DNA, 25 bp, Homo sapien
ttcacgagcgacgtgccctcaaaca

SEQ ID NO: 110116 - DNA, 25 bp, Homo sapien
gcggctttataaggcgcttcccatc

SEQ ID NO: 110117 - DNA, 25 bp, Homo sapien
gcagccgcgcacgaacatgttcacg

SEQ ID NO: 110118 - DNA, 25 bp, Homo sapien
actccgtgcggatctcgaagaactc

SEQ ID NO: 110119 - DNA, 25 bp, Homo sapien
gcctccttcgtgcacttcaaggctg

SEQ ID NO: 110120 - DNA, 25 bp, Homo sapien
gtcgcaatctcggttgaagtctctt

SEQ ID NO: 110121 - DNA, 25 bp, Homo sapien
cactacggatgagaaggtcctgggc

SEQ ID NO: 110122 - DNA, 25 bp, Homo sapien
cctgtggagtgacctcgtccagacc

SEQ ID NO: 110123 - DNA, 25 bp, Homo sapien
cgcagacccgatcggcaagttcttg

SEQ ID NO: 110124 - DNA, 25 bp, Homo sapien
gtgcaggaaggttctccaaggagta

SEQ ID NO: 110125 - DNA, 25 bp, Homo sapien
tctccaaggagtaggaccagaaagg

SEQ ID NO: 110126 - DNA, 25 bp, Homo sapien
ggttaatgtcgaggctgctaagtga

SEQ ID NO: 110127 - DNA, 25 bp, Homo sapien
ctgctaagtgatgctcgttaatttc

SEQ ID NO: 110128 - DNA, 25 bp, Homo sapien
tcaccggcgcacgtcactacggatg

SEQ ID NO: 110129 - DNA, 25 bp, Homo sapien
gttggatagaatgcggcccggtccc

SEQ ID NO: 110130 - DNA, 25 bp, Homo sapien
gccatggctgcgctgcagtatcaca

SEQ ID NO: 110131 - DNA, 25 bp, Homo sapien
tgcagtatcacagacgacgggaccc

SEQ ID NO: 110132 - DNA, 25 bp, Homo sapien
ccaaggaacggaggagtcacccaca

SEQ ID NO: 110133 - DNA, 25 bp, Homo sapien
aacggaggagtcacccacactacgc

SEQ ID NO: 110134 - DNA, 25 bp, Homo sapien
ttaactaggaatggcgcgatggcgc

SEQ ID NO: 110135 - DNA, 25 bp, Homo sapien
ggagaccgctgacttccagccaatc

SEQ ID NO: 110136 - DNA, 25 bp, Homo sapien
ccctgtgccgccttaactaggaatg

SEQ ID NO: 110137 - DNA, 25 bp, Homo sapien
tccccgtagggagctgcgcactgcg

SEQ ID NO: 110138 - DNA, 25 bp, Homo sapien
gggctcggtgggtgcatcctttatt

SEQ ID NO: 110139 - DNA, 25 bp, Homo sapien
gctggtgagtacttggtcggagcgc

SEQ ID NO: 110140 - DNA, 25 bp, Homo sapien
ggactcccaaccgtcagcctcgttc

SEQ ID NO: 110141 - DNA, 25 bp, Homo sapien
gccggcctcagtgggctgagtggtc

SEQ ID NO: 110142 - DNA, 25 bp, Homo sapien
tgcatcctttattggggagcgcggg

SEQ ID NO: 110143 - DNA, 25 bp, Homo sapien
gaggccctgatgcagccgggttccc

SEQ ID NO: 110144 - DNA, 25 bp, Homo sapien
ctcggtgggtgcatcctttattggg

SEQ ID NO: 110145 - DNA, 25 bp, Homo sapien
caggcgcactgtcggcgctcagagc

SEQ ID NO: 110146 - DNA, 25 bp, Homo sapien
agagcagtgcccgctatctcctggc

SEQ ID NO: 110147 - DNA, 25 bp, Homo sapien
cgggatcagtctccgcacgcggttc

SEQ ID NO: 110148 - DNA, 25 bp, Homo sapien
tccgcacgcggttccgcaggtggca

SEQ ID NO: 110149 - DNA, 25 bp, Homo sapien
gacttgaacgaaactccgagaccgc

SEQ ID NO: 110150 - DNA, 25 bp, Homo sapien
acgaaactccgagaccgctggcggg

SEQ ID NO: 110151 - DNA, 25 bp, Homo sapien
ctgaaagccggccaggcgcactgtc

SEQ ID NO: 110152 - DNA, 25 bp, Homo sapien
agtagggactggagacttggtgccc

SEQ ID NO: 110153 - DNA, 25 bp, Homo sapien
cgcctcgcgtccgttggccgataag

SEQ ID NO: 110154 - DNA, 25 bp, Homo sapien
aacagtgctgacacgtgtggccgga

SEQ ID NO: 110155 - DNA, 25 bp, Homo sapien
tcctagggccgaagtttccatcgtc

SEQ ID NO: 110156 - DNA, 25 bp, Homo sapien
tctcacctgaactaggccgggctgg

SEQ ID NO: 110157 - DNA, 25 bp, Homo sapien
gctgcctttagagtcgctgctgctt

SEQ ID NO: 110158 - DNA, 25 bp, Homo sapien
cgactctcgctggaatcaggacctg

SEQ ID NO: 110159 - DNA, 25 bp, Homo sapien
gcgtctcctccgtttgtgaagtctg

SEQ ID NO: 110160 - DNA, 25 bp, Homo sapien
tcgcgggcctaggtttccataccag

SEQ ID NO: 110161 - DNA, 25 bp, Homo sapien
agcgctagaagaggcttggcgctcc

SEQ ID NO: 110162 - DNA, 25 bp, Homo sapien
tgggcagacacgtgggccgcttctc

SEQ ID NO: 110163 - DNA, 25 bp, Homo sapien
cacaggacttgactctgggcagaca

SEQ ID NO: 110164 - DNA, 25 bp, Homo sapien
taaggagcgggaagaacacaggact

SEQ ID NO: 110165 - DNA, 25 bp, Homo sapien
gagcggccgcctcctagagaaagcc

SEQ ID NO: 110166 - DNA, 25 bp, Homo sapien
aacagctgtttgaatttggagctcc

SEQ ID NO: 110167 - DNA, 25 bp, Homo sapien
gaatttggagctccgcatgcgcagt

SEQ ID NO: 110168 - DNA, 25 bp, Homo sapien
acagagttgcttggccaagttggcc

SEQ ID NO: 110169 - DNA, 25 bp, Homo sapien
tcgtccacgtctacgaacagcgagg

SEQ ID NO: 110170 - DNA, 25 bp, Homo sapien
tcacgcagcgacactcgtctgaatc

SEQ ID NO: 110171 - DNA, 25 bp, Homo sapien
tctgaactgtcctcatctgcgtggc

SEQ ID NO: 110172 - DNA, 25 bp, Homo sapien
cgtggcccggaacaatatggacttc

SEQ ID NO: 110173 - DNA, 25 bp, Homo sapien
gggcttgtgtcccagaaggaattgc

SEQ ID NO: 110174 - DNA, 25 bp, Homo sapien
aaggaattgctctcgctctgcgatg

SEQ ID NO: 110175 - DNA, 25 bp, Homo sapien
gctctgcggaagacacctggcatca

SEQ ID NO: 110176 - DNA, 25 bp, Homo sapien
cagaactggtcagcgacgtccgggt

SEQ ID NO: 110177 - DNA, 25 bp, Homo sapien
tctcaccaatcacgtagtcgccgaa

SEQ ID NO: 110178 - DNA, 25 bp, Homo sapien
gccaggaactctcaccaatcacgta

SEQ ID NO: 110179 - DNA, 25 bp, Homo sapien
agaggtataggcagccgaatgtccc

SEQ ID NO: 110180 - DNA, 25 bp, Homo sapien
cagtgtctccggattttgggcccaa

SEQ ID NO: 110181 - DNA, 25 bp, Homo sapien
caaaagcgggtaggacagtgtctcc

SEQ ID NO: 110182 - DNA, 25 bp, Homo sapien
tcagacccgtcacacaacaaaagcg

SEQ ID NO: 110183 - DNA, 25 bp, Homo sapien
tctccgcgttggtcaagaagggcca

SEQ ID NO: 110184 - DNA, 25 bp, Homo sapien
cggacgtgttggacctctccgcgtt

SEQ ID NO: 110185 - DNA, 25 bp, Homo sapien
caagtaggactcagcccggcttctc

SEQ ID NO: 110186 - DNA, 25 bp, Homo sapien
ggcgtttagctctttgccacgggtg

SEQ ID NO: 110187 - DNA, 25 bp, Homo sapien
cagttcgcaaacgtgcgcccgggtt

SEQ ID NO: 110188 - DNA, 25 bp, Homo sapien
gcttctcgcagtcctctcgctaggg

SEQ ID NO: 110189 - DNA, 25 bp, Homo sapien
tgacccggatcagcgagtccagcgc

SEQ ID NO: 110190 - DNA, 25 bp, Homo sapien
gggcggtccagacacgtgaagttct

SEQ ID NO: 110191 - DNA, 25 bp, Homo sapien
tctgcgttcccgacgtttccctgaa

SEQ ID NO: 110192 - DNA, 25 bp, Homo sapien
agctcccacttgtcgcgctggaagc

SEQ ID NO: 110193 - DNA, 25 bp, Homo sapien
cgtgaacacgtgtgcctgggtgcaa

SEQ ID NO: 110194 - DNA, 25 bp, Homo sapien
tcggtcgcgtagctgacagcagtgc

SEQ ID NO: 110195 - DNA, 25 bp, Homo sapien
ctggctgtcggtcgcgtagctgaca

SEQ ID NO: 110196 - DNA, 25 bp, Homo sapien
gcgctgtgccaggtaggagtggcct

SEQ ID NO: 110197 - DNA, 25 bp, Homo sapien
aaaaaatggctctctgccgggtctg

SEQ ID NO: 110198 - DNA, 25 bp, Homo sapien
cgtgtgcctgggtgcaaaaaaaatg

SEQ ID NO: 110199 - DNA, 25 bp, Homo sapien
aacacgtgtgcctgggtgcaaaaaa

SEQ ID NO: 110200 - DNA, 25 bp, Homo sapien
ctcctcggtcagtgtgtgcgggatt

SEQ ID NO: 110201 - DNA, 25 bp, Homo sapien
ttctccaaagtgtttgcaggagccg

SEQ ID NO: 110202 - DNA, 25 bp, Homo sapien
ctccaagacgcctgacgtcagagcg

SEQ ID NO: 110203 - DNA, 25 bp, Homo sapien
gcttcccggggatagcgcggagcac

SEQ ID NO: 110204 - DNA, 25 bp, Homo sapien
tcctcggagtaagtgcggccggccc

SEQ ID NO: 110205 - DNA, 25 bp, Homo sapien
tctccctctgctttctttagcatgc

SEQ ID NO: 110206 - DNA, 25 bp, Homo sapien
gctttctttagcatgccccgcgggg

SEQ ID NO: 110207 - DNA, 25 bp, Homo sapien
caggctggcggttttgtttctccaa

SEQ ID NO: 110208 - DNA, 25 bp, Homo sapien
ctggcggttttgtttctccaaagtg

SEQ ID NO: 110209 - DNA, 25 bp, Homo sapien
tggaggtcaccttcagctactggga

SEQ ID NO: 110210 - DNA, 25 bp, Homo sapien
ggggccgttcgcatttgcatttatt

SEQ ID NO: 110211 - DNA, 25 bp, Homo sapien
cactgtcaggttggtggttacccta

SEQ ID NO: 110212 - DNA, 25 bp, Homo sapien
ccgcgtttttcctctttgctgcaga

SEQ ID NO: 110213 - DNA, 25 bp, Homo sapien
gtgccatgcacctcctcaagaagcg

SEQ ID NO: 110214 - DNA, 25 bp, Homo sapien
acaagaggttctcggcgcattacga

SEQ ID NO: 110215 - DNA, 25 bp, Homo sapien
gcctggtgaccctgaacgacatgaa

SEQ ID NO: 110216 - DNA, 25 bp, Homo sapien
tcctttgcactagacgacctcgatg

SEQ ID NO: 110217 - DNA, 25 bp, Homo sapien
agagttcgatgacctggtgtcggcc

SEQ ID NO: 110218 - DNA, 25 bp, Homo sapien
ttcgatgacctggtgtcggccctgc

SEQ ID NO: 110219 - DNA, 25 bp, Homo sapien
atgacctggtgtcggccctgcgctc

SEQ ID NO: 110220 - DNA, 25 bp, Homo sapien
caaggacttatgcaagctcaagcgc

SEQ ID NO: 110221 - DNA, 25 bp, Homo sapien
cttatgcaagctcaagcgcagccgc

SEQ ID NO: 110222 - DNA, 25 bp, Homo sapien
aagcgcagccgcaagcgatcaggga

SEQ ID NO: 110223 - DNA, 25 bp, Homo sapien
gggaggtcttcgacaaggacttatg

SEQ ID NO: 110224 - DNA, 25 bp, Homo sapien
ttcgacaaggacttatgcaagctca

SEQ ID NO: 110225 - DNA, 25 bp, Homo sapien
tcccagaagcggtcaagcagatagg

SEQ ID NO: 110226 - DNA, 25 bp, Homo sapien
gaagcctgatacgagcggaaccgca

SEQ ID NO: 110227 - DNA, 25 bp, Homo sapien
caataggcgaggacgcagtcccgcg

SEQ ID NO: 110228 - DNA, 25 bp, Homo sapien
agtgccaacgggtccctcccagaag

SEQ ID NO: 110229 - DNA, 25 bp, Homo sapien
atcgctccactgaggagtgccaacg

SEQ ID NO: 110230 - DNA, 25 bp, Homo sapien
gcggtccatctggagaacatcgctc

SEQ ID NO: 110231 - DNA, 25 bp, Homo sapien
gtcaagcagataggccgggagctac

SEQ ID NO: 110232 - DNA, 25 bp, Homo sapien
gcgccgccatgaagcctgatacgag

SEQ ID NO: 110233 - DNA, 25 bp, Homo sapien
ttgcagaccttgtagcgcaccatga

SEQ ID NO: 110234 - DNA, 25 bp, Homo sapien
ctgcgcttcgtccagatgttcgaga

SEQ ID NO: 110235 - DNA, 25 bp, Homo sapien
accttccgaggaggactgtagccgc

SEQ ID NO: 110236 - DNA, 25 bp, Homo sapien
tctgactcttgaggtccagggaggc

SEQ ID NO: 110237 - DNA, 25 bp, Homo sapien
tgaagtccaggagctcgttgcgcac

SEQ ID NO: 110238 - DNA, 25 bp, Homo sapien
ccgttggtctgcgagtacacattgc

SEQ ID NO: 110239 - DNA, 25 bp, Homo sapien
agtacacattgctcacggccgctgc

SEQ ID NO: 110240 - DNA, 25 bp, Homo sapien
ccatgtcgaaggagtggctgcgttt

SEQ ID NO: 110241 - DNA, 25 bp, Homo sapien
gccctgagccgcttattcagttata

SEQ ID NO: 110242 - DNA, 25 bp, Homo sapien
acggatcacacgctccaatctggga

SEQ ID NO: 110243 - DNA, 25 bp, Homo sapien
gcatacgcgcgtacccggtttctct

SEQ ID NO: 110244 - DNA, 25 bp, Homo sapien
ttcaagttcagacgagcctgccggg

SEQ ID NO: 110245 - DNA, 25 bp, Homo sapien
gccgcggaaaccagagggattcacg

SEQ ID NO: 110246 - DNA, 25 bp, Homo sapien
catcttggaatgtggggtgtcttca

SEQ ID NO: 110247 - DNA, 25 bp, Homo sapien
attcccaggaacctcgggcatcttg

SEQ ID NO: 110248 - DNA, 25 bp, Homo sapien
gagacgaccaacaccgccgcggaaa

SEQ ID NO: 110249 - DNA, 25 bp, Homo sapien
gctgtagtcatttataaccaccctg

SEQ ID NO: 110250 - DNA, 25 bp, Homo sapien
cgggtcaccatctccgcgctgtagt

SEQ ID NO: 110251 - DNA, 25 bp, Homo sapien
gtcgcttaactctccgtggtgccca

SEQ ID NO: 110252 - DNA, 25 bp, Homo sapien
gcttcggaaagcctgagccgtctcg

SEQ ID NO: 110253 - DNA, 25 bp, Homo sapien
cgcttcaggaacacgcagtgctgga

SEQ ID NO: 110254 - DNA, 25 bp, Homo sapien
accctgaagttggataatgcgccgc

SEQ ID NO: 110255 - DNA, 25 bp, Homo sapien
gatcagcgagcagccgactaacttg

SEQ ID NO: 110256 - DNA, 25 bp, Homo sapien
tgcccagctgaaggccagcgcgctt

SEQ ID NO: 110257 - DNA, 25 bp, Homo sapien
ggaggttctcgcaccagccaggcga

SEQ ID NO: 110258 - DNA, 25 bp, Homo sapien
tgttctcgcatttgccatccgggca

SEQ ID NO: 110259 - DNA, 25 bp, Homo sapien
gaagctcccgggcttgttctcgcat

SEQ ID NO: 110260 - DNA, 25 bp, Homo sapien
tgacaggcgatgcacttgaagctcc

SEQ ID NO: 110261 - DNA, 25 bp, Homo sapien
agggcagcctctactcccggaaggc

SEQ ID NO: 110262 - DNA, 25 bp, Homo sapien
cgtctgcggcggaaagacctagcct

SEQ ID NO: 110263 - DNA, 25 bp, Homo sapien
cactcgttcacgtctgcggcggaaa

SEQ ID NO: 110264 - DNA, 25 bp, Homo sapien
ccatccgggcaagagcttgggtccc

SEQ ID NO: 110265 - DNA, 25 bp, Homo sapien
cgtgtgtcccactcaggtagttctg

SEQ ID NO: 110266 - DNA, 25 bp, Homo sapien
ggcgctcagagcttctcgtccagct

SEQ ID NO: 110267 - DNA, 25 bp, Homo sapien
tcctcttaggcgtaggagaacaacc

SEQ ID NO: 110268 - DNA, 25 bp, Homo sapien
aacagctgctgtgttcctcttaggc

SEQ ID NO: 110269 - DNA, 25 bp, Homo sapien
tgggcacagccaggaacagctgctg

SEQ ID NO: 110270 - DNA, 25 bp, Homo sapien
aggctggccacgctgaggccatctc

SEQ ID NO: 110271 - DNA, 25 bp, Homo sapien
ccctaaagtgcacgcggggaccgtg

SEQ ID NO: 110272 - DNA, 25 bp, Homo sapien
aggcgcagtctagccgctccatgac

SEQ ID NO: 110273 - DNA, 25 bp, Homo sapien
gttctggccgcaaacttaaacctgc

SEQ ID NO: 110274 - DNA, 25 bp, Homo sapien
gcccgcgcatgcgtaacgaaactgc

SEQ ID NO: 110275 - DNA, 25 bp, Homo sapien
ctacactaggggacacatgcgcgcc

SEQ ID NO: 110276 - DNA, 25 bp, Homo sapien
aggagccaatatccagcggcccaga

SEQ ID NO: 110277 - DNA, 25 bp, Homo sapien
gcgcctgcgtagtactaagctcaag

SEQ ID NO: 110278 - DNA, 25 bp, Homo sapien
agcgcctgcgtattcctttcactgg

SEQ ID NO: 110279 - DNA, 25 bp, Homo sapien
gagtccggtactggagccaatcagc

SEQ ID NO: 110280 - DNA, 25 bp, Homo sapien
ttcgccattttgctaggcagcggca

SEQ ID NO: 110281 - DNA, 25 bp, Homo sapien
tcttttgggatgaaccggctcagtc

SEQ ID NO: 110282 - DNA, 25 bp, Homo sapien
gtcgcttccgattggcgttgtccca

SEQ ID NO: 110283 - DNA, 25 bp, Homo sapien
tgtcccaaggaagcctgcgcggatt

SEQ ID NO: 110284 - DNA, 25 bp, Homo sapien
gacctactggtctttcggaagcctc

SEQ ID NO: 110285 - DNA, 25 bp, Homo sapien
cgacggccggcacttgcacttaagt

SEQ ID NO: 110286 - DNA, 25 bp, Homo sapien
ttaacttcgtgctgcggcttcctta

SEQ ID NO: 110287 - DNA, 25 bp, Homo sapien
cgtcataagtatatgcccgccgttg

SEQ ID NO: 110288 - DNA, 25 bp, Homo sapien
tcccgcgagctaaggcacagtttaa

SEQ ID NO: 110289 - DNA, 25 bp, Homo sapien
cccggcttgagcagtcgtgtaacaa

SEQ ID NO: 110290 - DNA, 25 bp, Homo sapien
cctcattttcatgtcggcgcgagca

SEQ ID NO: 110291 - DNA, 25 bp, Homo sapien
ctgcagagtggaacgaccttccctg

SEQ ID NO: 110292 - DNA, 25 bp, Homo sapien
ccggggactgtctctcacatccatt

SEQ ID NO: 110293 - DNA, 25 bp, Homo sapien
agagcgcttagaggaggaacattta

SEQ ID NO: 110294 - DNA, 25 bp, Homo sapien
gggcaggagcttcactgttcacaca

SEQ ID NO: 110295 - DNA, 25 bp, Homo sapien
tgcgcgtgggcacttacacgttccc

SEQ ID NO: 110296 - DNA, 25 bp, Homo sapien
agccggctacgcacattccggagga

SEQ ID NO: 110297 - DNA, 25 bp, Homo sapien
gcgctgggatcactcaacaccaaga

SEQ ID NO: 110298 - DNA, 25 bp, Homo sapien
ctgggaacgacagaaacctgcctta

SEQ ID NO: 110299 - DNA, 25 bp, Homo sapien
ttttccctggatcttccgcggcaga

SEQ ID NO: 110300 - DNA, 25 bp, Homo sapien
accctcgtttgtacggctgcgcgaa

SEQ ID NO: 110301 - DNA, 25 bp, Homo sapien
accactggagatggggtagctacgc

SEQ ID NO: 110302 - DNA, 25 bp, Homo sapien
cctcttctaggacacgtggccagcg

SEQ ID NO: 110303 - DNA, 25 bp, Homo sapien
cgaattcctgcatcgcaacgctggg

SEQ ID NO: 110304 - DNA, 25 bp, Homo sapien
atgtgccaggcgtaaagctccgatt

SEQ ID NO: 110305 - DNA, 25 bp, Homo sapien
cagcctcgggcaggtacactttggt

SEQ ID NO: 110306 - DNA, 25 bp, Homo sapien
ttccactgctgacttaccggtttta

SEQ ID NO: 110307 - DNA, 25 bp, Homo sapien
ctgctacccaacgatgacgcaagta

SEQ ID NO: 110308 - DNA, 25 bp, Homo sapien
ggctgctccgaaaaacgacctcaca

SEQ ID NO: 110309 - DNA, 25 bp, Homo sapien
tctcgtcagcaagcagggccgacct

SEQ ID NO: 110310 - DNA, 25 bp, Homo sapien
tcacaggaatggctgcaagagcgcc

SEQ ID NO: 110311 - DNA, 25 bp, Homo sapien
cgctttatcggacaggaccaacgca

SEQ ID NO: 110312 - DNA, 25 bp, Homo sapien
gagctagaactctggcgcctactta

SEQ ID NO: 110313 - DNA, 25 bp, Homo sapien
ctcacggcggaatctcaagcacttc

SEQ ID NO: 110314 - DNA, 25 bp, Homo sapien
gcccgctttcttgacctcaggacga

SEQ ID NO: 110315 - DNA, 25 bp, Homo sapien
cccagactcagaagagccgcggtca

SEQ ID NO: 110316 - DNA, 25 bp, Homo sapien
cttttagggcccatgcacttgctga

SEQ ID NO: 110317 - DNA, 25 bp, Homo sapien
aactgtgctttctttgcggtggaga

SEQ ID NO: 110318 - DNA, 25 bp, Homo sapien
ctaggccgagcagggaatcgttaca

SEQ ID NO: 110319 - DNA, 25 bp, Homo sapien
cggatatccgcgcagaaactgtgct

SEQ ID NO: 110320 - DNA, 25 bp, Homo sapien
cagtgcctaacgcagttgctccagg

SEQ ID NO: 110321 - DNA, 25 bp, Homo sapien
ccggcgcgtaattggtgtcaactgt

SEQ ID NO: 110322 - DNA, 25 bp, Homo sapien
tgcgataattgctactgtctgggga

SEQ ID NO: 110323 - DNA, 25 bp, Homo sapien
gcgtctgtcagtccgcattaagata

SEQ ID NO: 110324 - DNA, 25 bp, Homo sapien
ccctggcagtaatttggctctgaaa

SEQ ID NO: 110325 - DNA, 25 bp, Homo sapien
gcctttgggacgcagttccattctg

SEQ ID NO: 110326 - DNA, 25 bp, Homo sapien
tggaggcgcaaacggctctgccttt

SEQ ID NO: 110327 - DNA, 25 bp, Homo sapien
tcttcgctgcagattccgggaactc

SEQ ID NO: 110328 - DNA, 25 bp, Homo sapien
ttaagatatgcaaagccgaggcgcc

SEQ ID NO: 110329 - DNA, 25 bp, Homo sapien
cttgcctgccgcacaatcggagctt

SEQ ID NO: 110330 - DNA, 25 bp, Homo sapien
aggcccggcaacaatagcactttta

SEQ ID NO: 110331 - DNA, 25 bp, Homo sapien
accgctaccgctggtggtggctctc

SEQ ID NO: 110332 - DNA, 25 bp, Homo sapien
caccagggctagcactgtaccgcta

SEQ ID NO: 110333 - DNA, 25 bp, Homo sapien
tcgcgcactaaacgcttcctggctg

SEQ ID NO: 110334 - DNA, 25 bp, Homo sapien
tggggctccctagtggagatctgtc

SEQ ID NO: 110335 - DNA, 25 bp, Homo sapien
atttgggactgtttggttctgagcg

SEQ ID NO: 110336 - DNA, 25 bp, Homo sapien
gagatctgtcgaggggcaccaccag

SEQ ID NO: 110337 - DNA, 25 bp, Homo sapien
cagaacccgaaaggagcgataattc

SEQ ID NO: 110338 - DNA, 25 bp, Homo sapien
gcctggagaggacaatgtacagtct

SEQ ID NO: 110339 - DNA, 25 bp, Homo sapien
ggcgcgtcaactggggcaaattaac

SEQ ID NO: 110340 - DNA, 25 bp, Homo sapien
cgcctcgcagcctctggtttcaaag

SEQ ID NO: 110341 - DNA, 25 bp, Homo sapien
gcggccagagccttcgaagtcagaa

SEQ ID NO: 110342 - DNA, 25 bp, Homo sapien
ggcggacaaacagcgcactgtgctt

SEQ ID NO: 110343 - DNA, 25 bp, Homo sapien
tgtacagtctgttctaacacccacc

SEQ ID NO: 110344 - DNA, 25 bp, Homo sapien
gataattcaccctagtgtcccgcgg

SEQ ID NO: 110345 - DNA, 25 bp, Homo sapien
cgcagagagttccttggagtgccct

SEQ ID NO: 110346 - DNA, 25 bp, Homo sapien
tcacagacaggcctgaacgcgcaga

SEQ ID NO: 110347 - DNA, 25 bp, Homo sapien
ctgccagcttcacagacaggcctga

SEQ ID NO: 110348 - DNA, 25 bp, Homo sapien
gctcccattgtcctccgcctgccag

SEQ ID NO: 110349 - DNA, 25 bp, Homo sapien
gcctgaacgcgcagagagttccttg

SEQ ID NO: 110350 - DNA, 25 bp, Homo sapien
gcatcctcttagtggctgtcctggc

SEQ ID NO: 110351 - DNA, 25 bp, Homo sapien
ccttggagtgccctgattttgtccc

SEQ ID NO: 110352 - DNA, 25 bp, Homo sapien
aacctccgcatcctcttagtggctg

SEQ ID NO: 110353 - DNA, 25 bp, Homo sapien
agccgccggtgttcatgcagatgcc

SEQ ID NO: 110354 - DNA, 25 bp, Homo sapien
ttggcgcattcgttcaggtctgtgc

SEQ ID NO: 110355 - DNA, 25 bp, Homo sapien
tgcgctcacccacgcagtagcggtg

SEQ ID NO: 110356 - DNA, 25 bp, Homo sapien
gcctcgcactcgttcacatctgaga

SEQ ID NO: 110357 - DNA, 25 bp, Homo sapien
ccggggtagcagttgcacttgtagt

SEQ ID NO: 110358 - DNA, 25 bp, Homo sapien
acatctgagaagaacgggtaggcca

SEQ ID NO: 110359 - DNA, 25 bp, Homo sapien
aaagttgatgcagaagccgccgtcg

SEQ ID NO: 110360 - DNA, 25 bp, Homo sapien
tagccgcggttgcagtggcaattgt

SEQ ID NO: 110361 - DNA, 25 bp, Homo sapien
aacgcgaagggagcgctaacgcgca

SEQ ID NO: 110362 - DNA, 25 bp, Homo sapien
ggcacccggagcgagctgctaagcc

SEQ ID NO: 110363 - DNA, 25 bp, Homo sapien
agcgagctgctaagccggactggac

SEQ ID NO: 110364 - DNA, 25 bp, Homo sapien
agcgccggctagttgctcaacctgc

SEQ ID NO: 110365 - DNA, 25 bp, Homo sapien
gctcaacctgctggattagtcactc

SEQ ID NO: 110366 - DNA, 25 bp, Homo sapien
ctggattagtcactcggcgggaccc

SEQ ID NO: 110367 - DNA, 25 bp, Homo sapien
tcggaaaaacgcgaagggagcgcta

SEQ ID NO: 110368 - DNA, 25 bp, Homo sapien
acgcagtctccctgctcgagctcgg

SEQ ID NO: 110369 - DNA, 25 bp, Homo sapien
tgacaagttaagaagtcagaaagtc

SEQ ID NO: 110370 - DNA, 25 bp, Homo sapien
gccttactggcgctgacagagcctc

SEQ ID NO: 110371 - DNA, 25 bp, Homo sapien
cggccaaggccgattgtttagtctg

SEQ ID NO: 110372 - DNA, 25 bp, Homo sapien
ggcatctggaattgcgctgcgctca

SEQ ID NO: 110373 - DNA, 25 bp, Homo sapien
ttaactctgggatttgctgacaagt

SEQ ID NO: 110374 - DNA, 25 bp, Homo sapien
cagaaagtcagtgacggcgggaact

SEQ ID NO: 110375 - DNA, 25 bp, Homo sapien
agcgcacagcagctccgtgctttgg

SEQ ID NO: 110376 - DNA, 25 bp, Homo sapien
tgtgcatttttaactctgggatttg

SEQ ID NO: 110377 - DNA, 25 bp, Homo sapien
acgatctggctgacacctctactca

SEQ ID NO: 110378 - DNA, 25 bp, Homo sapien
acttgagagcgtctggaaatggccc

SEQ ID NO: 110379 - DNA, 25 bp, Homo sapien
ctcggggatagagcggaaaacttct

SEQ ID NO: 110380 - DNA, 25 bp, Homo sapien
acttgtcttgctgaggtcgcacctc

SEQ ID NO: 110381 - DNA, 25 bp, Homo sapien
gacaaagaatacttcccggcccaga

SEQ ID NO: 110382 - DNA, 25 bp, Homo sapien
cggcgcactttgttccagccagggc

SEQ ID NO: 110383 - DNA, 25 bp, Homo sapien
gtgtttgcaaactgcccgcccgaga

SEQ ID NO: 110384 - DNA, 25 bp, Homo sapien
cgctcgctggctcactttgtgtttg

SEQ ID NO: 110385 - DNA, 25 bp, Homo sapien
cgcagggtgtcatggcaaatgttac

SEQ ID NO: 110386 - DNA, 25 bp, Homo sapien
acaaaaggtttctccgcatgtgggg

SEQ ID NO: 110387 - DNA, 25 bp, Homo sapien
tacggctcagattaagcgattgtta

SEQ ID NO: 110388 - DNA, 25 bp, Homo sapien
ttaatactcgctacgccatatgggc

SEQ ID NO: 110389 - DNA, 25 bp, Homo sapien
ccatatgggcccgtgaaaaggcaca

SEQ ID NO: 110390 - DNA, 25 bp, Homo sapien
cccaaggtaggtggaactcgtcact

SEQ ID NO: 110391 - DNA, 25 bp, Homo sapien
tcgcccgcccaggttctttgaagag

SEQ ID NO: 110392 - DNA, 25 bp, Homo sapien
ctccgggcatccatcagtctgttaa

SEQ ID NO: 110393 - DNA, 25 bp, Homo sapien
gcctccctcgtggattagcaagcga

SEQ ID NO: 110394 - DNA, 25 bp, Homo sapien
agtctctcatcacgaatcaggcttc

SEQ ID NO: 110395 - DNA, 25 bp, Homo sapien
cccggtgaggccatcctcggaaatt

SEQ ID NO: 110396 - DNA, 25 bp, Homo sapien
tcctcggaaattggggtcattctca

SEQ ID NO: 110397 - DNA, 25 bp, Homo sapien
gggtcattctcatttgcaaagcgga

SEQ ID NO: 110398 - DNA, 25 bp, Homo sapien
caaatttattccgaggcaggagccc

SEQ ID NO: 110399 - DNA, 25 bp, Homo sapien
ttaggccctttgtaattatcgctcc

SEQ ID NO: 110400 - DNA, 25 bp, Homo sapien
cagcgtaacgaattagtctctcatc

SEQ ID NO: 110401 - DNA, 25 bp, Homo sapien
tgagaaacttgatcgcgcccatctt

SEQ ID NO: 110402 - DNA, 25 bp, Homo sapien
ctaggcggccctagacaagtacggc

SEQ ID NO: 110403 - DNA, 25 bp, Homo sapien
tggaggccgcaattattcagacagt

SEQ ID NO: 110404 - DNA, 25 bp, Homo sapien
ggatttcccggacagacaactctgg

SEQ ID NO: 110405 - DNA, 25 bp, Homo sapien
gctggttggtcactaaccggatttc

SEQ ID NO: 110406 - DNA, 25 bp, Homo sapien
gggctgaattcggaggacctctctt

SEQ ID NO: 110407 - DNA, 25 bp, Homo sapien
gaagccctcggattcagtctggatc

SEQ ID NO: 110408 - DNA, 25 bp, Homo sapien
ctgaaccctcttggactgcctggca

SEQ ID NO: 110409 - DNA, 25 bp, Homo sapien
tccggattcttagcgcggactcaga

SEQ ID NO: 110410 - DNA, 25 bp, Homo sapien
agcaggcggccttcgagcttccttc

SEQ ID NO: 110411 - DNA, 25 bp, Homo sapien
agtcaggaagttcaagatggccgcc

SEQ ID NO: 110412 - DNA, 25 bp, Homo sapien
gcctaacggcgagagtcaaactttg

SEQ ID NO: 110413 - DNA, 25 bp, Homo sapien
gtaagtagtctctgtgagtgggcca

SEQ ID NO: 110414 - DNA, 25 bp, Homo sapien
cgggagcagccagagtaagtagtct

SEQ ID NO: 110415 - DNA, 25 bp, Homo sapien
gagacccagtcgctacgggagcagc

SEQ ID NO: 110416 - DNA, 25 bp, Homo sapien
tcaaactttgctttttccggcgcga

SEQ ID NO: 110417 - DNA, 25 bp, Homo sapien
tcttcagcccaagtgaaatgccccg

SEQ ID NO: 110418 - DNA, 25 bp, Homo sapien
ttcagcccaagtgaaatgccccgtc

SEQ ID NO: 110419 - DNA, 25 bp, Homo sapien
agcccaagtgaaatgccccgtcccg

SEQ ID NO: 110420 - DNA, 25 bp, Homo sapien
gcgcctggcgccgtctgtaacctac

SEQ ID NO: 110421 - DNA, 25 bp, Homo sapien
gggggagcctctcacgccaagtacg

SEQ ID NO: 110422 - DNA, 25 bp, Homo sapien
tctgtaacctacccgcgattcctgg

SEQ ID NO: 110423 - DNA, 25 bp, Homo sapien
ctgtaacctacccgcgattcctggg

SEQ ID NO: 110424 - DNA, 25 bp, Homo sapien
gtctgtaacctacccgcgattcctg

SEQ ID NO: 110425 - DNA, 25 bp, Homo sapien
gaaaacttttgtctgccgcgagcgg

SEQ ID NO: 110426 - DNA, 25 bp, Homo sapien
caacccagtgtcttcagcccaagtg

SEQ ID NO: 110427 - DNA, 25 bp, Homo sapien
aaaacttttgtctgccgcgagcggc

SEQ ID NO: 110428 - DNA, 25 bp, Homo sapien
cgaaaacttttgtctgccgcgagcg

SEQ ID NO: 110429 - DNA, 25 bp, Homo sapien
ccgaaaacttttgtctgccgcgagc

SEQ ID NO: 110430 - DNA, 25 bp, Homo sapien
cccgaaaacttttgtctgccgcgag

SEQ ID NO: 110431 - DNA, 25 bp, Homo sapien
tcccgaaaacttttgtctgccgcga

SEQ ID NO: 110432 - DNA, 25 bp, Homo sapien
cttccctctcgtgccggccagtccc

SEQ ID NO: 110433 - DNA, 25 bp, Homo sapien
tgttctgcgagttcctgacgctgtg

SEQ ID NO: 110434 - DNA, 25 bp, Homo sapien
tgccctgcgacctggactgcggcat

SEQ ID NO: 110435 - DNA, 25 bp, Homo sapien
gcatcctgtcctgcctgttctgcga

SEQ ID NO: 110436 - DNA, 25 bp, Homo sapien
ggcatcctggatgcctgctgcgagt

SEQ ID NO: 110437 - DNA, 25 bp, Homo sapien
tggactgcgccacctgtggctcctg

SEQ ID NO: 110438 - DNA, 25 bp, Homo sapien
tctggcgagtgtgccgactgcgacc

SEQ ID NO: 110439 - DNA, 25 bp, Homo sapien
gctcctgcagctcggaggactcgtg

SEQ ID NO: 110440 - DNA, 25 bp, Homo sapien
cgctgtgcaacatcgtcctggactg

SEQ ID NO: 110441 - DNA, 25 bp, Homo sapien
ttggtttgtgagcaaccctctcgcc

SEQ ID NO: 110442 - DNA, 25 bp, Homo sapien
agccattttggtctctgcctgaagc

SEQ ID NO: 110443 - DNA, 25 bp, Homo sapien
tcccgttcggcacagaggaaattgc

SEQ ID NO: 110444 - DNA, 25 bp, Homo sapien
ctcgcacgctaattgctcaacgttg

SEQ ID NO: 110445 - DNA, 25 bp, Homo sapien
ctcctaggcgaggtcataaacacca

SEQ ID NO: 110446 - DNA, 25 bp, Homo sapien
tacagcttctcaagccgggtggccg

SEQ ID NO: 110447 - DNA, 25 bp, Homo sapien
attagccattttcatcccgggattt

SEQ ID NO: 110448 - DNA, 25 bp, Homo sapien
cgttgatttgatctcccgttcggca

SEQ ID NO: 110449 - DNA, 25 bp, Homo sapien
aggcgcgctacacgtcgcccaaggg

SEQ ID NO: 110450 - DNA, 25 bp, Homo sapien
gctccagcacggacgagtccacgta

SEQ ID NO: 110451 - DNA, 25 bp, Homo sapien
cgcccaagggcaacaagtacgtggt

SEQ ID NO: 110452 - DNA, 25 bp, Homo sapien
gttttctacctggacctctccttca

SEQ ID NO: 110453 - DNA, 25 bp, Homo sapien
ctcctagaactgaagcgctgcggca

SEQ ID NO: 110454 - DNA, 25 bp, Homo sapien
gtacctcatgttcgccttcaacctg

SEQ ID NO: 110455 - DNA, 25 bp, Homo sapien
ttccggcgctacagcagcctatacg

SEQ ID NO: 110456 - DNA, 25 bp, Homo sapien
tccaggccgtcaagtacctcatgtt

SEQ ID NO: 110457 - DNA, 25 bp, Homo sapien
tctgaaggtcaatctgtccgccgcc

SEQ ID NO: 110458 - DNA, 25 bp, Homo sapien
aacttcttgcgagttcaccatcacg

SEQ ID NO: 110459 - DNA, 25 bp, Homo sapien
cggctccggcaacttgtcgcaagtt

SEQ ID NO: 110460 - DNA, 25 bp, Homo sapien
ggcttcttcaagagaccgagctgga

SEQ ID NO: 110461 - DNA, 25 bp, Homo sapien
taacccacggggagaaagagactgc

SEQ ID NO: 110462 - DNA, 25 bp, Homo sapien
cccagggtcatagaataacccacgg

SEQ ID NO: 110463 - DNA, 25 bp, Homo sapien
cggttacataaggtcgcggagaagc

SEQ ID NO: 110464 - DNA, 25 bp, Homo sapien
cgctcacctcgctctgaaggtcaat

SEQ ID NO: 110465 - DNA, 25 bp, Homo sapien
ctttgcagtcgggagcagtgagcat

SEQ ID NO: 110466 - DNA, 25 bp, Homo sapien
acgcagcctagaaggtccctttgga

SEQ ID NO: 110467 - DNA, 25 bp, Homo sapien
cggcagcaccaacgagacgctgcgg

SEQ ID NO: 110468 - DNA, 25 bp, Homo sapien
agcaccaacgagacgctgcgggctg

SEQ ID NO: 110469 - DNA, 25 bp, Homo sapien
cgaccggcacgcagcctagaaggtc

SEQ ID NO: 110470 - DNA, 25 bp, Homo sapien
tcgggagcagtgagcatgcgcagac

SEQ ID NO: 110471 - DNA, 25 bp, Homo sapien
cagcctagaaggtccctttggagga

SEQ ID NO: 110472 - DNA, 25 bp, Homo sapien
aaggtccctttggaggactttgcag

SEQ ID NO: 110473 - DNA, 25 bp, Homo sapien
gaagggccgcgctattagggcgggc

SEQ ID NO: 110474 - DNA, 25 bp, Homo sapien
cctgacggcagagtcggtccagaac

SEQ ID NO: 110475 - DNA, 25 bp, Homo sapien
gtcggtccagaactgcccggacagc

SEQ ID NO: 110476 - DNA, 25 bp, Homo sapien
gacgcacagcgagggtgagacccca

SEQ ID NO: 110477 - DNA, 25 bp, Homo sapien
cagagtcggtccagaactgcccgga

SEQ ID NO: 110478 - DNA, 25 bp, Homo sapien
cagcggactcgggaaacaccgcgtc

SEQ ID NO: 110479 - DNA, 25 bp, Homo sapien
acagcgacgcacagcgagggtgaga

SEQ ID NO: 110480 - DNA, 25 bp, Homo sapien
cggtccagaactgcccggacagcga

SEQ ID NO: 110481 - DNA, 25 bp, Homo sapien
ggctcccggcgtctgctggatgcct

SEQ ID NO: 110482 - DNA, 25 bp, Homo sapien
agatcccataaatgtggttttgttt

SEQ ID NO: 110483 - DNA, 25 bp, Homo sapien
accctgagatcccataaatgtggtt

SEQ ID NO: 110484 - DNA, 25 bp, Homo sapien
gccagagagcccttgcacctgcatg

SEQ ID NO: 110485 - DNA, 25 bp, Homo sapien
tgaaaacccagcgtaaacgcggctc

SEQ ID NO: 110486 - DNA, 25 bp, Homo sapien
ttcagcgaatggttgaaaacccagc

SEQ ID NO: 110487 - DNA, 25 bp, Homo sapien
gcgaggcgtttccattcagcgaatg

SEQ ID NO: 110488 - DNA, 25 bp, Homo sapien
gagcccgcacatttccaccctgaga

SEQ ID NO: 110489 - DNA, 25 bp, Homo sapien
cctctgactcggaacctgaaggatt

SEQ ID NO: 110490 - DNA, 25 bp, Homo sapien
agggaccaaacctcggtgaactctg

SEQ ID NO: 110491 - DNA, 25 bp, Homo sapien
ggcggttccagcctgcaaactcaga

SEQ ID NO: 110492 - DNA, 25 bp, Homo sapien
gagcaatgccgcctggagactattc

SEQ ID NO: 110493 - DNA, 25 bp, Homo sapien
gagactattcgtgatcccaaggaca

SEQ ID NO: 110494 - DNA, 25 bp, Homo sapien
caccatgtgctagtggcgcagctca

SEQ ID NO: 110495 - DNA, 25 bp, Homo sapien
ggagactggactcgaccgaactgaa

SEQ ID NO: 110496 - DNA, 25 bp, Homo sapien
tctaagacttttggcggagactttc

SEQ ID NO: 110497 - DNA, 25 bp, Homo sapien
agcaggcgctgacgccggtaccaca

SEQ ID NO: 110498 - DNA, 25 bp, Homo sapien
tcaccggcgtgtcctgtttctggcc

SEQ ID NO: 110499 - DNA, 25 bp, Homo sapien
cgtctcaccggcgtgtcctgtttct

SEQ ID NO: 110500 - DNA, 25 bp, Homo sapien
gaccacgtcctcacccgaagccatg

SEQ ID NO: 110501 - DNA, 25 bp, Homo sapien
ccggtaccacagagccgtgagcatc

SEQ ID NO: 110502 - DNA, 25 bp, Homo sapien
gggagctcttctcgaaccacagccg

SEQ ID NO: 110503 - DNA, 25 bp, Homo sapien
ccagcagccgccgtttcacctcgcg

SEQ ID NO: 110504 - DNA, 25 bp, Homo sapien
agccgtgagcatctgcggctgtccc

SEQ ID NO: 110505 - DNA, 25 bp, Homo sapien
gttcgcgccgcaggcgcaaagttta

SEQ ID NO: 110506 - DNA, 25 bp, Homo sapien
cgcctccgagtcttagaatgggctc

SEQ ID NO: 110507 - DNA, 25 bp, Homo sapien
ttagggtcagccacaaacgcgcggc

SEQ ID NO: 110508 - DNA, 25 bp, Homo sapien
gcgcaaagtttagggtcagccacaa

SEQ ID NO: 110509 - DNA, 25 bp, Homo sapien
tatttaccgccatcatcagcacgcg

SEQ ID NO: 110510 - DNA, 25 bp, Homo sapien
cccggtgtgtgaggattttgcttct

SEQ ID NO: 110511 - DNA, 25 bp, Homo sapien
accagggcgcgagacaaccgaacac

SEQ ID NO: 110512 - DNA, 25 bp, Homo sapien
tcagcacgcgcgagctgtcaccagg

SEQ ID NO: 110513 - DNA, 25 bp, Homo sapien
tgagccgacggattttgcagcaagc

SEQ ID NO: 110514 - DNA, 25 bp, Homo sapien
tgcccaaattcaaggcggcccgtgg

SEQ ID NO: 110515 - DNA, 25 bp, Homo sapien
cgtgcgatccttcccggcaactttt

SEQ ID NO: 110516 - DNA, 25 bp, Homo sapien
gcaagcgcatcctggcctttcttca

SEQ ID NO: 110517 - DNA, 25 bp, Homo sapien
ccatgaagctaggagagcgacactc

SEQ ID NO: 110518 - DNA, 25 bp, Homo sapien
gacattcccgtttggctgagcactc

SEQ ID NO: 110519 - DNA, 25 bp, Homo sapien
cccgaggtttctaaatccagacatt

SEQ ID NO: 110520 - DNA, 25 bp, Homo sapien
gtgacgcctccactgacatcatctg

SEQ ID NO: 110521 - DNA, 25 bp, Homo sapien
gcggctggcggccttgagcgcagcc

SEQ ID NO: 110522 - DNA, 25 bp, Homo sapien
gaggcccggcgttccacaaggtcca

SEQ ID NO: 110523 - DNA, 25 bp, Homo sapien
tcccggcaactaccagagagcgggg

SEQ ID NO: 110524 - DNA, 25 bp, Homo sapien
tctcccggcaactaccagagagcgg

SEQ ID NO: 110525 - DNA, 25 bp, Homo sapien
cagcccggtcggcagtgcagggcct

SEQ ID NO: 110526 - DNA, 25 bp, Homo sapien
cccggcgtgctctcccggtgcgccg

SEQ ID NO: 110527 - DNA, 25 bp, Homo sapien
gggctctcaacccaccgcgcgaagg

SEQ ID NO: 110528 - DNA, 25 bp, Homo sapien
gggtctcccggcaactaccagagag

SEQ ID NO: 110529 - DNA, 25 bp, Homo sapien
ccctcgcgacgatgtagcaaccgtg

SEQ ID NO: 110530 - DNA, 25 bp, Homo sapien
agtcactgtcgggaggagccgatta

SEQ ID NO: 110531 - DNA, 25 bp, Homo sapien
tcttagcctcggagcatcctgcaga

SEQ ID NO: 110532 - DNA, 25 bp, Homo sapien
catcctgcagattgctgtggggacc

SEQ ID NO: 110533 - DNA, 25 bp, Homo sapien
cgggtgccttcgcaacacagcagct

SEQ ID NO: 110534 - DNA, 25 bp, Homo sapien
ctcggcccgaagagaggcacagtta

SEQ ID NO: 110535 - DNA, 25 bp, Homo sapien
aaccgtggaatgctcggacgtcgca

SEQ ID NO: 110536 - DNA, 25 bp, Homo sapien
tccagcatccagtaagccagcatct

SEQ ID NO: 110537 - DNA, 25 bp, Homo sapien
ggcatccgaacagagccagtctcca

SEQ ID NO: 110538 - DNA, 25 bp, Homo sapien
tcccggcgttggcaactcctccacg

SEQ ID NO: 110539 - DNA, 25 bp, Homo sapien
gctctgctcagccaagtttcggtcc

SEQ ID NO: 110540 - DNA, 25 bp, Homo sapien
ctgcagtggcgaagtgtttacaaag

SEQ ID NO: 110541 - DNA, 25 bp, Homo sapien
ggccggcatccgaacagagccagtc

SEQ ID NO: 110542 - DNA, 25 bp, Homo sapien
ccgcgaggagaggattgcacctctc

SEQ ID NO: 110543 - DNA, 25 bp, Homo sapien
tggtcgcaaccaccagccgcgagga

SEQ ID NO: 110544 - DNA, 25 bp, Homo sapien
ctggtgctctgctcagccaagtttc

SEQ ID NO: 110545 - DNA, 25 bp, Homo sapien
gctctcggcgttcgagctctcaatg

SEQ ID NO: 110546 - DNA, 25 bp, Homo sapien
tgcttgctggccacagagtcgccct

SEQ ID NO: 110547 - DNA, 25 bp, Homo sapien
aggcactggtttcgcgaggagcact

SEQ ID NO: 110548 - DNA, 25 bp, Homo sapien
gcccaggagggtcagcgatcacctg

SEQ ID NO: 110549 - DNA, 25 bp, Homo sapien
taccttctgctgagatctgtcccgg

SEQ ID NO: 110550 - DNA, 25 bp, Homo sapien
tttgccagttgcctggtaccttctg

SEQ ID NO: 110551 - DNA, 25 bp, Homo sapien
tctcaatgcggtgcacctggactga

SEQ ID NO: 110552 - DNA, 25 bp, Homo sapien
cgatcacctggacggcgtagatggc

SEQ ID NO: 110553 - DNA, 25 bp, Homo sapien
ccgagagagtttgggtatcctgcaa

SEQ ID NO: 110554 - DNA, 25 bp, Homo sapien
agttggcggacctgtgtcttgattg

SEQ ID NO: 110555 - DNA, 25 bp, Homo sapien
gtcttgattggctcgttcgctgttg

SEQ ID NO: 110556 - DNA, 25 bp, Homo sapien
cccatcatgagctccgactggcgga

SEQ ID NO: 110557 - DNA, 25 bp, Homo sapien
ccctcgactgagcaacaagataatg

SEQ ID NO: 110558 - DNA, 25 bp, Homo sapien
tcgcgcacactacgccagaacaaga

SEQ ID NO: 110559 - DNA, 25 bp, Homo sapien
cccgattggtctgaagatgccgttt

SEQ ID NO: 110560 - DNA, 25 bp, Homo sapien
caagataatgcccagaaattcagcc

SEQ ID NO: 110561 - DNA, 25 bp, Homo sapien
cgttctacctgcaaggccgaaggga

SEQ ID NO: 110562 - DNA, 25 bp, Homo sapien
aatgttttctcttgacggatggccg

SEQ ID NO: 110563 - DNA, 25 bp, Homo sapien
gatggccgggactccttggccctcg

SEQ ID NO: 110564 - DNA, 25 bp, Homo sapien
gcgctttgtgcttggcctccgcggc

SEQ ID NO: 110565 - DNA, 25 bp, Homo sapien
gacgtacaggcgcttctttatgagc

SEQ ID NO: 110566 - DNA, 25 bp, Homo sapien
gcgcttctttatgagcgagcggccc

SEQ ID NO: 110567 - DNA, 25 bp, Homo sapien
tcgggagctgcctcaagtctgagta

SEQ ID NO: 110568 - DNA, 25 bp, Homo sapien
caagtctgagtagttgttccgggga

SEQ ID NO: 110569 - DNA, 25 bp, Homo sapien
caggggactctaccaggccatgtcc

SEQ ID NO: 110570 - DNA, 25 bp, Homo sapien
tcggccagtccgcaggttccaacgt

SEQ ID NO: 110571 - DNA, 25 bp, Homo sapien
agtccgcaggttccaacgtgtccct

SEQ ID NO: 110572 - DNA, 25 bp, Homo sapien
ggtcgtggtgtgcttcttcccgaag

SEQ ID NO: 110573 - DNA, 25 bp, Homo sapien
cccgaagagtttgctgaaggtgccc

SEQ ID NO: 110574 - DNA, 25 bp, Homo sapien
tgcttctttttcatgctgccgcagc

SEQ ID NO: 110575 - DNA, 25 bp, Homo sapien
cccggactgaactcagcacggtttc

SEQ ID NO: 110576 - DNA, 25 bp, Homo sapien
gtgccctgcaccgtctgcttctttt

SEQ ID NO: 110577 - DNA, 25 bp, Homo sapien
ccaggacggctacattgatttcatg

SEQ ID NO: 110578 - DNA, 25 bp, Homo sapien
aggacggctacattgatttcatgga

SEQ ID NO: 110579 - DNA, 25 bp, Homo sapien
cgcccaggacggctacattgatttc

SEQ ID NO: 110580 - DNA, 25 bp, Homo sapien
ggcttgccgagatgggcggagcctt

SEQ ID NO: 110581 - DNA, 25 bp, Homo sapien
tgatttcatggagtacgtggcagcg

SEQ ID NO: 110582 - DNA, 25 bp, Homo sapien
cggctacattgatttcatggagtac

SEQ ID NO: 110583 - DNA, 25 bp, Homo sapien
agcgtctcttggggcttgccgagat

SEQ ID NO: 110584 - DNA, 25 bp, Homo sapien
acattgatttcatggagtacgtggc

SEQ ID NO: 110585 - DNA, 25 bp, Homo sapien
tcggctgatgcttcctggggatttc

SEQ ID NO: 110586 - DNA, 25 bp, Homo sapien
taaaaccggaacaacgatctgattc

SEQ ID NO: 110587 - DNA, 25 bp, Homo sapien
ccggagatgaggacattgctgaaga

SEQ ID NO: 110588 - DNA, 25 bp, Homo sapien
ggcacactcggctgatgcttcctgg

SEQ ID NO: 110589 - DNA, 25 bp, Homo sapien
ggctcctcggctttgggcacactcg

SEQ ID NO: 110590 - DNA, 25 bp, Homo sapien
ctcctgcacggtcttgaggggctcc

SEQ ID NO: 110591 - DNA, 25 bp, Homo sapien
tttcttctcctgcacggtcttgagg

SEQ ID NO: 110592 - DNA, 25 bp, Homo sapien
agatgaggacattgctgaagagccc

SEQ ID NO: 110593 - DNA, 25 bp, Homo sapien
tggaaatttgcagcgccgggctgcg

SEQ ID NO: 110594 - DNA, 25 bp, Homo sapien
cagtggaaatttgcagcgccgggct

SEQ ID NO: 110595 - DNA, 25 bp, Homo sapien
ccagtggaaatttgcagcgccgggc

SEQ ID NO: 110596 - DNA, 25 bp, Homo sapien
gccgcaagcaactccaaactctccg

SEQ ID NO: 110597 - DNA, 25 bp, Homo sapien
cccagtggaaatttgcagcgccggg

SEQ ID NO: 110598 - DNA, 25 bp, Homo sapien
gcaactccaaactctccgcatccag

SEQ ID NO: 110599 - DNA, 25 bp, Homo sapien
ctctccgcatccagccgttctccct

SEQ ID NO: 110600 - DNA, 25 bp, Homo sapien
ccaaactctccgcatccagccgttc

SEQ ID NO: 110601 - DNA, 25 bp, Homo sapien
gcctctcagccatcgcttagaggga

SEQ ID NO: 110602 - DNA, 25 bp, Homo sapien
gctgcgcgcgtgcatccaccctccc

SEQ ID NO: 110603 - DNA, 25 bp, Homo sapien
aggaaacttactccccatctgcatg

SEQ ID NO: 110604 - DNA, 25 bp, Homo sapien
ccatctgcatgcaccgcctctcagc

SEQ ID NO: 110605 - DNA, 25 bp, Homo sapien
ctcagccatcgcttagagggaaggg

SEQ ID NO: 110606 - DNA, 25 bp, Homo sapien
ggggagacagaaatacatatgtatc

SEQ ID NO: 110607 - DNA, 25 bp, Homo sapien
agaaatacatatgtatctctcgccc

SEQ ID NO: 110608 - DNA, 25 bp, Homo sapien
ctggggagacagaaatacatatgta

SEQ ID NO: 110609 - DNA, 25 bp, Homo sapien
tgactttatttgtgcgctttgcgtg

SEQ ID NO: 110610 - DNA, 25 bp, Homo sapien
gctcggcattggtgcggaaacccga

SEQ ID NO: 110611 - DNA, 25 bp, Homo sapien
cgccatgactgtggaacgtggtgcc

SEQ ID NO: 110612 - DNA, 25 bp, Homo sapien
ctttgcaagctaacgactggggttt

SEQ ID NO: 110613 - DNA, 25 bp, Homo sapien
ggttattgtaacacgctttgcaagc

SEQ ID NO: 110614 - DNA, 25 bp, Homo sapien
ctgcgtagccgtcccggttattgta

SEQ ID NO: 110615 - DNA, 25 bp, Homo sapien
acccggaccagtgcaggattgcttc

SEQ ID NO: 110616 - DNA, 25 bp, Homo sapien
tgcaccttttgtaggctggcgagtc

SEQ ID NO: 110617 - DNA, 25 bp, Homo sapien
tagagccagaggtgcaggccatcga

SEQ ID NO: 110618 - DNA, 25 bp, Homo sapien
cctcgccttgtggggtaatagcccg

SEQ ID NO: 110619 - DNA, 25 bp, Homo sapien
ttggggaaacagctgtgccggccct

SEQ ID NO: 110620 - DNA, 25 bp, Homo sapien
gcagcccgacccagacttggggaaa

SEQ ID NO: 110621 - DNA, 25 bp, Homo sapien
accgactcctggacgtcctggagca

SEQ ID NO: 110622 - DNA, 25 bp, Homo sapien
cgcctgtggggaggaaccgactcct

SEQ ID NO: 110623 - DNA, 25 bp, Homo sapien
ccatcgaccggagcttgctggaatg

SEQ ID NO: 110624 - DNA, 25 bp, Homo sapien
ccggagcttgctggaatgttcggcc

SEQ ID NO: 110625 - DNA, 25 bp, Homo sapien
gggactgctgacagggaaccatagc

SEQ ID NO: 110626 - DNA, 25 bp, Homo sapien
gctgagagcgtagccacgccgcatt

SEQ ID NO: 110627 - DNA, 25 bp, Homo sapien
agtctccaagccaagtacgccatcg

SEQ ID NO: 110628 - DNA, 25 bp, Homo sapien
cgggactccaagcttacctcggaca

SEQ ID NO: 110629 - DNA, 25 bp, Homo sapien
cgcgcgtgaggtcgtcactttttag

SEQ ID NO: 110630 - DNA, 25 bp, Homo sapien
cggcttgcgtttacctcgcttttag

SEQ ID NO: 110631 - DNA, 25 bp, Homo sapien
tccacacgagtgataacggcttgcg

SEQ ID NO: 110632 - DNA, 25 bp, Homo sapien
tcctgttgccacctagacaataggg

SEQ ID NO: 110633 - DNA, 25 bp, Homo sapien
tgtacggtctcgtcgttgccctcat

SEQ ID NO: 110634 - DNA, 25 bp, Homo sapien
gctgcctatggcacggtcaagaccg

SEQ ID NO: 110635 - DNA, 25 bp, Homo sapien
cggtcaagaccggtgccggcatcgc

SEQ ID NO: 110636 - DNA, 25 bp, Homo sapien
agccggctttgccatagacatcttg

SEQ ID NO: 110637 - DNA, 25 bp, Homo sapien
ccagccaccgaatatgatgtaaaaa

SEQ ID NO: 110638 - DNA, 25 bp, Homo sapien
cagcgtcctagtgccggttgtctgt

SEQ ID NO: 110639 - DNA, 25 bp, Homo sapien
aagagcctgacacacacgcacggga

SEQ ID NO: 110640 - DNA, 25 bp, Homo sapien
acatcagcctctacaggagctgcct

SEQ ID NO: 110641 - DNA, 25 bp, Homo sapien
gagaagtgagcagttgttttccctg

SEQ ID NO: 110642 - DNA, 25 bp, Homo sapien
tccgatgagcgtcatgttggagccc

SEQ ID NO: 110643 - DNA, 25 bp, Homo sapien
tttgttgtttaaagcgtcgcctctg

SEQ ID NO: 110644 - DNA, 25 bp, Homo sapien
gatcaccggcgcaaagaccaccttg

SEQ ID NO: 110645 - DNA, 25 bp, Homo sapien
acaggtccgcttgcagatcaccggc

SEQ ID NO: 110646 - DNA, 25 bp, Homo sapien
acactggcccttgagacaggtccgc

SEQ ID NO: 110647 - DNA, 25 bp, Homo sapien
tgctgacaactgtcccgacactggc

SEQ ID NO: 110648 - DNA, 25 bp, Homo sapien
cgtcatgttggagccctgctgacaa

SEQ ID NO: 110649 - DNA, 25 bp, Homo sapien
tgccgttcttgttcgcgtctctgaa

SEQ ID NO: 110650 - DNA, 25 bp, Homo sapien
acgcgtccggtgattggcctaacat

SEQ ID NO: 110651 - DNA, 25 bp, Homo sapien
ttcggtcaaaagaacgtcgcgctgg

SEQ ID NO: 110652 - DNA, 25 bp, Homo sapien
caggagccgcgtctactttggtaga

SEQ ID NO: 110653 - DNA, 25 bp, Homo sapien
cggggagtcctgtatgctttcaact

SEQ ID NO: 110654 - DNA, 25 bp, Homo sapien
cgctggctctcttctccaagacttg

SEQ ID NO: 110655 - DNA, 25 bp, Homo sapien
cgtgcagttgctcagttcggtcaaa

SEQ ID NO: 110656 - DNA, 25 bp, Homo sapien
ttggtagacgaagcagcatcctttc

SEQ ID NO: 110657 - DNA, 25 bp, Homo sapien
tacattatttctaggggtggtggga

SEQ ID NO: 110658 - DNA, 25 bp, Homo sapien
ggcgagaacccgagacgcagccgct

SEQ ID NO: 110659 - DNA, 25 bp, Homo sapien
gcctcgcatgcttcgctcagatctg

SEQ ID NO: 110660 - DNA, 25 bp, Homo sapien
tggcctagcctaaagtcgggaccaa

SEQ ID NO: 110661 - DNA, 25 bp, Homo sapien
ttcgctcagatctgcggagctcccg

SEQ ID NO: 110662 - DNA, 25 bp, Homo sapien
agggatttgtcaccggaagtgaatg

SEQ ID NO: 110663 - DNA, 25 bp, Homo sapien
tgggagaagcggtacattatttcta

SEQ ID NO: 110664 - DNA, 25 bp, Homo sapien
caccggaagtgaatggcctagccta

SEQ ID NO: 110665 - DNA, 25 bp, Homo sapien
cagacccaaaagacgaggccgccgg

SEQ ID NO: 110666 - DNA, 25 bp, Homo sapien
acggcgcatttttggccgagtgcgc

SEQ ID NO: 110667 - DNA, 25 bp, Homo sapien
catctcgatgaccagggcgccgcga

SEQ ID NO: 110668 - DNA, 25 bp, Homo sapien
cgcgggcgttatgctgttcgcgccc

SEQ ID NO: 110669 - DNA, 25 bp, Homo sapien
tcggaagctctagggtgtgaatcac

SEQ ID NO: 110670 - DNA, 25 bp, Homo sapien
tgccttttcgaagcaccgccgagga

SEQ ID NO: 110671 - DNA, 25 bp, Homo sapien
tttctttcttctcggcaaaatggac

SEQ ID NO: 110672 - DNA, 25 bp, Homo sapien
ggcgccctccgaggacatctcgatg

SEQ ID NO: 110673 - DNA, 25 bp, Homo sapien
gaagcgtccacgatttagccaaacc

SEQ ID NO: 110674 - DNA, 25 bp, Homo sapien
gcgcgcgtacaaggattcagataca

SEQ ID NO: 110675 - DNA, 25 bp, Homo sapien
agtgcccaacggacgcgccaaagaa

SEQ ID NO: 110676 - DNA, 25 bp, Homo sapien
gctccctgcagaaacgctttagaag

SEQ ID NO: 110677 - DNA, 25 bp, Homo sapien
gtcgcgaatcctgaccggcgtgtaa

SEQ ID NO: 110678 - DNA, 25 bp, Homo sapien
atcgccgcgatgtggcgtttctcca

SEQ ID NO: 110679 - DNA, 25 bp, Homo sapien
cggacgtgccaaaacttgaaggcta

SEQ ID NO: 110680 - DNA, 25 bp, Homo sapien
ctcaggggcccactgtatgccatga

SEQ ID NO: 110681 - DNA, 25 bp, Homo sapien
cccatctgtaatgtggtaaccgagc

SEQ ID NO: 110682 - DNA, 25 bp, Homo sapien
tctgtaatgtggtaaccgagcccga

SEQ ID NO: 110683 - DNA, 25 bp, Homo sapien
ggagagtcgttagggacacctgccc

SEQ ID NO: 110684 - DNA, 25 bp, Homo sapien
ggcaggagagctctttccccatctg

SEQ ID NO: 110685 - DNA, 25 bp, Homo sapien
cctgcaatctgaaagaggcaggaga

SEQ ID NO: 110686 - DNA, 25 bp, Homo sapien
tcttgggaagatcctgcaatctgaa

SEQ ID NO: 110687 - DNA, 25 bp, Homo sapien
ctactgcagatagaggcggctggct

SEQ ID NO: 110688 - DNA, 25 bp, Homo sapien
gcggaagggtcagctactgcagata

SEQ ID NO: 110689 - DNA, 25 bp, Homo sapien
gagcggttcctcctcgcagggacac

SEQ ID NO: 110690 - DNA, 25 bp, Homo sapien
tcctgcgggctcctgagcggttcct

SEQ ID NO: 110691 - DNA, 25 bp, Homo sapien
cctgagcggttcctcctcgcaggga

SEQ ID NO: 110692 - DNA, 25 bp, Homo sapien
ctgacctgcagctgcctgtgcgacc

SEQ ID NO: 110693 - DNA, 25 bp, Homo sapien
gagccctcggctcccatcgactgca

SEQ ID NO: 110694 - DNA, 25 bp, Homo sapien
ctcccatcgactgcacccggccacg

SEQ ID NO: 110695 - DNA, 25 bp, Homo sapien
ggacgagaggccaccagctcaccca

SEQ ID NO: 110696 - DNA, 25 bp, Homo sapien
tgcgggctcctgagcggttcctcct

SEQ ID NO: 110697 - DNA, 25 bp, Homo sapien
tccttccttgaacaggcttgcgccg

SEQ ID NO: 110698 - DNA, 25 bp, Homo sapien
gctctgcagggtgtcttccttcctt

SEQ ID NO: 110699 - DNA, 25 bp, Homo sapien
gggttgcaaggttccgagctctgca

SEQ ID NO: 110700 - DNA, 25 bp, Homo sapien
gagaacgactgggttcgcctgccca

SEQ ID NO: 110701 - DNA, 25 bp, Homo sapien
tggattcaatgcctgagcccgcgtc

SEQ ID NO: 110702 - DNA, 25 bp, Homo sapien
cggccgggccatggattcaatgcct

SEQ ID NO: 110703 - DNA, 25 bp, Homo sapien
aggctagctgttgtcgtggttgctc

SEQ ID NO: 110704 - DNA, 25 bp, Homo sapien
ccttggtccgctttgaaggcgggct

SEQ ID NO: 110705 - DNA, 25 bp, Homo sapien
acctagcccaggattgcgaggcagc

SEQ ID NO: 110706 - DNA, 25 bp, Homo sapien
tctgtctcagcctgtactgcgcggc

SEQ ID NO: 110707 - DNA, 25 bp, Homo sapien
accgccgagtacaaggcatggctgc

SEQ ID NO: 110708 - DNA, 25 bp, Homo sapien
tggcagctgtatatcggagacaccc

SEQ ID NO: 110709 - DNA, 25 bp, Homo sapien
gcgcgctcacctgctattggccagg

SEQ ID NO: 110710 - DNA, 25 bp, Homo sapien
tccgcaggctggctaaaaggaccta

SEQ ID NO: 110711 - DNA, 25 bp, Homo sapien
ctcagctctgcggatctcaggggat

SEQ ID NO: 110712 - DNA, 25 bp, Homo sapien
ggctgccagcagtgcttatgcttta

SEQ ID NO: 110713 - DNA, 25 bp, Homo sapien
cgtgcctcgataggcagtaaccttc

SEQ ID NO: 110714 - DNA, 25 bp, Homo sapien
cggttgcgtagcgtttacccatgcg

SEQ ID NO: 110715 - DNA, 25 bp, Homo sapien
taaccttcatcgctgcggttgcgta

SEQ ID NO: 110716 - DNA, 25 bp, Homo sapien
ccagagagccagacgactagtgtgc

SEQ ID NO: 110717 - DNA, 25 bp, Homo sapien
gccagaaaccgcaaaggaggacacc

SEQ ID NO: 110718 - DNA, 25 bp, Homo sapien
cagccagcgccatggtgacaggaca

SEQ ID NO: 110719 - DNA, 25 bp, Homo sapien
gattgatctgcgtcgtgcctcgata

SEQ ID NO: 110720 - DNA, 25 bp, Homo sapien
ggtgccaagcagtgcccaacctagc

SEQ ID NO: 110721 - DNA, 25 bp, Homo sapien
tcgcagactcgggaccagatcactg

SEQ ID NO: 110722 - DNA, 25 bp, Homo sapien
ctcgggaccagatcactgttttact

SEQ ID NO: 110723 - DNA, 25 bp, Homo sapien
gactcgggaccagatcactgtttta

SEQ ID NO: 110724 - DNA, 25 bp, Homo sapien
gggaccagatcactgttttactgtg

SEQ ID NO: 110725 - DNA, 25 bp, Homo sapien
cactgttttactgtggggctgccca

SEQ ID NO: 110726 - DNA, 25 bp, Homo sapien
ccagatcactgttttactgtggggc

SEQ ID NO: 110727 - DNA, 25 bp, Homo sapien
tcactgttttactgtggggctgccc

SEQ ID NO: 110728 - DNA, 25 bp, Homo sapien
tacgtcgcagactcgggaccagatc

SEQ ID NO: 110729 - DNA, 25 bp, Homo sapien
agcaggttctcggtagcagccgaca

SEQ ID NO: 110730 - DNA, 25 bp, Homo sapien
caaagggccgctcgctgtgattact

SEQ ID NO: 110731 - DNA, 25 bp, Homo sapien
ggcgactatctgctgcgcggttacc

SEQ ID NO: 110732 - DNA, 25 bp, Homo sapien
caagatcgcatctcccggctcatgg

SEQ ID NO: 110733 - DNA, 25 bp, Homo sapien
aatacgcggaaagggagaatgcacc

SEQ ID NO: 110734 - DNA, 25 bp, Homo sapien
aagtcgacgacttctcctgggagcc

SEQ ID NO: 110735 - DNA, 25 bp, Homo sapien
ggtgacaacggcaacatggccctga

SEQ ID NO: 110736 - DNA, 25 bp, Homo sapien
ctccgctttgacgtcacttcctgtg

SEQ ID NO: 110737 - DNA, 25 bp, Homo sapien
tgcctccggcacttagctacgactg

SEQ ID NO: 110738 - DNA, 25 bp, Homo sapien
tgggaactctgggtcatcagactcc

SEQ ID NO: 110739 - DNA, 25 bp, Homo sapien
cccgccggaagaaccgagcttggct

SEQ ID NO: 110740 - DNA, 25 bp, Homo sapien
tccctcaggaaacgtatggactaca

SEQ ID NO: 110741 - DNA, 25 bp, Homo sapien
ggcctcctcggtctcgacacatatt

SEQ ID NO: 110742 - DNA, 25 bp, Homo sapien
ccatatccatgattgacgctggcga

SEQ ID NO: 110743 - DNA, 25 bp, Homo sapien
gctgtgtttatctcgttggggacta

SEQ ID NO: 110744 - DNA, 25 bp, Homo sapien
tgtaccgcctgacagatgcctttca

SEQ ID NO: 110745 - DNA, 25 bp, Homo sapien
cgcgcagttttctgcccattcgtca

SEQ ID NO: 110746 - DNA, 25 bp, Homo sapien
ctgccagctgatgccgggagctaac

SEQ ID NO: 110747 - DNA, 25 bp, Homo sapien
tcttccgagcgctactgccagctga

SEQ ID NO: 110748 - DNA, 25 bp, Homo sapien
aagcggcgccattcgtcttccgagc

SEQ ID NO: 110749 - DNA, 25 bp, Homo sapien
tccagagcgggttatcctttgggcc

SEQ ID NO: 110750 - DNA, 25 bp, Homo sapien
gcgacaatgtctccagagcgggtta

SEQ ID NO: 110751 - DNA, 25 bp, Homo sapien
tcgggcagaaggttgcgacaatgtc

SEQ ID NO: 110752 - DNA, 25 bp, Homo sapien
attcgtcaccacgttgagaccggga

SEQ ID NO: 110753 - DNA, 25 bp, Homo sapien
gaacagagctgcacccgcgtgagtc

SEQ ID NO: 110754 - DNA, 25 bp, Homo sapien
cgaggcctgtccttcacagagcaag

SEQ ID NO: 110755 - DNA, 25 bp, Homo sapien
cgtgcctccgcggaacagagctgca

SEQ ID NO: 110756 - DNA, 25 bp, Homo sapien
acccgcgtgagtcggcagccactgg

SEQ ID NO: 110757 - DNA, 25 bp, Homo sapien
agccaaaagccacggctcatttccg

SEQ ID NO: 110758 - DNA, 25 bp, Homo sapien
aggatgccaccttggcgacgcagca

SEQ ID NO: 110759 - DNA, 25 bp, Homo sapien
cttcacagagcaagggacgcggcac

SEQ ID NO: 110760 - DNA, 25 bp, Homo sapien
acccagcggaaagctaggggccctg

SEQ ID NO: 110761 - DNA, 25 bp, Homo sapien
cagcccgaatggaagcagccttctt

SEQ ID NO: 110762 - DNA, 25 bp, Homo sapien
gggcagctctaatgtcgcgtgacta

SEQ ID NO: 110763 - DNA, 25 bp, Homo sapien
gccgtcgctccgcaataacgtaaaa

SEQ ID NO: 110764 - DNA, 25 bp, Homo sapien
cggtgctcctagatgacgttgactg

SEQ ID NO: 110765 - DNA, 25 bp, Homo sapien
tcgagcggcagccatcatggattta

SEQ ID NO: 110766 - DNA, 25 bp, Homo sapien
gctgaaggttaaggtctctgccatc

SEQ ID NO: 110767 - DNA, 25 bp, Homo sapien
ctactgcgtttccaggcccaggaga

SEQ ID NO: 110768 - DNA, 25 bp, Homo sapien
tacctgaacgccgtgagagccaatc

SEQ ID NO: 110769 - DNA, 25 bp, Homo sapien
ggacgcatttccagcctccctgagt

SEQ ID NO: 110770 - DNA, 25 bp, Homo sapien
cctgagtttttctggtctgagccga

SEQ ID NO: 110771 - DNA, 25 bp, Homo sapien
ttgctcgagaactgccgagagttgc

SEQ ID NO: 110772 - DNA, 25 bp, Homo sapien
tcggcccaggtaagagttgctggtt

SEQ ID NO: 110773 - DNA, 25 bp, Homo sapien
cgcggagctttgttacctacgccga

SEQ ID NO: 110774 - DNA, 25 bp, Homo sapien
ctcctccgagttcctgggcaaagct

SEQ ID NO: 110775 - DNA, 25 bp, Homo sapien
catggcctctagctactggtctgga

SEQ ID NO: 110776 - DNA, 25 bp, Homo sapien
gactaatgtgtgaaggccgctgcca

SEQ ID NO: 110777 - DNA, 25 bp, Homo sapien
gatggagttcatcgacaacaagctg

SEQ ID NO: 110778 - DNA, 25 bp, Homo sapien
cggcgctacacgaccttcagcaaga

SEQ ID NO: 110779 - DNA, 25 bp, Homo sapien
ggcggctccgattcctcgctgactg

SEQ ID NO: 110780 - DNA, 25 bp, Homo sapien
ttcagcaagaggaagacgggcatca

SEQ ID NO: 110781 - DNA, 25 bp, Homo sapien
atcgacaacaagctgcggcgctaca

SEQ ID NO: 110782 - DNA, 25 bp, Homo sapien
tcgagcgccatgttaccgacccaag

SEQ ID NO: 110783 - DNA, 25 bp, Homo sapien
cgcggcagcgatagcggcactagca

SEQ ID NO: 110784 - DNA, 25 bp, Homo sapien
acgggcatcatgaagaaggtaccaa

SEQ ID NO: 110785 - DNA, 25 bp, Homo sapien
gagtagaaagggagcactccggtcc

SEQ ID NO: 110786 - DNA, 25 bp, Homo sapien
ccagggagtagaaagggagcactcc

SEQ ID NO: 110787 - DNA, 25 bp, Homo sapien
ggcctttgcattcctcccgccagct

SEQ ID NO: 110788 - DNA, 25 bp, Homo sapien
ccctagataagcgggcggcctccgt

SEQ ID NO: 110789 - DNA, 25 bp, Homo sapien
ggcagggcctttgcattcctcccgc

SEQ ID NO: 110790 - DNA, 25 bp, Homo sapien
tgcccatataaggccggcttgggct

SEQ ID NO: 110791 - DNA, 25 bp, Homo sapien
cgggcggcctccgtgcccatataag

SEQ ID NO: 110792 - DNA, 25 bp, Homo sapien
tcccgccagctgtctccccgctagg

SEQ ID NO: 110793 - DNA, 25 bp, Homo sapien
gccgtgcgtgcactcgccgtgtgac

SEQ ID NO: 110794 - DNA, 25 bp, Homo sapien
agccgcccgcggtagcacgcatgct

SEQ ID NO: 110795 - DNA, 25 bp, Homo sapien
gtagcacgcatgctccactcgcgcg

SEQ ID NO: 110796 - DNA, 25 bp, Homo sapien
ttccgccacgctcggcgtgggccgc

SEQ ID NO: 110797 - DNA, 25 bp, Homo sapien
cgtgcactcgccgtgtgacccggaa

SEQ ID NO: 110798 - DNA, 25 bp, Homo sapien
cactcgccgtgtgacccggaaggga

SEQ ID NO: 110799 - DNA, 25 bp, Homo sapien
ggaggtgagaggagagttctgcgcc

SEQ ID NO: 110800 - DNA, 25 bp, Homo sapien
tccactcgcgcgctgttccgccacg

SEQ ID NO: 110801 - DNA, 25 bp, Homo sapien
cgcagagcccggctgctgagtccac

SEQ ID NO: 110802 - DNA, 25 bp, Homo sapien
cgccgcgaatgctcccgcagaagta

SEQ ID NO: 110803 - DNA, 25 bp, Homo sapien
acgatccgctcgtacagcgtcctgt

SEQ ID NO: 110804 - DNA, 25 bp, Homo sapien
agccgagacacgatccgctcgtaca

SEQ ID NO: 110805 - DNA, 25 bp, Homo sapien
cgaatcgccgcagccgagacacgat

SEQ ID NO: 110806 - DNA, 25 bp, Homo sapien
cggtgagcactgtcccgaatcgccg

SEQ ID NO: 110807 - DNA, 25 bp, Homo sapien
tgctcggtgagcactgtcccgaatc

SEQ ID NO: 110808 - DNA, 25 bp, Homo sapien
ggccgccacgtgctcggtgagcact

SEQ ID NO: 110809 - DNA, 25 bp, Homo sapien
gccgtcggaacgtgatgtcagagga

SEQ ID NO: 110810 - DNA, 25 bp, Homo sapien
gagacaggtgagttttatgggaaca

SEQ ID NO: 110811 - DNA, 25 bp, Homo sapien
caggtgagttttatgggaacaggta

SEQ ID NO: 110812 - DNA, 25 bp, Homo sapien
gcagagagctgtaaggagaacctga

SEQ ID NO: 110813 - DNA, 25 bp, Homo sapien
agcgggtcacccaacgccgcactga

SEQ ID NO: 110814 - DNA, 25 bp, Homo sapien
ggatgatccgggtcggaaggccgcc

SEQ ID NO: 110815 - DNA, 25 bp, Homo sapien
gccgccgtcgcccaaggaggatcgg

SEQ ID NO: 110816 - DNA, 25 bp, Homo sapien
tgatgtcagggctggtgctgatgct

SEQ ID NO: 110817 - DNA, 25 bp, Homo sapien
tcagcggcctccttaatgcgagcgg

SEQ ID NO: 110818 - DNA, 25 bp, Homo sapien
gcctcagcggcctccttaatgcgag

SEQ ID NO: 110819 - DNA, 25 bp, Homo sapien
cctccttaatgcgagcgggggctcg

SEQ ID NO: 110820 - DNA, 25 bp, Homo sapien
ctggagcgcgtctacagccagcgca

SEQ ID NO: 110821 - DNA, 25 bp, Homo sapien
agcgcagccgcatccacgacgagct

SEQ ID NO: 110822 - DNA, 25 bp, Homo sapien
gcccgcgtcgtcctgtcaacctcga

SEQ ID NO: 110823 - DNA, 25 bp, Homo sapien
gtcaacctcgactcagcgctggccg

SEQ ID NO: 110824 - DNA, 25 bp, Homo sapien
cccggccatgaacgggctgccctcg

SEQ ID NO: 110825 - DNA, 25 bp, Homo sapien
cccaggcagtctgacgaagctgttc

SEQ ID NO: 110826 - DNA, 25 bp, Homo sapien
agcgcggtgatatggctcatccttc

SEQ ID NO: 110827 - DNA, 25 bp, Homo sapien
tgacgaagctgttcccgctcccaat

SEQ ID NO: 110828 - DNA, 25 bp, Homo sapien
gcacaacctcgcaggcccagtgaga

SEQ ID NO: 110829 - DNA, 25 bp, Homo sapien
atctggccagacacggctctgcgta

SEQ ID NO: 110830 - DNA, 25 bp, Homo sapien
cacgtcctccgcaagcgcggtgata

SEQ ID NO: 110831 - DNA, 25 bp, Homo sapien
ctctgcgtaattgcgctctgcggtc

SEQ ID NO: 110832 - DNA, 25 bp, Homo sapien
gcaggcccagtgagacataggaaac

SEQ ID NO: 110833 - DNA, 25 bp, Homo sapien
gcgaggacctggagacttgttaaaa

SEQ ID NO: 110834 - DNA, 25 bp, Homo sapien
actacgtggtcaaggatcgctggaa

SEQ ID NO: 110835 - DNA, 25 bp, Homo sapien
ctccctctggctggcggatgcagtg

SEQ ID NO: 110836 - DNA, 25 bp, Homo sapien
aggccgacatcctgccggccaacta

SEQ ID NO: 110837 - DNA, 25 bp, Homo sapien
taaggacgaaaccaacatgagtggg

SEQ ID NO: 110838 - DNA, 25 bp, Homo sapien
cgcccttaaggacgaaaccaacatg

SEQ ID NO: 110839 - DNA, 25 bp, Homo sapien
atgcagtgcctagcggccgccctta

SEQ ID NO: 110840 - DNA, 25 bp, Homo sapien
cggccaactacgtggtcaaggatcg

SEQ ID NO: 110841 - DNA, 25 bp, Homo sapien
atggccgttccgagacgtcacagcc

SEQ ID NO: 110842 - DNA, 25 bp, Homo sapien
tgggtcatcatcgacaaggagacgg

SEQ ID NO: 110843 - DNA, 25 bp, Homo sapien
gagctcaaggacttccctccagggg

SEQ ID NO: 110844 - DNA, 25 bp, Homo sapien
gcacatcgggcaccacggatgagga

SEQ ID NO: 110845 - DNA, 25 bp, Homo sapien
tttcgacagcaaagagtgggtcatc

SEQ ID NO: 110846 - DNA, 25 bp, Homo sapien
agcaggaggccctgagcaacgcctt

SEQ ID NO: 110847 - DNA, 25 bp, Homo sapien
ccagtggccgcatggacgtgtcagc

SEQ ID NO: 110848 - DNA, 25 bp, Homo sapien
acgtgtcagcctctgtggagcagga

SEQ ID NO: 110849 - DNA, 25 bp, Homo sapien
agacggagctgtcgagtctgtgcct

SEQ ID NO: 110850 - DNA, 25 bp, Homo sapien
gagtctgtgcctgacacctcttttc

SEQ ID NO: 110851 - DNA, 25 bp, Homo sapien
ttcttggtctctttcagttggagga

SEQ ID NO: 110852 - DNA, 25 bp, Homo sapien
cgctcggctgagagcagccctgtgc

SEQ ID NO: 110853 - DNA, 25 bp, Homo sapien
ggttccctcattcagcgcagccgct

SEQ ID NO: 110854 - DNA, 25 bp, Homo sapien
cgctggagacggagcattaccctca

SEQ ID NO: 110855 - DNA, 25 bp, Homo sapien
cgacgactggcgtcctccgtgttct

SEQ ID NO: 110856 - DNA, 25 bp, Homo sapien
ttcagttggaggaggacagactctc

SEQ ID NO: 110857 - DNA, 25 bp, Homo sapien
gggtgcgtcctccttagtgtacata

SEQ ID NO: 110858 - DNA, 25 bp, Homo sapien
gcccgggtagaaaagcatgcactga

SEQ ID NO: 110859 - DNA, 25 bp, Homo sapien
cgcacacgaagatgggacgcttttt

SEQ ID NO: 110860 - DNA, 25 bp, Homo sapien
gggccctcagagttctcagtgtcga

SEQ ID NO: 110861 - DNA, 25 bp, Homo sapien
ttcctgcgtaaggagacgccttcta

SEQ ID NO: 110862 - DNA, 25 bp, Homo sapien
gtcctgagtcccagtcggtttattc

SEQ ID NO: 110863 - DNA, 25 bp, Homo sapien
ccctagactgcgagtactgtacaaa

SEQ ID NO: 110864 - DNA, 25 bp, Homo sapien
tggccagcggaagcatgcacgaaaa

SEQ ID NO: 110865 - DNA, 25 bp, Homo sapien
cccatgcctgttgcagcccagcagc

SEQ ID NO: 110866 - DNA, 25 bp, Homo sapien
cctcaggctcactgtcggccaaaga

SEQ ID NO: 110867 - DNA, 25 bp, Homo sapien
accctctcaggcacgggctctgagg

SEQ ID NO: 110868 - DNA, 25 bp, Homo sapien
ctgaggaggacacgcccgcctctga

SEQ ID NO: 110869 - DNA, 25 bp, Homo sapien
tgagaccctctcaggcacgggctct

SEQ ID NO: 110870 - DNA, 25 bp, Homo sapien
attggcctccgcatgcccatgcctg

SEQ ID NO: 110871 - DNA, 25 bp, Homo sapien
ggctcggagccctcaggctcactgt

SEQ ID NO: 110872 - DNA, 25 bp, Homo sapien
agccgccaccaggagccggattccc

SEQ ID NO: 110873 - DNA, 25 bp, Homo sapien
ggccagataatgacgcccgctgctc

SEQ ID NO: 110874 - DNA, 25 bp, Homo sapien
agccagtccctgtcccgcagagaga

SEQ ID NO: 110875 - DNA, 25 bp, Homo sapien
ggctccaagaaaggacccagaggga

SEQ ID NO: 110876 - DNA, 25 bp, Homo sapien
caaacaacctcctggccgcggcctg

SEQ ID NO: 110877 - DNA, 25 bp, Homo sapien
ccagcacagccttacgcgcccgacg

SEQ ID NO: 110878 - DNA, 25 bp, Homo sapien
ggccagcctcacatcagtctctccg

SEQ ID NO: 110879 - DNA, 25 bp, Homo sapien
tcatcgaggactccacttctgggga

SEQ ID NO: 110880 - DNA, 25 bp, Homo sapien
tcagccacttttcatcgaggactcc

SEQ ID NO: 110881 - DNA, 25 bp, Homo sapien
cctgggcggaatccgcggttcctcg

SEQ ID NO: 110882 - DNA, 25 bp, Homo sapien
ctggcaacgcggacaggtccagctc

SEQ ID NO: 110883 - DNA, 25 bp, Homo sapien
gtccagctcatagctccgctccagg

SEQ ID NO: 110884 - DNA, 25 bp, Homo sapien
gcacacagtaggtacgccgctgcgg

SEQ ID NO: 110885 - DNA, 25 bp, Homo sapien
aaacaggttgctggcaacgcggaca

SEQ ID NO: 110886 - DNA, 25 bp, Homo sapien
acacagtaggtacgccgctgcggct

SEQ ID NO: 110887 - DNA, 25 bp, Homo sapien
ctcagggaatccagcggctcccatt

SEQ ID NO: 110888 - DNA, 25 bp, Homo sapien
ggcctcaccgaagaaaacaggttgc

SEQ ID NO: 110889 - DNA, 25 bp, Homo sapien
ccggggatgctccaggcctctggac

SEQ ID NO: 110890 - DNA, 25 bp, Homo sapien
tgccgctgtcgcctggatggtctcc

SEQ ID NO: 110891 - DNA, 25 bp, Homo sapien
tcccgggcatagtcggcgcgggact

SEQ ID NO: 110892 - DNA, 25 bp, Homo sapien
agcgctgctgcggtacatggttctt

SEQ ID NO: 110893 - DNA, 25 bp, Homo sapien
acatggttcttgcagcggcggccac

SEQ ID NO: 110894 - DNA, 25 bp, Homo sapien
cggccacggcgacagctctgacccg

SEQ ID NO: 110895 - DNA, 25 bp, Homo sapien
cgccctagacgcaggctcggagcgc

SEQ ID NO: 110896 - DNA, 25 bp, Homo sapien
agggcgcgagcacgcgtccgacaca

SEQ ID NO: 110897 - DNA, 25 bp, Homo sapien
tgcgtgcagctaccagcatatgggc

SEQ ID NO: 110898 - DNA, 25 bp, Homo sapien
tcgccgtgctcagtgcctgttactt

SEQ ID NO: 110899 - DNA, 25 bp, Homo sapien
ggctaggtcttccaacctctaggtg

SEQ ID NO: 110900 - DNA, 25 bp, Homo sapien
cttcaggtttgaggttccggatgcc

SEQ ID NO: 110901 - DNA, 25 bp, Homo sapien
gtgaccagcgtccagaaatccactg

SEQ ID NO: 110902 - DNA, 25 bp, Homo sapien
gcaaagccggctgttaccctgcaca

SEQ ID NO: 110903 - DNA, 25 bp, Homo sapien
tgaggcgtccatggaacgacttctg

SEQ ID NO: 110904 - DNA, 25 bp, Homo sapien
ggggacaccacaggccactgcttca

SEQ ID NO: 110905 - DNA, 25 bp, Homo sapien
ggactgagaaccaaacccagttgtc

SEQ ID NO: 110906 - DNA, 25 bp, Homo sapien
gcccaccggaagaagccagcacgtt

SEQ ID NO: 110907 - DNA, 25 bp, Homo sapien
cccacagcactagcggtctttacag

SEQ ID NO: 110908 - DNA, 25 bp, Homo sapien
tcagtctgtgaagaccgccggctct

SEQ ID NO: 110909 - DNA, 25 bp, Homo sapien
cttcccggaggccaagcatgagact

SEQ ID NO: 110910 - DNA, 25 bp, Homo sapien
tacactcagcgtcgttgtgctctgc

SEQ ID NO: 110911 - DNA, 25 bp, Homo sapien
tccagggcgcgtagataaataaata

SEQ ID NO: 110912 - DNA, 25 bp, Homo sapien
cacgttcggagacagtgggtactca

SEQ ID NO: 110913 - DNA, 25 bp, Homo sapien
atagcggcacggatacgggttccaa

SEQ ID NO: 110914 - DNA, 25 bp, Homo sapien
ggttccaagtgacaggagccgacga

SEQ ID NO: 110915 - DNA, 25 bp, Homo sapien
cgaacccagcttccttccaagagag

SEQ ID NO: 110916 - DNA, 25 bp, Homo sapien
tccaagagaggaggaaatcttagga

SEQ ID NO: 110917 - DNA, 25 bp, Homo sapien
aatcttaggagtctcaatgggagca

SEQ ID NO: 110918 - DNA, 25 bp, Homo sapien
tctcaatgggagcaaactattaagc

SEQ ID NO: 110919 - DNA, 25 bp, Homo sapien
aactattaagccaaaggagcgcaac

SEQ ID NO: 110920 - DNA, 25 bp, Homo sapien
catgcgagccgagcgctcgggaatc

SEQ ID NO: 110921 - DNA, 25 bp, Homo sapien
tggtgtgcacaaccgcgctgcgcct

SEQ ID NO: 110922 - DNA, 25 bp, Homo sapien
ttgcgtagctgctcctgcgcacaac

SEQ ID NO: 110923 - DNA, 25 bp, Homo sapien
tcgctgcccgtcctggtgtgcacaa

SEQ ID NO: 110924 - DNA, 25 bp, Homo sapien
cccagggcgcgttgcgtagctgctc

SEQ ID NO: 110925 - DNA, 25 bp, Homo sapien
tttctgcactacaccggagagggga

SEQ ID NO: 110926 - DNA, 25 bp, Homo sapien
taggaagctttctgcactacaccgg

SEQ ID NO: 110927 - DNA, 25 bp, Homo sapien
gcaggttttttggtcgcaagtagga

SEQ ID NO: 110928 - DNA, 25 bp, Homo sapien
tgcgcctcgaacctcgaggtccagg

SEQ ID NO: 110929 - DNA, 25 bp, Homo sapien
cccgcacggtccgtgtctgggcgtt

SEQ ID NO: 110930 - DNA, 25 bp, Homo sapien
cggttactgctgcttctgcccattc

SEQ ID NO: 110931 - DNA, 25 bp, Homo sapien
gataggccgctcttcccttgggagt

SEQ ID NO: 110932 - DNA, 25 bp, Homo sapien
gaaggccgcggcagatgtcccgcac

SEQ ID NO: 110933 - DNA, 25 bp, Homo sapien
cggcccgcgaggttcgcgtacactg

SEQ ID NO: 110934 - DNA, 25 bp, Homo sapien
tctcggctaggaggccgtacccgct

SEQ ID NO: 110935 - DNA, 25 bp, Homo sapien
cgagcggctcaagggcttcggctta

SEQ ID NO: 110936 - DNA, 25 bp, Homo sapien
ttcggcttaccggtctcggctagga

SEQ ID NO: 110937 - DNA, 25 bp, Homo sapien
gctactaggacgcacgcgcgagata

SEQ ID NO: 110938 - DNA, 25 bp, Homo sapien
gatcggccggaacacaaaaaggaga

SEQ ID NO: 110939 - DNA, 25 bp, Homo sapien
cacgcgcgagatagaacctctagtc

SEQ ID NO: 110940 - DNA, 25 bp, Homo sapien
atttaagattccaggaggcggtgcg

SEQ ID NO: 110941 - DNA, 25 bp, Homo sapien
gcggggaaaaatctcgcgatattta

SEQ ID NO: 110942 - DNA, 25 bp, Homo sapien
ttggacaaaagcaacttccggaagc

SEQ ID NO: 110943 - DNA, 25 bp, Homo sapien
gaagcccggatgtttggacaaaagc

SEQ ID NO: 110944 - DNA, 25 bp, Homo sapien
acctctagtctcgtggagagattga

SEQ ID NO: 110945 - DNA, 25 bp, Homo sapien
tcactggaccgctcctagaaaggcg

SEQ ID NO: 110946 - DNA, 25 bp, Homo sapien
tccgtcgtcacagggaataaatctc

SEQ ID NO: 110947 - DNA, 25 bp, Homo sapien
tgcccgggcaggatcctttacgatc

SEQ ID NO: 110948 - DNA, 25 bp, Homo sapien
atctcgctcgaaactcactggaccg

SEQ ID NO: 110949 - DNA, 25 bp, Homo sapien
ctctcgtctgatccctgctggggac

SEQ ID NO: 110950 - DNA, 25 bp, Homo sapien
cagctaccttgagggcttccagccg

SEQ ID NO: 110951 - DNA, 25 bp, Homo sapien
gcacagcgcgtttacttgatccatc

SEQ ID NO: 110952 - DNA, 25 bp, Homo sapien
ggtccatcatgaccgtcaccgcttt

SEQ ID NO: 110953 - DNA, 25 bp, Homo sapien
cctcctctcaagatcgagtgaaaga

SEQ ID NO: 110954 - DNA, 25 bp, Homo sapien
gagcattgtaggtttaggatttttg

SEQ ID NO: 110955 - DNA, 25 bp, Homo sapien
tgtttattagagcattgtaggttta

SEQ ID NO: 110956 - DNA, 25 bp, Homo sapien
cagcattcaaaggaaatgtttatta

SEQ ID NO: 110957 - DNA, 25 bp, Homo sapien
agggtatccctaatctgaaatttga

SEQ ID NO: 110958 - DNA, 25 bp, Homo sapien
ttccactcagggtatccctaatctg

SEQ ID NO: 110959 - DNA, 25 bp, Homo sapien
tcgagtgaaagaatcttaaaaactg

SEQ ID NO: 110960 - DNA, 25 bp, Homo sapien
ttgcaccaacacagcattcaaagga

SEQ ID NO: 110961 - DNA, 25 bp, Homo sapien
actgctttattaccaggctggcacc

SEQ ID NO: 110962 - DNA, 25 bp, Homo sapien
atttggccctttagcgcggatccta

SEQ ID NO: 110963 - DNA, 25 bp, Homo sapien
ggacaccagcgtagaagagcttaca

SEQ ID NO: 110964 - DNA, 25 bp, Homo sapien
gtcctcgcgctatgttctttttcta

SEQ ID NO: 110965 - DNA, 25 bp, Homo sapien
cttaagggagctgtagtctgacttc

SEQ ID NO: 110966 - DNA, 25 bp, Homo sapien
ccaggcctgggaattcacttaaatg

SEQ ID NO: 110967 - DNA, 25 bp, Homo sapien
tggacctcgagagctgcagaactga

SEQ ID NO: 110968 - DNA, 25 bp, Homo sapien
cgcggatcctagacaacaggttttg

SEQ ID NO: 110969 - DNA, 25 bp, Homo sapien
cggaggttctgtcctcagccgcagt

SEQ ID NO: 110970 - DNA, 25 bp, Homo sapien
cctgtcttccgggtgtcctacacgg

SEQ ID NO: 110971 - DNA, 25 bp, Homo sapien
gctgtgactccatcgccctgggtcg

SEQ ID NO: 110972 - DNA, 25 bp, Homo sapien
tcctacacggctctggctgtgactc

SEQ ID NO: 110973 - DNA, 25 bp, Homo sapien
gtcctcagccgcagtccctggtaag

SEQ ID NO: 110974 - DNA, 25 bp, Homo sapien
ccgcgagacctttattctaaccgca

SEQ ID NO: 110975 - DNA, 25 bp, Homo sapien
ccgacccaactgagccggaagtgga

SEQ ID NO: 110976 - DNA, 25 bp, Homo sapien
cgccatccattcgtttatccgctgg

SEQ ID NO: 110977 - DNA, 25 bp, Homo sapien
ctgctcacgtctcttatgctggtta

SEQ ID NO: 110978 - DNA, 25 bp, Homo sapien
gaggcggcttctcctagcaactcga

SEQ ID NO: 110979 - DNA, 25 bp, Homo sapien
tcgcaccgcgcaagacgctctatag

SEQ ID NO: 110980 - DNA, 25 bp, Homo sapien
cgattactacatcgcgcagggcctg

SEQ ID NO: 110981 - DNA, 25 bp, Homo sapien
atccttggcctcgtcgccgattact

SEQ ID NO: 110982 - DNA, 25 bp, Homo sapien
ctaccgctatgatcgggttctcttc

SEQ ID NO: 110983 - DNA, 25 bp, Homo sapien
ttatgctggttaagcgcgactaccg

SEQ ID NO: 110984 - DNA, 25 bp, Homo sapien
gggccttgcgagagcttgttctccg

SEQ ID NO: 110985 - DNA, 25 bp, Homo sapien
acagccggacaccagagccttgagg

SEQ ID NO: 110986 - DNA, 25 bp, Homo sapien
ggcccgctagtagcccacggagaag

SEQ ID NO: 110987 - DNA, 25 bp, Homo sapien
cctgaacccgcgagctggaagccga

SEQ ID NO: 110988 - DNA, 25 bp, Homo sapien
ttgctgggacgcatgactcaccttc

SEQ ID NO: 110989 - DNA, 25 bp, Homo sapien
tctgccgctcttcttaatttcagga

SEQ ID NO: 110990 - DNA, 25 bp, Homo sapien
gcggaagcagtctctgccgctcttc

SEQ ID NO: 110991 - DNA, 25 bp, Homo sapien
gagccggtacctccaaagtttcaga

SEQ ID NO: 110992 - DNA, 25 bp, Homo sapien
tgagggccgccatcttcaaaaacct

SEQ ID NO: 110993 - DNA, 25 bp, Homo sapien
agttccagttcgtggcctgttacca

SEQ ID NO: 110994 - DNA, 25 bp, Homo sapien
cctctgcgcgcaccgagcgggcact

SEQ ID NO: 110995 - DNA, 25 bp, Homo sapien
tgcggctccaggaaacggcgcgctc

SEQ ID NO: 110996 - DNA, 25 bp, Homo sapien
cctgggacacctccgcacggacggg

SEQ ID NO: 110997 - DNA, 25 bp, Homo sapien
ccatgacctcggtgtggaagcgcct

SEQ ID NO: 110998 - DNA, 25 bp, Homo sapien
tgacctcggtgtggaagcgcctgca

SEQ ID NO: 110999 - DNA, 25 bp, Homo sapien
gcaagcgggcggccaagttccagtt

SEQ ID NO: 111000 - DNA, 25 bp, Homo sapien
ccaagttccagttcgtggcctgtta

SEQ ID NO: 111001 - DNA, 25 bp, Homo sapien
cagtcgcgctgacggacagacagac

SEQ ID NO: 111002 - DNA, 25 bp, Homo sapien
ccatgccaaggtaagcggtcgtgcc

SEQ ID NO: 111003 - DNA, 25 bp, Homo sapien
tcttgggtgcattggagccttgcct

SEQ ID NO: 111004 - DNA, 25 bp, Homo sapien
gcactgaaacttttcgtccaacttc

SEQ ID NO: 111005 - DNA, 25 bp, Homo sapien
cttgggatcccgcagctgaccagtc

SEQ ID NO: 111006 - DNA, 25 bp, Homo sapien
ggggcaaagtgagtgacctgctttt

SEQ ID NO: 111007 - DNA, 25 bp, Homo sapien
ccagcagaaagaggaaagaggtagc

SEQ ID NO: 111008 - DNA, 25 bp, Homo sapien
ggcctccgaaaccatgaactttctg

SEQ ID NO: 111009 - DNA, 25 bp, Homo sapien
gtctgactcagccaagccggcatcg

SEQ ID NO: 111010 - DNA, 25 bp, Homo sapien
tgctggctaatctggctaataaata

SEQ ID NO: 111011 - DNA, 25 bp, Homo sapien
tccctcgagatgtagctgacgtttt

SEQ ID NO: 111012 - DNA, 25 bp, Homo sapien
gacgttttttcttatggctgcccta

SEQ ID NO: 111013 - DNA, 25 bp, Homo sapien
caggtgactcctagaggactgcgtc

SEQ ID NO: 111014 - DNA, 25 bp, Homo sapien
cccgagcgcgagaagaaattacagg

SEQ ID NO: 111015 - DNA, 25 bp, Homo sapien
gggcacggctaatgcgctctaatta

SEQ ID NO: 111016 - DNA, 25 bp, Homo sapien
acgcgccgtaattaagacgccgctc

SEQ ID NO: 111017 - DNA, 25 bp, Homo sapien
cgaaaagccgaggacagccggactc

SEQ ID NO: 111018 - DNA, 25 bp, Homo sapien
cagccggactcaccctgtagttata

SEQ ID NO: 111019 - DNA, 25 bp, Homo sapien
tctcgcaaaccagtaagtgccgcgg

SEQ ID NO: 111020 - DNA, 25 bp, Homo sapien
gccgaagttggatttctcgcaaacc

SEQ ID NO: 111021 - DNA, 25 bp, Homo sapien
cttgtggttgccgaagttggatttc

SEQ ID NO: 111022 - DNA, 25 bp, Homo sapien
tctgcacaagatgccggtggcgcga

SEQ ID NO: 111023 - DNA, 25 bp, Homo sapien
tagtagtgcgtctgcacaagatgcc

SEQ ID NO: 111024 - DNA, 25 bp, Homo sapien
ccctgtagttatagtagtgcgtctg

SEQ ID NO: 111025 - DNA, 25 bp, Homo sapien
gcagaatggtccgtcggcagcagct

SEQ ID NO: 111026 - DNA, 25 bp, Homo sapien
ggtgggctcgatgctcagccttccc

SEQ ID NO: 111027 - DNA, 25 bp, Homo sapien
ttcgctacgtgcagaatggtccgtc

SEQ ID NO: 111028 - DNA, 25 bp, Homo sapien
gtgcgtctcctccattcgctacgtg

SEQ ID NO: 111029 - DNA, 25 bp, Homo sapien
ttgaggcctcccttgtgcgtctcct

SEQ ID NO: 111030 - DNA, 25 bp, Homo sapien
gcgcgcacttgaggcctcccttgtg

SEQ ID NO: 111031 - DNA, 25 bp, Homo sapien
tctgcgaggccattacggccatctc

SEQ ID NO: 111032 - DNA, 25 bp, Homo sapien
cccgcttctttctgcgaggccatta

SEQ ID NO: 111033 - DNA, 25 bp, Homo sapien
cttttattttttctgctgctcccgg

SEQ ID NO: 111034 - DNA, 25 bp, Homo sapien
gagggaatgaggacttaacgcccac

SEQ ID NO: 111035 - DNA, 25 bp, Homo sapien
cagccctcgctcttttcttcgaaga

SEQ ID NO: 111036 - DNA, 25 bp, Homo sapien
aaaaacctggactcagctgcgcgtc

SEQ ID NO: 111037 - DNA, 25 bp, Homo sapien
gcaccatcccgagccaaatgtgagt

SEQ ID NO: 111038 - DNA, 25 bp, Homo sapien
tgccggaggtccagatacgcgccgc

SEQ ID NO: 111039 - DNA, 25 bp, Homo sapien
ccgatgccttctgtgccttttattt

SEQ ID NO: 111040 - DNA, 25 bp, Homo sapien
gtcgccaagtccgatgccttctgtg

SEQ ID NO: 111041 - DNA, 25 bp, Homo sapien
caacggcgccttcttcgtgaactac

SEQ ID NO: 111042 - DNA, 25 bp, Homo sapien
catgtacatgatccggctctgcctg

SEQ ID NO: 111043 - DNA, 25 bp, Homo sapien
atcggcaacgccatggacctgctgc

SEQ ID NO: 111044 - DNA, 25 bp, Homo sapien
caggtgtgtgttcctgcccgacaac

SEQ ID NO: 111045 - DNA, 25 bp, Homo sapien
atcccaggcctgctcatgtacatga

SEQ ID NO: 111046 - DNA, 25 bp, Homo sapien
cccaagggtgcagtgctggagcacc

SEQ ID NO: 111047 - DNA, 25 bp, Homo sapien
tcgtgaactacgtcattgcctcagc

SEQ ID NO: 111048 - DNA, 25 bp, Homo sapien
ctcagcctttatcggcaacgccatg

SEQ ID NO: 111049 - DNA, 25 bp, Homo sapien
cgagttccagtttggcgcagcctac

SEQ ID NO: 111050 - DNA, 25 bp, Homo sapien
accctctccactctaggaatgcagg

SEQ ID NO: 111051 - DNA, 25 bp, Homo sapien
catcatcgtgcccttcggtaggcac

SEQ ID NO: 111052 - DNA, 25 bp, Homo sapien
tggtcatgacctacagtatcacctg

SEQ ID NO: 111053 - DNA, 25 bp, Homo sapien
gcgtcttcacggtggtcatgaccta

SEQ ID NO: 111054 - DNA, 25 bp, Homo sapien
atgatgtgcgtcttcacggtggtca

SEQ ID NO: 111055 - DNA, 25 bp, Homo sapien
ctacgcctggatgatgtgcgtcttc

SEQ ID NO: 111056 - DNA, 25 bp, Homo sapien
cgcagcctacgcctggatgatgtgc

SEQ ID NO: 111057 - DNA, 25 bp, Homo sapien
gggtcgcctgttgcagcctctcttc

SEQ ID NO: 111058 - DNA, 25 bp, Homo sapien
ttgcagcctctcttccgcccggcgg

SEQ ID NO: 111059 - DNA, 25 bp, Homo sapien
caaaggcgccggccgccagtcccag

SEQ ID NO: 111060 - DNA, 25 bp, Homo sapien
ctggggtcgcctgttgcagcctctc

SEQ ID NO: 111061 - DNA, 25 bp, Homo sapien
ccgcgaggactggacgcagctggct

SEQ ID NO: 111062 - DNA, 25 bp, Homo sapien
cctcccactgagtcggctctggtct

SEQ ID NO: 111063 - DNA, 25 bp, Homo sapien
tccggagcctcgggtgcccaaaggc

SEQ ID NO: 111064 - DNA, 25 bp, Homo sapien
gcccggcggcccacaccggtcaggc

SEQ ID NO: 111065 - DNA, 25 bp, Homo sapien
aaactcgtatccctggcgtctcctt

SEQ ID NO: 111066 - DNA, 25 bp, Homo sapien
gtcttttactggctaaactcgtatc

SEQ ID NO: 111067 - DNA, 25 bp, Homo sapien
ccatcgatctggtcggtatcaggga

SEQ ID NO: 111068 - DNA, 25 bp, Homo sapien
tcacgttgacctccgcaaggggcag

SEQ ID NO: 111069 - DNA, 25 bp, Homo sapien
aacaggctgcggtcacgttgacctc

SEQ ID NO: 111070 - DNA, 25 bp, Homo sapien
ctcccgggcctaaaacaggctgcgg

SEQ ID NO: 111071 - DNA, 25 bp, Homo sapien
atctcagcgcgggagcagtgcttct

SEQ ID NO: 111072 - DNA, 25 bp, Homo sapien
tggctaaactcgtatccctggcgtc

SEQ ID NO: 111073 - DNA, 25 bp, Homo sapien
taagcctcgcggacagccgagaacc

SEQ ID NO: 111074 - DNA, 25 bp, Homo sapien
gcctcgcggacagccgagaaccgtg

SEQ ID NO: 111075 - DNA, 25 bp, Homo sapien
gtgtcagacagacccacgccactgc

SEQ ID NO: 111076 - DNA, 25 bp, Homo sapien
cgcttctgcgtcctggcgggtgggt

SEQ ID NO: 111077 - DNA, 25 bp, Homo sapien
tgaccagactgcgtgtcagacagac

SEQ ID NO: 111078 - DNA, 25 bp, Homo sapien
ccagactgcgtgtcagacagaccca

SEQ ID NO: 111079 - DNA, 25 bp, Homo sapien
agactgcgtgtcagacagacccacg

SEQ ID NO: 111080 - DNA, 25 bp, Homo sapien
gcgggtccctaagcctcgcggacag

SEQ ID NO: 111081 - DNA, 25 bp, Homo sapien
ggtgcccgacaagctcatcgtcatg

SEQ ID NO: 111082 - DNA, 25 bp, Homo sapien
ggacggtgtgccgttgctaagcaac

SEQ ID NO: 111083 - DNA, 25 bp, Homo sapien
cgggccttgttgctggatttccctc

SEQ ID NO: 111084 - DNA, 25 bp, Homo sapien
cggacatggtgctactgtcggtgcc

SEQ ID NO: 111085 - DNA, 25 bp, Homo sapien
atcgtcatgacgtacctgtgccaga

SEQ ID NO: 111086 - DNA, 25 bp, Homo sapien
gctcgttctcgatggacgatccgga

SEQ ID NO: 111087 - DNA, 25 bp, Homo sapien
gctgcagtgagtgtcaaggtccttc

SEQ ID NO: 111088 - DNA, 25 bp, Homo sapien
cgacgcggacctgctcaagaagagg

SEQ ID NO: 111089 - DNA, 25 bp, Homo sapien
ctgagatctccgctaggcttctttc

SEQ ID NO: 111090 - DNA, 25 bp, Homo sapien
ttccgccgcatgtcggcaaagagtc

SEQ ID NO: 111091 - DNA, 25 bp, Homo sapien
tagctgcctccgctctttttcggtg

SEQ ID NO: 111092 - DNA, 25 bp, Homo sapien
tcctcgcccgtagagacaccgttta

SEQ ID NO: 111093 - DNA, 25 bp, Homo sapien
cggctgtactgtgcttcgccttata

SEQ ID NO: 111094 - DNA, 25 bp, Homo sapien
ctgtcctttagggagccttagtcta

SEQ ID NO: 111095 - DNA, 25 bp, Homo sapien
ggcttgtggataacgctctggattt

SEQ ID NO: 111096 - DNA, 25 bp, Homo sapien
ccgctcttgatggagtcatgtccta

SEQ ID NO: 111097 - DNA, 25 bp, Homo sapien
tccacgatccgggacgtcagggtcc

SEQ ID NO: 111098 - DNA, 25 bp, Homo sapien
tccggcccggacaaagagcctctct

SEQ ID NO: 111099 - DNA, 25 bp, Homo sapien
tagccggctgctcaggtcagaggaa

SEQ ID NO: 111100 - DNA, 25 bp, Homo sapien
ccaaggagcacaaaaccaagccgca

SEQ ID NO: 111101 - DNA, 25 bp, Homo sapien
tccgggcagcgatatgctggccgac

SEQ ID NO: 111102 - DNA, 25 bp, Homo sapien
atatgctggccgacggccgagcagc

SEQ ID NO: 111103 - DNA, 25 bp, Homo sapien
ctgtgcttcgtcatcgcccttcata

SEQ ID NO: 111104 - DNA, 25 bp, Homo sapien
ggccagcggaagtgccgcgctcttc

SEQ ID NO: 111105 - DNA, 25 bp, Homo sapien
gtccacccagcggttactgtgggca

SEQ ID NO: 111106 - DNA, 25 bp, Homo sapien
tccttctcctgtggttccttgacgg

SEQ ID NO: 111107 - DNA, 25 bp, Homo sapien
cgcagagagcgcagagactcaatgc

SEQ ID NO: 111108 - DNA, 25 bp, Homo sapien
gcgcagagactcaatgccagagtcg

SEQ ID NO: 111109 - DNA, 25 bp, Homo sapien
tgccagagtcgtactggctctcctc

SEQ ID NO: 111110 - DNA, 25 bp, Homo sapien
ccggtctgagcaggatccggctcca

SEQ ID NO: 111111 - DNA, 25 bp, Homo sapien
ttactgtgggcagccgaaccgccca

SEQ ID NO: 111112 - DNA, 25 bp, Homo sapien
gaccaacagggtcgcctcacgcgga

SEQ ID NO: 111113 - DNA, 25 bp, Homo sapien
gccttttaagcgctcaggacagcca

SEQ ID NO: 111114 - DNA, 25 bp, Homo sapien
tgacaacagcggcaggcgcctttta

SEQ ID NO: 111115 - DNA, 25 bp, Homo sapien
cacccgcgcgaggatcaagtacgtg

SEQ ID NO: 111116 - DNA, 25 bp, Homo sapien
tgggtcacacggcagcgtacataca

SEQ ID NO: 111117 - DNA, 25 bp, Homo sapien
cgcctcgcgttcacttttccggaga

SEQ ID NO: 111118 - DNA, 25 bp, Homo sapien
aatctcacggagtggcaactgcgca

SEQ ID NO: 111119 - DNA, 25 bp, Homo sapien
ccagctgcctgaatggacacgagta

SEQ ID NO: 111120 - DNA, 25 bp, Homo sapien
tgcacgcctaggcagacaggtaaca

SEQ ID NO: 111121 - DNA, 25 bp, Homo sapien
gaagcttccctatgcgtgccgagga

SEQ ID NO: 111122 - DNA, 25 bp, Homo sapien
cctggccagcgtgaagcacttcagc

SEQ ID NO: 111123 - DNA, 25 bp, Homo sapien
ggctgctgcgccaagtgcaagaagc

SEQ ID NO: 111124 - DNA, 25 bp, Homo sapien
gcccgaggagttagttaagtctcca

SEQ ID NO: 111125 - DNA, 25 bp, Homo sapien
gaactacgttgtcttgtcgagcctg

SEQ ID NO: 111126 - DNA, 25 bp, Homo sapien
gaacacggcttccaggtgtcccagc

SEQ ID NO: 111127 - DNA, 25 bp, Homo sapien
tccaccggagcactcgggaacacgg

SEQ ID NO: 111128 - DNA, 25 bp, Homo sapien
ttcgaggcactcaagaagcggaaca

SEQ ID NO: 111129 - DNA, 25 bp, Homo sapien
ccgggaggtcctgagctcgacgcgc

SEQ ID NO: 111130 - DNA, 25 bp, Homo sapien
gctccagctcggctcagacaaaagg

SEQ ID NO: 111131 - DNA, 25 bp, Homo sapien
tccagctcggctcagacaaaaggcg

SEQ ID NO: 111132 - DNA, 25 bp, Homo sapien
cagctcggctcagacaaaaggcggc

SEQ ID NO: 111133 - DNA, 25 bp, Homo sapien
ctcggctcagacaaaaggcggcggc

SEQ ID NO: 111134 - DNA, 25 bp, Homo sapien
cgccgcgagggcctcaaggtgacac

SEQ ID NO: 111135 - DNA, 25 bp, Homo sapien
ccgcccgagaggaggtgagagtcta

SEQ ID NO: 111136 - DNA, 25 bp, Homo sapien
ggtgagagtctagggcgccccttcc

SEQ ID NO: 111137 - DNA, 25 bp, Homo sapien
ctgccgcgggtcaacacagtagaca

SEQ ID NO: 111138 - DNA, 25 bp, Homo sapien
cccagctactctgaggcggtgctca

SEQ ID NO: 111139 - DNA, 25 bp, Homo sapien
cgcgcactaccacgtggagaagcta

SEQ ID NO: 111140 - DNA, 25 bp, Homo sapien
acttccgtgagttcatggtggcctt

SEQ ID NO: 111141 - DNA, 25 bp, Homo sapien
acgagggcctagacgactacatgga

SEQ ID NO: 111142 - DNA, 25 bp, Homo sapien
cttcttcgcagagaacgagggccta

SEQ ID NO: 111143 - DNA, 25 bp, Homo sapien
cgagaacgcgtacctgtgccagcgc

SEQ ID NO: 111144 - DNA, 25 bp, Homo sapien
ggctcctgcgtagagacctcactgt

SEQ ID NO: 111145 - DNA, 25 bp, Homo sapien
atgcgtttccagctgccgccatggt

SEQ ID NO: 111146 - DNA, 25 bp, Homo sapien
aggaactgatcgacgtggaccctgc

SEQ ID NO: 111147 - DNA, 25 bp, Homo sapien
tggaccctgcgcacgtaattccggc

SEQ ID NO: 111148 - DNA, 25 bp, Homo sapien
acgtaattccggcagagcggcagca

SEQ ID NO: 111149 - DNA, 25 bp, Homo sapien
tgtggtgcctgggataaagtgcttt

SEQ ID NO: 111150 - DNA, 25 bp, Homo sapien
gtgccgctcgaagaacatgcgtttc

SEQ ID NO: 111151 - DNA, 25 bp, Homo sapien
acacgggccagcgatgcatgcagca

SEQ ID NO: 111152 - DNA, 25 bp, Homo sapien
aagtgctttagcaggttctccaggt

SEQ ID NO: 111153 - DNA, 25 bp, Homo sapien
aggcacgcggcttactcgcgcgcag

SEQ ID NO: 111154 - DNA, 25 bp, Homo sapien
tagtgggactgtggccttgcgctat

SEQ ID NO: 111155 - DNA, 25 bp, Homo sapien
gctatgccctgtgcttccgtgggac

SEQ ID NO: 111156 - DNA, 25 bp, Homo sapien
cttccgtgggacgtgtctaggaacg

SEQ ID NO: 111157 - DNA, 25 bp, Homo sapien
cccgcgggagggattacagccctcg

SEQ ID NO: 111158 - DNA, 25 bp, Homo sapien
gccagacggtttgcagacagtgact

SEQ ID NO: 111159 - DNA, 25 bp, Homo sapien
cacggaaaacgcaacccaggcaatg

SEQ ID NO: 111160 - DNA, 25 bp, Homo sapien
aacccaggcaatggccgcccgtggg

SEQ ID NO: 111161 - DNA, 25 bp, Homo sapien
ccctatcagtatggttcggccctca

SEQ ID NO: 111162 - DNA, 25 bp, Homo sapien
ctgcagcgtctttctcaccagaaaa

SEQ ID NO: 111163 - DNA, 25 bp, Homo sapien
caaaaagcaaactggggtcgccgcg

SEQ ID NO: 111164 - DNA, 25 bp, Homo sapien
ttcttttgcccaatcctgcagcgtc

SEQ ID NO: 111165 - DNA, 25 bp, Homo sapien
aagaagttcagaaaggcggccctca

SEQ ID NO: 111166 - DNA, 25 bp, Homo sapien
agctgccactgacgctgccatcgta

SEQ ID NO: 111167 - DNA, 25 bp, Homo sapien
ctccgggcagtgactttacgtggtc

SEQ ID NO: 111168 - DNA, 25 bp, Homo sapien
ctcacctggttcatgcccgcattga

SEQ ID NO: 111169 - DNA, 25 bp, Homo sapien
tggcagaaaacgtccgctcagcagc

SEQ ID NO: 111170 - DNA, 25 bp, Homo sapien
cggagcgctgactcgaacccgttct

SEQ ID NO: 111171 - DNA, 25 bp, Homo sapien
ctctgccatcctaagccggaaggtg

SEQ ID NO: 111172 - DNA, 25 bp, Homo sapien
cagggaagtcccattcgaaatagtt

SEQ ID NO: 111173 - DNA, 25 bp, Homo sapien
gggtggcccataacttctcgcgtcc

SEQ ID NO: 111174 - DNA, 25 bp, Homo sapien
tccacctgggctctcaataggcgga

SEQ ID NO: 111175 - DNA, 25 bp, Homo sapien
gcttcgaccctcagactggcagaaa

SEQ ID NO: 111176 - DNA, 25 bp, Homo sapien
ggccgccgtatttatttgtcaccga

SEQ ID NO: 111177 - DNA, 25 bp, Homo sapien
tctgccactcggtgacgtcacgatc

SEQ ID NO: 111178 - DNA, 25 bp, Homo sapien
tgccgccaagatgcctcgaattatg

SEQ ID NO: 111179 - DNA, 25 bp, Homo sapien
ctctgaagctcctctcggctgcttg

SEQ ID NO: 111180 - DNA, 25 bp, Homo sapien
gtggcccaatcgctgttactacttc

SEQ ID NO: 111181 - DNA, 25 bp, Homo sapien
tatctcgcgagacttgctattctgc

SEQ ID NO: 111182 - DNA, 25 bp, Homo sapien
gcagctgagcttccacaagacactt

SEQ ID NO: 111183 - DNA, 25 bp, Homo sapien
tgtgttagtcttcctgcagctgagc

SEQ ID NO: 111184 - DNA, 25 bp, Homo sapien
cgcgagagccgtagtttcttccatt

SEQ ID NO: 111185 - DNA, 25 bp, Homo sapien
cccgcggcctctgctaataaatttc

SEQ ID NO: 111186 - DNA, 25 bp, Homo sapien
gagttgcgggctgcggattagcaga

SEQ ID NO: 111187 - DNA, 25 bp, Homo sapien
aggcgctgggccagagttgcgggct

SEQ ID NO: 111188 - DNA, 25 bp, Homo sapien
tgctaataaatttccttgggcgagg

SEQ ID NO: 111189 - DNA, 25 bp, Homo sapien
ctctgctaataaatttccttgggcg

SEQ ID NO: 111190 - DNA, 25 bp, Homo sapien
ccgcggcctctgctaataaatttcc

SEQ ID NO: 111191 - DNA, 25 bp, Homo sapien
ggcctctgctaataaatttccttgg

SEQ ID NO: 111192 - DNA, 25 bp, Homo sapien
gcggcctctgctaataaatttcctt

SEQ ID NO: 111193 - DNA, 25 bp, Homo sapien
aaactcgccggatctgaagctgccc

SEQ ID NO: 111194 - DNA, 25 bp, Homo sapien
ccgcagccaggctagtggaaaactc

SEQ ID NO: 111195 - DNA, 25 bp, Homo sapien
aacaggctggtaacagccgcagcca

SEQ ID NO: 111196 - DNA, 25 bp, Homo sapien
cgacgaatctgaacaggctggtaac

SEQ ID NO: 111197 - DNA, 25 bp, Homo sapien
ggcttccaatttgacgacgaatctg

SEQ ID NO: 111198 - DNA, 25 bp, Homo sapien
ctgcatttgcgggtcctcagtattt

SEQ ID NO: 111199 - DNA, 25 bp, Homo sapien
ccgcagcttttatcagcacacaaga

SEQ ID NO: 111200 - DNA, 25 bp, Homo sapien
tcctcagtattttggctgtctcctc

SEQ ID NO: 111201 - DNA, 25 bp, Homo sapien
taagaacccttggaggcactgctgc

SEQ ID NO: 111202 - DNA, 25 bp, Homo sapien
gcccgagagggctaggatttttgaa

SEQ ID NO: 111203 - DNA, 25 bp, Homo sapien
acagggtgcaggcttgaattcttta

SEQ ID NO: 111204 - DNA, 25 bp, Homo sapien
tgaccggcactggaagttgattttc

SEQ ID NO: 111205 - DNA, 25 bp, Homo sapien
tccgaggaagagattcaccgttcta

SEQ ID NO: 111206 - DNA, 25 bp, Homo sapien
ggatcttaatgggattgcgcgttta

SEQ ID NO: 111207 - DNA, 25 bp, Homo sapien
aacactccggcgtagaccacgaaga

SEQ ID NO: 111208 - DNA, 25 bp, Homo sapien
caccgttctaagcttctttccagga

SEQ ID NO: 111209 - DNA, 25 bp, Homo sapien
tccagagtccgcgactggcaccagg

SEQ ID NO: 111210 - DNA, 25 bp, Homo sapien
atcttgtactcgaaagggctccaga

SEQ ID NO: 111211 - DNA, 25 bp, Homo sapien
ggggcgatcccgagtcacgcaacca

SEQ ID NO: 111212 - DNA, 25 bp, Homo sapien
cccaattaggaaggacagagtagta

SEQ ID NO: 111213 - DNA, 25 bp, Homo sapien
ggcgcagaatcgcttctcggagtca

SEQ ID NO: 111214 - DNA, 25 bp, Homo sapien
cggtctggctaaatgggttctcgca

SEQ ID NO: 111215 - DNA, 25 bp, Homo sapien
gcttccagttggtccggtctggcta

SEQ ID NO: 111216 - DNA, 25 bp, Homo sapien
ctcagcgagtgggagcaaagctcta

SEQ ID NO: 111217 - DNA, 25 bp, Homo sapien
tctcccttggtaacggcactcctag

SEQ ID NO: 111218 - DNA, 25 bp, Homo sapien
gtctatttaagagatctcatcccta

SEQ ID NO: 111219 - DNA, 25 bp, Homo sapien
ttttcatgggaatggaactggctcc

SEQ ID NO: 111220 - DNA, 25 bp, Homo sapien
tggctccctaggtggtgttcatttc

SEQ ID NO: 111221 - DNA, 25 bp, Homo sapien
atttcctctggatgcctcaggcctg

SEQ ID NO: 111222 - DNA, 25 bp, Homo sapien
ggcctgtctcctccaaagacgagaa

SEQ ID NO: 111223 - DNA, 25 bp, Homo sapien
cgtcattgcaactaacaaattgggg

SEQ ID NO: 111224 - DNA, 25 bp, Homo sapien
cggatcgctccaggtgtgattttca

SEQ ID NO: 111225 - DNA, 25 bp, Homo sapien
aagacctcctgccttggcggctcta

SEQ ID NO: 111226 - DNA, 25 bp, Homo sapien
gcagtcggcctcatcaaacttgatt

SEQ ID NO: 111227 - DNA, 25 bp, Homo sapien
acttcgctaacttgtggctgttgtg

SEQ ID NO: 111228 - DNA, 25 bp, Homo sapien
cgccagactctgttggcccatcaga

SEQ ID NO: 111229 - DNA, 25 bp, Homo sapien
ggctgttgtgatgcgtattcccgta

SEQ ID NO: 111230 - DNA, 25 bp, Homo sapien
tgcagcccggcaaaatgagcgacgt

SEQ ID NO: 111231 - DNA, 25 bp, Homo sapien
cacgacaaccgcaccatggtggaga

SEQ ID NO: 111232 - DNA, 25 bp, Homo sapien
ggtgttccaaagactccggcaaaga

SEQ ID NO: 111233 - DNA, 25 bp, Homo sapien
tggcaccctgcgaaggatgcttaga

SEQ ID NO: 111234 - DNA, 25 bp, Homo sapien
ccctgccagatgtttcggatgccaa

SEQ ID NO: 111235 - DNA, 25 bp, Homo sapien
ggatcgcttgcaccaggcatccctg

SEQ ID NO: 111236 - DNA, 25 bp, Homo sapien
tgcgcagctgcctagcggaaagcac

SEQ ID NO: 111237 - DNA, 25 bp, Homo sapien
acggccctagcgtttcagcgtgaaa

SEQ ID NO: 111238 - DNA, 25 bp, Homo sapien
ttcagcgtgaaacagacccggttgc

SEQ ID NO: 111239 - DNA, 25 bp, Homo sapien
gcccttctcttgtcttgagcgtcta

SEQ ID NO: 111240 - DNA, 25 bp, Homo sapien
tcaccaaactggcttcgtccctggg

SEQ ID NO: 111241 - DNA, 25 bp, Homo sapien
tcacaaagagctcgatctcggggtc

SEQ ID NO: 111242 - DNA, 25 bp, Homo sapien
atcccgacacctggagacgtctttc

SEQ ID NO: 111243 - DNA, 25 bp, Homo sapien
ggagacgtctttcaggaccagcctg

SEQ ID NO: 111244 - DNA, 25 bp, Homo sapien
gggtggacaaactgcggatcaactc

SEQ ID NO: 111245 - DNA, 25 bp, Homo sapien
aggtgtcacaggatccgcgactgtc

SEQ ID NO: 111246 - DNA, 25 bp, Homo sapien
gatcagtgtcccagatgctcacatg

SEQ ID NO: 111247 - DNA, 25 bp, Homo sapien
ggctcctcttcagggcggtgtttaa

SEQ ID NO: 111248 - DNA, 25 bp, Homo sapien
ttagctgtcgccgagtctgtcatgc

SEQ ID NO: 111249 - DNA, 25 bp, Homo sapien
gccttagacgctcgcctggcagctg

SEQ ID NO: 111250 - DNA, 25 bp, Homo sapien
ccgagttccgcgcattggaaagaag

SEQ ID NO: 111251 - DNA, 25 bp, Homo sapien
ctgcgcaggcgcctcaggaagagct

SEQ ID NO: 111252 - DNA, 25 bp, Homo sapien
tggcagctgcgcacactcggagcgc

SEQ ID NO: 111253 - DNA, 25 bp, Homo sapien
ttccgcgcattggaaagaagcgacc

SEQ ID NO: 111254 - DNA, 25 bp, Homo sapien
cgcattggaaagaagcgaccgcggc

SEQ ID NO: 111255 - DNA, 25 bp, Homo sapien
ctggtgagtacgcgcctcgcgcgct

SEQ ID NO: 111256 - DNA, 25 bp, Homo sapien
cccgagcggcgcagatagggacgtt

SEQ ID NO: 111257 - DNA, 25 bp, Homo sapien
tcgccaagcgtggtctctgacactc

SEQ ID NO: 111258 - DNA, 25 bp, Homo sapien
ggttccaacatcacaatcgccaagc

SEQ ID NO: 111259 - DNA, 25 bp, Homo sapien
cccaggtgccaaaacttctcgaagc

SEQ ID NO: 111260 - DNA, 25 bp, Homo sapien
tcgctcaccttatccaggcagttga

SEQ ID NO: 111261 - DNA, 25 bp, Homo sapien
tctcggtgggatacacgacttttcc

SEQ ID NO: 111262 - DNA, 25 bp, Homo sapien
gacttttccgcaacgggcgcactgg

SEQ ID NO: 111263 - DNA, 25 bp, Homo sapien
gcactccaggtacgggtgactcaca

SEQ ID NO: 111264 - DNA, 25 bp, Homo sapien
gggagagtgctcaaacccgcgtact

SEQ ID NO: 111265 - DNA, 25 bp, Homo sapien
tggctgaccgctggcccacagggat

SEQ ID NO: 111266 - DNA, 25 bp, Homo sapien
cgtcccagagctgctaccgcgctct

SEQ ID NO: 111267 - DNA, 25 bp, Homo sapien
caggtccagcaacaggggtgcagga

SEQ ID NO: 111268 - DNA, 25 bp, Homo sapien
gggctcttggctgaccgctggccca

SEQ ID NO: 111269 - DNA, 25 bp, Homo sapien
cgtcttgagcgagaagcagatgagc

SEQ ID NO: 111270 - DNA, 25 bp, Homo sapien
agcagcgcccgctggatcagcttgg

SEQ ID NO: 111271 - DNA, 25 bp, Homo sapien
cacagggatacccaggtccagcaac

SEQ ID NO: 111272 - DNA, 25 bp, Homo sapien
ctggatcagcttgggcgtcccagag

SEQ ID NO: 111273 - DNA, 25 bp, Homo sapien
cggcgcggttacataaccgacctgc

SEQ ID NO: 111274 - DNA, 25 bp, Homo sapien
gccgtcacccgggacaaagcggctc

SEQ ID NO: 111275 - DNA, 25 bp, Homo sapien
cagtgggattctgcctgctgcccgc

SEQ ID NO: 111276 - DNA, 25 bp, Homo sapien
gtcagtgggattctgcctgctgccc

SEQ ID NO: 111277 - DNA, 25 bp, Homo sapien
tctctgccgccgtgggtcagtggga

SEQ ID NO: 111278 - DNA, 25 bp, Homo sapien
ttacataaccgacctgctgggcgtc

SEQ ID NO: 111279 - DNA, 25 bp, Homo sapien
ctggccggcgcggttacataaccga

SEQ ID NO: 111280 - DNA, 25 bp, Homo sapien
aaccgacctgctgggcgtccgcgat

SEQ ID NO: 111281 - DNA, 25 bp, Homo sapien
actgctaggaaggttgcgggtccac

SEQ ID NO: 111282 - DNA, 25 bp, Homo sapien
ttttgccgctgacccagagatggcc

SEQ ID NO: 111283 - DNA, 25 bp, Homo sapien
tactgctgaatgtccgtcccggagg

SEQ ID NO: 111284 - DNA, 25 bp, Homo sapien
cgttatcgtcttgcgctactgctga

SEQ ID NO: 111285 - DNA, 25 bp, Homo sapien
cccgagcgagcaaattcctactgtc

SEQ ID NO: 111286 - DNA, 25 bp, Homo sapien
agccgaacgagggaaatggtcctca

SEQ ID NO: 111287 - DNA, 25 bp, Homo sapien
ggctccgctgtgtttttctattctg

SEQ ID NO: 111288 - DNA, 25 bp, Homo sapien
tggaccactccagctgggactgcta

SEQ ID NO: 111289 - DNA, 25 bp, Homo sapien
ccgacgccgtggacttccttagcaa

SEQ ID NO: 111290 - DNA, 25 bp, Homo sapien
gaggtgcctgatgtgttccaacaga

SEQ ID NO: 111291 - DNA, 25 bp, Homo sapien
ttcaatttgccctcggaagtgctgg

SEQ ID NO: 111292 - DNA, 25 bp, Homo sapien
tgtccttcgtggacgtgcatcccga

SEQ ID NO: 111293 - DNA, 25 bp, Homo sapien
tcaagatgtgctcgacgcccggaat

SEQ ID NO: 111294 - DNA, 25 bp, Homo sapien
tgaacctagtttggctgggactcgc

SEQ ID NO: 111295 - DNA, 25 bp, Homo sapien
aacaagctccttgggcccttaggcg

SEQ ID NO: 111296 - DNA, 25 bp, Homo sapien
ggtctcctgaacgtcccaacaagct

SEQ ID NO: 111297 - DNA, 25 bp, Homo sapien
tgcttctcgccgacagcactgcgag

SEQ ID NO: 111298 - DNA, 25 bp, Homo sapien
agcgggtgcgactcagcgagcccac

SEQ ID NO: 111299 - DNA, 25 bp, Homo sapien
gcaaggatcctagcgctgtttccga

SEQ ID NO: 111300 - DNA, 25 bp, Homo sapien
gacccaagcgctccaaacccgactg

SEQ ID NO: 111301 - DNA, 25 bp, Homo sapien
ctgggtccgcctagcgcggccttgt

SEQ ID NO: 111302 - DNA, 25 bp, Homo sapien
atcctagcgctgtttccgagggctg

SEQ ID NO: 111303 - DNA, 25 bp, Homo sapien
ctgcagggactgtgagcccaggacc

SEQ ID NO: 111304 - DNA, 25 bp, Homo sapien
actgtgagcccaggaccggccagca

SEQ ID NO: 111305 - DNA, 25 bp, Homo sapien
cggtagcatcccgacatgacattgc

SEQ ID NO: 111306 - DNA, 25 bp, Homo sapien
attgcagctgcaacaaagcgccggc

SEQ ID NO: 111307 - DNA, 25 bp, Homo sapien
ggggaaaagccctcaaatgcgcaga

SEQ ID NO: 111308 - DNA, 25 bp, Homo sapien
aaataacctagtcgaggccctctgg

SEQ ID NO: 111309 - DNA, 25 bp, Homo sapien
tggtgtgttgccttcccttggaaac

SEQ ID NO: 111310 - DNA, 25 bp, Homo sapien
tccacgcaagcgctcaccaggagaa

SEQ ID NO: 111311 - DNA, 25 bp, Homo sapien
cgcgagagagcaaaggaacgacttc

SEQ ID NO: 111312 - DNA, 25 bp, Homo sapien
cactgtcttccactgcggtagcatc

SEQ ID NO: 111313 - DNA, 25 bp, Homo sapien
tgcagaaagtaactccgcgtcgccg

SEQ ID NO: 111314 - DNA, 25 bp, Homo sapien
aggctgtgccctttctcggccttct

SEQ ID NO: 111315 - DNA, 25 bp, Homo sapien
cctttaaggtcctcgaggctgcttc

SEQ ID NO: 111316 - DNA, 25 bp, Homo sapien
gggcaactttgcctatcagcagaaa

SEQ ID NO: 111317 - DNA, 25 bp, Homo sapien
accttttgatccatctgaggcgaca

SEQ ID NO: 111318 - DNA, 25 bp, Homo sapien
gcgttctcgcgagatttgcctcctc

SEQ ID NO: 111319 - DNA, 25 bp, Homo sapien
ttagtctacggtgtcgccttttcta

SEQ ID NO: 111320 - DNA, 25 bp, Homo sapien
cgccttttctaactgcgagtgctaa

SEQ ID NO: 111321 - DNA, 25 bp, Homo sapien
taggcgctgaaacgcttgctctctc

SEQ ID NO: 111322 - DNA, 25 bp, Homo sapien
ggcaggcccgctttctgtcaaaatg

SEQ ID NO: 111323 - DNA, 25 bp, Homo sapien
gtgacttgatttcgcctgatcctgg

SEQ ID NO: 111324 - DNA, 25 bp, Homo sapien
tgcagttgcatcacggagagccttt

SEQ ID NO: 111325 - DNA, 25 bp, Homo sapien
actccagcctgtgcggaaaccacga

SEQ ID NO: 111326 - DNA, 25 bp, Homo sapien
tcgcccggtacagagataacacttg

SEQ ID NO: 111327 - DNA, 25 bp, Homo sapien
gcccgctgggtcacctgtaattgta

SEQ ID NO: 111328 - DNA, 25 bp, Homo sapien
gtcctcttcgccgaggtcccaagta

SEQ ID NO: 111329 - DNA, 25 bp, Homo sapien
gcacatgtgacatgtgtaagcgccg

SEQ ID NO: 111330 - DNA, 25 bp, Homo sapien
gctcccggccgtcttaaaaagcaca

SEQ ID NO: 111331 - DNA, 25 bp, Homo sapien
gccgaaggtgattgtcaggactgcg

SEQ ID NO: 111332 - DNA, 25 bp, Homo sapien
aaaagaccgggtgccggctcacgca

SEQ ID NO: 111333 - DNA, 25 bp, Homo sapien
cggccgtcttaaaaagcacatgtga

SEQ ID NO: 111334 - DNA, 25 bp, Homo sapien
agcctgtggcagaacgactggagcc

SEQ ID NO: 111335 - DNA, 25 bp, Homo sapien
gactggagccctctgcgaagcacct

SEQ ID NO: 111336 - DNA, 25 bp, Homo sapien
tccaccagatccagctcgcaggcgc

SEQ ID NO: 111337 - DNA, 25 bp, Homo sapien
cctctgtttacgaatgtttgggcgc

SEQ ID NO: 111338 - DNA, 25 bp, Homo sapien
ttagatgcccgtttccgctttcttc

SEQ ID NO: 111339 - DNA, 25 bp, Homo sapien
gcattcctgatgacgtttaggggta

SEQ ID NO: 111340 - DNA, 25 bp, Homo sapien
atgggcgcattcctgatgacgttta

SEQ ID NO: 111341 - DNA, 25 bp, Homo sapien
tagcgctctcatgggcgcattcctg

SEQ ID NO: 111342 - DNA, 25 bp, Homo sapien
tccagccaatctaatagcgctctca

SEQ ID NO: 111343 - DNA, 25 bp, Homo sapien
tgtttgggcgcgaattactctaagc

SEQ ID NO: 111344 - DNA, 25 bp, Homo sapien
tccgggtctcctctgtttacgaatg

SEQ ID NO: 111345 - DNA, 25 bp, Homo sapien
cgcgctcacttttcgcagcagtaga

SEQ ID NO: 111346 - DNA, 25 bp, Homo sapien
agacccacccaaatacgtgcttgtg

SEQ ID NO: 111347 - DNA, 25 bp, Homo sapien
tctcctgcacccagagaggtggtta

SEQ ID NO: 111348 - DNA, 25 bp, Homo sapien
tgacccttttgccaggatggagacc

SEQ ID NO: 111349 - DNA, 25 bp, Homo sapien
gcgcttgctgcttgaaccggtcaaa

SEQ ID NO: 111350 - DNA, 25 bp, Homo sapien
cttcagctttcaccggctgggagtc

SEQ ID NO: 111351 - DNA, 25 bp, Homo sapien
aagtgttgcagacctcctgggccaa

SEQ ID NO: 111352 - DNA, 25 bp, Homo sapien
ttagcctggggctgatctagtcttc

SEQ ID NO: 111353 - DNA, 25 bp, Homo sapien
ctgcatggaatggaaggagtcccgc

SEQ ID NO: 111354 - DNA, 25 bp, Homo sapien
ctcgcagctcgtcgaagagaccctg

SEQ ID NO: 111355 - DNA, 25 bp, Homo sapien
gcatttcccgtaggacctgtgcctc

SEQ ID NO: 111356 - DNA, 25 bp, Homo sapien
tgggtcccttgattcctcgcacctt

SEQ ID NO: 111357 - DNA, 25 bp, Homo sapien
gagacactcgttccaacgctgggtc

SEQ ID NO: 111358 - DNA, 25 bp, Homo sapien
gagcttgctgcgcttgaatgtcccg

SEQ ID NO: 111359 - DNA, 25 bp, Homo sapien
gccctcaccgagtggcatgctgata

SEQ ID NO: 111360 - DNA, 25 bp, Homo sapien
agagaccctggatctcgcgcttcca

SEQ ID NO: 111361 - DNA, 25 bp, Homo sapien
ctcggcatagacaggcgcagaattt

SEQ ID NO: 111362 - DNA, 25 bp, Homo sapien
gtgtgtggtgtcacccgcacctata

SEQ ID NO: 111363 - DNA, 25 bp, Homo sapien
ttttccgctctctcgactgtgagga

SEQ ID NO: 111364 - DNA, 25 bp, Homo sapien
gcggcgccttggttgcaaaatgaca

SEQ ID NO: 111365 - DNA, 25 bp, Homo sapien
ccggagtcagttgcaaacctggatc

SEQ ID NO: 111366 - DNA, 25 bp, Homo sapien
ctgtctggagtcagtagccaattcc

SEQ ID NO: 111367 - DNA, 25 bp, Homo sapien
agtccttccattacgagtttcagca

SEQ ID NO: 111368 - DNA, 25 bp, Homo sapien
cgcagaatttcgatgctggggtcta

SEQ ID NO: 111369 - DNA, 25 bp, Homo sapien
ccggaagcccgctaggaagtattga

SEQ ID NO: 111370 - DNA, 25 bp, Homo sapien
ggcagatttagaggctccagggacc

SEQ ID NO: 111371 - DNA, 25 bp, Homo sapien
ctcagaggcagatttagaggctcca

SEQ ID NO: 111372 - DNA, 25 bp, Homo sapien
ccgtgagtatggctcagaggcagat

SEQ ID NO: 111373 - DNA, 25 bp, Homo sapien
acctctcgccacagctgggtgcgtt

SEQ ID NO: 111374 - DNA, 25 bp, Homo sapien
attgatcgcacctggagagcgcgcg

SEQ ID NO: 111375 - DNA, 25 bp, Homo sapien
ggacccgcggctccttggagacagc

SEQ ID NO: 111376 - DNA, 25 bp, Homo sapien
cccgctaggaagtattgatcgcacc

SEQ ID NO: 111377 - DNA, 25 bp, Homo sapien
cctgtgtgggcatctttcacggaaa

SEQ ID NO: 111378 - DNA, 25 bp, Homo sapien
gctagctcaactcttcggggcagga

SEQ ID NO: 111379 - DNA, 25 bp, Homo sapien
cgcggagcctcgcttttaagcggaa

SEQ ID NO: 111380 - DNA, 25 bp, Homo sapien
tgctgagacgtcgaggttggaaata

SEQ ID NO: 111381 - DNA, 25 bp, Homo sapien
cgaagcgggccatggagattgctaa

SEQ ID NO: 111382 - DNA, 25 bp, Homo sapien
agccgcctcgaagatcctaagagtg

SEQ ID NO: 111383 - DNA, 25 bp, Homo sapien
cacggaaatttctgcccacgttcaa

SEQ ID NO: 111384 - DNA, 25 bp, Homo sapien
cacgttcaatgcgtacgggtctcta

SEQ ID NO: 111385 - DNA, 25 bp, Homo sapien
gtcgtcggacttccagccgccctac

SEQ ID NO: 111386 - DNA, 25 bp, Homo sapien
aagtgggttcggaagccggctctct

SEQ ID NO: 111387 - DNA, 25 bp, Homo sapien
tcccaggaccggcacgatggtgtcc

SEQ ID NO: 111388 - DNA, 25 bp, Homo sapien
tgggctcggtgtcccaaggacccta

SEQ ID NO: 111389 - DNA, 25 bp, Homo sapien
cggcctcggccatcccggaatggaa

SEQ ID NO: 111390 - DNA, 25 bp, Homo sapien
tgcattcggcgcaccacggcctgga

SEQ ID NO: 111391 - DNA, 25 bp, Homo sapien
acgtgctgctgcattcggcgcacca

SEQ ID NO: 111392 - DNA, 25 bp, Homo sapien
gcacgatggtgtcccgagccacagc

SEQ ID NO: 111393 - DNA, 25 bp, Homo sapien
attagcctcgctcttcggtgacccg

SEQ ID NO: 111394 - DNA, 25 bp, Homo sapien
gagcgtctcctttctaatgccaatg

SEQ ID NO: 111395 - DNA, 25 bp, Homo sapien
gccaatgacaacgacactgagggtg

SEQ ID NO: 111396 - DNA, 25 bp, Homo sapien
agcggaatcgcccacattagcctcg

SEQ ID NO: 111397 - DNA, 25 bp, Homo sapien
gaccggacaccgatagggaacagcc

SEQ ID NO: 111398 - DNA, 25 bp, Homo sapien
gggtgattttctgtgcctcgcccac

SEQ ID NO: 111399 - DNA, 25 bp, Homo sapien
ccctttgcaggcaactttgtaaaga

SEQ ID NO: 111400 - DNA, 25 bp, Homo sapien
aaagaatttacggatctactggcgc

SEQ ID NO: 111401 - DNA, 25 bp, Homo sapien
acgatcgtctcctttccttgcaggg

SEQ ID NO: 111402 - DNA, 25 bp, Homo sapien
tcaccctaagggctaaggcgaccga

SEQ ID NO: 111403 - DNA, 25 bp, Homo sapien
cgcccagtcgtgttgaggacataga

SEQ ID NO: 111404 - DNA, 25 bp, Homo sapien
ggacgcgccttgctcttactgtgca

SEQ ID NO: 111405 - DNA, 25 bp, Homo sapien
ctcggccgatcgcattagatgtgtt

SEQ ID NO: 111406 - DNA, 25 bp, Homo sapien
gtgttctgattgcacaaggccagga

SEQ ID NO: 111407 - DNA, 25 bp, Homo sapien
attctccagtaggtaatggggcggc

SEQ ID NO: 111408 - DNA, 25 bp, Homo sapien
ggagagaccacactgaaaacgatcg

SEQ ID NO: 111409 - DNA, 25 bp, Homo sapien
gggagcccgcgtctaggcacgctct

SEQ ID NO: 111410 - DNA, 25 bp, Homo sapien
cgtctaggcacgctctccaggttgc

SEQ ID NO: 111411 - DNA, 25 bp, Homo sapien
cagcctgcgtcgagccgtcgcacac

SEQ ID NO: 111412 - DNA, 25 bp, Homo sapien
cagggtgtcaacaagtgcgcacgcg

SEQ ID NO: 111413 - DNA, 25 bp, Homo sapien
tccaggttgccaagcagggtgtcaa

SEQ ID NO: 111414 - DNA, 25 bp, Homo sapien
ttgccaagcagggtgtcaacaagtg

SEQ ID NO: 111415 - DNA, 25 bp, Homo sapien
tcgcagctcgcctgctagagtttgt

SEQ ID NO: 111416 - DNA, 25 bp, Homo sapien
ctgctagagtttgtggcgcgccctc

SEQ ID NO: 111417 - DNA, 25 bp, Homo sapien
taccgcatcggtgaggccgcccatt

SEQ ID NO: 111418 - DNA, 25 bp, Homo sapien
accgcatcggtgaggccgcccattg

SEQ ID NO: 111419 - DNA, 25 bp, Homo sapien
cgcccattggctggcgtgccctgag

SEQ ID NO: 111420 - DNA, 25 bp, Homo sapien
cgcaggccctgccatcctcggcttg

SEQ ID NO: 111421 - DNA, 25 bp, Homo sapien
ccctgccatcctcggcttggccgct

SEQ ID NO: 111422 - DNA, 25 bp, Homo sapien
caggccctgccatcctcggcttggc

SEQ ID NO: 111423 - DNA, 25 bp, Homo sapien
attggctggcgtgccctgaggcgat

SEQ ID NO: 111424 - DNA, 25 bp, Homo sapien
ccgcatcggtgaggccgcccattgg

SEQ ID NO: 111425 - DNA, 25 bp, Homo sapien
cgagtccggcgttgagaagttacaa

SEQ ID NO: 111426 - DNA, 25 bp, Homo sapien
tcgtccaggaagtccaggtaatctc

SEQ ID NO: 111427 - DNA, 25 bp, Homo sapien
caccaaagtcgcgtggaggttccca

SEQ ID NO: 111428 - DNA, 25 bp, Homo sapien
ggaccttgggagcatataagcatta

SEQ ID NO: 111429 - DNA, 25 bp, Homo sapien
tctgaggtcggactagcgactgtcc

SEQ ID NO: 111430 - DNA, 25 bp, Homo sapien
tcgaacacaaactagcgagtccggc

SEQ ID NO: 111431 - DNA, 25 bp, Homo sapien
agctggcttcctaagagttcactta

SEQ ID NO: 111432 - DNA, 25 bp, Homo sapien
cgcccggaccatcgcttgtacttaa

SEQ ID NO: 111433 - DNA, 25 bp, Homo sapien
ccaacccgatgagggcgttgtcagc

SEQ ID NO: 111434 - DNA, 25 bp, Homo sapien
tgcagccacagagcgtcgcacagta

SEQ ID NO: 111435 - DNA, 25 bp, Homo sapien
agcactgcagccacagagcgtcgca

SEQ ID NO: 111436 - DNA, 25 bp, Homo sapien
agagcgtcgcacagtagccaccgcg

SEQ ID NO: 111437 - DNA, 25 bp, Homo sapien
tgaacttcaggttcggagacgagga

SEQ ID NO: 111438 - DNA, 25 bp, Homo sapien
acctgaacttcaggttcggagacga

SEQ ID NO: 111439 - DNA, 25 bp, Homo sapien
ctgttcgcggaacctgaacttcagg

SEQ ID NO: 111440 - DNA, 25 bp, Homo sapien
tttctgttcgcggaacctgaacttc

SEQ ID NO: 111441 - DNA, 25 bp, Homo sapien
cggctcacacgcactccggcccaca

SEQ ID NO: 111442 - DNA, 25 bp, Homo sapien
ggctcgcatcctgggctcccatgca

SEQ ID NO: 111443 - DNA, 25 bp, Homo sapien
ccgcttgcatgcacctcgcctccca

SEQ ID NO: 111444 - DNA, 25 bp, Homo sapien
cattcacgcccgctcacacgcaccc

SEQ ID NO: 111445 - DNA, 25 bp, Homo sapien
ccatgcacctggctcacattcacgc

SEQ ID NO: 111446 - DNA, 25 bp, Homo sapien
ctgctcacacgcacttcggctcaca

SEQ ID NO: 111447 - DNA, 25 bp, Homo sapien
cccaggctcccacggacctccgctc

SEQ ID NO: 111448 - DNA, 25 bp, Homo sapien
cacggacctccgctcacatgcaccc

SEQ ID NO: 111449 - DNA, 25 bp, Homo sapien
ctatgagaacgcagcgccctcggtg

SEQ ID NO: 111450 - DNA, 25 bp, Homo sapien
cggtggaacagggtcgtagataact

SEQ ID NO: 111451 - DNA, 25 bp, Homo sapien
cccgatgttgagtctccgaatccaa

SEQ ID NO: 111452 - DNA, 25 bp, Homo sapien
ccctggagctctgaacggctgtagt

SEQ ID NO: 111453 - DNA, 25 bp, Homo sapien
gtgggtctaggcatgtgctttcgcc

SEQ ID NO: 111454 - DNA, 25 bp, Homo sapien
aaccgccggcagctggctaatgggc

SEQ ID NO: 111455 - DNA, 25 bp, Homo sapien
ggaacgtctgtctaggctatgagaa

SEQ ID NO: 111456 - DNA, 25 bp, Homo sapien
gtccagagtcgcagcgttgggaacc

SEQ ID NO: 111457 - DNA, 25 bp, Homo sapien
agctcttccgggagccttacatccg

SEQ ID NO: 111458 - DNA, 25 bp, Homo sapien
gatgccttgcactgtcccagaaacg

SEQ ID NO: 111459 - DNA, 25 bp, Homo sapien
ctggaggatgggcttcccaagatgc

SEQ ID NO: 111460 - DNA, 25 bp, Homo sapien
agcgcctgagcaccctgtcggtcag

SEQ ID NO: 111461 - DNA, 25 bp, Homo sapien
gcatgcgggccgctgccatgacgac

SEQ ID NO: 111462 - DNA, 25 bp, Homo sapien
cactgtcccagaaacggatgtgccc

SEQ ID NO: 111463 - DNA, 25 bp, Homo sapien
gggagccttacatccgcaccggcta

SEQ ID NO: 111464 - DNA, 25 bp, Homo sapien
gggcttcccaagatgccttgcactg

SEQ ID NO: 111465 - DNA, 25 bp, Homo sapien
ttaccgcgagaacgcggagtcctgc

SEQ ID NO: 111466 - DNA, 25 bp, Homo sapien
tctctgcaactcatctaagggcctg

SEQ ID NO: 111467 - DNA, 25 bp, Homo sapien
gcgcacgcgcaaacctcctgtgatg

SEQ ID NO: 111468 - DNA, 25 bp, Homo sapien
gagttccggatgtttagcgttacca

SEQ ID NO: 111469 - DNA, 25 bp, Homo sapien
cgttaccatggatcctggaggtgcc

SEQ ID NO: 111470 - DNA, 25 bp, Homo sapien
cgaacactgcttgtcgcctgggcaa

SEQ ID NO: 111471 - DNA, 25 bp, Homo sapien
ggctgcaatggtgtccaatcccgtg

SEQ ID NO: 111472 - DNA, 25 bp, Homo sapien
tcccgtgcatggcttgccctttctt

SEQ ID NO: 111473 - DNA, 25 bp, Homo sapien
cagagcatggcatggctggcacggc

SEQ ID NO: 111474 - DNA, 25 bp, Homo sapien
tgcaggatacgatgagtgcccaagg

SEQ ID NO: 111475 - DNA, 25 bp, Homo sapien
cagagctgcaggatacgatgagtgc

SEQ ID NO: 111476 - DNA, 25 bp, Homo sapien
cgcgtcaagccatggtggcagcgcg

SEQ ID NO: 111477 - DNA, 25 bp, Homo sapien
agccggggtgcagataacgtacacg

SEQ ID NO: 111478 - DNA, 25 bp, Homo sapien
gtacagtgcacaaagccggggtgca

SEQ ID NO: 111479 - DNA, 25 bp, Homo sapien
caaagccggggtgcagataacgtac

SEQ ID NO: 111480 - DNA, 25 bp, Homo sapien
ccggaggggtacagtgcacaaagcc

SEQ ID NO: 111481 - DNA, 25 bp, Homo sapien
agcaccaggcagaagccgatgtccg

SEQ ID NO: 111482 - DNA, 25 bp, Homo sapien
cctccgatcagaggagggcccgctg

SEQ ID NO: 111483 - DNA, 25 bp, Homo sapien
cctggctgaagagcgggtaactttt

SEQ ID NO: 111484 - DNA, 25 bp, Homo sapien
ccgatgtccgcatggttgtggatga

SEQ ID NO: 111485 - DNA, 25 bp, Homo sapien
tttcgtcctcctgcggaaagccatg

SEQ ID NO: 111486 - DNA, 25 bp, Homo sapien
aagcccgatgaggacgcagagcacc

SEQ ID NO: 111487 - DNA, 25 bp, Homo sapien
tctcacctcgaacataagcccgatg

SEQ ID NO: 111488 - DNA, 25 bp, Homo sapien
ttgtggatgacgaactcctggctga

SEQ ID NO: 111489 - DNA, 25 bp, Homo sapien
agccgcgaaccggccttctggctgg

SEQ ID NO: 111490 - DNA, 25 bp, Homo sapien
ccttctggctggccacagcgccctg

SEQ ID NO: 111491 - DNA, 25 bp, Homo sapien
aagccgcgaaccggccttctggctg

SEQ ID NO: 111492 - DNA, 25 bp, Homo sapien
ggaagccgcgaaccggccttctggc

SEQ ID NO: 111493 - DNA, 25 bp, Homo sapien
agggaagccgcgaaccggccttctg

SEQ ID NO: 111494 - DNA, 25 bp, Homo sapien
cagggaagccgcgaaccggccttct

SEQ ID NO: 111495 - DNA, 25 bp, Homo sapien
gcgcgggtgcggcggaagcagggaa

SEQ ID NO: 111496 - DNA, 25 bp, Homo sapien
ccgcgaaccggccttctggctggcc

SEQ ID NO: 111497 - DNA, 25 bp, Homo sapien
gtcctggctctgagacgttgctaga

SEQ ID NO: 111498 - DNA, 25 bp, Homo sapien
tgctagaggacaaatccgcgggatt

SEQ ID NO: 111499 - DNA, 25 bp, Homo sapien
cgggatctcttggaccctctccagg

SEQ ID NO: 111500 - DNA, 25 bp, Homo sapien
taactcggaccttataaagcgcgcc

SEQ ID NO: 111501 - DNA, 25 bp, Homo sapien
ccctgccgggtgtgttagaagcaag

SEQ ID NO: 111502 - DNA, 25 bp, Homo sapien
agaacccatacgaggcagccgccga

SEQ ID NO: 111503 - DNA, 25 bp, Homo sapien
agaccgagttccttgagagcgacac

SEQ ID NO: 111504 - DNA, 25 bp, Homo sapien
cctggctgagtgtcaggcaaaacta

SEQ ID NO: 111505 - DNA, 25 bp, Homo sapien
gtgcggagactgcttccggactcca

SEQ ID NO: 111506 - DNA, 25 bp, Homo sapien
agtgggacagcgctggtgcggagac

SEQ ID NO: 111507 - DNA, 25 bp, Homo sapien
aggcgagaagggacacagcgcatgc

SEQ ID NO: 111508 - DNA, 25 bp, Homo sapien
gattcagccggagggcatggaccgg

SEQ ID NO: 111509 - DNA, 25 bp, Homo sapien
acaggccgcccggattcagccggag

SEQ ID NO: 111510 - DNA, 25 bp, Homo sapien
cgaaggcaggatagacggagcaacg

SEQ ID NO: 111511 - DNA, 25 bp, Homo sapien
acggagcaacgggtccggctgccgc

SEQ ID NO: 111512 - DNA, 25 bp, Homo sapien
gcggagactgcttccggactccagg

SEQ ID NO: 111513 - DNA, 25 bp, Homo sapien
tccaccgtcacgcatgcggtggctg

SEQ ID NO: 111514 - DNA, 25 bp, Homo sapien
ccagggcttggccatctgagatcgc

SEQ ID NO: 111515 - DNA, 25 bp, Homo sapien
tgagatcgcactctcccatgctcgt

SEQ ID NO: 111516 - DNA, 25 bp, Homo sapien
ggcttggccatctgagatcgcactc

SEQ ID NO: 111517 - DNA, 25 bp, Homo sapien
ttggccatctgagatcgcactctcc

SEQ ID NO: 111518 - DNA, 25 bp, Homo sapien
accgtcacgcatgcggtggctgcgc

SEQ ID NO: 111519 - DNA, 25 bp, Homo sapien
catgcaggggcgtagcggcagccca

SEQ ID NO: 111520 - DNA, 25 bp, Homo sapien
ccgctcagcccatgcaggggcgtag

SEQ ID NO: 111521 - DNA, 25 bp, Homo sapien
cagctccagaggatggacggccagc

SEQ ID NO: 111522 - DNA, 25 bp, Homo sapien
gtgtcttccggagccctaagctggc

SEQ ID NO: 111523 - DNA, 25 bp, Homo sapien
ccacttcgttttcacgtctgggagg

SEQ ID NO: 111524 - DNA, 25 bp, Homo sapien
tggggaggagaccaacgctttgatt

SEQ ID NO: 111525 - DNA, 25 bp, Homo sapien
ccctggtaggtgttctgagtggcta

SEQ ID NO: 111526 - DNA, 25 bp, Homo sapien
tggctagggatccttccctcgcgtg

SEQ ID NO: 111527 - DNA, 25 bp, Homo sapien
acggccagcgtgaaagctagagctc

SEQ ID NO: 111528 - DNA, 25 bp, Homo sapien
cggtagacagctccagaggatggac

SEQ ID NO: 111529 - DNA, 25 bp, Homo sapien
cgaacgcctcgttgcagatcggctc

SEQ ID NO: 111530 - DNA, 25 bp, Homo sapien
tccctgggaaaagttaccctgcagc

SEQ ID NO: 111531 - DNA, 25 bp, Homo sapien
cttctactggggacgaccggccgct

SEQ ID NO: 111532 - DNA, 25 bp, Homo sapien
ctactacagtgacaggtcgcccggc

SEQ ID NO: 111533 - DNA, 25 bp, Homo sapien
cagcctccggcaggaaaacaaacaa

SEQ ID NO: 111534 - DNA, 25 bp, Homo sapien
gcgcatggtagtgcagcaggaaccc

SEQ ID NO: 111535 - DNA, 25 bp, Homo sapien
tggggacaatccctgctaggaccgg

SEQ ID NO: 111536 - DNA, 25 bp, Homo sapien
ccggagctggaaatggggacaatcc

SEQ ID NO: 111537 - DNA, 25 bp, Homo sapien
ctccggttgggtctttttgcgcagg

SEQ ID NO: 111538 - DNA, 25 bp, Homo sapien
cagcatcagatgacgcgggcggcct

SEQ ID NO: 111539 - DNA, 25 bp, Homo sapien
aacagcatcagatgacgcgggcggc

SEQ ID NO: 111540 - DNA, 25 bp, Homo sapien
caggaaacagcatcagatgacgcgg

SEQ ID NO: 111541 - DNA, 25 bp, Homo sapien
tgggccgagactgcctgttcctggc

SEQ ID NO: 111542 - DNA, 25 bp, Homo sapien
agttgggccgagactgcctgttcct

SEQ ID NO: 111543 - DNA, 25 bp, Homo sapien
cgcagttgggccgagactgcctgtt

SEQ ID NO: 111544 - DNA, 25 bp, Homo sapien
actccggttgggtctttttgcgcag

SEQ ID NO: 111545 - DNA, 25 bp, Homo sapien
agttattgccgctgcctggtgcgct

SEQ ID NO: 111546 - DNA, 25 bp, Homo sapien
ccgccagcatggtaacctggccagg

SEQ ID NO: 111547 - DNA, 25 bp, Homo sapien
acaggcaggagtagacacccggaca

SEQ ID NO: 111548 - DNA, 25 bp, Homo sapien
tggtgcgcttctccgaccgagaact

SEQ ID NO: 111549 - DNA, 25 bp, Homo sapien
ccgcgaagatggctgccgtacgccg

SEQ ID NO: 111550 - DNA, 25 bp, Homo sapien
tctccagtagggctgacgctccggt

SEQ ID NO: 111551 - DNA, 25 bp, Homo sapien
cgagaactctgctaagctccgctgc

SEQ ID NO: 111552 - DNA, 25 bp, Homo sapien
gcacacagtaggtccgcgaccctta

SEQ ID NO: 111553 - DNA, 25 bp, Homo sapien
caggtccgagacctaacggcagttc

SEQ ID NO: 111554 - DNA, 25 bp, Homo sapien
gctgccgttgtctggtttcaataaa

SEQ ID NO: 111555 - DNA, 25 bp, Homo sapien
agatccatccctccgcgtctggtgt

SEQ ID NO: 111556 - DNA, 25 bp, Homo sapien
cggagctgacggctttaccttttag

SEQ ID NO: 111557 - DNA, 25 bp, Homo sapien
ccttttagcccaaggggcggcagca

SEQ ID NO: 111558 - DNA, 25 bp, Homo sapien
aaggcgccggctatctacaatcaga

SEQ ID NO: 111559 - DNA, 25 bp, Homo sapien
cgtgggctgaccgtgacgtcacaat

SEQ ID NO: 111560 - DNA, 25 bp, Homo sapien
tttcgccgactccaaagaaagcgcg

SEQ ID NO: 111561 - DNA, 25 bp, Homo sapien
attcccgggcaatgaccagacctcg

SEQ ID NO: 111562 - DNA, 25 bp, Homo sapien
ggacgccctttgtcaccggcctgag

SEQ ID NO: 111563 - DNA, 25 bp, Homo sapien
gcgtggacaccgttaactgcctgtg

SEQ ID NO: 111564 - DNA, 25 bp, Homo sapien
cggaccacgcaaccttgggatcgga

SEQ ID NO: 111565 - DNA, 25 bp, Homo sapien
tgacttctggtgcttccacgccctt

SEQ ID NO: 111566 - DNA, 25 bp, Homo sapien
caggctggagtttaggacgttcatc

SEQ ID NO: 111567 - DNA, 25 bp, Homo sapien
cgttcatcagagtcccgagacgcgc

SEQ ID NO: 111568 - DNA, 25 bp, Homo sapien
tgagggccaccatcacttctgggtt

SEQ ID NO: 111569 - DNA, 25 bp, Homo sapien
tggtgcactggcttcttcctacttg

SEQ ID NO: 111570 - DNA, 25 bp, Homo sapien
gtcggcctcgctttacgcaaacgcg

SEQ ID NO: 111571 - DNA, 25 bp, Homo sapien
cctgcgctccaggttttatagacta

SEQ ID NO: 111572 - DNA, 25 bp, Homo sapien
tacttgtgaccaaaacctgcgccgc

SEQ ID NO: 111573 - DNA, 25 bp, Homo sapien
ccgcttctctttgccggtctggtgc

SEQ ID NO: 111574 - DNA, 25 bp, Homo sapien
cttgagaacgtccttgtgccggtcc

SEQ ID NO: 111575 - DNA, 25 bp, Homo sapien
ctaggcgaaagcagggacgatgctc

SEQ ID NO: 111576 - DNA, 25 bp, Homo sapien
atgcccagtctttgcgtccgctagc

SEQ ID NO: 111577 - DNA, 25 bp, Homo sapien
acgccgtgcagtcgtgaggccaagc

SEQ ID NO: 111578 - DNA, 25 bp, Homo sapien
tcgtgaggccaagctgagcatgctc

SEQ ID NO: 111579 - DNA, 25 bp, Homo sapien
agcatgctcggagagccggcctgtc

SEQ ID NO: 111580 - DNA, 25 bp, Homo sapien
aaaacctggaccgtggagatccgca

SEQ ID NO: 111581 - DNA, 25 bp, Homo sapien
cacgccgcgcagttgttgtgataca

SEQ ID NO: 111582 - DNA, 25 bp, Homo sapien
ccgcgcagttgttgtgatacagccc

SEQ ID NO: 111583 - DNA, 25 bp, Homo sapien
tgactcagcgctttgtgcgggctcc

SEQ ID NO: 111584 - DNA, 25 bp, Homo sapien
aaaaacgcgagacccgctctccagg

SEQ ID NO: 111585 - DNA, 25 bp, Homo sapien
ctggcacagaagataccgaactggc

SEQ ID NO: 111586 - DNA, 25 bp, Homo sapien
gtccctgcatctacctgggctcaga

SEQ ID NO: 111587 - DNA, 25 bp, Homo sapien
ggttaaccacgtggctctacgaata

SEQ ID NO: 111588 - DNA, 25 bp, Homo sapien
tgtagcactccacggtgagcacgtc

SEQ ID NO: 111589 - DNA, 25 bp, Homo sapien
acgtacactctgtcgctcagcgtga

SEQ ID NO: 111590 - DNA, 25 bp, Homo sapien
gcggcgtacacgagcccgttgaaca

SEQ ID NO: 111591 - DNA, 25 bp, Homo sapien
ccgttgaacacgctcaggctgaagt

SEQ ID NO: 111592 - DNA, 25 bp, Homo sapien
cccgagtcacgttgttgggcatcga

SEQ ID NO: 111593 - DNA, 25 bp, Homo sapien
attcgggctgtttccatctggaagc

SEQ ID NO: 111594 - DNA, 25 bp, Homo sapien
ggtcagtcgaccctctctggatgca

SEQ ID NO: 111595 - DNA, 25 bp, Homo sapien
tctggaagctacagagcactgcatc

SEQ ID NO: 111596 - DNA, 25 bp, Homo sapien
cgctccaggttccttgaagcacttc

SEQ ID NO: 111597 - DNA, 25 bp, Homo sapien
tggagagcatcgacaagcgccactg

SEQ ID NO: 111598 - DNA, 25 bp, Homo sapien
gatctaccgctatgcccggagcctg

SEQ ID NO: 111599 - DNA, 25 bp, Homo sapien
accggatattttgcgcgtagtcact

SEQ ID NO: 111600 - DNA, 25 bp, Homo sapien
gctaggtactgacacctggcacttg

SEQ ID NO: 111601 - DNA, 25 bp, Homo sapien
ctgcttcctgggaggcaaaccttcg

SEQ ID NO: 111602 - DNA, 25 bp, Homo sapien
ggctttttcatactccgctgggaga

SEQ ID NO: 111603 - DNA, 25 bp, Homo sapien
tccacagggtgtaaagctcagttgc

SEQ ID NO: 111604 - DNA, 25 bp, Homo sapien
cttcttcccaggtgagcgtcgctgt

SEQ ID NO: 111605 - DNA, 25 bp, Homo sapien
gccaccacttgggacttgttgtaac

SEQ ID NO: 111606 - DNA, 25 bp, Homo sapien
cgcaggcgggattggaaattccaca

SEQ ID NO: 111607 - DNA, 25 bp, Homo sapien
cctcgtggaggctgcatttgtttcc

SEQ ID NO: 111608 - DNA, 25 bp, Homo sapien
cttttccagtgtaggagtgcgccga

SEQ ID NO: 111609 - DNA, 25 bp, Homo sapien
gtgcaacatcgcctgtaaagacagc

SEQ ID NO: 111610 - DNA, 25 bp, Homo sapien
ttgcagcattgagcggaaccggact

SEQ ID NO: 111611 - DNA, 25 bp, Homo sapien
caccgcaaatcaccagtgctcatgg

SEQ ID NO: 111612 - DNA, 25 bp, Homo sapien
tcacgtcattttctgctcgggagcc

SEQ ID NO: 111613 - DNA, 25 bp, Homo sapien
cggaggcattggctcagtaactttt

SEQ ID NO: 111614 - DNA, 25 bp, Homo sapien
cccggcagaagactccggaggcatt

SEQ ID NO: 111615 - DNA, 25 bp, Homo sapien
gacagcaaagccaccgcagaagttg

SEQ ID NO: 111616 - DNA, 25 bp, Homo sapien
gaaccggacttgagcccgtgatgtc

SEQ ID NO: 111617 - DNA, 25 bp, Homo sapien
tgcgtttccaagactcgcggccctg

SEQ ID NO: 111618 - DNA, 25 bp, Homo sapien
gaaacgttctctaacgctccagttg

SEQ ID NO: 111619 - DNA, 25 bp, Homo sapien
cgaagacggcgcgataataatctaa

SEQ ID NO: 111620 - DNA, 25 bp, Homo sapien
gttcccagggatatctccgtgctca

SEQ ID NO: 111621 - DNA, 25 bp, Homo sapien
acgataaggtttggagattcccagg

SEQ ID NO: 111622 - DNA, 25 bp, Homo sapien
attcccagggcgatctgggactccg

SEQ ID NO: 111623 - DNA, 25 bp, Homo sapien
ccgtgctcacgtgagcgtggtcctc

SEQ ID NO: 111624 - DNA, 25 bp, Homo sapien
taacgctccagttgcggaagcctgc

SEQ ID NO: 111625 - DNA, 25 bp, Homo sapien
cagaactctcgctgctactagggga

SEQ ID NO: 111626 - DNA, 25 bp, Homo sapien
ccctcggagcaattctgggccagga

SEQ ID NO: 111627 - DNA, 25 bp, Homo sapien
tgcgcttgcgcattcatgccgtcaa

SEQ ID NO: 111628 - DNA, 25 bp, Homo sapien
cgctcgaacttgctttagtcctgga

SEQ ID NO: 111629 - DNA, 25 bp, Homo sapien
agagctgtgcgccaattactttgcc

SEQ ID NO: 111630 - DNA, 25 bp, Homo sapien
cgtgcttcggtagtgcagaactctc

SEQ ID NO: 111631 - DNA, 25 bp, Homo sapien
tcgtgacgtacgaggtccagcatta

SEQ ID NO: 111632 - DNA, 25 bp, Homo sapien
acgcatgcgcccaaacgcttttacg

SEQ ID NO: 111633 - DNA, 25 bp, Homo sapien
gctgaggcagtgcttcaccgcggat

SEQ ID NO: 111634 - DNA, 25 bp, Homo sapien
cctgcgggaatcgacagaaatgccg

SEQ ID NO: 111635 - DNA, 25 bp, Homo sapien
cccgatccagagatgctcccggaga

SEQ ID NO: 111636 - DNA, 25 bp, Homo sapien
atccagagatgctcccggagaagct

SEQ ID NO: 111637 - DNA, 25 bp, Homo sapien
tgcttcaccgcggatggcacattcc

SEQ ID NO: 111638 - DNA, 25 bp, Homo sapien
gaccagagctgttctgcgcactgcg

SEQ ID NO: 111639 - DNA, 25 bp, Homo sapien
gctgtgaggaccagagctgttctgc

SEQ ID NO: 111640 - DNA, 25 bp, Homo sapien
gggcacctgcgggaatcgacagaaa

SEQ ID NO: 111641 - DNA, 25 bp, Homo sapien
agtggcaagcccaacccgagcaaga

SEQ ID NO: 111642 - DNA, 25 bp, Homo sapien
cccgagcaagacctgcgctgaaacg

SEQ ID NO: 111643 - DNA, 25 bp, Homo sapien
agctcagaggctcagaaactcgctc

SEQ ID NO: 111644 - DNA, 25 bp, Homo sapien
agaggctcagaaactcgctctcagc

SEQ ID NO: 111645 - DNA, 25 bp, Homo sapien
tcgcagccagctgagtgttgcgcca

SEQ ID NO: 111646 - DNA, 25 bp, Homo sapien
gcccgggagataaggttcgcgctcc

SEQ ID NO: 111647 - DNA, 25 bp, Homo sapien
ctcggggttgccgtcgcagccagct

SEQ ID NO: 111648 - DNA, 25 bp, Homo sapien
cgctgaaacggattggctgccctcc

SEQ ID NO: 111649 - DNA, 25 bp, Homo sapien
tccaggaccacgtgtggttagcacc

SEQ ID NO: 111650 - DNA, 25 bp, Homo sapien
aagactcgcttctgggagtccagga

SEQ ID NO: 111651 - DNA, 25 bp, Homo sapien
acgtctcacacaaccacgtttggta

SEQ ID NO: 111652 - DNA, 25 bp, Homo sapien
ggttagcaccacaggccacgtctca

SEQ ID NO: 111653 - DNA, 25 bp, Homo sapien
accacgtttggtacaggcagaatct

SEQ ID NO: 111654 - DNA, 25 bp, Homo sapien
ggaaccagttcgcagtcgtactcta

SEQ ID NO: 111655 - DNA, 25 bp, Homo sapien
catctcgtccttctgctctgcgtgg

SEQ ID NO: 111656 - DNA, 25 bp, Homo sapien
aggcagaatctgtccgtctttcgtc

SEQ ID NO: 111657 - DNA, 25 bp, Homo sapien
cagtcgagctccacgcggtcctagt

SEQ ID NO: 111658 - DNA, 25 bp, Homo sapien
tgcccgccggacctccgagcttcct

SEQ ID NO: 111659 - DNA, 25 bp, Homo sapien
cggtcctagtcaccactgcagccgc

SEQ ID NO: 111660 - DNA, 25 bp, Homo sapien
acgcggtcctagtcaccactgcagc

SEQ ID NO: 111661 - DNA, 25 bp, Homo sapien
agtcgagctccacgcggtcctagtc

SEQ ID NO: 111662 - DNA, 25 bp, Homo sapien
gggtcccagtcgagctccacgcggt

SEQ ID NO: 111663 - DNA, 25 bp, Homo sapien
cgcttgtccccgcacgggtcccagt

SEQ ID NO: 111664 - DNA, 25 bp, Homo sapien
gagctccacgcggtcctagtcacca

SEQ ID NO: 111665 - DNA, 25 bp, Homo sapien
gcagctctctaccacttcggtgcta

SEQ ID NO: 111666 - DNA, 25 bp, Homo sapien
aggcaccatctgctgcgtctctggg

SEQ ID NO: 111667 - DNA, 25 bp, Homo sapien
cgccgactacttcaaaatgggaggg

SEQ ID NO: 111668 - DNA, 25 bp, Homo sapien
agctcaggttcaaacaccgcggaaa

SEQ ID NO: 111669 - DNA, 25 bp, Homo sapien
cagcttgtggtgacatcagcgcaaa

SEQ ID NO: 111670 - DNA, 25 bp, Homo sapien
ctcgaagccgagaggctgcaatgta

SEQ ID NO: 111671 - DNA, 25 bp, Homo sapien
tttcagtgggaggtacctcgaagcc

SEQ ID NO: 111672 - DNA, 25 bp, Homo sapien
ggtgctacgccctcccgtgacttaa

SEQ ID NO: 111673 - DNA, 25 bp, Homo sapien
ggaggattcaggtcactctgtgaca

SEQ ID NO: 111674 - DNA, 25 bp, Homo sapien
catctttttggcgtgggaggattca

SEQ ID NO: 111675 - DNA, 25 bp, Homo sapien
agtccctctcgggtttcagcagcgg

SEQ ID NO: 111676 - DNA, 25 bp, Homo sapien
ggctctccctgggtaagggatgatc

SEQ ID NO: 111677 - DNA, 25 bp, Homo sapien
tgcctgagaaacaaagccgcagatc

SEQ ID NO: 111678 - DNA, 25 bp, Homo sapien
tttgggatccacaacaggtgcctga

SEQ ID NO: 111679 - DNA, 25 bp, Homo sapien
tcagcagcggcaaatctcagcgagc

SEQ ID NO: 111680 - DNA, 25 bp, Homo sapien
gcgcatctgcggcatttcctggccg

SEQ ID NO: 111681 - DNA, 25 bp, Homo sapien
tgaacgacccgagaagaccgatttc

SEQ ID NO: 111682 - DNA, 25 bp, Homo sapien
gctgatgacatcacggccaggctgc

SEQ ID NO: 111683 - DNA, 25 bp, Homo sapien
ggagcgcttgccatgactcagcaga

SEQ ID NO: 111684 - DNA, 25 bp, Homo sapien
ttcatcggatgcctccctttctgga

SEQ ID NO: 111685 - DNA, 25 bp, Homo sapien
gcgtgtcttacctcggcttcttgaa

SEQ ID NO: 111686 - DNA, 25 bp, Homo sapien
ttgttcctggtagcccgcagaaacc

SEQ ID NO: 111687 - DNA, 25 bp, Homo sapien
gcgcttcactctccaaatcggctta

SEQ ID NO: 111688 - DNA, 25 bp, Homo sapien
gcacattggatgctgtagggtctca

SEQ ID NO: 111689 - DNA, 25 bp, Homo sapien
ggtaggaactaccatcccagcatcc

SEQ ID NO: 111690 - DNA, 25 bp, Homo sapien
ttcgctgtagctcagagtctttttc

SEQ ID NO: 111691 - DNA, 25 bp, Homo sapien
tcgcgcggcgggtaggaactaccat

SEQ ID NO: 111692 - DNA, 25 bp, Homo sapien
agggctgcccctcttttgaagcggt

SEQ ID NO: 111693 - DNA, 25 bp, Homo sapien
tgaagcggttttcgtctctttccgc

SEQ ID NO: 111694 - DNA, 25 bp, Homo sapien
tttcgtctctttccgccagtggcct

SEQ ID NO: 111695 - DNA, 25 bp, Homo sapien
agggagacgacttcgctgtagctca

SEQ ID NO: 111696 - DNA, 25 bp, Homo sapien
tgtagctcagagtctttttccattc

SEQ ID NO: 111697 - DNA, 25 bp, Homo sapien
aggaacccgcagcaacaatggccgc

SEQ ID NO: 111698 - DNA, 25 bp, Homo sapien
gtcctggcgttctcagaggcgaacc

SEQ ID NO: 111699 - DNA, 25 bp, Homo sapien
tccgcacactctgtggcaagagcca

SEQ ID NO: 111700 - DNA, 25 bp, Homo sapien
ggggcgatacctcttcagtgtcttg

SEQ ID NO: 111701 - DNA, 25 bp, Homo sapien
gaggctggtaactaacgcgttttca

SEQ ID NO: 111702 - DNA, 25 bp, Homo sapien
agcgacgttttaaggcaggattgcc

SEQ ID NO: 111703 - DNA, 25 bp, Homo sapien
agccagagctcgagttccgttccta

SEQ ID NO: 111704 - DNA, 25 bp, Homo sapien
attgcccttcggtgttgagcttgcg

SEQ ID NO: 111705 - DNA, 25 bp, Homo sapien
gcatggttcttttcctctccggcga

SEQ ID NO: 111706 - DNA, 25 bp, Homo sapien
tctttccgccggtggcgtcggcgct

SEQ ID NO: 111707 - DNA, 25 bp, Homo sapien
tttgaagaggttttgcgtctctttc

SEQ ID NO: 111708 - DNA, 25 bp, Homo sapien
cctttgaagaggttttgcgtctctt

SEQ ID NO: 111709 - DNA, 25 bp, Homo sapien
ctcctttgaagaggttttgcgtctc

SEQ ID NO: 111710 - DNA, 25 bp, Homo sapien
ctcctcctttgaagaggttttgcgt

SEQ ID NO: 111711 - DNA, 25 bp, Homo sapien
catagcgggccagtaagggccgctc

SEQ ID NO: 111712 - DNA, 25 bp, Homo sapien
tagcgggccagtaagggccgctcct

SEQ ID NO: 111713 - DNA, 25 bp, Homo sapien
gaggctggtaactaacgcgttttca

SEQ ID NO: 111714 - DNA, 25 bp, Homo sapien
gtcctggcgttctcagaggcgaacc

SEQ ID NO: 111715 - DNA, 25 bp, Homo sapien
ggggcgatacctcttcagtgtcttg

SEQ ID NO: 111716 - DNA, 25 bp, Homo sapien
aggaacccgcagcaacaatggccgc

SEQ ID NO: 111717 - DNA, 25 bp, Homo sapien
agcgacgttttaaggcaggattgcc

SEQ ID NO: 111718 - DNA, 25 bp, Homo sapien
tccgcacactctgtggcaagagcca

SEQ ID NO: 111719 - DNA, 25 bp, Homo sapien
attgcccttcggtgttgagcttgcg

SEQ ID NO: 111720 - DNA, 25 bp, Homo sapien
agccagagctcgagttccgttccta

SEQ ID NO: 111721 - DNA, 25 bp, Homo sapien
ggcttagatggctcaggcgaagatc

SEQ ID NO: 111722 - DNA, 25 bp, Homo sapien
ctgcccttctttggctacgctgcag

SEQ ID NO: 111723 - DNA, 25 bp, Homo sapien
cgaagccgtcactgagcaatacacc

SEQ ID NO: 111724 - DNA, 25 bp, Homo sapien
cgctaaagccaacgaggggcgcttc

SEQ ID NO: 111725 - DNA, 25 bp, Homo sapien
tgtggctcgcgaacctctaactcca

SEQ ID NO: 111726 - DNA, 25 bp, Homo sapien
cagacgatccgctagccacattagg

SEQ ID NO: 111727 - DNA, 25 bp, Homo sapien
gtcgaccgataggaaccttcgcgtg

SEQ ID NO: 111728 - DNA, 25 bp, Homo sapien
ccacattaggcgctcggtctctgcg

SEQ ID NO: 111729 - DNA, 25 bp, Homo sapien
gcagcatccagaacgccaagcaggc

SEQ ID NO: 111730 - DNA, 25 bp, Homo sapien
gccatgtcctggatgatgcctccga

SEQ ID NO: 111731 - DNA, 25 bp, Homo sapien
agctggtgttcctgcgcaaccgcaa

SEQ ID NO: 111732 - DNA, 25 bp, Homo sapien
tccgagtcatcaaggttgggccggc

SEQ ID NO: 111733 - DNA, 25 bp, Homo sapien
agatcatcatgctcaaccggcgcca

SEQ ID NO: 111734 - DNA, 25 bp, Homo sapien
gatgatgcctccgacgagtacaaga

SEQ ID NO: 111735 - DNA, 25 bp, Homo sapien
aggcgcttcgcaacatgatcaactc

SEQ ID NO: 111736 - DNA, 25 bp, Homo sapien
gagcggctggtcatctcacatgagg

SEQ ID NO: 111737 - DNA, 25 bp, Homo sapien
gcggccgtaatatatgctgccatta

SEQ ID NO: 111738 - DNA, 25 bp, Homo sapien
ttaagaatccgtgcagcttccagcg

SEQ ID NO: 111739 - DNA, 25 bp, Homo sapien
agggacgcatgtgttgctggaattc

SEQ ID NO: 111740 - DNA, 25 bp, Homo sapien
cgcggatctgctttggttttgactg

SEQ ID NO: 111741 - DNA, 25 bp, Homo sapien
gctgcgactcactgggtttgattta

SEQ ID NO: 111742 - DNA, 25 bp, Homo sapien
cgggttttgactgagacctccgtcg

SEQ ID NO: 111743 - DNA, 25 bp, Homo sapien
cattgcatttcagagcccgggccca

SEQ ID NO: 111744 - DNA, 25 bp, Homo sapien
gaactgttacactagcaattgttta

SEQ ID NO: 111745 - DNA, 25 bp, Homo sapien
cagggctcagattgagtggctcagc

SEQ ID NO: 111746 - DNA, 25 bp, Homo sapien
agagacgagcaggatctcctagatc

SEQ ID NO: 111747 - DNA, 25 bp, Homo sapien
cggccaatgacggtccgcatgagtt

SEQ ID NO: 111748 - DNA, 25 bp, Homo sapien
cgaactttattagtagccagggctc

SEQ ID NO: 111749 - DNA, 25 bp, Homo sapien
gagcggctagttcgcaccctctttc

SEQ ID NO: 111750 - DNA, 25 bp, Homo sapien
aggcaattccaggtacccaccgctg

SEQ ID NO: 111751 - DNA, 25 bp, Homo sapien
cactccggagagtaaggcacaaccc

SEQ ID NO: 111752 - DNA, 25 bp, Homo sapien
ccttctctagctggaacttgggatc

SEQ ID NO: 111753 - DNA, 25 bp, Homo sapien
cgggagacccagctaagccttgtgc

SEQ ID NO: 111754 - DNA, 25 bp, Homo sapien
tgaaggtctcgtctcccacgacctg

SEQ ID NO: 111755 - DNA, 25 bp, Homo sapien
cccgttcctgagtgaaggtctcgtc

SEQ ID NO: 111756 - DNA, 25 bp, Homo sapien
cgatagaaacacgattcacatcgtc

SEQ ID NO: 111757 - DNA, 25 bp, Homo sapien
cccagccactcgatagaaacacgat

SEQ ID NO: 111758 - DNA, 25 bp, Homo sapien
gctaagccttgtgcggctacctcct

SEQ ID NO: 111759 - DNA, 25 bp, Homo sapien
tcgctgtccaggagatgtctgcgcg

SEQ ID NO: 111760 - DNA, 25 bp, Homo sapien
tcctcctggctgatcccaacccggt

SEQ ID NO: 111761 - DNA, 25 bp, Homo sapien
gaagccaagagcggcgccttccgca

SEQ ID NO: 111762 - DNA, 25 bp, Homo sapien
gaaccccgtgaagcccatggtgacc

SEQ ID NO: 111763 - DNA, 25 bp, Homo sapien
aaaagagaggcggcctagttagtgc

SEQ ID NO: 111764 - DNA, 25 bp, Homo sapien
aggcggcctagttagtgcggcgccc

SEQ ID NO: 111765 - DNA, 25 bp, Homo sapien
gctgggcccagagcgctccatggct

SEQ ID NO: 111766 - DNA, 25 bp, Homo sapien
gccgaagccaagagcggcgccttcc

SEQ ID NO: 111767 - DNA, 25 bp, Homo sapien
ccgaaccccgtgaagcccatggtga

SEQ ID NO: 111768 - DNA, 25 bp, Homo sapien
ccgccgaagccaagagcggcgcctt

SEQ ID NO: 111769 - DNA, 25 bp, Homo sapien
ggatctctgtgcgtcctcactggcc

SEQ ID NO: 111770 - DNA, 25 bp, Homo sapien
ctcgctcggacgcaggcagggtctt

SEQ ID NO: 111771 - DNA, 25 bp, Homo sapien
cgagggatctctgtgcgtcctcact

SEQ ID NO: 111772 - DNA, 25 bp, Homo sapien
aagcgcgaggttccgctcgctcgga

SEQ ID NO: 111773 - DNA, 25 bp, Homo sapien
caccagcggccttaactggagaggc

SEQ ID NO: 111774 - DNA, 25 bp, Homo sapien
ctccgccaaccactcattggtggtg

SEQ ID NO: 111775 - DNA, 25 bp, Homo sapien
tctcattgggcggtagcgcaagtcg

SEQ ID NO: 111776 - DNA, 25 bp, Homo sapien
ccactcattggtggtggtgccagga

SEQ ID NO: 111777 - DNA, 25 bp, Homo sapien
cacgggtggtaacgatctggttcca

SEQ ID NO: 111778 - DNA, 25 bp, Homo sapien
aaaagccgctttgtgaccgccgcct

SEQ ID NO: 111779 - DNA, 25 bp, Homo sapien
ggaggcaccggcttttgagtccctc

SEQ ID NO: 111780 - DNA, 25 bp, Homo sapien
gagccgctcactgcatggtagagtc

SEQ ID NO: 111781 - DNA, 25 bp, Homo sapien
tattcctgtgagtagccgtcgcatc

SEQ ID NO: 111782 - DNA, 25 bp, Homo sapien
ccggctgtatgattaggccacaatc

SEQ ID NO: 111783 - DNA, 25 bp, Homo sapien
ctacactcttgtgctcgacggccgg

SEQ ID NO: 111784 - DNA, 25 bp, Homo sapien
acagccactgggtgcagctacactc

SEQ ID NO: 111785 - DNA, 25 bp, Homo sapien
cggtcgagaaaaagcgctcctctga

SEQ ID NO: 111786 - DNA, 25 bp, Homo sapien
agcagccatttggtcccaggaggaa

SEQ ID NO: 111787 - DNA, 25 bp, Homo sapien
cgcggaagccaagaatagtgtcgtc

SEQ ID NO: 111788 - DNA, 25 bp, Homo sapien
tagtgtcgtcagcagcagccatttg

SEQ ID NO: 111789 - DNA, 25 bp, Homo sapien
gtgccgcgtcctccgaagacaggga

SEQ ID NO: 111790 - DNA, 25 bp, Homo sapien
gcgcctgtggaccatttggaccgcg

SEQ ID NO: 111791 - DNA, 25 bp, Homo sapien
tcctcttgctgccagtggtagcgct

SEQ ID NO: 111792 - DNA, 25 bp, Homo sapien
cgctcgaggccctaaagcgcgcagg

SEQ ID NO: 111793 - DNA, 25 bp, Homo sapien
tttgacgctggcagtcttggttttc

SEQ ID NO: 111794 - DNA, 25 bp, Homo sapien
aaagacgtggcagcaagcgggagtc

SEQ ID NO: 111795 - DNA, 25 bp, Homo sapien
agtcttggttttctgctagtgctgc

SEQ ID NO: 111796 - DNA, 25 bp, Homo sapien
tgctggcacttttaccggccgggcc

SEQ ID NO: 111797 - DNA, 25 bp, Homo sapien
ccctgcgtcgtgctggcacttttac

SEQ ID NO: 111798 - DNA, 25 bp, Homo sapien
agtcggggatagtgtcatcggttcg

SEQ ID NO: 111799 - DNA, 25 bp, Homo sapien
gtcgtgctggcacttttaccggccg

SEQ ID NO: 111800 - DNA, 25 bp, Homo sapien
ccatctttgacgctggcagtcttgg

SEQ ID NO: 111801 - DNA, 25 bp, Homo sapien
ggctctcccgcctgttgcgggtgtt

SEQ ID NO: 111802 - DNA, 25 bp, Homo sapien
agactgatttcggcctcctgacctc

SEQ ID NO: 111803 - DNA, 25 bp, Homo sapien
ggagactgatttcggcctcctgacc

SEQ ID NO: 111804 - DNA, 25 bp, Homo sapien
ggcaccgcgcaaggggccctgtttc

SEQ ID NO: 111805 - DNA, 25 bp, Homo sapien
tgttgcgggtgtttatccggctgct

SEQ ID NO: 111806 - DNA, 25 bp, Homo sapien
ctcccgcctgttgcgggtgtttatc

SEQ ID NO: 111807 - DNA, 25 bp, Homo sapien
ggcagccgaccgctctaggggtcca

SEQ ID NO: 111808 - DNA, 25 bp, Homo sapien
gcctgttgcgggtgtttatccggct

SEQ ID NO: 111809 - DNA, 25 bp, Homo sapien
agcccgggagatgcaggccacccga

SEQ ID NO: 111810 - DNA, 25 bp, Homo sapien
gtcagcccgggagatgcaggccacc

SEQ ID NO: 111811 - DNA, 25 bp, Homo sapien
cccgggagatgcaggccacccgata

SEQ ID NO: 111812 - DNA, 25 bp, Homo sapien
agtcagcccgggagatgcaggccac

SEQ ID NO: 111813 - DNA, 25 bp, Homo sapien
gcccgggagatgcaggccacccgat

SEQ ID NO: 111814 - DNA, 25 bp, Homo sapien
ccgggagatgcaggccacccgatag

SEQ ID NO: 111815 - DNA, 25 bp, Homo sapien
gctcagccataccaccggccgggtc

SEQ ID NO: 111816 - DNA, 25 bp, Homo sapien
ctcagccataccaccggccgggtcc

SEQ ID NO: 111817 - DNA, 25 bp, Homo sapien
gtgcccacagccacgaagaggccag

SEQ ID NO: 111818 - DNA, 25 bp, Homo sapien
accttcgagccgaggccagtccggg

SEQ ID NO: 111819 - DNA, 25 bp, Homo sapien
gggcatggcccctgcgtccacagat

SEQ ID NO: 111820 - DNA, 25 bp, Homo sapien
cccggagagtcaggcccacagagca

SEQ ID NO: 111821 - DNA, 25 bp, Homo sapien
caggcccacagagcatgcccatgtg

SEQ ID NO: 111822 - DNA, 25 bp, Homo sapien
acagagcatgcccatgtgggccggc

SEQ ID NO: 111823 - DNA, 25 bp, Homo sapien
cagatgacctctttgcccgcaagct

SEQ ID NO: 111824 - DNA, 25 bp, Homo sapien
cgcaagctgcgccagccagcaaggc

SEQ ID NO: 111825 - DNA, 25 bp, Homo sapien
cttagtcgccgtccgtccatcagta

SEQ ID NO: 111826 - DNA, 25 bp, Homo sapien
tccgaccacgaatactcctgtaata

SEQ ID NO: 111827 - DNA, 25 bp, Homo sapien
tcctcgctgggcattcaaacagctt

SEQ ID NO: 111828 - DNA, 25 bp, Homo sapien
tcaaacagctttccgacatcaccag

SEQ ID NO: 111829 - DNA, 25 bp, Homo sapien
ccgacatcaccagccaaggattttt

SEQ ID NO: 111830 - DNA, 25 bp, Homo sapien
ggaaaaagcataagcttgagccttc

SEQ ID NO: 111831 - DNA, 25 bp, Homo sapien
ttgagccttccgatccgaccacgaa

SEQ ID NO: 111832 - DNA, 25 bp, Homo sapien
gtccgtccatcagtacctgcagggg

SEQ ID NO: 111833 - DNA, 25 bp, Homo sapien
aacaagcaggttcacttgggacgcc

SEQ ID NO: 111834 - DNA, 25 bp, Homo sapien
ctgtggaaatcctcccagtatctgg

SEQ ID NO: 111835 - DNA, 25 bp, Homo sapien
ctgtgaccgtgcagctgtggaaatc

SEQ ID NO: 111836 - DNA, 25 bp, Homo sapien
tcctggcaatccgtaagggctgtga

SEQ ID NO: 111837 - DNA, 25 bp, Homo sapien
gccgctgccgcagagttcgaataag

SEQ ID NO: 111838 - DNA, 25 bp, Homo sapien
agccaggtcgctaaagctgccgaga

SEQ ID NO: 111839 - DNA, 25 bp, Homo sapien
ccacgctcagaaggaaagccaggtc

SEQ ID NO: 111840 - DNA, 25 bp, Homo sapien
tcggcctccgcaaacagattgctcg

SEQ ID NO: 111841 - DNA, 25 bp, Homo sapien
cgccagcgcctacttaacttgcaaa

SEQ ID NO: 111842 - DNA, 25 bp, Homo sapien
aggccgaatatgcaccagccgatca

SEQ ID NO: 111843 - DNA, 25 bp, Homo sapien
cctaccagtagtaagaggccgaata

SEQ ID NO: 111844 - DNA, 25 bp, Homo sapien
cctgcaaccctagacgtcatcggtg

SEQ ID NO: 111845 - DNA, 25 bp, Homo sapien
cagcgatgacggcaagagcttccaa

SEQ ID NO: 111846 - DNA, 25 bp, Homo sapien
gttgccaaggagactggacccacta

SEQ ID NO: 111847 - DNA, 25 bp, Homo sapien
gggacgaaaggccaccacatacttc

SEQ ID NO: 111848 - DNA, 25 bp, Homo sapien
ccacaccgtgtgacaatgttttaca

SEQ ID NO: 111849 - DNA, 25 bp, Homo sapien
ccctggaagcgaggcagccagttaa

SEQ ID NO: 111850 - DNA, 25 bp, Homo sapien
gcagccagttaagcggcgtaagcta

SEQ ID NO: 111851 - DNA, 25 bp, Homo sapien
ttaagcggcgtaagctaagagacgc

SEQ ID NO: 111852 - DNA, 25 bp, Homo sapien
cggggttacctactccacatgtggg

SEQ ID NO: 111853 - DNA, 25 bp, Homo sapien
gtgtttttcccaagtgcggcttctg

SEQ ID NO: 111854 - DNA, 25 bp, Homo sapien
ttaccctgcagcatgcgcagcgcgg

SEQ ID NO: 111855 - DNA, 25 bp, Homo sapien
ttgacggtgttagccctggaagcga

SEQ ID NO: 111856 - DNA, 25 bp, Homo sapien
ggccctgttccttaattaccctgca

SEQ ID NO: 111857 - DNA, 25 bp, Homo sapien
tcgcaacttacttgagccgcgcaca

SEQ ID NO: 111858 - DNA, 25 bp, Homo sapien
ggtggcacttcgtccctgcagaaaa

SEQ ID NO: 111859 - DNA, 25 bp, Homo sapien
cctgtcctcgtgtgcgcttgaaaaa

SEQ ID NO: 111860 - DNA, 25 bp, Homo sapien
acggctctggacttcgataggactc

SEQ ID NO: 111861 - DNA, 25 bp, Homo sapien
ccttcctagaccaaggggtcatcta

SEQ ID NO: 111862 - DNA, 25 bp, Homo sapien
gtcacctattaccttcagcgccaga

SEQ ID NO: 111863 - DNA, 25 bp, Homo sapien
gagcctttgggaaactgctgaaatg

SEQ ID NO: 111864 - DNA, 25 bp, Homo sapien
tccagacccgccactagcataggtg

SEQ ID NO: 111865 - DNA, 25 bp, Homo sapien
tctctcgaaatctcagttggcgctg

SEQ ID NO: 111866 - DNA, 25 bp, Homo sapien
tgttgatcgcaggtatagccggctg

SEQ ID NO: 111867 - DNA, 25 bp, Homo sapien
ttcttgcagctggacaacgagctcc

SEQ ID NO: 111868 - DNA, 25 bp, Homo sapien
acgagctcctccgttcgacaggcgg

SEQ ID NO: 111869 - DNA, 25 bp, Homo sapien
tgaacctcgcgcctagcgtgtttgc

SEQ ID NO: 111870 - DNA, 25 bp, Homo sapien
ccgctttcgtggttctgctttttca

SEQ ID NO: 111871 - DNA, 25 bp, Homo sapien
gacgcgcgccttttattgacgcaaa

SEQ ID NO: 111872 - DNA, 25 bp, Homo sapien
gcctggtagggaggacaaatctctc

SEQ ID NO: 111873 - DNA, 25 bp, Homo sapien
cctctgcagggaggctccggatcat

SEQ ID NO: 111874 - DNA, 25 bp, Homo sapien
atcgaggcttccctggttgcttagc

SEQ ID NO: 111875 - DNA, 25 bp, Homo sapien
agcggcaagtaagcacctggcctcg

SEQ ID NO: 111876 - DNA, 25 bp, Homo sapien
tgtcctggccgttcggtgttgccag

SEQ ID NO: 111877 - DNA, 25 bp, Homo sapien
gcgagaaaatcgctaaggccctttc

SEQ ID NO: 111878 - DNA, 25 bp, Homo sapien
acgcggtggcccaacaggaccacaa

SEQ ID NO: 111879 - DNA, 25 bp, Homo sapien
ttccgggttgttcctgtgggagctc

SEQ ID NO: 111880 - DNA, 25 bp, Homo sapien
ttccctggttgcttagctgggtctc

SEQ ID NO: 111881 - DNA, 25 bp, Homo sapien
ctcctcccagacacgggtttgagca

SEQ ID NO: 111882 - DNA, 25 bp, Homo sapien
tgtcgaccctcaagtccgccagagg

SEQ ID NO: 111883 - DNA, 25 bp, Homo sapien
ccaaaggtagcttggacgtcgtcgc

SEQ ID NO: 111884 - DNA, 25 bp, Homo sapien
ggacaacaagtactgcgccgactgc

SEQ ID NO: 111885 - DNA, 25 bp, Homo sapien
gctcatcctatccaagcttctgagg

SEQ ID NO: 111886 - DNA, 25 bp, Homo sapien
gctcagaagctgaacgagcagcacc

SEQ ID NO: 111887 - DNA, 25 bp, Homo sapien
gctcctgtcgggagaaggctcagaa

SEQ ID NO: 111888 - DNA, 25 bp, Homo sapien
tagcgatgctcggaccctccacagg

SEQ ID NO: 111889 - DNA, 25 bp, Homo sapien
cccaccgcgctctttctgaagagtg

SEQ ID NO: 111890 - DNA, 25 bp, Homo sapien
accaggatccagtgcagctgcgcca

SEQ ID NO: 111891 - DNA, 25 bp, Homo sapien
agcggaagcctgctctcagtccctt

SEQ ID NO: 111892 - DNA, 25 bp, Homo sapien
cgtgtccacgtcgagcatgatgatg

SEQ ID NO: 111893 - DNA, 25 bp, Homo sapien
caggttcgcgcaagctagagcgaca

SEQ ID NO: 111894 - DNA, 25 bp, Homo sapien
aaaagcgcggacttcatggtgcacg

SEQ ID NO: 111895 - DNA, 25 bp, Homo sapien
atgacaattaggatccagggcagga

SEQ ID NO: 111896 - DNA, 25 bp, Homo sapien
agtcccttgctcttgtcttctcaga

SEQ ID NO: 111897 - DNA, 25 bp, Homo sapien
tgacggtgacacctcttcgacacca

SEQ ID NO: 111898 - DNA, 25 bp, Homo sapien
gcctgctgacggtgacacctcttcg

SEQ ID NO: 111899 - DNA, 25 bp, Homo sapien
ctcttcaatgggcaacctgctcggc

SEQ ID NO: 111900 - DNA, 25 bp, Homo sapien
agcccaccaccgtggaggactgcga

SEQ ID NO: 111901 - DNA, 25 bp, Homo sapien
accaccgtggaggactgcgactcca

SEQ ID NO: 111902 - DNA, 25 bp, Homo sapien
cccagaggggcaagtgccaagccgc

SEQ ID NO: 111903 - DNA, 25 bp, Homo sapien
gagctgggcgggatccctcatcccg

SEQ ID NO: 111904 - DNA, 25 bp, Homo sapien
ggctgacctgtctcccggtggagcc

SEQ ID NO: 111905 - DNA, 25 bp, Homo sapien
agctaccgcgtcatcgtgcggacca

SEQ ID NO: 111906 - DNA, 25 bp, Homo sapien
cagagggcgggaccaatcgttttct

SEQ ID NO: 111907 - DNA, 25 bp, Homo sapien
caaggtaccacggacgctgctcaca

SEQ ID NO: 111908 - DNA, 25 bp, Homo sapien
gggctcagcttcacccaaggtacca

SEQ ID NO: 111909 - DNA, 25 bp, Homo sapien
caaggaaacttctggagcacgtggc

SEQ ID NO: 111910 - DNA, 25 bp, Homo sapien
aacttcttcgggatggacgagtcgc

SEQ ID NO: 111911 - DNA, 25 bp, Homo sapien
cgacaccttgtatgcatcctgagtg

SEQ ID NO: 111912 - DNA, 25 bp, Homo sapien
tccgtggcaccatctcggaggacgc

SEQ ID NO: 111913 - DNA, 25 bp, Homo sapien
tcgcctgacagctgatgggctcacc

SEQ ID NO: 111914 - DNA, 25 bp, Homo sapien
aaaagtctggactgcctcggcgaga

SEQ ID NO: 111915 - DNA, 25 bp, Homo sapien
gcccaccgcgttctttgtgtgtctc

SEQ ID NO: 111916 - DNA, 25 bp, Homo sapien
gagtcgagaaagtcacccgcgatga

SEQ ID NO: 111917 - DNA, 25 bp, Homo sapien
agcccaggtgccctaaaccacttga

SEQ ID NO: 111918 - DNA, 25 bp, Homo sapien
cccgccagctccataaagtattaaa

SEQ ID NO: 111919 - DNA, 25 bp, Homo sapien
gtgcccttcaagctaccgcaatttt

SEQ ID NO: 111920 - DNA, 25 bp, Homo sapien
ccctccaatgatgtcggcgtacaga

SEQ ID NO: 111921 - DNA, 25 bp, Homo sapien
ccagtcgtaggccaagtagtccttc

SEQ ID NO: 111922 - DNA, 25 bp, Homo sapien
tctggctgcagatgacttccgaacc

SEQ ID NO: 111923 - DNA, 25 bp, Homo sapien
tcctggagatcgacaacgcccgtct

SEQ ID NO: 111924 - DNA, 25 bp, Homo sapien
aggacctgcggtacaagattcttgg

SEQ ID NO: 111925 - DNA, 25 bp, Homo sapien
agccactctacaagactatccagga

SEQ ID NO: 111926 - DNA, 25 bp, Homo sapien
caacggcaaactggaggtgaagatc

SEQ ID NO: 111927 - DNA, 25 bp, Homo sapien
ctccgtgagttttgtggcagaggtt

SEQ ID NO: 111928 - DNA, 25 bp, Homo sapien
aatatgcagaacctcagcgaccctc

SEQ ID NO: 111929 - DNA, 25 bp, Homo sapien
tgaacgaatatagtccctggaagcc

SEQ ID NO: 111930 - DNA, 25 bp, Homo sapien
gggtcacctccgcaaaggccaaatc

SEQ ID NO: 111931 - DNA, 25 bp, Homo sapien
aaccgattgcctaccgtggactctg

SEQ ID NO: 111932 - DNA, 25 bp, Homo sapien
gagtgagaccctcggatgcaccctc

SEQ ID NO: 111933 - DNA, 25 bp, Homo sapien
agccctgctgctgaaagtgagctcg

SEQ ID NO: 111934 - DNA, 25 bp, Homo sapien
acccgtagcagcttccgagagcgta

SEQ ID NO: 111935 - DNA, 25 bp, Homo sapien
tcagaatcgaaatccgcactggcgc

SEQ ID NO: 111936 - DNA, 25 bp, Homo sapien
tggactctgtattccgagtgagacc

SEQ ID NO: 111937 - DNA, 25 bp, Homo sapien
caactcgccagccaggcgcactggt

SEQ ID NO: 111938 - DNA, 25 bp, Homo sapien
agctttttagcctctggtccccgcg

SEQ ID NO: 111939 - DNA, 25 bp, Homo sapien
cactgtagctttccagctgagcttt

SEQ ID NO: 111940 - DNA, 25 bp, Homo sapien
ccgcgcagcgaaatgcgcttgggga

SEQ ID NO: 111941 - DNA, 25 bp, Homo sapien
cttgccctcgcggagccagtctccg

SEQ ID NO: 111942 - DNA, 25 bp, Homo sapien
ccctcccaattcatccaggaccttg

SEQ ID NO: 111943 - DNA, 25 bp, Homo sapien
agcggcggcgtttcaggaacccagg

SEQ ID NO: 111944 - DNA, 25 bp, Homo sapien
gcgcactggtgggtctccggcttcc

SEQ ID NO: 111945 - DNA, 25 bp, Homo sapien
agcctctgagactccgcctaactga

SEQ ID NO: 111946 - DNA, 25 bp, Homo sapien
tccgcctaactgacacccaaactct

SEQ ID NO: 111947 - DNA, 25 bp, Homo sapien
ctggatggaagcctctgagactccg

SEQ ID NO: 111948 - DNA, 25 bp, Homo sapien
agcagcggcatcaccctggatggaa

SEQ ID NO: 111949 - DNA, 25 bp, Homo sapien
tctgcgagagcagcggcatcaccct

SEQ ID NO: 111950 - DNA, 25 bp, Homo sapien
tggcagctatgtctgcgagagcagc

SEQ ID NO: 111951 - DNA, 25 bp, Homo sapien
ctgagtggctggcagctatgtctgc

SEQ ID NO: 111952 - DNA, 25 bp, Homo sapien
cgaggtgctgtgcacgttggcgact

SEQ ID NO: 111953 - DNA, 25 bp, Homo sapien
ggaggattatcagaccaggtaccgc

SEQ ID NO: 111954 - DNA, 25 bp, Homo sapien
gaccatgctgcggaacgactctttg

SEQ ID NO: 111955 - DNA, 25 bp, Homo sapien
tcctcatgcggaaggccaagcgcga

SEQ ID NO: 111956 - DNA, 25 bp, Homo sapien
tttgagctcagaccagtccgagtcg

SEQ ID NO: 111957 - DNA, 25 bp, Homo sapien
cttactcggctgagagaactgcgga

SEQ ID NO: 111958 - DNA, 25 bp, Homo sapien
gcagcgacccgaacctagctcggta

SEQ ID NO: 111959 - DNA, 25 bp, Homo sapien
gcggaaacgcgtgccaaagacctca

SEQ ID NO: 111960 - DNA, 25 bp, Homo sapien
cgcccgagtacaccagctgcgagga

SEQ ID NO: 111961 - DNA, 25 bp, Homo sapien
tcttcgcacgtgttcgtggtcttcc

SEQ ID NO: 111962 - DNA, 25 bp, Homo sapien
ccacgctttcgtgtgagtacccgcg

SEQ ID NO: 111963 - DNA, 25 bp, Homo sapien
caggtccggatttagaattcgaagc

SEQ ID NO: 111964 - DNA, 25 bp, Homo sapien
cctgtacaacgtgctggagagaccc

SEQ ID NO: 111965 - DNA, 25 bp, Homo sapien
ggcgggtgcagaactacctgtacaa

SEQ ID NO: 111966 - DNA, 25 bp, Homo sapien
gggaagccgctctcttacacgagta

SEQ ID NO: 111967 - DNA, 25 bp, Homo sapien
ttagaaattgggactcctcggcctc

SEQ ID NO: 111968 - DNA, 25 bp, Homo sapien
cgcgtgcacacgtggtggcttttat

SEQ ID NO: 111969 - DNA, 25 bp, Homo sapien
ctcccgctacaggttgctcctggtg

SEQ ID NO: 111970 - DNA, 25 bp, Homo sapien
gatagtgtccggacctcctcttcca

SEQ ID NO: 111971 - DNA, 25 bp, Homo sapien
gtttaatgtccatggggaggccgct

SEQ ID NO: 111972 - DNA, 25 bp, Homo sapien
cggccggaagatcaagtagggttct

SEQ ID NO: 111973 - DNA, 25 bp, Homo sapien
cggtgagcttgagtagggactcttc

SEQ ID NO: 111974 - DNA, 25 bp, Homo sapien
tcagcgcatttttggccgcttctgc

SEQ ID NO: 111975 - DNA, 25 bp, Homo sapien
caaaacaggctgtctcgcggtgagc

SEQ ID NO: 111976 - DNA, 25 bp, Homo sapien
ctaagcgaatatcgttcagcgcatt

SEQ ID NO: 111977 - DNA, 25 bp, Homo sapien
tgtgaggagacagcggtacctcctg

SEQ ID NO: 111978 - DNA, 25 bp, Homo sapien
agacagcggtacctcctgggccgcg

SEQ ID NO: 111979 - DNA, 25 bp, Homo sapien
gcggcgcgggaagcaacccagagcc

SEQ ID NO: 111980 - DNA, 25 bp, Homo sapien
tcccgcctgctctgtgtaggagaca

SEQ ID NO: 111981 - DNA, 25 bp, Homo sapien
cgcctgctctgtgtaggagacagcc

SEQ ID NO: 111982 - DNA, 25 bp, Homo sapien
ctgctctgtgtaggagacagcctgc

SEQ ID NO: 111983 - DNA, 25 bp, Homo sapien
cgattgtgaggagacagcggtacct

SEQ ID NO: 111984 - DNA, 25 bp, Homo sapien
ctctgtgtaggagacagcctgcgga

SEQ ID NO: 111985 - DNA, 25 bp, Homo sapien
tctcttccaacggagccgctgactg

SEQ ID NO: 111986 - DNA, 25 bp, Homo sapien
agatgccaccgacagcacgcagctg

SEQ ID NO: 111987 - DNA, 25 bp, Homo sapien
gagtctgaccgttctctggcgcaca

SEQ ID NO: 111988 - DNA, 25 bp, Homo sapien
cgacgaccagcagccaagttaaacg

SEQ ID NO: 111989 - DNA, 25 bp, Homo sapien
agacagcgcggttcacattctcttc

SEQ ID NO: 111990 - DNA, 25 bp, Homo sapien
tccaagactagagccaccagatgcc

SEQ ID NO: 111991 - DNA, 25 bp, Homo sapien
ctcgggattgcacgcctagctcaga

SEQ ID NO: 111992 - DNA, 25 bp, Homo sapien
acgcactgttccgtgagcagctttg

SEQ ID NO: 111993 - DNA, 25 bp, Homo sapien
ttcctgctggccaaagcgctgaatg

SEQ ID NO: 111994 - DNA, 25 bp, Homo sapien
cacgcacgtggagcgcttcacattc

SEQ ID NO: 111995 - DNA, 25 bp, Homo sapien
ctcgggtaagcgacttctggtcttc

SEQ ID NO: 111996 - DNA, 25 bp, Homo sapien
ggcctggaccttctccgagcagcag

SEQ ID NO: 111997 - DNA, 25 bp, Homo sapien
ttcaattgcgcctgtcgcgacgtgc

SEQ ID NO: 111998 - DNA, 25 bp, Homo sapien
gacggccgcgtagtgttcaattgcg

SEQ ID NO: 111999 - DNA, 25 bp, Homo sapien
ctggccaccaacgaggtgaccacta

SEQ ID NO: 112000 - DNA, 25 bp, Homo sapien
actacgtcgctggactcggcttcac

SEQ ID NO: 112001 - DNA, 25 bp, Homo sapien
ctttttaccgttcagggatgctctc

SEQ ID NO: 112002 - DNA, 25 bp, Homo sapien
cactccgtttcttcgatcctttaga

SEQ ID NO: 112003 - DNA, 25 bp, Homo sapien
tgggctccgcgccttaattacaccg

SEQ ID NO: 112004 - DNA, 25 bp, Homo sapien
aaccgactgaactgagggcgtgacc

SEQ ID NO: 112005 - DNA, 25 bp, Homo sapien
agcatttcgcgtttctggcctggga

SEQ ID NO: 112006 - DNA, 25 bp, Homo sapien
cgctaaggcacgagtagtacagctc

SEQ ID NO: 112007 - DNA, 25 bp, Homo sapien
acagtctaggtggattaacgcgcca

SEQ ID NO: 112008 - DNA, 25 bp, Homo sapien
cacgtaaaccatctttgggccttga

SEQ ID NO: 112009 - DNA, 25 bp, Homo sapien
cgatcgcgggaaccctcagagcagc

SEQ ID NO: 112010 - DNA, 25 bp, Homo sapien
ggtgctggtgccaatgtatagccta

SEQ ID NO: 112011 - DNA, 25 bp, Homo sapien
tttacacacacgaatccgcgcgggg

SEQ ID NO: 112012 - DNA, 25 bp, Homo sapien
caccgttcgagcgttccattttaca

SEQ ID NO: 112013 - DNA, 25 bp, Homo sapien
ctaccatagcagattcaccgttcga

SEQ ID NO: 112014 - DNA, 25 bp, Homo sapien
tccaatgctcgatggctccaaggtc

SEQ ID NO: 112015 - DNA, 25 bp, Homo sapien
tcccgggaccagaacagatgagttt

SEQ ID NO: 112016 - DNA, 25 bp, Homo sapien
cttctcgggaacctgcgagcaggca

SEQ ID NO: 112017 - DNA, 25 bp, Homo sapien
ctcacctgctcgatgtaagggattc

SEQ ID NO: 112018 - DNA, 25 bp, Homo sapien
ccacttggtccggagcttgtacaaa

SEQ ID NO: 112019 - DNA, 25 bp, Homo sapien
agccttcagctcgagcatggccttg

SEQ ID NO: 112020 - DNA, 25 bp, Homo sapien
ggtgctcttgcctcttcctctaggg

SEQ ID NO: 112021 - DNA, 25 bp, Homo sapien
cgggagagttcccatcttatgaccc

SEQ ID NO: 112022 - DNA, 25 bp, Homo sapien
acccacggcgggatatgtctacgtg

SEQ ID NO: 112023 - DNA, 25 bp, Homo sapien
cggtgccactcagccatggactgga

SEQ ID NO: 112024 - DNA, 25 bp, Homo sapien
ataggagccgtaaaccacgacctcg

SEQ ID NO: 112025 - DNA, 25 bp, Homo sapien
tcctggcgaacatttggaatctata

SEQ ID NO: 112026 - DNA, 25 bp, Homo sapien
ggattgccggcttctccgcaccctg

SEQ ID NO: 112027 - DNA, 25 bp, Homo sapien
cacacatttcctggcgaacatttgg

SEQ ID NO: 112028 - DNA, 25 bp, Homo sapien
cgaacatttggaatctatagcttta

SEQ ID NO: 112029 - DNA, 25 bp, Homo sapien
tatagctttaggaaaaaccgatctg

SEQ ID NO: 112030 - DNA, 25 bp, Homo sapien
ggaaaaaccgatctgggacgcgcta

SEQ ID NO: 112031 - DNA, 25 bp, Homo sapien
aaccgatctgggacgcgctagtccc

SEQ ID NO: 112032 - DNA, 25 bp, Homo sapien
cgcgctagtccccaggaactgatgc

SEQ ID NO: 112033 - DNA, 25 bp, Homo sapien
cgaccgcagacctttaaatagttag

SEQ ID NO: 112034 - DNA, 25 bp, Homo sapien
taagtcccatcctacgtttagtcaa

SEQ ID NO: 112035 - DNA, 25 bp, Homo sapien
tatctgccgttcaacttaagtccca

SEQ ID NO: 112036 - DNA, 25 bp, Homo sapien
gatcagtgaaatatatctgccgttc

SEQ ID NO: 112037 - DNA, 25 bp, Homo sapien
gcaccgcgaggatcagtgaaatata

SEQ ID NO: 112038 - DNA, 25 bp, Homo sapien
cttacctatttgcaccgcgaggatc

SEQ ID NO: 112039 - DNA, 25 bp, Homo sapien
gggctgagcggccacttacctattt

SEQ ID NO: 112040 - DNA, 25 bp, Homo sapien
tagtcaaaccatttgcgaccgcaga

SEQ ID NO: 112041 - DNA, 25 bp, Homo sapien
cccgaagctgccagcaaggcagtga

SEQ ID NO: 112042 - DNA, 25 bp, Homo sapien
ggccgagacccagcggtcttcaata

SEQ ID NO: 112043 - DNA, 25 bp, Homo sapien
caacaagtcggggacccagcgatcc

SEQ ID NO: 112044 - DNA, 25 bp, Homo sapien
tctctccaggctgccaacaagtcgg

SEQ ID NO: 112045 - DNA, 25 bp, Homo sapien
aggatgtcgccactcagaaggccga

SEQ ID NO: 112046 - DNA, 25 bp, Homo sapien
tcttcaatagaagtccgggaggccg

SEQ ID NO: 112047 - DNA, 25 bp, Homo sapien
agcaaggcagtgacccagcggtttc

SEQ ID NO: 112048 - DNA, 25 bp, Homo sapien
acccagcggtttcgcgaggatgccc

SEQ ID NO: 112049 - DNA, 25 bp, Homo sapien
attggacacttcctgcgctgcttca

SEQ ID NO: 112050 - DNA, 25 bp, Homo sapien
aagtggtaacctacgcagctgctcc

SEQ ID NO: 112051 - DNA, 25 bp, Homo sapien
agcggcaccagcatcatcgaccata

SEQ ID NO: 112052 - DNA, 25 bp, Homo sapien
atcgaccatactgggaccagcagcc

SEQ ID NO: 112053 - DNA, 25 bp, Homo sapien
ggcggctttcgcaagacctcttcca

SEQ ID NO: 112054 - DNA, 25 bp, Homo sapien
cggcatagcggcaccattggacact

SEQ ID NO: 112055 - DNA, 25 bp, Homo sapien
ccaccagggccggatgcgaatctgt

SEQ ID NO: 112056 - DNA, 25 bp, Homo sapien
cgggctctcttttaccatattcgac

SEQ ID NO: 112057 - DNA, 25 bp, Homo sapien
agccactttgttggcgcggtaatcg

SEQ ID NO: 112058 - DNA, 25 bp, Homo sapien
actggccaatggctgcgtgaaatca

SEQ ID NO: 112059 - DNA, 25 bp, Homo sapien
ttggaacaatgtcccaccacggagg

SEQ ID NO: 112060 - DNA, 25 bp, Homo sapien
cccaaggcctctacgtgggtcgttg

SEQ ID NO: 112061 - DNA, 25 bp, Homo sapien
tagtcggcgaagctcgacagtgtcc

SEQ ID NO: 112062 - DNA, 25 bp, Homo sapien
tcctgagggatatagtgtcggcaga

SEQ ID NO: 112063 - DNA, 25 bp, Homo sapien
gaggaactgccgctgtgttttgctt

SEQ ID NO: 112064 - DNA, 25 bp, Homo sapien
ctggcacgctactcttacgacgtca

SEQ ID NO: 112065 - DNA, 25 bp, Homo sapien
gcagctcaccttcacgtgctcatag

SEQ ID NO: 112066 - DNA, 25 bp, Homo sapien
gtgctcatagtagctcccggtgttc

SEQ ID NO: 112067 - DNA, 25 bp, Homo sapien
gcggagtcgcacttcagtctgagca

SEQ ID NO: 112068 - DNA, 25 bp, Homo sapien
tctgagcagcaggtggtccacaacc

SEQ ID NO: 112069 - DNA, 25 bp, Homo sapien
catcgcggctgagcttcaacttctc

SEQ ID NO: 112070 - DNA, 25 bp, Homo sapien
gggcgctctttttctgccgggatcc

SEQ ID NO: 112071 - DNA, 25 bp, Homo sapien
aagctctctgcatggcctttccgtg

SEQ ID NO: 112072 - DNA, 25 bp, Homo sapien
accaagcactactggcgggcacaca

SEQ ID NO: 112073 - DNA, 25 bp, Homo sapien
gcgccctgcagattgtctcttgttg

SEQ ID NO: 112074 - DNA, 25 bp, Homo sapien
ccggactccgcacttcgacgtgata

SEQ ID NO: 112075 - DNA, 25 bp, Homo sapien
caagcagcaatttccgttggcacgg

SEQ ID NO: 112076 - DNA, 25 bp, Homo sapien
gggtcgcggtttccttcaccaagca

SEQ ID NO: 112077 - DNA, 25 bp, Homo sapien
catgttctacttccgaggctgtggc

SEQ ID NO: 112078 - DNA, 25 bp, Homo sapien
ccgtcactcgtgtcagcttcaaagt

SEQ ID NO: 112079 - DNA, 25 bp, Homo sapien
ggaaagtagctccaaaccgccaatc

SEQ ID NO: 112080 - DNA, 25 bp, Homo sapien
cccgtgatattaaagcaagatggcc

SEQ ID NO: 112081 - DNA, 25 bp, Homo sapien
ggggcgagtccttttgtatgaatta

SEQ ID NO: 112082 - DNA, 25 bp, Homo sapien
ggcccgcatttacaagactatcttg

SEQ ID NO: 112083 - DNA, 25 bp, Homo sapien
gcgtcgcagcaggtcatcaaaaatt

SEQ ID NO: 112084 - DNA, 25 bp, Homo sapien
cttacctgtgttctggcggcaaacc

SEQ ID NO: 112085 - DNA, 25 bp, Homo sapien
acgttcacggcgactactgcactta

SEQ ID NO: 112086 - DNA, 25 bp, Homo sapien
tgctggcttagctccaaaggttgta

SEQ ID NO: 112087 - DNA, 25 bp, Homo sapien
gcagcgatctctgggttctacgtta

SEQ ID NO: 112088 - DNA, 25 bp, Homo sapien
gaattactctcagctccggtcgggg

SEQ ID NO: 112089 - DNA, 25 bp, Homo sapien
ttcctcagcgttaggagccttctca

SEQ ID NO: 112090 - DNA, 25 bp, Homo sapien
cgacggtgcgaagcccaaacgaaga

SEQ ID NO: 112091 - DNA, 25 bp, Homo sapien
gtcccgctgacgataactccttttc

SEQ ID NO: 112092 - DNA, 25 bp, Homo sapien
ctcgctgaattttgggacgcgtccc

SEQ ID NO: 112093 - DNA, 25 bp, Homo sapien
cagggccttttctgttcctaggaga

SEQ ID NO: 112094 - DNA, 25 bp, Homo sapien
ctcgacggaattggcctgccgtctc

SEQ ID NO: 112095 - DNA, 25 bp, Homo sapien
tggaaaacgccacttcctcgacgga

SEQ ID NO: 112096 - DNA, 25 bp, Homo sapien
aaacgaagacgccatcggcctcggc

SEQ ID NO: 112097 - DNA, 25 bp, Homo sapien
tatggatacgccgctcgagcctccg

SEQ ID NO: 112098 - DNA, 25 bp, Homo sapien
ggccacgtcgctggcgtttttccag

SEQ ID NO: 112099 - DNA, 25 bp, Homo sapien
gtcgctggcgtttttccagcgctgg

SEQ ID NO: 112100 - DNA, 25 bp, Homo sapien
ctccgcagcgtcaggtcgccagggt

SEQ ID NO: 112101 - DNA, 25 bp, Homo sapien
aacagctgggtggtatggatacgcc

SEQ ID NO: 112102 - DNA, 25 bp, Homo sapien
gccaggccacgtcgctggcgttttt

SEQ ID NO: 112103 - DNA, 25 bp, Homo sapien
gtggtatggatacgccgctcgagcc

SEQ ID NO: 112104 - DNA, 25 bp, Homo sapien
cggggcgcaccctgcttcctaggga

SEQ ID NO: 112105 - DNA, 25 bp, Homo sapien
ggagttctcgtaggattggcgcaaa

SEQ ID NO: 112106 - DNA, 25 bp, Homo sapien
actgagcggcactctgaacgggctc

SEQ ID NO: 112107 - DNA, 25 bp, Homo sapien
cggagacctcatgacgcctacgtga

SEQ ID NO: 112108 - DNA, 25 bp, Homo sapien
cctacgtgagcaggtgtactcgcca

SEQ ID NO: 112109 - DNA, 25 bp, Homo sapien
ccgccatcttaggtgtgggcaactc

SEQ ID NO: 112110 - DNA, 25 bp, Homo sapien
gattggcgcaaagtgagcccgctcc

SEQ ID NO: 112111 - DNA, 25 bp, Homo sapien
aagcggagttctgggagttctcgta

SEQ ID NO: 112112 - DNA, 25 bp, Homo sapien
ggcaactctggcttgggttggacta

SEQ ID NO: 112113 - DNA, 25 bp, Homo sapien
gtcctgtctcaatttagatctctca

SEQ ID NO: 112114 - DNA, 25 bp, Homo sapien
ccctggatttgcgatgtttgccaca

SEQ ID NO: 112115 - DNA, 25 bp, Homo sapien
ggcgcgcccatttcagattactaaa

SEQ ID NO: 112116 - DNA, 25 bp, Homo sapien
gcagcggactgtagcccaggcagac

SEQ ID NO: 112117 - DNA, 25 bp, Homo sapien
atctctcactctgctgttaggcgcg

SEQ ID NO: 112118 - DNA, 25 bp, Homo sapien
tttgcgatgtttgccacagcagcga

SEQ ID NO: 112119 - DNA, 25 bp, Homo sapien
ccgcctgcgtttagcaactgctttc

SEQ ID NO: 112120 - DNA, 25 bp, Homo sapien
aggggtggagcctccaagtcctgtc

SEQ ID NO: 112121 - DNA, 25 bp, Homo sapien
cggcgcgtgatctctggttcactgc

SEQ ID NO: 112122 - DNA, 25 bp, Homo sapien
atctctggttcactgcccgggtccg

SEQ ID NO: 112123 - DNA, 25 bp, Homo sapien
gtctgcgccgtagtcctcgtattcc

SEQ ID NO: 112124 - DNA, 25 bp, Homo sapien
acgatgaagggctcgcgctcaggca

SEQ ID NO: 112125 - DNA, 25 bp, Homo sapien
ctctgcaggctcgtctgcgccgtag

SEQ ID NO: 112126 - DNA, 25 bp, Homo sapien
accggcacgatgaagggctcgcgct

SEQ ID NO: 112127 - DNA, 25 bp, Homo sapien
gccctcgggcacgtaaggctctgtc

SEQ ID NO: 112128 - DNA, 25 bp, Homo sapien
gtagtcctcgtattccgctgtccgc

SEQ ID NO: 112129 - DNA, 25 bp, Homo sapien
gtggcatttcccgtcttacacgatg

SEQ ID NO: 112130 - DNA, 25 bp, Homo sapien
tccagggagaactgcgcgctcacag

SEQ ID NO: 112131 - DNA, 25 bp, Homo sapien
gccctattctgctcggttgtaaaaa

SEQ ID NO: 112132 - DNA, 25 bp, Homo sapien
agcgtcaggcgcttttgatttgaaa

SEQ ID NO: 112133 - DNA, 25 bp, Homo sapien
ggaagcgtcagccacctggaacagc

SEQ ID NO: 112134 - DNA, 25 bp, Homo sapien
gggacgctcacttccagtggcattt

SEQ ID NO: 112135 - DNA, 25 bp, Homo sapien
tgggaatcgctgttgctccctcggt

SEQ ID NO: 112136 - DNA, 25 bp, Homo sapien
ttgaaaagcgttaggcctgggaatc

SEQ ID NO: 112137 - DNA, 25 bp, Homo sapien
ttttctccaacccagcagctgagct

SEQ ID NO: 112138 - DNA, 25 bp, Homo sapien
agctaagctagctcgattaattcga

SEQ ID NO: 112139 - DNA, 25 bp, Homo sapien
gattaattcgaaagcgctcctcggc

SEQ ID NO: 112140 - DNA, 25 bp, Homo sapien
tgcgcttgcctaccctctttttctc

SEQ ID NO: 112141 - DNA, 25 bp, Homo sapien
gcccactcgattgtttcaacctgct

SEQ ID NO: 112142 - DNA, 25 bp, Homo sapien
tcagcaccacagagaatccagcccg

SEQ ID NO: 112143 - DNA, 25 bp, Homo sapien
cagcccgctctctacgatgcagggg

SEQ ID NO: 112144 - DNA, 25 bp, Homo sapien
tggcgcgcccactcgattgtttcaa

SEQ ID NO: 112145 - DNA, 25 bp, Homo sapien
tgctaaccaacagggacagccgcga

SEQ ID NO: 112146 - DNA, 25 bp, Homo sapien
tttggaaacccatctcggagcgccc

SEQ ID NO: 112147 - DNA, 25 bp, Homo sapien
gcgcgcttgcttcccaggctggaaa

SEQ ID NO: 112148 - DNA, 25 bp, Homo sapien
tgtcctgttggttgcgctgattaga

SEQ ID NO: 112149 - DNA, 25 bp, Homo sapien
cgaccctaggtcgtgcgaacacctg

SEQ ID NO: 112150 - DNA, 25 bp, Homo sapien
gccagcgctgttggagtcttttatt

SEQ ID NO: 112151 - DNA, 25 bp, Homo sapien
attgtgttctgtcaccgaggtcgca

SEQ ID NO: 112152 - DNA, 25 bp, Homo sapien
tggttaccagccaagcgagcgagtg

SEQ ID NO: 112153 - DNA, 25 bp, Homo sapien
gtctacttttgggaacgtgtgcata

SEQ ID NO: 112154 - DNA, 25 bp, Homo sapien
ttcgagcattccttcggcgtgaggt

SEQ ID NO: 112155 - DNA, 25 bp, Homo sapien
ctgaacgggatgctttgcgtgcaca

SEQ ID NO: 112156 - DNA, 25 bp, Homo sapien
tcccagtatacaaggcaacgctcta

SEQ ID NO: 112157 - DNA, 25 bp, Homo sapien
caaggtgcaagctagacgccgtttc

SEQ ID NO: 112158 - DNA, 25 bp, Homo sapien
gcggttcgccttagccaagtggaaa

SEQ ID NO: 112159 - DNA, 25 bp, Homo sapien
ccgcgccgcgggctacttaatagag

SEQ ID NO: 112160 - DNA, 25 bp, Homo sapien
ggcgcgccctccattgaaatcgaca

SEQ ID NO: 112161 - DNA, 25 bp, Homo sapien
gtagcaccgtgccagccgtaaggat

SEQ ID NO: 112162 - DNA, 25 bp, Homo sapien
cctgctactctggttatcgtggcga

SEQ ID NO: 112163 - DNA, 25 bp, Homo sapien
ccgttgctgtttgaaggccgtgtta

SEQ ID NO: 112164 - DNA, 25 bp, Homo sapien
ccgtgttatccggtctccgagtctt

SEQ ID NO: 112165 - DNA, 25 bp, Homo sapien
cgtccacttcatccttcgcgttata

SEQ ID NO: 112166 - DNA, 25 bp, Homo sapien
cgcaccctgatcatctgtcctgtga

SEQ ID NO: 112167 - DNA, 25 bp, Homo sapien
gggctcagccattggatcgcgaatc

SEQ ID NO: 112168 - DNA, 25 bp, Homo sapien
ggtcctagagctacggtgacacttc

SEQ ID NO: 112169 - DNA, 25 bp, Homo sapien
aaaggcctccgctgatgcattcacg

SEQ ID NO: 112170 - DNA, 25 bp, Homo sapien
cccggatattcagttatctgcgctg

SEQ ID NO: 112171 - DNA, 25 bp, Homo sapien
gcggccattttacggcctgggacga

SEQ ID NO: 112172 - DNA, 25 bp, Homo sapien
aggcgtgtttgtgtgctcgctttca

SEQ ID NO: 112173 - DNA, 25 bp, Homo sapien
ctgcctttgtataggcccgtctgaa

SEQ ID NO: 112174 - DNA, 25 bp, Homo sapien
ggtagcgcaggggagattacttttc

SEQ ID NO: 112175 - DNA, 25 bp, Homo sapien
aggtacgtctgtttctgcccttgac

SEQ ID NO: 112176 - DNA, 25 bp, Homo sapien
ccacatggacagtcgcaaaggcctc

SEQ ID NO: 112177 - DNA, 25 bp, Homo sapien
ggaccgcccagtctcagcctaaaaa

SEQ ID NO: 112178 - DNA, 25 bp, Homo sapien
agctttccatcattcggccgcgaga

SEQ ID NO: 112179 - DNA, 25 bp, Homo sapien
ccggattcagaagcggcctcagtga

SEQ ID NO: 112180 - DNA, 25 bp, Homo sapien
cccagaccctttgttctcgaggttg

SEQ ID NO: 112181 - DNA, 25 bp, Homo sapien
ctgtcgaaatcgctagctgcgcatc

SEQ ID NO: 112182 - DNA, 25 bp, Homo sapien
gaagcgggacttactcaacctcata

SEQ ID NO: 112183 - DNA, 25 bp, Homo sapien
attctggtcgttcctccctgaagcg

SEQ ID NO: 112184 - DNA, 25 bp, Homo sapien
tcctacggttgtggatgtgccagtc

SEQ ID NO: 112185 - DNA, 25 bp, Homo sapien
gcctgacagtgcatcaagagctttg

SEQ ID NO: 112186 - DNA, 25 bp, Homo sapien
ggcgtgcactacagacgagccattc

SEQ ID NO: 112187 - DNA, 25 bp, Homo sapien
tgggtccgccgattactcactttgt

SEQ ID NO: 112188 - DNA, 25 bp, Homo sapien
tcggcggagtttggtgatgtcactc

SEQ ID NO: 112189 - DNA, 25 bp, Homo sapien
tgtctcagaagcacgttaaaatgtc

SEQ ID NO: 112190 - DNA, 25 bp, Homo sapien
cctacagcccggatgggacgactga

SEQ ID NO: 112191 - DNA, 25 bp, Homo sapien
agcgccagcttacgatacagccaaa

SEQ ID NO: 112192 - DNA, 25 bp, Homo sapien
agggctcgtccctctccagctaaag

SEQ ID NO: 112193 - DNA, 25 bp, Homo sapien
tccctgcttgaactgattctcgctg

SEQ ID NO: 112194 - DNA, 25 bp, Homo sapien
tccagccggacaggacctgctttgc

SEQ ID NO: 112195 - DNA, 25 bp, Homo sapien
tgagcagtggttcttgccgcaaccg

SEQ ID NO: 112196 - DNA, 25 bp, Homo sapien
tgcacagtcacagtatccagccgga

SEQ ID NO: 112197 - DNA, 25 bp, Homo sapien
attctcgctgttggtagactgcaca

SEQ ID NO: 112198 - DNA, 25 bp, Homo sapien
gctttgccgggactggaaacaacta

SEQ ID NO: 112199 - DNA, 25 bp, Homo sapien
aggccgtttcgccatgggaagaaca

SEQ ID NO: 112200 - DNA, 25 bp, Homo sapien
acgcttctgttcactgcccgaggac

SEQ ID NO: 112201 - DNA, 25 bp, Homo sapien
tctgcagactttgcccacaggagtt

SEQ ID NO: 112202 - DNA, 25 bp, Homo sapien
ggtccggtacactgtggcaatcaca

SEQ ID NO: 112203 - DNA, 25 bp, Homo sapien
tcctggtaaatgtagtccttggcgc

SEQ ID NO: 112204 - DNA, 25 bp, Homo sapien
cccagttgatagttccgtgagttcc

SEQ ID NO: 112205 - DNA, 25 bp, Homo sapien
ccgcccaggttcacagctgaaacta

SEQ ID NO: 112206 - DNA, 25 bp, Homo sapien
actgcttgaggagaaggctttgacc

SEQ ID NO: 112207 - DNA, 25 bp, Homo sapien
ggctttgaccaaatgggatctctta

SEQ ID NO: 112208 - DNA, 25 bp, Homo sapien
taacctggacgcttttggatctgca

SEQ ID NO: 112209 - DNA, 25 bp, Homo sapien
ccaaagcccgtattaaagaatgccg

SEQ ID NO: 112210 - DNA, 25 bp, Homo sapien
tgtggagcactcgtctcctcctcgg

SEQ ID NO: 112211 - DNA, 25 bp, Homo sapien
ttctctggactggttgtggagcact

SEQ ID NO: 112212 - DNA, 25 bp, Homo sapien
gggccctgcacagctttccaggacg

SEQ ID NO: 112213 - DNA, 25 bp, Homo sapien
ccgcgttgactaggctcctgcttag

SEQ ID NO: 112214 - DNA, 25 bp, Homo sapien
tagagccgagtacccgcgttgacta

SEQ ID NO: 112215 - DNA, 25 bp, Homo sapien
aagagacttggcctgcgccatttcc

SEQ ID NO: 112216 - DNA, 25 bp, Homo sapien
cccgctacaggaacccagaaggtag

SEQ ID NO: 112217 - DNA, 25 bp, Homo sapien
tagttactatggaaacccagctgcc

SEQ ID NO: 112218 - DNA, 25 bp, Homo sapien
gccatcgctatgtctctgcaaaaga

SEQ ID NO: 112219 - DNA, 25 bp, Homo sapien
tccgacccgagtgttcgtggaactg

SEQ ID NO: 112220 - DNA, 25 bp, Homo sapien
agcccaaactgctacccgcgaggtg

SEQ ID NO: 112221 - DNA, 25 bp, Homo sapien
gcagccgaggccaaaaagagcgttt

SEQ ID NO: 112222 - DNA, 25 bp, Homo sapien
cgtttgtcgccgtctagattacatc

SEQ ID NO: 112223 - DNA, 25 bp, Homo sapien
gattacatcacgcagagcctccagc

SEQ ID NO: 112224 - DNA, 25 bp, Homo sapien
acgcgtttgttgcaaaggtactccg

SEQ ID NO: 112225 - DNA, 25 bp, Homo sapien
actgagctttatcttgtgcggtgac

SEQ ID NO: 112226 - DNA, 25 bp, Homo sapien
tctaccgcggtccaactgagcttta

SEQ ID NO: 112227 - DNA, 25 bp, Homo sapien
ggcaccgggtcctggacgaaatcta

SEQ ID NO: 112228 - DNA, 25 bp, Homo sapien
ggtctgaaccgctccttggcctact

SEQ ID NO: 112229 - DNA, 25 bp, Homo sapien
caccaacagcggagggcgttagcac

SEQ ID NO: 112230 - DNA, 25 bp, Homo sapien
ctccgcgctgtcatgattgctgggt

SEQ ID NO: 112231 - DNA, 25 bp, Homo sapien
caaggaccgcggatgcttgaatcgc

SEQ ID NO: 112232 - DNA, 25 bp, Homo sapien
ggatgcttgaatcgcgcttctcgcc

SEQ ID NO: 112233 - DNA, 25 bp, Homo sapien
ctgtcagtgtgtgttcacgagccga

SEQ ID NO: 112234 - DNA, 25 bp, Homo sapien
gacttacccgatcgcagctccgaga

SEQ ID NO: 112235 - DNA, 25 bp, Homo sapien
gccgcctgccctatagctgtcagtg

SEQ ID NO: 112236 - DNA, 25 bp, Homo sapien
ttcggctccaccattcaagcaacgg

SEQ ID NO: 112237 - DNA, 25 bp, Homo sapien
acaactctcaggcagcgactacggc

SEQ ID NO: 112238 - DNA, 25 bp, Homo sapien
gcagggcgtgcgatttatttattta

SEQ ID NO: 112239 - DNA, 25 bp, Homo sapien
tgtttatgggtcacttcagggccgc

SEQ ID NO: 112240 - DNA, 25 bp, Homo sapien
cgcagcacaggctctattcagcggc

SEQ ID NO: 112241 - DNA, 25 bp, Homo sapien
acttggtgacgtgaggtgtctgcaa

SEQ ID NO: 112242 - DNA, 25 bp, Homo sapien
ccctgtaactctgagcgtggggcgc

SEQ ID NO: 112243 - DNA, 25 bp, Homo sapien
cacagcatcattttctgggatcctc

SEQ ID NO: 112244 - DNA, 25 bp, Homo sapien
ctgggatcttcacagcatcattttc

SEQ ID NO: 112245 - DNA, 25 bp, Homo sapien
tcagactcgtgcagagcccaggctt

SEQ ID NO: 112246 - DNA, 25 bp, Homo sapien
ggggtcctactgcagcacttggtga

SEQ ID NO: 112247 - DNA, 25 bp, Homo sapien
ctcagatatttggagatgcatagac

SEQ ID NO: 112248 - DNA, 25 bp, Homo sapien
tcctgcttatccacctgggatcttc

SEQ ID NO: 112249 - DNA, 25 bp, Homo sapien
acactggagttggtacatacgggtc

SEQ ID NO: 112250 - DNA, 25 bp, Homo sapien
tttcggaatggaaagccgcttttgc

SEQ ID NO: 112251 - DNA, 25 bp, Homo sapien
tgtacttgtttttctcctctcgctg

SEQ ID NO: 112252 - DNA, 25 bp, Homo sapien
agtacagccgcatgggaataatccc

SEQ ID NO: 112253 - DNA, 25 bp, Homo sapien
cgagccattgcaatgccagcattta

SEQ ID NO: 112254 - DNA, 25 bp, Homo sapien
ccctgaccttggacgagccatattg

SEQ ID NO: 112255 - DNA, 25 bp, Homo sapien
cccaaccgagtgtgggttccagtcg

SEQ ID NO: 112256 - DNA, 25 bp, Homo sapien
gaggaacgtctgcaacaggcatcta

SEQ ID NO: 112257 - DNA, 25 bp, Homo sapien
ttctgtctccagacggcccttttta

SEQ ID NO: 112258 - DNA, 25 bp, Homo sapien
ttaggaccaaactcccagctggggc

SEQ ID NO: 112259 - DNA, 25 bp, Homo sapien
cgagatgcgggaggtttgaacacaa

SEQ ID NO: 112260 - DNA, 25 bp, Homo sapien
ggaggcctagactgcactacgaaga

SEQ ID NO: 112261 - DNA, 25 bp, Homo sapien
atgactctacccgagctcccattgg

SEQ ID NO: 112262 - DNA, 25 bp, Homo sapien
ttggccgaccgctctagctgtagcg

SEQ ID NO: 112263 - DNA, 25 bp, Homo sapien
aaattggggcaaaacgcggagcgct

SEQ ID NO: 112264 - DNA, 25 bp, Homo sapien
gagaccgcagccaatcatgatgact

SEQ ID NO: 112265 - DNA, 25 bp, Homo sapien
aggggagctcagtccaccagccact

SEQ ID NO: 112266 - DNA, 25 bp, Homo sapien
ccactccagggagagacggaaacta

SEQ ID NO: 112267 - DNA, 25 bp, Homo sapien
gcgctgggcttttatctgcggaccc

SEQ ID NO: 112268 - DNA, 25 bp, Homo sapien
agcgctttacccagaggctgccggc

SEQ ID NO: 112269 - DNA, 25 bp, Homo sapien
gaggatggtcatccgcgtgttcatc

SEQ ID NO: 112270 - DNA, 25 bp, Homo sapien
gcggctcgtagctgggttcagctct

SEQ ID NO: 112271 - DNA, 25 bp, Homo sapien
tcttcctcgggcttcgtggcggtga

SEQ ID NO: 112272 - DNA, 25 bp, Homo sapien
cttttatctgcggacccgccgggag

SEQ ID NO: 112273 - DNA, 25 bp, Homo sapien
ggagtcaactgaaatcccgggatgg

SEQ ID NO: 112274 - DNA, 25 bp, Homo sapien
cgtcacgtgacggactcagtagacc

SEQ ID NO: 112275 - DNA, 25 bp, Homo sapien
tcagtagaccgccactggctgtgca

SEQ ID NO: 112276 - DNA, 25 bp, Homo sapien
ctgtgcacgttatggggtttccacc

SEQ ID NO: 112277 - DNA, 25 bp, Homo sapien
ggcctgaggcttgtaacactccgtt

SEQ ID NO: 112278 - DNA, 25 bp, Homo sapien
gtcccggaagtgacgtctcccagag

SEQ ID NO: 112279 - DNA, 25 bp, Homo sapien
aacggtattgccacgtgacccgctc

SEQ ID NO: 112280 - DNA, 25 bp, Homo sapien
cggcggaaccaggacaacgaagatg

SEQ ID NO: 112281 - DNA, 25 bp, Homo sapien
cgtggacactacgtttaggacacta

SEQ ID NO: 112282 - DNA, 25 bp, Homo sapien
cagcggctttacctgcgatggacca

SEQ ID NO: 112283 - DNA, 25 bp, Homo sapien
ccctagtattgggactcgctggcgt

SEQ ID NO: 112284 - DNA, 25 bp, Homo sapien
tgatccgcagcatccgaaagccgca

SEQ ID NO: 112285 - DNA, 25 bp, Homo sapien
ggaccaggtccagcggtagaactct

SEQ ID NO: 112286 - DNA, 25 bp, Homo sapien
ctctaccgtgtcgttgagtgccgtg

SEQ ID NO: 112287 - DNA, 25 bp, Homo sapien
caagcggaaggcgtcgtcaaggttc

SEQ ID NO: 112288 - DNA, 25 bp, Homo sapien
tgcgctcaagggtgcgacgccaact

SEQ ID NO: 112289 - DNA, 25 bp, Homo sapien
cgtagtgatagcgacggggaaattc

SEQ ID NO: 112290 - DNA, 25 bp, Homo sapien
gactgtcgcttctacgtggctagca

SEQ ID NO: 112291 - DNA, 25 bp, Homo sapien
tgaccaataggagaccgtagtgata

SEQ ID NO: 112292 - DNA, 25 bp, Homo sapien
ccagcgcagctttctgtaggtaagt

SEQ ID NO: 112293 - DNA, 25 bp, Homo sapien
aagttctgtcttaccggtgcaccgg

SEQ ID NO: 112294 - DNA, 25 bp, Homo sapien
tgcaccggcgcactgaggaacagcc

SEQ ID NO: 112295 - DNA, 25 bp, Homo sapien
taggggctcattgttagcgctggtc

SEQ ID NO: 112296 - DNA, 25 bp, Homo sapien
gccaggtatgcgacgcggctaaacg

SEQ ID NO: 112297 - DNA, 25 bp, Homo sapien
cttccgcatgcgcacaaggagcaga

SEQ ID NO: 112298 - DNA, 25 bp, Homo sapien
gcagaagccgaccagctcgtcacgt

SEQ ID NO: 112299 - DNA, 25 bp, Homo sapien
ccagttccgattggtctgtttcatg

SEQ ID NO: 112300 - DNA, 25 bp, Homo sapien
gctgcatagcctgagaatcccggtg

SEQ ID NO: 112301 - DNA, 25 bp, Homo sapien
accaatgtggaagcctcctcgggtg

SEQ ID NO: 112302 - DNA, 25 bp, Homo sapien
gaaactatttcattggcgccacctc

SEQ ID NO: 112303 - DNA, 25 bp, Homo sapien
ccctctggcccgaccaatgtggaag

SEQ ID NO: 112304 - DNA, 25 bp, Homo sapien
cggcaggtggctcattttactttcc

SEQ ID NO: 112305 - DNA, 25 bp, Homo sapien
cgctcgtgtctctggagctttagca

SEQ ID NO: 112306 - DNA, 25 bp, Homo sapien
ctttagatcatcacggttgggctcc

SEQ ID NO: 112307 - DNA, 25 bp, Homo sapien
cccaggaggagacactttaaatgcc

SEQ ID NO: 112308 - DNA, 25 bp, Homo sapien
gtgcgcccgtagatgcgtgtattta

SEQ ID NO: 112309 - DNA, 25 bp, Homo sapien
cagttgtgcggggaaaatgtcttca

SEQ ID NO: 112310 - DNA, 25 bp, Homo sapien
aactggcggctcttgctgccacaca

SEQ ID NO: 112311 - DNA, 25 bp, Homo sapien
aggcggcaacacttccaggagctgc

SEQ ID NO: 112312 - DNA, 25 bp, Homo sapien
tttataccgggcttctctgcgcttc

SEQ ID NO: 112313 - DNA, 25 bp, Homo sapien
cgcctcgcgcgaagcccggcagcct

SEQ ID NO: 112314 - DNA, 25 bp, Homo sapien
caggacgggagcgtagcgcatcgcc

SEQ ID NO: 112315 - DNA, 25 bp, Homo sapien
cgcatcgccgggacaggccattcat

SEQ ID NO: 112316 - DNA, 25 bp, Homo sapien
ggaccctggccactcggccctctcc

SEQ ID NO: 112317 - DNA, 25 bp, Homo sapien
catcgccgggacaggccattcatta

SEQ ID NO: 112318 - DNA, 25 bp, Homo sapien
ccgggacaggccattcattagctga

SEQ ID NO: 112319 - DNA, 25 bp, Homo sapien
gacaggccattcattagctgagggg

SEQ ID NO: 112320 - DNA, 25 bp, Homo sapien
cgctggagggcgtgtccagcaggac

SEQ ID NO: 112321 - DNA, 25 bp, Homo sapien
ttcggcaggcggctgcaatacagcc

SEQ ID NO: 112322 - DNA, 25 bp, Homo sapien
gcaccctccagaaggcgaatactct

SEQ ID NO: 112323 - DNA, 25 bp, Homo sapien
tacagccgctactacaggaatcggg

SEQ ID NO: 112324 - DNA, 25 bp, Homo sapien
ctccctcaccagtcgctagatgaaa

SEQ ID NO: 112325 - DNA, 25 bp, Homo sapien
ctagatgaaactgcgccggtggatt

SEQ ID NO: 112326 - DNA, 25 bp, Homo sapien
cggtggattccgcagggtccacata

SEQ ID NO: 112327 - DNA, 25 bp, Homo sapien
aagggactcatcctcagtgaaggca

SEQ ID NO: 112328 - DNA, 25 bp, Homo sapien
agggtccacatagagccacaaaggg

SEQ ID NO: 112329 - DNA, 25 bp, Homo sapien
ttcaggccagccatctcgtagttag

SEQ ID NO: 112330 - DNA, 25 bp, Homo sapien
atgccttggacacccggtcgctacg

SEQ ID NO: 112331 - DNA, 25 bp, Homo sapien
gagacctggcaggatgccttggaca

SEQ ID NO: 112332 - DNA, 25 bp, Homo sapien
ctctctaggtagctggagactcgcg

SEQ ID NO: 112333 - DNA, 25 bp, Homo sapien
agaaacgtctctctaggtagctgga

SEQ ID NO: 112334 - DNA, 25 bp, Homo sapien
gccatctcgtagttagaaacgtctc

SEQ ID NO: 112335 - DNA, 25 bp, Homo sapien
cagcggggaactctaggccaacaac

SEQ ID NO: 112336 - DNA, 25 bp, Homo sapien
ccaacaacggtgatgggagtgtccc

SEQ ID NO: 112337 - DNA, 25 bp, Homo sapien
aggtccctcagaggatccagcgagg

SEQ ID NO: 112338 - DNA, 25 bp, Homo sapien
ctccctcggttccacgagaggaaag

SEQ ID NO: 112339 - DNA, 25 bp, Homo sapien
ctcgcatcctaaccgggacctggtg

SEQ ID NO: 112340 - DNA, 25 bp, Homo sapien
cggtttttgcactccggaagccgcg

SEQ ID NO: 112341 - DNA, 25 bp, Homo sapien
gacccgccgtgcgtactttctggag

SEQ ID NO: 112342 - DNA, 25 bp, Homo sapien
gttagccaagttccggctgcggcgc

SEQ ID NO: 112343 - DNA, 25 bp, Homo sapien
tgtaacctgaaacttccctcgcatc

SEQ ID NO: 112344 - DNA, 25 bp, Homo sapien
ctctgggacagactggagacgacta

SEQ ID NO: 112345 - DNA, 25 bp, Homo sapien
cgtggatttcaaaccgccctctaga

SEQ ID NO: 112346 - DNA, 25 bp, Homo sapien
cacgaggtccgtggatttcaaaccg

SEQ ID NO: 112347 - DNA, 25 bp, Homo sapien
cttcatgttcaagtacgcccgcaga

SEQ ID NO: 112348 - DNA, 25 bp, Homo sapien
tagaaagcctcctagtgcgatgttg

SEQ ID NO: 112349 - DNA, 25 bp, Homo sapien
gtgcgatgttgctgtgggaaaaccc

SEQ ID NO: 112350 - DNA, 25 bp, Homo sapien
cctcggtgattgcttgctgttcctc

SEQ ID NO: 112351 - DNA, 25 bp, Homo sapien
cgcagacgagcaaatcggagcaacc

SEQ ID NO: 112352 - DNA, 25 bp, Homo sapien
gtgtagtgcccggaaacctgctcct

SEQ ID NO: 112353 - DNA, 25 bp, Homo sapien
cttcttatgagcgtgacttggcgcg

SEQ ID NO: 112354 - DNA, 25 bp, Homo sapien
cagaccggaccaagctggaggttcc

SEQ ID NO: 112355 - DNA, 25 bp, Homo sapien
accaggagaggttccacgtgcggac

SEQ ID NO: 112356 - DNA, 25 bp, Homo sapien
gttccacgtgcggaccaaccagcgg

SEQ ID NO: 112357 - DNA, 25 bp, Homo sapien
cggccggagagtgcaccaccgagaa

SEQ ID NO: 112358 - DNA, 25 bp, Homo sapien
tgcaccaccgagaaggcgcgtgacc

SEQ ID NO: 112359 - DNA, 25 bp, Homo sapien
cggggcgcgcattttcaaaaccagg

SEQ ID NO: 112360 - DNA, 25 bp, Homo sapien
cccactctgcttcttatgagcgtga

SEQ ID NO: 112361 - DNA, 25 bp, Homo sapien
gcagcaggtaaaagcgtccctgccc

SEQ ID NO: 112362 - DNA, 25 bp, Homo sapien
acgccttgcgagtctgactgctgtg

SEQ ID NO: 112363 - DNA, 25 bp, Homo sapien
ctggtagccggctccgagcatcctt

SEQ ID NO: 112364 - DNA, 25 bp, Homo sapien
ctctgggagctgtcactaggccctt

SEQ ID NO: 112365 - DNA, 25 bp, Homo sapien
atcgaaggcctcagacgtcgacgcc

SEQ ID NO: 112366 - DNA, 25 bp, Homo sapien
acttgagggcgctgtggcaacagct

SEQ ID NO: 112367 - DNA, 25 bp, Homo sapien
gcttcccgcgacagtccacttgagg

SEQ ID NO: 112368 - DNA, 25 bp, Homo sapien
gagcatccttctcggcccggctagg

SEQ ID NO: 112369 - DNA, 25 bp, Homo sapien
ctcgcgagctgacactgaagctggc

SEQ ID NO: 112370 - DNA, 25 bp, Homo sapien
ccgcaacctcgcagggcagcagatg

SEQ ID NO: 112371 - DNA, 25 bp, Homo sapien
cgacacttcgagtcctggagcggga

SEQ ID NO: 112372 - DNA, 25 bp, Homo sapien
tcttctcttctgtcaccatcacgta

SEQ ID NO: 112373 - DNA, 25 bp, Homo sapien
cgtcagtcccggaatcccgcaaggg

SEQ ID NO: 112374 - DNA, 25 bp, Homo sapien
ctcctcttggtcgtcagtcccggaa

SEQ ID NO: 112375 - DNA, 25 bp, Homo sapien
gcgcgcaggacctctcaggaagcct

SEQ ID NO: 112376 - DNA, 25 bp, Homo sapien
aaccctatccctttgctcacgaagt

SEQ ID NO: 112377 - DNA, 25 bp, Homo sapien
gaagcgcccaagcaacaacgtctgc

SEQ ID NO: 112378 - DNA, 25 bp, Homo sapien
gcccggcttacctcggtcaggaagc

SEQ ID NO: 112379 - DNA, 25 bp, Homo sapien
tcgggccgagaatctgacctgtccc

SEQ ID NO: 112380 - DNA, 25 bp, Homo sapien
ctggggctgttaccattgagtgacc

SEQ ID NO: 112381 - DNA, 25 bp, Homo sapien
tccgacgtcgaggtcatctcccaaa

SEQ ID NO: 112382 - DNA, 25 bp, Homo sapien
tcacggcagaggactatccgccagc

SEQ ID NO: 112383 - DNA, 25 bp, Homo sapien
cagaggccagtgaatcgtaaacgtc

SEQ ID NO: 112384 - DNA, 25 bp, Homo sapien
acctttgaatctgggaagccttctc

SEQ ID NO: 112385 - DNA, 25 bp, Homo sapien
ctgcgggtttaccttgttgaggtga

SEQ ID NO: 112386 - DNA, 25 bp, Homo sapien
agcctgcgagaagcgctgagtcatg

SEQ ID NO: 112387 - DNA, 25 bp, Homo sapien
atggcaggagatcatccgagccggc

SEQ ID NO: 112388 - DNA, 25 bp, Homo sapien
aagagggccctgaccctgatagaga

SEQ ID NO: 112389 - DNA, 25 bp, Homo sapien
ctgcgagaagcgctgagtcatggca

SEQ ID NO: 112390 - DNA, 25 bp, Homo sapien
tgcaagagggccctgaccctgatag

SEQ ID NO: 112391 - DNA, 25 bp, Homo sapien
tgggcctgcgggtttaccttgttga

SEQ ID NO: 112392 - DNA, 25 bp, Homo sapien
cctgaccctgatagagaggggccga

SEQ ID NO: 112393 - DNA, 25 bp, Homo sapien
tagcgttgcgccatgttatgccctc

SEQ ID NO: 112394 - DNA, 25 bp, Homo sapien
tggctcctccgacgagtcaggtgac

SEQ ID NO: 112395 - DNA, 25 bp, Homo sapien
tgctggactagccacaacgtgcgtt

SEQ ID NO: 112396 - DNA, 25 bp, Homo sapien
atgcatcggatacccaagccctggc

SEQ ID NO: 112397 - DNA, 25 bp, Homo sapien
tccctcagtcgcgaaggagattatc

SEQ ID NO: 112398 - DNA, 25 bp, Homo sapien
acccttcctggctttggagaggagc

SEQ ID NO: 112399 - DNA, 25 bp, Homo sapien
gctgctgcagcaaagggctcgtcct

SEQ ID NO: 112400 - DNA, 25 bp, Homo sapien
gcaccctgggattatcctctgcgga

SEQ ID NO: 112401 - DNA, 25 bp, Homo sapien
ctatataaagctcgggtctcggacc

SEQ ID NO: 112402 - DNA, 25 bp, Homo sapien
ctcccacgggtgcagaagatcgacc

SEQ ID NO: 112403 - DNA, 25 bp, Homo sapien
cgccttcacgcgcagcctttttgtt

SEQ ID NO: 112404 - DNA, 25 bp, Homo sapien
gcctgagagagacatgcgagacacc

SEQ ID NO: 112405 - DNA, 25 bp, Homo sapien
tttctccgcagccatgtgtcgaagg

SEQ ID NO: 112406 - DNA, 25 bp, Homo sapien
ccatttgggagttgcacgcgttcac

SEQ ID NO: 112407 - DNA, 25 bp, Homo sapien
tatcccgcagatacgcaggcttctg

SEQ ID NO: 112408 - DNA, 25 bp, Homo sapien
cctactggaactggtcaagattgcc

SEQ ID NO: 112409 - DNA, 25 bp, Homo sapien
ctccgcggacgtgctgcgtcagaat

SEQ ID NO: 112410 - DNA, 25 bp, Homo sapien
gctgagcatgcgtacttcctccctg

SEQ ID NO: 112411 - DNA, 25 bp, Homo sapien
tgcggaactagctgagcatgcgtac

SEQ ID NO: 112412 - DNA, 25 bp, Homo sapien
acgtgctgcgtcagaatgcgcctca

SEQ ID NO: 112413 - DNA, 25 bp, Homo sapien
tgctgaacgtcccttcccagtcttt

SEQ ID NO: 112414 - DNA, 25 bp, Homo sapien
gtgctgtcccgtctggcggcgatcc

SEQ ID NO: 112415 - DNA, 25 bp, Homo sapien
ccggggtttgaagatgctgaacgtc

SEQ ID NO: 112416 - DNA, 25 bp, Homo sapien
ctgaagttcgggatgcggaactagc

SEQ ID NO: 112417 - DNA, 25 bp, Homo sapien
cgctgggcgtccgaaaagcctggaa

SEQ ID NO: 112418 - DNA, 25 bp, Homo sapien
cccggcagcccgctgatgtgcgtgt

SEQ ID NO: 112419 - DNA, 25 bp, Homo sapien
ggcagtctttagtttagaggggcta

SEQ ID NO: 112420 - DNA, 25 bp, Homo sapien
ctagccagccggtaaccacgggcgg

SEQ ID NO: 112421 - DNA, 25 bp, Homo sapien
gccggggctagccagccggtaacca

SEQ ID NO: 112422 - DNA, 25 bp, Homo sapien
cggatctaggagctactcgcccggc

SEQ ID NO: 112423 - DNA, 25 bp, Homo sapien
cgccgcacctcggatctaggagcta

SEQ ID NO: 112424 - DNA, 25 bp, Homo sapien
acgccgctgggcgtccgaaaagcct

SEQ ID NO: 112425 - DNA, 25 bp, Homo sapien
tcgctcgagtatgaagcacggcctc

SEQ ID NO: 112426 - DNA, 25 bp, Homo sapien
tgggtttcccaatgcctttacaagc

SEQ ID NO: 112427 - DNA, 25 bp, Homo sapien
tagtggctaaaccttcgctgctgca

SEQ ID NO: 112428 - DNA, 25 bp, Homo sapien
cgctgctgcagtaaaatgcctttcc

SEQ ID NO: 112429 - DNA, 25 bp, Homo sapien
gggtccaccagttgtcagggtaaca

SEQ ID NO: 112430 - DNA, 25 bp, Homo sapien
ggtccttgtgtttccgcactccgca

SEQ ID NO: 112431 - DNA, 25 bp, Homo sapien
gccagcccgtggctttctgggaaat

SEQ ID NO: 112432 - DNA, 25 bp, Homo sapien
tccctggctttctctacgttcctta

SEQ ID NO: 112433 - DNA, 25 bp, Homo sapien
cacagactcgcagaagttcaggttc

SEQ ID NO: 112434 - DNA, 25 bp, Homo sapien
cgagcctggaagcagtatctgaacc

SEQ ID NO: 112435 - DNA, 25 bp, Homo sapien
cgagctttgcgactgacacggccaa

SEQ ID NO: 112436 - DNA, 25 bp, Homo sapien
atctgaaccgtctggagggtgacca

SEQ ID NO: 112437 - DNA, 25 bp, Homo sapien
ttcgcgccggagagaagttataggc

SEQ ID NO: 112438 - DNA, 25 bp, Homo sapien
agcgccttcgtctccctcagaagaa

SEQ ID NO: 112439 - DNA, 25 bp, Homo sapien
ctccaccgagaaagcgtgcgccttg

SEQ ID NO: 112440 - DNA, 25 bp, Homo sapien
tgggcctccttaagccataagcgtc

SEQ ID NO: 112441 - DNA, 25 bp, Homo sapien
ccgcaggtttctagaggcctctaca

SEQ ID NO: 112442 - DNA, 25 bp, Homo sapien
cttcggatgaacagccgggtgaatc

SEQ ID NO: 112443 - DNA, 25 bp, Homo sapien
ctagatgggcgcaaagcagatgacc

SEQ ID NO: 112444 - DNA, 25 bp, Homo sapien
gcttagcacgtactgttggaatcca

SEQ ID NO: 112445 - DNA, 25 bp, Homo sapien
cttggcctggctgaaagccacatta

SEQ ID NO: 112446 - DNA, 25 bp, Homo sapien
ctagagtatgcaaagaggccggccc

SEQ ID NO: 112447 - DNA, 25 bp, Homo sapien
tggcacagtcgggtccttaacagct

SEQ ID NO: 112448 - DNA, 25 bp, Homo sapien
gccggccctgcgagactaaataagt

SEQ ID NO: 112449 - DNA, 25 bp, Homo sapien
gcccgtcaagggttatagcttagtg

SEQ ID NO: 112450 - DNA, 25 bp, Homo sapien
gcggctgtctcgaaaacgcctctca

SEQ ID NO: 112451 - DNA, 25 bp, Homo sapien
ccgccgctttggctatggaggtaca

SEQ ID NO: 112452 - DNA, 25 bp, Homo sapien
acgcgggtttctgttgataagtgca

SEQ ID NO: 112453 - DNA, 25 bp, Homo sapien
taagtgcaaagtacggccctctcgg

SEQ ID NO: 112454 - DNA, 25 bp, Homo sapien
ctctaaggggaactcgtaatgctca

SEQ ID NO: 112455 - DNA, 25 bp, Homo sapien
aaggcgcctgactcctctaagggga

SEQ ID NO: 112456 - DNA, 25 bp, Homo sapien
taaatacatcatctcccggggcggc

SEQ ID NO: 112457 - DNA, 25 bp, Homo sapien
ggtgacaaaagcactggatgagatt

SEQ ID NO: 112458 - DNA, 25 bp, Homo sapien
aattgaattacaacacgaggtgaca

SEQ ID NO: 112459 - DNA, 25 bp, Homo sapien
tgagagaaatgaccacgtcgggctc

SEQ ID NO: 112460 - DNA, 25 bp, Homo sapien
aaatgaccacgtcgggctcaggatg

SEQ ID NO: 112461 - DNA, 25 bp, Homo sapien
ctcaggatggatgggattaatggca

SEQ ID NO: 112462 - DNA, 25 bp, Homo sapien
gattaatggcaggttgggcacagca

SEQ ID NO: 112463 - DNA, 25 bp, Homo sapien
ggcacagcaagagaaatgaccaggc

SEQ ID NO: 112464 - DNA, 25 bp, Homo sapien
agagaaatgaccaggccaggcacgg

SEQ ID NO: 112465 - DNA, 25 bp, Homo sapien
ccgaggtggcgcacttcatgaacgc

SEQ ID NO: 112466 - DNA, 25 bp, Homo sapien
agttcacgcgccacagctatgtgtc

SEQ ID NO: 112467 - DNA, 25 bp, Homo sapien
gcctgggagcttacgattttgcaca

SEQ ID NO: 112468 - DNA, 25 bp, Homo sapien
tggctcggctcttcaccaaggttca

SEQ ID NO: 112469 - DNA, 25 bp, Homo sapien
ggcgaccagtaccagggcactatct

SEQ ID NO: 112470 - DNA, 25 bp, Homo sapien
ggcactatctggttcaccgtgtaca

SEQ ID NO: 112471 - DNA, 25 bp, Homo sapien
gccctgcgctacgatgccatggtaa

SEQ ID NO: 112472 - DNA, 25 bp, Homo sapien
tgccagctggatgcatagaagtccc

SEQ ID NO: 112473 - DNA, 25 bp, Homo sapien
tggcgaccggccatttccggaaatc

SEQ ID NO: 112474 - DNA, 25 bp, Homo sapien
ttcgtgacacgaacccgcagaggga

SEQ ID NO: 112475 - DNA, 25 bp, Homo sapien
tggaaactctgacaacactggcgac

SEQ ID NO: 112476 - DNA, 25 bp, Homo sapien
tagcgcgcagtcttccgtggaaact

SEQ ID NO: 112477 - DNA, 25 bp, Homo sapien
gcacacagacgcctaccggcagtta

SEQ ID NO: 112478 - DNA, 25 bp, Homo sapien
cagggcaccatctccgtaacggcga

SEQ ID NO: 112479 - DNA, 25 bp, Homo sapien
cgctgcggcgttacctgttaagaag

SEQ ID NO: 112480 - DNA, 25 bp, Homo sapien
gcgtctgcaccttcggagaaaagcc

SEQ ID NO: 112481 - DNA, 25 bp, Homo sapien
ccgagactgaatgaaaggcccgccc

SEQ ID NO: 112482 - DNA, 25 bp, Homo sapien
cccaggttctggcagtcgttacctc

SEQ ID NO: 112483 - DNA, 25 bp, Homo sapien
tcctgtccgatggtatcgggttgcg

SEQ ID NO: 112484 - DNA, 25 bp, Homo sapien
tgcgggaaacgcgtgctcgctgctc

SEQ ID NO: 112485 - DNA, 25 bp, Homo sapien
cccattggaatccattttccagaaa

SEQ ID NO: 112486 - DNA, 25 bp, Homo sapien
gtcgctcaggcacgagtggccgcct

SEQ ID NO: 112487 - DNA, 25 bp, Homo sapien
tgacaacgtagcctacgcctcggga

SEQ ID NO: 112488 - DNA, 25 bp, Homo sapien
ccagctcactccacaatgtcatgga

SEQ ID NO: 112489 - DNA, 25 bp, Homo sapien
cggcctcagcttaggaccgattcga

SEQ ID NO: 112490 - DNA, 25 bp, Homo sapien
acctcagtacatgtggcagtccggc

SEQ ID NO: 112491 - DNA, 25 bp, Homo sapien
ttaaagctcttaactcggcctgcgc

SEQ ID NO: 112492 - DNA, 25 bp, Homo sapien
tgcgccaccatcttttgctcggata

SEQ ID NO: 112493 - DNA, 25 bp, Homo sapien
tgcgcagccagtagctccttatata

SEQ ID NO: 112494 - DNA, 25 bp, Homo sapien
gaaacgacgctttcgcctgccacga

SEQ ID NO: 112495 - DNA, 25 bp, Homo sapien
tggccgtcacgactcaacctcagta

SEQ ID NO: 112496 - DNA, 25 bp, Homo sapien
ctcgcacctattggacatggaagta

SEQ ID NO: 112497 - DNA, 25 bp, Homo sapien
tccgagtgagacttctggagccagc

SEQ ID NO: 112498 - DNA, 25 bp, Homo sapien
gctcaacgtactccagaatcgaatg

SEQ ID NO: 112499 - DNA, 25 bp, Homo sapien
tcgaatgttgagagaagcagtgctc

SEQ ID NO: 112500 - DNA, 25 bp, Homo sapien
gggagaacgccctgggctcaacgta

SEQ ID NO: 112501 - DNA, 25 bp, Homo sapien
agcagtgctctgatccagctcagga

SEQ ID NO: 112502 - DNA, 25 bp, Homo sapien
tgcacgcaccgtccacaaggtgagg

SEQ ID NO: 112503 - DNA, 25 bp, Homo sapien
ctccagctctggcttggggatgttt

SEQ ID NO: 112504 - DNA, 25 bp, Homo sapien
gcttggggatgtttgccagctttga

SEQ ID NO: 112505 - DNA, 25 bp, Homo sapien
aagctccggttgacctctggaagcc

SEQ ID NO: 112506 - DNA, 25 bp, Homo sapien
cgagtgagcgacaacagcggtagct

SEQ ID NO: 112507 - DNA, 25 bp, Homo sapien
ccgagtgagcgacaacagcggtagc

SEQ ID NO: 112508 - DNA, 25 bp, Homo sapien
cgccgagtgagcgacaacagcggta

SEQ ID NO: 112509 - DNA, 25 bp, Homo sapien
cggaagctccggttgacctctggaa

SEQ ID NO: 112510 - DNA, 25 bp, Homo sapien
gctccggttgacctctggaagccgc

SEQ ID NO: 112511 - DNA, 25 bp, Homo sapien
aggacgagcccgaggactagcccca

SEQ ID NO: 112512 - DNA, 25 bp, Homo sapien
tagctcgggaatggggtctcgcagc

SEQ ID NO: 112513 - DNA, 25 bp, Homo sapien
cggcccggatgcaagcacatctgtc

SEQ ID NO: 112514 - DNA, 25 bp, Homo sapien
cttagcagtcgcgttgtgttcaaaa

SEQ ID NO: 112515 - DNA, 25 bp, Homo sapien
gtgctgcccggaaaacccgtgaagc

SEQ ID NO: 112516 - DNA, 25 bp, Homo sapien
ggctacagcgggcttgatcctcagt

SEQ ID NO: 112517 - DNA, 25 bp, Homo sapien
ttagccctgagctatccgtcatccg

SEQ ID NO: 112518 - DNA, 25 bp, Homo sapien
tcaggcccggctatttcaagaattc

SEQ ID NO: 112519 - DNA, 25 bp, Homo sapien
cctcagtgctgggtggaaaaaccgc

SEQ ID NO: 112520 - DNA, 25 bp, Homo sapien
tccagaaaaagagtgcaccggcgtg

SEQ ID NO: 112521 - DNA, 25 bp, Homo sapien
cgtgaccgagagcaggccttcacca

SEQ ID NO: 112522 - DNA, 25 bp, Homo sapien
cttttattgtgcactggggattacc

SEQ ID NO: 112523 - DNA, 25 bp, Homo sapien
cccgcggctgaggaaatgtacacgg

SEQ ID NO: 112524 - DNA, 25 bp, Homo sapien
gagttgcggtcaaggcggaaaatcc

SEQ ID NO: 112525 - DNA, 25 bp, Homo sapien
ggtcgccgcttccttggcatcatcg

SEQ ID NO: 112526 - DNA, 25 bp, Homo sapien
tggaagcggccaccgactactgtca

SEQ ID NO: 112527 - DNA, 25 bp, Homo sapien
cgccgaacgtggcattgtgttatca

SEQ ID NO: 112528 - DNA, 25 bp, Homo sapien
ccactggtttgattcctttgccttc

SEQ ID NO: 112529 - DNA, 25 bp, Homo sapien
cctccgccgctctctctagcaggcg

SEQ ID NO: 112530 - DNA, 25 bp, Homo sapien
cctcagaaccggaaaggctagcact

SEQ ID NO: 112531 - DNA, 25 bp, Homo sapien
tcagaaccggaaaggctagcactgg

SEQ ID NO: 112532 - DNA, 25 bp, Homo sapien
gaaccggaaaggctagcactggatg

SEQ ID NO: 112533 - DNA, 25 bp, Homo sapien
gccgctctctctagcaggcggggcg

SEQ ID NO: 112534 - DNA, 25 bp, Homo sapien
ccgcagcctccggaagacaggggac

SEQ ID NO: 112535 - DNA, 25 bp, Homo sapien
cagcctccggaagacaggggacgct

SEQ ID NO: 112536 - DNA, 25 bp, Homo sapien
gaaaggctagcactggatgggtccc

SEQ ID NO: 112537 - DNA, 25 bp, Homo sapien
ttatccaccgagcacagtttccatg

SEQ ID NO: 112538 - DNA, 25 bp, Homo sapien
cgtatttttcaagcctcggggcgcg

SEQ ID NO: 112539 - DNA, 25 bp, Homo sapien
gcggctcgggaagaacaacttgtgc

SEQ ID NO: 112540 - DNA, 25 bp, Homo sapien
tgcggcgcttttgcactttcctaag

SEQ ID NO: 112541 - DNA, 25 bp, Homo sapien
tgcgccctcctagcaaagcggggtt

SEQ ID NO: 112542 - DNA, 25 bp, Homo sapien
ttccctcccgcaaggaattttgctg

SEQ ID NO: 112543 - DNA, 25 bp, Homo sapien
atccgccttccgagatgctggcagc

SEQ ID NO: 112544 - DNA, 25 bp, Homo sapien
agttgctgagttgctctgcacgctc

SEQ ID NO: 112545 - DNA, 25 bp, Homo sapien
gggcctaccttggtctgttcgctca

SEQ ID NO: 112546 - DNA, 25 bp, Homo sapien
ggggctgactaactgtcccgccgcg

SEQ ID NO: 112547 - DNA, 25 bp, Homo sapien
cccgcaggtgtcgactcgcaggttt

SEQ ID NO: 112548 - DNA, 25 bp, Homo sapien
gtgccgagagctcgttaggccgcct

SEQ ID NO: 112549 - DNA, 25 bp, Homo sapien
ttggtctgttcgctcagcttctcac

SEQ ID NO: 112550 - DNA, 25 bp, Homo sapien
tctcacttctcaggtcgctcagcag

SEQ ID NO: 112551 - DNA, 25 bp, Homo sapien
gctcagcttctcacttctcaggtcg

SEQ ID NO: 112552 - DNA, 25 bp, Homo sapien
tcgctcagcaggtcgcgacccaaat

SEQ ID NO: 112553 - DNA, 25 bp, Homo sapien
aacagcggtccattcctgccggagg

SEQ ID NO: 112554 - DNA, 25 bp, Homo sapien
gtcgattccgatccaggtcagccta

SEQ ID NO: 112555 - DNA, 25 bp, Homo sapien
tagctctcagtctcgatcctttagg

SEQ ID NO: 112556 - DNA, 25 bp, Homo sapien
ggactctcccactgactggcacttg

SEQ ID NO: 112557 - DNA, 25 bp, Homo sapien
cgcatgcgcacacagatccggagcg

SEQ ID NO: 112558 - DNA, 25 bp, Homo sapien
agggctgccctctagcctttgcgcg

SEQ ID NO: 112559 - DNA, 25 bp, Homo sapien
cgcgtcctgcctcgtcgagacttag

SEQ ID NO: 112560 - DNA, 25 bp, Homo sapien
cggacctcgggagacttagtaattg

SEQ ID NO: 112561 - DNA, 25 bp, Homo sapien
gagcggcttcgtctctatgaccaca

SEQ ID NO: 112562 - DNA, 25 bp, Homo sapien
actcaacttccttagctggcgggga

SEQ ID NO: 112563 - DNA, 25 bp, Homo sapien
cggggagacgcagtttacagaacta

SEQ ID NO: 112564 - DNA, 25 bp, Homo sapien
gcccagttttagtgcgtggccgacc

SEQ ID NO: 112565 - DNA, 25 bp, Homo sapien
cagcgaggcaggacagttcttcacc

SEQ ID NO: 112566 - DNA, 25 bp, Homo sapien
tgctcagaggcttaaaggcaggctc

SEQ ID NO: 112567 - DNA, 25 bp, Homo sapien
gcctttgtgaggactacgattccca

SEQ ID NO: 112568 - DNA, 25 bp, Homo sapien
gcctcctaccctgtggatgctcaga

SEQ ID NO: 112569 - DNA, 25 bp, Homo sapien
accatggctacgtcctcgatgtcta

SEQ ID NO: 112570 - DNA, 25 bp, Homo sapien
cctggcaagcaatagcgcggcgaaa

SEQ ID NO: 112571 - DNA, 25 bp, Homo sapien
cgccatgtccacctctacggaagtg

SEQ ID NO: 112572 - DNA, 25 bp, Homo sapien
aaggagccgtgtggctcgccactaa

SEQ ID NO: 112573 - DNA, 25 bp, Homo sapien
cgcagagtcagtaagaccatggcta

SEQ ID NO: 112574 - DNA, 25 bp, Homo sapien
gcgctccgggatccatacctggcaa

SEQ ID NO: 112575 - DNA, 25 bp, Homo sapien
atcccgagtgcatctggaatacgca

SEQ ID NO: 112576 - DNA, 25 bp, Homo sapien
tcgatgtctaaggtatgtggtggcc

SEQ ID NO: 112577 - DNA, 25 bp, Homo sapien
ttctgaagtcgaaaacagcaccgtg

SEQ ID NO: 112578 - DNA, 25 bp, Homo sapien
cagcaggaacccaagcgaacacgtc

SEQ ID NO: 112579 - DNA, 25 bp, Homo sapien
tacgacttccgtcatgcaaggcgcg

SEQ ID NO: 112580 - DNA, 25 bp, Homo sapien
ccgggctcaacagcgggtcgaaatc

SEQ ID NO: 112581 - DNA, 25 bp, Homo sapien
acgcggctcctaatacgcccgagta

SEQ ID NO: 112582 - DNA, 25 bp, Homo sapien
ggcgcttctgtgctgagactagatc

SEQ ID NO: 112583 - DNA, 25 bp, Homo sapien
aatccagagtccttttcagagtggc

SEQ ID NO: 112584 - DNA, 25 bp, Homo sapien
cccgagtacggtcagtagcttgcga

SEQ ID NO: 112585 - DNA, 25 bp, Homo sapien
tacgctccgcctgaaaccgaggatg

SEQ ID NO: 112586 - DNA, 25 bp, Homo sapien
acgacagcgagaccgcggagaacta

SEQ ID NO: 112587 - DNA, 25 bp, Homo sapien
gggtgtcgcagctctcttcgacgta

SEQ ID NO: 112588 - DNA, 25 bp, Homo sapien
gcttctcgtcgcgttccgtcttgca

SEQ ID NO: 112589 - DNA, 25 bp, Homo sapien
tcctctcctagggacttgtcgcacg

SEQ ID NO: 112590 - DNA, 25 bp, Homo sapien
taccgcacccggaaggctcaaggag

SEQ ID NO: 112591 - DNA, 25 bp, Homo sapien
accattgaggcgtcacggttcgtca

SEQ ID NO: 112592 - DNA, 25 bp, Homo sapien
ttcgacgtacctgtcctcaggagcc

SEQ ID NO: 112593 - DNA, 25 bp, Homo sapien
ccgatgcaaacagttgggctccgta

SEQ ID NO: 112594 - DNA, 25 bp, Homo sapien
gctcctcgcaccttttcgctggagg

SEQ ID NO: 112595 - DNA, 25 bp, Homo sapien
tctcgctccagtcccatttatgaag

SEQ ID NO: 112596 - DNA, 25 bp, Homo sapien
gtcccatttatgaagcgcggtccca

SEQ ID NO: 112597 - DNA, 25 bp, Homo sapien
gcgcggtcccatcacgtgttaatga

SEQ ID NO: 112598 - DNA, 25 bp, Homo sapien
ttaatgagcctttgtcctgccctgg

SEQ ID NO: 112599 - DNA, 25 bp, Homo sapien
tcacaccctgaccaggccaagaagg

SEQ ID NO: 112600 - DNA, 25 bp, Homo sapien
gggccattaatcacacgctcccggg

SEQ ID NO: 112601 - DNA, 25 bp, Homo sapien
tgaattccaacctctccgatccggg

SEQ ID NO: 112602 - DNA, 25 bp, Homo sapien
gacgctactggttcgcctttgcgca

SEQ ID NO: 112603 - DNA, 25 bp, Homo sapien
ggcgcgccactttcattcaggatca

SEQ ID NO: 112604 - DNA, 25 bp, Homo sapien
tgtgcaattgccctcgtaccgaact

SEQ ID NO: 112605 - DNA, 25 bp, Homo sapien
acccgaatcgcagccgtaatctgaa

SEQ ID NO: 112606 - DNA, 25 bp, Homo sapien
cgggatcttgttgtgagccatgtct

SEQ ID NO: 112607 - DNA, 25 bp, Homo sapien
tgttcccattcatccacgaagcgta

SEQ ID NO: 112608 - DNA, 25 bp, Homo sapien
tcagcggaaggatagcaaagagtta

SEQ ID NO: 112609 - DNA, 25 bp, Homo sapien
cgcccgagtcatgttccgcgatctt

SEQ ID NO: 112610 - DNA, 25 bp, Homo sapien
gcgatcttctcaggctctcctagca

SEQ ID NO: 112611 - DNA, 25 bp, Homo sapien
tcgttgctgagcgacaagcttccta

SEQ ID NO: 112612 - DNA, 25 bp, Homo sapien
gcttcctagcgctatgactgtcgtc

SEQ ID NO: 112613 - DNA, 25 bp, Homo sapien
tgacgcccgctccattcttgctttg

SEQ ID NO: 112614 - DNA, 25 bp, Homo sapien
gcgcttctgattggctcccaggagt

SEQ ID NO: 112615 - DNA, 25 bp, Homo sapien
cccgatttagaaggctggcggcgtt

SEQ ID NO: 112616 - DNA, 25 bp, Homo sapien
ggctatttgttgctgcgccgccacc

SEQ ID NO: 112617 - DNA, 25 bp, Homo sapien
tcgtgtagcgagacatgaccgcttc

SEQ ID NO: 112618 - DNA, 25 bp, Homo sapien
caaaggagctgaaacgcgggcactc

SEQ ID NO: 112619 - DNA, 25 bp, Homo sapien
gggcactcgctggagcgcaaaccct

SEQ ID NO: 112620 - DNA, 25 bp, Homo sapien
gcgtccgcgacgttcctgatgaaca

SEQ ID NO: 112621 - DNA, 25 bp, Homo sapien
gaattccgaagacaggagcgcggcc

SEQ ID NO: 112622 - DNA, 25 bp, Homo sapien
tcccaggccctatgggatccgggta

SEQ ID NO: 112623 - DNA, 25 bp, Homo sapien
agtgagagccgctttcaaccgcgcc

SEQ ID NO: 112624 - DNA, 25 bp, Homo sapien
cggagtagtccgagggctcacacct

SEQ ID NO: 112625 - DNA, 25 bp, Homo sapien
cttcctctgcgagtacgacgcgctg

SEQ ID NO: 112626 - DNA, 25 bp, Homo sapien
ggccgctccgagctggagctactga

SEQ ID NO: 112627 - DNA, 25 bp, Homo sapien
tggagctactgaagctgcgctcggc

SEQ ID NO: 112628 - DNA, 25 bp, Homo sapien
ggccacaacctcatcgctgaggtcg

SEQ ID NO: 112629 - DNA, 25 bp, Homo sapien
tgtgggaccgcgctaaacctgcggt

SEQ ID NO: 112630 - DNA, 25 bp, Homo sapien
cccagtcaaagtcagttcgcgttgc

SEQ ID NO: 112631 - DNA, 25 bp, Homo sapien
tgacgcacttcttcgagcgggagcc

SEQ ID NO: 112632 - DNA, 25 bp, Homo sapien
cgagctggcctacgaggagcaccat

SEQ ID NO: 112633 - DNA, 25 bp, Homo sapien
ttagcgactccttccctgttgtgcc

SEQ ID NO: 112634 - DNA, 25 bp, Homo sapien
gctcgctccgaaactcctgtttgca

SEQ ID NO: 112635 - DNA, 25 bp, Homo sapien
cggctcccggcttcagttacggaag

SEQ ID NO: 112636 - DNA, 25 bp, Homo sapien
ccagcgacgagggttcgaaaatgcc

SEQ ID NO: 112637 - DNA, 25 bp, Homo sapien
caagggacctcgttctcagggaaga

SEQ ID NO: 112638 - DNA, 25 bp, Homo sapien
cactttaagacttcccgagcggcgg

SEQ ID NO: 112639 - DNA, 25 bp, Homo sapien
tgcgtctccacgtgcaagaggaact

SEQ ID NO: 112640 - DNA, 25 bp, Homo sapien
cgagccaataaagcgtgaacccgtc

SEQ ID NO: 112641 - DNA, 25 bp, Homo sapien
cagcaggacctgatgcgcatccata

SEQ ID NO: 112642 - DNA, 25 bp, Homo sapien
ttgcacatccagaaacgccattttg

SEQ ID NO: 112643 - DNA, 25 bp, Homo sapien
ggcacagccggagcgaccttttaaa

SEQ ID NO: 112644 - DNA, 25 bp, Homo sapien
atcatgccagggagccaagcgtcct

SEQ ID NO: 112645 - DNA, 25 bp, Homo sapien
ctgcggagttgatgaactttgcaca

SEQ ID NO: 112646 - DNA, 25 bp, Homo sapien
ctcgcaggagcaacacgtgatgtgt

SEQ ID NO: 112647 - DNA, 25 bp, Homo sapien
ctgcagagcgcgttgtacttttgaa

SEQ ID NO: 112648 - DNA, 25 bp, Homo sapien
caagtttgcatctctcctcggtctc

SEQ ID NO: 112649 - DNA, 25 bp, Homo sapien
cgtagagcgcgaaaccaggagctga

SEQ ID NO: 112650 - DNA, 25 bp, Homo sapien
tcttcaggttgtagcgggtctccat

SEQ ID NO: 112651 - DNA, 25 bp, Homo sapien
ggagcctcggcaaatgccgcccagt

SEQ ID NO: 112652 - DNA, 25 bp, Homo sapien
aggtcagcctcctcgggtagtcgca

SEQ ID NO: 112653 - DNA, 25 bp, Homo sapien
cctcgtccgggatttgtgaagttgc

SEQ ID NO: 112654 - DNA, 25 bp, Homo sapien
ttgccctgacgtggcagtagcttcg

SEQ ID NO: 112655 - DNA, 25 bp, Homo sapien
ctgcaaagctgtccgcagccggctg

SEQ ID NO: 112656 - DNA, 25 bp, Homo sapien
tcacccggactcttcaggttgtagc

SEQ ID NO: 112657 - DNA, 25 bp, Homo sapien
tgaccctggcttcaacagcaccgtt

SEQ ID NO: 112658 - DNA, 25 bp, Homo sapien
cagcaccgttctgggagagaggtcc

SEQ ID NO: 112659 - DNA, 25 bp, Homo sapien
gcccgcagcctatttctgaagcgga

SEQ ID NO: 112660 - DNA, 25 bp, Homo sapien
tttttagccacgacatctgaccctg

SEQ ID NO: 112661 - DNA, 25 bp, Homo sapien
ctccaagtcggtggctcgcgcacgg

SEQ ID NO: 112662 - DNA, 25 bp, Homo sapien
agcggaggtttgtctagagctcagc

SEQ ID NO: 112663 - DNA, 25 bp, Homo sapien
gcgctccctcatttggcagctcgag

SEQ ID NO: 112664 - DNA, 25 bp, Homo sapien
gtcacctgacacacactgtcacata

SEQ ID NO: 112665 - DNA, 25 bp, Homo sapien
gctcggccacaggtaacccgcagga

SEQ ID NO: 112666 - DNA, 25 bp, Homo sapien
cggcgaagcctcagcaagtggcatc

SEQ ID NO: 112667 - DNA, 25 bp, Homo sapien
ccctggacgacagcactagggtgca

SEQ ID NO: 112668 - DNA, 25 bp, Homo sapien
ctcctgctcgcttgcagtttgaagg

SEQ ID NO: 112669 - DNA, 25 bp, Homo sapien
ggagaactttcttctggggctcgtc

SEQ ID NO: 112670 - DNA, 25 bp, Homo sapien
agaaaggtaccaggcgacctcgccg

SEQ ID NO: 112671 - DNA, 25 bp, Homo sapien
ggtgccacctctctctcgcgagggt

SEQ ID NO: 112672 - DNA, 25 bp, Homo sapien
tgcctccctggaatatggaacttcg

SEQ ID NO: 112673 - DNA, 25 bp, Homo sapien
catgtccaccagaggtccgccggag

SEQ ID NO: 112674 - DNA, 25 bp, Homo sapien
cgcgatcgcaccaaaccaaggaagc

SEQ ID NO: 112675 - DNA, 25 bp, Homo sapien
aggaagcagccagtgcctcccgtca

SEQ ID NO: 112676 - DNA, 25 bp, Homo sapien
tagggacagatggagaatccagctc

SEQ ID NO: 112677 - DNA, 25 bp, Homo sapien
gctcagacccaggtaagctgctttg

SEQ ID NO: 112678 - DNA, 25 bp, Homo sapien
tttggaaggcagagaaccgccggta

SEQ ID NO: 112679 - DNA, 25 bp, Homo sapien
acctgctttaacgttagcgtcgctg

SEQ ID NO: 112680 - DNA, 25 bp, Homo sapien
taagcgggaagcagccatgtccacc

SEQ ID NO: 112681 - DNA, 25 bp, Homo sapien
agccagcaactacgcccgcaggaaa

SEQ ID NO: 112682 - DNA, 25 bp, Homo sapien
ggaagcttactagtggggcgaccca

SEQ ID NO: 112683 - DNA, 25 bp, Homo sapien
tgacgtcatcagctcgggacggcta

SEQ ID NO: 112684 - DNA, 25 bp, Homo sapien
ggactcgcgaacacagcacgtggtg

SEQ ID NO: 112685 - DNA, 25 bp, Homo sapien
ctcagcggcggaaacgccagtcttc

SEQ ID NO: 112686 - DNA, 25 bp, Homo sapien
tgagcacacggcgtttgacgtcatc

SEQ ID NO: 112687 - DNA, 25 bp, Homo sapien
ctcgttcttggctgcgattaaccgc

SEQ ID NO: 112688 - DNA, 25 bp, Homo sapien
caagaagtgctccatgacccagggc

SEQ ID NO: 112689 - DNA, 25 bp, Homo sapien
acgtctggccgcaggtagccacgtt

SEQ ID NO: 112690 - DNA, 25 bp, Homo sapien
gctgcgacgtgctttgcgtctgata

SEQ ID NO: 112691 - DNA, 25 bp, Homo sapien
tttgcgtctgatatgattggccgta

SEQ ID NO: 112692 - DNA, 25 bp, Homo sapien
tgattggccgtaggcactcagtccc

SEQ ID NO: 112693 - DNA, 25 bp, Homo sapien
gagtccatctggagcggccaagtag

SEQ ID NO: 112694 - DNA, 25 bp, Homo sapien
cctctgtggtccttcgagagggtct

SEQ ID NO: 112695 - DNA, 25 bp, Homo sapien
gcgcgcccaggaattgtcccttcgg

SEQ ID NO: 112696 - DNA, 25 bp, Homo sapien
ccctgatagcgctctggtattggtg

SEQ ID NO: 112697 - DNA, 25 bp, Homo sapien
aggcggtcctcacccagcttcaatg

SEQ ID NO: 112698 - DNA, 25 bp, Homo sapien
gcgcggccatgatgattcagcaatg

SEQ ID NO: 112699 - DNA, 25 bp, Homo sapien
tcagcaatgccctcaagtgtcactc

SEQ ID NO: 112700 - DNA, 25 bp, Homo sapien
cctcaacgtcttcaaggtcagcgtc

SEQ ID NO: 112701 - DNA, 25 bp, Homo sapien
tccaccctggagattgcctagcagc

SEQ ID NO: 112702 - DNA, 25 bp, Homo sapien
cgcgaggaagtacaagcaggctgcc

SEQ ID NO: 112703 - DNA, 25 bp, Homo sapien
tcctgctggcttcgtttgatcactg

SEQ ID NO: 112704 - DNA, 25 bp, Homo sapien
gcgtctacttgcaaaattggcctta

SEQ ID NO: 112705 - DNA, 25 bp, Homo sapien
ctgttcacttcgaggcagctctgtg

SEQ ID NO: 112706 - DNA, 25 bp, Homo sapien
tgtgctgcgcaaccagatccacgtg

SEQ ID NO: 112707 - DNA, 25 bp, Homo sapien
cagggagtttcagcaccgcgccaaa

SEQ ID NO: 112708 - DNA, 25 bp, Homo sapien
ttcgagaagtctctgcggatcggca

SEQ ID NO: 112709 - DNA, 25 bp, Homo sapien
agcaagatcctggacgcccgggatg

SEQ ID NO: 112710 - DNA, 25 bp, Homo sapien
cgcgtggactcgcacagcaagatcc

SEQ ID NO: 112711 - DNA, 25 bp, Homo sapien
accagcttcttaggggtcagcctcc

SEQ ID NO: 112712 - DNA, 25 bp, Homo sapien
gatccacgtgaaatcccttccagag

SEQ ID NO: 112713 - DNA, 25 bp, Homo sapien
gtgtgttgcaccttgacttcatgga

SEQ ID NO: 112714 - DNA, 25 bp, Homo sapien
cttcccgttcctagaaaatgccata

SEQ ID NO: 112715 - DNA, 25 bp, Homo sapien
taggagagattcgatccaggtctgc

SEQ ID NO: 112716 - DNA, 25 bp, Homo sapien
caacccgatctttcgctaggagaga

SEQ ID NO: 112717 - DNA, 25 bp, Homo sapien
agctacgcgggacgctttccgacaa

SEQ ID NO: 112718 - DNA, 25 bp, Homo sapien
tggcgcccttaggtcttagctacgc

SEQ ID NO: 112719 - DNA, 25 bp, Homo sapien
ggtgcaaggtttccctctcagaagc

SEQ ID NO: 112720 - DNA, 25 bp, Homo sapien
tcacctcgccggagaactttgcgtc

SEQ ID NO: 112721 - DNA, 25 bp, Homo sapien
agcgtgcacgaaatcgcccgaggga

SEQ ID NO: 112722 - DNA, 25 bp, Homo sapien
cagaggcgcacattagcgtgcacga

SEQ ID NO: 112723 - DNA, 25 bp, Homo sapien
catttaggaaaacacagaggcgcac

SEQ ID NO: 112724 - DNA, 25 bp, Homo sapien
gctgccaggtcatcctgtctaaaga

SEQ ID NO: 112725 - DNA, 25 bp, Homo sapien
ccgcttgatgaagaaaccagcattt

SEQ ID NO: 112726 - DNA, 25 bp, Homo sapien
tgatgcgttattccgccgcttgatg

SEQ ID NO: 112727 - DNA, 25 bp, Homo sapien
agaaactctggtcgcgcctacctga

SEQ ID NO: 112728 - DNA, 25 bp, Homo sapien
ccctatcggacaaacgctttgaccg

SEQ ID NO: 112729 - DNA, 25 bp, Homo sapien
ttgtagtcgatctcttcaaagttga

SEQ ID NO: 112730 - DNA, 25 bp, Homo sapien
ggaaggggcttcgatcatctcaccg

SEQ ID NO: 112731 - DNA, 25 bp, Homo sapien
atctcaccggccgaagacgaggagg

SEQ ID NO: 112732 - DNA, 25 bp, Homo sapien
aggcaccttcagagccggcaccagg

SEQ ID NO: 112733 - DNA, 25 bp, Homo sapien
ctgtagacatgatccctcgcggcgc

SEQ ID NO: 112734 - DNA, 25 bp, Homo sapien
ttggacctctagaacaaatttcgcg

SEQ ID NO: 112735 - DNA, 25 bp, Homo sapien
cgcgagacctttattacagggcctc

SEQ ID NO: 112736 - DNA, 25 bp, Homo sapien
cctgacgtaattaaagtgcgcgaac

SEQ ID NO: 112737 - DNA, 25 bp, Homo sapien
ttccagcggatcttgccgcactttc

SEQ ID NO: 112738 - DNA, 25 bp, Homo sapien
gagtagagccgcgtcttccagcgga

SEQ ID NO: 112739 - DNA, 25 bp, Homo sapien
ctgagtagagttgtgttcgcacagc

SEQ ID NO: 112740 - DNA, 25 bp, Homo sapien
gcctcgggaacacggtctgagtaga

SEQ ID NO: 112741 - DNA, 25 bp, Homo sapien
gggcagccattgtgcctcgggaaca

SEQ ID NO: 112742 - DNA, 25 bp, Homo sapien
tcaccctgttctgtttctggggagg

SEQ ID NO: 112743 - DNA, 25 bp, Homo sapien
cggacggccttttcaccctgttctg

SEQ ID NO: 112744 - DNA, 25 bp, Homo sapien
actttcctcagttgcgaagggcacg

SEQ ID NO: 112745 - DNA, 25 bp, Homo sapien
gttgaagcccagtcaaccacacgtc

SEQ ID NO: 112746 - DNA, 25 bp, Homo sapien
tcccggcccacacctctttcctctc

SEQ ID NO: 112747 - DNA, 25 bp, Homo sapien
cgggaagcctctcttggcgtccctt

SEQ ID NO: 112748 - DNA, 25 bp, Homo sapien
tcaagctcttcctgcgccacgggca

SEQ ID NO: 112749 - DNA, 25 bp, Homo sapien
tcccagcctcgccatcgcggggcgt

SEQ ID NO: 112750 - DNA, 25 bp, Homo sapien
aaccacacgtcccagggcttaggcg

SEQ ID NO: 112751 - DNA, 25 bp, Homo sapien
agtcaaccacacgtcccagggctta

SEQ ID NO: 112752 - DNA, 25 bp, Homo sapien
ctgcaccgggttgaagcccagtcaa

SEQ ID NO: 112753 - DNA, 25 bp, Homo sapien
acctccgcggcgttattgttccgtg

SEQ ID NO: 112754 - DNA, 25 bp, Homo sapien
gcccaggcggcatccttacaaattg

SEQ ID NO: 112755 - DNA, 25 bp, Homo sapien
gggcactcggattcctcaattgctg

SEQ ID NO: 112756 - DNA, 25 bp, Homo sapien
accctcagggttcaggtctttggca

SEQ ID NO: 112757 - DNA, 25 bp, Homo sapien
gctccaactacaggcaccgaaaggt

SEQ ID NO: 112758 - DNA, 25 bp, Homo sapien
gggttcagcatctatacaggttgca

SEQ ID NO: 112759 - DNA, 25 bp, Homo sapien
cgtttctagcagatgtccgtccttc

SEQ ID NO: 112760 - DNA, 25 bp, Homo sapien
ctccgacgcagtgagcacttcatta

SEQ ID NO: 112761 - DNA, 25 bp, Homo sapien
ggtcggatggaagcctttttcagca

SEQ ID NO: 112762 - DNA, 25 bp, Homo sapien
tagtcctcttagacccgcgaccgga

SEQ ID NO: 112763 - DNA, 25 bp, Homo sapien
agtcagctctatgttcgcggtctta

SEQ ID NO: 112764 - DNA, 25 bp, Homo sapien
ccgagtccttgcaagaagtgaatta

SEQ ID NO: 112765 - DNA, 25 bp, Homo sapien
ttacccgaccctggtgagtagctgc

SEQ ID NO: 112766 - DNA, 25 bp, Homo sapien
gccagccaatctggtggccgctttc

SEQ ID NO: 112767 - DNA, 25 bp, Homo sapien
tgaaacggtacctcctgtcgcctcg

SEQ ID NO: 112768 - DNA, 25 bp, Homo sapien
ggctgtcactcttaggcctgtttta

SEQ ID NO: 112769 - DNA, 25 bp, Homo sapien
gcagcagctccagattcactgctct

SEQ ID NO: 112770 - DNA, 25 bp, Homo sapien
gcgcagcagctccagattcactgct

SEQ ID NO: 112771 - DNA, 25 bp, Homo sapien
gcagctccagattcactgctctccc

SEQ ID NO: 112772 - DNA, 25 bp, Homo sapien
cagtcgcgctcttaggacagcgccg

SEQ ID NO: 112773 - DNA, 25 bp, Homo sapien
agtcgcgctcttaggacagcgccgc

SEQ ID NO: 112774 - DNA, 25 bp, Homo sapien
cgcgctcttaggacagcgccgccac

SEQ ID NO: 112775 - DNA, 25 bp, Homo sapien
gggtcgggcgtcaaagcttggcgcg

SEQ ID NO: 112776 - DNA, 25 bp, Homo sapien
cgaagccggagatgggcagagagcg

SEQ ID NO: 112777 - DNA, 25 bp, Homo sapien
cgtctactgcgagtcaggccgtgat

SEQ ID NO: 112778 - DNA, 25 bp, Homo sapien
tcccgagcctggatcgcagttccaa

SEQ ID NO: 112779 - DNA, 25 bp, Homo sapien
gtctgcagttcctccgcgtctactg

SEQ ID NO: 112780 - DNA, 25 bp, Homo sapien
ccaaattaggccgtgggcggacacg

SEQ ID NO: 112781 - DNA, 25 bp, Homo sapien
ttctcgctgcttgtcaccattctct

SEQ ID NO: 112782 - DNA, 25 bp, Homo sapien
agttccaagtccaaggctcggcggg

SEQ ID NO: 112783 - DNA, 25 bp, Homo sapien
ggacacgcctgtatctgggacttta

SEQ ID NO: 112784 - DNA, 25 bp, Homo sapien
cctctcctttgtggagcccaaatta

SEQ ID NO: 112785 - DNA, 25 bp, Homo sapien
gttcctccgcctgggcaaaggcatc

SEQ ID NO: 112786 - DNA, 25 bp, Homo sapien
caaaggcatcgagggtaccgcaagt

SEQ ID NO: 112787 - DNA, 25 bp, Homo sapien
tggcgccgaccgaaataactccagt

SEQ ID NO: 112788 - DNA, 25 bp, Homo sapien
cctctatgctcaggtcgcatcgttc

SEQ ID NO: 112789 - DNA, 25 bp, Homo sapien
tcctccgctgcagagaacaacgctg

SEQ ID NO: 112790 - DNA, 25 bp, Homo sapien
ccggaactttcctgacatagcactt

SEQ ID NO: 112791 - DNA, 25 bp, Homo sapien
atggctccatgtagtccctcccgga

SEQ ID NO: 112792 - DNA, 25 bp, Homo sapien
ctagaaggcctaaccgctcagacgg

SEQ ID NO: 112793 - DNA, 25 bp, Homo sapien
gctcggttctctaggttgaaattcc

SEQ ID NO: 112794 - DNA, 25 bp, Homo sapien
tcctgataccgcgaatcactagtgc

SEQ ID NO: 112795 - DNA, 25 bp, Homo sapien
acattatgcgctcaggttcaggccg

SEQ ID NO: 112796 - DNA, 25 bp, Homo sapien
gcgacagagggcttcatcttgctga

SEQ ID NO: 112797 - DNA, 25 bp, Homo sapien
agtctcaatgtcaccggcctggcgg

SEQ ID NO: 112798 - DNA, 25 bp, Homo sapien
agacccacggttgcttttaacgctg

SEQ ID NO: 112799 - DNA, 25 bp, Homo sapien
tgctgatttcccgttccgctcggtt

SEQ ID NO: 112800 - DNA, 25 bp, Homo sapien
ctctgcccagggcatttaaaaggga

SEQ ID NO: 112801 - DNA, 25 bp, Homo sapien
gcggagccctgtggcgtctgaaccc

SEQ ID NO: 112802 - DNA, 25 bp, Homo sapien
agtcagcgggacgtgccacctgcag

SEQ ID NO: 112803 - DNA, 25 bp, Homo sapien
tgcagtgctggctagggctttttat

SEQ ID NO: 112804 - DNA, 25 bp, Homo sapien
gctggctagggctttttatttacta

SEQ ID NO: 112805 - DNA, 25 bp, Homo sapien
gtgcgtctccagtctgacgcgaccg

SEQ ID NO: 112806 - DNA, 25 bp, Homo sapien
tgccaaggtgcgtctccagtctgac

SEQ ID NO: 112807 - DNA, 25 bp, Homo sapien
ctcagtcgccgcagtggtggctaca

SEQ ID NO: 112808 - DNA, 25 bp, Homo sapien
tggctacagactgcgcatgtgaccc

SEQ ID NO: 112809 - DNA, 25 bp, Homo sapien
gactccaggcgactccttggccggg

SEQ ID NO: 112810 - DNA, 25 bp, Homo sapien
tgccgcgtgtcccttaaaagctggg

SEQ ID NO: 112811 - DNA, 25 bp, Homo sapien
gcctctgcgaccctatgaactctga

SEQ ID NO: 112812 - DNA, 25 bp, Homo sapien
cctgggacaggaacgacagacaatg

SEQ ID NO: 112813 - DNA, 25 bp, Homo sapien
aatgcagccaatggcgtcacgcgcg

SEQ ID NO: 112814 - DNA, 25 bp, Homo sapien
ctacccaatcgaaaggcgtggctga

SEQ ID NO: 112815 - DNA, 25 bp, Homo sapien
tcggtcagttcctcgggcgagttac

SEQ ID NO: 112816 - DNA, 25 bp, Homo sapien
tgagagcatcctcactcggtcagtt

SEQ ID NO: 112817 - DNA, 25 bp, Homo sapien
cccagaccaccaacaggaatctttg

SEQ ID NO: 112818 - DNA, 25 bp, Homo sapien
tagaactgcgccctccgcaacgttt

SEQ ID NO: 112819 - DNA, 25 bp, Homo sapien
agcagcagggtggagaacgctccct

SEQ ID NO: 112820 - DNA, 25 bp, Homo sapien
gtgcctgtcgtacccgctcacattt

SEQ ID NO: 112821 - DNA, 25 bp, Homo sapien
tctaaaccgcaaacaggcgaaattc

SEQ ID NO: 112822 - DNA, 25 bp, Homo sapien
gctaccaatcgcctcgcgatatctg

SEQ ID NO: 112823 - DNA, 25 bp, Homo sapien
tatctgcgcggaaacagtcggagcc

SEQ ID NO: 112824 - DNA, 25 bp, Homo sapien
gtacccggctgcagcaaggacccgg

SEQ ID NO: 112825 - DNA, 25 bp, Homo sapien
gagagcgcgcgccaagtttcaaatg

SEQ ID NO: 112826 - DNA, 25 bp, Homo sapien
aatgtcgccagtctttccagaagcc

SEQ ID NO: 112827 - DNA, 25 bp, Homo sapien
ggcgggaattttccagcctcaaata

SEQ ID NO: 112828 - DNA, 25 bp, Homo sapien
aagtcactatttacgaccgcgtcga

SEQ ID NO: 112829 - DNA, 25 bp, Homo sapien
gcctctgccgtatctgctaactttg

SEQ ID NO: 112830 - DNA, 25 bp, Homo sapien
actgccaagtcagagcgtgcgttcc

SEQ ID NO: 112831 - DNA, 25 bp, Homo sapien
ccacttgatcttggagttcgcgaag

SEQ ID NO: 112832 - DNA, 25 bp, Homo sapien
ggtccactccaacccagagatcgga

SEQ ID NO: 112833 - DNA, 25 bp, Homo sapien
ttcactgtcaaagccaactgcgagc

SEQ ID NO: 112834 - DNA, 25 bp, Homo sapien
gccgcaagcccttcgagtgcaagga

SEQ ID NO: 112835 - DNA, 25 bp, Homo sapien
aaggccacccgcaaggatatcgaga

SEQ ID NO: 112836 - DNA, 25 bp, Homo sapien
agcggccctacatttgcaagatctg

SEQ ID NO: 112837 - DNA, 25 bp, Homo sapien
tgggcatctcgccataccagtgcaa

SEQ ID NO: 112838 - DNA, 25 bp, Homo sapien
tgcaaccaggtgtttgccttctcgg

SEQ ID NO: 112839 - DNA, 25 bp, Homo sapien
ccgctgagcatggaggccaagatca

SEQ ID NO: 112840 - DNA, 25 bp, Homo sapien
ggcgaggacctcaagcactatcgtg

SEQ ID NO: 112841 - DNA, 25 bp, Homo sapien
tccatcctttccatagcagtctctc

SEQ ID NO: 112842 - DNA, 25 bp, Homo sapien
acaggacctcactaccgagttcggg

SEQ ID NO: 112843 - DNA, 25 bp, Homo sapien
ggccgaggctaggacacaggacctc

SEQ ID NO: 112844 - DNA, 25 bp, Homo sapien
cgctgggaagccttagctctcgctt

SEQ ID NO: 112845 - DNA, 25 bp, Homo sapien
aggcgctcttcgaccacggaacatc

SEQ ID NO: 112846 - DNA, 25 bp, Homo sapien
agccaggacctgcctaggcgctctt

SEQ ID NO: 112847 - DNA, 25 bp, Homo sapien
cggacaaaaatgcgccctccctgga

SEQ ID NO: 112848 - DNA, 25 bp, Homo sapien
gaagccttagctctcgctttctacc

SEQ ID NO: 112849 - DNA, 25 bp, Homo sapien
gccggacatcaagccctcggtggtg

SEQ ID NO: 112850 - DNA, 25 bp, Homo sapien
caacggcggcttgctctactcgcag

SEQ ID NO: 112851 - DNA, 25 bp, Homo sapien
cagcggcggatcaaactgggattta

SEQ ID NO: 112852 - DNA, 25 bp, Homo sapien
ctctgggcaccctgtatggcaacgt

SEQ ID NO: 112853 - DNA, 25 bp, Homo sapien
caccatctgcaggtttgaggccctg

SEQ ID NO: 112854 - DNA, 25 bp, Homo sapien
gcatagacaagatcgcagcgcaagg

SEQ ID NO: 112855 - DNA, 25 bp, Homo sapien
ggcgcaagcggaaaaagcggacctc

SEQ ID NO: 112856 - DNA, 25 bp, Homo sapien
gctcaccagtggatcaccgcgctgt

SEQ ID NO: 112857 - DNA, 25 bp, Homo sapien
tctgagctccaggtccgcgaaaaga

SEQ ID NO: 112858 - DNA, 25 bp, Homo sapien
attcttctgtccgtgggagctctga

SEQ ID NO: 112859 - DNA, 25 bp, Homo sapien
ggccttgtgcctcgagaaatgtgaa

SEQ ID NO: 112860 - DNA, 25 bp, Homo sapien
agtgtatcatcctatgggctgcaga

SEQ ID NO: 112861 - DNA, 25 bp, Homo sapien
ggccgcctcagttccttcgaagatg

SEQ ID NO: 112862 - DNA, 25 bp, Homo sapien
taaattgattcagagccaggccgcc

SEQ ID NO: 112863 - DNA, 25 bp, Homo sapien
caacgtgggaaggatctcagcatta

SEQ ID NO: 112864 - DNA, 25 bp, Homo sapien
atcgccggtgatgtcctatcgcaga

SEQ ID NO: 112865 - DNA, 25 bp, Homo sapien
cacaccctggagcaagagacacttg

SEQ ID NO: 112866 - DNA, 25 bp, Homo sapien
ccgagccttgatgggaatgacttac

SEQ ID NO: 112867 - DNA, 25 bp, Homo sapien
ggaaaagttgcacctaccagcggta

SEQ ID NO: 112868 - DNA, 25 bp, Homo sapien
cagttcagaccgctacgctgtcaga

SEQ ID NO: 112869 - DNA, 25 bp, Homo sapien
cagggagcgccaaagacatagacta

SEQ ID NO: 112870 - DNA, 25 bp, Homo sapien
tctgggcggctaaagaactgatggc

SEQ ID NO: 112871 - DNA, 25 bp, Homo sapien
ctggctcttggctctaggtttaaga

SEQ ID NO: 112872 - DNA, 25 bp, Homo sapien
cgctagcgcccaccgaagttactga

SEQ ID NO: 112873 - DNA, 25 bp, Homo sapien
tctagacgcaggagttggcaagccc

SEQ ID NO: 112874 - DNA, 25 bp, Homo sapien
aagaggtaccttggccttgccgcgc

SEQ ID NO: 112875 - DNA, 25 bp, Homo sapien
gtcgcgaaggcccagacagcctagc

SEQ ID NO: 112876 - DNA, 25 bp, Homo sapien
tccagatgtcttgggtatagccgtc

SEQ ID NO: 112877 - DNA, 25 bp, Homo sapien
gaaatcagggattctctgcggctcc

SEQ ID NO: 112878 - DNA, 25 bp, Homo sapien
tcggacgtcgagctgttccactcta

SEQ ID NO: 112879 - DNA, 25 bp, Homo sapien
tgttccactctatcgcttcccaagg

SEQ ID NO: 112880 - DNA, 25 bp, Homo sapien
tgcccagtcgcaaaagaggtacctt

SEQ ID NO: 112881 - DNA, 25 bp, Homo sapien
gtttggggcccagaactgcaccgca

SEQ ID NO: 112882 - DNA, 25 bp, Homo sapien
tgggagagttctaaagcggcctttc

SEQ ID NO: 112883 - DNA, 25 bp, Homo sapien
cggcctttcgcctctcggaggaggt

SEQ ID NO: 112884 - DNA, 25 bp, Homo sapien
gaggaaatcactcagctctgaaaag

SEQ ID NO: 112885 - DNA, 25 bp, Homo sapien
tagagtccatctccgcgaactgggg

SEQ ID NO: 112886 - DNA, 25 bp, Homo sapien
agaactgcaccgcagggccgcagag

SEQ ID NO: 112887 - DNA, 25 bp, Homo sapien
ctcagtactggaggcctagagtcca

SEQ ID NO: 112888 - DNA, 25 bp, Homo sapien
ctctgaaaagcgtcgcaaacgggcg

SEQ ID NO: 112889 - DNA, 25 bp, Homo sapien
tgcgcgttcctaacctttgccagtg

SEQ ID NO: 112890 - DNA, 25 bp, Homo sapien
ccctcgcaaagggagatctgatctg

SEQ ID NO: 112891 - DNA, 25 bp, Homo sapien
gatctgctcagtctctaggtaaata

SEQ ID NO: 112892 - DNA, 25 bp, Homo sapien
ttatcccgtctccaaatgcgcgttc

SEQ ID NO: 112893 - DNA, 25 bp, Homo sapien
cctttatcccggctgaggagtcctc

SEQ ID NO: 112894 - DNA, 25 bp, Homo sapien
atgtaataaatcctggcggggccgg

SEQ ID NO: 112895 - DNA, 25 bp, Homo sapien
aaagccgcgccggaatgaaatcagc

SEQ ID NO: 112896 - DNA, 25 bp, Homo sapien
tcgaccgattctgcttttactttta

SEQ ID NO: 112897 - DNA, 25 bp, Homo sapien
tccggtgttccaccgcaatggggtc

SEQ ID NO: 112898 - DNA, 25 bp, Homo sapien
tggggtcaagagttatgaacacttc

SEQ ID NO: 112899 - DNA, 25 bp, Homo sapien
gaacacttcgtgtcctcaggagctc

SEQ ID NO: 112900 - DNA, 25 bp, Homo sapien
tctgggtctgaagccgctacacaga

SEQ ID NO: 112901 - DNA, 25 bp, Homo sapien
ctcacgaagaccaggaagcggcctc

SEQ ID NO: 112902 - DNA, 25 bp, Homo sapien
gcccgtgctatctcctacatagttg

SEQ ID NO: 112903 - DNA, 25 bp, Homo sapien
catagttgccttccgaacgcctgga

SEQ ID NO: 112904 - DNA, 25 bp, Homo sapien
tgggcttaggggtcccattccactc

SEQ ID NO: 112905 - DNA, 25 bp, Homo sapien
agaaagagcccgaggcacgtcagca

SEQ ID NO: 112906 - DNA, 25 bp, Homo sapien
cctcacagcctgcaggcagactgta

SEQ ID NO: 112907 - DNA, 25 bp, Homo sapien
gcagactgtagcgtagaaagagccc

SEQ ID NO: 112908 - DNA, 25 bp, Homo sapien
aggcacgtcagcagttctcaagggc

SEQ ID NO: 112909 - DNA, 25 bp, Homo sapien
cccggcgccaaaggaagaagacaga

SEQ ID NO: 112910 - DNA, 25 bp, Homo sapien
tagatgcggcacaaccgccgcaagc

SEQ ID NO: 112911 - DNA, 25 bp, Homo sapien
cgactctctagatgcggcacaaccg

SEQ ID NO: 112912 - DNA, 25 bp, Homo sapien
ttcaccagcgaccaggcagcgcgag

SEQ ID NO: 112913 - DNA, 25 bp, Homo sapien
gcccgatgggaaaagctgctggcca

SEQ ID NO: 112914 - DNA, 25 bp, Homo sapien
gccgcacgcgcttcgtatttcagaa

SEQ ID NO: 112915 - DNA, 25 bp, Homo sapien
gccaggtgttcgaatcccgactcca

SEQ ID NO: 112916 - DNA, 25 bp, Homo sapien
cgctctcgaatctggggtgacagga

SEQ ID NO: 112917 - DNA, 25 bp, Homo sapien
ccgccaagctcaggttagtccgtta

SEQ ID NO: 112918 - DNA, 25 bp, Homo sapien
cttgaggctgaagctgacaatctta

SEQ ID NO: 112919 - DNA, 25 bp, Homo sapien
cgtttgcacccgtttgtctcctagc

SEQ ID NO: 112920 - DNA, 25 bp, Homo sapien
cctacagcacttcggagacgggctc

SEQ ID NO: 112921 - DNA, 25 bp, Homo sapien
gcgtatccgagaggcagcagcatct

SEQ ID NO: 112922 - DNA, 25 bp, Homo sapien
tccaggtccctaaccctgtggaatc

SEQ ID NO: 112923 - DNA, 25 bp, Homo sapien
cctcaccaatgcagaaacgcgtatc

SEQ ID NO: 112924 - DNA, 25 bp, Homo sapien
agcctgggcaagctacataaccttc

SEQ ID NO: 112925 - DNA, 25 bp, Homo sapien
tgggtcacttccctaaactcggctc

SEQ ID NO: 112926 - DNA, 25 bp, Homo sapien
gcagctcgttagatgcgctcccgaa

SEQ ID NO: 112927 - DNA, 25 bp, Homo sapien
cttgcggtgcaaggccttaatcgca

SEQ ID NO: 112928 - DNA, 25 bp, Homo sapien
tgacgcgcagacaggaacagccttg

SEQ ID NO: 112929 - DNA, 25 bp, Homo sapien
gtgtaaagccactctcgtctcctga

SEQ ID NO: 112930 - DNA, 25 bp, Homo sapien
gacagccggcttgaggctccttata

SEQ ID NO: 112931 - DNA, 25 bp, Homo sapien
aggccatgtccaacgtcagtaaaac

SEQ ID NO: 112932 - DNA, 25 bp, Homo sapien
gacttgaacccagctctcgagttga

SEQ ID NO: 112933 - DNA, 25 bp, Homo sapien
tctcgagttgatagccaggtacatg

SEQ ID NO: 112934 - DNA, 25 bp, Homo sapien
tccaggtggagacagcagcttgacc

SEQ ID NO: 112935 - DNA, 25 bp, Homo sapien
ccgcgagcgaccctacatgaatatg

SEQ ID NO: 112936 - DNA, 25 bp, Homo sapien
ggcgtcgtcagtcggataaacacta

SEQ ID NO: 112937 - DNA, 25 bp, Homo sapien
aacagaggcgggataaagtcaccta

SEQ ID NO: 112938 - DNA, 25 bp, Homo sapien
cgcacggcctggacgaagcaaagcc

SEQ ID NO: 112939 - DNA, 25 bp, Homo sapien
acggcctggacgaagcaaagccaac

SEQ ID NO: 112940 - DNA, 25 bp, Homo sapien
ggcctggacgaagcaaagccaaccc

SEQ ID NO: 112941 - DNA, 25 bp, Homo sapien
cccagtgcatgctgcgcggctggct

SEQ ID NO: 112942 - DNA, 25 bp, Homo sapien
cgtgatgtcattgctccccggggca

SEQ ID NO: 112943 - DNA, 25 bp, Homo sapien
cagaggcgggataaagtcacctacc

SEQ ID NO: 112944 - DNA, 25 bp, Homo sapien
gaacgcgcaggactcacctggggcg

SEQ ID NO: 112945 - DNA, 25 bp, Homo sapien
ccaagccttaggtttcgcgctgacc

SEQ ID NO: 112946 - DNA, 25 bp, Homo sapien
cgccaacgggactatgcgaggttta

SEQ ID NO: 112947 - DNA, 25 bp, Homo sapien
ggaccactggtcctgagctcttttc

SEQ ID NO: 112948 - DNA, 25 bp, Homo sapien
gcctgcgcttttccagacaggacca

SEQ ID NO: 112949 - DNA, 25 bp, Homo sapien
caattgactgcatgcgaaggacctc

SEQ ID NO: 112950 - DNA, 25 bp, Homo sapien
agggacgcgcagcttttgtattaca

SEQ ID NO: 112951 - DNA, 25 bp, Homo sapien
tccgagatcactttcgccgtctgca

SEQ ID NO: 112952 - DNA, 25 bp, Homo sapien
agacgccagcgctcgcaattgactg

SEQ ID NO: 112953 - DNA, 25 bp, Homo sapien
aagatggcgcccgatttgtctcacc

SEQ ID NO: 112954 - DNA, 25 bp, Homo sapien
cgatgcttctacttcttcgggaaca

SEQ ID NO: 112955 - DNA, 25 bp, Homo sapien
ccggcaagtgcccacgtataattgt

SEQ ID NO: 112956 - DNA, 25 bp, Homo sapien
gcagcgtacgcagcctattttaagt

SEQ ID NO: 112957 - DNA, 25 bp, Homo sapien
cggaccgcagcgctttaaaggaatg

SEQ ID NO: 112958 - DNA, 25 bp, Homo sapien
agcgctctgatttaccaagtctggc

SEQ ID NO: 112959 - DNA, 25 bp, Homo sapien
gatgggaccgtgagcactctcttta

SEQ ID NO: 112960 - DNA, 25 bp, Homo sapien
ttctcgtccgagaggaaactctgtg

SEQ ID NO: 112961 - DNA, 25 bp, Homo sapien
cgcggccgagaaaaggtcctcagag

SEQ ID NO: 112962 - DNA, 25 bp, Homo sapien
aggccaccgagagaacgtttgctta

SEQ ID NO: 112963 - DNA, 25 bp, Homo sapien
atgcgctcccacacaggtaaccagg

SEQ ID NO: 112964 - DNA, 25 bp, Homo sapien
tcctcagagaagagcgacgatgaca

SEQ ID NO: 112965 - DNA, 25 bp, Homo sapien
gagcttcaagttcctgggcaccctg

SEQ ID NO: 112966 - DNA, 25 bp, Homo sapien
tggacctggacttcgccaccaagct

SEQ ID NO: 112967 - DNA, 25 bp, Homo sapien
gggcgaagtgctagacctcacctca

SEQ ID NO: 112968 - DNA, 25 bp, Homo sapien
ctgcagcgtgtgcaacaagcggttc

SEQ ID NO: 112969 - DNA, 25 bp, Homo sapien
agaccgagaaactgcggcgaccata

SEQ ID NO: 112970 - DNA, 25 bp, Homo sapien
gtcaaggtcgccgaagcgaagaccg

SEQ ID NO: 112971 - DNA, 25 bp, Homo sapien
cgccgaagcgaagaccgagaaactg

SEQ ID NO: 112972 - DNA, 25 bp, Homo sapien
agaaactgcggcgaccataccgccg

SEQ ID NO: 112973 - DNA, 25 bp, Homo sapien
tgcgaccaaagcgccgcgttctcaa

SEQ ID NO: 112974 - DNA, 25 bp, Homo sapien
ccgcagcgtctacaacctggggaga

SEQ ID NO: 112975 - DNA, 25 bp, Homo sapien
cttgcgtggcgcctgcgttctgcgt

SEQ ID NO: 112976 - DNA, 25 bp, Homo sapien
gcgttctgcgtgtccgcagagcccg

SEQ ID NO: 112977 - DNA, 25 bp, Homo sapien
gcactcggaactgagctgggatcca

SEQ ID NO: 112978 - DNA, 25 bp, Homo sapien
ctgacccttggaggtgctgagattg

SEQ ID NO: 112979 - DNA, 25 bp, Homo sapien
ctcgcgagagcgtcttgagaattct

SEQ ID NO: 112980 - DNA, 25 bp, Homo sapien
ctatcgacaaaagttccggcccgcg

SEQ ID NO: 112981 - DNA, 25 bp, Homo sapien
ggtaaccgcgctcctcgatcaaatc

SEQ ID NO: 112982 - DNA, 25 bp, Homo sapien
cccaggtgagaagacggaagatcgc

SEQ ID NO: 112983 - DNA, 25 bp, Homo sapien
ccgcggcctagctaaaccaagaatc

SEQ ID NO: 112984 - DNA, 25 bp, Homo sapien
ctgccatggaacacagcttgccctg

SEQ ID NO: 112985 - DNA, 25 bp, Homo sapien
tgcagatccagcaaaagacccgaga

SEQ ID NO: 112986 - DNA, 25 bp, Homo sapien
agcgctaagcgatctgcctaataga

SEQ ID NO: 112987 - DNA, 25 bp, Homo sapien
gcctaatagagggaacgccagctga

SEQ ID NO: 112988 - DNA, 25 bp, Homo sapien
ctgcgtgagccgatctgcagatcca

SEQ ID NO: 112989 - DNA, 25 bp, Homo sapien
cccgagagcggcttgaacgccagat

SEQ ID NO: 112990 - DNA, 25 bp, Homo sapien
tgaacgccagatgattcctccctga

SEQ ID NO: 112991 - DNA, 25 bp, Homo sapien
gggttcggcctcacacacctgtcga

SEQ ID NO: 112992 - DNA, 25 bp, Homo sapien
tgcgcgactgcaaagtctggcatgc

SEQ ID NO: 112993 - DNA, 25 bp, Homo sapien
agccgaattacgtctgcctggcatc

SEQ ID NO: 112994 - DNA, 25 bp, Homo sapien
cgctctgaagccgaattacgtctgc

SEQ ID NO: 112995 - DNA, 25 bp, Homo sapien
tttgcttaagcaaggcgctctgaag

SEQ ID NO: 112996 - DNA, 25 bp, Homo sapien
cacacagccttttgcttaagcaagg

SEQ ID NO: 112997 - DNA, 25 bp, Homo sapien
tggggaacgtacacacagccttttg

SEQ ID NO: 112998 - DNA, 25 bp, Homo sapien
ggactcctggggaacgtacacacag

SEQ ID NO: 112999 - DNA, 25 bp, Homo sapien
gtgaccagggccagcctttgccagc

SEQ ID NO: 113000 - DNA, 25 bp, Homo sapien
tctgcctggcatcccgaaacactga

SEQ ID NO: 113001 - DNA, 25 bp, Homo sapien
gagacaggagcgagccttccctttc

SEQ ID NO: 113002 - DNA, 25 bp, Homo sapien
tgggcccgcagagatcccaagcgct

SEQ ID NO: 113003 - DNA, 25 bp, Homo sapien
ctaaggccggttcactgcgcattgt

SEQ ID NO: 113004 - DNA, 25 bp, Homo sapien
gcctcgagcttttctgcacgtgagc

SEQ ID NO: 113005 - DNA, 25 bp, Homo sapien
ccgcaggctgctttctaggatttga

SEQ ID NO: 113006 - DNA, 25 bp, Homo sapien
cacttgcacttcagcgcgcggttct

SEQ ID NO: 113007 - DNA, 25 bp, Homo sapien
cagatgcccgaggtcagacagtttc

SEQ ID NO: 113008 - DNA, 25 bp, Homo sapien
gacgtcagtcattggctgcaggtta

SEQ ID NO: 113009 - DNA, 25 bp, Homo sapien
tgggacttagctctccgtagcctgc

SEQ ID NO: 113010 - DNA, 25 bp, Homo sapien
atccaccggccatgcaattaagggg

SEQ ID NO: 113011 - DNA, 25 bp, Homo sapien
gccctattcagacccggccttaatg

SEQ ID NO: 113012 - DNA, 25 bp, Homo sapien
tgtggtctgaaagaagccgctcatc

SEQ ID NO: 113013 - DNA, 25 bp, Homo sapien
ccagcctcgttagggcaacctgtta

SEQ ID NO: 113014 - DNA, 25 bp, Homo sapien
gccttgcccgaacggttctactgtg

SEQ ID NO: 113015 - DNA, 25 bp, Homo sapien
atttcgctttaacggagactctgga

SEQ ID NO: 113016 - DNA, 25 bp, Homo sapien
gggacctgaaactcaaggcctttga

SEQ ID NO: 113017 - DNA, 25 bp, Homo sapien
gacgctcaccaaaaatgtcatcctg

SEQ ID NO: 113018 - DNA, 25 bp, Homo sapien
gcggcagttcccttttggcacaaaa

SEQ ID NO: 113019 - DNA, 25 bp, Homo sapien
ccgggtggtcctttcactacacacg

SEQ ID NO: 113020 - DNA, 25 bp, Homo sapien
cccagaccgtcattgtaaaagatcc

SEQ ID NO: 113021 - DNA, 25 bp, Homo sapien
gctccctgcaaaattttattctctg

SEQ ID NO: 113022 - DNA, 25 bp, Homo sapien
cccgagatcgtcctgggtacctaga

SEQ ID NO: 113023 - DNA, 25 bp, Homo sapien
cagaatttcatcctgtgcacccaca

SEQ ID NO: 113024 - DNA, 25 bp, Homo sapien
tgtcatcctgctcacctaggtccta

SEQ ID NO: 113025 - DNA, 25 bp, Homo sapien
tctctcaccaaactccgcgcccttg

SEQ ID NO: 113026 - DNA, 25 bp, Homo sapien
tgagtgccgactgctgcatcccggc

SEQ ID NO: 113027 - DNA, 25 bp, Homo sapien
ggcaacaatgcacggagccgccaga

SEQ ID NO: 113028 - DNA, 25 bp, Homo sapien
aaggacctggagcacccgagcgcct

SEQ ID NO: 113029 - DNA, 25 bp, Homo sapien
actcgcgcccttccaaggacctgga

SEQ ID NO: 113030 - DNA, 25 bp, Homo sapien
gcggctctctggctagcgcgcagct

SEQ ID NO: 113031 - DNA, 25 bp, Homo sapien
cgctagcggtgccaaaaggctcccg

SEQ ID NO: 113032 - DNA, 25 bp, Homo sapien
cgcccttgcgctagcggtgccaaaa

SEQ ID NO: 113033 - DNA, 25 bp, Homo sapien
gggccaaaccactagctttgactcc

SEQ ID NO: 113034 - DNA, 25 bp, Homo sapien
gccaaaggtcggcaaacagcgaccg

SEQ ID NO: 113035 - DNA, 25 bp, Homo sapien
cgccagggccaaaccactagctttg

SEQ ID NO: 113036 - DNA, 25 bp, Homo sapien
ccctgaccagagagacttatagcac

SEQ ID NO: 113037 - DNA, 25 bp, Homo sapien
agagagacttatagcactcgcccgc

SEQ ID NO: 113038 - DNA, 25 bp, Homo sapien
acttatagcactcgcccgctttggg

SEQ ID NO: 113039 - DNA, 25 bp, Homo sapien
cgtcccaggagccaaaggtcggcaa

SEQ ID NO: 113040 - DNA, 25 bp, Homo sapien
tctgagagtccagaggcccaaccgg

SEQ ID NO: 113041 - DNA, 25 bp, Homo sapien
ggtctcaaagcctatccgggtggtg

SEQ ID NO: 113042 - DNA, 25 bp, Homo sapien
ctcgcgcaagtatgggctcaagatc

SEQ ID NO: 113043 - DNA, 25 bp, Homo sapien
gtcatgccggcctttacagtctaca

SEQ ID NO: 113044 - DNA, 25 bp, Homo sapien
gctcaaattgcacttcggcgggctg

SEQ ID NO: 113045 - DNA, 25 bp, Homo sapien
gctgctgaagtatccggagtccatc

SEQ ID NO: 113046 - DNA, 25 bp, Homo sapien
ggagtccatctcctacttcagcggg

SEQ ID NO: 113047 - DNA, 25 bp, Homo sapien
atcgaccgagagatcgccatgcaca

SEQ ID NO: 113048 - DNA, 25 bp, Homo sapien
tactgtggcaagctgtactcgcgca

SEQ ID NO: 113049 - DNA, 25 bp, Homo sapien
caggcgtaactggtctttgtggaaa

SEQ ID NO: 113050 - DNA, 25 bp, Homo sapien
gccaacgtgtttagttccagaagga

SEQ ID NO: 113051 - DNA, 25 bp, Homo sapien
gccacccaggtgtgagttgtgaaga

SEQ ID NO: 113052 - DNA, 25 bp, Homo sapien
cgggagtggctagaactaccgtttg

SEQ ID NO: 113053 - DNA, 25 bp, Homo sapien
ccgcgtttaggtggacagtccagga

SEQ ID NO: 113054 - DNA, 25 bp, Homo sapien
cgctcccattggtgcattccttgga

SEQ ID NO: 113055 - DNA, 25 bp, Homo sapien
cctgagccgagcataagccgcaatt

SEQ ID NO: 113056 - DNA, 25 bp, Homo sapien
ccgcaggactctactcagggaaaag

SEQ ID NO: 113057 - DNA, 25 bp, Homo sapien
cggtgatgcgctgacagaaggtaaa

SEQ ID NO: 113058 - DNA, 25 bp, Homo sapien
catgcgtgtccaggaacagcgacca

SEQ ID NO: 113059 - DNA, 25 bp, Homo sapien
ttgcaaataaaatgcggactgcgcg

SEQ ID NO: 113060 - DNA, 25 bp, Homo sapien
ctggcttttagcgtccatgcgtgtc

SEQ ID NO: 113061 - DNA, 25 bp, Homo sapien
cagcgaccagggcaagtgcttgagt

SEQ ID NO: 113062 - DNA, 25 bp, Homo sapien
cgacccaaaggcctccggtgatgcg

SEQ ID NO: 113063 - DNA, 25 bp, Homo sapien
gcacccgcttcgctttgcaaataaa

SEQ ID NO: 113064 - DNA, 25 bp, Homo sapien
gactgcgcgagaaagcctggctttt

SEQ ID NO: 113065 - DNA, 25 bp, Homo sapien
cagcggggttacctttgccacttca

SEQ ID NO: 113066 - DNA, 25 bp, Homo sapien
cgcgcgtgaccaaaaacggctctca

SEQ ID NO: 113067 - DNA, 25 bp, Homo sapien
actgcaggtctatccgctaagcgcg

SEQ ID NO: 113068 - DNA, 25 bp, Homo sapien
caaactttgtaccttctggggatgg

SEQ ID NO: 113069 - DNA, 25 bp, Homo sapien
tcgtaggtgcctccacagagccaaa

SEQ ID NO: 113070 - DNA, 25 bp, Homo sapien
ttctttgccgagtgtgaaaccagcc

SEQ ID NO: 113071 - DNA, 25 bp, Homo sapien
cgccacttcagttcagcctctttag

SEQ ID NO: 113072 - DNA, 25 bp, Homo sapien
gtggggtgccttcgcgaataaaatc

SEQ ID NO: 113073 - DNA, 25 bp, Homo sapien
ttagcccacgcagctttcagtcatg

SEQ ID NO: 113074 - DNA, 25 bp, Homo sapien
ctggttgcccgtgagtccagcctta

SEQ ID NO: 113075 - DNA, 25 bp, Homo sapien
cagtcatggcctccgtaatcgcgcg

SEQ ID NO: 113076 - DNA, 25 bp, Homo sapien
cgttcagcgaccatgccgaggactt

SEQ ID NO: 113077 - DNA, 25 bp, Homo sapien
tgacttcaaggccaccgccgtggtg

SEQ ID NO: 113078 - DNA, 25 bp, Homo sapien
ggtggatggatagcgctttcaaaga

SEQ ID NO: 113079 - DNA, 25 bp, Homo sapien
ctacaaagagaaatacgtggtcctc

SEQ ID NO: 113080 - DNA, 25 bp, Homo sapien
taatcgcgcgcatggcatagcccgc

SEQ ID NO: 113081 - DNA, 25 bp, Homo sapien
ccaggcaggctgttttgtcagctgc

SEQ ID NO: 113082 - DNA, 25 bp, Homo sapien
cgcgggcaaacccaatcttggttca

SEQ ID NO: 113083 - DNA, 25 bp, Homo sapien
tcactttggcgtctcggaactgaca

SEQ ID NO: 113084 - DNA, 25 bp, Homo sapien
tcggaactgacagggctccgtcaga

SEQ ID NO: 113085 - DNA, 25 bp, Homo sapien
gggctccgtcagatcttccgtttcc

SEQ ID NO: 113086 - DNA, 25 bp, Homo sapien
cctcctgcgcgtccgtgatattgat

SEQ ID NO: 113087 - DNA, 25 bp, Homo sapien
ccgtgatattgattgacagcctctc

SEQ ID NO: 113088 - DNA, 25 bp, Homo sapien
atcttggttcactttggcgtctcgg

SEQ ID NO: 113089 - DNA, 25 bp, Homo sapien
actgttgtgcacgatggtcgcgtag

SEQ ID NO: 113090 - DNA, 25 bp, Homo sapien
cgctgacgatacagtgtggcctgga

SEQ ID NO: 113091 - DNA, 25 bp, Homo sapien
tggtcgcgtagctctgcacccatac

SEQ ID NO: 113092 - DNA, 25 bp, Homo sapien
agcactcgagggtcaaaatggcatt

SEQ ID NO: 113093 - DNA, 25 bp, Homo sapien
tgaaggggtctcagtcttgcactca

SEQ ID NO: 113094 - DNA, 25 bp, Homo sapien
tgcactcacgtgaggacatagttga

SEQ ID NO: 113095 - DNA, 25 bp, Homo sapien
gggtctcagtcttgcactcacgtga

SEQ ID NO: 113096 - DNA, 25 bp, Homo sapien
ggacatagttgacgctgacgataca

SEQ ID NO: 113097 - DNA, 25 bp, Homo sapien
gccttacgcaaatggtgcgcgcagc

SEQ ID NO: 113098 - DNA, 25 bp, Homo sapien
tgcgagggatttaaatcgtggctcc

SEQ ID NO: 113099 - DNA, 25 bp, Homo sapien
cacctgtcctcttgcgagggattta

SEQ ID NO: 113100 - DNA, 25 bp, Homo sapien
ggcccagtgtcggagaagtccctca

SEQ ID NO: 113101 - DNA, 25 bp, Homo sapien
ttagagaatttaggtgggcccagtg

SEQ ID NO: 113102 - DNA, 25 bp, Homo sapien
tccgcctatattagcggcccgcgga

SEQ ID NO: 113103 - DNA, 25 bp, Homo sapien
cccagaaatgcttcttccgcctata

SEQ ID NO: 113104 - DNA, 25 bp, Homo sapien
ggcccgcggatgttagagaatttag

SEQ ID NO: 113105 - DNA, 25 bp, Homo sapien
ggcacgcaccaatgtcccagttctg

SEQ ID NO: 113106 - DNA, 25 bp, Homo sapien
gcgcgcttttccctttctcagcaag

SEQ ID NO: 113107 - DNA, 25 bp, Homo sapien
agtcgctcggcaaaaacgtgatctc

SEQ ID NO: 113108 - DNA, 25 bp, Homo sapien
tgcttctctctgagacccgcgggtt

SEQ ID NO: 113109 - DNA, 25 bp, Homo sapien
tccacgcacacttagagccgaggtg

SEQ ID NO: 113110 - DNA, 25 bp, Homo sapien
tcgagcgtgttactggctcccacca

SEQ ID NO: 113111 - DNA, 25 bp, Homo sapien
gggctctcagatcgggattcctcca

SEQ ID NO: 113112 - DNA, 25 bp, Homo sapien
ctctctggtggagcatgatcaatca

SEQ ID NO: 113113 - DNA, 25 bp, Homo sapien
ttccctaaaggatgcccaagtctta

SEQ ID NO: 113114 - DNA, 25 bp, Homo sapien
gccaccgcgtcggtcactggaaagc

SEQ ID NO: 113115 - DNA, 25 bp, Homo sapien
catcgagccagaggcgatacacgtc

SEQ ID NO: 113116 - DNA, 25 bp, Homo sapien
tcctcgtcgataagggtcgtgttcc

SEQ ID NO: 113117 - DNA, 25 bp, Homo sapien
tccagctcactggtcatggcgacgc

SEQ ID NO: 113118 - DNA, 25 bp, Homo sapien
tcgggacccagcttatgaccacttc

SEQ ID NO: 113119 - DNA, 25 bp, Homo sapien
agcacgaagggagtgcctcctcttc

SEQ ID NO: 113120 - DNA, 25 bp, Homo sapien
taatggtccatggtgtcgctctgca

SEQ ID NO: 113121 - DNA, 25 bp, Homo sapien
ctgtaaagaggaggatgtcgccgtc

SEQ ID NO: 113122 - DNA, 25 bp, Homo sapien
ggatcttccagctacgcaccttgta

SEQ ID NO: 113123 - DNA, 25 bp, Homo sapien
acgcttggccaagacgcacttcatc

SEQ ID NO: 113124 - DNA, 25 bp, Homo sapien
gagcgctcgatctcatactctggga

SEQ ID NO: 113125 - DNA, 25 bp, Homo sapien
gcacgcgtctctgccacgactaatt

SEQ ID NO: 113126 - DNA, 25 bp, Homo sapien
gcgtcgcaggcatgtgtctacctta

SEQ ID NO: 113127 - DNA, 25 bp, Homo sapien
ggtctgccgggtgaatgtattcata

SEQ ID NO: 113128 - DNA, 25 bp, Homo sapien
ccttaccctgcacgaagtgagagtg

SEQ ID NO: 113129 - DNA, 25 bp, Homo sapien
agcgggcaaagactgcgttgcgact

SEQ ID NO: 113130 - DNA, 25 bp, Homo sapien
ctcccaaagcggctggaagacaccc

SEQ ID NO: 113131 - DNA, 25 bp, Homo sapien
gagcattttgaaggcctcccaaagc

SEQ ID NO: 113132 - DNA, 25 bp, Homo sapien
cgctgagcattttgaaggcctccca

SEQ ID NO: 113133 - DNA, 25 bp, Homo sapien
ctgcgctgagcattttgaaggcctc

SEQ ID NO: 113134 - DNA, 25 bp, Homo sapien
ggtgcgaagactgcgctgagcattt

SEQ ID NO: 113135 - DNA, 25 bp, Homo sapien
caaagactgcgttgcgactggggac

SEQ ID NO: 113136 - DNA, 25 bp, Homo sapien
ttcccgaagggtgcgaagactgcgc

SEQ ID NO: 113137 - DNA, 25 bp, Homo sapien
tccgcagccgagctctttagagaaa

SEQ ID NO: 113138 - DNA, 25 bp, Homo sapien
gtcgagtggccttcgtgttcagcct

SEQ ID NO: 113139 - DNA, 25 bp, Homo sapien
aagagagggaaattggtgcaaccag

SEQ ID NO: 113140 - DNA, 25 bp, Homo sapien
ttggtgcaaccagcccgaatcaagc

SEQ ID NO: 113141 - DNA, 25 bp, Homo sapien
gcccgaatcaagctcctagagcagt

SEQ ID NO: 113142 - DNA, 25 bp, Homo sapien
agcagtcactggtaggaggtccctt

SEQ ID NO: 113143 - DNA, 25 bp, Homo sapien
ggaggtcccttcacgcaccaaggcg

SEQ ID NO: 113144 - DNA, 25 bp, Homo sapien
cctgtgtggttgacctgagggcatc

SEQ ID NO: 113145 - DNA, 25 bp, Homo sapien
gacggggacctcgacatgattgtcc

SEQ ID NO: 113146 - DNA, 25 bp, Homo sapien
gcagacctggctgactgcgtgcttc

SEQ ID NO: 113147 - DNA, 25 bp, Homo sapien
tagacgactgcttgcccttcaggga

SEQ ID NO: 113148 - DNA, 25 bp, Homo sapien
agactggatctggacctaaggttta

SEQ ID NO: 113149 - DNA, 25 bp, Homo sapien
ggactcggacgatggcacctaaccc

SEQ ID NO: 113150 - DNA, 25 bp, Homo sapien
cttaggttctacttggcgcagggac

SEQ ID NO: 113151 - DNA, 25 bp, Homo sapien
tttggctatgccacctccctagagg

SEQ ID NO: 113152 - DNA, 25 bp, Homo sapien
gcgggcgaatcccacttaggttcta

SEQ ID NO: 113153 - DNA, 25 bp, Homo sapien
ccacaagcaacaccatatgctgctt

SEQ ID NO: 113154 - DNA, 25 bp, Homo sapien
acagcgagcgacatcggcaccaata

SEQ ID NO: 113155 - DNA, 25 bp, Homo sapien
cccgggtctacaccaagccgactag

SEQ ID NO: 113156 - DNA, 25 bp, Homo sapien
gaacgccgccctgctattcttctcc

SEQ ID NO: 113157 - DNA, 25 bp, Homo sapien
ttctgatcaaacagcgagcgacatc

SEQ ID NO: 113158 - DNA, 25 bp, Homo sapien
gcaccaataattgacgagaccggct

SEQ ID NO: 113159 - DNA, 25 bp, Homo sapien
taattgacgagaccggctggaaatc

SEQ ID NO: 113160 - DNA, 25 bp, Homo sapien
accatatgctgcttctgatcaaaca

SEQ ID NO: 113161 - DNA, 25 bp, Homo sapien
gacccaagtgtaggggcgccttctc

SEQ ID NO: 113162 - DNA, 25 bp, Homo sapien
ccgcgccacagctggaggcggacta

SEQ ID NO: 113163 - DNA, 25 bp, Homo sapien
caccacggaccagtgacgtcaagtg

SEQ ID NO: 113164 - DNA, 25 bp, Homo sapien
gcaggaggatttctccgcgcattcc

SEQ ID NO: 113165 - DNA, 25 bp, Homo sapien
tcacagcccattttgtcccaacttt

SEQ ID NO: 113166 - DNA, 25 bp, Homo sapien
cccaactttgttttagccaccagag

SEQ ID NO: 113167 - DNA, 25 bp, Homo sapien
ttagccaccagagcgcgtctgtgcg

SEQ ID NO: 113168 - DNA, 25 bp, Homo sapien
actagtgcgggtcctgtgcacctgc

SEQ ID NO: 113169 - DNA, 25 bp, Homo sapien
ggcggctgctgtcctaagtttcaca

SEQ ID NO: 113170 - DNA, 25 bp, Homo sapien
gtttcacaaattgcaaaacgatgca

SEQ ID NO: 113171 - DNA, 25 bp, Homo sapien
gatgcagaaaagatggccgggtctc

SEQ ID NO: 113172 - DNA, 25 bp, Homo sapien
atgtcctgaagcagccacggcggaa

SEQ ID NO: 113173 - DNA, 25 bp, Homo sapien
cagccacggcggaagcgctggcctt

SEQ ID NO: 113174 - DNA, 25 bp, Homo sapien
gatgtcatcagtgcgtctccctcct

SEQ ID NO: 113175 - DNA, 25 bp, Homo sapien
agcggcccgatgtcatcagtgcgtc

SEQ ID NO: 113176 - DNA, 25 bp, Homo sapien
tggccttgcacctggagactgcgag

SEQ ID NO: 113177 - DNA, 25 bp, Homo sapien
tagaatcctggtcctccgtagttgc

SEQ ID NO: 113178 - DNA, 25 bp, Homo sapien
ccgtagttgctacgaagccagttca

SEQ ID NO: 113179 - DNA, 25 bp, Homo sapien
gctctgaatcttactacccgcggga

SEQ ID NO: 113180 - DNA, 25 bp, Homo sapien
tttagcttcaacttcactccggggc

SEQ ID NO: 113181 - DNA, 25 bp, Homo sapien
ggctcccttttctggatcatgaatt

SEQ ID NO: 113182 - DNA, 25 bp, Homo sapien
ggggcgcccatctcttaactgttct

SEQ ID NO: 113183 - DNA, 25 bp, Homo sapien
gggcgtcttctgcttcacctacctt

SEQ ID NO: 113184 - DNA, 25 bp, Homo sapien
ctggaccttggctacctctttaact

SEQ ID NO: 113185 - DNA, 25 bp, Homo sapien
gtgacggcctctcgctaagtcctca

SEQ ID NO: 113186 - DNA, 25 bp, Homo sapien
taatctttgaacctaggttggagcc

SEQ ID NO: 113187 - DNA, 25 bp, Homo sapien
taacacctgtttttctaatctttga

SEQ ID NO: 113188 - DNA, 25 bp, Homo sapien
gcatgacgacgtaacacctgttttt

SEQ ID NO: 113189 - DNA, 25 bp, Homo sapien
gagagtgaattagcatgacgacgta

SEQ ID NO: 113190 - DNA, 25 bp, Homo sapien
cacacaactgtctgagccgcgttta

SEQ ID NO: 113191 - DNA, 25 bp, Homo sapien
ttggagccggaacgctgctccttca

SEQ ID NO: 113192 - DNA, 25 bp, Homo sapien
ccgcgtttaccgagagagtgaatta

SEQ ID NO: 113193 - DNA, 25 bp, Homo sapien
ctacagaaggtgaactttcggttgt

SEQ ID NO: 113194 - DNA, 25 bp, Homo sapien
cccgcaaaaggcaaaatcaagacta

SEQ ID NO: 113195 - DNA, 25 bp, Homo sapien
tcaagactacagaaggtgaactttc

SEQ ID NO: 113196 - DNA, 25 bp, Homo sapien
tcggttgtaaaagaacgagtgaaca

SEQ ID NO: 113197 - DNA, 25 bp, Homo sapien
acatactggaattccggtgcaaacc

SEQ ID NO: 113198 - DNA, 25 bp, Homo sapien
tggaattccggtgcaaaccgccgaa

SEQ ID NO: 113199 - DNA, 25 bp, Homo sapien
cgccgaaccggggttcaatgcctcg

SEQ ID NO: 113200 - DNA, 25 bp, Homo sapien
acgagtgaacacatactggaattcc

SEQ ID NO: 113201 - DNA, 25 bp, Homo sapien
cggattggctgtccttccataacga

SEQ ID NO: 113202 - DNA, 25 bp, Homo sapien
cgcgacctaggcgatggaagctcca

SEQ ID NO: 113203 - DNA, 25 bp, Homo sapien
tgctgcgggagaacctagcgcttaa

SEQ ID NO: 113204 - DNA, 25 bp, Homo sapien
tcgaggatcagtaacacccggagtg

SEQ ID NO: 113205 - DNA, 25 bp, Homo sapien
gctcaagcagctcaaccggcgtctg

SEQ ID NO: 113206 - DNA, 25 bp, Homo sapien
cccgatgattgaaggcactgcttcc

SEQ ID NO: 113207 - DNA, 25 bp, Homo sapien
ggccgcctcatgcaggaggtgaatc

SEQ ID NO: 113208 - DNA, 25 bp, Homo sapien
cgcgggttccttgacatcgaggatc

SEQ ID NO: 113209 - DNA, 25 bp, Homo sapien
cgaatcgggaattggcattccgtaa

SEQ ID NO: 113210 - DNA, 25 bp, Homo sapien
cactaggcagctccgaacgcgggga

SEQ ID NO: 113211 - DNA, 25 bp, Homo sapien
actcagtgacagtcgcagcttaacc

SEQ ID NO: 113212 - DNA, 25 bp, Homo sapien
tggttgcgtctccaagtcgtgagcc

SEQ ID NO: 113213 - DNA, 25 bp, Homo sapien
gtcgtgagcctccaatagctgctcc

SEQ ID NO: 113214 - DNA, 25 bp, Homo sapien
cccgggaaattaccactgtgctcgt

SEQ ID NO: 113215 - DNA, 25 bp, Homo sapien
attaccactgtgctcgtctgggccg

SEQ ID NO: 113216 - DNA, 25 bp, Homo sapien
agggcctcaggccactaggcagctc

SEQ ID NO: 113217 - DNA, 25 bp, Homo sapien
ggtcgcgcccagtcacagggaaccg

SEQ ID NO: 113218 - DNA, 25 bp, Homo sapien
tgccactgaaaaggatgacaggtcg

SEQ ID NO: 113219 - DNA, 25 bp, Homo sapien
ggactcgacctcatgccactgaaaa

SEQ ID NO: 113220 - DNA, 25 bp, Homo sapien
aaccgcgtgtgaggaccatcagtca

SEQ ID NO: 113221 - DNA, 25 bp, Homo sapien
cagacgcaaagacgcacagacccgg

SEQ ID NO: 113222 - DNA, 25 bp, Homo sapien
gggacgctccactttaccctggctg

SEQ ID NO: 113223 - DNA, 25 bp, Homo sapien
tccagcctctagtccgctgggttcg

SEQ ID NO: 113224 - DNA, 25 bp, Homo sapien
caacgtcggcacgtcgactcgtcga

SEQ ID NO: 113225 - DNA, 25 bp, Homo sapien
gcctttaaagcaagaggcgaggaac

SEQ ID NO: 113226 - DNA, 25 bp, Homo sapien
aggaggcgtgtctgtctctgccgcc

SEQ ID NO: 113227 - DNA, 25 bp, Homo sapien
tcggtctggtagctggggacttttc

SEQ ID NO: 113228 - DNA, 25 bp, Homo sapien
cacgaggtgtttgttttcaagagga

SEQ ID NO: 113229 - DNA, 25 bp, Homo sapien
gcattttccacctggagagaaggaa

SEQ ID NO: 113230 - DNA, 25 bp, Homo sapien
gaacagtagcgctgcggacgtccgt

SEQ ID NO: 113231 - DNA, 25 bp, Homo sapien
tggacggattcactgcgagtctttg

SEQ ID NO: 113232 - DNA, 25 bp, Homo sapien
actccgggctccttcacgaggtgtt

SEQ ID NO: 113233 - DNA, 25 bp, Homo sapien
ggatgctctccgactaacatggatg

SEQ ID NO: 113234 - DNA, 25 bp, Homo sapien
tgtggctcgctatcgacatctcgtc

SEQ ID NO: 113235 - DNA, 25 bp, Homo sapien
tctctatgaccatgccgtgatcgtg

SEQ ID NO: 113236 - DNA, 25 bp, Homo sapien
ggatgtcccaccattccttgcagtg

SEQ ID NO: 113237 - DNA, 25 bp, Homo sapien
caaggctgggtttcctactgatttc

SEQ ID NO: 113238 - DNA, 25 bp, Homo sapien
acatctcgtccgttaccaaggctgg

SEQ ID NO: 113239 - DNA, 25 bp, Homo sapien
tccttggcgcagtgagtgaagaaca

SEQ ID NO: 113240 - DNA, 25 bp, Homo sapien
tgctggatttctcccggatgctctc

SEQ ID NO: 113241 - DNA, 25 bp, Homo sapien
cgcttagagtgctgaacccttgcca

SEQ ID NO: 113242 - DNA, 25 bp, Homo sapien
ctcccgctaggactgtgattcgacc

SEQ ID NO: 113243 - DNA, 25 bp, Homo sapien
agtgacgtctctctagtgctcaaga

SEQ ID NO: 113244 - DNA, 25 bp, Homo sapien
ctttgcagttacacccaggagcgtc

SEQ ID NO: 113245 - DNA, 25 bp, Homo sapien
ccgcctttgatcctgtgttgggaca

SEQ ID NO: 113246 - DNA, 25 bp, Homo sapien
ctgccctaggtcgagccagatgttc

SEQ ID NO: 113247 - DNA, 25 bp, Homo sapien
cagcgcgtcccagcgtatgtaaatg

SEQ ID NO: 113248 - DNA, 25 bp, Homo sapien
ggtgtgaccaattccacggcctcta

SEQ ID NO: 113249 - DNA, 25 bp, Homo sapien
ctctcagctctggaaagtaaaagtg

SEQ ID NO: 113250 - DNA, 25 bp, Homo sapien
tcagctttcagttagtttttccacc

SEQ ID NO: 113251 - DNA, 25 bp, Homo sapien
cggttgagttgctccatcgctctct

SEQ ID NO: 113252 - DNA, 25 bp, Homo sapien
gaactgtagtttccagctggcagaa

SEQ ID NO: 113253 - DNA, 25 bp, Homo sapien
ctgagtatgcgggaagccacgcagc

SEQ ID NO: 113254 - DNA, 25 bp, Homo sapien
atcgacagacgttgcgagacctttg

SEQ ID NO: 113255 - DNA, 25 bp, Homo sapien
tcgggcctccggctggtattcctgc

SEQ ID NO: 113256 - DNA, 25 bp, Homo sapien
ggcgttttctcagctttcagttagt

SEQ ID NO: 113257 - DNA, 25 bp, Homo sapien
atggaaggttcaatctcgcgcgctc

SEQ ID NO: 113258 - DNA, 25 bp, Homo sapien
ccgagtctggcacgtgagcaacgtc

SEQ ID NO: 113259 - DNA, 25 bp, Homo sapien
agtgacaggtctcgcagcaagttgc

SEQ ID NO: 113260 - DNA, 25 bp, Homo sapien
ggcagtcgatgtacttccgggttca

SEQ ID NO: 113261 - DNA, 25 bp, Homo sapien
gtccttcgggactgaacgccacaca

SEQ ID NO: 113262 - DNA, 25 bp, Homo sapien
cgctccctcaggaagtgacagactc

SEQ ID NO: 113263 - DNA, 25 bp, Homo sapien
cagggctccagtcgaaccgcctggt

SEQ ID NO: 113264 - DNA, 25 bp, Homo sapien
acccaggctagcgacgcgaccatga

SEQ ID NO: 113265 - DNA, 25 bp, Homo sapien
gctaaagacacgtcagccctgagcg

SEQ ID NO: 113266 - DNA, 25 bp, Homo sapien
tgcagccgaggaccctccagttctg

SEQ ID NO: 113267 - DNA, 25 bp, Homo sapien
gccgcctcggaacaagacagtggca

SEQ ID NO: 113268 - DNA, 25 bp, Homo sapien
ccagtgtccagtttccgtcggctaa

SEQ ID NO: 113269 - DNA, 25 bp, Homo sapien
ctccggcggtaatggcgttactctt

SEQ ID NO: 113270 - DNA, 25 bp, Homo sapien
gcgttactcttcatccgggctccgg

SEQ ID NO: 113271 - DNA, 25 bp, Homo sapien
gcagcttgcggttagccgttctttc

SEQ ID NO: 113272 - DNA, 25 bp, Homo sapien
actcccggcgtggaagctaaagaca

SEQ ID NO: 113273 - DNA, 25 bp, Homo sapien
cggaaggaatcaggacagtttgccc

SEQ ID NO: 113274 - DNA, 25 bp, Homo sapien
tcttgatcctccgaaggcccagggc

SEQ ID NO: 113275 - DNA, 25 bp, Homo sapien
ctttcaggcgggagagatcttgcca

SEQ ID NO: 113276 - DNA, 25 bp, Homo sapien
ttgccatcgcggcttcccgaaagga

SEQ ID NO: 113277 - DNA, 25 bp, Homo sapien
tgtcaagaaagttaccgccaagtgg

SEQ ID NO: 113278 - DNA, 25 bp, Homo sapien
tctccatgtcgtaggaatgtcaaga

SEQ ID NO: 113279 - DNA, 25 bp, Homo sapien
gggcgcgccttgcatttgtctccat

SEQ ID NO: 113280 - DNA, 25 bp, Homo sapien
tctcgccgacgttttttcttgatcc

SEQ ID NO: 113281 - DNA, 25 bp, Homo sapien
gcccgcagccgctttgactaaaata

SEQ ID NO: 113282 - DNA, 25 bp, Homo sapien
ttcgcttcccgatttagccagggga

SEQ ID NO: 113283 - DNA, 25 bp, Homo sapien
ctaaaataggcatcgcgacggcggc

SEQ ID NO: 113284 - DNA, 25 bp, Homo sapien
ggggctgagatccaactttcgcttc

SEQ ID NO: 113285 - DNA, 25 bp, Homo sapien
tctgcacacccgaggactcggtttg

SEQ ID NO: 113286 - DNA, 25 bp, Homo sapien
tgtcgcctcgctacaagattctatc

SEQ ID NO: 113287 - DNA, 25 bp, Homo sapien
ttctatccttgtttgggcatgagtg

SEQ ID NO: 113288 - DNA, 25 bp, Homo sapien
ggcggcattcgtcgttcctccttac

SEQ ID NO: 113289 - DNA, 25 bp, Homo sapien
cgtcccggaacctcgaggtctctat

SEQ ID NO: 113290 - DNA, 25 bp, Homo sapien
acggctgctgggttctgactcaccc

SEQ ID NO: 113291 - DNA, 25 bp, Homo sapien
aagtctcggaacatgcccggggctg

SEQ ID NO: 113292 - DNA, 25 bp, Homo sapien
ggagagaccctcctagccttcgagg

SEQ ID NO: 113293 - DNA, 25 bp, Homo sapien
gatcccaggaattcagcccgaagcg

SEQ ID NO: 113294 - DNA, 25 bp, Homo sapien
ccaggccgagaaacgatagggactt

SEQ ID NO: 113295 - DNA, 25 bp, Homo sapien
ccgtgcggagtcttttctttttatg

SEQ ID NO: 113296 - DNA, 25 bp, Homo sapien
gaggtctctattcgccgcattcggc

SEQ ID NO: 113297 - DNA, 25 bp, Homo sapien
gataggaaccgcagcaaaggatccc

SEQ ID NO: 113298 - DNA, 25 bp, Homo sapien
gcgcccgctaagttgcccgaagcgg

SEQ ID NO: 113299 - DNA, 25 bp, Homo sapien
gcccgcgcggaagccctcagcgtcc

SEQ ID NO: 113300 - DNA, 25 bp, Homo sapien
cctgcccggagcttcagcccggcgc

SEQ ID NO: 113301 - DNA, 25 bp, Homo sapien
cctagacctccgagctgtgagcggc

SEQ ID NO: 113302 - DNA, 25 bp, Homo sapien
tcggcgcggataggaaccgcagcaa

SEQ ID NO: 113303 - DNA, 25 bp, Homo sapien
cgactcgcgttcttcaggggtcggc

SEQ ID NO: 113304 - DNA, 25 bp, Homo sapien
tccgagctgtgagcggcgacacagc

SEQ ID NO: 113305 - DNA, 25 bp, Homo sapien
ttacggcggtctcgtcgcggtacac

SEQ ID NO: 113306 - DNA, 25 bp, Homo sapien
cggccagagctagcacaaacggact

SEQ ID NO: 113307 - DNA, 25 bp, Homo sapien
tacacgtcggggtactgaagggaca

SEQ ID NO: 113308 - DNA, 25 bp, Homo sapien
aggcagagatacttacggcggtctc

SEQ ID NO: 113309 - DNA, 25 bp, Homo sapien
tcgaaggcctacaggaagaggagct

SEQ ID NO: 113310 - DNA, 25 bp, Homo sapien
ctagcagagtgaccgcccgcgggac

SEQ ID NO: 113311 - DNA, 25 bp, Homo sapien
tccgccgccagcactagcagagtga

SEQ ID NO: 113312 - DNA, 25 bp, Homo sapien
ctccgggagcggacctgagctagcc

SEQ ID NO: 113313 - DNA, 25 bp, Homo sapien
acgggctctgccattcctatccgga

SEQ ID NO: 113314 - DNA, 25 bp, Homo sapien
ccaagtcccgctggggaaatccgca

SEQ ID NO: 113315 - DNA, 25 bp, Homo sapien
ttcaagctgtttgggcaccaggagg

SEQ ID NO: 113316 - DNA, 25 bp, Homo sapien
gatccgaatggtggccaagtcccgc

SEQ ID NO: 113317 - DNA, 25 bp, Homo sapien
ttggattccatctccgcaaggattg

SEQ ID NO: 113318 - DNA, 25 bp, Homo sapien
cggactcaccgactgaactattcca

SEQ ID NO: 113319 - DNA, 25 bp, Homo sapien
tccagtttccttatcgacgcgattg

SEQ ID NO: 113320 - DNA, 25 bp, Homo sapien
gctggcttcgggacagctccactac

SEQ ID NO: 113321 - DNA, 25 bp, Homo sapien
atctggagagtgcattctgcggacc

SEQ ID NO: 113322 - DNA, 25 bp, Homo sapien
tctcctaaccgcaagcgaagcgagg

SEQ ID NO: 113323 - DNA, 25 bp, Homo sapien
gcagtccttcctggacgagctctga

SEQ ID NO: 113324 - DNA, 25 bp, Homo sapien
ccgaagatgcgttgcgtgactatgc

SEQ ID NO: 113325 - DNA, 25 bp, Homo sapien
gacctgcctgcctgactctagtctg

SEQ ID NO: 113326 - DNA, 25 bp, Homo sapien
ctctagtctgcaagtctcgggcaca

SEQ ID NO: 113327 - DNA, 25 bp, Homo sapien
aggcgccctttcttttatgatgttt

SEQ ID NO: 113328 - DNA, 25 bp, Homo sapien
ggactcaggcaagcaccttctccta

SEQ ID NO: 113329 - DNA, 25 bp, Homo sapien
tgaactctaccaagctcagcgcgta

SEQ ID NO: 113330 - DNA, 25 bp, Homo sapien
tacgtttcttgttctccgagctcga

SEQ ID NO: 113331 - DNA, 25 bp, Homo sapien
ctctggattggactgcattcgccta

SEQ ID NO: 113332 - DNA, 25 bp, Homo sapien
ctccagaagtgggttgtgcaagaca

SEQ ID NO: 113333 - DNA, 25 bp, Homo sapien
cagcgcggggatagcttttctatta

SEQ ID NO: 113334 - DNA, 25 bp, Homo sapien
agagcccgtccttttgtctggagtg

SEQ ID NO: 113335 - DNA, 25 bp, Homo sapien
tcctcctgcggtcaaagcatcagtc

SEQ ID NO: 113336 - DNA, 25 bp, Homo sapien
ccagaggactctcgagataggttta

SEQ ID NO: 113337 - DNA, 25 bp, Homo sapien
ccctccagtgttgcggagaggcaag

SEQ ID NO: 113338 - DNA, 25 bp, Homo sapien
cagccgagtggctaaggaaatctta

SEQ ID NO: 113339 - DNA, 25 bp, Homo sapien
ggaagccagacggttaacacagaca

SEQ ID NO: 113340 - DNA, 25 bp, Homo sapien
acggttaacacagacaaagtgctgc

SEQ ID NO: 113341 - DNA, 25 bp, Homo sapien
cagacaaagtgctgccgtgacactc

SEQ ID NO: 113342 - DNA, 25 bp, Homo sapien
caaagtgctgccgtgacactcggcc

SEQ ID NO: 113343 - DNA, 25 bp, Homo sapien
acactcggccctccagtgttgcgga

SEQ ID NO: 113344 - DNA, 25 bp, Homo sapien
ctaaggaaatcttaagcagggaggg

SEQ ID NO: 113345 - DNA, 25 bp, Homo sapien
gtcggagctgaaccctgctgcactt

SEQ ID NO: 113346 - DNA, 25 bp, Homo sapien
ccaacggggcagtacgcttgaactc

SEQ ID NO: 113347 - DNA, 25 bp, Homo sapien
gtcgctcttgagcatgcgccaacgg

SEQ ID NO: 113348 - DNA, 25 bp, Homo sapien
tccgccctctggtatccagcgaata

SEQ ID NO: 113349 - DNA, 25 bp, Homo sapien
tctaggaatttcctcacacaaggtg

SEQ ID NO: 113350 - DNA, 25 bp, Homo sapien
atacaaccggcaacgctgcggagcc

SEQ ID NO: 113351 - DNA, 25 bp, Homo sapien
tggcagcgcaccacaagtccagtca

SEQ ID NO: 113352 - DNA, 25 bp, Homo sapien
cgtgttctgcctaacccagcaagga

SEQ ID NO: 113353 - DNA, 25 bp, Homo sapien
tggggtgttcgttccgcacccgctc

SEQ ID NO: 113354 - DNA, 25 bp, Homo sapien
ccgcctgactgtggggtgttcgttc

SEQ ID NO: 113355 - DNA, 25 bp, Homo sapien
ctctggcgctccaaaaagaagcagc

SEQ ID NO: 113356 - DNA, 25 bp, Homo sapien
aggaggacaagacgatgccgctgtc

SEQ ID NO: 113357 - DNA, 25 bp, Homo sapien
tcaggtgtgttcttccatagggccc

SEQ ID NO: 113358 - DNA, 25 bp, Homo sapien
tggcgctcaggtgtgttcttccata

SEQ ID NO: 113359 - DNA, 25 bp, Homo sapien
gcgctgggtgctggttctgcaaccc

SEQ ID NO: 113360 - DNA, 25 bp, Homo sapien
gctgcgctagcccttggactcctga

SEQ ID NO: 113361 - DNA, 25 bp, Homo sapien
cggtgtcttcccagagagtggtgaa

SEQ ID NO: 113362 - DNA, 25 bp, Homo sapien
ctcctgccgcagtaaacacaaagtg

SEQ ID NO: 113363 - DNA, 25 bp, Homo sapien
atacagcgcgccatccagagagctc

SEQ ID NO: 113364 - DNA, 25 bp, Homo sapien
ggccactgttggcttctgaatggtt

SEQ ID NO: 113365 - DNA, 25 bp, Homo sapien
ctgaatggtttgcaaggcggatatc

SEQ ID NO: 113366 - DNA, 25 bp, Homo sapien
acgacgcggactcctctgacaggta

SEQ ID NO: 113367 - DNA, 25 bp, Homo sapien
tgagccgttcctttccatcgcagag

SEQ ID NO: 113368 - DNA, 25 bp, Homo sapien
tccagtcatggactaccggcggctt

SEQ ID NO: 113369 - DNA, 25 bp, Homo sapien
cccattggcgggtttgcttttattg

SEQ ID NO: 113370 - DNA, 25 bp, Homo sapien
ttattggtttgttctgcgctccctc

SEQ ID NO: 113371 - DNA, 25 bp, Homo sapien
gctagccgttttgctccaggagata

SEQ ID NO: 113372 - DNA, 25 bp, Homo sapien
tcccattggagctccggctaaggcg

SEQ ID NO: 113373 - DNA, 25 bp, Homo sapien
atcactcgggtgtttgaacgctcgc

SEQ ID NO: 113374 - DNA, 25 bp, Homo sapien
ggcagagtcccaagcgcatccttca

SEQ ID NO: 113375 - DNA, 25 bp, Homo sapien
aagcctttccgatgcgctctgcagc

SEQ ID NO: 113376 - DNA, 25 bp, Homo sapien
ggtaggaactcccacaggcaaaagc

SEQ ID NO: 113377 - DNA, 25 bp, Homo sapien
gccacttgcccgagagcacgtggtg

SEQ ID NO: 113378 - DNA, 25 bp, Homo sapien
gtccgtgaagtcgtccgtgtaaaca

SEQ ID NO: 113379 - DNA, 25 bp, Homo sapien
tgtaaacacagatgacctggcgccc

SEQ ID NO: 113380 - DNA, 25 bp, Homo sapien
gctcaccttggccacctgaagctgg

SEQ ID NO: 113381 - DNA, 25 bp, Homo sapien
gcaatgccagcccaggcgtggtcca

SEQ ID NO: 113382 - DNA, 25 bp, Homo sapien
gtccagcttgaagcccggtgccaga

SEQ ID NO: 113383 - DNA, 25 bp, Homo sapien
cggtgccagatgcataagccacttg

SEQ ID NO: 113384 - DNA, 25 bp, Homo sapien
tccagtacacccaagcggtccgtga

SEQ ID NO: 113385 - DNA, 25 bp, Homo sapien
gtgtgtgtgccgaagaaggctccct

SEQ ID NO: 113386 - DNA, 25 bp, Homo sapien
caaccacttcaacggccgggcagag

SEQ ID NO: 113387 - DNA, 25 bp, Homo sapien
agctcccggtcaagagcagctcgct

SEQ ID NO: 113388 - DNA, 25 bp, Homo sapien
agtcggaccggagcaaacagccacc

SEQ ID NO: 113389 - DNA, 25 bp, Homo sapien
cccagagcggaagattgcggtgact

SEQ ID NO: 113390 - DNA, 25 bp, Homo sapien
cgagccggtcgtgattactcccaga

SEQ ID NO: 113391 - DNA, 25 bp, Homo sapien
accctgctaaggtgctaactttgga

SEQ ID NO: 113392 - DNA, 25 bp, Homo sapien
cgcgtctgatttgccaggtgagcct

SEQ ID NO: 113393 - DNA, 25 bp, Homo sapien
cagcaggggtcgctgcttcgctgcc

SEQ ID NO: 113394 - DNA, 25 bp, Homo sapien
gcagtcctccaagacgcggcctcca

SEQ ID NO: 113395 - DNA, 25 bp, Homo sapien
tagcctggaggcctgcagtccgcgc

SEQ ID NO: 113396 - DNA, 25 bp, Homo sapien
gcctgacgtacaggtgagtgcgcct

SEQ ID NO: 113397 - DNA, 25 bp, Homo sapien
tgagtgtcccgtgtcctgccagcct

SEQ ID NO: 113398 - DNA, 25 bp, Homo sapien
attgagcgcggcgaagccttccgtt

SEQ ID NO: 113399 - DNA, 25 bp, Homo sapien
ggctccgaatgcagactgcgaaccc

SEQ ID NO: 113400 - DNA, 25 bp, Homo sapien
aatgcagactgcgaacccggggacg

SEQ ID NO: 113401 - DNA, 25 bp, Homo sapien
tggtcaagtctctgcactcagggcc

SEQ ID NO: 113402 - DNA, 25 bp, Homo sapien
gcagttgtactgcttgcgcaggttc

SEQ ID NO: 113403 - DNA, 25 bp, Homo sapien
cctctcggggttgattgcatagctg

SEQ ID NO: 113404 - DNA, 25 bp, Homo sapien
agcgctcatccagtttgcccacgaa

SEQ ID NO: 113405 - DNA, 25 bp, Homo sapien
gtttgcccacgaactccagggtcca

SEQ ID NO: 113406 - DNA, 25 bp, Homo sapien
taacttgtcgaagtcgatgggcacc

SEQ ID NO: 113407 - DNA, 25 bp, Homo sapien
gcaggttctcgtgcgtgaagagctc

SEQ ID NO: 113408 - DNA, 25 bp, Homo sapien
tctcgtagatgctgcgtagctgctc

SEQ ID NO: 113409 - DNA, 25 bp, Homo sapien
acacagccgtgtccttcaccgaggg

SEQ ID NO: 113410 - DNA, 25 bp, Homo sapien
ctccacatagttgcggatgagctgc

SEQ ID NO: 113411 - DNA, 25 bp, Homo sapien
tgggctggctgtcctccatttcccg

SEQ ID NO: 113412 - DNA, 25 bp, Homo sapien
ccagaagcggctgaagaagtcgttc

SEQ ID NO: 113413 - DNA, 25 bp, Homo sapien
ccgaggggtagtagacctccacata

SEQ ID NO: 113414 - DNA, 25 bp, Homo sapien
ggtgcagcgactccagcttgcgctt

SEQ ID NO: 113415 - DNA, 25 bp, Homo sapien
tggccgcaaagccacaggcactgca

SEQ ID NO: 113416 - DNA, 25 bp, Homo sapien
ggagaagtccacgtcgctgaagagc

SEQ ID NO: 113417 - DNA, 25 bp, Homo sapien
gcatggatgttgcagccactctacc

SEQ ID NO: 113418 - DNA, 25 bp, Homo sapien
cccgcacttacctgggacgcgagtt

SEQ ID NO: 113419 - DNA, 25 bp, Homo sapien
acgcgagttctgtactttgccgggc

SEQ ID NO: 113420 - DNA, 25 bp, Homo sapien
cgggactccgtgtgtcatttccgca

SEQ ID NO: 113421 - DNA, 25 bp, Homo sapien
tttccgcacaaggacacaggagccc

SEQ ID NO: 113422 - DNA, 25 bp, Homo sapien
atgtgtcctcccaccgcgagttcgt

SEQ ID NO: 113423 - DNA, 25 bp, Homo sapien
ccgcgagttcgtcctcggaaacgtg

SEQ ID NO: 113424 - DNA, 25 bp, Homo sapien
gtggtttctcagacccgagagtttg

SEQ ID NO: 113425 - DNA, 25 bp, Homo sapien
cctgcatagcgatgttgctgagctc

SEQ ID NO: 113426 - DNA, 25 bp, Homo sapien
cacctgcatagcgatgttgctgagc

SEQ ID NO: 113427 - DNA, 25 bp, Homo sapien
cgcacctgcatagcgatgttgctga

SEQ ID NO: 113428 - DNA, 25 bp, Homo sapien
gcatagcgatgttgctgagctcgtc

SEQ ID NO: 113429 - DNA, 25 bp, Homo sapien
gcgatgttgctgagctcgtcgctca

SEQ ID NO: 113430 - DNA, 25 bp, Homo sapien
tgagctcgtcgctcagcaggcagcg

SEQ ID NO: 113431 - DNA, 25 bp, Homo sapien
agctcgtcgctcagcaggcagcgaa

SEQ ID NO: 113432 - DNA, 25 bp, Homo sapien
cgtcgctcagcaggcagcgaaggct

SEQ ID NO: 113433 - DNA, 25 bp, Homo sapien
gcagcgaaggctcatgaaggacgtg

SEQ ID NO: 113434 - DNA, 25 bp, Homo sapien
gcggggaacccgaggctccaagata

SEQ ID NO: 113435 - DNA, 25 bp, Homo sapien
acgccaagagcccaccgaggagatg

SEQ ID NO: 113436 - DNA, 25 bp, Homo sapien
tggaggaccgaccacgccaagagcc

SEQ ID NO: 113437 - DNA, 25 bp, Homo sapien
ggacttggaggaccgaccacgccaa

SEQ ID NO: 113438 - DNA, 25 bp, Homo sapien
actacctgattccagtgggccgggg

SEQ ID NO: 113439 - DNA, 25 bp, Homo sapien
gcctctgacactacctgattccagt

SEQ ID NO: 113440 - DNA, 25 bp, Homo sapien
cccacgatcttctccgcctctgaca

SEQ ID NO: 113441 - DNA, 25 bp, Homo sapien
ttggtgtcacgaacaacggtcagcc

SEQ ID NO: 113442 - DNA, 25 bp, Homo sapien
ggccgagtctggattcattagagtc

SEQ ID NO: 113443 - DNA, 25 bp, Homo sapien
ccacgtctcagtggtggaacgccta

SEQ ID NO: 113444 - DNA, 25 bp, Homo sapien
ctgcacacggtatctgggccgagtc

SEQ ID NO: 113445 - DNA, 25 bp, Homo sapien
cgcccagcactgagtggcatgcata

SEQ ID NO: 113446 - DNA, 25 bp, Homo sapien
ctcccggaagctttttgtcgctatc

SEQ ID NO: 113447 - DNA, 25 bp, Homo sapien
tcagggcccaaccagacataaggca

SEQ ID NO: 113448 - DNA, 25 bp, Homo sapien
ccttgggagaaacagcggtgcctcc

SEQ ID NO: 113449 - DNA, 25 bp, Homo sapien
tatccagtgacggtggaagccacgc

SEQ ID NO: 113450 - DNA, 25 bp, Homo sapien
attcatttttcctcagcggctccta

SEQ ID NO: 113451 - DNA, 25 bp, Homo sapien
gcggctcctaggacgggctcaaaaa

SEQ ID NO: 113452 - DNA, 25 bp, Homo sapien
cgcagcatccgcgtatccagtgacg

SEQ ID NO: 113453 - DNA, 25 bp, Homo sapien
agcgacggaagatggctgacgactc

SEQ ID NO: 113454 - DNA, 25 bp, Homo sapien
tatccttacccgtgacagccactga

SEQ ID NO: 113455 - DNA, 25 bp, Homo sapien
aggaagccggctcacccagtgaaaa

SEQ ID NO: 113456 - DNA, 25 bp, Homo sapien
cccacctcgcggagctgagaagcag

SEQ ID NO: 113457 - DNA, 25 bp, Homo sapien
tcccttcccgccagtgagcatgatg

SEQ ID NO: 113458 - DNA, 25 bp, Homo sapien
cccagatgatgaatttcgggctgcc

SEQ ID NO: 113459 - DNA, 25 bp, Homo sapien
cgggactccaagcagggctcgtcca

SEQ ID NO: 113460 - DNA, 25 bp, Homo sapien
gcgtcatcgacctgaccgtgggcca

SEQ ID NO: 113461 - DNA, 25 bp, Homo sapien
cgcggcctgcaacgtcatcgtgaac

SEQ ID NO: 113462 - DNA, 25 bp, Homo sapien
cggtcaaggagaataactgtgcttc

SEQ ID NO: 113463 - DNA, 25 bp, Homo sapien
actgtgcttccaactgccacctgga

SEQ ID NO: 113464 - DNA, 25 bp, Homo sapien
tccagcaacggggagaacttcattc

SEQ ID NO: 113465 - DNA, 25 bp, Homo sapien
tcggccacccaaggacgtttgtatc

SEQ ID NO: 113466 - DNA, 25 bp, Homo sapien
ggggcaccagcaggatgtactattc

SEQ ID NO: 113467 - DNA, 25 bp, Homo sapien
atgtactattctcggcgcggcgtga

SEQ ID NO: 113468 - DNA, 25 bp, Homo sapien
tgcccgccgacatgagctgcaacgg

SEQ ID NO: 113469 - DNA, 25 bp, Homo sapien
gcggcgtgatcaccgaccagaactc

SEQ ID NO: 113470 - DNA, 25 bp, Homo sapien
cggatcaacactctgggccgcatga

SEQ ID NO: 113471 - DNA, 25 bp, Homo sapien
gaccacgactgcaacgactcctgga

SEQ ID NO: 113472 - DNA, 25 bp, Homo sapien
cgtttgtatcaaggctgcgcgtccc

SEQ ID NO: 113473 - DNA, 25 bp, Homo sapien
ggggcccacagcaacgccagtgccc

SEQ ID NO: 113474 - DNA, 25 bp, Homo sapien
ttgagtgcccactcggcctcgactg

SEQ ID NO: 113475 - DNA, 25 bp, Homo sapien
aagttgagtgcccactcggcctcga

SEQ ID NO: 113476 - DNA, 25 bp, Homo sapien
atgcaagttgagtgcccactcggcc

SEQ ID NO: 113477 - DNA, 25 bp, Homo sapien
cggcatgcaagttgagtgcccactc

SEQ ID NO: 113478 - DNA, 25 bp, Homo sapien
tcccatcgccatgtcgtgggtgggc

SEQ ID NO: 113479 - DNA, 25 bp, Homo sapien
cagcggcatgcaagttgagtgccca

SEQ ID NO: 113480 - DNA, 25 bp, Homo sapien
ccatcgccatgtcgtgggtgggccc

SEQ ID NO: 113481 - DNA, 25 bp, Homo sapien
tcctgctgccgctggaatccggact

SEQ ID NO: 113482 - DNA, 25 bp, Homo sapien
tccaagaagaggcagcggatctccc

SEQ ID NO: 113483 - DNA, 25 bp, Homo sapien
agccgcccgctcatttctcctgctg

SEQ ID NO: 113484 - DNA, 25 bp, Homo sapien
cgggactctgggtctgactcaacga

SEQ ID NO: 113485 - DNA, 25 bp, Homo sapien
aggaagggaacacggcagagtcctc

SEQ ID NO: 113486 - DNA, 25 bp, Homo sapien
gtggccgtttccaccgaagacacca

SEQ ID NO: 113487 - DNA, 25 bp, Homo sapien
gactcaacgaatgccggaggccacc

SEQ ID NO: 113488 - DNA, 25 bp, Homo sapien
gcaggaagaagacagtggccgtttc

SEQ ID NO: 113489 - DNA, 25 bp, Homo sapien
tcggcgtacaggatcccagagaagg

SEQ ID NO: 113490 - DNA, 25 bp, Homo sapien
ggaactcggcgaggtctcgccctta

SEQ ID NO: 113491 - DNA, 25 bp, Homo sapien
ccggcattctgatctcggggccaga

SEQ ID NO: 113492 - DNA, 25 bp, Homo sapien
ctctcgcgagaggagatagttcccg

SEQ ID NO: 113493 - DNA, 25 bp, Homo sapien
tgtcatcgtactggaactgctgccc

SEQ ID NO: 113494 - DNA, 25 bp, Homo sapien
ccagagaaggcttcccgccggagca

SEQ ID NO: 113495 - DNA, 25 bp, Homo sapien
agaggtagtatgtcgccgggatcac

SEQ ID NO: 113496 - DNA, 25 bp, Homo sapien
agaaggtgttcccactgtcatcgta

SEQ ID NO: 113497 - DNA, 25 bp, Homo sapien
tccagcaactgctgctccgacagga

SEQ ID NO: 113498 - DNA, 25 bp, Homo sapien
cggctcggctgatgttgtccatctt

SEQ ID NO: 113499 - DNA, 25 bp, Homo sapien
agctcccggcactcaggatccagat

SEQ ID NO: 113500 - DNA, 25 bp, Homo sapien
gccgtcggctgcgttcgcagagaaa

SEQ ID NO: 113501 - DNA, 25 bp, Homo sapien
gagcacccaccgctttggacaattg

SEQ ID NO: 113502 - DNA, 25 bp, Homo sapien
cctacaagtttcttacctcgctgga

SEQ ID NO: 113503 - DNA, 25 bp, Homo sapien
cgacgacggcctccgctgtggaaat

SEQ ID NO: 113504 - DNA, 25 bp, Homo sapien
tgtccatcttgctgacgacctgttg

SEQ ID NO: 113505 - DNA, 25 bp, Homo sapien
gaccgcggccttggcaaggacttga

SEQ ID NO: 113506 - DNA, 25 bp, Homo sapien
aaggacttgagtctgcgttccagcc

SEQ ID NO: 113507 - DNA, 25 bp, Homo sapien
ccaagttgctcactgggctgtgctg

SEQ ID NO: 113508 - DNA, 25 bp, Homo sapien
agccttggggaaccctagctcttag

SEQ ID NO: 113509 - DNA, 25 bp, Homo sapien
tgtgcgtaaaaggatctagacagac

SEQ ID NO: 113510 - DNA, 25 bp, Homo sapien
ctagacagacagtcgtgcgcccgca

SEQ ID NO: 113511 - DNA, 25 bp, Homo sapien
ccggtacccgctcagcagctaggag

SEQ ID NO: 113512 - DNA, 25 bp, Homo sapien
acggaaatcgcagctacgagggcta

SEQ ID NO: 113513 - DNA, 25 bp, Homo sapien
cctcatattcttgtgcgggtgtctg

SEQ ID NO: 113514 - DNA, 25 bp, Homo sapien
cttacgtcgtgtgagtctaccaacc

SEQ ID NO: 113515 - DNA, 25 bp, Homo sapien
aggcctttcgctctcaaatatcgtc

SEQ ID NO: 113516 - DNA, 25 bp, Homo sapien
tggccctcacttggctgtagcagaa

SEQ ID NO: 113517 - DNA, 25 bp, Homo sapien
gccctcgaagttcctctccgggaga

SEQ ID NO: 113518 - DNA, 25 bp, Homo sapien
agccacgcgtgcacactcatgggtc

SEQ ID NO: 113519 - DNA, 25 bp, Homo sapien
ggggcgcgtttctttcgcatccaca

SEQ ID NO: 113520 - DNA, 25 bp, Homo sapien
gctctgcccggccttcttagaaata

SEQ ID NO: 113521 - DNA, 25 bp, Homo sapien
gtttcggtgccagacaatcaaagga

SEQ ID NO: 113522 - DNA, 25 bp, Homo sapien
ctttccattcgcaaacagcttgtca

SEQ ID NO: 113523 - DNA, 25 bp, Homo sapien
cagcttgtcagactggaactcttcc

SEQ ID NO: 113524 - DNA, 25 bp, Homo sapien
tcttccttcgttcagctggtgtttc

SEQ ID NO: 113525 - DNA, 25 bp, Homo sapien
cagaggccggcgctattaactcccg

SEQ ID NO: 113526 - DNA, 25 bp, Homo sapien
gggcagcctgagaatcaaagccgtc

SEQ ID NO: 113527 - DNA, 25 bp, Homo sapien
accggcggctggttaactgtactgt

SEQ ID NO: 113528 - DNA, 25 bp, Homo sapien
cggcctccaggttcaataaggatta

SEQ ID NO: 113529 - DNA, 25 bp, Homo sapien
gttgggcccaaaacagggactctgc

SEQ ID NO: 113530 - DNA, 25 bp, Homo sapien
caaacagccggttttgtccagggca

SEQ ID NO: 113531 - DNA, 25 bp, Homo sapien
agaccactgcacctgctgagccaga

SEQ ID NO: 113532 - DNA, 25 bp, Homo sapien
ctgacctccgttttacccatctgta

SEQ ID NO: 113533 - DNA, 25 bp, Homo sapien
ctggcaagccgtaagtccaagagct

SEQ ID NO: 113534 - DNA, 25 bp, Homo sapien
agagctttggctccaccagcgtgta

SEQ ID NO: 113535 - DNA, 25 bp, Homo sapien
cgtgtacgacgctcatttcctttct

SEQ ID NO: 113536 - DNA, 25 bp, Homo sapien
gagcggaagtttctcactgacaatt

SEQ ID NO: 113537 - DNA, 25 bp, Homo sapien
agcccggttgcctgtttctaatctg

SEQ ID NO: 113538 - DNA, 25 bp, Homo sapien
cctagagggcaacagtccggaagct

SEQ ID NO: 113539 - DNA, 25 bp, Homo sapien
cggggtcaaccagcttgtctcgtga

SEQ ID NO: 113540 - DNA, 25 bp, Homo sapien
agaggagctttgcaacggggtcaac

SEQ ID NO: 113541 - DNA, 25 bp, Homo sapien
ctcgctcggcttgctaaatgagagg

SEQ ID NO: 113542 - DNA, 25 bp, Homo sapien
catttaggccctttccagaccggtg

SEQ ID NO: 113543 - DNA, 25 bp, Homo sapien
ctgagctttctcaggcccgcaggac

SEQ ID NO: 113544 - DNA, 25 bp, Homo sapien
aaccacagcgggctccttgcggaaa

SEQ ID NO: 113545 - DNA, 25 bp, Homo sapien
gcacgcacaggcgaactctgattga

SEQ ID NO: 113546 - DNA, 25 bp, Homo sapien
cggctgtacaagttggctgtcaaaa

SEQ ID NO: 113547 - DNA, 25 bp, Homo sapien
cccggtgcagataatggaggcgaca

SEQ ID NO: 113548 - DNA, 25 bp, Homo sapien
ggatgagggcctctcttcactattc

SEQ ID NO: 113549 - DNA, 25 bp, Homo sapien
ctgccgagagagcttaaatagaatt

SEQ ID NO: 113550 - DNA, 25 bp, Homo sapien
tgcaatcacgtgctgtcggagccca

SEQ ID NO: 113551 - DNA, 25 bp, Homo sapien
ggggactccagcattcacttgcacg

SEQ ID NO: 113552 - DNA, 25 bp, Homo sapien
ggctagctccacaagcggctgtaca

SEQ ID NO: 113553 - DNA, 25 bp, Homo sapien
ccagcagctgcggttttgcaagagc

SEQ ID NO: 113554 - DNA, 25 bp, Homo sapien
ccgcgtaggtcataactggggaatt

SEQ ID NO: 113555 - DNA, 25 bp, Homo sapien
ctccaggcggtagcacaataacaca

SEQ ID NO: 113556 - DNA, 25 bp, Homo sapien
gttgtctccatttagccgccaggtg

SEQ ID NO: 113557 - DNA, 25 bp, Homo sapien
cagcccaccagtcggatgagttgtc

SEQ ID NO: 113558 - DNA, 25 bp, Homo sapien
agccgtttcgttgcctctggattgc

SEQ ID NO: 113559 - DNA, 25 bp, Homo sapien
gcccagacctgtagaccgtgagttg

SEQ ID NO: 113560 - DNA, 25 bp, Homo sapien
ccggatcaacaagtgggtacctctc

SEQ ID NO: 113561 - DNA, 25 bp, Homo sapien
ccatgctactctttttgacgggtca

SEQ ID NO: 113562 - DNA, 25 bp, Homo sapien
ccctccacctgagacgagtctggga

SEQ ID NO: 113563 - DNA, 25 bp, Homo sapien
ctcgggttccaggagcaagtttaca

SEQ ID NO: 113564 - DNA, 25 bp, Homo sapien
caagtttacacctgcggtgcctcga

SEQ ID NO: 113565 - DNA, 25 bp, Homo sapien
cactggtggctctataggcaggtgc

SEQ ID NO: 113566 - DNA, 25 bp, Homo sapien
tgtcgccgtccgaattcccatgcta

SEQ ID NO: 113567 - DNA, 25 bp, Homo sapien
gccgagcctggtcgttaccgaacac

SEQ ID NO: 113568 - DNA, 25 bp, Homo sapien
tgctgccgcggggttgtaattaccc

SEQ ID NO: 113569 - DNA, 25 bp, Homo sapien
gatctggccctgctcatgcccaagg

SEQ ID NO: 113570 - DNA, 25 bp, Homo sapien
atgcccaaggccctcgcgttttgca

SEQ ID NO: 113571 - DNA, 25 bp, Homo sapien
gtcctgaagtctcgtccctgttcca

SEQ ID NO: 113572 - DNA, 25 bp, Homo sapien
cggctctctaagcttcacctgcttg

SEQ ID NO: 113573 - DNA, 25 bp, Homo sapien
accactccgcgactggcggaagttc

SEQ ID NO: 113574 - DNA, 25 bp, Homo sapien
tcttgaagtagcctgggacgtccca

SEQ ID NO: 113575 - DNA, 25 bp, Homo sapien
tgcggggtctgccaaacccggctct

SEQ ID NO: 113576 - DNA, 25 bp, Homo sapien
ggactggccctcttgaagtagcctg

SEQ ID NO: 113577 - DNA, 25 bp, Homo sapien
ggagttctccttgacgctcctcagc

SEQ ID NO: 113578 - DNA, 25 bp, Homo sapien
tgtcatcatctgtatcctgccgggg

SEQ ID NO: 113579 - DNA, 25 bp, Homo sapien
tcatgcagacggacgaagagattgg

SEQ ID NO: 113580 - DNA, 25 bp, Homo sapien
ccgcaggcgcggatcaagaagatca

SEQ ID NO: 113581 - DNA, 25 bp, Homo sapien
acaactttatagacaggcgcagcca

SEQ ID NO: 113582 - DNA, 25 bp, Homo sapien
agcggcgtcttaaccggcggcgcta

SEQ ID NO: 113583 - DNA, 25 bp, Homo sapien
cccgagatgccgagcaagaagaaga

SEQ ID NO: 113584 - DNA, 25 bp, Homo sapien
gcttgggcccagttcccgctgggca

SEQ ID NO: 113585 - DNA, 25 bp, Homo sapien
ctgcagctatggagggcgagcctcc

SEQ ID NO: 113586 - DNA, 25 bp, Homo sapien
acctagatagtctggatcccgggga

SEQ ID NO: 113587 - DNA, 25 bp, Homo sapien
tctctggaagaagggagatccgcac

SEQ ID NO: 113588 - DNA, 25 bp, Homo sapien
cctcgtccgtgtgcagagccgcgat

SEQ ID NO: 113589 - DNA, 25 bp, Homo sapien
tggagcaaccctgacgtccctgggt

SEQ ID NO: 113590 - DNA, 25 bp, Homo sapien
gcgcgaggaactcccgaaggctcca

SEQ ID NO: 113591 - DNA, 25 bp, Homo sapien
gaaggctccacatcgacctccagtg

SEQ ID NO: 113592 - DNA, 25 bp, Homo sapien
tcccgcgcaacttcgagtttaaaga

SEQ ID NO: 113593 - DNA, 25 bp, Homo sapien
gcaggccgaagattgccctgaatta

SEQ ID NO: 113594 - DNA, 25 bp, Homo sapien
aacctgttgaacttgtgtattgaca

SEQ ID NO: 113595 - DNA, 25 bp, Homo sapien
ggacgtcagagtgcttcctgggcct

SEQ ID NO: 113596 - DNA, 25 bp, Homo sapien
gggagcgtccaacctgttgaacttg

SEQ ID NO: 113597 - DNA, 25 bp, Homo sapien
tcccaaggctcttaagcgcgcaaca

SEQ ID NO: 113598 - DNA, 25 bp, Homo sapien
acaagttgtcaagctcggcaggccg

SEQ ID NO: 113599 - DNA, 25 bp, Homo sapien
gcgcaacagcaagaaccaggacgtc

SEQ ID NO: 113600 - DNA, 25 bp, Homo sapien
ctggagcacggtccgagctgcgtcc

SEQ ID NO: 113601 - DNA, 25 bp, Homo sapien
tcagcggccttgctgggcccaaaga

SEQ ID NO: 113602 - DNA, 25 bp, Homo sapien
cagagcggcagaccctcgtgagcct

SEQ ID NO: 113603 - DNA, 25 bp, Homo sapien
ttcttcaccgcggtcacgcagctgg

SEQ ID NO: 113604 - DNA, 25 bp, Homo sapien
gcagaccctcgtgagcctggctcag

SEQ ID NO: 113605 - DNA, 25 bp, Homo sapien
tgctgggcccaaagagactcgtgcc

SEQ ID NO: 113606 - DNA, 25 bp, Homo sapien
ccaaagagactcgtgccagcgaatg

SEQ ID NO: 113607 - DNA, 25 bp, Homo sapien
agagactcgtgccagcgaatggaga

SEQ ID NO: 113608 - DNA, 25 bp, Homo sapien
cggtgtccaccactccagagcggca

SEQ ID NO: 113609 - DNA, 25 bp, Homo sapien
gcaagtggccctctacttccgtgga

SEQ ID NO: 113610 - DNA, 25 bp, Homo sapien
tctacttccgtggacacaaggagga

SEQ ID NO: 113611 - DNA, 25 bp, Homo sapien
gacgtccaccatccgcaagcaagtg

SEQ ID NO: 113612 - DNA, 25 bp, Homo sapien
tttgcctctgcagccgtgcagcacg

SEQ ID NO: 113613 - DNA, 25 bp, Homo sapien
cgccggcatgcgtttctctgtttgc

SEQ ID NO: 113614 - DNA, 25 bp, Homo sapien
tcgacgtctctaatcgccggcatgc

SEQ ID NO: 113615 - DNA, 25 bp, Homo sapien
cggctgtgtctcgacgtctctaatc

SEQ ID NO: 113616 - DNA, 25 bp, Homo sapien
ttttgcccgcccagacttgacattg

SEQ ID NO: 113617 - DNA, 25 bp, Homo sapien
tcgcaaacaggttccggccggacta

SEQ ID NO: 113618 - DNA, 25 bp, Homo sapien
catcgatctcgaggaagttgctggg

SEQ ID NO: 113619 - DNA, 25 bp, Homo sapien
accctgatttcgtaagtggtgaagc

SEQ ID NO: 113620 - DNA, 25 bp, Homo sapien
gtttgcgggttgctcacatcgatct

SEQ ID NO: 113621 - DNA, 25 bp, Homo sapien
tccgtaggcgtcattcaggttctgc

SEQ ID NO: 113622 - DNA, 25 bp, Homo sapien
acggtctccgccatttcgctgtagc

SEQ ID NO: 113623 - DNA, 25 bp, Homo sapien
ccaggggagaaacggctcactagct

SEQ ID NO: 113624 - DNA, 25 bp, Homo sapien
cggtcgcgaagagaacgagcacgta

SEQ ID NO: 113625 - DNA, 25 bp, Homo sapien
tcacgttccctaactgatcccttgg

SEQ ID NO: 113626 - DNA, 25 bp, Homo sapien
gactggagctgcctgttccgttcca

SEQ ID NO: 113627 - DNA, 25 bp, Homo sapien
catgtggctactggaggtcacgttc

SEQ ID NO: 113628 - DNA, 25 bp, Homo sapien
atcccttggttctctcgggtggagc

SEQ ID NO: 113629 - DNA, 25 bp, Homo sapien
accgtctctcttctgggttccaata

SEQ ID NO: 113630 - DNA, 25 bp, Homo sapien
tcgtacggagttcaagatggcggcc

SEQ ID NO: 113631 - DNA, 25 bp, Homo sapien
ctggtcgctcttggttaccctgcgc

SEQ ID NO: 113632 - DNA, 25 bp, Homo sapien
gggtttgactttgccaccgtctctc

SEQ ID NO: 113633 - DNA, 25 bp, Homo sapien
tggattctccggacagcaccgagga

SEQ ID NO: 113634 - DNA, 25 bp, Homo sapien
cgagacgcgtctcggattcgtcgga

SEQ ID NO: 113635 - DNA, 25 bp, Homo sapien
tctcggattcgtcggagtgcgcttg

SEQ ID NO: 113636 - DNA, 25 bp, Homo sapien
gagtacatttgctggattctccgga

SEQ ID NO: 113637 - DNA, 25 bp, Homo sapien
acagcaccgaggaggtaggtccgca

SEQ ID NO: 113638 - DNA, 25 bp, Homo sapien
taggtccgcagccaactttggagta

SEQ ID NO: 113639 - DNA, 25 bp, Homo sapien
ctttggagtagagtttaccgtagtg

SEQ ID NO: 113640 - DNA, 25 bp, Homo sapien
agggcgaacggacaggagtacattt

SEQ ID NO: 113641 - DNA, 25 bp, Homo sapien
gtacgcgtcgaactagcttggtgca

SEQ ID NO: 113642 - DNA, 25 bp, Homo sapien
gattggtttctagtgcgccctctcc

SEQ ID NO: 113643 - DNA, 25 bp, Homo sapien
ccagcgcgcgaaggattggtttcta

SEQ ID NO: 113644 - DNA, 25 bp, Homo sapien
gtcgagtgcgctgcaactttcctcc

SEQ ID NO: 113645 - DNA, 25 bp, Homo sapien
gcagccagcgccacattccatttaa

SEQ ID NO: 113646 - DNA, 25 bp, Homo sapien
cgcgtgtggatacgatgacatcatc

SEQ ID NO: 113647 - DNA, 25 bp, Homo sapien
gcagcgcgcgaaactctcaatcagg

SEQ ID NO: 113648 - DNA, 25 bp, Homo sapien
gctggtaaacaagcgcgcgcggcta

SEQ ID NO: 113649 - DNA, 25 bp, Homo sapien
gaagatttatgttccgactcgctcc

SEQ ID NO: 113650 - DNA, 25 bp, Homo sapien
gacgacgtccgcgagaatgcaaacc

SEQ ID NO: 113651 - DNA, 25 bp, Homo sapien
gctggtccgggttttctagcagccc

SEQ ID NO: 113652 - DNA, 25 bp, Homo sapien
ttcccggtgactccggatctgcttc

SEQ ID NO: 113653 - DNA, 25 bp, Homo sapien
ctataactttgtgctgctgccgcgg

SEQ ID NO: 113654 - DNA, 25 bp, Homo sapien
gcgccctgcgtgtgtctataacttt

SEQ ID NO: 113655 - DNA, 25 bp, Homo sapien
ccgcgctttgttgtcgttgagactc

SEQ ID NO: 113656 - DNA, 25 bp, Homo sapien
ccgtcagcctaggttgaggcgccct

SEQ ID NO: 113657 - DNA, 25 bp, Homo sapien
gcaccaattctaacgccagcacagt

SEQ ID NO: 113658 - DNA, 25 bp, Homo sapien
caagtataccaagagccgtggccgc

SEQ ID NO: 113659 - DNA, 25 bp, Homo sapien
tggatgcgtggacggacttccgttc

SEQ ID NO: 113660 - DNA, 25 bp, Homo sapien
catggacaatagcaacaagtatacc

SEQ ID NO: 113661 - DNA, 25 bp, Homo sapien
gggctgtctccatggacaatagcaa

SEQ ID NO: 113662 - DNA, 25 bp, Homo sapien
acggacttccgttcacgcaccaatt

SEQ ID NO: 113663 - DNA, 25 bp, Homo sapien
cccacgtcacgcagcagtgatgagc

SEQ ID NO: 113664 - DNA, 25 bp, Homo sapien
gccagcacagtcagtggccgcctgt

SEQ ID NO: 113665 - DNA, 25 bp, Homo sapien
ttctacgcatgcgttggcgggaccc

SEQ ID NO: 113666 - DNA, 25 bp, Homo sapien
gatgaattgaacctcgcagccgctg

SEQ ID NO: 113667 - DNA, 25 bp, Homo sapien
tgctatctccagtgctcatcacagg

SEQ ID NO: 113668 - DNA, 25 bp, Homo sapien
tcatcacaggtgctttgggtcaggt

SEQ ID NO: 113669 - DNA, 25 bp, Homo sapien
gtcgtccgcctgtgtgtcctcggat

SEQ ID NO: 113670 - DNA, 25 bp, Homo sapien
acgcctcggagcttctacgcatgcg

SEQ ID NO: 113671 - DNA, 25 bp, Homo sapien
tgctaaacgaaaagcggacacccgc

SEQ ID NO: 113672 - DNA, 25 bp, Homo sapien
caggtcggaagcctccttccctgag

SEQ ID NO: 113673 - DNA, 25 bp, Homo sapien
cgactgtgaggaggcaacgtgacct

SEQ ID NO: 113674 - DNA, 25 bp, Homo sapien
acgtgacctccgtgttgcacagggc

SEQ ID NO: 113675 - DNA, 25 bp, Homo sapien
cgaacagctaattctcaggtacgga

SEQ ID NO: 113676 - DNA, 25 bp, Homo sapien
ctgacgcggcgaggtgaaaaatcac

SEQ ID NO: 113677 - DNA, 25 bp, Homo sapien
gacgactcacggtgcgcaggtctcc

SEQ ID NO: 113678 - DNA, 25 bp, Homo sapien
cgcagtctctcccagcttagcattt

SEQ ID NO: 113679 - DNA, 25 bp, Homo sapien
ccctatctggggagcgttttcggat

SEQ ID NO: 113680 - DNA, 25 bp, Homo sapien
cttagcattttctgcccagggacga

SEQ ID NO: 113681 - DNA, 25 bp, Homo sapien
cctccagccattcggggcttttttg

SEQ ID NO: 113682 - DNA, 25 bp, Homo sapien
cggtaggacgtcttcgcgttgactt

SEQ ID NO: 113683 - DNA, 25 bp, Homo sapien
gtgacggcctcttcattactccaaa

SEQ ID NO: 113684 - DNA, 25 bp, Homo sapien
gtacactgagacttcgtcacacata

SEQ ID NO: 113685 - DNA, 25 bp, Homo sapien
tcccggacgtttggactctgtcctg

SEQ ID NO: 113686 - DNA, 25 bp, Homo sapien
tgccggctgctacgcatgcgtgact

SEQ ID NO: 113687 - DNA, 25 bp, Homo sapien
gcgacccgccgaggcaaagccttag

SEQ ID NO: 113688 - DNA, 25 bp, Homo sapien
aagacgctacttctccgatccctga

SEQ ID NO: 113689 - DNA, 25 bp, Homo sapien
aacatcggctggagcacggtgaacc

SEQ ID NO: 113690 - DNA, 25 bp, Homo sapien
ctccgaatctgacggggaggagaac

SEQ ID NO: 113691 - DNA, 25 bp, Homo sapien
gccaacggtggctccgaatctgacg

SEQ ID NO: 113692 - DNA, 25 bp, Homo sapien
agcgctcagccaacggtggctccga

SEQ ID NO: 113693 - DNA, 25 bp, Homo sapien
actttgaacgggatgaggagcgctc

SEQ ID NO: 113694 - DNA, 25 bp, Homo sapien
acgtccgagttctgccgcaccttgg

SEQ ID NO: 113695 - DNA, 25 bp, Homo sapien
tgttcaacgccacgtccgagttctg

SEQ ID NO: 113696 - DNA, 25 bp, Homo sapien
ggggccatcgtgttcaacgccacgt

SEQ ID NO: 113697 - DNA, 25 bp, Homo sapien
caccgggatgcactgctcctgcaga

SEQ ID NO: 113698 - DNA, 25 bp, Homo sapien
ccacctcggccactggaagaagagc

SEQ ID NO: 113699 - DNA, 25 bp, Homo sapien
tcgacacagccggtgaagaagcagc

SEQ ID NO: 113700 - DNA, 25 bp, Homo sapien
ccggcagcgattccagttcctgatc

SEQ ID NO: 113701 - DNA, 25 bp, Homo sapien
cccgaaccttgtgacgtcgagctaa

SEQ ID NO: 113702 - DNA, 25 bp, Homo sapien
gttgcccagtcacgcttcctggacg

SEQ ID NO: 113703 - DNA, 25 bp, Homo sapien
agctgaagcccatttccgggaagca

SEQ ID NO: 113704 - DNA, 25 bp, Homo sapien
acaggcggcgttctcactcgacaca

SEQ ID NO: 113705 - DNA, 25 bp, Homo sapien
cccggacgaccatgagagataagga

SEQ ID NO: 113706 - DNA, 25 bp, Homo sapien
gggtcccactcagtcgccagggaga

SEQ ID NO: 113707 - DNA, 25 bp, Homo sapien
taaacttcatggtggccctgcgatc

SEQ ID NO: 113708 - DNA, 25 bp, Homo sapien
ccctgcaacggggtaaacttcatgg

SEQ ID NO: 113709 - DNA, 25 bp, Homo sapien
ggactcagacgcacctggcctggac

SEQ ID NO: 113710 - DNA, 25 bp, Homo sapien
cctctagagacctgcgcgaggctgt

SEQ ID NO: 113711 - DNA, 25 bp, Homo sapien
tgctggatctgtacaacgccctgtc

SEQ ID NO: 113712 - DNA, 25 bp, Homo sapien
cctccaagcggttctcctggtgatc

SEQ ID NO: 113713 - DNA, 25 bp, Homo sapien
atgggcgctaaagtcgtcacgttcg

SEQ ID NO: 113714 - DNA, 25 bp, Homo sapien
tgccctcagattaccagacacgacg

SEQ ID NO: 113715 - DNA, 25 bp, Homo sapien
aggcacctcgacttgcaacacttcg

SEQ ID NO: 113716 - DNA, 25 bp, Homo sapien
gctaaggctcgcaacgctcagtcaa

SEQ ID NO: 113717 - DNA, 25 bp, Homo sapien
ggctcggacgataccaacgggaatc

SEQ ID NO: 113718 - DNA, 25 bp, Homo sapien
tgggagcttctgcaaatcgttcttc

SEQ ID NO: 113719 - DNA, 25 bp, Homo sapien
ctggacttgtctcatgcctgcgata

SEQ ID NO: 113720 - DNA, 25 bp, Homo sapien
ggctaggaattacgatgcactttta

SEQ ID NO: 113721 - DNA, 25 bp, Homo sapien
atttcggcagcggatcgcctttccg

SEQ ID NO: 113722 - DNA, 25 bp, Homo sapien
tcaactttgcgcctgttgctgggcc

SEQ ID NO: 113723 - DNA, 25 bp, Homo sapien
ctgcgactgcggatcttcaacctca

SEQ ID NO: 113724 - DNA, 25 bp, Homo sapien
gcggctgggcctttcctcaactttg

SEQ ID NO: 113725 - DNA, 25 bp, Homo sapien
cagcggcgctcttcgcaatctgaaa

SEQ ID NO: 113726 - DNA, 25 bp, Homo sapien
ccgcccacgacggaggtttctctgt

SEQ ID NO: 113727 - DNA, 25 bp, Homo sapien
gtttctctgtggttacctcagcggc

SEQ ID NO: 113728 - DNA, 25 bp, Homo sapien
ccgcctgcgaagaaggaacggtctg

SEQ ID NO: 113729 - DNA, 25 bp, Homo sapien
cgccgagacaggagatgaaagcctc

SEQ ID NO: 113730 - DNA, 25 bp, Homo sapien
cttgcgcgtgcaaggctagctcttt

SEQ ID NO: 113731 - DNA, 25 bp, Homo sapien
tcattacttctggatccctctaccg

SEQ ID NO: 113732 - DNA, 25 bp, Homo sapien
cccgggctttattcgcgactcatta

SEQ ID NO: 113733 - DNA, 25 bp, Homo sapien
ctcatgacggaagggcaaagatctt

SEQ ID NO: 113734 - DNA, 25 bp, Homo sapien
tgcctgacctgccaggcgtggttcc

SEQ ID NO: 113735 - DNA, 25 bp, Homo sapien
cggacgagggcagacggaatctcat

SEQ ID NO: 113736 - DNA, 25 bp, Homo sapien
ccgcttcctgttgggctggcaacca

SEQ ID NO: 113737 - DNA, 25 bp, Homo sapien
cttctgcgccgcaccggtttctgct

SEQ ID NO: 113738 - DNA, 25 bp, Homo sapien
gacgccgaaccacgtggcccgcaga

SEQ ID NO: 113739 - DNA, 25 bp, Homo sapien
caagagccgcttgcgcgcggacgcc

SEQ ID NO: 113740 - DNA, 25 bp, Homo sapien
agccacagccaacccggaagcgcgg

SEQ ID NO: 113741 - DNA, 25 bp, Homo sapien
tcgctgccaactcacccggcggcct

SEQ ID NO: 113742 - DNA, 25 bp, Homo sapien
cgcggcagacctaccgctcaggggc

SEQ ID NO: 113743 - DNA, 25 bp, Homo sapien
tggggccgccagacacactaggggc

SEQ ID NO: 113744 - DNA, 25 bp, Homo sapien
aagcgcggcgccaagagccgcttgc

SEQ ID NO: 113745 - DNA, 25 bp, Homo sapien
cggggttccgtgcaacagataccaa

SEQ ID NO: 113746 - DNA, 25 bp, Homo sapien
cgtgcaacagataccaagatgcctc

SEQ ID NO: 113747 - DNA, 25 bp, Homo sapien
cggaaggctccttacctggccgcag

SEQ ID NO: 113748 - DNA, 25 bp, Homo sapien
tcctcagggaagcaactgcctccag

SEQ ID NO: 113749 - DNA, 25 bp, Homo sapien
agggaagcaactgcctccagggact

SEQ ID NO: 113750 - DNA, 25 bp, Homo sapien
ttgccggggagacctctggccgcca

SEQ ID NO: 113751 - DNA, 25 bp, Homo sapien
gccgccacgcacctgctgcttggtg

SEQ ID NO: 113752 - DNA, 25 bp, Homo sapien
accaagatgcctccagggcggacca

SEQ ID NO: 113753 - DNA, 25 bp, Homo sapien
tatgagactagagctgtgagtaccc

SEQ ID NO: 113754 - DNA, 25 bp, Homo sapien
gctcggtccagaagctggttctgta

SEQ ID NO: 113755 - DNA, 25 bp, Homo sapien
agggatccggaaacacctgatcatc

SEQ ID NO: 113756 - DNA, 25 bp, Homo sapien
cctgatcatctataggtttagtgcc

SEQ ID NO: 113757 - DNA, 25 bp, Homo sapien
tttagtgcctaatgggtgttgttcc

SEQ ID NO: 113758 - DNA, 25 bp, Homo sapien
ttgttcctggctggacttgatgtcc

SEQ ID NO: 113759 - DNA, 25 bp, Homo sapien
tgaggggttttctcgccgagtctcc

SEQ ID NO: 113760 - DNA, 25 bp, Homo sapien
gacctctctatgatacgtcctccag

SEQ ID NO: 113761 - DNA, 25 bp, Homo sapien
ttcctggcagcctgaagtgtacacc

SEQ ID NO: 113762 - DNA, 25 bp, Homo sapien
ccaggactctccaggcttcgcaatg

SEQ ID NO: 113763 - DNA, 25 bp, Homo sapien
tccgcgtgggcatttcactcactca

SEQ ID NO: 113764 - DNA, 25 bp, Homo sapien
ggctgtggcctcatcttgcactttg

SEQ ID NO: 113765 - DNA, 25 bp, Homo sapien
tccctccctatgcagggtgcaaatc

SEQ ID NO: 113766 - DNA, 25 bp, Homo sapien
acgcccatgttcgtgctggtaggca

SEQ ID NO: 113767 - DNA, 25 bp, Homo sapien
ttccagtacttggtgccctcggaga

SEQ ID NO: 113768 - DNA, 25 bp, Homo sapien
tacaggcagccttggagaattgatc

SEQ ID NO: 113769 - DNA, 25 bp, Homo sapien
tccggccagtaaggaagagttcctc

SEQ ID NO: 113770 - DNA, 25 bp, Homo sapien
gatgcccgcactcgctttaccgtta

SEQ ID NO: 113771 - DNA, 25 bp, Homo sapien
ctcgacgcgcgagtgaacaacaccg

SEQ ID NO: 113772 - DNA, 25 bp, Homo sapien
agcggctccgtaactctgcccaagg

SEQ ID NO: 113773 - DNA, 25 bp, Homo sapien
cacgcaaacgcacgagctcgcttta

SEQ ID NO: 113774 - DNA, 25 bp, Homo sapien
gactcgcgctcaccgtgaaatcttg

SEQ ID NO: 113775 - DNA, 25 bp, Homo sapien
ccttcttcatgcttcggcagcggtc

SEQ ID NO: 113776 - DNA, 25 bp, Homo sapien
atgttttcagacaccgactcgcgga

SEQ ID NO: 113777 - DNA, 25 bp, Homo sapien
aggtctccagtgttcccagttccca

SEQ ID NO: 113778 - DNA, 25 bp, Homo sapien
gttctagtggcttgaggtatccgca

SEQ ID NO: 113779 - DNA, 25 bp, Homo sapien
ggggcgcctcaactctatagctcta

SEQ ID NO: 113780 - DNA, 25 bp, Homo sapien
actgcgcgagaagcgagaccttaga

SEQ ID NO: 113781 - DNA, 25 bp, Homo sapien
tggaggcctatctccctcagaactg

SEQ ID NO: 113782 - DNA, 25 bp, Homo sapien
ggatcgtccacgactcacttcaagg

SEQ ID NO: 113783 - DNA, 25 bp, Homo sapien
gagtctgagtctgatccctccgaaa

SEQ ID NO: 113784 - DNA, 25 bp, Homo sapien
acgccaggtccgtcaagcctaagtc

SEQ ID NO: 113785 - DNA, 25 bp, Homo sapien
tgcacttgactaaatcgccttcatc

SEQ ID NO: 113786 - DNA, 25 bp, Homo sapien
ttgccgtcatgtcggctgcgattgc

SEQ ID NO: 113787 - DNA, 25 bp, Homo sapien
ggccgcttcctatggttcgggttca

SEQ ID NO: 113788 - DNA, 25 bp, Homo sapien
cgactccctcatgcacttgactaaa

SEQ ID NO: 113789 - DNA, 25 bp, Homo sapien
tcgccttcatcaaagccgtctctag

SEQ ID NO: 113790 - DNA, 25 bp, Homo sapien
cgtctctagcagtggcagtggactc

SEQ ID NO: 113791 - DNA, 25 bp, Homo sapien
cagggtctccgcagaagatttgttg

SEQ ID NO: 113792 - DNA, 25 bp, Homo sapien
tcggactcggacagtgagagcagtc

SEQ ID NO: 113793 - DNA, 25 bp, Homo sapien
cgtccttcttcacgggatgcgcgga

SEQ ID NO: 113794 - DNA, 25 bp, Homo sapien
gggatgcgcggagcctagaagggcg

SEQ ID NO: 113795 - DNA, 25 bp, Homo sapien
ggatgcgcggagcctagaagggcgc

SEQ ID NO: 113796 - DNA, 25 bp, Homo sapien
gatgcgcggagcctagaagggcgcc

SEQ ID NO: 113797 - DNA, 25 bp, Homo sapien
atgcgcggagcctagaagggcgccc

SEQ ID NO: 113798 - DNA, 25 bp, Homo sapien
tgcgcggagcctagaagggcgcccg

SEQ ID NO: 113799 - DNA, 25 bp, Homo sapien
gcgcggagcctagaagggcgcccgg

SEQ ID NO: 113800 - DNA, 25 bp, Homo sapien
gtccttcttcacgggatgcgcggag

SEQ ID NO: 113801 - DNA, 25 bp, Homo sapien
cccaagtactggctgaatagtgaat

SEQ ID NO: 113802 - DNA, 25 bp, Homo sapien
aagatgcgacccgtggagccgccta

SEQ ID NO: 113803 - DNA, 25 bp, Homo sapien
agtctatctgggcactgaaagatgc

SEQ ID NO: 113804 - DNA, 25 bp, Homo sapien
ttggccgcacttcagtctatctggg

SEQ ID NO: 113805 - DNA, 25 bp, Homo sapien
aatgaactccgcttggccgcacttc

SEQ ID NO: 113806 - DNA, 25 bp, Homo sapien
agtgaatgaactccgcttggccgca

SEQ ID NO: 113807 - DNA, 25 bp, Homo sapien
actggctgaatagtgaatgaactcc

SEQ ID NO: 113808 - DNA, 25 bp, Homo sapien
ccgtggagccgcctaagagagcaca

SEQ ID NO: 113809 - DNA, 25 bp, Homo sapien
ttcccatgtgagacggtggttgtgc

SEQ ID NO: 113810 - DNA, 25 bp, Homo sapien
gacagatcatgggtgcactggctac

SEQ ID NO: 113811 - DNA, 25 bp, Homo sapien
acggcattacttactggaatgattc

SEQ ID NO: 113812 - DNA, 25 bp, Homo sapien
gacgctcatcttttaacggcattac

SEQ ID NO: 113813 - DNA, 25 bp, Homo sapien
agccacgtcaaagacgctcatcttt

SEQ ID NO: 113814 - DNA, 25 bp, Homo sapien
ctcgccaaaggagcacacgggtctc

SEQ ID NO: 113815 - DNA, 25 bp, Homo sapien
tcacgggcctccttcccatgtgaga

SEQ ID NO: 113816 - DNA, 25 bp, Homo sapien
tcagcggacagatcatgggtgcact

SEQ ID NO: 113817 - DNA, 25 bp, Homo sapien
gggccagaaaaagcgcattcctaac

SEQ ID NO: 113818 - DNA, 25 bp, Homo sapien
gcgtaaccttatcctgccctgccga

SEQ ID NO: 113819 - DNA, 25 bp, Homo sapien
cccggctgtacagggtccctcaaga

SEQ ID NO: 113820 - DNA, 25 bp, Homo sapien
tgtacagggtccctcaagaggtgcc

SEQ ID NO: 113821 - DNA, 25 bp, Homo sapien
agggtccctcaagaggtgccctccg

SEQ ID NO: 113822 - DNA, 25 bp, Homo sapien
cggagctgaaagacatagggccaga

SEQ ID NO: 113823 - DNA, 25 bp, Homo sapien
aaagcgcattcctaacgggatcccg

SEQ ID NO: 113824 - DNA, 25 bp, Homo sapien
ggcctccaaagcctgacggagctga

SEQ ID NO: 113825 - DNA, 25 bp, Homo sapien
ttctagaaggcgatgctttggaagc

SEQ ID NO: 113826 - DNA, 25 bp, Homo sapien
actacggggcctgtcttctagaagg

SEQ ID NO: 113827 - DNA, 25 bp, Homo sapien
cactctctctcggagtagtgggagc

SEQ ID NO: 113828 - DNA, 25 bp, Homo sapien
cacagagatgatggaactacggggc

SEQ ID NO: 113829 - DNA, 25 bp, Homo sapien
gtcaggggtcaggtctgaaaacaca

SEQ ID NO: 113830 - DNA, 25 bp, Homo sapien
tttaagtggcgggaaatgctgaccg

SEQ ID NO: 113831 - DNA, 25 bp, Homo sapien
tggcgggcacgcgtatcaaacaaac

SEQ ID NO: 113832 - DNA, 25 bp, Homo sapien
ggctgcccggagctaaaacactctc

SEQ ID NO: 113833 - DNA, 25 bp, Homo sapien
ggcaacaggcgcactccgagcgagc

SEQ ID NO: 113834 - DNA, 25 bp, Homo sapien
gaggcctagaggagaagcccagcta

SEQ ID NO: 113835 - DNA, 25 bp, Homo sapien
ccagcgcgaggctgtattctgttcc

SEQ ID NO: 113836 - DNA, 25 bp, Homo sapien
tcgagccagatctccagccagatgc

SEQ ID NO: 113837 - DNA, 25 bp, Homo sapien
cgcctgggaaaagttgtcgctgaga

SEQ ID NO: 113838 - DNA, 25 bp, Homo sapien
gagatgttttcggatcgcgagcgcc

SEQ ID NO: 113839 - DNA, 25 bp, Homo sapien
accctggctcttggcaccatgtctg

SEQ ID NO: 113840 - DNA, 25 bp, Homo sapien
agtatcttcggcttttttcctgccg

SEQ ID NO: 113841 - DNA, 25 bp, Homo sapien
acaccttcggcatggagagcacgca

SEQ ID NO: 113842 - DNA, 25 bp, Homo sapien
ttgtggctaagcaaggcacctcctt

SEQ ID NO: 113843 - DNA, 25 bp, Homo sapien
gctatccctttgttgccaggcatgg

SEQ ID NO: 113844 - DNA, 25 bp, Homo sapien
cctgcgtgccatctacgaagctatc

SEQ ID NO: 113845 - DNA, 25 bp, Homo sapien
cgtagacgaaaacagcggcgactca

SEQ ID NO: 113846 - DNA, 25 bp, Homo sapien
gagtgcctcttccatgtgggcgaca

SEQ ID NO: 113847 - DNA, 25 bp, Homo sapien
ttaagtcgtgctgagtacggccacc

SEQ ID NO: 113848 - DNA, 25 bp, Homo sapien
tcctcagcaactcgtcggggtccga

SEQ ID NO: 113849 - DNA, 25 bp, Homo sapien
ggaagttccacaacgaccgtcacta

SEQ ID NO: 113850 - DNA, 25 bp, Homo sapien
ggcgctcagccgattggaagttcca

SEQ ID NO: 113851 - DNA, 25 bp, Homo sapien
tttccgcctcgccttgtagacgtga

SEQ ID NO: 113852 - DNA, 25 bp, Homo sapien
cgccagcttcgccttgaaatcataa

SEQ ID NO: 113853 - DNA, 25 bp, Homo sapien
cgcggtccgccttcagcaagggact

SEQ ID NO: 113854 - DNA, 25 bp, Homo sapien
gccgtggcttcctcgagctcattag

SEQ ID NO: 113855 - DNA, 25 bp, Homo sapien
gctcattagcgaactcactggcccg

SEQ ID NO: 113856 - DNA, 25 bp, Homo sapien
gtaggtgccgcgtcccactttgcac

SEQ ID NO: 113857 - DNA, 25 bp, Homo sapien
ccgacatttccctccgtagtagttg

SEQ ID NO: 113858 - DNA, 25 bp, Homo sapien
ggagcccgagttccctcagctttca

SEQ ID NO: 113859 - DNA, 25 bp, Homo sapien
gcagcccgacgcaaaccaaggatct

SEQ ID NO: 113860 - DNA, 25 bp, Homo sapien
gctgcacattttttcgaagggaccg

SEQ ID NO: 113861 - DNA, 25 bp, Homo sapien
ctcacggtgatggaagctgcacatt

SEQ ID NO: 113862 - DNA, 25 bp, Homo sapien
tggttgttcgctagtctcacggtga

SEQ ID NO: 113863 - DNA, 25 bp, Homo sapien
gctcgctctactctctctaacggga

SEQ ID NO: 113864 - DNA, 25 bp, Homo sapien
cttacacagtatggccggcgacatt

SEQ ID NO: 113865 - DNA, 25 bp, Homo sapien
aataagctgcttcgcctcggagctg

SEQ ID NO: 113866 - DNA, 25 bp, Homo sapien
ggagcggcaggaacccaataagctg

SEQ ID NO: 113867 - DNA, 25 bp, Homo sapien
ttctggcagaagcaatttgcgcggc

SEQ ID NO: 113868 - DNA, 25 bp, Homo sapien
ccggaagccgacatctcgagttctg

SEQ ID NO: 113869 - DNA, 25 bp, Homo sapien
tgctctgaggcaccgagaaacgagg

SEQ ID NO: 113870 - DNA, 25 bp, Homo sapien
cctcggagctgaagcccgtactcaa

SEQ ID NO: 113871 - DNA, 25 bp, Homo sapien
tagtaagcgctacgccaaaagcctg

SEQ ID NO: 113872 - DNA, 25 bp, Homo sapien
cttgggaccttagccctaatcgtca

SEQ ID NO: 113873 - DNA, 25 bp, Homo sapien
cagcatctactacttccgagacacg

SEQ ID NO: 113874 - DNA, 25 bp, Homo sapien
ttccgagacacgcacatcatcaagg

SEQ ID NO: 113875 - DNA, 25 bp, Homo sapien
caggagcgcatggtcggagaactcc

SEQ ID NO: 113876 - DNA, 25 bp, Homo sapien
ctacaacatgggcagcaacagcatc

SEQ ID NO: 113877 - DNA, 25 bp, Homo sapien
gagaactccgggacctgtcgcccga

SEQ ID NO: 113878 - DNA, 25 bp, Homo sapien
cccagcgggtaaaagctgcgcggcc

SEQ ID NO: 113879 - DNA, 25 bp, Homo sapien
aagctcggcactcacggctctgagg

SEQ ID NO: 113880 - DNA, 25 bp, Homo sapien
actgacggccatggcgcgttcgaac

SEQ ID NO: 113881 - DNA, 25 bp, Homo sapien
gtggtactgtctcggcctctcactc

SEQ ID NO: 113882 - DNA, 25 bp, Homo sapien
taaccaagacaacagggcgcgattc

SEQ ID NO: 113883 - DNA, 25 bp, Homo sapien
agggcgcgattccaatcaagatggc

SEQ ID NO: 113884 - DNA, 25 bp, Homo sapien
acgtaatcgccgagggcacgtgcat

SEQ ID NO: 113885 - DNA, 25 bp, Homo sapien
ccctggttaagagttgcaggtagcg

SEQ ID NO: 113886 - DNA, 25 bp, Homo sapien
agcggtagcgatggacactctggat

SEQ ID NO: 113887 - DNA, 25 bp, Homo sapien
gggccgatcgatcaccagcccgggt

SEQ ID NO: 113888 - DNA, 25 bp, Homo sapien
ctctggatcgagtagtgtaagtgcg

SEQ ID NO: 113889 - DNA, 25 bp, Homo sapien
atccagaacgcttgcggggtgctct

SEQ ID NO: 113890 - DNA, 25 bp, Homo sapien
catgctggaaaccttcggctccaaa

SEQ ID NO: 113891 - DNA, 25 bp, Homo sapien
ggtgctcttcgtgtccatgctggaa

SEQ ID NO: 113892 - DNA, 25 bp, Homo sapien
tccgaggcccaatcatctggaggct

SEQ ID NO: 113893 - DNA, 25 bp, Homo sapien
tcggtgttcggcatccagaacgctt

SEQ ID NO: 113894 - DNA, 25 bp, Homo sapien
cggctccaaagacgatgacaagatg

SEQ ID NO: 113895 - DNA, 25 bp, Homo sapien
gtgtctgcctccgagtgtgcatgtc

SEQ ID NO: 113896 - DNA, 25 bp, Homo sapien
acctagaggcttcagtgtcgatccc

SEQ ID NO: 113897 - DNA, 25 bp, Homo sapien
gccagcctctgtgagctcagctaag

SEQ ID NO: 113898 - DNA, 25 bp, Homo sapien
tgcctaggctagagagctacgtccg

SEQ ID NO: 113899 - DNA, 25 bp, Homo sapien
acgtccggtctcctaggcaaccata

SEQ ID NO: 113900 - DNA, 25 bp, Homo sapien
tcaacttccggcttgaggcacgata

SEQ ID NO: 113901 - DNA, 25 bp, Homo sapien
gagcgagcgtcttttgccacgaaca

SEQ ID NO: 113902 - DNA, 25 bp, Homo sapien
gcgtgccgaagttcctcttctctgc

SEQ ID NO: 113903 - DNA, 25 bp, Homo sapien
ctccagaagttctgctgagaagcgc

SEQ ID NO: 113904 - DNA, 25 bp, Homo sapien
ggcagcaagacgacttctccggagc

SEQ ID NO: 113905 - DNA, 25 bp, Homo sapien
tgcgtgaacatgtcggccgtgtaca

SEQ ID NO: 113906 - DNA, 25 bp, Homo sapien
agaccagagccgtcggcgtccacgt

SEQ ID NO: 113907 - DNA, 25 bp, Homo sapien
tcggccgtgtacaggtgcttgctgt

SEQ ID NO: 113908 - DNA, 25 bp, Homo sapien
ctctggatcccgtgcgtgaacatgt

SEQ ID NO: 113909 - DNA, 25 bp, Homo sapien
ttaccagggcgcgaagaacatgacg

SEQ ID NO: 113910 - DNA, 25 bp, Homo sapien
aacatgacgaagtgcgcggcgctct

SEQ ID NO: 113911 - DNA, 25 bp, Homo sapien
tacaggtgcttgctgtgcgggtcct

SEQ ID NO: 113912 - DNA, 25 bp, Homo sapien
tgggagagccttccgagtccggcct

SEQ ID NO: 113913 - DNA, 25 bp, Homo sapien
caggctgcagctcttgttgccatga

SEQ ID NO: 113914 - DNA, 25 bp, Homo sapien
caaggtaagaaaatccgcccgcgtg

SEQ ID NO: 113915 - DNA, 25 bp, Homo sapien
gccatgtagtagtctgcagtcacta

SEQ ID NO: 113916 - DNA, 25 bp, Homo sapien
ttactgaaaacatgttcgccgccgc

SEQ ID NO: 113917 - DNA, 25 bp, Homo sapien
gcagccgctgagacggtttttcaca

SEQ ID NO: 113918 - DNA, 25 bp, Homo sapien
tgatgtcacggacgcaaccactggg

SEQ ID NO: 113919 - DNA, 25 bp, Homo sapien
caccgatctcatggatgggctccga

SEQ ID NO: 113920 - DNA, 25 bp, Homo sapien
ccgccatttcacatccagcagagga

SEQ ID NO: 113921 - DNA, 25 bp, Homo sapien
cgttactgtggcagcgggcatccca

SEQ ID NO: 113922 - DNA, 25 bp, Homo sapien
ggctccgctcctgacagatggcgca

SEQ ID NO: 113923 - DNA, 25 bp, Homo sapien
cagatggcgcaactgcaacgacgcg

SEQ ID NO: 113924 - DNA, 25 bp, Homo sapien
ctgctcgctgctactcttgctgatg

SEQ ID NO: 113925 - DNA, 25 bp, Homo sapien
tcctccggtgcaaccgcgggaagac

SEQ ID NO: 113926 - DNA, 25 bp, Homo sapien
agctgcgagccgcaaccattggcgc

SEQ ID NO: 113927 - DNA, 25 bp, Homo sapien
gtctcgaaggccttcggctcgcggc

SEQ ID NO: 113928 - DNA, 25 bp, Homo sapien
agccgcaaccattggcgcctggggc

SEQ ID NO: 113929 - DNA, 25 bp, Homo sapien
tgctcccttagtgccaggtcccaga

SEQ ID NO: 113930 - DNA, 25 bp, Homo sapien
ctctgctagagagctgccgtaagtc

SEQ ID NO: 113931 - DNA, 25 bp, Homo sapien
ccgtcgctaagcacgtctgtaggtt

SEQ ID NO: 113932 - DNA, 25 bp, Homo sapien
gccttgtcaacatcttcgagcatcg

SEQ ID NO: 113933 - DNA, 25 bp, Homo sapien
agcagcagccgatctggtttccgca

SEQ ID NO: 113934 - DNA, 25 bp, Homo sapien
gcacttgcgtgtcaccgttaccgta

SEQ ID NO: 113935 - DNA, 25 bp, Homo sapien
gcccggcgtagcttaccctgtacga

SEQ ID NO: 113936 - DNA, 25 bp, Homo sapien
ggttttccgtcagaaggccgcgcaa

SEQ ID NO: 113937 - DNA, 25 bp, Homo sapien
gagctcaaagccatttctccgctga

SEQ ID NO: 113938 - DNA, 25 bp, Homo sapien
gtggcaatggcagggacactgtacc

SEQ ID NO: 113939 - DNA, 25 bp, Homo sapien
ggtcttgcctgccaaccgctgagct

SEQ ID NO: 113940 - DNA, 25 bp, Homo sapien
tgtcaaaaggaaaagcgttgtcgtc

SEQ ID NO: 113941 - DNA, 25 bp, Homo sapien
tctccgctgacatccagtagtgctc

SEQ ID NO: 113942 - DNA, 25 bp, Homo sapien
atccagtagtgctcttccagggctc

SEQ ID NO: 113943 - DNA, 25 bp, Homo sapien
ggcggtgcctcgcttattttccctc

SEQ ID NO: 113944 - DNA, 25 bp, Homo sapien
tcctctccgtgtgcagtatcccgag

SEQ ID NO: 113945 - DNA, 25 bp, Homo sapien
gacattccctttttctaagtccaga

SEQ ID NO: 113946 - DNA, 25 bp, Homo sapien
tccaagaacccactagcatgtaatc

SEQ ID NO: 113947 - DNA, 25 bp, Homo sapien
aggctgcttgctgctatcattgcta

SEQ ID NO: 113948 - DNA, 25 bp, Homo sapien
aggctttgccgacgaccgacattcc

SEQ ID NO: 113949 - DNA, 25 bp, Homo sapien
taagtccagatacagagctccaaga

SEQ ID NO: 113950 - DNA, 25 bp, Homo sapien
tttgcggctggatactaaagcatca

SEQ ID NO: 113951 - DNA, 25 bp, Homo sapien
catcagggtgaaggaaaggctgctt

SEQ ID NO: 113952 - DNA, 25 bp, Homo sapien
gagcacacagggagcaagttatttg

SEQ ID NO: 113953 - DNA, 25 bp, Homo sapien
gtacaccgcggtgcggaggtacata

SEQ ID NO: 113954 - DNA, 25 bp, Homo sapien
cacctccgggtaggtctggttctcg

SEQ ID NO: 113955 - DNA, 25 bp, Homo sapien
ctggttctcgccagtggccatggaa

SEQ ID NO: 113956 - DNA, 25 bp, Homo sapien
ggttcaccgggtatcctactgcgtc

SEQ ID NO: 113957 - DNA, 25 bp, Homo sapien
ggctccggcaggtgaacaccttcta

SEQ ID NO: 113958 - DNA, 25 bp, Homo sapien
ggtgaacaccttctagagcagctgc

SEQ ID NO: 113959 - DNA, 25 bp, Homo sapien
agagcagctgcagctaccgttgcgg

SEQ ID NO: 113960 - DNA, 25 bp, Homo sapien
gacacggagacagcggattagagcc

SEQ ID NO: 113961 - DNA, 25 bp, Homo sapien
ccctcagccgcacatttggagcaga

SEQ ID NO: 113962 - DNA, 25 bp, Homo sapien
tagcgggtccttctgtctcgggccg

SEQ ID NO: 113963 - DNA, 25 bp, Homo sapien
cgcctagcgggtccttctgtctcgg

SEQ ID NO: 113964 - DNA, 25 bp, Homo sapien
tgcggcgcgaacagcaccgcctccc

SEQ ID NO: 113965 - DNA, 25 bp, Homo sapien
atgcgctccctagtggctgcggcgc

SEQ ID NO: 113966 - DNA, 25 bp, Homo sapien
agcagatgcgctccctagtggctgc

SEQ ID NO: 113967 - DNA, 25 bp, Homo sapien
tttggagcagatgcgctccctagtg

SEQ ID NO: 113968 - DNA, 25 bp, Homo sapien
tcagccgcacatttggagcagatgc

SEQ ID NO: 113969 - DNA, 25 bp, Homo sapien
catttcctcgttcgtggggctctct

SEQ ID NO: 113970 - DNA, 25 bp, Homo sapien
tgccttgttggtttcagcccgaccg

SEQ ID NO: 113971 - DNA, 25 bp, Homo sapien
cggacttcgtctttagggcacttgc

SEQ ID NO: 113972 - DNA, 25 bp, Homo sapien
ctttgcttgctacgtttcggacttc

SEQ ID NO: 113973 - DNA, 25 bp, Homo sapien
caaagggcgtttgctgtgtcaacta

SEQ ID NO: 113974 - DNA, 25 bp, Homo sapien
tggctctgtgccttcttccaaaggg

SEQ ID NO: 113975 - DNA, 25 bp, Homo sapien
atgtgaaacgtaggcgcgaaccacc

SEQ ID NO: 113976 - DNA, 25 bp, Homo sapien
aaccacctgagctttgtttgcggac

SEQ ID NO: 113977 - DNA, 25 bp, Homo sapien
gagataatcgaagaacttttctccc

SEQ ID NO: 113978 - DNA, 25 bp, Homo sapien
aagagcaagcttttgtgagataatc

SEQ ID NO: 113979 - DNA, 25 bp, Homo sapien
agcaagcttttgtgagataatcgaa

SEQ ID NO: 113980 - DNA, 25 bp, Homo sapien
caagcttttgtgagataatcgaaga

SEQ ID NO: 113981 - DNA, 25 bp, Homo sapien
ttgtgagataatcgaagaacttttc

SEQ ID NO: 113982 - DNA, 25 bp, Homo sapien
ccgtttgtttgttggagtggtgcca

SEQ ID NO: 113983 - DNA, 25 bp, Homo sapien
gcagagtaaaagagcaagcttttgt

SEQ ID NO: 113984 - DNA, 25 bp, Homo sapien
agtggtgccaggtactggttttgga

SEQ ID NO: 113985 - DNA, 25 bp, Homo sapien
cccaaacctgcgttgccacgaatgg

SEQ ID NO: 113986 - DNA, 25 bp, Homo sapien
acgggttaagatgcggccaaatgtc

SEQ ID NO: 113987 - DNA, 25 bp, Homo sapien
tccttgactgtacgccatgggctcc

SEQ ID NO: 113988 - DNA, 25 bp, Homo sapien
gcagaggtgccgaaagctcggaatc

SEQ ID NO: 113989 - DNA, 25 bp, Homo sapien
ggccctgttagggtgaacaacctgc

SEQ ID NO: 113990 - DNA, 25 bp, Homo sapien
aggcggcgccatacacagtgttaaa

SEQ ID NO: 113991 - DNA, 25 bp, Homo sapien
ctttcgctgcgcaagtagatccagg

SEQ ID NO: 113992 - DNA, 25 bp, Homo sapien
aagagggtctcgttctaactgtgcc

SEQ ID NO: 113993 - DNA, 25 bp, Homo sapien
gctgcagagtggctgccagtccaca

SEQ ID NO: 113994 - DNA, 25 bp, Homo sapien
cgagctcccaaaggcagcggagaaa

SEQ ID NO: 113995 - DNA, 25 bp, Homo sapien
ggtccctggcgaccagctgcagagt

SEQ ID NO: 113996 - DNA, 25 bp, Homo sapien
cctccatcacttgggcgcgcaggag

SEQ ID NO: 113997 - DNA, 25 bp, Homo sapien
tgtgtgtgtctaagcgaatctcttc

SEQ ID NO: 113998 - DNA, 25 bp, Homo sapien
cactcagtgtgactgggatcttccc

SEQ ID NO: 113999 - DNA, 25 bp, Homo sapien
ccgcccaaaagagcaacactcagtg

SEQ ID NO: 114000 - DNA, 25 bp, Homo sapien
cccagttggactgaggtcgcagctt

SEQ ID NO: 114001 - DNA, 25 bp, Homo sapien
cgggttctgtaaagacacgtggaga

SEQ ID NO: 114002 - DNA, 25 bp, Homo sapien
tttttcctgacgcagggtccaagca

SEQ ID NO: 114003 - DNA, 25 bp, Homo sapien
ggtccaagcagtcagcttgagctta

SEQ ID NO: 114004 - DNA, 25 bp, Homo sapien
ctgtgaaagcggaaagtctcctctg

SEQ ID NO: 114005 - DNA, 25 bp, Homo sapien
cagcagccggctcgatgacaggtct

SEQ ID NO: 114006 - DNA, 25 bp, Homo sapien
ctcctctgaggaaagcggttgaact

SEQ ID NO: 114007 - DNA, 25 bp, Homo sapien
aggcggcgttcgctcctctgggact

SEQ ID NO: 114008 - DNA, 25 bp, Homo sapien
gacacgtggagaagattcgattccg

SEQ ID NO: 114009 - DNA, 25 bp, Homo sapien
tgtgtcgctacaacctgcccgagag

SEQ ID NO: 114010 - DNA, 25 bp, Homo sapien
aggacgcgagctgactacctgactc

SEQ ID NO: 114011 - DNA, 25 bp, Homo sapien
gaacagatcaggagtcgccggcatt

SEQ ID NO: 114012 - DNA, 25 bp, Homo sapien
gattcgacctggaccacactctgtg

SEQ ID NO: 114013 - DNA, 25 bp, Homo sapien
ggctcctaggcttgcggaacagatc

SEQ ID NO: 114014 - DNA, 25 bp, Homo sapien
tacgtgcctacaggtctcagctgtg

SEQ ID NO: 114015 - DNA, 25 bp, Homo sapien
gccctcgggaaaggctacgtgccta

SEQ ID NO: 114016 - DNA, 25 bp, Homo sapien
aggcgatggagtgtcccggttaatt

SEQ ID NO: 114017 - DNA, 25 bp, Homo sapien
gcgcggttgactacgcttatcaatc

SEQ ID NO: 114018 - DNA, 25 bp, Homo sapien
ggccacagtcgacaggatcctggga

SEQ ID NO: 114019 - DNA, 25 bp, Homo sapien
acctgtgtcgcctcggtttcttcac

SEQ ID NO: 114020 - DNA, 25 bp, Homo sapien
cgagaactctctgcgcggttgacta

SEQ ID NO: 114021 - DNA, 25 bp, Homo sapien
gcgtcgtaacatcgcgcgagaactc

SEQ ID NO: 114022 - DNA, 25 bp, Homo sapien
cgagctctgcccgaaacgtctagca

SEQ ID NO: 114023 - DNA, 25 bp, Homo sapien
ccaggccgctcattttggaagaagt

SEQ ID NO: 114024 - DNA, 25 bp, Homo sapien
tctcggtccggatctcctgaggcat

SEQ ID NO: 114025 - DNA, 25 bp, Homo sapien
cgccacagatttctagggccttctc

SEQ ID NO: 114026 - DNA, 25 bp, Homo sapien
tcacggtatcgcgagaacttgctga

SEQ ID NO: 114027 - DNA, 25 bp, Homo sapien
tcactaacatttcagcggcggtgtc

SEQ ID NO: 114028 - DNA, 25 bp, Homo sapien
gcgaacgcccgttttcctcagaggc

SEQ ID NO: 114029 - DNA, 25 bp, Homo sapien
atccaggccgctcatgttgctaaca

SEQ ID NO: 114030 - DNA, 25 bp, Homo sapien
gtcgctcgggacttggtcagaaata

SEQ ID NO: 114031 - DNA, 25 bp, Homo sapien
ggtcggctgccatcaccacagaagc

SEQ ID NO: 114032 - DNA, 25 bp, Homo sapien
tgcccggctttgatcgccacatgac

SEQ ID NO: 114033 - DNA, 25 bp, Homo sapien
atcgcattccgtgcgtcggatctgg

SEQ ID NO: 114034 - DNA, 25 bp, Homo sapien
gatgagaacctggagatcgcattcc

SEQ ID NO: 114035 - DNA, 25 bp, Homo sapien
accgagccgggaacacgatgagaac

SEQ ID NO: 114036 - DNA, 25 bp, Homo sapien
ctgacgcgtgaagcctgagccacgg

SEQ ID NO: 114037 - DNA, 25 bp, Homo sapien
cgacgccggagagaacgaagcctcg

SEQ ID NO: 114038 - DNA, 25 bp, Homo sapien
gctctcagtagcgtcgcccgaggct

SEQ ID NO: 114039 - DNA, 25 bp, Homo sapien
ggcaaccctactttgcggctgcaga

SEQ ID NO: 114040 - DNA, 25 bp, Homo sapien
gccgcgatttcctcgacggtccttg

SEQ ID NO: 114041 - DNA, 25 bp, Homo sapien
tgtgcacgcaaatcagcgcggccgc

SEQ ID NO: 114042 - DNA, 25 bp, Homo sapien
tcttctccgccgtggcattccagtg

SEQ ID NO: 114043 - DNA, 25 bp, Homo sapien
cgtcggacgtgcaggacctcctgaa

SEQ ID NO: 114044 - DNA, 25 bp, Homo sapien
tgctggacctgcacgtcaagcacca

SEQ ID NO: 114045 - DNA, 25 bp, Homo sapien
tgccgtgcaaccaggccaaggcgtc

SEQ ID NO: 114046 - DNA, 25 bp, Homo sapien
gcgccttttacgagtgcgcggccac

SEQ ID NO: 114047 - DNA, 25 bp, Homo sapien
cgagaggccgagctttctcagggcc

SEQ ID NO: 114048 - DNA, 25 bp, Homo sapien
acctcctgaaggatctgaaggctca

SEQ ID NO: 114049 - DNA, 25 bp, Homo sapien
agcctttcacactcaacaatgggga

SEQ ID NO: 114050 - DNA, 25 bp, Homo sapien
cccggtagcagctttgtttgcattg

SEQ ID NO: 114051 - DNA, 25 bp, Homo sapien
agggcctctggtcttgaaccacttc

SEQ ID NO: 114052 - DNA, 25 bp, Homo sapien
tggcgatccacacgcgccttttgga

SEQ ID NO: 114053 - DNA, 25 bp, Homo sapien
cgccgaggaccaggttagctcataa

SEQ ID NO: 114054 - DNA, 25 bp, Homo sapien
gcggccatttactgccctgtgattg

SEQ ID NO: 114055 - DNA, 25 bp, Homo sapien
caactggggctgcattttaaacacc

SEQ ID NO: 114056 - DNA, 25 bp, Homo sapien
tttcctgtgacctagctgcggtgca

SEQ ID NO: 114057 - DNA, 25 bp, Homo sapien
cataatgtccaccttgcggctgggc

SEQ ID NO: 114058 - DNA, 25 bp, Homo sapien
tcatgacgagcgagaaaacctcctc

SEQ ID NO: 114059 - DNA, 25 bp, Homo sapien
caacaggtagttcgagtactggacc

SEQ ID NO: 114060 - DNA, 25 bp, Homo sapien
acaggatgttctgcaccgtcgtgcc

SEQ ID NO: 114061 - DNA, 25 bp, Homo sapien
ctcggcaaagcgaaacaggatgttc

SEQ ID NO: 114062 - DNA, 25 bp, Homo sapien
tagcagaactggtgctcgcagctcg

SEQ ID NO: 114063 - DNA, 25 bp, Homo sapien
gctcgcgcaggatggtgacatagac

SEQ ID NO: 114064 - DNA, 25 bp, Homo sapien
ccgccgggcaggtcatagcccataa

SEQ ID NO: 114065 - DNA, 25 bp, Homo sapien
tatccttcactgacgcgcgatgccg

SEQ ID NO: 114066 - DNA, 25 bp, Homo sapien
ctgtaggtgtccttggcgaatgcca

SEQ ID NO: 114067 - DNA, 25 bp, Homo sapien
tgtgggacaggcagcaaatcagtgc

SEQ ID NO: 114068 - DNA, 25 bp, Homo sapien
cctggccaggcagaacgagtcgaac

SEQ ID NO: 114069 - DNA, 25 bp, Homo sapien
gctgcagttaagcaagccgggtctg

SEQ ID NO: 114070 - DNA, 25 bp, Homo sapien
gagcaagggccacgatgacagatta

SEQ ID NO: 114071 - DNA, 25 bp, Homo sapien
aggccctggagtccatctaccctga

SEQ ID NO: 114072 - DNA, 25 bp, Homo sapien
ggcctttcagcccagactcatcgag

SEQ ID NO: 114073 - DNA, 25 bp, Homo sapien
ggtcgtccctttgcacacacggagg

SEQ ID NO: 114074 - DNA, 25 bp, Homo sapien
gtacctacagcatggccaccgcaag

SEQ ID NO: 114075 - DNA, 25 bp, Homo sapien
aaatccagggcttgtcgcaggcaca

SEQ ID NO: 114076 - DNA, 25 bp, Homo sapien
cactgctaggatgtgcggccaccac

SEQ ID NO: 114077 - DNA, 25 bp, Homo sapien
attgcgaactgggtcgctacgcttc

SEQ ID NO: 114078 - DNA, 25 bp, Homo sapien
ttactttgcgaaggtctctggaacc

SEQ ID NO: 114079 - DNA, 25 bp, Homo sapien
aggcgtggtgagttcagattctttc

SEQ ID NO: 114080 - DNA, 25 bp, Homo sapien
agattctttcagcaggtcctctgga

SEQ ID NO: 114081 - DNA, 25 bp, Homo sapien
ggcgggatctcctccatcgatttga

SEQ ID NO: 114082 - DNA, 25 bp, Homo sapien
ttcttgtcgaactgcgaaggcctgc

SEQ ID NO: 114083 - DNA, 25 bp, Homo sapien
ccggccaaagcctggattgcggtct

SEQ ID NO: 114084 - DNA, 25 bp, Homo sapien
gtcgccacacttacgggatccgagg

SEQ ID NO: 114085 - DNA, 25 bp, Homo sapien
ttgactcttgacacaccgcactgga

SEQ ID NO: 114086 - DNA, 25 bp, Homo sapien
tgcctcccagttcggagcttgctgg

SEQ ID NO: 114087 - DNA, 25 bp, Homo sapien
aggaccgtggcctgtttggcacaag

SEQ ID NO: 114088 - DNA, 25 bp, Homo sapien
tcaccgtgaccttggggcccagaat

SEQ ID NO: 114089 - DNA, 25 bp, Homo sapien
aatcaggtgagtgctctgccgcatc

SEQ ID NO: 114090 - DNA, 25 bp, Homo sapien
tccggaagaaacagtgtacctggcg

SEQ ID NO: 114091 - DNA, 25 bp, Homo sapien
ccaggaagactgctgtgtgcagctc

SEQ ID NO: 114092 - DNA, 25 bp, Homo sapien
cggagctggaagacaccttcctgca

SEQ ID NO: 114093 - DNA, 25 bp, Homo sapien
cggcgtcctttctgcgctgagccag

SEQ ID NO: 114094 - DNA, 25 bp, Homo sapien
agaaagtgagtttcgcgggagcatc

SEQ ID NO: 114095 - DNA, 25 bp, Homo sapien
ctccggccagcgcaggttgagagaa

SEQ ID NO: 114096 - DNA, 25 bp, Homo sapien
gcaagggcttgctagtctatccgga

SEQ ID NO: 114097 - DNA, 25 bp, Homo sapien
agccaccgatgttcacgcccagaga

SEQ ID NO: 114098 - DNA, 25 bp, Homo sapien
aacctccgtgtccaaggagggactg

SEQ ID NO: 114099 - DNA, 25 bp, Homo sapien
tgaagccgacccagcagaaagggtg

SEQ ID NO: 114100 - DNA, 25 bp, Homo sapien
ctggtgcgatggttgcgttgacacc

SEQ ID NO: 114101 - DNA, 25 bp, Homo sapien
atggttgcgttgacacctgtactcc

SEQ ID NO: 114102 - DNA, 25 bp, Homo sapien
agatgtccaaaacggaacctccgtg

SEQ ID NO: 114103 - DNA, 25 bp, Homo sapien
tcacgcccagagatgtccaaaacgg

SEQ ID NO: 114104 - DNA, 25 bp, Homo sapien
ttgacacctgtactcctgcgggcct

SEQ ID NO: 114105 - DNA, 25 bp, Homo sapien
ctgacactccgtacccttgataatg

SEQ ID NO: 114106 - DNA, 25 bp, Homo sapien
tacagggcgccggagaaatttaatc

SEQ ID NO: 114107 - DNA, 25 bp, Homo sapien
gtgtatctcacttactcctcgcacg

SEQ ID NO: 114108 - DNA, 25 bp, Homo sapien
cgcacgaccaggaacagatcgggta

SEQ ID NO: 114109 - DNA, 25 bp, Homo sapien
tgagtaaagccagtgacccgaagtc

SEQ ID NO: 114110 - DNA, 25 bp, Homo sapien
gtgctgggatccaccaggaactata

SEQ ID NO: 114111 - DNA, 25 bp, Homo sapien
ccttgataatgaggtgcgctgagcc

SEQ ID NO: 114112 - DNA, 25 bp, Homo sapien
atgccctttccactacacgtcggtg

SEQ ID NO: 114113 - DNA, 25 bp, Homo sapien
atccgctgggaaccgcatagtctcc

SEQ ID NO: 114114 - DNA, 25 bp, Homo sapien
taccaccaggtacgtgtctcctctg

SEQ ID NO: 114115 - DNA, 25 bp, Homo sapien
taccaagtctatggtcctccgcagc

SEQ ID NO: 114116 - DNA, 25 bp, Homo sapien
atgagctgtctggatgttatgtacc

SEQ ID NO: 114117 - DNA, 25 bp, Homo sapien
ctttgctccgcctgatgactccaga

SEQ ID NO: 114118 - DNA, 25 bp, Homo sapien
tttaaatgcccactagcgggagctc

SEQ ID NO: 114119 - DNA, 25 bp, Homo sapien
tgtacgccaaggtctgctgtgcctc

SEQ ID NO: 114120 - DNA, 25 bp, Homo sapien
acccttggccgcatgcttgtcagag

SEQ ID NO: 114121 - DNA, 25 bp, Homo sapien
tgcacgaagtctacgcgccgcactt

SEQ ID NO: 114122 - DNA, 25 bp, Homo sapien
agccgcagtgacacgcacctctttt

SEQ ID NO: 114123 - DNA, 25 bp, Homo sapien
tacagactgctccttcccgatgagc

SEQ ID NO: 114124 - DNA, 25 bp, Homo sapien
gcctccttctggaatagcgcgtacc

SEQ ID NO: 114125 - DNA, 25 bp, Homo sapien
ctatgggccgctgctgatgccagcc

SEQ ID NO: 114126 - DNA, 25 bp, Homo sapien
gaagaagtttggtctccgcggagcc

SEQ ID NO: 114127 - DNA, 25 bp, Homo sapien
gcgctgagtccagccgcagtgacac

SEQ ID NO: 114128 - DNA, 25 bp, Homo sapien
tcagcgtggactcaggtaagcagag

SEQ ID NO: 114129 - DNA, 25 bp, Homo sapien
tcactgcctgggaacgcgacttcct

SEQ ID NO: 114130 - DNA, 25 bp, Homo sapien
ctcccgcgcggaattggaatcccgg

SEQ ID NO: 114131 - DNA, 25 bp, Homo sapien
tgccttttgacaaagccgctcctcg

SEQ ID NO: 114132 - DNA, 25 bp, Homo sapien
acagccgtgtgcagggccagttctt

SEQ ID NO: 114133 - DNA, 25 bp, Homo sapien
taacctggcgtctctgcactttctc

SEQ ID NO: 114134 - DNA, 25 bp, Homo sapien
agcccatttcacttagtttccagac

SEQ ID NO: 114135 - DNA, 25 bp, Homo sapien
tagtttccagacttcctgactctgc

SEQ ID NO: 114136 - DNA, 25 bp, Homo sapien
agtaggttactgcattccttgtcgc

SEQ ID NO: 114137 - DNA, 25 bp, Homo sapien
caggggctacgaccggcccaaagct

SEQ ID NO: 114138 - DNA, 25 bp, Homo sapien
acacagcgcacagcctgcggacagg

SEQ ID NO: 114139 - DNA, 25 bp, Homo sapien
cgcccaggacggagactatcaaagg

SEQ ID NO: 114140 - DNA, 25 bp, Homo sapien
acgttctctgcgcagagcggctacc

SEQ ID NO: 114141 - DNA, 25 bp, Homo sapien
acgcccatcgtggagcggcacgtgc

SEQ ID NO: 114142 - DNA, 25 bp, Homo sapien
gacagtcacgaggaagggctccacc

SEQ ID NO: 114143 - DNA, 25 bp, Homo sapien
accttccggcccatggacacggatg

SEQ ID NO: 114144 - DNA, 25 bp, Homo sapien
gatgccggcggccactatgactgcc

SEQ ID NO: 114145 - DNA, 25 bp, Homo sapien
ccatcccggtctggtccactcccac

SEQ ID NO: 114146 - DNA, 25 bp, Homo sapien
ccgagtgccggtggcttgcctctca

SEQ ID NO: 114147 - DNA, 25 bp, Homo sapien
ctcgaaatccgcacggggtccgagg

SEQ ID NO: 114148 - DNA, 25 bp, Homo sapien
cttgtctcgaaatccgcacggggtc

SEQ ID NO: 114149 - DNA, 25 bp, Homo sapien
cgctatctctggacccttgtctcga

SEQ ID NO: 114150 - DNA, 25 bp, Homo sapien
tgcagtactcacaccgcacgcctgg

SEQ ID NO: 114151 - DNA, 25 bp, Homo sapien
tcaggtggcagcgtccgctaggctc

SEQ ID NO: 114152 - DNA, 25 bp, Homo sapien
cccatgccggccactgcagtactca

SEQ ID NO: 114153 - DNA, 25 bp, Homo sapien
cggcgacacacggaagactcagtca

SEQ ID NO: 114154 - DNA, 25 bp, Homo sapien
ccacgtcgcagaaaggaaggatttc

SEQ ID NO: 114155 - DNA, 25 bp, Homo sapien
ttctgcaccctggttggaaaggccc

SEQ ID NO: 114156 - DNA, 25 bp, Homo sapien
ctacggcttgaatccctgagaaacg

SEQ ID NO: 114157 - DNA, 25 bp, Homo sapien
gagcggcctgtcagcggccatatta

SEQ ID NO: 114158 - DNA, 25 bp, Homo sapien
tcaagggcctctcccgactgctgaa

SEQ ID NO: 114159 - DNA, 25 bp, Homo sapien
ggacgcagccacgagggacaaaata

SEQ ID NO: 114160 - DNA, 25 bp, Homo sapien
gacaggatgcgatcttggcctatga

SEQ ID NO: 114161 - DNA, 25 bp, Homo sapien
ctggaagcgcccatcgcattgaaga

SEQ ID NO: 114162 - DNA, 25 bp, Homo sapien
ccagaagccgcgtcagaattccacg

SEQ ID NO: 114163 - DNA, 25 bp, Homo sapien
tccacgctggccaatcggaactgtc

SEQ ID NO: 114164 - DNA, 25 bp, Homo sapien
tcggaactgtccatgtactactggg

SEQ ID NO: 114165 - DNA, 25 bp, Homo sapien
gtcttggaccgctagaccgctggtc

SEQ ID NO: 114166 - DNA, 25 bp, Homo sapien
tctgcaaatcacagcgctagcgctt

SEQ ID NO: 114167 - DNA, 25 bp, Homo sapien
tgctggggtcccattcagacaagtc

SEQ ID NO: 114168 - DNA, 25 bp, Homo sapien
cgcattgaagaccacgtgtgccttg

SEQ ID NO: 114169 - DNA, 25 bp, Homo sapien
ttcgtacctagccaccctgtatgtg

SEQ ID NO: 114170 - DNA, 25 bp, Homo sapien
tccgcaaagtgctgaacaggtgagc

SEQ ID NO: 114171 - DNA, 25 bp, Homo sapien
acagacggtagctttccgaccgagc

SEQ ID NO: 114172 - DNA, 25 bp, Homo sapien
cgccgaaccatgtggtgaccaccat

SEQ ID NO: 114173 - DNA, 25 bp, Homo sapien
gtgaccaccatcgagaacctgccgg

SEQ ID NO: 114174 - DNA, 25 bp, Homo sapien
cgtgcgccagaggatccgcaaagtg

SEQ ID NO: 114175 - DNA, 25 bp, Homo sapien
ggcacacgatgcacccggctgcgtt

SEQ ID NO: 114176 - DNA, 25 bp, Homo sapien
gggcacgaggaaacaaggagaaatc

SEQ ID NO: 114177 - DNA, 25 bp, Homo sapien
gcagaccctcggaacgcgggtggac

SEQ ID NO: 114178 - DNA, 25 bp, Homo sapien
gcgctcggactacagaggaccggac

SEQ ID NO: 114179 - DNA, 25 bp, Homo sapien
agtaagagctgggacggacctttgt

SEQ ID NO: 114180 - DNA, 25 bp, Homo sapien
gggacggacctttgtagctttgcga

SEQ ID NO: 114181 - DNA, 25 bp, Homo sapien
gacggacctttgtagctttgcgaaa

SEQ ID NO: 114182 - DNA, 25 bp, Homo sapien
ggacctttgtagctttgcgaaatta

SEQ ID NO: 114183 - DNA, 25 bp, Homo sapien
ttttcctccacaactgccagctcgg

SEQ ID NO: 114184 - DNA, 25 bp, Homo sapien
ctttgtagctttgcgaaattaaccg

SEQ ID NO: 114185 - DNA, 25 bp, Homo sapien
cctcgggcaatgacttcaggcgtgc

SEQ ID NO: 114186 - DNA, 25 bp, Homo sapien
cgaagttgcagctgcgggttctctc

SEQ ID NO: 114187 - DNA, 25 bp, Homo sapien
cccaggctcaaaggctccaggcgaa

SEQ ID NO: 114188 - DNA, 25 bp, Homo sapien
gcagacaataaagcccaacccgcgg

SEQ ID NO: 114189 - DNA, 25 bp, Homo sapien
ctgggacgcggcaagccatatgtca

SEQ ID NO: 114190 - DNA, 25 bp, Homo sapien
caagccatatgtcagcccgggtgct

SEQ ID NO: 114191 - DNA, 25 bp, Homo sapien
ttccttaccggcagggaagctgcgg

SEQ ID NO: 114192 - DNA, 25 bp, Homo sapien
gctggttaacggctgctcagctacg

SEQ ID NO: 114193 - DNA, 25 bp, Homo sapien
cttactggctgtgtcagaagtcgcc

SEQ ID NO: 114194 - DNA, 25 bp, Homo sapien
ggaacgcgttgctcccgaggccgaa

SEQ ID NO: 114195 - DNA, 25 bp, Homo sapien
cttgggacgaactggagaaaaacat

SEQ ID NO: 114196 - DNA, 25 bp, Homo sapien
gtgcctgtccggtcccggagttgaa

SEQ ID NO: 114197 - DNA, 25 bp, Homo sapien
acaccttggcagtctctgagacttc

SEQ ID NO: 114198 - DNA, 25 bp, Homo sapien
attcacagggtctttgcacgcagcc

SEQ ID NO: 114199 - DNA, 25 bp, Homo sapien
gctcggttttggaggcatgctttcc

SEQ ID NO: 114200 - DNA, 25 bp, Homo sapien
ggaggcatgctttccaaactttcta

SEQ ID NO: 114201 - DNA, 25 bp, Homo sapien
cctgggctctttaacgagcagcaga

SEQ ID NO: 114202 - DNA, 25 bp, Homo sapien
agccgccgcagggttatattgggcc

SEQ ID NO: 114203 - DNA, 25 bp, Homo sapien
cagatgcgcatgctgcttctctccg

SEQ ID NO: 114204 - DNA, 25 bp, Homo sapien
caaagtctcaacgtcgaaccgaagg

SEQ ID NO: 114205 - DNA, 25 bp, Homo sapien
agcttctctaggctgcgcgaaggaa

SEQ ID NO: 114206 - DNA, 25 bp, Homo sapien
aggactccggaaaagtgactatctc

SEQ ID NO: 114207 - DNA, 25 bp, Homo sapien
tctccggcaggaaagccttctaagc

SEQ ID NO: 114208 - DNA, 25 bp, Homo sapien
gactatctcggaagaccagggtaga

SEQ ID NO: 114209 - DNA, 25 bp, Homo sapien
tggaaacagaagtcccactcctgca

SEQ ID NO: 114210 - DNA, 25 bp, Homo sapien
ctcgccctgagcactgtatttattc

SEQ ID NO: 114211 - DNA, 25 bp, Homo sapien
tcccgcattggtggaaacagaagtc

SEQ ID NO: 114212 - DNA, 25 bp, Homo sapien
gggacttctccagtagcgacaactc

SEQ ID NO: 114213 - DNA, 25 bp, Homo sapien
tctccagtagcgacaactctgcggc

SEQ ID NO: 114214 - DNA, 25 bp, Homo sapien
atcttccggccgtagctcctggcag

SEQ ID NO: 114215 - DNA, 25 bp, Homo sapien
gtagctcctggcagacgcgagacct

SEQ ID NO: 114216 - DNA, 25 bp, Homo sapien
tgcagaacaagaacctcccgcattg

SEQ ID NO: 114217 - DNA, 25 bp, Homo sapien
cgagcgtgaggcctgacgtaaaaaa

SEQ ID NO: 114218 - DNA, 25 bp, Homo sapien
gtcgatccgggatcgtgccgccagt

SEQ ID NO: 114219 - DNA, 25 bp, Homo sapien
tgctgccagctcatgcccggggtcg

SEQ ID NO: 114220 - DNA, 25 bp, Homo sapien
ccgagccgccgtaatagtgctgctg

SEQ ID NO: 114221 - DNA, 25 bp, Homo sapien
gtagtccatgctgtgcccagccagc

SEQ ID NO: 114222 - DNA, 25 bp, Homo sapien
ctggctgtagtccatgctgtgccca

SEQ ID NO: 114223 - DNA, 25 bp, Homo sapien
ttggaggtgtctccggctgttgctt

SEQ ID NO: 114224 - DNA, 25 bp, Homo sapien
tcaggtgcatctcctggctgtagtc

SEQ ID NO: 114225 - DNA, 25 bp, Homo sapien
gtgaagttatcaggtcccgtgggta

SEQ ID NO: 114226 - DNA, 25 bp, Homo sapien
gagtctggcaggaagaagatcgccc

SEQ ID NO: 114227 - DNA, 25 bp, Homo sapien
gcgctgaataccagcagcagcacga

SEQ ID NO: 114228 - DNA, 25 bp, Homo sapien
agcagcacgaacttctccgtcaggc

SEQ ID NO: 114229 - DNA, 25 bp, Homo sapien
gataaagtttccagcgggtctccgc

SEQ ID NO: 114230 - DNA, 25 bp, Homo sapien
gggagactcgtcaacttcgcccgct

SEQ ID NO: 114231 - DNA, 25 bp, Homo sapien
actaatctcactgccggtcttgggg

SEQ ID NO: 114232 - DNA, 25 bp, Homo sapien
cgctgagactgctgcctctttccta

SEQ ID NO: 114233 - DNA, 25 bp, Homo sapien
tgcagagctacacccgccaggtagg

SEQ ID NO: 114234 - DNA, 25 bp, Homo sapien
agcgtaagcgttcgaggatctgacc

SEQ ID NO: 114235 - DNA, 25 bp, Homo sapien
ccggaaagcttgagagccttcgctc

SEQ ID NO: 114236 - DNA, 25 bp, Homo sapien
ggcgcagaaaacactccctcgggga

SEQ ID NO: 114237 - DNA, 25 bp, Homo sapien
gagaccgagacctgcgcactacaac

SEQ ID NO: 114238 - DNA, 25 bp, Homo sapien
tcccaaccagagaggacgtggcata

SEQ ID NO: 114239 - DNA, 25 bp, Homo sapien
gatcgtgtactttgccctgcaggta

SEQ ID NO: 114240 - DNA, 25 bp, Homo sapien
ccaagttggcagagatcggagctcc

SEQ ID NO: 114241 - DNA, 25 bp, Homo sapien
ccagagaatgttcgggtgagccact

SEQ ID NO: 114242 - DNA, 25 bp, Homo sapien
ctgccagtgcgtcatttcggaaaac

SEQ ID NO: 114243 - DNA, 25 bp, Homo sapien
cgagtcaccttactttggggaagca

SEQ ID NO: 114244 - DNA, 25 bp, Homo sapien
gtctcgcctctggtactcttagttg

SEQ ID NO: 114245 - DNA, 25 bp, Homo sapien
ttagttgctagccttcagtaccagc

SEQ ID NO: 114246 - DNA, 25 bp, Homo sapien
ggctctcccgactaacaacaaaaga

SEQ ID NO: 114247 - DNA, 25 bp, Homo sapien
gacccgacgacggaacgccacgatg

SEQ ID NO: 114248 - DNA, 25 bp, Homo sapien
tcagctcgctgatgtggcttccttg

SEQ ID NO: 114249 - DNA, 25 bp, Homo sapien
ctaacgagttcatcacctggagcca

SEQ ID NO: 114250 - DNA, 25 bp, Homo sapien
cccggctcaggggttacaaatcgcg

SEQ ID NO: 114251 - DNA, 25 bp, Homo sapien
ccctgtattgttcgctcggggagcc

SEQ ID NO: 114252 - DNA, 25 bp, Homo sapien
agagttcgaacgtgccggctttcct

SEQ ID NO: 114253 - DNA, 25 bp, Homo sapien
ccctgcgccgcgttaacaatgaagc

SEQ ID NO: 114254 - DNA, 25 bp, Homo sapien
tgtagaatttggaatccctgcgccg

SEQ ID NO: 114255 - DNA, 25 bp, Homo sapien
ttttctctgtcgtgcagtcggctcc

SEQ ID NO: 114256 - DNA, 25 bp, Homo sapien
cgcgggagcctctttactgcacact

SEQ ID NO: 114257 - DNA, 25 bp, Homo sapien
ggctcggatcgccttctctttggtc

SEQ ID NO: 114258 - DNA, 25 bp, Homo sapien
ttactatctgcgagacacttccgga

SEQ ID NO: 114259 - DNA, 25 bp, Homo sapien
cgtcacttccttccaggcctgggta

SEQ ID NO: 114260 - DNA, 25 bp, Homo sapien
taggataaaacacggagcgcgcagc

SEQ ID NO: 114261 - DNA, 25 bp, Homo sapien
gacagcttctttctcgcctttccga

SEQ ID NO: 114262 - DNA, 25 bp, Homo sapien
caacgtcacaagagcagcggataca

SEQ ID NO: 114263 - DNA, 25 bp, Homo sapien
cccagaggccgcaaaaagcacctta

SEQ ID NO: 114264 - DNA, 25 bp, Homo sapien
tgcgcatgcgcgtcactagacgaca

SEQ ID NO: 114265 - DNA, 25 bp, Homo sapien
cacgatgcgacgtcggaaagcagga

SEQ ID NO: 114266 - DNA, 25 bp, Homo sapien
gcagaacctcatcatcgcccaaggg

SEQ ID NO: 114267 - DNA, 25 bp, Homo sapien
gtcacagaaatcttagcagaacctc

SEQ ID NO: 114268 - DNA, 25 bp, Homo sapien
gaaattcccgcagtcacgtcacaga

SEQ ID NO: 114269 - DNA, 25 bp, Homo sapien
cacaagtaggataaaagagctcgcc

SEQ ID NO: 114270 - DNA, 25 bp, Homo sapien
agaaaaaagctaccgtggcacgtgc

SEQ ID NO: 114271 - DNA, 25 bp, Homo sapien
cgataattagttggtggttaacgca

SEQ ID NO: 114272 - DNA, 25 bp, Homo sapien
gcgggttgtgtgacgatcaccgata

SEQ ID NO: 114273 - DNA, 25 bp, Homo sapien
ggcgaccaagggactacagcgttag

SEQ ID NO: 114274 - DNA, 25 bp, Homo sapien
cttcccagccggcaaagagcgcgga

SEQ ID NO: 114275 - DNA, 25 bp, Homo sapien
cgataggtgagttgtccgcgaccct

SEQ ID NO: 114276 - DNA, 25 bp, Homo sapien
cggcaggaatcctcctccggcgata

SEQ ID NO: 114277 - DNA, 25 bp, Homo sapien
gggacagcccgaacctccaggtcag

SEQ ID NO: 114278 - DNA, 25 bp, Homo sapien
actcgctgcggaatctgcctttgca

SEQ ID NO: 114279 - DNA, 25 bp, Homo sapien
gatcagtcggacgtctacacccgca

SEQ ID NO: 114280 - DNA, 25 bp, Homo sapien
tgcctttgcacgtgatcagtcggac

SEQ ID NO: 114281 - DNA, 25 bp, Homo sapien
tcccgaaggcgaaaatggcagggcc

SEQ ID NO: 114282 - DNA, 25 bp, Homo sapien
cggctgctcccggagggctcacaaa

SEQ ID NO: 114283 - DNA, 25 bp, Homo sapien
tgagtgcttacgtcgcagcgagatc

SEQ ID NO: 114284 - DNA, 25 bp, Homo sapien
ggggacgaagagcagcctaaactta

SEQ ID NO: 114285 - DNA, 25 bp, Homo sapien
aaccctgactcggaccgctcgggag

SEQ ID NO: 114286 - DNA, 25 bp, Homo sapien
gctcgggatatttcgatgccaccca

SEQ ID NO: 114287 - DNA, 25 bp, Homo sapien
gccgagtcctctttcagcagcagca

SEQ ID NO: 114288 - DNA, 25 bp, Homo sapien
agcgagatctgtgctgggataatta

SEQ ID NO: 114289 - DNA, 25 bp, Homo sapien
tgtaggaggaggattcacacatctg

SEQ ID NO: 114290 - DNA, 25 bp, Homo sapien
gccgctctggatgcctcggttgcac

SEQ ID NO: 114291 - DNA, 25 bp, Homo sapien
ctgggagcacgaccgacttcagctc

SEQ ID NO: 114292 - DNA, 25 bp, Homo sapien
ttcagctcagcaaaccgcggtcatg

SEQ ID NO: 114293 - DNA, 25 bp, Homo sapien
ggacccgcatcattgcgcgcagcag

SEQ ID NO: 114294 - DNA, 25 bp, Homo sapien
cgccagcaggtcctaatgcctgtca

SEQ ID NO: 114295 - DNA, 25 bp, Homo sapien
tgcctgtcacttcccaggacgctgg

SEQ ID NO: 114296 - DNA, 25 bp, Homo sapien
gcccagcaacgcagggtgcctagga

SEQ ID NO: 114297 - DNA, 25 bp, Homo sapien
gtccctcgccaagagacaagtcttc

SEQ ID NO: 114298 - DNA, 25 bp, Homo sapien
cagaccttgccactgcagttggagc

SEQ ID NO: 114299 - DNA, 25 bp, Homo sapien
agcctgcgggactggcactcaccgg

SEQ ID NO: 114300 - DNA, 25 bp, Homo sapien
caggagtcgcagaccctggccagtg

SEQ ID NO: 114301 - DNA, 25 bp, Homo sapien
ctcgaccctttgaccaccgccctcg

SEQ ID NO: 114302 - DNA, 25 bp, Homo sapien
ctgctccgtgtactgcgtggagagc

SEQ ID NO: 114303 - DNA, 25 bp, Homo sapien
ccgacggactggtcctggacgtgct

SEQ ID NO: 114304 - DNA, 25 bp, Homo sapien
gacaagtcttctgctccgtgtactg

SEQ ID NO: 114305 - DNA, 25 bp, Homo sapien
tctgggtcccaaacacaggaaaggc

SEQ ID NO: 114306 - DNA, 25 bp, Homo sapien
gtctgagctagacggagcatctccc

SEQ ID NO: 114307 - DNA, 25 bp, Homo sapien
gcctttacctctacccactgaaatg

SEQ ID NO: 114308 - DNA, 25 bp, Homo sapien
agcgccgatctgctggagaatctca

SEQ ID NO: 114309 - DNA, 25 bp, Homo sapien
gagaatctcattatcccatcggcgc

SEQ ID NO: 114310 - DNA, 25 bp, Homo sapien
tgcccacgagagaggcgactttacg

SEQ ID NO: 114311 - DNA, 25 bp, Homo sapien
gccctgggctgagatttgagaacgc

SEQ ID NO: 114312 - DNA, 25 bp, Homo sapien
gaacgctccttctggatgaggaaga

SEQ ID NO: 114313 - DNA, 25 bp, Homo sapien
cgctgtccggagcacagtcccggga

SEQ ID NO: 114314 - DNA, 25 bp, Homo sapien
cagcacctgcgtgtgggcaacacga

SEQ ID NO: 114315 - DNA, 25 bp, Homo sapien
gactgggaggcagctagcagcacct

SEQ ID NO: 114316 - DNA, 25 bp, Homo sapien
ccttccttcgggaacgcggagctag

SEQ ID NO: 114317 - DNA, 25 bp, Homo sapien
agactaaaggcccactgcccatggc

SEQ ID NO: 114318 - DNA, 25 bp, Homo sapien
cccactgcacggagcgggagactaa

SEQ ID NO: 114319 - DNA, 25 bp, Homo sapien
agttgatcccttcccactgcacgga

SEQ ID NO: 114320 - DNA, 25 bp, Homo sapien
gcccatggctgcgaaaaccttcctt

SEQ ID NO: 114321 - DNA, 25 bp, Homo sapien
cccggtgcagatgaacctgtacgcc

SEQ ID NO: 114322 - DNA, 25 bp, Homo sapien
tgtcggcctcgcgagccgcaacagg

SEQ ID NO: 114323 - DNA, 25 bp, Homo sapien
cagcggatttgagggcaggacccgt

SEQ ID NO: 114324 - DNA, 25 bp, Homo sapien
gcccaggccacctcgtcgtcctcgt

SEQ ID NO: 114325 - DNA, 25 bp, Homo sapien
cagatgaacctgtacgccacctggg

SEQ ID NO: 114326 - DNA, 25 bp, Homo sapien
cgtccagctgcgtgcctaggtgagc

SEQ ID NO: 114327 - DNA, 25 bp, Homo sapien
cctgggagccagatcggcgtcgcct

SEQ ID NO: 114328 - DNA, 25 bp, Homo sapien
cccttctactccgcgggagcgaggg

SEQ ID NO: 114329 - DNA, 25 bp, Homo sapien
tcccacccgcgcctttggtataatg

SEQ ID NO: 114330 - DNA, 25 bp, Homo sapien
atccacacgtgagtcccggtttccg

SEQ ID NO: 114331 - DNA, 25 bp, Homo sapien
aatgtgactcttttcgcccagcgcc

SEQ ID NO: 114332 - DNA, 25 bp, Homo sapien
ggtataatgcctgctgcccaaactc

SEQ ID NO: 114333 - DNA, 25 bp, Homo sapien
tgccgtgttgcacatccagaactcc

SEQ ID NO: 114334 - DNA, 25 bp, Homo sapien
cttcgctctcggacagaacagattg

SEQ ID NO: 114335 - DNA, 25 bp, Homo sapien
tcagctcgaagtcagccaccatgga

SEQ ID NO: 114336 - DNA, 25 bp, Homo sapien
aaatgcgcccgtggaatgctctacc

SEQ ID NO: 114337 - DNA, 25 bp, Homo sapien
aggctctaggctcagactccgggcc

SEQ ID NO: 114338 - DNA, 25 bp, Homo sapien
ccgcaggaactgcagtagggaccga

SEQ ID NO: 114339 - DNA, 25 bp, Homo sapien
cggcgccaggctctaggctcagact

SEQ ID NO: 114340 - DNA, 25 bp, Homo sapien
cctaccagccgcaggaactgcagta

SEQ ID NO: 114341 - DNA, 25 bp, Homo sapien
aggaactgcagtagggaccgagccc

SEQ ID NO: 114342 - DNA, 25 bp, Homo sapien
gtcgcagaggagaccgaagccatgc

SEQ ID NO: 114343 - DNA, 25 bp, Homo sapien
gagaccgaagccatgcggccaccga

SEQ ID NO: 114344 - DNA, 25 bp, Homo sapien
tgcttcctccgtccaccgtcggcaa

SEQ ID NO: 114345 - DNA, 25 bp, Homo sapien
aggctcccgcctcacggcaagaaaa

SEQ ID NO: 114346 - DNA, 25 bp, Homo sapien
tcacggcaagaaaaataaaggcctc

SEQ ID NO: 114347 - DNA, 25 bp, Homo sapien
gtcaccgacaaacactcctagcagg

SEQ ID NO: 114348 - DNA, 25 bp, Homo sapien
tcctagcaggcgttgttaaacgttc

SEQ ID NO: 114349 - DNA, 25 bp, Homo sapien
ccctcgcaccgactgcgggaaggag

SEQ ID NO: 114350 - DNA, 25 bp, Homo sapien
ctctcgggagaacaatgcgtctgtc

SEQ ID NO: 114351 - DNA, 25 bp, Homo sapien
cacagtgactgatagggcagcgagc

SEQ ID NO: 114352 - DNA, 25 bp, Homo sapien
tgcgtctgtcacacagtgactgata

SEQ ID NO: 114353 - DNA, 25 bp, Homo sapien
gggtggccagttcaaaagtcctaca

SEQ ID NO: 114354 - DNA, 25 bp, Homo sapien
ggcacgaactgttggacacgaattc

SEQ ID NO: 114355 - DNA, 25 bp, Homo sapien
cacgcgcttggggttattctttaca

SEQ ID NO: 114356 - DNA, 25 bp, Homo sapien
gattatgtcctgaaatgcccgcgtc

SEQ ID NO: 114357 - DNA, 25 bp, Homo sapien
gtaacgtggccgacagacctgatca

SEQ ID NO: 114358 - DNA, 25 bp, Homo sapien
gccgcgaaagtagcctcaggagttg

SEQ ID NO: 114359 - DNA, 25 bp, Homo sapien
agccagtcagcagtttggatccaga

SEQ ID NO: 114360 - DNA, 25 bp, Homo sapien
cctccgcaggggttagcaagattgc

SEQ ID NO: 114361 - DNA, 25 bp, Homo sapien
tgtcgcctctccacaacttcagaag

SEQ ID NO: 114362 - DNA, 25 bp, Homo sapien
tccgaatgccatccacgggcagcgt

SEQ ID NO: 114363 - DNA, 25 bp, Homo sapien
aaggcctggactcctcggatccgct

SEQ ID NO: 114364 - DNA, 25 bp, Homo sapien
gtgcggcttgtgtctcatctcagca

SEQ ID NO: 114365 - DNA, 25 bp, Homo sapien
aacggcctccatgcctcagagtcaa

SEQ ID NO: 114366 - DNA, 25 bp, Homo sapien
ggtacctgagctccgtggaaggcct

SEQ ID NO: 114367 - DNA, 25 bp, Homo sapien
ccacgtttgcccatgcggattcagc

SEQ ID NO: 114368 - DNA, 25 bp, Homo sapien
gcggcggccatgacatcctccatgg

SEQ ID NO: 114369 - DNA, 25 bp, Homo sapien
aggatgccgcaactgcagtccgagc

SEQ ID NO: 114370 - DNA, 25 bp, Homo sapien
ctgaaaacctctgcttgagctcggg

SEQ ID NO: 114371 - DNA, 25 bp, Homo sapien
ccctgtgaacctgaaaacctctgct

SEQ ID NO: 114372 - DNA, 25 bp, Homo sapien
cagggtccaggaccggccaaacttg

SEQ ID NO: 114373 - DNA, 25 bp, Homo sapien
tcccagaaatgcatgcgaccgatcc

SEQ ID NO: 114374 - DNA, 25 bp, Homo sapien
aactgcagtccgagcggcagagccc

SEQ ID NO: 114375 - DNA, 25 bp, Homo sapien
ccgcactcgggaggcgccacaaagg

SEQ ID NO: 114376 - DNA, 25 bp, Homo sapien
gaggccaccgctcccagaaatgcat

SEQ ID NO: 114377 - DNA, 25 bp, Homo sapien
cctgtgaagccgctggcaagtcacc

SEQ ID NO: 114378 - DNA, 25 bp, Homo sapien
tcattaccaacgaggcgcaggggtc

SEQ ID NO: 114379 - DNA, 25 bp, Homo sapien
tcgctactcagctcgcagaggcagg

SEQ ID NO: 114380 - DNA, 25 bp, Homo sapien
tcggcgactgcagaaactacggttt

SEQ ID NO: 114381 - DNA, 25 bp, Homo sapien
ggcctccggctttgaagttcctcac

SEQ ID NO: 114382 - DNA, 25 bp, Homo sapien
ccctctagtggcagccggttttgag

SEQ ID NO: 114383 - DNA, 25 bp, Homo sapien
tctgtgatgtcaccacgacgcgctg

SEQ ID NO: 114384 - DNA, 25 bp, Homo sapien
acttggcagacgtcgtgcgtcatta

SEQ ID NO: 114385 - DNA, 25 bp, Homo sapien
gatagcgcctgcctcgcagagcttc

SEQ ID NO: 114386 - DNA, 25 bp, Homo sapien
agcatctggagttccgcctgccggt

SEQ ID NO: 114387 - DNA, 25 bp, Homo sapien
tcctcatggcgcaggagcatctgga

SEQ ID NO: 114388 - DNA, 25 bp, Homo sapien
ggtgatctgcatagcccgaggaagc

SEQ ID NO: 114389 - DNA, 25 bp, Homo sapien
ttaacaggtatctgctcctcatggc

SEQ ID NO: 114390 - DNA, 25 bp, Homo sapien
atggcgctgtcgtgtacccttaaca

SEQ ID NO: 114391 - DNA, 25 bp, Homo sapien
ctctgtctctgtggagactgggctt

SEQ ID NO: 114392 - DNA, 25 bp, Homo sapien
cgcgagaaacgtcgggatagcgcct

SEQ ID NO: 114393 - DNA, 25 bp, Homo sapien
taacgtcactactgagcgccgggcg

SEQ ID NO: 114394 - DNA, 25 bp, Homo sapien
cgcaggctctcaatgacgtcaggta

SEQ ID NO: 114395 - DNA, 25 bp, Homo sapien
cggcggattcgaacgttcggactga

SEQ ID NO: 114396 - DNA, 25 bp, Homo sapien
ggcttgctcagggttaacgtcacta

SEQ ID NO: 114397 - DNA, 25 bp, Homo sapien
tcggactgaggtttttctgcctgaa

SEQ ID NO: 114398 - DNA, 25 bp, Homo sapien
tctgcctgaagaagcgtcatacgga

SEQ ID NO: 114399 - DNA, 25 bp, Homo sapien
accggattgttttcgctggcccagt

SEQ ID NO: 114400 - DNA, 25 bp, Homo sapien
ttgtgtgcgatacagagagcacctc

SEQ ID NO: 114401 - DNA, 25 bp, Homo sapien
tgcgtgtgagcagagactgaagcca

SEQ ID NO: 114402 - DNA, 25 bp, Homo sapien
cagcggagaaagacgccggcatttc

SEQ ID NO: 114403 - DNA, 25 bp, Homo sapien
tcatctttgtagtcaggcgaccaac

SEQ ID NO: 114404 - DNA, 25 bp, Homo sapien
cattgaaaaactgtgcggagtgacc

SEQ ID NO: 114405 - DNA, 25 bp, Homo sapien
ccttgccaggaagcacgagtgccac

SEQ ID NO: 114406 - DNA, 25 bp, Homo sapien
cgcctgcgtgcgctaatgagctcaa

SEQ ID NO: 114407 - DNA, 25 bp, Homo sapien
actacaaggccttgagcacccgggc

SEQ ID NO: 114408 - DNA, 25 bp, Homo sapien
gccaccgctgcttgtgtcatctttg

SEQ ID NO: 114409 - DNA, 25 bp, Homo sapien
cgcggccttttcagggaaggcctca

SEQ ID NO: 114410 - DNA, 25 bp, Homo sapien
ttgcgtctcccaggcctagacaagc

SEQ ID NO: 114411 - DNA, 25 bp, Homo sapien
gatccggctgcaccgcattgcgtct

SEQ ID NO: 114412 - DNA, 25 bp, Homo sapien
ctttaaggcagcgaacgggccaaga

SEQ ID NO: 114413 - DNA, 25 bp, Homo sapien
ggaaacccggacactgagccgccta

SEQ ID NO: 114414 - DNA, 25 bp, Homo sapien
ccgaggtagcggcttcacctttaag

SEQ ID NO: 114415 - DNA, 25 bp, Homo sapien
acgggccaagagaagcgtgtttcgc

SEQ ID NO: 114416 - DNA, 25 bp, Homo sapien
tgagccgcctaagtcggcctgagcc

SEQ ID NO: 114417 - DNA, 25 bp, Homo sapien
cgaatccctatagcaaacatgtctt

SEQ ID NO: 114418 - DNA, 25 bp, Homo sapien
tagcaaacatgtcttgacggaagac

SEQ ID NO: 114419 - DNA, 25 bp, Homo sapien
cctatagcaaacatgtcttgacgga

SEQ ID NO: 114420 - DNA, 25 bp, Homo sapien
gaatccctatagcaaacatgtcttg

SEQ ID NO: 114421 - DNA, 25 bp, Homo sapien
ccctatagcaaacatgtcttgacgg

SEQ ID NO: 114422 - DNA, 25 bp, Homo sapien
tccctatagcaaacatgtcttgacg

SEQ ID NO: 114423 - DNA, 25 bp, Homo sapien
cccgaatccctatagcaaacatgtc

SEQ ID NO: 114424 - DNA, 25 bp, Homo sapien
atagcaaacatgtcttgacggaaga

SEQ ID NO: 114425 - DNA, 25 bp, Homo sapien
ccgccgcagttcagtgcttggataa

SEQ ID NO: 114426 - DNA, 25 bp, Homo sapien
cacagcacgcctatcggatgtgaga

SEQ ID NO: 114427 - DNA, 25 bp, Homo sapien
gggcactgtctatatacgcctaaca

SEQ ID NO: 114428 - DNA, 25 bp, Homo sapien
attactgggttactatgcacttgcg

SEQ ID NO: 114429 - DNA, 25 bp, Homo sapien
atgcacttgcgactgatttcttggc

SEQ ID NO: 114430 - DNA, 25 bp, Homo sapien
aggcgccagcgaagaagtaagtgca

SEQ ID NO: 114431 - DNA, 25 bp, Homo sapien
tatggacggcgtctttcacccttgc

SEQ ID NO: 114432 - DNA, 25 bp, Homo sapien
agttgccgcacaacatgctacctgc

SEQ ID NO: 114433 - DNA, 25 bp, Homo sapien
acaacaccggcttgtgtgagatgga

SEQ ID NO: 114434 - DNA, 25 bp, Homo sapien
gggcaggaagcgatgctgctgctct

SEQ ID NO: 114435 - DNA, 25 bp, Homo sapien
gctctcgcacctccgcggcgtgcag

SEQ ID NO: 114436 - DNA, 25 bp, Homo sapien
gcggaggacacaacaccggcttgtg

SEQ ID NO: 114437 - DNA, 25 bp, Homo sapien
aacaccggcttgtgtgagatggaaa

SEQ ID NO: 114438 - DNA, 25 bp, Homo sapien
gagatggaaatttagtaatcgcttc

SEQ ID NO: 114439 - DNA, 25 bp, Homo sapien
aaatttagtaatcgcttctcggccg

SEQ ID NO: 114440 - DNA, 25 bp, Homo sapien
gcctttcggggcagacgtcggggca

SEQ ID NO: 114441 - DNA, 25 bp, Homo sapien
gatgggacagttcagccctttccgc

SEQ ID NO: 114442 - DNA, 25 bp, Homo sapien
ccacaggcaagagagtaccggcaga

SEQ ID NO: 114443 - DNA, 25 bp, Homo sapien
taccggcagacagcggcgcgagaca

SEQ ID NO: 114444 - DNA, 25 bp, Homo sapien
tgaacgccggccactctaggatcct

SEQ ID NO: 114445 - DNA, 25 bp, Homo sapien
ggaggcatagctcgcggtgtcacct

SEQ ID NO: 114446 - DNA, 25 bp, Homo sapien
gtacgtagatggacgcccttgggct

SEQ ID NO: 114447 - DNA, 25 bp, Homo sapien
ggcaggcaagacgaccgtgacagcc

SEQ ID NO: 114448 - DNA, 25 bp, Homo sapien
agcggccattactgcgcagcctctt

SEQ ID NO: 114449 - DNA, 25 bp, Homo sapien
ctgacaacactaaactgaagcgcta

SEQ ID NO: 114450 - DNA, 25 bp, Homo sapien
acacgtttggagaagcgagcggtac

SEQ ID NO: 114451 - DNA, 25 bp, Homo sapien
cgagcggtacagtccattccacggc

SEQ ID NO: 114452 - DNA, 25 bp, Homo sapien
tgaagcgctaagaccaacccttacg

SEQ ID NO: 114453 - DNA, 25 bp, Homo sapien
cacggtggtgacttccttttccgct

SEQ ID NO: 114454 - DNA, 25 bp, Homo sapien
cgcttttccgttttgcgtgcctttg

SEQ ID NO: 114455 - DNA, 25 bp, Homo sapien
attccacggcgacattttaggattc

SEQ ID NO: 114456 - DNA, 25 bp, Homo sapien
cgctctgggaagaccgattcatctc

SEQ ID NO: 114457 - DNA, 25 bp, Homo sapien
tgttggacataagcacgcggttctc

SEQ ID NO: 114458 - DNA, 25 bp, Homo sapien
gtgatgcgcttgttctgctcctcca

SEQ ID NO: 114459 - DNA, 25 bp, Homo sapien
gccgccggacttgtacttgtacttg

SEQ ID NO: 114460 - DNA, 25 bp, Homo sapien
tctgctgccgatcggagaagctctt

SEQ ID NO: 114461 - DNA, 25 bp, Homo sapien
ggcctccgagcggatgtccttcatc

SEQ ID NO: 114462 - DNA, 25 bp, Homo sapien
cggaaggccttcatctgagcgttga

SEQ ID NO: 114463 - DNA, 25 bp, Homo sapien
gtacctgactcacggaaatgggctc

SEQ ID NO: 114464 - DNA, 25 bp, Homo sapien
ttgtacttgttgagctccgccgtga

SEQ ID NO: 114465 - DNA, 25 bp, Homo sapien
tcgatctcgttctgaggcggtgaca

SEQ ID NO: 114466 - DNA, 25 bp, Homo sapien
agccttttgcgctcggctttgcgga

SEQ ID NO: 114467 - DNA, 25 bp, Homo sapien
ccggcagtttttgttggctctctcc

SEQ ID NO: 114468 - DNA, 25 bp, Homo sapien
ggctctctccaactcgtggcgcatt

SEQ ID NO: 114469 - DNA, 25 bp, Homo sapien
cgtggcgcatttcctgcagttgaca

SEQ ID NO: 114470 - DNA, 25 bp, Homo sapien
ggttctcagctcatcgatctcgttc

SEQ ID NO: 114471 - DNA, 25 bp, Homo sapien
acaggccgcgtgtcaaaatcaaact

SEQ ID NO: 114472 - DNA, 25 bp, Homo sapien
gcatcctcctcgaagaaagtgtccc

SEQ ID NO: 114473 - DNA, 25 bp, Homo sapien
tcgcagcgaactgtccctcggtcta

SEQ ID NO: 114474 - DNA, 25 bp, Homo sapien
ggccgcgattgtctgtcgcagcgaa

SEQ ID NO: 114475 - DNA, 25 bp, Homo sapien
acagaattgagtttagtgccggccc

SEQ ID NO: 114476 - DNA, 25 bp, Homo sapien
ggtcttgttaccctgctgttgctgc

SEQ ID NO: 114477 - DNA, 25 bp, Homo sapien
cgcaacgccgcttccggagtttctg

SEQ ID NO: 114478 - DNA, 25 bp, Homo sapien
gctcagactgcagacatccttcttt

SEQ ID NO: 114479 - DNA, 25 bp, Homo sapien
ccgcccgctccttcttgagatggaa

SEQ ID NO: 114480 - DNA, 25 bp, Homo sapien
gccgccgttcttagcgtgcatctga

SEQ ID NO: 114481 - DNA, 25 bp, Homo sapien
ccacctggcacgaactctggggaca

SEQ ID NO: 114482 - DNA, 25 bp, Homo sapien
tcgatgcccatgaacgctcagagtg

SEQ ID NO: 114483 - DNA, 25 bp, Homo sapien
gccgcagtcgtatccatgccgagtt

SEQ ID NO: 114484 - DNA, 25 bp, Homo sapien
actcacctgcggagaactggccttg

SEQ ID NO: 114485 - DNA, 25 bp, Homo sapien
tgccgtcacgggagtcgtaactact

SEQ ID NO: 114486 - DNA, 25 bp, Homo sapien
tctgacaatggcttcccagggaatt

SEQ ID NO: 114487 - DNA, 25 bp, Homo sapien
catgccgagtttgggagaagtttca

SEQ ID NO: 114488 - DNA, 25 bp, Homo sapien
agtgggtccttagaaccgcatttca

SEQ ID NO: 114489 - DNA, 25 bp, Homo sapien
ggcatgttcagccaggcctccaggt

SEQ ID NO: 114490 - DNA, 25 bp, Homo sapien
actgtggaccatggccaggcgagct

SEQ ID NO: 114491 - DNA, 25 bp, Homo sapien
cgtcctcgttatcctctgcttcttg

SEQ ID NO: 114492 - DNA, 25 bp, Homo sapien
tcctccttattgtcgctgccaacag

SEQ ID NO: 114493 - DNA, 25 bp, Homo sapien
tccaggttggagaccgcctgctgca

SEQ ID NO: 114494 - DNA, 25 bp, Homo sapien
ccacttccaggctggcgatctggag

SEQ ID NO: 114495 - DNA, 25 bp, Homo sapien
tctcttctccggcatgttcagccag

SEQ ID NO: 114496 - DNA, 25 bp, Homo sapien
ctgccaacagatcaatgtcatcgtc

SEQ ID NO: 114497 - DNA, 25 bp, Homo sapien
caaacgtgcttgctggggatacggt

SEQ ID NO: 114498 - DNA, 25 bp, Homo sapien
cggccctgaaccacggggcttgcag

SEQ ID NO: 114499 - DNA, 25 bp, Homo sapien
acatatagcgatggccggccctgaa

SEQ ID NO: 114500 - DNA, 25 bp, Homo sapien
gttgggctccacatatagcgatggc

SEQ ID NO: 114501 - DNA, 25 bp, Homo sapien
tgcgtcacctttctctgactgctga

SEQ ID NO: 114502 - DNA, 25 bp, Homo sapien
gcctctgtgcaaacgtgcttgctgg

SEQ ID NO: 114503 - DNA, 25 bp, Homo sapien
cagagtggaccactgacaacaaggc

SEQ ID NO: 114504 - DNA, 25 bp, Homo sapien
tctgactgctgagttgggctccaca

SEQ ID NO: 114505 - DNA, 25 bp, Homo sapien
tctcctgaagaacaactaagatttg

SEQ ID NO: 114506 - DNA, 25 bp, Homo sapien
gttttccatggagatgacgggacgt

SEQ ID NO: 114507 - DNA, 25 bp, Homo sapien
gtttcttcagtatttcaggcgttca

SEQ ID NO: 114508 - DNA, 25 bp, Homo sapien
atgaatggtggaactctcctgaaga

SEQ ID NO: 114509 - DNA, 25 bp, Homo sapien
ttgtctagtgactttaagcccaaga

SEQ ID NO: 114510 - DNA, 25 bp, Homo sapien
gtttcgaggcattcagaaggtgtta

SEQ ID NO: 114511 - DNA, 25 bp, Homo sapien
gcccaagaaatctgaaacttaatga

SEQ ID NO: 114512 - DNA, 25 bp, Homo sapien
caggcgttcaatcctgctttgtcta

SEQ ID NO: 114513 - DNA, 25 bp, Homo sapien
acgctgccagcctcggcgttgcaga

SEQ ID NO: 114514 - DNA, 25 bp, Homo sapien
cacggcggcactgcgtttgctaggc

SEQ ID NO: 114515 - DNA, 25 bp, Homo sapien
cactctgacgtgcacggcggcactg

SEQ ID NO: 114516 - DNA, 25 bp, Homo sapien
ggggtctcaatcagcagcccacagc

SEQ ID NO: 114517 - DNA, 25 bp, Homo sapien
ccagcctcggcgttgcagagcacgg

SEQ ID NO: 114518 - DNA, 25 bp, Homo sapien
acggcggcgttatcccacgctgcca

SEQ ID NO: 114519 - DNA, 25 bp, Homo sapien
cgatctttgcgcacggcggcgttat

SEQ ID NO: 114520 - DNA, 25 bp, Homo sapien
cagcggggtctcaatcagcagccca

SEQ ID NO: 114521 - DNA, 25 bp, Homo sapien
ccttaggcaacttcctcgggcgctg

SEQ ID NO: 114522 - DNA, 25 bp, Homo sapien
cgcggggctgcttttcctgcaactt

SEQ ID NO: 114523 - DNA, 25 bp, Homo sapien
ctgcaacttgtttacgcctgcctta

SEQ ID NO: 114524 - DNA, 25 bp, Homo sapien
cgcctgccttattctggggaggaaa

SEQ ID NO: 114525 - DNA, 25 bp, Homo sapien
ataatgggctttgcacactcgcgtc

SEQ ID NO: 114526 - DNA, 25 bp, Homo sapien
ggagaaaaacttgagagccctggaa

SEQ ID NO: 114527 - DNA, 25 bp, Homo sapien
gcgcgaccgtgagagaaagtttaaa

SEQ ID NO: 114528 - DNA, 25 bp, Homo sapien
gcgcaacttttggactggtggtaaa

SEQ ID NO: 114529 - DNA, 25 bp, Homo sapien
aagtgcaactttgtggccgggacgc

SEQ ID NO: 114530 - DNA, 25 bp, Homo sapien
tttgggctctcgaagtgcaactttg

SEQ ID NO: 114531 - DNA, 25 bp, Homo sapien
tgcaagcgggtactttgttcccaaa

SEQ ID NO: 114532 - DNA, 25 bp, Homo sapien
ctccgggaatactgcgagtcggctg

SEQ ID NO: 114533 - DNA, 25 bp, Homo sapien
cggcatctgaggagaaagcgtccga

SEQ ID NO: 114534 - DNA, 25 bp, Homo sapien
ttttgtctttcttggacgcggtggc

SEQ ID NO: 114535 - DNA, 25 bp, Homo sapien
tgggatccatctggagccgagcaga

SEQ ID NO: 114536 - DNA, 25 bp, Homo sapien
caacccgcctcttcggggctttatg

SEQ ID NO: 114537 - DNA, 25 bp, Homo sapien
ggatggagccggatttttcccgctg

SEQ ID NO: 114538 - DNA, 25 bp, Homo sapien
ggatttttcccgctgttgctccacg

SEQ ID NO: 114539 - DNA, 25 bp, Homo sapien
ggacgcgtgacctgagcccacggca

SEQ ID NO: 114540 - DNA, 25 bp, Homo sapien
ggatccggcccggagcaacaggacc

SEQ ID NO: 114541 - DNA, 25 bp, Homo sapien
agagggagccgcagaaaatcccaaa

SEQ ID NO: 114542 - DNA, 25 bp, Homo sapien
aggatcggagcacgaaacacgcgtc

SEQ ID NO: 114543 - DNA, 25 bp, Homo sapien
gtcgcgctcctttaggttctcctcg

SEQ ID NO: 114544 - DNA, 25 bp, Homo sapien
gctgctcacctaaaaatgctcccaa

SEQ ID NO: 114545 - DNA, 25 bp, Homo sapien
gctgcgccacgggaaataaatgagg

SEQ ID NO: 114546 - DNA, 25 bp, Homo sapien
taaatgagggctgccaaaggccgtc

SEQ ID NO: 114547 - DNA, 25 bp, Homo sapien
acccagcgtcgcattgcagagtcga

SEQ ID NO: 114548 - DNA, 25 bp, Homo sapien
ctgctctgcgctcgaactttgggag

SEQ ID NO: 114549 - DNA, 25 bp, Homo sapien
ccaaaaggactcagggtagcaccga

SEQ ID NO: 114550 - DNA, 25 bp, Homo sapien
tgcaaccggggtgtacatcagtgct

SEQ ID NO: 114551 - DNA, 25 bp, Homo sapien
ctgcctgtagcgaagcgttttaatg

SEQ ID NO: 114552 - DNA, 25 bp, Homo sapien
taatgcacgcattgtgggtccgaca

SEQ ID NO: 114553 - DNA, 25 bp, Homo sapien
ttcgaaaatgctctgcagttgcgtc

SEQ ID NO: 114554 - DNA, 25 bp, Homo sapien
cagcaggaacctgtacggaagacgg

SEQ ID NO: 114555 - DNA, 25 bp, Homo sapien
aaaccgtagctcctcggcgtcgctt

SEQ ID NO: 114556 - DNA, 25 bp, Homo sapien
agacctctggaggaaaccgtagctc

SEQ ID NO: 114557 - DNA, 25 bp, Homo sapien
ctcgagctctgggaatataggggca

SEQ ID NO: 114558 - DNA, 25 bp, Homo sapien
aaggcccggatcagactcgagctct

SEQ ID NO: 114559 - DNA, 25 bp, Homo sapien
ttgcgtctccatctgtactatcacc

SEQ ID NO: 114560 - DNA, 25 bp, Homo sapien
cggcgccaccagaaggttccgtctg

SEQ ID NO: 114561 - DNA, 25 bp, Homo sapien
cgaggccacgcagggcgattcctgc

SEQ ID NO: 114562 - DNA, 25 bp, Homo sapien
agtcgctttgccctgactgcgagag

SEQ ID NO: 114563 - DNA, 25 bp, Homo sapien
aaagtactctcgctggtaggtccgc

SEQ ID NO: 114564 - DNA, 25 bp, Homo sapien
ataatccggggcgttgagtcgcttt

SEQ ID NO: 114565 - DNA, 25 bp, Homo sapien
ccgaaatcagacaggaagccaaata

SEQ ID NO: 114566 - DNA, 25 bp, Homo sapien
gacacacagagtgcccgaaatcaga

SEQ ID NO: 114567 - DNA, 25 bp, Homo sapien
ggacccaaaataaccgacacacaga

SEQ ID NO: 114568 - DNA, 25 bp, Homo sapien
atggtccgggagtgcttcttcgccc

SEQ ID NO: 114569 - DNA, 25 bp, Homo sapien
ccaggcacgtgcactggtacttgca

SEQ ID NO: 114570 - DNA, 25 bp, Homo sapien
agacgaacgtccatgctgcacaggg

SEQ ID NO: 114571 - DNA, 25 bp, Homo sapien
ctcgcagcatttcccgggcagcttg

SEQ ID NO: 114572 - DNA, 25 bp, Homo sapien
ttggtccttgggctcgtcacacacc

SEQ ID NO: 114573 - DNA, 25 bp, Homo sapien
ctgacttagaggaagactcgactca

SEQ ID NO: 114574 - DNA, 25 bp, Homo sapien
tccctgggagagaatcacgaccctg

SEQ ID NO: 114575 - DNA, 25 bp, Homo sapien
ttcggtcggcacagttaggactccc

SEQ ID NO: 114576 - DNA, 25 bp, Homo sapien
ttgcagctgctctggaaggactctc

SEQ ID NO: 114577 - DNA, 25 bp, Homo sapien
ctcccggcgcttacccggctgcaga

SEQ ID NO: 114578 - DNA, 25 bp, Homo sapien
gcccatactggcggcggtcatggtt

SEQ ID NO: 114579 - DNA, 25 bp, Homo sapien
aggcgacgcggacggggcccatact

SEQ ID NO: 114580 - DNA, 25 bp, Homo sapien
ggaggaccacgaaggcgacgcggac

SEQ ID NO: 114581 - DNA, 25 bp, Homo sapien
cggggaagagttgttgtgtgagttt

SEQ ID NO: 114582 - DNA, 25 bp, Homo sapien
gcggcccgaggcttttatacgctcc

SEQ ID NO: 114583 - DNA, 25 bp, Homo sapien
ccgaggcttttatacgctccgggcg

SEQ ID NO: 114584 - DNA, 25 bp, Homo sapien
gaggcttttatacgctccgggcggc

SEQ ID NO: 114585 - DNA, 25 bp, Homo sapien
tcttctagtggtaccgcccaggcct

SEQ ID NO: 114586 - DNA, 25 bp, Homo sapien
ggcctctgagggatgcgtcctaccc

SEQ ID NO: 114587 - DNA, 25 bp, Homo sapien
ggtggtatctcccaggctctacatt

SEQ ID NO: 114588 - DNA, 25 bp, Homo sapien
agtggtaccgcccaggccttaatca

SEQ ID NO: 114589 - DNA, 25 bp, Homo sapien
gctctacattctcgggagcggcgcc

SEQ ID NO: 114590 - DNA, 25 bp, Homo sapien
gaaataagttattggccgcgcgcct

SEQ ID NO: 114591 - DNA, 25 bp, Homo sapien
cccggccgttgcttctgtatataga

SEQ ID NO: 114592 - DNA, 25 bp, Homo sapien
ccattccgtgcggtggtatctccca

SEQ ID NO: 114593 - DNA, 25 bp, Homo sapien
tgccctccgagtccaggagggtccg

SEQ ID NO: 114594 - DNA, 25 bp, Homo sapien
tcggcttccctaccgcgcgccttct

SEQ ID NO: 114595 - DNA, 25 bp, Homo sapien
ccacgacgatgtcggcggacgccat

SEQ ID NO: 114596 - DNA, 25 bp, Homo sapien
cagtacttgccctccgagtccagga

SEQ ID NO: 114597 - DNA, 25 bp, Homo sapien
tgcggataggttcggcccgagcccc

SEQ ID NO: 114598 - DNA, 25 bp, Homo sapien
agcagcacatcctcgggcgcctcct

SEQ ID NO: 114599 - DNA, 25 bp, Homo sapien
ccggcccttccagcggatccacttg

SEQ ID NO: 114600 - DNA, 25 bp, Homo sapien
acgatgtcggcggacgccatggccc

SEQ ID NO: 114601 - DNA, 25 bp, Homo sapien
atccgattacttcgcagcctgcaga

SEQ ID NO: 114602 - DNA, 25 bp, Homo sapien
gcctaggttagggacacgctcttct

SEQ ID NO: 114603 - DNA, 25 bp, Homo sapien
tgagcactcctcctatctggggcct

SEQ ID NO: 114604 - DNA, 25 bp, Homo sapien
cgcctttcgaggcacagtcccaaga

SEQ ID NO: 114605 - DNA, 25 bp, Homo sapien
aagataggctcttgtccttcgacgc

SEQ ID NO: 114606 - DNA, 25 bp, Homo sapien
aggttccggctcaatctttcccaga

SEQ ID NO: 114607 - DNA, 25 bp, Homo sapien
tgtttgctttcacaccgggacggca

SEQ ID NO: 114608 - DNA, 25 bp, Homo sapien
ctggtgtttccagctcagttgcatc

SEQ ID NO: 114609 - DNA, 25 bp, Homo sapien
cggagccctcagctgcaattctcag

SEQ ID NO: 114610 - DNA, 25 bp, Homo sapien
caattctcagctgatgggcggtggc

SEQ ID NO: 114611 - DNA, 25 bp, Homo sapien
gctgggtaggcccacctgaccacag

SEQ ID NO: 114612 - DNA, 25 bp, Homo sapien
cctgaccacgcgcacaaacaagaag

SEQ ID NO: 114613 - DNA, 25 bp, Homo sapien
gcacaaacaagaaggcgcagcagcc

SEQ ID NO: 114614 - DNA, 25 bp, Homo sapien
ccgcagcacaactcaggaagaaggc

SEQ ID NO: 114615 - DNA, 25 bp, Homo sapien
gcatgcccgcagcacaactcaggaa

SEQ ID NO: 114616 - DNA, 25 bp, Homo sapien
cttttctattggcccgcggggctga

SEQ ID NO: 114617 - DNA, 25 bp, Homo sapien
ttcaagccacgtccttggactcgac

SEQ ID NO: 114618 - DNA, 25 bp, Homo sapien
gactcgacctccaaggagccactgg

SEQ ID NO: 114619 - DNA, 25 bp, Homo sapien
cccaaagccttccaggactctgggt

SEQ ID NO: 114620 - DNA, 25 bp, Homo sapien
cggcttcaagccacgtccttggact

SEQ ID NO: 114621 - DNA, 25 bp, Homo sapien
aattcatggtcacctcctggtgcgc

SEQ ID NO: 114622 - DNA, 25 bp, Homo sapien
ttgctaaagagacacgccggaagcc

SEQ ID NO: 114623 - DNA, 25 bp, Homo sapien
ggctcccggccacgcaattcatggt

SEQ ID NO: 114624 - DNA, 25 bp, Homo sapien
cctggtgcgcgtggtccctccaggt

SEQ ID NO: 114625 - DNA, 25 bp, Homo sapien
tgttgcactcgccaaggaccggcct

SEQ ID NO: 114626 - DNA, 25 bp, Homo sapien
aacccttaaataccggcatgcgtgc

SEQ ID NO: 114627 - DNA, 25 bp, Homo sapien
cgcctcaatccggaaacagaaactc

SEQ ID NO: 114628 - DNA, 25 bp, Homo sapien
cacgcggacacacttgtttggcttc

SEQ ID NO: 114629 - DNA, 25 bp, Homo sapien
ccggcctggcagagatagaaaactc

SEQ ID NO: 114630 - DNA, 25 bp, Homo sapien
ctgtcgcgctccgtagaatgagttc

SEQ ID NO: 114631 - DNA, 25 bp, Homo sapien
ttgcgttcttgctgggattcgtgac

SEQ ID NO: 114632 - DNA, 25 bp, Homo sapien
ctcgcagtacgtttgcctcagaacc

SEQ ID NO: 114633 - DNA, 25 bp, Homo sapien
gtgctctctgccctagaagacgtcc

SEQ ID NO: 114634 - DNA, 25 bp, Homo sapien
gcctgcgcgtaacggagttcatcca

SEQ ID NO: 114635 - DNA, 25 bp, Homo sapien
cccgcttgtgtacgctatttgttgt

SEQ ID NO: 114636 - DNA, 25 bp, Homo sapien
gcaaaacttccatcctgtccacgtg

SEQ ID NO: 114637 - DNA, 25 bp, Homo sapien
tacttaattacggacgcactgaacc

SEQ ID NO: 114638 - DNA, 25 bp, Homo sapien
tttcaccagaggcacagcgcgaagg

SEQ ID NO: 114639 - DNA, 25 bp, Homo sapien
aaggggatgtcctgttttcaccaga

SEQ ID NO: 114640 - DNA, 25 bp, Homo sapien
tccacgtgaagttgtcgctgcctta

SEQ ID NO: 114641 - DNA, 25 bp, Homo sapien
atttttagcgtggtgaagcgaggtt

SEQ ID NO: 114642 - DNA, 25 bp, Homo sapien
aatttgcggaccgagtccggtggca

SEQ ID NO: 114643 - DNA, 25 bp, Homo sapien
agctcggagcgattagggaatttgc

SEQ ID NO: 114644 - DNA, 25 bp, Homo sapien
ctccctttgtttgcgagattctgaa

SEQ ID NO: 114645 - DNA, 25 bp, Homo sapien
cacttgaaagagttttctccctttg

SEQ ID NO: 114646 - DNA, 25 bp, Homo sapien
cgaactttcgtttggtagcacttga

SEQ ID NO: 114647 - DNA, 25 bp, Homo sapien
cttgttttattctgcgccgcacagc

SEQ ID NO: 114648 - DNA, 25 bp, Homo sapien
gcacagcaacccgaactttcgtttg

SEQ ID NO: 114649 - DNA, 25 bp, Homo sapien
ttaaacacatcaacaagaaaaaagc

SEQ ID NO: 114650 - DNA, 25 bp, Homo sapien
ctatcaatacggtaaacagacaacc

SEQ ID NO: 114651 - DNA, 25 bp, Homo sapien
tgcaaactatgcatccaacaaaaga

SEQ ID NO: 114652 - DNA, 25 bp, Homo sapien
tatattcagaatctataagcaactt

SEQ ID NO: 114653 - DNA, 25 bp, Homo sapien
cccattaagaagtaggcgaatcgct

SEQ ID NO: 114654 - DNA, 25 bp, Homo sapien
cattaagaagtaggcgaatcgcttc

SEQ ID NO: 114655 - DNA, 25 bp, Homo sapien
gaagtaggcgaatcgcttcaacctg

SEQ ID NO: 114656 - DNA, 25 bp, Homo sapien
tgcatccaacaaaagacttatattc

SEQ ID NO: 114657 - DNA, 25 bp, Homo sapien
ggccctatctggatcgaaactcgca

SEQ ID NO: 114658 - DNA, 25 bp, Homo sapien
atgcagaatcaatcggggctcctca

SEQ ID NO: 114659 - DNA, 25 bp, Homo sapien
atctggatcgaaactcgcactcgcc

SEQ ID NO: 114660 - DNA, 25 bp, Homo sapien
cctggaggccctatctggatcgaaa

SEQ ID NO: 114661 - DNA, 25 bp, Homo sapien
tggcccatcccatgcagaatcaatc

SEQ ID NO: 114662 - DNA, 25 bp, Homo sapien
gggctcctcactcccgcgcctgctc

SEQ ID NO: 114663 - DNA, 25 bp, Homo sapien
gctccacctggaggccctatctgga

SEQ ID NO: 114664 - DNA, 25 bp, Homo sapien
gagccgtggcccatcccatgcagaa

SEQ ID NO: 114665 - DNA, 25 bp, Homo sapien
agagcaccgaggagagctccaactg

SEQ ID NO: 114666 - DNA, 25 bp, Homo sapien
gacaaatacgagaacgggtacattc

SEQ ID NO: 114667 - DNA, 25 bp, Homo sapien
cgcggcggtgacttacacatctcga

SEQ ID NO: 114668 - DNA, 25 bp, Homo sapien
acccggtcaacctggtgagtgctcc

SEQ ID NO: 114669 - DNA, 25 bp, Homo sapien
cagatcctggctaacgacaaatacg

SEQ ID NO: 114670 - DNA, 25 bp, Homo sapien
gtccagctacatcgcccacttgagg

SEQ ID NO: 114671 - DNA, 25 bp, Homo sapien
acacgctcaggctggcgtccagcta

SEQ ID NO: 114672 - DNA, 25 bp, Homo sapien
ctccaactgcgagaatgggtctccc

SEQ ID NO: 114673 - DNA, 25 bp, Homo sapien
ggaaccaccgcgtcctgaccttgga

SEQ ID NO: 114674 - DNA, 25 bp, Homo sapien
accgcgagccgcttatgtggaacca

SEQ ID NO: 114675 - DNA, 25 bp, Homo sapien
ctgaaagaagtggtgaccgcgagcc

SEQ ID NO: 114676 - DNA, 25 bp, Homo sapien
ggaaacccgagagtgacctgaaaga

SEQ ID NO: 114677 - DNA, 25 bp, Homo sapien
gcagacgtggccctttatggtggcc

SEQ ID NO: 114678 - DNA, 25 bp, Homo sapien
agagataaccggtctctccagagca

SEQ ID NO: 114679 - DNA, 25 bp, Homo sapien
ccgggagtaaattgcagagataacc

SEQ ID NO: 114680 - DNA, 25 bp, Homo sapien
cgagaacactttacaacgacgagga

SEQ ID NO: 114681 - DNA, 25 bp, Homo sapien
agccttgaaacttccgcttcatttg

SEQ ID NO: 114682 - DNA, 25 bp, Homo sapien
tgttattcctcgcagagagccttga

SEQ ID NO: 114683 - DNA, 25 bp, Homo sapien
gtgcgtttagctcccgccacgactt

SEQ ID NO: 114684 - DNA, 25 bp, Homo sapien
ttctcggcttagtttggtacctgga

SEQ ID NO: 114685 - DNA, 25 bp, Homo sapien
ccgcagtgtttacaagacgtcttcg

SEQ ID NO: 114686 - DNA, 25 bp, Homo sapien
ttcggggttatgaccgcagtgttta

SEQ ID NO: 114687 - DNA, 25 bp, Homo sapien
atgccaccggggctgtttaatgttc

SEQ ID NO: 114688 - DNA, 25 bp, Homo sapien
tccaggctacggaacagctcctaag

SEQ ID NO: 114689 - DNA, 25 bp, Homo sapien
taggccctgaaagtgccagaacaaa

SEQ ID NO: 114690 - DNA, 25 bp, Homo sapien
tcgcggtcagccttaccgagggaca

SEQ ID NO: 114691 - DNA, 25 bp, Homo sapien
tgggccgaggaaagcgatccatttt

SEQ ID NO: 114692 - DNA, 25 bp, Homo sapien
gcgatccattttctctaaccgtttg

SEQ ID NO: 114693 - DNA, 25 bp, Homo sapien
cgtttgctccagagctgtcaggtta

SEQ ID NO: 114694 - DNA, 25 bp, Homo sapien
cggccgcccagagaagaatgtgtta

SEQ ID NO: 114695 - DNA, 25 bp, Homo sapien
cctgggccctgctgacgaagcaaac

SEQ ID NO: 114696 - DNA, 25 bp, Homo sapien
ccctagccgtgcctcgagttcagag

SEQ ID NO: 114697 - DNA, 25 bp, Homo sapien
tgcagatccgctggctcagggatga

SEQ ID NO: 114698 - DNA, 25 bp, Homo sapien
agagtttttggaagtaggcgagacg

SEQ ID NO: 114699 - DNA, 25 bp, Homo sapien
agacggggaaggagttctgagcctc

SEQ ID NO: 114700 - DNA, 25 bp, Homo sapien
ttctgagcctcagtccgcacagcct

SEQ ID NO: 114701 - DNA, 25 bp, Homo sapien
ctttccgggtgcaatctccgggcca

SEQ ID NO: 114702 - DNA, 25 bp, Homo sapien
gtgtcccgctgcagatccgctggct

SEQ ID NO: 114703 - DNA, 25 bp, Homo sapien
gcaggttctgggttacgtccccaca

SEQ ID NO: 114704 - DNA, 25 bp, Homo sapien
tccgggtgcaatctccgggccagcg

SEQ ID NO: 114705 - DNA, 25 bp, Homo sapien
aagtggcatacggtcctgcgttatc

SEQ ID NO: 114706 - DNA, 25 bp, Homo sapien
agtctagtccgatgcccattagcgc

SEQ ID NO: 114707 - DNA, 25 bp, Homo sapien
cccggtcgctctaagaccaggattc

SEQ ID NO: 114708 - DNA, 25 bp, Homo sapien
caggattccaattcgcctagtgagg

SEQ ID NO: 114709 - DNA, 25 bp, Homo sapien
ctcactaggggaatttatcgcgaca

SEQ ID NO: 114710 - DNA, 25 bp, Homo sapien
cgcgacatcataaattaacgggttc

SEQ ID NO: 114711 - DNA, 25 bp, Homo sapien
ctagtctatttattgtcgcggggaa

SEQ ID NO: 114712 - DNA, 25 bp, Homo sapien
cgaccgcaaacccacgtagagtaag

SEQ ID NO: 114713 - DNA, 25 bp, Homo sapien
gttagcgctcaaagaccggctcggc

SEQ ID NO: 114714 - DNA, 25 bp, Homo sapien
tttccttgaaggagccgccgtgact

SEQ ID NO: 114715 - DNA, 25 bp, Homo sapien
cggcgagcactgacgtttccttgaa

SEQ ID NO: 114716 - DNA, 25 bp, Homo sapien
gcttcgctcactgtccctgcagata

SEQ ID NO: 114717 - DNA, 25 bp, Homo sapien
ctctcatttattccgccgccggaga

SEQ ID NO: 114718 - DNA, 25 bp, Homo sapien
gcagggccgttatcagtctccatcg

SEQ ID NO: 114719 - DNA, 25 bp, Homo sapien
acaaatggcccttgtgcacggtcgg

SEQ ID NO: 114720 - DNA, 25 bp, Homo sapien
cgcgcgctcggccttataaaaaagg

SEQ ID NO: 114721 - DNA, 25 bp, Homo sapien
cgatgccggtgccttccagtaaccc

SEQ ID NO: 114722 - DNA, 25 bp, Homo sapien
cgggcagttacaagttaccactatt

SEQ ID NO: 114723 - DNA, 25 bp, Homo sapien
ggccaggtacctggcgctcgctgtt

SEQ ID NO: 114724 - DNA, 25 bp, Homo sapien
agttaccactattcgcagggccagg

SEQ ID NO: 114725 - DNA, 25 bp, Homo sapien
accactattcgcagggccaggtacc

SEQ ID NO: 114726 - DNA, 25 bp, Homo sapien
tgcagaacagcgatgccggtgcctt

SEQ ID NO: 114727 - DNA, 25 bp, Homo sapien
ccgggctctgcagaacagcgatgcc

SEQ ID NO: 114728 - DNA, 25 bp, Homo sapien
cggagcgggcagttacaagttacca

SEQ ID NO: 114729 - DNA, 25 bp, Homo sapien
tcttctccaggtgatgcgctcctgg

SEQ ID NO: 114730 - DNA, 25 bp, Homo sapien
tttctccttccatcattgctccgaa

SEQ ID NO: 114731 - DNA, 25 bp, Homo sapien
gcggggagcgagtcgctcttctcca

SEQ ID NO: 114732 - DNA, 25 bp, Homo sapien
atgctgtggctcttaccgagcggga

SEQ ID NO: 114733 - DNA, 25 bp, Homo sapien
gatacggccaatctccggggagatg

SEQ ID NO: 114734 - DNA, 25 bp, Homo sapien
ccggacggtgggatacggccaatct

SEQ ID NO: 114735 - DNA, 25 bp, Homo sapien
tatgcatcaccgctgcaggaccctg

SEQ ID NO: 114736 - DNA, 25 bp, Homo sapien
ttgctccgaaacatatgcatcaccg

SEQ ID NO: 114737 - DNA, 25 bp, Homo sapien
tgcgcaagcgcgacgtcttagctgt

SEQ ID NO: 114738 - DNA, 25 bp, Homo sapien
ctgccacctaccttcatcgtagtta

SEQ ID NO: 114739 - DNA, 25 bp, Homo sapien
atcgtagttatagcctcgaacattc

SEQ ID NO: 114740 - DNA, 25 bp, Homo sapien
cgaacattccgatgccgggccatga

SEQ ID NO: 114741 - DNA, 25 bp, Homo sapien
ctgataaggcgccaactgcagcctg

SEQ ID NO: 114742 - DNA, 25 bp, Homo sapien
acgtcttagctgtgcaccgcgcgac

SEQ ID NO: 114743 - DNA, 25 bp, Homo sapien
acggcaatgcctcagggtcactgtc

SEQ ID NO: 114744 - DNA, 25 bp, Homo sapien
cactccgcttagatactgataaggc

SEQ ID NO: 114745 - DNA, 25 bp, Homo sapien
ggggtctctacttttgcaaattgtc

SEQ ID NO: 114746 - DNA, 25 bp, Homo sapien
cagaagccgctccagagactgatga

SEQ ID NO: 114747 - DNA, 25 bp, Homo sapien
cccttcacatttttggccggacaga

SEQ ID NO: 114748 - DNA, 25 bp, Homo sapien
tcattctttatggaggcgaggacca

SEQ ID NO: 114749 - DNA, 25 bp, Homo sapien
acaggcggctgaaaagcagatttta

SEQ ID NO: 114750 - DNA, 25 bp, Homo sapien
gaagcacgccctgcggctcattttg

SEQ ID NO: 114751 - DNA, 25 bp, Homo sapien
gccgtcgcacatgtcactgcactta

SEQ ID NO: 114752 - DNA, 25 bp, Homo sapien
gagggaaatcctcgtccgaactgtc

SEQ ID NO: 114753 - DNA, 25 bp, Homo sapien
tgcttgacaactgtcccggagtttt

SEQ ID NO: 114754 - DNA, 25 bp, Homo sapien
cctcgatcccgaatacagggctgta

SEQ ID NO: 114755 - DNA, 25 bp, Homo sapien
agctcgagacatcggtcctaccagg

SEQ ID NO: 114756 - DNA, 25 bp, Homo sapien
agtcccggtcacttcaggcctcagt

SEQ ID NO: 114757 - DNA, 25 bp, Homo sapien
ggccggcccagaagctagccaacta

SEQ ID NO: 114758 - DNA, 25 bp, Homo sapien
ttggagcccgtcttgatagtttctg

SEQ ID NO: 114759 - DNA, 25 bp, Homo sapien
ctttaggtcgggcagtgaatccctc

SEQ ID NO: 114760 - DNA, 25 bp, Homo sapien
ctaccaggccttatcggtcagatga

SEQ ID NO: 114761 - DNA, 25 bp, Homo sapien
agcgcacccatgatgtactcacgga

SEQ ID NO: 114762 - DNA, 25 bp, Homo sapien
gcgggaacagtctcctccactcgga

SEQ ID NO: 114763 - DNA, 25 bp, Homo sapien
tccaccgccttcttccaggaggagg

SEQ ID NO: 114764 - DNA, 25 bp, Homo sapien
tactcacggagaggggtacgcagaa

SEQ ID NO: 114765 - DNA, 25 bp, Homo sapien
acgctcgtcggtcactacgctatca

SEQ ID NO: 114766 - DNA, 25 bp, Homo sapien
gtgaggactctcagaaatcgcattc

SEQ ID NO: 114767 - DNA, 25 bp, Homo sapien
cgcaaaagtacggtgaggactctca

SEQ ID NO: 114768 - DNA, 25 bp, Homo sapien
gcgacccgtgtcctgaaagcaagcc

SEQ ID NO: 114769 - DNA, 25 bp, Homo sapien
gatcgcgtccctcgctttggtcaca

SEQ ID NO: 114770 - DNA, 25 bp, Homo sapien
ggtgctctccaaacacagcgtggta

SEQ ID NO: 114771 - DNA, 25 bp, Homo sapien
cacgctcagccagggtaatgttatg

SEQ ID NO: 114772 - DNA, 25 bp, Homo sapien
tccttgtgcagatcgctcagacgtc

SEQ ID NO: 114773 - DNA, 25 bp, Homo sapien
gagtgtcttactcgctacagccgga

SEQ ID NO: 114774 - DNA, 25 bp, Homo sapien
agcgactgcttttccttctcaagag

SEQ ID NO: 114775 - DNA, 25 bp, Homo sapien
cgggtcttccgagagtcagccaata

SEQ ID NO: 114776 - DNA, 25 bp, Homo sapien
ccagaacatcaagcggagggcgtta

SEQ ID NO: 114777 - DNA, 25 bp, Homo sapien
tgctattaagatgttgcctgcggcc

SEQ ID NO: 114778 - DNA, 25 bp, Homo sapien
taacggcgcaacgtctccttggttc

SEQ ID NO: 114779 - DNA, 25 bp, Homo sapien
aaatatggcctgtcctcggtcttca

SEQ ID NO: 114780 - DNA, 25 bp, Homo sapien
ggcccgtagtgcctcgaaaacctga

SEQ ID NO: 114781 - DNA, 25 bp, Homo sapien
gtctccaggcaggttcgcaaacacg

SEQ ID NO: 114782 - DNA, 25 bp, Homo sapien
acgtctccgtcacttccgatctggg

SEQ ID NO: 114783 - DNA, 25 bp, Homo sapien
tgctgcgggtcacagttattttctc

SEQ ID NO: 114784 - DNA, 25 bp, Homo sapien
gggtagacctactcaacgcactttg

SEQ ID NO: 114785 - DNA, 25 bp, Homo sapien
cctgaccctttgtgatggcgccgat

SEQ ID NO: 114786 - DNA, 25 bp, Homo sapien
tcccgggcagttcaggaaagcttgc

SEQ ID NO: 114787 - DNA, 25 bp, Homo sapien
tgcgattcagggcaaatgattctcc

SEQ ID NO: 114788 - DNA, 25 bp, Homo sapien
cgccgatagcgctcggatgaaatta

SEQ ID NO: 114789 - DNA, 25 bp, Homo sapien
cgcacggtgggtaagtcctttatcg

SEQ ID NO: 114790 - DNA, 25 bp, Homo sapien
attctccgacagacgctgggctcca

SEQ ID NO: 114791 - DNA, 25 bp, Homo sapien
cttctccgggtgtgaaattaccatg

SEQ ID NO: 114792 - DNA, 25 bp, Homo sapien
ttccacgccggaaagcccaaggaga

SEQ ID NO: 114793 - DNA, 25 bp, Homo sapien
ttctttctctccaggcgctcttgct

SEQ ID NO: 114794 - DNA, 25 bp, Homo sapien
gggcctctctactaagacgcagcta

SEQ ID NO: 114795 - DNA, 25 bp, Homo sapien
tcttagaggtgcaagttcgcgtccc

SEQ ID NO: 114796 - DNA, 25 bp, Homo sapien
ccagggctagtctctgggtcttaga

SEQ ID NO: 114797 - DNA, 25 bp, Homo sapien
cttcttcacgaacgcgagcttcttc

SEQ ID NO: 114798 - DNA, 25 bp, Homo sapien
tctgaaaacagaaggtcggcgtctg

SEQ ID NO: 114799 - DNA, 25 bp, Homo sapien
tcggcgtctgcctctgacaaacagg

SEQ ID NO: 114800 - DNA, 25 bp, Homo sapien
aatgcttctctcgttcctgccggac

SEQ ID NO: 114801 - DNA, 25 bp, Homo sapien
aggtgcccagaaactgctcgtcctg

SEQ ID NO: 114802 - DNA, 25 bp, Homo sapien
cgactctctggccactggtttggtc

SEQ ID NO: 114803 - DNA, 25 bp, Homo sapien
ttcaactgaattagacccgaggccg

SEQ ID NO: 114804 - DNA, 25 bp, Homo sapien
gctcgcctccacctgttgcgggaaa

SEQ ID NO: 114805 - DNA, 25 bp, Homo sapien
cggtcacctgtttcgcttcgcactg

SEQ ID NO: 114806 - DNA, 25 bp, Homo sapien
agctccgccatggtgctccgatgac

SEQ ID NO: 114807 - DNA, 25 bp, Homo sapien
ggagacgctatttccctccgaactc

SEQ ID NO: 114808 - DNA, 25 bp, Homo sapien
ctccgaactctgaagtagccaggtc

SEQ ID NO: 114809 - DNA, 25 bp, Homo sapien
agcctcgtcgttccttgcagacgct

SEQ ID NO: 114810 - DNA, 25 bp, Homo sapien
ccggacaaccgatgccaggggcagc

SEQ ID NO: 114811 - DNA, 25 bp, Homo sapien
agctcgccttcatcgggtggatttc

SEQ ID NO: 114812 - DNA, 25 bp, Homo sapien
tgacaagtcggctcgcaaacctgcg

SEQ ID NO: 114813 - DNA, 25 bp, Homo sapien
atcgggtggatttcctcctccttgc

SEQ ID NO: 114814 - DNA, 25 bp, Homo sapien
ccgctcgccctctgcagagtttaga

SEQ ID NO: 114815 - DNA, 25 bp, Homo sapien
agagaaagtgatgccctcgtccgcc

SEQ ID NO: 114816 - DNA, 25 bp, Homo sapien
ggcgctctccacgttccagaagctg

SEQ ID NO: 114817 - DNA, 25 bp, Homo sapien
cctgtgcggaccaatcagaatctca

SEQ ID NO: 114818 - DNA, 25 bp, Homo sapien
cgatgctcctgaatggacgcctgga

SEQ ID NO: 114819 - DNA, 25 bp, Homo sapien
gctggccttcctaaggacgatgctc

SEQ ID NO: 114820 - DNA, 25 bp, Homo sapien
gttggcccacaattcccagtctgca

SEQ ID NO: 114821 - DNA, 25 bp, Homo sapien
tagcccgtgtccttgttccttgaga

SEQ ID NO: 114822 - DNA, 25 bp, Homo sapien
tggtctctctaaccgcgccagtgtg

SEQ ID NO: 114823 - DNA, 25 bp, Homo sapien
gagtcaacgccctttcctgtgcgga

SEQ ID NO: 114824 - DNA, 25 bp, Homo sapien
tcttccagttgtgtgcaagtgcata

SEQ ID NO: 114825 - DNA, 25 bp, Homo sapien
ttcaacgacctcacttccagatggg

SEQ ID NO: 114826 - DNA, 25 bp, Homo sapien
gggctccctcaacatcttgctcaag

SEQ ID NO: 114827 - DNA, 25 bp, Homo sapien
tctccttcctgaccctggtgcagtg

SEQ ID NO: 114828 - DNA, 25 bp, Homo sapien
tggtgcagtgcctgaccagctccac

SEQ ID NO: 114829 - DNA, 25 bp, Homo sapien
agcctgcccatgtacgtggtcttca

SEQ ID NO: 114830 - DNA, 25 bp, Homo sapien
cgcggggatcactgagttcaacgac

SEQ ID NO: 114831 - DNA, 25 bp, Homo sapien
tcgctcagctcgcaaaagggacttc

SEQ ID NO: 114832 - DNA, 25 bp, Homo sapien
acgcagagctgcctaaccgcaagaa

SEQ ID NO: 114833 - DNA, 25 bp, Homo sapien
cccgaccgcaagtcataggctgtgg

SEQ ID NO: 114834 - DNA, 25 bp, Homo sapien
gctacccagctggatggcagcgcga

SEQ ID NO: 114835 - DNA, 25 bp, Homo sapien
tccaggcgacctgagtcccagggcg

SEQ ID NO: 114836 - DNA, 25 bp, Homo sapien
gtgccacgctccaggcgacctgagt

SEQ ID NO: 114837 - DNA, 25 bp, Homo sapien
gggcagcagactgctcagtcccacg

SEQ ID NO: 114838 - DNA, 25 bp, Homo sapien
gcaagtcataggctgtgggcaccgc

SEQ ID NO: 114839 - DNA, 25 bp, Homo sapien
cggatctcgcgacgcgcggcttgca

SEQ ID NO: 114840 - DNA, 25 bp, Homo sapien
cctcaattctcgagaccgaaagtgc

SEQ ID NO: 114841 - DNA, 25 bp, Homo sapien
caagtgcctcgcacttcagcctttg

SEQ ID NO: 114842 - DNA, 25 bp, Homo sapien
tgtcctggcgtcattgtgtgtccca

SEQ ID NO: 114843 - DNA, 25 bp, Homo sapien
ggcgtcattgtgtgtcccagccagg

SEQ ID NO: 114844 - DNA, 25 bp, Homo sapien
tgtcccagccaggtgcttctgccgt

SEQ ID NO: 114845 - DNA, 25 bp, Homo sapien
gcttctgccgtctccgacagtgaca

SEQ ID NO: 114846 - DNA, 25 bp, Homo sapien
ctgccgtctccgacagtgacaagtg

SEQ ID NO: 114847 - DNA, 25 bp, Homo sapien
cgtctccgacagtgacaagtgcctc

SEQ ID NO: 114848 - DNA, 25 bp, Homo sapien
cgtctacgctgtccggagggtgaac

SEQ ID NO: 114849 - DNA, 25 bp, Homo sapien
caggagaaaggcaaccgacgagttc

SEQ ID NO: 114850 - DNA, 25 bp, Homo sapien
tgccgcgaacgacggtacctgagga

SEQ ID NO: 114851 - DNA, 25 bp, Homo sapien
ctcacaccctgcatgacaaggggta

SEQ ID NO: 114852 - DNA, 25 bp, Homo sapien
aagaggagagccatgctgctaccga

SEQ ID NO: 114853 - DNA, 25 bp, Homo sapien
tgctaccgacggtcgctggctccaa

SEQ ID NO: 114854 - DNA, 25 bp, Homo sapien
cgtcacttccgtcaccggggtctgt

SEQ ID NO: 114855 - DNA, 25 bp, Homo sapien
actcaggcgcagcacccagcagtga

SEQ ID NO: 114856 - DNA, 25 bp, Homo sapien
gcgtgatttgttgtggcggcaacca

SEQ ID NO: 114857 - DNA, 25 bp, Homo sapien
cttgggttagaagcaacggctctct

SEQ ID NO: 114858 - DNA, 25 bp, Homo sapien
ccgggcctctccttagcaaagttga

SEQ ID NO: 114859 - DNA, 25 bp, Homo sapien
cgcgctcagcccgactttgaatttg

SEQ ID NO: 114860 - DNA, 25 bp, Homo sapien
cgcttagtatttcgaggcactttgc

SEQ ID NO: 114861 - DNA, 25 bp, Homo sapien
atccttttgttttctgcgcgccagc

SEQ ID NO: 114862 - DNA, 25 bp, Homo sapien
gcgtagagactcatgcttgccactt

SEQ ID NO: 114863 - DNA, 25 bp, Homo sapien
cgctcgacggaaaactgactctgca

SEQ ID NO: 114864 - DNA, 25 bp, Homo sapien
tgcgaggacaaacgtccgtactttc

SEQ ID NO: 114865 - DNA, 25 bp, Homo sapien
tttgtacttgctgctctctcccgcg

SEQ ID NO: 114866 - DNA, 25 bp, Homo sapien
ttctgcatcatatcgccctgcgtgg

SEQ ID NO: 114867 - DNA, 25 bp, Homo sapien
ccgacagctgcttcttgattttgta

SEQ ID NO: 114868 - DNA, 25 bp, Homo sapien
aactgctgtaggtcctgctccgaca

SEQ ID NO: 114869 - DNA, 25 bp, Homo sapien
caagtccttggactcggccgacagc

SEQ ID NO: 114870 - DNA, 25 bp, Homo sapien
cgcagcccgtccatggctaggttca

SEQ ID NO: 114871 - DNA, 25 bp, Homo sapien
gcccatgcgcgtagggcatgacttc

SEQ ID NO: 114872 - DNA, 25 bp, Homo sapien
tcgcgtccgttgatcttcagcctca

SEQ ID NO: 114873 - DNA, 25 bp, Homo sapien
gaggtgggcgtagatctttcttccc

SEQ ID NO: 114874 - DNA, 25 bp, Homo sapien
atcaatcgcggaacctcgggcactt

SEQ ID NO: 114875 - DNA, 25 bp, Homo sapien
acgctagctagtgactgagagtctc

SEQ ID NO: 114876 - DNA, 25 bp, Homo sapien
tgcgccgctgagtcacttcgaagaa

SEQ ID NO: 114877 - DNA, 25 bp, Homo sapien
cgtcggacagggaaatcagaagctc

SEQ ID NO: 114878 - DNA, 25 bp, Homo sapien
tggaacgggaaacaaacgctagcta

SEQ ID NO: 114879 - DNA, 25 bp, Homo sapien
cccaggagtggtctctagaagaacc

SEQ ID NO: 114880 - DNA, 25 bp, Homo sapien
ttcccttgactcaaaccgagcggtc

SEQ ID NO: 114881 - DNA, 25 bp, Homo sapien
ttgtttcaataatcgcagctctctg

SEQ ID NO: 114882 - DNA, 25 bp, Homo sapien
gagcaattatgcctccacgctgaag

SEQ ID NO: 114883 - DNA, 25 bp, Homo sapien
tccatggacactcgagcaattatgc

SEQ ID NO: 114884 - DNA, 25 bp, Homo sapien
acaaagcgccgagaatccatggaca

SEQ ID NO: 114885 - DNA, 25 bp, Homo sapien
ttaaatgctcccgtcgttcgcaggg

SEQ ID NO: 114886 - DNA, 25 bp, Homo sapien
cctttctcggagactgaactaagtg

SEQ ID NO: 114887 - DNA, 25 bp, Homo sapien
ttttgttgttcgtttgcgctcgcgc

SEQ ID NO: 114888 - DNA, 25 bp, Homo sapien
gatttgattgaaatggcgtgtgcca

SEQ ID NO: 114889 - DNA, 25 bp, Homo sapien
cttccctaagggttttcagctccag

SEQ ID NO: 114890 - DNA, 25 bp, Homo sapien
tcagctccagtaacagaggtgcctg

SEQ ID NO: 114891 - DNA, 25 bp, Homo sapien
atcgttctccggcaacaggtgcgtc

SEQ ID NO: 114892 - DNA, 25 bp, Homo sapien
cggatttctttctgagggctgacta

SEQ ID NO: 114893 - DNA, 25 bp, Homo sapien
gtcttgcttcgtggagtctcttttc

SEQ ID NO: 114894 - DNA, 25 bp, Homo sapien
acttcccatccgttgcggggcttga

SEQ ID NO: 114895 - DNA, 25 bp, Homo sapien
tggtccaaggttcagggcctccttc

SEQ ID NO: 114896 - DNA, 25 bp, Homo sapien
cggtcaccctctgctttttcgaagg

SEQ ID NO: 114897 - DNA, 25 bp, Homo sapien
agcttccgaaatgcccaggtgactc

SEQ ID NO: 114898 - DNA, 25 bp, Homo sapien
tcaccgcgatttccacatggatgtg

SEQ ID NO: 114899 - DNA, 25 bp, Homo sapien
agccagctgttcctttcagataatg

SEQ ID NO: 114900 - DNA, 25 bp, Homo sapien
gttggttttgcagcgctcctggact

SEQ ID NO: 114901 - DNA, 25 bp, Homo sapien
caccgtctacctggcgttggttttg

SEQ ID NO: 114902 - DNA, 25 bp, Homo sapien
ccttgaccaggacttgggactttgc

SEQ ID NO: 114903 - DNA, 25 bp, Homo sapien
agcggccgccaagagagatcacacc

SEQ ID NO: 114904 - DNA, 25 bp, Homo sapien
cccgacccagagagtcacgtgactt

SEQ ID NO: 114905 - DNA, 25 bp, Homo sapien
cccacctagattccggtgactcaga

SEQ ID NO: 114906 - DNA, 25 bp, Homo sapien
cctagattccggtgactcagagcgc

SEQ ID NO: 114907 - DNA, 25 bp, Homo sapien
tggtcgctagactgcaaccagccgc

SEQ ID NO: 114908 - DNA, 25 bp, Homo sapien
gacgtctggccgtggtcgctagact

SEQ ID NO: 114909 - DNA, 25 bp, Homo sapien
tgggagcatttccaccacagcgagg

SEQ ID NO: 114910 - DNA, 25 bp, Homo sapien
tgacagccctcctcgtaggacccgc

SEQ ID NO: 114911 - DNA, 25 bp, Homo sapien
cgggcactcaccgtactccatgagg

SEQ ID NO: 114912 - DNA, 25 bp, Homo sapien
ccgctggtaaacaggctgggttctg

SEQ ID NO: 114913 - DNA, 25 bp, Homo sapien
ggcccaaaaaagctgttagtgactg

SEQ ID NO: 114914 - DNA, 25 bp, Homo sapien
gtgattcatcagcatccgcgccggg

SEQ ID NO: 114915 - DNA, 25 bp, Homo sapien
cctggcacagggagtggcccaaaaa

SEQ ID NO: 114916 - DNA, 25 bp, Homo sapien
tccgggagcaagtacaaagccatca

SEQ ID NO: 114917 - DNA, 25 bp, Homo sapien
aagccatcaaggagagctgcacctg

SEQ ID NO: 114918 - DNA, 25 bp, Homo sapien
cgcctcgggaaattgatgtgggatt

SEQ ID NO: 114919 - DNA, 25 bp, Homo sapien
ttagtgactgaacgcaagaattttc

SEQ ID NO: 114920 - DNA, 25 bp, Homo sapien
agaattttccggttagcagacgacg

SEQ ID NO: 114921 - DNA, 25 bp, Homo sapien
gcggccaaggtggtgctcaccctct

SEQ ID NO: 114922 - DNA, 25 bp, Homo sapien
gtgctcaccctctccacgcaagccg

SEQ ID NO: 114923 - DNA, 25 bp, Homo sapien
cagcgcggccaaggtggtgctcacc

SEQ ID NO: 114924 - DNA, 25 bp, Homo sapien
ggagcctcatgagcgggagcagcgc

SEQ ID NO: 114925 - DNA, 25 bp, Homo sapien
ccaggacctcgtccgggaaggcagc

SEQ ID NO: 114926 - DNA, 25 bp, Homo sapien
atccaggacctcgtccgggaaggca

SEQ ID NO: 114927 - DNA, 25 bp, Homo sapien
tgtccatccaggacctcgtccggga

SEQ ID NO: 114928 - DNA, 25 bp, Homo sapien
tccacgcaagccgacaggtgcgcgg

SEQ ID NO: 114929 - DNA, 25 bp, Homo sapien
atcctcgaaagcagcgggtttggtt

SEQ ID NO: 114930 - DNA, 25 bp, Homo sapien
tctgcactgacacttggctggagcc

SEQ ID NO: 114931 - DNA, 25 bp, Homo sapien
gcctgaatcggatgctctgcactga

SEQ ID NO: 114932 - DNA, 25 bp, Homo sapien
ggtacaagaagttggcctgcgcctg

SEQ ID NO: 114933 - DNA, 25 bp, Homo sapien
gaagtctgccggcatcctcgaaagc

SEQ ID NO: 114934 - DNA, 25 bp, Homo sapien
tactcttgaggtcgggaagtctgcc

SEQ ID NO: 114935 - DNA, 25 bp, Homo sapien
ggcgactccgctttgacactactct

SEQ ID NO: 114936 - DNA, 25 bp, Homo sapien
cctgcacgctgggaggcttgcagaa

SEQ ID NO: 114937 - DNA, 25 bp, Homo sapien
tccgtctgtctttccatctgtcgtg

SEQ ID NO: 114938 - DNA, 25 bp, Homo sapien
ggagctgctccagtacctgcttctc

SEQ ID NO: 114939 - DNA, 25 bp, Homo sapien
ccgacagtgccgcagagatcgctct

SEQ ID NO: 114940 - DNA, 25 bp, Homo sapien
ggctcagggctgagttcctcttggc

SEQ ID NO: 114941 - DNA, 25 bp, Homo sapien
aagtgatacatgtgctgtgccgagg

SEQ ID NO: 114942 - DNA, 25 bp, Homo sapien
ccctgcgcgggcagtaagtgataca

SEQ ID NO: 114943 - DNA, 25 bp, Homo sapien
acagcgcgagcgtttaaaaaacatc

SEQ ID NO: 114944 - DNA, 25 bp, Homo sapien
cgggtgaaggcccttccatggtgac

SEQ ID NO: 114945 - DNA, 25 bp, Homo sapien
tctgggacctaggacaacttcttgg

SEQ ID NO: 114946 - DNA, 25 bp, Homo sapien
gagtacggccattcgccctggctga

SEQ ID NO: 114947 - DNA, 25 bp, Homo sapien
tacccactatgctacgcaaacgaga

SEQ ID NO: 114948 - DNA, 25 bp, Homo sapien
cagttccagattctctccatgtgtc

SEQ ID NO: 114949 - DNA, 25 bp, Homo sapien
ccgccttccggctgatttgcagtga

SEQ ID NO: 114950 - DNA, 25 bp, Homo sapien
gaggttcccaaaccggttgcacaga

SEQ ID NO: 114951 - DNA, 25 bp, Homo sapien
ccagcgggtcccatagagttaagta

SEQ ID NO: 114952 - DNA, 25 bp, Homo sapien
cgcaagggaccctgaaagctgtctg

SEQ ID NO: 114953 - DNA, 25 bp, Homo sapien
atgctgtccacaggctccacggctt

SEQ ID NO: 114954 - DNA, 25 bp, Homo sapien
gatccggttccgcatgctgtacctg

SEQ ID NO: 114955 - DNA, 25 bp, Homo sapien
ggacagactccgaggcatcaagcct

SEQ ID NO: 114956 - DNA, 25 bp, Homo sapien
cggttccgcatgctgtacctgctgc

SEQ ID NO: 114957 - DNA, 25 bp, Homo sapien
ctcgccagtccgtccagggaacatc

SEQ ID NO: 114958 - DNA, 25 bp, Homo sapien
tctccctccgagatgacggtcatgg

SEQ ID NO: 114959 - DNA, 25 bp, Homo sapien
ccgcgggctatgctgtccacaggct

SEQ ID NO: 114960 - DNA, 25 bp, Homo sapien
ggctgctctggatccggttccgcat

SEQ ID NO: 114961 - DNA, 25 bp, Homo sapien
tccctccctccggattggagaggga

SEQ ID NO: 114962 - DNA, 25 bp, Homo sapien
ggagccgcgagtcccgctgaagttt

SEQ ID NO: 114963 - DNA, 25 bp, Homo sapien
cgagaggaagttccaggggcagctc

SEQ ID NO: 114964 - DNA, 25 bp, Homo sapien
ttcctccacccgcagggcttcgcgg

SEQ ID NO: 114965 - DNA, 25 bp, Homo sapien
aacacaaaggaagtcccgggcagcg

SEQ ID NO: 114966 - DNA, 25 bp, Homo sapien
tgcatccaacacaaaggaagtcccg

SEQ ID NO: 114967 - DNA, 25 bp, Homo sapien
aagcgagggaagtgccgccgacacc

SEQ ID NO: 114968 - DNA, 25 bp, Homo sapien
gatccctcagtctgcctcccgtcgg

SEQ ID NO: 114969 - DNA, 25 bp, Homo sapien
acgcccgccggagttacagctaaag

SEQ ID NO: 114970 - DNA, 25 bp, Homo sapien
gaggctgtacctcttacgtcacttc

SEQ ID NO: 114971 - DNA, 25 bp, Homo sapien
tcttcacgccgccttggagccaaaa

SEQ ID NO: 114972 - DNA, 25 bp, Homo sapien
ctcctgggtcacagagcctaaaacg

SEQ ID NO: 114973 - DNA, 25 bp, Homo sapien
tagcttccggaaagggtactgcatt

SEQ ID NO: 114974 - DNA, 25 bp, Homo sapien
cttcgggcatgctcgaacagcattc

SEQ ID NO: 114975 - DNA, 25 bp, Homo sapien
gacactctggttccgccttcgggca

SEQ ID NO: 114976 - DNA, 25 bp, Homo sapien
ggaacagttgcatggcgacactctg

SEQ ID NO: 114977 - DNA, 25 bp, Homo sapien
cccgagcctagctggcctcaagaga

SEQ ID NO: 114978 - DNA, 25 bp, Homo sapien
gtgcagtcgcccaggaagaccctaa

SEQ ID NO: 114979 - DNA, 25 bp, Homo sapien
ccggcttagtttcccagtgcagtcg

SEQ ID NO: 114980 - DNA, 25 bp, Homo sapien
tctgagccgctagtctttttcttgg

SEQ ID NO: 114981 - DNA, 25 bp, Homo sapien
tcctagaggtaaagcccgtggcttc

SEQ ID NO: 114982 - DNA, 25 bp, Homo sapien
cccgagttggcgcactcgattttca

SEQ ID NO: 114983 - DNA, 25 bp, Homo sapien
ggatccctatggagatgaccctgtc

SEQ ID NO: 114984 - DNA, 25 bp, Homo sapien
ggctccgtgttgttggatccctatg

SEQ ID NO: 114985 - DNA, 25 bp, Homo sapien
agctctatctgcttagacacccggg

SEQ ID NO: 114986 - DNA, 25 bp, Homo sapien
gctctatctgcttagacacccgggc

SEQ ID NO: 114987 - DNA, 25 bp, Homo sapien
cagctctatctgcttagacacccgg

SEQ ID NO: 114988 - DNA, 25 bp, Homo sapien
gcagctctatctgcttagacacccg

SEQ ID NO: 114989 - DNA, 25 bp, Homo sapien
acgcagctctatctgcttagacacc

SEQ ID NO: 114990 - DNA, 25 bp, Homo sapien
ccacgcagctctatctgcttagaca

SEQ ID NO: 114991 - DNA, 25 bp, Homo sapien
gcggcagtcggatccccacgcagct

SEQ ID NO: 114992 - DNA, 25 bp, Homo sapien
ctctatctgcttagacacccgggcg

SEQ ID NO: 114993 - DNA, 25 bp, Homo sapien
gcagcgcgggttcccagccattcct

SEQ ID NO: 114994 - DNA, 25 bp, Homo sapien
gacgagtcccacagtgagatatttg

SEQ ID NO: 114995 - DNA, 25 bp, Homo sapien
ggagacgagtcccacagtgagatat

SEQ ID NO: 114996 - DNA, 25 bp, Homo sapien
cctcgggagacgagtcccacagtga

SEQ ID NO: 114997 - DNA, 25 bp, Homo sapien
attccttgggtccaggtcgaggaag

SEQ ID NO: 114998 - DNA, 25 bp, Homo sapien
ccattccttgggtccaggtcgagga

SEQ ID NO: 114999 - DNA, 25 bp, Homo sapien
cagccattccttgggtccaggtcga

SEQ ID NO: 115000 - DNA, 25 bp, Homo sapien
gagtcccacagtgagatatttgatg

SEQ ID NO: 115001 - DNA, 25 bp, Homo sapien
gagaaacacccaccgggctggcttg

SEQ ID NO: 115002 - DNA, 25 bp, Homo sapien
ggacgcgacgttacctgtaggacca

SEQ ID NO: 115003 - DNA, 25 bp, Homo sapien
gcggcagcgcttcccggaaagttgt

SEQ ID NO: 115004 - DNA, 25 bp, Homo sapien
gcatcgctcagcgttaagccttcca

SEQ ID NO: 115005 - DNA, 25 bp, Homo sapien
ctgaatagtatttctgctccgcatc

SEQ ID NO: 115006 - DNA, 25 bp, Homo sapien
caatgtcgcagtaggagaagagatc

SEQ ID NO: 115007 - DNA, 25 bp, Homo sapien
accttcttggtgctctcaatgtcgc

SEQ ID NO: 115008 - DNA, 25 bp, Homo sapien
tgtaggaccacgtcgttcggcagct

SEQ ID NO: 115009 - DNA, 25 bp, Homo sapien
ggtgcgacgtgtcggctttgcactt

SEQ ID NO: 115010 - DNA, 25 bp, Homo sapien
gtgcggctctgtgcgctccagatca

SEQ ID NO: 115011 - DNA, 25 bp, Homo sapien
tccgcactcggctcacgtgacgttt

SEQ ID NO: 115012 - DNA, 25 bp, Homo sapien
tggaacgatttttaccgcggtgcga

SEQ ID NO: 115013 - DNA, 25 bp, Homo sapien
cggctttgcacttggcggtggttca

SEQ ID NO: 115014 - DNA, 25 bp, Homo sapien
ggaagccggcagaaatggaacgatt

SEQ ID NO: 115015 - DNA, 25 bp, Homo sapien
ttgggtgctcgctctcgcggcgctt

SEQ ID NO: 115016 - DNA, 25 bp, Homo sapien
ctgcggagacaaagacttccgggac

SEQ ID NO: 115017 - DNA, 25 bp, Homo sapien
gcgggcgatgccaaaaacggtaaga

SEQ ID NO: 115018 - DNA, 25 bp, Homo sapien
gtcccgtcagccgtgaggtcacctg

SEQ ID NO: 115019 - DNA, 25 bp, Homo sapien
gaatcaaaacaagccggagacccgc

SEQ ID NO: 115020 - DNA, 25 bp, Homo sapien
gaacggccgtgcctctgggatccgc

SEQ ID NO: 115021 - DNA, 25 bp, Homo sapien
tgggatccgccttcgctgacgccgg

SEQ ID NO: 115022 - DNA, 25 bp, Homo sapien
agcgtgtcagtgcagccgaatcaaa

SEQ ID NO: 115023 - DNA, 25 bp, Homo sapien
cgggcacctacctggacgcgagcga

SEQ ID NO: 115024 - DNA, 25 bp, Homo sapien
gcggccgcaaaaacaagcgcgccaa

SEQ ID NO: 115025 - DNA, 25 bp, Homo sapien
gaaacgtggtaaactgtgccctgtg

SEQ ID NO: 115026 - DNA, 25 bp, Homo sapien
tcagtgccagccacagaaacgtggt

SEQ ID NO: 115027 - DNA, 25 bp, Homo sapien
cggaagttcattctggccgcgctca

SEQ ID NO: 115028 - DNA, 25 bp, Homo sapien
cacgtgcgcatggaagacgatgccc

SEQ ID NO: 115029 - DNA, 25 bp, Homo sapien
aagctgaacactttccacgtgcgca

SEQ ID NO: 115030 - DNA, 25 bp, Homo sapien
cccaggcataagctgaacactttcc

SEQ ID NO: 115031 - DNA, 25 bp, Homo sapien
gtaaactgtgccctgtgccaccggg

SEQ ID NO: 115032 - DNA, 25 bp, Homo sapien
cgtgcagttccttcggcggctggac

SEQ ID NO: 115033 - DNA, 25 bp, Homo sapien
cccaattggccactgacgagctctg

SEQ ID NO: 115034 - DNA, 25 bp, Homo sapien
gccgcctcgtgggtacgaatactaa

SEQ ID NO: 115035 - DNA, 25 bp, Homo sapien
cgagaattatttgcgcgcctgcgcg

SEQ ID NO: 115036 - DNA, 25 bp, Homo sapien
agcttccttggtgggacgtactcca

SEQ ID NO: 115037 - DNA, 25 bp, Homo sapien
gcggtcgagttccaaccaagccctg

SEQ ID NO: 115038 - DNA, 25 bp, Homo sapien
ggaggccggacctatcagtgacaga

SEQ ID NO: 115039 - DNA, 25 bp, Homo sapien
gtcgtccggtgctgaaaatgtcctc

SEQ ID NO: 115040 - DNA, 25 bp, Homo sapien
tccgtagcccgagtgataagccatg

SEQ ID NO: 115041 - DNA, 25 bp, Homo sapien
cactctgctgggctgctgtttgcac

SEQ ID NO: 115042 - DNA, 25 bp, Homo sapien
gtttcgatcgagtcaacagctcact

SEQ ID NO: 115043 - DNA, 25 bp, Homo sapien
gatcgagtcaacagctcactctgct

SEQ ID NO: 115044 - DNA, 25 bp, Homo sapien
ctgctgtttgcacacgaagtccgtc

SEQ ID NO: 115045 - DNA, 25 bp, Homo sapien
ctgtttgcacacgaagtccgtcata

SEQ ID NO: 115046 - DNA, 25 bp, Homo sapien
tgcacacgaagtccgtcataaaatc

SEQ ID NO: 115047 - DNA, 25 bp, Homo sapien
tttcgccggggtttcgatcgagtca

SEQ ID NO: 115048 - DNA, 25 bp, Homo sapien
ccggggtttcgatcgagtcaacagc

SEQ ID NO: 115049 - DNA, 25 bp, Homo sapien
tcactcggttcacctagcgatctgc

SEQ ID NO: 115050 - DNA, 25 bp, Homo sapien
agggctttggccacagttaatatag

SEQ ID NO: 115051 - DNA, 25 bp, Homo sapien
agctgccaacaatgagctgtgtttc

SEQ ID NO: 115052 - DNA, 25 bp, Homo sapien
tcagcagcacatagaggggaccttc

SEQ ID NO: 115053 - DNA, 25 bp, Homo sapien
gccctgctgcgaacttcaggcatta

SEQ ID NO: 115054 - DNA, 25 bp, Homo sapien
atcagccctcctcatcctgttgttg

SEQ ID NO: 115055 - DNA, 25 bp, Homo sapien
ttgcgatttctgctccgaagaccga

SEQ ID NO: 115056 - DNA, 25 bp, Homo sapien
ttcctggcgtgcaaagcgcttcgct

SEQ ID NO: 115057 - DNA, 25 bp, Homo sapien
ctgaggactgaacgcccacgattta

SEQ ID NO: 115058 - DNA, 25 bp, Homo sapien
cggccgccaggttagagatgaagat

SEQ ID NO: 115059 - DNA, 25 bp, Homo sapien
tgttgcccagcaagcccacggtgat

SEQ ID NO: 115060 - DNA, 25 bp, Homo sapien
ctcgggaacggaaccgctctcattc

SEQ ID NO: 115061 - DNA, 25 bp, Homo sapien
caccgagaggttggaaagagactta

SEQ ID NO: 115062 - DNA, 25 bp, Homo sapien
gcgctgttggtgatgaagatcttca

SEQ ID NO: 115063 - DNA, 25 bp, Homo sapien
tgcaagtttactgtccgcggggcaa

SEQ ID NO: 115064 - DNA, 25 bp, Homo sapien
tcacagcaccacgtccctaagagtt

SEQ ID NO: 115065 - DNA, 25 bp, Homo sapien
cgccaaaatgctcgggtcttctgtg

SEQ ID NO: 115066 - DNA, 25 bp, Homo sapien
cgccatgcgcggcataagcgccaaa

SEQ ID NO: 115067 - DNA, 25 bp, Homo sapien
gtcccagctggggatccgtagttga

SEQ ID NO: 115068 - DNA, 25 bp, Homo sapien
cttctgtgggttctaaccgccgaga

SEQ ID NO: 115069 - DNA, 25 bp, Homo sapien
cgccgagagccaagcaccctgaggt

SEQ ID NO: 115070 - DNA, 25 bp, Homo sapien
tccgtagttgacttgacgtcgctga

SEQ ID NO: 115071 - DNA, 25 bp, Homo sapien
agcaacggaagagtgggcagcattt

SEQ ID NO: 115072 - DNA, 25 bp, Homo sapien
ttgctctgaacgctcgtgcgcgcta

SEQ ID NO: 115073 - DNA, 25 bp, Homo sapien
tgaactctccagaaacggcgtaaag

SEQ ID NO: 115074 - DNA, 25 bp, Homo sapien
cgccgtcgggaaagcccatgaactc

SEQ ID NO: 115075 - DNA, 25 bp, Homo sapien
ccagggttcaccttgcgccgtcggg

SEQ ID NO: 115076 - DNA, 25 bp, Homo sapien
agccggagtcgggtcatacgccgca

SEQ ID NO: 115077 - DNA, 25 bp, Homo sapien
ttcggccctggggttgaagatcctg

SEQ ID NO: 115078 - DNA, 25 bp, Homo sapien
agatgccacaggagcgcctgccttc

SEQ ID NO: 115079 - DNA, 25 bp, Homo sapien
gctgcaaacgctggggagatgccac

SEQ ID NO: 115080 - DNA, 25 bp, Homo sapien
tgatcttgcggccaaaggggacctc

SEQ ID NO: 115081 - DNA, 25 bp, Homo sapien
ttgcattcatgctccctcgggtgtc

SEQ ID NO: 115082 - DNA, 25 bp, Homo sapien
tttccaggtgtttggaggacgcact

SEQ ID NO: 115083 - DNA, 25 bp, Homo sapien
ccctgcggagacgtcattgcattca

SEQ ID NO: 115084 - DNA, 25 bp, Homo sapien
agagcatttcctgttgtgcagctga

SEQ ID NO: 115085 - DNA, 25 bp, Homo sapien
caccgcctggatttcccacggggag

SEQ ID NO: 115086 - DNA, 25 bp, Homo sapien
tcccggaggaaaccgagctcgcaag

SEQ ID NO: 115087 - DNA, 25 bp, Homo sapien
cgggcgcactttcctcagcgtaatt

SEQ ID NO: 115088 - DNA, 25 bp, Homo sapien
gccaaagttcaagccgcgtccaggg

SEQ ID NO: 115089 - DNA, 25 bp, Homo sapien
tgtgcttctcctctttgtcactgct

SEQ ID NO: 115090 - DNA, 25 bp, Homo sapien
tacattttgtccatggccttgaggg

SEQ ID NO: 115091 - DNA, 25 bp, Homo sapien
ggttgttgctgaggtacattttgtc

SEQ ID NO: 115092 - DNA, 25 bp, Homo sapien
ttttggcgttgttgtccgtgtggct

SEQ ID NO: 115093 - DNA, 25 bp, Homo sapien
cgggaggagagcctcactttctgtg

SEQ ID NO: 115094 - DNA, 25 bp, Homo sapien
ctcctctttgtcactgcttttggcg

SEQ ID NO: 115095 - DNA, 25 bp, Homo sapien
aggagagcctcactttctgtgcttc

SEQ ID NO: 115096 - DNA, 25 bp, Homo sapien
actgcttttggcgttgttgtccgtg

SEQ ID NO: 115097 - DNA, 25 bp, Homo sapien
cgctcacctggaaagtcaccgctga

SEQ ID NO: 115098 - DNA, 25 bp, Homo sapien
agactcagccaacgacgtcatcgga

SEQ ID NO: 115099 - DNA, 25 bp, Homo sapien
tggacgcaccgggttattcctggca

SEQ ID NO: 115100 - DNA, 25 bp, Homo sapien
tctgacactgtacggagatgggccc

SEQ ID NO: 115101 - DNA, 25 bp, Homo sapien
tgtgccacagtcaccgaagatgttt

SEQ ID NO: 115102 - DNA, 25 bp, Homo sapien
ctccgtggagcgtcaaggtccaaga

SEQ ID NO: 115103 - DNA, 25 bp, Homo sapien
agaccctccaagttgctctgggctc

SEQ ID NO: 115104 - DNA, 25 bp, Homo sapien
gtgtctggtagcatttccttaagga

SEQ ID NO: 115105 - DNA, 25 bp, Homo sapien
ggtccactccttcagtctaggttcc

SEQ ID NO: 115106 - DNA, 25 bp, Homo sapien
gctgcctgtgctcgggtttacaccc

SEQ ID NO: 115107 - DNA, 25 bp, Homo sapien
agaggtcgcatccacacctgggatg

SEQ ID NO: 115108 - DNA, 25 bp, Homo sapien
tgacgaaagagatgacgacacgccg

SEQ ID NO: 115109 - DNA, 25 bp, Homo sapien
ccaggaagcgtcaccgcgattccgg

SEQ ID NO: 115110 - DNA, 25 bp, Homo sapien
tgcgaacgcaggagcagaatgacga

SEQ ID NO: 115111 - DNA, 25 bp, Homo sapien
gccctcgtagcactcagaggtcgca

SEQ ID NO: 115112 - DNA, 25 bp, Homo sapien
gcagtggagagcgtccgcaaaccgc

SEQ ID NO: 115113 - DNA, 25 bp, Homo sapien
atttctgaacggacctgggcttgtc

SEQ ID NO: 115114 - DNA, 25 bp, Homo sapien
tcacgtttgtgatttcgggagagca

SEQ ID NO: 115115 - DNA, 25 bp, Homo sapien
ccggtgacagtctctgcggaaagtc

SEQ ID NO: 115116 - DNA, 25 bp, Homo sapien
aacgtttgctcaaatgccggggtcg

SEQ ID NO: 115117 - DNA, 25 bp, Homo sapien
agctgctttgctgtagtccacgccc

SEQ ID NO: 115118 - DNA, 25 bp, Homo sapien
ggcactcgggagctatttctgaacg

SEQ ID NO: 115119 - DNA, 25 bp, Homo sapien
cagcggcagaaagcgtagctgcttt

SEQ ID NO: 115120 - DNA, 25 bp, Homo sapien
ggggtagtctaatgaaaaggcactc

SEQ ID NO: 115121 - DNA, 25 bp, Homo sapien
acgtcattggggtcacctgcgccct

SEQ ID NO: 115122 - DNA, 25 bp, Homo sapien
cgtgagagggaccagtgcaaaaggc

SEQ ID NO: 115123 - DNA, 25 bp, Homo sapien
ggacagcaatatgcggggcgacttc

SEQ ID NO: 115124 - DNA, 25 bp, Homo sapien
cccgtcctgtgacgtcagtgcctgg

SEQ ID NO: 115125 - DNA, 25 bp, Homo sapien
cagccgctcacgaggtgtccgggca

SEQ ID NO: 115126 - DNA, 25 bp, Homo sapien
aagcagccaggacaccatgcccgag

SEQ ID NO: 115127 - DNA, 25 bp, Homo sapien
gccaggacaccatgcccgaggacgg

SEQ ID NO: 115128 - DNA, 25 bp, Homo sapien
caatgacgtcattggggtcacctgc

SEQ ID NO: 115129 - DNA, 25 bp, Homo sapien
cagacgagacaaaagggagcgcact

SEQ ID NO: 115130 - DNA, 25 bp, Homo sapien
tcttccgtctctgccgctgagtatg

SEQ ID NO: 115131 - DNA, 25 bp, Homo sapien
cagaaccactcgctaccgaagctgg

SEQ ID NO: 115132 - DNA, 25 bp, Homo sapien
cgaagctgggcacggaaaacactcc

SEQ ID NO: 115133 - DNA, 25 bp, Homo sapien
ccgaacttggcctggtcaaaccacg

SEQ ID NO: 115134 - DNA, 25 bp, Homo sapien
cggtcacctgaccaagtcggacttg

SEQ ID NO: 115135 - DNA, 25 bp, Homo sapien
cgacacccggaagtgcgaaacgcgg

SEQ ID NO: 115136 - DNA, 25 bp, Homo sapien
taacgcagtgggaggtgaaaccgac

SEQ ID NO: 115137 - DNA, 25 bp, Homo sapien
ggcttccgaggcttttccatcagaa

SEQ ID NO: 115138 - DNA, 25 bp, Homo sapien
aagaggaacattctcggtcttcggc

SEQ ID NO: 115139 - DNA, 25 bp, Homo sapien
gcagcaccgcagcttggcttccgag

SEQ ID NO: 115140 - DNA, 25 bp, Homo sapien
cgaccctaggcggaagatgctaaaa

SEQ ID NO: 115141 - DNA, 25 bp, Homo sapien
gggtccacatctccggctcaggtaa

SEQ ID NO: 115142 - DNA, 25 bp, Homo sapien
agagcgacctctcgtcgtcctcgag

SEQ ID NO: 115143 - DNA, 25 bp, Homo sapien
ggcggctccttcctgtgcaaacttt

SEQ ID NO: 115144 - DNA, 25 bp, Homo sapien
cggattgctgggtgaacagagcttc

SEQ ID NO: 115145 - DNA, 25 bp, Homo sapien
gcggacccatgatcgaaggaccaaa

SEQ ID NO: 115146 - DNA, 25 bp, Homo sapien
cgcgatgcctcgctgtggtttttta

SEQ ID NO: 115147 - DNA, 25 bp, Homo sapien
tccatttttctgtgcgcgatgcctc

SEQ ID NO: 115148 - DNA, 25 bp, Homo sapien
tgggatccagccgattttaccttaa

SEQ ID NO: 115149 - DNA, 25 bp, Homo sapien
ggtagcgctcgccaaactctttgtc

SEQ ID NO: 115150 - DNA, 25 bp, Homo sapien
aaaggagccgcttgatcgctggacc

SEQ ID NO: 115151 - DNA, 25 bp, Homo sapien
cgccatttgcgtattacagtgtttt

SEQ ID NO: 115152 - DNA, 25 bp, Homo sapien
ccgggacatgaacgcctggaagtct

SEQ ID NO: 115153 - DNA, 25 bp, Homo sapien
cagcgagcctatgtaacttccggtc

SEQ ID NO: 115154 - DNA, 25 bp, Homo sapien
gacccatcagctcctcggcgattgg

SEQ ID NO: 115155 - DNA, 25 bp, Homo sapien
cagaagcggccttcagctggacctt

SEQ ID NO: 115156 - DNA, 25 bp, Homo sapien
ctgcagcatggtgagcaagccttgc

SEQ ID NO: 115157 - DNA, 25 bp, Homo sapien
aagccttgcttgtttcggcggccga

SEQ ID NO: 115158 - DNA, 25 bp, Homo sapien
gccaggctgcttccggtaatacctt

SEQ ID NO: 115159 - DNA, 25 bp, Homo sapien
cgtgtccgcggctttgttttttatg

SEQ ID NO: 115160 - DNA, 25 bp, Homo sapien
ctctgtggcgcctcaacgttaagga

SEQ ID NO: 115161 - DNA, 25 bp, Homo sapien
caaatggcagatgccgtgggctttg

SEQ ID NO: 115162 - DNA, 25 bp, Homo sapien
tcacacatgagaaacgcgacagatg

SEQ ID NO: 115163 - DNA, 25 bp, Homo sapien
agcgccaggttgtaagaatcgggtc

SEQ ID NO: 115164 - DNA, 25 bp, Homo sapien
tcgggtctgtggacctcataccaga

SEQ ID NO: 115165 - DNA, 25 bp, Homo sapien
ctcataccagataggcgcgaacgcc

SEQ ID NO: 115166 - DNA, 25 bp, Homo sapien
gtaccgacgggctgaatgacaaatg

SEQ ID NO: 115167 - DNA, 25 bp, Homo sapien
cgccagagcccaatcacacatgaga

SEQ ID NO: 115168 - DNA, 25 bp, Homo sapien
tctaaatcaaggctcggggcggtac

SEQ ID NO: 115169 - DNA, 25 bp, Homo sapien
cttgggaacttctgcgctatgatta

SEQ ID NO: 115170 - DNA, 25 bp, Homo sapien
caggggagtcctgctctcgaaatta

SEQ ID NO: 115171 - DNA, 25 bp, Homo sapien
gggactttgcctctcttccgcgaga

SEQ ID NO: 115172 - DNA, 25 bp, Homo sapien
cccgcttggaaagttctggagtccg

SEQ ID NO: 115173 - DNA, 25 bp, Homo sapien
tctcccgttggggtggttcagcaat

SEQ ID NO: 115174 - DNA, 25 bp, Homo sapien
taagctggcacttgagattctcccg

SEQ ID NO: 115175 - DNA, 25 bp, Homo sapien
tcagtctctgggagacgggctaagc

SEQ ID NO: 115176 - DNA, 25 bp, Homo sapien
cggtcactttgttcccattaactca

SEQ ID NO: 115177 - DNA, 25 bp, Homo sapien
cgccgctctagcgttttacaggaga

SEQ ID NO: 115178 - DNA, 25 bp, Homo sapien
agcggactcgcgctttgctctcatt

SEQ ID NO: 115179 - DNA, 25 bp, Homo sapien
acgcaggtaacaactcgccgctcta

SEQ ID NO: 115180 - DNA, 25 bp, Homo sapien
cgatgtacttggactgcaggtgctc

SEQ ID NO: 115181 - DNA, 25 bp, Homo sapien
agcacttctgtacgcggaaagcacg

SEQ ID NO: 115182 - DNA, 25 bp, Homo sapien
agccggtcctttggagacaggaata

SEQ ID NO: 115183 - DNA, 25 bp, Homo sapien
ggcggtccacaaggctgaagcatct

SEQ ID NO: 115184 - DNA, 25 bp, Homo sapien
gtaactctcgctcatagggctcaga

SEQ ID NO: 115185 - DNA, 25 bp, Homo sapien
tggctgttccaggactcggcgacag

SEQ ID NO: 115186 - DNA, 25 bp, Homo sapien
gacttacgcagctccaagaaacgtg

SEQ ID NO: 115187 - DNA, 25 bp, Homo sapien
ctgttccaggactcggcgacaggcc

SEQ ID NO: 115188 - DNA, 25 bp, Homo sapien
tgttccaggactcggcgacaggccg

SEQ ID NO: 115189 - DNA, 25 bp, Homo sapien
tgacactcagacttacgcagctcca

SEQ ID NO: 115190 - DNA, 25 bp, Homo sapien
gacactcagacttacgcagctccaa

SEQ ID NO: 115191 - DNA, 25 bp, Homo sapien
ctcagacttacgcagctccaagaaa

SEQ ID NO: 115192 - DNA, 25 bp, Homo sapien
ctggctgttccaggactcggcgaca

SEQ ID NO: 115193 - DNA, 25 bp, Homo sapien
acgtagagtactccaagaaacgtgc

SEQ ID NO: 115194 - DNA, 25 bp, Homo sapien
gacgtagagtactccaagaaacgtg

SEQ ID NO: 115195 - DNA, 25 bp, Homo sapien
aatgacactcagacgtagagtactc

SEQ ID NO: 115196 - DNA, 25 bp, Homo sapien
tgacactcagacgtagagtactcca

SEQ ID NO: 115197 - DNA, 25 bp, Homo sapien
gacactcagacgtagagtactccaa

SEQ ID NO: 115198 - DNA, 25 bp, Homo sapien
cactcagacgtagagtactccaaga

SEQ ID NO: 115199 - DNA, 25 bp, Homo sapien
ctcagacgtagagtactccaagaaa

SEQ ID NO: 115200 - DNA, 25 bp, Homo sapien
cagacgtagagtactccaagaaacg

SEQ ID NO: 115201 - DNA, 25 bp, Homo sapien
gttccacactcgctccgtcccattg

SEQ ID NO: 115202 - DNA, 25 bp, Homo sapien
tgatcaggttccacactcgctccgt

SEQ ID NO: 115203 - DNA, 25 bp, Homo sapien
gtcactgttgtagcgcgcgtactcc

SEQ ID NO: 115204 - DNA, 25 bp, Homo sapien
aggtcactgttgtagcgcgcgtact

SEQ ID NO: 115205 - DNA, 25 bp, Homo sapien
cccaggtcactgttgtagcgcgcgt

SEQ ID NO: 115206 - DNA, 25 bp, Homo sapien
cgacgccaccaacccggactccctg

SEQ ID NO: 115207 - DNA, 25 bp, Homo sapien
acagcgacgccaccaacccggactc

SEQ ID NO: 115208 - DNA, 25 bp, Homo sapien
ctggtactcccccaggtcactgttg

SEQ ID NO: 115209 - DNA, 25 bp, Homo sapien
cttcttcagcgccaacgagggcctg

SEQ ID NO: 115210 - DNA, 25 bp, Homo sapien
ccaagtgcttcagcttcggcagcgc

SEQ ID NO: 115211 - DNA, 25 bp, Homo sapien
agtttgactactcggcgcacggcgt

SEQ ID NO: 115212 - DNA, 25 bp, Homo sapien
tggagaagctctttggcgccagctc

SEQ ID NO: 115213 - DNA, 25 bp, Homo sapien
cagctatcactacgtgcggcgcaca

SEQ ID NO: 115214 - DNA, 25 bp, Homo sapien
atggctacctgtacatcccgctggc

SEQ ID NO: 115215 - DNA, 25 bp, Homo sapien
tgaaggacgtagacttccgcgagtc

SEQ ID NO: 115216 - DNA, 25 bp, Homo sapien
cggctcacgtgcactaccaggtgga

SEQ ID NO: 115217 - DNA, 25 bp, Homo sapien
ttatagaagtatctttacaggtacc

SEQ ID NO: 115218 - DNA, 25 bp, Homo sapien
caacctcgactacgcgcagcccagg

SEQ ID NO: 115219 - DNA, 25 bp, Homo sapien
tctttacaggtaccgctccgtccca

SEQ ID NO: 115220 - DNA, 25 bp, Homo sapien
tatctttacaggtaccgctccgtcc

SEQ ID NO: 115221 - DNA, 25 bp, Homo sapien
gtatctttacaggtaccgctccgtc

SEQ ID NO: 115222 - DNA, 25 bp, Homo sapien
aagtatctttacaggtaccgctccg

SEQ ID NO: 115223 - DNA, 25 bp, Homo sapien
atagaagtatctttacaggtaccgc

SEQ ID NO: 115224 - DNA, 25 bp, Homo sapien
agaagtatctttacaggtaccgctc

SEQ ID NO: 115225 - DNA, 25 bp, Homo sapien
cactcatgtttaacctgctccaaga

SEQ ID NO: 115226 - DNA, 25 bp, Homo sapien
ttaccctttccttaaacagcacgca

SEQ ID NO: 115227 - DNA, 25 bp, Homo sapien
gacactcatgtttaacctgctccaa

SEQ ID NO: 115228 - DNA, 25 bp, Homo sapien
tgacactcatgtttaacctgctcca

SEQ ID NO: 115229 - DNA, 25 bp, Homo sapien
atgacactcatgtttaacctgctcc

SEQ ID NO: 115230 - DNA, 25 bp, Homo sapien
aatgacactcatgtttaacctgctc

SEQ ID NO: 115231 - DNA, 25 bp, Homo sapien
agaaatgacactcatgtttaacctg

SEQ ID NO: 115232 - DNA, 25 bp, Homo sapien
ccctttccttaaacagcacgcaccg

SEQ ID NO: 115233 - DNA, 25 bp, Homo sapien
gaaagaccgtgtgtggaaagaagcc

SEQ ID NO: 115234 - DNA, 25 bp, Homo sapien
gcgcaggagggctgcaaagccgagt

SEQ ID NO: 115235 - DNA, 25 bp, Homo sapien
gcggtcccaagcacaggcgaccgag

SEQ ID NO: 115236 - DNA, 25 bp, Homo sapien
catgaaggctgagaaaggccgagtg

SEQ ID NO: 115237 - DNA, 25 bp, Homo sapien
ccagagtgctctgtgcaatgcggtc

SEQ ID NO: 115238 - DNA, 25 bp, Homo sapien
tgctctgtgcaatgcggtcccaagc

SEQ ID NO: 115239 - DNA, 25 bp, Homo sapien
aatgcggtcccaagcacaggcgacc

SEQ ID NO: 115240 - DNA, 25 bp, Homo sapien
tgtgtggaaagaagccagagtgctc

SEQ ID NO: 115241 - DNA, 25 bp, Homo sapien
cacggacccggtgaaggctgagaaa

SEQ ID NO: 115242 - DNA, 25 bp, Homo sapien
aaatgtgtcccagcgtctcgacgtc

SEQ ID NO: 115243 - DNA, 25 bp, Homo sapien
tctcgacgtcatggtcacacggacc

SEQ ID NO: 115244 - DNA, 25 bp, Homo sapien
acggacccggtgaaggctgagaaat

SEQ ID NO: 115245 - DNA, 25 bp, Homo sapien
ctgagaaatgtgtcccagcgtctcg

SEQ ID NO: 115246 - DNA, 25 bp, Homo sapien
gctgagaaatgtgtcccagcgtctc

SEQ ID NO: 115247 - DNA, 25 bp, Homo sapien
agcgtctcgacgtcatggtcacacg

SEQ ID NO: 115248 - DNA, 25 bp, Homo sapien
tagcagtgtctcgacatcatggtca

SEQ ID NO: 115249 - DNA, 25 bp, Homo sapien
cacacggactacacggactcggtta

SEQ ID NO: 115250 - DNA, 25 bp, Homo sapien
tgtgtcgcagcgtctcaatgacatg

SEQ ID NO: 115251 - DNA, 25 bp, Homo sapien
gcgtagcagtgtctcgacatcatgg

SEQ ID NO: 115252 - DNA, 25 bp, Homo sapien
cgtcacggtcacacggacccggtga

SEQ ID NO: 115253 - DNA, 25 bp, Homo sapien
taagaaatgtgtcccagcgtctcga

SEQ ID NO: 115254 - DNA, 25 bp, Homo sapien
ctcaatgacatggtcacacggagtc

SEQ ID NO: 115255 - DNA, 25 bp, Homo sapien
gtgtcacagcatctcgacatcatgg

SEQ ID NO: 115256 - DNA, 25 bp, Homo sapien
agtgtcttgacgtcatggtcacaca

SEQ ID NO: 115257 - DNA, 25 bp, Homo sapien
gcagcagcacctagtggagcggccc

SEQ ID NO: 115258 - DNA, 25 bp, Homo sapien
acagatccatcaccacccatttgga

SEQ ID NO: 115259 - DNA, 25 bp, Homo sapien
tgggacccaccaccgccagtccaga

SEQ ID NO: 115260 - DNA, 25 bp, Homo sapien
aacctagcaccgctggtcgggaagg

SEQ ID NO: 115261 - DNA, 25 bp, Homo sapien
cccatttagatccagcagcgcgcgt

SEQ ID NO: 115262 - DNA, 25 bp, Homo sapien
cagcagcgcccatttagacctagca

SEQ ID NO: 115263 - DNA, 25 bp, Homo sapien
agacggaaccctagcaccgcgcggg

SEQ ID NO: 115264 - DNA, 25 bp, Homo sapien
agcactgcccatttagatccagcag

SEQ ID NO: 115265 - DNA, 25 bp, Homo sapien
ggacctggcagaacgatgctgcttc

SEQ ID NO: 115266 - DNA, 25 bp, Homo sapien
agaatgcctcttcgccggcacagca

SEQ ID NO: 115267 - DNA, 25 bp, Homo sapien
ttggaaccagcagtgtggcacctca

SEQ ID NO: 115268 - DNA, 25 bp, Homo sapien
ggccgcttcctatgacggttgtttg

SEQ ID NO: 115269 - DNA, 25 bp, Homo sapien
cctctgagctgcgacagcctggttg

SEQ ID NO: 115270 - DNA, 25 bp, Homo sapien
gctgcgttgcctgactcgacacaga

SEQ ID NO: 115271 - DNA, 25 bp, Homo sapien
ccagatgcatggcttggcccagatg

SEQ ID NO: 115272 - DNA, 25 bp, Homo sapien
gtagggcatcacacatccaaggaca

SEQ ID NO: 115273 - DNA, 25 bp, Homo sapien
cgctgtgtgccgctgatgtttatca

SEQ ID NO: 115274 - DNA, 25 bp, Homo sapien
ttcgcggacgacaacatcatcgagg

SEQ ID NO: 115275 - DNA, 25 bp, Homo sapien
cagcggtcatgggttttttcctcta

SEQ ID NO: 115276 - DNA, 25 bp, Homo sapien
ttcttcaagacctgcgtggccaccg

SEQ ID NO: 115277 - DNA, 25 bp, Homo sapien
ggtgagccgtaccttctccaagttc

SEQ ID NO: 115278 - DNA, 25 bp, Homo sapien
cgccttcgtgctcaacctggtacag

SEQ ID NO: 115279 - DNA, 25 bp, Homo sapien
tgcgtcatgcccttcgacaagctgg

SEQ ID NO: 115280 - DNA, 25 bp, Homo sapien
ggtcacggccctgcaaaaccatgtg

SEQ ID NO: 115281 - DNA, 25 bp, Homo sapien
ggtttgaggccttcacccgtgatct

SEQ ID NO: 115282 - DNA, 25 bp, Homo sapien
ctgggtcacgtggttgaacttgttc

SEQ ID NO: 115283 - DNA, 25 bp, Homo sapien
cccaggtgttcttgggcgtcttgac

SEQ ID NO: 115284 - DNA, 25 bp, Homo sapien
ttggcatccagcaccacagcggcga

SEQ ID NO: 115285 - DNA, 25 bp, Homo sapien
gccgttttcctccatgcgctcgatg

SEQ ID NO: 115286 - DNA, 25 bp, Homo sapien
gatgtccttcagtggcttgccgaaa

SEQ ID NO: 115287 - DNA, 25 bp, Homo sapien
ttctcggaagacagatagacgttgc

SEQ ID NO: 115288 - DNA, 25 bp, Homo sapien
ttctggaagtcgaagccgccgatca

SEQ ID NO: 115289 - DNA, 25 bp, Homo sapien
agggtcgcgccatgtgacagatatc

SEQ ID NO: 115290 - DNA, 25 bp, Homo sapien
tcagcctgtccatccttgtttagga

SEQ ID NO: 115291 - DNA, 25 bp, Homo sapien
accggatgtgacacctccattcttg

SEQ ID NO: 115292 - DNA, 25 bp, Homo sapien
gcgctccagccgcaaggcatattag

SEQ ID NO: 115293 - DNA, 25 bp, Homo sapien
ttgagccatgccgtgaccgaaatcg

SEQ ID NO: 115294 - DNA, 25 bp, Homo sapien
tggccaatacgctgcagtccatttg

SEQ ID NO: 115295 - DNA, 25 bp, Homo sapien
cgctgattcaggctttcttgtgaca

SEQ ID NO: 115296 - DNA, 25 bp, Homo sapien
aagacgcctttgtatgcgccatagg

SEQ ID NO: 115297 - DNA, 25 bp, Homo sapien
cgcagatcttcttttcggttaccga

SEQ ID NO: 115298 - DNA, 25 bp, Homo sapien
gggcaacgtcgtgcagccagtcata

SEQ ID NO: 115299 - DNA, 25 bp, Homo sapien
cgcagattgaaatgcacgccgtaca

SEQ ID NO: 115300 - DNA, 25 bp, Homo sapien
ctgatggcacagcaccgcagattga

SEQ ID NO: 115301 - DNA, 25 bp, Homo sapien
aacatttttgctgccctgatggcac

SEQ ID NO: 115302 - DNA, 25 bp, Homo sapien
acctgatggttggaaacatttttgc

SEQ ID NO: 115303 - DNA, 25 bp, Homo sapien
ttacgtcgtccgactacggctgcga

SEQ ID NO: 115304 - DNA, 25 bp, Homo sapien
tgccataaactactgcaacctgatg

SEQ ID NO: 115305 - DNA, 25 bp, Homo sapien
tgcgccgtcaacttcgtcaggttca

SEQ ID NO: 115306 - DNA, 25 bp, Homo sapien
gcctcttgaagcgatgcgtcatctc

SEQ ID NO: 115307 - DNA, 25 bp, Homo sapien
cggatgatcgtcaccgcaaacttca

SEQ ID NO: 115308 - DNA, 25 bp, Homo sapien
accacccgactaggttgctctctta

SEQ ID NO: 115309 - DNA, 25 bp, Homo sapien
agcgaattcatgtccgcctcgatga

SEQ ID NO: 115310 - DNA, 25 bp, Homo sapien
ggcatccagggctttgatctccgta

SEQ ID NO: 115311 - DNA, 25 bp, Homo sapien
tagggtgccgcttcattcactactc

SEQ ID NO: 115312 - DNA, 25 bp, Homo sapien
gcgtgccacagatgctcaacgaatg

SEQ ID NO: 115313 - DNA, 25 bp, Homo sapien
gaggggcccaggcacccgcatttaa

SEQ ID NO: 115314 - DNA, 25 bp, Homo sapien
aagtgggctcgcacaccgacggcct

SEQ ID NO: 115315 - DNA, 25 bp, Homo sapien
gtttggccgccttcaacagcacctg

SEQ ID NO: 115316 - DNA, 25 bp, Homo sapien
gaccgtgcatctagcgcgccctggt

SEQ ID NO: 115317 - DNA, 25 bp, Homo sapien
agggacccgacagctctgccgcgga

SEQ ID NO: 115318 - DNA, 25 bp, Homo sapien
agaggagaccggtgccagacttcac

SEQ ID NO: 115319 - DNA, 25 bp, Homo sapien
aagtcgcagctggtcccaagcagtg

SEQ ID NO: 115320 - DNA, 25 bp, Homo sapien
agggagtaagacaccgccttcctgg

SEQ ID NO: 115321 - DNA, 25 bp, Homo sapien
ggggctctcttctgttctgcagcga

SEQ ID NO: 115322 - DNA, 25 bp, Homo sapien
gggcgcagttcttccacttttgtga

SEQ ID NO: 115323 - DNA, 25 bp, Homo sapien
ctggagggcggagtttacatcatcc

SEQ ID NO: 115324 - DNA, 25 bp, Homo sapien
cgccgcgtgaagagaatgtgtaaac

SEQ ID NO: 115325 - DNA, 25 bp, Homo sapien
ctcggggcgaagttcatacctccta

SEQ ID NO: 115326 - DNA, 25 bp, Homo sapien
tcctagaagccgagactaatagttc

SEQ ID NO: 115327 - DNA, 25 bp, Homo sapien
cgggcacaatcgctgctggaatctt

SEQ ID NO: 115328 - DNA, 25 bp, Homo sapien
gtgaaccgctacctccgctcgatgt

SEQ ID NO: 115329 - DNA, 25 bp, Homo sapien
cgcgtttccgggagcctccagtggc

SEQ ID NO: 115330 - DNA, 25 bp, Homo sapien
gacgcggacccagctcctctaggag

SEQ ID NO: 115331 - DNA, 25 bp, Homo sapien
ctctgctgggcgaagcgagcaccac

SEQ ID NO: 115332 - DNA, 25 bp, Homo sapien
cgaggagctagacgcggacccagct

SEQ ID NO: 115333 - DNA, 25 bp, Homo sapien
gacatctgtccagcgtgggccgtgc

SEQ ID NO: 115334 - DNA, 25 bp, Homo sapien
tccaggggaccagacagaaaacaaa

SEQ ID NO: 115335 - DNA, 25 bp, Homo sapien
gcagccacgccttcaggacgcgtgg

SEQ ID NO: 115336 - DNA, 25 bp, Homo sapien
actgaactctcctgggagcacgcgc

SEQ ID NO: 115337 - DNA, 25 bp, Homo sapien
gcgcccgctgtctccatgtttaggt

SEQ ID NO: 115338 - DNA, 25 bp, Homo sapien
gcctcctcctgtgcaatctgaagaa

SEQ ID NO: 115339 - DNA, 25 bp, Homo sapien
ccaaggccgtctcttagggaggatc

SEQ ID NO: 115340 - DNA, 25 bp, Homo sapien
agggtcgcagattgcgccaagattc

SEQ ID NO: 115341 - DNA, 25 bp, Homo sapien
gtgtccaacgatttggccagcgcta

SEQ ID NO: 115342 - DNA, 25 bp, Homo sapien
cgcaagcctaggtcttctgtctgta

SEQ ID NO: 115343 - DNA, 25 bp, Homo sapien
tctaggtaacttcccaacagtgttg

SEQ ID NO: 115344 - DNA, 25 bp, Homo sapien
ggggagactccacccagtaagcgac

SEQ ID NO: 115345 - DNA, 25 bp, Homo sapien
gactaggctgccaggcgcagcgaca

SEQ ID NO: 115346 - DNA, 25 bp, Homo sapien
tgcgcgggataaacccggaagaagc

SEQ ID NO: 115347 - DNA, 25 bp, Homo sapien
gccgggctgagccttgcaaacaagt

SEQ ID NO: 115348 - DNA, 25 bp, Homo sapien
ggctctcgccgagaggctcctgaca

SEQ ID NO: 115349 - DNA, 25 bp, Homo sapien
agtcgccagcgctctctcctgggag

SEQ ID NO: 115350 - DNA, 25 bp, Homo sapien
cgcagaagtggctcccgaggaagcc

SEQ ID NO: 115351 - DNA, 25 bp, Homo sapien
ggctcctgacagaaaaacgtgcgtg

SEQ ID NO: 115352 - DNA, 25 bp, Homo sapien
ccgcgagacggactgaagtcggcca

SEQ ID NO: 115353 - DNA, 25 bp, Homo sapien
tgcctgctgccctggagcttacact

SEQ ID NO: 115354 - DNA, 25 bp, Homo sapien
agcttacactccaggcggacgggtc

SEQ ID NO: 115355 - DNA, 25 bp, Homo sapien
gtgggtttgcgcctctccaaccctg

SEQ ID NO: 115356 - DNA, 25 bp, Homo sapien
gcctttgtgataactgcgtaggtga

SEQ ID NO: 115357 - DNA, 25 bp, Homo sapien
tgtttcacctgcaagattttccggc

SEQ ID NO: 115358 - DNA, 25 bp, Homo sapien
tggccagaccgtgaaacttaaatac

SEQ ID NO: 115359 - DNA, 25 bp, Homo sapien
ctctgaaggtgtgcgctctttctct

SEQ ID NO: 115360 - DNA, 25 bp, Homo sapien
cagatatcgcaaacggcaccagttc

SEQ ID NO: 115361 - DNA, 25 bp, Homo sapien
cgcgcgtcaagaactggctagtcca

SEQ ID NO: 115362 - DNA, 25 bp, Homo sapien
cgatcgaattccacttgctaggcta

SEQ ID NO: 115363 - DNA, 25 bp, Homo sapien
catcgcaggcttcctctttgggaga

SEQ ID NO: 115364 - DNA, 25 bp, Homo sapien
ccaatctgatcgtccatggcggcta

SEQ ID NO: 115365 - DNA, 25 bp, Homo sapien
accagcggcattttctgacgggcca

SEQ ID NO: 115366 - DNA, 25 bp, Homo sapien
gccacccaatggctggacttcttca

SEQ ID NO: 115367 - DNA, 25 bp, Homo sapien
aggcatattcctcagcactggcaga

SEQ ID NO: 115368 - DNA, 25 bp, Homo sapien
tcccgctgctacgtggaatcgcaag

SEQ ID NO: 115369 - DNA, 25 bp, Homo sapien
taccgcaagggttgatctggacatc

SEQ ID NO: 115370 - DNA, 25 bp, Homo sapien
gatgcgcctgaatcactaaacggta

SEQ ID NO: 115371 - DNA, 25 bp, Homo sapien
caggcctcttctggaacagtgcatg

SEQ ID NO: 115372 - DNA, 25 bp, Homo sapien
ttcagccaaggaatgccatgcacga

SEQ ID NO: 115373 - DNA, 25 bp, Homo sapien
tgggcacgggccatcagcaaatacc

SEQ ID NO: 115374 - DNA, 25 bp, Homo sapien
tacctgcccaactgcgtggaaatcg

SEQ ID NO: 115375 - DNA, 25 bp, Homo sapien
acgcccgcctgttcactgagcgatg

SEQ ID NO: 115376 - DNA, 25 bp, Homo sapien
atcgcctgctacaaggccgggctca

SEQ ID NO: 115377 - DNA, 25 bp, Homo sapien
gatgcttgtgcatacccgttcgggc

SEQ ID NO: 115378 - DNA, 25 bp, Homo sapien
ggtgcttgtcgtcagcctgtatctg

SEQ ID NO: 115379 - DNA, 25 bp, Homo sapien
gccggacgcttcgttgattctatga

SEQ ID NO: 115380 - DNA, 25 bp, Homo sapien
acgtccgggacgcttttgatctgtc

SEQ ID NO: 115381 - DNA, 25 bp, Homo sapien
cgtcgttcgccataagcggctactg

SEQ ID NO: 115382 - DNA, 25 bp, Homo sapien
ttgcgcaggttcatcgatgccaacg

SEQ ID NO: 115383 - DNA, 25 bp, Homo sapien
cgttcatgtcgaccggcatcttctt

SEQ ID NO: 115384 - DNA, 25 bp, Homo sapien
atctgtcggacggttcattcggaac

SEQ ID NO: 115385 - DNA, 25 bp, Homo sapien
acaatcgaacatgtgccgcctggca

SEQ ID NO: 115386 - DNA, 25 bp, Homo sapien
agcaggtactgctgatcacccagga

SEQ ID NO: 115387 - DNA, 25 bp, Homo sapien
tccattcttacaggtggcgctgatc

SEQ ID NO: 115388 - DNA, 25 bp, Homo sapien
tgcttcggcagtccaacccagatgg

SEQ ID NO: 115389 - DNA, 25 bp, Homo sapien
atcggtgagtgccatccatgcttcg

SEQ ID NO: 115390 - DNA, 25 bp, Homo sapien
gaaggcctcgtcttcggcgactaca

SEQ ID NO: 115391 - DNA, 25 bp, Homo sapien
ccgccctatgtgaatgccgacagca

SEQ ID NO: 115392 - DNA, 25 bp, Homo sapien
gccgcaacgcgtacgaagtccattt

SEQ ID NO: 115393 - DNA, 25 bp, Homo sapien
aaggcgtctccaaccctccagacgg

SEQ ID NO: 115394 - DNA, 25 bp, Homo sapien
cacggcggctcatccacatatgctg

SEQ ID NO: 115395 - DNA, 25 bp, Homo sapien
tccagacggcggctactccacacac

SEQ ID NO: 115396 - DNA, 25 bp, Homo sapien
acacacggcggctcatccacatatg

SEQ ID NO: 115397 - DNA, 25 bp, Homo sapien
gcggctcatccacatatgctggctc

SEQ ID NO: 115398 - DNA, 25 bp, Homo sapien
ggcggctcatccacatatgctggct

SEQ ID NO: 115399 - DNA, 25 bp, Homo sapien
agacggcggctactccacacacggc

SEQ ID NO: 115400 - DNA, 25 bp, Homo sapien
cgcaaggcgtctccaaccctccaga

SEQ ID NO: 115401 - DNA, 25 bp, Homo sapien
gcatttacccggcgcattctaaccg

SEQ ID NO: 115402 - DNA, 25 bp, Homo sapien
cggcgcattctaaccgcctttgagg

SEQ ID NO: 115403 - DNA, 25 bp, Homo sapien
ggcgcattctaaccgcctttgaggt

SEQ ID NO: 115404 - DNA, 25 bp, Homo sapien
cagctcctccgttcccgtcatagcc

SEQ ID NO: 115405 - DNA, 25 bp, Homo sapien
tcatagcctcacacgggcttcgctg

SEQ ID NO: 115406 - DNA, 25 bp, Homo sapien
catagcctcacacgggcttcgctgg

SEQ ID NO: 115407 - DNA, 25 bp, Homo sapien
tcgctggacacgtccaggacgcagc

SEQ ID NO: 115408 - DNA, 25 bp, Homo sapien
cttcgctggacacgtccaggacgca

SEQ ID NO: 115409 - DNA, 25 bp, Homo sapien
gccagccgcagagaacacgcacaag

SEQ ID NO: 115410 - DNA, 25 bp, Homo sapien
agttcaggagctctgcgcgtctcag

SEQ ID NO: 115411 - DNA, 25 bp, Homo sapien
tctgcgcgtctcaggcagccaggac

SEQ ID NO: 115412 - DNA, 25 bp, Homo sapien
tcgagagaggctgcgatggtcccac

SEQ ID NO: 115413 - DNA, 25 bp, Homo sapien
cgtgcatttccttaaagaacggagg

SEQ ID NO: 115414 - DNA, 25 bp, Homo sapien
ggctggagcagcaccacgtgcattt

SEQ ID NO: 115415 - DNA, 25 bp, Homo sapien
ctcagggttggttagttcaggagct

SEQ ID NO: 115416 - DNA, 25 bp, Homo sapien
acgcacaagcctgacggctggagca

SEQ ID NO: 115417 - DNA, 25 bp, Homo sapien
cactgctgctcgcacggagcctggg

SEQ ID NO: 115418 - DNA, 25 bp, Homo sapien
cagcggcaggacacgtgaccatcca

SEQ ID NO: 115419 - DNA, 25 bp, Homo sapien
agccctcagtgcagcggcaggacac

SEQ ID NO: 115420 - DNA, 25 bp, Homo sapien
ctgtagccttgtggcccaccgggct

SEQ ID NO: 115421 - DNA, 25 bp, Homo sapien
ccaggcgacagtggcagctgtagcc

SEQ ID NO: 115422 - DNA, 25 bp, Homo sapien
tgccagccggaagccctcagtgcag

SEQ ID NO: 115423 - DNA, 25 bp, Homo sapien
tgcggatcatcctccgctggccgga

SEQ ID NO: 115424 - DNA, 25 bp, Homo sapien
acagtggcagctgtagccttgtggc

SEQ ID NO: 115425 - DNA, 25 bp, Homo sapien
cgagttccacggaggcctgactgcc

SEQ ID NO: 115426 - DNA, 25 bp, Homo sapien
actgcccagaccagaggcgcaggga

SEQ ID NO: 115427 - DNA, 25 bp, Homo sapien
gctgggtttctctcaccgttctcca

SEQ ID NO: 115428 - DNA, 25 bp, Homo sapien
cgcgtggaaccagctgggtttctct

SEQ ID NO: 115429 - DNA, 25 bp, Homo sapien
acggaggcctgactgccgtctggcc

SEQ ID NO: 115430 - DNA, 25 bp, Homo sapien
gttccgcgaccactcctcccgctgt

SEQ ID NO: 115431 - DNA, 25 bp, Homo sapien
aggggtcagcggttccgcgaccact

SEQ ID NO: 115432 - DNA, 25 bp, Homo sapien
gatgcacgccgcgtggaaccagctg

SEQ ID NO: 115433 - DNA, 25 bp, Homo sapien
cattcctgttcatgcgtggtcgtcg

SEQ ID NO: 115434 - DNA, 25 bp, Homo sapien
ccggcctagcttctgtttgatcatt

SEQ ID NO: 115435 - DNA, 25 bp, Homo sapien
cgccgtttctttctgctaccgctaa

SEQ ID NO: 115436 - DNA, 25 bp, Homo sapien
agtggcagtttcttcagtacggtcc

SEQ ID NO: 115437 - DNA, 25 bp, Homo sapien
agctttgctttcagtcggcgtgcac

SEQ ID NO: 115438 - DNA, 25 bp, Homo sapien
ggccgcttaggtgcacttctcaatg

SEQ ID NO: 115439 - DNA, 25 bp, Homo sapien
ccgagtgtcacaatcgttgttacca

SEQ ID NO: 115440 - DNA, 25 bp, Homo sapien
aggtgcattccgctctagaacattc

SEQ ID NO: 115441 - DNA, 25 bp, Homo sapien
gctaagcctggagagactgacttcg

SEQ ID NO: 115442 - DNA, 25 bp, Homo sapien
agctaagcctggagagactgacttc

SEQ ID NO: 115443 - DNA, 25 bp, Homo sapien
ctaagcctggagagactgacttcgg

SEQ ID NO: 115444 - DNA, 25 bp, Homo sapien
taagcctggagagactgacttcggg

SEQ ID NO: 115445 - DNA, 25 bp, Homo sapien
agcctggagagactgacttcgggac

SEQ ID NO: 115446 - DNA, 25 bp, Homo sapien
tggagctaagcctggagagactgac

SEQ ID NO: 115447 - DNA, 25 bp, Homo sapien
gagctaagcctggagagactgactt

SEQ ID NO: 115448 - DNA, 25 bp, Homo sapien
ctggagctaagcctggagagactga

SEQ ID NO: 115449 - DNA, 25 bp, Homo sapien
atgctcaggtgctcgcggtcgagct

SEQ ID NO: 115450 - DNA, 25 bp, Homo sapien
tgtccctgtagggatgacggcgcct

SEQ ID NO: 115451 - DNA, 25 bp, Homo sapien
tcggggaccatgaagccacagcttc

SEQ ID NO: 115452 - DNA, 25 bp, Homo sapien
ctgagccgggacagaaagctttttc

SEQ ID NO: 115453 - DNA, 25 bp, Homo sapien
cccaggtgttcctagagagccagcg

SEQ ID NO: 115454 - DNA, 25 bp, Homo sapien
ttcctagagagccagcggcgtctcc

SEQ ID NO: 115455 - DNA, 25 bp, Homo sapien
tgggccctctcaggtgtccctgtag

SEQ ID NO: 115456 - DNA, 25 bp, Homo sapien
agccgcaggccgtctgtgccggaac

SEQ ID NO: 115457 - DNA, 25 bp, Homo sapien
acactggatgtgctcctgatctgcc

SEQ ID NO: 115458 - DNA, 25 bp, Homo sapien
ctggctcaagttccacattggtatc

SEQ ID NO: 115459 - DNA, 25 bp, Homo sapien
gtggactcctatcccaactggctca

SEQ ID NO: 115460 - DNA, 25 bp, Homo sapien
gtgctgaaggtgcagaattcctctc

SEQ ID NO: 115461 - DNA, 25 bp, Homo sapien
tccatgctgatgttcgtcctcgctg

SEQ ID NO: 115462 - DNA, 25 bp, Homo sapien
cgttgctcattacggcagcgtcacc

SEQ ID NO: 115463 - DNA, 25 bp, Homo sapien
cacgggcctgttctttccatgctga

SEQ ID NO: 115464 - DNA, 25 bp, Homo sapien
accggtacgagctgtactccagaca

SEQ ID NO: 115465 - DNA, 25 bp, Homo sapien
ttcaatatttaagacccggccagcc

SEQ ID NO: 115466 - DNA, 25 bp, Homo sapien
ctcctggtgagctctgtttgttttc

SEQ ID NO: 115467 - DNA, 25 bp, Homo sapien
cttcctctgacaaaccgtgcgattc

SEQ ID NO: 115468 - DNA, 25 bp, Homo sapien
accgtgcgattctgatggaaaattc

SEQ ID NO: 115469 - DNA, 25 bp, Homo sapien
tggaaaattcattagtcggctggtc

SEQ ID NO: 115470 - DNA, 25 bp, Homo sapien
attagtcggctggtctctttccctc

SEQ ID NO: 115471 - DNA, 25 bp, Homo sapien
gagctctgtttgttttcataaccaa

SEQ ID NO: 115472 - DNA, 25 bp, Homo sapien
catccacactcctggtgagctctgt

SEQ ID NO: 115473 - DNA, 25 bp, Homo sapien
tccgagggacccaggctttgggatc

SEQ ID NO: 115474 - DNA, 25 bp, Homo sapien
gcgaagtggactcgtggtttttctc

SEQ ID NO: 115475 - DNA, 25 bp, Homo sapien
ccctactgcgttcgtggccgtgctt

SEQ ID NO: 115476 - DNA, 25 bp, Homo sapien
tgcagtcaaggacctggttgccatg

SEQ ID NO: 115477 - DNA, 25 bp, Homo sapien
tcggaaaagggagcgccctactgcg

SEQ ID NO: 115478 - DNA, 25 bp, Homo sapien
tcccattctctttccggaatccagg

SEQ ID NO: 115479 - DNA, 25 bp, Homo sapien
cgttaccatgacgaccgggctccta

SEQ ID NO: 115480 - DNA, 25 bp, Homo sapien
ggaatccaggccttccgtcttcctg

SEQ ID NO: 115481 - DNA, 25 bp, Homo sapien
ctgagggctttcatgaccaagaggc

SEQ ID NO: 115482 - DNA, 25 bp, Homo sapien
ccacgccttggtacgccttggacag

SEQ ID NO: 115483 - DNA, 25 bp, Homo sapien
ccaatgcctcgcctaggtgtgtttt

SEQ ID NO: 115484 - DNA, 25 bp, Homo sapien
gggctctccagattcactcgggtca

SEQ ID NO: 115485 - DNA, 25 bp, Homo sapien
tcgggcccattctccggagtctgag

SEQ ID NO: 115486 - DNA, 25 bp, Homo sapien
tggaaaagctctccctcgtcctgcg

SEQ ID NO: 115487 - DNA, 25 bp, Homo sapien
ctaacccgttgatcagcagaaggca

SEQ ID NO: 115488 - DNA, 25 bp, Homo sapien
cggctaccggctctttatgctcaga

SEQ ID NO: 115489 - DNA, 25 bp, Homo sapien
ctgcttggtgattaggcggtatttc

SEQ ID NO: 115490 - DNA, 25 bp, Homo sapien
tgtctcttgaccagctgcgagcaga

SEQ ID NO: 115491 - DNA, 25 bp, Homo sapien
gccctgaacagaggcaggatcctag

SEQ ID NO: 115492 - DNA, 25 bp, Homo sapien
gaaagccagggaggccgatcagtca

SEQ ID NO: 115493 - DNA, 25 bp, Homo sapien
tttcaagggtaccagacagggacca

SEQ ID NO: 115494 - DNA, 25 bp, Homo sapien
tcggaccaaaaggatgccctgcggg

SEQ ID NO: 115495 - DNA, 25 bp, Homo sapien
gcggacgcgttgaatcggaccaaaa

SEQ ID NO: 115496 - DNA, 25 bp, Homo sapien
cgccactcggtaaagcccagagaga

SEQ ID NO: 115497 - DNA, 25 bp, Homo sapien
gctcaccacgcctccgttgcgcttg

SEQ ID NO: 115498 - DNA, 25 bp, Homo sapien
aagtccaatggctcggcctcagcct

SEQ ID NO: 115499 - DNA, 25 bp, Homo sapien
cacgaagtccaatggctcggcctca

SEQ ID NO: 115500 - DNA, 25 bp, Homo sapien
tccgtggccaccacgaagtccaatg

SEQ ID NO: 115501 - DNA, 25 bp, Homo sapien
agatggccagcacttcctcaaactc

SEQ ID NO: 115502 - DNA, 25 bp, Homo sapien
ccgagatggccagcacttcctcaaa

SEQ ID NO: 115503 - DNA, 25 bp, Homo sapien
ctaggaaggtagtccaggccgccgt

SEQ ID NO: 115504 - DNA, 25 bp, Homo sapien
gaaggtagtccaggccgccgtagat

SEQ ID NO: 115505 - DNA, 25 bp, Homo sapien
ctcaggcttgctcgccccagcgcac

SEQ ID NO: 115506 - DNA, 25 bp, Homo sapien
agcgcgcctagctctcaggcttgct

SEQ ID NO: 115507 - DNA, 25 bp, Homo sapien
catcccttgtctgcgcactcaggcc

SEQ ID NO: 115508 - DNA, 25 bp, Homo sapien
gccacatcccttgtctgcgcactca

SEQ ID NO: 115509 - DNA, 25 bp, Homo sapien
cgccggccacatcccttgtctgcgc

SEQ ID NO: 115510 - DNA, 25 bp, Homo sapien
tggccaccactctgccacacgagcc

SEQ ID NO: 115511 - DNA, 25 bp, Homo sapien
cacggggaccgcgtgcccctcactg

SEQ ID NO: 115512 - DNA, 25 bp, Homo sapien
cactctgccacacgagccgcgcgct

SEQ ID NO: 115513 - DNA, 25 bp, Homo sapien
cgactctaacgtcggtcagcgctgg

SEQ ID NO: 115514 - DNA, 25 bp, Homo sapien
agccagggccgagatgccgcaaagc

SEQ ID NO: 115515 - DNA, 25 bp, Homo sapien
tgtcggagcccgactctaacgtcgg

SEQ ID NO: 115516 - DNA, 25 bp, Homo sapien
atccggagcggactcgtgccctgct

SEQ ID NO: 115517 - DNA, 25 bp, Homo sapien
cccaagagtcaaaggaggatgacgc

SEQ ID NO: 115518 - DNA, 25 bp, Homo sapien
cggtgccaagagagaggtccctttg

SEQ ID NO: 115519 - DNA, 25 bp, Homo sapien
cccggtgccaagagagaggtccctt

SEQ ID NO: 115520 - DNA, 25 bp, Homo sapien
cagggccgagatgccgcaaagccaa

SEQ ID NO: 115521 - DNA, 25 bp, Homo sapien
ggccacgcttagcagcggacgcaga

SEQ ID NO: 115522 - DNA, 25 bp, Homo sapien
tggaagagctcattctccctggaga

SEQ ID NO: 115523 - DNA, 25 bp, Homo sapien
tcctccttggggataggcgggaaca

SEQ ID NO: 115524 - DNA, 25 bp, Homo sapien
ggctctgctgcacgggaatcgccga

SEQ ID NO: 115525 - DNA, 25 bp, Homo sapien
tagcgcgcttgcagcgtgtccacct

SEQ ID NO: 115526 - DNA, 25 bp, Homo sapien
ctcctcgaagagctgcgtgagtcgc

SEQ ID NO: 115527 - DNA, 25 bp, Homo sapien
catagcgcgcctggtgctcctcgaa

SEQ ID NO: 115528 - DNA, 25 bp, Homo sapien
tctgtcggcggggacaccatagcgc

SEQ ID NO: 115529 - DNA, 25 bp, Homo sapien
gcgactcagcctcaagagcacgctg

SEQ ID NO: 115530 - DNA, 25 bp, Homo sapien
gatctcacctgggttgaccgggtct

SEQ ID NO: 115531 - DNA, 25 bp, Homo sapien
cgtatccggaggctacagaaagctc

SEQ ID NO: 115532 - DNA, 25 bp, Homo sapien
agaaagctccagatgccggcgccac

SEQ ID NO: 115533 - DNA, 25 bp, Homo sapien
cgccacagacaaggcgaggattgtc

SEQ ID NO: 115534 - DNA, 25 bp, Homo sapien
tgagccagccgcttgacacatgtgg

SEQ ID NO: 115535 - DNA, 25 bp, Homo sapien
cacatgtggaagctgaaacctggac

SEQ ID NO: 115536 - DNA, 25 bp, Homo sapien
tgggatctccgctacgcgcctggat

SEQ ID NO: 115537 - DNA, 25 bp, Homo sapien
tgccaaagctgctgtcgccttcttg

SEQ ID NO: 115538 - DNA, 25 bp, Homo sapien
ggcgtttctgccgtatttgccaaag

SEQ ID NO: 115539 - DNA, 25 bp, Homo sapien
ggtcctcgtcagagccgcagcagca

SEQ ID NO: 115540 - DNA, 25 bp, Homo sapien
cagaggccacccaggatggagatca

SEQ ID NO: 115541 - DNA, 25 bp, Homo sapien
ctcactcacttggttccggggtaca

SEQ ID NO: 115542 - DNA, 25 bp, Homo sapien
ggcgtaccaggagatggccaccatc

SEQ ID NO: 115543 - DNA, 25 bp, Homo sapien
atcccgcagatacctggggaccgga

SEQ ID NO: 115544 - DNA, 25 bp, Homo sapien
cagagctgctacacgtaggcgtttc

SEQ ID NO: 115545 - DNA, 25 bp, Homo sapien
cactacagtctactgtgccacagtc

SEQ ID NO: 115546 - DNA, 25 bp, Homo sapien
tgccacagtctccatggcccagtgg

SEQ ID NO: 115547 - DNA, 25 bp, Homo sapien
cgtccggcggatgctggcacgacct

SEQ ID NO: 115548 - DNA, 25 bp, Homo sapien
gatgctggcacgacctggcgacgcc

SEQ ID NO: 115549 - DNA, 25 bp, Homo sapien
ttcctctcagttcagcagcgccggc

SEQ ID NO: 115550 - DNA, 25 bp, Homo sapien
gtagttcggcttccctcggccaagc

SEQ ID NO: 115551 - DNA, 25 bp, Homo sapien
ggtcctccacagacaccagctcgtt

SEQ ID NO: 115552 - DNA, 25 bp, Homo sapien
gcgagcctcacactacagtctactg

SEQ ID NO: 115553 - DNA, 25 bp, Homo sapien
gcgcggcatcctgtaccttggaaaa

SEQ ID NO: 115554 - DNA, 25 bp, Homo sapien
tcctttagctggacacggaccgtgc

SEQ ID NO: 115555 - DNA, 25 bp, Homo sapien
tctctctgacaaaggccgggaactc

SEQ ID NO: 115556 - DNA, 25 bp, Homo sapien
gtccgaacagaacgctcagaacctc

SEQ ID NO: 115557 - DNA, 25 bp, Homo sapien
ggccgggaactcaagaaatcatttc

SEQ ID NO: 115558 - DNA, 25 bp, Homo sapien
ctcggagcaacgctcaaggcatctg

SEQ ID NO: 115559 - DNA, 25 bp, Homo sapien
cgcacacgcagatgtcttcacgaca

SEQ ID NO: 115560 - DNA, 25 bp, Homo sapien
gccacttttcttctgctcggagcgt

SEQ ID NO: 115561 - DNA, 25 bp, Homo sapien
acgtggcctgcagcgcaggtgctca

SEQ ID NO: 115562 - DNA, 25 bp, Homo sapien
cagggagagccctaaggcatcacac

SEQ ID NO: 115563 - DNA, 25 bp, Homo sapien
cccgacaccgggcttctgtggacag

SEQ ID NO: 115564 - DNA, 25 bp, Homo sapien
ccgcagcctgcagctcccgacaccg

SEQ ID NO: 115565 - DNA, 25 bp, Homo sapien
agagccctaaggcatcacacgtggc

SEQ ID NO: 115566 - DNA, 25 bp, Homo sapien
cctaaggcatcacacgtggcctgca

SEQ ID NO: 115567 - DNA, 25 bp, Homo sapien
ggcctgcagcgcaggtgctcaccga

SEQ ID NO: 115568 - DNA, 25 bp, Homo sapien
tcaccgagtgctcacagccgcgtgg

SEQ ID NO: 115569 - DNA, 25 bp, Homo sapien
ggctttcagcatagttgtccgccgc

SEQ ID NO: 115570 - DNA, 25 bp, Homo sapien
ccgcagatcagacgggtggggacct

SEQ ID NO: 115571 - DNA, 25 bp, Homo sapien
ctccgggagcaagccgcagatcaga

SEQ ID NO: 115572 - DNA, 25 bp, Homo sapien
aggatcttggctttcagcatagttg

SEQ ID NO: 115573 - DNA, 25 bp, Homo sapien
tcaggacggagctctacttggccgc

SEQ ID NO: 115574 - DNA, 25 bp, Homo sapien
cagggccgacgggactcggccactt

SEQ ID NO: 115575 - DNA, 25 bp, Homo sapien
ggccaggacttacctcgcaaggccc

SEQ ID NO: 115576 - DNA, 25 bp, Homo sapien
acggagctctacttggccgctttcg

SEQ ID NO: 115577 - DNA, 25 bp, Homo sapien
acacggggcaactgggacgaaatgg

SEQ ID NO: 115578 - DNA, 25 bp, Homo sapien
cacgatgaagctggccctgctcctg

SEQ ID NO: 115579 - DNA, 25 bp, Homo sapien
ctttgtgtcgcggagcaggttctcg

SEQ ID NO: 115580 - DNA, 25 bp, Homo sapien
ttcctctatcccttctcggccgcag

SEQ ID NO: 115581 - DNA, 25 bp, Homo sapien
tccgagtagaggtggttccgaccgc

SEQ ID NO: 115582 - DNA, 25 bp, Homo sapien
tcacgtggctctgccgctcacctgc

SEQ ID NO: 115583 - DNA, 25 bp, Homo sapien
cctcgttccgggctccgagtagagg

SEQ ID NO: 115584 - DNA, 25 bp, Homo sapien
ggcgttcggccgctcacgtggctct

SEQ ID NO: 115585 - DNA, 25 bp, Homo sapien
ccgcgctaacgaggatcgggataga

SEQ ID NO: 115586 - DNA, 25 bp, Homo sapien
cgctaacgaggatcgggatagaccg

SEQ ID NO: 115587 - DNA, 25 bp, Homo sapien
cgggatagaccggaggggccgcgct

SEQ ID NO: 115588 - DNA, 25 bp, Homo sapien
tccggaccccacgaggcgctctgga

SEQ ID NO: 115589 - DNA, 25 bp, Homo sapien
cgccgcgctaacgaggatcgggata

SEQ ID NO: 115590 - DNA, 25 bp, Homo sapien
gcgctgccaccaaccgggtctccac

SEQ ID NO: 115591 - DNA, 25 bp, Homo sapien
ccctgcccgtcgttcgctccccgag

SEQ ID NO: 115592 - DNA, 25 bp, Homo sapien
gcagaagcacggggaactccggacc

SEQ ID NO: 115593 - DNA, 25 bp, Homo sapien
ctggcccagtgtgggccctgcggcc

SEQ ID NO: 115594 - DNA, 25 bp, Homo sapien
cggccgcccaggccagcaacaggcg

SEQ ID NO: 115595 - DNA, 25 bp, Homo sapien
cggcacggggctcagcagcccaggg

SEQ ID NO: 115596 - DNA, 25 bp, Homo sapien
cggcgccgtgggaagagagcgtagc

SEQ ID NO: 115597 - DNA, 25 bp, Homo sapien
aggtgcggcgccgtgggaagagagc

SEQ ID NO: 115598 - DNA, 25 bp, Homo sapien
cgaggagtggccaggtcgcccccca

SEQ ID NO: 115599 - DNA, 25 bp, Homo sapien
tcctcgggggtccgaggagtggcca

SEQ ID NO: 115600 - DNA, 25 bp, Homo sapien
cagcagcatcgcgatgcccccggac

SEQ ID NO: 115601 - DNA, 25 bp, Homo sapien
tgcagcccgatccacagcagccggc

SEQ ID NO: 115602 - DNA, 25 bp, Homo sapien
cctgtggtccacgtgaagccgcgca

SEQ ID NO: 115603 - DNA, 25 bp, Homo sapien
gcctcatcttgcagcgccgggcagg

SEQ ID NO: 115604 - DNA, 25 bp, Homo sapien
tcgaagccaaactggcacaggtagc

SEQ ID NO: 115605 - DNA, 25 bp, Homo sapien
actggcacaggtagccgtcgacagc

SEQ ID NO: 115606 - DNA, 25 bp, Homo sapien
gccgtcgacagccagcgtgcacgag

SEQ ID NO: 115607 - DNA, 25 bp, Homo sapien
gcccagttggtgaaagccgtgtcct

SEQ ID NO: 115608 - DNA, 25 bp, Homo sapien
gcaggcgccctcgaagccaaactgg

SEQ ID NO: 115609 - DNA, 25 bp, Homo sapien
ccaacttttgcaagctgtagttatt

SEQ ID NO: 115610 - DNA, 25 bp, Homo sapien
tcaggtgatgggcacagacggcaac

SEQ ID NO: 115611 - DNA, 25 bp, Homo sapien
gttgcagatgtacgtccttccattt

SEQ ID NO: 115612 - DNA, 25 bp, Homo sapien
cggtctccaaggtgaacctcgcaca

SEQ ID NO: 115613 - DNA, 25 bp, Homo sapien
tccatttctggctaccgcggagctg

SEQ ID NO: 115614 - DNA, 25 bp, Homo sapien
acctcgcacaaatgcgttgcagatg

SEQ ID NO: 115615 - DNA, 25 bp, Homo sapien
agagccacagcggaggcgccttctg

SEQ ID NO: 115616 - DNA, 25 bp, Homo sapien
ttttcctttcgcgtgaactcgccgc

SEQ ID NO: 115617 - DNA, 25 bp, Homo sapien
cgctttgatttacagcagctgcagg

SEQ ID NO: 115618 - DNA, 25 bp, Homo sapien
cccattgatcactcgcttgatcgga

SEQ ID NO: 115619 - DNA, 25 bp, Homo sapien
cttgatcggaaattgatcctctttg

SEQ ID NO: 115620 - DNA, 25 bp, Homo sapien
gttcaattcatcgatcagcccaaga

SEQ ID NO: 115621 - DNA, 25 bp, Homo sapien
atcagcccaagatggcgccgggagc

SEQ ID NO: 115622 - DNA, 25 bp, Homo sapien
gctcactccgtctcaatatgtctca

SEQ ID NO: 115623 - DNA, 25 bp, Homo sapien
ccaaccggagtcttgaaggcgctgc

SEQ ID NO: 115624 - DNA, 25 bp, Homo sapien
actaaccactacaggggcgctccga

SEQ ID NO: 115625 - DNA, 25 bp, Homo sapien
ttcatcagatgaacgcacggccggc

SEQ ID NO: 115626 - DNA, 25 bp, Homo sapien
gccaccgcaacggtattggcgaacc

SEQ ID NO: 115627 - DNA, 25 bp, Homo sapien
cgtgaccatcgtgttcgctttgaag

SEQ ID NO: 115628 - DNA, 25 bp, Homo sapien
aacactccagaggtgaggcgcgtga

SEQ ID NO: 115629 - DNA, 25 bp, Homo sapien
cttatcgaacagagccgggagttca

SEQ ID NO: 115630 - DNA, 25 bp, Homo sapien
tgagcagtccagaaagcggcttatc

SEQ ID NO: 115631 - DNA, 25 bp, Homo sapien
accggcaggatgaaagtgagcagtc

SEQ ID NO: 115632 - DNA, 25 bp, Homo sapien
ccgtgagcgtttcattttcatcaga

SEQ ID NO: 115633 - DNA, 25 bp, Homo sapien
acgtcggcctttctgatctgtgtct

SEQ ID NO: 115634 - DNA, 25 bp, Homo sapien
cctgcttaaagctggatgtcgagac

SEQ ID NO: 115635 - DNA, 25 bp, Homo sapien
agcgccggttgacgagaacctttga

SEQ ID NO: 115636 - DNA, 25 bp, Homo sapien
tgctgttgctggagaagaaccgctc

SEQ ID NO: 115637 - DNA, 25 bp, Homo sapien
ctcgggctctaatggtattgcattc

SEQ ID NO: 115638 - DNA, 25 bp, Homo sapien
tgcattctcaaaacgggcgcgcgcc

SEQ ID NO: 115639 - DNA, 25 bp, Homo sapien
cagcctcgctctggtggtgttttca

SEQ ID NO: 115640 - DNA, 25 bp, Homo sapien
ttgggcagctggtaaaacgcgtaca

SEQ ID NO: 115641 - DNA, 25 bp, Homo sapien
tcagtcagtgacagccagccctgcg

SEQ ID NO: 115642 - DNA, 25 bp, Homo sapien
tctgtcggcaccgagtacagccagg

SEQ ID NO: 115643 - DNA, 25 bp, Homo sapien
aggaggcgctgaaacgagcgtatca

SEQ ID NO: 115644 - DNA, 25 bp, Homo sapien
cgagcgtatcagcaaaagccatacc

SEQ ID NO: 115645 - DNA, 25 bp, Homo sapien
agcaccgtcatcaactggttccaca

SEQ ID NO: 115646 - DNA, 25 bp, Homo sapien
tggttccacaactacaggtacgacg

SEQ ID NO: 115647 - DNA, 25 bp, Homo sapien
ctacaggtacgacggctggctcaca

SEQ ID NO: 115648 - DNA, 25 bp, Homo sapien
gcagcctacatgaagcggcggcaca

SEQ ID NO: 115649 - DNA, 25 bp, Homo sapien
ccagccgggaggaacctatcgaatg

SEQ ID NO: 115650 - DNA, 25 bp, Homo sapien
cggatccgcagagaactgttcattg

SEQ ID NO: 115651 - DNA, 25 bp, Homo sapien
ttgaggaaattcaggccgggagtca

SEQ ID NO: 115652 - DNA, 25 bp, Homo sapien
gctcgctgcagagccttttcggcct

SEQ ID NO: 115653 - DNA, 25 bp, Homo sapien
ggccgcgaacttgaacagcatcatc

SEQ ID NO: 115654 - DNA, 25 bp, Homo sapien
aacctatcgaatgggagttctgagg

SEQ ID NO: 115655 - DNA, 25 bp, Homo sapien
ccgccgcttgttgtcttgtaggtct

SEQ ID NO: 115656 - DNA, 25 bp, Homo sapien
ttgtcttgtaggtctcggatccgca

SEQ ID NO: 115657 - DNA, 25 bp, Homo sapien
agccagcaagcaccggccaccggcg

SEQ ID NO: 115658 - DNA, 25 bp, Homo sapien
tccgcgcgtgtcgtctttgtgtgcg

SEQ ID NO: 115659 - DNA, 25 bp, Homo sapien
acgcgccttggtccgcgcgtgtcgt

SEQ ID NO: 115660 - DNA, 25 bp, Homo sapien
ttatacccagttcctcgctccctgg

SEQ ID NO: 115661 - DNA, 25 bp, Homo sapien
gtatggcctccttatacccagttcc

SEQ ID NO: 115662 - DNA, 25 bp, Homo sapien
cgcctgtaggtatggcctccttata

SEQ ID NO: 115663 - DNA, 25 bp, Homo sapien
caggtctcttccctacgctgggagc

SEQ ID NO: 115664 - DNA, 25 bp, Homo sapien
cagctgcgcgcctgtaggtatggcc

SEQ ID NO: 115665 - DNA, 25 bp, Homo sapien
cgccgacgatgcaagctgttgacct

SEQ ID NO: 115666 - DNA, 25 bp, Homo sapien
cgtatccggggtgttcgaacaattg

SEQ ID NO: 115667 - DNA, 25 bp, Homo sapien
catggctgttcttttctgctggggc

SEQ ID NO: 115668 - DNA, 25 bp, Homo sapien
tgttgacctgcacagataaaccgtg

SEQ ID NO: 115669 - DNA, 25 bp, Homo sapien
ttcgaacaattgtgcggcgccgacg

SEQ ID NO: 115670 - DNA, 25 bp, Homo sapien
gtgtacttctgcgttgacatgcatc

SEQ ID NO: 115671 - DNA, 25 bp, Homo sapien
acacccacgagcacatgtacatgcg

SEQ ID NO: 115672 - DNA, 25 bp, Homo sapien
tgcttgtcgtggcaagggttctttg

SEQ ID NO: 115673 - DNA, 25 bp, Homo sapien
ctcatcaatattttaaggaatgacc

SEQ ID NO: 115674 - DNA, 25 bp, Homo sapien
cactgtgccgcgcatcgattggtcg

SEQ ID NO: 115675 - DNA, 25 bp, Homo sapien
gcatcgattggtcgcgggcccatta

SEQ ID NO: 115676 - DNA, 25 bp, Homo sapien
ggggcggcgagtccgactcatcaat

SEQ ID NO: 115677 - DNA, 25 bp, Homo sapien
gcgagtccgactcatcaatatttta

SEQ ID NO: 115678 - DNA, 25 bp, Homo sapien
cagcgctatttttaccgccggaaag

SEQ ID NO: 115679 - DNA, 25 bp, Homo sapien
tggtcctccaattgtcagcgctatt

SEQ ID NO: 115680 - DNA, 25 bp, Homo sapien
cctccaattgtcagcgctattttta

SEQ ID NO: 115681 - DNA, 25 bp, Homo sapien
ccgccgtggactttgcgcacaagtt

SEQ ID NO: 115682 - DNA, 25 bp, Homo sapien
tgcgcacaagttctgccgtttcctg

SEQ ID NO: 115683 - DNA, 25 bp, Homo sapien
gaagccatgaatggtgccggccctg

SEQ ID NO: 115684 - DNA, 25 bp, Homo sapien
gtttcctgcgggacaacccagctta

SEQ ID NO: 115685 - DNA, 25 bp, Homo sapien
gcggacacctctgcactcaaggcgg

SEQ ID NO: 115686 - DNA, 25 bp, Homo sapien
tctcgctgcgcaacatgagcctgtg

SEQ ID NO: 115687 - DNA, 25 bp, Homo sapien
aaggcccgcgttcgcaagggcttct

SEQ ID NO: 115688 - DNA, 25 bp, Homo sapien
ggcagttctgcgagctgcatgcgca

SEQ ID NO: 115689 - DNA, 25 bp, Homo sapien
ccagcccgcacctgggtcagtaggt

SEQ ID NO: 115690 - DNA, 25 bp, Homo sapien
tgggtcagtaggtcctgcaccagct

SEQ ID NO: 115691 - DNA, 25 bp, Homo sapien
cctgccgctccggtgccagtaggga

SEQ ID NO: 115692 - DNA, 25 bp, Homo sapien
ggctcagcgcctgacggatgccctg

SEQ ID NO: 115693 - DNA, 25 bp, Homo sapien
ctcatggaccgaagcagaggtcgtc

SEQ ID NO: 115694 - DNA, 25 bp, Homo sapien
ggtcctgcatcagtgctgccgcagc

SEQ ID NO: 115695 - DNA, 25 bp, Homo sapien
ccgcggctgtgtgtcggtcctgcat

SEQ ID NO: 115696 - DNA, 25 bp, Homo sapien
cagaaggcggcgctcatggaccgaa

SEQ ID NO: 115697 - DNA, 25 bp, Homo sapien
cgcccggccagcactacttctccag

SEQ ID NO: 115698 - DNA, 25 bp, Homo sapien
gcgcgccgtggagaaccagtactcc

SEQ ID NO: 115699 - DNA, 25 bp, Homo sapien
gctcttcagtgaagacacgatgtta

SEQ ID NO: 115700 - DNA, 25 bp, Homo sapien
ggagaaccagtactccttctactag

SEQ ID NO: 115701 - DNA, 25 bp, Homo sapien
ctgccgtcgccttgttgcagagccg

SEQ ID NO: 115702 - DNA, 25 bp, Homo sapien
ggtgggacacgccaagctcttcagt

SEQ ID NO: 115703 - DNA, 25 bp, Homo sapien
cacgatgttattaaaagcctgtttt

SEQ ID NO: 115704 - DNA, 25 bp, Homo sapien
aagcctgttttagggactgcacccg

SEQ ID NO: 115705 - DNA, 25 bp, Homo sapien
aactggaaccgacgcttacggagca

SEQ ID NO: 115706 - DNA, 25 bp, Homo sapien
tatgcgagagcggttcttcctggcc

SEQ ID NO: 115707 - DNA, 25 bp, Homo sapien
caagggtatgcgagagcggttcttc

SEQ ID NO: 115708 - DNA, 25 bp, Homo sapien
cgacgcttacggagcaagggtatgc

SEQ ID NO: 115709 - DNA, 25 bp, Homo sapien
taactggaaccgacgcttacggagc

SEQ ID NO: 115710 - DNA, 25 bp, Homo sapien
agggtatgcgagagcggttcttcct

SEQ ID NO: 115711 - DNA, 25 bp, Homo sapien
acgcttacggagcaagggtatgcga

SEQ ID NO: 115712 - DNA, 25 bp, Homo sapien
ccgacgcttacggagcaagggtatg

SEQ ID NO: 115713 - DNA, 25 bp, Homo sapien
cttggagggcgcgtaaagctcatag

SEQ ID NO: 115714 - DNA, 25 bp, Homo sapien
gtaaagctcataggctggagcttct

SEQ ID NO: 115715 - DNA, 25 bp, Homo sapien
cgcgtaaagctcataggctggagct

SEQ ID NO: 115716 - DNA, 25 bp, Homo sapien
gcgcgtaaagctcataggctggagc

SEQ ID NO: 115717 - DNA, 25 bp, Homo sapien
cgtaaagctcataggctggagcttc

SEQ ID NO: 115718 - DNA, 25 bp, Homo sapien
gcgtaaagctcataggctggagctt

SEQ ID NO: 115719 - DNA, 25 bp, Homo sapien
cgccgctcgcttgtgaaactggaag

SEQ ID NO: 115720 - DNA, 25 bp, Homo sapien
gcggctcatgaagaacccggtgaga

SEQ ID NO: 115721 - DNA, 25 bp, Homo sapien
aaactggaaggctgccatggctagc

SEQ ID NO: 115722 - DNA, 25 bp, Homo sapien
ctgtgtcgtcatacttgcgcgccga

SEQ ID NO: 115723 - DNA, 25 bp, Homo sapien
catgaatattcagcaggctgcttgc

SEQ ID NO: 115724 - DNA, 25 bp, Homo sapien
cccttcagggacgtgagcatctagc

SEQ ID NO: 115725 - DNA, 25 bp, Homo sapien
tttgaacacaataacccacgccagc

SEQ ID NO: 115726 - DNA, 25 bp, Homo sapien
gtgagcatctagctgcactgatttg

SEQ ID NO: 115727 - DNA, 25 bp, Homo sapien
ctgctcctctccctcgcgcgatccc

SEQ ID NO: 115728 - DNA, 25 bp, Homo sapien
gtcactacccatccggggttggtga

SEQ ID NO: 115729 - DNA, 25 bp, Homo sapien
tgcccgggcgcggtcactacccatc

SEQ ID NO: 115730 - DNA, 25 bp, Homo sapien
ggaaggggacgactgtaggctgccc

SEQ ID NO: 115731 - DNA, 25 bp, Homo sapien
gccacgcagtccgagcgggagccga

SEQ ID NO: 115732 - DNA, 25 bp, Homo sapien
ctcgtggtctgtgggtagccggacc

SEQ ID NO: 115733 - DNA, 25 bp, Homo sapien
gggcctcgccttgactcccagagct

SEQ ID NO: 115734 - DNA, 25 bp, Homo sapien
cgcccagaggatcagggtcggcggc

SEQ ID NO: 115735 - DNA, 25 bp, Homo sapien
tagtccaggttgcactgctcgacgg

SEQ ID NO: 115736 - DNA, 25 bp, Homo sapien
cccgctcggggcagtagtccaggtt

SEQ ID NO: 115737 - DNA, 25 bp, Homo sapien
gtgctatcacgctgtccaccaaggc

SEQ ID NO: 115738 - DNA, 25 bp, Homo sapien
gcaccgaccggctgggtgctatcac

SEQ ID NO: 115739 - DNA, 25 bp, Homo sapien
tcctggcatagcaccgaccggctgg

SEQ ID NO: 115740 - DNA, 25 bp, Homo sapien
agctcccggaaagtgacgcagacgc

SEQ ID NO: 115741 - DNA, 25 bp, Homo sapien
tgcggtggatggcatgcttccactg

SEQ ID NO: 115742 - DNA, 25 bp, Homo sapien
tggcatgcttccactggtgccgtgc

SEQ ID NO: 115743 - DNA, 25 bp, Homo sapien
ctgccgctcgcagatcagacaggtc

SEQ ID NO: 115744 - DNA, 25 bp, Homo sapien
agacaggtccggatgcccttgcaac

SEQ ID NO: 115745 - DNA, 25 bp, Homo sapien
cttgcaaccgcattcccgaaggact

SEQ ID NO: 115746 - DNA, 25 bp, Homo sapien
ctgggctcagttaccgcggacgcca

SEQ ID NO: 115747 - DNA, 25 bp, Homo sapien
agatccggagtctggagtaagagcc

SEQ ID NO: 115748 - DNA, 25 bp, Homo sapien
gttatcgccctctgggttcggcaga

SEQ ID NO: 115749 - DNA, 25 bp, Homo sapien
tcggcagagtggtccaaatgtcttc

SEQ ID NO: 115750 - DNA, 25 bp, Homo sapien
tcttcttgttgggagatcgtggccc

SEQ ID NO: 115751 - DNA, 25 bp, Homo sapien
tggatgcacacgcatgcagctggtg

SEQ ID NO: 115752 - DNA, 25 bp, Homo sapien
agtcgggcgcacctgtaaccggtgc

SEQ ID NO: 115753 - DNA, 25 bp, Homo sapien
cgccgctttcttaggaaacgccgca

SEQ ID NO: 115754 - DNA, 25 bp, Homo sapien
tgcacgtgcgtaatggatgcacacg

SEQ ID NO: 115755 - DNA, 25 bp, Homo sapien
cggctacgcggtctcagctggacgc

SEQ ID NO: 115756 - DNA, 25 bp, Homo sapien
cccttgtaggcgtgaccgaggacgc

SEQ ID NO: 115757 - DNA, 25 bp, Homo sapien
cgctggtacccggacctggacttcg

SEQ ID NO: 115758 - DNA, 25 bp, Homo sapien
tgaccgaggacgctggtacccggac

SEQ ID NO: 115759 - DNA, 25 bp, Homo sapien
cgggccggtctccatagtaactggc

SEQ ID NO: 115760 - DNA, 25 bp, Homo sapien
agtaactggccgacattcgcgcagg

SEQ ID NO: 115761 - DNA, 25 bp, Homo sapien
atgctcacagttggacagtttggtc

SEQ ID NO: 115762 - DNA, 25 bp, Homo sapien
atcggtgcttccgtgtgcgtcatca

SEQ ID NO: 115763 - DNA, 25 bp, Homo sapien
agcctctggcctcacgacggagatt

SEQ ID NO: 115764 - DNA, 25 bp, Homo sapien
gttaaatctctgcttcggcctcgga

SEQ ID NO: 115765 - DNA, 25 bp, Homo sapien
ccagcacgcgtcaggccggttaaat

SEQ ID NO: 115766 - DNA, 25 bp, Homo sapien
tcagtgctttgcagacggtgccctt

SEQ ID NO: 115767 - DNA, 25 bp, Homo sapien
catcccgcccgtggccgcaaggccc

SEQ ID NO: 115768 - DNA, 25 bp, Homo sapien
ggtggaagagcttgggcgacatgat

SEQ ID NO: 115769 - DNA, 25 bp, Homo sapien
cggcgatgaacggtacattctggag

SEQ ID NO: 115770 - DNA, 25 bp, Homo sapien
tgacggcgatgaacggtacattctg

SEQ ID NO: 115771 - DNA, 25 bp, Homo sapien
acccagctgtgcatcccgcccgtgg

SEQ ID NO: 115772 - DNA, 25 bp, Homo sapien
ccggtagggaacactctgcagtcca

SEQ ID NO: 115773 - DNA, 25 bp, Homo sapien
tcgccggagccggtagggaacactc

SEQ ID NO: 115774 - DNA, 25 bp, Homo sapien
cacaggaagctggtgacggcgatga

SEQ ID NO: 115775 - DNA, 25 bp, Homo sapien
cgtcctggtttggagaccgcaggct

SEQ ID NO: 115776 - DNA, 25 bp, Homo sapien
tgagtctccgcgtcctggtttggag

SEQ ID NO: 115777 - DNA, 25 bp, Homo sapien
gcggcaggctcctctctcttttggc

SEQ ID NO: 115778 - DNA, 25 bp, Homo sapien
tgctgcaagacaaataggcaggggc

SEQ ID NO: 115779 - DNA, 25 bp, Homo sapien
gctgccagtgctgcaagacaaatag

SEQ ID NO: 115780 - DNA, 25 bp, Homo sapien
ccaccttcacgatgcagtaggggtc

SEQ ID NO: 115781 - DNA, 25 bp, Homo sapien
gggctcattgtccaccttcacgatg

SEQ ID NO: 115782 - DNA, 25 bp, Homo sapien
gcggtacctgatgatgggctcattg

SEQ ID NO: 115783 - DNA, 25 bp, Homo sapien
ggccgcagctctcattggccgtctg

SEQ ID NO: 115784 - DNA, 25 bp, Homo sapien
gtacagcgagctgcgcttggccatc

SEQ ID NO: 115785 - DNA, 25 bp, Homo sapien
ccacgatgcggatgtacagcgagct

SEQ ID NO: 115786 - DNA, 25 bp, Homo sapien
tcacatgtccttggcgggaaggttc

SEQ ID NO: 115787 - DNA, 25 bp, Homo sapien
cgcgctcacatgtccttggcgggaa

SEQ ID NO: 115788 - DNA, 25 bp, Homo sapien
ccgtctggtgctcgcagaaaatgtc

SEQ ID NO: 115789 - DNA, 25 bp, Homo sapien
tgagccgcggatcgctgacaaattc

SEQ ID NO: 115790 - DNA, 25 bp, Homo sapien
gcggatcgctgacaaattctcgccc

SEQ ID NO: 115791 - DNA, 25 bp, Homo sapien
cagaaggcggctctgtgcctcggaa

SEQ ID NO: 115792 - DNA, 25 bp, Homo sapien
tgtgatgtatacctcgcacgaaaga

SEQ ID NO: 115793 - DNA, 25 bp, Homo sapien
tgcagaggcgtgcagcgctcaccac

SEQ ID NO: 115794 - DNA, 25 bp, Homo sapien
tttcccgcatgtgacacagagtgcg

SEQ ID NO: 115795 - DNA, 25 bp, Homo sapien
ggagcgtgtcatttcccgcatgtga

SEQ ID NO: 115796 - DNA, 25 bp, Homo sapien
ctcacggatggtggagcgtgtcatt

SEQ ID NO: 115797 - DNA, 25 bp, Homo sapien
tgccgtgcacggtgtctgacacatc

SEQ ID NO: 115798 - DNA, 25 bp, Homo sapien
atgggcgtcccgtgccaggaattga

SEQ ID NO: 115799 - DNA, 25 bp, Homo sapien
cagaatcttgatgacgggcgccacg

SEQ ID NO: 115800 - DNA, 25 bp, Homo sapien
tcggcaatgccgttcactgggaacc

SEQ ID NO: 115801 - DNA, 25 bp, Homo sapien
tcagtccggtgtcacaagtagattc

SEQ ID NO: 115802 - DNA, 25 bp, Homo sapien
acgctgctttgtgatctgagaatcg

SEQ ID NO: 115803 - DNA, 25 bp, Homo sapien
tctagacggcgaaatcaactgaacg

SEQ ID NO: 115804 - DNA, 25 bp, Homo sapien
aaaagcctctcttcaccggacgctg

SEQ ID NO: 115805 - DNA, 25 bp, Homo sapien
gatcgcgatcctgaatcctcctctg

SEQ ID NO: 115806 - DNA, 25 bp, Homo sapien
ccacgcaacagaagggcggtacttt

SEQ ID NO: 115807 - DNA, 25 bp, Homo sapien
ccgtactgccgaaagcgctcgtcga

SEQ ID NO: 115808 - DNA, 25 bp, Homo sapien
tgccgaaagcgctcgtcgaaggtgg

SEQ ID NO: 115809 - DNA, 25 bp, Homo sapien
ctgccgaaagcgctcgtcgaaggtg

SEQ ID NO: 115810 - DNA, 25 bp, Homo sapien
gtactgccgaaagcgctcgtcgaag

SEQ ID NO: 115811 - DNA, 25 bp, Homo sapien
agccgtactgccgaaagcgctcgtc

SEQ ID NO: 115812 - DNA, 25 bp, Homo sapien
cgtactgccgaaagcgctcgtcgaa

SEQ ID NO: 115813 - DNA, 25 bp, Homo sapien
ccgaaagcgctcgtcgaaggtgggc

SEQ ID NO: 115814 - DNA, 25 bp, Homo sapien
gccgtactgccgaaagcgctcgtcg

SEQ ID NO: 115815 - DNA, 25 bp, Homo sapien
accagctcgtttttgttcatgggca

SEQ ID NO: 115816 - DNA, 25 bp, Homo sapien
accttgcctcctgccacgtagaatg

SEQ ID NO: 115817 - DNA, 25 bp, Homo sapien
gcacctcgccaacctggtagagctg

SEQ ID NO: 115818 - DNA, 25 bp, Homo sapien
ggtcctgccaaggtaccacgtaggc

SEQ ID NO: 115819 - DNA, 25 bp, Homo sapien
agcaagctctcttccggcaggttga

SEQ ID NO: 115820 - DNA, 25 bp, Homo sapien
caggttgacccagcgggaatagttg

SEQ ID NO: 115821 - DNA, 25 bp, Homo sapien
cccataatagaagggccgcacctcg

SEQ ID NO: 115822 - DNA, 25 bp, Homo sapien
ttcggatttcgaaggcaggcaccac

SEQ ID NO: 115823 - DNA, 25 bp, Homo sapien
tcttccggattactccggcggggca

SEQ ID NO: 115824 - DNA, 25 bp, Homo sapien
cgcttttcggcgcatgctcagagcg

SEQ ID NO: 115825 - DNA, 25 bp, Homo sapien
aggatcttgcgcaggcgcgagaaaa

SEQ ID NO: 115826 - DNA, 25 bp, Homo sapien
taagaggcctcttccggattactcc

SEQ ID NO: 115827 - DNA, 25 bp, Homo sapien
gccaccagagccctaataagaggcc

SEQ ID NO: 115828 - DNA, 25 bp, Homo sapien
gagcaagaacgactcgaaggctgga

SEQ ID NO: 115829 - DNA, 25 bp, Homo sapien
ttctcgccctcgaagagcaagaacg

SEQ ID NO: 115830 - DNA, 25 bp, Homo sapien
cccgtgggcgcttttcggcgcatgc

SEQ ID NO: 115831 - DNA, 25 bp, Homo sapien
accggctcgctcttgtttcagcaaa

SEQ ID NO: 115832 - DNA, 25 bp, Homo sapien
ccaagccaggccgtacagctcaggt

SEQ ID NO: 115833 - DNA, 25 bp, Homo sapien
tcgattggccgtggcaagtgaccct

SEQ ID NO: 115834 - DNA, 25 bp, Homo sapien
ctcctatttgacttgaggcggcaca

SEQ ID NO: 115835 - DNA, 25 bp, Homo sapien
ctctgtctccgtcaggtccgactgt

SEQ ID NO: 115836 - DNA, 25 bp, Homo sapien
atggccattgtgtctgatactatcc

SEQ ID NO: 115837 - DNA, 25 bp, Homo sapien
tgcaggtgaagtacgacgaggatct

SEQ ID NO: 115838 - DNA, 25 bp, Homo sapien
ccgaactctgaaggagtggacactg

SEQ ID NO: 115839 - DNA, 25 bp, Homo sapien
atacgctcttcgaagtccgcaggtg

SEQ ID NO: 115840 - DNA, 25 bp, Homo sapien
cgggcgcctgctactgcatttacag

SEQ ID NO: 115841 - DNA, 25 bp, Homo sapien
tccacatccaggtcaggtggcgttt

SEQ ID NO: 115842 - DNA, 25 bp, Homo sapien
taggctttgagctaggccgtttccg

SEQ ID NO: 115843 - DNA, 25 bp, Homo sapien
tgcatttacaggctgacccggggtc

SEQ ID NO: 115844 - DNA, 25 bp, Homo sapien
aagtagttcttcagcctcgggttgg

SEQ ID NO: 115845 - DNA, 25 bp, Homo sapien
ctcgcagacctgaggaatgtagttc

SEQ ID NO: 115846 - DNA, 25 bp, Homo sapien
ctgacggagaagctgcgatagtacc

SEQ ID NO: 115847 - DNA, 25 bp, Homo sapien
atgaagccctgtcgctcacaagtgc

SEQ ID NO: 115848 - DNA, 25 bp, Homo sapien
atcttggtaaaggaagcgcctggga

SEQ ID NO: 115849 - DNA, 25 bp, Homo sapien
cttcgaatctgacagcagggccagc

SEQ ID NO: 115850 - DNA, 25 bp, Homo sapien
tcacaagtgcggcatctccgagatg

SEQ ID NO: 115851 - DNA, 25 bp, Homo sapien
ctcgcgaggtgcgaaaattcaaatg

SEQ ID NO: 115852 - DNA, 25 bp, Homo sapien
tcagcagtgtggattgctccgccca

SEQ ID NO: 115853 - DNA, 25 bp, Homo sapien
gtccaacagaaaccacggagctccg

SEQ ID NO: 115854 - DNA, 25 bp, Homo sapien
gtcgccgggtcactcccttattatg

SEQ ID NO: 115855 - DNA, 25 bp, Homo sapien
tctggggtttcagcgagagtcttct

SEQ ID NO: 115856 - DNA, 25 bp, Homo sapien
cggctcgagtggtgttgtcatccgc

SEQ ID NO: 115857 - DNA, 25 bp, Homo sapien
agagtcttctaatccgaggcgctgc

SEQ ID NO: 115858 - DNA, 25 bp, Homo sapien
ctgcgggacgggtgagcttccctcc

SEQ ID NO: 115859 - DNA, 25 bp, Homo sapien
tccttctagcagaaatggcggctgc

SEQ ID NO: 115860 - DNA, 25 bp, Homo sapien
agagtcggcgccacagatccgaaca

SEQ ID NO: 115861 - DNA, 25 bp, Homo sapien
acagatccgaacagtgggtcgggca

SEQ ID NO: 115862 - DNA, 25 bp, Homo sapien
atcctctaccttccttctagcagaa

SEQ ID NO: 115863 - DNA, 25 bp, Homo sapien
gcacttccgggatggatctttcgtg

SEQ ID NO: 115864 - DNA, 25 bp, Homo sapien
actgactgagatccggctggagacc

SEQ ID NO: 115865 - DNA, 25 bp, Homo sapien
cccgccaacgtgtgcggtaacctag

SEQ ID NO: 115866 - DNA, 25 bp, Homo sapien
catggagacgaccagtaagcacttc

SEQ ID NO: 115867 - DNA, 25 bp, Homo sapien
ttggctctaagacgcccaggaaccg

SEQ ID NO: 115868 - DNA, 25 bp, Homo sapien
cgagcctcgcgccttggctctaaga

SEQ ID NO: 115869 - DNA, 25 bp, Homo sapien
ggagcaaaaaggcactcgtcacggc

SEQ ID NO: 115870 - DNA, 25 bp, Homo sapien
ggtaacctagttctatactgactga

SEQ ID NO: 115871 - DNA, 25 bp, Homo sapien
tcactgagaacgtccagcacgcctt

SEQ ID NO: 115872 - DNA, 25 bp, Homo sapien
acactgccgcgagcttcgagagttc

SEQ ID NO: 115873 - DNA, 25 bp, Homo sapien
tgcgcactagatgaggcagtcaacc

SEQ ID NO: 115874 - DNA, 25 bp, Homo sapien
gcccaggtgcgcactagatgaggca

SEQ ID NO: 115875 - DNA, 25 bp, Homo sapien
tgaggcagtcaaccaagtcaattgg

SEQ ID NO: 115876 - DNA, 25 bp, Homo sapien
cggagctcactgagaacgtccagca

SEQ ID NO: 115877 - DNA, 25 bp, Homo sapien
ccaagtcaattggttcccgatcaac

SEQ ID NO: 115878 - DNA, 25 bp, Homo sapien
tggttcccgatcaactaaatctctc

SEQ ID NO: 115879 - DNA, 25 bp, Homo sapien
tcttctttccctgtgtccgaagagg

SEQ ID NO: 115880 - DNA, 25 bp, Homo sapien
gcaagcccggatttaccgcagcctg

SEQ ID NO: 115881 - DNA, 25 bp, Homo sapien
taggacatctgcatggctctcgggg

SEQ ID NO: 115882 - DNA, 25 bp, Homo sapien
caccggatggcgtaggacatctgca

SEQ ID NO: 115883 - DNA, 25 bp, Homo sapien
ctcaaaatattggtcttgctcctcc

SEQ ID NO: 115884 - DNA, 25 bp, Homo sapien
cctgtagacgcggtaatcgccgcta

SEQ ID NO: 115885 - DNA, 25 bp, Homo sapien
gtccatggtggtcttcagcaggccc

SEQ ID NO: 115886 - DNA, 25 bp, Homo sapien
tgcagcatcgccaccagcatgagcg

SEQ ID NO: 115887 - DNA, 25 bp, Homo sapien
cacgtccgtcctgcaggcaagagct

SEQ ID NO: 115888 - DNA, 25 bp, Homo sapien
accgaggcaaacacggaggcacgta

SEQ ID NO: 115889 - DNA, 25 bp, Homo sapien
gccatgtggtcggtttctttattga

SEQ ID NO: 115890 - DNA, 25 bp, Homo sapien
ggtttctttattgagaccacagacg

SEQ ID NO: 115891 - DNA, 25 bp, Homo sapien
accacagacggtagcgcaggtccct

SEQ ID NO: 115892 - DNA, 25 bp, Homo sapien
ttcccgagtccaagtccgaatgccg

SEQ ID NO: 115893 - DNA, 25 bp, Homo sapien
gaggccacagagcacgtccgtcctg

SEQ ID NO: 115894 - DNA, 25 bp, Homo sapien
caaacacggaggcacgtaggagtcc

SEQ ID NO: 115895 - DNA, 25 bp, Homo sapien
agcacctagaactttccaaagcgtg

SEQ ID NO: 115896 - DNA, 25 bp, Homo sapien
tgcttggaatttaacaccttggtcg

SEQ ID NO: 115897 - DNA, 25 bp, Homo sapien
gaatttaacaccttggtcgtcgatc

SEQ ID NO: 115898 - DNA, 25 bp, Homo sapien
cggatctcttcccaagcacctagaa

SEQ ID NO: 115899 - DNA, 25 bp, Homo sapien
tctcttcccaagcacctagaacttt

SEQ ID NO: 115900 - DNA, 25 bp, Homo sapien
ccaaagcgtgcttggaatttaacac

SEQ ID NO: 115901 - DNA, 25 bp, Homo sapien
atccctgccgcctacggatctcttc

SEQ ID NO: 115902 - DNA, 25 bp, Homo sapien
cctagaactttccaaagcgtgcttg

SEQ ID NO: 115903 - DNA, 25 bp, Homo sapien
ttgcccgcaatatgcagggaaatga

SEQ ID NO: 115904 - DNA, 25 bp, Homo sapien
tggcgccggtttctttgtctgagcc

SEQ ID NO: 115905 - DNA, 25 bp, Homo sapien
ccctgtttttcctgggaggatgcgt

SEQ ID NO: 115906 - DNA, 25 bp, Homo sapien
ttggccgtcagtgtgccctgttttt

SEQ ID NO: 115907 - DNA, 25 bp, Homo sapien
acctcccgtccagctgtctgaaggg

SEQ ID NO: 115908 - DNA, 25 bp, Homo sapien
cgactcttctgcgagggacgtcaaa

SEQ ID NO: 115909 - DNA, 25 bp, Homo sapien
agggaaatgagcacctcgccctgct

SEQ ID NO: 115910 - DNA, 25 bp, Homo sapien
cgccgctcgctcattcagttttgga

SEQ ID NO: 115911 - DNA, 25 bp, Homo sapien
caggaggctgccaagctgtaccaca

SEQ ID NO: 115912 - DNA, 25 bp, Homo sapien
cctaatccgctcaggcgtcgaggtg

SEQ ID NO: 115913 - DNA, 25 bp, Homo sapien
tgcaacacggccactgtgtacaaga

SEQ ID NO: 115914 - DNA, 25 bp, Homo sapien
atcggcctctccatgatgctcatca

SEQ ID NO: 115915 - DNA, 25 bp, Homo sapien
tccactactgcatcggcaacggctt

SEQ ID NO: 115916 - DNA, 25 bp, Homo sapien
aagccggctatttcgggctcttcca

SEQ ID NO: 115917 - DNA, 25 bp, Homo sapien
gtcaacgtggtgtgcttcatccagc

SEQ ID NO: 115918 - DNA, 25 bp, Homo sapien
agactctgaaactggtgctgctggg

SEQ ID NO: 115919 - DNA, 25 bp, Homo sapien
ccctgcagtttactgggctcttctg

SEQ ID NO: 115920 - DNA, 25 bp, Homo sapien
aatgaaccggcctaggacgcgccct

SEQ ID NO: 115921 - DNA, 25 bp, Homo sapien
ccggccagtctggattgccctaacg

SEQ ID NO: 115922 - DNA, 25 bp, Homo sapien
caggatcggattatgggttgttacc

SEQ ID NO: 115923 - DNA, 25 bp, Homo sapien
ggctcttctgtgacccgctttccga

SEQ ID NO: 115924 - DNA, 25 bp, Homo sapien
accggggcagacaaggcccttctgc

SEQ ID NO: 115925 - DNA, 25 bp, Homo sapien
gcggctagggatacgccctgtacca

SEQ ID NO: 115926 - DNA, 25 bp, Homo sapien
gggccagctgtcctctcttctgatc

SEQ ID NO: 115927 - DNA, 25 bp, Homo sapien
accgcctccagtttgctatcttcga

SEQ ID NO: 115928 - DNA, 25 bp, Homo sapien
tagactcgccagctccgcttttatc

SEQ ID NO: 115929 - DNA, 25 bp, Homo sapien
gctcctccatcgagacagcactaga

SEQ ID NO: 115930 - DNA, 25 bp, Homo sapien
gtggctgcatttttccggctgcttc

SEQ ID NO: 115931 - DNA, 25 bp, Homo sapien
gccggaatcgccgtgtcattttagt

SEQ ID NO: 115932 - DNA, 25 bp, Homo sapien
gctgtccttgttcgtgcacccaata

SEQ ID NO: 115933 - DNA, 25 bp, Homo sapien
tggcatgcccaagctcacctatatc

SEQ ID NO: 115934 - DNA, 25 bp, Homo sapien
ccttcggtggattgttgaatgcatc

SEQ ID NO: 115935 - DNA, 25 bp, Homo sapien
aagaaaagggtgtgggcgcacatcc

SEQ ID NO: 115936 - DNA, 25 bp, Homo sapien
caaacgggtcctcaagttcatcaag

SEQ ID NO: 115937 - DNA, 25 bp, Homo sapien
aagtttgtgcgggacatgatcccgg

SEQ ID NO: 115938 - DNA, 25 bp, Homo sapien
ctccaaagacaaacgggtcctcaag

SEQ ID NO: 115939 - DNA, 25 bp, Homo sapien
cacgccaaggagttactgaaaggtc

SEQ ID NO: 115940 - DNA, 25 bp, Homo sapien
cgtacaagcagcacgccaaggagtt

SEQ ID NO: 115941 - DNA, 25 bp, Homo sapien
catgatcccggaggcatgtggcttc

SEQ ID NO: 115942 - DNA, 25 bp, Homo sapien
gagcaaagcaacgtcctggccgcca

SEQ ID NO: 115943 - DNA, 25 bp, Homo sapien
ttgttgcaagcaccgtccactcagg

SEQ ID NO: 115944 - DNA, 25 bp, Homo sapien
gcacgcacgattggcacctgccagt

SEQ ID NO: 115945 - DNA, 25 bp, Homo sapien
gtccgagcccacagcccaccgctgg

SEQ ID NO: 115946 - DNA, 25 bp, Homo sapien
tgcaagcaccgtccactcaggaggc

SEQ ID NO: 115947 - DNA, 25 bp, Homo sapien
ccctcgctttgtcttcgttgttgca

SEQ ID NO: 115948 - DNA, 25 bp, Homo sapien
ccaggggcacgcacgattggcacct

SEQ ID NO: 115949 - DNA, 25 bp, Homo sapien
cgcaaccggtgtgacgagtgccaac

SEQ ID NO: 115950 - DNA, 25 bp, Homo sapien
tgtcttcgttgttgcaagcaccgtc

SEQ ID NO: 115951 - DNA, 25 bp, Homo sapien
cggatgtttctctcttttcggcctc

SEQ ID NO: 115952 - DNA, 25 bp, Homo sapien
ctttccgggagctcattccgacgcg

SEQ ID NO: 115953 - DNA, 25 bp, Homo sapien
gaacacgcccgaggcaaaccacttg

SEQ ID NO: 115954 - DNA, 25 bp, Homo sapien
agacacacattaacggtcgggccgc

SEQ ID NO: 115955 - DNA, 25 bp, Homo sapien
acaaccagcttaggttctcagcaga

SEQ ID NO: 115956 - DNA, 25 bp, Homo sapien
tttcgggcctgaatggccagcactg

SEQ ID NO: 115957 - DNA, 25 bp, Homo sapien
ttctcagcagaaaggccgacaggcg

SEQ ID NO: 115958 - DNA, 25 bp, Homo sapien
cgcagcgtggactcactttttcgga

SEQ ID NO: 115959 - DNA, 25 bp, Homo sapien
gcggccaggcaaaagcagcgctttc

SEQ ID NO: 115960 - DNA, 25 bp, Homo sapien
agcagtggcaccgtgaagggcttca

SEQ ID NO: 115961 - DNA, 25 bp, Homo sapien
ggcttcagggccagtgttcctctga

SEQ ID NO: 115962 - DNA, 25 bp, Homo sapien
tcctctgacggagggacaagagttt

SEQ ID NO: 115963 - DNA, 25 bp, Homo sapien
ggccacttggatgagccagcggcta

SEQ ID NO: 115964 - DNA, 25 bp, Homo sapien
ctagtaggctcccagtgagcggcga

SEQ ID NO: 115965 - DNA, 25 bp, Homo sapien
ggaggaccagatgcgctccagccga

SEQ ID NO: 115966 - DNA, 25 bp, Homo sapien
gctcccgctggcacgatccataatg

SEQ ID NO: 115967 - DNA, 25 bp, Homo sapien
aaggggcagagaagccgcacctgca

SEQ ID NO: 115968 - DNA, 25 bp, Homo sapien
cctcagggactcgactctggctcgg

SEQ ID NO: 115969 - DNA, 25 bp, Homo sapien
tagggacgaggtgtaacctcacctc

SEQ ID NO: 115970 - DNA, 25 bp, Homo sapien
ggaaccagagctgccacaggtcgcc

SEQ ID NO: 115971 - DNA, 25 bp, Homo sapien
tagttcgatccggtcttctctgagc

SEQ ID NO: 115972 - DNA, 25 bp, Homo sapien
cccgcttcgtcagctccgaggtgat

SEQ ID NO: 115973 - DNA, 25 bp, Homo sapien
ccgaggtgatgccagagccgctcct

SEQ ID NO: 115974 - DNA, 25 bp, Homo sapien
ccgagagctctgtaggggcagcact

SEQ ID NO: 115975 - DNA, 25 bp, Homo sapien
gctggccttagccagactccacagg

SEQ ID NO: 115976 - DNA, 25 bp, Homo sapien
gtggagtgagcgaatcccttctctg

SEQ ID NO: 115977 - DNA, 25 bp, Homo sapien
cccttctctggagctccatagggga

SEQ ID NO: 115978 - DNA, 25 bp, Homo sapien
agtcgctgtggcactcagtcctacg

SEQ ID NO: 115979 - DNA, 25 bp, Homo sapien
tgagacatcgagaggaagtcgctgt

SEQ ID NO: 115980 - DNA, 25 bp, Homo sapien
gagaggaagaaaccagtgagacatc

SEQ ID NO: 115981 - DNA, 25 bp, Homo sapien
tggccgttccgacctccggtcagga

SEQ ID NO: 115982 - DNA, 25 bp, Homo sapien
gtgcccgcttcctgagtggccgttc

SEQ ID NO: 115983 - DNA, 25 bp, Homo sapien
ctcagacccgccagcgtgggtcccg

SEQ ID NO: 115984 - DNA, 25 bp, Homo sapien
cgtccactcagacccgccagcgtgg

SEQ ID NO: 115985 - DNA, 25 bp, Homo sapien
gcgtccactcagacccgccagcgtg

SEQ ID NO: 115986 - DNA, 25 bp, Homo sapien
ccgcgtccactcagacccgccagcg

SEQ ID NO: 115987 - DNA, 25 bp, Homo sapien
agcgtgggtcccgctcgcgacctgt

SEQ ID NO: 115988 - DNA, 25 bp, Homo sapien
actcagacccgccagcgtgggtccc

SEQ ID NO: 115989 - DNA, 25 bp, Homo sapien
gtgggtcccgctcgcgacctgtccc

SEQ ID NO: 115990 - DNA, 25 bp, Homo sapien
cccgcgtccactcagacccgccagc

SEQ ID NO: 115991 - DNA, 25 bp, Homo sapien
gcctgtccccgcgtccactcagacc

SEQ ID NO: 115992 - DNA, 25 bp, Homo sapien
catgaaatgggcgtaggacccttgg

SEQ ID NO: 115993 - DNA, 25 bp, Homo sapien
gacccttgggttccaagggagtgca

SEQ ID NO: 115994 - DNA, 25 bp, Homo sapien
ccttgggttccaagggagtgcagca

SEQ ID NO: 115995 - DNA, 25 bp, Homo sapien
cttgggttccaagggagtgcagcac

SEQ ID NO: 115996 - DNA, 25 bp, Homo sapien
tgggttccaagggagtgcagcacag

SEQ ID NO: 115997 - DNA, 25 bp, Homo sapien
gcagcgccaccgcacccatgacgcc

SEQ ID NO: 115998 - DNA, 25 bp, Homo sapien
ccgcacccatgacgccccgagcaca

SEQ ID NO: 115999 - DNA, 25 bp, Homo sapien
ggccttgctgctcattggttgcggt

SEQ ID NO: 116000 - DNA, 25 bp, Homo sapien
gtctcggccttgctgctcattggtt

SEQ ID NO: 116001 - DNA, 25 bp, Homo sapien
cggctcctcccgtggtatgacggta

SEQ ID NO: 116002 - DNA, 25 bp, Homo sapien
tcctcccgtggtatgacggtaacta

SEQ ID NO: 116003 - DNA, 25 bp, Homo sapien
tcccgtggtatgacggtaactaggc

SEQ ID NO: 116004 - DNA, 25 bp, Homo sapien
tggtatgacggtaactaggccggca

SEQ ID NO: 116005 - DNA, 25 bp, Homo sapien
tatgacggtaactaggccggcagcg

SEQ ID NO: 116006 - DNA, 25 bp, Homo sapien
ctcattggttgcggtgatggagact

SEQ ID NO: 116007 - DNA, 25 bp, Homo sapien
tttccctgttccttcggcagcagca

SEQ ID NO: 116008 - DNA, 25 bp, Homo sapien
gggattcgagaacgctccgacgtca

SEQ ID NO: 116009 - DNA, 25 bp, Homo sapien
ccgaaagttttgcaggcagcccttg

SEQ ID NO: 116010 - DNA, 25 bp, Homo sapien
gactttggaccatggagattctgca

SEQ ID NO: 116011 - DNA, 25 bp, Homo sapien
ctctaggagctgaaaccagtgggta

SEQ ID NO: 116012 - DNA, 25 bp, Homo sapien
gtttggagcgctacgagctaccttc

SEQ ID NO: 116013 - DNA, 25 bp, Homo sapien
tgcggggcgtgcaaaactcaaaagt

SEQ ID NO: 116014 - DNA, 25 bp, Homo sapien
cggctctcagagaaccactgcatgg

SEQ ID NO: 116015 - DNA, 25 bp, Homo sapien
ggctcccagcctttcgtaccgtggc

SEQ ID NO: 116016 - DNA, 25 bp, Homo sapien
gggcccgacggaggcatccgaggca

SEQ ID NO: 116017 - DNA, 25 bp, Homo sapien
atgaatgagcccagggcccgacgga

SEQ ID NO: 116018 - DNA, 25 bp, Homo sapien
tgatgatgaatgagcccagggcccg

SEQ ID NO: 116019 - DNA, 25 bp, Homo sapien
cccaggctgatgatgaatgagccca

SEQ ID NO: 116020 - DNA, 25 bp, Homo sapien
gctttcccaggctgatgatgaatga

SEQ ID NO: 116021 - DNA, 25 bp, Homo sapien
tgaggctttcccaggctgatgatga

SEQ ID NO: 116022 - DNA, 25 bp, Homo sapien
ctttcgtaccgtggcccctgaggct

SEQ ID NO: 116023 - DNA, 25 bp, Homo sapien
tccgctggcgaaccaagtagatgtt

SEQ ID NO: 116024 - DNA, 25 bp, Homo sapien
tacaagacaaaatcggcttcccagg

SEQ ID NO: 116025 - DNA, 25 bp, Homo sapien
cttcccagggagctagacctcgagt

SEQ ID NO: 116026 - DNA, 25 bp, Homo sapien
ttagaccgcagcaggaagttttccc

SEQ ID NO: 116027 - DNA, 25 bp, Homo sapien
actcacccactcgaggaccttgatg

SEQ ID NO: 116028 - DNA, 25 bp, Homo sapien
ggaccttgatgaagccgagtggctc

SEQ ID NO: 116029 - DNA, 25 bp, Homo sapien
gttgatctggaagccggacatcctc

SEQ ID NO: 116030 - DNA, 25 bp, Homo sapien
acctggccgagtcgactgatccgct

SEQ ID NO: 116031 - DNA, 25 bp, Homo sapien
aggaggacgtgatgcacgcgctctt

SEQ ID NO: 116032 - DNA, 25 bp, Homo sapien
ttacctaactggtcccagctccagg

SEQ ID NO: 116033 - DNA, 25 bp, Homo sapien
ccaggaggatgttgaactcggcttc

SEQ ID NO: 116034 - DNA, 25 bp, Homo sapien
gcttctgccgcaggattcatctcgg

SEQ ID NO: 116035 - DNA, 25 bp, Homo sapien
ggagaaaaatgagcttcaccgcgct

SEQ ID NO: 116036 - DNA, 25 bp, Homo sapien
cccgagctttaccttgtaggagtcg

SEQ ID NO: 116037 - DNA, 25 bp, Homo sapien
tcaccgcgctccgttgcttaagtca

SEQ ID NO: 116038 - DNA, 25 bp, Homo sapien
tgcttaagtcactgctcggtcggcg

SEQ ID NO: 116039 - DNA, 25 bp, Homo sapien
ctcatgaactccgtgctgcggggca

SEQ ID NO: 116040 - DNA, 25 bp, Homo sapien
tcctggccggatctgtaaacactcg

SEQ ID NO: 116041 - DNA, 25 bp, Homo sapien
agcgacagttgcgaccgcgagtaca

SEQ ID NO: 116042 - DNA, 25 bp, Homo sapien
atccggcaacttcttcgcgcgtaaa

SEQ ID NO: 116043 - DNA, 25 bp, Homo sapien
tagccgtagacgtccttgctgcgca

SEQ ID NO: 116044 - DNA, 25 bp, Homo sapien
accatgggttccaggttcactcgca

SEQ ID NO: 116045 - DNA, 25 bp, Homo sapien
gacacttgttcattcctccgggcgg

SEQ ID NO: 116046 - DNA, 25 bp, Homo sapien
gctggcgtctctcgctacttttctc

SEQ ID NO: 116047 - DNA, 25 bp, Homo sapien
gggcagtggtacgagatctacgaca

SEQ ID NO: 116048 - DNA, 25 bp, Homo sapien
cccggagtacctgtggaagaagatt

SEQ ID NO: 116049 - DNA, 25 bp, Homo sapien
atctacgacaagtaccaggtggtgc

SEQ ID NO: 116050 - DNA, 25 bp, Homo sapien
gctgattggctatgacgtcactgac

SEQ ID NO: 116051 - DNA, 25 bp, Homo sapien
tgcacgacgatgagctggagttcac

SEQ ID NO: 116052 - DNA, 25 bp, Homo sapien
aagctctacgccatgcacccgtggg

SEQ ID NO: 116053 - DNA, 25 bp, Homo sapien
gcggacttctaccaccggctgggac

SEQ ID NO: 116054 - DNA, 25 bp, Homo sapien
agcaccaccagccagaccattaagg

SEQ ID NO: 116055 - DNA, 25 bp, Homo sapien
gcaggagaacgagcgcaaaggcacc

SEQ ID NO: 116056 - DNA, 25 bp, Homo sapien
tggagttcgcgctgcagcacttcac

SEQ ID NO: 116057 - DNA, 25 bp, Homo sapien
ggggttcaccatggcgaatgacgcc

SEQ ID NO: 116058 - DNA, 25 bp, Homo sapien
tcaacttcgccgaggagcccatgca

SEQ ID NO: 116059 - DNA, 25 bp, Homo sapien
agcccatgcagtccgactccgagga

SEQ ID NO: 116060 - DNA, 25 bp, Homo sapien
gcgttcaatggtgaggaccagaccc

SEQ ID NO: 116061 - DNA, 25 bp, Homo sapien
tgtgctctcggatcttgccgctttg

SEQ ID NO: 116062 - DNA, 25 bp, Homo sapien
aggcaggatgagcatcgagatcccg

SEQ ID NO: 116063 - DNA, 25 bp, Homo sapien
tggcgctaagccacacaatgcttgg

SEQ ID NO: 116064 - DNA, 25 bp, Homo sapien
caatgcttggtttgccgcaggcttt

SEQ ID NO: 116065 - DNA, 25 bp, Homo sapien
cccgggacacaacaagatcagctgg

SEQ ID NO: 116066 - DNA, 25 bp, Homo sapien
tggctcattcatcgccgccgaggca

SEQ ID NO: 116067 - DNA, 25 bp, Homo sapien
ggcctcccaattcttgcctaatttg

SEQ ID NO: 116068 - DNA, 25 bp, Homo sapien
ctaatttggaagagagccgcagccc

SEQ ID NO: 116069 - DNA, 25 bp, Homo sapien
cctttttaaggcaactggcggagtg

SEQ ID NO: 116070 - DNA, 25 bp, Homo sapien
gccggtcttcgcagtggctcattca

SEQ ID NO: 116071 - DNA, 25 bp, Homo sapien
tttcggttgaggagtaagagctgcc

SEQ ID NO: 116072 - DNA, 25 bp, Homo sapien
acttcgcggcaggtttgttgtcttt

SEQ ID NO: 116073 - DNA, 25 bp, Homo sapien
cacttcgcggcaggtttgttgtctt

SEQ ID NO: 116074 - DNA, 25 bp, Homo sapien
gcacttcgcggcaggtttgttgtct

SEQ ID NO: 116075 - DNA, 25 bp, Homo sapien
ctggtggtgttgtcgtggccggagc

SEQ ID NO: 116076 - DNA, 25 bp, Homo sapien
cgcgggagcagtaacccgcgcgggg

SEQ ID NO: 116077 - DNA, 25 bp, Homo sapien
ctgccgcgggagcagtaacccgcgc

SEQ ID NO: 116078 - DNA, 25 bp, Homo sapien
tcggttgaggagtaagagctgccgc

SEQ ID NO: 116079 - DNA, 25 bp, Homo sapien
taaccgttcgattggtgcccgcggc

SEQ ID NO: 116080 - DNA, 25 bp, Homo sapien
tttgttgtctttcagttagggaaga

SEQ ID NO: 116081 - DNA, 25 bp, Homo sapien
ttgtctttcagttagggaagaggtg

SEQ ID NO: 116082 - DNA, 25 bp, Homo sapien
ctcgttccttcttctcggagggttg

SEQ ID NO: 116083 - DNA, 25 bp, Homo sapien
cttcttctcggagggttgcccttgg

SEQ ID NO: 116084 - DNA, 25 bp, Homo sapien
cagttaaccgttcgattggtgcccg

SEQ ID NO: 116085 - DNA, 25 bp, Homo sapien
accgttcgattggtgcccgcggcga

SEQ ID NO: 116086 - DNA, 25 bp, Homo sapien
gggcagttaaccgttcgattggtgc

SEQ ID NO: 116087 - DNA, 25 bp, Homo sapien
tacgcagttcgaatgaatgggctcc

SEQ ID NO: 116088 - DNA, 25 bp, Homo sapien
tgttacgcagttcgaatgaatgggc

SEQ ID NO: 116089 - DNA, 25 bp, Homo sapien
ggggaacgcgatgaatggcgaaaga

SEQ ID NO: 116090 - DNA, 25 bp, Homo sapien
cattgttacgcagttcgaatgaatg

SEQ ID NO: 116091 - DNA, 25 bp, Homo sapien
cccggggctcattgttacgcagttc

SEQ ID NO: 116092 - DNA, 25 bp, Homo sapien
ggctcattgttacgcagttcgaatg

SEQ ID NO: 116093 - DNA, 25 bp, Homo sapien
ggggctcattgttacgcagttcgaa

SEQ ID NO: 116094 - DNA, 25 bp, Homo sapien
cggggctcattgttacgcagttcga

SEQ ID NO: 116095 - DNA, 25 bp, Homo sapien
gcggactcctctccgtgtggacaga

SEQ ID NO: 116096 - DNA, 25 bp, Homo sapien
tgcacaggcggagcttctgcacgcc

SEQ ID NO: 116097 - DNA, 25 bp, Homo sapien
aggaccacccgtctgcacaggcgga

SEQ ID NO: 116098 - DNA, 25 bp, Homo sapien
ttctgcacgccggacaagatggggc

SEQ ID NO: 116099 - DNA, 25 bp, Homo sapien
tcctctccgtgtggacagatgacga

SEQ ID NO: 116100 - DNA, 25 bp, Homo sapien
cagcgaaagcggtttccgtctgctc

SEQ ID NO: 116101 - DNA, 25 bp, Homo sapien
aagcggtttccgtctgctcgggcct

SEQ ID NO: 116102 - DNA, 25 bp, Homo sapien
ctgggccgatgcctctgtctgcctg

SEQ ID NO: 116103 - DNA, 25 bp, Homo sapien
ggagtggtcacgtccagactggaaa

SEQ ID NO: 116104 - DNA, 25 bp, Homo sapien
cagaagttcccggactgtagctgca

SEQ ID NO: 116105 - DNA, 25 bp, Homo sapien
cacctcgctgtccaggtgcggagca

SEQ ID NO: 116106 - DNA, 25 bp, Homo sapien
ttctgcaaagcaacgggttgggtcc

SEQ ID NO: 116107 - DNA, 25 bp, Homo sapien
cggcgctttcagctgtctctcgcag

SEQ ID NO: 116108 - DNA, 25 bp, Homo sapien
cagggagcttcgtttgccctccaca

SEQ ID NO: 116109 - DNA, 25 bp, Homo sapien
tggccgcagcgcttatctgtgaagc

SEQ ID NO: 116110 - DNA, 25 bp, Homo sapien
atgtcgtcagcagcagaacggctcc

SEQ ID NO: 116111 - DNA, 25 bp, Homo sapien
aagcgcgttcgctgaatttgcacca

SEQ ID NO: 116112 - DNA, 25 bp, Homo sapien
tgccaataaacgtggtcgcgccgcc

SEQ ID NO: 116113 - DNA, 25 bp, Homo sapien
cctgccgccaattagaaaacaactg

SEQ ID NO: 116114 - DNA, 25 bp, Homo sapien
ctccaagcatcaggtcaaaagtcta

SEQ ID NO: 116115 - DNA, 25 bp, Homo sapien
gtggaaagtctgtcctcctgaagaa

SEQ ID NO: 116116 - DNA, 25 bp, Homo sapien
aaaggagtgcgtcttaagcgcgttc

SEQ ID NO: 116117 - DNA, 25 bp, Homo sapien
cagttcccacgactcccagggaggt

SEQ ID NO: 116118 - DNA, 25 bp, Homo sapien
gggccgcacttagcagtggaaagtc

SEQ ID NO: 116119 - DNA, 25 bp, Homo sapien
gcaggggcttactcgcttcaagttt

SEQ ID NO: 116120 - DNA, 25 bp, Homo sapien
tacagctgcagctacatggtgtcgc

SEQ ID NO: 116121 - DNA, 25 bp, Homo sapien
gcaggccacgagacccgaaggttct

SEQ ID NO: 116122 - DNA, 25 bp, Homo sapien
gctgcagctaacaggtgatcccgtt

SEQ ID NO: 116123 - DNA, 25 bp, Homo sapien
ggccggtctacagcgagctcgcttt

SEQ ID NO: 116124 - DNA, 25 bp, Homo sapien
cagctttctttctgagacgccgaga

SEQ ID NO: 116125 - DNA, 25 bp, Homo sapien
tttccagcaacagcacgagcggcgc

SEQ ID NO: 116126 - DNA, 25 bp, Homo sapien
tgggactcttaagtggtcacggatc

SEQ ID NO: 116127 - DNA, 25 bp, Homo sapien
gctctgcgagccgaatcatggatca

SEQ ID NO: 116128 - DNA, 25 bp, Homo sapien
ggccaaaattgggacaacctgcttg

SEQ ID NO: 116129 - DNA, 25 bp, Homo sapien
acacttttgctacaccaggcggagg

SEQ ID NO: 116130 - DNA, 25 bp, Homo sapien
ccggagcgcgcgtgtttacactttt

SEQ ID NO: 116131 - DNA, 25 bp, Homo sapien
tgggtctaggtagctcgtcacgaca

SEQ ID NO: 116132 - DNA, 25 bp, Homo sapien
taccgtctggtgtggtacctacctc

SEQ ID NO: 116133 - DNA, 25 bp, Homo sapien
cgcacagcaggcaaaagggattatg

SEQ ID NO: 116134 - DNA, 25 bp, Homo sapien
accggggcatataccaagttagctc

SEQ ID NO: 116135 - DNA, 25 bp, Homo sapien
gtcgtgtgtactgctccttggccaa

SEQ ID NO: 116136 - DNA, 25 bp, Homo sapien
ccagaggcacggaaggtcccgctca

SEQ ID NO: 116137 - DNA, 25 bp, Homo sapien
tacgcggcttaaccgtgttgggctg

SEQ ID NO: 116138 - DNA, 25 bp, Homo sapien
cgacagcgtacgacgccgagcctga

SEQ ID NO: 116139 - DNA, 25 bp, Homo sapien
cgagcctgacaggaacgcctcgtgc

SEQ ID NO: 116140 - DNA, 25 bp, Homo sapien
tgatgacgtaggctgcgcctgtgca

SEQ ID NO: 116141 - DNA, 25 bp, Homo sapien
ctgcgctccttacgacagcgtacga

SEQ ID NO: 116142 - DNA, 25 bp, Homo sapien
ttggcggaaaggaaaatacagcgga

SEQ ID NO: 116143 - DNA, 25 bp, Homo sapien
tttggagagccctcctcggtcagca

SEQ ID NO: 116144 - DNA, 25 bp, Homo sapien
gtttcaaggcttctccattccaggg

SEQ ID NO: 116145 - DNA, 25 bp, Homo sapien
ttctggtgccatccggagacaaaca

SEQ ID NO: 116146 - DNA, 25 bp, Homo sapien
aggcactctcctgggcaatggattt

SEQ ID NO: 116147 - DNA, 25 bp, Homo sapien
gtggcgtttaatcccaggggcgtca

SEQ ID NO: 116148 - DNA, 25 bp, Homo sapien
caggggcgtcatttccatccagtcc

SEQ ID NO: 116149 - DNA, 25 bp, Homo sapien
tcccacgaaggtgagcaagcagctt

SEQ ID NO: 116150 - DNA, 25 bp, Homo sapien
tgttcccagaatgaagcctccgctc

SEQ ID NO: 116151 - DNA, 25 bp, Homo sapien
gatgccagatcccaccgctaagagc

SEQ ID NO: 116152 - DNA, 25 bp, Homo sapien
ggacccgcacctgtaaggccgacaa

SEQ ID NO: 116153 - DNA, 25 bp, Homo sapien
gtgtctctctcgttccgcctcgatt

SEQ ID NO: 116154 - DNA, 25 bp, Homo sapien
ctggatttcagctgtgccttcaccc

SEQ ID NO: 116155 - DNA, 25 bp, Homo sapien
gtccaagtgacaacgcagcagcctc

SEQ ID NO: 116156 - DNA, 25 bp, Homo sapien
gtgtcctccgttctcgacgaagcta

SEQ ID NO: 116157 - DNA, 25 bp, Homo sapien
gcgggtaatcactcctggctcaaca

SEQ ID NO: 116158 - DNA, 25 bp, Homo sapien
cgcgcaaggagctacttacgttctc

SEQ ID NO: 116159 - DNA, 25 bp, Homo sapien
agcctaggggaacatagctactgtc

SEQ ID NO: 116160 - DNA, 25 bp, Homo sapien
cgcggtgctgaaagggatctcctgt

SEQ ID NO: 116161 - DNA, 25 bp, Homo sapien
ggacggtgtccctaacaccagatta

SEQ ID NO: 116162 - DNA, 25 bp, Homo sapien
tcttcttcgctggtggtgagcatgc

SEQ ID NO: 116163 - DNA, 25 bp, Homo sapien
ctgcatctacactcgcaagggcgtc

SEQ ID NO: 116164 - DNA, 25 bp, Homo sapien
atccggaacctcaaggagctgctgc

SEQ ID NO: 116165 - DNA, 25 bp, Homo sapien
cccacgcctggcaggagctatataa

SEQ ID NO: 116166 - DNA, 25 bp, Homo sapien
ggtcatgtaccgctccaccaagggc

SEQ ID NO: 116167 - DNA, 25 bp, Homo sapien
cgggccgctattccctttcagcaga

SEQ ID NO: 116168 - DNA, 25 bp, Homo sapien
tgagcttccaacacaaacactggcg

SEQ ID NO: 116169 - DNA, 25 bp, Homo sapien
aaccggcctgcatcagctgagcttc

SEQ ID NO: 116170 - DNA, 25 bp, Homo sapien
gactcgctcgttcccggcaatgacg

SEQ ID NO: 116171 - DNA, 25 bp, Homo sapien
cgccggacaagggtccagaacgatc

SEQ ID NO: 116172 - DNA, 25 bp, Homo sapien
tcgggaagtgccctccaaagaaaga

SEQ ID NO: 116173 - DNA, 25 bp, Homo sapien
caaatacggtttgcgcttctggggc

SEQ ID NO: 116174 - DNA, 25 bp, Homo sapien
ggctgcgataccagtctcttggagg

SEQ ID NO: 116175 - DNA, 25 bp, Homo sapien
gaaagccgcctcgtctgtcgactca

SEQ ID NO: 116176 - DNA, 25 bp, Homo sapien
gctgcatgtttttggccgagagaat

SEQ ID NO: 116177 - DNA, 25 bp, Homo sapien
ggttcttacaacaaatcgctgcgca

SEQ ID NO: 116178 - DNA, 25 bp, Homo sapien
tgcgctagcattctgccgggaaagc

SEQ ID NO: 116179 - DNA, 25 bp, Homo sapien
aacaacagttttccacgtgcgcgta

SEQ ID NO: 116180 - DNA, 25 bp, Homo sapien
cccaggcctgtctttgtgagctgac

SEQ ID NO: 116181 - DNA, 25 bp, Homo sapien
gagacagccgcatcacagaatcgtg

SEQ ID NO: 116182 - DNA, 25 bp, Homo sapien
cctcactgaggatgcgccacaggtc

SEQ ID NO: 116183 - DNA, 25 bp, Homo sapien
gcgccggtttctcaacctagttagc

SEQ ID NO: 116184 - DNA, 25 bp, Homo sapien
gaaaactggtctctggaccgcccgc

SEQ ID NO: 116185 - DNA, 25 bp, Homo sapien
gcccaggtcgggctcaaaatgcggc

SEQ ID NO: 116186 - DNA, 25 bp, Homo sapien
tcaacctagttagccagtggcacca

SEQ ID NO: 116187 - DNA, 25 bp, Homo sapien
acatgctcgcgatcacgcaggactc

SEQ ID NO: 116188 - DNA, 25 bp, Homo sapien
cagcccaagagaccaccaagggtcg

SEQ ID NO: 116189 - DNA, 25 bp, Homo sapien
agaccaccaagggtcggcggctacg

SEQ ID NO: 116190 - DNA, 25 bp, Homo sapien
cggcggaaaactggtctctggaccg

SEQ ID NO: 116191 - DNA, 25 bp, Homo sapien
cagaagaatcaaagggcgccaggca

SEQ ID NO: 116192 - DNA, 25 bp, Homo sapien
ctgggaccgctacggaaccgccaga

SEQ ID NO: 116193 - DNA, 25 bp, Homo sapien
gcgcagccgaacagcagaagaatca

SEQ ID NO: 116194 - DNA, 25 bp, Homo sapien
cgccaggcaggacttacatgaggtc

SEQ ID NO: 116195 - DNA, 25 bp, Homo sapien
cgacgtggtcatgttgcagatattc

SEQ ID NO: 116196 - DNA, 25 bp, Homo sapien
agatattcacgtcgcggtagccctc

SEQ ID NO: 116197 - DNA, 25 bp, Homo sapien
caccactgttgcagcgccctgatgg

SEQ ID NO: 116198 - DNA, 25 bp, Homo sapien
ctctggcccagctgcattcggtgtc

SEQ ID NO: 116199 - DNA, 25 bp, Homo sapien
ttcacctgattttcaaagcctgagg

SEQ ID NO: 116200 - DNA, 25 bp, Homo sapien
aagcctgaggtttccgacgtgctgc

SEQ ID NO: 116201 - DNA, 25 bp, Homo sapien
cccattctccaggtggctggatcgc

SEQ ID NO: 116202 - DNA, 25 bp, Homo sapien
tccaggtggctggatcgcgctgcca

SEQ ID NO: 116203 - DNA, 25 bp, Homo sapien
ctgaggtttccgacgtgctgcaccg

SEQ ID NO: 116204 - DNA, 25 bp, Homo sapien
agagtccgctcgtagacgctgtacg

SEQ ID NO: 116205 - DNA, 25 bp, Homo sapien
gagtcttgctctccttgcgcactgg

SEQ ID NO: 116206 - DNA, 25 bp, Homo sapien
gccgactgttcattcacctgatttt

SEQ ID NO: 116207 - DNA, 25 bp, Homo sapien
accagctgcgcgatgccaggattag

SEQ ID NO: 116208 - DNA, 25 bp, Homo sapien
cgccgtatttctcgtgctccgtagg

SEQ ID NO: 116209 - DNA, 25 bp, Homo sapien
gctccgtaggtatccacatggctaa

SEQ ID NO: 116210 - DNA, 25 bp, Homo sapien
cggcggcgcagtcattgttctgatt

SEQ ID NO: 116211 - DNA, 25 bp, Homo sapien
gagttcgcctccagtagcgtttcta

SEQ ID NO: 116212 - DNA, 25 bp, Homo sapien
taatggctgcttccaagacccaggg

SEQ ID NO: 116213 - DNA, 25 bp, Homo sapien
tcgcccgaatgcaggaagaccgtga

SEQ ID NO: 116214 - DNA, 25 bp, Homo sapien
ttaggcattttcaaccgggcggagc

SEQ ID NO: 116215 - DNA, 25 bp, Homo sapien
gcacgcgtccgcctctgaaacactg

SEQ ID NO: 116216 - DNA, 25 bp, Homo sapien
gcggctgcctcagaaacaccgggca

SEQ ID NO: 116217 - DNA, 25 bp, Homo sapien
acgcgtccgcctctgaaacaccggg

SEQ ID NO: 116218 - DNA, 25 bp, Homo sapien
gcatgcgtccgcctctgaaacaccg

SEQ ID NO: 116219 - DNA, 25 bp, Homo sapien
atgcgtccgcctctgaaacaccggg

SEQ ID NO: 116220 - DNA, 25 bp, Homo sapien
accgggcatgcgtccgcctctgaaa

SEQ ID NO: 116221 - DNA, 25 bp, Homo sapien
ggctgcctcagaaacaccgggcacg

SEQ ID NO: 116222 - DNA, 25 bp, Homo sapien
cgccttagagccaccgggcatgcgt

SEQ ID NO: 116223 - DNA, 25 bp, Homo sapien
tttcgatcacagctcttcacgggga

SEQ ID NO: 116224 - DNA, 25 bp, Homo sapien
cccgcgctagagagaaacatgtatc

SEQ ID NO: 116225 - DNA, 25 bp, Homo sapien
ctgttgttagccgaagactcgcctc

SEQ ID NO: 116226 - DNA, 25 bp, Homo sapien
cagagttcctttctcggcggcgatc

SEQ ID NO: 116227 - DNA, 25 bp, Homo sapien
tgctcctcgcgcgatttagatctgg

SEQ ID NO: 116228 - DNA, 25 bp, Homo sapien
ccgccgcttctcgactctgttgtta

SEQ ID NO: 116229 - DNA, 25 bp, Homo sapien
cgtttcccagaattcagtgaggcca

SEQ ID NO: 116230 - DNA, 25 bp, Homo sapien
gggcgtcccacgatgccgaagaaca

SEQ ID NO: 116231 - DNA, 25 bp, Homo sapien
gcccgaggccatacgcgctaataca

SEQ ID NO: 116232 - DNA, 25 bp, Homo sapien
gccagtgtcggcgtaaactttctcc

SEQ ID NO: 116233 - DNA, 25 bp, Homo sapien
tacgcgctaatacaggccagtgtcg

SEQ ID NO: 116234 - DNA, 25 bp, Homo sapien
aactcctccagaggcaggtatccta

SEQ ID NO: 116235 - DNA, 25 bp, Homo sapien
aggcttcagcctgcgactgagaaca

SEQ ID NO: 116236 - DNA, 25 bp, Homo sapien
ggagccctggcagtgtctatgccta

SEQ ID NO: 116237 - DNA, 25 bp, Homo sapien
cgaccacaacgtggcgcccagttga

SEQ ID NO: 116238 - DNA, 25 bp, Homo sapien
ttgcgaaatacggagaggcgctccc

SEQ ID NO: 116239 - DNA, 25 bp, Homo sapien
acgagcagtatttcggccgccggcc

SEQ ID NO: 116240 - DNA, 25 bp, Homo sapien
ggtggaccctcacccaaaagtgcaa

SEQ ID NO: 116241 - DNA, 25 bp, Homo sapien
acgagctgtgagcaacgcgcttgcg

SEQ ID NO: 116242 - DNA, 25 bp, Homo sapien
ggccctctgcgcacgagcagtattt

SEQ ID NO: 116243 - DNA, 25 bp, Homo sapien
tggacgctcttcaccacaccggaga

SEQ ID NO: 116244 - DNA, 25 bp, Homo sapien
cgcgctgtttaccttctcggtactt

SEQ ID NO: 116245 - DNA, 25 bp, Homo sapien
aaactgattggtggattttgagggc

SEQ ID NO: 116246 - DNA, 25 bp, Homo sapien
cagaggaaccggagcgacagccttg

SEQ ID NO: 116247 - DNA, 25 bp, Homo sapien
gagctccgcctacgaaggctgagca

SEQ ID NO: 116248 - DNA, 25 bp, Homo sapien
gagcgtggctgttcgcgctcatccc

SEQ ID NO: 116249 - DNA, 25 bp, Homo sapien
acgaaggctgagcatcgccgcaaga

SEQ ID NO: 116250 - DNA, 25 bp, Homo sapien
atgttttccaaacgggctgcctgcg

SEQ ID NO: 116251 - DNA, 25 bp, Homo sapien
gcaagggagtccctcagacggagtg

SEQ ID NO: 116252 - DNA, 25 bp, Homo sapien
catgtctctgggagaaccccggagt

SEQ ID NO: 116253 - DNA, 25 bp, Homo sapien
ctccagcgccgtgtgagggccctga

SEQ ID NO: 116254 - DNA, 25 bp, Homo sapien
agcatcgccgcaagaggcggagtct

SEQ ID NO: 116255 - DNA, 25 bp, Homo sapien
ttctccagcgggttgtttacatagc

SEQ ID NO: 116256 - DNA, 25 bp, Homo sapien
gtgtgtacagttcgcattgccaaca

SEQ ID NO: 116257 - DNA, 25 bp, Homo sapien
ggccgagctgcgactttactctgct

SEQ ID NO: 116258 - DNA, 25 bp, Homo sapien
cgagcctccgagaaagcgcgagaca

SEQ ID NO: 116259 - DNA, 25 bp, Homo sapien
tctggcgtagcacaaacaagttctc

SEQ ID NO: 116260 - DNA, 25 bp, Homo sapien
ggctccgctgcaaatccgaacaata

SEQ ID NO: 116261 - DNA, 25 bp, Homo sapien
tggtccggcggtacttcagaatcct

SEQ ID NO: 116262 - DNA, 25 bp, Homo sapien
gtcgcggtaagtttcttggccctca

SEQ ID NO: 116263 - DNA, 25 bp, Homo sapien
agttcgaggccttcccgatccggat

SEQ ID NO: 116264 - DNA, 25 bp, Homo sapien
agaagcagtcagttccctgcaccca

SEQ ID NO: 116265 - DNA, 25 bp, Homo sapien
ttgtatatttttccgccagaagcag

SEQ ID NO: 116266 - DNA, 25 bp, Homo sapien
gggtggtgtgctcttctctaaaaac

SEQ ID NO: 116267 - DNA, 25 bp, Homo sapien
gctgtaacagttttcttcgcaagtt

SEQ ID NO: 116268 - DNA, 25 bp, Homo sapien
gccgctgtcaacttgcgctgtaaca

SEQ ID NO: 116269 - DNA, 25 bp, Homo sapien
ctgccggaggctcgctaactttccg

SEQ ID NO: 116270 - DNA, 25 bp, Homo sapien
cccgatccggatgtgatgaaaaaga

SEQ ID NO: 116271 - DNA, 25 bp, Homo sapien
gggacccataggacgcgttaacatg

SEQ ID NO: 116272 - DNA, 25 bp, Homo sapien
aggtcagggtcactgagcttgccca

SEQ ID NO: 116273 - DNA, 25 bp, Homo sapien
ttcccgtgttcgcagcggagccgga

SEQ ID NO: 116274 - DNA, 25 bp, Homo sapien
agagaatcccttcggagaccaggtc

SEQ ID NO: 116275 - DNA, 25 bp, Homo sapien
ggacgcgttaacatggacctggaaa

SEQ ID NO: 116276 - DNA, 25 bp, Homo sapien
acatggacctggaaaacaaagtgaa

SEQ ID NO: 116277 - DNA, 25 bp, Homo sapien
cccacactcgggagcgacagaattg

SEQ ID NO: 116278 - DNA, 25 bp, Homo sapien
gttccgcaggtttcccgtgttcgca

SEQ ID NO: 116279 - DNA, 25 bp, Homo sapien
aaggcggacgtacagctcttcatgg

SEQ ID NO: 116280 - DNA, 25 bp, Homo sapien
tcttagccaggttcctgtgcgccca

SEQ ID NO: 116281 - DNA, 25 bp, Homo sapien
atgtgatcgcagagccggtgactac

SEQ ID NO: 116282 - DNA, 25 bp, Homo sapien
cggctcaactcgcatctcaaggtga

SEQ ID NO: 116283 - DNA, 25 bp, Homo sapien
cgcccgcgtagccaggaattcttag

SEQ ID NO: 116284 - DNA, 25 bp, Homo sapien
cctcagctgggcttcgaggatgtga

SEQ ID NO: 116285 - DNA, 25 bp, Homo sapien
cgcccaccgtgaccctaagagaaga

SEQ ID NO: 116286 - DNA, 25 bp, Homo sapien
agctcttcatggacgacgactccta

SEQ ID NO: 116287 - DNA, 25 bp, Homo sapien
acacgacacggccttcccaggaaca

SEQ ID NO: 116288 - DNA, 25 bp, Homo sapien
ccacatgtgcgtggaacgggacaga

SEQ ID NO: 116289 - DNA, 25 bp, Homo sapien
gcatatctgacacgacacggccttc

SEQ ID NO: 116290 - DNA, 25 bp, Homo sapien
ggagcagcatatctgacacgacacg

SEQ ID NO: 116291 - DNA, 25 bp, Homo sapien
cggcctcaggagcagcatatctgac

SEQ ID NO: 116292 - DNA, 25 bp, Homo sapien
ggttcagacggcttcggcacagggt

SEQ ID NO: 116293 - DNA, 25 bp, Homo sapien
cccgtgggcactcactggagcgggt

SEQ ID NO: 116294 - DNA, 25 bp, Homo sapien
tgggatgagcaccacgctcagcagc

SEQ ID NO: 116295 - DNA, 25 bp, Homo sapien
ctggctccgccaaaaatggggactt

SEQ ID NO: 116296 - DNA, 25 bp, Homo sapien
gggactttcgggattgtgatcatca

SEQ ID NO: 116297 - DNA, 25 bp, Homo sapien
actccttctgcatcttggcgtctgg

SEQ ID NO: 116298 - DNA, 25 bp, Homo sapien
acgcgttttctggatgggtctagga

SEQ ID NO: 116299 - DNA, 25 bp, Homo sapien
cctgagattgggtctgttgggccca

SEQ ID NO: 116300 - DNA, 25 bp, Homo sapien
ccctgagctaggaggacacggaaaa

SEQ ID NO: 116301 - DNA, 25 bp, Homo sapien
acttcggagcactcctctggcgttg

SEQ ID NO: 116302 - DNA, 25 bp, Homo sapien
cggctgctgttggatcttagataaa

SEQ ID NO: 116303 - DNA, 25 bp, Homo sapien
tcccgcttatctccggctgtgctaa

SEQ ID NO: 116304 - DNA, 25 bp, Homo sapien
cgcagccagggcgagaaaacttctc

SEQ ID NO: 116305 - DNA, 25 bp, Homo sapien
cgagaaaacttctccacctagaaag

SEQ ID NO: 116306 - DNA, 25 bp, Homo sapien
gctgtgctaacttcagactgcctga

SEQ ID NO: 116307 - DNA, 25 bp, Homo sapien
tagaaagtttcaccttgtcgtgggc

SEQ ID NO: 116308 - DNA, 25 bp, Homo sapien
agcgcctcagtctggtcgcctggcg

SEQ ID NO: 116309 - DNA, 25 bp, Homo sapien
cagcacgcgaggcagacagacacgt

SEQ ID NO: 116310 - DNA, 25 bp, Homo sapien
atttccctctgggtggtgccagtcc

SEQ ID NO: 116311 - DNA, 25 bp, Homo sapien
gcagttgtctgatgaagagaaggta

SEQ ID NO: 116312 - DNA, 25 bp, Homo sapien
cccatccttactgcgcccagtgcct

SEQ ID NO: 116313 - DNA, 25 bp, Homo sapien
ctgatgaagagaaggtaagagtcgc

SEQ ID NO: 116314 - DNA, 25 bp, Homo sapien
aggagcagttgtctgatgaagagaa

SEQ ID NO: 116315 - DNA, 25 bp, Homo sapien
cgccgcggtttgtcgccagaaggaa

SEQ ID NO: 116316 - DNA, 25 bp, Homo sapien
cgcacgcgcacagccgcgctcagtc

SEQ ID NO: 116317 - DNA, 25 bp, Homo sapien
gctgaggaccgcacggaaacgggga

SEQ ID NO: 116318 - DNA, 25 bp, Homo sapien
ggcattggcccgcagctggccttgc

SEQ ID NO: 116319 - DNA, 25 bp, Homo sapien
cggaggaagagctgcgccgcgcaca

SEQ ID NO: 116320 - DNA, 25 bp, Homo sapien
ctccgtggcccggagttgcgtcttg

SEQ ID NO: 116321 - DNA, 25 bp, Homo sapien
ggagacggagaagaacgggtgtcgc

SEQ ID NO: 116322 - DNA, 25 bp, Homo sapien
gcgggcgaaggagttcccaggacac

SEQ ID NO: 116323 - DNA, 25 bp, Homo sapien
ccctcgggtgtctgcgccggaactc

SEQ ID NO: 116324 - DNA, 25 bp, Homo sapien
tgccaagcggccgaagtgtggtcgg

SEQ ID NO: 116325 - DNA, 25 bp, Homo sapien
agttagaccgagtccttcctcacgc

SEQ ID NO: 116326 - DNA, 25 bp, Homo sapien
cggagttagaccgagtccttcctca

SEQ ID NO: 116327 - DNA, 25 bp, Homo sapien
gcagtatctgccaaagcacccagga

SEQ ID NO: 116328 - DNA, 25 bp, Homo sapien
gcacacgcgaatacaggaaccttta

SEQ ID NO: 116329 - DNA, 25 bp, Homo sapien
caaacaagtccctgagcgtgcaatg

SEQ ID NO: 116330 - DNA, 25 bp, Homo sapien
cctctgcgaaatgacctgttggctt

SEQ ID NO: 116331 - DNA, 25 bp, Homo sapien
gcacccaggaaagatgcagttttta

SEQ ID NO: 116332 - DNA, 25 bp, Homo sapien
gctgcggagcgcaaaagatcacata

SEQ ID NO: 116333 - DNA, 25 bp, Homo sapien
tggcggccgtgaactgttccattgc

SEQ ID NO: 116334 - DNA, 25 bp, Homo sapien
tagccgcgccgtttatcaccggaaa

SEQ ID NO: 116335 - DNA, 25 bp, Homo sapien
agtccaacgtgctgcaggacggctc

SEQ ID NO: 116336 - DNA, 25 bp, Homo sapien
tctcatcgacctgtgtggggccaca

SEQ ID NO: 116337 - DNA, 25 bp, Homo sapien
tgcgggctcccacactgaagcaact

SEQ ID NO: 116338 - DNA, 25 bp, Homo sapien
cccaggagcgcgaatgtcctctctg

SEQ ID NO: 116339 - DNA, 25 bp, Homo sapien
acactgaagcaactggaggcccagc

SEQ ID NO: 116340 - DNA, 25 bp, Homo sapien
aggacggctctctcatcgacctgtg

SEQ ID NO: 116341 - DNA, 25 bp, Homo sapien
gggcacgtccatggctaccacggct

SEQ ID NO: 116342 - DNA, 25 bp, Homo sapien
agcagccctgggtctacgtccgctg

SEQ ID NO: 116343 - DNA, 25 bp, Homo sapien
ctacctgagacgtccggtcgagata

SEQ ID NO: 116344 - DNA, 25 bp, Homo sapien
tggaagcgctccagtctggagccct

SEQ ID NO: 116345 - DNA, 25 bp, Homo sapien
gcccttcagctctccgggcgcatgc

SEQ ID NO: 116346 - DNA, 25 bp, Homo sapien
agccaaggaagctccctgtcggcac

SEQ ID NO: 116347 - DNA, 25 bp, Homo sapien
atgccagccaaggaagctccctgtc

SEQ ID NO: 116348 - DNA, 25 bp, Homo sapien
tcgcagcgcgctcgccgccatgcca

SEQ ID NO: 116349 - DNA, 25 bp, Homo sapien
gacgtccggtcgagatacccaatct

SEQ ID NO: 116350 - DNA, 25 bp, Homo sapien
atcatcctcgctctcgctactctcg

SEQ ID NO: 116351 - DNA, 25 bp, Homo sapien
tcgcactggacgcagacagggagct

SEQ ID NO: 116352 - DNA, 25 bp, Homo sapien
gaggagcgttgcattccgcagaacc

SEQ ID NO: 116353 - DNA, 25 bp, Homo sapien
ggactggggatcaaagaccacggaa

SEQ ID NO: 116354 - DNA, 25 bp, Homo sapien
agaaatgggcgcacgacctggctcc

SEQ ID NO: 116355 - DNA, 25 bp, Homo sapien
cacgcgcgcagcgagaggtgaacaa

SEQ ID NO: 116356 - DNA, 25 bp, Homo sapien
atccgaatgcgagctcggagccgcg

SEQ ID NO: 116357 - DNA, 25 bp, Homo sapien
ggtcaaattcgccaggaaacacgtc

SEQ ID NO: 116358 - DNA, 25 bp, Homo sapien
gggcggcacttaacccgctgctgtc

SEQ ID NO: 116359 - DNA, 25 bp, Homo sapien
gcttttgtcttacgaggcttccgga

SEQ ID NO: 116360 - DNA, 25 bp, Homo sapien
ggccgaacagcatgacgtccgcttt

SEQ ID NO: 116361 - DNA, 25 bp, Homo sapien
ttcagttctgcttgctgtcggcacc

SEQ ID NO: 116362 - DNA, 25 bp, Homo sapien
tcacgatatttgctgcgacccgcag

SEQ ID NO: 116363 - DNA, 25 bp, Homo sapien
ctgcggagcagcaactctcacgata

SEQ ID NO: 116364 - DNA, 25 bp, Homo sapien
ccaatttccgactcacagggctgcg

SEQ ID NO: 116365 - DNA, 25 bp, Homo sapien
tggttggccagttcgtcccaatttc

SEQ ID NO: 116366 - DNA, 25 bp, Homo sapien
gcttccggaacacggcccagaatta

SEQ ID NO: 116367 - DNA, 25 bp, Homo sapien
tcatgacttctgaggcgggcaagga

SEQ ID NO: 116368 - DNA, 25 bp, Homo sapien
gtggattttcccgagctctgtcatg

SEQ ID NO: 116369 - DNA, 25 bp, Homo sapien
ttctacgggagaacaaaccatttca

SEQ ID NO: 116370 - DNA, 25 bp, Homo sapien
cctgctgcttacaaatcatgacttc

SEQ ID NO: 116371 - DNA, 25 bp, Homo sapien
tacactagcgctgggtcaaagaagc

SEQ ID NO: 116372 - DNA, 25 bp, Homo sapien
gagtgcgcctctcctagaatccgtc

SEQ ID NO: 116373 - DNA, 25 bp, Homo sapien
cgcccaactccgtaaatggcaggtt

SEQ ID NO: 116374 - DNA, 25 bp, Homo sapien
ttgactcctaggttgagcccataga

SEQ ID NO: 116375 - DNA, 25 bp, Homo sapien
acgctcgccttgaaccgggactcga

SEQ ID NO: 116376 - DNA, 25 bp, Homo sapien
gctttatttatgctctctcggcgca

SEQ ID NO: 116377 - DNA, 25 bp, Homo sapien
gcgcctggcttttggaaggtgaaaa

SEQ ID NO: 116378 - DNA, 25 bp, Homo sapien
cccgcaccttttgaacttgttgctg

SEQ ID NO: 116379 - DNA, 25 bp, Homo sapien
ttattgatcgcactagcagagcagc

SEQ ID NO: 116380 - DNA, 25 bp, Homo sapien
ggagacgcctttcctaacctgcgtg

SEQ ID NO: 116381 - DNA, 25 bp, Homo sapien
gatgctctccctcggtgacattttg

SEQ ID NO: 116382 - DNA, 25 bp, Homo sapien
gaagcttccctttgttcatccgagg

SEQ ID NO: 116383 - DNA, 25 bp, Homo sapien
tgacgcgtctgtcatggtcccctcg

SEQ ID NO: 116384 - DNA, 25 bp, Homo sapien
gtgacgcgtctgtcatggtcccctc

SEQ ID NO: 116385 - DNA, 25 bp, Homo sapien
gacgcgtctgtcatggtcccctcgg

SEQ ID NO: 116386 - DNA, 25 bp, Homo sapien
cactgtgacgcgtctgtcatggtcc

SEQ ID NO: 116387 - DNA, 25 bp, Homo sapien
tgtgacgcgtctgtcatggtcccct

SEQ ID NO: 116388 - DNA, 25 bp, Homo sapien
ccactgtgacgcgtctgtcatggtc

SEQ ID NO: 116389 - DNA, 25 bp, Homo sapien
actgtgacgcgtctgtcatggtccc

SEQ ID NO: 116390 - DNA, 25 bp, Homo sapien
acgcgtctgtcatggtcccctcggc

SEQ ID NO: 116391 - DNA, 25 bp, Homo sapien
tgtccactgtgacgcgtcggtcact

SEQ ID NO: 116392 - DNA, 25 bp, Homo sapien
cgtgtccactgtgacgcgtcggtca

SEQ ID NO: 116393 - DNA, 25 bp, Homo sapien
cgtatccactgtgaggcgtcggtca

SEQ ID NO: 116394 - DNA, 25 bp, Homo sapien
gcacacgtatccactgtgaggcgtc

SEQ ID NO: 116395 - DNA, 25 bp, Homo sapien
gcacacgtatccactgtgacgcgtc

SEQ ID NO: 116396 - DNA, 25 bp, Homo sapien
acgtatccactgtgacgcgtcggtc

SEQ ID NO: 116397 - DNA, 25 bp, Homo sapien
ccactgtgacgcgtcggtcactgtc

SEQ ID NO: 116398 - DNA, 25 bp, Homo sapien
acgtatccactgtgaggcgtcggtc

SEQ ID NO: 116399 - DNA, 25 bp, Homo sapien
ggacagaaggcagtcccacagcgcc

SEQ ID NO: 116400 - DNA, 25 bp, Homo sapien
aggacagaaggcagtcccacagcgc

SEQ ID NO: 116401 - DNA, 25 bp, Homo sapien
aaggacagaaggcagtcccacagcg

SEQ ID NO: 116402 - DNA, 25 bp, Homo sapien
tgaaggacagaaggcagtcccacag

SEQ ID NO: 116403 - DNA, 25 bp, Homo sapien
atgaaggacagaaggcagtcccaca

SEQ ID NO: 116404 - DNA, 25 bp, Homo sapien
ggatgaaggacagaaggcagtccca

SEQ ID NO: 116405 - DNA, 25 bp, Homo sapien
cgggagcacacaccagcagcaggcg

SEQ ID NO: 116406 - DNA, 25 bp, Homo sapien
cggatgaaggacagaaggcagtccc

SEQ ID NO: 116407 - DNA, 25 bp, Homo sapien
cccagcacgtgcaggaagcagctca

SEQ ID NO: 116408 - DNA, 25 bp, Homo sapien
agcgccgcgatcatgggcaggtgcc

SEQ ID NO: 116409 - DNA, 25 bp, Homo sapien
ggcccagcacgtgcaggaagcagct

SEQ ID NO: 116410 - DNA, 25 bp, Homo sapien
ccagcacgtgcaggaagcagctcag

SEQ ID NO: 116411 - DNA, 25 bp, Homo sapien
agcagctcaggtggttctgctgccg

SEQ ID NO: 116412 - DNA, 25 bp, Homo sapien
actcctggaagttgaggtgggtgcg

SEQ ID NO: 116413 - DNA, 25 bp, Homo sapien
ctgcggaacacgtgcggctgcagca

SEQ ID NO: 116414 - DNA, 25 bp, Homo sapien
ctcgctgcggaacacgtgcggctgc

SEQ ID NO: 116415 - DNA, 25 bp, Homo sapien
tcggcgactgctgttatgaggagta

SEQ ID NO: 116416 - DNA, 25 bp, Homo sapien
acgatggccctggtgttctactatg

SEQ ID NO: 116417 - DNA, 25 bp, Homo sapien
ttctactatgtcacggggtttttca

SEQ ID NO: 116418 - DNA, 25 bp, Homo sapien
tgcagcgcctagtcgttaccgtttt

SEQ ID NO: 116419 - DNA, 25 bp, Homo sapien
ttgagtatttgcttcgcctggctgc

SEQ ID NO: 116420 - DNA, 25 bp, Homo sapien
gctgtggccttcttctgcttggaca

SEQ ID NO: 116421 - DNA, 25 bp, Homo sapien
gcggatcaagcccaggtcacattaa

SEQ ID NO: 116422 - DNA, 25 bp, Homo sapien
gggtttttcattgccgtctctgtca

SEQ ID NO: 116423 - DNA, 25 bp, Homo sapien
tggaaagtctctgctaagccacctc

SEQ ID NO: 116424 - DNA, 25 bp, Homo sapien
ccctgtgcattctgatgagacgctc

SEQ ID NO: 116425 - DNA, 25 bp, Homo sapien
gcccgagagaatgagcgcccttcta

SEQ ID NO: 116426 - DNA, 25 bp, Homo sapien
gcccttctagttaggacagttcctg

SEQ ID NO: 116427 - DNA, 25 bp, Homo sapien
ccgcccggctactagggtttctctg

SEQ ID NO: 116428 - DNA, 25 bp, Homo sapien
taagtagtttagcacacagcgcgga

SEQ ID NO: 116429 - DNA, 25 bp, Homo sapien
ctgcattggcttcagctggagacgc

SEQ ID NO: 116430 - DNA, 25 bp, Homo sapien
cagacgccgggttagtcattcaaac

SEQ ID NO: 116431 - DNA, 25 bp, Homo sapien
cggattctgttacgcactgtttgca

SEQ ID NO: 116432 - DNA, 25 bp, Homo sapien
cggactctccctttgacagtgattg

SEQ ID NO: 116433 - DNA, 25 bp, Homo sapien
atggcgcccggtattcgtagtttct

SEQ ID NO: 116434 - DNA, 25 bp, Homo sapien
tccggcgacagcgagtgacacaaat

SEQ ID NO: 116435 - DNA, 25 bp, Homo sapien
ccgcgatgttgtacctagaagacta

SEQ ID NO: 116436 - DNA, 25 bp, Homo sapien
tttctcacggtaactggcagcctcg

SEQ ID NO: 116437 - DNA, 25 bp, Homo sapien
cgcctcaggcgccaaagtggttttt

SEQ ID NO: 116438 - DNA, 25 bp, Homo sapien
ggccgggctacgtcattgcttgaac

SEQ ID NO: 116439 - DNA, 25 bp, Homo sapien
cgcgtgagcgacctctggccctcac

SEQ ID NO: 116440 - DNA, 25 bp, Homo sapien
tcttgttacagaccgcggaggtgtg

SEQ ID NO: 116441 - DNA, 25 bp, Homo sapien
gttcttgttacagaccgcggaggtg

SEQ ID NO: 116442 - DNA, 25 bp, Homo sapien
gccgccggttcttgttacagaccgc

SEQ ID NO: 116443 - DNA, 25 bp, Homo sapien
tctggccctcacggcgggcgacgaa

SEQ ID NO: 116444 - DNA, 25 bp, Homo sapien
tccaccgttcgctccgccgcatggt

SEQ ID NO: 116445 - DNA, 25 bp, Homo sapien
gacggaaagcatcctccaccgttcg

SEQ ID NO: 116446 - DNA, 25 bp, Homo sapien
ctcgggccgccggttcttgttacag

SEQ ID NO: 116447 - DNA, 25 bp, Homo sapien
ctgccgcatctgctttgatttaacc

SEQ ID NO: 116448 - DNA, 25 bp, Homo sapien
ctgagcaggaccacttgtgcgcttc

SEQ ID NO: 116449 - DNA, 25 bp, Homo sapien
cgtggtcctgtagctctctaagttc

SEQ ID NO: 116450 - DNA, 25 bp, Homo sapien
tccaccggttcctgcaaataaagta

SEQ ID NO: 116451 - DNA, 25 bp, Homo sapien
cctctttggctacgagctgagcagc

SEQ ID NO: 116452 - DNA, 25 bp, Homo sapien
atggaactgcatgatcaccgccgcc

SEQ ID NO: 116453 - DNA, 25 bp, Homo sapien
aggaaaccgtacctgctgccgagca

SEQ ID NO: 116454 - DNA, 25 bp, Homo sapien
gccctttagtgcacggggattgaga

SEQ ID NO: 116455 - DNA, 25 bp, Homo sapien
ccaggcgctgcacaatctgaacttg

SEQ ID NO: 116456 - DNA, 25 bp, Homo sapien
agctctcagcctacacgctgcaggg

SEQ ID NO: 116457 - DNA, 25 bp, Homo sapien
gccacagccaacctggggaagatgc

SEQ ID NO: 116458 - DNA, 25 bp, Homo sapien
gccaacctggggaagatgcgaccca

SEQ ID NO: 116459 - DNA, 25 bp, Homo sapien
gagaaagccagctcgccgctgggcc

SEQ ID NO: 116460 - DNA, 25 bp, Homo sapien
gaaaaatgtgtcaccgccgtctccc

SEQ ID NO: 116461 - DNA, 25 bp, Homo sapien
aacgtccggacacgccgtgacaacg

SEQ ID NO: 116462 - DNA, 25 bp, Homo sapien
atctgaacttgccacgtgggagctg

SEQ ID NO: 116463 - DNA, 25 bp, Homo sapien
atgcgaatcctaaagcgtttcctcg

SEQ ID NO: 116464 - DNA, 25 bp, Homo sapien
cttcgctgctctcggagcgctcaga

SEQ ID NO: 116465 - DNA, 25 bp, Homo sapien
aagaggcaaagtcccgcacgccgga

SEQ ID NO: 116466 - DNA, 25 bp, Homo sapien
cggctttctccagattattcctctc

SEQ ID NO: 116467 - DNA, 25 bp, Homo sapien
gcagaccgtctggaaatgcgaatcc

SEQ ID NO: 116468 - DNA, 25 bp, Homo sapien
cgcttgcattcagctcctctgtgtt

SEQ ID NO: 116469 - DNA, 25 bp, Homo sapien
cgccgccatctagccaggaggaaaa

SEQ ID NO: 116470 - DNA, 25 bp, Homo sapien
cttcgatctatacactggaggatta

SEQ ID NO: 116471 - DNA, 25 bp, Homo sapien
ggggaggctccgaattcctagaaga

SEQ ID NO: 116472 - DNA, 25 bp, Homo sapien
tctcatctgccaatcggcggcgctg

SEQ ID NO: 116473 - DNA, 25 bp, Homo sapien
gctgccagttgctacgtcatgcccg

SEQ ID NO: 116474 - DNA, 25 bp, Homo sapien
ctctgatctctgacctgcgttctta

SEQ ID NO: 116475 - DNA, 25 bp, Homo sapien
acgtcgagttctcccaggataatta

SEQ ID NO: 116476 - DNA, 25 bp, Homo sapien
agtctgggcattacgctctaaatag

SEQ ID NO: 116477 - DNA, 25 bp, Homo sapien
tcgaatcttccgagtcgctgcaggg

SEQ ID NO: 116478 - DNA, 25 bp, Homo sapien
caggtttgtaactgtccgtggcaga

SEQ ID NO: 116479 - DNA, 25 bp, Homo sapien
agatccctggactctgtagaacctg

SEQ ID NO: 116480 - DNA, 25 bp, Homo sapien
tccctgcttcctaggccgttgagaa

SEQ ID NO: 116481 - DNA, 25 bp, Homo sapien
tgagaagcactcaggtcacccactc

SEQ ID NO: 116482 - DNA, 25 bp, Homo sapien
ctctcggtgaccagagcggtcagtc

SEQ ID NO: 116483 - DNA, 25 bp, Homo sapien
ggcgccgcaggactcatagaagtga

SEQ ID NO: 116484 - DNA, 25 bp, Homo sapien
tggattctccgcgacaacagccctg

SEQ ID NO: 116485 - DNA, 25 bp, Homo sapien
tccacaacccggaaggagctcaggc

SEQ ID NO: 116486 - DNA, 25 bp, Homo sapien
cccacaggggctgttagtaatctcc

SEQ ID NO: 116487 - DNA, 25 bp, Homo sapien
taaatacgtttttggctgcgggtgc

SEQ ID NO: 116488 - DNA, 25 bp, Homo sapien
agctggagcagtcgctaacattttg

SEQ ID NO: 116489 - DNA, 25 bp, Homo sapien
gccaagggtttggacgtgctcatca

SEQ ID NO: 116490 - DNA, 25 bp, Homo sapien
ggtgcgcgccatgattcgttcaatg

SEQ ID NO: 116491 - DNA, 25 bp, Homo sapien
ccacaggcacgaaggggatcatgca

SEQ ID NO: 116492 - DNA, 25 bp, Homo sapien
acgcggccttaccagcttgtactgc

SEQ ID NO: 116493 - DNA, 25 bp, Homo sapien
tgtccatgtctgagtcgccagcgtc

SEQ ID NO: 116494 - DNA, 25 bp, Homo sapien
gagtggttgaccacacgcggcctta

SEQ ID NO: 116495 - DNA, 25 bp, Homo sapien
gtgcacttgtgcctcccaaagagcg

SEQ ID NO: 116496 - DNA, 25 bp, Homo sapien
gcgcacgcttccgagtttccattga

SEQ ID NO: 116497 - DNA, 25 bp, Homo sapien
gcagcctggatgtctgtgcgcatca

SEQ ID NO: 116498 - DNA, 25 bp, Homo sapien
gcccgaaccgagtctggaccattta

SEQ ID NO: 116499 - DNA, 25 bp, Homo sapien
cggtgtctgcaagcctcctctaagc

SEQ ID NO: 116500 - DNA, 25 bp, Homo sapien
ctctcccggagcattttaaatactg

SEQ ID NO: 116501 - DNA, 25 bp, Homo sapien
cgccagagttgtgtccacaggtgca

SEQ ID NO: 116502 - DNA, 25 bp, Homo sapien
aaagagcgcgcgtagagaccatttc

SEQ ID NO: 116503 - DNA, 25 bp, Homo sapien
cggtggatgagtccgtccagctgca

SEQ ID NO: 116504 - DNA, 25 bp, Homo sapien
cctcacttgcccacccacactcagc

SEQ ID NO: 116505 - DNA, 25 bp, Homo sapien
caacgcccgggagtcgctggtgtcc

SEQ ID NO: 116506 - DNA, 25 bp, Homo sapien
atgaagcggtggatgagtccgtcca

SEQ ID NO: 116507 - DNA, 25 bp, Homo sapien
agtcgctggtgtccgcaaggagcgt

SEQ ID NO: 116508 - DNA, 25 bp, Homo sapien
tccaacgcccgggagtcgctggtgt

SEQ ID NO: 116509 - DNA, 25 bp, Homo sapien
aagcggtggatgagtccgtccagct

SEQ ID NO: 116510 - DNA, 25 bp, Homo sapien
tgtccgcaaggagcgtgatgaagcg

SEQ ID NO: 116511 - DNA, 25 bp, Homo sapien
caccgagctctgtgagactcccttg

SEQ ID NO: 116512 - DNA, 25 bp, Homo sapien
ggcgccggatctggtttaagagacc

SEQ ID NO: 116513 - DNA, 25 bp, Homo sapien
gccttggccgtctcagccttcatta

SEQ ID NO: 116514 - DNA, 25 bp, Homo sapien
cgcctcattcaggattcggtggcca

SEQ ID NO: 116515 - DNA, 25 bp, Homo sapien
tggccagcgcagagccatttgaata

SEQ ID NO: 116516 - DNA, 25 bp, Homo sapien
aggggtcaggaaacttagctcgaga

SEQ ID NO: 116517 - DNA, 25 bp, Homo sapien
cttgctcacgagttccaaacagtta

SEQ ID NO: 116518 - DNA, 25 bp, Homo sapien
gggctctccacttctcggttcttgc

SEQ ID NO: 116519 - DNA, 25 bp, Homo sapien
cgcggctcttcctcgaaggttactg

SEQ ID NO: 116520 - DNA, 25 bp, Homo sapien
gacggctgagtgacctctttccctc

SEQ ID NO: 116521 - DNA, 25 bp, Homo sapien
agcgcgaacatctctccggaacatc

SEQ ID NO: 116522 - DNA, 25 bp, Homo sapien
ttcgaggatctctgagcaacgacgg

SEQ ID NO: 116523 - DNA, 25 bp, Homo sapien
ggcctccaacttcttcacaaaagtg

SEQ ID NO: 116524 - DNA, 25 bp, Homo sapien
agcgacttcgttttcttgcatagta

SEQ ID NO: 116525 - DNA, 25 bp, Homo sapien
ggacgcgactccatctgtagcaaag

SEQ ID NO: 116526 - DNA, 25 bp, Homo sapien
gcgaccaagctcttgccctaatttc

SEQ ID NO: 116527 - DNA, 25 bp, Homo sapien
cgctggagctggttatcaggttccc

SEQ ID NO: 116528 - DNA, 25 bp, Homo sapien
gcagtttcctacagaaaaccgcacg

SEQ ID NO: 116529 - DNA, 25 bp, Homo sapien
agcgccacggctcttaggcaggcct

SEQ ID NO: 116530 - DNA, 25 bp, Homo sapien
tagccgttcccagcgcagtttccta

SEQ ID NO: 116531 - DNA, 25 bp, Homo sapien
attctacgcggcacaggctgtccga

SEQ ID NO: 116532 - DNA, 25 bp, Homo sapien
cacttttgagtcaccgcgcattcta

SEQ ID NO: 116533 - DNA, 25 bp, Homo sapien
ccctcgcgcttggatgaacgagcgc

SEQ ID NO: 116534 - DNA, 25 bp, Homo sapien
cttgcacattgcacgagccggagcc

SEQ ID NO: 116535 - DNA, 25 bp, Homo sapien
tcaggagtgtttcctaccaccaggg

SEQ ID NO: 116536 - DNA, 25 bp, Homo sapien
tacgcgatgcacctcacgacgaaga

SEQ ID NO: 116537 - DNA, 25 bp, Homo sapien
cgtccgactcctcttcgctggaaga

SEQ ID NO: 116538 - DNA, 25 bp, Homo sapien
ttccggacacgtcgagttagattca

SEQ ID NO: 116539 - DNA, 25 bp, Homo sapien
gggcgcctcaggaattgctccgcca

SEQ ID NO: 116540 - DNA, 25 bp, Homo sapien
aattgaatgttgaagagccgcgcgg

SEQ ID NO: 116541 - DNA, 25 bp, Homo sapien
aaaatacggtgtcctgcgtttcgca

SEQ ID NO: 116542 - DNA, 25 bp, Homo sapien
tggcgcctacaacaagcaacacgtg

SEQ ID NO: 116543 - DNA, 25 bp, Homo sapien
cgagtctactcaacctcgtcttggc

SEQ ID NO: 116544 - DNA, 25 bp, Homo sapien
gagaaaattcaaaacgagtctactc

SEQ ID NO: 116545 - DNA, 25 bp, Homo sapien
ccacaaggcgacatgggaagtccgc

SEQ ID NO: 116546 - DNA, 25 bp, Homo sapien
cgatggcgcgtccttgggctcagca

SEQ ID NO: 116547 - DNA, 25 bp, Homo sapien
gcagacagcgctgccagacctctga

SEQ ID NO: 116548 - DNA, 25 bp, Homo sapien
tgagggaccacacattgggcgctcc

SEQ ID NO: 116549 - DNA, 25 bp, Homo sapien
cgtccggtaggtctgcgcagacagc

SEQ ID NO: 116550 - DNA, 25 bp, Homo sapien
actcaacctcgtcttggctccgagg

SEQ ID NO: 116551 - DNA, 25 bp, Homo sapien
aggaggccgcagtcaaaatctgttc

SEQ ID NO: 116552 - DNA, 25 bp, Homo sapien
gtcaccggctctaggctggatctaa

SEQ ID NO: 116553 - DNA, 25 bp, Homo sapien
aaatctgttctcctacctgtgtacg

SEQ ID NO: 116554 - DNA, 25 bp, Homo sapien
gtcgtatcctagcaacggccctggc

SEQ ID NO: 116555 - DNA, 25 bp, Homo sapien
ctcgtcgaagtgctttcccaggctc

SEQ ID NO: 116556 - DNA, 25 bp, Homo sapien
aggctcctaagacgcagcttccata

SEQ ID NO: 116557 - DNA, 25 bp, Homo sapien
cgcgttctcagctgttggtcgtatc

SEQ ID NO: 116558 - DNA, 25 bp, Homo sapien
cctgtgtacgaaaccaaactattct

SEQ ID NO: 116559 - DNA, 25 bp, Homo sapien
gactcggtgacgcacaaccctttgg

SEQ ID NO: 116560 - DNA, 25 bp, Homo sapien
cccggtaaggcatgcagaacgagtc

SEQ ID NO: 116561 - DNA, 25 bp, Homo sapien
gcccgcgacagtaggggtcaacacc

SEQ ID NO: 116562 - DNA, 25 bp, Homo sapien
caacacccgcgggaagtagggctat

SEQ ID NO: 116563 - DNA, 25 bp, Homo sapien
tagggctatcggactgagtctaccc

SEQ ID NO: 116564 - DNA, 25 bp, Homo sapien
attccaacagtgacctccattcgtc

SEQ ID NO: 116565 - DNA, 25 bp, Homo sapien
ttgggaacaattctcagacctgctc

SEQ ID NO: 116566 - DNA, 25 bp, Homo sapien
agacctgctcaatcgaccaccgagg

SEQ ID NO: 116567 - DNA, 25 bp, Homo sapien
agtcagaggcgccacatctcgcagc

SEQ ID NO: 116568 - DNA, 25 bp, Homo sapien
agtgaagagggactcgttctcctgc

SEQ ID NO: 116569 - DNA, 25 bp, Homo sapien
ctgaccacacatttcttgccgagga

SEQ ID NO: 116570 - DNA, 25 bp, Homo sapien
gggcgcaggcttccaacttcgtact

SEQ ID NO: 116571 - DNA, 25 bp, Homo sapien
aacttcgtactctggcctctggcgt

SEQ ID NO: 116572 - DNA, 25 bp, Homo sapien
gaacccagctactgctgcttgaaga

SEQ ID NO: 116573 - DNA, 25 bp, Homo sapien
cacctttgcgaagcgtcagtgagga

SEQ ID NO: 116574 - DNA, 25 bp, Homo sapien
cgcggagctaagtggaatcccggtt

SEQ ID NO: 116575 - DNA, 25 bp, Homo sapien
gtaccgcaagcgcaggaagcgcttc

SEQ ID NO: 116576 - DNA, 25 bp, Homo sapien
agcgcttcaggaacacttggcagtg

SEQ ID NO: 116577 - DNA, 25 bp, Homo sapien
cttggcagtggtagagcgccagcac

SEQ ID NO: 116578 - DNA, 25 bp, Homo sapien
ggtacaccttctccagggcgaaatg

SEQ ID NO: 116579 - DNA, 25 bp, Homo sapien
agaagcctagcatccgcaggtccgg

SEQ ID NO: 116580 - DNA, 25 bp, Homo sapien
ccagcacgtccagggtgatcccgtg

SEQ ID NO: 116581 - DNA, 25 bp, Homo sapien
tgatcccgtgcatcccgtagaagta

SEQ ID NO: 116582 - DNA, 25 bp, Homo sapien
tcccgtagaagtagaggcgcatcca

SEQ ID NO: 116583 - DNA, 25 bp, Homo sapien
ccacggacagacacatgaccgcgta

SEQ ID NO: 116584 - DNA, 25 bp, Homo sapien
tgccggtcccgaagatcaccacgga

SEQ ID NO: 116585 - DNA, 25 bp, Homo sapien
ccgcgtaggctccataggactcctg

SEQ ID NO: 116586 - DNA, 25 bp, Homo sapien
aaggggttcttcagtctcacacgcc

SEQ ID NO: 116587 - DNA, 25 bp, Homo sapien
ctcacacgccggttcgtgctgtttc

SEQ ID NO: 116588 - DNA, 25 bp, Homo sapien
ggagtgcaattgtccacccttcgtg

SEQ ID NO: 116589 - DNA, 25 bp, Homo sapien
ggctcatggattccttcacccaagg

SEQ ID NO: 116590 - DNA, 25 bp, Homo sapien
caaggatccattctgggccagcgcc

SEQ ID NO: 116591 - DNA, 25 bp, Homo sapien
gtggccttcttggtaacagttgctc

SEQ ID NO: 116592 - DNA, 25 bp, Homo sapien
agccgcagctcctgcttagttagga

SEQ ID NO: 116593 - DNA, 25 bp, Homo sapien
tcagccaagttgagtcccagcaagg

SEQ ID NO: 116594 - DNA, 25 bp, Homo sapien
ccagcaaggtatgccctccaaggtt

SEQ ID NO: 116595 - DNA, 25 bp, Homo sapien
ctgccgaagttgctgctgagagtta

SEQ ID NO: 116596 - DNA, 25 bp, Homo sapien
gcggccactgccaaagttgcttctc

SEQ ID NO: 116597 - DNA, 25 bp, Homo sapien
atccagttgcaagccgaggtctcta

SEQ ID NO: 116598 - DNA, 25 bp, Homo sapien
ctttcgacagcgtttgatccagttg

SEQ ID NO: 116599 - DNA, 25 bp, Homo sapien
tgtgcgagcagagcacccgcaagct

SEQ ID NO: 116600 - DNA, 25 bp, Homo sapien
actcaacgcagacaaacccacaggg

SEQ ID NO: 116601 - DNA, 25 bp, Homo sapien
agctccctcggtataaaactcaacg

SEQ ID NO: 116602 - DNA, 25 bp, Homo sapien
cacgactctccagactgtgcgagca

SEQ ID NO: 116603 - DNA, 25 bp, Homo sapien
aacggccgatccacacaatggcagg

SEQ ID NO: 116604 - DNA, 25 bp, Homo sapien
tgaacagataaaccaacggccgatc

SEQ ID NO: 116605 - DNA, 25 bp, Homo sapien
ccaccagcaggtgaacagataaacc

SEQ ID NO: 116606 - DNA, 25 bp, Homo sapien
ccaccagggtcactggagaggagca

SEQ ID NO: 116607 - DNA, 25 bp, Homo sapien
gcaggtgacgtcacacgcacgctga

SEQ ID NO: 116608 - DNA, 25 bp, Homo sapien
gatccctgggcatagtcgcttgttc

SEQ ID NO: 116609 - DNA, 25 bp, Homo sapien
tgactttccagctttcgtggcggga

SEQ ID NO: 116610 - DNA, 25 bp, Homo sapien
cgaaatactgacaggatgcgacgtc

SEQ ID NO: 116611 - DNA, 25 bp, Homo sapien
ttcacacactgatggcgcctggagg

SEQ ID NO: 116612 - DNA, 25 bp, Homo sapien
gaccagctgcgtaacggttcacaca

SEQ ID NO: 116613 - DNA, 25 bp, Homo sapien
tccacgcatgcgtgcaggatccctg

SEQ ID NO: 116614 - DNA, 25 bp, Homo sapien
cgctgacggttcagctccacgcatg

SEQ ID NO: 116615 - DNA, 25 bp, Homo sapien
ggttcccacctgcaagagtgctgtc

SEQ ID NO: 116616 - DNA, 25 bp, Homo sapien
ggggaccaaggcgaatccatactga

SEQ ID NO: 116617 - DNA, 25 bp, Homo sapien
cttttggggtcaaagcgtgtcatcc

SEQ ID NO: 116618 - DNA, 25 bp, Homo sapien
agaagctcgtcttggcgcgtctatt

SEQ ID NO: 116619 - DNA, 25 bp, Homo sapien
ccggcaccgagagctttgcaacttc

SEQ ID NO: 116620 - DNA, 25 bp, Homo sapien
cagtgaagcagtcgaggcgtttctc

SEQ ID NO: 116621 - DNA, 25 bp, Homo sapien
cgggaatgtttagcggctccttcca

SEQ ID NO: 116622 - DNA, 25 bp, Homo sapien
gtctattggctggtactgacgccca

SEQ ID NO: 116623 - DNA, 25 bp, Homo sapien
gggccatctacttgtgctcaggaaa

SEQ ID NO: 116624 - DNA, 25 bp, Homo sapien
gcgccaagtctcttccatgtgaata

SEQ ID NO: 116625 - DNA, 25 bp, Homo sapien
ttcggcacttgctttcctcggagcc

SEQ ID NO: 116626 - DNA, 25 bp, Homo sapien
cctggctgtccgctgaaaggtttta

SEQ ID NO: 116627 - DNA, 25 bp, Homo sapien
gactacggacatgcagggccatcta

SEQ ID NO: 116628 - DNA, 25 bp, Homo sapien
gggatcacatctccaagccttggga

SEQ ID NO: 116629 - DNA, 25 bp, Homo sapien
cttttccaacaagcagggcgttttg

SEQ ID NO: 116630 - DNA, 25 bp, Homo sapien
gggatcgccaatcgcttcgcgccaa

SEQ ID NO: 116631 - DNA, 25 bp, Homo sapien
aagagctgcagacccacgggcagtg

SEQ ID NO: 116632 - DNA, 25 bp, Homo sapien
ttctggctcaaaccagggacggcga

SEQ ID NO: 116633 - DNA, 25 bp, Homo sapien
ttcgcgggagagttctggctcaaac

SEQ ID NO: 116634 - DNA, 25 bp, Homo sapien
cacgtggtcctctagagggcttcgc

SEQ ID NO: 116635 - DNA, 25 bp, Homo sapien
tgtccctaaggcacgtggtcctcta

SEQ ID NO: 116636 - DNA, 25 bp, Homo sapien
accaaggaaagagcgccgacgcctc

SEQ ID NO: 116637 - DNA, 25 bp, Homo sapien
tgctgctctgcgaacaaccacgact

SEQ ID NO: 116638 - DNA, 25 bp, Homo sapien
agacaaagatatgcgggttagaaac

SEQ ID NO: 116639 - DNA, 25 bp, Homo sapien
agcagagactctccggcagcgacag

SEQ ID NO: 116640 - DNA, 25 bp, Homo sapien
ctacgcacgtgcgttggggtctccc

SEQ ID NO: 116641 - DNA, 25 bp, Homo sapien
caacggtccctcaggctttaggaga

SEQ ID NO: 116642 - DNA, 25 bp, Homo sapien
cagcgacagggagcgactgactgac

SEQ ID NO: 116643 - DNA, 25 bp, Homo sapien
agtcagcctctcttttactctgtcg

SEQ ID NO: 116644 - DNA, 25 bp, Homo sapien
cgagggcaggaagtgacaagctcac

SEQ ID NO: 116645 - DNA, 25 bp, Homo sapien
caggaaactttattaagtcagcctc

SEQ ID NO: 116646 - DNA, 25 bp, Homo sapien
cttactcaactcttagggcgggccg

SEQ ID NO: 116647 - DNA, 25 bp, Homo sapien
aacacccaggtgaacgacgcatcca

SEQ ID NO: 116648 - DNA, 25 bp, Homo sapien
tatcccggacctaatgcggaacggc

SEQ ID NO: 116649 - DNA, 25 bp, Homo sapien
gttacgctgagctcggtcccatcac

SEQ ID NO: 116650 - DNA, 25 bp, Homo sapien
aactaaagctgcctgccgacaacgg

SEQ ID NO: 116651 - DNA, 25 bp, Homo sapien
ccgcgagcggcaaaaaacaggcttg

SEQ ID NO: 116652 - DNA, 25 bp, Homo sapien
gcaccggttttgtgagagcgcccaa

SEQ ID NO: 116653 - DNA, 25 bp, Homo sapien
cgtcgcactgcattcttaccaaaca

SEQ ID NO: 116654 - DNA, 25 bp, Homo sapien
cttctccatggagggtctgaacgga

SEQ ID NO: 116655 - DNA, 25 bp, Homo sapien
ttcagtgctactggttcccaagggc

SEQ ID NO: 116656 - DNA, 25 bp, Homo sapien
ctcttttcgcggatcttcgggaaga

SEQ ID NO: 116657 - DNA, 25 bp, Homo sapien
gcgcgttagagacctagacccgttc

SEQ ID NO: 116658 - DNA, 25 bp, Homo sapien
taggggcctggacgcaacaaaccaa

SEQ ID NO: 116659 - DNA, 25 bp, Homo sapien
aggattccgcccttggagacgactt

SEQ ID NO: 116660 - DNA, 25 bp, Homo sapien
tactacgcgcaagtccctcggtgga

SEQ ID NO: 116661 - DNA, 25 bp, Homo sapien
tgaggaaccatggaagctagctagc

SEQ ID NO: 116662 - DNA, 25 bp, Homo sapien
cgctgcggagcgatgaatcctttcc

SEQ ID NO: 116663 - DNA, 25 bp, Homo sapien
tcatcaagatggtgagaacgggccc

SEQ ID NO: 116664 - DNA, 25 bp, Homo sapien
gagatcgcgtctctttcgctccgtg

SEQ ID NO: 116665 - DNA, 25 bp, Homo sapien
cttcctggaactcaccaccgttttg

SEQ ID NO: 116666 - DNA, 25 bp, Homo sapien
tgcaaatcaactctttcagcgcttc

SEQ ID NO: 116667 - DNA, 25 bp, Homo sapien
cctaggtgggtatacaagtgtgcgc

SEQ ID NO: 116668 - DNA, 25 bp, Homo sapien
gtacggagattcctccaggactctg

SEQ ID NO: 116669 - DNA, 25 bp, Homo sapien
tcggtaggaggttccacaaagctct

SEQ ID NO: 116670 - DNA, 25 bp, Homo sapien
tggcaggtcaaagcccacatcggta

SEQ ID NO: 116671 - DNA, 25 bp, Homo sapien
gtactgctgacgcatactgttctgg

SEQ ID NO: 116672 - DNA, 25 bp, Homo sapien
ttcagtcagaacgtgaatgtactgc

SEQ ID NO: 116673 - DNA, 25 bp, Homo sapien
gtcgcaggcgttcgcagctattttg

SEQ ID NO: 116674 - DNA, 25 bp, Homo sapien
tgctcttatgtattagcgccgctcc

SEQ ID NO: 116675 - DNA, 25 bp, Homo sapien
ctcatccttttgtccttcagtcaga

SEQ ID NO: 116676 - DNA, 25 bp, Homo sapien
cgcagactgctctctcatccttttg

SEQ ID NO: 116677 - DNA, 25 bp, Homo sapien
ggtcagttctccagtccgccggctg

SEQ ID NO: 116678 - DNA, 25 bp, Homo sapien
agattagcgtgatgcagtgctctta

SEQ ID NO: 116679 - DNA, 25 bp, Homo sapien
tcaagagcccgaccgcgcggctgaa

SEQ ID NO: 116680 - DNA, 25 bp, Homo sapien
tcgacgcatacactcaagagcccga

SEQ ID NO: 116681 - DNA, 25 bp, Homo sapien
ccgcgcggctgaaatcgcggagctc

SEQ ID NO: 116682 - DNA, 25 bp, Homo sapien
ctgcagctggagatggcagcaatcc

SEQ ID NO: 116683 - DNA, 25 bp, Homo sapien
agatggcagcaatcccgggaggtct

SEQ ID NO: 116684 - DNA, 25 bp, Homo sapien
tctccgggcctcttcagggtgcgtc

SEQ ID NO: 116685 - DNA, 25 bp, Homo sapien
cctcttcagggtgcgtccaggaggc

SEQ ID NO: 116686 - DNA, 25 bp, Homo sapien
ccacgagaccgcttaacttcgcggg

SEQ ID NO: 116687 - DNA, 25 bp, Homo sapien
gtggagggccaatctggatgtgcaa

SEQ ID NO: 116688 - DNA, 25 bp, Homo sapien
ggtgccacccagtcagatctgcctg

SEQ ID NO: 116689 - DNA, 25 bp, Homo sapien
agtgcctctccatagccatcaccaa

SEQ ID NO: 116690 - DNA, 25 bp, Homo sapien
aagccagagatggagggagtctgct

SEQ ID NO: 116691 - DNA, 25 bp, Homo sapien
cacccagtcagatctgcctgcaggg

SEQ ID NO: 116692 - DNA, 25 bp, Homo sapien
ctgctggtgccacccagtcagatct

SEQ ID NO: 116693 - DNA, 25 bp, Homo sapien
gctggtgccacccagtcagatctgc

SEQ ID NO: 116694 - DNA, 25 bp, Homo sapien
tggtgccacccagtcagatctgcct

SEQ ID NO: 116695 - DNA, 25 bp, Homo sapien
tctgtaacgggtgcctgcatcagcc

SEQ ID NO: 116696 - DNA, 25 bp, Homo sapien
ccgcttctgtaacgggtgcctgcat

SEQ ID NO: 116697 - DNA, 25 bp, Homo sapien
ttctgtaacgggtgcctgcatcagc

SEQ ID NO: 116698 - DNA, 25 bp, Homo sapien
gggtgcctgcatcagccccggagca

SEQ ID NO: 116699 - DNA, 25 bp, Homo sapien
cttctgtaacgggtgcctgcatcag

SEQ ID NO: 116700 - DNA, 25 bp, Homo sapien
ccgccgcttctgtaacgggtgcctg

SEQ ID NO: 116701 - DNA, 25 bp, Homo sapien
ccgcctcggccaggatcagctccac

SEQ ID NO: 116702 - DNA, 25 bp, Homo sapien
gccgcttctgtaacgggtgcctgca

SEQ ID NO: 116703 - DNA, 25 bp, Homo sapien
cccgggacttcctcgccgcagtgcc

SEQ ID NO: 116704 - DNA, 25 bp, Homo sapien
ggtcgccaggacaactacgcggtcc

SEQ ID NO: 116705 - DNA, 25 bp, Homo sapien
cgagggcgacactaggccgctgccc

SEQ ID NO: 116706 - DNA, 25 bp, Homo sapien
tcgggtcctcccgagccaggggaca

SEQ ID NO: 116707 - DNA, 25 bp, Homo sapien
agcttcgcggggatcctgctggact

SEQ ID NO: 116708 - DNA, 25 bp, Homo sapien
gggatcctgctggactgcacgaaaa

SEQ ID NO: 116709 - DNA, 25 bp, Homo sapien
tgctggactgcacgaaaaagtgagc

SEQ ID NO: 116710 - DNA, 25 bp, Homo sapien
tgcaagtccggctcagaagcccggc

SEQ ID NO: 116711 - DNA, 25 bp, Homo sapien
ccggccgccgatacctggtaatagg

SEQ ID NO: 116712 - DNA, 25 bp, Homo sapien
ttcagatgatccatgcgcttgtgca

SEQ ID NO: 116713 - DNA, 25 bp, Homo sapien
gcgatgctgttaattgccttgagtt

SEQ ID NO: 116714 - DNA, 25 bp, Homo sapien
ccgccaaagttggtgcttgtccttc

SEQ ID NO: 116715 - DNA, 25 bp, Homo sapien
tgcgagccggggtatttgctaaaaa

SEQ ID NO: 116716 - DNA, 25 bp, Homo sapien
gagcggggcagtttcatagtttaga

SEQ ID NO: 116717 - DNA, 25 bp, Homo sapien
aaggcgacgtagtttccctggagcg

SEQ ID NO: 116718 - DNA, 25 bp, Homo sapien
ctccagatcgcagtggtgcttcttc

SEQ ID NO: 116719 - DNA, 25 bp, Homo sapien
cacgcggcgagttgatctggccaac

SEQ ID NO: 116720 - DNA, 25 bp, Homo sapien
atggcctggacacccagctgtcgga

SEQ ID NO: 116721 - DNA, 25 bp, Homo sapien
gccggaggactaggccgcttccgta

SEQ ID NO: 116722 - DNA, 25 bp, Homo sapien
ccgcttccgtattggggcggagata

SEQ ID NO: 116723 - DNA, 25 bp, Homo sapien
agcgctcagactctcagggaacggc

SEQ ID NO: 116724 - DNA, 25 bp, Homo sapien
atctggccaacggaccagcagtgga

SEQ ID NO: 116725 - DNA, 25 bp, Homo sapien
catcacgccacggatgctgggatcc

SEQ ID NO: 116726 - DNA, 25 bp, Homo sapien
gtctgctacggccaatagaagctcg

SEQ ID NO: 116727 - DNA, 25 bp, Homo sapien
cagatcccagagaacgtcctaccta

SEQ ID NO: 116728 - DNA, 25 bp, Homo sapien
ggccgcctatttggggaataaatga

SEQ ID NO: 116729 - DNA, 25 bp, Homo sapien
caggcgctctgatgctgacatatta

SEQ ID NO: 116730 - DNA, 25 bp, Homo sapien
gcatcgcgacgttagaggtttccca

SEQ ID NO: 116731 - DNA, 25 bp, Homo sapien
tgagctatgtaagccctgccgcatc

SEQ ID NO: 116732 - DNA, 25 bp, Homo sapien
agaggtgggctttgcctctgaagca

SEQ ID NO: 116733 - DNA, 25 bp, Homo sapien
ccgagccaagtggaaggcttgtcca

SEQ ID NO: 116734 - DNA, 25 bp, Homo sapien
gtcctacctagtgcccgtttctaca

SEQ ID NO: 116735 - DNA, 25 bp, Homo sapien
gccgagttagctgcagggttacaaa

SEQ ID NO: 116736 - DNA, 25 bp, Homo sapien
cccggcctgaattaatgtgttacta

SEQ ID NO: 116737 - DNA, 25 bp, Homo sapien
tatttcgggcgagccagtgtttcca

SEQ ID NO: 116738 - DNA, 25 bp, Homo sapien
tttccaggggaaacctaatgacgca

SEQ ID NO: 116739 - DNA, 25 bp, Homo sapien
ccacctttatccaggggcagccaga

SEQ ID NO: 116740 - DNA, 25 bp, Homo sapien
gcaccttcctggtctcgggctagaa

SEQ ID NO: 116741 - DNA, 25 bp, Homo sapien
cgggctagaactggggcttcccatc

SEQ ID NO: 116742 - DNA, 25 bp, Homo sapien
tctctgccgggttctatattttgcc

SEQ ID NO: 116743 - DNA, 25 bp, Homo sapien
gggtctccgacatctgtttattacg

SEQ ID NO: 116744 - DNA, 25 bp, Homo sapien
atcgttgtcattatcaagtcctaca

SEQ ID NO: 116745 - DNA, 25 bp, Homo sapien
tcctcttggagttcccggctcaggg

SEQ ID NO: 116746 - DNA, 25 bp, Homo sapien
tgcccttcacagatcgttgtcatta

SEQ ID NO: 116747 - DNA, 25 bp, Homo sapien
aagtcctacactttgagagcagaaa

SEQ ID NO: 116748 - DNA, 25 bp, Homo sapien
tttattacgttggaccgcatgctgc

SEQ ID NO: 116749 - DNA, 25 bp, Homo sapien
ccgcatgctgcatatgatccagcca

SEQ ID NO: 116750 - DNA, 25 bp, Homo sapien
cccgtacgtggtgggtctccgacat

SEQ ID NO: 116751 - DNA, 25 bp, Homo sapien
caggaccaacgagggcgcagccgta

SEQ ID NO: 116752 - DNA, 25 bp, Homo sapien
gcggctcgaagcaccttcccaaggg

SEQ ID NO: 116753 - DNA, 25 bp, Homo sapien
cccaaggggctggtccttgcgccat

SEQ ID NO: 116754 - DNA, 25 bp, Homo sapien
ttgcgccatagtcgcgccggagcct

SEQ ID NO: 116755 - DNA, 25 bp, Homo sapien
cctctggagggacatcaaggatttc

SEQ ID NO: 116756 - DNA, 25 bp, Homo sapien
gggacatcaaggatttctcgctcct

SEQ ID NO: 116757 - DNA, 25 bp, Homo sapien
gaatcgcagcgccagcggttgcaag

SEQ ID NO: 116758 - DNA, 25 bp, Homo sapien
gcaagttgtgatcgggccgctataa

SEQ ID NO: 116759 - DNA, 25 bp, Homo sapien
gtgggtctccaatacgcgcttgcca

SEQ ID NO: 116760 - DNA, 25 bp, Homo sapien
agaggcagtgtgttcccgctctgcc

SEQ ID NO: 116761 - DNA, 25 bp, Homo sapien
ctgcctcaccgggaaaccgctaggg

SEQ ID NO: 116762 - DNA, 25 bp, Homo sapien
ctggatgtggaaagcgccctccacc

SEQ ID NO: 116763 - DNA, 25 bp, Homo sapien
cttcgtaggcttccaccgtcaggcg

SEQ ID NO: 116764 - DNA, 25 bp, Homo sapien
tgaaccacggtttgtgcccagcgcc

SEQ ID NO: 116765 - DNA, 25 bp, Homo sapien
ctcgcggctcttcacgcggctgaaa

SEQ ID NO: 116766 - DNA, 25 bp, Homo sapien
cgcgcttgccagtcctttaagctga

SEQ ID NO: 116767 - DNA, 25 bp, Homo sapien
ggaatgaaacgatgcgcgccaggtc

SEQ ID NO: 116768 - DNA, 25 bp, Homo sapien
cagtacaggaaatgtcttcacgatc

SEQ ID NO: 116769 - DNA, 25 bp, Homo sapien
aaccgctgagctgctcgggtgcctt

SEQ ID NO: 116770 - DNA, 25 bp, Homo sapien
actcgagtcctctggaaaccgctga

SEQ ID NO: 116771 - DNA, 25 bp, Homo sapien
ctctctcacaaggagtcgagtcgga

SEQ ID NO: 116772 - DNA, 25 bp, Homo sapien
gtccgcccagtgtctcccagaaaag

SEQ ID NO: 116773 - DNA, 25 bp, Homo sapien
gagccacaaactgccgcggtcggtg

SEQ ID NO: 116774 - DNA, 25 bp, Homo sapien
aaggggagtcggaatctctctcaca

SEQ ID NO: 116775 - DNA, 25 bp, Homo sapien
gaggcggcccacaaataaggtcagg

SEQ ID NO: 116776 - DNA, 25 bp, Homo sapien
tcgttgcccaaaagagaccggagga

SEQ ID NO: 116777 - DNA, 25 bp, Homo sapien
agattccggaagtgctcgttgccca

SEQ ID NO: 116778 - DNA, 25 bp, Homo sapien
ttcagtcaccacgaagcactgcttc

SEQ ID NO: 116779 - DNA, 25 bp, Homo sapien
ccgaaacgctggctttggtaggaca

SEQ ID NO: 116780 - DNA, 25 bp, Homo sapien
gccggccatgagaccgggaaaccca

SEQ ID NO: 116781 - DNA, 25 bp, Homo sapien
agctcacacgccgagagattccgga

SEQ ID NO: 116782 - DNA, 25 bp, Homo sapien
ggtaggacaaccaagctcacacgcc

SEQ ID NO: 116783 - DNA, 25 bp, Homo sapien
aagtccacggtgtaatcgctgcagg

SEQ ID NO: 116784 - DNA, 25 bp, Homo sapien
cttccaggccggattggccgccgta

SEQ ID NO: 116785 - DNA, 25 bp, Homo sapien
agggcctcctcgatgctgcgtcgca

SEQ ID NO: 116786 - DNA, 25 bp, Homo sapien
ggctccgctcagcagcccgaaggtg

SEQ ID NO: 116787 - DNA, 25 bp, Homo sapien
gtgcagcacctcatagccctgcagg

SEQ ID NO: 116788 - DNA, 25 bp, Homo sapien
gcctagctggaaggcccaccagggc

SEQ ID NO: 116789 - DNA, 25 bp, Homo sapien
acaagcggaagagcttggcccagca

SEQ ID NO: 116790 - DNA, 25 bp, Homo sapien
caggcgcaagcagggcctcgctgca

SEQ ID NO: 116791 - DNA, 25 bp, Homo sapien
cccgactgaagatccggacctccag

SEQ ID NO: 116792 - DNA, 25 bp, Homo sapien
tggcgcccagctgggcaacgcttcg

SEQ ID NO: 116793 - DNA, 25 bp, Homo sapien
gcctggcgagagcaatcacacactc

SEQ ID NO: 116794 - DNA, 25 bp, Homo sapien
gagcaatcacacactcccagggcgg

SEQ ID NO: 116795 - DNA, 25 bp, Homo sapien
ccaggaaacacactcgcaggtcaga

SEQ ID NO: 116796 - DNA, 25 bp, Homo sapien
ctgggcaacgcttcgtggtatctca

SEQ ID NO: 116797 - DNA, 25 bp, Homo sapien
ttcgtggtatctcaccgcttctctc

SEQ ID NO: 116798 - DNA, 25 bp, Homo sapien
ctcgccgagcctccgaaaaggggcg

SEQ ID NO: 116799 - DNA, 25 bp, Homo sapien
atgcgcgcacctaggggtacgagac

SEQ ID NO: 116800 - DNA, 25 bp, Homo sapien
ccctccatgccgctgagaggaggaa

SEQ ID NO: 116801 - DNA, 25 bp, Homo sapien
ggacaggccgaacccggatctggcc

SEQ ID NO: 116802 - DNA, 25 bp, Homo sapien
ccgaacccggatctggccagaaacg

SEQ ID NO: 116803 - DNA, 25 bp, Homo sapien
tctggccagaaacgggtcagggctc

SEQ ID NO: 116804 - DNA, 25 bp, Homo sapien
acagcaggcactcgcaccgggcagg

SEQ ID NO: 116805 - DNA, 25 bp, Homo sapien
acccggcgcttacttgtaggtgagg

SEQ ID NO: 116806 - DNA, 25 bp, Homo sapien
cgagacccggcgcttacttgtaggt

SEQ ID NO: 116807 - DNA, 25 bp, Homo sapien
atttagtgcgaattcgatctggggc

SEQ ID NO: 116808 - DNA, 25 bp, Homo sapien
ttagtgcgaattcgatctggggctg

SEQ ID NO: 116809 - DNA, 25 bp, Homo sapien
tgtccgagagcgtgccgagcggagc

SEQ ID NO: 116810 - DNA, 25 bp, Homo sapien
ccaggagcccgatcgagatgatgat

SEQ ID NO: 116811 - DNA, 25 bp, Homo sapien
agcccgatcgagatgatgatggtta

SEQ ID NO: 116812 - DNA, 25 bp, Homo sapien
ccgatcgagatgatgatggttatgc

SEQ ID NO: 116813 - DNA, 25 bp, Homo sapien
agatgatgatggttatgcagcccga

SEQ ID NO: 116814 - DNA, 25 bp, Homo sapien
tgatggttatgcagcccgagggtct

SEQ ID NO: 116815 - DNA, 25 bp, Homo sapien
caggccaggaagtggctacggtgca

SEQ ID NO: 116816 - DNA, 25 bp, Homo sapien
gtcccatcgtgtccctgttcattcg

SEQ ID NO: 116817 - DNA, 25 bp, Homo sapien
ccaagtacctggtactggcagagct

SEQ ID NO: 116818 - DNA, 25 bp, Homo sapien
cgggctgagcgggaaaatctggaac

SEQ ID NO: 116819 - DNA, 25 bp, Homo sapien
gaggcccacgcccaagtacctggta

SEQ ID NO: 116820 - DNA, 25 bp, Homo sapien
gcgtcccatcgtgtccctgttcatt

SEQ ID NO: 116821 - DNA, 25 bp, Homo sapien
aggacacgcaccgtgatgcccggca

SEQ ID NO: 116822 - DNA, 25 bp, Homo sapien
gtgcagctccgtgccagaaccgcgt

SEQ ID NO: 116823 - DNA, 25 bp, Homo sapien
gtgcaacgaagcacctaacccttcg

SEQ ID NO: 116824 - DNA, 25 bp, Homo sapien
tcagccgactccacgttagagagcg

SEQ ID NO: 116825 - DNA, 25 bp, Homo sapien
ctcttgcacgccgacgatgccaggt

SEQ ID NO: 116826 - DNA, 25 bp, Homo sapien
gactccagaggcagggcttctcctt

SEQ ID NO: 116827 - DNA, 25 bp, Homo sapien
ccagaagaggaaaggagctggactc

SEQ ID NO: 116828 - DNA, 25 bp, Homo sapien
atcccagattcagcgagggtacatc

SEQ ID NO: 116829 - DNA, 25 bp, Homo sapien
ctacgcagatgcctagactcggttc

SEQ ID NO: 116830 - DNA, 25 bp, Homo sapien
agcgaggtccaatctagggctaaga

SEQ ID NO: 116831 - DNA, 25 bp, Homo sapien
gtgcgccgccgggatcctctctgat

SEQ ID NO: 116832 - DNA, 25 bp, Homo sapien
acggcgcttttgtctccggtgagtt

SEQ ID NO: 116833 - DNA, 25 bp, Homo sapien
caatgactcaaaaccgcacgacgtg

SEQ ID NO: 116834 - DNA, 25 bp, Homo sapien
gagattaatacacacgcctcgtctc

SEQ ID NO: 116835 - DNA, 25 bp, Homo sapien
cgctggtgcttagtaaccgactttc

SEQ ID NO: 116836 - DNA, 25 bp, Homo sapien
catcgctagagtgctcgccgcgcta

SEQ ID NO: 116837 - DNA, 25 bp, Homo sapien
gcgctagcagcctcgcgttccaggg

SEQ ID NO: 116838 - DNA, 25 bp, Homo sapien
ttttgtggcgggaagcttctgcgct

SEQ ID NO: 116839 - DNA, 25 bp, Homo sapien
gcctgaccttccctggcgtcgcggc

SEQ ID NO: 116840 - DNA, 25 bp, Homo sapien
gggccgcctgaccttccctggcgtc

SEQ ID NO: 116841 - DNA, 25 bp, Homo sapien
ggccgcctgaccttccctggcgtcg

SEQ ID NO: 116842 - DNA, 25 bp, Homo sapien
gccgcctgaccttccctggcgtcgc

SEQ ID NO: 116843 - DNA, 25 bp, Homo sapien
ccgcctgaccttccctggcgtcgcg

SEQ ID NO: 116844 - DNA, 25 bp, Homo sapien
cgggccgcctgaccttccctggcgt

SEQ ID NO: 116845 - DNA, 25 bp, Homo sapien
ctgaccttccctggcgtcgcggccc

SEQ ID NO: 116846 - DNA, 25 bp, Homo sapien
cttccctggcgtcgcggcccgtccg

SEQ ID NO: 116847 - DNA, 25 bp, Homo sapien
ttcaccactgcctcatctttattcg

SEQ ID NO: 116848 - DNA, 25 bp, Homo sapien
cccggctatgcgattgttagaccaa

SEQ ID NO: 116849 - DNA, 25 bp, Homo sapien
ttagaccaatggctactcggggacg

SEQ ID NO: 116850 - DNA, 25 bp, Homo sapien
aggtaagtacggtgatgcccagccc

SEQ ID NO: 116851 - DNA, 25 bp, Homo sapien
ctgatgctgctggagatcccgggac

SEQ ID NO: 116852 - DNA, 25 bp, Homo sapien
ggaccctctgtgtgcagcctgggat

SEQ ID NO: 116853 - DNA, 25 bp, Homo sapien
ggacgtggcgctttccagccaatcc

SEQ ID NO: 116854 - DNA, 25 bp, Homo sapien
gctactcggggacgctatgcgacag

SEQ ID NO: 116855 - DNA, 25 bp, Homo sapien
agcctaggagctcctgacgctgtcc

SEQ ID NO: 116856 - DNA, 25 bp, Homo sapien
ttggaggaaacagtcccacctcgtc

SEQ ID NO: 116857 - DNA, 25 bp, Homo sapien
ccattgctgagcatgaccgggccct

SEQ ID NO: 116858 - DNA, 25 bp, Homo sapien
tggggcagccataagcctaggagct

SEQ ID NO: 116859 - DNA, 25 bp, Homo sapien
cccgcgctctctaggggagagcctt

SEQ ID NO: 116860 - DNA, 25 bp, Homo sapien
agcgcgtctctccacttcagtccga

SEQ ID NO: 116861 - DNA, 25 bp, Homo sapien
ccctcttggggcagccataagccta

SEQ ID NO: 116862 - DNA, 25 bp, Homo sapien
cgtgtctgcgcttttggaggaaaca

SEQ ID NO: 116863 - DNA, 25 bp, Homo sapien
ttcctcgagcgcgagcacatcaagc

SEQ ID NO: 116864 - DNA, 25 bp, Homo sapien
caagctcgtgtccataggtcagtgc

SEQ ID NO: 116865 - DNA, 25 bp, Homo sapien
gcccgcgccagcatgatgaacaaca

SEQ ID NO: 116866 - DNA, 25 bp, Homo sapien
gaacaacagcggctactcagacgcc

SEQ ID NO: 116867 - DNA, 25 bp, Homo sapien
agacagacgagatgccgtccacgga

SEQ ID NO: 116868 - DNA, 25 bp, Homo sapien
cacctcaagtgcgtgggcaagcgcc

SEQ ID NO: 116869 - DNA, 25 bp, Homo sapien
ccaacttccgccaaatgaagctgga

SEQ ID NO: 116870 - DNA, 25 bp, Homo sapien
gtccgtggccctcgagttcctcgag

SEQ ID NO: 116871 - DNA, 25 bp, Homo sapien
caggcgacgtgagcatcggcatcaa

SEQ ID NO: 116872 - DNA, 25 bp, Homo sapien
ctgcagaggctgacattgacttcga

SEQ ID NO: 116873 - DNA, 25 bp, Homo sapien
gcagtgcccgcttctctgcaggcga

SEQ ID NO: 116874 - DNA, 25 bp, Homo sapien
cctacttcacggtggactgcagcga

SEQ ID NO: 116875 - DNA, 25 bp, Homo sapien
tcaaggccaatgagcccacctactt

SEQ ID NO: 116876 - DNA, 25 bp, Homo sapien
ggaggcgtaaacgtgcccaagagcc

SEQ ID NO: 116877 - DNA, 25 bp, Homo sapien
gacggctgtcccatcgacatcaagg

SEQ ID NO: 116878 - DNA, 25 bp, Homo sapien
accgtcaagtacacgccaccagggg

SEQ ID NO: 116879 - DNA, 25 bp, Homo sapien
agcaggagggtgagcaccgcacact

SEQ ID NO: 116880 - DNA, 25 bp, Homo sapien
cagcatcacccggcagcaggagggt

SEQ ID NO: 116881 - DNA, 25 bp, Homo sapien
gcctgggatccttcggcagcatcac

SEQ ID NO: 116882 - DNA, 25 bp, Homo sapien
agcgcctgggatccttcggcagcat

SEQ ID NO: 116883 - DNA, 25 bp, Homo sapien
agcgcacggagatcagcaagacgcg

SEQ ID NO: 116884 - DNA, 25 bp, Homo sapien
tgacacgcaccttcacacgcagcag

SEQ ID NO: 116885 - DNA, 25 bp, Homo sapien
gcagccacacctacacccgcacgga

SEQ ID NO: 116886 - DNA, 25 bp, Homo sapien
tggaggagtccacccaggtcggcgg

SEQ ID NO: 116887 - DNA, 25 bp, Homo sapien
gccagcgcgactacgattcggcttt

SEQ ID NO: 116888 - DNA, 25 bp, Homo sapien
gacgccgcagagcaaatccctagga

SEQ ID NO: 116889 - DNA, 25 bp, Homo sapien
tcgccaccttagcagatgaggcttc

SEQ ID NO: 116890 - DNA, 25 bp, Homo sapien
attcggctttgctacaggaggtgcg

SEQ ID NO: 116891 - DNA, 25 bp, Homo sapien
ctcaggggacgctgatgtcatttgc

SEQ ID NO: 116892 - DNA, 25 bp, Homo sapien
tgtcatttgcggatcacgccacgga

SEQ ID NO: 116893 - DNA, 25 bp, Homo sapien
tacgttattacaccgacgccgcaga

SEQ ID NO: 116894 - DNA, 25 bp, Homo sapien
accggagccggcatctctttgagca

SEQ ID NO: 116895 - DNA, 25 bp, Homo sapien
aagtaccgtggccagcacgtgcccg

SEQ ID NO: 116896 - DNA, 25 bp, Homo sapien
tgtcaagtaccgtggccagcacgtg

SEQ ID NO: 116897 - DNA, 25 bp, Homo sapien
aagccgcagagatcgtcgagggcga

SEQ ID NO: 116898 - DNA, 25 bp, Homo sapien
cggtcgctgtcaagtaccgtggcca

SEQ ID NO: 116899 - DNA, 25 bp, Homo sapien
ctttcagttcactgtggggccgctg

SEQ ID NO: 116900 - DNA, 25 bp, Homo sapien
cccatacggtcgctgtcaagtaccg

SEQ ID NO: 116901 - DNA, 25 bp, Homo sapien
agcgcctacagcgtgcgctttgtgc

SEQ ID NO: 116902 - DNA, 25 bp, Homo sapien
cgaggacagcgcctacagcgtgcgc

SEQ ID NO: 116903 - DNA, 25 bp, Homo sapien
caggcacgctctcactgggatctta

SEQ ID NO: 116904 - DNA, 25 bp, Homo sapien
gccgcatgcgcctcacgtagcgtga

SEQ ID NO: 116905 - DNA, 25 bp, Homo sapien
acgtagcgtgagaagatggacaaca

SEQ ID NO: 116906 - DNA, 25 bp, Homo sapien
gaggctccgagacagctctgctctc

SEQ ID NO: 116907 - DNA, 25 bp, Homo sapien
agggtacccagctggcaccgagcgt

SEQ ID NO: 116908 - DNA, 25 bp, Homo sapien
actgggatcttaagcagggcccgcg

SEQ ID NO: 116909 - DNA, 25 bp, Homo sapien
gccgccagggaagacgaccagagct

SEQ ID NO: 116910 - DNA, 25 bp, Homo sapien
atggacaacagagcgctcagcacgg

SEQ ID NO: 116911 - DNA, 25 bp, Homo sapien
gaaccgccatcccaatttcctggtg

SEQ ID NO: 116912 - DNA, 25 bp, Homo sapien
tgagatcgaagacactttccggtac

SEQ ID NO: 116913 - DNA, 25 bp, Homo sapien
cggcataggggagcttaacaagaac

SEQ ID NO: 116914 - DNA, 25 bp, Homo sapien
ggacacggtgactggtttcctgctg

SEQ ID NO: 116915 - DNA, 25 bp, Homo sapien
ctgttaatgcgcatgtcccggaatg

SEQ ID NO: 116916 - DNA, 25 bp, Homo sapien
cacatggaggccgtgttgctgttaa

SEQ ID NO: 116917 - DNA, 25 bp, Homo sapien
tacggcgcaggcgtattcacatgga

SEQ ID NO: 116918 - DNA, 25 bp, Homo sapien
aggggtaagctcatcgcagtgatcg

SEQ ID NO: 116919 - DNA, 25 bp, Homo sapien
ttccaggacctgcagaggcggcagt

SEQ ID NO: 116920 - DNA, 25 bp, Homo sapien
tgccagagtgcagtgcgctcacttc

SEQ ID NO: 116921 - DNA, 25 bp, Homo sapien
tcatgctctgcgtcagcgtggtagt

SEQ ID NO: 116922 - DNA, 25 bp, Homo sapien
caccgccttctaggggtcttgcctg

SEQ ID NO: 116923 - DNA, 25 bp, Homo sapien
ccttcaaggccttgggacgctcagg

SEQ ID NO: 116924 - DNA, 25 bp, Homo sapien
gccgacctttgtggctcgcctttga

SEQ ID NO: 116925 - DNA, 25 bp, Homo sapien
tggctcgcctttgatcatgctctgc

SEQ ID NO: 116926 - DNA, 25 bp, Homo sapien
tgcgctcacttcaaagggacccggg

SEQ ID NO: 116927 - DNA, 25 bp, Homo sapien
acagcgcatcaaaggggcccaggaa

SEQ ID NO: 116928 - DNA, 25 bp, Homo sapien
atgctgaccggacactacattccta

SEQ ID NO: 116929 - DNA, 25 bp, Homo sapien
cggacactacattcctaacaagatc

SEQ ID NO: 116930 - DNA, 25 bp, Homo sapien
ggctgcggcgagacagcgcatcaaa

SEQ ID NO: 116931 - DNA, 25 bp, Homo sapien
accgccagggcgttaccgtcgcagg

SEQ ID NO: 116932 - DNA, 25 bp, Homo sapien
aggcactgcacgttgccgctctacg

SEQ ID NO: 116933 - DNA, 25 bp, Homo sapien
cgttgccgctctacggaccgacaga

SEQ ID NO: 116934 - DNA, 25 bp, Homo sapien
tggctcccaggccatgctgaccgga

SEQ ID NO: 116935 - DNA, 25 bp, Homo sapien
acccaggctttgttcagggagggct

SEQ ID NO: 116936 - DNA, 25 bp, Homo sapien
gcgcgcgaacctcaggcagggctaa

SEQ ID NO: 116937 - DNA, 25 bp, Homo sapien
ctcccacccaggctttgttcaggga

SEQ ID NO: 116938 - DNA, 25 bp, Homo sapien
gccgtctgtcgtcgcggctcagcag

SEQ ID NO: 116939 - DNA, 25 bp, Homo sapien
ggccatgctagctccgcctcgctcg

SEQ ID NO: 116940 - DNA, 25 bp, Homo sapien
gcctcccgcacctggactcaccttc

SEQ ID NO: 116941 - DNA, 25 bp, Homo sapien
gcgaacctcaggcagggctaagagc

SEQ ID NO: 116942 - DNA, 25 bp, Homo sapien
gcgcgcgcctttcccatgcacacct

SEQ ID NO: 116943 - DNA, 25 bp, Homo sapien
taagttctgggacaagacctacaga

SEQ ID NO: 116944 - DNA, 25 bp, Homo sapien
ctagacttgtgggtgggcaacagcc

SEQ ID NO: 116945 - DNA, 25 bp, Homo sapien
agggacggacggagcctctacctga

SEQ ID NO: 116946 - DNA, 25 bp, Homo sapien
gtccggagacaaccgctcaaggcca

SEQ ID NO: 116947 - DNA, 25 bp, Homo sapien
gcacctcaaacggatcggggcgtga

SEQ ID NO: 116948 - DNA, 25 bp, Homo sapien
accgaagctcggtctccaggcgcag

SEQ ID NO: 116949 - DNA, 25 bp, Homo sapien
ggccctggttgaggcctagacttgt

SEQ ID NO: 116950 - DNA, 25 bp, Homo sapien
accactcgaggaggctggcacttac

SEQ ID NO: 116951 - DNA, 25 bp, Homo sapien
actcgcccttgctcttaccgggcca

SEQ ID NO: 116952 - DNA, 25 bp, Homo sapien
gaggttgaggttaaagcgttcatcc

SEQ ID NO: 116953 - DNA, 25 bp, Homo sapien
ggccggcctgggacttccaaagcgc

SEQ ID NO: 116954 - DNA, 25 bp, Homo sapien
ccagctgcgcctggaaagcgagctc

SEQ ID NO: 116955 - DNA, 25 bp, Homo sapien
cagagctcagcttggtcccgccgcc

SEQ ID NO: 116956 - DNA, 25 bp, Homo sapien
atctgcagttgccaggtcagtgcgg

SEQ ID NO: 116957 - DNA, 25 bp, Homo sapien
ctcagcccggatctgcagttgccag

SEQ ID NO: 116958 - DNA, 25 bp, Homo sapien
ggaatggcagactctcgtcccccga

SEQ ID NO: 116959 - DNA, 25 bp, Homo sapien
gacttgccctcagaagcctatcttg

SEQ ID NO: 116960 - DNA, 25 bp, Homo sapien
acggctctgattcttctccggagga

SEQ ID NO: 116961 - DNA, 25 bp, Homo sapien
aatgtcggctttgctccttccatgg

SEQ ID NO: 116962 - DNA, 25 bp, Homo sapien
tgcctggtacacgagctgcaatgtc

SEQ ID NO: 116963 - DNA, 25 bp, Homo sapien
taaagcgcctgcactgcctggtaca

SEQ ID NO: 116964 - DNA, 25 bp, Homo sapien
tcctcgctagcagcttgggacatta

SEQ ID NO: 116965 - DNA, 25 bp, Homo sapien
ggaagcgacagcaccgatacctttg

SEQ ID NO: 116966 - DNA, 25 bp, Homo sapien
caggtgcgactagtttcccaaaagc

SEQ ID NO: 116967 - DNA, 25 bp, Homo sapien
gtgctctcgccactgcgtataacga

SEQ ID NO: 116968 - DNA, 25 bp, Homo sapien
cgttttaggcgctgacactgaccta

SEQ ID NO: 116969 - DNA, 25 bp, Homo sapien
tcggcactcagaacgcggccactgt

SEQ ID NO: 116970 - DNA, 25 bp, Homo sapien
tgtgcctgccgacaccaaggtgatt

SEQ ID NO: 116971 - DNA, 25 bp, Homo sapien
accaaggtgatttgtgctctcgcca

SEQ ID NO: 116972 - DNA, 25 bp, Homo sapien
taggcgctgacactgacctacagcg

SEQ ID NO: 116973 - DNA, 25 bp, Homo sapien
ccactgcgtataacgagttggcccg

SEQ ID NO: 116974 - DNA, 25 bp, Homo sapien
tgatttgtgctctcgccactgcgta

SEQ ID NO: 116975 - DNA, 25 bp, Homo sapien
accagagatcggttcgtccagcggg

SEQ ID NO: 116976 - DNA, 25 bp, Homo sapien
cgcctgcgcgttctcttgtttacag

SEQ ID NO: 116977 - DNA, 25 bp, Homo sapien
tgaacatctccagcgcgaagcgggt

SEQ ID NO: 116978 - DNA, 25 bp, Homo sapien
gttaggtcaaagctcctatcccttg

SEQ ID NO: 116979 - DNA, 25 bp, Homo sapien
ccatcaccagagatcggttcgtcca

SEQ ID NO: 116980 - DNA, 25 bp, Homo sapien
cggcccggacccaacagacgctcca

SEQ ID NO: 116981 - DNA, 25 bp, Homo sapien
ggccgcggttgaacatctccagcgc

SEQ ID NO: 116982 - DNA, 25 bp, Homo sapien
ctcttgtttacaggaggcacgtggg

SEQ ID NO: 116983 - DNA, 25 bp, Homo sapien
cccgacttccaggagtttgtcaata

SEQ ID NO: 116984 - DNA, 25 bp, Homo sapien
acattactcggtgcagtcggtcatc

SEQ ID NO: 116985 - DNA, 25 bp, Homo sapien
cgccatggccatcttcgaactgctg

SEQ ID NO: 116986 - DNA, 25 bp, Homo sapien
tcctaagctgcccaacggtgtgttc

SEQ ID NO: 116987 - DNA, 25 bp, Homo sapien
ggggtggtcaccaaagtccagcaca

SEQ ID NO: 116988 - DNA, 25 bp, Homo sapien
cggcgaactcaaagacgatgacttc

SEQ ID NO: 116989 - DNA, 25 bp, Homo sapien
ctatattgtgaaagagccgcctcct

SEQ ID NO: 116990 - DNA, 25 bp, Homo sapien
ctacggggccttctactgtgacagg

SEQ ID NO: 116991 - DNA, 25 bp, Homo sapien
gagttttctgggctgacggcacttt

SEQ ID NO: 116992 - DNA, 25 bp, Homo sapien
tccggggaggagttctccttcgtca

SEQ ID NO: 116993 - DNA, 25 bp, Homo sapien
ccaatgggaagtcgggctcctgcac

SEQ ID NO: 116994 - DNA, 25 bp, Homo sapien
aggagttctccttcgtcagcccgct

SEQ ID NO: 116995 - DNA, 25 bp, Homo sapien
tgacggcactttgggggaatttatc

SEQ ID NO: 116996 - DNA, 25 bp, Homo sapien
ttcgtcagcccgctggtgaaatacc

SEQ ID NO: 116997 - DNA, 25 bp, Homo sapien
agccgcactgccgagttttctgggc

SEQ ID NO: 116998 - DNA, 25 bp, Homo sapien
ggtgaaatacctgctcttcttcttc

SEQ ID NO: 116999 - DNA, 25 bp, Homo sapien
tacctgtcgcctaaaggaggtgaca

SEQ ID NO: 117000 - DNA, 25 bp, Homo sapien
tcggagcacagacgcaggaagaagc

SEQ ID NO: 117001 - DNA, 25 bp, Homo sapien
tccaaaatgggcacctcggagcaca

SEQ ID NO: 117002 - DNA, 25 bp, Homo sapien
gcgcatcagcgtgtcctccaaaatg

SEQ ID NO: 117003 - DNA, 25 bp, Homo sapien
tcagcaagctccatggcgtccgcag

SEQ ID NO: 117004 - DNA, 25 bp, Homo sapien
ctgaattcccaacggcagatgtgga

SEQ ID NO: 117005 - DNA, 25 bp, Homo sapien
attgccaaatacacgcacgcttctg

SEQ ID NO: 117006 - DNA, 25 bp, Homo sapien
cgtggccaaatcacaccgagaatgc

SEQ ID NO: 117007 - DNA, 25 bp, Homo sapien
ggaaatagcctcgaccgaactgctg

SEQ ID NO: 117008 - DNA, 25 bp, Homo sapien
gctgtgctagctgcttgcccagcga

SEQ ID NO: 117009 - DNA, 25 bp, Homo sapien
agcctcgaccgaactgctgcgggga

SEQ ID NO: 117010 - DNA, 25 bp, Homo sapien
tcggcctggcgggaaatagcctcga

SEQ ID NO: 117011 - DNA, 25 bp, Homo sapien
gcgctcagaccaggggctcggcctg

SEQ ID NO: 117012 - DNA, 25 bp, Homo sapien
gagtgttcccggagtctcctcgccg

SEQ ID NO: 117013 - DNA, 25 bp, Homo sapien
ccagcgagtgttcccggagtctcct

SEQ ID NO: 117014 - DNA, 25 bp, Homo sapien
tagctgcttgcccagcgagtgttcc

SEQ ID NO: 117015 - DNA, 25 bp, Homo sapien
actgctggccggagactcggactcc

SEQ ID NO: 117016 - DNA, 25 bp, Homo sapien
aggcccgtgcattccagagagccca

SEQ ID NO: 117017 - DNA, 25 bp, Homo sapien
cgcacggcaagctcgtgctctggtc

SEQ ID NO: 117018 - DNA, 25 bp, Homo sapien
ctgcgctacaacgtgtgcctgggct

SEQ ID NO: 117019 - DNA, 25 bp, Homo sapien
cttggggagtcgtgcatcccgttcc

SEQ ID NO: 117020 - DNA, 25 bp, Homo sapien
acaacttggattgcgaggctagggc

SEQ ID NO: 117021 - DNA, 25 bp, Homo sapien
tctcctagggctgaagacaacttgg

SEQ ID NO: 117022 - DNA, 25 bp, Homo sapien
gcccagcgagctagagcaacaaagg

SEQ ID NO: 117023 - DNA, 25 bp, Homo sapien
ggccatgaagcggagcgacccacat

SEQ ID NO: 117024 - DNA, 25 bp, Homo sapien
ttctgatcgcaggaccggagatacc

SEQ ID NO: 117025 - DNA, 25 bp, Homo sapien
cgccgcgcacagtcaagaaggtact

SEQ ID NO: 117026 - DNA, 25 bp, Homo sapien
tcgcaactaggactgagcacggccg

SEQ ID NO: 117027 - DNA, 25 bp, Homo sapien
gccgggagcaaacgcactacaggtt

SEQ ID NO: 117028 - DNA, 25 bp, Homo sapien
cctcggctgaatctcacttagtgga

SEQ ID NO: 117029 - DNA, 25 bp, Homo sapien
ctcactcctttctgttagctgccgg

SEQ ID NO: 117030 - DNA, 25 bp, Homo sapien
aggggaactgcagatcctctcggca

SEQ ID NO: 117031 - DNA, 25 bp, Homo sapien
acagcgagtccctcgtttcgggcga

SEQ ID NO: 117032 - DNA, 25 bp, Homo sapien
ctccggcaaagcgagctgaaccctg

SEQ ID NO: 117033 - DNA, 25 bp, Homo sapien
ggcgagctgccgtaaccaatagagg

SEQ ID NO: 117034 - DNA, 25 bp, Homo sapien
gcaatgccgcaggactaaaaagatc

SEQ ID NO: 117035 - DNA, 25 bp, Homo sapien
ctaggagtctccgtccgccagcaat

SEQ ID NO: 117036 - DNA, 25 bp, Homo sapien
ggagcctgtagctaacctaggagtc

SEQ ID NO: 117037 - DNA, 25 bp, Homo sapien
ggcccgcccgcaaatggcaatggca

SEQ ID NO: 117038 - DNA, 25 bp, Homo sapien
cgggcgagatgcgttctcttcagaa

SEQ ID NO: 117039 - DNA, 25 bp, Homo sapien
atgcccacagtgacgggtccgagct

SEQ ID NO: 117040 - DNA, 25 bp, Homo sapien
ttttaggtcgtggtcctgttgagca

SEQ ID NO: 117041 - DNA, 25 bp, Homo sapien
cggagtcaggccagccgtctttcca

SEQ ID NO: 117042 - DNA, 25 bp, Homo sapien
ggtcgacctcaacgcgtggcgaaaa

SEQ ID NO: 117043 - DNA, 25 bp, Homo sapien
tcggctgagaatcgccatggtaatc

SEQ ID NO: 117044 - DNA, 25 bp, Homo sapien
ttgccctggcaacggtaaccacggc

SEQ ID NO: 117045 - DNA, 25 bp, Homo sapien
gcctcgtactaggtgacggcccatc

SEQ ID NO: 117046 - DNA, 25 bp, Homo sapien
tccgagctgttagctgccgtagcca

SEQ ID NO: 117047 - DNA, 25 bp, Homo sapien
cttcttgcaagttaggaggtggccg

SEQ ID NO: 117048 - DNA, 25 bp, Homo sapien
ggcgcgttgcccaccttcttgcaag

SEQ ID NO: 117049 - DNA, 25 bp, Homo sapien
ggcagcgctcgccattgccgctggt

SEQ ID NO: 117050 - DNA, 25 bp, Homo sapien
gccgctctgaggtgagtgccctacc

SEQ ID NO: 117051 - DNA, 25 bp, Homo sapien
taccgcgcaatctccagctatttca

SEQ ID NO: 117052 - DNA, 25 bp, Homo sapien
ctctttgggcgacctccgaagcttc

SEQ ID NO: 117053 - DNA, 25 bp, Homo sapien
cgtgggcttgttacccaggtagact

SEQ ID NO: 117054 - DNA, 25 bp, Homo sapien
acgctggaatatggcgcgttgccca

SEQ ID NO: 117055 - DNA, 25 bp, Homo sapien
cccgagtgccagtggccgcctttat

SEQ ID NO: 117056 - DNA, 25 bp, Homo sapien
gcctttatgtgccagggtgctgcag

SEQ ID NO: 117057 - DNA, 25 bp, Homo sapien
gcccaatcagcgatggcaggacatc

SEQ ID NO: 117058 - DNA, 25 bp, Homo sapien
tggccggctgagaccacgtgtccac

SEQ ID NO: 117059 - DNA, 25 bp, Homo sapien
ggggtcactcagagcccgagcgcat

SEQ ID NO: 117060 - DNA, 25 bp, Homo sapien
ggggctcaacacctgcccgactgtg

SEQ ID NO: 117061 - DNA, 25 bp, Homo sapien
cagcctgaacgccacgatgcaggga

SEQ ID NO: 117062 - DNA, 25 bp, Homo sapien
cgatgaagacttcgtgggccctgct

SEQ ID NO: 117063 - DNA, 25 bp, Homo sapien
ttttgtggctcagactaagttcggc

SEQ ID NO: 117064 - DNA, 25 bp, Homo sapien
ccttgatgagacgtagtcgggcctc

SEQ ID NO: 117065 - DNA, 25 bp, Homo sapien
ccaccgtcagcttcgccagagggaa

SEQ ID NO: 117066 - DNA, 25 bp, Homo sapien
ccggtggtaaaaccgctggagctca

SEQ ID NO: 117067 - DNA, 25 bp, Homo sapien
gccgccaccgtccaggaacagaaag

SEQ ID NO: 117068 - DNA, 25 bp, Homo sapien
cgcacgcactaggaggaggagttaa

SEQ ID NO: 117069 - DNA, 25 bp, Homo sapien
ctgggtccagaatggcttcggattc

SEQ ID NO: 117070 - DNA, 25 bp, Homo sapien
ctgcacttcagctcgtccaggatga

SEQ ID NO: 117071 - DNA, 25 bp, Homo sapien
gataccctggatcccttacggctca

SEQ ID NO: 117072 - DNA, 25 bp, Homo sapien
ccgcaagggcctcatacatatttta

SEQ ID NO: 117073 - DNA, 25 bp, Homo sapien
gccgccgagacagatccgatttcca

SEQ ID NO: 117074 - DNA, 25 bp, Homo sapien
tggcccattcacctgctgtcgagaa

SEQ ID NO: 117075 - DNA, 25 bp, Homo sapien
ggtcctcagacccatgcgatgctgg

SEQ ID NO: 117076 - DNA, 25 bp, Homo sapien
ggtcctcactttgctggcctgtcca

SEQ ID NO: 117077 - DNA, 25 bp, Homo sapien
agcgcatcctaagcccgcgtgtatc

SEQ ID NO: 117078 - DNA, 25 bp, Homo sapien
tcgacgcttggccaggtttaggaaa

SEQ ID NO: 117079 - DNA, 25 bp, Homo sapien
tgcgcacccgtagagctgagtgacc

SEQ ID NO: 117080 - DNA, 25 bp, Homo sapien
cctgggtgccactagcgctattaac

SEQ ID NO: 117081 - DNA, 25 bp, Homo sapien
gggtgacaccctcactgcccatagt

SEQ ID NO: 117082 - DNA, 25 bp, Homo sapien
cccgggttggaagagcaaacgaatg

SEQ ID NO: 117083 - DNA, 25 bp, Homo sapien
gcaggttcctttgcgttcgctcagg

SEQ ID NO: 117084 - DNA, 25 bp, Homo sapien
gctcgcaggattttcgccctcagga

SEQ ID NO: 117085 - DNA, 25 bp, Homo sapien
taggacagatttctccgaaggctcg

SEQ ID NO: 117086 - DNA, 25 bp, Homo sapien
gcgggtattactgtacacggtgtcc

SEQ ID NO: 117087 - DNA, 25 bp, Homo sapien
gtgctcaaggctgacctgtctcagg

SEQ ID NO: 117088 - DNA, 25 bp, Homo sapien
tagggccactggacgatctctgcag

SEQ ID NO: 117089 - DNA, 25 bp, Homo sapien
tggcgtgcttggaaatccgaccctg

SEQ ID NO: 117090 - DNA, 25 bp, Homo sapien
ggccggggatgattcaccttgaatg

SEQ ID NO: 117091 - DNA, 25 bp, Homo sapien
tcgacggagtgcacagagaatgact

SEQ ID NO: 117092 - DNA, 25 bp, Homo sapien
tcaaccgtcctttggtctgacacca

SEQ ID NO: 117093 - DNA, 25 bp, Homo sapien
cgcggacgcggattagatccttctc

SEQ ID NO: 117094 - DNA, 25 bp, Homo sapien
ccacccggagcattcagaagggacc

SEQ ID NO: 117095 - DNA, 25 bp, Homo sapien
ggagtctttcgatcttggcccagcc

SEQ ID NO: 117096 - DNA, 25 bp, Homo sapien
tctagcatctagattctcgtgggtc

SEQ ID NO: 117097 - DNA, 25 bp, Homo sapien
ctcgtgggtcaacaaagtcactgga

SEQ ID NO: 117098 - DNA, 25 bp, Homo sapien
ttcgaaaaccgtatgcgtgtgcttc

SEQ ID NO: 117099 - DNA, 25 bp, Homo sapien
gtgcttctgtgcgtttttcctctga

SEQ ID NO: 117100 - DNA, 25 bp, Homo sapien
tcctctgatcgaggtagggccctgt

SEQ ID NO: 117101 - DNA, 25 bp, Homo sapien
aggctggagtggttccttcccggct

SEQ ID NO: 117102 - DNA, 25 bp, Homo sapien
cctcggtcctttgctctagcatcta

SEQ ID NO: 117103 - DNA, 25 bp, Homo sapien
ggatgggacggtcttttccttgcta

SEQ ID NO: 117104 - DNA, 25 bp, Homo sapien
gcatccgcgttcgtgtctgggccct

SEQ ID NO: 117105 - DNA, 25 bp, Homo sapien
gcgaatatcccctcttgctgtctgc

SEQ ID NO: 117106 - DNA, 25 bp, Homo sapien
tgccgcggcgtcttcgcgaatatcc

SEQ ID NO: 117107 - DNA, 25 bp, Homo sapien
gggttgctttctgccgcggcgtctt

SEQ ID NO: 117108 - DNA, 25 bp, Homo sapien
ttccttgctaggagtccgctgtgga

SEQ ID NO: 117109 - DNA, 25 bp, Homo sapien
tcttttccttgctaggagtccgctg

SEQ ID NO: 117110 - DNA, 25 bp, Homo sapien
tgggacggtcttttccttgctagga

SEQ ID NO: 117111 - DNA, 25 bp, Homo sapien
agtagccgtgctgcgggaccgctcc

SEQ ID NO: 117112 - DNA, 25 bp, Homo sapien
acagtgcagcctcggagagccgcca

SEQ ID NO: 117113 - DNA, 25 bp, Homo sapien
ttttctcctttgtcccaggcgatgc

SEQ ID NO: 117114 - DNA, 25 bp, Homo sapien
acctgcgctgtgatgcccagcatca

SEQ ID NO: 117115 - DNA, 25 bp, Homo sapien
gcatcatggacacggccaggacgtc

SEQ ID NO: 117116 - DNA, 25 bp, Homo sapien
accacgaagcgctcctgcaggtgca

SEQ ID NO: 117117 - DNA, 25 bp, Homo sapien
gcagcacggggtctgtatccagaag

SEQ ID NO: 117118 - DNA, 25 bp, Homo sapien
ccaggacgtcggtgatgtgcaccac

SEQ ID NO: 117119 - DNA, 25 bp, Homo sapien
agagtgattcctttaccggggcctg

SEQ ID NO: 117120 - DNA, 25 bp, Homo sapien
cgtcgatgaggaatctacgtccctc

SEQ ID NO: 117121 - DNA, 25 bp, Homo sapien
tgccgaagcacgaagcacgtacgcc

SEQ ID NO: 117122 - DNA, 25 bp, Homo sapien
acaggtgtaacccacagagtgattc

SEQ ID NO: 117123 - DNA, 25 bp, Homo sapien
cggcgttctcacgtcctggaagtca

SEQ ID NO: 117124 - DNA, 25 bp, Homo sapien
tccagtacctggaacattctccgcg

SEQ ID NO: 117125 - DNA, 25 bp, Homo sapien
ttccctaccagggtcacgtcgatga

SEQ ID NO: 117126 - DNA, 25 bp, Homo sapien
gcagcttcagttccgcggaggacag

SEQ ID NO: 117127 - DNA, 25 bp, Homo sapien
atacagcttgaccacgtccgtgtcc

SEQ ID NO: 117128 - DNA, 25 bp, Homo sapien
ccctccacgaaggatacagcttgac

SEQ ID NO: 117129 - DNA, 25 bp, Homo sapien
ctcttgcccggactgggagatgaca

SEQ ID NO: 117130 - DNA, 25 bp, Homo sapien
tagcagcctccactataagcggacg

SEQ ID NO: 117131 - DNA, 25 bp, Homo sapien
taagcggacgactcctgctcagtcg

SEQ ID NO: 117132 - DNA, 25 bp, Homo sapien
gtcacctctgtgacgtcatcggagg

SEQ ID NO: 117133 - DNA, 25 bp, Homo sapien
ccaaacgtcgcggaggaaagtcaca

SEQ ID NO: 117134 - DNA, 25 bp, Homo sapien
agcgagcagcaacgcgtatttcggg

SEQ ID NO: 117135 - DNA, 25 bp, Homo sapien
cggcaaacgcttgtccctcacaggg

SEQ ID NO: 117136 - DNA, 25 bp, Homo sapien
ctcatctatcagctgccggattttc

SEQ ID NO: 117137 - DNA, 25 bp, Homo sapien
taactcgtgaactcacgcgtccacg

SEQ ID NO: 117138 - DNA, 25 bp, Homo sapien
gacccagggttaactcgtgaactca

SEQ ID NO: 117139 - DNA, 25 bp, Homo sapien
tccgtcctgggaggttaatatccgc

SEQ ID NO: 117140 - DNA, 25 bp, Homo sapien
atcttggtccgctgccgagttgctt

SEQ ID NO: 117141 - DNA, 25 bp, Homo sapien
cagcctggctgggaaagtctaaccg

SEQ ID NO: 117142 - DNA, 25 bp, Homo sapien
tatccgcctcttgaggcagcctggc

SEQ ID NO: 117143 - DNA, 25 bp, Homo sapien
acgactgaccattggctgcctttca

SEQ ID NO: 117144 - DNA, 25 bp, Homo sapien
cgccacctaccaagaaaacgactga

SEQ ID NO: 117145 - DNA, 25 bp, Homo sapien
tgcggcaatcgttagcgggtcatgt

SEQ ID NO: 117146 - DNA, 25 bp, Homo sapien
taagtcattggtctctggtgggacc

SEQ ID NO: 117147 - DNA, 25 bp, Homo sapien
ctgcctttcaccaaggcggtaagtc

SEQ ID NO: 117148 - DNA, 25 bp, Homo sapien
ggcctctgacactcggtcttcgatt

SEQ ID NO: 117149 - DNA, 25 bp, Homo sapien
gagtctttccgcaggcgcggcctct

SEQ ID NO: 117150 - DNA, 25 bp, Homo sapien
gccatagctatggttaccacgtttc

SEQ ID NO: 117151 - DNA, 25 bp, Homo sapien
tttggcttctctaaacgcagcggga

SEQ ID NO: 117152 - DNA, 25 bp, Homo sapien
agccgtggatttcagtctgtacacc

SEQ ID NO: 117153 - DNA, 25 bp, Homo sapien
tcgctcaccgaacatctggcacgtg

SEQ ID NO: 117154 - DNA, 25 bp, Homo sapien
cgggaagctttaagccagagccaca

SEQ ID NO: 117155 - DNA, 25 bp, Homo sapien
cagcttctggtgtcttctgcaaggg

SEQ ID NO: 117156 - DNA, 25 bp, Homo sapien
gggcagggacaaaacccagcttctg

SEQ ID NO: 117157 - DNA, 25 bp, Homo sapien
ggaggcgatcgatcagaccacagca

SEQ ID NO: 117158 - DNA, 25 bp, Homo sapien
agccgctctgaaccggaatgatctg

SEQ ID NO: 117159 - DNA, 25 bp, Homo sapien
cgctcggagcgttaccagggaaaca

SEQ ID NO: 117160 - DNA, 25 bp, Homo sapien
cagggaaacaggtctcggttttgcg

SEQ ID NO: 117161 - DNA, 25 bp, Homo sapien
cgcaccatgtcctctggccggaaaa

SEQ ID NO: 117162 - DNA, 25 bp, Homo sapien
agccaagctcaagcgggaggccacc

SEQ ID NO: 117163 - DNA, 25 bp, Homo sapien
ggccaccggcaagcggctctaaagt

SEQ ID NO: 117164 - DNA, 25 bp, Homo sapien
aactaggtagtctcttctcgcgaga

SEQ ID NO: 117165 - DNA, 25 bp, Homo sapien
aacccgcgtagattccaagacagga

SEQ ID NO: 117166 - DNA, 25 bp, Homo sapien
tcggttttgcggctcccactcagct

SEQ ID NO: 117167 - DNA, 25 bp, Homo sapien
gctgcatgcacgagccaggaactgc

SEQ ID NO: 117168 - DNA, 25 bp, Homo sapien
gcacatcttccctcagcgtttctga

SEQ ID NO: 117169 - DNA, 25 bp, Homo sapien
tggctgcggcgacaaaatgaagata

SEQ ID NO: 117170 - DNA, 25 bp, Homo sapien
cgccgtcatgaaacagttcgccttc

SEQ ID NO: 117171 - DNA, 25 bp, Homo sapien
atgtcgcgcccaaggcctcttaata

SEQ ID NO: 117172 - DNA, 25 bp, Homo sapien
ccctcagctaacgagcgggctctag

SEQ ID NO: 117173 - DNA, 25 bp, Homo sapien
tccaccaagtaggaggaagcggctc

SEQ ID NO: 117174 - DNA, 25 bp, Homo sapien
gccttcgtgcacatgcgcgagaacg

SEQ ID NO: 117175 - DNA, 25 bp, Homo sapien
agaccatgatcgaggacgtgcagtc

SEQ ID NO: 117176 - DNA, 25 bp, Homo sapien
tcaagatctttctggagtcccacgg

SEQ ID NO: 117177 - DNA, 25 bp, Homo sapien
atccaggcggtcaagatctttctgg

SEQ ID NO: 117178 - DNA, 25 bp, Homo sapien
cggcatcagctatgagaccatgatc

SEQ ID NO: 117179 - DNA, 25 bp, Homo sapien
ggagcaggagcagatgttcgccttc

SEQ ID NO: 117180 - DNA, 25 bp, Homo sapien
aggagcagatgttcgccttccggtc

SEQ ID NO: 117181 - DNA, 25 bp, Homo sapien
gcgctccaccgacacttttaactac

SEQ ID NO: 117182 - DNA, 25 bp, Homo sapien
gagtcccacggcatcagctatgaga

SEQ ID NO: 117183 - DNA, 25 bp, Homo sapien
gccggctagcgaggccttttgttct

SEQ ID NO: 117184 - DNA, 25 bp, Homo sapien
cgctcctcgcagtcacaagtactgg

SEQ ID NO: 117185 - DNA, 25 bp, Homo sapien
atcgctcctcaaaacggggtcctga

SEQ ID NO: 117186 - DNA, 25 bp, Homo sapien
ctgcccacatgagccttttccggtg

SEQ ID NO: 117187 - DNA, 25 bp, Homo sapien
tcagggttcccaatgtgcctccgga

SEQ ID NO: 117188 - DNA, 25 bp, Homo sapien
gttctagcctcacgggttgcctcta

SEQ ID NO: 117189 - DNA, 25 bp, Homo sapien
agacgccgctcaatggttgccaagg

SEQ ID NO: 117190 - DNA, 25 bp, Homo sapien
tctcatctcagggtcgcagaagggc

SEQ ID NO: 117191 - DNA, 25 bp, Homo sapien
gttctccgaaacatggagtcctgta

SEQ ID NO: 117192 - DNA, 25 bp, Homo sapien
tcctacttgtgggacagccagcctt

SEQ ID NO: 117193 - DNA, 25 bp, Homo sapien
agtcattccgttagctggctccacc

SEQ ID NO: 117194 - DNA, 25 bp, Homo sapien
gcacctcggggtcgtagagaacaca

SEQ ID NO: 117195 - DNA, 25 bp, Homo sapien
gtcctgtaggcaaggtcttacctga

SEQ ID NO: 117196 - DNA, 25 bp, Homo sapien
ccgagaacctctggcctcaggaagc

SEQ ID NO: 117197 - DNA, 25 bp, Homo sapien
cccgcgacagagtttagtcattccg

SEQ ID NO: 117198 - DNA, 25 bp, Homo sapien
gaagcgcatgcgcaaccggttctcc

SEQ ID NO: 117199 - DNA, 25 bp, Homo sapien
ggctctaaaagtcggtgcccactcg

SEQ ID NO: 117200 - DNA, 25 bp, Homo sapien
tgcctctgggcgaaaactctaccga

SEQ ID NO: 117201 - DNA, 25 bp, Homo sapien
ggtgtcactcctgcccgcaatggaa

SEQ ID NO: 117202 - DNA, 25 bp, Homo sapien
gaatgttcagaacgcgggacctcct

SEQ ID NO: 117203 - DNA, 25 bp, Homo sapien
aactcatcaggggagggtttctgca

SEQ ID NO: 117204 - DNA, 25 bp, Homo sapien
tttgcccgtggccttaactcatcag

SEQ ID NO: 117205 - DNA, 25 bp, Homo sapien
gcagcagaatctcgggctcagggtt

SEQ ID NO: 117206 - DNA, 25 bp, Homo sapien
cacggttcagtacccacgcttcgaa

SEQ ID NO: 117207 - DNA, 25 bp, Homo sapien
gggctccttgctctactggctgcca

SEQ ID NO: 117208 - DNA, 25 bp, Homo sapien
ctcgtgcttggtctgcttgatgatc

SEQ ID NO: 117209 - DNA, 25 bp, Homo sapien
cgcaggtagtcgtccttgttggtca

SEQ ID NO: 117210 - DNA, 25 bp, Homo sapien
ttcccgcagcaccaacaggtatggc

SEQ ID NO: 117211 - DNA, 25 bp, Homo sapien
ggcgagcagggatcacatctgattc

SEQ ID NO: 117212 - DNA, 25 bp, Homo sapien
aggacgcactcctgtctcaaaatgc

SEQ ID NO: 117213 - DNA, 25 bp, Homo sapien
tcagcaggtcctggaacaccatggc

SEQ ID NO: 117214 - DNA, 25 bp, Homo sapien
ccatagaagcgcgtgtgccatctca

SEQ ID NO: 117215 - DNA, 25 bp, Homo sapien
tcttccaagagcgatgcgagtgtca

SEQ ID NO: 117216 - DNA, 25 bp, Homo sapien
gttctggtgggcatgtcttccaaga

SEQ ID NO: 117217 - DNA, 25 bp, Homo sapien
cctttttgataatccactgcggggc

SEQ ID NO: 117218 - DNA, 25 bp, Homo sapien
cccgatgaccgtggcctttttgata

SEQ ID NO: 117219 - DNA, 25 bp, Homo sapien
aggggtctgtgttcacccgatgacc

SEQ ID NO: 117220 - DNA, 25 bp, Homo sapien
ttttatttgggtggcgacttctgcg

SEQ ID NO: 117221 - DNA, 25 bp, Homo sapien
aatcatcttggacgacttcccagcg

SEQ ID NO: 117222 - DNA, 25 bp, Homo sapien
cccgggaacagggtgctcccactag

SEQ ID NO: 117223 - DNA, 25 bp, Homo sapien
aattatcttgtctccgcgttctttc

SEQ ID NO: 117224 - DNA, 25 bp, Homo sapien
acttgaggtgcgacgacttgtaata

SEQ ID NO: 117225 - DNA, 25 bp, Homo sapien
cttgtaataggctttggtgcagccc

SEQ ID NO: 117226 - DNA, 25 bp, Homo sapien
acttcttgtcgcagtcgagccagtc

SEQ ID NO: 117227 - DNA, 25 bp, Homo sapien
agcaggtgtgacagacctcctccgg

SEQ ID NO: 117228 - DNA, 25 bp, Homo sapien
ccagagaacccaccagaggctgctg

SEQ ID NO: 117229 - DNA, 25 bp, Homo sapien
gtcatgtttaacagcctcagaaatt

SEQ ID NO: 117230 - DNA, 25 bp, Homo sapien
cgcgttctttcttctgccggcgagc

SEQ ID NO: 117231 - DNA, 25 bp, Homo sapien
gtgggatctcgaaatggaaacagtc

SEQ ID NO: 117232 - DNA, 25 bp, Homo sapien
ccgagttccagggagttgctgattc

SEQ ID NO: 117233 - DNA, 25 bp, Homo sapien
catcctgcgtccctgccggagaaaa

SEQ ID NO: 117234 - DNA, 25 bp, Homo sapien
cccgtctctagagtgcaccaaggca

SEQ ID NO: 117235 - DNA, 25 bp, Homo sapien
agacactgtctggtatcctaaagtc

SEQ ID NO: 117236 - DNA, 25 bp, Homo sapien
cctgctaggtaactcgccttctgga

SEQ ID NO: 117237 - DNA, 25 bp, Homo sapien
agctctacctttgcgctggctttaa

SEQ ID NO: 117238 - DNA, 25 bp, Homo sapien
ttccagtggagaaccgagacaccgc

SEQ ID NO: 117239 - DNA, 25 bp, Homo sapien
tagcgaagggctagaggcaaacacc

SEQ ID NO: 117240 - DNA, 25 bp, Homo sapien
agctgcggttctgctgtgtcatgca

SEQ ID NO: 117241 - DNA, 25 bp, Homo sapien
gatcctccggtagcgaagggctaga

SEQ ID NO: 117242 - DNA, 25 bp, Homo sapien
tggcttgaaattgctgcagcagctg

SEQ ID NO: 117243 - DNA, 25 bp, Homo sapien
gctagaggcaaacaccgagctcctc

SEQ ID NO: 117244 - DNA, 25 bp, Homo sapien
ctgctgtgtcatgcaagaaggaggc

SEQ ID NO: 117245 - DNA, 25 bp, Homo sapien
aggaacctgatcctccggtagcgaa

SEQ ID NO: 117246 - DNA, 25 bp, Homo sapien
cttcctgggcggatggcttgaaatt

SEQ ID NO: 117247 - DNA, 25 bp, Homo sapien
ctacggtgctgacaagatggcggct

SEQ ID NO: 117248 - DNA, 25 bp, Homo sapien
ggggacagttcagtcgattgctgcc

SEQ ID NO: 117249 - DNA, 25 bp, Homo sapien
cccgaatgtctgaggtcgtccgagg

SEQ ID NO: 117250 - DNA, 25 bp, Homo sapien
ctccggagtcttagttcagctgctg

SEQ ID NO: 117251 - DNA, 25 bp, Homo sapien
cgcgctacacaagtggagctccttt

SEQ ID NO: 117252 - DNA, 25 bp, Homo sapien
gagcgacgtgggaaaccctgagata

SEQ ID NO: 117253 - DNA, 25 bp, Homo sapien
ccctgagataggacattggcccggc

SEQ ID NO: 117254 - DNA, 25 bp, Homo sapien
ttcccgagtaagtgccgggccttga

SEQ ID NO: 117255 - DNA, 25 bp, Homo sapien
tataatgattacctgcgggcggctc

SEQ ID NO: 117256 - DNA, 25 bp, Homo sapien
ggcgtttagccgagctctctgatta

SEQ ID NO: 117257 - DNA, 25 bp, Homo sapien
taccgccgtttatcagagtcgcagc

SEQ ID NO: 117258 - DNA, 25 bp, Homo sapien
gagtcgcagctttcgttccgccgct

SEQ ID NO: 117259 - DNA, 25 bp, Homo sapien
cgccgacaaagtcctcgctggatta

SEQ ID NO: 117260 - DNA, 25 bp, Homo sapien
gctggattaccgtcgcctgcccgat

SEQ ID NO: 117261 - DNA, 25 bp, Homo sapien
atgcccattccgattacgcacgcta

SEQ ID NO: 117262 - DNA, 25 bp, Homo sapien
acgcacgctattcgggctcctataa

SEQ ID NO: 117263 - DNA, 25 bp, Homo sapien
ttctttcccatgcaaacccacttag

SEQ ID NO: 117264 - DNA, 25 bp, Homo sapien
actcaccattctgggagggcgacgg

SEQ ID NO: 117265 - DNA, 25 bp, Homo sapien
caaggtcagggctccgtgtgtgacc

SEQ ID NO: 117266 - DNA, 25 bp, Homo sapien
cacctgccgcgctgcggagtttgga

SEQ ID NO: 117267 - DNA, 25 bp, Homo sapien
gagacgaatctacgcccaggccctg

SEQ ID NO: 117268 - DNA, 25 bp, Homo sapien
actcctcccgagtggagagtggaga

SEQ ID NO: 117269 - DNA, 25 bp, Homo sapien
cggcggcgttgacaacagtagcagc

SEQ ID NO: 117270 - DNA, 25 bp, Homo sapien
tgtttgcccgggcagaatccaccgc

SEQ ID NO: 117271 - DNA, 25 bp, Homo sapien
ggaggggttttctccaggatctagc

SEQ ID NO: 117272 - DNA, 25 bp, Homo sapien
ggatctagccgcgtcccgggcacag

SEQ ID NO: 117273 - DNA, 25 bp, Homo sapien
cccgcctgaagaggaggcacatcgg

SEQ ID NO: 117274 - DNA, 25 bp, Homo sapien
ctggagtctatctgccagatggggc

SEQ ID NO: 117275 - DNA, 25 bp, Homo sapien
tccggggttgctaatctggagtcta

SEQ ID NO: 117276 - DNA, 25 bp, Homo sapien
aagtcggctgcaagcaggcgatgcc

SEQ ID NO: 117277 - DNA, 25 bp, Homo sapien
aaatttggctcacgtgactccgggg

SEQ ID NO: 117278 - DNA, 25 bp, Homo sapien
gtacggcgtaaatttggctcacgtg

SEQ ID NO: 117279 - DNA, 25 bp, Homo sapien
gggttccaagctcgggctctgagcc

SEQ ID NO: 117280 - DNA, 25 bp, Homo sapien
aaagagctcggcacaccgtgtgtcc

SEQ ID NO: 117281 - DNA, 25 bp, Homo sapien
tcgacccaggtggacgaaagagctc

SEQ ID NO: 117282 - DNA, 25 bp, Homo sapien
cagtagatttgtggaggtcgaccca

SEQ ID NO: 117283 - DNA, 25 bp, Homo sapien
cgcggcggcaggcttttctaagccg

SEQ ID NO: 117284 - DNA, 25 bp, Homo sapien
cgcgcgcttcctagttctagcagca

SEQ ID NO: 117285 - DNA, 25 bp, Homo sapien
tctaagccggtttctctggagggtg

SEQ ID NO: 117286 - DNA, 25 bp, Homo sapien
tcattggagaaggaaccgcgcggcc

SEQ ID NO: 117287 - DNA, 25 bp, Homo sapien
tccaaggtgggcgtaatgtccaaca

SEQ ID NO: 117288 - DNA, 25 bp, Homo sapien
acagcttctcttgcggcgtccaagg

SEQ ID NO: 117289 - DNA, 25 bp, Homo sapien
gcaaatactccaccgaggcacaggg

SEQ ID NO: 117290 - DNA, 25 bp, Homo sapien
gccctcctctgaacgtgtgcgtgtg

SEQ ID NO: 117291 - DNA, 25 bp, Homo sapien
agatggagcctatgccgctgcctct

SEQ ID NO: 117292 - DNA, 25 bp, Homo sapien
gagcgccgcattgacactgcagatg

SEQ ID NO: 117293 - DNA, 25 bp, Homo sapien
ggcccaggtctgtccgaccttgctg

SEQ ID NO: 117294 - DNA, 25 bp, Homo sapien
ccgcgggctgaatgtccttgatgcc

SEQ ID NO: 117295 - DNA, 25 bp, Homo sapien
cgacccggatgctatggcaacaggt

SEQ ID NO: 117296 - DNA, 25 bp, Homo sapien
attggttcacccgacccggatgcta

SEQ ID NO: 117297 - DNA, 25 bp, Homo sapien
ggcgatgcgaactgcccgcctctgt

SEQ ID NO: 117298 - DNA, 25 bp, Homo sapien
aacgcctcaggttggtcggcgatgc

SEQ ID NO: 117299 - DNA, 25 bp, Homo sapien
tttgatagctttccgcggagtccct

SEQ ID NO: 117300 - DNA, 25 bp, Homo sapien
tgtagtgggaactgtggtctcgatc

SEQ ID NO: 117301 - DNA, 25 bp, Homo sapien
ggtgggtgatgggacattctctccc

SEQ ID NO: 117302 - DNA, 25 bp, Homo sapien
caacaggtggtgtttgatagctttc

SEQ ID NO: 117303 - DNA, 25 bp, Homo sapien
tcgcccggcaatgaggaagcgccca

SEQ ID NO: 117304 - DNA, 25 bp, Homo sapien
cagcgtgcggtcattccttcactca

SEQ ID NO: 117305 - DNA, 25 bp, Homo sapien
gatgagtcaagtggcaggttctgca

SEQ ID NO: 117306 - DNA, 25 bp, Homo sapien
ctctccattcacaggtggtgctggc

SEQ ID NO: 117307 - DNA, 25 bp, Homo sapien
gagcagtgtttccagaccgaattcc

SEQ ID NO: 117308 - DNA, 25 bp, Homo sapien
ctgaggaccgagagcagtgtttcca

SEQ ID NO: 117309 - DNA, 25 bp, Homo sapien
cgaagggacgcactccaggacgcac

SEQ ID NO: 117310 - DNA, 25 bp, Homo sapien
cggaacaaccaagcccaacgcagga

SEQ ID NO: 117311 - DNA, 25 bp, Homo sapien
cgctaaacaagatggcgacctccga

SEQ ID NO: 117312 - DNA, 25 bp, Homo sapien
tacagtttcgcgcagaaaaagagcg

SEQ ID NO: 117313 - DNA, 25 bp, Homo sapien
tacgcgcggaggagactacaggccc

SEQ ID NO: 117314 - DNA, 25 bp, Homo sapien
ctggggtcagtctcctaggcaaccc

SEQ ID NO: 117315 - DNA, 25 bp, Homo sapien
cccgatcgttacagtttcgcgcaga

SEQ ID NO: 117316 - DNA, 25 bp, Homo sapien
atcccgaactggagcccgatcgtta

SEQ ID NO: 117317 - DNA, 25 bp, Homo sapien
aggcttgggcagatcccgaactgga

SEQ ID NO: 117318 - DNA, 25 bp, Homo sapien
agggctctcctgaggaccagagctg

SEQ ID NO: 117319 - DNA, 25 bp, Homo sapien
cggccagactacatgtcccaggatg

SEQ ID NO: 117320 - DNA, 25 bp, Homo sapien
ccgcccagagcgctgaaagtaactc

SEQ ID NO: 117321 - DNA, 25 bp, Homo sapien
agtgtttcttgcgagaccgcccaga

SEQ ID NO: 117322 - DNA, 25 bp, Homo sapien
cgacgctgccaagaagctgtagttc

SEQ ID NO: 117323 - DNA, 25 bp, Homo sapien
tgaagtcccaaagcgtcagtgtttc

SEQ ID NO: 117324 - DNA, 25 bp, Homo sapien
cggccgccagggtcacaacaaactt

SEQ ID NO: 117325 - DNA, 25 bp, Homo sapien
tgccgtgcacctttacctcaggatg

SEQ ID NO: 117326 - DNA, 25 bp, Homo sapien
gttcgcagtcagcttcggtcccatt

SEQ ID NO: 117327 - DNA, 25 bp, Homo sapien
gcgcgtacctttaaatagcccgtga

SEQ ID NO: 117328 - DNA, 25 bp, Homo sapien
ggagctccgcactgcgccttgttaa

SEQ ID NO: 117329 - DNA, 25 bp, Homo sapien
gccctctaccggcttgagatgctta

SEQ ID NO: 117330 - DNA, 25 bp, Homo sapien
cctcagggagggcaagaatcgaaac

SEQ ID NO: 117331 - DNA, 25 bp, Homo sapien
ttacaagtgaggcaaccgggctaca

SEQ ID NO: 117332 - DNA, 25 bp, Homo sapien
ggcgcccgctaggacccaaaatgcg

SEQ ID NO: 117333 - DNA, 25 bp, Homo sapien
tccaccggtctgtgaagcccacttt

SEQ ID NO: 117334 - DNA, 25 bp, Homo sapien
ccttgttaacagctgggtccgggca

SEQ ID NO: 117335 - DNA, 25 bp, Homo sapien
acccgttgcctgatgacgagagttg

SEQ ID NO: 117336 - DNA, 25 bp, Homo sapien
gagttgtggcctcatcgtgcttccc

SEQ ID NO: 117337 - DNA, 25 bp, Homo sapien
gccgtttcctgagaccagagctgta

SEQ ID NO: 117338 - DNA, 25 bp, Homo sapien
ttctagcggctggataccgggttct

SEQ ID NO: 117339 - DNA, 25 bp, Homo sapien
atctccgaaggctgtccgaagtctc

SEQ ID NO: 117340 - DNA, 25 bp, Homo sapien
ttcctccgagctggttgctaggtga

SEQ ID NO: 117341 - DNA, 25 bp, Homo sapien
atcctctgggatccctcttcctgga

SEQ ID NO: 117342 - DNA, 25 bp, Homo sapien
tgtatccgcagcaggtcagcacttc

SEQ ID NO: 117343 - DNA, 25 bp, Homo sapien
agctccgaggttacagacgtttcca

SEQ ID NO: 117344 - DNA, 25 bp, Homo sapien
gcatttcagtgttcggcaggagcta

SEQ ID NO: 117345 - DNA, 25 bp, Homo sapien
atctgaagctcttttccgcggccgc

SEQ ID NO: 117346 - DNA, 25 bp, Homo sapien
cttgccggcctcttaggtaattggc

SEQ ID NO: 117347 - DNA, 25 bp, Homo sapien
ggtgcccattggctttcgcataaaa

SEQ ID NO: 117348 - DNA, 25 bp, Homo sapien
cgcggaatactgtctggctgtgcac

SEQ ID NO: 117349 - DNA, 25 bp, Homo sapien
ttggcgtccgtggtaaccaatcagg

SEQ ID NO: 117350 - DNA, 25 bp, Homo sapien
ttggcgccatgaagctaaagactgc

SEQ ID NO: 117351 - DNA, 25 bp, Homo sapien
gaacgcgatgtgctgccagttcaca

SEQ ID NO: 117352 - DNA, 25 bp, Homo sapien
taatgccgccggctggcatccggtt

SEQ ID NO: 117353 - DNA, 25 bp, Homo sapien
cccatgctggcagtggtaatgccgc

SEQ ID NO: 117354 - DNA, 25 bp, Homo sapien
attccaagcggttgtgggacccacg

SEQ ID NO: 117355 - DNA, 25 bp, Homo sapien
ccgggaggcaaattccaagcggttg

SEQ ID NO: 117356 - DNA, 25 bp, Homo sapien
gcaacggctccttccgactggagcg

SEQ ID NO: 117357 - DNA, 25 bp, Homo sapien
cggcaacttccagaagccgggtctc

SEQ ID NO: 117358 - DNA, 25 bp, Homo sapien
cttagcttccagagcggagccggga

SEQ ID NO: 117359 - DNA, 25 bp, Homo sapien
agaacatcccaggtagtcccgaggc

SEQ ID NO: 117360 - DNA, 25 bp, Homo sapien
aggtactcccggaccagctcgtcag

SEQ ID NO: 117361 - DNA, 25 bp, Homo sapien
gcgccctgttggttggcgttacatc

SEQ ID NO: 117362 - DNA, 25 bp, Homo sapien
gccatcgcagcgctagcgtctttag

SEQ ID NO: 117363 - DNA, 25 bp, Homo sapien
gcggcggctttgtctgaattactga

SEQ ID NO: 117364 - DNA, 25 bp, Homo sapien
gaattactgaaagtggcggctgcca

SEQ ID NO: 117365 - DNA, 25 bp, Homo sapien
tgccacccacgtcaaacaagactgg

SEQ ID NO: 117366 - DNA, 25 bp, Homo sapien
tgaacccgcggaagagcaggtactc

SEQ ID NO: 117367 - DNA, 25 bp, Homo sapien
ctccggcgcacgaagccgggtgact

SEQ ID NO: 117368 - DNA, 25 bp, Homo sapien
aggtctgttttctgacccagacagg

SEQ ID NO: 117369 - DNA, 25 bp, Homo sapien
acgaggtgccaggtctgttttctga

SEQ ID NO: 117370 - DNA, 25 bp, Homo sapien
ccctgtaacgaggtgccaggtctgt

SEQ ID NO: 117371 - DNA, 25 bp, Homo sapien
gcccattggcccgtcaccacgcatc

SEQ ID NO: 117372 - DNA, 25 bp, Homo sapien
ttttctgtcgccttcggacaacttg

SEQ ID NO: 117373 - DNA, 25 bp, Homo sapien
agctgattactgacgcgagggtccc

SEQ ID NO: 117374 - DNA, 25 bp, Homo sapien
cggacaacttgtaacactgtttctt

SEQ ID NO: 117375 - DNA, 25 bp, Homo sapien
cgaatcgcttcgagagggagcttta

SEQ ID NO: 117376 - DNA, 25 bp, Homo sapien
catgaaccgaatcccgaatcgcttc

SEQ ID NO: 117377 - DNA, 25 bp, Homo sapien
acctgtggcagaacctctcggagga

SEQ ID NO: 117378 - DNA, 25 bp, Homo sapien
cttctgactggcagcgggatcatta

SEQ ID NO: 117379 - DNA, 25 bp, Homo sapien
ggcgccgcttctgttccaggtatct

SEQ ID NO: 117380 - DNA, 25 bp, Homo sapien
ttttacaaacagacgatggaccttc

SEQ ID NO: 117381 - DNA, 25 bp, Homo sapien
tgctggggtccacaccatgaaccga

SEQ ID NO: 117382 - DNA, 25 bp, Homo sapien
cgctggtctccacgcccgaggaggt

SEQ ID NO: 117383 - DNA, 25 bp, Homo sapien
gactctcagctttcggtgggttcca

SEQ ID NO: 117384 - DNA, 25 bp, Homo sapien
caatgtcatttggtcggcggttttc

SEQ ID NO: 117385 - DNA, 25 bp, Homo sapien
ccgcccaccagggatatctaaaggg

SEQ ID NO: 117386 - DNA, 25 bp, Homo sapien
tgcacgcgtgtgctgcttcaatgtc

SEQ ID NO: 117387 - DNA, 25 bp, Homo sapien
tgctggactgatgcctttcttcgtg

SEQ ID NO: 117388 - DNA, 25 bp, Homo sapien
cgggccaccatcttacattagggta

SEQ ID NO: 117389 - DNA, 25 bp, Homo sapien
ccgggagttgaagtcctctctcaga

SEQ ID NO: 117390 - DNA, 25 bp, Homo sapien
attgcttcagcgagtccgaccttta

SEQ ID NO: 117391 - DNA, 25 bp, Homo sapien
tcttcgcaagtcctgtcgcgcgctc

SEQ ID NO: 117392 - DNA, 25 bp, Homo sapien
ttcaggcggtgaggccaacgcgctc

SEQ ID NO: 117393 - DNA, 25 bp, Homo sapien
gggcgctgcgacactgcaagtcgtt

SEQ ID NO: 117394 - DNA, 25 bp, Homo sapien
acactgcaagtcgtttccgggcgcg

SEQ ID NO: 117395 - DNA, 25 bp, Homo sapien
gcggagctgctgcagtccttcgcgc

SEQ ID NO: 117396 - DNA, 25 bp, Homo sapien
catttcccccttgaggattgccgac

SEQ ID NO: 117397 - DNA, 25 bp, Homo sapien
accgacatcatgctccagttcctgg

SEQ ID NO: 117398 - DNA, 25 bp, Homo sapien
tccagttcctggtgagtggagctgc

SEQ ID NO: 117399 - DNA, 25 bp, Homo sapien
atctcgggcgacctggaggccctcg

SEQ ID NO: 117400 - DNA, 25 bp, Homo sapien
agcgcgtgacaatctcccatctcgg

SEQ ID NO: 117401 - DNA, 25 bp, Homo sapien
tgacgtgtgaccagtccctggtgtg

SEQ ID NO: 117402 - DNA, 25 bp, Homo sapien
ttgttcgggcccgtgatgttgacgt

SEQ ID NO: 117403 - DNA, 25 bp, Homo sapien
atgcccggctcttgttcgggcccgt

SEQ ID NO: 117404 - DNA, 25 bp, Homo sapien
ccatttacgtctgtgccggcaggga

SEQ ID NO: 117405 - DNA, 25 bp, Homo sapien
ccctttgcaccggagcagtcgcata

SEQ ID NO: 117406 - DNA, 25 bp, Homo sapien
ccaccacgttccatttacgtctgtg

SEQ ID NO: 117407 - DNA, 25 bp, Homo sapien
ccggggctacctggccgctgagtca

SEQ ID NO: 117408 - DNA, 25 bp, Homo sapien
cgaggggagcgcgacagtgagcgcc

SEQ ID NO: 117409 - DNA, 25 bp, Homo sapien
cgccctccgcgcgacgccaggtgag

SEQ ID NO: 117410 - DNA, 25 bp, Homo sapien
cggggcccgagaccctcatgcggcc

SEQ ID NO: 117411 - DNA, 25 bp, Homo sapien
aggacgaggatccacgcgggtcggc

SEQ ID NO: 117412 - DNA, 25 bp, Homo sapien
gcgcgtggattctccgcggcttccg

SEQ ID NO: 117413 - DNA, 25 bp, Homo sapien
gatcctgggactggtgtcgctctca

SEQ ID NO: 117414 - DNA, 25 bp, Homo sapien
cgcccgggccatgcttgccgcgccg

SEQ ID NO: 117415 - DNA, 25 bp, Homo sapien
ggcgcgaacgccactagtgcgcatg

SEQ ID NO: 117416 - DNA, 25 bp, Homo sapien
gccaccgggcccagcagagaggttc

SEQ ID NO: 117417 - DNA, 25 bp, Homo sapien
cagcagagaggttccgcctggccga

SEQ ID NO: 117418 - DNA, 25 bp, Homo sapien
agaggcaggaacctttacacttccg

SEQ ID NO: 117419 - DNA, 25 bp, Homo sapien
tcctccgcggaacgcctctctctgg

SEQ ID NO: 117420 - DNA, 25 bp, Homo sapien
atgcgcaatgtacaggctgccggga

SEQ ID NO: 117421 - DNA, 25 bp, Homo sapien
cagcagcaagcggatgccgccgggc

SEQ ID NO: 117422 - DNA, 25 bp, Homo sapien
gagaaagaaagttcttttgcggcca

SEQ ID NO: 117423 - DNA, 25 bp, Homo sapien
agcccgaagctcatgaggtaccaga

SEQ ID NO: 117424 - DNA, 25 bp, Homo sapien
ggctgccctgagatacagaattgtc

SEQ ID NO: 117425 - DNA, 25 bp, Homo sapien
ctcacggggtaagtagagactcatc

SEQ ID NO: 117426 - DNA, 25 bp, Homo sapien
ctaacttgtagctctcggacacgga

SEQ ID NO: 117427 - DNA, 25 bp, Homo sapien
gtcccaggcaatcgccgctaacttg

SEQ ID NO: 117428 - DNA, 25 bp, Homo sapien
aatgtcccttggagtccgcacctga

SEQ ID NO: 117429 - DNA, 25 bp, Homo sapien
caaggctcttgcatgtacggaaata

SEQ ID NO: 117430 - DNA, 25 bp, Homo sapien
gggcttcgccacctaactcacaatg

SEQ ID NO: 117431 - DNA, 25 bp, Homo sapien
gtggcagacttgaccgagcaatata

SEQ ID NO: 117432 - DNA, 25 bp, Homo sapien
tgcgtacgccttacaccatgagcta

SEQ ID NO: 117433 - DNA, 25 bp, Homo sapien
gatgcctactacaagcgctgccgtg

SEQ ID NO: 117434 - DNA, 25 bp, Homo sapien
ctgcagctgcctccgtgtataatta

SEQ ID NO: 117435 - DNA, 25 bp, Homo sapien
tctctgtacgacatggcccggtatg

SEQ ID NO: 117436 - DNA, 25 bp, Homo sapien
cagccgcgcggaattctctgtacga

SEQ ID NO: 117437 - DNA, 25 bp, Homo sapien
ccacttcatattacgggcgggatcg

SEQ ID NO: 117438 - DNA, 25 bp, Homo sapien
tggtccaaagagtgtccgatagatc

SEQ ID NO: 117439 - DNA, 25 bp, Homo sapien
ctctggtcctcgcaagggctgagag

SEQ ID NO: 117440 - DNA, 25 bp, Homo sapien
acttttgaccagctggcccctgatg

SEQ ID NO: 117441 - DNA, 25 bp, Homo sapien
gagcgcaccagaggccgactggcca

SEQ ID NO: 117442 - DNA, 25 bp, Homo sapien
tgtgcactgcgcatgaccagccagg

SEQ ID NO: 117443 - DNA, 25 bp, Homo sapien
aaaggctgtggcaccgtcctgctct

SEQ ID NO: 117444 - DNA, 25 bp, Homo sapien
ctgctctctggtcctcgcaagggct

SEQ ID NO: 117445 - DNA, 25 bp, Homo sapien
agttcgagcgcaccagaggccgact

SEQ ID NO: 117446 - DNA, 25 bp, Homo sapien
actgaaggtgtgtgcactgcgcatg

SEQ ID NO: 117447 - DNA, 25 bp, Homo sapien
aaccttggagtgaattcgtcggcgg

SEQ ID NO: 117448 - DNA, 25 bp, Homo sapien
ggtgccaagtcgaagcgccgacctc

SEQ ID NO: 117449 - DNA, 25 bp, Homo sapien
ctccgccagtgggaaccttggagtg

SEQ ID NO: 117450 - DNA, 25 bp, Homo sapien
ttcctaaatcccgagcgaaagccca

SEQ ID NO: 117451 - DNA, 25 bp, Homo sapien
gcgaaagcccaagctgaacatgaac

SEQ ID NO: 117452 - DNA, 25 bp, Homo sapien
gaacatgaactctgcccggaggcga

SEQ ID NO: 117453 - DNA, 25 bp, Homo sapien
attgtgggaaactccgctcactccc

SEQ ID NO: 117454 - DNA, 25 bp, Homo sapien
cggctgcaccgcaccggggcattgt

SEQ ID NO: 117455 - DNA, 25 bp, Homo sapien
aagtctccgcccacgccttggaatg

SEQ ID NO: 117456 - DNA, 25 bp, Homo sapien
cgggctctgacagctcgctcagctt

SEQ ID NO: 117457 - DNA, 25 bp, Homo sapien
tcggaccggcaaggttcctctctct

SEQ ID NO: 117458 - DNA, 25 bp, Homo sapien
gaagacccgctctcatcccaggaaa

SEQ ID NO: 117459 - DNA, 25 bp, Homo sapien
gctacggctccagacacaaactttg

SEQ ID NO: 117460 - DNA, 25 bp, Homo sapien
cttgaccaattggatatccgccttg

SEQ ID NO: 117461 - DNA, 25 bp, Homo sapien
gccttgcctagcagacccaatcaga

SEQ ID NO: 117462 - DNA, 25 bp, Homo sapien
cgggtcctcaccgtgtggtacatga

SEQ ID NO: 117463 - DNA, 25 bp, Homo sapien
gtgtgccaccagaacatccagagcc

SEQ ID NO: 117464 - DNA, 25 bp, Homo sapien
tcaacctgttggacacttgcgccgt

SEQ ID NO: 117465 - DNA, 25 bp, Homo sapien
gcgagtccaccgagcggcctctgag

SEQ ID NO: 117466 - DNA, 25 bp, Homo sapien
gtgcgaggaacggtctccgctgaca

SEQ ID NO: 117467 - DNA, 25 bp, Homo sapien
agaacatccagagccgggcgcccaa

SEQ ID NO: 117468 - DNA, 25 bp, Homo sapien
caccgaagcctcagttgctgggaga

SEQ ID NO: 117469 - DNA, 25 bp, Homo sapien
ttcgccacccaaggtgagaaccggc

SEQ ID NO: 117470 - DNA, 25 bp, Homo sapien
gctgggcgtattccacgagcgcctc

SEQ ID NO: 117471 - DNA, 25 bp, Homo sapien
cattgggcgcgtgcctaaccctctg

SEQ ID NO: 117472 - DNA, 25 bp, Homo sapien
gaccctccaccagatgcgcgcctaa

SEQ ID NO: 117473 - DNA, 25 bp, Homo sapien
taatcctccatcaggcgcgcgccta

SEQ ID NO: 117474 - DNA, 25 bp, Homo sapien
ctctgacccattgggcgcgtgccta

SEQ ID NO: 117475 - DNA, 25 bp, Homo sapien
atcgggcacgcctctgacccattgg

SEQ ID NO: 117476 - DNA, 25 bp, Homo sapien
gggcgtgcgcctaaccctccaacgc

SEQ ID NO: 117477 - DNA, 25 bp, Homo sapien
agcgtccttgagctcccatcgggca

SEQ ID NO: 117478 - DNA, 25 bp, Homo sapien
agcgcctttaatcctccatcgggca

SEQ ID NO: 117479 - DNA, 25 bp, Homo sapien
agaaactggagtcggtggcacgcac

SEQ ID NO: 117480 - DNA, 25 bp, Homo sapien
ctgggcatccgatgtaggctgagtt

SEQ ID NO: 117481 - DNA, 25 bp, Homo sapien
ggcctcctgtaggtgccatcgctgt

SEQ ID NO: 117482 - DNA, 25 bp, Homo sapien
cccacccgagttccagaaactggag

SEQ ID NO: 117483 - DNA, 25 bp, Homo sapien
ccatcgctgtctgtggtgatgagcc

SEQ ID NO: 117484 - DNA, 25 bp, Homo sapien
tgatgagccggtccttctcagcgtc

SEQ ID NO: 117485 - DNA, 25 bp, Homo sapien
tctcagcgtcggcaggacagccgtt

SEQ ID NO: 117486 - DNA, 25 bp, Homo sapien
gcgaggcttgggagaacgttttatc

SEQ ID NO: 117487 - DNA, 25 bp, Homo sapien
cgctccttagtgtcgcccgaggaca

SEQ ID NO: 117488 - DNA, 25 bp, Homo sapien
tgtcgatctgcatctgtgccctgcg

SEQ ID NO: 117489 - DNA, 25 bp, Homo sapien
tggggtccaggatcttgtcgatctg

SEQ ID NO: 117490 - DNA, 25 bp, Homo sapien
gcggtacacccggtgtcgctcctta

SEQ ID NO: 117491 - DNA, 25 bp, Homo sapien
ttcctgggctctatgaacacggagg

SEQ ID NO: 117492 - DNA, 25 bp, Homo sapien
caggtcgtctaccaccgggaactcg

SEQ ID NO: 117493 - DNA, 25 bp, Homo sapien
cttgttgcgatggtgctcgatctca

SEQ ID NO: 117494 - DNA, 25 bp, Homo sapien
ctcgatctcagacttgtgccgcagc

SEQ ID NO: 117495 - DNA, 25 bp, Homo sapien
ccgccttcctgccttaagaaggtgc

SEQ ID NO: 117496 - DNA, 25 bp, Homo sapien
gagagaatgcccagagagcgtttga

SEQ ID NO: 117497 - DNA, 25 bp, Homo sapien
cgttttagggaaagtggcgctcctg

SEQ ID NO: 117498 - DNA, 25 bp, Homo sapien
ccctgcacttagcaggccttgagca

SEQ ID NO: 117499 - DNA, 25 bp, Homo sapien
gccagacaaagtcgggctcctgcgc

SEQ ID NO: 117500 - DNA, 25 bp, Homo sapien
tgccttaagaaggtgcggccacctc

SEQ ID NO: 117501 - DNA, 25 bp, Homo sapien
ctcctgcgctagagctcagcgtgca

SEQ ID NO: 117502 - DNA, 25 bp, Homo sapien
ccacctctgcgggtcttcgggaagc

SEQ ID NO: 117503 - DNA, 25 bp, Homo sapien
agacacaatgcgaggacgtcgttcc

SEQ ID NO: 117504 - DNA, 25 bp, Homo sapien
ctgctgggcgtaagacacaatgcga

SEQ ID NO: 117505 - DNA, 25 bp, Homo sapien
gtgttttgttagctgctgggcgtaa

SEQ ID NO: 117506 - DNA, 25 bp, Homo sapien
ctggtgaccaccgaaactcagagga

SEQ ID NO: 117507 - DNA, 25 bp, Homo sapien
actgcacttctctggtgaccaccga

SEQ ID NO: 117508 - DNA, 25 bp, Homo sapien
cggagaactttgctgcccggcgctg

SEQ ID NO: 117509 - DNA, 25 bp, Homo sapien
gcgtgagcgctgcacccttacttac

SEQ ID NO: 117510 - DNA, 25 bp, Homo sapien
cacccttacttacgtcggctgctgg

SEQ ID NO: 117511 - DNA, 25 bp, Homo sapien
tcccgccaaatatcaccagaataag

SEQ ID NO: 117512 - DNA, 25 bp, Homo sapien
ccagaataagtgagctccgaagtcc

SEQ ID NO: 117513 - DNA, 25 bp, Homo sapien
gctccgaagtcccagtccggattta

SEQ ID NO: 117514 - DNA, 25 bp, Homo sapien
agcaacttttctggcgtgggcggtt

SEQ ID NO: 117515 - DNA, 25 bp, Homo sapien
ttctcaccagcagtcccggttgggg

SEQ ID NO: 117516 - DNA, 25 bp, Homo sapien
tcctgcagcaggaaacgctcgggcc

SEQ ID NO: 117517 - DNA, 25 bp, Homo sapien
gccgcgcaggtccttcaggaacatg

SEQ ID NO: 117518 - DNA, 25 bp, Homo sapien
acagcgttgatggagcgtctgctcc

SEQ ID NO: 117519 - DNA, 25 bp, Homo sapien
gcccagcgctcacaggtcgtttatt

SEQ ID NO: 117520 - DNA, 25 bp, Homo sapien
cagtgaccaccaacaacgacagagg

SEQ ID NO: 117521 - DNA, 25 bp, Homo sapien
ctggcggtcttcatctcggatatcc

SEQ ID NO: 117522 - DNA, 25 bp, Homo sapien
ccaagtaagaaaacggagactgctc

SEQ ID NO: 117523 - DNA, 25 bp, Homo sapien
cgcggaacaaacaaggccctggcct

SEQ ID NO: 117524 - DNA, 25 bp, Homo sapien
cgtctcaggataccgtgctagggga

SEQ ID NO: 117525 - DNA, 25 bp, Homo sapien
tcagggaccgcaagagatgtggccc

SEQ ID NO: 117526 - DNA, 25 bp, Homo sapien
gtggccgcctcttttgcagtgacca

SEQ ID NO: 117527 - DNA, 25 bp, Homo sapien
ttattcttctgattcgtgcgggcgg

SEQ ID NO: 117528 - DNA, 25 bp, Homo sapien
accgctcggactgcgaatagttgca

SEQ ID NO: 117529 - DNA, 25 bp, Homo sapien
accggcccagcaagttgagtttgca

SEQ ID NO: 117530 - DNA, 25 bp, Homo sapien
cagggtctctggcagtacttgcgac

SEQ ID NO: 117531 - DNA, 25 bp, Homo sapien
ggtctccaacaccacaaagcggtcg

SEQ ID NO: 117532 - DNA, 25 bp, Homo sapien
tccactctcggctctcaggtcaaga

SEQ ID NO: 117533 - DNA, 25 bp, Homo sapien
tctcctccaggcactagcattttag

SEQ ID NO: 117534 - DNA, 25 bp, Homo sapien
tgatgaagcagcacacctccgggtc

SEQ ID NO: 117535 - DNA, 25 bp, Homo sapien
tcctcccaagaggaacctcggctct

SEQ ID NO: 117536 - DNA, 25 bp, Homo sapien
tcgtaccagcgtccaggcggggtta

SEQ ID NO: 117537 - DNA, 25 bp, Homo sapien
agcttttctcccgttcgtaccagcg

SEQ ID NO: 117538 - DNA, 25 bp, Homo sapien
gggcgctggttctccaacgagcttt

SEQ ID NO: 117539 - DNA, 25 bp, Homo sapien
acggaaccaagaagccgcgggcgct

SEQ ID NO: 117540 - DNA, 25 bp, Homo sapien
tccgcggcagaagctgcacggaacc

SEQ ID NO: 117541 - DNA, 25 bp, Homo sapien
tgtggtggggactcacaagaccgac

SEQ ID NO: 117542 - DNA, 25 bp, Homo sapien
gcagaagctgcacggaaccaagaag

SEQ ID NO: 117543 - DNA, 25 bp, Homo sapien
cggtgaagcccatcagaacgtagta

SEQ ID NO: 117544 - DNA, 25 bp, Homo sapien
ccgggtgcgaatagtaaactgctcg

SEQ ID NO: 117545 - DNA, 25 bp, Homo sapien
cagcggcctgcttctatttatgtgg

SEQ ID NO: 117546 - DNA, 25 bp, Homo sapien
gagccgcgcagagtagcgttcatta

SEQ ID NO: 117547 - DNA, 25 bp, Homo sapien
ttcattagcttgtcaccggtgcggc

SEQ ID NO: 117548 - DNA, 25 bp, Homo sapien
agagctgcgtggagttcagttaccc

SEQ ID NO: 117549 - DNA, 25 bp, Homo sapien
acaggccgagccatgtcgtcacttc

SEQ ID NO: 117550 - DNA, 25 bp, Homo sapien
ggtcggtctcagtcccatcccgatg

SEQ ID NO: 117551 - DNA, 25 bp, Homo sapien
gtccgaccgtaccattaggcgcctg

SEQ ID NO: 117552 - DNA, 25 bp, Homo sapien
ttggtcggctaacgggcatcttcaa

SEQ ID NO: 117553 - DNA, 25 bp, Homo sapien
cccttgttctgggttagaggtcctg

SEQ ID NO: 117554 - DNA, 25 bp, Homo sapien
gaggtcctggtaccttcagttaaca

SEQ ID NO: 117555 - DNA, 25 bp, Homo sapien
cggtcaacggacaagtgagcggttc

SEQ ID NO: 117556 - DNA, 25 bp, Homo sapien
tggtgggctgcaattttcgagaatc

SEQ ID NO: 117557 - DNA, 25 bp, Homo sapien
tgtcttctcagcgtgttccatatca

SEQ ID NO: 117558 - DNA, 25 bp, Homo sapien
agcggttccactgctcgtcagtcga

SEQ ID NO: 117559 - DNA, 25 bp, Homo sapien
cgacgatgggcatggtctctactta

SEQ ID NO: 117560 - DNA, 25 bp, Homo sapien
gggctgtcgtcttccacgtacacgt

SEQ ID NO: 117561 - DNA, 25 bp, Homo sapien
ggctaacctctagcgcattttgcta

SEQ ID NO: 117562 - DNA, 25 bp, Homo sapien
atttgggtctgaatcgccatcaccg

SEQ ID NO: 117563 - DNA, 25 bp, Homo sapien
ggatccggcttgcacagtcagttaa

SEQ ID NO: 117564 - DNA, 25 bp, Homo sapien
gcccgtgtcgcttctgtcccaagaa

SEQ ID NO: 117565 - DNA, 25 bp, Homo sapien
cacctcccgggacggtaagtctctg

SEQ ID NO: 117566 - DNA, 25 bp, Homo sapien
agagccgttagggtggaactccact

SEQ ID NO: 117567 - DNA, 25 bp, Homo sapien
gccattccggggcagcttgaccaag

SEQ ID NO: 117568 - DNA, 25 bp, Homo sapien
gcaccggcaccttgaggaagcgcgt

SEQ ID NO: 117569 - DNA, 25 bp, Homo sapien
acttgggctgctttcgggaccttca

SEQ ID NO: 117570 - DNA, 25 bp, Homo sapien
ggtgagcactcacccgtaagcgtta

SEQ ID NO: 117571 - DNA, 25 bp, Homo sapien
gtcgccgaagttgtcaggccacgcc

SEQ ID NO: 117572 - DNA, 25 bp, Homo sapien
ggctttttcttgctcgagggctcca

SEQ ID NO: 117573 - DNA, 25 bp, Homo sapien
ggaccttcaggttgtcgcaccttcg

SEQ ID NO: 117574 - DNA, 25 bp, Homo sapien
ttcccacgggctccattgggagctc

SEQ ID NO: 117575 - DNA, 25 bp, Homo sapien
cggcacccggcgcagaggctccagc

SEQ ID NO: 117576 - DNA, 25 bp, Homo sapien
gtcgggctacgagggcagcaccagc

SEQ ID NO: 117577 - DNA, 25 bp, Homo sapien
agtcattcatttcagggcggccaga

SEQ ID NO: 117578 - DNA, 25 bp, Homo sapien
cggcggagtcattcatttcagggcg

SEQ ID NO: 117579 - DNA, 25 bp, Homo sapien
gacgcggcggagtcattcatttcag

SEQ ID NO: 117580 - DNA, 25 bp, Homo sapien
gtcagagtcaccttggccgctgtcc

SEQ ID NO: 117581 - DNA, 25 bp, Homo sapien
gacccggaggcggtcagagtcacct

SEQ ID NO: 117582 - DNA, 25 bp, Homo sapien
tcattcatttcagggcggccagacg

SEQ ID NO: 117583 - DNA, 25 bp, Homo sapien
cttacgcttgagtccacatttttgg

SEQ ID NO: 117584 - DNA, 25 bp, Homo sapien
gacgcattaggttgtgtggtccgcc

SEQ ID NO: 117585 - DNA, 25 bp, Homo sapien
tctgaatcatgggtggatgctcctc

SEQ ID NO: 117586 - DNA, 25 bp, Homo sapien
tcctcgatgatctgcacgctgcttg

SEQ ID NO: 117587 - DNA, 25 bp, Homo sapien
cacgctgcttgtgttctcgatctcc

SEQ ID NO: 117588 - DNA, 25 bp, Homo sapien
tcgatctcctcgctcttacgcttga

SEQ ID NO: 117589 - DNA, 25 bp, Homo sapien
ttggtaggtatcaaggaggctcaca

SEQ ID NO: 117590 - DNA, 25 bp, Homo sapien
aggctcacagtgcttcgacgcatta

SEQ ID NO: 117591 - DNA, 25 bp, Homo sapien
ctgccatcttgagcctgtgtctccg

SEQ ID NO: 117592 - DNA, 25 bp, Homo sapien
cgcgcgcaatcgagcgccgatggca

SEQ ID NO: 117593 - DNA, 25 bp, Homo sapien
ctggcaaagtggctcgcccatctca

SEQ ID NO: 117594 - DNA, 25 bp, Homo sapien
atctcacagccggttggcgctcgcg

SEQ ID NO: 117595 - DNA, 25 bp, Homo sapien
cttcggaaagccacacgaggtcaga

SEQ ID NO: 117596 - DNA, 25 bp, Homo sapien
agaggcaccgaagccctgccgtgca

SEQ ID NO: 117597 - DNA, 25 bp, Homo sapien
gttcctgccggagtctggcttccac

SEQ ID NO: 117598 - DNA, 25 bp, Homo sapien
gcctcagtcggaatctgccatcttg

SEQ ID NO: 117599 - DNA, 25 bp, Homo sapien
tcgtgttggaaagaagcagaagcag

SEQ ID NO: 117600 - DNA, 25 bp, Homo sapien
ccttcgagtcgtgttggaaagaagc

SEQ ID NO: 117601 - DNA, 25 bp, Homo sapien
gccctcagggctttccttcgagtcg

SEQ ID NO: 117602 - DNA, 25 bp, Homo sapien
ccacgctgccttccgtccacgcaga

SEQ ID NO: 117603 - DNA, 25 bp, Homo sapien
gacactggaaccacgctagtctccg

SEQ ID NO: 117604 - DNA, 25 bp, Homo sapien
cgatgacgacactggaaccacgcta

SEQ ID NO: 117605 - DNA, 25 bp, Homo sapien
tgcgctgggcccagatacgcggctc

SEQ ID NO: 117606 - DNA, 25 bp, Homo sapien
cccttttttagcagcgatgacgaca

SEQ ID NO: 117607 - DNA, 25 bp, Homo sapien
aggcctggacctgttgactgcgatt

SEQ ID NO: 117608 - DNA, 25 bp, Homo sapien
gcgcggccactttttacccaggatc

SEQ ID NO: 117609 - DNA, 25 bp, Homo sapien
tgccgagctggagtccttcctaatc

SEQ ID NO: 117610 - DNA, 25 bp, Homo sapien
attctctgccctctcgtccgaagga

SEQ ID NO: 117611 - DNA, 25 bp, Homo sapien
aaacctctgatttgctgcgtgctgc

SEQ ID NO: 117612 - DNA, 25 bp, Homo sapien
gttgactgcgattggcccgcctcat

SEQ ID NO: 117613 - DNA, 25 bp, Homo sapien
ggtgctgagaaagcccaggcaactc

SEQ ID NO: 117614 - DNA, 25 bp, Homo sapien
caaaaaggttcctcctgctcgctgc

SEQ ID NO: 117615 - DNA, 25 bp, Homo sapien
ggctcccacgtcagagagaacctta

SEQ ID NO: 117616 - DNA, 25 bp, Homo sapien
agacctcccgctgcaaaatgagaaa

SEQ ID NO: 117617 - DNA, 25 bp, Homo sapien
aatccgggccgtgcagtctgccgga

SEQ ID NO: 117618 - DNA, 25 bp, Homo sapien
gagaaccttacaaaatggcgacggc

SEQ ID NO: 117619 - DNA, 25 bp, Homo sapien
ggagccgagtgaccaatcccgaggc

SEQ ID NO: 117620 - DNA, 25 bp, Homo sapien
atcccgaggctgcatacaaatgacc

SEQ ID NO: 117621 - DNA, 25 bp, Homo sapien
atacaaatgaccacgcagcacgggg

SEQ ID NO: 117622 - DNA, 25 bp, Homo sapien
tgagaaacccaaatccgggccgtgc

SEQ ID NO: 117623 - DNA, 25 bp, Homo sapien
ttaaagccgctcagcgtcgcccagg

SEQ ID NO: 117624 - DNA, 25 bp, Homo sapien
gcgccgtagaccatgaacctgcaga

SEQ ID NO: 117625 - DNA, 25 bp, Homo sapien
ttacccggctctcaggaacttgcag

SEQ ID NO: 117626 - DNA, 25 bp, Homo sapien
ggccggcgaaaaacagaacctgtgc

SEQ ID NO: 117627 - DNA, 25 bp, Homo sapien
ctccgcatagaagacgcacttaatt

SEQ ID NO: 117628 - DNA, 25 bp, Homo sapien
acagggacaactgacgggagctctc

SEQ ID NO: 117629 - DNA, 25 bp, Homo sapien
gtacctagtccctgaaaatggcttc

SEQ ID NO: 117630 - DNA, 25 bp, Homo sapien
cgggcttcgtagacggctcacagaa

SEQ ID NO: 117631 - DNA, 25 bp, Homo sapien
ttcgtgtttgttgtggcgactcttc

SEQ ID NO: 117632 - DNA, 25 bp, Homo sapien
gttcacgtcgtacggctgccggcac

SEQ ID NO: 117633 - DNA, 25 bp, Homo sapien
catgaagcggttcacgtcgtacggc

SEQ ID NO: 117634 - DNA, 25 bp, Homo sapien
ttgtggcgactcttcgcccgggcca

SEQ ID NO: 117635 - DNA, 25 bp, Homo sapien
tgccggcacacacagtacacgggcg

SEQ ID NO: 117636 - DNA, 25 bp, Homo sapien
cggccctctttgttcgtgtttgttg

SEQ ID NO: 117637 - DNA, 25 bp, Homo sapien
ctggcccaggaagtttgataaagac

SEQ ID NO: 117638 - DNA, 25 bp, Homo sapien
aaccagtccttgcagatatcgcact

SEQ ID NO: 117639 - DNA, 25 bp, Homo sapien
gctcagccatcgcataggggggaac

SEQ ID NO: 117640 - DNA, 25 bp, Homo sapien
gcccaccagctgtggcaagtttcta

SEQ ID NO: 117641 - DNA, 25 bp, Homo sapien
caccagctgtggcaagtttctagta

SEQ ID NO: 117642 - DNA, 25 bp, Homo sapien
gctgtggcaagtttctagtaagaga

SEQ ID NO: 117643 - DNA, 25 bp, Homo sapien
ttctagtaagagagggatagagaca

SEQ ID NO: 117644 - DNA, 25 bp, Homo sapien
gggatagagacaggcggagaccgct

SEQ ID NO: 117645 - DNA, 25 bp, Homo sapien
ccgctggggagtttcccggtgctca

SEQ ID NO: 117646 - DNA, 25 bp, Homo sapien
tttcccggtgctcagccatcgcata

SEQ ID NO: 117647 - DNA, 25 bp, Homo sapien
cttggctagtgcctgatccttctct

SEQ ID NO: 117648 - DNA, 25 bp, Homo sapien
cgggcttggctagtgcctgatcctt

SEQ ID NO: 117649 - DNA, 25 bp, Homo sapien
gtttccgatacagcatgtgcggcct

SEQ ID NO: 117650 - DNA, 25 bp, Homo sapien
gtagccgtttccgatacagcatgtg

SEQ ID NO: 117651 - DNA, 25 bp, Homo sapien
ttgacaatcactccagtagccgttt

SEQ ID NO: 117652 - DNA, 25 bp, Homo sapien
gtgtgttgacaatcactccagtagc

SEQ ID NO: 117653 - DNA, 25 bp, Homo sapien
acccgctcagcgtgggctttggtgt

SEQ ID NO: 117654 - DNA, 25 bp, Homo sapien
cggggtcgttgtgtgttgacaatca

SEQ ID NO: 117655 - DNA, 25 bp, Homo sapien
cgcatcaccgcttgcgcacccgaga

SEQ ID NO: 117656 - DNA, 25 bp, Homo sapien
gagcacaaaagcctctgccgcatgg

SEQ ID NO: 117657 - DNA, 25 bp, Homo sapien
agcctctgccgcatggatcggggcc

SEQ ID NO: 117658 - DNA, 25 bp, Homo sapien
gacgcccacgtgaccctcccgtcgc

SEQ ID NO: 117659 - DNA, 25 bp, Homo sapien
tgcgaccagggtttccggacgccca

SEQ ID NO: 117660 - DNA, 25 bp, Homo sapien
gagatccgcagtggtcgccgctctc

SEQ ID NO: 117661 - DNA, 25 bp, Homo sapien
ttgcgcacccgagatccgcagtggt

SEQ ID NO: 117662 - DNA, 25 bp, Homo sapien
acaaaagcctctgccgcatggatcg

SEQ ID NO: 117663 - DNA, 25 bp, Homo sapien
cacgatgagggtccgctccagggtc

SEQ ID NO: 117664 - DNA, 25 bp, Homo sapien
cagcgtgaagccacctctcaaagcg

SEQ ID NO: 117665 - DNA, 25 bp, Homo sapien
cgtgaagccacctctcaaagcgctg

SEQ ID NO: 117666 - DNA, 25 bp, Homo sapien
ctctcaaagcgctggatcccgtccc

SEQ ID NO: 117667 - DNA, 25 bp, Homo sapien
agcgaaacccgcagcgcaacgcgcc

SEQ ID NO: 117668 - DNA, 25 bp, Homo sapien
ttcaccacgatgagggtccgctcca

SEQ ID NO: 117669 - DNA, 25 bp, Homo sapien
ccctcctgagctagggcgcacgaag

SEQ ID NO: 117670 - DNA, 25 bp, Homo sapien
atctggcttcaccacgatgagggtc

SEQ ID NO: 117671 - DNA, 25 bp, Homo sapien
aggtgacctgtttagtccagccgcc

SEQ ID NO: 117672 - DNA, 25 bp, Homo sapien
tcctgatgttgtggctgttgttccg

SEQ ID NO: 117673 - DNA, 25 bp, Homo sapien
aagcttcttctcacagttgggcgga

SEQ ID NO: 117674 - DNA, 25 bp, Homo sapien
tgcagagatcgagacaacgccggtc

SEQ ID NO: 117675 - DNA, 25 bp, Homo sapien
cgcgcaacgtcctacctgcaggtga

SEQ ID NO: 117676 - DNA, 25 bp, Homo sapien
gtatctgagcgctctcgccacttca

SEQ ID NO: 117677 - DNA, 25 bp, Homo sapien
ggatcacatagttccggtccggctg

SEQ ID NO: 117678 - DNA, 25 bp, Homo sapien
gcagcctccgccattactgtttatc

SEQ ID NO: 117679 - DNA, 25 bp, Homo sapien
ttagacctggacgtccaagcctggg

SEQ ID NO: 117680 - DNA, 25 bp, Homo sapien
acctcgggcagtgagtcaggcacca

SEQ ID NO: 117681 - DNA, 25 bp, Homo sapien
ccgcttactctaggcagttaacaca

SEQ ID NO: 117682 - DNA, 25 bp, Homo sapien
gcttccggcctgaggcttagacctg

SEQ ID NO: 117683 - DNA, 25 bp, Homo sapien
cggagctgcggtaaacaggaccttc

SEQ ID NO: 117684 - DNA, 25 bp, Homo sapien
ggcccagtgagctaatccgcagctg

SEQ ID NO: 117685 - DNA, 25 bp, Homo sapien
gggaactcagactcccgtctgcaga

SEQ ID NO: 117686 - DNA, 25 bp, Homo sapien
agttaacacactctcggcaccgggc

SEQ ID NO: 117687 - DNA, 25 bp, Homo sapien
gggcactttgcccaaggtcgtctcc

SEQ ID NO: 117688 - DNA, 25 bp, Homo sapien
ttccgcagttggtgccgtctgacag

SEQ ID NO: 117689 - DNA, 25 bp, Homo sapien
atccggcccagatgggcagctccgt

SEQ ID NO: 117690 - DNA, 25 bp, Homo sapien
gcgtctccgtcagggtttgcctgtc

SEQ ID NO: 117691 - DNA, 25 bp, Homo sapien
gtttgcctgtcgcacctgaggtgct

SEQ ID NO: 117692 - DNA, 25 bp, Homo sapien
gcacctgaggtgcttcgagctcaga

SEQ ID NO: 117693 - DNA, 25 bp, Homo sapien
gagtgccctcgcgatgccaggctct

SEQ ID NO: 117694 - DNA, 25 bp, Homo sapien
ttcgagctcagacagggactcagcc

SEQ ID NO: 117695 - DNA, 25 bp, Homo sapien
cacgtggccgctttttaatgctgaa

SEQ ID NO: 117696 - DNA, 25 bp, Homo sapien
tctcaccttgactggggcgcctgaa

SEQ ID NO: 117697 - DNA, 25 bp, Homo sapien
gtgtctcctgaagccgcgactcgag

SEQ ID NO: 117698 - DNA, 25 bp, Homo sapien
ttagggtagagtctgttcggcagcc

SEQ ID NO: 117699 - DNA, 25 bp, Homo sapien
cggcagcctttaatcggagacgtca

SEQ ID NO: 117700 - DNA, 25 bp, Homo sapien
tgaaaaatcactctggctgcaggga

SEQ ID NO: 117701 - DNA, 25 bp, Homo sapien
ccactcctggagatgagcgactctg

SEQ ID NO: 117702 - DNA, 25 bp, Homo sapien
cgccttttcagaagcggctgcgcac

SEQ ID NO: 117703 - DNA, 25 bp, Homo sapien
ttgagactgtccttccactcggcca

SEQ ID NO: 117704 - DNA, 25 bp, Homo sapien
cgggagaactctcggaatttgtctc

SEQ ID NO: 117705 - DNA, 25 bp, Homo sapien
ttggccagcgcattggcgctatcta

SEQ ID NO: 117706 - DNA, 25 bp, Homo sapien
gctatctacgcgctcctgaccgatg

SEQ ID NO: 117707 - DNA, 25 bp, Homo sapien
tcctgaccgatggtgcttgtgtccc

SEQ ID NO: 117708 - DNA, 25 bp, Homo sapien
ttgtgtcccgggagaactctcggaa

SEQ ID NO: 117709 - DNA, 25 bp, Homo sapien
agcagctcaagcaggtcagcccagg

SEQ ID NO: 117710 - DNA, 25 bp, Homo sapien
tcagcccaggcctcgttgagactgt

SEQ ID NO: 117711 - DNA, 25 bp, Homo sapien
ggtgtacctggtgaattctccttct

SEQ ID NO: 117712 - DNA, 25 bp, Homo sapien
gggcctcgagaatggcacggacaca

SEQ ID NO: 117713 - DNA, 25 bp, Homo sapien
ttcttctctgcgtacacctggcagg

SEQ ID NO: 117714 - DNA, 25 bp, Homo sapien
cggaggcgaacagcatctccacgca

SEQ ID NO: 117715 - DNA, 25 bp, Homo sapien
ccacgcagatgatgaagttctggta

SEQ ID NO: 117716 - DNA, 25 bp, Homo sapien
atgaagttctggtagccggcggcca

SEQ ID NO: 117717 - DNA, 25 bp, Homo sapien
cggctcctctgacgggtgctgtgac

SEQ ID NO: 117718 - DNA, 25 bp, Homo sapien
attcctgggcctcgagaatggcacg

SEQ ID NO: 117719 - DNA, 25 bp, Homo sapien
ctcctccggaatggcagggtccgca

SEQ ID NO: 117720 - DNA, 25 bp, Homo sapien
tgacgtaatctgaggcgcgccttcg

SEQ ID NO: 117721 - DNA, 25 bp, Homo sapien
agcgccgccatcttataaccgagag

SEQ ID NO: 117722 - DNA, 25 bp, Homo sapien
ccattgtgtgtgtttacgtaggaag

SEQ ID NO: 117723 - DNA, 25 bp, Homo sapien
gtgaccttctcggaccaaccctgag

SEQ ID NO: 117724 - DNA, 25 bp, Homo sapien
ctggatacttcagccaatcgtgacc

SEQ ID NO: 117725 - DNA, 25 bp, Homo sapien
cccacagagatgcagagctggatac

SEQ ID NO: 117726 - DNA, 25 bp, Homo sapien
acgacgagaagtcgccgcggcaacg

SEQ ID NO: 117727 - DNA, 25 bp, Homo sapien
tccaagctcgcgcaggcaactatta

SEQ ID NO: 117728 - DNA, 25 bp, Homo sapien
caggcaactattacggggagcagta

SEQ ID NO: 117729 - DNA, 25 bp, Homo sapien
gtgaacgacccggagttactggctc

SEQ ID NO: 117730 - DNA, 25 bp, Homo sapien
atgaagtggattcgccctattcctg

SEQ ID NO: 117731 - DNA, 25 bp, Homo sapien
cgcccgagctggtcactaatgaagt

SEQ ID NO: 117732 - DNA, 25 bp, Homo sapien
tttgtgtgatgcacgtgaaccgccc

SEQ ID NO: 117733 - DNA, 25 bp, Homo sapien
acggcagcggaaacgcgggtattct

SEQ ID NO: 117734 - DNA, 25 bp, Homo sapien
attcctggcgactctacaaggttgg

SEQ ID NO: 117735 - DNA, 25 bp, Homo sapien
ggagcctctccggatcagaactttt

SEQ ID NO: 117736 - DNA, 25 bp, Homo sapien
gatcagaactttttaggccgcccgc

SEQ ID NO: 117737 - DNA, 25 bp, Homo sapien
acaggcgagttctgtcccgtcacca

SEQ ID NO: 117738 - DNA, 25 bp, Homo sapien
agcacctggaggtttctttcgcccg

SEQ ID NO: 117739 - DNA, 25 bp, Homo sapien
gaagaacatttctgggtgcgcgccc

SEQ ID NO: 117740 - DNA, 25 bp, Homo sapien
cgcagccgaggacacttggcattta

SEQ ID NO: 117741 - DNA, 25 bp, Homo sapien
acactccaggcagaagacggcgctg

SEQ ID NO: 117742 - DNA, 25 bp, Homo sapien
ggagcaaccgacctgctggtgacca

SEQ ID NO: 117743 - DNA, 25 bp, Homo sapien
tcccttgaacgagccggggaatctg

SEQ ID NO: 117744 - DNA, 25 bp, Homo sapien
cgcggggacccaagcatcaggggtc

SEQ ID NO: 117745 - DNA, 25 bp, Homo sapien
gaatctggagggagcacacaggaaa

SEQ ID NO: 117746 - DNA, 25 bp, Homo sapien
gcagcggtttcccttgaacgagccg

SEQ ID NO: 117747 - DNA, 25 bp, Homo sapien
ctgagcatccgagccggttcccgcc

SEQ ID NO: 117748 - DNA, 25 bp, Homo sapien
cccaccgtccctgagcatccgagcc

SEQ ID NO: 117749 - DNA, 25 bp, Homo sapien
aaaggcagcctcaagccggtgggcc

SEQ ID NO: 117750 - DNA, 25 bp, Homo sapien
caggaaaggcagagccgcgagctgg

SEQ ID NO: 117751 - DNA, 25 bp, Homo sapien
tgcggccggaacgttcatccttgcg

SEQ ID NO: 117752 - DNA, 25 bp, Homo sapien
aaccgcgagcctattcggaggcgcc

SEQ ID NO: 117753 - DNA, 25 bp, Homo sapien
cgagcctattcggaggcgcccgtgt

SEQ ID NO: 117754 - DNA, 25 bp, Homo sapien
ccggcttcgggaaccgcgagcctat

SEQ ID NO: 117755 - DNA, 25 bp, Homo sapien
ttcccacggagccagagcaggcgtc

SEQ ID NO: 117756 - DNA, 25 bp, Homo sapien
aggcgcctttcccacggagccagag

SEQ ID NO: 117757 - DNA, 25 bp, Homo sapien
ctgctccaccatggctaggcgaggc

SEQ ID NO: 117758 - DNA, 25 bp, Homo sapien
tcgaaggtgaccacgaacacggcca

SEQ ID NO: 117759 - DNA, 25 bp, Homo sapien
tttcctctggcgagctttgcgttcc

SEQ ID NO: 117760 - DNA, 25 bp, Homo sapien
tttcatcagtcgtgcggaggaccgc

SEQ ID NO: 117761 - DNA, 25 bp, Homo sapien
gcgcaagttgcggagtttctgtttc

SEQ ID NO: 117762 - DNA, 25 bp, Homo sapien
cggcagtatttccaaggcgcaagtt

SEQ ID NO: 117763 - DNA, 25 bp, Homo sapien
aggtgtctggccctttcatcagtcg

SEQ ID NO: 117764 - DNA, 25 bp, Homo sapien
ttctcctcggttttcaggtggtggc

SEQ ID NO: 117765 - DNA, 25 bp, Homo sapien
ggaccgcgtgatttccttccagttc

SEQ ID NO: 117766 - DNA, 25 bp, Homo sapien
ctgctcgggttagatcgtcaggtga

SEQ ID NO: 117767 - DNA, 25 bp, Homo sapien
ctcggggagccttagaggtttgcat

SEQ ID NO: 117768 - DNA, 25 bp, Homo sapien
tcggggctgtgagccaaaaacattc

SEQ ID NO: 117769 - DNA, 25 bp, Homo sapien
aaaaacattcagtacttcggcgccg

SEQ ID NO: 117770 - DNA, 25 bp, Homo sapien
gacccagtacttcgggccaggcacg

SEQ ID NO: 117771 - DNA, 25 bp, Homo sapien
tcctacgagcagtacttcgggccgg

SEQ ID NO: 117772 - DNA, 25 bp, Homo sapien
gcaccaggctcacggtcacaggtga

SEQ ID NO: 117773 - DNA, 25 bp, Homo sapien
tcacaggtgagattcgggcgtctcc

SEQ ID NO: 117774 - DNA, 25 bp, Homo sapien
acccggctctcagtgctgggtaagc

SEQ ID NO: 117775 - DNA, 25 bp, Homo sapien
ggtgcagcgacttgcccaagccatg

SEQ ID NO: 117776 - DNA, 25 bp, Homo sapien
ccaagccatgtcagagccaggcgta

SEQ ID NO: 117777 - DNA, 25 bp, Homo sapien
agcccaggcaggagctttacagaca

SEQ ID NO: 117778 - DNA, 25 bp, Homo sapien
tgaccaagatccagacacgaaaaga

SEQ ID NO: 117779 - DNA, 25 bp, Homo sapien
gcccaccttagttcaaagctgagta

SEQ ID NO: 117780 - DNA, 25 bp, Homo sapien
cccagatttctcagtttgtctttcc

SEQ ID NO: 117781 - DNA, 25 bp, Homo sapien
gcacggcgacgctttcataccgaga

SEQ ID NO: 117782 - DNA, 25 bp, Homo sapien
gagaaaagagttcccggctagcacg

SEQ ID NO: 117783 - DNA, 25 bp, Homo sapien
gggtcttggtccaccttccagcaca
